United States Patent 11,369,692 (MATERIALS AND METHODS FOR TREATMENT OF DUCHENNE MUSCULAR DYSTROPHY) - sequence listing, part 2

SEQ ID NO: 30691 - DNA, 20 bp, Artificial Sequence
  chemically synthesized
ctgctcttttaactttgatt

SEQ ID NO: 30692 - DNA, 20 bp, Artificial Sequence
  chemically synthesized
tctgctcttttaactttgat

SEQ ID NO: 30693 - DNA, 20 bp, Artificial Sequence
  chemically synthesized
tggatcctaatcaaagttaa

SEQ ID NO: 30694 - DNA, 20 bp, Artificial Sequence
  chemically synthesized
gatcctaatcaaagttaaaa

SEQ ID NO: 30695 - DNA, 20 bp, Artificial Sequence
  chemically synthesized
cctaatcaaagttaaaagag

SEQ ID NO: 30696 - DNA, 20 bp, Artificial Sequence
  chemically synthesized
attcagcttataaaagaaaa

SEQ ID NO: 30697 - DNA, 20 bp, Artificial Sequence
  chemically synthesized
atttttcttttttcttttat

SEQ ID NO: 30698 - DNA, 20 bp, Artificial Sequence
  chemically synthesized
ctttactattcagcttataa

SEQ ID NO: 30699 - DNA, 20 bp, Artificial Sequence
  chemically synthesized
tttttcttttataagctgaa

SEQ ID NO: 30700 - DNA, 20 bp, Artificial Sequence
  chemically synthesized
cttttataagctgaatagta

SEQ ID NO: 30701 - DNA, 20 bp, Artificial Sequence
  chemically synthesized
aatgttcttcctttactatt

SEQ ID NO: 30702 - DNA, 20 bp, Artificial Sequence
  chemically synthesized
ttttataagctgaatagtaa

SEQ ID NO: 30703 - DNA, 20 bp, Artificial Sequence
  chemically synthesized
tataagctgaatagtaaagg

SEQ ID NO: 30704 - DNA, 20 bp, Artificial Sequence
  chemically synthesized
taaaggaagaacatttataa

SEQ ID NO: 30705 - DNA, 20 bp, Artificial Sequence
  chemically synthesized
tttactcaaatttgttatta

SEQ ID NO: 30706 - DNA, 20 bp, Artificial Sequence
  chemically synthesized
atttactcaaatttgttatt

SEQ ID NO: 30707 - DNA, 20 bp, Artificial Sequence
  chemically synthesized
acagccttaataacaaattt

SEQ ID NO: 30708 - DNA, 20 bp, Artificial Sequence
  chemically synthesized
agctgacaaaattagcacag

SEQ ID NO: 30709 - DNA, 20 bp, Artificial Sequence
  chemically synthesized
ctagctgacaaaattagcac

SEQ ID NO: 30710 - DNA, 20 bp, Artificial Sequence
  chemically synthesized
cctagctgacaaaattagca

SEQ ID NO: 30711 - DNA, 20 bp, Artificial Sequence
  chemically synthesized
atctcctgtgctaattttgt

SEQ ID NO: 30712 - DNA, 20 bp, Artificial Sequence
  chemically synthesized
tattccctagctgacaaaat

SEQ ID NO: 30713 - DNA, 20 bp, Artificial Sequence
  chemically synthesized
cctgtgctaattttgtcagc

SEQ ID NO: 30714 - DNA, 20 bp, Artificial Sequence
  chemically synthesized
ctgtgctaattttgtcagct

SEQ ID NO: 30715 - DNA, 20 bp, Artificial Sequence
  chemically synthesized
tgtgctaattttgtcagcta

SEQ ID NO: 30716 - DNA, 20 bp, Artificial Sequence
  chemically synthesized
attttgtcagctagggaata

SEQ ID NO: 30717 - DNA, 20 bp, Artificial Sequence
  chemically synthesized
atatgacattctttattccc

SEQ ID NO: 30718 - DNA, 20 bp, Artificial Sequence
  chemically synthesized
agggaataaagaatgtcata

SEQ ID NO: 30719 - DNA, 20 bp, Artificial Sequence
  chemically synthesized
aaagaatgtcatatggattc

SEQ ID NO: 30720 - DNA, 20 bp, Artificial Sequence
  chemically synthesized
ctttatcggcataattaaac

SEQ ID NO: 30721 - DNA, 20 bp, Artificial Sequence
  chemically synthesized
ccagtttaattatgccgata

SEQ ID NO: 30722 - DNA, 20 bp, Artificial Sequence
  chemically synthesized
gtttaattatgccgataaag

SEQ ID NO: 30723 - DNA, 20 bp, Artificial Sequence
  chemically synthesized
gatttataaaactgctttat

SEQ ID NO: 30724 - DNA, 20 bp, Artificial Sequence
  chemically synthesized
gcagttttataaatcatgct

SEQ ID NO: 30725 - DNA, 20 bp, Artificial Sequence
  chemically synthesized
agttttataaatcatgctaa

SEQ ID NO: 30726 - DNA, 20 bp, Artificial Sequence
  chemically synthesized
ataaatcatgctaagagtaa

SEQ ID NO: 30727 - DNA, 20 bp, Artificial Sequence
  chemically synthesized
aaaggaacatccattactct

SEQ ID NO: 30728 - DNA, 20 bp, Artificial Sequence
  chemically synthesized
agagtaatggatgttccttt

SEQ ID NO: 30729 - DNA, 20 bp, Artificial Sequence
  chemically synthesized
aatggatgttcctttgagaa

SEQ ID NO: 30730 - DNA, 20 bp, Artificial Sequence
  chemically synthesized
tccgagttctctgttctcaa

SEQ ID NO: 30731 - DNA, 20 bp, Artificial Sequence
  chemically synthesized
ctccgagttctctgttctca

SEQ ID NO: 30732 - DNA, 20 bp, Artificial Sequence
  chemically synthesized
tggatgttcctttgagaaca

SEQ ID NO: 30733 - DNA, 20 bp, Artificial Sequence
  chemically synthesized
tcctttgagaacagagaact

SEQ ID NO: 30734 - DNA, 20 bp, Artificial Sequence
  chemically synthesized
ctttgagaacagagaactcg

SEQ ID NO: 30735 - DNA, 20 bp, Artificial Sequence
  chemically synthesized
acacacattttacaaactcc

SEQ ID NO: 30736 - DNA, 20 bp, Artificial Sequence
  chemically synthesized
agtttgtaaaatgtgtgttc

SEQ ID NO: 30737 - DNA, 20 bp, Artificial Sequence
  chemically synthesized
taaaatgtgtgttctggact

SEQ ID NO: 30738 - DNA, 20 bp, Artificial Sequence
  chemically synthesized
agaagataaggaaccaagtc

SEQ ID NO: 30739 - DNA, 20 bp, Artificial Sequence
  chemically synthesized
atggtagaagataaggaacc

SEQ ID NO: 30740 - DNA, 20 bp, Artificial Sequence
  chemically synthesized
actcactatggtagaagata

SEQ ID NO: 30741 - DNA, 20 bp, Artificial Sequence
  chemically synthesized
tactcactatggtagaagat

SEQ ID NO: 30742 - DNA, 20 bp, Artificial Sequence
  chemically synthesized
tggttccttatcttctacca

SEQ ID NO: 30743 - DNA, 20 bp, Artificial Sequence
  chemically synthesized
atttatactcactatggtag

SEQ ID NO: 30744 - DNA, 20 bp, Artificial Sequence
  chemically synthesized
tccttatcttctaccatagt

SEQ ID NO: 30745 - DNA, 20 bp, Artificial Sequence
  chemically synthesized
ttgatttatactcactatgg

SEQ ID NO: 30746 - DNA, 20 bp, Artificial Sequence
  chemically synthesized
gatttgatttatactcacta

SEQ ID NO: 30747 - DNA, 20 bp, Artificial Sequence
  chemically synthesized
tagtgagtataaatcaaatc

SEQ ID NO: 30748 - DNA, 20 bp, Artificial Sequence
  chemically synthesized
tataaatcaaatcaagtctt

SEQ ID NO: 30749 - DNA, 20 bp, Artificial Sequence
  chemically synthesized
tcaaatcaagtcttgagtct

SEQ ID NO: 30750 - DNA, 20 bp, Artificial Sequence
  chemically synthesized
acttgagcagactgagactc

SEQ ID NO: 30751 - DNA, 20 bp, Artificial Sequence
  chemically synthesized
catttggacttgagcagact

SEQ ID NO: 30752 - DNA, 20 bp, Artificial Sequence
  chemically synthesized
tcttgagtctcagtctgctc

SEQ ID NO: 30753 - DNA, 20 bp, Artificial Sequence
  chemically synthesized
tctttccatttggacttgag

SEQ ID NO: 30754 - DNA, 20 bp, Artificial Sequence
  chemically synthesized
ccttctttccatttggactt

SEQ ID NO: 30755 - DNA, 20 bp, Artificial Sequence
  chemically synthesized
tcagtctgctcaagtccaaa

SEQ ID NO: 30756 - DNA, 20 bp, Artificial Sequence
  chemically synthesized
tctgctcaagtccaaatgga

SEQ ID NO: 30757 - DNA, 20 bp, Artificial Sequence
  chemically synthesized
acttttcccttctttccatt

SEQ ID NO: 30758 - DNA, 20 bp, Artificial Sequence
  chemically synthesized
gctcaagtccaaatggaaag

SEQ ID NO: 30759 - DNA, 20 bp, Artificial Sequence
  chemically synthesized
ctcaagtccaaatggaaaga

SEQ ID NO: 30760 - DNA, 20 bp, Artificial Sequence
  chemically synthesized
tcaagtccaaatggaaagaa

SEQ ID NO: 30761 - DNA, 20 bp, Artificial Sequence
  chemically synthesized
tccaaatggaaagaagggaa

SEQ ID NO: 30762 - DNA, 20 bp, Artificial Sequence
  chemically synthesized
ggaaaagttgccccatccac

SEQ ID NO: 30763 - DNA, 20 bp, Artificial Sequence
  chemically synthesized
tgctaccataccggtggatg

SEQ ID NO: 30764 - DNA, 20 bp, Artificial Sequence
  chemically synthesized
atgctaccataccggtggat

SEQ ID NO: 30765 - DNA, 20 bp, Artificial Sequence
  chemically synthesized
aatgctaccataccggtgga

SEQ ID NO: 30766 - DNA, 20 bp, Artificial Sequence
  chemically synthesized
agttgccccatccaccggta

SEQ ID NO: 30767 - DNA, 20 bp, Artificial Sequence
  chemically synthesized
aaataatgctaccataccgg

SEQ ID NO: 30768 - DNA, 20 bp, Artificial Sequence
  chemically synthesized
tgccccatccaccggtatgg

SEQ ID NO: 30769 - DNA, 20 bp, Artificial Sequence
  chemically synthesized
gggaaataatgctaccatac

SEQ ID NO: 30770 - DNA, 20 bp, Artificial Sequence
  chemically synthesized
gtccttccagtttttgattt

SEQ ID NO: 30771 - DNA, 20 bp, Artificial Sequence
  chemically synthesized
tgtccttccagtttttgatt

SEQ ID NO: 30772 - DNA, 20 bp, Artificial Sequence
  chemically synthesized
ttatttcccaaatcaaaaac

SEQ ID NO: 30773 - DNA, 20 bp, Artificial Sequence
  chemically synthesized
tttcccaaatcaaaaactgg

SEQ ID NO: 30774 - DNA, 20 bp, Artificial Sequence
  chemically synthesized
ttcccaaatcaaaaactgga

SEQ ID NO: 30775 - DNA, 20 bp, Artificial Sequence
  chemically synthesized
catccctttgagtgtccttc

SEQ ID NO: 30776 - DNA, 20 bp, Artificial Sequence
  chemically synthesized
aaaaactggaaggacactca

SEQ ID NO: 30777 - DNA, 20 bp, Artificial Sequence
  chemically synthesized
aaaactggaaggacactcaa

SEQ ID NO: 30778 - DNA, 20 bp, Artificial Sequence
  chemically synthesized
aaactggaaggacactcaaa

SEQ ID NO: 30779 - DNA, 20 bp, Artificial Sequence
  chemically synthesized
ttttgtcctgtcatcccttt

SEQ ID NO: 30780 - DNA, 20 bp, Artificial Sequence
  chemically synthesized
aaggacactcaaagggatga

SEQ ID NO: 30781 - DNA, 20 bp, Artificial Sequence
  chemically synthesized
aggacactcaaagggatgac

SEQ ID NO: 30782 - DNA, 20 bp, Artificial Sequence
  chemically synthesized
ttttctatcaatttcagttt

SEQ ID NO: 30783 - DNA, 20 bp, Artificial Sequence
  chemically synthesized
aaatctgaaactgaaattga

SEQ ID NO: 30784 - DNA, 20 bp, Artificial Sequence
  chemically synthesized
cctggattttctatcaattt

SEQ ID NO: 30785 - DNA, 20 bp, Artificial Sequence
  chemically synthesized
actgaaattgatagaaaatc

SEQ ID NO: 30786 - DNA, 20 bp, Artificial Sequence
  chemically synthesized
ctgaaattgatagaaaatcc

SEQ ID NO: 30787 - DNA, 20 bp, Artificial Sequence
  chemically synthesized
agagtaggtggcatatgacc

SEQ ID NO: 30788 - DNA, 20 bp, Artificial Sequence
  chemically synthesized
tcacacagctatagagtagg

SEQ ID NO: 30789 - DNA, 20 bp, Artificial Sequence
  chemically synthesized
gtcatatgccacctactcta

SEQ ID NO: 30790 - DNA, 20 bp, Artificial Sequence
  chemically synthesized
tcctcacacagctatagagt

SEQ ID NO: 30791 - DNA, 20 bp, Artificial Sequence
  chemically synthesized
atcctcacacagctatagag

SEQ ID NO: 30792 - DNA, 20 bp, Artificial Sequence
  chemically synthesized
ttaatcctcacacagctata

SEQ ID NO: 30793 - DNA, 20 bp, Artificial Sequence
  chemically synthesized
atttaatcctcacacagcta

SEQ ID NO: 30794 - DNA, 20 bp, Artificial Sequence
  chemically synthesized
cacctactctatagctgtgt

SEQ ID NO: 30795 - DNA, 20 bp, Artificial Sequence
  chemically synthesized
acctactctatagctgtgtg

SEQ ID NO: 30796 - DNA, 20 bp, Artificial Sequence
  chemically synthesized
aaccatatttaatcctcaca

SEQ ID NO: 30797 - DNA, 20 bp, Artificial Sequence
  chemically synthesized
agctgtgtgaggattaaata

SEQ ID NO: 30798 - DNA, 20 bp, Artificial Sequence
  chemically synthesized
ttacaatggcgaagagtttt

SEQ ID NO: 30799 - DNA, 20 bp, Artificial Sequence
  chemically synthesized
tagcactttacaatggcgaa

SEQ ID NO: 30800 - DNA, 20 bp, Artificial Sequence
  chemically synthesized
tgtagcactttacaatggcg

SEQ ID NO: 30801 - DNA, 20 bp, Artificial Sequence
  chemically synthesized
gaaaactcttcgccattgta

SEQ ID NO: 30802 - DNA, 20 bp, Artificial Sequence
  chemically synthesized
atttgtgtagcactttacaa

SEQ ID NO: 30803 - DNA, 20 bp, Artificial Sequence
  chemically synthesized
ataattgtactttatttgtg

SEQ ID NO: 30804 - DNA, 20 bp, Artificial Sequence
  chemically synthesized
tgtaaagtgctacacaaata

SEQ ID NO: 30805 - DNA, 20 bp, Artificial Sequence
  chemically synthesized
aattattacaaatatgatta

SEQ ID NO: 30806 - DNA, 20 bp, Artificial Sequence
  chemically synthesized
attattacaaatatgattat

SEQ ID NO: 30807 - DNA, 20 bp, Artificial Sequence
  chemically synthesized
ttacaaatatgattataggc

SEQ ID NO: 30808 - DNA, 20 bp, Artificial Sequence
  chemically synthesized
tacaaatatgattataggct

SEQ ID NO: 30809 - DNA, 20 bp, Artificial Sequence
  chemically synthesized
caaatatgattataggctag

SEQ ID NO: 30810 - DNA, 20 bp, Artificial Sequence
  chemically synthesized
atatgattataggctaggag

SEQ ID NO: 30811 - DNA, 20 bp, Artificial Sequence
  chemically synthesized
tgattataggctaggagcgg

SEQ ID NO: 30812 - DNA, 20 bp, Artificial Sequence
  chemically synthesized
caggcgtgagccaccgctcc

SEQ ID NO: 30813 - DNA, 20 bp, Artificial Sequence
  chemically synthesized
agtgctgagattacaggcgt

SEQ ID NO: 30814 - DNA, 20 bp, Artificial Sequence
  chemically synthesized
gtggctcacgcctgtaatct

SEQ ID NO: 30815 - DNA, 20 bp, Artificial Sequence
  chemically synthesized
tcccagagtgctgagattac

SEQ ID NO: 30816 - DNA, 20 bp, Artificial Sequence
  chemically synthesized
ctcccagagtgctgagatta

SEQ ID NO: 30817 - DNA, 20 bp, Artificial Sequence
  chemically synthesized
cgcctgtaatctcagcactc

SEQ ID NO: 30818 - DNA, 20 bp, Artificial Sequence
  chemically synthesized
cctcggcctcccagagtgct

SEQ ID NO: 30819 - DNA, 20 bp, Artificial Sequence
  chemically synthesized
gcctgtaatctcagcactct

SEQ ID NO: 30820 - DNA, 20 bp, Artificial Sequence
  chemically synthesized
ctgtaatctcagcactctgg

SEQ ID NO: 30821 - DNA, 20 bp, Artificial Sequence
  chemically synthesized
tgtaatctcagcactctggg

SEQ ID NO: 30822 - DNA, 20 bp, Artificial Sequence
  chemically synthesized
ccacccgcctcggcctccca

SEQ ID NO: 30823 - DNA, 20 bp, Artificial Sequence
  chemically synthesized
tctcagcactctgggaggcc

SEQ ID NO: 30824 - DNA, 20 bp, Artificial Sequence
  chemically synthesized
atccacccgcctcggcctcc

SEQ ID NO: 30825 - DNA, 20 bp, Artificial Sequence
  chemically synthesized
ctcagcactctgggaggccg

SEQ ID NO: 30826 - DNA, 20 bp, Artificial Sequence
  chemically synthesized
agcactctgggaggccgagg

SEQ ID NO: 30827 - DNA, 20 bp, Artificial Sequence
  chemically synthesized
gcactctgggaggccgaggc

SEQ ID NO: 30828 - DNA, 20 bp, Artificial Sequence
  chemically synthesized
ctctgggaggccgaggcggg

SEQ ID NO: 30829 - DNA, 20 bp, Artificial Sequence
  chemically synthesized
acctcatgatccacccgcct

SEQ ID NO: 30830 - DNA, 20 bp, Artificial Sequence
  chemically synthesized
ggccgaggcgggtggatcat

SEQ ID NO: 30831 - DNA, 20 bp, Artificial Sequence
  chemically synthesized
gccgaggcgggtggatcatg

SEQ ID NO: 30832 - DNA, 20 bp, Artificial Sequence
  chemically synthesized
ggcgggtggatcatgaggtc

SEQ ID NO: 30833 - DNA, 20 bp, Artificial Sequence
  chemically synthesized
cgggtggatcatgaggtcaa

SEQ ID NO: 30834 - DNA, 20 bp, Artificial Sequence
  chemically synthesized
gatcatgaggtcaagagatc

SEQ ID NO: 30835 - DNA, 20 bp, Artificial Sequence
  chemically synthesized
tcaagagatcgagaccatcc

SEQ ID NO: 30836 - DNA, 20 bp, Artificial Sequence
  chemically synthesized
tttcaccatgttggccagga

SEQ ID NO: 30837 - DNA, 20 bp, Artificial Sequence
  chemically synthesized
ggggtttcaccatgttggcc

SEQ ID NO: 30838 - DNA, 20 bp, Artificial Sequence
  chemically synthesized
cgagaccatcctggccaaca

SEQ ID NO: 30839 - DNA, 20 bp, Artificial Sequence
  chemically synthesized
cggggtttcaccatgttggc

SEQ ID NO: 30840 - DNA, 20 bp, Artificial Sequence
  chemically synthesized
gagacggggtttcaccatgt

SEQ ID NO: 30841 - DNA, 20 bp, Artificial Sequence
  chemically synthesized
ttgtatttttagtagagacg

SEQ ID NO: 30842 - DNA, 20 bp, Artificial Sequence
  chemically synthesized
tttgtatttttagtagagac

SEQ ID NO: 30843 - DNA, 20 bp, Artificial Sequence
  chemically synthesized
ttttgtatttttagtagaga

SEQ ID NO: 30844 - DNA, 20 bp, Artificial Sequence
  chemically synthesized
taatttttgtatttttagta

SEQ ID NO: 30845 - DNA, 20 bp, Artificial Sequence
  chemically synthesized
gctaatttttgtatttttag

SEQ ID NO: 30846 - DNA, 20 bp, Artificial Sequence
  chemically synthesized
tcagctaatttttgtatttt

SEQ ID NO: 30847 - DNA, 20 bp, Artificial Sequence
  chemically synthesized
tctactaaaaatacaaaaat

SEQ ID NO: 30848 - DNA, 20 bp, Artificial Sequence
  chemically synthesized
taaaaatacaaaaattagct

SEQ ID NO: 30849 - DNA, 20 bp, Artificial Sequence
  chemically synthesized
atacaaaaattagctgagca

SEQ ID NO: 30850 - DNA, 20 bp, Artificial Sequence
  chemically synthesized
caaaaattagctgagcatgg

SEQ ID NO: 30851 - DNA, 20 bp, Artificial Sequence
  chemically synthesized
cagcctcccgccaccatgct

SEQ ID NO: 30852 - DNA, 20 bp, Artificial Sequence
  chemically synthesized
aaattagctgagcatggtgg

SEQ ID NO: 30853 - DNA, 20 bp, Artificial Sequence
  chemically synthesized
aattagctgagcatggtggc

SEQ ID NO: 30854 - DNA, 20 bp, Artificial Sequence
  chemically synthesized
ttagctgagcatggtggcgg

SEQ ID NO: 30855 - DNA, 20 bp, Artificial Sequence
  chemically synthesized
tagctgagcatggtggcggg

SEQ ID NO: 30856 - DNA, 20 bp, Artificial Sequence
  chemically synthesized
catggtggcgggaggctgct

SEQ ID NO: 30857 - DNA, 20 bp, Artificial Sequence
  chemically synthesized
atggtggcgggaggctgctg

SEQ ID NO: 30858 - DNA, 20 bp, Artificial Sequence
  chemically synthesized
gtggcgggaggctgctgagg

SEQ ID NO: 30859 - DNA, 20 bp, Artificial Sequence
  chemically synthesized
tggcgggaggctgctgaggc

SEQ ID NO: 30860 - DNA, 20 bp, Artificial Sequence
  chemically synthesized
aagcgattctcctgcctcag

SEQ ID NO: 30861 - DNA, 20 bp, Artificial Sequence
  chemically synthesized
gcgggaggctgctgaggcag

SEQ ID NO: 30862 - DNA, 20 bp, Artificial Sequence
  chemically synthesized
ttcaagcgattctcctgcct

SEQ ID NO: 30863 - DNA, 20 bp, Artificial Sequence
  chemically synthesized
gcaggagaatcgcttgaacg

SEQ ID NO: 30864 - DNA, 20 bp, Artificial Sequence
  chemically synthesized
caggagaatcgcttgaacgc

SEQ ID NO: 30865 - DNA, 20 bp, Artificial Sequence
  chemically synthesized
aacctccaccgcccgcgttc

SEQ ID NO: 30866 - DNA, 20 bp, Artificial Sequence
  chemically synthesized
gagaatcgcttgaacgcggg

SEQ ID NO: 30867 - DNA, 20 bp, Artificial Sequence
  chemically synthesized
aatcgcttgaacgcgggcgg

SEQ ID NO: 30868 - DNA, 20 bp, Artificial Sequence
  chemically synthesized
tcgcttgaacgcgggcggtg

SEQ ID NO: 30869 - DNA, 20 bp, Artificial Sequence
  chemically synthesized
cgcttgaacgcgggcggtgg

SEQ ID NO: 30870 - DNA, 20 bp, Artificial Sequence
  chemically synthesized
aacgcgggcggtggaggttg

SEQ ID NO: 30871 - DNA, 20 bp, Artificial Sequence
  chemically synthesized
cgggcggtggaggttgcagt

SEQ ID NO: 30872 - DNA, 20 bp, Artificial Sequence
  chemically synthesized
ggtggaggttgcagtgagat

SEQ ID NO: 30873 - DNA, 20 bp, Artificial Sequence
  chemically synthesized
gagatcgtgcaactgcactc

SEQ ID NO: 30874 - DNA, 20 bp, Artificial Sequence
  chemically synthesized
tctgtcgccaggctggagtg

SEQ ID NO: 30875 - DNA, 20 bp, Artificial Sequence
  chemically synthesized
cgtgcaactgcactccagcc

SEQ ID NO: 30876 - DNA, 20 bp, Artificial Sequence
  chemically synthesized
ctcactctgtcgccaggctg

SEQ ID NO: 30877 - DNA, 20 bp, Artificial Sequence
  chemically synthesized
gtctcactctgtcgccaggc

SEQ ID NO: 30878 - DNA, 20 bp, Artificial Sequence
  chemically synthesized
actgcactccagcctggcga

SEQ ID NO: 30879 - DNA, 20 bp, Artificial Sequence
  chemically synthesized
tgcactccagcctggcgaca

SEQ ID NO: 30880 - DNA, 20 bp, Artificial Sequence
  chemically synthesized
cggagtctcactctgtcgcc

SEQ ID NO: 30881 - DNA, 20 bp, Artificial Sequence
  chemically synthesized
acggagtctcactctgtcgc

SEQ ID NO: 30882 - DNA, 20 bp, Artificial Sequence
  chemically synthesized
ctccagcctggcgacagagt

SEQ ID NO: 30883 - DNA, 20 bp, Artificial Sequence
  chemically synthesized
aattttttttttttgagacg

SEQ ID NO: 30884 - DNA, 20 bp, Artificial Sequence
  chemically synthesized
ttaattttttttttttgaga

SEQ ID NO: 30885 - DNA, 20 bp, Artificial Sequence
  chemically synthesized
taatttaatttttttttttt

SEQ ID NO: 30886 - DNA, 20 bp, Artificial Sequence
  chemically synthesized
acctaaaggatatgaataat

SEQ ID NO: 30887 - DNA, 20 bp, Artificial Sequence
  chemically synthesized
aacctaaaggatatgaataa

SEQ ID NO: 30888 - DNA, 20 bp, Artificial Sequence
  chemically synthesized
atcctattattcatatcctt

SEQ ID NO: 30889 - DNA, 20 bp, Artificial Sequence
  chemically synthesized
tcctattattcatatccttt

SEQ ID NO: 30890 - DNA, 20 bp, Artificial Sequence
  chemically synthesized
attattcatatcctttaggt

SEQ ID NO: 30891 - DNA, 20 bp, Artificial Sequence
  chemically synthesized
ctttgtcaccaccaacctaa

SEQ ID NO: 30892 - DNA, 20 bp, Artificial Sequence
  chemically synthesized
tctttgtcaccaccaaccta

SEQ ID NO: 30893 - DNA, 20 bp, Artificial Sequence
  chemically synthesized
attcatatcctttaggttgg

SEQ ID NO: 30894 - DNA, 20 bp, Artificial Sequence
  chemically synthesized
cctttaggttggtggtgaca

SEQ ID NO: 30895 - DNA, 20 bp, Artificial Sequence
  chemically synthesized
tttaggttggtggtgacaaa

SEQ ID NO: 30896 - DNA, 20 bp, Artificial Sequence
  chemically synthesized
ttaggttggtggtgacaaag

SEQ ID NO: 30897 - DNA, 20 bp, Artificial Sequence
  chemically synthesized
tggtggtgacaaagaggaac

SEQ ID NO: 30898 - DNA, 20 bp, Artificial Sequence
  chemically synthesized
ggtggtgacaaagaggaact

SEQ ID NO: 30899 - DNA, 20 bp, Artificial Sequence
  chemically synthesized
gtggtgacaaagaggaactg

SEQ ID NO: 30900 - DNA, 20 bp, Artificial Sequence
  chemically synthesized
tggtgacaaagaggaactgg

SEQ ID NO: 30901 - DNA, 20 bp, Artificial Sequence
  chemically synthesized
acaaagaggaactgggggtt

SEQ ID NO: 30902 - DNA, 20 bp, Artificial Sequence
  chemically synthesized
caaagaggaactgggggttt

SEQ ID NO: 30903 - DNA, 20 bp, Artificial Sequence
  chemically synthesized
tgttgtcagccctaaacccc

SEQ ID NO: 30904 - DNA, 20 bp, Artificial Sequence
  chemically synthesized
aaagaggaactgggggttta

SEQ ID NO: 30905 - DNA, 20 bp, Artificial Sequence
  chemically synthesized
cttggttgtatgaatgttgt

SEQ ID NO: 30906 - DNA, 20 bp, Artificial Sequence
  chemically synthesized
ctgacaacattcatacaacc

SEQ ID NO: 30907 - DNA, 20 bp, Artificial Sequence
  chemically synthesized
cccctggctagagtaaagct

SEQ ID NO: 30908 - DNA, 20 bp, Artificial Sequence
  chemically synthesized
catacaaccaagctttactc

SEQ ID NO: 30909 - DNA, 20 bp, Artificial Sequence
  chemically synthesized
tttaacccctggctagagta

SEQ ID NO: 30910 - DNA, 20 bp, Artificial Sequence
  chemically synthesized
caaccaagctttactctagc

SEQ ID NO: 30911 - DNA, 20 bp, Artificial Sequence
  chemically synthesized
aaccaagctttactctagcc

SEQ ID NO: 30912 - DNA, 20 bp, Artificial Sequence
  chemically synthesized
accaagctttactctagcca

SEQ ID NO: 30913 - DNA, 20 bp, Artificial Sequence
  chemically synthesized
ccaagctttactctagccag

SEQ ID NO: 30914 - DNA, 20 bp, Artificial Sequence
  chemically synthesized
tttgttttaacccctggcta

SEQ ID NO: 30915 - DNA, 20 bp, Artificial Sequence
  chemically synthesized
gttttgttttaacccctggc

SEQ ID NO: 30916 - DNA, 20 bp, Artificial Sequence
  chemically synthesized
actggttttgttttaacccc

SEQ ID NO: 30917 - DNA, 20 bp, Artificial Sequence
  chemically synthesized
gccaggggttaaaacaaaac

SEQ ID NO: 30918 - DNA, 20 bp, Artificial Sequence
  chemically synthesized
atctttcatcattaaatgac

SEQ ID NO: 30919 - DNA, 20 bp, Artificial Sequence
  chemically synthesized
aaccagtcatttaatgatga

SEQ ID NO: 30920 - DNA, 20 bp, Artificial Sequence
  chemically synthesized
atttaatgatgaaagatcac

SEQ ID NO: 30921 - DNA, 20 bp, Artificial Sequence
  chemically synthesized
ttcttatatgtcatgttggc

SEQ ID NO: 30922 - DNA, 20 bp, Artificial Sequence
  chemically synthesized
cattttcttatatgtcatgt

SEQ ID NO: 30923 - DNA, 20 bp, Artificial Sequence
  chemically synthesized
cactggccaacatgacatat

SEQ ID NO: 30924 - DNA, 20 bp, Artificial Sequence
  chemically synthesized
acatgacatataagaaaatg

SEQ ID NO: 30925 - DNA, 20 bp, Artificial Sequence
  chemically synthesized
tataagaaaatgaagaccaa

SEQ ID NO: 30926 - DNA, 20 bp, Artificial Sequence
  chemically synthesized
agaaaatgaagaccaataga

SEQ ID NO: 30927 - DNA, 20 bp, Artificial Sequence
  chemically synthesized
gcaagtcccttgctttctat

SEQ ID NO: 30928 - DNA, 20 bp, Artificial Sequence
  chemically synthesized
aatgaagaccaatagaaagc

SEQ ID NO: 30929 - DNA, 20 bp, Artificial Sequence
  chemically synthesized
atgaagaccaatagaaagca

SEQ ID NO: 30930 - DNA, 20 bp, Artificial Sequence
  chemically synthesized
tgaagaccaatagaaagcaa

SEQ ID NO: 30931 - DNA, 20 bp, Artificial Sequence
  chemically synthesized
agaaagcaagggacttgccc

SEQ ID NO: 30932 - DNA, 20 bp, Artificial Sequence
  chemically synthesized
gaaagcaagggacttgcccg

SEQ ID NO: 30933 - DNA, 20 bp, Artificial Sequence
  chemically synthesized
gctttggtgtgacctcgggc

SEQ ID NO: 30934 - DNA, 20 bp, Artificial Sequence
  chemically synthesized
gccagctttggtgtgacctc

SEQ ID NO: 30935 - DNA, 20 bp, Artificial Sequence
  chemically synthesized
tgccagctttggtgtgacct

SEQ ID NO: 30936 - DNA, 20 bp, Artificial Sequence
  chemically synthesized
acttgcccgaggtcacacca

SEQ ID NO: 30937 - DNA, 20 bp, Artificial Sequence
  chemically synthesized
gcccgaggtcacaccaaagc

SEQ ID NO: 30938 - DNA, 20 bp, Artificial Sequence
  chemically synthesized
ctagattcagatgccagctt

SEQ ID NO: 30939 - DNA, 20 bp, Artificial Sequence
  chemically synthesized
ggatagctagattcagatgc

SEQ ID NO: 30940 - DNA, 20 bp, Artificial Sequence
  chemically synthesized
ccaaagctggcatctgaatc

SEQ ID NO: 30941 - DNA, 20 bp, Artificial Sequence
  chemically synthesized
ctggaaaggatagctagatt

SEQ ID NO: 30942 - DNA, 20 bp, Artificial Sequence
  chemically synthesized
tttgaactggaaaggatagc

SEQ ID NO: 30943 - DNA, 20 bp, Artificial Sequence
  chemically synthesized
ctgaatctagctatcctttc

SEQ ID NO: 30944 - DNA, 20 bp, Artificial Sequence
  chemically synthesized
acgctttgaactggaaagga

SEQ ID NO: 30945 - DNA, 20 bp, Artificial Sequence
  chemically synthesized
cataacgctttgaactggaa

SEQ ID NO: 30946 - DNA, 20 bp, Artificial Sequence
  chemically synthesized
ccataacgctttgaactgga

SEQ ID NO: 30947 - DNA, 20 bp, Artificial Sequence
  chemically synthesized
tagctatcctttccagttca

SEQ ID NO: 30948 - DNA, 20 bp, Artificial Sequence
  chemically synthesized
actgccataacgctttgaac

SEQ ID NO: 30949 - DNA, 20 bp, Artificial Sequence
  chemically synthesized
ctttccagttcaaagcgtta

SEQ ID NO: 30950 - DNA, 20 bp, Artificial Sequence
  chemically synthesized
tccagttcaaagcgttatgg

SEQ ID NO: 30951 - DNA, 20 bp, Artificial Sequence
  chemically synthesized
caaagcgttatggcagtaaa

SEQ ID NO: 30952 - DNA, 20 bp, Artificial Sequence
  chemically synthesized
ttatggcagtaaaaagtcaa

SEQ ID NO: 30953 - DNA, 20 bp, Artificial Sequence
  chemically synthesized
tatggcagtaaaaagtcaaa

SEQ ID NO: 30954 - DNA, 20 bp, Artificial Sequence
  chemically synthesized
ggcagtaaaaagtcaaaagg

SEQ ID NO: 30955 - DNA, 20 bp, Artificial Sequence
  chemically synthesized
cagtaaaaagtcaaaaggca

SEQ ID NO: 30956 - DNA, 20 bp, Artificial Sequence
  chemically synthesized
agtaaaaagtcaaaaggcag

SEQ ID NO: 30957 - DNA, 20 bp, Artificial Sequence
  chemically synthesized
aaggcagaggttttaacact

SEQ ID NO: 30958 - DNA, 20 bp, Artificial Sequence
  chemically synthesized
tagttccttaatatattgct

SEQ ID NO: 30959 - DNA, 20 bp, Artificial Sequence
  chemically synthesized
ttaacactgagcaatatatt

SEQ ID NO: 30960 - DNA, 20 bp, Artificial Sequence
  chemically synthesized
taacactgagcaatatatta

SEQ ID NO: 30961 - DNA, 20 bp, Artificial Sequence
  chemically synthesized
tgagcaatatattaaggaac

SEQ ID NO: 30962 - DNA, 20 bp, Artificial Sequence
  chemically synthesized
gcaatatattaaggaactag

SEQ ID NO: 30963 - DNA, 20 bp, Artificial Sequence
  chemically synthesized
tatattaaggaactagaagc

SEQ ID NO: 30964 - DNA, 20 bp, Artificial Sequence
  chemically synthesized
tattaaggaactagaagcaa

SEQ ID NO: 30965 - DNA, 20 bp, Artificial Sequence
  chemically synthesized
ctttccttggctcttgcttc

SEQ ID NO: 30966 - DNA, 20 bp, Artificial Sequence
  chemically synthesized
aggaactagaagcaagagcc

SEQ ID NO: 30967 - DNA, 20 bp, Artificial Sequence
  chemically synthesized
ggaactagaagcaagagcca

SEQ ID NO: 30968 - DNA, 20 bp, Artificial Sequence
  chemically synthesized
ctagaagcaagagccaagga

SEQ ID NO: 30969 - DNA, 20 bp, Artificial Sequence
  chemically synthesized
actcaatatttagctttcct

SEQ ID NO: 30970 - DNA, 20 bp, Artificial Sequence
  chemically synthesized
gccaaggaaagctaaatatt

SEQ ID NO: 30971 - DNA, 20 bp, Artificial Sequence
  chemically synthesized
ccactaagctactcaatatt

SEQ ID NO: 30972 - DNA, 20 bp, Artificial Sequence
  chemically synthesized
aaggaaagctaaatattgag

SEQ ID NO: 30973 - DNA, 20 bp, Artificial Sequence
  chemically synthesized
aagctaaatattgagtagct

SEQ ID NO: 30974 - DNA, 20 bp, Artificial Sequence
  chemically synthesized
ctaaatattgagtagcttag

SEQ ID NO: 30975 - DNA, 20 bp, Artificial Sequence
  chemically synthesized
aaatattgagtagcttagtg

SEQ ID NO: 30976 - DNA, 20 bp, Artificial Sequence
  chemically synthesized
gaactaaactgttctccact

SEQ ID NO: 30977 - DNA, 20 bp, Artificial Sequence
  chemically synthesized
ttgagtagcttagtggagaa

SEQ ID NO: 30978 - DNA, 20 bp, Artificial Sequence
  chemically synthesized
tagcttagtggagaacagtt

SEQ ID NO: 30979 - DNA, 20 bp, Artificial Sequence
  chemically synthesized
tttagttcacaaaatatgct

SEQ ID NO: 30980 - DNA, 20 bp, Artificial Sequence
  chemically synthesized
ttcacaaaatatgctgagaa

SEQ ID NO: 30981 - DNA, 20 bp, Artificial Sequence
  chemically synthesized
gcttgtcctaatgcttttct

SEQ ID NO: 30982 - DNA, 20 bp, Artificial Sequence
  chemically synthesized
aaatatgctgagaaaagcat

SEQ ID NO: 30983 - DNA, 20 bp, Artificial Sequence
  chemically synthesized
aatatgctgagaaaagcatt

SEQ ID NO: 30984 - DNA, 20 bp, Artificial Sequence
  chemically synthesized
gctgagaaaagcattaggac

SEQ ID NO: 30985 - DNA, 20 bp, Artificial Sequence
  chemically synthesized
attccttccttttgcattag

SEQ ID NO: 30986 - DNA, 20 bp, Artificial Sequence
  chemically synthesized
aggacaagctcctaatgcaa

SEQ ID NO: 30987 - DNA, 20 bp, Artificial Sequence
  chemically synthesized
gaattccttccttttgcatt

SEQ ID NO: 30988 - DNA, 20 bp, Artificial Sequence
  chemically synthesized
ggacaagctcctaatgcaaa

SEQ ID NO: 30989 - DNA, 20 bp, Artificial Sequence
  chemically synthesized
tgaattccttccttttgcat

SEQ ID NO: 30990 - DNA, 20 bp, Artificial Sequence
  chemically synthesized
caagctcctaatgcaaaagg

SEQ ID NO: 30991 - DNA, 20 bp, Artificial Sequence
  chemically synthesized
aagctcctaatgcaaaagga

SEQ ID NO: 30992 - DNA, 20 bp, Artificial Sequence
  chemically synthesized
atgcaaaaggaaggaattca

SEQ ID NO: 30993 - DNA, 20 bp, Artificial Sequence
  chemically synthesized
ggaaggaattcatagtcatt

SEQ ID NO: 30994 - DNA, 20 bp, Artificial Sequence
  chemically synthesized
catagtcattcagaatcctg

SEQ ID NO: 30995 - DNA, 20 bp, Artificial Sequence
  chemically synthesized
gctcttgggttagaaactgc

SEQ ID NO: 30996 - DNA, 20 bp, Artificial Sequence
  chemically synthesized
tgctcttgggttagaaactg

SEQ ID NO: 30997 - DNA, 20 bp, Artificial Sequence
  chemically synthesized
aatcctgcagtttctaaccc

SEQ ID NO: 30998 - DNA, 20 bp, Artificial Sequence
  chemically synthesized
tcctgcagtttctaacccaa

SEQ ID NO: 30999 - DNA, 20 bp, Artificial Sequence
  chemically synthesized
tcctgaggatgctcttgggt

SEQ ID NO: 31000 - DNA, 20 bp, Artificial Sequence
  chemically synthesized
tccctcctgaggatgctctt

SEQ ID NO: 31001 - DNA, 20 bp, Artificial Sequence
  chemically synthesized
ttccctcctgaggatgctct

SEQ ID NO: 31002 - DNA, 20 bp, Artificial Sequence
  chemically synthesized
ttctaacccaagagcatcct

SEQ ID NO: 31003 - DNA, 20 bp, Artificial Sequence
  chemically synthesized
tctaacccaagagcatcctc

SEQ ID NO: 31004 - DNA, 20 bp, Artificial Sequence
  chemically synthesized
taacccaagagcatcctcag

SEQ ID NO: 31005 - DNA, 20 bp, Artificial Sequence
  chemically synthesized
aacccaagagcatcctcagg

SEQ ID NO: 31006 - DNA, 20 bp, Artificial Sequence
  chemically synthesized
acccaagagcatcctcagga

SEQ ID NO: 31007 - DNA, 20 bp, Artificial Sequence
  chemically synthesized
ccattaagtattccctcctg

SEQ ID NO: 31008 - DNA, 20 bp, Artificial Sequence
  chemically synthesized
tccattaagtattccctcct

SEQ ID NO: 31009 - DNA, 20 bp, Artificial Sequence
  chemically synthesized
cctcaggagggaatacttaa

SEQ ID NO: 31010 - DNA, 20 bp, Artificial Sequence
  chemically synthesized
taggctttctacattccatt

SEQ ID NO: 31011 - DNA, 20 bp, Artificial Sequence
  chemically synthesized
agggaatacttaatggaatg

SEQ ID NO: 31012 - DNA, 20 bp, Artificial Sequence
  chemically synthesized
aatacttaatggaatgtaga

SEQ ID NO: 31013 - DNA, 20 bp, Artificial Sequence
  chemically synthesized
gaatgtagaaagcctatcaa

SEQ ID NO: 31014 - DNA, 20 bp, Artificial Sequence
  chemically synthesized
atgtagaaagcctatcaaaa

SEQ ID NO: 31015 - DNA, 20 bp, Artificial Sequence
  chemically synthesized
gttcactctcctcttttgat

SEQ ID NO: 31016 - DNA, 20 bp, Artificial Sequence
  chemically synthesized
tgtagaaagcctatcaaaag

SEQ ID NO: 31017 - DNA, 20 bp, Artificial Sequence
  chemically synthesized
tgttcactctcctcttttga

SEQ ID NO: 31018 - DNA, 20 bp, Artificial Sequence
  chemically synthesized
tagaaagcctatcaaaagag

SEQ ID NO: 31019 - DNA, 20 bp, Artificial Sequence
  chemically synthesized
gaaagcctatcaaaagagga

SEQ ID NO: 31020 - DNA, 20 bp, Artificial Sequence
  chemically synthesized
cccaagaggaagggatattg

SEQ ID NO: 31021 - DNA, 20 bp, Artificial Sequence
  chemically synthesized
actacaatatcccttcctct

SEQ ID NO: 31022 - DNA, 20 bp, Artificial Sequence
  chemically synthesized
ctcagcttgcccaagaggaa

SEQ ID NO: 31023 - DNA, 20 bp, Artificial Sequence
  chemically synthesized
ctacaatatcccttcctctt

SEQ ID NO: 31024 - DNA, 20 bp, Artificial Sequence
  chemically synthesized
cctcagcttgcccaagagga

SEQ ID NO: 31025 - DNA, 20 bp, Artificial Sequence
  chemically synthesized
tcctcagcttgcccaagagg

SEQ ID NO: 31026 - DNA, 20 bp, Artificial Sequence
  chemically synthesized
aatatcccttcctcttgggc

SEQ ID NO: 31027 - DNA, 20 bp, Artificial Sequence
  chemically synthesized
ctttcctcagcttgcccaag

SEQ ID NO: 31028 - DNA, 20 bp, Artificial Sequence
  chemically synthesized
tctttcctcagcttgcccaa

SEQ ID NO: 31029 - DNA, 20 bp, Artificial Sequence
  chemically synthesized
cctctttcctcagcttgccc

SEQ ID NO: 31030 - DNA, 20 bp, Artificial Sequence
  chemically synthesized
cccttcctcttgggcaagct

SEQ ID NO: 31031 - DNA, 20 bp, Artificial Sequence
  chemically synthesized
ccttcctcttgggcaagctg

SEQ ID NO: 31032 - DNA, 20 bp, Artificial Sequence
  chemically synthesized
cctcttgggcaagctgagga

SEQ ID NO: 31033 - DNA, 20 bp, Artificial Sequence
  chemically synthesized
tcttgggcaagctgaggaaa

SEQ ID NO: 31034 - DNA, 20 bp, Artificial Sequence
  chemically synthesized
cttgggcaagctgaggaaag

SEQ ID NO: 31035 - DNA, 20 bp, Artificial Sequence
  chemically synthesized
aatccttgtacctctttcct

SEQ ID NO: 31036 - DNA, 20 bp, Artificial Sequence
  chemically synthesized
caagctgaggaaagaggtac

SEQ ID NO: 31037 - DNA, 20 bp, Artificial Sequence
  chemically synthesized
aagctgaggaaagaggtaca

SEQ ID NO: 31038 - DNA, 20 bp, Artificial Sequence
  chemically synthesized
aagaggtacaaggattttga

SEQ ID NO: 31039 - DNA, 20 bp, Artificial Sequence
  chemically synthesized
aggtacaaggattttgatag

SEQ ID NO: 31040 - DNA, 20 bp, Artificial Sequence
  chemically synthesized
taaatcagcaatttgcaaga

SEQ ID NO: 31041 - DNA, 20 bp, Artificial Sequence
  chemically synthesized
tataaatcagcaatttgcaa

SEQ ID NO: 31042 - DNA, 20 bp, Artificial Sequence
  chemically synthesized
attataaatcagcaatttgc

SEQ ID NO: 31043 - DNA, 20 bp, Artificial Sequence
  chemically synthesized
acatcaatatcattataaat

SEQ ID NO: 31044 - DNA, 20 bp, Artificial Sequence
  chemically synthesized
gatattgatgtatctttaaa

SEQ ID NO: 31045 - DNA, 20 bp, Artificial Sequence
  chemically synthesized
atggggctaaaagcttttta

SEQ ID NO: 31046 - DNA, 20 bp, Artificial Sequence
  chemically synthesized
atgtatctttaaaaagcttt

SEQ ID NO: 31047 - DNA, 20 bp, Artificial Sequence
  chemically synthesized
agttaagtcaatggggctaa

SEQ ID NO: 31048 - DNA, 20 bp, Artificial Sequence
  chemically synthesized
aagtcctagttaagtcaatg

SEQ ID NO: 31049 - DNA, 20 bp, Artificial Sequence
  chemically synthesized
taagtcctagttaagtcaat

SEQ ID NO: 31050 - DNA, 20 bp, Artificial Sequence
  chemically synthesized
ttaagtcctagttaagtcaa

SEQ ID NO: 31051 - DNA, 20 bp, Artificial Sequence
  chemically synthesized
tttagccccattgacttaac

SEQ ID NO: 31052 - DNA, 20 bp, Artificial Sequence
  chemically synthesized
ttagccccattgacttaact

SEQ ID NO: 31053 - DNA, 20 bp, Artificial Sequence
  chemically synthesized
gaactagttaagtcctagtt

SEQ ID NO: 31054 - DNA, 20 bp, Artificial Sequence
  chemically synthesized
taggagaactagttaagtcc

SEQ ID NO: 31055 - DNA, 20 bp, Artificial Sequence
  chemically synthesized
tgacttaactaggacttaac

SEQ ID NO: 31056 - DNA, 20 bp, Artificial Sequence
  chemically synthesized
tctagttaggagaactagtt

SEQ ID NO: 31057 - DNA, 20 bp, Artificial Sequence
  chemically synthesized
gcagttctagttaggagaac

SEQ ID NO: 31058 - DNA, 20 bp, Artificial Sequence
  chemically synthesized
acttaactagttctcctaac

SEQ ID NO: 31059 - DNA, 20 bp, Artificial Sequence
  chemically synthesized
tcttcagcagttctagttag

SEQ ID NO: 31060 - DNA, 20 bp, Artificial Sequence
  chemically synthesized
attcttcagcagttctagtt

SEQ ID NO: 31061 - DNA, 20 bp, Artificial Sequence
  chemically synthesized
gattcttcagcagttctagt

SEQ ID NO: 31062 - DNA, 20 bp, Artificial Sequence
  chemically synthesized
gtgtgattcttcagcagttc

SEQ ID NO: 31063 - DNA, 20 bp, Artificial Sequence
  chemically synthesized
tctcctaactagaactgctg

SEQ ID NO: 31064 - DNA, 20 bp, Artificial Sequence
  chemically synthesized
ttaggggtgtgattcttcag

SEQ ID NO: 31065 - DNA, 20 bp, Artificial Sequence
  chemically synthesized
aggttaggggtgtgattctt

SEQ ID NO: 31066 - DNA, 20 bp, Artificial Sequence
  chemically synthesized
aagaatcacacccctaacct

SEQ ID NO: 31067 - DNA, 20 bp, Artificial Sequence
  chemically synthesized
tctgctgggcctgaggttag

SEQ ID NO: 31068 - DNA, 20 bp, Artificial Sequence
  chemically synthesized
agaatcacacccctaacctc

SEQ ID NO: 31069 - DNA, 20 bp, Artificial Sequence
  chemically synthesized
gtctgctgggcctgaggtta

SEQ ID NO: 31070 - DNA, 20 bp, Artificial Sequence
  chemically synthesized
ggtctgctgggcctgaggtt

SEQ ID NO: 31071 - DNA, 20 bp, Artificial Sequence
  chemically synthesized
gggtctgctgggcctgaggt

SEQ ID NO: 31072 - DNA, 20 bp, Artificial Sequence
  chemically synthesized
cacacccctaacctcaggcc

SEQ ID NO: 31073 - DNA, 20 bp, Artificial Sequence
  chemically synthesized
tttagggtctgctgggcctg

SEQ ID NO: 31074 - DNA, 20 bp, Artificial Sequence
  chemically synthesized
ttttagggtctgctgggcct

SEQ ID NO: 31075 - DNA, 20 bp, Artificial Sequence
  chemically synthesized
acccctaacctcaggcccag

SEQ ID NO: 31076 - DNA, 20 bp, Artificial Sequence
  chemically synthesized
gtttaattttagggtctgct

SEQ ID NO: 31077 - DNA, 20 bp, Artificial Sequence
  chemically synthesized
ggtttaattttagggtctgc

SEQ ID NO: 31078 - DNA, 20 bp, Artificial Sequence
  chemically synthesized
aaaatgagggtttaatttta

SEQ ID NO: 31079 - DNA, 20 bp, Artificial Sequence
  chemically synthesized
taaaatgagggtttaatttt

SEQ ID NO: 31080 - DNA, 20 bp, Artificial Sequence
  chemically synthesized
ttaaaatgagggtttaattt

SEQ ID NO: 31081 - DNA, 20 bp, Artificial Sequence
  chemically synthesized
gcttcagaatgttaaaatga

SEQ ID NO: 31082 - DNA, 20 bp, Artificial Sequence
  chemically synthesized
agcttcagaatgttaaaatg

SEQ ID NO: 31083 - DNA, 20 bp, Artificial Sequence
  chemically synthesized
gagcttcagaatgttaaaat

SEQ ID NO: 31084 - DNA, 20 bp, Artificial Sequence
  chemically synthesized
accctcattttaacattctg

SEQ ID NO: 31085 - DNA, 20 bp, Artificial Sequence
  chemically synthesized
ctatggtttgcagagagctt

SEQ ID NO: 31086 - DNA, 20 bp, Artificial Sequence
  chemically synthesized
tcatgtctatggtttgcaga

SEQ ID NO: 31087 - DNA, 20 bp, Artificial Sequence
  chemically synthesized
cttcatgtctatggtttgca

SEQ ID NO: 31088 - DNA, 20 bp, Artificial Sequence
  chemically synthesized
ctgaagctctctgcaaacca

SEQ ID NO: 31089 - DNA, 20 bp, Artificial Sequence
  chemically synthesized
agcttcatgtctatggtttg

SEQ ID NO: 31090 - DNA, 20 bp, Artificial Sequence
  chemically synthesized
agcccttagcttcatgtcta

SEQ ID NO: 31091 - DNA, 20 bp, Artificial Sequence
  chemically synthesized
ctctgcaaaccatagacatg

SEQ ID NO: 31092 - DNA, 20 bp, Artificial Sequence
  chemically synthesized
caaaccatagacatgaagct

SEQ ID NO: 31093 - DNA, 20 bp, Artificial Sequence
  chemically synthesized
aaaccatagacatgaagcta

SEQ ID NO: 31094 - DNA, 20 bp, Artificial Sequence
  chemically synthesized
aaccatagacatgaagctaa

SEQ ID NO: 31095 - DNA, 20 bp, Artificial Sequence
  chemically synthesized
gtctatcagcacgtagccct

SEQ ID NO: 31096 - DNA, 20 bp, Artificial Sequence
  chemically synthesized
gaaggcagtctatcagcacg

SEQ ID NO: 31097 - DNA, 20 bp, Artificial Sequence
  chemically synthesized
agctaagggctacgtgctga

SEQ ID NO: 31098 - DNA, 20 bp, Artificial Sequence
  chemically synthesized
aagatttgaaggcagtctat

SEQ ID NO: 31099 - DNA, 20 bp, Artificial Sequence
  chemically synthesized
aaaaccataagatttgaagg

SEQ ID NO: 31100 - DNA, 20 bp, Artificial Sequence
  chemically synthesized
ttaaaaaccataagatttga

SEQ ID NO: 31101 - DNA, 20 bp, Artificial Sequence
  chemically synthesized
tttaaaaaccataagatttg

SEQ ID NO: 31102 - DNA, 20 bp, Artificial Sequence
  chemically synthesized
tagactgccttcaaatctta

SEQ ID NO: 31103 - DNA, 20 bp, Artificial Sequence
  chemically synthesized
aagtggtctttaaaaaccat

SEQ ID NO: 31104 - DNA, 20 bp, Artificial Sequence
  chemically synthesized
ttcaaatcttatggttttta

SEQ ID NO: 31105 - DNA, 20 bp, Artificial Sequence
  chemically synthesized
tttggaattcttaggaaaag

SEQ ID NO: 31106 - DNA, 20 bp, Artificial Sequence
  chemically synthesized
ttttaaagaccacttttcct

SEQ ID NO: 31107 - DNA, 20 bp, Artificial Sequence
  chemically synthesized
gtttttggaattcttaggaa

SEQ ID NO: 31108 - DNA, 20 bp, Artificial Sequence
  chemically synthesized
tgagtgtttttggaattctt

SEQ ID NO: 31109 - DNA, 20 bp, Artificial Sequence
  chemically synthesized
ctgagtgtttttggaattct

SEQ ID NO: 31110 - DNA, 20 bp, Artificial Sequence
  chemically synthesized
aatggacttctgagtgtttt

SEQ ID NO: 31111 - DNA, 20 bp, Artificial Sequence
  chemically synthesized
ctaagaattccaaaaacact

SEQ ID NO: 31112 - DNA, 20 bp, Artificial Sequence
  chemically synthesized
agaattccaaaaacactcag

SEQ ID NO: 31113 - DNA, 20 bp, Artificial Sequence
  chemically synthesized
attttcaaaaatggacttct

SEQ ID NO: 31114 - DNA, 20 bp, Artificial Sequence
  chemically synthesized
aagctctcaattttcaaaaa

SEQ ID NO: 31115 - DNA, 20 bp, Artificial Sequence
  chemically synthesized
gaagtccatttttgaaaatt

SEQ ID NO: 31116 - DNA, 20 bp, Artificial Sequence
  chemically synthesized
agtccatttttgaaaattga

SEQ ID NO: 31117 - DNA, 20 bp, Artificial Sequence
  chemically synthesized
tgctcacctgaatgatgcga

SEQ ID NO: 31118 - DNA, 20 bp, Artificial Sequence
  chemically synthesized
ttgagagctttcgcatcatt

SEQ ID NO: 31119 - DNA, 20 bp, Artificial Sequence
  chemically synthesized
tgagagctttcgcatcattc

SEQ ID NO: 31120 - DNA, 20 bp, Artificial Sequence
  chemically synthesized
agctttcgcatcattcaggt

SEQ ID NO: 31121 - DNA, 20 bp, Artificial Sequence
  chemically synthesized
cattcaggtgagcatcatgc

SEQ ID NO: 31122 - DNA, 20 bp, Artificial Sequence
  chemically synthesized
caggtgagcatcatgctgga

SEQ ID NO: 31123 - DNA, 20 bp, Artificial Sequence
  chemically synthesized
gtgagcatcatgctggatag

SEQ ID NO: 31124 - DNA, 20 bp, Artificial Sequence
  chemically synthesized
tgagcatcatgctggatagt

SEQ ID NO: 31125 - DNA, 20 bp, Artificial Sequence
  chemically synthesized
aatttttggatcctactatc

SEQ ID NO: 31126 - DNA, 20 bp, Artificial Sequence
  chemically synthesized
ggatagtaggatccaaaaat

SEQ ID NO: 31127 - DNA, 20 bp, Artificial Sequence
  chemically synthesized
gatagtaggatccaaaaatt

SEQ ID NO: 31128 - DNA, 20 bp, Artificial Sequence
  chemically synthesized
ttaatctgttgcccaatttt

SEQ ID NO: 31129 - DNA, 20 bp, Artificial Sequence
  chemically synthesized
aggatccaaaaattgggcaa

SEQ ID NO: 31130 - DNA, 20 bp, Artificial Sequence
  chemically synthesized
aaattgggcaacagattaaa

SEQ ID NO: 31131 - DNA, 20 bp, Artificial Sequence
  chemically synthesized
aattgggcaacagattaaaa

SEQ ID NO: 31132 - DNA, 20 bp, Artificial Sequence
  chemically synthesized
attgggcaacagattaaaaa

SEQ ID NO: 31133 - DNA, 20 bp, Artificial Sequence
  chemically synthesized
ggcaacagattaaaaagggc

SEQ ID NO: 31134 - DNA, 20 bp, Artificial Sequence
  chemically synthesized
tagcgttcttcagaaggatc

SEQ ID NO: 31135 - DNA, 20 bp, Artificial Sequence
  chemically synthesized
aaaagggctagatccttctg

SEQ ID NO: 31136 - DNA, 20 bp, Artificial Sequence
  chemically synthesized
aagttatagcgttcttcaga

SEQ ID NO: 31137 - DNA, 20 bp, Artificial Sequence
  chemically synthesized
taagttatagcgttcttcag

SEQ ID NO: 31138 - DNA, 20 bp, Artificial Sequence
  chemically synthesized
tcttaagttatagcgttctt

SEQ ID NO: 31139 - DNA, 20 bp, Artificial Sequence
  chemically synthesized
tctgaagaacgctataactt

SEQ ID NO: 31140 - DNA, 20 bp, Artificial Sequence
  chemically synthesized
gttttccttttcttaagtta

SEQ ID NO: 31141 - DNA, 20 bp, Artificial Sequence
  chemically synthesized
agaacgctataacttaagaa

SEQ ID NO: 31142 - DNA, 20 bp, Artificial Sequence
  chemically synthesized
gaacgctataacttaagaaa

SEQ ID NO: 31143 - DNA, 20 bp, Artificial Sequence
  chemically synthesized
gtactggttttccttttctt

SEQ ID NO: 31144 - DNA, 20 bp, Artificial Sequence
  chemically synthesized
taacttaagaaaaggaaaac

SEQ ID NO: 31145 - DNA, 20 bp, Artificial Sequence
  chemically synthesized
agtgttttctcaaggggtac

SEQ ID NO: 31146 - DNA, 20 bp, Artificial Sequence
  chemically synthesized
aaggaaaaccagtacccctt

SEQ ID NO: 31147 - DNA, 20 bp, Artificial Sequence
  chemically synthesized
accacaagtgttttctcaag

SEQ ID NO: 31148 - DNA, 20 bp, Artificial Sequence
  chemically synthesized
aaccacaagtgttttctcaa

SEQ ID NO: 31149 - DNA, 20 bp, Artificial Sequence
  chemically synthesized
taaccacaagtgttttctca

SEQ ID NO: 31150 - DNA, 20 bp, Artificial Sequence
  chemically synthesized
ttaaccacaagtgttttctc

SEQ ID NO: 31151 - DNA, 20 bp, Artificial Sequence
  chemically synthesized
accccttgagaaaacacttg

SEQ ID NO: 31152 - DNA, 20 bp, Artificial Sequence
  chemically synthesized
ttgagaaaacacttgtggtt

SEQ ID NO: 31153 - DNA, 20 bp, Artificial Sequence
  chemically synthesized
attgaagccctcttaaccac

SEQ ID NO: 31154 - DNA, 20 bp, Artificial Sequence
  chemically synthesized
gagaaaacacttgtggttaa

SEQ ID NO: 31155 - DNA, 20 bp, Artificial Sequence
  chemically synthesized
agaaaacacttgtggttaag

SEQ ID NO: 31156 - DNA, 20 bp, Artificial Sequence
  chemically synthesized
gaaaacacttgtggttaaga

SEQ ID NO: 31157 - DNA, 20 bp, Artificial Sequence
  chemically synthesized
tggttaagagggcttcaatg

SEQ ID NO: 31158 - DNA, 20 bp, Artificial Sequence
  chemically synthesized
ggttaagagggcttcaatga

SEQ ID NO: 31159 - DNA, 20 bp, Artificial Sequence
  chemically synthesized
aatttccttttccttcattg

SEQ ID NO: 31160 - DNA, 20 bp, Artificial Sequence
  chemically synthesized
agagggcttcaatgaaggaa

SEQ ID NO: 31161 - DNA, 20 bp, Artificial Sequence
  chemically synthesized
gagggcttcaatgaaggaaa

SEQ ID NO: 31162 - DNA, 20 bp, Artificial Sequence
  chemically synthesized
tcaatgaaggaaaaggaaat

SEQ ID NO: 31163 - DNA, 20 bp, Artificial Sequence
  chemically synthesized
aaggaaaaggaaattggaat

SEQ ID NO: 31164 - DNA, 20 bp, Artificial Sequence
  chemically synthesized
gaaattggaataagtaacac

SEQ ID NO: 31165 - DNA, 20 bp, Artificial Sequence
  chemically synthesized
ataagtaacaccagaacata

SEQ ID NO: 31166 - DNA, 20 bp, Artificial Sequence
  chemically synthesized
tctagatgcaccgtatgttc

SEQ ID NO: 31167 - DNA, 20 bp, Artificial Sequence
  chemically synthesized
accagaacatacggtgcatc

SEQ ID NO: 31168 - DNA, 20 bp, Artificial Sequence
  chemically synthesized
tcaagcagtttattaaaatc

SEQ ID NO: 31169 - DNA, 20 bp, Artificial Sequence
  chemically synthesized
aaagctgattttatttcaag

SEQ ID NO: 31170 - DNA, 20 bp, Artificial Sequence
  chemically synthesized
cagaaagctgattttatttc

SEQ ID NO: 31171 - DNA, 20 bp, Artificial Sequence
  chemically synthesized
taaactgcttgaaataaaat

SEQ ID NO: 31172 - DNA, 20 bp, Artificial Sequence
  chemically synthesized
gaaataaaatcagctttctg

SEQ ID NO: 31173 - DNA, 20 bp, Artificial Sequence
  chemically synthesized
gagaatcgctgcacttcaga

SEQ ID NO: 31174 - DNA, 20 bp, Artificial Sequence
  chemically synthesized
aaaatcagctttctgaagtg

SEQ ID NO: 31175 - DNA, 20 bp, Artificial Sequence
  chemically synthesized
aagagagaatcgctgcactt

SEQ ID NO: 31176 - DNA, 20 bp, Artificial Sequence
  chemically synthesized
aaaataggataatgtgaaga

SEQ ID NO: 31177 - DNA, 20 bp, Artificial Sequence
  chemically synthesized
taaaaataggataatgtgaa

SEQ ID NO: 31178 - DNA, 20 bp, Artificial Sequence
  chemically synthesized
ggtaaaaataggataatgtg

SEQ ID NO: 31179 - DNA, 20 bp, Artificial Sequence
  chemically synthesized
ggagacatgtaggtaaaaat

SEQ ID NO: 31180 - DNA, 20 bp, Artificial Sequence
  chemically synthesized
aggagacatgtaggtaaaaa

SEQ ID NO: 31181 - DNA, 20 bp, Artificial Sequence
  chemically synthesized
agtttatgaaggagacatgt

SEQ ID NO: 31182 - DNA, 20 bp, Artificial Sequence
  chemically synthesized
cagtttatgaaggagacatg

SEQ ID NO: 31183 - DNA, 20 bp, Artificial Sequence
  chemically synthesized
aagaagaccagtttatgaag

SEQ ID NO: 31184 - DNA, 20 bp, Artificial Sequence
  chemically synthesized
acaagaagaccagtttatga

SEQ ID NO: 31185 - DNA, 20 bp, Artificial Sequence
  chemically synthesized
tacatgtctccttcataaac

SEQ ID NO: 31186 - DNA, 20 bp, Artificial Sequence
  chemically synthesized
tacaagaagaccagtttatg

SEQ ID NO: 31187 - DNA, 20 bp, Artificial Sequence
  chemically synthesized
tcagtatagtacaagaagac

SEQ ID NO: 31188 - DNA, 20 bp, Artificial Sequence
  chemically synthesized
tactgtcagtatagtacaag

SEQ ID NO: 31189 - DNA, 20 bp, Artificial Sequence
  chemically synthesized
tgatactgtcagtatagtac

SEQ ID NO: 31190 - DNA, 20 bp, Artificial Sequence
  chemically synthesized
gtcttcttgtactatactga

SEQ ID NO: 31191 - DNA, 20 bp, Artificial Sequence
  chemically synthesized
catttgtgatactgtcagta

SEQ ID NO: 31192 - DNA, 20 bp, Artificial Sequence
  chemically synthesized
ttttgcatttgtgatactgt

SEQ ID NO: 31193 - DNA, 20 bp, Artificial Sequence
  chemically synthesized
tcctttttaaattacaatgt

SEQ ID NO: 31194 - DNA, 20 bp, Artificial Sequence
  chemically synthesized
aactcacattgtaatttaaa

SEQ ID NO: 31195 - DNA, 20 bp, Artificial Sequence
  chemically synthesized
actcacattgtaatttaaaa

SEQ ID NO: 31196 - DNA, 20 bp, Artificial Sequence
  chemically synthesized
gtaatttaaaaaggaaccat

SEQ ID NO: 31197 - DNA, 20 bp, Artificial Sequence
  chemically synthesized
taatttaaaaaggaaccatt

SEQ ID NO: 31198 - DNA, 20 bp, Artificial Sequence
  chemically synthesized
aatttaaaaaggaaccattg

SEQ ID NO: 31199 - DNA, 20 bp, Artificial Sequence
  chemically synthesized
taaaatatgtggttccccaa

SEQ ID NO: 31200 - DNA, 20 bp, Artificial Sequence
  chemically synthesized
tataaatacaataaaatatg

SEQ ID NO: 31201 - DNA, 20 bp, Artificial Sequence
  chemically synthesized
attttattgtatttataatt

SEQ ID NO: 31202 - DNA, 20 bp, Artificial Sequence
  chemically synthesized
tttattgtatttataattaa

SEQ ID NO: 31203 - DNA, 20 bp, Artificial Sequence
  chemically synthesized
tagcctgtcttattgggggg

SEQ ID NO: 31204 - DNA, 20 bp, Artificial Sequence
  chemically synthesized
ttagcctgtcttattggggg

SEQ ID NO: 31205 - DNA, 20 bp, Artificial Sequence
  chemically synthesized
ttaagagacccccccccaat

SEQ ID NO: 31206 - DNA, 20 bp, Artificial Sequence
  chemically synthesized
cttagcctgtcttattgggg

SEQ ID NO: 31207 - DNA, 20 bp, Artificial Sequence
  chemically synthesized
tcttagcctgtcttattggg

SEQ ID NO: 31208 - DNA, 20 bp, Artificial Sequence
  chemically synthesized
ttcttagcctgtcttattgg

SEQ ID NO: 31209 - DNA, 20 bp, Artificial Sequence
  chemically synthesized
tttcttagcctgtcttattg

SEQ ID NO: 31210 - DNA, 20 bp, Artificial Sequence
  chemically synthesized
gagacccccccccaataaga

SEQ ID NO: 31211 - DNA, 20 bp, Artificial Sequence
  chemically synthesized
atttcttagcctgtcttatt

SEQ ID NO: 31212 - DNA, 20 bp, Artificial Sequence
  chemically synthesized
agacccccccccaataagac

SEQ ID NO: 31213 - DNA, 20 bp, Artificial Sequence
  chemically synthesized
tatttcttagcctgtcttat

SEQ ID NO: 31214 - DNA, 20 bp, Artificial Sequence
  chemically synthesized
cccccccaataagacaggct

SEQ ID NO: 31215 - DNA, 20 bp, Artificial Sequence
  chemically synthesized
tgtttaaaaacattatttct

SEQ ID NO: 31216 - DNA, 20 bp, Artificial Sequence
  chemically synthesized
taagaaataatgtttttaaa

SEQ ID NO: 31217 - DNA, 20 bp, Artificial Sequence
  chemically synthesized
aagaaataatgtttttaaac

SEQ ID NO: 31218 - DNA, 20 bp, Artificial Sequence
  chemically synthesized
agaaataatgtttttaaaca

SEQ ID NO: 31219 - DNA, 20 bp, Artificial Sequence
  chemically synthesized
tccagcctgggcaacagaac

SEQ ID NO: 31220 - DNA, 20 bp, Artificial Sequence
  chemically synthesized
cagggtctcgttctgttgcc

SEQ ID NO: 31221 - DNA, 20 bp, Artificial Sequence
  chemically synthesized
agggtctcgttctgttgccc

SEQ ID NO: 31222 - DNA, 20 bp, Artificial Sequence
  chemically synthesized
ctgcactccagcctgggcaa

SEQ ID NO: 31223 - DNA, 20 bp, Artificial Sequence
  chemically synthesized
tctcgttctgttgcccaggc

SEQ ID NO: 31224 - DNA, 20 bp, Artificial Sequence
  chemically synthesized
tcgttctgttgcccaggctg

SEQ ID NO: 31225 - DNA, 20 bp, Artificial Sequence
  chemically synthesized
acatcactgcactccagcct

SEQ ID NO: 31226 - DNA, 20 bp, Artificial Sequence
  chemically synthesized
tacatcactgcactccagcc

SEQ ID NO: 31227 - DNA, 20 bp, Artificial Sequence
  chemically synthesized
ctgttgcccaggctggagtg

SEQ ID NO: 31228 - DNA, 20 bp, Artificial Sequence
  chemically synthesized
gaggttacatcactgcactc

SEQ ID NO: 31229 - DNA, 20 bp, Artificial Sequence
  chemically synthesized
ggagtgcagtgatgtaacct

SEQ ID NO: 31230 - DNA, 20 bp, Artificial Sequence
  chemically synthesized
gacgagactgcagtgagccg

SEQ ID NO: 31231 - DNA, 20 bp, Artificial Sequence
  chemically synthesized
ggacgagactgcagtgagcc

SEQ ID NO: 31232 - DNA, 20 bp, Artificial Sequence
  chemically synthesized
gatgtaacctcggctcactg

SEQ ID NO: 31233 - DNA, 20 bp, Artificial Sequence
  chemically synthesized
cgggaggacgagactgcagt

SEQ ID NO: 31234 - DNA, 20 bp, Artificial Sequence
  chemically synthesized
agcccgggaggacgagactg

SEQ ID NO: 31235 - DNA, 20 bp, Artificial Sequence
  chemically synthesized
tcactgcagtctcgtcctcc

SEQ ID NO: 31236 - DNA, 20 bp, Artificial Sequence
  chemically synthesized
tcgcttgagcccgggaggac

SEQ ID NO: 31237 - DNA, 20 bp, Artificial Sequence
  chemically synthesized
cactgcagtctcgtcctccc

SEQ ID NO: 31238 - DNA, 20 bp, Artificial Sequence
  chemically synthesized
gagggtcgcttgagcccggg

SEQ ID NO: 31239 - DNA, 20 bp, Artificial Sequence
  chemically synthesized
ggagggtcgcttgagcccgg

SEQ ID NO: 31240 - DNA, 20 bp, Artificial Sequence
  chemically synthesized
agtctcgtcctcccgggctc

SEQ ID NO: 31241 - DNA, 20 bp, Artificial Sequence
  chemically synthesized
tgggagggtcgcttgagccc

SEQ ID NO: 31242 - DNA, 20 bp, Artificial Sequence
  chemically synthesized
gtgggagggtcgcttgagcc

SEQ ID NO: 31243 - DNA, 20 bp, Artificial Sequence
  chemically synthesized
ctgaggtgggagggtcgctt

SEQ ID NO: 31244 - DNA, 20 bp, Artificial Sequence
  chemically synthesized
ctcaggaggctgaggtggga

SEQ ID NO: 31245 - DNA, 20 bp, Artificial Sequence
  chemically synthesized
ctcaagcgaccctcccacct

SEQ ID NO: 31246 - DNA, 20 bp, Artificial Sequence
  chemically synthesized
actcaggaggctgaggtggg

SEQ ID NO: 31247 - DNA, 20 bp, Artificial Sequence
  chemically synthesized
tactcaggaggctgaggtgg

SEQ ID NO: 31248 - DNA, 20 bp, Artificial Sequence
  chemically synthesized
gatactcaggaggctgaggt

SEQ ID NO: 31249 - DNA, 20 bp, Artificial Sequence
  chemically synthesized
agatactcaggaggctgagg

SEQ ID NO: 31250 - DNA, 20 bp, Artificial Sequence
  chemically synthesized
cccagatactcaggaggctg

SEQ ID NO: 31251 - DNA, 20 bp, Artificial Sequence
  chemically synthesized
tcccagatactcaggaggct

SEQ ID NO: 31252 - DNA, 20 bp, Artificial Sequence
  chemically synthesized
ccctcccacctcagcctcct

SEQ ID NO: 31253 - DNA, 20 bp, Artificial Sequence
  chemically synthesized
tgtagtcccagatactcagg

SEQ ID NO: 31254 - DNA, 20 bp, Artificial Sequence
  chemically synthesized
ctgtagtcccagatactcag

SEQ ID NO: 31255 - DNA, 20 bp, Artificial Sequence
  chemically synthesized
acctcagcctcctgagtatc

SEQ ID NO: 31256 - DNA, 20 bp, Artificial Sequence
  chemically synthesized
gcctgtagtcccagatactc

SEQ ID NO: 31257 - DNA, 20 bp, Artificial Sequence
  chemically synthesized
cctcagcctcctgagtatct

SEQ ID NO: 31258 - DNA, 20 bp, Artificial Sequence
  chemically synthesized
tgcctgtagtcccagatact

SEQ ID NO: 31259 - DNA, 20 bp, Artificial Sequence
  chemically synthesized
ctcctgagtatctgggacta

SEQ ID NO: 31260 - DNA, 20 bp, Artificial Sequence
  chemically synthesized
tcctgagtatctgggactac

SEQ ID NO: 31261 - DNA, 20 bp, Artificial Sequence
  chemically synthesized
gtggcatgtgcctgtagtcc

SEQ ID NO: 31262 - DNA, 20 bp, Artificial Sequence
  chemically synthesized
agcatggtggcatgtgcctg

SEQ ID NO: 31263 - DNA, 20 bp, Artificial Sequence
  chemically synthesized
caggcacatgccaccatgct

SEQ ID NO: 31264 - DNA, 20 bp, Artificial Sequence
  chemically synthesized
caaaaattagccgagcatgg

SEQ ID NO: 31265 - DNA, 20 bp, Artificial Sequence
  chemically synthesized
atacaaaaattagccgagca

SEQ ID NO: 31266 - DNA, 20 bp, Artificial Sequence
  chemically synthesized
aaaaaatacaaaaattagcc

SEQ ID NO: 31267 - DNA, 20 bp, Artificial Sequence
  chemically synthesized
tctacaaaaaatacaaaaat

SEQ ID NO: 31268 - DNA, 20 bp, Artificial Sequence
  chemically synthesized
gctaatttttgtattttttg

SEQ ID NO: 31269 - DNA, 20 bp, Artificial Sequence
  chemically synthesized
taatttttgtattttttgta

SEQ ID NO: 31270 - DNA, 20 bp, Artificial Sequence
  chemically synthesized
ttttgtattttttgtagaga

SEQ ID NO: 31271 - DNA, 20 bp, Artificial Sequence
  chemically synthesized
tttgtattttttgtagagat

SEQ ID NO: 31272 - DNA, 20 bp, Artificial Sequence
  chemically synthesized
ttgtattttttgtagagatg

SEQ ID NO: 31273 - DNA, 20 bp, Artificial Sequence
  chemically synthesized
gtattttttgtagagatggg

SEQ ID NO: 31274 - DNA, 20 bp, Artificial Sequence
  chemically synthesized
tttttgtagagatggggaga

SEQ ID NO: 31275 - DNA, 20 bp, Artificial Sequence
  chemically synthesized
ttttgtagagatggggagac

SEQ ID NO: 31276 - DNA, 20 bp, Artificial Sequence
  chemically synthesized
tttgtagagatggggagacg

SEQ ID NO: 31277 - DNA, 20 bp, Artificial Sequence
  chemically synthesized
cggggtttcaccacgttgcc

SEQ ID NO: 31278 - DNA, 20 bp, Artificial Sequence
  chemically synthesized
caagaccagcctgggcaacg

SEQ ID NO: 31279 - DNA, 20 bp, Artificial Sequence
  chemically synthesized
ggggtttcaccacgttgccc

SEQ ID NO: 31280 - DNA, 20 bp, Artificial Sequence
  chemically synthesized
tttcaccacgttgcccaggc

SEQ ID NO: 31281 - DNA, 20 bp, Artificial Sequence
  chemically synthesized
caggagttcaagaccagcct

SEQ ID NO: 31282 - DNA, 20 bp, Artificial Sequence
  chemically synthesized
tcaggagttcaagaccagcc

SEQ ID NO: 31283 - DNA, 20 bp, Artificial Sequence
  chemically synthesized
tgagctcaggagttcaagac

SEQ ID NO: 31284 - DNA, 20 bp, Artificial Sequence
  chemically synthesized
tcacttgagctcaggagttc

SEQ ID NO: 31285 - DNA, 20 bp, Artificial Sequence
  chemically synthesized
caggctggtcttgaactcct

SEQ ID NO: 31286 - DNA, 20 bp, Artificial Sequence
  chemically synthesized
agcagctcacttgagctcag

SEQ ID NO: 31287 - DNA, 20 bp, Artificial Sequence
  chemically synthesized
ggtcttgaactcctgagctc

SEQ ID NO: 31288 - DNA, 20 bp, Artificial Sequence
  chemically synthesized
cgagcagctcacttgagctc

SEQ ID NO: 31289 - DNA, 20 bp, Artificial Sequence
  chemically synthesized
gcgagcagctcacttgagct

SEQ ID NO: 31290 - DNA, 20 bp, Artificial Sequence
  chemically synthesized
ttgaactcctgagctcaagt

SEQ ID NO: 31291 - DNA, 20 bp, Artificial Sequence
  chemically synthesized
ccgaggcgagcagctcactt

SEQ ID NO: 31292 - DNA, 20 bp, Artificial Sequence
  chemically synthesized
ctcaagtgagctgctcgcct

SEQ ID NO: 31293 - DNA, 20 bp, Artificial Sequence
  chemically synthesized
cttttggaggccgaggcgag

SEQ ID NO: 31294 - DNA, 20 bp, Artificial Sequence
  chemically synthesized
gcacttttggaggccgaggc

SEQ ID NO: 31295 - DNA, 20 bp, Artificial Sequence
  chemically synthesized
cctagcacttttggaggccg

SEQ ID NO: 31296 - DNA, 20 bp, Artificial Sequence
  chemically synthesized
tcctagcacttttggaggcc

SEQ ID NO: 31297 - DNA, 20 bp, Artificial Sequence
  chemically synthesized
ctgctcgcctcggcctccaa

SEQ ID NO: 31298 - DNA, 20 bp, Artificial Sequence
  chemically synthesized
tgtaatcctagcacttttgg

SEQ ID NO: 31299 - DNA, 20 bp, Artificial Sequence
  chemically synthesized
ttgtaatcctagcacttttg

SEQ ID NO: 31300 - DNA, 20 bp, Artificial Sequence
  chemically synthesized
gcctcggcctccaaaagtgc

SEQ ID NO: 31301 - DNA, 20 bp, Artificial Sequence
  chemically synthesized
atttgtaatcctagcacttt

SEQ ID NO: 31302 - DNA, 20 bp, Artificial Sequence
  chemically synthesized
cctcggcctccaaaagtgct

SEQ ID NO: 31303 - DNA, 20 bp, Artificial Sequence
  chemically synthesized
gtggctcacatttgtaatcc

SEQ ID NO: 31304 - DNA, 20 bp, Artificial Sequence
  chemically synthesized
agtgctaggattacaaatgt

SEQ ID NO: 31305 - DNA, 20 bp, Artificial Sequence
  chemically synthesized
caaatgtgagccactgtgcc

SEQ ID NO: 31306 - DNA, 20 bp, Artificial Sequence
  chemically synthesized
agaatttaggctgggcacag

SEQ ID NO: 31307 - DNA, 20 bp, Artificial Sequence
  chemically synthesized
agtagaatttaggctgggca

SEQ ID NO: 31308 - DNA, 20 bp, Artificial Sequence
  chemically synthesized
aacagagtagaatttaggct

SEQ ID NO: 31309 - DNA, 20 bp, Artificial Sequence
  chemically synthesized
caacagagtagaatttaggc

SEQ ID NO: 31310 - DNA, 20 bp, Artificial Sequence
  chemically synthesized
tgaccaacagagtagaattt

SEQ ID NO: 31311 - DNA, 20 bp, Artificial Sequence
  chemically synthesized
ctgaccaacagagtagaatt

SEQ ID NO: 31312 - DNA, 20 bp, Artificial Sequence
  chemically synthesized
cagcctaaattctactctgt

SEQ ID NO: 31313 - DNA, 20 bp, Artificial Sequence
  chemically synthesized
agatatactgaccaacagag

SEQ ID NO: 31314 - DNA, 20 bp, Artificial Sequence
  chemically synthesized
ctaaattctactctgttggt

SEQ ID NO: 31315 - DNA, 20 bp, Artificial Sequence
  chemically synthesized
gacagatatactgaccaaca

SEQ ID NO: 31316 - DNA, 20 bp, Artificial Sequence
  chemically synthesized
tggacagatatactgaccaa

SEQ ID NO: 31317 - DNA, 20 bp, Artificial Sequence
  chemically synthesized
caagagtatttacatatgga

SEQ ID NO: 31318 - DNA, 20 bp, Artificial Sequence
  chemically synthesized
taatcaagagtatttacata

SEQ ID NO: 31319 - DNA, 20 bp, Artificial Sequence
  chemically synthesized
ctacaaatttaagtaatcaa

SEQ ID NO: 31320 - DNA, 20 bp, Artificial Sequence
  chemically synthesized
tactacaaatttaagtaatc

SEQ ID NO: 31321 - DNA, 20 bp, Artificial Sequence
  chemically synthesized
ctcttgattacttaaatttg

SEQ ID NO: 31322 - DNA, 20 bp, Artificial Sequence
  chemically synthesized
tcaaatcttactacaaattt

SEQ ID NO: 31323 - DNA, 20 bp, Artificial Sequence
  chemically synthesized
tgattacttaaatttgtagt

SEQ ID NO: 31324 - DNA, 20 bp, Artificial Sequence
  chemically synthesized
tttgtagtaagatttgacat

SEQ ID NO: 31325 - DNA, 20 bp, Artificial Sequence
  chemically synthesized
atttgacattggaaattgtg

SEQ ID NO: 31326 - DNA, 20 bp, Artificial Sequence
  chemically synthesized
tttgacattggaaattgtga

SEQ ID NO: 31327 - DNA, 20 bp, Artificial Sequence
  chemically synthesized
acattggaaattgtgaaggc

SEQ ID NO: 31328 - DNA, 20 bp, Artificial Sequence
  chemically synthesized
cattggaaattgtgaaggcc

SEQ ID NO: 31329 - DNA, 20 bp, Artificial Sequence
  chemically synthesized
gaaattgtgaaggccaggtg

SEQ ID NO: 31330 - DNA, 20 bp, Artificial Sequence
  chemically synthesized
attgtgaaggccaggtgcag

SEQ ID NO: 31331 - DNA, 20 bp, Artificial Sequence
  chemically synthesized
caagggtgagccactgcacc

SEQ ID NO: 31332 - DNA, 20 bp, Artificial Sequence
  chemically synthesized
caggtgcagtggctcaccct

SEQ ID NO: 31333 - DNA, 20 bp, Artificial Sequence
  chemically synthesized
aggtgcagtggctcaccctt

SEQ ID NO: 31334 - DNA, 20 bp, Artificial Sequence
  chemically synthesized
agctctgagatcccaagggt

SEQ ID NO: 31335 - DNA, 20 bp, Artificial Sequence
  chemically synthesized
ccacagctctgagatcccaa

SEQ ID NO: 31336 - DNA, 20 bp, Artificial Sequence
  chemically synthesized
cccacagctctgagatccca

SEQ ID NO: 31337 - DNA, 20 bp, Artificial Sequence
  chemically synthesized
gtggctcacccttgggatct

SEQ ID NO: 31338 - DNA, 20 bp, Artificial Sequence
  chemically synthesized
tcccacagctctgagatccc

SEQ ID NO: 31339 - DNA, 20 bp, Artificial Sequence
  chemically synthesized
ggctcacccttgggatctca

SEQ ID NO: 31340 - DNA, 20 bp, Artificial Sequence
  chemically synthesized
cccttgggatctcagagctg

SEQ ID NO: 31341 - DNA, 20 bp, Artificial Sequence
  chemically synthesized
ccttggcctcccacagctct

SEQ ID NO: 31342 - DNA, 20 bp, Artificial Sequence
  chemically synthesized
ccttgggatctcagagctgt

SEQ ID NO: 31343 - DNA, 20 bp, Artificial Sequence
  chemically synthesized
ttgggatctcagagctgtgg

SEQ ID NO: 31344 - DNA, 20 bp, Artificial Sequence
  chemically synthesized
tgggatctcagagctgtggg

SEQ ID NO: 31345 - DNA, 20 bp, Artificial Sequence
  chemically synthesized
cctcccaccttggcctccca

SEQ ID NO: 31346 - DNA, 20 bp, Artificial Sequence
  chemically synthesized
tctcagagctgtgggaggcc

SEQ ID NO: 31347 - DNA, 20 bp, Artificial Sequence
  chemically synthesized
ctcagagctgtgggaggcca

SEQ ID NO: 31348 - DNA, 20 bp, Artificial Sequence
  chemically synthesized
agagctgtgggaggccaagg

SEQ ID NO: 31349 - DNA, 20 bp, Artificial Sequence
  chemically synthesized
gagctgtgggaggccaaggt

SEQ ID NO: 31350 - DNA, 20 bp, Artificial Sequence
  chemically synthesized
gctgtgggaggccaaggtgg

SEQ ID NO: 31351 - DNA, 20 bp, Artificial Sequence
  chemically synthesized
ctgtgggaggccaaggtggg

SEQ ID NO: 31352 - DNA, 20 bp, Artificial Sequence
  chemically synthesized
ctcaagcgatcctcccacct

SEQ ID NO: 31353 - DNA, 20 bp, Artificial Sequence
  chemically synthesized
ccaaggtgggaggatcgctt

SEQ ID NO: 31354 - DNA, 20 bp, Artificial Sequence
  chemically synthesized
tgggaggatcgcttgagccc

SEQ ID NO: 31355 - DNA, 20 bp, Artificial Sequence
  chemically synthesized
ggtctcaaactcttgggctc

SEQ ID NO: 31356 - DNA, 20 bp, Artificial Sequence
  chemically synthesized
ggaggatcgcttgagcccaa

SEQ ID NO: 31357 - DNA, 20 bp, Artificial Sequence
  chemically synthesized
cagcctggtctcaaactctt

SEQ ID NO: 31358 - DNA, 20 bp, Artificial Sequence
  chemically synthesized
tcgcttgagcccaagagttt

SEQ ID NO: 31359 - DNA, 20 bp, Artificial Sequence
  chemically synthesized
ccagcctggtctcaaactct

SEQ ID NO: 31360 - DNA, 20 bp, Artificial Sequence
  chemically synthesized
tgagcccaagagtttgagac

SEQ ID NO: 31361 - DNA, 20 bp, Artificial Sequence
  chemically synthesized
gagcccaagagtttgagacc

SEQ ID NO: 31362 - DNA, 20 bp, Artificial Sequence
  chemically synthesized
ccaagagtttgagaccaggc

SEQ ID NO: 31363 - DNA, 20 bp, Artificial Sequence
  chemically synthesized
caagagtttgagaccaggct

SEQ ID NO: 31364 - DNA, 20 bp, Artificial Sequence
  chemically synthesized
tcttaccatgttgcccagcc

SEQ ID NO: 31365 - DNA, 20 bp, Artificial Sequence
  chemically synthesized
tgagaccaggctgggcaaca

SEQ ID NO: 31366 - DNA, 20 bp, Artificial Sequence
  chemically synthesized
ggaggtcttaccatgttgcc

SEQ ID NO: 31367 - DNA, 20 bp, Artificial Sequence
  chemically synthesized
accaggctgggcaacatggt

SEQ ID NO: 31368 - DNA, 20 bp, Artificial Sequence
  chemically synthesized
taaattttttgtagagatgg

SEQ ID NO: 31369 - DNA, 20 bp, Artificial Sequence
  chemically synthesized
ttaaattttttgtagagatg

SEQ ID NO: 31370 - DNA, 20 bp, Artificial Sequence
  chemically synthesized
ttttaaattttttgtagaga

SEQ ID NO: 31371 - DNA, 20 bp, Artificial Sequence
  chemically synthesized
ctttttttaaattttttgta

SEQ ID NO: 31372 - DNA, 20 bp, Artificial Sequence
  chemically synthesized
atctttttttaaattttttg

SEQ ID NO: 31373 - DNA, 20 bp, Artificial Sequence
  chemically synthesized
ctctacaaaaaatttaaaaa

SEQ ID NO: 31374 - DNA, 20 bp, Artificial Sequence
  chemically synthesized
caaaaaatttaaaaaaagat

SEQ ID NO: 31375 - DNA, 20 bp, Artificial Sequence
  chemically synthesized
aaatttaaaaaaagattagc

SEQ ID NO: 31376 - DNA, 20 bp, Artificial Sequence
  chemically synthesized
aaaaaaagattagccagaca

SEQ ID NO: 31377 - DNA, 20 bp, Artificial Sequence
  chemically synthesized
aaaagattagccagacacgg

SEQ ID NO: 31378 - DNA, 20 bp, Artificial Sequence
  chemically synthesized
tagccgtgtgccaccgtgtc

SEQ ID NO: 31379 - DNA, 20 bp, Artificial Sequence
  chemically synthesized
tagccagacacggtggcaca

SEQ ID NO: 31380 - DNA, 20 bp, Artificial Sequence
  chemically synthesized
gacacggtggcacacggcta

SEQ ID NO: 31381 - DNA, 20 bp, Artificial Sequence
  chemically synthesized
gtggcacacggctatagtcc

SEQ ID NO: 31382 - DNA, 20 bp, Artificial Sequence
  chemically synthesized
cttccaagtagctgggacta

SEQ ID NO: 31383 - DNA, 20 bp, Artificial Sequence
  chemically synthesized
cggctatagtcccagctact

SEQ ID NO: 31384 - DNA, 20 bp, Artificial Sequence
  chemically synthesized
cctcagccttccaagtagct

SEQ ID NO: 31385 - DNA, 20 bp, Artificial Sequence
  chemically synthesized
acctcagccttccaagtagc

SEQ ID NO: 31386 - DNA, 20 bp, Artificial Sequence
  chemically synthesized
ctatagtcccagctacttgg

SEQ ID NO: 31387 - DNA, 20 bp, Artificial Sequence
  chemically synthesized
tatagtcccagctacttgga

SEQ ID NO: 31388 - DNA, 20 bp, Artificial Sequence
  chemically synthesized
tcccacctcagccttccaag

SEQ ID NO: 31389 - DNA, 20 bp, Artificial Sequence
  chemically synthesized
ccctcccacctcagccttcc

SEQ ID NO: 31390 - DNA, 20 bp, Artificial Sequence
  chemically synthesized
tcccagctacttggaaggct

SEQ ID NO: 31391 - DNA, 20 bp, Artificial Sequence
  chemically synthesized
cccagctacttggaaggctg

SEQ ID NO: 31392 - DNA, 20 bp, Artificial Sequence
  chemically synthesized
agctacttggaaggctgagg

SEQ ID NO: 31393 - DNA, 20 bp, Artificial Sequence
  chemically synthesized
gctacttggaaggctgaggt

SEQ ID NO: 31394 - DNA, 20 bp, Artificial Sequence
  chemically synthesized
tacttggaaggctgaggtgg

SEQ ID NO: 31395 - DNA, 20 bp, Artificial Sequence
  chemically synthesized
acttggaaggctgaggtggg

SEQ ID NO: 31396 - DNA, 20 bp, Artificial Sequence
  chemically synthesized
ctcaagtgaccctcccacct

SEQ ID NO: 31397 - DNA, 20 bp, Artificial Sequence
  chemically synthesized
cttggaaggctgaggtggga

SEQ ID NO: 31398 - DNA, 20 bp, Artificial Sequence
  chemically synthesized
ctgaggtgggagggtcactt

SEQ ID NO: 31399 - DNA, 20 bp, Artificial Sequence
  chemically synthesized
gtgggagggtcacttgagcc

SEQ ID NO: 31400 - DNA, 20 bp, Artificial Sequence
  chemically synthesized
tgggagggtcacttgagcct

SEQ ID NO: 31401 - DNA, 20 bp, Artificial Sequence
  chemically synthesized
agctttgaacacccaggctc

SEQ ID NO: 31402 - DNA, 20 bp, Artificial Sequence
  chemically synthesized
cactgcagctttgaacaccc

SEQ ID NO: 31403 - DNA, 20 bp, Artificial Sequence
  chemically synthesized
tcactgcagctttgaacacc

SEQ ID NO: 31404 - DNA, 20 bp, Artificial Sequence
  chemically synthesized
cacttgagcctgggtgttca

SEQ ID NO: 31405 - DNA, 20 bp, Artificial Sequence
  chemically synthesized
agcctgggtgttcaaagctg

SEQ ID NO: 31406 - DNA, 20 bp, Artificial Sequence
  chemically synthesized
tgggtgttcaaagctgcagt

SEQ ID NO: 31407 - DNA, 20 bp, Artificial Sequence
  chemically synthesized
ggcctgatcatggctcactg

SEQ ID NO: 31408 - DNA, 20 bp, Artificial Sequence
  chemically synthesized
aagctgcagtgagccatgat

SEQ ID NO: 31409 - DNA, 20 bp, Artificial Sequence
  chemically synthesized
agctgcagtgagccatgatc

SEQ ID NO: 31410 - DNA, 20 bp, Artificial Sequence
  chemically synthesized
ggagtgcagtggcctgatca

SEQ ID NO: 31411 - DNA, 20 bp, Artificial Sequence
  chemically synthesized
tcacatagactggagtgcag

SEQ ID NO: 31412 - DNA, 20 bp, Artificial Sequence
  chemically synthesized
atgatcaggccactgcactc

SEQ ID NO: 31413 - DNA, 20 bp, Artificial Sequence
  chemically synthesized
ctgtcacatagactggagtg

SEQ ID NO: 31414 - DNA, 20 bp, Artificial Sequence
  chemically synthesized
ttgctctgtcacatagactg

SEQ ID NO: 31415 - DNA, 20 bp, Artificial Sequence
  chemically synthesized
tcttgctctgtcacatagac

SEQ ID NO: 31416 - DNA, 20 bp, Artificial Sequence
  chemically synthesized
ctgcactccagtctatgtga

SEQ ID NO: 31417 - DNA, 20 bp, Artificial Sequence
  chemically synthesized
gcactccagtctatgtgaca

SEQ ID NO: 31418 - DNA, 20 bp, Artificial Sequence
  chemically synthesized
cagcatcttgctctgtcaca

SEQ ID NO: 31419 - DNA, 20 bp, Artificial Sequence
  chemically synthesized
tccagtctatgtgacagagc

SEQ ID NO: 31420 - DNA, 20 bp, Artificial Sequence
  chemically synthesized
gtttttttttttttttttga

SEQ ID NO: 31421 - DNA, 20 bp, Artificial Sequence
  chemically synthesized
aaaaaaaaaaaccccaataa

SEQ ID NO: 31422 - DNA, 20 bp, Artificial Sequence
  chemically synthesized
gcttagagatacttttattg

SEQ ID NO: 31423 - DNA, 20 bp, Artificial Sequence
  chemically synthesized
tgcttagagatacttttatt

SEQ ID NO: 31424 - DNA, 20 bp, Artificial Sequence
  chemically synthesized
ctgcttagagatacttttat

SEQ ID NO: 31425 - DNA, 20 bp, Artificial Sequence
  chemically synthesized
accccaataaaagtatctct

SEQ ID NO: 31426 - DNA, 20 bp, Artificial Sequence
  chemically synthesized
ccaataaaagtatctctaag

SEQ ID NO: 31427 - DNA, 20 bp, Artificial Sequence
  chemically synthesized
cacataatatatgctgctta

SEQ ID NO: 31428 - DNA, 20 bp, Artificial Sequence
  chemically synthesized
cacacataatatatgctgct

SEQ ID NO: 31429 - DNA, 20 bp, Artificial Sequence
  chemically synthesized
agcagcatatattatgtgtg

SEQ ID NO: 31430 - DNA, 20 bp, Artificial Sequence
  chemically synthesized
gcagcatatattatgtgtgt

SEQ ID NO: 31431 - DNA, 20 bp, Artificial Sequence
  chemically synthesized
cagcatatattatgtgtgtg

SEQ ID NO: 31432 - DNA, 20 bp, Artificial Sequence
  chemically synthesized
agcatatattatgtgtgtgg

SEQ ID NO: 31433 - DNA, 20 bp, Artificial Sequence
  chemically synthesized
atatattatgtgtgtggggg

SEQ ID NO: 31434 - DNA, 20 bp, Artificial Sequence
  chemically synthesized
tatattatgtgtgtgggggc

SEQ ID NO: 31435 - DNA, 20 bp, Artificial Sequence
  chemically synthesized
atattatgtgtgtgggggca

SEQ ID NO: 31436 - DNA, 20 bp, Artificial Sequence
  chemically synthesized
tatgtgtgtgggggcagggt

SEQ ID NO: 31437 - DNA, 20 bp, Artificial Sequence
  chemically synthesized
ttaagaaaatattttttaaa

SEQ ID NO: 31438 - DNA, 20 bp, Artificial Sequence
  chemically synthesized
aaaatattttcttaaaattt

SEQ ID NO: 31439 - DNA, 20 bp, Artificial Sequence
  chemically synthesized
aagttcattactgaaatttt

SEQ ID NO: 31440 - DNA, 20 bp, Artificial Sequence
  chemically synthesized
taaaatttcagtaatgaact

SEQ ID NO: 31441 - DNA, 20 bp, Artificial Sequence
  chemically synthesized
aaaatttcagtaatgaactt

SEQ ID NO: 31442 - DNA, 20 bp, Artificial Sequence
  chemically synthesized
aaatttcagtaatgaactta

SEQ ID NO: 31443 - DNA, 20 bp, Artificial Sequence
  chemically synthesized
cagtaatgaacttagggacc

SEQ ID NO: 31444 - DNA, 20 bp, Artificial Sequence
  chemically synthesized
caatttatgtctaggtccct

SEQ ID NO: 31445 - DNA, 20 bp, Artificial Sequence
  chemically synthesized
ttttctcacaatttatgtct

SEQ ID NO: 31446 - DNA, 20 bp, Artificial Sequence
  chemically synthesized
cttttctcacaatttatgtc

SEQ ID NO: 31447 - DNA, 20 bp, Artificial Sequence
  chemically synthesized
gggacctagacataaattgt

SEQ ID NO: 31448 - DNA, 20 bp, Artificial Sequence
  chemically synthesized
ctagacataaattgtgagaa

SEQ ID NO: 31449 - DNA, 20 bp, Artificial Sequence
  chemically synthesized
tagacataaattgtgagaaa

SEQ ID NO: 31450 - DNA, 20 bp, Artificial Sequence
  chemically synthesized
cataaattgtgagaaaagga

SEQ ID NO: 31451 - DNA, 20 bp, Artificial Sequence
  chemically synthesized
ataaattgtgagaaaaggac

SEQ ID NO: 31452 - DNA, 20 bp, Artificial Sequence
  chemically synthesized
aagtgcaattatgtggttaa

SEQ ID NO: 31453 - DNA, 20 bp, Artificial Sequence
  chemically synthesized
ttacatgaagtgcaattatg

SEQ ID NO: 31454 - DNA, 20 bp, Artificial Sequence
  chemically synthesized
atataatattgatttacatg

SEQ ID NO: 31455 - DNA, 20 bp, Artificial Sequence
  chemically synthesized
catgtaaatcaatattatat

SEQ ID NO: 31456 - DNA, 20 bp, Artificial Sequence
  chemically synthesized
tagtatttcaaaataaattc

SEQ ID NO: 31457 - DNA, 20 bp, Artificial Sequence
  chemically synthesized
gtatttcaaaataaattcca

SEQ ID NO: 31458 - DNA, 20 bp, Artificial Sequence
  chemically synthesized
tgttagatagtaatatgctc

SEQ ID NO: 31459 - DNA, 20 bp, Artificial Sequence
  chemically synthesized
caacatcagtagatgttaga

SEQ ID NO: 31460 - DNA, 20 bp, Artificial Sequence
  chemically synthesized
tttacaacatcagtagatgt

SEQ ID NO: 31461 - DNA, 20 bp, Artificial Sequence
  chemically synthesized
gaaagcatttacaacatcag

SEQ ID NO: 31462 - DNA, 20 bp, Artificial Sequence
  chemically synthesized
ccagaaagcatttacaacat

SEQ ID NO: 31463 - DNA, 20 bp, Artificial Sequence
  chemically synthesized
ctgatgttgtaaatgctttc

SEQ ID NO: 31464 - DNA, 20 bp, Artificial Sequence
  chemically synthesized
gatgttgtaaatgctttctg

SEQ ID NO: 31465 - DNA, 20 bp, Artificial Sequence
  chemically synthesized
gagctcttcaaggctccaga

SEQ ID NO: 31466 - DNA, 20 bp, Artificial Sequence
  chemically synthesized
ctctgagctcttcaaggctc

SEQ ID NO: 31467 - DNA, 20 bp, Artificial Sequence
  chemically synthesized
aaatgctttctggagccttg

SEQ ID NO: 31468 - DNA, 20 bp, Artificial Sequence
  chemically synthesized
atgctttctggagccttgaa

SEQ ID NO: 31469 - DNA, 20 bp, Artificial Sequence
  chemically synthesized
ttaaaactctgagctcttca

SEQ ID NO: 31470 - DNA, 20 bp, Artificial Sequence
  chemically synthesized
tttaaaactctgagctcttc

SEQ ID NO: 31471 - DNA, 20 bp, Artificial Sequence
  chemically synthesized
ttctggagccttgaagagct

SEQ ID NO: 31472 - DNA, 20 bp, Artificial Sequence
  chemically synthesized
ctggagccttgaagagctca

SEQ ID NO: 31473 - DNA, 20 bp, Artificial Sequence
  chemically synthesized
gcttggtgatttaaaactct

SEQ ID NO: 31474 - DNA, 20 bp, Artificial Sequence
  chemically synthesized
gctcagagttttaaatcacc

SEQ ID NO: 31475 - DNA, 20 bp, Artificial Sequence
  chemically synthesized
actgttccaataggttagct

SEQ ID NO: 31476 - DNA, 20 bp, Artificial Sequence
  chemically synthesized
aaatcaccaagctaacctat

SEQ ID NO: 31477 - DNA, 20 bp, Artificial Sequence
  chemically synthesized
gaaagactgttccaataggt

SEQ ID NO: 31478 - DNA, 20 bp, Artificial Sequence
  chemically synthesized
accaagctaacctattggaa

SEQ ID NO: 31479 - DNA, 20 bp, Artificial Sequence
  chemically synthesized
aatggaaagactgttccaat

SEQ ID NO: 31480 - DNA, 20 bp, Artificial Sequence
  chemically synthesized
taatggaaagactgttccaa

SEQ ID NO: 31481 - DNA, 20 bp, Artificial Sequence
  chemically synthesized
atttttacaaatgtaatgga

SEQ ID NO: 31482 - DNA, 20 bp, Artificial Sequence
  chemically synthesized
tagcatttttacaaatgtaa

SEQ ID NO: 31483 - DNA, 20 bp, Artificial Sequence
  chemically synthesized
tacatttgtaaaaatgctaa

SEQ ID NO: 31484 - DNA, 20 bp, Artificial Sequence
  chemically synthesized
ggtgagttttagatttctat

SEQ ID NO: 31485 - DNA, 20 bp, Artificial Sequence
  chemically synthesized
ttgattcatgaggtgagttt

SEQ ID NO: 31486 - DNA, 20 bp, Artificial Sequence
  chemically synthesized
atatgtttgattcatgaggt

SEQ ID NO: 31487 - DNA, 20 bp, Artificial Sequence
  chemically synthesized
aataatatgtttgattcatg

SEQ ID NO: 31488 - DNA, 20 bp, Artificial Sequence
  chemically synthesized
taataatatgtttgattcat

SEQ ID NO: 31489 - DNA, 20 bp, Artificial Sequence
  chemically synthesized
atcaaacatattattacttc

SEQ ID NO: 31490 - DNA, 20 bp, Artificial Sequence
  chemically synthesized
tcaaacatattattacttct

SEQ ID NO: 31491 - DNA, 20 bp, Artificial Sequence
  chemically synthesized
caaacatattattacttcta

SEQ ID NO: 31492 - DNA, 20 bp, Artificial Sequence
  chemically synthesized
aacatattattacttctagg

SEQ ID NO: 31493 - DNA, 20 bp, Artificial Sequence
  chemically synthesized
cattcttcgtcactccctag

SEQ ID NO: 31494 - DNA, 20 bp, Artificial Sequence
  chemically synthesized
gtacattcttcgtcactccc

SEQ ID NO: 31495 - DNA, 20 bp, Artificial Sequence
  chemically synthesized
attacttctagggagtgacg

SEQ ID NO: 31496 - DNA, 20 bp, Artificial Sequence
  chemically synthesized
tcattcatttgttattgaga

SEQ ID NO: 31497 - DNA, 20 bp, Artificial Sequence
  chemically synthesized
gtcattcatttgttattgag

SEQ ID NO: 31498 - DNA, 20 bp, Artificial Sequence
  chemically synthesized
ggtcattcatttgttattga

SEQ ID NO: 31499 - DNA, 20 bp, Artificial Sequence
  chemically synthesized
tgggtcattcatttgttatt

SEQ ID NO: 31500 - DNA, 20 bp, Artificial Sequence
  chemically synthesized
tcaataacaaatgaatgacc

SEQ ID NO: 31501 - DNA, 20 bp, Artificial Sequence
  chemically synthesized
aataacaaatgaatgaccca

SEQ ID NO: 31502 - DNA, 20 bp, Artificial Sequence
  chemically synthesized
ataacaaatgaatgacccag

SEQ ID NO: 31503 - DNA, 20 bp, Artificial Sequence
  chemically synthesized
aacaaatgaatgacccagag

SEQ ID NO: 31504 - DNA, 20 bp, Artificial Sequence
  chemically synthesized
atttcccattagactcctct

SEQ ID NO: 31505 - DNA, 20 bp, Artificial Sequence
  chemically synthesized
tatttcccattagactcctc

SEQ ID NO: 31506 - DNA, 20 bp, Artificial Sequence
  chemically synthesized
aatgacccagaggagtctaa

SEQ ID NO: 31507 - DNA, 20 bp, Artificial Sequence
  chemically synthesized
atgacccagaggagtctaat

SEQ ID NO: 31508 - DNA, 20 bp, Artificial Sequence
  chemically synthesized
gctcttgagatatttcccat

SEQ ID NO: 31509 - DNA, 20 bp, Artificial Sequence
  chemically synthesized
agtctaatgggaaatatctc

SEQ ID NO: 31510 - DNA, 20 bp, Artificial Sequence
  chemically synthesized
tctaatgggaaatatctcaa

SEQ ID NO: 31511 - DNA, 20 bp, Artificial Sequence
  chemically synthesized
tgtcaaatagagaggctctt

SEQ ID NO: 31512 - DNA, 20 bp, Artificial Sequence
  chemically synthesized
caagctgttgtcaaatagag

SEQ ID NO: 31513 - DNA, 20 bp, Artificial Sequence
  chemically synthesized
gcaagctgttgtcaaataga

SEQ ID NO: 31514 - DNA, 20 bp, Artificial Sequence
  chemically synthesized
aggcaagctgttgtcaaata

SEQ ID NO: 31515 - DNA, 20 bp, Artificial Sequence
  chemically synthesized
tgaggcaagctgttgtcaaa

SEQ ID NO: 31516 - DNA, 20 bp, Artificial Sequence
  chemically synthesized
agagcctctctatttgacaa

SEQ ID NO: 31517 - DNA, 20 bp, Artificial Sequence
  chemically synthesized
tcttacaggctgagtgaggc

SEQ ID NO: 31518 - DNA, 20 bp, Artificial Sequence
  chemically synthesized
tgacaacagcttgcctcact

SEQ ID NO: 31519 - DNA, 20 bp, Artificial Sequence
  chemically synthesized
cgtgtcttacaggctgagtg

SEQ ID NO: 31520 - DNA, 20 bp, Artificial Sequence
  chemically synthesized
ccgtgtcttacaggctgagt

SEQ ID NO: 31521 - DNA, 20 bp, Artificial Sequence
  chemically synthesized
gcttgcctcactcagcctgt

SEQ ID NO: 31522 - DNA, 20 bp, Artificial Sequence
  chemically synthesized
ccatccgtgtcttacaggct

SEQ ID NO: 31523 - DNA, 20 bp, Artificial Sequence
  chemically synthesized
gccacccatccgtgtcttac

SEQ ID NO: 31524 - DNA, 20 bp, Artificial Sequence
  chemically synthesized
ctcactcagcctgtaagaca

SEQ ID NO: 31525 - DNA, 20 bp, Artificial Sequence
  chemically synthesized
tgccacccatccgtgtctta

SEQ ID NO: 31526 - DNA, 20 bp, Artificial Sequence
  chemically synthesized
ctcagcctgtaagacacgga

SEQ ID NO: 31527 - DNA, 20 bp, Artificial Sequence
  chemically synthesized
tcagcctgtaagacacggat

SEQ ID NO: 31528 - DNA, 20 bp, Artificial Sequence
  chemically synthesized
gcctgtaagacacggatggg

SEQ ID NO: 31529 - DNA, 20 bp, Artificial Sequence
  chemically synthesized
gagaaaacaaacaacaggag

SEQ ID NO: 31530 - DNA, 20 bp, Artificial Sequence
  chemically synthesized
tctgagaaaacaaacaacag

SEQ ID NO: 31531 - DNA, 20 bp, Artificial Sequence
  chemically synthesized
attctgagaaaacaaacaac

SEQ ID NO: 31532 - DNA, 20 bp, Artificial Sequence
  chemically synthesized
cattctgagaaaacaaacaa

SEQ ID NO: 31533 - DNA, 20 bp, Artificial Sequence
  chemically synthesized
tctcctgttgtttgttttct

SEQ ID NO: 31534 - DNA, 20 bp, Artificial Sequence
  chemically synthesized
tgttttaaaatgtacattct

SEQ ID NO: 31535 - DNA, 20 bp, Artificial Sequence
  chemically synthesized
agaatgtacattttaaaaca

SEQ ID NO: 31536 - DNA, 20 bp, Artificial Sequence
  chemically synthesized
gaatgtacattttaaaacat

SEQ ID NO: 31537 - DNA, 20 bp, Artificial Sequence
  chemically synthesized
cataggaatgattacatttt

SEQ ID NO: 31538 - DNA, 20 bp, Artificial Sequence
  chemically synthesized
cggctaactctgcagacaag

SEQ ID NO: 31539 - DNA, 20 bp, Artificial Sequence
  chemically synthesized
tttagaaatccacttgtctg

SEQ ID NO: 31540 - DNA, 20 bp, Artificial Sequence
  chemically synthesized
tagaaatccacttgtctgca

SEQ ID NO: 31541 - DNA, 20 bp, Artificial Sequence
  chemically synthesized
tttcggctaactctgcagac

SEQ ID NO: 31542 - DNA, 20 bp, Artificial Sequence
  chemically synthesized
aatccacttgtctgcagagt

SEQ ID NO: 31543 - DNA, 20 bp, Artificial Sequence
  chemically synthesized
gtacctttcggctaactctg

SEQ ID NO: 31544 - DNA, 20 bp, Artificial Sequence
  chemically synthesized
ttgtctgcagagttagccga

SEQ ID NO: 31545 - DNA, 20 bp, Artificial Sequence
  chemically synthesized
tgtctgcagagttagccgaa

SEQ ID NO: 31546 - DNA, 20 bp, Artificial Sequence
  chemically synthesized
atttttcaagaggtaccttt

SEQ ID NO: 31547 - DNA, 20 bp, Artificial Sequence
  chemically synthesized
tgtgatcattatttttcaag

SEQ ID NO: 31548 - DNA, 20 bp, Artificial Sequence
  chemically synthesized
ctgtgatcattatttttcaa

SEQ ID NO: 31549 - DNA, 20 bp, Artificial Sequence
  chemically synthesized
tgctgtgatcattatttttc

SEQ ID NO: 31550 - DNA, 20 bp, Artificial Sequence
  chemically synthesized
ctcttgaaaaataatgatca

SEQ ID NO: 31551 - DNA, 20 bp, Artificial Sequence
  chemically synthesized
tgaaaaataatgatcacagc

SEQ ID NO: 31552 - DNA, 20 bp, Artificial Sequence
  chemically synthesized
aataatgatcacagcaagtt

SEQ ID NO: 31553 - DNA, 20 bp, Artificial Sequence
  chemically synthesized
gatcacagcaagtttagaaa

SEQ ID NO: 31554 - DNA, 20 bp, Artificial Sequence
  chemically synthesized
ctttgggctgagggtggggc

SEQ ID NO: 31555 - DNA, 20 bp, Artificial Sequence
  chemically synthesized
actttgggctgagggtgggg

SEQ ID NO: 31556 - DNA, 20 bp, Artificial Sequence
  chemically synthesized
gaaacagcctgccccaccct

SEQ ID NO: 31557 - DNA, 20 bp, Artificial Sequence
  chemically synthesized
tttactttgggctgagggtg

SEQ ID NO: 31558 - DNA, 20 bp, Artificial Sequence
  chemically synthesized
ttttactttgggctgagggt

SEQ ID NO: 31559 - DNA, 20 bp, Artificial Sequence
  chemically synthesized
cttttactttgggctgaggg

SEQ ID NO: 31560 - DNA, 20 bp, Artificial Sequence
  chemically synthesized
tttcttttactttgggctga

SEQ ID NO: 31561 - DNA, 20 bp, Artificial Sequence
  chemically synthesized
cctgccccaccctcagccca

SEQ ID NO: 31562 - DNA, 20 bp, Artificial Sequence
  chemically synthesized
ttttcttttactttgggctg

SEQ ID NO: 31563 - DNA, 20 bp, Artificial Sequence
  chemically synthesized
tttttcttttactttgggct

SEQ ID NO: 31564 - DNA, 20 bp, Artificial Sequence
  chemically synthesized
ccaccctcagcccaaagtaa

SEQ ID NO: 31565 - DNA, 20 bp, Artificial Sequence
  chemically synthesized
ttttgtttttcttttacttt

SEQ ID NO: 31566 - DNA, 20 bp, Artificial Sequence
  chemically synthesized
tttttgtttttcttttactt

SEQ ID NO: 31567 - DNA, 20 bp, Artificial Sequence
  chemically synthesized
taaaagaaaaacaaaaatct

SEQ ID NO: 31568 - DNA, 20 bp, Artificial Sequence
  chemically synthesized
acgatattggacaagtgtct

SEQ ID NO: 31569 - DNA, 20 bp, Artificial Sequence
  chemically synthesized
aaaaagtaacgatattggac

SEQ ID NO: 31570 - DNA, 20 bp, Artificial Sequence
  chemically synthesized
aaaaaaaaaagtaacgatat

SEQ ID NO: 31571 - DNA, 20 bp, Artificial Sequence
  chemically synthesized
aaaaaaaaaaaaaaaaaaaa

SEQ ID NO: 31572 - DNA, 20 bp, Artificial Sequence
  chemically synthesized
tttttttttttttttttttt

SEQ ID NO: 31573 - DNA, 20 bp, Artificial Sequence
  chemically synthesized
ttttttttttttttttgaga

SEQ ID NO: 31574 - DNA, 20 bp, Artificial Sequence
  chemically synthesized
ttttttttttttttgagatg

SEQ ID NO: 31575 - DNA, 20 bp, Artificial Sequence
  chemically synthesized
cactccctcctgggcaacaa

SEQ ID NO: 31576 - DNA, 20 bp, Artificial Sequence
  chemically synthesized
ggagtttcactcttgttgcc

SEQ ID NO: 31577 - DNA, 20 bp, Artificial Sequence
  chemically synthesized
gagtttcactcttgttgccc

SEQ ID NO: 31578 - DNA, 20 bp, Artificial Sequence
  chemically synthesized
agcactccctcctgggcaac

SEQ ID NO: 31579 - DNA, 20 bp, Artificial Sequence
  chemically synthesized
gtttcactcttgttgcccag

SEQ ID NO: 31580 - DNA, 20 bp, Artificial Sequence
  chemically synthesized
tttcactcttgttgcccagg

SEQ ID NO: 31581 - DNA, 20 bp, Artificial Sequence
  chemically synthesized
ttcactcttgttgcccagga

SEQ ID NO: 31582 - DNA, 20 bp, Artificial Sequence
  chemically synthesized
cactcttgttgcccaggagg

SEQ ID NO: 31583 - DNA, 20 bp, Artificial Sequence
  chemically synthesized
acgctgtagcactccctcct

SEQ ID NO: 31584 - DNA, 20 bp, Artificial Sequence
  chemically synthesized
cacgctgtagcactccctcc

SEQ ID NO: 31585 - DNA, 20 bp, Artificial Sequence
  chemically synthesized
ttgcccaggagggagtgcta

SEQ ID NO: 31586 - DNA, 20 bp, Artificial Sequence
  chemically synthesized
aatgagctgagatcacgctg

SEQ ID NO: 31587 - DNA, 20 bp, Artificial Sequence
  chemically synthesized
ggagtgctacagcgtgatct

SEQ ID NO: 31588 - DNA, 20 bp, Artificial Sequence
  chemically synthesized
gtcggaggttgcaatgagct

SEQ ID NO: 31589 - DNA, 20 bp, Artificial Sequence
  chemically synthesized
caggagtcggaggttgcaat

SEQ ID NO: 31590 - DNA, 20 bp, Artificial Sequence
  chemically synthesized
cacttgaacccaggagtcgg

SEQ ID NO: 31591 - DNA, 20 bp, Artificial Sequence
  chemically synthesized
tcattgcaacctccgactcc

SEQ ID NO: 31592 - DNA, 20 bp, Artificial Sequence
  chemically synthesized
tcacttgaacccaggagtcg

SEQ ID NO: 31593 - DNA, 20 bp, Artificial Sequence
  chemically synthesized
cattgcaacctccgactcct

SEQ ID NO: 31594 - DNA, 20 bp, Artificial Sequence
  chemically synthesized
aatcacttgaacccaggagt

SEQ ID NO: 31595 - DNA, 20 bp, Artificial Sequence
  chemically synthesized
gaagaatcacttgaacccag

SEQ ID NO: 31596 - DNA, 20 bp, Artificial Sequence
  chemically synthesized
aacctccgactcctgggttc

SEQ ID NO: 31597 - DNA, 20 bp, Artificial Sequence
  chemically synthesized
ctgaagaatcacttgaaccc

SEQ ID NO: 31598 - DNA, 20 bp, Artificial Sequence
  chemically synthesized
gctgaagaatcacttgaacc

SEQ ID NO: 31599 - DNA, 20 bp, Artificial Sequence
  chemically synthesized
cctgggttcaagtgattctt

SEQ ID NO: 31600 - DNA, 20 bp, Artificial Sequence
  chemically synthesized
ttcaagtgattcttcagcct

SEQ ID NO: 31601 - DNA, 20 bp, Artificial Sequence
  chemically synthesized
tactcaagaggccgaggctg

SEQ ID NO: 31602 - DNA, 20 bp, Artificial Sequence
  chemically synthesized
cccagctactcaagaggccg

SEQ ID NO: 31603 - DNA, 20 bp, Artificial Sequence
  chemically synthesized
tcccagctactcaagaggcc

SEQ ID NO: 31604 - DNA, 20 bp, Artificial Sequence
  chemically synthesized
ttcttcagcctcggcctctt

SEQ ID NO: 31605 - DNA, 20 bp, Artificial Sequence
  chemically synthesized
ttcagcctcggcctcttgag

SEQ ID NO: 31606 - DNA, 20 bp, Artificial Sequence
  chemically synthesized
tgtaatcccagctactcaag

SEQ ID NO: 31607 - DNA, 20 bp, Artificial Sequence
  chemically synthesized
ctgtaatcccagctactcaa

SEQ ID NO: 31608 - DNA, 20 bp, Artificial Sequence
  chemically synthesized
gcctcggcctcttgagtagc

SEQ ID NO: 31609 - DNA, 20 bp, Artificial Sequence
  chemically synthesized
gcctgtaatcccagctactc

SEQ ID NO: 31610 - DNA, 20 bp, Artificial Sequence
  chemically synthesized
cctcggcctcttgagtagct

SEQ ID NO: 31611 - DNA, 20 bp, Artificial Sequence
  chemically synthesized
ctcttgagtagctgggatta

SEQ ID NO: 31612 - DNA, 20 bp, Artificial Sequence
  chemically synthesized
tcttgagtagctgggattac

SEQ ID NO: 31613 - DNA, 20 bp, Artificial Sequence
  chemically synthesized
gtggcacatgcctgtaatcc

SEQ ID NO: 31614 - DNA, 20 bp, Artificial Sequence
  chemically synthesized
caggcatgtgccaccacacc

SEQ ID NO: 31615 - DNA, 20 bp, Artificial Sequence
  chemically synthesized
aaaaaattagccaggtgtgg

SEQ ID NO: 31616 - DNA, 20 bp, Artificial Sequence
  chemically synthesized
aacaaaaaattagccaggtg

SEQ ID NO: 31617 - DNA, 20 bp, Artificial Sequence
  chemically synthesized
aaaaaaacaaaaaattagcc

SEQ ID NO: 31618 - DNA, 20 bp, Artificial Sequence
  chemically synthesized
taaaaaaacaaaaaattagc

SEQ ID NO: 31619 - DNA, 20 bp, Artificial Sequence
  chemically synthesized
ttactaaaaaaacaaaaaat

SEQ ID NO: 31620 - DNA, 20 bp, Artificial Sequence
  chemically synthesized
tggctaattttttgtttttt

SEQ ID NO: 31621 - DNA, 20 bp, Artificial Sequence
  chemically synthesized
aattttttgtttttttagta

SEQ ID NO: 31622 - DNA, 20 bp, Artificial Sequence
  chemically synthesized
ttttgtttttttagtaaaga

SEQ ID NO: 31623 - DNA, 20 bp, Artificial Sequence
  chemically synthesized
tttgtttttttagtaaagat

SEQ ID NO: 31624 - DNA, 20 bp, Artificial Sequence
  chemically synthesized
ttgtttttttagtaaagatg

SEQ ID NO: 31625 - DNA, 20 bp, Artificial Sequence
  chemically synthesized
aagatggggtttcaccatgt

SEQ ID NO: 31626 - DNA, 20 bp, Artificial Sequence
  chemically synthesized
tggggtttcaccatgttagc

SEQ ID NO: 31627 - DNA, 20 bp, Artificial Sequence
  chemically synthesized
caagaccttcctggctaaca

SEQ ID NO: 31628 - DNA, 20 bp, Artificial Sequence
  chemically synthesized
ggggtttcaccatgttagcc

SEQ ID NO: 31629 - DNA, 20 bp, Artificial Sequence
  chemically synthesized
gtttcaccatgttagccagg

SEQ ID NO: 31630 - DNA, 20 bp, Artificial Sequence
  chemically synthesized
tttcaccatgttagccagga

SEQ ID NO: 31631 - DNA, 20 bp, Artificial Sequence
  chemically synthesized
tcaggagatcaagaccttcc

SEQ ID NO: 31632 - DNA, 20 bp, Artificial Sequence
  chemically synthesized
atcacctgagtcaggagatc

SEQ ID NO: 31633 - DNA, 20 bp, Artificial Sequence
  chemically synthesized
aaggtcttgatctcctgact

SEQ ID NO: 31634 - DNA, 20 bp, Artificial Sequence
  chemically synthesized
aggtcttgatctcctgactc

SEQ ID NO: 31635 - DNA, 20 bp, Artificial Sequence
  chemically synthesized
gggcggatcacctgagtcag

SEQ ID NO: 31636 - DNA, 20 bp, Artificial Sequence
  chemically synthesized
gtgggcggatcacctgagtc

SEQ ID NO: 31637 - DNA, 20 bp, Artificial Sequence
  chemically synthesized
ggtgggcggatcacctgagt

SEQ ID NO: 31638 - DNA, 20 bp, Artificial Sequence
  chemically synthesized
tcgaggtgggcggatcacct

SEQ ID NO: 31639 - DNA, 20 bp, Artificial Sequence
  chemically synthesized
ctttgggaggtcgaggtggg

SEQ ID NO: 31640 - DNA, 20 bp, Artificial Sequence
  chemically synthesized
gcactttgggaggtcgaggt

SEQ ID NO: 31641 - DNA, 20 bp, Artificial Sequence
  chemically synthesized
agcactttgggaggtcgagg

SEQ ID NO: 31642 - DNA, 20 bp, Artificial Sequence
  chemically synthesized
cccagcactttgggaggtcg

SEQ ID NO: 31643 - DNA, 20 bp, Artificial Sequence
  chemically synthesized
tcccagcactttgggaggtc

SEQ ID NO: 31644 - DNA, 20 bp, Artificial Sequence
  chemically synthesized
ccgcccacctcgacctccca

SEQ ID NO: 31645 - DNA, 20 bp, Artificial Sequence
  chemically synthesized
tgtaatcccagcactttggg

SEQ ID NO: 31646 - DNA, 20 bp, Artificial Sequence
  chemically synthesized
ctgtaatcccagcactttgg

SEQ ID NO: 31647 - DNA, 20 bp, Artificial Sequence
  chemically synthesized
acctcgacctcccaaagtgc

SEQ ID NO: 31648 - DNA, 20 bp, Artificial Sequence
  chemically synthesized
gcctgtaatcccagcacttt

SEQ ID NO: 31649 - DNA, 20 bp, Artificial Sequence
  chemically synthesized
cctcgacctcccaaagtgct

SEQ ID NO: 31650 - DNA, 20 bp, Artificial Sequence
  chemically synthesized
cgcctgtaatcccagcactt

SEQ ID NO: 31651 - DNA, 20 bp, Artificial Sequence
  chemically synthesized
ctcccaaagtgctgggatta

SEQ ID NO: 31652 - DNA, 20 bp, Artificial Sequence
  chemically synthesized
tcccaaagtgctgggattac

SEQ ID NO: 31653 - DNA, 20 bp, Artificial Sequence
  chemically synthesized
gtggctcacgcctgtaatcc

SEQ ID NO: 31654 - DNA, 20 bp, Artificial Sequence
  chemically synthesized
agtgctgggattacaggcgt

SEQ ID NO: 31655 - DNA, 20 bp, Artificial Sequence
  chemically synthesized
caggcgtgagccaccgtgcc

SEQ ID NO: 31656 - DNA, 20 bp, Artificial Sequence
  chemically synthesized
gatattggggctgggcacgg

SEQ ID NO: 31657 - DNA, 20 bp, Artificial Sequence
  chemically synthesized
gaggatattggggctgggca

SEQ ID NO: 31658 - DNA, 20 bp, Artificial Sequence
  chemically synthesized
aatgtgaggatattggggct

SEQ ID NO: 31659 - DNA, 20 bp, Artificial Sequence
  chemically synthesized
aaatgtgaggatattggggc

SEQ ID NO: 31660 - DNA, 20 bp, Artificial Sequence
  chemically synthesized
tttaaaatgtgaggatattg

SEQ ID NO: 31661 - DNA, 20 bp, Artificial Sequence
  chemically synthesized
ctttaaaatgtgaggatatt

SEQ ID NO: 31662 - DNA, 20 bp, Artificial Sequence
  chemically synthesized
tctttaaaatgtgaggatat

SEQ ID NO: 31663 - DNA, 20 bp, Artificial Sequence
  chemically synthesized
tgctttatctttaaaatgtg

SEQ ID NO: 31664 - DNA, 20 bp, Artificial Sequence
  chemically synthesized
gtgctttatctttaaaatgt

SEQ ID NO: 31665 - DNA, 20 bp, Artificial Sequence
  chemically synthesized
cccaatatcctcacatttta

SEQ ID NO: 31666 - DNA, 20 bp, Artificial Sequence
  chemically synthesized
atcctcacattttaaagata

SEQ ID NO: 31667 - DNA, 20 bp, Artificial Sequence
  chemically synthesized
cattttaaagataaagcacc

SEQ ID NO: 31668 - DNA, 20 bp, Artificial Sequence
  chemically synthesized
attttaaagataaagcacca

SEQ ID NO: 31669 - DNA, 20 bp, Artificial Sequence
  chemically synthesized
tgtctattttttgtagacct

SEQ ID NO: 31670 - DNA, 20 bp, Artificial Sequence
  chemically synthesized
gcaccaaggtctacaaaaaa

SEQ ID NO: 31671 - DNA, 20 bp, Artificial Sequence
  chemically synthesized
tgtctcatgtctattttttg

SEQ ID NO: 31672 - DNA, 20 bp, Artificial Sequence
  chemically synthesized
ggtctacaaaaaatagacat

SEQ ID NO: 31673 - DNA, 20 bp, Artificial Sequence
  chemically synthesized
aaaaatagacatgagacact

SEQ ID NO: 31674 - DNA, 20 bp, Artificial Sequence
  chemically synthesized
taagtgggatataagagacc

SEQ ID NO: 31675 - DNA, 20 bp, Artificial Sequence
  chemically synthesized
gtggagtaagtgggatataa

SEQ ID NO: 31676 - DNA, 20 bp, Artificial Sequence
  chemically synthesized
tagtggagtaagtgggatat

SEQ ID NO: 31677 - DNA, 20 bp, Artificial Sequence
  chemically synthesized
agaatagtagtggagtaagt

SEQ ID NO: 31678 - DNA, 20 bp, Artificial Sequence
  chemically synthesized
gagaatagtagtggagtaag

SEQ ID NO: 31679 - DNA, 20 bp, Artificial Sequence
  chemically synthesized
gtagagaatagtagtggagt

SEQ ID NO: 31680 - DNA, 20 bp, Artificial Sequence
  chemically synthesized
ggtagtagagaatagtagtg

SEQ ID NO: 31681 - DNA, 20 bp, Artificial Sequence
  chemically synthesized
atggtagtagagaatagtag

SEQ ID NO: 31682 - DNA, 20 bp, Artificial Sequence
  chemically synthesized
agaatggtagtagagaatag

SEQ ID NO: 31683 - DNA, 20 bp, Artificial Sequence
  chemically synthesized
catagaatggtagtagagaa

SEQ ID NO: 31684 - DNA, 20 bp, Artificial Sequence
  chemically synthesized
atagtcatagaatggtagta

SEQ ID NO: 31685 - DNA, 20 bp, Artificial Sequence
  chemically synthesized
caatagtcatagaatggtag

SEQ ID NO: 31686 - DNA, 20 bp, Artificial Sequence
  chemically synthesized
ccccaatagtcatagaatgg

SEQ ID NO: 31687 - DNA, 20 bp, Artificial Sequence
  chemically synthesized
tacccccaatagtcatagaa

SEQ ID NO: 31688 - DNA, 20 bp, Artificial Sequence
  chemically synthesized
tactaccattctatgactat

SEQ ID NO: 31689 - DNA, 20 bp, Artificial Sequence
  chemically synthesized
gtgactacccccaatagtca

SEQ ID NO: 31690 - DNA, 20 bp, Artificial Sequence
  chemically synthesized
actaccattctatgactatt

SEQ ID NO: 31691 - DNA, 20 bp, Artificial Sequence
  chemically synthesized
ctaccattctatgactattg

SEQ ID NO: 31692 - DNA, 20 bp, Artificial Sequence
  chemically synthesized
taccattctatgactattgg

SEQ ID NO: 31693 - DNA, 20 bp, Artificial Sequence
  chemically synthesized
cattctatgactattggggg

SEQ ID NO: 31694 - DNA, 20 bp, Artificial Sequence
  chemically synthesized
ttgtctgtgactacccccaa

SEQ ID NO: 31695 - DNA, 20 bp, Artificial Sequence
  chemically synthesized
atgactattgggggtagtca

SEQ ID NO: 31696 - DNA, 20 bp, Artificial Sequence
  chemically synthesized
tagtcacagacaaatgctga

SEQ ID NO: 31697 - DNA, 20 bp, Artificial Sequence
  chemically synthesized
actggaaatcagttttcttt

SEQ ID NO: 31698 - DNA, 20 bp, Artificial Sequence
  chemically synthesized
gctgaaagaaaactgatttc

SEQ ID NO: 31699 - DNA, 20 bp, Artificial Sequence
  chemically synthesized
cactaaaagcaactggaaat

SEQ ID NO: 31700 - DNA, 20 bp, Artificial Sequence
  chemically synthesized
aataaatcactaaaagcaac

SEQ ID NO: 31701 - DNA, 20 bp, Artificial Sequence
  chemically synthesized
aactgatttccagttgcttt

SEQ ID NO: 31702 - DNA, 20 bp, Artificial Sequence
  chemically synthesized
cacagggaataaatcactaa

SEQ ID NO: 31703 - DNA, 20 bp, Artificial Sequence
  chemically synthesized
cattgtcttggattttcaca

SEQ ID NO: 31704 - DNA, 20 bp, Artificial Sequence
  chemically synthesized
gcattgtcttggattttcac

SEQ ID NO: 31705 - DNA, 20 bp, Artificial Sequence
  chemically synthesized
agcattgtcttggattttca

SEQ ID NO: 31706 - DNA, 20 bp, Artificial Sequence
  chemically synthesized
tttattccctgtgaaaatcc

SEQ ID NO: 31707 - DNA, 20 bp, Artificial Sequence
  chemically synthesized
gtttgacaaaagcattgtct

SEQ ID NO: 31708 - DNA, 20 bp, Artificial Sequence
  chemically synthesized
tcacattaatggtttgacaa

SEQ ID NO: 31709 - DNA, 20 bp, Artificial Sequence
  chemically synthesized
aattttttacatcacattaa

SEQ ID NO: 31710 - DNA, 20 bp, Artificial Sequence
  chemically synthesized
atgtgatgtaaaaaattttc

SEQ ID NO: 31711 - DNA, 20 bp, Artificial Sequence
  chemically synthesized
tgtgatgtaaaaaattttct

SEQ ID NO: 31712 - DNA, 20 bp, Artificial Sequence
  chemically synthesized
gtgatgtaaaaaattttctg

SEQ ID NO: 31713 - DNA, 20 bp, Artificial Sequence
  chemically synthesized
tcattaggaatttgagtccc

SEQ ID NO: 31714 - DNA, 20 bp, Artificial Sequence
  chemically synthesized
tgaacagtcattaggaattt

SEQ ID NO: 31715 - DNA, 20 bp, Artificial Sequence
  chemically synthesized
atgatgactgaacagtcatt

SEQ ID NO: 31716 - DNA, 20 bp, Artificial Sequence
  chemically synthesized
tatgatgactgaacagtcat

SEQ ID NO: 31717 - DNA, 20 bp, Artificial Sequence
  chemically synthesized
tcaaattcctaatgactgtt

SEQ ID NO: 31718 - DNA, 20 bp, Artificial Sequence
  chemically synthesized
ggttcactatgatgactgaa

SEQ ID NO: 31719 - DNA, 20 bp, Artificial Sequence
  chemically synthesized
taatgactgttcagtcatca

SEQ ID NO: 31720 - DNA, 20 bp, Artificial Sequence
  chemically synthesized
atagtaaagaaataatttaa

SEQ ID NO: 31721 - DNA, 20 bp, Artificial Sequence
  chemically synthesized
catagtaaagaaataattta

SEQ ID NO: 31722 - DNA, 20 bp, Artificial Sequence
  chemically synthesized
aaacaaagcaagacatagta

SEQ ID NO: 31723 - DNA, 20 bp, Artificial Sequence
  chemically synthesized
tacacaaacaaagcaagaca

SEQ ID NO: 31724 - DNA, 20 bp, Artificial Sequence
  chemically synthesized
gagtcctacacaaacaaagc

SEQ ID NO: 31725 - DNA, 20 bp, Artificial Sequence
  chemically synthesized
gccagagtcctacacaaaca

SEQ ID NO: 31726 - DNA, 20 bp, Artificial Sequence
  chemically synthesized
tatgtcttgctttgtttgtg

SEQ ID NO: 31727 - DNA, 20 bp, Artificial Sequence
  chemically synthesized
atgtcttgctttgtttgtgt

SEQ ID NO: 31728 - DNA, 20 bp, Artificial Sequence
  chemically synthesized
gctttgtttgtgtaggactc

SEQ ID NO: 31729 - DNA, 20 bp, Artificial Sequence
  chemically synthesized
attgagagaaaatattgcca

SEQ ID NO: 31730 - DNA, 20 bp, Artificial Sequence
  chemically synthesized
aaattgagagaaaatattgc

SEQ ID NO: 31731 - DNA, 20 bp, Artificial Sequence
  chemically synthesized
gtacctacacaaaaaattga

SEQ ID NO: 31732 - DNA, 20 bp, Artificial Sequence
  chemically synthesized
gtgtacctacacaaaaaatt

SEQ ID NO: 31733 - DNA, 20 bp, Artificial Sequence
  chemically synthesized
ttttctctcaattttttgtg

SEQ ID NO: 31734 - DNA, 20 bp, Artificial Sequence
  chemically synthesized
tttctctcaattttttgtgt

SEQ ID NO: 31735 - DNA, 20 bp, Artificial Sequence
  chemically synthesized
caattttttgtgtaggtaca

SEQ ID NO: 31736 - DNA, 20 bp, Artificial Sequence
  chemically synthesized
taggtacacagccgataaat

SEQ ID NO: 31737 - DNA, 20 bp, Artificial Sequence
  chemically synthesized
aggtacacagccgataaatg

SEQ ID NO: 31738 - DNA, 20 bp, Artificial Sequence
  chemically synthesized
attgtgtttccctcatttat

SEQ ID NO: 31739 - DNA, 20 bp, Artificial Sequence
  chemically synthesized
ggtacacagccgataaatga

SEQ ID NO: 31740 - DNA, 20 bp, Artificial Sequence
  chemically synthesized
aggaggtttccatcaagtgt

SEQ ID NO: 31741 - DNA, 20 bp, Artificial Sequence
  chemically synthesized
acaatatttctaacacttga

SEQ ID NO: 31742 - DNA, 20 bp, Artificial Sequence
  chemically synthesized
ttgcagaggaggtttccatc

SEQ ID NO: 31743 - DNA, 20 bp, Artificial Sequence
  chemically synthesized
ctaaaatggctttgcagagg

SEQ ID NO: 31744 - DNA, 20 bp, Artificial Sequence
  chemically synthesized
tgatggaaacctcctctgca

SEQ ID NO: 31745 - DNA, 20 bp, Artificial Sequence
  chemically synthesized
tctaaaatggctttgcagag

SEQ ID NO: 31746 - DNA, 20 bp, Artificial Sequence
  chemically synthesized
gatctaaaatggctttgcag

SEQ ID NO: 31747 - DNA, 20 bp, Artificial Sequence
  chemically synthesized
agatctaaaatggctttgca

SEQ ID NO: 31748 - DNA, 20 bp, Artificial Sequence
  chemically synthesized
acagatctaaaatggctttg

SEQ ID NO: 31749 - DNA, 20 bp, Artificial Sequence
  chemically synthesized
cctcctctgcaaagccattt

SEQ ID NO: 31750 - DNA, 20 bp, Artificial Sequence
  chemically synthesized
tatttccaacagatctaaaa

SEQ ID NO: 31751 - DNA, 20 bp, Artificial Sequence
  chemically synthesized
caaagccattttagatctgt

SEQ ID NO: 31752 - DNA, 20 bp, Artificial Sequence
  chemically synthesized
taattttagattatttccaa

SEQ ID NO: 31753 - DNA, 20 bp, Artificial Sequence
  chemically synthesized
caatataagataattaattt

SEQ ID NO: 31754 - DNA, 20 bp, Artificial Sequence
  chemically synthesized
aaatagataaaaaacaatat

SEQ ID NO: 31755 - DNA, 20 bp, Artificial Sequence
  chemically synthesized
gaacttttttgattaaaaaa

SEQ ID NO: 31756 - DNA, 20 bp, Artificial Sequence
  chemically synthesized
tatctattttttaatcaaaa

SEQ ID NO: 31757 - DNA, 20 bp, Artificial Sequence
  chemically synthesized
cattttagtggtagagaaaa

SEQ ID NO: 31758 - DNA, 20 bp, Artificial Sequence
  chemically synthesized
atgtagacattttagtggta

SEQ ID NO: 31759 - DNA, 20 bp, Artificial Sequence
  chemically synthesized
agatgtagacattttagtgg

SEQ ID NO: 31760 - DNA, 20 bp, Artificial Sequence
  chemically synthesized
tgcagatgtagacattttag

SEQ ID NO: 31761 - DNA, 20 bp, Artificial Sequence
  chemically synthesized
aaatgcagatgtagacattt

SEQ ID NO: 31762 - DNA, 20 bp, Artificial Sequence
  chemically synthesized
agttgtgaaaaatgcagatg

SEQ ID NO: 31763 - DNA, 20 bp, Artificial Sequence
  chemically synthesized
atgtccagttgtgaaaaatg

SEQ ID NO: 31764 - DNA, 20 bp, Artificial Sequence
  chemically synthesized
acatctgcatttttcacaac

SEQ ID NO: 31765 - DNA, 20 bp, Artificial Sequence
  chemically synthesized
atttttcacaactggacata

SEQ ID NO: 31766 - DNA, 20 bp, Artificial Sequence
  chemically synthesized
gtatttttagtctgtatgtc

SEQ ID NO: 31767 - DNA, 20 bp, Artificial Sequence
  chemically synthesized
gagatcatctcatgtatttt

SEQ ID NO: 31768 - DNA, 20 bp, Artificial Sequence
  chemically synthesized
catacagactaaaaatacat

SEQ ID NO: 31769 - DNA, 20 bp, Artificial Sequence
  chemically synthesized
atacatgagatgatctcttt

SEQ ID NO: 31770 - DNA, 20 bp, Artificial Sequence
  chemically synthesized
caggtaactttaaactcaaa

SEQ ID NO: 31771 - DNA, 20 bp, Artificial Sequence
  chemically synthesized
gtcaggtaactttaaactca

SEQ ID NO: 31772 - DNA, 20 bp, Artificial Sequence
  chemically synthesized
agatgatctctttgagttta

SEQ ID NO: 31773 - DNA, 20 bp, Artificial Sequence
  chemically synthesized
gagtttaaagttacctgaca

SEQ ID NO: 31774 - DNA, 20 bp, Artificial Sequence
  chemically synthesized
tgattctcatggactttgtc

SEQ ID NO: 31775 - DNA, 20 bp, Artificial Sequence
  chemically synthesized
ctgattctcatggactttgt

SEQ ID NO: 31776 - DNA, 20 bp, Artificial Sequence
  chemically synthesized
agttacctgacaaagtccat

SEQ ID NO: 31777 - DNA, 20 bp, Artificial Sequence
  chemically synthesized
ctgacaaagtccatgagaat

SEQ ID NO: 31778 - DNA, 20 bp, Artificial Sequence
  chemically synthesized
cttaaggaccctgattctca

SEQ ID NO: 31779 - DNA, 20 bp, Artificial Sequence
  chemically synthesized
tgacaaagtccatgagaatc

SEQ ID NO: 31780 - DNA, 20 bp, Artificial Sequence
  chemically synthesized
gacaaagtccatgagaatca

SEQ ID NO: 31781 - DNA, 20 bp, Artificial Sequence
  chemically synthesized
ccatgagaatcagggtcctt

SEQ ID NO: 31782 - DNA, 20 bp, Artificial Sequence
  chemically synthesized
atgtagataatttatactta

SEQ ID NO: 31783 - DNA, 20 bp, Artificial Sequence
  chemically synthesized
tatgtagataatttatactt

SEQ ID NO: 31784 - DNA, 20 bp, Artificial Sequence
  chemically synthesized
acacacgccccacatatatg

SEQ ID NO: 31785 - DNA, 20 bp, Artificial Sequence
  chemically synthesized
ataaattatctacatatatg

SEQ ID NO: 31786 - DNA, 20 bp, Artificial Sequence
  chemically synthesized
taaattatctacatatatgt

SEQ ID NO: 31787 - DNA, 20 bp, Artificial Sequence
  chemically synthesized
aaattatctacatatatgtg

SEQ ID NO: 31788 - DNA, 20 bp, Artificial Sequence
  chemically synthesized
tgtgtgtgtgtgtgtgtgtg

SEQ ID NO: 31789 - DNA, 20 bp, Artificial Sequence
  chemically synthesized
ttatgacagaaaagcagcag

SEQ ID NO: 31790 - DNA, 20 bp, Artificial Sequence
  chemically synthesized
aacttatgacagaaaagcag

SEQ ID NO: 31791 - DNA, 20 bp, Artificial Sequence
  chemically synthesized
gagaacttatgacagaaaag

SEQ ID NO: 31792 - DNA, 20 bp, Artificial Sequence
  chemically synthesized
aatgagaacttatgacagaa

SEQ ID NO: 31793 - DNA, 20 bp, Artificial Sequence
  chemically synthesized
tactgctgcttttctgtcat

SEQ ID NO: 31794 - DNA, 20 bp, Artificial Sequence
  chemically synthesized
taactaatgagaacttatga

SEQ ID NO: 31795 - DNA, 20 bp, Artificial Sequence
  chemically synthesized
tttctgtcataagttctcat

SEQ ID NO: 31796 - DNA, 20 bp, Artificial Sequence
  chemically synthesized
gctacaattcattaactaat

SEQ ID NO: 31797 - DNA, 20 bp, Artificial Sequence
  chemically synthesized
tctcattagttaatgaattg

SEQ ID NO: 31798 - DNA, 20 bp, Artificial Sequence
  chemically synthesized
tagttaatgaattgtagcta

SEQ ID NO: 31799 - DNA, 20 bp, Artificial Sequence
  chemically synthesized
gttaatgaattgtagctata

SEQ ID NO: 31800 - DNA, 20 bp, Artificial Sequence
  chemically synthesized
tttcttacttagtgtctcta

SEQ ID NO: 31801 - DNA, 20 bp, Artificial Sequence
  chemically synthesized
attgtagctatagagacact

SEQ ID NO: 31802 - DNA, 20 bp, Artificial Sequence
  chemically synthesized
tagctatagagacactaagt

SEQ ID NO: 31803 - DNA, 20 bp, Artificial Sequence
  chemically synthesized
cccccattccatttcttact

SEQ ID NO: 31804 - DNA, 20 bp, Artificial Sequence
  chemically synthesized
tagagacactaagtaagaaa

SEQ ID NO: 31805 - DNA, 20 bp, Artificial Sequence
  chemically synthesized
acactaagtaagaaatggaa

SEQ ID NO: 31806 - DNA, 20 bp, Artificial Sequence
  chemically synthesized
cactaagtaagaaatggaat

SEQ ID NO: 31807 - DNA, 20 bp, Artificial Sequence
  chemically synthesized
actaagtaagaaatggaatg

SEQ ID NO: 31808 - DNA, 20 bp, Artificial Sequence
  chemically synthesized
ctaagtaagaaatggaatgg

SEQ ID NO: 31809 - DNA, 20 bp, Artificial Sequence
  chemically synthesized
atggaatgggggtatcgacg

SEQ ID NO: 31810 - DNA, 20 bp, Artificial Sequence
  chemically synthesized
cagttagatgtttggtaaaa

SEQ ID NO: 31811 - DNA, 20 bp, Artificial Sequence
  chemically synthesized
attatttacagttagatgtt

SEQ ID NO: 31812 - DNA, 20 bp, Artificial Sequence
  chemically synthesized
gaatttatattatttacagt

SEQ ID NO: 31813 - DNA, 20 bp, Artificial Sequence
  chemically synthesized
caatgaatttatattattta

SEQ ID NO: 31814 - DNA, 20 bp, Artificial Sequence
  chemically synthesized
taaataatataaattcattg

SEQ ID NO: 31815 - DNA, 20 bp, Artificial Sequence
  chemically synthesized
ataaattcattgtagaaaat

SEQ ID NO: 31816 - DNA, 20 bp, Artificial Sequence
  chemically synthesized
aattcattgtagaaaatcag

SEQ ID NO: 31817 - DNA, 20 bp, Artificial Sequence
  chemically synthesized
attgtagaaaatcagtggaa

SEQ ID NO: 31818 - DNA, 20 bp, Artificial Sequence
  chemically synthesized
ttgtagaaaatcagtggaaa

SEQ ID NO: 31819 - DNA, 20 bp, Artificial Sequence
  chemically synthesized
tcagtggaaaaggaatgaaa

SEQ ID NO: 31820 - DNA, 20 bp, Artificial Sequence
  chemically synthesized
gaatgaaaaagaaaaccacc

SEQ ID NO: 31821 - DNA, 20 bp, Artificial Sequence
  chemically synthesized
gctctctaatacattctggg

SEQ ID NO: 31822 - DNA, 20 bp, Artificial Sequence
  chemically synthesized
ggagctctctaatacattct

SEQ ID NO: 31823 - DNA, 20 bp, Artificial Sequence
  chemically synthesized
tggagctctctaatacattc

SEQ ID NO: 31824 - DNA, 20 bp, Artificial Sequence
  chemically synthesized
gaaaaccacccagaatgtat

SEQ ID NO: 31825 - DNA, 20 bp, Artificial Sequence
  chemically synthesized
aaaccacccagaatgtatta

SEQ ID NO: 31826 - DNA, 20 bp, Artificial Sequence
  chemically synthesized
accacccagaatgtattaga

SEQ ID NO: 31827 - DNA, 20 bp, Artificial Sequence
  chemically synthesized
aatgtattagagagctccaa

SEQ ID NO: 31828 - DNA, 20 bp, Artificial Sequence
  chemically synthesized
tgcttgagatattaccattg

SEQ ID NO: 31829 - DNA, 20 bp, Artificial Sequence
  chemically synthesized
attgcttgagatattaccat

SEQ ID NO: 31830 - DNA, 20 bp, Artificial Sequence
  chemically synthesized
agctccaatggtaatatctc

SEQ ID NO: 31831 - DNA, 20 bp, Artificial Sequence
  chemically synthesized
gaaaagctataatattgctt

SEQ ID NO: 31832 - DNA, 20 bp, Artificial Sequence
  chemically synthesized
taatatctcaagcaatatta

SEQ ID NO: 31833 - DNA, 20 bp, Artificial Sequence
  chemically synthesized
gcaatattatagcttttcat

SEQ ID NO: 31834 - DNA, 20 bp, Artificial Sequence
  chemically synthesized
agcaagtatttactgatgaa

SEQ ID NO: 31835 - DNA, 20 bp, Artificial Sequence
  chemically synthesized
gttagaactgaaaaagtagc

SEQ ID NO: 31836 - DNA, 20 bp, Artificial Sequence
  chemically synthesized
gtaaatacttgctacttttt

SEQ ID NO: 31837 - DNA, 20 bp, Artificial Sequence
  chemically synthesized
ttttgttagaactgaaaaag

SEQ ID NO: 31838 - DNA, 20 bp, Artificial Sequence
  chemically synthesized
acattttgttagaactgaaa

SEQ ID NO: 31839 - DNA, 20 bp, Artificial Sequence
  chemically synthesized
agaaggtgaaaacattttgt

SEQ ID NO: 31840 - DNA, 20 bp, Artificial Sequence
  chemically synthesized
ttgaacacaataggattaga

SEQ ID NO: 31841 - DNA, 20 bp, Artificial Sequence
  chemically synthesized
tttgaacacaataggattag

SEQ ID NO: 31842 - DNA, 20 bp, Artificial Sequence
  chemically synthesized
gggtttgaacacaataggat

SEQ ID NO: 31843 - DNA, 20 bp, Artificial Sequence
  chemically synthesized
acccagggtttgaacacaat

SEQ ID NO: 31844 - DNA, 20 bp, Artificial Sequence
  chemically synthesized
cacccagggtttgaacacaa

SEQ ID NO: 31845 - DNA, 20 bp, Artificial Sequence
  chemically synthesized
atcctattgtgttcaaaccc

SEQ ID NO: 31846 - DNA, 20 bp, Artificial Sequence
  chemically synthesized
tcctattgtgttcaaaccct

SEQ ID NO: 31847 - DNA, 20 bp, Artificial Sequence
  chemically synthesized
ttgtgttcaaaccctgggtg

SEQ ID NO: 31848 - DNA, 20 bp, Artificial Sequence
  chemically synthesized
tgtgttcaaaccctgggtgc

SEQ ID NO: 31849 - DNA, 20 bp, Artificial Sequence
  chemically synthesized
caggtgttcccctgcaccca

SEQ ID NO: 31850 - DNA, 20 bp, Artificial Sequence
  chemically synthesized
gtgttcaaaccctgggtgca

SEQ ID NO: 31851 - DNA, 20 bp, Artificial Sequence
  chemically synthesized
tcaggtgttcccctgcaccc

SEQ ID NO: 31852 - DNA, 20 bp, Artificial Sequence
  chemically synthesized
tgttcaaaccctgggtgcag

SEQ ID NO: 31853 - DNA, 20 bp, Artificial Sequence
  chemically synthesized
ttcaggtgttcccctgcacc

SEQ ID NO: 31854 - DNA, 20 bp, Artificial Sequence
  chemically synthesized
ccttgccctcaaaagcattc

SEQ ID NO: 31855 - DNA, 20 bp, Artificial Sequence
  chemically synthesized
gccttgccctcaaaagcatt

SEQ ID NO: 31856 - DNA, 20 bp, Artificial Sequence
  chemically synthesized
gggaacacctgaatgctttt

SEQ ID NO: 31857 - DNA, 20 bp, Artificial Sequence
  chemically synthesized
ggaacacctgaatgcttttg

SEQ ID NO: 31858 - DNA, 20 bp, Artificial Sequence
  chemically synthesized
gaacacctgaatgcttttga

SEQ ID NO: 31859 - DNA, 20 bp, Artificial Sequence
  chemically synthesized
gttacctgccttgccctcaa

SEQ ID NO: 31860 - DNA, 20 bp, Artificial Sequence
  chemically synthesized
acctgaatgcttttgagggc

SEQ ID NO: 31861 - DNA, 20 bp, Artificial Sequence
  chemically synthesized
cctgaatgcttttgagggca

SEQ ID NO: 31862 - DNA, 20 bp, Artificial Sequence
  chemically synthesized
gaatgcttttgagggcaagg

SEQ ID NO: 31863 - DNA, 20 bp, Artificial Sequence
  chemically synthesized
aatgcttttgagggcaaggc

SEQ ID NO: 31864 - DNA, 20 bp, Artificial Sequence
  chemically synthesized
taacataaacatgtgttgaa

SEQ ID NO: 31865 - DNA, 20 bp, Artificial Sequence
  chemically synthesized
aacataaacatgtgttgaac

SEQ ID NO: 31866 - DNA, 20 bp, Artificial Sequence
  chemically synthesized
catgtgttgaacaggctgct

SEQ ID NO: 31867 - DNA, 20 bp, Artificial Sequence
  chemically synthesized
atgtgttgaacaggctgctt

SEQ ID NO: 31868 - DNA, 20 bp, Artificial Sequence
  chemically synthesized
aatttgccaaagttcccaag

SEQ ID NO: 31869 - DNA, 20 bp, Artificial Sequence
  chemically synthesized
tctaatttgccaaagttccc

SEQ ID NO: 31870 - DNA, 20 bp, Artificial Sequence
  chemically synthesized
aacaggctgcttgggaactt

SEQ ID NO: 31871 - DNA, 20 bp, Artificial Sequence
  chemically synthesized
ttccattctctaatttgcca

SEQ ID NO: 31872 - DNA, 20 bp, Artificial Sequence
  chemically synthesized
gcttgggaactttggcaaat

SEQ ID NO: 31873 - DNA, 20 bp, Artificial Sequence
  chemically synthesized
ttgggaactttggcaaatta

SEQ ID NO: 31874 - DNA, 20 bp, Artificial Sequence
  chemically synthesized
aactttggcaaattagagaa

SEQ ID NO: 31875 - DNA, 20 bp, Artificial Sequence
  chemically synthesized
ttagagaatggaaatctcct

SEQ ID NO: 31876 - DNA, 20 bp, Artificial Sequence
  chemically synthesized
gagaatggaaatctccttag

SEQ ID NO: 31877 - DNA, 20 bp, Artificial Sequence
  chemically synthesized
tagagacgcccacttctaag

SEQ ID NO: 31878 - DNA, 20 bp, Artificial Sequence
  chemically synthesized
aatggaaatctccttagaag

SEQ ID NO: 31879 - DNA, 20 bp, Artificial Sequence
  chemically synthesized
atggaaatctccttagaagt

SEQ ID NO: 31880 - DNA, 20 bp, Artificial Sequence
  chemically synthesized
cctagagacgcccacttcta

SEQ ID NO: 31881 - DNA, 20 bp, Artificial Sequence
  chemically synthesized
tcctagagacgcccacttct

SEQ ID NO: 31882 - DNA, 20 bp, Artificial Sequence
  chemically synthesized
tccttagaagtgggcgtctc

SEQ ID NO: 31883 - DNA, 20 bp, Artificial Sequence
  chemically synthesized
ccttagaagtgggcgtctct

SEQ ID NO: 31884 - DNA, 20 bp, Artificial Sequence
  chemically synthesized
tggtaggttacacattccta

SEQ ID NO: 31885 - DNA, 20 bp, Artificial Sequence
  chemically synthesized
catggtaggttacacattcc

SEQ ID NO: 31886 - DNA, 20 bp, Artificial Sequence
  chemically synthesized
tggttcacagtatgcatggt

SEQ ID NO: 31887 - DNA, 20 bp, Artificial Sequence
  chemically synthesized
gtggttcacagtatgcatgg

SEQ ID NO: 31888 - DNA, 20 bp, Artificial Sequence
  chemically synthesized
acagtggttcacagtatgca

SEQ ID NO: 31889 - DNA, 20 bp, Artificial Sequence
  chemically synthesized
gtggaagctacagtggttca

SEQ ID NO: 31890 - DNA, 20 bp, Artificial Sequence
  chemically synthesized
atgcatactgtgaaccactg

SEQ ID NO: 31891 - DNA, 20 bp, Artificial Sequence
  chemically synthesized
ctctaccgtggaagctacag

SEQ ID NO: 31892 - DNA, 20 bp, Artificial Sequence
  chemically synthesized
atactctaccgtggaagcta

SEQ ID NO: 31893 - DNA, 20 bp, Artificial Sequence
  chemically synthesized
gtgaaccactgtagcttcca

SEQ ID NO: 31894 - DNA, 20 bp, Artificial Sequence
  chemically synthesized
aaccactgtagcttccacgg

SEQ ID NO: 31895 - DNA, 20 bp, Artificial Sequence
  chemically synthesized
ccaggcatactctaccgtgg

SEQ ID NO: 31896 - DNA, 20 bp, Artificial Sequence
  chemically synthesized
ccactgtagcttccacggta

SEQ ID NO: 31897 - DNA, 20 bp, Artificial Sequence
  chemically synthesized
actccaggcatactctaccg

SEQ ID NO: 31898 - DNA, 20 bp, Artificial Sequence
  chemically synthesized
cttccacggtagagtatgcc

SEQ ID NO: 31899 - DNA, 20 bp, Artificial Sequence
  chemically synthesized
tccacggtagagtatgcctg

SEQ ID NO: 31900 - DNA, 20 bp, Artificial Sequence
  chemically synthesized
acggtagagtatgcctggag

SEQ ID NO: 31901 - DNA, 20 bp, Artificial Sequence
  chemically synthesized
cggtagagtatgcctggagt

SEQ ID NO: 31902 - DNA, 20 bp, Artificial Sequence
  chemically synthesized
ggtagagtatgcctggagtg

SEQ ID NO: 31903 - DNA, 20 bp, Artificial Sequence
  chemically synthesized
gtagagtatgcctggagtgg

SEQ ID NO: 31904 - DNA, 20 bp, Artificial Sequence
  chemically synthesized
tccctctgtacccccactcc

SEQ ID NO: 31905 - DNA, 20 bp, Artificial Sequence
  chemically synthesized
ttccctctgtacccccactc

SEQ ID NO: 31906 - DNA, 20 bp, Artificial Sequence
  chemically synthesized
gtatgcctggagtgggggta

SEQ ID NO: 31907 - DNA, 20 bp, Artificial Sequence
  chemically synthesized
atgcctggagtgggggtaca

SEQ ID NO: 31908 - DNA, 20 bp, Artificial Sequence
  chemically synthesized
tgcctggagtgggggtacag

SEQ ID NO: 31909 - DNA, 20 bp, Artificial Sequence
  chemically synthesized
gcctggagtgggggtacaga

SEQ ID NO: 31910 - DNA, 20 bp, Artificial Sequence
  chemically synthesized
agtgggggtacagagggaaa

SEQ ID NO: 31911 - DNA, 20 bp, Artificial Sequence
  chemically synthesized
ggtgaggtgctgaaaatatc

SEQ ID NO: 31912 - DNA, 20 bp, Artificial Sequence
  chemically synthesized
aagcaacatcttgatatttt

SEQ ID NO: 31913 - DNA, 20 bp, Artificial Sequence
  chemically synthesized
tgatattttcagcacctcac

SEQ ID NO: 31914 - DNA, 20 bp, Artificial Sequence
  chemically synthesized
atattttcagcacctcacca

SEQ ID NO: 31915 - DNA, 20 bp, Artificial Sequence
  chemically synthesized
tgaacctcatgtctctggtg

SEQ ID NO: 31916 - DNA, 20 bp, Artificial Sequence
  chemically synthesized
ctgaacctcatgtctctggt

SEQ ID NO: 31917 - DNA, 20 bp, Artificial Sequence
  chemically synthesized
cagcacctcaccagagacat

SEQ ID NO: 31918 - DNA, 20 bp, Artificial Sequence
  chemically synthesized
gaacctgaacctcatgtctc

SEQ ID NO: 31919 - DNA, 20 bp, Artificial Sequence
  chemically synthesized
agcacctcaccagagacatg

SEQ ID NO: 31920 - DNA, 20 bp, Artificial Sequence
  chemically synthesized
ctcaccagagacatgaggtt

SEQ ID NO: 31921 - DNA, 20 bp, Artificial Sequence
  chemically synthesized
tcaccagagacatgaggttc

SEQ ID NO: 31922 - DNA, 20 bp, Artificial Sequence
  chemically synthesized
acatgaggttcaggttcgat

SEQ ID NO: 31923 - DNA, 20 bp, Artificial Sequence
  chemically synthesized
catgaggttcaggttcgatt

SEQ ID NO: 31924 - DNA, 20 bp, Artificial Sequence
  chemically synthesized
tgaggttcaggttcgattag

SEQ ID NO: 31925 - DNA, 20 bp, Artificial Sequence
  chemically synthesized
aggttcaggttcgattagga

SEQ ID NO: 31926 - DNA, 20 bp, Artificial Sequence
  chemically synthesized
ggttcaggttcgattaggag

SEQ ID NO: 31927 - DNA, 20 bp, Artificial Sequence
  chemically synthesized
gttcaggttcgattaggaga

SEQ ID NO: 31928 - DNA, 20 bp, Artificial Sequence
  chemically synthesized
ttcaggttcgattaggagag

SEQ ID NO: 31929 - DNA, 20 bp, Artificial Sequence
  chemically synthesized
tcaggttcgattaggagagg

SEQ ID NO: 31930 - DNA, 20 bp, Artificial Sequence
  chemically synthesized
gttcgattaggagagggggc

SEQ ID NO: 31931 - DNA, 20 bp, Artificial Sequence
  chemically synthesized
ttaggagagggggctagatg

SEQ ID NO: 31932 - DNA, 20 bp, Artificial Sequence
  chemically synthesized
caaatgtttaagaccacatc

SEQ ID NO: 31933 - DNA, 20 bp, Artificial Sequence
  chemically synthesized
gtctggcgtgtcaaatgttt

SEQ ID NO: 31934 - DNA, 20 bp, Artificial Sequence
  chemically synthesized
gtcttaaacatttgacacgc

SEQ ID NO: 31935 - DNA, 20 bp, Artificial Sequence
  chemically synthesized
gcagaaatggtgttgtggtc

SEQ ID NO: 31936 - DNA, 20 bp, Artificial Sequence
  chemically synthesized
tgaaagcagaaatggtgttg

SEQ ID NO: 31937 - DNA, 20 bp, Artificial Sequence
  chemically synthesized
aggtatcttgaaagcagaaa

SEQ ID NO: 31938 - DNA, 20 bp, Artificial Sequence
  chemically synthesized
acaacaccatttctgctttc

SEQ ID NO: 31939 - DNA, 20 bp, Artificial Sequence
  chemically synthesized
ggtgaaaggtatcttgaaag

SEQ ID NO: 31940 - DNA, 20 bp, Artificial Sequence
  chemically synthesized
gttggtgaaaggtatcttga

SEQ ID NO: 31941 - DNA, 20 bp, Artificial Sequence
  chemically synthesized
aactacagtcagttggtgaa

SEQ ID NO: 31942 - DNA, 20 bp, Artificial Sequence
  chemically synthesized
caactacagtcagttggtga

SEQ ID NO: 31943 - DNA, 20 bp, Artificial Sequence
  chemically synthesized
agccttcaactacagtcagt

SEQ ID NO: 31944 - DNA, 20 bp, Artificial Sequence
  chemically synthesized
tacctttcaccaactgactg

SEQ ID NO: 31945 - DNA, 20 bp, Artificial Sequence
  chemically synthesized
cggaagccttcaactacagt

SEQ ID NO: 31946 - DNA, 20 bp, Artificial Sequence
  chemically synthesized
tcaccaactgactgtagttg

SEQ ID NO: 31947 - DNA, 20 bp, Artificial Sequence
  chemically synthesized
caccaactgactgtagttga

SEQ ID NO: 31948 - DNA, 20 bp, Artificial Sequence
  chemically synthesized
tggtcggaagccttcaacta

SEQ ID NO: 31949 - DNA, 20 bp, Artificial Sequence
  chemically synthesized
gagctggatgaaatggtcgg

SEQ ID NO: 31950 - DNA, 20 bp, Artificial Sequence
  chemically synthesized
tttgagctggatgaaatggt

SEQ ID NO: 31951 - DNA, 20 bp, Artificial Sequence
  chemically synthesized
aggcttccgaccatttcatc

SEQ ID NO: 31952 - DNA, 20 bp, Artificial Sequence
  chemically synthesized
gctctttgagctggatgaaa

SEQ ID NO: 31953 - DNA, 20 bp, Artificial Sequence
  chemically synthesized
cgaccatttcatccagctca

SEQ ID NO: 31954 - DNA, 20 bp, Artificial Sequence
  chemically synthesized
accatttcatccagctcaaa

SEQ ID NO: 31955 - DNA, 20 bp, Artificial Sequence
  chemically synthesized
gtccaaattgctctttgagc

SEQ ID NO: 31956 - DNA, 20 bp, Artificial Sequence
  chemically synthesized
ttaggtccaaattgctcttt

SEQ ID NO: 31957 - DNA, 20 bp, Artificial Sequence
  chemically synthesized
atccagctcaaagagcaatt

SEQ ID NO: 31958 - DNA, 20 bp, Artificial Sequence
  chemically synthesized
caaagagcaatttggaccta

SEQ ID NO: 31959 - DNA, 20 bp, Artificial Sequence
  chemically synthesized
aaagagcaatttggacctaa

SEQ ID NO: 31960 - DNA, 20 bp, Artificial Sequence
  chemically synthesized
aagagcaatttggacctaaa

SEQ ID NO: 31961 - DNA, 20 bp, Artificial Sequence
  chemically synthesized
tcttcaagaggtatcccttt

SEQ ID NO: 31962 - DNA, 20 bp, Artificial Sequence
  chemically synthesized
ttcttcaagaggtatccctt

SEQ ID NO: 31963 - DNA, 20 bp, Artificial Sequence
  chemically synthesized
acctaaagggatacctcttg

SEQ ID NO: 31964 - DNA, 20 bp, Artificial Sequence
  chemically synthesized
taaagggatacctcttgaag

SEQ ID NO: 31965 - DNA, 20 bp, Artificial Sequence
  chemically synthesized
ttatatttttcttcttcaag

SEQ ID NO: 31966 - DNA, 20 bp, Artificial Sequence
  chemically synthesized
tttatatttttcttcttcaa

SEQ ID NO: 31967 - DNA, 20 bp, Artificial Sequence
  chemically synthesized
agtttatatttttcttcttc

SEQ ID NO: 31968 - DNA, 20 bp, Artificial Sequence
  chemically synthesized
gaagaaaaatataaactaat

SEQ ID NO: 31969 - DNA, 20 bp, Artificial Sequence
  chemically synthesized
tgattttagtttttacttat

SEQ ID NO: 31970 - DNA, 20 bp, Artificial Sequence
  chemically synthesized
aagaaacttttcattgattt

SEQ ID NO: 31971 - DNA, 20 bp, Artificial Sequence
  chemically synthesized
taaaaactaaaatcaatgaa

SEQ ID NO: 31972 - DNA, 20 bp, Artificial Sequence
  chemically synthesized
atcaatgaaaagtttctttt

SEQ ID NO: 31973 - DNA, 20 bp, Artificial Sequence
  chemically synthesized
cataagcataaaatactgaa

SEQ ID NO: 31974 - DNA, 20 bp, Artificial Sequence
  chemically synthesized
gtgtttcagagtcgaaacat

SEQ ID NO: 31975 - DNA, 20 bp, Artificial Sequence
  chemically synthesized
tccaaaattacagtgtttca

SEQ ID NO: 31976 - DNA, 20 bp, Artificial Sequence
  chemically synthesized
tctccaaaattacagtgttt

SEQ ID NO: 31977 - DNA, 20 bp, Artificial Sequence
  chemically synthesized
actctgaaacactgtaattt

SEQ ID NO: 31978 - DNA, 20 bp, Artificial Sequence
  chemically synthesized
tttccccctctccaaaatta

SEQ ID NO: 31979 - DNA, 20 bp, Artificial Sequence
  chemically synthesized
tctgaaacactgtaattttg

SEQ ID NO: 31980 - DNA, 20 bp, Artificial Sequence
  chemically synthesized
tgaaacactgtaattttgga

SEQ ID NO: 31981 - DNA, 20 bp, Artificial Sequence
  chemically synthesized
gaaacactgtaattttggag

SEQ ID NO: 31982 - DNA, 20 bp, Artificial Sequence
  chemically synthesized
aaacactgtaattttggaga

SEQ ID NO: 31983 - DNA, 20 bp, Artificial Sequence
  chemically synthesized
aacactgtaattttggagag

SEQ ID NO: 31984 - DNA, 20 bp, Artificial Sequence
  chemically synthesized
acactgtaattttggagagg

SEQ ID NO: 31985 - DNA, 20 bp, Artificial Sequence
  chemically synthesized
tgtaattttggagaggggga

SEQ ID NO: 31986 - DNA, 20 bp, Artificial Sequence
  chemically synthesized
gtaattttggagagggggaa

SEQ ID NO: 31987 - DNA, 20 bp, Artificial Sequence
  chemically synthesized
attttggagagggggaaagg

SEQ ID NO: 31988 - DNA, 20 bp, Artificial Sequence
  chemically synthesized
gagagggggaaaggcagtgc

SEQ ID NO: 31989 - DNA, 20 bp, Artificial Sequence
  chemically synthesized
agggggaaaggcagtgctgg

SEQ ID NO: 31990 - DNA, 20 bp, Artificial Sequence
  chemically synthesized
tcccatataagattaactac

SEQ ID NO: 31991 - DNA, 20 bp, Artificial Sequence
  chemically synthesized
tgctggtagttaatcttata

SEQ ID NO: 31992 - DNA, 20 bp, Artificial Sequence
  chemically synthesized
gctggtagttaatcttatat

SEQ ID NO: 31993 - DNA, 20 bp, Artificial Sequence
  chemically synthesized
acatccttgagatcccatat

SEQ ID NO: 31994 - DNA, 20 bp, Artificial Sequence
  chemically synthesized
ttaatcttatatgggatctc

SEQ ID NO: 31995 - DNA, 20 bp, Artificial Sequence
  chemically synthesized
taatcttatatgggatctca

SEQ ID NO: 31996 - DNA, 20 bp, Artificial Sequence
  chemically synthesized
tatatgggatctcaaggatg

SEQ ID NO: 31997 - DNA, 20 bp, Artificial Sequence
  chemically synthesized
cccagcctgcctacatcctt

SEQ ID NO: 31998 - DNA, 20 bp, Artificial Sequence
  chemically synthesized
atatgggatctcaaggatgt

SEQ ID NO: 31999 - DNA, 20 bp, Artificial Sequence
  chemically synthesized
tgggatctcaaggatgtagg

SEQ ID NO: 32000 - DNA, 20 bp, Artificial Sequence
  chemically synthesized
gggatctcaaggatgtaggc

SEQ ID NO: 32001 - DNA, 20 bp, Artificial Sequence
  chemically synthesized
tctcaaggatgtaggcaggc

SEQ ID NO: 32002 - DNA, 20 bp, Artificial Sequence
  chemically synthesized
ctcaaggatgtaggcaggct

SEQ ID NO: 32003 - DNA, 20 bp, Artificial Sequence
  chemically synthesized
tgtaggcaggctgggcgctg

SEQ ID NO: 32004 - DNA, 20 bp, Artificial Sequence
  chemically synthesized
caagcgtaagccacagcgcc

SEQ ID NO: 32005 - DNA, 20 bp, Artificial Sequence
  chemically synthesized
aggattacaagcgtaagcca

SEQ ID NO: 32006 - DNA, 20 bp, Artificial Sequence
  chemically synthesized
attgttaggattacaagcgt

SEQ ID NO: 32007 - DNA, 20 bp, Artificial Sequence
  chemically synthesized
tcccaaattgttaggattac

SEQ ID NO: 32008 - DNA, 20 bp, Artificial Sequence
  chemically synthesized
cgcttgtaatcctaacaatt

SEQ ID NO: 32009 - DNA, 20 bp, Artificial Sequence
  chemically synthesized
ccttggcctcccaaattgtt

SEQ ID NO: 32010 - DNA, 20 bp, Artificial Sequence
  chemically synthesized
gcttgtaatcctaacaattt

SEQ ID NO: 32011 - DNA, 20 bp, Artificial Sequence
  chemically synthesized
accttggcctcccaaattgt

SEQ ID NO: 32012 - DNA, 20 bp, Artificial Sequence
  chemically synthesized
ttgtaatcctaacaatttgg

SEQ ID NO: 32013 - DNA, 20 bp, Artificial Sequence
  chemically synthesized
tgtaatcctaacaatttggg

SEQ ID NO: 32014 - DNA, 20 bp, Artificial Sequence
  chemically synthesized
tcctaacaatttgggaggcc

SEQ ID NO: 32015 - DNA, 20 bp, Artificial Sequence
  chemically synthesized
cctaacaatttgggaggcca

SEQ ID NO: 32016 - DNA, 20 bp, Artificial Sequence
  chemically synthesized
aacaatttgggaggccaagg

SEQ ID NO: 32017 - DNA, 20 bp, Artificial Sequence
  chemically synthesized
acaatttgggaggccaaggt

SEQ ID NO: 32018 - DNA, 20 bp, Artificial Sequence
  chemically synthesized
aatttgggaggccaaggtgg

SEQ ID NO: 32019 - DNA, 20 bp, Artificial Sequence
  chemically synthesized
atttgggaggccaaggtggg

SEQ ID NO: 32020 - DNA, 20 bp, Artificial Sequence
  chemically synthesized
ctcaggtgatcctcccacct

SEQ ID NO: 32021 - DNA, 20 bp, Artificial Sequence
  chemically synthesized
ccaaggtgggaggatcacct

SEQ ID NO: 32022 - DNA, 20 bp, Artificial Sequence
  chemically synthesized
caaggtgggaggatcacctg

SEQ ID NO: 32023 - DNA, 20 bp, Artificial Sequence
  chemically synthesized
gtgggaggatcacctgaggt

SEQ ID NO: 32024 - DNA, 20 bp, Artificial Sequence
  chemically synthesized
tgggaggatcacctgaggtc

SEQ ID NO: 32025 - DNA, 20 bp, Artificial Sequence
  chemically synthesized
ggtctcgaactcctgacctc

SEQ ID NO: 32026 - DNA, 20 bp, Artificial Sequence
  chemically synthesized
ggaggatcacctgaggtcag

SEQ ID NO: 32027 - DNA, 20 bp, Artificial Sequence
  chemically synthesized
tggtctcgaactcctgacct

SEQ ID NO: 32028 - DNA, 20 bp, Artificial Sequence
  chemically synthesized
tcacctgaggtcaggagttc

SEQ ID NO: 32029 - DNA, 20 bp, Artificial Sequence
  chemically synthesized
tgaggtcaggagttcgagac

SEQ ID NO: 32030 - DNA, 20 bp, Artificial Sequence
  chemically synthesized
tcaggagttcgagaccagcc

SEQ ID NO: 32031 - DNA, 20 bp, Artificial Sequence
  chemically synthesized
ttttgccatgttggctaggc

SEQ ID NO: 32032 - DNA, 20 bp, Artificial Sequence
  chemically synthesized
ggggttttgccatgttggct

SEQ ID NO: 32033 - DNA, 20 bp, Artificial Sequence
  chemically synthesized
cgagaccagcctagccaaca

SEQ ID NO: 32034 - DNA, 20 bp, Artificial Sequence
  chemically synthesized
cggggttttgccatgttggc

SEQ ID NO: 32035 - DNA, 20 bp, Artificial Sequence
  chemically synthesized
gggacggggttttgccatgt

SEQ ID NO: 32036 - DNA, 20 bp, Artificial Sequence
  chemically synthesized
acatggcaaaaccccgtccc

SEQ ID NO: 32037 - DNA, 20 bp, Artificial Sequence
  chemically synthesized
ttgtatttttactagggacg

SEQ ID NO: 32038 - DNA, 20 bp, Artificial Sequence
  chemically synthesized
tttgtatttttactagggac

SEQ ID NO: 32039 - DNA, 20 bp, Artificial Sequence
  chemically synthesized
ttttgtatttttactaggga

SEQ ID NO: 32040 - DNA, 20 bp, Artificial Sequence
  chemically synthesized
taatttttgtatttttacta

SEQ ID NO: 32041 - DNA, 20 bp, Artificial Sequence
  chemically synthesized
ctaatttttgtatttttact

SEQ ID NO: 32042 - DNA, 20 bp, Artificial Sequence
  chemically synthesized
gctaatttttgtatttttac

SEQ ID NO: 32043 - DNA, 20 bp, Artificial Sequence
  chemically synthesized
cctagtaaaaatacaaaaat

SEQ ID NO: 32044 - DNA, 20 bp, Artificial Sequence
  chemically synthesized
gtaaaaatacaaaaattagc

SEQ ID NO: 32045 - DNA, 20 bp, Artificial Sequence
  chemically synthesized
taaaaatacaaaaattagct

SEQ ID NO: 32046 - DNA, 20 bp, Artificial Sequence
  chemically synthesized
atacaaaaattagctgggta

SEQ ID NO: 32047 - DNA, 20 bp, Artificial Sequence
  chemically synthesized
caaaaattagctgggtatgg

SEQ ID NO: 32048 - DNA, 20 bp, Artificial Sequence
  chemically synthesized
taggcacccgccaccatacc

SEQ ID NO: 32049 - DNA, 20 bp, Artificial Sequence
  chemically synthesized
aaattagctgggtatggtgg

SEQ ID NO: 32050 - DNA, 20 bp, Artificial Sequence
  chemically synthesized
aattagctgggtatggtggc

SEQ ID NO: 32051 - DNA, 20 bp, Artificial Sequence
  chemically synthesized
tgggtatggtggcgggtgcc

SEQ ID NO: 32052 - DNA, 20 bp, Artificial Sequence
  chemically synthesized
cccgagtagctgggattact

SEQ ID NO: 32053 - DNA, 20 bp, Artificial Sequence
  chemically synthesized
tggcgggtgcctagtaatcc

SEQ ID NO: 32054 - DNA, 20 bp, Artificial Sequence
  chemically synthesized
tcccgagtagctgggattac

SEQ ID NO: 32055 - DNA, 20 bp, Artificial Sequence
  chemically synthesized
gcctagtaatcccagctact

SEQ ID NO: 32056 - DNA, 20 bp, Artificial Sequence
  chemically synthesized
cttcagcctcccgagtagct

SEQ ID NO: 32057 - DNA, 20 bp, Artificial Sequence
  chemically synthesized
cctagtaatcccagctactc

SEQ ID NO: 32058 - DNA, 20 bp, Artificial Sequence
  chemically synthesized
gcttcagcctcccgagtagc

SEQ ID NO: 32059 - DNA, 20 bp, Artificial Sequence
  chemically synthesized
tagtaatcccagctactcgg

SEQ ID NO: 32060 - DNA, 20 bp, Artificial Sequence
  chemically synthesized
agtaatcccagctactcggg

SEQ ID NO: 32061 - DNA, 20 bp, Artificial Sequence
  chemically synthesized
tcctgcttcagcctcccgag

SEQ ID NO: 32062 - DNA, 20 bp, Artificial Sequence
  chemically synthesized
ttctcctgcttcagcctccc

SEQ ID NO: 32063 - DNA, 20 bp, Artificial Sequence
  chemically synthesized
cccagctactcgggaggctg

SEQ ID NO: 32064 - DNA, 20 bp, Artificial Sequence
  chemically synthesized
agctactcgggaggctgaag

SEQ ID NO: 32065 - DNA, 20 bp, Artificial Sequence
  chemically synthesized
gctactcgggaggctgaagc

SEQ ID NO: 32066 - DNA, 20 bp, Artificial Sequence
  chemically synthesized
tactcgggaggctgaagcag

SEQ ID NO: 32067 - DNA, 20 bp, Artificial Sequence
  chemically synthesized
atgaagtgattctcctgctt

SEQ ID NO: 32068 - DNA, 20 bp, Artificial Sequence
  chemically synthesized
gcaggagaatcacttcatcc

SEQ ID NO: 32069 - DNA, 20 bp, Artificial Sequence
  chemically synthesized
caggagaatcacttcatcct

SEQ ID NO: 32070 - DNA, 20 bp, Artificial Sequence
  chemically synthesized
aggagaatcacttcatcctg

SEQ ID NO: 32071 - DNA, 20 bp, Artificial Sequence
  chemically synthesized
acctccgcctccccaggatg

SEQ ID NO: 32072 - DNA, 20 bp, Artificial Sequence
  chemically synthesized
gagaatcacttcatcctggg

SEQ ID NO: 32073 - DNA, 20 bp, Artificial Sequence
  chemically synthesized
agaatcacttcatcctgggg

SEQ ID NO: 32074 - DNA, 20 bp, Artificial Sequence
  chemically synthesized
atcacttcatcctggggagg

SEQ ID NO: 32075 - DNA, 20 bp, Artificial Sequence
  chemically synthesized
acggcaacctccgcctcccc

SEQ ID NO: 32076 - DNA, 20 bp, Artificial Sequence
  chemically synthesized
cacggcaacctccgcctccc

SEQ ID NO: 32077 - DNA, 20 bp, Artificial Sequence
  chemically synthesized
cacttcatcctggggaggcg

SEQ ID NO: 32078 - DNA, 20 bp, Artificial Sequence
  chemically synthesized
acttcatcctggggaggcgg

SEQ ID NO: 32079 - DNA, 20 bp, Artificial Sequence
  chemically synthesized
ggggaggcggaggttgccgt

SEQ ID NO: 32080 - DNA, 20 bp, Artificial Sequence
  chemically synthesized
ggcggaggttgccgtgagcc

SEQ ID NO: 32081 - DNA, 20 bp, Artificial Sequence
  chemically synthesized
agtggcacgatcttggctca

SEQ ID NO: 32082 - DNA, 20 bp, Artificial Sequence
  chemically synthesized
ggaatgcagtggcacgatct

SEQ ID NO: 32083 - DNA, 20 bp, Artificial Sequence
  chemically synthesized
tcacccaggctggaatgcag

SEQ ID NO: 32084 - DNA, 20 bp, Artificial Sequence
  chemically synthesized
aagatcgtgccactgcattc

SEQ ID NO: 32085 - DNA, 20 bp, Artificial Sequence
  chemically synthesized
ctgtcacccaggctggaatg

SEQ ID NO: 32086 - DNA, 20 bp, Artificial Sequence
  chemically synthesized
cgtgccactgcattccagcc

SEQ ID NO: 32087 - DNA, 20 bp, Artificial Sequence
  chemically synthesized
gtgccactgcattccagcct

SEQ ID NO: 32088 - DNA, 20 bp, Artificial Sequence
  chemically synthesized
tctcactctgtcacccaggc

SEQ ID NO: 32089 - DNA, 20 bp, Artificial Sequence
  chemically synthesized
ctgcattccagcctgggtga

SEQ ID NO: 32090 - DNA, 20 bp, Artificial Sequence
  chemically synthesized
agattctcactctgtcaccc

SEQ ID NO: 32091 - DNA, 20 bp, Artificial Sequence
  chemically synthesized
gcattccagcctgggtgaca

SEQ ID NO: 32092 - DNA, 20 bp, Artificial Sequence
  chemically synthesized
cagattctcactctgtcacc

SEQ ID NO: 32093 - DNA, 20 bp, Artificial Sequence
  chemically synthesized
tccagcctgggtgacagagt

SEQ ID NO: 32094 - DNA, 20 bp, Artificial Sequence
  chemically synthesized
tgtttgtttgttttttgaga

SEQ ID NO: 32095 - DNA, 20 bp, Artificial Sequence
  chemically synthesized
tttttgtttgtttgtttttt

SEQ ID NO: 32096 - DNA, 20 bp, Artificial Sequence
  chemically synthesized
caaaaaacaaacaaacaaaa

SEQ ID NO: 32097 - DNA, 20 bp, Artificial Sequence
  chemically synthesized
aaaaaacaaacaaacaaaaa

SEQ ID NO: 32098 - DNA, 20 bp, Artificial Sequence
  chemically synthesized
caaacaaacaaaaaaggatg

SEQ ID NO: 32099 - DNA, 20 bp, Artificial Sequence
  chemically synthesized
catatagaatgattgttata

SEQ ID NO: 32100 - DNA, 20 bp, Artificial Sequence
  chemically synthesized
aacaatcattctatatgtgc

SEQ ID NO: 32101 - DNA, 20 bp, Artificial Sequence
  chemically synthesized
tcactgttgcctggcacata

SEQ ID NO: 32102 - DNA, 20 bp, Artificial Sequence
  chemically synthesized
acaatcattctatatgtgcc

SEQ ID NO: 32103 - DNA, 20 bp, Artificial Sequence
  chemically synthesized
attctatatgtgccaggcaa

SEQ ID NO: 32104 - DNA, 20 bp, Artificial Sequence
  chemically synthesized
gcactcctttcactgttgcc

SEQ ID NO: 32105 - DNA, 20 bp, Artificial Sequence
  chemically synthesized
tatgtgccaggcaacagtga

SEQ ID NO: 32106 - DNA, 20 bp, Artificial Sequence
  chemically synthesized
atgtgccaggcaacagtgaa

SEQ ID NO: 32107 - DNA, 20 bp, Artificial Sequence
  chemically synthesized
gtgccaggcaacagtgaaag

SEQ ID NO: 32108 - DNA, 20 bp, Artificial Sequence
  chemically synthesized
tgaaaggagtgcccattgtt

SEQ ID NO: 32109 - DNA, 20 bp, Artificial Sequence
  chemically synthesized
gaaaggagtgcccattgttt

SEQ ID NO: 32110 - DNA, 20 bp, Artificial Sequence
  chemically synthesized
tatggtgggtcctaaacaat

SEQ ID NO: 32111 - DNA, 20 bp, Artificial Sequence
  chemically synthesized
gtatggtgggtcctaaacaa

SEQ ID NO: 32112 - DNA, 20 bp, Artificial Sequence
  chemically synthesized
atttctggaaatggtatggt

SEQ ID NO: 32113 - DNA, 20 bp, Artificial Sequence
  chemically synthesized
tatttctggaaatggtatgg

SEQ ID NO: 32114 - DNA, 20 bp, Artificial Sequence
  chemically synthesized
tggtatttctggaaatggta

SEQ ID NO: 32115 - DNA, 20 bp, Artificial Sequence
  chemically synthesized
aggacccaccataccatttc

SEQ ID NO: 32116 - DNA, 20 bp, Artificial Sequence
  chemically synthesized
ttgagtggtatttctggaaa

SEQ ID NO: 32117 - DNA, 20 bp, Artificial Sequence
  chemically synthesized
agttacttgagtggtatttc

SEQ ID NO: 32118 - DNA, 20 bp, Artificial Sequence
  chemically synthesized
catttccagaaataccactc

SEQ ID NO: 32119 - DNA, 20 bp, Artificial Sequence
  chemically synthesized
tgaatagtaagttacttgag

SEQ ID NO: 32120 - DNA, 20 bp, Artificial Sequence
  chemically synthesized
ctatgaatagtaagttactt

SEQ ID NO: 32121 - DNA, 20 bp, Artificial Sequence
  chemically synthesized
tagttttacctatgaatagt

SEQ ID NO: 32122 - DNA, 20 bp, Artificial Sequence
  chemically synthesized
ctcaagtaacttactattca

SEQ ID NO: 32123 - DNA, 20 bp, Artificial Sequence
  chemically synthesized
tcaagtaacttactattcat

SEQ ID NO: 32124 - DNA, 20 bp, Artificial Sequence
  chemically synthesized
ttgatagttttacctatgaa

SEQ ID NO: 32125 - DNA, 20 bp, Artificial Sequence
  chemically synthesized
tacacgtatataggaattga

SEQ ID NO: 32126 - DNA, 20 bp, Artificial Sequence
  chemically synthesized
catacctgctacacgtatat

SEQ ID NO: 32127 - DNA, 20 bp, Artificial Sequence
  chemically synthesized
acatacctgctacacgtata

SEQ ID NO: 32128 - DNA, 20 bp, Artificial Sequence
  chemically synthesized
tatcaattcctatatacgtg

SEQ ID NO: 32129 - DNA, 20 bp, Artificial Sequence
  chemically synthesized
caattcctatatacgtgtag

SEQ ID NO: 32130 - DNA, 20 bp, Artificial Sequence
  chemically synthesized
aattcctatatacgtgtagc

SEQ ID NO: 32131 - DNA, 20 bp, Artificial Sequence
  chemically synthesized
atatacgtgtagcaggtatg

SEQ ID NO: 32132 - DNA, 20 bp, Artificial Sequence
  chemically synthesized
taggtaaagtatatttatgt

SEQ ID NO: 32133 - DNA, 20 bp, Artificial Sequence
  chemically synthesized
caacataaatatactttacc

SEQ ID NO: 32134 - DNA, 20 bp, Artificial Sequence
  chemically synthesized
ttgattttatttactaggta

SEQ ID NO: 32135 - DNA, 20 bp, Artificial Sequence
  chemically synthesized
tctcattgattttatttact

SEQ ID NO: 32136 - DNA, 20 bp, Artificial Sequence
  chemically synthesized
ttctcattgattttatttac

SEQ ID NO: 32137 - DNA, 20 bp, Artificial Sequence
  chemically synthesized
acctagtaaataaaatcaat

SEQ ID NO: 32138 - DNA, 20 bp, Artificial Sequence
  chemically synthesized
gtaaataaaatcaatgagaa

SEQ ID NO: 32139 - DNA, 20 bp, Artificial Sequence
  chemically synthesized
aaaatcaatgagaacagtga

SEQ ID NO: 32140 - DNA, 20 bp, Artificial Sequence
  chemically synthesized
gagaacagtgaaagtactaa

SEQ ID NO: 32141 - DNA, 20 bp, Artificial Sequence
  chemically synthesized
atttgtcctcagttttctgt

SEQ ID NO: 32142 - DNA, 20 bp, Artificial Sequence
  chemically synthesized
gaaagtactaacagaaaact

SEQ ID NO: 32143 - DNA, 20 bp, Artificial Sequence
  chemically synthesized
aaagtactaacagaaaactg

SEQ ID NO: 32144 - DNA, 20 bp, Artificial Sequence
  chemically synthesized
gctacacctggatttgtcct

SEQ ID NO: 32145 - DNA, 20 bp, Artificial Sequence
  chemically synthesized
cagaaaactgaggacaaatc

SEQ ID NO: 32146 - DNA, 20 bp, Artificial Sequence
  chemically synthesized
agaaaactgaggacaaatcc

SEQ ID NO: 32147 - DNA, 20 bp, Artificial Sequence
  chemically synthesized
actgaggacaaatccaggtg

SEQ ID NO: 32148 - DNA, 20 bp, Artificial Sequence
  chemically synthesized
cagctatgtggggctacacc

SEQ ID NO: 32149 - DNA, 20 bp, Artificial Sequence
  chemically synthesized
aatccaggtgtagccccaca

SEQ ID NO: 32150 - DNA, 20 bp, Artificial Sequence
  chemically synthesized
cagggctacacagctatgtg

SEQ ID NO: 32151 - DNA, 20 bp, Artificial Sequence
  chemically synthesized
tcagggctacacagctatgt

SEQ ID NO: 32152 - DNA, 20 bp, Artificial Sequence
  chemically synthesized
atcagggctacacagctatg

SEQ ID NO: 32153 - DNA, 20 bp, Artificial Sequence
  chemically synthesized
tgtagccccacatagctgtg

SEQ ID NO: 32154 - DNA, 20 bp, Artificial Sequence
  chemically synthesized
aggaattgatcagggctaca

SEQ ID NO: 32155 - DNA, 20 bp, Artificial Sequence
  chemically synthesized
gctcagggaggaattgatca

SEQ ID NO: 32156 - DNA, 20 bp, Artificial Sequence
  chemically synthesized
ggctcagggaggaattgatc

SEQ ID NO: 32157 - DNA, 20 bp, Artificial Sequence
  chemically synthesized
aggctcagggaggaattgat

SEQ ID NO: 32158 - DNA, 20 bp, Artificial Sequence
  chemically synthesized
gccctgatcaattcctccct

SEQ ID NO: 32159 - DNA, 20 bp, Artificial Sequence
  chemically synthesized
cagcgaagccaggctcaggg

SEQ ID NO: 32160 - DNA, 20 bp, Artificial Sequence
  chemically synthesized
acagcgaagccaggctcagg

SEQ ID NO: 32161 - DNA, 20 bp, Artificial Sequence
  chemically synthesized
gatcaattcctccctgagcc

SEQ ID NO: 32162 - DNA, 20 bp, Artificial Sequence
  chemically synthesized
ggacagcgaagccaggctca

SEQ ID NO: 32163 - DNA, 20 bp, Artificial Sequence
  chemically synthesized
aggacagcgaagccaggctc

SEQ ID NO: 32164 - DNA, 20 bp, Artificial Sequence
  chemically synthesized
caggacagcgaagccaggct

SEQ ID NO: 32165 - DNA, 20 bp, Artificial Sequence
  chemically synthesized
tttcacaggacagcgaagcc

SEQ ID NO: 32166 - DNA, 20 bp, Artificial Sequence
  chemically synthesized
atttcacaggacagcgaagc

SEQ ID NO: 32167 - DNA, 20 bp, Artificial Sequence
  chemically synthesized
ccacatttcacaggacagcg

SEQ ID NO: 32168 - DNA, 20 bp, Artificial Sequence
  chemically synthesized
aacatccacatttcacagga

SEQ ID NO: 32169 - DNA, 20 bp, Artificial Sequence
  chemically synthesized
tatcaacatccacatttcac

SEQ ID NO: 32170 - DNA, 20 bp, Artificial Sequence
  chemically synthesized
cttcgctgtcctgtgaaatg

SEQ ID NO: 32171 - DNA, 20 bp, Artificial Sequence
  chemically synthesized
gtatcaacatccacatttca

SEQ ID NO: 32172 - DNA, 20 bp, Artificial Sequence
  chemically synthesized
caaccaacctgcatggtgga

SEQ ID NO: 32173 - DNA, 20 bp, Artificial Sequence
  chemically synthesized
tgttgataccatccaccatg

SEQ ID NO: 32174 - DNA, 20 bp, Artificial Sequence
  chemically synthesized
gttgataccatccaccatgc

SEQ ID NO: 32175 - DNA, 20 bp, Artificial Sequence
  chemically synthesized
ccagcaaccaacctgcatgg

SEQ ID NO: 32176 - DNA, 20 bp, Artificial Sequence
  chemically synthesized
ataccatccaccatgcaggt

SEQ ID NO: 32177 - DNA, 20 bp, Artificial Sequence
  chemically synthesized
gtgccagcaaccaacctgca

SEQ ID NO: 32178 - DNA, 20 bp, Artificial Sequence
  chemically synthesized
ccaccatgcaggttggttgc

SEQ ID NO: 32179 - DNA, 20 bp, Artificial Sequence
  chemically synthesized
gttttccacatgggatgtgc

SEQ ID NO: 32180 - DNA, 20 bp, Artificial Sequence
  chemically synthesized
ggttgctggcacatcccatg

SEQ ID NO: 32181 - DNA, 20 bp, Artificial Sequence
  chemically synthesized
ctattgtatgttttccacat

SEQ ID NO: 32182 - DNA, 20 bp, Artificial Sequence
  chemically synthesized
cctattgtatgttttccaca

SEQ ID NO: 32183 - DNA, 20 bp, Artificial Sequence
  chemically synthesized
cccatgtggaaaacatacaa

SEQ ID NO: 32184 - DNA, 20 bp, Artificial Sequence
  chemically synthesized
ccatgtggaaaacatacaat

SEQ ID NO: 32185 - DNA, 20 bp, Artificial Sequence
  chemically synthesized
taacatctcccatttattgc

SEQ ID NO: 32186 - DNA, 20 bp, Artificial Sequence
  chemically synthesized
tacaataggcccgcaataaa

SEQ ID NO: 32187 - DNA, 20 bp, Artificial Sequence
  chemically synthesized
ataacatctcccatttattg

SEQ ID NO: 32188 - DNA, 20 bp, Artificial Sequence
  chemically synthesized
acaataggcccgcaataaat

SEQ ID NO: 32189 - DNA, 20 bp, Artificial Sequence
  chemically synthesized
aataggcccgcaataaatgg

SEQ ID NO: 32190 - DNA, 20 bp, Artificial Sequence
  chemically synthesized
ttatccaagtggtgattcat

SEQ ID NO: 32191 - DNA, 20 bp, Artificial Sequence
  chemically synthesized
ttatctgatgaatcaccact

SEQ ID NO: 32192 - DNA, 20 bp, Artificial Sequence
  chemically synthesized
tcgttgggcttttatccaag

SEQ ID NO: 32193 - DNA, 20 bp, Artificial Sequence
  chemically synthesized
atgaatcaccacttggataa

SEQ ID NO: 32194 - DNA, 20 bp, Artificial Sequence
  chemically synthesized
cattcgttgggcttttatcc

SEQ ID NO: 32195 - DNA, 20 bp, Artificial Sequence
  chemically synthesized
gtaacaatcaaacattcgtt

SEQ ID NO: 32196 - DNA, 20 bp, Artificial Sequence
  chemically synthesized
tgtaacaatcaaacattcgt

SEQ ID NO: 32197 - DNA, 20 bp, Artificial Sequence
  chemically synthesized
tttgattgttacaaaactat

SEQ ID NO: 32198 - DNA, 20 bp, Artificial Sequence
  chemically synthesized
ttcagagttaatatttccaa

SEQ ID NO: 32199 - DNA, 20 bp, Artificial Sequence
  chemically synthesized
attggaaatattaactctga

SEQ ID NO: 32200 - DNA, 20 bp, Artificial Sequence
  chemically synthesized
ttggaaatattaactctgaa

SEQ ID NO: 32201 - DNA, 20 bp, Artificial Sequence
  chemically synthesized
agtttgcttttcacctttca

SEQ ID NO: 32202 - DNA, 20 bp, Artificial Sequence
  chemically synthesized
gaagtttgcttttcaccttt

SEQ ID NO: 32203 - DNA, 20 bp, Artificial Sequence
  chemically synthesized
tattaactctgaaaggtgaa

SEQ ID NO: 32204 - DNA, 20 bp, Artificial Sequence
  chemically synthesized
gaaaagcaaacttcaacact

SEQ ID NO: 32205 - DNA, 20 bp, Artificial Sequence
  chemically synthesized
tgcaagtgaactaagtgttg

SEQ ID NO: 32206 - DNA, 20 bp, Artificial Sequence
  chemically synthesized
aaaccacttgcaagtgaact

SEQ ID NO: 32207 - DNA, 20 bp, Artificial Sequence
  chemically synthesized
tcaacacttagttcacttgc

SEQ ID NO: 32208 - DNA, 20 bp, Artificial Sequence
  chemically synthesized
acacttagttcacttgcaag

SEQ ID NO: 32209 - DNA, 20 bp, Artificial Sequence
  chemically synthesized
cccaataacaaaccacttgc

SEQ ID NO: 32210 - DNA, 20 bp, Artificial Sequence
  chemically synthesized
acttgcaagtggtttgttat

SEQ ID NO: 32211 - DNA, 20 bp, Artificial Sequence
  chemically synthesized
cttgcaagtggtttgttatt

SEQ ID NO: 32212 - DNA, 20 bp, Artificial Sequence
  chemically synthesized
caagtggtttgttattgggc

SEQ ID NO: 32213 - DNA, 20 bp, Artificial Sequence
  chemically synthesized
tggtttgttattgggctagc

SEQ ID NO: 32214 - DNA, 20 bp, Artificial Sequence
  chemically synthesized
tttgaaattctgtttcttgc

SEQ ID NO: 32215 - DNA, 20 bp, Artificial Sequence
  chemically synthesized
gttattgggctagcaagaaa

SEQ ID NO: 32216 - DNA, 20 bp, Artificial Sequence
  chemically synthesized
tagcaagaaacagaatttca

SEQ ID NO: 32217 - DNA, 20 bp, Artificial Sequence
  chemically synthesized
agcaagaaacagaatttcaa

SEQ ID NO: 32218 - DNA, 20 bp, Artificial Sequence
  chemically synthesized
gcaagaaacagaatttcaaa

SEQ ID NO: 32219 - DNA, 20 bp, Artificial Sequence
  chemically synthesized
caagaaacagaatttcaaag

SEQ ID NO: 32220 - DNA, 20 bp, Artificial Sequence
  chemically synthesized
aagaaacagaatttcaaagg

SEQ ID NO: 32221 - DNA, 20 bp, Artificial Sequence
  chemically synthesized
aacagaatttcaaagggggc

SEQ ID NO: 32222 - DNA, 20 bp, Artificial Sequence
  chemically synthesized
cgtaagtgtgtgatcaattc

SEQ ID NO: 32223 - DNA, 20 bp, Artificial Sequence
  chemically synthesized
taataaaaggaagtcatcgt

SEQ ID NO: 32224 - DNA, 20 bp, Artificial Sequence
  chemically synthesized
aatttttatataataaaagg

SEQ ID NO: 32225 - DNA, 20 bp, Artificial Sequence
  chemically synthesized
tataatttttatataataaa

SEQ ID NO: 32226 - DNA, 20 bp, Artificial Sequence
  chemically synthesized
gtataatttttatataataa

SEQ ID NO: 32227 - DNA, 20 bp, Artificial Sequence
  chemically synthesized
tatataaaaattatacctga

SEQ ID NO: 32228 - DNA, 20 bp, Artificial Sequence
  chemically synthesized
cttttatgaaatcaactttc

SEQ ID NO: 32229 - DNA, 20 bp, Artificial Sequence
  chemically synthesized
tcttttatgaaatcaacttt

SEQ ID NO: 32230 - DNA, 20 bp, Artificial Sequence
  chemically synthesized
cctgaaagttgatttcataa

SEQ ID NO: 32231 - DNA, 20 bp, Artificial Sequence
  chemically synthesized
tgaaagttgatttcataaaa

SEQ ID NO: 32232 - DNA, 20 bp, Artificial Sequence
  chemically synthesized
agttgatttcataaaagaga

SEQ ID NO: 32233 - DNA, 20 bp, Artificial Sequence
  chemically synthesized
agagaaagtttgcaataaat

SEQ ID NO: 32234 - DNA, 20 bp, Artificial Sequence
  chemically synthesized
tttacagttgcaggggattt

SEQ ID NO: 32235 - DNA, 20 bp, Artificial Sequence
  chemically synthesized
acagaattttacagttgcag

SEQ ID NO: 32236 - DNA, 20 bp, Artificial Sequence
  chemically synthesized
aacagaattttacagttgca

SEQ ID NO: 32237 - DNA, 20 bp, Artificial Sequence
  chemically synthesized
taacagaattttacagttgc

SEQ ID NO: 32238 - DNA, 20 bp, Artificial Sequence
  chemically synthesized
ataacagaattttacagttg

SEQ ID NO: 32239 - DNA, 20 bp, Artificial Sequence
  chemically synthesized
tgaattataacagaatttta

SEQ ID NO: 32240 - DNA, 20 bp, Artificial Sequence
  chemically synthesized
cactcaattttgaattataa

SEQ ID NO: 32241 - DNA, 20 bp, Artificial Sequence
  chemically synthesized
ttctgttataattcaaaatt

SEQ ID NO: 32242 - DNA, 20 bp, Artificial Sequence
  chemically synthesized
tcaaaattgagtgatgtcac

SEQ ID NO: 32243 - DNA, 20 bp, Artificial Sequence
  chemically synthesized
ctctcatgacttgtgacatt

SEQ ID NO: 32244 - DNA, 20 bp, Artificial Sequence
  chemically synthesized
tgtcacaagcccaatgtcac

SEQ ID NO: 32245 - DNA, 20 bp, Artificial Sequence
  chemically synthesized
tctctcatgacttgtgacat

SEQ ID NO: 32246 - DNA, 20 bp, Artificial Sequence
  chemically synthesized
agcccaatgtcacaagtcat

SEQ ID NO: 32247 - DNA, 20 bp, Artificial Sequence
  chemically synthesized
cccaatgtcacaagtcatga

SEQ ID NO: 32248 - DNA, 20 bp, Artificial Sequence
  chemically synthesized
cacaagtcatgagagattat

SEQ ID NO: 32249 - DNA, 20 bp, Artificial Sequence
  chemically synthesized
catgagagattatcagtttt

SEQ ID NO: 32250 - DNA, 20 bp, Artificial Sequence
  chemically synthesized
tgagtttatcaccacatcta

SEQ ID NO: 32251 - DNA, 20 bp, Artificial Sequence
  chemically synthesized
ttttctccatactttagatg

SEQ ID NO: 32252 - DNA, 20 bp, Artificial Sequence
  chemically synthesized
ttatcaccacatctaaagta

SEQ ID NO: 32253 - DNA, 20 bp, Artificial Sequence
  chemically synthesized
atcaccacatctaaagtatg

SEQ ID NO: 32254 - DNA, 20 bp, Artificial Sequence
  chemically synthesized
ctaaaattttctccatactt

SEQ ID NO: 32255 - DNA, 20 bp, Artificial Sequence
  chemically synthesized
ctaaagtatggagaaaattt

SEQ ID NO: 32256 - DNA, 20 bp, Artificial Sequence
  chemically synthesized
tgtatatttaatttgtatta

SEQ ID NO: 32257 - DNA, 20 bp, Artificial Sequence
  chemically synthesized
gtatatttaatttgtattaa

SEQ ID NO: 32258 - DNA, 20 bp, Artificial Sequence
  chemically synthesized
atatttaatttgtattaaag

SEQ ID NO: 32259 - DNA, 20 bp, Artificial Sequence
  chemically synthesized
agcaaacatgtattcattga

SEQ ID NO: 32260 - DNA, 20 bp, Artificial Sequence
  chemically synthesized
attcattgatagtccataat

SEQ ID NO: 32261 - DNA, 20 bp, Artificial Sequence
  chemically synthesized
gtttgatgaaaagctaatta

SEQ ID NO: 32262 - DNA, 20 bp, Artificial Sequence
  chemically synthesized
ttgcaaacatgtttgatgaa

SEQ ID NO: 32263 - DNA, 20 bp, Artificial Sequence
  chemically synthesized
atgtttgcaatttctcatta

SEQ ID NO: 32264 - DNA, 20 bp, Artificial Sequence
  chemically synthesized
gtttgcaatttctcattaca

SEQ ID NO: 32265 - DNA, 20 bp, Artificial Sequence
  chemically synthesized
actttcaattactctgtaat

SEQ ID NO: 32266 - DNA, 20 bp, Artificial Sequence
  chemically synthesized
tctcattacagagtaattga

SEQ ID NO: 32267 - DNA, 20 bp, Artificial Sequence
  chemically synthesized
cattacagagtaattgaaag

SEQ ID NO: 32268 - DNA, 20 bp, Artificial Sequence
  chemically synthesized
tacagagtaattgaaagtgg

SEQ ID NO: 32269 - DNA, 20 bp, Artificial Sequence
  chemically synthesized
cagagtaattgaaagtggta

SEQ ID NO: 32270 - DNA, 20 bp, Artificial Sequence
  chemically synthesized
catatttccattttgttgta

SEQ ID NO: 32271 - DNA, 20 bp, Artificial Sequence
  chemically synthesized
gagaatactatacaacaaaa

SEQ ID NO: 32272 - DNA, 20 bp, Artificial Sequence
  chemically synthesized
tatacaacaaaatggaaata

SEQ ID NO: 32273 - DNA, 20 bp, Artificial Sequence
  chemically synthesized
acaaaatggaaatatggcca

SEQ ID NO: 32274 - DNA, 20 bp, Artificial Sequence
  chemically synthesized
tggaaagtaatgtattacca

SEQ ID NO: 32275 - DNA, 20 bp, Artificial Sequence
  chemically synthesized
catggtaatacattactttc

SEQ ID NO: 32276 - DNA, 20 bp, Artificial Sequence
  chemically synthesized
ggtaatacattactttccag

SEQ ID NO: 32277 - DNA, 20 bp, Artificial Sequence
  chemically synthesized
ctttttttttttccactgga

SEQ ID NO: 32278 - DNA, 20 bp, Artificial Sequence
  chemically synthesized
cttgctttttttttttccac

SEQ ID NO: 32279 - DNA, 20 bp, Artificial Sequence
  chemically synthesized
ctttccagtggaaaaaaaaa

SEQ ID NO: 32280 - DNA, 20 bp, Artificial Sequence
  chemically synthesized
ccagtggaaaaaaaaaaagc

SEQ ID NO: 32281 - DNA, 20 bp, Artificial Sequence
  chemically synthesized
aaaaaaaaaaagcaagttat

SEQ ID NO: 32282 - DNA, 20 bp, Artificial Sequence
  chemically synthesized
aaaaaaagcaagttataaga

SEQ ID NO: 32283 - DNA, 20 bp, Artificial Sequence
  chemically synthesized
ctatacatatatttttatag

SEQ ID NO: 32284 - DNA, 20 bp, Artificial Sequence
  chemically synthesized
tttctatacatatattttta

SEQ ID NO: 32285 - DNA, 20 bp, Artificial Sequence
  chemically synthesized
cttctataaaaatatatgta

SEQ ID NO: 32286 - DNA, 20 bp, Artificial Sequence
  chemically synthesized
tataaaaatatatgtataga

SEQ ID NO: 32287 - DNA, 20 bp, Artificial Sequence
  chemically synthesized
tgtatagaaagacatttttg

SEQ ID NO: 32288 - DNA, 20 bp, Artificial Sequence
  chemically synthesized
aaagacatttttgaagatcc

SEQ ID NO: 32289 - DNA, 20 bp, Artificial Sequence
  chemically synthesized
tagctggtgtttaatagtct

SEQ ID NO: 32290 - DNA, 20 bp, Artificial Sequence
  chemically synthesized
ttagctggtgtttaatagtc

SEQ ID NO: 32291 - DNA, 20 bp, Artificial Sequence
  chemically synthesized
tagagttagctggtgtttaa

SEQ ID NO: 32292 - DNA, 20 bp, Artificial Sequence
  chemically synthesized
gatcctagactattaaacac

SEQ ID NO: 32293 - DNA, 20 bp, Artificial Sequence
  chemically synthesized
ccccacttcttagagttagc

SEQ ID NO: 32294 - DNA, 20 bp, Artificial Sequence
  chemically synthesized
attaaacaccagctaactct

SEQ ID NO: 32295 - DNA, 20 bp, Artificial Sequence
  chemically synthesized
gtaaccccacttcttagagt

SEQ ID NO: 32296 - DNA, 20 bp, Artificial Sequence
  chemically synthesized
aaacaccagctaactctaag

SEQ ID NO: 32297 - DNA, 20 bp, Artificial Sequence
  chemically synthesized
caccagctaactctaagaag

SEQ ID NO: 32298 - DNA, 20 bp, Artificial Sequence
  chemically synthesized
attcgtaaccccacttctta

SEQ ID NO: 32299 - DNA, 20 bp, Artificial Sequence
  chemically synthesized
accagctaactctaagaagt

SEQ ID NO: 32300 - DNA, 20 bp, Artificial Sequence
  chemically synthesized
ccagctaactctaagaagtg

SEQ ID NO: 32301 - DNA, 20 bp, Artificial Sequence
  chemically synthesized
tcattcgtaaccccacttct

SEQ ID NO: 32302 - DNA, 20 bp, Artificial Sequence
  chemically synthesized
gacaggctaacaataaagaa

SEQ ID NO: 32303 - DNA, 20 bp, Artificial Sequence
  chemically synthesized
tagacaggctaacaataaag

SEQ ID NO: 32304 - DNA, 20 bp, Artificial Sequence
  chemically synthesized
atttgtctcttctttattgt

SEQ ID NO: 32305 - DNA, 20 bp, Artificial Sequence
  chemically synthesized
atatagacaggctaacaata

SEQ ID NO: 32306 - DNA, 20 bp, Artificial Sequence
  chemically synthesized
tgaagtttaaaaatatagac

SEQ ID NO: 32307 - DNA, 20 bp, Artificial Sequence
  chemically synthesized
ttgaagtttaaaaatataga

SEQ ID NO: 32308 - DNA, 20 bp, Artificial Sequence
  chemically synthesized
atttttgaagtttaaaaata

SEQ ID NO: 32309 - DNA, 20 bp, Artificial Sequence
  chemically synthesized
aatacctattcatatttttg

SEQ ID NO: 32310 - DNA, 20 bp, Artificial Sequence
  chemically synthesized
ttaaacttcaaaaatatgaa

SEQ ID NO: 32311 - DNA, 20 bp, Artificial Sequence
  chemically synthesized
taaacttcaaaaatatgaat

SEQ ID NO: 32312 - DNA, 20 bp, Artificial Sequence
  chemically synthesized
ttttaaaatcattattatta

SEQ ID NO: 32313 - DNA, 20 bp, Artificial Sequence
  chemically synthesized
aataataatgattttaaaat

SEQ ID NO: 32314 - DNA, 20 bp, Artificial Sequence
  chemically synthesized
taataatgattttaaaataa

SEQ ID NO: 32315 - DNA, 20 bp, Artificial Sequence
  chemically synthesized
gtgaattaaaatattacaac

SEQ ID NO: 32316 - DNA, 20 bp, Artificial Sequence
  chemically synthesized
actctaattacagtaatttc

SEQ ID NO: 32317 - DNA, 20 bp, Artificial Sequence
  chemically synthesized
caactagaaattactgtaat

SEQ ID NO: 32318 - DNA, 20 bp, Artificial Sequence
  chemically synthesized
actagaaattactgtaatta

SEQ ID NO: 32319 - DNA, 20 bp, Artificial Sequence
  chemically synthesized
aacatttcctactctaatta

SEQ ID NO: 32320 - DNA, 20 bp, Artificial Sequence
  chemically synthesized
agaaattactgtaattagag

SEQ ID NO: 32321 - DNA, 20 bp, Artificial Sequence
  chemically synthesized
gaaattactgtaattagagt

SEQ ID NO: 32322 - DNA, 20 bp, Artificial Sequence
  chemically synthesized
gtaattagagtaggaaatgt

SEQ ID NO: 32323 - DNA, 20 bp, Artificial Sequence
  chemically synthesized
attagagtaggaaatgttag

SEQ ID NO: 32324 - DNA, 20 bp, Artificial Sequence
  chemically synthesized
agagtaggaaatgttagaag

SEQ ID NO: 32325 - DNA, 20 bp, Artificial Sequence
  chemically synthesized
gagtaggaaatgttagaagt

SEQ ID NO: 32326 - DNA, 20 bp, Artificial Sequence
  chemically synthesized
acctgtggtttacacagatt

SEQ ID NO: 32327 - DNA, 20 bp, Artificial Sequence
  chemically synthesized
atcgtaacctgtggtttaca

SEQ ID NO: 32328 - DNA, 20 bp, Artificial Sequence
  chemically synthesized
ggctaaatctgtgtaaacca

SEQ ID NO: 32329 - DNA, 20 bp, Artificial Sequence
  chemically synthesized
gctaaatctgtgtaaaccac

SEQ ID NO: 32330 - DNA, 20 bp, Artificial Sequence
  chemically synthesized
ggcctcctgatcgtaacctg

SEQ ID NO: 32331 - DNA, 20 bp, Artificial Sequence
  chemically synthesized
tgtaaaccacaggttacgat

SEQ ID NO: 32332 - DNA, 20 bp, Artificial Sequence
  chemically synthesized
gtaaaccacaggttacgatc

SEQ ID NO: 32333 - DNA, 20 bp, Artificial Sequence
  chemically synthesized
aaaccacaggttacgatcag

SEQ ID NO: 32334 - DNA, 20 bp, Artificial Sequence
  chemically synthesized
aaccacaggttacgatcagg

SEQ ID NO: 32335 - DNA, 20 bp, Artificial Sequence
  chemically synthesized
ggttacgatcaggaggccca

SEQ ID NO: 32336 - DNA, 20 bp, Artificial Sequence
  chemically synthesized
gctaatttaaattagtctgt

SEQ ID NO: 32337 - DNA, 20 bp, Artificial Sequence
  chemically synthesized
agctaatttaaattagtctg

SEQ ID NO: 32338 - DNA, 20 bp, Artificial Sequence
  chemically synthesized
cacaaagagctaatttaaat

SEQ ID NO: 32339 - DNA, 20 bp, Artificial Sequence
  chemically synthesized
gcccacagactaatttaaat

SEQ ID NO: 32340 - DNA, 20 bp, Artificial Sequence
  chemically synthesized
taatttaaattagctctttg

SEQ ID NO: 32341 - DNA, 20 bp, Artificial Sequence
  chemically synthesized
actagaaatctgtccacaaa

SEQ ID NO: 32342 - DNA, 20 bp, Artificial Sequence
  chemically synthesized
ttaaattagctctttgtgga

SEQ ID NO: 32343 - DNA, 20 bp, Artificial Sequence
  chemically synthesized
aaactagaaatctgtccaca

SEQ ID NO: 32344 - DNA, 20 bp, Artificial Sequence
  chemically synthesized
gctctttgtggacagatttc

SEQ ID NO: 32345 - DNA, 20 bp, Artificial Sequence
  chemically synthesized
tgattgtacaagagaaaaac

SEQ ID NO: 32346 - DNA, 20 bp, Artificial Sequence
  chemically synthesized
caggacccctgattgtacaa

SEQ ID NO: 32347 - DNA, 20 bp, Artificial Sequence
  chemically synthesized
tagtttttctcttgtacaat

SEQ ID NO: 32348 - DNA, 20 bp, Artificial Sequence
  chemically synthesized
cccaggacccctgattgtac

SEQ ID NO: 32349 - DNA, 20 bp, Artificial Sequence
  chemically synthesized
agtttttctcttgtacaatc

SEQ ID NO: 32350 - DNA, 20 bp, Artificial Sequence
  chemically synthesized
gtttttctcttgtacaatca

SEQ ID NO: 32351 - DNA, 20 bp, Artificial Sequence
  chemically synthesized
tttttctcttgtacaatcag

SEQ ID NO: 32352 - DNA, 20 bp, Artificial Sequence
  chemically synthesized
tcttgtacaatcaggggtcc

SEQ ID NO: 32353 - DNA, 20 bp, Artificial Sequence
  chemically synthesized
cttgtacaatcaggggtcct

SEQ ID NO: 32354 - DNA, 20 bp, Artificial Sequence
  chemically synthesized
tgtacaatcaggggtcctgg

SEQ ID NO: 32355 - DNA, 20 bp, Artificial Sequence
  chemically synthesized
ctttctatcccagtactccc

SEQ ID NO: 32356 - DNA, 20 bp, Artificial Sequence
  chemically synthesized
atcaggggtcctgggagtac

SEQ ID NO: 32357 - DNA, 20 bp, Artificial Sequence
  chemically synthesized
tctttctatcccagtactcc

SEQ ID NO: 32358 - DNA, 20 bp, Artificial Sequence
  chemically synthesized
tcaggggtcctgggagtact

SEQ ID NO: 32359 - DNA, 20 bp, Artificial Sequence
  chemically synthesized
gggtcctgggagtactggga

SEQ ID NO: 32360 - DNA, 20 bp, Artificial Sequence
  chemically synthesized
cctgggagtactgggataga

SEQ ID NO: 32361 - DNA, 20 bp, Artificial Sequence
  chemically synthesized
gcaagctggtctttctatcc

SEQ ID NO: 32362 - DNA, 20 bp, Artificial Sequence
  chemically synthesized
gagtactgggatagaaagac

SEQ ID NO: 32363 - DNA, 20 bp, Artificial Sequence
  chemically synthesized
gatagaaagaccagcttgcc

SEQ ID NO: 32364 - DNA, 20 bp, Artificial Sequence
  chemically synthesized
agcagctgtcctgggcaagc

SEQ ID NO: 32365 - DNA, 20 bp, Artificial Sequence
  chemically synthesized
atagaaagaccagcttgccc

SEQ ID NO: 32366 - DNA, 20 bp, Artificial Sequence
  chemically synthesized
gggcagcagctgtcctgggc

SEQ ID NO: 32367 - DNA, 20 bp, Artificial Sequence
  chemically synthesized
aaagaccagcttgcccagga

SEQ ID NO: 32368 - DNA, 20 bp, Artificial Sequence
  chemically synthesized
aagtgggcagcagctgtcct

SEQ ID NO: 32369 - DNA, 20 bp, Artificial Sequence
  chemically synthesized
gaagtgggcagcagctgtcc

SEQ ID NO: 32370 - DNA, 20 bp, Artificial Sequence
  chemically synthesized
gcttcatctgaagtgggcag

SEQ ID NO: 32371 - DNA, 20 bp, Artificial Sequence
  chemically synthesized
aggacagctgctgcccactt

SEQ ID NO: 32372 - DNA, 20 bp, Artificial Sequence
  chemically synthesized
aaggcttcatctgaagtggg

SEQ ID NO: 32373 - DNA, 20 bp, Artificial Sequence
  chemically synthesized
gaaaaggcttcatctgaagt

SEQ ID NO: 32374 - DNA, 20 bp, Artificial Sequence
  chemically synthesized
tgaaaaggcttcatctgaag

SEQ ID NO: 32375 - DNA, 20 bp, Artificial Sequence
  chemically synthesized
gctgctgcccacttcagatg

SEQ ID NO: 32376 - DNA, 20 bp, Artificial Sequence
  chemically synthesized
gaatgaaaaggcttcatctg

SEQ ID NO: 32377 - DNA, 20 bp, Artificial Sequence
  chemically synthesized
tggcaaatgagagaatgaaa

SEQ ID NO: 32378 - DNA, 20 bp, Artificial Sequence
  chemically synthesized
ttggcaaatgagagaatgaa

SEQ ID NO: 32379 - DNA, 20 bp, Artificial Sequence
  chemically synthesized
gcttatcttttggcaaatga

SEQ ID NO: 32380 - DNA, 20 bp, Artificial Sequence
  chemically synthesized
atgcttatcttttggcaaat

SEQ ID NO: 32381 - DNA, 20 bp, Artificial Sequence
  chemically synthesized
ttcattctctcatttgccaa

SEQ ID NO: 32382 - DNA, 20 bp, Artificial Sequence
  chemically synthesized
tctctcatttgccaaaagat

SEQ ID NO: 32383 - DNA, 20 bp, Artificial Sequence
  chemically synthesized
aaacgtgaatgcttatcttt

SEQ ID NO: 32384 - DNA, 20 bp, Artificial Sequence
  chemically synthesized
gcattcacgttttccacctg

SEQ ID NO: 32385 - DNA, 20 bp, Artificial Sequence
  chemically synthesized
tggactgtttataccacagg

SEQ ID NO: 32386 - DNA, 20 bp, Artificial Sequence
  chemically synthesized
ttgtggactgtttataccac

SEQ ID NO: 32387 - DNA, 20 bp, Artificial Sequence
  chemically synthesized
attgtggactgtttatacca

SEQ ID NO: 32388 - DNA, 20 bp, Artificial Sequence
  chemically synthesized
ttttccacctgtggtataaa

SEQ ID NO: 32389 - DNA, 20 bp, Artificial Sequence
  chemically synthesized
tataaacagtccacaattat

SEQ ID NO: 32390 - DNA, 20 bp, Artificial Sequence
  chemically synthesized
atgtttttggcttataattg

SEQ ID NO: 32391 - DNA, 20 bp, Artificial Sequence
  chemically synthesized
cagcccctacagaatgtttt

SEQ ID NO: 32392 - DNA, 20 bp, Artificial Sequence
  chemically synthesized
tataagccaaaaacattctg

SEQ ID NO: 32393 - DNA, 20 bp, Artificial Sequence
  chemically synthesized
ataagccaaaaacattctgt

SEQ ID NO: 32394 - DNA, 20 bp, Artificial Sequence
  chemically synthesized
taagccaaaaacattctgta

SEQ ID NO: 32395 - DNA, 20 bp, Artificial Sequence
  chemically synthesized
aagccaaaaacattctgtag

SEQ ID NO: 32396 - DNA, 20 bp, Artificial Sequence
  chemically synthesized
caaaaacattctgtaggggc

SEQ ID NO: 32397 - DNA, 20 bp, Artificial Sequence
  chemically synthesized
tgctacatttccagccccta

SEQ ID NO: 32398 - DNA, 20 bp, Artificial Sequence
  chemically synthesized
ttctgtaggggctggaaatg

SEQ ID NO: 32399 - DNA, 20 bp, Artificial Sequence
  chemically synthesized
attttcaagtgctacatttc

SEQ ID NO: 32400 - DNA, 20 bp, Artificial Sequence
  chemically synthesized
gaaatgtagcacttgaaaat

SEQ ID NO: 32401 - DNA, 20 bp, Artificial Sequence
  chemically synthesized
attgggatcagctaattttc

SEQ ID NO: 32402 - DNA, 20 bp, Artificial Sequence
  chemically synthesized
attttaaataaaattgggat

SEQ ID NO: 32403 - DNA, 20 bp, Artificial Sequence
  chemically synthesized
ttaaaattttaaataaaatt

SEQ ID NO: 32404 - DNA, 20 bp, Artificial Sequence
  chemically synthesized
tttaaaattttaaataaaat

SEQ ID NO: 32405 - DNA, 20 bp, Artificial Sequence
  chemically synthesized
aacgtttacacacttataac

SEQ ID NO: 32406 - DNA, 20 bp, Artificial Sequence
  chemically synthesized
tgtcatttcagtctggttat

SEQ ID NO: 32407 - DNA, 20 bp, Artificial Sequence
  chemically synthesized
aatattatgtcatttcagtc

SEQ ID NO: 32408 - DNA, 20 bp, Artificial Sequence
  chemically synthesized
cgagtaatattatgtcattt

SEQ ID NO: 32409 - DNA, 20 bp, Artificial Sequence
  chemically synthesized
agagagatccaatacatttc

SEQ ID NO: 32410 - DNA, 20 bp, Artificial Sequence
  chemically synthesized
taatattactcgaaatgtat

SEQ ID NO: 32411 - DNA, 20 bp, Artificial Sequence
  chemically synthesized
cgaaatgtattggatctctc

SEQ ID NO: 32412 - DNA, 20 bp, Artificial Sequence
  chemically synthesized
atgtattggatctctctggc

SEQ ID NO: 32413 - DNA, 20 bp, Artificial Sequence
  chemically synthesized
agtcacttatactagccaga

SEQ ID NO: 32414 - DNA, 20 bp, Artificial Sequence
  chemically synthesized
aaagtcacttatactagcca

SEQ ID NO: 32415 - DNA, 20 bp, Artificial Sequence
  chemically synthesized
acaaagtcacttatactagc

SEQ ID NO: 32416 - DNA, 20 bp, Artificial Sequence
  chemically synthesized
tggatctctctggctagtat

SEQ ID NO: 32417 - DNA, 20 bp, Artificial Sequence
  chemically synthesized
aaaaacaaagtcacttatac

SEQ ID NO: 32418 - DNA, 20 bp, Artificial Sequence
  chemically synthesized
aacatgaaaaaggaaaaaca

SEQ ID NO: 32419 - DNA, 20 bp, Artificial Sequence
  chemically synthesized
gtaaataaaaaacatgaaaa

SEQ ID NO: 32420 - DNA, 20 bp, Artificial Sequence
  chemically synthesized
tgtaaataaaaaacatgaaa

SEQ ID NO: 32421 - DNA, 20 bp, Artificial Sequence
  chemically synthesized
tgttttttatttacattttt

SEQ ID NO: 32422 - DNA, 20 bp, Artificial Sequence
  chemically synthesized
gttttttatttacatttttc

SEQ ID NO: 32423 - DNA, 20 bp, Artificial Sequence
  chemically synthesized
tttacatttttcaggttttc

SEQ ID NO: 32424 - DNA, 20 bp, Artificial Sequence
  chemically synthesized
acatttttcaggttttctag

SEQ ID NO: 32425 - DNA, 20 bp, Artificial Sequence
  chemically synthesized
ataaatgattaaatgtcttc

SEQ ID NO: 32426 - DNA, 20 bp, Artificial Sequence
  chemically synthesized
gacatttaatcatttataat

SEQ ID NO: 32427 - DNA, 20 bp, Artificial Sequence
  chemically synthesized
tgtttaataaaaccattttt

SEQ ID NO: 32428 - DNA, 20 bp, Artificial Sequence
  chemically synthesized
aagagatattagccaaaaaa

SEQ ID NO: 32429 - DNA, 20 bp, Artificial Sequence
  chemically synthesized
aaggactagagaagagatat

SEQ ID NO: 32430 - DNA, 20 bp, Artificial Sequence
  chemically synthesized
tttggctaatatctcttctc

SEQ ID NO: 32431 - DNA, 20 bp, Artificial Sequence
  chemically synthesized
agacaccaaggactagagaa

SEQ ID NO: 32432 - DNA, 20 bp, Artificial Sequence
  chemically synthesized
agagacaccaaggactagag

SEQ ID NO: 32433 - DNA, 20 bp, Artificial Sequence
  chemically synthesized
aatatctcttctctagtcct

SEQ ID NO: 32434 - DNA, 20 bp, Artificial Sequence
  chemically synthesized
tatagagacaccaaggacta

SEQ ID NO: 32435 - DNA, 20 bp, Artificial Sequence
  chemically synthesized
gctatagagacaccaaggac

SEQ ID NO: 32436 - DNA, 20 bp, Artificial Sequence
  chemically synthesized
ttgcagctatagagacacca

SEQ ID NO: 32437 - DNA, 20 bp, Artificial Sequence
  chemically synthesized
attgcagctatagagacacc

SEQ ID NO: 32438 - DNA, 20 bp, Artificial Sequence
  chemically synthesized
tctagtccttggtgtctcta

SEQ ID NO: 32439 - DNA, 20 bp, Artificial Sequence
  chemically synthesized
caaaatgaattgcagctata

SEQ ID NO: 32440 - DNA, 20 bp, Artificial Sequence
  chemically synthesized
cacaaaatgaattgcagcta

SEQ ID NO: 32441 - DNA, 20 bp, Artificial Sequence
  chemically synthesized
gattctcacaaaatgaattg

SEQ ID NO: 32442 - DNA, 20 bp, Artificial Sequence
  chemically synthesized
atagctgcaattcattttgt

SEQ ID NO: 32443 - DNA, 20 bp, Artificial Sequence
  chemically synthesized
ctattactgcttttgtgtca

SEQ ID NO: 32444 - DNA, 20 bp, Artificial Sequence
  chemically synthesized
tgtgagaatctatgacacaa

SEQ ID NO: 32445 - DNA, 20 bp, Artificial Sequence
  chemically synthesized
gagaatctatgacacaaaag

SEQ ID NO: 32446 - DNA, 20 bp, Artificial Sequence
  chemically synthesized
ctatgacacaaaagcagtaa

SEQ ID NO: 32447 - DNA, 20 bp, Artificial Sequence
  chemically synthesized
tgtgtgtgtcagggggtacg

SEQ ID NO: 32448 - DNA, 20 bp, Artificial Sequence
  chemically synthesized
tggggtgtgtgtgtgtcagg

SEQ ID NO: 32449 - DNA, 20 bp, Artificial Sequence
  chemically synthesized
gtggggtgtgtgtgtgtcag

SEQ ID NO: 32450 - DNA, 20 bp, Artificial Sequence
  chemically synthesized
agtggggtgtgtgtgtgtca

SEQ ID NO: 32451 - DNA, 20 bp, Artificial Sequence
  chemically synthesized
aagtggggtgtgtgtgtgtc

SEQ ID NO: 32452 - DNA, 20 bp, Artificial Sequence
  chemically synthesized
taagtggggtgtgtgtgtgt

SEQ ID NO: 32453 - DNA, 20 bp, Artificial Sequence
  chemically synthesized
tgtgtaggtatacgtaagtg

SEQ ID NO: 32454 - DNA, 20 bp, Artificial Sequence
  chemically synthesized
ctgtgtaggtatacgtaagt

SEQ ID NO: 32455 - DNA, 20 bp, Artificial Sequence
  chemically synthesized
tctgtgtaggtatacgtaag

SEQ ID NO: 32456 - DNA, 20 bp, Artificial Sequence
  chemically synthesized
aattctgtgtaggtatacgt

SEQ ID NO: 32457 - DNA, 20 bp, Artificial Sequence
  chemically synthesized
cccacttacgtatacctaca

SEQ ID NO: 32458 - DNA, 20 bp, Artificial Sequence
  chemically synthesized
cttaaacataaattctgtgt

SEQ ID NO: 32459 - DNA, 20 bp, Artificial Sequence
  chemically synthesized
acttaaacataaattctgtg

SEQ ID NO: 32460 - DNA, 20 bp, Artificial Sequence
  chemically synthesized
cctacacagaatttatgttt

SEQ ID NO: 32461 - DNA, 20 bp, Artificial Sequence
  chemically synthesized
gatgaacactgtgggaatca

SEQ ID NO: 32462 - DNA, 20 bp, Artificial Sequence
  chemically synthesized
tgatgaacactgtgggaatc

SEQ ID NO: 32463 - DNA, 20 bp, Artificial Sequence
  chemically synthesized
tttaagtaccctgattccca

SEQ ID NO: 32464 - DNA, 20 bp, Artificial Sequence
  chemically synthesized
gtgatgaacactgtgggaat

SEQ ID NO: 32465 - DNA, 20 bp, Artificial Sequence
  chemically synthesized
ggttatgtgatgaacactgt

SEQ ID NO: 32466 - DNA, 20 bp, Artificial Sequence
  chemically synthesized
aggttatgtgatgaacactg

SEQ ID NO: 32467 - DNA, 20 bp, Artificial Sequence
  chemically synthesized
aggcgatctctttggattta

SEQ ID NO: 32468 - DNA, 20 bp, Artificial Sequence
  chemically synthesized
atcacataaccttaaatcca

SEQ ID NO: 32469 - DNA, 20 bp, Artificial Sequence
  chemically synthesized
aaggcgatctctttggattt

SEQ ID NO: 32470 - DNA, 20 bp, Artificial Sequence
  chemically synthesized
cacataaccttaaatccaaa

SEQ ID NO: 32471 - DNA, 20 bp, Artificial Sequence
  chemically synthesized
aacacataaggcgatctctt

SEQ ID NO: 32472 - DNA, 20 bp, Artificial Sequence
  chemically synthesized
tattgatagaaaaacacata

SEQ ID NO: 32473 - DNA, 20 bp, Artificial Sequence
  chemically synthesized
atattgatagaaaaacacat

SEQ ID NO: 32474 - DNA, 20 bp, Artificial Sequence
  chemically synthesized
tctgtgaatggacatattga

SEQ ID NO: 32475 - DNA, 20 bp, Artificial Sequence
  chemically synthesized
tctatcaatatgtccattca

SEQ ID NO: 32476 - DNA, 20 bp, Artificial Sequence
  chemically synthesized
caagcctgcatttctgtgaa

SEQ ID NO: 32477 - DNA, 20 bp, Artificial Sequence
  chemically synthesized
tatgtccattcacagaaatg

SEQ ID NO: 32478 - DNA, 20 bp, Artificial Sequence
  chemically synthesized
atgtccattcacagaaatgc

SEQ ID NO: 32479 - DNA, 20 bp, Artificial Sequence
  chemically synthesized
acagaaatgcaggcttgaaa

SEQ ID NO: 32480 - DNA, 20 bp, Artificial Sequence
  chemically synthesized
gaaatgcaggcttgaaaaag

SEQ ID NO: 32481 - DNA, 20 bp, Artificial Sequence
  chemically synthesized
catgtcttttctactttttc

SEQ ID NO: 32482 - DNA, 20 bp, Artificial Sequence
  chemically synthesized
gcaggcttgaaaaagtagaa

SEQ ID NO: 32483 - DNA, 20 bp, Artificial Sequence
  chemically synthesized
taaaaaaatacataaaaaca

SEQ ID NO: 32484 - DNA, 20 bp, Artificial Sequence
  chemically synthesized
aaatacataaaaacacagcc

SEQ ID NO: 32485 - DNA, 20 bp, Artificial Sequence
  chemically synthesized
aatacataaaaacacagcct

SEQ ID NO: 32486 - DNA, 20 bp, Artificial Sequence
  chemically synthesized
tgggtctcactatgttgccc

SEQ ID NO: 32487 - DNA, 20 bp, Artificial Sequence
  chemically synthesized
aaaacacagcctgggcaaca

SEQ ID NO: 32488 - DNA, 20 bp, Artificial Sequence
  chemically synthesized
atgggtctcactatgttgcc

SEQ ID NO: 32489 - DNA, 20 bp, Artificial Sequence
  chemically synthesized
cacagcctgggcaacatagt

SEQ ID NO: 32490 - DNA, 20 bp, Artificial Sequence
  chemically synthesized
ttatttatttttgtagagat

SEQ ID NO: 32491 - DNA, 20 bp, Artificial Sequence
  chemically synthesized
tttatttatttttgtagaga

SEQ ID NO: 32492 - DNA, 20 bp, Artificial Sequence
  chemically synthesized
tatttttatttatttttgta

SEQ ID NO: 32493 - DNA, 20 bp, Artificial Sequence
  chemically synthesized
tttatttttatttatttttg

SEQ ID NO: 32494 - DNA, 20 bp, Artificial Sequence
  chemically synthesized
taaaaataaattttaaaaat

SEQ ID NO: 32495 - DNA, 20 bp, Artificial Sequence
  chemically synthesized
aataaattttaaaaatgagc

SEQ ID NO: 32496 - DNA, 20 bp, Artificial Sequence
  chemically synthesized
ataaattttaaaaatgagct

SEQ ID NO: 32497 - DNA, 20 bp, Artificial Sequence
  chemically synthesized
ttttaaaaatgagctgggtg

SEQ ID NO: 32498 - DNA, 20 bp, Artificial Sequence
  chemically synthesized
taaaaatgagctgggtgtgg

SEQ ID NO: 32499 - DNA, 20 bp, Artificial Sequence
  chemically synthesized
caggaatgcaccaccacacc

SEQ ID NO: 32500 - DNA, 20 bp, Artificial Sequence
  chemically synthesized
gtggtgcattcctgttgtcc

SEQ ID NO: 32501 - DNA, 20 bp, Artificial Sequence
  chemically synthesized
tcctgagtagctgggacaac

SEQ ID NO: 32502 - DNA, 20 bp, Artificial Sequence
  chemically synthesized
ctcctgagtagctgggacaa

SEQ ID NO: 32503 - DNA, 20 bp, Artificial Sequence
  chemically synthesized
ttcctgttgtcccagctact

SEQ ID NO: 32504 - DNA, 20 bp, Artificial Sequence
  chemically synthesized
cctcagcctcctgagtagct

SEQ ID NO: 32505 - DNA, 20 bp, Artificial Sequence
  chemically synthesized
tcctgttgtcccagctactc

SEQ ID NO: 32506 - DNA, 20 bp, Artificial Sequence
  chemically synthesized
gcctcagcctcctgagtagc

SEQ ID NO: 32507 - DNA, 20 bp, Artificial Sequence
  chemically synthesized
ctgttgtcccagctactcag

SEQ ID NO: 32508 - DNA, 20 bp, Artificial Sequence
  chemically synthesized
tgttgtcccagctactcagg

SEQ ID NO: 32509 - DNA, 20 bp, Artificial Sequence
  chemically synthesized
ttctgcctcagcctcctgag

SEQ ID NO: 32510 - DNA, 20 bp, Artificial Sequence
  chemically synthesized
ttcttctgcctcagcctcct

SEQ ID NO: 32511 - DNA, 20 bp, Artificial Sequence
  chemically synthesized
tcccagctactcaggaggct

SEQ ID NO: 32512 - DNA, 20 bp, Artificial Sequence
  chemically synthesized
cccagctactcaggaggctg

SEQ ID NO: 32513 - DNA, 20 bp, Artificial Sequence
  chemically synthesized
agctactcaggaggctgagg

SEQ ID NO: 32514 - DNA, 20 bp, Artificial Sequence
  chemically synthesized
tactcaggaggctgaggcag

SEQ ID NO: 32515 - DNA, 20 bp, Artificial Sequence
  chemically synthesized
tcatggcggttcttctgcct

SEQ ID NO: 32516 - DNA, 20 bp, Artificial Sequence
  chemically synthesized
tgaggcagaagaaccgccat

SEQ ID NO: 32517 - DNA, 20 bp, Artificial Sequence
  chemically synthesized
tcgaacccctgggctcatgg

SEQ ID NO: 32518 - DNA, 20 bp, Artificial Sequence
  chemically synthesized
cagaagaaccgccatgagcc

SEQ ID NO: 32519 - DNA, 20 bp, Artificial Sequence
  chemically synthesized
agaagaaccgccatgagccc

SEQ ID NO: 32520 - DNA, 20 bp, Artificial Sequence
  chemically synthesized
gcctcgaacccctgggctca

SEQ ID NO: 32521 - DNA, 20 bp, Artificial Sequence
  chemically synthesized
gaagaaccgccatgagccca

SEQ ID NO: 32522 - DNA, 20 bp, Artificial Sequence
  chemically synthesized
aagaaccgccatgagcccag

SEQ ID NO: 32523 - DNA, 20 bp, Artificial Sequence
  chemically synthesized
tattgcagcctcgaacccct

SEQ ID NO: 32524 - DNA, 20 bp, Artificial Sequence
  chemically synthesized
cgccatgagcccaggggttc

SEQ ID NO: 32525 - DNA, 20 bp, Artificial Sequence
  chemically synthesized
ttattgcagcctcgaacccc

SEQ ID NO: 32526 - DNA, 20 bp, Artificial Sequence
  chemically synthesized
gccatgagcccaggggttcg

SEQ ID NO: 32527 - DNA, 20 bp, Artificial Sequence
  chemically synthesized
caggggttcgaggctgcaat

SEQ ID NO: 32528 - DNA, 20 bp, Artificial Sequence
  chemically synthesized
ggtgcggttatagcttattg

SEQ ID NO: 32529 - DNA, 20 bp, Artificial Sequence
  chemically synthesized
ggagtgcagtggtgcggtta

SEQ ID NO: 32530 - DNA, 20 bp, Artificial Sequence
  chemically synthesized
caggctggagtgcagtggtg

SEQ ID NO: 32531 - DNA, 20 bp, Artificial Sequence
  chemically synthesized
tctcccaggctggagtgcag

SEQ ID NO: 32532 - DNA, 20 bp, Artificial Sequence
  chemically synthesized
ataaccgcaccactgcactc

SEQ ID NO: 32533 - DNA, 20 bp, Artificial Sequence
  chemically synthesized
ctgtctcccaggctggagtg

SEQ ID NO: 32534 - DNA, 20 bp, Artificial Sequence
  chemically synthesized
cgcaccactgcactccagcc

SEQ ID NO: 32535 - DNA, 20 bp, Artificial Sequence
  chemically synthesized
gcaccactgcactccagcct

SEQ ID NO: 32536 - DNA, 20 bp, Artificial Sequence
  chemically synthesized
ttgctctgtctcccaggctg

SEQ ID NO: 32537 - DNA, 20 bp, Artificial Sequence
  chemically synthesized
accactgcactccagcctgg

SEQ ID NO: 32538 - DNA, 20 bp, Artificial Sequence
  chemically synthesized
tcttgctctgtctcccaggc

SEQ ID NO: 32539 - DNA, 20 bp, Artificial Sequence
  chemically synthesized
ctgcactccagcctgggaga

SEQ ID NO: 32540 - DNA, 20 bp, Artificial Sequence
  chemically synthesized
agggtcttgctctgtctccc

SEQ ID NO: 32541 - DNA, 20 bp, Artificial Sequence
  chemically synthesized
gcactccagcctgggagaca

SEQ ID NO: 32542 - DNA, 20 bp, Artificial Sequence
  chemically synthesized
cagggtcttgctctgtctcc

SEQ ID NO: 32543 - DNA, 20 bp, Artificial Sequence
  chemically synthesized
tccagcctgggagacagagc

SEQ ID NO: 32544 - DNA, 20 bp, Artificial Sequence
  chemically synthesized
ttgggttttgttttgggaca

SEQ ID NO: 32545 - DNA, 20 bp, Artificial Sequence
  chemically synthesized
tttgggttttgttttgggac

SEQ ID NO: 32546 - DNA, 20 bp, Artificial Sequence
  chemically synthesized
ttttgggttttgttttggga

SEQ ID NO: 32547 - DNA, 20 bp, Artificial Sequence
  chemically synthesized
cttgttttgggttttgtttt

SEQ ID NO: 32548 - DNA, 20 bp, Artificial Sequence
  chemically synthesized
gcttgttttgggttttgttt

SEQ ID NO: 32549 - DNA, 20 bp, Artificial Sequence
  chemically synthesized
cccaaaacaaaacccaaaac

SEQ ID NO: 32550 - DNA, 20 bp, Artificial Sequence
  chemically synthesized
cttaagttgcagcttgtttt

SEQ ID NO: 32551 - DNA, 20 bp, Artificial Sequence
  chemically synthesized
tcttaagttgcagcttgttt

SEQ ID NO: 32552 - DNA, 20 bp, Artificial Sequence
  chemically synthesized
cccaaaacaagctgcaactt

SEQ ID NO: 32553 - DNA, 20 bp, Artificial Sequence
  chemically synthesized
aaatgagttatcttaagttg

SEQ ID NO: 32554 - DNA, 20 bp, Artificial Sequence
  chemically synthesized
attctgaaatgagttatctt

SEQ ID NO: 32555 - DNA, 20 bp, Artificial Sequence
  chemically synthesized
caacttaagataactcattt

SEQ ID NO: 32556 - DNA, 20 bp, Artificial Sequence
  chemically synthesized
tacaaggaatattctgaaat

SEQ ID NO: 32557 - DNA, 20 bp, Artificial Sequence
  chemically synthesized
tcatttcagaatattccttg

SEQ ID NO: 32558 - DNA, 20 bp, Artificial Sequence
  chemically synthesized
tttgtcgttttagatctaca

SEQ ID NO: 32559 - DNA, 20 bp, Artificial Sequence
  chemically synthesized
gtttgtcgttttagatctac

SEQ ID NO: 32560 - DNA, 20 bp, Artificial Sequence
  chemically synthesized
agatgtctggtttgtcgttt

SEQ ID NO: 32561 - DNA, 20 bp, Artificial Sequence
  chemically synthesized
gtagatctaaaacgacaaac

SEQ ID NO: 32562 - DNA, 20 bp, Artificial Sequence
  chemically synthesized
aaaacgacaaaccagacatc

SEQ ID NO: 32563 - DNA, 20 bp, Artificial Sequence
  chemically synthesized
tggacaaatgtccagatgtc

SEQ ID NO: 32564 - DNA, 20 bp, Artificial Sequence
  chemically synthesized
ttttacactggacaaatgtc

SEQ ID NO: 32565 - DNA, 20 bp, Artificial Sequence
  chemically synthesized
cagacatctggacatttgtc

SEQ ID NO: 32566 - DNA, 20 bp, Artificial Sequence
  chemically synthesized
ggacatttgtccagtgtaaa

SEQ ID NO: 32567 - DNA, 20 bp, Artificial Sequence
  chemically synthesized
aaacaccagtctttttacac

SEQ ID NO: 32568 - DNA, 20 bp, Artificial Sequence
  chemically synthesized
tttgtccagtgtaaaaagac

SEQ ID NO: 32569 - DNA, 20 bp, Artificial Sequence
  chemically synthesized
aaataagggtttgaaaacac

SEQ ID NO: 32570 - DNA, 20 bp, Artificial Sequence
  chemically synthesized
ggtacagagcatacaaataa

SEQ ID NO: 32571 - DNA, 20 bp, Artificial Sequence
  chemically synthesized
gggtacagagcatacaaata

SEQ ID NO: 32572 - DNA, 20 bp, Artificial Sequence
  chemically synthesized
tgggtacagagcatacaaat

SEQ ID NO: 32573 - DNA, 20 bp, Artificial Sequence
  chemically synthesized
aattattttgaatgggtaca

SEQ ID NO: 32574 - DNA, 20 bp, Artificial Sequence
  chemically synthesized
tgaattattttgaatgggta

SEQ ID NO: 32575 - DNA, 20 bp, Artificial Sequence
  chemically synthesized
taacttgaattattttgaat

SEQ ID NO: 32576 - DNA, 20 bp, Artificial Sequence
  chemically synthesized
ataacttgaattattttgaa

SEQ ID NO: 32577 - DNA, 20 bp, Artificial Sequence
  chemically synthesized
gtacccattcaaaataattc

SEQ ID NO: 32578 - DNA, 20 bp, Artificial Sequence
  chemically synthesized
ttcaaaataattcaagttat

SEQ ID NO: 32579 - DNA, 20 bp, Artificial Sequence
  chemically synthesized
tcaaaataattcaagttatg

SEQ ID NO: 32580 - DNA, 20 bp, Artificial Sequence
  chemically synthesized
caaaataattcaagttatga

SEQ ID NO: 32581 - DNA, 20 bp, Artificial Sequence
  chemically synthesized
aaaataattcaagttatgag

SEQ ID NO: 32582 - DNA, 20 bp, Artificial Sequence
  chemically synthesized
taattcaagttatgagggga

SEQ ID NO: 32583 - DNA, 20 bp, Artificial Sequence
  chemically synthesized
agttatgaggggaaagaaaa

SEQ ID NO: 32584 - DNA, 20 bp, Artificial Sequence
  chemically synthesized
gggaaagaaaacagaactgt

SEQ ID NO: 32585 - DNA, 20 bp, Artificial Sequence
  chemically synthesized
ggaaagaaaacagaactgtc

SEQ ID NO: 32586 - DNA, 20 bp, Artificial Sequence
  chemically synthesized
gtgtttatgtaagagcctga

SEQ ID NO: 32587 - DNA, 20 bp, Artificial Sequence
  chemically synthesized
cttgttttgtgtttatgtaa

SEQ ID NO: 32588 - DNA, 20 bp, Artificial Sequence
  chemically synthesized
ggcttgttttgtgtttatgt

SEQ ID NO: 32589 - DNA, 20 bp, Artificial Sequence
  chemically synthesized
ctcttacataaacacaaaac

SEQ ID NO: 32590 - DNA, 20 bp, Artificial Sequence
  chemically synthesized
acacaaaacaagccatacta

SEQ ID NO: 32591 - DNA, 20 bp, Artificial Sequence
  chemically synthesized
tttaaatgatttctttagta

SEQ ID NO: 32592 - DNA, 20 bp, Artificial Sequence
  chemically synthesized
gaacatttaaatgatttctt

SEQ ID NO: 32593 - DNA, 20 bp, Artificial Sequence
  chemically synthesized
tgttcacattaatgacccgc

SEQ ID NO: 32594 - DNA, 20 bp, Artificial Sequence
  chemically synthesized
gttcacattaatgacccgcc

SEQ ID NO: 32595 - DNA, 20 bp, Artificial Sequence
  chemically synthesized
cacaattcctaaggcctggc

SEQ ID NO: 32596 - DNA, 20 bp, Artificial Sequence
  chemically synthesized
tcacaattcctaaggcctgg

SEQ ID NO: 32597 - DNA, 20 bp, Artificial Sequence
  chemically synthesized
attaatgacccgccaggcct

SEQ ID NO: 32598 - DNA, 20 bp, Artificial Sequence
  chemically synthesized
ttaatgacccgccaggcctt

SEQ ID NO: 32599 - DNA, 20 bp, Artificial Sequence
  chemically synthesized
tgctcacaattcctaaggcc

SEQ ID NO: 32600 - DNA, 20 bp, Artificial Sequence
  chemically synthesized
tccggtgctcacaattccta

SEQ ID NO: 32601 - DNA, 20 bp, Artificial Sequence
  chemically synthesized
ttccggtgctcacaattcct

SEQ ID NO: 32602 - DNA, 20 bp, Artificial Sequence
  chemically synthesized
cgccaggccttaggaattgt

SEQ ID NO: 32603 - DNA, 20 bp, Artificial Sequence
  chemically synthesized
gccttaggaattgtgagcac

SEQ ID NO: 32604 - DNA, 20 bp, Artificial Sequence
  chemically synthesized
taggaattgtgagcaccgga

SEQ ID NO: 32605 - DNA, 20 bp, Artificial Sequence
  chemically synthesized
aattgtgagcaccggaaaga

SEQ ID NO: 32606 - DNA, 20 bp, Artificial Sequence
  chemically synthesized
ggaattttctgccgtctttc

SEQ ID NO: 32607 - DNA, 20 bp, Artificial Sequence
  chemically synthesized
tgtgagcaccggaaagacgg

SEQ ID NO: 32608 - DNA, 20 bp, Artificial Sequence
  chemically synthesized
aaaccacaaatgttgtgtaa

SEQ ID NO: 32609 - DNA, 20 bp, Artificial Sequence
  chemically synthesized
caaaccacaaatgttgtgta

SEQ ID NO: 32610 - DNA, 20 bp, Artificial Sequence
  chemically synthesized
attcctttacacaacatttg

SEQ ID NO: 32611 - DNA, 20 bp, Artificial Sequence
  chemically synthesized
tttacacaacatttgtggtt

SEQ ID NO: 32612 - DNA, 20 bp, Artificial Sequence
  chemically synthesized
caacatttgtggtttggcaa

SEQ ID NO: 32613 - DNA, 20 bp, Artificial Sequence
  chemically synthesized
aacatttgtggtttggcaaa

SEQ ID NO: 32614 - DNA, 20 bp, Artificial Sequence
  chemically synthesized
acatttgtggtttggcaaaa

SEQ ID NO: 32615 - DNA, 20 bp, Artificial Sequence
  chemically synthesized
gtttggcaaaagggttgtct

SEQ ID NO: 32616 - DNA, 20 bp, Artificial Sequence
  chemically synthesized
gatttcttccgtgtgaaacc

SEQ ID NO: 32617 - DNA, 20 bp, Artificial Sequence
  chemically synthesized
agggttgtcttggtttcaca

SEQ ID NO: 32618 - DNA, 20 bp, Artificial Sequence
  chemically synthesized
gttgtcttggtttcacacgg

SEQ ID NO: 32619 - DNA, 20 bp, Artificial Sequence
  chemically synthesized
ttcacacggaagaaatcaac

SEQ ID NO: 32620 - DNA, 20 bp, Artificial Sequence
  chemically synthesized
aaatcaacaagcacctgaaa

SEQ ID NO: 32621 - DNA, 20 bp, Artificial Sequence
  chemically synthesized
cgaagatagaaaactgtttc

SEQ ID NO: 32622 - DNA, 20 bp, Artificial Sequence
  chemically synthesized
acgaagatagaaaactgttt

SEQ ID NO: 32623 - DNA, 20 bp, Artificial Sequence
  chemically synthesized
gaaacagttttctatcttcg

SEQ ID NO: 32624 - DNA, 20 bp, Artificial Sequence
  chemically synthesized
aaacagttttctatcttcgt

SEQ ID NO: 32625 - DNA, 20 bp, Artificial Sequence
  chemically synthesized
tttttttcttcccacgaaga

SEQ ID NO: 32626 - DNA, 20 bp, Artificial Sequence
  chemically synthesized
cagttttctatcttcgtggg

SEQ ID NO: 32627 - DNA, 20 bp, Artificial Sequence
  chemically synthesized
tttttttttttcttcccacg

SEQ ID NO: 32628 - DNA, 20 bp, Artificial Sequence
  chemically synthesized
cgtgggaagaaaaaaaaaaa

SEQ ID NO: 32629 - DNA, 20 bp, Artificial Sequence
  chemically synthesized
ggaaaaacagttgcaattta

SEQ ID NO: 32630 - DNA, 20 bp, Artificial Sequence
  chemically synthesized
tgcctaaaatgatggaaaaa

SEQ ID NO: 32631 - DNA, 20 bp, Artificial Sequence
  chemically synthesized
caactgtttttccatcattt

SEQ ID NO: 32632 - DNA, 20 bp, Artificial Sequence
  chemically synthesized
aactgtttttccatcatttt

SEQ ID NO: 32633 - DNA, 20 bp, Artificial Sequence
  chemically synthesized
ctctttggtgcctaaaatga

SEQ ID NO: 32634 - DNA, 20 bp, Artificial Sequence
  chemically synthesized
ttccatcattttaggcacca

SEQ ID NO: 32635 - DNA, 20 bp, Artificial Sequence
  chemically synthesized
ccatcattttaggcaccaaa

SEQ ID NO: 32636 - DNA, 20 bp, Artificial Sequence
  chemically synthesized
taggtctttgtagttctctt

SEQ ID NO: 32637 - DNA, 20 bp, Artificial Sequence
  chemically synthesized
aggcaccaaagagaactaca

SEQ ID NO: 32638 - DNA, 20 bp, Artificial Sequence
  chemically synthesized
agagggcctataggtctttg

SEQ ID NO: 32639 - DNA, 20 bp, Artificial Sequence
  chemically synthesized
aagagaactacaaagaccta

SEQ ID NO: 32640 - DNA, 20 bp, Artificial Sequence
  chemically synthesized
agagaactacaaagacctat

SEQ ID NO: 32641 - DNA, 20 bp, Artificial Sequence
  chemically synthesized
atatacctgagagggcctat

SEQ ID NO: 32642 - DNA, 20 bp, Artificial Sequence
  chemically synthesized
aatatacctgagagggccta

SEQ ID NO: 32643 - DNA, 20 bp, Artificial Sequence
  chemically synthesized
caaagacctataggccctct

SEQ ID NO: 32644 - DNA, 20 bp, Artificial Sequence
  chemically synthesized
aaagacctataggccctctc

SEQ ID NO: 32645 - DNA, 20 bp, Artificial Sequence
  chemically synthesized
aaaattcaatatacctgaga

SEQ ID NO: 32646 - DNA, 20 bp, Artificial Sequence
  chemically synthesized
aaaaattcaatatacctgag

SEQ ID NO: 32647 - DNA, 20 bp, Artificial Sequence
  chemically synthesized
taaaaattcaatatacctga

SEQ ID NO: 32648 - DNA, 20 bp, Artificial Sequence
  chemically synthesized
cctaaaaattcaatatacct

SEQ ID NO: 32649 - DNA, 20 bp, Artificial Sequence
  chemically synthesized
tctcaggtatattgaatttt

SEQ ID NO: 32650 - DNA, 20 bp, Artificial Sequence
  chemically synthesized
ctcaggtatattgaattttt

SEQ ID NO: 32651 - DNA, 20 bp, Artificial Sequence
  chemically synthesized
tccttaaaaacaagttttag

SEQ ID NO: 32652 - DNA, 20 bp, Artificial Sequence
  chemically synthesized
ggttccttaaaaacaagttt

SEQ ID NO: 32653 - DNA, 20 bp, Artificial Sequence
  chemically synthesized
aacttctaaaacttgttttt

SEQ ID NO: 32654 - DNA, 20 bp, Artificial Sequence
  chemically synthesized
acttctaaaacttgttttta

SEQ ID NO: 32655 - DNA, 20 bp, Artificial Sequence
  chemically synthesized
atcagaggttccttaaaaac

SEQ ID NO: 32656 - DNA, 20 bp, Artificial Sequence
  chemically synthesized
gtcagctttctttttatcag

SEQ ID NO: 32657 - DNA, 20 bp, Artificial Sequence
  chemically synthesized
tttaaggaacctctgataaa

SEQ ID NO: 32658 - DNA, 20 bp, Artificial Sequence
  chemically synthesized
agtcagctttctttttatca

SEQ ID NO: 32659 - DNA, 20 bp, Artificial Sequence
  chemically synthesized
acagtcagctttctttttat

SEQ ID NO: 32660 - DNA, 20 bp, Artificial Sequence
  chemically synthesized
aggaacctctgataaaaaga

SEQ ID NO: 32661 - DNA, 20 bp, Artificial Sequence
  chemically synthesized
tcctatccaaaattgacagt

SEQ ID NO: 32662 - DNA, 20 bp, Artificial Sequence
  chemically synthesized
agaaagctgactgtcaattt

SEQ ID NO: 32663 - DNA, 20 bp, Artificial Sequence
  chemically synthesized
accttcctatccaaaattga

SEQ ID NO: 32664 - DNA, 20 bp, Artificial Sequence
  chemically synthesized
agctgactgtcaattttgga

SEQ ID NO: 32665 - DNA, 20 bp, Artificial Sequence
  chemically synthesized
gctgactgtcaattttggat

SEQ ID NO: 32666 - DNA, 20 bp, Artificial Sequence
  chemically synthesized
gactgtcaattttggatagg

SEQ ID NO: 32667 - DNA, 20 bp, Artificial Sequence
  chemically synthesized
actgtcaattttggatagga

SEQ ID NO: 32668 - DNA, 20 bp, Artificial Sequence
  chemically synthesized
tgtttcaagggtgaaagcag

SEQ ID NO: 32669 - DNA, 20 bp, Artificial Sequence
  chemically synthesized
gattgtttcaagggtgaaag

SEQ ID NO: 32670 - DNA, 20 bp, Artificial Sequence
  chemically synthesized
ctagattgtttcaagggtga

SEQ ID NO: 32671 - DNA, 20 bp, Artificial Sequence
  chemically synthesized
acatcactagattgtttcaa

SEQ ID NO: 32672 - DNA, 20 bp, Artificial Sequence
  chemically synthesized
tacatcactagattgtttca

SEQ ID NO: 32673 - DNA, 20 bp, Artificial Sequence
  chemically synthesized
atacatcactagattgtttc

SEQ ID NO: 32674 - DNA, 20 bp, Artificial Sequence
  chemically synthesized
ctttcacccttgaaacaatc

SEQ ID NO: 32675 - DNA, 20 bp, Artificial Sequence
  chemically synthesized
ttgctatataaatacatcac

SEQ ID NO: 32676 - DNA, 20 bp, Artificial Sequence
  chemically synthesized
aatctagtgatgtatttata

SEQ ID NO: 32677 - DNA, 20 bp, Artificial Sequence
  chemically synthesized
tagtgatgtatttatatagc

SEQ ID NO: 32678 - DNA, 20 bp, Artificial Sequence
  chemically synthesized
taaagtagtttgcagtgtga

SEQ ID NO: 32679 - DNA, 20 bp, Artificial Sequence
  chemically synthesized
ctttaggataaagtagtttg

SEQ ID NO: 32680 - DNA, 20 bp, Artificial Sequence
  chemically synthesized
aggtgacctttaggataaag

SEQ ID NO: 32681 - DNA, 20 bp, Artificial Sequence
  chemically synthesized
ctgcaaactactttatccta

SEQ ID NO: 32682 - DNA, 20 bp, Artificial Sequence
  chemically synthesized
gacaggtgacctttaggata

SEQ ID NO: 32683 - DNA, 20 bp, Artificial Sequence
  chemically synthesized
tgcaaactactttatcctaa

SEQ ID NO: 32684 - DNA, 20 bp, Artificial Sequence
  chemically synthesized
ttaaatgacaggtgaccttt

SEQ ID NO: 32685 - DNA, 20 bp, Artificial Sequence
  chemically synthesized
gttaaatgacaggtgacctt

SEQ ID NO: 32686 - DNA, 20 bp, Artificial Sequence
  chemically synthesized
tttcctccaagttaaatgac

SEQ ID NO: 32687 - DNA, 20 bp, Artificial Sequence
  chemically synthesized
gtttcctccaagttaaatga

SEQ ID NO: 32688 - DNA, 20 bp, Artificial Sequence
  chemically synthesized
aggtcacctgtcatttaact

SEQ ID NO: 32689 - DNA, 20 bp, Artificial Sequence
  chemically synthesized
gtcacctgtcatttaacttg

SEQ ID NO: 32690 - DNA, 20 bp, Artificial Sequence
  chemically synthesized
tcacctgtcatttaacttgg

SEQ ID NO: 32691 - DNA, 20 bp, Artificial Sequence
  chemically synthesized
gacatggccatgtttcctcc

SEQ ID NO: 32692 - DNA, 20 bp, Artificial Sequence
  chemically synthesized
catttaacttggaggaaaca

SEQ ID NO: 32693 - DNA, 20 bp, Artificial Sequence
  chemically synthesized
ccagtctttaggtaaggaca

SEQ ID NO: 32694 - DNA, 20 bp, Artificial Sequence
  chemically synthesized
catggccatgtccttaccta

SEQ ID NO: 32695 - DNA, 20 bp, Artificial Sequence
  chemically synthesized
gctctaccagtctttaggta

SEQ ID NO: 32696 - DNA, 20 bp, Artificial Sequence
  chemically synthesized
agctctaccagtctttaggt

SEQ ID NO: 32697 - DNA, 20 bp, Artificial Sequence
  chemically synthesized
ccatgtccttacctaaagac

SEQ ID NO: 32698 - DNA, 20 bp, Artificial Sequence
  chemically synthesized
acagagctctaccagtcttt

SEQ ID NO: 32699 - DNA, 20 bp, Artificial Sequence
  chemically synthesized
gacagagctctaccagtctt

SEQ ID NO: 32700 - DNA, 20 bp, Artificial Sequence
  chemically synthesized
tgtccttacctaaagactgg

SEQ ID NO: 32701 - DNA, 20 bp, Artificial Sequence
  chemically synthesized
tccttacctaaagactggta

SEQ ID NO: 32702 - DNA, 20 bp, Artificial Sequence
  chemically synthesized
ccaaaatgacagagctctac

SEQ ID NO: 32703 - DNA, 20 bp, Artificial Sequence
  chemically synthesized
gggaccatcccaaaatgaca

SEQ ID NO: 32704 - DNA, 20 bp, Artificial Sequence
  chemically synthesized
ctggtagagctctgtcattt

SEQ ID NO: 32705 - DNA, 20 bp, Artificial Sequence
  chemically synthesized
tggtagagctctgtcatttt

SEQ ID NO: 32706 - DNA, 20 bp, Artificial Sequence
  chemically synthesized
ctgggaccatcccaaaatga

SEQ ID NO: 32707 - DNA, 20 bp, Artificial Sequence
  chemically synthesized
agagctctgtcattttggga

SEQ ID NO: 32708 - DNA, 20 bp, Artificial Sequence
  chemically synthesized
ctgtcattttgggatggtcc

SEQ ID NO: 32709 - DNA, 20 bp, Artificial Sequence
  chemically synthesized
cattttgggatggtcccagc

SEQ ID NO: 32710 - DNA, 20 bp, Artificial Sequence
  chemically synthesized
cgagactcaaacaacttgct

SEQ ID NO: 32711 - DNA, 20 bp, Artificial Sequence
  chemically synthesized
acgagactcaaacaacttgc

SEQ ID NO: 32712 - DNA, 20 bp, Artificial Sequence
  chemically synthesized
atggtcccagcaagttgttt

SEQ ID NO: 32713 - DNA, 20 bp, Artificial Sequence
  chemically synthesized
agcaagttgtttgagtctcg

SEQ ID NO: 32714 - DNA, 20 bp, Artificial Sequence
  chemically synthesized
atgttttgtgttttagccac

SEQ ID NO: 32715 - DNA, 20 bp, Artificial Sequence
  chemically synthesized
tttctttatgttttgtgttt

SEQ ID NO: 32716 - DNA, 20 bp, Artificial Sequence
  chemically synthesized
tggctaaaacacaaaacata

SEQ ID NO: 32717 - DNA, 20 bp, Artificial Sequence
  chemically synthesized
taaaacacaaaacataaaga

SEQ ID NO: 32718 - DNA, 20 bp, Artificial Sequence
  chemically synthesized
caaaacataaagaaagactt

SEQ ID NO: 32719 - DNA, 20 bp, Artificial Sequence
  chemically synthesized
actactcattgtaaatgcta

SEQ ID NO: 32720 - DNA, 20 bp, Artificial Sequence
  chemically synthesized
aagactttagcatttacaat

SEQ ID NO: 32721 - DNA, 20 bp, Artificial Sequence
  chemically synthesized
actttagcatttacaatgag

SEQ ID NO: 32722 - DNA, 20 bp, Artificial Sequence
  chemically synthesized
agcatttacaatgagtagtc

SEQ ID NO: 32723 - DNA, 20 bp, Artificial Sequence
  chemically synthesized
acaatgagtagtcaagaaaa

SEQ ID NO: 32724 - DNA, 20 bp, Artificial Sequence
  chemically synthesized
caatgagtagtcaagaaaac

SEQ ID NO: 32725 - DNA, 20 bp, Artificial Sequence
  chemically synthesized
tagtcaagaaaacaggaaaa

SEQ ID NO: 32726 - DNA, 20 bp, Artificial Sequence
  chemically synthesized
aaagattccgaatggttcaa

SEQ ID NO: 32727 - DNA, 20 bp, Artificial Sequence
  chemically synthesized
atttttgcttttgaaccatt

SEQ ID NO: 32728 - DNA, 20 bp, Artificial Sequence
  chemically synthesized
tttgaaataaagattccgaa

SEQ ID NO: 32729 - DNA, 20 bp, Artificial Sequence
  chemically synthesized
cattcggaatctttatttca

SEQ ID NO: 32730 - DNA, 20 bp, Artificial Sequence
  chemically synthesized
tatggaagcgctttgaaata

SEQ ID NO: 32731 - DNA, 20 bp, Artificial Sequence
  chemically synthesized
tttatttcaaagcgcttcca

SEQ ID NO: 32732 - DNA, 20 bp, Artificial Sequence
  chemically synthesized
atttcttcaatacactatgg

SEQ ID NO: 32733 - DNA, 20 bp, Artificial Sequence
  chemically synthesized
aacatttcttcaatacacta

SEQ ID NO: 32734 - DNA, 20 bp, Artificial Sequence
  chemically synthesized
agcgcttccatagtgtattg

SEQ ID NO: 32735 - DNA, 20 bp, Artificial Sequence
  chemically synthesized
tgaagaaatgtttatcttac

SEQ ID NO: 32736 - DNA, 20 bp, Artificial Sequence
  chemically synthesized
agaaatgtttatcttacaag

SEQ ID NO: 32737 - DNA, 20 bp, Artificial Sequence
  chemically synthesized
aaaggggcctttctgcttgt

SEQ ID NO: 32738 - DNA, 20 bp, Artificial Sequence
  chemically synthesized
atgtttatcttacaagcaga

SEQ ID NO: 32739 - DNA, 20 bp, Artificial Sequence
  chemically synthesized
tgtttatcttacaagcagaa

SEQ ID NO: 32740 - DNA, 20 bp, Artificial Sequence
  chemically synthesized
tttggaaacaaagcagaaag

SEQ ID NO: 32741 - DNA, 20 bp, Artificial Sequence
  chemically synthesized
ctttggaaacaaagcagaaa

SEQ ID NO: 32742 - DNA, 20 bp, Artificial Sequence
  chemically synthesized
tctttggaaacaaagcagaa

SEQ ID NO: 32743 - DNA, 20 bp, Artificial Sequence
  chemically synthesized
ctctttggaaacaaagcaga

SEQ ID NO: 32744 - DNA, 20 bp, Artificial Sequence
  chemically synthesized
ttttctctttggaaacaaag

SEQ ID NO: 32745 - DNA, 20 bp, Artificial Sequence
  chemically synthesized
tgcttttctctttggaaaca

SEQ ID NO: 32746 - DNA, 20 bp, Artificial Sequence
  chemically synthesized
ccctttctgctttgtttcca

SEQ ID NO: 32747 - DNA, 20 bp, Artificial Sequence
  chemically synthesized
ctttctgctttgtttccaaa

SEQ ID NO: 32748 - DNA, 20 bp, Artificial Sequence
  chemically synthesized
tgctttgtttccaaagagaa

SEQ ID NO: 32749 - DNA, 20 bp, Artificial Sequence
  chemically synthesized
gtttatattgcttttctctt

SEQ ID NO: 32750 - DNA, 20 bp, Artificial Sequence
  chemically synthesized
aaagcaatataaacattatt

SEQ ID NO: 32751 - DNA, 20 bp, Artificial Sequence
  chemically synthesized
atataaacattattcggttc

SEQ ID NO: 32752 - DNA, 20 bp, Artificial Sequence
  chemically synthesized
tgcaaagaagaaacaaattc

SEQ ID NO: 32753 - DNA, 20 bp, Artificial Sequence
  chemically synthesized
atcgatttgtgggtgcaaag

SEQ ID NO: 32754 - DNA, 20 bp, Artificial Sequence
  chemically synthesized
gcgatcgatttgtgggtgca

SEQ ID NO: 32755 - DNA, 20 bp, Artificial Sequence
  chemically synthesized
ctgaagtgcgatcgatttgt

SEQ ID NO: 32756 - DNA, 20 bp, Artificial Sequence
  chemically synthesized
actgaagtgcgatcgatttg

SEQ ID NO: 32757 - DNA, 20 bp, Artificial Sequence
  chemically synthesized
cccacaaatcgatcgcactt

SEQ ID NO: 32758 - DNA, 20 bp, Artificial Sequence
  chemically synthesized
aggtcaatttatcataactg

SEQ ID NO: 32759 - DNA, 20 bp, Artificial Sequence
  chemically synthesized
cgattattgatcacataaca

SEQ ID NO: 32760 - DNA, 20 bp, Artificial Sequence
  chemically synthesized
tcgattattgatcacataac

SEQ ID NO: 32761 - DNA, 20 bp, Artificial Sequence
  chemically synthesized
tgtgatcaataatcgactat

SEQ ID NO: 32762 - DNA, 20 bp, Artificial Sequence
  chemically synthesized
gtgatcaataatcgactatc

SEQ ID NO: 32763 - DNA, 20 bp, Artificial Sequence
  chemically synthesized
gatgggtgaagaagtcctga

SEQ ID NO: 32764 - DNA, 20 bp, Artificial Sequence
  chemically synthesized
tccacattggatgggtgaag

SEQ ID NO: 32765 - DNA, 20 bp, Artificial Sequence
  chemically synthesized
tgttccacattggatgggtg

SEQ ID NO: 32766 - DNA, 20 bp, Artificial Sequence
  chemically synthesized
tgtagtgttccacattggat

SEQ ID NO: 32767 - DNA, 20 bp, Artificial Sequence
  chemically synthesized
acttcttcacccatccaatg

SEQ ID NO: 32768 - DNA, 20 bp, Artificial Sequence
  chemically synthesized
ctgtagtgttccacattgga

SEQ ID NO: 32769 - DNA, 20 bp, Artificial Sequence
  chemically synthesized
ctttctgtagtgttccacat

SEQ ID NO: 32770 - DNA, 20 bp, Artificial Sequence
  chemically synthesized
ccatccaatgtggaacacta

SEQ ID NO: 32771 - DNA, 20 bp, Artificial Sequence
  chemically synthesized
ccaatgtggaacactacaga

SEQ ID NO: 32772 - DNA, 20 bp, Artificial Sequence
  chemically synthesized
caatgtggaacactacagaa

SEQ ID NO: 32773 - DNA, 20 bp, Artificial Sequence
  chemically synthesized
agttgtcggtgtcctttctg

SEQ ID NO: 32774 - DNA, 20 bp, Artificial Sequence
  chemically synthesized
gttgaataataatcagttgt

SEQ ID NO: 32775 - DNA, 20 bp, Artificial Sequence
  chemically synthesized
tgacagagttgaataataat

SEQ ID NO: 32776 - DNA, 20 bp, Artificial Sequence
  chemically synthesized
attattattcaactctgtca

SEQ ID NO: 32777 - DNA, 20 bp, Artificial Sequence
  chemically synthesized
tattattcaactctgtcaaa

SEQ ID NO: 32778 - DNA, 20 bp, Artificial Sequence
  chemically synthesized
tgtccggtatctctttgaca

SEQ ID NO: 32779 - DNA, 20 bp, Artificial Sequence
  chemically synthesized
aatgtccggtatctctttga

SEQ ID NO: 32780 - DNA, 20 bp, Artificial Sequence
  chemically synthesized
caactctgtcaaagagatac

SEQ ID NO: 32781 - DNA, 20 bp, Artificial Sequence
  chemically synthesized
gtcaaagagataccggacat

SEQ ID NO: 32782 - DNA, 20 bp, Artificial Sequence
  chemically synthesized
atatttattgaactaatgtc

SEQ ID NO: 32783 - DNA, 20 bp, Artificial Sequence
  chemically synthesized
agtgaaagcaaatgagaagt

SEQ ID NO: 32784 - DNA, 20 bp, Artificial Sequence
  chemically synthesized
gggcagtgaaagcaaatgag

SEQ ID NO: 32785 - DNA, 20 bp, Artificial Sequence
  chemically synthesized
caggggcagtgaaagcaaat

SEQ ID NO: 32786 - DNA, 20 bp, Artificial Sequence
  chemically synthesized
aaaaatgtcaggggcagtga

SEQ ID NO: 32787 - DNA, 20 bp, Artificial Sequence
  chemically synthesized
taatggaaaaatgtcagggg

SEQ ID NO: 32788 - DNA, 20 bp, Artificial Sequence
  chemically synthesized
gagtaatggaaaaatgtcag

SEQ ID NO: 32789 - DNA, 20 bp, Artificial Sequence
  chemically synthesized
agagtaatggaaaaatgtca

SEQ ID NO: 32790 - DNA, 20 bp, Artificial Sequence
  chemically synthesized
aagagtaatggaaaaatgtc

SEQ ID NO: 32791 - DNA, 20 bp, Artificial Sequence
  chemically synthesized
aaagagtaatggaaaaatgt

SEQ ID NO: 32792 - DNA, 20 bp, Artificial Sequence
  chemically synthesized
atatgtagaggaaagagtaa

SEQ ID NO: 32793 - DNA, 20 bp, Artificial Sequence
  chemically synthesized
atctgtatatgtagaggaaa

SEQ ID NO: 32794 - DNA, 20 bp, Artificial Sequence
  chemically synthesized
agatctgtatatgtagagga

SEQ ID NO: 32795 - DNA, 20 bp, Artificial Sequence
  chemically synthesized
tatgagatctgtatatgtag

SEQ ID NO: 32796 - DNA, 20 bp, Artificial Sequence
  chemically synthesized
atatgagatctgtatatgta

SEQ ID NO: 32797 - DNA, 20 bp, Artificial Sequence
  chemically synthesized
tactctttcctctacatata

SEQ ID NO: 32798 - DNA, 20 bp, Artificial Sequence
  chemically synthesized
ggatatgagatctgtatatg

SEQ ID NO: 32799 - DNA, 20 bp, Artificial Sequence
  chemically synthesized
aatacaggtatcatggatat

SEQ ID NO: 32800 - DNA, 20 bp, Artificial Sequence
  chemically synthesized
gaaatgaaatacaggtatca

SEQ ID NO: 32801 - DNA, 20 bp, Artificial Sequence
  chemically synthesized
cttaagctgaaatgaaatac

SEQ ID NO: 32802 - DNA, 20 bp, Artificial Sequence
  chemically synthesized
ccttaagctgaaatgaaata

SEQ ID NO: 32803 - DNA, 20 bp, Artificial Sequence
  chemically synthesized
atgatacctgtatttcattt

SEQ ID NO: 32804 - DNA, 20 bp, Artificial Sequence
  chemically synthesized
cctgtatttcatttcagctt

SEQ ID NO: 32805 - DNA, 20 bp, Artificial Sequence
  chemically synthesized
ctgtatttcatttcagctta

SEQ ID NO: 32806 - DNA, 20 bp, Artificial Sequence
  chemically synthesized
tcaggcagtagatatacctt

SEQ ID NO: 32807 - DNA, 20 bp, Artificial Sequence
  chemically synthesized
atgatatattagtcaggcag

SEQ ID NO: 32808 - DNA, 20 bp, Artificial Sequence
  chemically synthesized
gttatgatatattagtcagg

SEQ ID NO: 32809 - DNA, 20 bp, Artificial Sequence
  chemically synthesized
gaagttatgatatattagtc

SEQ ID NO: 32810 - DNA, 20 bp, Artificial Sequence
  chemically synthesized
ggaagttatgatatattagt

SEQ ID NO: 32811 - DNA, 20 bp, Artificial Sequence
  chemically synthesized
agaaggaagttatgatatat

SEQ ID NO: 32812 - DNA, 20 bp, Artificial Sequence
  chemically synthesized
ctgaaataatgggaagaagg

SEQ ID NO: 32813 - DNA, 20 bp, Artificial Sequence
  chemically synthesized
actctgaaataatgggaaga

SEQ ID NO: 32814 - DNA, 20 bp, Artificial Sequence
  chemically synthesized
cactctgaaataatgggaag

SEQ ID NO: 32815 - DNA, 20 bp, Artificial Sequence
  chemically synthesized
aaacactctgaaataatggg

SEQ ID NO: 32816 - DNA, 20 bp, Artificial Sequence
  chemically synthesized
cttccttcttcccattattt

SEQ ID NO: 32817 - DNA, 20 bp, Artificial Sequence
  chemically synthesized
aaaaaacactctgaaataat

SEQ ID NO: 32818 - DNA, 20 bp, Artificial Sequence
  chemically synthesized
gaaaaaacactctgaaataa

SEQ ID NO: 32819 - DNA, 20 bp, Artificial Sequence
  chemically synthesized
tccttcttcccattatttca

SEQ ID NO: 32820 - DNA, 20 bp, Artificial Sequence
  chemically synthesized
gagtgttttttctttaaacg

SEQ ID NO: 32821 - DNA, 20 bp, Artificial Sequence
  chemically synthesized
tgtatagcgtactgcgttta

SEQ ID NO: 32822 - DNA, 20 bp, Artificial Sequence
  chemically synthesized
ggaagaggtgtagtggtgta

SEQ ID NO: 32823 - DNA, 20 bp, Artificial Sequence
  chemically synthesized
aaatataggaagaggtgtag

SEQ ID NO: 32824 - DNA, 20 bp, Artificial Sequence
  chemically synthesized
agtaaatataggaagaggtg

SEQ ID NO: 32825 - DNA, 20 bp, Artificial Sequence
  chemically synthesized
gcccaagtaaatataggaag

SEQ ID NO: 32826 - DNA, 20 bp, Artificial Sequence
  chemically synthesized
ggcccaagtaaatataggaa

SEQ ID NO: 32827 - DNA, 20 bp, Artificial Sequence
  chemically synthesized
caggcccaagtaaatatagg

SEQ ID NO: 32828 - DNA, 20 bp, Artificial Sequence
  chemically synthesized
attcaggcccaagtaaatat

SEQ ID NO: 32829 - DNA, 20 bp, Artificial Sequence
  chemically synthesized
cattcaggcccaagtaaata

SEQ ID NO: 32830 - DNA, 20 bp, Artificial Sequence
  chemically synthesized
cacctcttcctatatttact

SEQ ID NO: 32831 - DNA, 20 bp, Artificial Sequence
  chemically synthesized
acctcttcctatatttactt

SEQ ID NO: 32832 - DNA, 20 bp, Artificial Sequence
  chemically synthesized
tgaatgcttcattcaggccc

SEQ ID NO: 32833 - DNA, 20 bp, Artificial Sequence
  chemically synthesized
tatttacttgggcctgaatg

SEQ ID NO: 32834 - DNA, 20 bp, Artificial Sequence
  chemically synthesized
cagctgtgaatgcttcattc

SEQ ID NO: 32835 - DNA, 20 bp, Artificial Sequence
  chemically synthesized
acagctgtgaatgcttcatt

SEQ ID NO: 32836 - DNA, 20 bp, Artificial Sequence
  chemically synthesized
gggcctgaatgaagcattca

SEQ ID NO: 32837 - DNA, 20 bp, Artificial Sequence
  chemically synthesized
acacttcaagaaatggaaga

SEQ ID NO: 32838 - DNA, 20 bp, Artificial Sequence
  chemically synthesized
aaccacacttcaagaaatgg

SEQ ID NO: 32839 - DNA, 20 bp, Artificial Sequence
  chemically synthesized
cagctgtcttccatttcttg

SEQ ID NO: 32840 - DNA, 20 bp, Artificial Sequence
  chemically synthesized
agcaaccacacttcaagaaa

SEQ ID NO: 32841 - DNA, 20 bp, Artificial Sequence
  chemically synthesized
gtcttccatttcttgaagtg

SEQ ID NO: 32842 - DNA, 20 bp, Artificial Sequence
  chemically synthesized
atagccagcaaccacacttc

SEQ ID NO: 32843 - DNA, 20 bp, Artificial Sequence
  chemically synthesized
atttcttgaagtgtggttgc

SEQ ID NO: 32844 - DNA, 20 bp, Artificial Sequence
  chemically synthesized
gaagtgtggttgctggctat

SEQ ID NO: 32845 - DNA, 20 bp, Artificial Sequence
  chemically synthesized
ttgtggcaggagctgatagc

SEQ ID NO: 32846 - DNA, 20 bp, Artificial Sequence
  chemically synthesized
ctttttgtggcaggagctga

SEQ ID NO: 32847 - DNA, 20 bp, Artificial Sequence
  chemically synthesized
ttttgttctttttgtggcag

SEQ ID NO: 32848 - DNA, 20 bp, Artificial Sequence
  chemically synthesized
tgttttgttctttttgtggc

SEQ ID NO: 32849 - DNA, 20 bp, Artificial Sequence
  chemically synthesized
ctatcagctcctgccacaaa

SEQ ID NO: 32850 - DNA, 20 bp, Artificial Sequence
  chemically synthesized
gtgttttgttctttttgtgg

SEQ ID NO: 32851 - DNA, 20 bp, Artificial Sequence
  chemically synthesized
aaggtgttttgttctttttg

SEQ ID NO: 32852 - DNA, 20 bp, Artificial Sequence
  chemically synthesized
tgtaattgaatgaggaacaa

SEQ ID NO: 32853 - DNA, 20 bp, Artificial Sequence
  chemically synthesized
atgtaattgaatgaggaaca

SEQ ID NO: 32854 - DNA, 20 bp, Artificial Sequence
  chemically synthesized
tttattcatgtaattgaatg

SEQ ID NO: 32855 - DNA, 20 bp, Artificial Sequence
  chemically synthesized
gtttattcatgtaattgaat

SEQ ID NO: 32856 - DNA, 20 bp, Artificial Sequence
  chemically synthesized
tcaattacatgaataaaccc

SEQ ID NO: 32857 - DNA, 20 bp, Artificial Sequence
  chemically synthesized
aattacatgaataaaccctg

SEQ ID NO: 32858 - DNA, 20 bp, Artificial Sequence
  chemically synthesized
tatatgtagttatttctcca

SEQ ID NO: 32859 - DNA, 20 bp, Artificial Sequence
  chemically synthesized
gtatatgtagttatttctcc

SEQ ID NO: 32860 - DNA, 20 bp, Artificial Sequence
  chemically synthesized
agtatatgtagttatttctc

SEQ ID NO: 32861 - DNA, 20 bp, Artificial Sequence
  chemically synthesized
aaagtaaggaaaagtatatg

SEQ ID NO: 32862 - DNA, 20 bp, Artificial Sequence
  chemically synthesized
agatgggccaaagtaaggaa

SEQ ID NO: 32863 - DNA, 20 bp, Artificial Sequence
  chemically synthesized
acatatacttttccttactt

SEQ ID NO: 32864 - DNA, 20 bp, Artificial Sequence
  chemically synthesized
tatgtagatgggccaaagta

SEQ ID NO: 32865 - DNA, 20 bp, Artificial Sequence
  chemically synthesized
ttatgtagatgggccaaagt

SEQ ID NO: 32866 - DNA, 20 bp, Artificial Sequence
  chemically synthesized
tgatttatgtagatgggcca

SEQ ID NO: 32867 - DNA, 20 bp, Artificial Sequence
  chemically synthesized
ctatggtgatttatgtagat

SEQ ID NO: 32868 - DNA, 20 bp, Artificial Sequence
  chemically synthesized
gctatggtgatttatgtaga

SEQ ID NO: 32869 - DNA, 20 bp, Artificial Sequence
  chemically synthesized
tgacgctatggtgatttatg

SEQ ID NO: 32870 - DNA, 20 bp, Artificial Sequence
  chemically synthesized
cccatctacataaatcacca

SEQ ID NO: 32871 - DNA, 20 bp, Artificial Sequence
  chemically synthesized
aaactggaaatatgacgcta

SEQ ID NO: 32872 - DNA, 20 bp, Artificial Sequence
  chemically synthesized
tcaccatagcgtcatatttc

SEQ ID NO: 32873 - DNA, 20 bp, Artificial Sequence
  chemically synthesized
agcgtcatatttccagtttt

SEQ ID NO: 32874 - DNA, 20 bp, Artificial Sequence
  chemically synthesized
gcgtcatatttccagttttc

SEQ ID NO: 32875 - DNA, 20 bp, Artificial Sequence
  chemically synthesized
cgtcatatttccagttttca

SEQ ID NO: 32876 - DNA, 20 bp, Artificial Sequence
  chemically synthesized
gtcatgcaatccctgaaaac

SEQ ID NO: 32877 - DNA, 20 bp, Artificial Sequence
  chemically synthesized
agttttcagggattgcatga

SEQ ID NO: 32878 - DNA, 20 bp, Artificial Sequence
  chemically synthesized
gttttcagggattgcatgac

SEQ ID NO: 32879 - DNA, 20 bp, Artificial Sequence
  chemically synthesized
ttgcatgacaggctttgata

SEQ ID NO: 32880 - DNA, 20 bp, Artificial Sequence
  chemically synthesized
aactgcattttactgtatca

SEQ ID NO: 32881 - DNA, 20 bp, Artificial Sequence
  chemically synthesized
ggctttgatacagtaaaatg

SEQ ID NO: 32882 - DNA, 20 bp, Artificial Sequence
  chemically synthesized
atgagtacccaaatatcatt

SEQ ID NO: 32883 - DNA, 20 bp, Artificial Sequence
  chemically synthesized
atgcagttctgaatgatatt

SEQ ID NO: 32884 - DNA, 20 bp, Artificial Sequence
  chemically synthesized
tgcagttctgaatgatattt

SEQ ID NO: 32885 - DNA, 20 bp, Artificial Sequence
  chemically synthesized
gatatttgggtactcatatg

SEQ ID NO: 32886 - DNA, 20 bp, Artificial Sequence
  chemically synthesized
tatttgggtactcatatgca

SEQ ID NO: 32887 - DNA, 20 bp, Artificial Sequence
  chemically synthesized
tatgaataggctctgcatat

SEQ ID NO: 32888 - DNA, 20 bp, Artificial Sequence
  chemically synthesized
cccctcaaaagtttatgaat

SEQ ID NO: 32889 - DNA, 20 bp, Artificial Sequence
  chemically synthesized
tcccctcaaaagtttatgaa

SEQ ID NO: 32890 - DNA, 20 bp, Artificial Sequence
  chemically synthesized
gagcctattcataaactttt

SEQ ID NO: 32891 - DNA, 20 bp, Artificial Sequence
  chemically synthesized
agcctattcataaacttttg

SEQ ID NO: 32892 - DNA, 20 bp, Artificial Sequence
  chemically synthesized
gcctattcataaacttttga

SEQ ID NO: 32893 - DNA, 20 bp, Artificial Sequence
  chemically synthesized
cctattcataaacttttgag

SEQ ID NO: 32894 - DNA, 20 bp, Artificial Sequence
  chemically synthesized
ttccctccccttcccctcaa

SEQ ID NO: 32895 - DNA, 20 bp, Artificial Sequence
  chemically synthesized
attcataaacttttgagggg

SEQ ID NO: 32896 - DNA, 20 bp, Artificial Sequence
  chemically synthesized
ttcataaacttttgagggga

SEQ ID NO: 32897 - DNA, 20 bp, Artificial Sequence
  chemically synthesized
tcataaacttttgaggggaa

SEQ ID NO: 32898 - DNA, 20 bp, Artificial Sequence
  chemically synthesized
cataaacttttgaggggaag

SEQ ID NO: 32899 - DNA, 20 bp, Artificial Sequence
  chemically synthesized
taaacttttgaggggaaggg

SEQ ID NO: 32900 - DNA, 20 bp, Artificial Sequence
  chemically synthesized
aaacttttgaggggaagggg

SEQ ID NO: 32901 - DNA, 20 bp, Artificial Sequence
  chemically synthesized
aacttttgaggggaagggga

SEQ ID NO: 32902 - DNA, 20 bp, Artificial Sequence
  chemically synthesized
ttttgaggggaaggggaggg

SEQ ID NO: 32903 - DNA, 20 bp, Artificial Sequence
  chemically synthesized
tttgaggggaaggggaggga

SEQ ID NO: 32904 - DNA, 20 bp, Artificial Sequence
  chemically synthesized
ggaaggggagggaaggaaaa

SEQ ID NO: 32905 - DNA, 20 bp, Artificial Sequence
  chemically synthesized
aaggggagggaaggaaaaaa

SEQ ID NO: 32906 - DNA, 20 bp, Artificial Sequence
  chemically synthesized
aaaagagaaatcgcttaaac

SEQ ID NO: 32907 - DNA, 20 bp, Artificial Sequence
  chemically synthesized
aaagagaaatcgcttaaact

SEQ ID NO: 32908 - DNA, 20 bp, Artificial Sequence
  chemically synthesized
aagagaaatcgcttaaactg

SEQ ID NO: 32909 - DNA, 20 bp, Artificial Sequence
  chemically synthesized
ctctggaaatgccccagttt

SEQ ID NO: 32910 - DNA, 20 bp, Artificial Sequence
  chemically synthesized
ctggtcctctggaaatgccc

SEQ ID NO: 32911 - DNA, 20 bp, Artificial Sequence
  chemically synthesized
cgcttaaactggggcatttc

SEQ ID NO: 32912 - DNA, 20 bp, Artificial Sequence
  chemically synthesized
cttaaactggggcatttcca

SEQ ID NO: 32913 - DNA, 20 bp, Artificial Sequence
  chemically synthesized
ttaaactggggcatttccag

SEQ ID NO: 32914 - DNA, 20 bp, Artificial Sequence
  chemically synthesized
ctggggcatttccagaggac

SEQ ID NO: 32915 - DNA, 20 bp, Artificial Sequence
  chemically synthesized
ccctgtactttctggtcctc

SEQ ID NO: 32916 - DNA, 20 bp, Artificial Sequence
  chemically synthesized
ggcatttccagaggaccaga

SEQ ID NO: 32917 - DNA, 20 bp, Artificial Sequence
  chemically synthesized
ttccagaggaccagaaagta

SEQ ID NO: 32918 - DNA, 20 bp, Artificial Sequence
  chemically synthesized
tgtgaggcccctgtactttc

SEQ ID NO: 32919 - DNA, 20 bp, Artificial Sequence
  chemically synthesized
tccagaggaccagaaagtac

SEQ ID NO: 32920 - DNA, 20 bp, Artificial Sequence
  chemically synthesized
ccagaggaccagaaagtaca

SEQ ID NO: 32921 - DNA, 20 bp, Artificial Sequence
  chemically synthesized
cagaggaccagaaagtacag

SEQ ID NO: 32922 - DNA, 20 bp, Artificial Sequence
  chemically synthesized
gaaagtacaggggcctcaca

SEQ ID NO: 32923 - DNA, 20 bp, Artificial Sequence
  chemically synthesized
cagactcctctttctgtgtg

SEQ ID NO: 32924 - DNA, 20 bp, Artificial Sequence
  chemically synthesized
gtacaggggcctcacacaga

SEQ ID NO: 32925 - DNA, 20 bp, Artificial Sequence
  chemically synthesized
ccagactcctctttctgtgt

SEQ ID NO: 32926 - DNA, 20 bp, Artificial Sequence
  chemically synthesized
acaggggcctcacacagaaa

SEQ ID NO: 32927 - DNA, 20 bp, Artificial Sequence
  chemically synthesized
caggggcctcacacagaaag

SEQ ID NO: 32928 - DNA, 20 bp, Artificial Sequence
  chemically synthesized
ggggcctcacacagaaagag

SEQ ID NO: 32929 - DNA, 20 bp, Artificial Sequence
  chemically synthesized
ctcacacagaaagaggagtc

SEQ ID NO: 32930 - DNA, 20 bp, Artificial Sequence
  chemically synthesized
cacacagaaagaggagtctg

SEQ ID NO: 32931 - DNA, 20 bp, Artificial Sequence
  chemically synthesized
cacagaaagaggagtctgga

SEQ ID NO: 32932 - DNA, 20 bp, Artificial Sequence
  chemically synthesized
acagaaagaggagtctggag

SEQ ID NO: 32933 - DNA, 20 bp, Artificial Sequence
  chemically synthesized
attcgacattgttgcctctc

SEQ ID NO: 32934 - DNA, 20 bp, Artificial Sequence
  chemically synthesized
ggagaggcaacaatgtcgaa

SEQ ID NO: 32935 - DNA, 20 bp, Artificial Sequence
  chemically synthesized
gcaacaatgtcgaatggcct

SEQ ID NO: 32936 - DNA, 20 bp, Artificial Sequence
  chemically synthesized
aaaattcaaaacatacgcta

SEQ ID NO: 32937 - DNA, 20 bp, Artificial Sequence
  chemically synthesized
taaaattcaaaacatacgct

SEQ ID NO: 32938 - DNA, 20 bp, Artificial Sequence
  chemically synthesized
ttagcgtatgttttgaattt

SEQ ID NO: 32939 - DNA, 20 bp, Artificial Sequence
  chemically synthesized
tagcgtatgttttgaatttt

SEQ ID NO: 32940 - DNA, 20 bp, Artificial Sequence
  chemically synthesized
agcgtatgttttgaatttta

SEQ ID NO: 32941 - DNA, 20 bp, Artificial Sequence
  chemically synthesized
ttcaccgccagtagggcgca

SEQ ID NO: 32942 - DNA, 20 bp, Artificial Sequence
  chemically synthesized
atttcaccgccagtagggcg

SEQ ID NO: 32943 - DNA, 20 bp, Artificial Sequence
  chemically synthesized
tttagggctctgcgccctac

SEQ ID NO: 32944 - DNA, 20 bp, Artificial Sequence
  chemically synthesized
agggctctgcgccctactgg

SEQ ID NO: 32945 - DNA, 20 bp, Artificial Sequence
  chemically synthesized
tttaaatttcaccgccagta

SEQ ID NO: 32946 - DNA, 20 bp, Artificial Sequence
  chemically synthesized
ctttaaatttcaccgccagt

SEQ ID NO: 32947 - DNA, 20 bp, Artificial Sequence
  chemically synthesized
gctttaaatttcaccgccag

SEQ ID NO: 32948 - DNA, 20 bp, Artificial Sequence
  chemically synthesized
cttgctttaaatttcaccgc

SEQ ID NO: 32949 - DNA, 20 bp, Artificial Sequence
  chemically synthesized
cctactggcggtgaaattta

SEQ ID NO: 32950 - DNA, 20 bp, Artificial Sequence
  chemically synthesized
ctggcggtgaaatttaaagc

SEQ ID NO: 32951 - DNA, 20 bp, Artificial Sequence
  chemically synthesized
tttaaccctccaaggtaggc

SEQ ID NO: 32952 - DNA, 20 bp, Artificial Sequence
  chemically synthesized
taaagcaagcctgcctacct

SEQ ID NO: 32953 - DNA, 20 bp, Artificial Sequence
  chemically synthesized
ctttaaccctccaaggtagg

SEQ ID NO: 32954 - DNA, 20 bp, Artificial Sequence
  chemically synthesized
aagcaagcctgcctaccttg

SEQ ID NO: 32955 - DNA, 20 bp, Artificial Sequence
  chemically synthesized
agcaagcctgcctaccttgg

SEQ ID NO: 32956 - DNA, 20 bp, Artificial Sequence
  chemically synthesized
atcctttaaccctccaaggt

SEQ ID NO: 32957 - DNA, 20 bp, Artificial Sequence
  chemically synthesized
gcaagcctgcctaccttgga

SEQ ID NO: 32958 - DNA, 20 bp, Artificial Sequence
  chemically synthesized
aatcctttaaccctccaagg

SEQ ID NO: 32959 - DNA, 20 bp, Artificial Sequence
  chemically synthesized
actaatcctttaaccctcca

SEQ ID NO: 32960 - DNA, 20 bp, Artificial Sequence
  chemically synthesized
aactaatcctttaaccctcc

SEQ ID NO: 32961 - DNA, 20 bp, Artificial Sequence
  chemically synthesized
ctgcctaccttggagggtta

SEQ ID NO: 32962 - DNA, 20 bp, Artificial Sequence
  chemically synthesized
tgcctaccttggagggttaa

SEQ ID NO: 32963 - DNA, 20 bp, Artificial Sequence
  chemically synthesized
accttggagggttaaaggat

SEQ ID NO: 32964 - DNA, 20 bp, Artificial Sequence
  chemically synthesized
ggttaaaggattagttgaaa

SEQ ID NO: 32965 - DNA, 20 bp, Artificial Sequence
  chemically synthesized
gttaaaggattagttgaaat

SEQ ID NO: 32966 - DNA, 20 bp, Artificial Sequence
  chemically synthesized
aaggattagttgaaataggt

SEQ ID NO: 32967 - DNA, 20 bp, Artificial Sequence
  chemically synthesized
agttgaaataggtaagtgac

SEQ ID NO: 32968 - DNA, 20 bp, Artificial Sequence
  chemically synthesized
tattgagcaccaaatggtgc

SEQ ID NO: 32969 - DNA, 20 bp, Artificial Sequence
  chemically synthesized
ggtaagtgaccggcaccatt

SEQ ID NO: 32970 - DNA, 20 bp, Artificial Sequence
  chemically synthesized
accacatattgagcaccaaa

SEQ ID NO: 32971 - DNA, 20 bp, Artificial Sequence
  chemically synthesized
accatttggtgctcaatatg

SEQ ID NO: 32972 - DNA, 20 bp, Artificial Sequence
  chemically synthesized
accaaaagcgaccacatatt

SEQ ID NO: 32973 - DNA, 20 bp, Artificial Sequence
  chemically synthesized
gctcaatatgtggtcgcttt

SEQ ID NO: 32974 - DNA, 20 bp, Artificial Sequence
  chemically synthesized
tgaggggcacatgataccaa

SEQ ID NO: 32975 - DNA, 20 bp, Artificial Sequence
  chemically synthesized
ttaatagatgacaatttgag

SEQ ID NO: 32976 - DNA, 20 bp, Artificial Sequence
  chemically synthesized
tttaatagatgacaatttga

SEQ ID NO: 32977 - DNA, 20 bp, Artificial Sequence
  chemically synthesized
ttttaatagatgacaatttg

SEQ ID NO: 32978 - DNA, 20 bp, Artificial Sequence
  chemically synthesized
cttttaatagatgacaattt

SEQ ID NO: 32979 - DNA, 20 bp, Artificial Sequence
  chemically synthesized
ctcaaattgtcatctattaa

SEQ ID NO: 32980 - DNA, 20 bp, Artificial Sequence
  chemically synthesized
aataacagatttgcttttaa

SEQ ID NO: 32981 - DNA, 20 bp, Artificial Sequence
  chemically synthesized
attaaaagcaaatctgttat

SEQ ID NO: 32982 - DNA, 20 bp, Artificial Sequence
  chemically synthesized
atattgtaatcaactaataa

SEQ ID NO: 32983 - DNA, 20 bp, Artificial Sequence
  chemically synthesized
gttattagttgattacaata

SEQ ID NO: 32984 - DNA, 20 bp, Artificial Sequence
  chemically synthesized
agttgattacaatatagatg

SEQ ID NO: 32985 - DNA, 20 bp, Artificial Sequence
  chemically synthesized
ttgattgacttaattacagt

SEQ ID NO: 32986 - DNA, 20 bp, Artificial Sequence
  chemically synthesized
atgtggatccaactgtaatt

SEQ ID NO: 32987 - DNA, 20 bp, Artificial Sequence
  chemically synthesized
cgccttgattgacttaatta

SEQ ID NO: 32988 - DNA, 20 bp, Artificial Sequence
  chemically synthesized
caactgtaattaagtcaatc

SEQ ID NO: 32989 - DNA, 20 bp, Artificial Sequence
  chemically synthesized
aactgtaattaagtcaatca

SEQ ID NO: 32990 - DNA, 20 bp, Artificial Sequence
  chemically synthesized
taattaagtcaatcaaggcg

SEQ ID NO: 32991 - DNA, 20 bp, Artificial Sequence
  chemically synthesized
taagtcaatcaaggcgaaga

SEQ ID NO: 32992 - DNA, 20 bp, Artificial Sequence
  chemically synthesized
aggcgaagaaagacccttcc

SEQ ID NO: 32993 - DNA, 20 bp, Artificial Sequence
  chemically synthesized
gcgaagaaagacccttccta

SEQ ID NO: 32994 - DNA, 20 bp, Artificial Sequence
  chemically synthesized
ttggttttgctctctaggaa

SEQ ID NO: 32995 - DNA, 20 bp, Artificial Sequence
  chemically synthesized
gaagaaagacccttcctaga

SEQ ID NO: 32996 - DNA, 20 bp, Artificial Sequence
  chemically synthesized
gttggttttgctctctagga

SEQ ID NO: 32997 - DNA, 20 bp, Artificial Sequence
  chemically synthesized
tgttggttttgctctctagg

SEQ ID NO: 32998 - DNA, 20 bp, Artificial Sequence
  chemically synthesized
gtgtgttggttttgctctct

SEQ ID NO: 32999 - DNA, 20 bp, Artificial Sequence
  chemically synthesized
agtgtgttggttttgctctc

SEQ ID NO: 33000 - DNA, 20 bp, Artificial Sequence
  chemically synthesized
ggtgataacatgtagtgtgt

SEQ ID NO: 33001 - DNA, 20 bp, Artificial Sequence
  chemically synthesized
taaacataggtgataacatg

SEQ ID NO: 33002 - DNA, 20 bp, Artificial Sequence
  chemically synthesized
aacttattttttttaaacat

SEQ ID NO: 33003 - DNA, 20 bp, Artificial Sequence
  chemically synthesized
taacttattttttttaaaca

SEQ ID NO: 33004 - DNA, 20 bp, Artificial Sequence
  chemically synthesized
cacctatgtttaaaaaaaat

SEQ ID NO: 33005 - DNA, 20 bp, Artificial Sequence
  chemically synthesized
ataagttaaaacaaccgttt

SEQ ID NO: 33006 - DNA, 20 bp, Artificial Sequence
  chemically synthesized
gttaaaacaaccgtttaagt

SEQ ID NO: 33007 - DNA, 20 bp, Artificial Sequence
  chemically synthesized
atttcttaaaccaacttaaa

SEQ ID NO: 33008 - DNA, 20 bp, Artificial Sequence
  chemically synthesized
acaaccgtttaagttggttt

SEQ ID NO: 33009 - DNA, 20 bp, Artificial Sequence
  chemically synthesized
gtttaagttggtttaagaaa

SEQ ID NO: 33010 - DNA, 20 bp, Artificial Sequence
  chemically synthesized
acacaatcataaacctcata

SEQ ID NO: 33011 - DNA, 20 bp, Artificial Sequence
  chemically synthesized
gatttccatatgtctttatg

SEQ ID NO: 33012 - DNA, 20 bp, Artificial Sequence
  chemically synthesized
tgatttccatatgtctttat

SEQ ID NO: 33013 - DNA, 20 bp, Artificial Sequence
  chemically synthesized
ataaacctcataaagacata

SEQ ID NO: 33014 - DNA, 20 bp, Artificial Sequence
  chemically synthesized
gtctttgaagttgtacagtt

SEQ ID NO: 33015 - DNA, 20 bp, Artificial Sequence
  chemically synthesized
ggatggtctttgaagttgta

SEQ ID NO: 33016 - DNA, 20 bp, Artificial Sequence
  chemically synthesized
atccaaactgtacaacttca

SEQ ID NO: 33017 - DNA, 20 bp, Artificial Sequence
  chemically synthesized
tattacagggatggtctttg

SEQ ID NO: 33018 - DNA, 20 bp, Artificial Sequence
  chemically synthesized
actagtaaatattacaggga

SEQ ID NO: 33019 - DNA, 20 bp, Artificial Sequence
  chemically synthesized
actgactagtaaatattaca

SEQ ID NO: 33020 - DNA, 20 bp, Artificial Sequence
  chemically synthesized
cactgactagtaaatattac

SEQ ID NO: 33021 - DNA, 20 bp, Artificial Sequence
  chemically synthesized
tcactgactagtaaatatta

SEQ ID NO: 33022 - DNA, 20 bp, Artificial Sequence
  chemically synthesized
accatccctgtaatatttac

SEQ ID NO: 33023 - DNA, 20 bp, Artificial Sequence
  chemically synthesized
tccctgtaatatttactagt

SEQ ID NO: 33024 - DNA, 20 bp, Artificial Sequence
  chemically synthesized
ctcactgttcaatcactgac

SEQ ID NO: 33025 - DNA, 20 bp, Artificial Sequence
  chemically synthesized
tttactagtcagtgattgaa

SEQ ID NO: 33026 - DNA, 20 bp, Artificial Sequence
  chemically synthesized
ctagtcagtgattgaacagt

SEQ ID NO: 33027 - DNA, 20 bp, Artificial Sequence
  chemically synthesized
tagtcagtgattgaacagtg

SEQ ID NO: 33028 - DNA, 20 bp, Artificial Sequence
  chemically synthesized
agtcagtgattgaacagtga

SEQ ID NO: 33029 - DNA, 20 bp, Artificial Sequence
  chemically synthesized
ttcttgcaaattgatttcag

SEQ ID NO: 33030 - DNA, 20 bp, Artificial Sequence
  chemically synthesized
attttcttgcaaattgattt

SEQ ID NO: 33031 - DNA, 20 bp, Artificial Sequence
  chemically synthesized
ggctactgaaatcaatttgc

SEQ ID NO: 33032 - DNA, 20 bp, Artificial Sequence
  chemically synthesized
caagaaaatgttcacttgtg

SEQ ID NO: 33033 - DNA, 20 bp, Artificial Sequence
  chemically synthesized
acagtgaaacagcacttcac

SEQ ID NO: 33034 - DNA, 20 bp, Artificial Sequence
  chemically synthesized
gtatttggaagacagtgaaa

SEQ ID NO: 33035 - DNA, 20 bp, Artificial Sequence
  chemically synthesized
aaataaacgtatttggaaga

SEQ ID NO: 33036 - DNA, 20 bp, Artificial Sequence
  chemically synthesized
actgaaataaacgtatttgg

SEQ ID NO: 33037 - DNA, 20 bp, Artificial Sequence
  chemically synthesized
aaaactgaaataaacgtatt

SEQ ID NO: 33038 - DNA, 20 bp, Artificial Sequence
  chemically synthesized
tcttccaaatacgtttattt

SEQ ID NO: 33039 - DNA, 20 bp, Artificial Sequence
  chemically synthesized
atttcagttttacttttcca

SEQ ID NO: 33040 - DNA, 20 bp, Artificial Sequence
  chemically synthesized
ttcagttttacttttccata

SEQ ID NO: 33041 - DNA, 20 bp, Artificial Sequence
  chemically synthesized
tgtgagttgtctctatggaa

SEQ ID NO: 33042 - DNA, 20 bp, Artificial Sequence
  chemically synthesized
tcaaatgtgagttgtctcta

SEQ ID NO: 33043 - DNA, 20 bp, Artificial Sequence
  chemically synthesized
catagagacaactcacattt

SEQ ID NO: 33044 - DNA, 20 bp, Artificial Sequence
  chemically synthesized
atagagacaactcacatttg

SEQ ID NO: 33045 - DNA, 20 bp, Artificial Sequence
  chemically synthesized
ttgttatagtcctcaaatgt

SEQ ID NO: 33046 - DNA, 20 bp, Artificial Sequence
  chemically synthesized
tcacatttgaggactataac

SEQ ID NO: 33047 - DNA, 20 bp, Artificial Sequence
  chemically synthesized
cacatttgaggactataaca

SEQ ID NO: 33048 - DNA, 20 bp, Artificial Sequence
  chemically synthesized
acatttgaggactataacaa

SEQ ID NO: 33049 - DNA, 20 bp, Artificial Sequence
  chemically synthesized
caactgataagcccttgtta

SEQ ID NO: 33050 - DNA, 20 bp, Artificial Sequence
  chemically synthesized
ggactataacaagggcttat

SEQ ID NO: 33051 - DNA, 20 bp, Artificial Sequence
  chemically synthesized
ataacaagggcttatcagtt

SEQ ID NO: 33052 - DNA, 20 bp, Artificial Sequence
  chemically synthesized
gttatattccctcaactgat

SEQ ID NO: 33053 - DNA, 20 bp, Artificial Sequence
  chemically synthesized
taacaagggcttatcagttg

SEQ ID NO: 33054 - DNA, 20 bp, Artificial Sequence
  chemically synthesized
aacaagggcttatcagttga

SEQ ID NO: 33055 - DNA, 20 bp, Artificial Sequence
  chemically synthesized
tatcagttgagggaatataa

SEQ ID NO: 33056 - DNA, 20 bp, Artificial Sequence
  chemically synthesized
tcagttgagggaatataaca

SEQ ID NO: 33057 - DNA, 20 bp, Artificial Sequence
  chemically synthesized
aatataacagagtgacattc

SEQ ID NO: 33058 - DNA, 20 bp, Artificial Sequence
  chemically synthesized
agagtgacattcaagtctta

SEQ ID NO: 33059 - DNA, 20 bp, Artificial Sequence
  chemically synthesized
agtgacattcaagtcttaaa

SEQ ID NO: 33060 - DNA, 20 bp, Artificial Sequence
  chemically synthesized
acattcaagtcttaaagagc

SEQ ID NO: 33061 - DNA, 20 bp, Artificial Sequence
  chemically synthesized
tcctgctcttcttgctcttt

SEQ ID NO: 33062 - DNA, 20 bp, Artificial Sequence
  chemically synthesized
ttcaagtcttaaagagcaag

SEQ ID NO: 33063 - DNA, 20 bp, Artificial Sequence
  chemically synthesized
caagtcttaaagagcaagaa

SEQ ID NO: 33064 - DNA, 20 bp, Artificial Sequence
  chemically synthesized
gtcttaaagagcaagaagag

SEQ ID NO: 33065 - DNA, 20 bp, Artificial Sequence
  chemically synthesized
tcttaaagagcaagaagagc

SEQ ID NO: 33066 - DNA, 20 bp, Artificial Sequence
  chemically synthesized
ttaaagagcaagaagagcag

SEQ ID NO: 33067 - DNA, 20 bp, Artificial Sequence
  chemically synthesized
agcaagaagagcaggagata

SEQ ID NO: 33068 - DNA, 20 bp, Artificial Sequence
  chemically synthesized
ctaaaaccccttaaagcata

SEQ ID NO: 33069 - DNA, 20 bp, Artificial Sequence
  chemically synthesized
agatatggtctctatgcttt

SEQ ID NO: 33070 - DNA, 20 bp, Artificial Sequence
  chemically synthesized
gatatggtctctatgcttta

SEQ ID NO: 33071 - DNA, 20 bp, Artificial Sequence
  chemically synthesized
tcctaaaaccccttaaagca

SEQ ID NO: 33072 - DNA, 20 bp, Artificial Sequence
  chemically synthesized
atatggtctctatgctttaa

SEQ ID NO: 33073 - DNA, 20 bp, Artificial Sequence
  chemically synthesized
tatggtctctatgctttaag

SEQ ID NO: 33074 - DNA, 20 bp, Artificial Sequence
  chemically synthesized
gggtgtcctaaaacccctta

SEQ ID NO: 33075 - DNA, 20 bp, Artificial Sequence
  chemically synthesized
ctctatgctttaaggggttt

SEQ ID NO: 33076 - DNA, 20 bp, Artificial Sequence
  chemically synthesized
tctatgctttaaggggtttt

SEQ ID NO: 33077 - DNA, 20 bp, Artificial Sequence
  chemically synthesized
ttttaggacaccccatgacc

SEQ ID NO: 33078 - DNA, 20 bp, Artificial Sequence
  chemically synthesized
cataaaccggcttggtcatg

SEQ ID NO: 33079 - DNA, 20 bp, Artificial Sequence
  chemically synthesized
tcataaaccggcttggtcat

SEQ ID NO: 33080 - DNA, 20 bp, Artificial Sequence
  chemically synthesized
atcataaaccggcttggtca

SEQ ID NO: 33081 - DNA, 20 bp, Artificial Sequence
  chemically synthesized
aggacaccccatgaccaagc

SEQ ID NO: 33082 - DNA, 20 bp, Artificial Sequence
  chemically synthesized
ctccagatcataaaccggct

SEQ ID NO: 33083 - DNA, 20 bp, Artificial Sequence
  chemically synthesized
cccttctccagatcataaac

SEQ ID NO: 33084 - DNA, 20 bp, Artificial Sequence
  chemically synthesized
gaccaagccggtttatgatc

SEQ ID NO: 33085 - DNA, 20 bp, Artificial Sequence
  chemically synthesized
ccaagccggtttatgatctg

SEQ ID NO: 33086 - DNA, 20 bp, Artificial Sequence
  chemically synthesized
agccggtttatgatctggag

SEQ ID NO: 33087 - DNA, 20 bp, Artificial Sequence
  chemically synthesized
gccggtttatgatctggaga

SEQ ID NO: 33088 - DNA, 20 bp, Artificial Sequence
  chemically synthesized
ccggtttatgatctggagaa

SEQ ID NO: 33089 - DNA, 20 bp, Artificial Sequence
  chemically synthesized
cggtttatgatctggagaag

SEQ ID NO: 33090 - DNA, 20 bp, Artificial Sequence
  chemically synthesized
agtcctgcctaccccttctc

SEQ ID NO: 33091 - DNA, 20 bp, Artificial Sequence
  chemically synthesized
tttatgatctggagaagggg

SEQ ID NO: 33092 - DNA, 20 bp, Artificial Sequence
  chemically synthesized
ttatgatctggagaaggggt

SEQ ID NO: 33093 - DNA, 20 bp, Artificial Sequence
  chemically synthesized
tgatctggagaaggggtagg

SEQ ID NO: 33094 - DNA, 20 bp, Artificial Sequence
  chemically synthesized
gatctggagaaggggtaggc

SEQ ID NO: 33095 - DNA, 20 bp, Artificial Sequence
  chemically synthesized
ggagaaggggtaggcaggac

SEQ ID NO: 33096 - DNA, 20 bp, Artificial Sequence
  chemically synthesized
gtgctgtgcatgtaaagtac

SEQ ID NO: 33097 - DNA, 20 bp, Artificial Sequence
  chemically synthesized
ctccttgtgctgtgcatgta

SEQ ID NO: 33098 - DNA, 20 bp, Artificial Sequence
  chemically synthesized
ggactggtactttacatgca

SEQ ID NO: 33099 - DNA, 20 bp, Artificial Sequence
  chemically synthesized
gtactttacatgcacagcac

SEQ ID NO: 33100 - DNA, 20 bp, Artificial Sequence
  chemically synthesized
tactttacatgcacagcaca

SEQ ID NO: 33101 - DNA, 20 bp, Artificial Sequence
  chemically synthesized
ctttacatgcacagcacaag

SEQ ID NO: 33102 - DNA, 20 bp, Artificial Sequence
  chemically synthesized
tttacatgcacagcacaagg

SEQ ID NO: 33103 - DNA, 20 bp, Artificial Sequence
  chemically synthesized
tgcacagcacaaggaggctg

SEQ ID NO: 33104 - DNA, 20 bp, Artificial Sequence
  chemically synthesized
cacaaggaggctgcagcttg

SEQ ID NO: 33105 - DNA, 20 bp, Artificial Sequence
  chemically synthesized
ttccacgaagctgcaagctg

SEQ ID NO: 33106 - DNA, 20 bp, Artificial Sequence
  chemically synthesized
cactttttccacgaagctgc

SEQ ID NO: 33107 - DNA, 20 bp, Artificial Sequence
  chemically synthesized
ggctgcagcttgcagcttcg

SEQ ID NO: 33108 - DNA, 20 bp, Artificial Sequence
  chemically synthesized
caagcaacactttttccacg

SEQ ID NO: 33109 - DNA, 20 bp, Artificial Sequence
  chemically synthesized
agcttgcagcttcgtggaaa

SEQ ID NO: 33110 - DNA, 20 bp, Artificial Sequence
  chemically synthesized
gaaaaagtgttgcttgttct

SEQ ID NO: 33111 - DNA, 20 bp, Artificial Sequence
  chemically synthesized
aaaaagtgttgcttgttctc

SEQ ID NO: 33112 - DNA, 20 bp, Artificial Sequence
  chemically synthesized
gctgagaaatgcctgagaac

SEQ ID NO: 33113 - DNA, 20 bp, Artificial Sequence
  chemically synthesized
ttccgagctgagaaatgcct

SEQ ID NO: 33114 - DNA, 20 bp, Artificial Sequence
  chemically synthesized
gcttgttctcaggcatttct

SEQ ID NO: 33115 - DNA, 20 bp, Artificial Sequence
  chemically synthesized
ttctcaggcatttctcagct

SEQ ID NO: 33116 - DNA, 20 bp, Artificial Sequence
  chemically synthesized
atacactcactttccgagct

SEQ ID NO: 33117 - DNA, 20 bp, Artificial Sequence
  chemically synthesized
caggcatttctcagctcgga

SEQ ID NO: 33118 - DNA, 20 bp, Artificial Sequence
  chemically synthesized
catttctcagctcggaaagt

SEQ ID NO: 33119 - DNA, 20 bp, Artificial Sequence
  chemically synthesized
ttggtatacactcactttcc

SEQ ID NO: 33120 - DNA, 20 bp, Artificial Sequence
  chemically synthesized
tctgcacttatatatggaat

SEQ ID NO: 33121 - DNA, 20 bp, Artificial Sequence
  chemically synthesized
tgtataccaattccatatat

SEQ ID NO: 33122 - DNA, 20 bp, Artificial Sequence
  chemically synthesized
ccttgctctgcacttatata

SEQ ID NO: 33123 - DNA, 20 bp, Artificial Sequence
  chemically synthesized
accaattccatatataagtg

SEQ ID NO: 33124 - DNA, 20 bp, Artificial Sequence
  chemically synthesized
caattccatatataagtgca

SEQ ID NO: 33125 - DNA, 20 bp, Artificial Sequence
  chemically synthesized
tccatatataagtgcagagc

SEQ ID NO: 33126 - DNA, 20 bp, Artificial Sequence
  chemically synthesized
ccatatataagtgcagagca

SEQ ID NO: 33127 - DNA, 20 bp, Artificial Sequence
  chemically synthesized
atataagtgcagagcaagga

SEQ ID NO: 33128 - DNA, 20 bp, Artificial Sequence
  chemically synthesized
tataagtgcagagcaaggaa

SEQ ID NO: 33129 - DNA, 20 bp, Artificial Sequence
  chemically synthesized
aggaaaggttaccttctatt

SEQ ID NO: 33130 - DNA, 20 bp, Artificial Sequence
  chemically synthesized
tgcagggtggtctcaataga

SEQ ID NO: 33131 - DNA, 20 bp, Artificial Sequence
  chemically synthesized
atgcagggtggtctcaatag

SEQ ID NO: 33132 - DNA, 20 bp, Artificial Sequence
  chemically synthesized
tgaatgcagggtggtctcaa

SEQ ID NO: 33133 - DNA, 20 bp, Artificial Sequence
  chemically synthesized
gaggaggcctgaatgcaggg

SEQ ID NO: 33134 - DNA, 20 bp, Artificial Sequence
  chemically synthesized
tattgagaccaccctgcatt

SEQ ID NO: 33135 - DNA, 20 bp, Artificial Sequence
  chemically synthesized
attgagaccaccctgcattc

SEQ ID NO: 33136 - DNA, 20 bp, Artificial Sequence
  chemically synthesized
atagaggaggcctgaatgca

SEQ ID NO: 33137 - DNA, 20 bp, Artificial Sequence
  chemically synthesized
aatagaggaggcctgaatgc

SEQ ID NO: 33138 - DNA, 20 bp, Artificial Sequence
  chemically synthesized
aaatagaggaggcctgaatg

SEQ ID NO: 33139 - DNA, 20 bp, Artificial Sequence
  chemically synthesized
atgacctttggaaatagagg

SEQ ID NO: 33140 - DNA, 20 bp, Artificial Sequence
  chemically synthesized
gatgacctttggaaatagag

SEQ ID NO: 33141 - DNA, 20 bp, Artificial Sequence
  chemically synthesized
tggatgacctttggaaatag

SEQ ID NO: 33142 - DNA, 20 bp, Artificial Sequence
  chemically synthesized
ctggatgacctttggaaata

SEQ ID NO: 33143 - DNA, 20 bp, Artificial Sequence
  chemically synthesized
tcaggcctcctctatttcca

SEQ ID NO: 33144 - DNA, 20 bp, Artificial Sequence
  chemically synthesized
caggcctcctctatttccaa

SEQ ID NO: 33145 - DNA, 20 bp, Artificial Sequence
  chemically synthesized
atctggatgacctttggaaa

SEQ ID NO: 33146 - DNA, 20 bp, Artificial Sequence
  chemically synthesized
tatcacatctggatgacctt

SEQ ID NO: 33147 - DNA, 20 bp, Artificial Sequence
  chemically synthesized
ctctatttccaaaggtcatc

SEQ ID NO: 33148 - DNA, 20 bp, Artificial Sequence
  chemically synthesized
cctggtgcttatatcacatc

SEQ ID NO: 33149 - DNA, 20 bp, Artificial Sequence
  chemically synthesized
aggtcatccagatgtgatat

SEQ ID NO: 33150 - DNA, 20 bp, Artificial Sequence
  chemically synthesized
tccagatgtgatataagcac

SEQ ID NO: 33151 - DNA, 20 bp, Artificial Sequence
  chemically synthesized
ccagatgtgatataagcacc

SEQ ID NO: 33152 - DNA, 20 bp, Artificial Sequence
  chemically synthesized
cagatgtgatataagcacca

SEQ ID NO: 33153 - DNA, 20 bp, Artificial Sequence
  chemically synthesized
gatgtgatataagcaccagg

SEQ ID NO: 33154 - DNA, 20 bp, Artificial Sequence
  chemically synthesized
tgatataagcaccagggaga

SEQ ID NO: 33155 - DNA, 20 bp, Artificial Sequence
  chemically synthesized
gatataagcaccagggagaa

SEQ ID NO: 33156 - DNA, 20 bp, Artificial Sequence
  chemically synthesized
cttcgctcttcctttctccc

SEQ ID NO: 33157 - DNA, 20 bp, Artificial Sequence
  chemically synthesized
ataagcaccagggagaaagg

SEQ ID NO: 33158 - DNA, 20 bp, Artificial Sequence
  chemically synthesized
aagcaccagggagaaaggaa

SEQ ID NO: 33159 - DNA, 20 bp, Artificial Sequence
  chemically synthesized
ccagggagaaaggaagagcg

SEQ ID NO: 33160 - DNA, 20 bp, Artificial Sequence
  chemically synthesized
agggagaaaggaagagcgaa

SEQ ID NO: 33161 - DNA, 20 bp, Artificial Sequence
  chemically synthesized
ggagaaaggaagagcgaaga

SEQ ID NO: 33162 - DNA, 20 bp, Artificial Sequence
  chemically synthesized
gagaaaggaagagcgaagag

SEQ ID NO: 33163 - DNA, 20 bp, Artificial Sequence
  chemically synthesized
aaaggaagagcgaagagagg

SEQ ID NO: 33164 - DNA, 20 bp, Artificial Sequence
  chemically synthesized
gtgtgagcccttgtacatgt

SEQ ID NO: 33165 - DNA, 20 bp, Artificial Sequence
  chemically synthesized
acatgtgtgcccacatgtac

SEQ ID NO: 33166 - DNA, 20 bp, Artificial Sequence
  chemically synthesized
tgtgtgagcccttgtacatg

SEQ ID NO: 33167 - DNA, 20 bp, Artificial Sequence
  chemically synthesized
catgtgtgcccacatgtaca

SEQ ID NO: 33168 - DNA, 20 bp, Artificial Sequence
  chemically synthesized
atgtgtgcccacatgtacaa

SEQ ID NO: 33169 - DNA, 20 bp, Artificial Sequence
  chemically synthesized
cacatgtacaagggctcaca

SEQ ID NO: 33170 - DNA, 20 bp, Artificial Sequence
  chemically synthesized
acatgtacaagggctcacac

SEQ ID NO: 33171 - DNA, 20 bp, Artificial Sequence
  chemically synthesized
tgactagtaagggcctgtgt

SEQ ID NO: 33172 - DNA, 20 bp, Artificial Sequence
  chemically synthesized
gggctcacacaggcccttac

SEQ ID NO: 33173 - DNA, 20 bp, Artificial Sequence
  chemically synthesized
ttacacagtgtgactagtaa

SEQ ID NO: 33174 - DNA, 20 bp, Artificial Sequence
  chemically synthesized
gttacacagtgtgactagta

SEQ ID NO: 33175 - DNA, 20 bp, Artificial Sequence
  chemically synthesized
tgttacacagtgtgactagt

SEQ ID NO: 33176 - DNA, 20 bp, Artificial Sequence
  chemically synthesized
ttgttgttacacagtgtgac

SEQ ID NO: 33177 - DNA, 20 bp, Artificial Sequence
  chemically synthesized
gatgggacattgttgttaca

SEQ ID NO: 33178 - DNA, 20 bp, Artificial Sequence
  chemically synthesized
taacaacaatgtcccatctc

SEQ ID NO: 33179 - DNA, 20 bp, Artificial Sequence
  chemically synthesized
aacaacaatgtcccatctcc

SEQ ID NO: 33180 - DNA, 20 bp, Artificial Sequence
  chemically synthesized
cttacaaatatcctggagat

SEQ ID NO: 33181 - DNA, 20 bp, Artificial Sequence
  chemically synthesized
ccttacaaatatcctggaga

SEQ ID NO: 33182 - DNA, 20 bp, Artificial Sequence
  chemically synthesized
cggtccttacaaatatcctg

SEQ ID NO: 33183 - DNA, 20 bp, Artificial Sequence
  chemically synthesized
tacggtccttacaaatatcc

SEQ ID NO: 33184 - DNA, 20 bp, Artificial Sequence
  chemically synthesized
cccatctccaggatatttgt

SEQ ID NO: 33185 - DNA, 20 bp, Artificial Sequence
  chemically synthesized
ccatctccaggatatttgta

SEQ ID NO: 33186 - DNA, 20 bp, Artificial Sequence
  chemically synthesized
caggatatttgtaaggaccg

SEQ ID NO: 33187 - DNA, 20 bp, Artificial Sequence
  chemically synthesized
cagacctatagaagatgcta

SEQ ID NO: 33188 - DNA, 20 bp, Artificial Sequence
  chemically synthesized
aaggaccgtagcatcttcta

SEQ ID NO: 33189 - DNA, 20 bp, Artificial Sequence
  chemically synthesized
aggaccgtagcatcttctat

SEQ ID NO: 33190 - DNA, 20 bp, Artificial Sequence
  chemically synthesized
gtttttctgcagacctatag

SEQ ID NO: 33191 - DNA, 20 bp, Artificial Sequence
  chemically synthesized
aatgtttttctgcagaccta

SEQ ID NO: 33192 - DNA, 20 bp, Artificial Sequence
  chemically synthesized
tagcatcttctataggtctg

SEQ ID NO: 33193 - DNA, 20 bp, Artificial Sequence
  chemically synthesized
ctcagctaaatgtttttctg

SEQ ID NO: 33194 - DNA, 20 bp, Artificial Sequence
  chemically synthesized
taggtctgcagaaaaacatt

SEQ ID NO: 33195 - DNA, 20 bp, Artificial Sequence
  chemically synthesized
ctgcagaaaaacatttagct

SEQ ID NO: 33196 - DNA, 20 bp, Artificial Sequence
  chemically synthesized
aaacatttagctgagctgat

SEQ ID NO: 33197 - DNA, 20 bp, Artificial Sequence
  chemically synthesized
tctgatcaggcttatcagct

SEQ ID NO: 33198 - DNA, 20 bp, Artificial Sequence
  chemically synthesized
ctctgtctgatcaggcttat

SEQ ID NO: 33199 - DNA, 20 bp, Artificial Sequence
  chemically synthesized
gctgagctgataagcctgat

SEQ ID NO: 33200 - DNA, 20 bp, Artificial Sequence
  chemically synthesized
agctgataagcctgatcaga

SEQ ID NO: 33201 - DNA, 20 bp, Artificial Sequence
  chemically synthesized
ttccctgtctctgtctgatc

SEQ ID NO: 33202 - DNA, 20 bp, Artificial Sequence
  chemically synthesized
gttccctgtctctgtctgat

SEQ ID NO: 33203 - DNA, 20 bp, Artificial Sequence
  chemically synthesized
ctgataagcctgatcagaca

SEQ ID NO: 33204 - DNA, 20 bp, Artificial Sequence
  chemically synthesized
taagcctgatcagacagaga

SEQ ID NO: 33205 - DNA, 20 bp, Artificial Sequence
  chemically synthesized
aagcctgatcagacagagac

SEQ ID NO: 33206 - DNA, 20 bp, Artificial Sequence
  chemically synthesized
agcctgatcagacagagaca

SEQ ID NO: 33207 - DNA, 20 bp, Artificial Sequence
  chemically synthesized
cagacagagacagggaacca

SEQ ID NO: 33208 - DNA, 20 bp, Artificial Sequence
  chemically synthesized
agacagggaaccacggtgaa

SEQ ID NO: 33209 - DNA, 20 bp, Artificial Sequence
  chemically synthesized
cagatggtggcttttcaccg

SEQ ID NO: 33210 - DNA, 20 bp, Artificial Sequence
  chemically synthesized
cacggtgaaaagccaccatc

SEQ ID NO: 33211 - DNA, 20 bp, Artificial Sequence
  chemically synthesized
ttgaagtccattccagatgg

SEQ ID NO: 33212 - DNA, 20 bp, Artificial Sequence
  chemically synthesized
tgaaaagccaccatctggaa

SEQ ID NO: 33213 - DNA, 20 bp, Artificial Sequence
  chemically synthesized
aatttgaagtccattccaga

SEQ ID NO: 33214 - DNA, 20 bp, Artificial Sequence
  chemically synthesized
ctctaatttgaagtccattc

SEQ ID NO: 33215 - DNA, 20 bp, Artificial Sequence
  chemically synthesized
atctggaatggacttcaaat

SEQ ID NO: 33216 - DNA, 20 bp, Artificial Sequence
  chemically synthesized
ctggaatggacttcaaatta

SEQ ID NO: 33217 - DNA, 20 bp, Artificial Sequence
  chemically synthesized
gcctatgttcctctaatttg

SEQ ID NO: 33218 - DNA, 20 bp, Artificial Sequence
  chemically synthesized
tggaatggacttcaaattag

SEQ ID NO: 33219 - DNA, 20 bp, Artificial Sequence
  chemically synthesized
gacttcaaattagaggaaca

SEQ ID NO: 33220 - DNA, 20 bp, Artificial Sequence
  chemically synthesized
acttcaaattagaggaacat

SEQ ID NO: 33221 - DNA, 20 bp, Artificial Sequence
  chemically synthesized
caaattagaggaacataggc

SEQ ID NO: 33222 - DNA, 20 bp, Artificial Sequence
  chemically synthesized
tttagaactgtgtttggtac

SEQ ID NO: 33223 - DNA, 20 bp, Artificial Sequence
  chemically synthesized
ttttagaactgtgtttggta

SEQ ID NO: 33224 - DNA, 20 bp, Artificial Sequence
  chemically synthesized
aaataaacctgtaccaaaca

SEQ ID NO: 33225 - DNA, 20 bp, Artificial Sequence
  chemically synthesized
tttccttttagaactgtgtt

SEQ ID NO: 33226 - DNA, 20 bp, Artificial Sequence
  chemically synthesized
tgtaccaaacacagttctaa

SEQ ID NO: 33227 - DNA, 20 bp, Artificial Sequence
  chemically synthesized
gtaccaaacacagttctaaa

SEQ ID NO: 33228 - DNA, 20 bp, Artificial Sequence
  chemically synthesized
caaacacagttctaaaagga

SEQ ID NO: 33229 - DNA, 20 bp, Artificial Sequence
  chemically synthesized
aaacacagttctaaaaggaa

SEQ ID NO: 33230 - DNA, 20 bp, Artificial Sequence
  chemically synthesized
acactgtttccctttccttt

SEQ ID NO: 33231 - DNA, 20 bp, Artificial Sequence
  chemically synthesized
aacacagttctaaaaggaaa

SEQ ID NO: 33232 - DNA, 20 bp, Artificial Sequence
  chemically synthesized
gttctaaaaggaaagggaaa

SEQ ID NO: 33233 - DNA, 20 bp, Artificial Sequence
  chemically synthesized
gaaacagtgtgtacaattta

SEQ ID NO: 33234 - DNA, 20 bp, Artificial Sequence
  chemically synthesized
aaacagtgtgtacaatttac

SEQ ID NO: 33235 - DNA, 20 bp, Artificial Sequence
  chemically synthesized
acagtgtgtacaatttacag

SEQ ID NO: 33236 - DNA, 20 bp, Artificial Sequence
  chemically synthesized
atttacaggagaatcccaca

SEQ ID NO: 33237 - DNA, 20 bp, Artificial Sequence
  chemically synthesized
agccctcattcattctatgt

SEQ ID NO: 33238 - DNA, 20 bp, Artificial Sequence
  chemically synthesized
aagccctcattcattctatg

SEQ ID NO: 33239 - DNA, 20 bp, Artificial Sequence
  chemically synthesized
gaatcccacatagaatgaat

SEQ ID NO: 33240 - DNA, 20 bp, Artificial Sequence
  chemically synthesized
aatcccacatagaatgaatg

SEQ ID NO: 33241 - DNA, 20 bp, Artificial Sequence
  chemically synthesized
atcccacatagaatgaatga

SEQ ID NO: 33242 - DNA, 20 bp, Artificial Sequence
  chemically synthesized
tagaatgaatgagggcttca

SEQ ID NO: 33243 - DNA, 20 bp, Artificial Sequence
  chemically synthesized
gaatgaatgagggcttcatg

SEQ ID NO: 33244 - DNA, 20 bp, Artificial Sequence
  chemically synthesized
agaagatggggagctccatg

SEQ ID NO: 33245 - DNA, 20 bp, Artificial Sequence
  chemically synthesized
aaatttctttagaagatggg

SEQ ID NO: 33246 - DNA, 20 bp, Artificial Sequence
  chemically synthesized
tgaaatttctttagaagatg

SEQ ID NO: 33247 - DNA, 20 bp, Artificial Sequence
  chemically synthesized
atgaaatttctttagaagat

SEQ ID NO: 33248 - DNA, 20 bp, Artificial Sequence
  chemically synthesized
atggagctccccatcttcta

SEQ ID NO: 33249 - DNA, 20 bp, Artificial Sequence
  chemically synthesized
catgaaatttctttagaaga

SEQ ID NO: 33250 - DNA, 20 bp, Artificial Sequence
  chemically synthesized
cagtcatgaaatttctttag

SEQ ID NO: 33251 - DNA, 20 bp, Artificial Sequence
  chemically synthesized
caacagtcatgaaatttctt

SEQ ID NO: 33252 - DNA, 20 bp, Artificial Sequence
  chemically synthesized
taaagaaatttcatgactgt

SEQ ID NO: 33253 - DNA, 20 bp, Artificial Sequence
  chemically synthesized
caggaatgtatgtatgccaa

SEQ ID NO: 33254 - DNA, 20 bp, Artificial Sequence
  chemically synthesized
aataaattctttaaaaaggc

SEQ ID NO: 33255 - DNA, 20 bp, Artificial Sequence
  chemically synthesized
aaataaattctttaaaaagg

SEQ ID NO: 33256 - DNA, 20 bp, Artificial Sequence
  chemically synthesized
catacattcctgccttttta

SEQ ID NO: 33257 - DNA, 20 bp, Artificial Sequence
  chemically synthesized
tcaaaataaattctttaaaa

SEQ ID NO: 33258 - DNA, 20 bp, Artificial Sequence
  chemically synthesized
ttcaaaataaattctttaaa

SEQ ID NO: 33259 - DNA, 20 bp, Artificial Sequence
  chemically synthesized
tttttaaagaatttattttg

SEQ ID NO: 33260 - DNA, 20 bp, Artificial Sequence
  chemically synthesized
ttttaaagaatttattttga

SEQ ID NO: 33261 - DNA, 20 bp, Artificial Sequence
  chemically synthesized
ttgaaggttaaaattatgaa

SEQ ID NO: 33262 - DNA, 20 bp, Artificial Sequence
  chemically synthesized
tgaaggttaaaattatgaaa

SEQ ID NO: 33263 - DNA, 20 bp, Artificial Sequence
  chemically synthesized
gaaggttaaaattatgaaaa

SEQ ID NO: 33264 - DNA, 20 bp, Artificial Sequence
  chemically synthesized
taaaattatgaaaagggttt

SEQ ID NO: 33265 - DNA, 20 bp, Artificial Sequence
  chemically synthesized
attatttttttttaatccat

SEQ ID NO: 33266 - DNA, 20 bp, Artificial Sequence
  chemically synthesized
tcagttttgccgaggactga

SEQ ID NO: 33267 - DNA, 20 bp, Artificial Sequence
  chemically synthesized
ttttttaatccatcagtcct

SEQ ID NO: 33268 - DNA, 20 bp, Artificial Sequence
  chemically synthesized
ggagattttcagttttgccg

SEQ ID NO: 33269 - DNA, 20 bp, Artificial Sequence
  chemically synthesized
aggagattttcagttttgcc

SEQ ID NO: 33270 - DNA, 20 bp, Artificial Sequence
  chemically synthesized
cttccagtaaaggagatttt

SEQ ID NO: 33271 - DNA, 20 bp, Artificial Sequence
  chemically synthesized
aaactgaaaatctcctttac

SEQ ID NO: 33272 - DNA, 20 bp, Artificial Sequence
  chemically synthesized
tcctccttcttccagtaaag

SEQ ID NO: 33273 - DNA, 20 bp, Artificial Sequence
  chemically synthesized
ctgaaaatctcctttactgg

SEQ ID NO: 33274 - DNA, 20 bp, Artificial Sequence
  chemically synthesized
tttcctccttcttccagtaa

SEQ ID NO: 33275 - DNA, 20 bp, Artificial Sequence
  chemically synthesized
atttcctccttcttccagta

SEQ ID NO: 33276 - DNA, 20 bp, Artificial Sequence
  chemically synthesized
aaaatctcctttactggaag

SEQ ID NO: 33277 - DNA, 20 bp, Artificial Sequence
  chemically synthesized
aaatctcctttactggaaga

SEQ ID NO: 33278 - DNA, 20 bp, Artificial Sequence
  chemically synthesized
atctcctttactggaagaag

SEQ ID NO: 33279 - DNA, 20 bp, Artificial Sequence
  chemically synthesized
ttagaatttcctccttcttc

SEQ ID NO: 33280 - DNA, 20 bp, Artificial Sequence
  chemically synthesized
tctcctttactggaagaagg

SEQ ID NO: 33281 - DNA, 20 bp, Artificial Sequence
  chemically synthesized
tggaagaaggaggaaattct

SEQ ID NO: 33282 - DNA, 20 bp, Artificial Sequence
  chemically synthesized
gggcaatggaattgggggct

SEQ ID NO: 33283 - DNA, 20 bp, Artificial Sequence
  chemically synthesized
caaatgggcaatggaattgg

SEQ ID NO: 33284 - DNA, 20 bp, Artificial Sequence
  chemically synthesized
acaaatgggcaatggaattg

SEQ ID NO: 33285 - DNA, 20 bp, Artificial Sequence
  chemically synthesized
cacaaatgggcaatggaatt

SEQ ID NO: 33286 - DNA, 20 bp, Artificial Sequence
  chemically synthesized
tcacaaatgggcaatggaat

SEQ ID NO: 33287 - DNA, 20 bp, Artificial Sequence
  chemically synthesized
cttaactcacaaatgggcaa

SEQ ID NO: 33288 - DNA, 20 bp, Artificial Sequence
  chemically synthesized
caattccattgcccatttgt

SEQ ID NO: 33289 - DNA, 20 bp, Artificial Sequence
  chemically synthesized
tagtatcttaactcacaaat

SEQ ID NO: 33290 - DNA, 20 bp, Artificial Sequence
  chemically synthesized
ctagtatcttaactcacaaa

SEQ ID NO: 33291 - DNA, 20 bp, Artificial Sequence
  chemically synthesized
ccattgcccatttgtgagtt

SEQ ID NO: 33292 - DNA, 20 bp, Artificial Sequence
  chemically synthesized
ccatttgtgagttaagatac

SEQ ID NO: 33293 - DNA, 20 bp, Artificial Sequence
  chemically synthesized
gaatagtacctatcaaggac

SEQ ID NO: 33294 - DNA, 20 bp, Artificial Sequence
  chemically synthesized
gttaagatactagtccttga

SEQ ID NO: 33295 - DNA, 20 bp, Artificial Sequence
  chemically synthesized
ttaagatactagtccttgat

SEQ ID NO: 33296 - DNA, 20 bp, Artificial Sequence
  chemically synthesized
tgggagaatagtacctatca

SEQ ID NO: 33297 - DNA, 20 bp, Artificial Sequence
  chemically synthesized
ctgggagaatagtacctatc

SEQ ID NO: 33298 - DNA, 20 bp, Artificial Sequence
  chemically synthesized
cttgataggtactattctcc

SEQ ID NO: 33299 - DNA, 20 bp, Artificial Sequence
  chemically synthesized
atcacagataactgggagaa

SEQ ID NO: 33300 - DNA, 20 bp, Artificial Sequence
  chemically synthesized
ccagaatcacagataactgg

SEQ ID NO: 33301 - DNA, 20 bp, Artificial Sequence
  chemically synthesized
ccccagaatcacagataact

SEQ ID NO: 33302 - DNA, 20 bp, Artificial Sequence
  chemically synthesized
cccccagaatcacagataac

SEQ ID NO: 33303 - DNA, 20 bp, Artificial Sequence
  chemically synthesized
ctcccagttatctgtgattc

SEQ ID NO: 33304 - DNA, 20 bp, Artificial Sequence
  chemically synthesized
tcccagttatctgtgattct

SEQ ID NO: 33305 - DNA, 20 bp, Artificial Sequence
  chemically synthesized
attcaagtcccccagaatca

SEQ ID NO: 33306 - DNA, 20 bp, Artificial Sequence
  chemically synthesized
cccagttatctgtgattctg

SEQ ID NO: 33307 - DNA, 20 bp, Artificial Sequence
  chemically synthesized
ccagttatctgtgattctgg

SEQ ID NO: 33308 - DNA, 20 bp, Artificial Sequence
  chemically synthesized
tctatgttattcaagtcccc

SEQ ID NO: 33309 - DNA, 20 bp, Artificial Sequence
  chemically synthesized
ttcatttatctatgttattc

SEQ ID NO: 33310 - DNA, 20 bp, Artificial Sequence
  chemically synthesized
tctgggggacttgaataaca

SEQ ID NO: 33311 - DNA, 20 bp, Artificial Sequence
  chemically synthesized
agcttctggaattgtttgag

SEQ ID NO: 33312 - DNA, 20 bp, Artificial Sequence
  chemically synthesized
ttagcttctggaattgtttg

SEQ ID NO: 33313 - DNA, 20 bp, Artificial Sequence
  chemically synthesized
gttagcttctggaattgttt

SEQ ID NO: 33314 - DNA, 20 bp, Artificial Sequence
  chemically synthesized
atgaactcctcaaacaattc

SEQ ID NO: 33315 - DNA, 20 bp, Artificial Sequence
  chemically synthesized
aactcctcaaacaattccag

SEQ ID NO: 33316 - DNA, 20 bp, Artificial Sequence
  chemically synthesized
aggtgagaaaggttagcttc

SEQ ID NO: 33317 - DNA, 20 bp, Artificial Sequence
  chemically synthesized
gtgttgaaggtgagaaaggt

SEQ ID NO: 33318 - DNA, 20 bp, Artificial Sequence
  chemically synthesized
ttgtgtgttgaaggtgagaa

SEQ ID NO: 33319 - DNA, 20 bp, Artificial Sequence
  chemically synthesized
tttgtgtgttgaaggtgaga

SEQ ID NO: 33320 - DNA, 20 bp, Artificial Sequence
  chemically synthesized
aaggtttgtgtgttgaaggt

SEQ ID NO: 33321 - DNA, 20 bp, Artificial Sequence
  chemically synthesized
ataaaaggtttgtgtgttga

SEQ ID NO: 33322 - DNA, 20 bp, Artificial Sequence
  chemically synthesized
aataaaaggtttgtgtgttg

SEQ ID NO: 33323 - DNA, 20 bp, Artificial Sequence
  chemically synthesized
ttgcattgcttagaaataaa

SEQ ID NO: 33324 - DNA, 20 bp, Artificial Sequence
  chemically synthesized
tttgcattgcttagaaataa

SEQ ID NO: 33325 - DNA, 20 bp, Artificial Sequence
  chemically synthesized
cacacaaaccttttatttct

SEQ ID NO: 33326 - DNA, 20 bp, Artificial Sequence
  chemically synthesized
tctagttcttttgcattgct

SEQ ID NO: 33327 - DNA, 20 bp, Artificial Sequence
  chemically synthesized
tttatttctaagcaatgcaa

SEQ ID NO: 33328 - DNA, 20 bp, Artificial Sequence
  chemically synthesized
tctaagcaatgcaaaagaac

SEQ ID NO: 33329 - DNA, 20 bp, Artificial Sequence
  chemically synthesized
atgcaaaagaactagaaaaa

SEQ ID NO: 33330 - DNA, 20 bp, Artificial Sequence
  chemically synthesized
gaaatctaaatctgtttttc

SEQ ID NO: 33331 - DNA, 20 bp, Artificial Sequence
  chemically synthesized
aagaactagaaaaacagatt

SEQ ID NO: 33332 - DNA, 20 bp, Artificial Sequence
  chemically synthesized
agatttagatttcacctttg

SEQ ID NO: 33333 - DNA, 20 bp, Artificial Sequence
  chemically synthesized
aagtgaaactaagactgcaa

SEQ ID NO: 33334 - DNA, 20 bp, Artificial Sequence
  chemically synthesized
gaagtgaaactaagactgca

SEQ ID NO: 33335 - DNA, 20 bp, Artificial Sequence
  chemically synthesized
agatttcacctttgcagtct

SEQ ID NO: 33336 - DNA, 20 bp, Artificial Sequence
  chemically synthesized
tttgcaattgaagtgaaact

SEQ ID NO: 33337 - DNA, 20 bp, Artificial Sequence
  chemically synthesized
ttagaactgatttgcaattg

SEQ ID NO: 33338 - DNA, 20 bp, Artificial Sequence
  chemically synthesized
gtttcacttcaattgcaaat

SEQ ID NO: 33339 - DNA, 20 bp, Artificial Sequence
  chemically synthesized
ttcaattgcaaatcagttct

SEQ ID NO: 33340 - DNA, 20 bp, Artificial Sequence
  chemically synthesized
tgcaaatcagttctaagcaa

SEQ ID NO: 33341 - DNA, 20 bp, Artificial Sequence
  chemically synthesized
ttgtgctcacttcttttgct

SEQ ID NO: 33342 - DNA, 20 bp, Artificial Sequence
  chemically synthesized
aaatcagttctaagcaaaag

SEQ ID NO: 33343 - DNA, 20 bp, Artificial Sequence
  chemically synthesized
cagttctaagcaaaagaagt

SEQ ID NO: 33344 - DNA, 20 bp, Artificial Sequence
  chemically synthesized
taagcaaaagaagtgagcac

SEQ ID NO: 33345 - DNA, 20 bp, Artificial Sequence
  chemically synthesized
gcaaaagaagtgagcacaag

SEQ ID NO: 33346 - DNA, 20 bp, Artificial Sequence
  chemically synthesized
aagaagtgagcacaagtgga

SEQ ID NO: 33347 - DNA, 20 bp, Artificial Sequence
  chemically synthesized
aagtgagcacaagtggaaag

SEQ ID NO: 33348 - DNA, 20 bp, Artificial Sequence
  chemically synthesized
agcacaagtggaaagaagaa

SEQ ID NO: 33349 - DNA, 20 bp, Artificial Sequence
  chemically synthesized
gtggaaagaagaaaagaata

SEQ ID NO: 33350 - DNA, 20 bp, Artificial Sequence
  chemically synthesized
tggaaagaagaaaagaataa

SEQ ID NO: 33351 - DNA, 20 bp, Artificial Sequence
  chemically synthesized
ggaaagaagaaaagaataaa

SEQ ID NO: 33352 - DNA, 20 bp, Artificial Sequence
  chemically synthesized
atttttctcgttttaagaat

SEQ ID NO: 33353 - DNA, 20 bp, Artificial Sequence
  chemically synthesized
gtgtgactaattcttaaaac

SEQ ID NO: 33354 - DNA, 20 bp, Artificial Sequence
  chemically synthesized
aagactatttttctcgtttt

SEQ ID NO: 33355 - DNA, 20 bp, Artificial Sequence
  chemically synthesized
aattcttaaaacgagaaaaa

SEQ ID NO: 33356 - DNA, 20 bp, Artificial Sequence
  chemically synthesized
ttttagcattaaatgattaa

SEQ ID NO: 33357 - DNA, 20 bp, Artificial Sequence
  chemically synthesized
gctacgttgccaagcatttt

SEQ ID NO: 33358 - DNA, 20 bp, Artificial Sequence
  chemically synthesized
catttaatgctaaaaatgct

SEQ ID NO: 33359 - DNA, 20 bp, Artificial Sequence
  chemically synthesized
gctaaaaatgcttggcaacg

SEQ ID NO: 33360 - DNA, 20 bp, Artificial Sequence
  chemically synthesized
ggttttttggctacgttgcc

SEQ ID NO: 33361 - DNA, 20 bp, Artificial Sequence
  chemically synthesized
caaagaatctgaaggttttt

SEQ ID NO: 33362 - DNA, 20 bp, Artificial Sequence
  chemically synthesized
caacgtagccaaaaaacctt

SEQ ID NO: 33363 - DNA, 20 bp, Artificial Sequence
  chemically synthesized
atagttaccaaagaatctga

SEQ ID NO: 33364 - DNA, 20 bp, Artificial Sequence
  chemically synthesized
tatagttaccaaagaatctg

SEQ ID NO: 33365 - DNA, 20 bp, Artificial Sequence
  chemically synthesized
caaaaaaccttcagattctt

SEQ ID NO: 33366 - DNA, 20 bp, Artificial Sequence
  chemically synthesized
ggttcgtcatatagttacca

SEQ ID NO: 33367 - DNA, 20 bp, Artificial Sequence
  chemically synthesized
tgaatatttggttcgtcata

SEQ ID NO: 33368 - DNA, 20 bp, Artificial Sequence
  chemically synthesized
caagccgtgaagtgaatatt

SEQ ID NO: 33369 - DNA, 20 bp, Artificial Sequence
  chemically synthesized
cgaaccaaatattcacttca

SEQ ID NO: 33370 - DNA, 20 bp, Artificial Sequence
  chemically synthesized
gtagaaaataacaagccgtg

SEQ ID NO: 33371 - DNA, 20 bp, Artificial Sequence
  chemically synthesized
catcacaggtagaaaataac

SEQ ID NO: 33372 - DNA, 20 bp, Artificial Sequence
  chemically synthesized
ggctctggattcatcacagg

SEQ ID NO: 33373 - DNA, 20 bp, Artificial Sequence
  chemically synthesized
tggggctctggattcatcac

SEQ ID NO: 33374 - DNA, 20 bp, Artificial Sequence
  chemically synthesized
gtggggctctggattcatca

SEQ ID NO: 33375 - DNA, 20 bp, Artificial Sequence
  chemically synthesized
ttttctacctgtgatgaatc

SEQ ID NO: 33376 - DNA, 20 bp, Artificial Sequence
  chemically synthesized
ttctacctgtgatgaatcca

SEQ ID NO: 33377 - DNA, 20 bp, Artificial Sequence
  chemically synthesized
aatgtgtcccagtggggctc

SEQ ID NO: 33378 - DNA, 20 bp, Artificial Sequence
  chemically synthesized
tgatgaatccagagccccac

SEQ ID NO: 33379 - DNA, 20 bp, Artificial Sequence
  chemically synthesized
gatgaatccagagccccact

SEQ ID NO: 33380 - DNA, 20 bp, Artificial Sequence
  chemically synthesized
gggttaaatgtgtcccagtg

SEQ ID NO: 33381 - DNA, 20 bp, Artificial Sequence
  chemically synthesized
agggttaaatgtgtcccagt

SEQ ID NO: 33382 - DNA, 20 bp, Artificial Sequence
  chemically synthesized
gagggttaaatgtgtcccag

SEQ ID NO: 33383 - DNA, 20 bp, Artificial Sequence
  chemically synthesized
ttggagggttaaatgtgtcc

SEQ ID NO: 33384 - DNA, 20 bp, Artificial Sequence
  chemically synthesized
acacatttaaccctccaaaa

SEQ ID NO: 33385 - DNA, 20 bp, Artificial Sequence
  chemically synthesized
tagttcctatctattttgga

SEQ ID NO: 33386 - DNA, 20 bp, Artificial Sequence
  chemically synthesized
atagttcctatctattttgg

SEQ ID NO: 33387 - DNA, 20 bp, Artificial Sequence
  chemically synthesized
catagttcctatctattttg

SEQ ID NO: 33388 - DNA, 20 bp, Artificial Sequence
  chemically synthesized
atttaaccctccaaaataga

SEQ ID NO: 33389 - DNA, 20 bp, Artificial Sequence
  chemically synthesized
ttcatagttcctatctattt

SEQ ID NO: 33390 - DNA, 20 bp, Artificial Sequence
  chemically synthesized
tttaaccctccaaaatagat

SEQ ID NO: 33391 - DNA, 20 bp, Artificial Sequence
  chemically synthesized
atagataggaactatgaata

SEQ ID NO: 33392 - DNA, 20 bp, Artificial Sequence
  chemically synthesized
tttcatccagtccatattca

SEQ ID NO: 33393 - DNA, 20 bp, Artificial Sequence
  chemically synthesized
taggaactatgaatatggac

SEQ ID NO: 33394 - DNA, 20 bp, Artificial Sequence
  chemically synthesized
tttgtgcttacagtttcatc

SEQ ID NO: 33395 - DNA, 20 bp, Artificial Sequence
  chemically synthesized
tatggactggatgaaactgt

SEQ ID NO: 33396 - DNA, 20 bp, Artificial Sequence
  chemically synthesized
gttatgcagatttgtgctta

SEQ ID NO: 33397 - DNA, 20 bp, Artificial Sequence
  chemically synthesized
caagatagatatgagttatg

SEQ ID NO: 33398 - DNA, 20 bp, Artificial Sequence
  chemically synthesized
tcaaggtacaagatagatat

SEQ ID NO: 33399 - DNA, 20 bp, Artificial Sequence
  chemically synthesized
ttgtccttcaaggtacaaga

SEQ ID NO: 33400 - DNA, 20 bp, Artificial Sequence
  chemically synthesized
tggtttgtccttcaaggtac

SEQ ID NO: 33401 - DNA, 20 bp, Artificial Sequence
  chemically synthesized
catatctatcttgtaccttg

SEQ ID NO: 33402 - DNA, 20 bp, Artificial Sequence
  chemically synthesized
atatctatcttgtaccttga

SEQ ID NO: 33403 - DNA, 20 bp, Artificial Sequence
  chemically synthesized
aaaatgtggtttgtccttca

SEQ ID NO: 33404 - DNA, 20 bp, Artificial Sequence
  chemically synthesized
aaaaatgtggtttgtccttc

SEQ ID NO: 33405 - DNA, 20 bp, Artificial Sequence
  chemically synthesized
attgatcacagacaaaaatg

SEQ ID NO: 33406 - DNA, 20 bp, Artificial Sequence
  chemically synthesized
tgtaaaatcggtattgatca

SEQ ID NO: 33407 - DNA, 20 bp, Artificial Sequence
  chemically synthesized
tgtgatcaataccgatttta

SEQ ID NO: 33408 - DNA, 20 bp, Artificial Sequence
  chemically synthesized
aagaaacgaagctgtaaaat

SEQ ID NO: 33409 - DNA, 20 bp, Artificial Sequence
  chemically synthesized
caggcacagagtaagaaacg

SEQ ID NO: 33410 - DNA, 20 bp, Artificial Sequence
  chemically synthesized
ttagaaggcaggcacagagt

SEQ ID NO: 33411 - DNA, 20 bp, Artificial Sequence
  chemically synthesized
tgttttagaaggcaggcaca

SEQ ID NO: 33412 - DNA, 20 bp, Artificial Sequence
  chemically synthesized
actgttttagaaggcaggca

SEQ ID NO: 33413 - DNA, 20 bp, Artificial Sequence
  chemically synthesized
tctctactgttttagaaggc

SEQ ID NO: 33414 - DNA, 20 bp, Artificial Sequence
  chemically synthesized
ttctctactgttttagaagg

SEQ ID NO: 33415 - DNA, 20 bp, Artificial Sequence
  chemically synthesized
tctgtgcctgccttctaaaa

SEQ ID NO: 33416 - DNA, 20 bp, Artificial Sequence
  chemically synthesized
gaattctctactgttttaga

SEQ ID NO: 33417 - DNA, 20 bp, Artificial Sequence
  chemically synthesized
agaattctctactgttttag

SEQ ID NO: 33418 - DNA, 20 bp, Artificial Sequence
  chemically synthesized
gtgcctgccttctaaaacag

SEQ ID NO: 33419 - DNA, 20 bp, Artificial Sequence
  chemically synthesized
ctgagaattctctactgttt

SEQ ID NO: 33420 - DNA, 20 bp, Artificial Sequence
  chemically synthesized
gcctgccttctaaaacagta

SEQ ID NO: 33421 - DNA, 20 bp, Artificial Sequence
  chemically synthesized
ctaaaacagtagagaattct

SEQ ID NO: 33422 - DNA, 20 bp, Artificial Sequence
  chemically synthesized
gctcttctcatggagttact

SEQ ID NO: 33423 - DNA, 20 bp, Artificial Sequence
  chemically synthesized
agaattctcagtaactccat

SEQ ID NO: 33424 - DNA, 20 bp, Artificial Sequence
  chemically synthesized
attctcagtaactccatgag

SEQ ID NO: 33425 - DNA, 20 bp, Artificial Sequence
  chemically synthesized
aaatgtgggctcttctcatg

SEQ ID NO: 33426 - DNA, 20 bp, Artificial Sequence
  chemically synthesized
tctcagtaactccatgagaa

SEQ ID NO: 33427 - DNA, 20 bp, Artificial Sequence
  chemically synthesized
gtaaatgtgggctcttctca

SEQ ID NO: 33428 - DNA, 20 bp, Artificial Sequence
  chemically synthesized
tgcatattccaggtaaatgt

SEQ ID NO: 33429 - DNA, 20 bp, Artificial Sequence
  chemically synthesized
ctgcatattccaggtaaatg

SEQ ID NO: 33430 - DNA, 20 bp, Artificial Sequence
  chemically synthesized
gagaagagcccacatttacc

SEQ ID NO: 33431 - DNA, 20 bp, Artificial Sequence
  chemically synthesized
ctatatcgtctgcatattcc

SEQ ID NO: 33432 - DNA, 20 bp, Artificial Sequence
  chemically synthesized
ccacatttacctggaatatg

SEQ ID NO: 33433 - DNA, 20 bp, Artificial Sequence
  chemically synthesized
tctatatcgtctgcatattc

SEQ ID NO: 33434 - DNA, 20 bp, Artificial Sequence
  chemically synthesized
cctggaatatgcagacgata

SEQ ID NO: 33435 - DNA, 20 bp, Artificial Sequence
  chemically synthesized
gcagacgatatagaaaaaca

SEQ ID NO: 33436 - DNA, 20 bp, Artificial Sequence
  chemically synthesized
tatagaaaaacacggtgtgc

SEQ ID NO: 33437 - DNA, 20 bp, Artificial Sequence
  chemically synthesized
atagaaaaacacggtgtgct

SEQ ID NO: 33438 - DNA, 20 bp, Artificial Sequence
  chemically synthesized
tagaaaaacacggtgtgcta

SEQ ID NO: 33439 - DNA, 20 bp, Artificial Sequence
  chemically synthesized
gaaaaacacggtgtgctagg

SEQ ID NO: 33440 - DNA, 20 bp, Artificial Sequence
  chemically synthesized
aaaaacacggtgtgctaggg

SEQ ID NO: 33441 - DNA, 20 bp, Artificial Sequence
  chemically synthesized
aaacacggtgtgctagggag

SEQ ID NO: 33442 - DNA, 20 bp, Artificial Sequence
  chemically synthesized
aacacggtgtgctagggagg

SEQ ID NO: 33443 - DNA, 20 bp, Artificial Sequence
  chemically synthesized
acacggtgtgctagggagga

SEQ ID NO: 33444 - DNA, 20 bp, Artificial Sequence
  chemically synthesized
cccttccactccctcctccc

SEQ ID NO: 33445 - DNA, 20 bp, Artificial Sequence
  chemically synthesized
acggtgtgctagggaggagg

SEQ ID NO: 33446 - DNA, 20 bp, Artificial Sequence
  chemically synthesized
gtgtgctagggaggagggag

SEQ ID NO: 33447 - DNA, 20 bp, Artificial Sequence
  chemically synthesized
tgctagggaggagggagtgg

SEQ ID NO: 33448 - DNA, 20 bp, Artificial Sequence
  chemically synthesized
gctagggaggagggagtgga

SEQ ID NO: 33449 - DNA, 20 bp, Artificial Sequence
  chemically synthesized
ctagggaggagggagtggaa

SEQ ID NO: 33450 - DNA, 20 bp, Artificial Sequence
  chemically synthesized
gggaggagggagtggaaggg

SEQ ID NO: 33451 - DNA, 20 bp, Artificial Sequence
  chemically synthesized
ggaggagggagtggaagggt

SEQ ID NO: 33452 - DNA, 20 bp, Artificial Sequence
  chemically synthesized
ggagggagtggaagggtggg

SEQ ID NO: 33453 - DNA, 20 bp, Artificial Sequence
  chemically synthesized
aagggtgggtggcactgttt

SEQ ID NO: 33454 - DNA, 20 bp, Artificial Sequence
  chemically synthesized
aaaagagacaattaccaaaa

SEQ ID NO: 33455 - DNA, 20 bp, Artificial Sequence
  chemically synthesized
ggagagtgaaatgcagaaaa

SEQ ID NO: 33456 - DNA, 20 bp, Artificial Sequence
  chemically synthesized
gtggagagtgaaatgcagaa

SEQ ID NO: 33457 - DNA, 20 bp, Artificial Sequence
  chemically synthesized
ccgatgtggagagtgaaatg

SEQ ID NO: 33458 - DNA, 20 bp, Artificial Sequence
  chemically synthesized
ctgcatttcactctccacat

SEQ ID NO: 33459 - DNA, 20 bp, Artificial Sequence
  chemically synthesized
gagtgtatttccgatgtgga

SEQ ID NO: 33460 - DNA, 20 bp, Artificial Sequence
  chemically synthesized
gggagtgtatttccgatgtg

SEQ ID NO: 33461 - DNA, 20 bp, Artificial Sequence
  chemically synthesized
tggggagtgtatttccgatg

SEQ ID NO: 33462 - DNA, 20 bp, Artificial Sequence
  chemically synthesized
ggttgttcatggtatatggg

SEQ ID NO: 33463 - DNA, 20 bp, Artificial Sequence
  chemically synthesized
ttggttgttcatggtatatg

SEQ ID NO: 33464 - DNA, 20 bp, Artificial Sequence
  chemically synthesized
tttggttgttcatggtatat

SEQ ID NO: 33465 - DNA, 20 bp, Artificial Sequence
  chemically synthesized
ttttggttgttcatggtata

SEQ ID NO: 33466 - DNA, 20 bp, Artificial Sequence
  chemically synthesized
atttcccttttggttgttca

SEQ ID NO: 33467 - DNA, 20 bp, Artificial Sequence
  chemically synthesized
catataccatgaacaaccaa

SEQ ID NO: 33468 - DNA, 20 bp, Artificial Sequence
  chemically synthesized
atataccatgaacaaccaaa

SEQ ID NO: 33469 - DNA, 20 bp, Artificial Sequence
  chemically synthesized
tataccatgaacaaccaaaa

SEQ ID NO: 33470 - DNA, 20 bp, Artificial Sequence
  chemically synthesized
aggtttcagaatttcccttt

SEQ ID NO: 33471 - DNA, 20 bp, Artificial Sequence
  chemically synthesized
attaacatgtgaacaggttt

SEQ ID NO: 33472 - DNA, 20 bp, Artificial Sequence
  chemically synthesized
gtacccattaacatgtgaac

SEQ ID NO: 33473 - DNA, 20 bp, Artificial Sequence
  chemically synthesized
tgtacccattaacatgtgaa

SEQ ID NO: 33474 - DNA, 20 bp, Artificial Sequence
  chemically synthesized
gaaacctgttcacatgttaa

SEQ ID NO: 33475 - DNA, 20 bp, Artificial Sequence
  chemically synthesized
aaacctgttcacatgttaat

SEQ ID NO: 33476 - DNA, 20 bp, Artificial Sequence
  chemically synthesized
ttaatgggtacatctttgtt

SEQ ID NO: 33477 - DNA, 20 bp, Artificial Sequence
  chemically synthesized
gttctcagaaaggccaaaca

SEQ ID NO: 33478 - DNA, 20 bp, Artificial Sequence
  chemically synthesized
catctttgtttggcctttct

SEQ ID NO: 33479 - DNA, 20 bp, Artificial Sequence
  chemically synthesized
gaacattgttgttctcagaa

SEQ ID NO: 33480 - DNA, 20 bp, Artificial Sequence
  chemically synthesized
tgaacattgttgttctcaga

SEQ ID NO: 33481 - DNA, 20 bp, Artificial Sequence
  chemically synthesized
atgttgaacattgttgttct

SEQ ID NO: 33482 - DNA, 20 bp, Artificial Sequence
  chemically synthesized
gagaacaacaatgttcaaca

SEQ ID NO: 33483 - DNA, 20 bp, Artificial Sequence
  chemically synthesized
caatgttcaacatagatcac

SEQ ID NO: 33484 - DNA, 20 bp, Artificial Sequence
  chemically synthesized
tctctgtgttaatgtacgta

SEQ ID NO: 33485 - DNA, 20 bp, Artificial Sequence
  chemically synthesized
agtctgtacgtacattaaca

SEQ ID NO: 33486 - DNA, 20 bp, Artificial Sequence
  chemically synthesized
tctgtacgtacattaacaca

SEQ ID NO: 33487 - DNA, 20 bp, Artificial Sequence
  chemically synthesized
acgtacattaacacagagat

SEQ ID NO: 33488 - DNA, 20 bp, Artificial Sequence
  chemically synthesized
cgttttaaggattatttatg

SEQ ID NO: 33489 - DNA, 20 bp, Artificial Sequence
  chemically synthesized
aagatgtaaagagcgtttta

SEQ ID NO: 33490 - DNA, 20 bp, Artificial Sequence
  chemically synthesized
aaagatgtaaagagcgtttt

SEQ ID NO: 33491 - DNA, 20 bp, Artificial Sequence
  chemically synthesized
acattttttaaagatgtaaa

SEQ ID NO: 33492 - DNA, 20 bp, Artificial Sequence
  chemically synthesized
taacattttttaaagatgta

SEQ ID NO: 33493 - DNA, 20 bp, Artificial Sequence
  chemically synthesized
aaaatcaataacatttttta

SEQ ID NO: 33494 - DNA, 20 bp, Artificial Sequence
  chemically synthesized
ttaaaaaatgttattgattt

SEQ ID NO: 33495 - DNA, 20 bp, Artificial Sequence
  chemically synthesized
gttattgattttggccctgc

SEQ ID NO: 33496 - DNA, 20 bp, Artificial Sequence
  chemically synthesized
gccaggctttggaaccagca

SEQ ID NO: 33497 - DNA, 20 bp, Artificial Sequence
  chemically synthesized
tgccaggctttggaaccagc

SEQ ID NO: 33498 - DNA, 20 bp, Artificial Sequence
  chemically synthesized
atgccaggctttggaaccag

SEQ ID NO: 33499 - DNA, 20 bp, Artificial Sequence
  chemically synthesized
ttttggccctgctggttcca

SEQ ID NO: 33500 - DNA, 20 bp, Artificial Sequence
  chemically synthesized
ctgatgccaggctttggaac

SEQ ID NO: 33501 - DNA, 20 bp, Artificial Sequence
  chemically synthesized
gccctgctggttccaaagcc

SEQ ID NO: 33502 - DNA, 20 bp, Artificial Sequence
  chemically synthesized
gcatatctgatgccaggctt

SEQ ID NO: 33503 - DNA, 20 bp, Artificial Sequence
  chemically synthesized
ctggttccaaagcctggcat

SEQ ID NO: 33504 - DNA, 20 bp, Artificial Sequence
  chemically synthesized
agagaggcatatctgatgcc

SEQ ID NO: 33505 - DNA, 20 bp, Artificial Sequence
  chemically synthesized
cagagaggcatatctgatgc

SEQ ID NO: 33506 - DNA, 20 bp, Artificial Sequence
  chemically synthesized
ggcatcagatatgcctctct

SEQ ID NO: 33507 - DNA, 20 bp, Artificial Sequence
  chemically synthesized
atcagatatgcctctctgag

SEQ ID NO: 33508 - DNA, 20 bp, Artificial Sequence
  chemically synthesized
cgtataaatactgctcagag

SEQ ID NO: 33509 - DNA, 20 bp, Artificial Sequence
  chemically synthesized
tcgtataaatactgctcaga

SEQ ID NO: 33510 - DNA, 20 bp, Artificial Sequence
  chemically synthesized
cttcgtataaatactgctca

SEQ ID NO: 33511 - DNA, 20 bp, Artificial Sequence
  chemically synthesized
atcttcgtataaatactgct

SEQ ID NO: 33512 - DNA, 20 bp, Artificial Sequence
  chemically synthesized
ctctgagcagtatttatacg

SEQ ID NO: 33513 - DNA, 20 bp, Artificial Sequence
  chemically synthesized
tgtagaaagaagaaggagag

SEQ ID NO: 33514 - DNA, 20 bp, Artificial Sequence
  chemically synthesized
ttgtagaaagaagaaggaga

SEQ ID NO: 33515 - DNA, 20 bp, Artificial Sequence
  chemically synthesized
tttgtagaaagaagaaggag

SEQ ID NO: 33516 - DNA, 20 bp, Artificial Sequence
  chemically synthesized
gtttgtagaaagaagaagga

SEQ ID NO: 33517 - DNA, 20 bp, Artificial Sequence
  chemically synthesized
tggtttgtagaaagaagaag

SEQ ID NO: 33518 - DNA, 20 bp, Artificial Sequence
  chemically synthesized
catggtttgtagaaagaaga

SEQ ID NO: 33519 - DNA, 20 bp, Artificial Sequence
  chemically synthesized
tcatggtttgtagaaagaag

SEQ ID NO: 33520 - DNA, 20 bp, Artificial Sequence
  chemically synthesized
ttatcatggtttgtagaaag

SEQ ID NO: 33521 - DNA, 20 bp, Artificial Sequence
  chemically synthesized
agattatcatggtttgtaga

SEQ ID NO: 33522 - DNA, 20 bp, Artificial Sequence
  chemically synthesized
aaaaagattatcatggtttg

SEQ ID NO: 33523 - DNA, 20 bp, Artificial Sequence
  chemically synthesized
aaaagggaaaaagattatca

SEQ ID NO: 33524 - DNA, 20 bp, Artificial Sequence
  chemically synthesized
cgcctcaaataaaagggaaa

SEQ ID NO: 33525 - DNA, 20 bp, Artificial Sequence
  chemically synthesized
tatcaccgcctcaaataaaa

SEQ ID NO: 33526 - DNA, 20 bp, Artificial Sequence
  chemically synthesized
aatctttttcccttttattt

SEQ ID NO: 33527 - DNA, 20 bp, Artificial Sequence
  chemically synthesized
ctatcaccgcctcaaataaa

SEQ ID NO: 33528 - DNA, 20 bp, Artificial Sequence
  chemically synthesized
atctttttcccttttatttg

SEQ ID NO: 33529 - DNA, 20 bp, Artificial Sequence
  chemically synthesized
cctatcaccgcctcaaataa

SEQ ID NO: 33530 - DNA, 20 bp, Artificial Sequence
  chemically synthesized
tttttcccttttatttgagg

SEQ ID NO: 33531 - DNA, 20 bp, Artificial Sequence
  chemically synthesized
ccttttatttgaggcggtga

SEQ ID NO: 33532 - DNA, 20 bp, Artificial Sequence
  chemically synthesized
cttttatttgaggcggtgat

SEQ ID NO: 33533 - DNA, 20 bp, Artificial Sequence
  chemically synthesized
ttatattttaatttgcatca

SEQ ID NO: 33534 - DNA, 20 bp, Artificial Sequence
  chemically synthesized
tttatattttaatttgcatc

SEQ ID NO: 33535 - DNA, 20 bp, Artificial Sequence
  chemically synthesized
ctttatattttaatttgcat

SEQ ID NO: 33536 - DNA, 20 bp, Artificial Sequence
  chemically synthesized
ctgatgcaaattaaaatata

SEQ ID NO: 33537 - DNA, 20 bp, Artificial Sequence
  chemically synthesized
aaagtcatcgactatgacaa

SEQ ID NO: 33538 - DNA, 20 bp, Artificial Sequence
  chemically synthesized
gttgctggggtcttttgtca

SEQ ID NO: 33539 - DNA, 20 bp, Artificial Sequence
  chemically synthesized
tcgactatgacaaaagaccc

SEQ ID NO: 33540 - DNA, 20 bp, Artificial Sequence
  chemically synthesized
ttgacaagtaggtgttgctg

SEQ ID NO: 33541 - DNA, 20 bp, Artificial Sequence
  chemically synthesized
attgacaagtaggtgttgct

SEQ ID NO: 33542 - DNA, 20 bp, Artificial Sequence
  chemically synthesized
tattgacaagtaggtgttgc

SEQ ID NO: 33543 - DNA, 20 bp, Artificial Sequence
  chemically synthesized
atttcttattattgacaagt

SEQ ID NO: 33544 - DNA, 20 bp, Artificial Sequence
  chemically synthesized
aatttcttattattgacaag

SEQ ID NO: 33545 - DNA, 20 bp, Artificial Sequence
  chemically synthesized
tttaatttcttattattgac

SEQ ID NO: 33546 - DNA, 20 bp, Artificial Sequence
  chemically synthesized
aacacctacttgtcaataat

SEQ ID NO: 33547 - DNA, 20 bp, Artificial Sequence
  chemically synthesized
ttgtcaataataagaaatta

SEQ ID NO: 33548 - DNA, 20 bp, Artificial Sequence
  chemically synthesized
aattaaagcattactctact

SEQ ID NO: 33549 - DNA, 20 bp, Artificial Sequence
  chemically synthesized
ggtcagccttgtgctcagta

SEQ ID NO: 33550 - DNA, 20 bp, Artificial Sequence
  chemically synthesized
taggtcagccttgtgctcag

SEQ ID NO: 33551 - DNA, 20 bp, Artificial Sequence
  chemically synthesized
agcattactctactgagcac

SEQ ID NO: 33552 - DNA, 20 bp, Artificial Sequence
  chemically synthesized
gcattactctactgagcaca

SEQ ID NO: 33553 - DNA, 20 bp, Artificial Sequence
  chemically synthesized
aattaggtcagccttgtgct

SEQ ID NO: 33554 - DNA, 20 bp, Artificial Sequence
  chemically synthesized
tgtatggtaggaaattaggt

SEQ ID NO: 33555 - DNA, 20 bp, Artificial Sequence
  chemically synthesized
aaattgtatggtaggaaatt

SEQ ID NO: 33556 - DNA, 20 bp, Artificial Sequence
  chemically synthesized
taaattgtatggtaggaaat

SEQ ID NO: 33557 - DNA, 20 bp, Artificial Sequence
  chemically synthesized
gaaaatttaaattgtatggt

SEQ ID NO: 33558 - DNA, 20 bp, Artificial Sequence
  chemically synthesized
agaaaatttaaattgtatgg

SEQ ID NO: 33559 - DNA, 20 bp, Artificial Sequence
  chemically synthesized
gagagaaaatttaaattgta

SEQ ID NO: 33560 - DNA, 20 bp, Artificial Sequence
  chemically synthesized
cttgaaactaaagcaggtga

SEQ ID NO: 33561 - DNA, 20 bp, Artificial Sequence
  chemically synthesized
tacttgaaactaaagcaggt

SEQ ID NO: 33562 - DNA, 20 bp, Artificial Sequence
  chemically synthesized
aaattttctctcacctgctt

SEQ ID NO: 33563 - DNA, 20 bp, Artificial Sequence
  chemically synthesized
acactacttgaaactaaagc

SEQ ID NO: 33564 - DNA, 20 bp, Artificial Sequence
  chemically synthesized
cacactacttgaaactaaag

SEQ ID NO: 33565 - DNA, 20 bp, Artificial Sequence
  chemically synthesized
ctctcacctgctttagtttc

SEQ ID NO: 33566 - DNA, 20 bp, Artificial Sequence
  chemically synthesized
ttgcacactacttgaaacta

SEQ ID NO: 33567 - DNA, 20 bp, Artificial Sequence
  chemically synthesized
tcacctgctttagtttcaag

SEQ ID NO: 33568 - DNA, 20 bp, Artificial Sequence
  chemically synthesized
tttagtttcaagtagtgtgc

SEQ ID NO: 33569 - DNA, 20 bp, Artificial Sequence
  chemically synthesized
ttagtttcaagtagtgtgca

SEQ ID NO: 33570 - DNA, 20 bp, Artificial Sequence
  chemically synthesized
caaggttattataactgcct

SEQ ID NO: 33571 - DNA, 20 bp, Artificial Sequence
  chemically synthesized
aggttattataactgcctca

SEQ ID NO: 33572 - DNA, 20 bp, Artificial Sequence
  chemically synthesized
cagcaggaacagctctgagg

SEQ ID NO: 33573 - DNA, 20 bp, Artificial Sequence
  chemically synthesized
tgacagcaggaacagctctg

SEQ ID NO: 33574 - DNA, 20 bp, Artificial Sequence
  chemically synthesized
ctgacagcaggaacagctct

SEQ ID NO: 33575 - DNA, 20 bp, Artificial Sequence
  chemically synthesized
tccagcactgacagcaggaa

SEQ ID NO: 33576 - DNA, 20 bp, Artificial Sequence
  chemically synthesized
ctcagagctgttcctgctgt

SEQ ID NO: 33577 - DNA, 20 bp, Artificial Sequence
  chemically synthesized
attattccagcactgacagc

SEQ ID NO: 33578 - DNA, 20 bp, Artificial Sequence
  chemically synthesized
gattattccagcactgacag

SEQ ID NO: 33579 - DNA, 20 bp, Artificial Sequence
  chemically synthesized
gctgttcctgctgtcagtgc

SEQ ID NO: 33580 - DNA, 20 bp, Artificial Sequence
  chemically synthesized
tctgattattccagcactga

SEQ ID NO: 33581 - DNA, 20 bp, Artificial Sequence
  chemically synthesized
gctgtcagtgctggaataat

SEQ ID NO: 33582 - DNA, 20 bp, Artificial Sequence
  chemically synthesized
tccaataagtctgattattc

SEQ ID NO: 33583 - DNA, 20 bp, Artificial Sequence
  chemically synthesized
gctggaataatcagacttat

SEQ ID NO: 33584 - DNA, 20 bp, Artificial Sequence
  chemically synthesized
actaaaaaagcaattccaat

SEQ ID NO: 33585 - DNA, 20 bp, Artificial Sequence
  chemically synthesized
acttattggaattgcttttt

SEQ ID NO: 33586 - DNA, 20 bp, Artificial Sequence
  chemically synthesized
ttgtttttaagaaactaaaa

SEQ ID NO: 33587 - DNA, 20 bp, Artificial Sequence
  chemically synthesized
agtgtttaatgtttgttttt

SEQ ID NO: 33588 - DNA, 20 bp, Artificial Sequence
  chemically synthesized
aaacattaaacacttataaa

SEQ ID NO: 33589 - DNA, 20 bp, Artificial Sequence
  chemically synthesized
agatatttgttactttttat

SEQ ID NO: 33590 - DNA, 20 bp, Artificial Sequence
  chemically synthesized
gtaacaaatatctactgctg

SEQ ID NO: 33591 - DNA, 20 bp, Artificial Sequence
  chemically synthesized
cattttcccagccacagcag

SEQ ID NO: 33592 - DNA, 20 bp, Artificial Sequence
  chemically synthesized
caaatatctactgctgtggc

SEQ ID NO: 33593 - DNA, 20 bp, Artificial Sequence
  chemically synthesized
tgccattttcccagccacag

SEQ ID NO: 33594 - DNA, 20 bp, Artificial Sequence
  chemically synthesized
aaatatctactgctgtggct

SEQ ID NO: 33595 - DNA, 20 bp, Artificial Sequence
  chemically synthesized
aactgccattttcccagcca

SEQ ID NO: 33596 - DNA, 20 bp, Artificial Sequence
  chemically synthesized
tactgctgtggctgggaaaa

SEQ ID NO: 33597 - DNA, 20 bp, Artificial Sequence
  chemically synthesized
ttaggcaactgccattttcc

SEQ ID NO: 33598 - DNA, 20 bp, Artificial Sequence
  chemically synthesized
tgctgtggctgggaaaatgg

SEQ ID NO: 33599 - DNA, 20 bp, Artificial Sequence
  chemically synthesized
gaagaaatcttattttaatt

SEQ ID NO: 33600 - DNA, 20 bp, Artificial Sequence
  chemically synthesized
agaagaaatcttattttaat

SEQ ID NO: 33601 - DNA, 20 bp, Artificial Sequence
  chemically synthesized
ggcagttgcctaattaaaat

SEQ ID NO: 33602 - DNA, 20 bp, Artificial Sequence
  chemically synthesized
ccaaataacaatggtggcag

SEQ ID NO: 33603 - DNA, 20 bp, Artificial Sequence
  chemically synthesized
gtaccaaataacaatggtgg

SEQ ID NO: 33604 - DNA, 20 bp, Artificial Sequence
  chemically synthesized
tcagtaccaaataacaatgg

SEQ ID NO: 33605 - DNA, 20 bp, Artificial Sequence
  chemically synthesized
ttttcagtaccaaataacaa

SEQ ID NO: 33606 - DNA, 20 bp, Artificial Sequence
  chemically synthesized
cttctgccaccattgttatt

SEQ ID NO: 33607 - DNA, 20 bp, Artificial Sequence
  chemically synthesized
gcaactgtttggaatatttt

SEQ ID NO: 33608 - DNA, 20 bp, Artificial Sequence
  chemically synthesized
ggtactgaaaatattccaaa

SEQ ID NO: 33609 - DNA, 20 bp, Artificial Sequence
  chemically synthesized
tttttaaaaaggcaactgtt

SEQ ID NO: 33610 - DNA, 20 bp, Artificial Sequence
  chemically synthesized
ggacagatagttttttaaaa

SEQ ID NO: 33611 - DNA, 20 bp, Artificial Sequence
  chemically synthesized
tggacagatagttttttaaa

SEQ ID NO: 33612 - DNA, 20 bp, Artificial Sequence
  chemically synthesized
cctgggaagtagtggacaga

SEQ ID NO: 33613 - DNA, 20 bp, Artificial Sequence
  chemically synthesized
tctccctgggaagtagtgga

SEQ ID NO: 33614 - DNA, 20 bp, Artificial Sequence
  chemically synthesized
gttttctccctgggaagtag

SEQ ID NO: 33615 - DNA, 20 bp, Artificial Sequence
  chemically synthesized
actatctgtccactacttcc

SEQ ID NO: 33616 - DNA, 20 bp, Artificial Sequence
  chemically synthesized
ctatctgtccactacttccc

SEQ ID NO: 33617 - DNA, 20 bp, Artificial Sequence
  chemically synthesized
tatctgtccactacttccca

SEQ ID NO: 33618 - DNA, 20 bp, Artificial Sequence
  chemically synthesized
ttagttttctccctgggaag

SEQ ID NO: 33619 - DNA, 20 bp, Artificial Sequence
  chemically synthesized
tctgtccactacttcccagg

SEQ ID NO: 33620 - DNA, 20 bp, Artificial Sequence
  chemically synthesized
cgattagttttctccctggg

SEQ ID NO: 33621 - DNA, 20 bp, Artificial Sequence
  chemically synthesized
tagcgattagttttctccct

SEQ ID NO: 33622 - DNA, 20 bp, Artificial Sequence
  chemically synthesized
atagcgattagttttctccc

SEQ ID NO: 33623 - DNA, 20 bp, Artificial Sequence
  chemically synthesized
ttatattgctgcatagcgat

SEQ ID NO: 33624 - DNA, 20 bp, Artificial Sequence
  chemically synthesized
ggagaaaactaatcgctatg

SEQ ID NO: 33625 - DNA, 20 bp, Artificial Sequence
  chemically synthesized
tccctttttatattgctgca

SEQ ID NO: 33626 - DNA, 20 bp, Artificial Sequence
  chemically synthesized
tcgctatgcagcaatataaa

SEQ ID NO: 33627 - DNA, 20 bp, Artificial Sequence
  chemically synthesized
cgctatgcagcaatataaaa

SEQ ID NO: 33628 - DNA, 20 bp, Artificial Sequence
  chemically synthesized
gctatgcagcaatataaaaa

SEQ ID NO: 33629 - DNA, 20 bp, Artificial Sequence
  chemically synthesized
tatgcagcaatataaaaagg

SEQ ID NO: 33630 - DNA, 20 bp, Artificial Sequence
  chemically synthesized
taatcctctgcaaatcgcaa

SEQ ID NO: 33631 - DNA, 20 bp, Artificial Sequence
  chemically synthesized
tctaatcctctgcaaatcgc

SEQ ID NO: 33632 - DNA, 20 bp, Artificial Sequence
  chemically synthesized
gagcgttctcttgcgatttg

SEQ ID NO: 33633 - DNA, 20 bp, Artificial Sequence
  chemically synthesized
gcgttctcttgcgatttgca

SEQ ID NO: 33634 - DNA, 20 bp, Artificial Sequence
  chemically synthesized
cgttctcttgcgatttgcag

SEQ ID NO: 33635 - DNA, 20 bp, Artificial Sequence
  chemically synthesized
tcttgcgatttgcagaggat

SEQ ID NO: 33636 - DNA, 20 bp, Artificial Sequence
  chemically synthesized
ttgcgatttgcagaggatta

SEQ ID NO: 33637 - DNA, 20 bp, Artificial Sequence
  chemically synthesized
atttgcagaggattagagtt

SEQ ID NO: 33638 - DNA, 20 bp, Artificial Sequence
  chemically synthesized
gtttggtttcatatataatc

SEQ ID NO: 33639 - DNA, 20 bp, Artificial Sequence
  chemically synthesized
ttggtttcatatataatctg

SEQ ID NO: 33640 - DNA, 20 bp, Artificial Sequence
  chemically synthesized
gtgtgtggatcaatgggctc

SEQ ID NO: 33641 - DNA, 20 bp, Artificial Sequence
  chemically synthesized
atttgtgtgtgtggatcaat

SEQ ID NO: 33642 - DNA, 20 bp, Artificial Sequence
  chemically synthesized
catttgtgtgtgtggatcaa

SEQ ID NO: 33643 - DNA, 20 bp, Artificial Sequence
  chemically synthesized
agggaaatcatttgtgtgtg

SEQ ID NO: 33644 - DNA, 20 bp, Artificial Sequence
  chemically synthesized
agtctgatcctcagattaaa

SEQ ID NO: 33645 - DNA, 20 bp, Artificial Sequence
  chemically synthesized
aaatgatttccctttaatct

SEQ ID NO: 33646 - DNA, 20 bp, Artificial Sequence
  chemically synthesized
gagtctgatcctcagattaa

SEQ ID NO: 33647 - DNA, 20 bp, Artificial Sequence
  chemically synthesized
aatgatttccctttaatctg

SEQ ID NO: 33648 - DNA, 20 bp, Artificial Sequence
  chemically synthesized
agagtctgatcctcagatta

SEQ ID NO: 33649 - DNA, 20 bp, Artificial Sequence
  chemically synthesized
tttccctttaatctgaggat

SEQ ID NO: 33650 - DNA, 20 bp, Artificial Sequence
  chemically synthesized
tagaaaaagagtctgatcct

SEQ ID NO: 33651 - DNA, 20 bp, Artificial Sequence
  chemically synthesized
tgaggatcagactctttttc

SEQ ID NO: 33652 - DNA, 20 bp, Artificial Sequence
  chemically synthesized
ccaaggttcctctagaaaaa

SEQ ID NO: 33653 - DNA, 20 bp, Artificial Sequence
  chemically synthesized
aggatcagactctttttcta

SEQ ID NO: 33654 - DNA, 20 bp, Artificial Sequence
  chemically synthesized
ggatcagactctttttctag

SEQ ID NO: 33655 - DNA, 20 bp, Artificial Sequence
  chemically synthesized
tgccaaggttcctctagaaa

SEQ ID NO: 33656 - DNA, 20 bp, Artificial Sequence
  chemically synthesized
cgcaaatgccaaggttcctc

SEQ ID NO: 33657 - DNA, 20 bp, Artificial Sequence
  chemically synthesized
ctctttttctagaggaacct

SEQ ID NO: 33658 - DNA, 20 bp, Artificial Sequence
  chemically synthesized
aattcagcacgcaaatgcca

SEQ ID NO: 33659 - DNA, 20 bp, Artificial Sequence
  chemically synthesized
caattcagcacgcaaatgcc

SEQ ID NO: 33660 - DNA, 20 bp, Artificial Sequence
  chemically synthesized
gcaagccaagttcaacaatt

SEQ ID NO: 33661 - DNA, 20 bp, Artificial Sequence
  chemically synthesized
gcgtgctgaattgttgaact

SEQ ID NO: 33662 - DNA, 20 bp, Artificial Sequence
  chemically synthesized
gtattccagcaatgcaagcc

SEQ ID NO: 33663 - DNA, 20 bp, Artificial Sequence
  chemically synthesized
ttgaacttggcttgcattgc

SEQ ID NO: 33664 - DNA, 20 bp, Artificial Sequence
  chemically synthesized
tgccagtattccagcaatgc

SEQ ID NO: 33665 - DNA, 20 bp, Artificial Sequence
  chemically synthesized
ggcttgcattgctggaatac

SEQ ID NO: 33666 - DNA, 20 bp, Artificial Sequence
  chemically synthesized
tccacaccctgccagtattc

SEQ ID NO: 33667 - DNA, 20 bp, Artificial Sequence
  chemically synthesized
ttgcattgctggaatactgg

SEQ ID NO: 33668 - DNA, 20 bp, Artificial Sequence
  chemically synthesized
tgcattgctggaatactggc

SEQ ID NO: 33669 - DNA, 20 bp, Artificial Sequence
  chemically synthesized
gcattgctggaatactggca

SEQ ID NO: 33670 - DNA, 20 bp, Artificial Sequence
  chemically synthesized
ttttaccatccacaccctgc

SEQ ID NO: 33671 - DNA, 20 bp, Artificial Sequence
  chemically synthesized
gctggaatactggcagggtg

SEQ ID NO: 33672 - DNA, 20 bp, Artificial Sequence
  chemically synthesized
gaatactggcagggtgtgga

SEQ ID NO: 33673 - DNA, 20 bp, Artificial Sequence
  chemically synthesized
ggatggtaaaatatatttta

SEQ ID NO: 33674 - DNA, 20 bp, Artificial Sequence
  chemically synthesized
ttttaaagtttctgctaccg

SEQ ID NO: 33675 - DNA, 20 bp, Artificial Sequence
  chemically synthesized
tttaaagtttctgctaccgt

SEQ ID NO: 33676 - DNA, 20 bp, Artificial Sequence
  chemically synthesized
aaacccctgccccacggtag

SEQ ID NO: 33677 - DNA, 20 bp, Artificial Sequence
  chemically synthesized
ttaaagtttctgctaccgtg

SEQ ID NO: 33678 - DNA, 20 bp, Artificial Sequence
  chemically synthesized
tccaaacccctgccccacgg

SEQ ID NO: 33679 - DNA, 20 bp, Artificial Sequence
  chemically synthesized
aagtttctgctaccgtgggg

SEQ ID NO: 33680 - DNA, 20 bp, Artificial Sequence
  chemically synthesized
agtttctgctaccgtggggc

SEQ ID NO: 33681 - DNA, 20 bp, Artificial Sequence
  chemically synthesized
gtttctgctaccgtggggca

SEQ ID NO: 33682 - DNA, 20 bp, Artificial Sequence
  chemically synthesized
ccctccaaacccctgcccca

SEQ ID NO: 33683 - DNA, 20 bp, Artificial Sequence
  chemically synthesized
tttctgctaccgtggggcag

SEQ ID NO: 33684 - DNA, 20 bp, Artificial Sequence
  chemically synthesized
gctaccgtggggcaggggtt

SEQ ID NO: 33685 - DNA, 20 bp, Artificial Sequence
  chemically synthesized
taccgtggggcaggggtttg

SEQ ID NO: 33686 - DNA, 20 bp, Artificial Sequence
  chemically synthesized
accgtggggcaggggtttgg

SEQ ID NO: 33687 - DNA, 20 bp, Artificial Sequence
  chemically synthesized
ccgtggggcaggggtttgga

SEQ ID NO: 33688 - DNA, 20 bp, Artificial Sequence
  chemically synthesized
cgtggggcaggggtttggag

SEQ ID NO: 33689 - DNA, 20 bp, Artificial Sequence
  chemically synthesized
ggggcaggggtttggagggg

SEQ ID NO: 33690 - DNA, 20 bp, Artificial Sequence
  chemically synthesized
gggcaggggtttggaggggt

SEQ ID NO: 33691 - DNA, 20 bp, Artificial Sequence
  chemically synthesized
ggaggggtgggcatcaatat

SEQ ID NO: 33692 - DNA, 20 bp, Artificial Sequence
  chemically synthesized
gtgggcatcaatataagcat

SEQ ID NO: 33693 - DNA, 20 bp, Artificial Sequence
  chemically synthesized
taagcatcagaaatccattc

SEQ ID NO: 33694 - DNA, 20 bp, Artificial Sequence
  chemically synthesized
caagaaatggggaactagaa

SEQ ID NO: 33695 - DNA, 20 bp, Artificial Sequence
  chemically synthesized
gggaacaagaaatggggaac

SEQ ID NO: 33696 - DNA, 20 bp, Artificial Sequence
  chemically synthesized
atcccagggaacaagaaatg

SEQ ID NO: 33697 - DNA, 20 bp, Artificial Sequence
  chemically synthesized
tatcccagggaacaagaaat

SEQ ID NO: 33698 - DNA, 20 bp, Artificial Sequence
  chemically synthesized
atatcccagggaacaagaaa

SEQ ID NO: 33699 - DNA, 20 bp, Artificial Sequence
  chemically synthesized
gttccccatttcttgttccc

SEQ ID NO: 33700 - DNA, 20 bp, Artificial Sequence
  chemically synthesized
ttccccatttcttgttccct

SEQ ID NO: 33701 - DNA, 20 bp, Artificial Sequence
  chemically synthesized
tggtaaatatcccagggaac

SEQ ID NO: 33702 - DNA, 20 bp, Artificial Sequence
  chemically synthesized
ataaaatggtaaatatccca

SEQ ID NO: 33703 - DNA, 20 bp, Artificial Sequence
  chemically synthesized
aataaaatggtaaatatccc

SEQ ID NO: 33704 - DNA, 20 bp, Artificial Sequence
  chemically synthesized
gaataaaatggtaaatatcc

SEQ ID NO: 33705 - DNA, 20 bp, Artificial Sequence
  chemically synthesized
tttagccagacagaataaaa

SEQ ID NO: 33706 - DNA, 20 bp, Artificial Sequence
  chemically synthesized
atttaccattttattctgtc

SEQ ID NO: 33707 - DNA, 20 bp, Artificial Sequence
  chemically synthesized
ttgccctggctttagccaga

SEQ ID NO: 33708 - DNA, 20 bp, Artificial Sequence
  chemically synthesized
cattttattctgtctggcta

SEQ ID NO: 33709 - DNA, 20 bp, Artificial Sequence
  chemically synthesized
atctttgccctggctttagc

SEQ ID NO: 33710 - DNA, 20 bp, Artificial Sequence
  chemically synthesized
ttattctgtctggctaaagc

SEQ ID NO: 33711 - DNA, 20 bp, Artificial Sequence
  chemically synthesized
tattctgtctggctaaagcc

SEQ ID NO: 33712 - DNA, 20 bp, Artificial Sequence
  chemically synthesized
attctgtctggctaaagcca

SEQ ID NO: 33713 - DNA, 20 bp, Artificial Sequence
  chemically synthesized
aatcatctttgccctggctt

SEQ ID NO: 33714 - DNA, 20 bp, Artificial Sequence
  chemically synthesized
gtctggctaaagccagggca

SEQ ID NO: 33715 - DNA, 20 bp, Artificial Sequence
  chemically synthesized
cgaggcaatcatctttgccc

SEQ ID NO: 33716 - DNA, 20 bp, Artificial Sequence
  chemically synthesized
cagggcaaagatgattgcct

SEQ ID NO: 33717 - DNA, 20 bp, Artificial Sequence
  chemically synthesized
ggcaaagatgattgcctcgg

SEQ ID NO: 33718 - DNA, 20 bp, Artificial Sequence
  chemically synthesized
aacagctggaacagccaccg

SEQ ID NO: 33719 - DNA, 20 bp, Artificial Sequence
  chemically synthesized
taacagctggaacagccacc

SEQ ID NO: 33720 - DNA, 20 bp, Artificial Sequence
  chemically synthesized
gattgcctcggtggctgttc

SEQ ID NO: 33721 - DNA, 20 bp, Artificial Sequence
  chemically synthesized
aggacaactaacagctggaa

SEQ ID NO: 33722 - DNA, 20 bp, Artificial Sequence
  chemically synthesized
tcggtggctgttccagctgt

SEQ ID NO: 33723 - DNA, 20 bp, Artificial Sequence
  chemically synthesized
aacggaggacaactaacagc

SEQ ID NO: 33724 - DNA, 20 bp, Artificial Sequence
  chemically synthesized
ataaaacggaggacaactaa

SEQ ID NO: 33725 - DNA, 20 bp, Artificial Sequence
  chemically synthesized
ttgaaaagcaaataaaacgg

SEQ ID NO: 33726 - DNA, 20 bp, Artificial Sequence
  chemically synthesized
cttgaaaagcaaataaaacg

SEQ ID NO: 33727 - DNA, 20 bp, Artificial Sequence
  chemically synthesized
accttgaaaagcaaataaaa

SEQ ID NO: 33728 - DNA, 20 bp, Artificial Sequence
  chemically synthesized
ctccgttttatttgcttttc

SEQ ID NO: 33729 - DNA, 20 bp, Artificial Sequence
  chemically synthesized
tccgttttatttgcttttca

SEQ ID NO: 33730 - DNA, 20 bp, Artificial Sequence
  chemically synthesized
ggtaggagttaaaccttgaa

SEQ ID NO: 33731 - DNA, 20 bp, Artificial Sequence
  chemically synthesized
ccaaagttgagggtgggtag

SEQ ID NO: 33732 - DNA, 20 bp, Artificial Sequence
  chemically synthesized
gaccaaagttgagggtgggt

SEQ ID NO: 33733 - DNA, 20 bp, Artificial Sequence
  chemically synthesized
tgaccaaagttgagggtggg

SEQ ID NO: 33734 - DNA, 20 bp, Artificial Sequence
  chemically synthesized
ctttgaccaaagttgagggt

SEQ ID NO: 33735 - DNA, 20 bp, Artificial Sequence
  chemically synthesized
gctttgaccaaagttgaggg

SEQ ID NO: 33736 - DNA, 20 bp, Artificial Sequence
  chemically synthesized
ctcctacccaccctcaactt

SEQ ID NO: 33737 - DNA, 20 bp, Artificial Sequence
  chemically synthesized
attgctttgaccaaagttga

SEQ ID NO: 33738 - DNA, 20 bp, Artificial Sequence
  chemically synthesized
aattgctttgaccaaagttg

SEQ ID NO: 33739 - DNA, 20 bp, Artificial Sequence
  chemically synthesized
aaattgctttgaccaaagtt

SEQ ID NO: 33740 - DNA, 20 bp, Artificial Sequence
  chemically synthesized
cccaccctcaactttggtca

SEQ ID NO: 33741 - DNA, 20 bp, Artificial Sequence
  chemically synthesized
aaaagaaattgctttgacca

SEQ ID NO: 33742 - DNA, 20 bp, Artificial Sequence
  chemically synthesized
tggtcaaagcaatttctttt

SEQ ID NO: 33743 - DNA, 20 bp, Artificial Sequence
  chemically synthesized
ggtcaaagcaatttcttttc

SEQ ID NO: 33744 - DNA, 20 bp, Artificial Sequence
  chemically synthesized
gtcaaagcaatttcttttca

SEQ ID NO: 33745 - DNA, 20 bp, Artificial Sequence
  chemically synthesized
cgattggacacgaccctgaa

SEQ ID NO: 33746 - DNA, 20 bp, Artificial Sequence
  chemically synthesized
ttttcagggtcgtgtccaat

SEQ ID NO: 33747 - DNA, 20 bp, Artificial Sequence
  chemically synthesized
ttcagggtcgtgtccaatcg

SEQ ID NO: 33748 - DNA, 20 bp, Artificial Sequence
  chemically synthesized
atcattgtttgatctccgat

SEQ ID NO: 33749 - DNA, 20 bp, Artificial Sequence
  chemically synthesized
gaacaccgtggaattggttt

SEQ ID NO: 33750 - DNA, 20 bp, Artificial Sequence
  chemically synthesized
gatgactgaaaccaattcca

SEQ ID NO: 33751 - DNA, 20 bp, Artificial Sequence
  chemically synthesized
acccttgaacaccgtggaat

SEQ ID NO: 33752 - DNA, 20 bp, Artificial Sequence
  chemically synthesized
tctctgacccttgaacaccg

SEQ ID NO: 33753 - DNA, 20 bp, Artificial Sequence
  chemically synthesized
aaaccaattccacggtgttc

SEQ ID NO: 33754 - DNA, 20 bp, Artificial Sequence
  chemically synthesized
aaccaattccacggtgttca

SEQ ID NO: 33755 - DNA, 20 bp, Artificial Sequence
  chemically synthesized
accaattccacggtgttcaa

SEQ ID NO: 33756 - DNA, 20 bp, Artificial Sequence
  chemically synthesized
attccacggtgttcaagggt

SEQ ID NO: 33757 - DNA, 20 bp, Artificial Sequence
  chemically synthesized
tccacggtgttcaagggtca

SEQ ID NO: 33758 - DNA, 20 bp, Artificial Sequence
  chemically synthesized
aagcaacacggttatatgaa

SEQ ID NO: 33759 - DNA, 20 bp, Artificial Sequence
  chemically synthesized
gaagcaacacggttatatga

SEQ ID NO: 33760 - DNA, 20 bp, Artificial Sequence
  chemically synthesized
gtggagcaaatgaagcaaca

SEQ ID NO: 33761 - DNA, 20 bp, Artificial Sequence
  chemically synthesized
agaagcgagtggagcaaatg

SEQ ID NO: 33762 - DNA, 20 bp, Artificial Sequence
  chemically synthesized
tgctgttggagaagcgagtg

SEQ ID NO: 33763 - DNA, 20 bp, Artificial Sequence
  chemically synthesized
tttgctgttggagaagcgag

SEQ ID NO: 33764 - DNA, 20 bp, Artificial Sequence
  chemically synthesized
acatttgctgttggagaagc

SEQ ID NO: 33765 - DNA, 20 bp, Artificial Sequence
  chemically synthesized
tgctccactcgcttctccaa

SEQ ID NO: 33766 - DNA, 20 bp, Artificial Sequence
  chemically synthesized
ggatacatttgctgttggag

SEQ ID NO: 33767 - DNA, 20 bp, Artificial Sequence
  chemically synthesized
ggaggatacatttgctgttg

SEQ ID NO: 33768 - DNA, 20 bp, Artificial Sequence
  chemically synthesized
ttggaggatacatttgctgt

SEQ ID NO: 33769 - DNA, 20 bp, Artificial Sequence
  chemically synthesized
aacagcaaatgtatcctcca

SEQ ID NO: 33770 - DNA, 20 bp, Artificial Sequence
  chemically synthesized
cagcaaatgtatcctccaaa

SEQ ID NO: 33771 - DNA, 20 bp, Artificial Sequence
  chemically synthesized
agcaaatgtatcctccaaag

SEQ ID NO: 33772 - DNA, 20 bp, Artificial Sequence
  chemically synthesized
gcaaatgtatcctccaaaga

SEQ ID NO: 33773 - DNA, 20 bp, Artificial Sequence
  chemically synthesized
ttactcaagcccctctttgg

SEQ ID NO: 33774 - DNA, 20 bp, Artificial Sequence
  chemically synthesized
caaatgtatcctccaaagag

SEQ ID NO: 33775 - DNA, 20 bp, Artificial Sequence
  chemically synthesized
tttactcaagcccctctttg

SEQ ID NO: 33776 - DNA, 20 bp, Artificial Sequence
  chemically synthesized
cttttactcaagcccctctt

SEQ ID NO: 33777 - DNA, 20 bp, Artificial Sequence
  chemically synthesized
tatcctccaaagaggggctt

SEQ ID NO: 33778 - DNA, 20 bp, Artificial Sequence
  chemically synthesized
ccaaagaggggcttgagtaa

SEQ ID NO: 33779 - DNA, 20 bp, Artificial Sequence
  chemically synthesized
caaagaggggcttgagtaaa

SEQ ID NO: 33780 - DNA, 20 bp, Artificial Sequence
  chemically synthesized
ttttttattgccttttactc

SEQ ID NO: 33781 - DNA, 20 bp, Artificial Sequence
  chemically synthesized
ttgagtaaaaggcaataaaa

SEQ ID NO: 33782 - DNA, 20 bp, Artificial Sequence
  chemically synthesized
gtaaaaggcaataaaaaagc

SEQ ID NO: 33783 - DNA, 20 bp, Artificial Sequence
  chemically synthesized
taaaaggcaataaaaaagct

SEQ ID NO: 33784 - DNA, 20 bp, Artificial Sequence
  chemically synthesized
tcaacctttctttttttgcc

SEQ ID NO: 33785 - DNA, 20 bp, Artificial Sequence
  chemically synthesized
ataaaaaagctaggcaaaaa

SEQ ID NO: 33786 - DNA, 20 bp, Artificial Sequence
  chemically synthesized
aaaagctaggcaaaaaaaga

SEQ ID NO: 33787 - DNA, 20 bp, Artificial Sequence
  chemically synthesized
aaagctaggcaaaaaaagaa

SEQ ID NO: 33788 - DNA, 20 bp, Artificial Sequence
  chemically synthesized
gcaaaaaaagaaaggttgat

SEQ ID NO: 33789 - DNA, 20 bp, Artificial Sequence
  chemically synthesized
caaaaaaagaaaggttgatt

SEQ ID NO: 33790 - DNA, 20 bp, Artificial Sequence
  chemically synthesized
aaaaaaagaaaggttgattg

SEQ ID NO: 33791 - DNA, 20 bp, Artificial Sequence
  chemically synthesized
aaaaaagaaaggttgattgg

SEQ ID NO: 33792 - DNA, 20 bp, Artificial Sequence
  chemically synthesized
agaaaggttgattgggggtg

SEQ ID NO: 33793 - DNA, 20 bp, Artificial Sequence
  chemically synthesized
gaaaggttgattgggggtgt

SEQ ID NO: 33794 - DNA, 20 bp, Artificial Sequence
  chemically synthesized
aaaggttgattgggggtgtg

SEQ ID NO: 33795 - DNA, 20 bp, Artificial Sequence
  chemically synthesized
aaggttgattgggggtgtgg

SEQ ID NO: 33796 - DNA, 20 bp, Artificial Sequence
  chemically synthesized
aggttgattgggggtgtggg

SEQ ID NO: 33797 - DNA, 20 bp, Artificial Sequence
  chemically synthesized
ggttgattgggggtgtgggg

SEQ ID NO: 33798 - DNA, 20 bp, Artificial Sequence
  chemically synthesized
gttgattgggggtgtggggg

SEQ ID NO: 33799 - DNA, 20 bp, Artificial Sequence
  chemically synthesized
ttgattgggggtgtgggggg

SEQ ID NO: 33800 - DNA, 20 bp, Artificial Sequence
  chemically synthesized
tgattgggggtgtggggggg

SEQ ID NO: 33801 - DNA, 20 bp, Artificial Sequence
  chemically synthesized
gattgggggtgtgggggggg

SEQ ID NO: 33802 - DNA, 20 bp, Artificial Sequence
  chemically synthesized
attgggggtgtggggggggg

SEQ ID NO: 33803 - DNA, 20 bp, Artificial Sequence
  chemically synthesized
ttgggggtgtgggggggggg

SEQ ID NO: 33804 - DNA, 20 bp, Artificial Sequence
  chemically synthesized
tgggggtgtggggggggggg

SEQ ID NO: 33805 - DNA, 20 bp, Artificial Sequence
  chemically synthesized
gggtgtgggggggggggggg

SEQ ID NO: 33806 - DNA, 20 bp, Artificial Sequence
  chemically synthesized
ggtgtggggggggggggggt

SEQ ID NO: 33807 - DNA, 20 bp, Artificial Sequence
  chemically synthesized
ggggggggggggtgggtgac

SEQ ID NO: 33808 - DNA, 20 bp, Artificial Sequence
  chemically synthesized
gggggggggggtgggtgaca

SEQ ID NO: 33809 - DNA, 20 bp, Artificial Sequence
  chemically synthesized
gggggggggtgggtgacaag

SEQ ID NO: 33810 - DNA, 20 bp, Artificial Sequence
  chemically synthesized
gggggggtgggtgacaagga

SEQ ID NO: 33811 - DNA, 20 bp, Artificial Sequence
  chemically synthesized
tgggtgacaaggagagatga

SEQ ID NO: 33812 - DNA, 20 bp, Artificial Sequence
  chemically synthesized
gggtgacaaggagagatgac

SEQ ID NO: 33813 - DNA, 20 bp, Artificial Sequence
  chemically synthesized
ggtgacaaggagagatgaca

SEQ ID NO: 33814 - DNA, 20 bp, Artificial Sequence
  chemically synthesized
aaggagagatgacagggata

SEQ ID NO: 33815 - DNA, 20 bp, Artificial Sequence
  chemically synthesized
gagagatgacagggataaag

SEQ ID NO: 33816 - DNA, 20 bp, Artificial Sequence
  chemically synthesized
agatgacagggataaagcag

SEQ ID NO: 33817 - DNA, 20 bp, Artificial Sequence
  chemically synthesized
cagggataaagcagaagacc

SEQ ID NO: 33818 - DNA, 20 bp, Artificial Sequence
  chemically synthesized
ggataaagcagaagaccaag

SEQ ID NO: 33819 - DNA, 20 bp, Artificial Sequence
  chemically synthesized
ataaagcagaagaccaagaa

SEQ ID NO: 33820 - DNA, 20 bp, Artificial Sequence
  chemically synthesized
cttgggcaataaactcttct

SEQ ID NO: 33821 - DNA, 20 bp, Artificial Sequence
  chemically synthesized
ccaagaagagtttattgccc

SEQ ID NO: 33822 - DNA, 20 bp, Artificial Sequence
  chemically synthesized
caagaagagtttattgccca

SEQ ID NO: 33823 - DNA, 20 bp, Artificial Sequence
  chemically synthesized
tgaaatctacatttttcctt

SEQ ID NO: 33824 - DNA, 20 bp, Artificial Sequence
  chemically synthesized
gtgaaatctacatttttcct

SEQ ID NO: 33825 - DNA, 20 bp, Artificial Sequence
  chemically synthesized
ttattgcccaaggaaaaatg

SEQ ID NO: 33826 - DNA, 20 bp, Artificial Sequence
  chemically synthesized
aaaaatgtagatttcactta

SEQ ID NO: 33827 - DNA, 20 bp, Artificial Sequence
  chemically synthesized
aacttttaagtggcgtcttt

SEQ ID NO: 33828 - DNA, 20 bp, Artificial Sequence
  chemically synthesized
cacttaaagacgccacttaa

SEQ ID NO: 33829 - DNA, 20 bp, Artificial Sequence
  chemically synthesized
ttaagtggtgaacttttaag

SEQ ID NO: 33830 - DNA, 20 bp, Artificial Sequence
  chemically synthesized
gatttaagtggtgaactttt

SEQ ID NO: 33831 - DNA, 20 bp, Artificial Sequence
  chemically synthesized
taaaagttcaccacttaaat

SEQ ID NO: 33832 - DNA, 20 bp, Artificial Sequence
  chemically synthesized
aaaaatccatccgatttaag

SEQ ID NO: 33833 - DNA, 20 bp, Artificial Sequence
  chemically synthesized
gaaaaaaatccatccgattt

SEQ ID NO: 33834 - DNA, 20 bp, Artificial Sequence
  chemically synthesized
agttcaccacttaaatcgga

SEQ ID NO: 33835 - DNA, 20 bp, Artificial Sequence
  chemically synthesized
tttttttcatgatgtaaaaa

SEQ ID NO: 33836 - DNA, 20 bp, Artificial Sequence
  chemically synthesized
attaatattatgcctccctc

SEQ ID NO: 33837 - DNA, 20 bp, Artificial Sequence
  chemically synthesized
ggggtttagttgctcgaggg

SEQ ID NO: 33838 - DNA, 20 bp, Artificial Sequence
  chemically synthesized
aggggtttagttgctcgagg

SEQ ID NO: 33839 - DNA, 20 bp, Artificial Sequence
  chemically synthesized
gaaggggtttagttgctcga

SEQ ID NO: 33840 - DNA, 20 bp, Artificial Sequence
  chemically synthesized
tgaaggggtttagttgctcg

SEQ ID NO: 33841 - DNA, 20 bp, Artificial Sequence
  chemically synthesized
ttgaaggggtttagttgctc

SEQ ID NO: 33842 - DNA, 20 bp, Artificial Sequence
  chemically synthesized
agctttaaattgaaggggtt

SEQ ID NO: 33843 - DNA, 20 bp, Artificial Sequence
  chemically synthesized
tttgaagctttaaattgaag

SEQ ID NO: 33844 - DNA, 20 bp, Artificial Sequence
  chemically synthesized
gtttgaagctttaaattgaa

SEQ ID NO: 33845 - DNA, 20 bp, Artificial Sequence
  chemically synthesized
agtttgaagctttaaattga

SEQ ID NO: 33846 - DNA, 20 bp, Artificial Sequence
  chemically synthesized
aactaaaccccttcaattta

SEQ ID NO: 33847 - DNA, 20 bp, Artificial Sequence
  chemically synthesized
aagtttgaagctttaaattg

SEQ ID NO: 33848 - DNA, 20 bp, Artificial Sequence
  chemically synthesized
caaatttgaagttaagtttg

SEQ ID NO: 33849 - DNA, 20 bp, Artificial Sequence
  chemically synthesized
tattagtcaaatttgaagtt

SEQ ID NO: 33850 - DNA, 20 bp, Artificial Sequence
  chemically synthesized
gcttatattagtcaaatttg

SEQ ID NO: 33851 - DNA, 20 bp, Artificial Sequence
  chemically synthesized
acttcaaatttgactaatat

SEQ ID NO: 33852 - DNA, 20 bp, Artificial Sequence
  chemically synthesized
gcagaacactttgcttatat

SEQ ID NO: 33853 - DNA, 20 bp, Artificial Sequence
  chemically synthesized
aaatttgactaatataagca

SEQ ID NO: 33854 - DNA, 20 bp, Artificial Sequence
  chemically synthesized
cagcacggcaataaaaaggg

SEQ ID NO: 33855 - DNA, 20 bp, Artificial Sequence
  chemically synthesized
tcccagcacggcaataaaaa

SEQ ID NO: 33856 - DNA, 20 bp, Artificial Sequence
  chemically synthesized
atcccagcacggcaataaaa

SEQ ID NO: 33857 - DNA, 20 bp, Artificial Sequence
  chemically synthesized
aatcccagcacggcaataaa

SEQ ID NO: 33858 - DNA, 20 bp, Artificial Sequence
  chemically synthesized
tgccctttttattgccgtgc

SEQ ID NO: 33859 - DNA, 20 bp, Artificial Sequence
  chemically synthesized
gccctttttattgccgtgct

SEQ ID NO: 33860 - DNA, 20 bp, Artificial Sequence
  chemically synthesized
tgtcactcccaatcccagca

SEQ ID NO: 33861 - DNA, 20 bp, Artificial Sequence
  chemically synthesized
ttttattgccgtgctgggat

SEQ ID NO: 33862 - DNA, 20 bp, Artificial Sequence
  chemically synthesized
tttattgccgtgctgggatt

SEQ ID NO: 33863 - DNA, 20 bp, Artificial Sequence
  chemically synthesized
tattgccgtgctgggattgg

SEQ ID NO: 33864 - DNA, 20 bp, Artificial Sequence
  chemically synthesized
aagtttgtcactcccaatcc

SEQ ID NO: 33865 - DNA, 20 bp, Artificial Sequence
  chemically synthesized
ggagtgacaaactttgcttg

SEQ ID NO: 33866 - DNA, 20 bp, Artificial Sequence
  chemically synthesized
tctgtgctcatcttcaagca

SEQ ID NO: 33867 - DNA, 20 bp, Artificial Sequence
  chemically synthesized
gacaaactttgcttgaagat

SEQ ID NO: 33868 - DNA, 20 bp, Artificial Sequence
  chemically synthesized
aggtgtctgtgctcatcttc

SEQ ID NO: 33869 - DNA, 20 bp, Artificial Sequence
  chemically synthesized
actttgcttgaagatgagca

SEQ ID NO: 33870 - DNA, 20 bp, Artificial Sequence
  chemically synthesized
tgaagatgagcacagacacc

SEQ ID NO: 33871 - DNA, 20 bp, Artificial Sequence
  chemically synthesized
aagatgagcacagacacctg

SEQ ID NO: 33872 - DNA, 20 bp, Artificial Sequence
  chemically synthesized
gtgttctctcgcatttctcc

SEQ ID NO: 33873 - DNA, 20 bp, Artificial Sequence
  chemically synthesized
ggtgttctctcgcatttctc

SEQ ID NO: 33874 - DNA, 20 bp, Artificial Sequence
  chemically synthesized
acagacacctggagaaatgc

SEQ ID NO: 33875 - DNA, 20 bp, Artificial Sequence
  chemically synthesized
agacacctggagaaatgcga

SEQ ID NO: 33876 - DNA, 20 bp, Artificial Sequence
  chemically synthesized
agaaatgcgagagaacaccc

SEQ ID NO: 33877 - DNA, 20 bp, Artificial Sequence
  chemically synthesized
tgggtgtggagtcatttcta

SEQ ID NO: 33878 - DNA, 20 bp, Artificial Sequence
  chemically synthesized
ttgggtgtggagtcatttct

SEQ ID NO: 33879 - DNA, 20 bp, Artificial Sequence
  chemically synthesized
attgggtgtggagtcatttc

SEQ ID NO: 33880 - DNA, 20 bp, Artificial Sequence
  chemically synthesized
gcccttcgggattgggtgtg

SEQ ID NO: 33881 - DNA, 20 bp, Artificial Sequence
  chemically synthesized
ttgcccttcgggattgggtg

SEQ ID NO: 33882 - DNA, 20 bp, Artificial Sequence
  chemically synthesized
tgactccacacccaatcccg

SEQ ID NO: 33883 - DNA, 20 bp, Artificial Sequence
  chemically synthesized
tttttttgcccttcgggatt

SEQ ID NO: 33884 - DNA, 20 bp, Artificial Sequence
  chemically synthesized
gactccacacccaatcccga

SEQ ID NO: 33885 - DNA, 20 bp, Artificial Sequence
  chemically synthesized
ttttttttgcccttcgggat

SEQ ID NO: 33886 - DNA, 20 bp, Artificial Sequence
  chemically synthesized
actccacacccaatcccgaa

SEQ ID NO: 33887 - DNA, 20 bp, Artificial Sequence
  chemically synthesized
tttttttttttttgcccttc

SEQ ID NO: 33888 - DNA, 20 bp, Artificial Sequence
  chemically synthesized
ttttttttttttttgccctt

SEQ ID NO: 33889 - DNA, 20 bp, Artificial Sequence
  chemically synthesized
aaaaaaaaaaaaaaaaaaaa

SEQ ID NO: 33890 - DNA, 20 bp, Artificial Sequence
  chemically synthesized
gtggggatttttgtttgttt

SEQ ID NO: 33891 - DNA, 20 bp, Artificial Sequence
  chemically synthesized
ggtggggatttttgtttgtt

SEQ ID NO: 33892 - DNA, 20 bp, Artificial Sequence
  chemically synthesized
gtcaaagatttcagggggtg

SEQ ID NO: 33893 - DNA, 20 bp, Artificial Sequence
  chemically synthesized
agtcaaagatttcagggggt

SEQ ID NO: 33894 - DNA, 20 bp, Artificial Sequence
  chemically synthesized
aagtcaaagatttcaggggg

SEQ ID NO: 33895 - DNA, 20 bp, Artificial Sequence
  chemically synthesized
cagaagtcaaagatttcagg

SEQ ID NO: 33896 - DNA, 20 bp, Artificial Sequence
  chemically synthesized
ccagaagtcaaagatttcag

SEQ ID NO: 33897 - DNA, 20 bp, Artificial Sequence
  chemically synthesized
cccagaagtcaaagatttca

SEQ ID NO: 33898 - DNA, 20 bp, Artificial Sequence
  chemically synthesized
gcccagaagtcaaagatttc

SEQ ID NO: 33899 - DNA, 20 bp, Artificial Sequence
  chemically synthesized
agcccagaagtcaaagattt

SEQ ID NO: 33900 - DNA, 20 bp, Artificial Sequence
  chemically synthesized
cccctgaaatctttgacttc

SEQ ID NO: 33901 - DNA, 20 bp, Artificial Sequence
  chemically synthesized
caactaaagcccagaagtca

SEQ ID NO: 33902 - DNA, 20 bp, Artificial Sequence
  chemically synthesized
ccctgaaatctttgacttct

SEQ ID NO: 33903 - DNA, 20 bp, Artificial Sequence
  chemically synthesized
aacaaacaactaaagcccag

SEQ ID NO: 33904 - DNA, 20 bp, Artificial Sequence
  chemically synthesized
aatctttgacttctgggctt

SEQ ID NO: 33905 - DNA, 20 bp, Artificial Sequence
  chemically synthesized
aagaacaaacaactaaagcc

SEQ ID NO: 33906 - DNA, 20 bp, Artificial Sequence
  chemically synthesized
aaagaaagaacaaacaacta

SEQ ID NO: 33907 - DNA, 20 bp, Artificial Sequence
  chemically synthesized
cctgcagaaatcaggaaaga

SEQ ID NO: 33908 - DNA, 20 bp, Artificial Sequence
  chemically synthesized
aagacctgcagaaatcagga

SEQ ID NO: 33909 - DNA, 20 bp, Artificial Sequence
  chemically synthesized
ccccaagacctgcagaaatc

SEQ ID NO: 33910 - DNA, 20 bp, Artificial Sequence
  chemically synthesized
tctttctttcctgatttctg

SEQ ID NO: 33911 - DNA, 20 bp, Artificial Sequence
  chemically synthesized
gccccaagacctgcagaaat

SEQ ID NO: 33912 - DNA, 20 bp, Artificial Sequence
  chemically synthesized
ctttctttcctgatttctgc

SEQ ID NO: 33913 - DNA, 20 bp, Artificial Sequence
  chemically synthesized
ttcctgatttctgcaggtct

SEQ ID NO: 33914 - DNA, 20 bp, Artificial Sequence
  chemically synthesized
attccatgccccaagacctg

SEQ ID NO: 33915 - DNA, 20 bp, Artificial Sequence
  chemically synthesized
tcctgatttctgcaggtctt

SEQ ID NO: 33916 - DNA, 20 bp, Artificial Sequence
  chemically synthesized
cctgatttctgcaggtcttg

SEQ ID NO: 33917 - DNA, 20 bp, Artificial Sequence
  chemically synthesized
tttctgcaggtcttggggca

SEQ ID NO: 33918 - DNA, 20 bp, Artificial Sequence
  chemically synthesized
ccgtgctcattccatgcccc

SEQ ID NO: 33919 - DNA, 20 bp, Artificial Sequence
  chemically synthesized
caggtcttggggcatggaat

SEQ ID NO: 33920 - DNA, 20 bp, Artificial Sequence
  chemically synthesized
cttggggcatggaatgagca

SEQ ID NO: 33921 - DNA, 20 bp, Artificial Sequence
  chemically synthesized
ggggcatggaatgagcacgg

SEQ ID NO: 33922 - DNA, 20 bp, Artificial Sequence
  chemically synthesized
aatgagcacggtagaaaatg

SEQ ID NO: 33923 - DNA, 20 bp, Artificial Sequence
  chemically synthesized
agcacggtagaaaatgcagc

SEQ ID NO: 33924 - DNA, 20 bp, Artificial Sequence
  chemically synthesized
gcacggtagaaaatgcagcg

SEQ ID NO: 33925 - DNA, 20 bp, Artificial Sequence
  chemically synthesized
cacggtagaaaatgcagcga

SEQ ID NO: 33926 - DNA, 20 bp, Artificial Sequence
  chemically synthesized
aaatgcagcgagggaaatgt

SEQ ID NO: 33927 - DNA, 20 bp, Artificial Sequence
  chemically synthesized
gcagcgagggaaatgtcagt

SEQ ID NO: 33928 - DNA, 20 bp, Artificial Sequence
  chemically synthesized
gaaatgtcagttggaatcct

SEQ ID NO: 33929 - DNA, 20 bp, Artificial Sequence
  chemically synthesized
atgtcagttggaatcctcgg

SEQ ID NO: 33930 - DNA, 20 bp, Artificial Sequence
  chemically synthesized
tttctgcctgatttcttccg

SEQ ID NO: 33931 - DNA, 20 bp, Artificial Sequence
  chemically synthesized
ctttctgcctgatttcttcc

SEQ ID NO: 33932 - DNA, 20 bp, Artificial Sequence
  chemically synthesized
ttggaatcctcggaagaaat

SEQ ID NO: 33933 - DNA, 20 bp, Artificial Sequence
  chemically synthesized
tggaatcctcggaagaaatc

SEQ ID NO: 33934 - DNA, 20 bp, Artificial Sequence
  chemically synthesized
aatcctcggaagaaatcagg

SEQ ID NO: 33935 - DNA, 20 bp, Artificial Sequence
  chemically synthesized
ctcggaagaaatcaggcaga

SEQ ID NO: 33936 - DNA, 20 bp, Artificial Sequence
  chemically synthesized
caggcagaaagttgaccttt

SEQ ID NO: 33937 - DNA, 20 bp, Artificial Sequence
  chemically synthesized
attgcactgcaagtgccaaa

SEQ ID NO: 33938 - DNA, 20 bp, Artificial Sequence
  chemically synthesized
cattgcactgcaagtgccaa

SEQ ID NO: 33939 - DNA, 20 bp, Artificial Sequence
  chemically synthesized
agttgaccttttggcacttg

SEQ ID NO: 33940 - DNA, 20 bp, Artificial Sequence
  chemically synthesized
gctaccttccattgcactgc

SEQ ID NO: 33941 - DNA, 20 bp, Artificial Sequence
  chemically synthesized
ttttggcacttgcagtgcaa

SEQ ID NO: 33942 - DNA, 20 bp, Artificial Sequence
  chemically synthesized
tggcacttgcagtgcaatgg

SEQ ID NO: 33943 - DNA, 20 bp, Artificial Sequence
  chemically synthesized
ggcacttgcagtgcaatgga

SEQ ID NO: 33944 - DNA, 20 bp, Artificial Sequence
  chemically synthesized
acttgcagtgcaatggaagg

SEQ ID NO: 33945 - DNA, 20 bp, Artificial Sequence
  chemically synthesized
gtagaaggaaggggcgcacg

SEQ ID NO: 33946 - DNA, 20 bp, Artificial Sequence
  chemically synthesized
ctcttactcgtagaaggaag

SEQ ID NO: 33947 - DNA, 20 bp, Artificial Sequence
  chemically synthesized
gctcttactcgtagaaggaa

SEQ ID NO: 33948 - DNA, 20 bp, Artificial Sequence
  chemically synthesized
cgctcttactcgtagaagga

SEQ ID NO: 33949 - DNA, 20 bp, Artificial Sequence
  chemically synthesized
tcgctcttactcgtagaagg

SEQ ID NO: 33950 - DNA, 20 bp, Artificial Sequence
  chemically synthesized
cgtgcgccccttccttctac

SEQ ID NO: 33951 - DNA, 20 bp, Artificial Sequence
  chemically synthesized
tcgtcgctcttactcgtaga

SEQ ID NO: 33952 - DNA, 20 bp, Artificial Sequence
  chemically synthesized
atcgtcgctcttactcgtag

SEQ ID NO: 33953 - DNA, 20 bp, Artificial Sequence
  chemically synthesized
cgccccttccttctacgagt

SEQ ID NO: 33954 - DNA, 20 bp, Artificial Sequence
  chemically synthesized
ccccttccttctacgagtaa

SEQ ID NO: 33955 - DNA, 20 bp, Artificial Sequence
  chemically synthesized
taaatcgtcgctcttactcg

SEQ ID NO: 33956 - DNA, 20 bp, Artificial Sequence
  chemically synthesized
tacgagtaagagcgacgatt

SEQ ID NO: 33957 - DNA, 20 bp, Artificial Sequence
  chemically synthesized
acgagtaagagcgacgattt

SEQ ID NO: 33958 - DNA, 20 bp, Artificial Sequence
  chemically synthesized
taagagcgacgatttaggaa

SEQ ID NO: 33959 - DNA, 20 bp, Artificial Sequence
  chemically synthesized
agcgacgatttaggaacagc

SEQ ID NO: 33960 - DNA, 20 bp, Artificial Sequence
  chemically synthesized
agtgtggacgtgagcaaggc

SEQ ID NO: 33961 - DNA, 20 bp, Artificial Sequence
  chemically synthesized
tgccagtgtggacgtgagca

SEQ ID NO: 33962 - DNA, 20 bp, Artificial Sequence
  chemically synthesized
ctgccagtgtggacgtgagc

SEQ ID NO: 33963 - DNA, 20 bp, Artificial Sequence
  chemically synthesized
caggctgccagtgtggacgt

SEQ ID NO: 33964 - DNA, 20 bp, Artificial Sequence
  chemically synthesized
agccttgctcacgtccacac

SEQ ID NO: 33965 - DNA, 20 bp, Artificial Sequence
  chemically synthesized
cttgctcacgtccacactgg

SEQ ID NO: 33966 - DNA, 20 bp, Artificial Sequence
  chemically synthesized
tcctttccaggctgccagtg

SEQ ID NO: 33967 - DNA, 20 bp, Artificial Sequence
  chemically synthesized
tcacgtccacactggcagcc

SEQ ID NO: 33968 - DNA, 20 bp, Artificial Sequence
  chemically synthesized
ttcactcctttccaggctgc

SEQ ID NO: 33969 - DNA, 20 bp, Artificial Sequence
  chemically synthesized
gtccacactggcagcctgga

SEQ ID NO: 33970 - DNA, 20 bp, Artificial Sequence
  chemically synthesized
tccacactggcagcctggaa

SEQ ID NO: 33971 - DNA, 20 bp, Artificial Sequence
  chemically synthesized
cacactggcagcctggaaag

SEQ ID NO: 33972 - DNA, 20 bp, Artificial Sequence
  chemically synthesized
ggagcttttcactcctttcc

SEQ ID NO: 33973 - DNA, 20 bp, Artificial Sequence
  chemically synthesized
gggagcttttcactcctttc

SEQ ID NO: 33974 - DNA, 20 bp, Artificial Sequence
  chemically synthesized
gcagcctggaaaggagtgaa

SEQ ID NO: 33975 - DNA, 20 bp, Artificial Sequence
  chemically synthesized
aaaggagtgaaaagctcccc

SEQ ID NO: 33976 - DNA, 20 bp, Artificial Sequence
  chemically synthesized
cgcggggattggggccgggg

SEQ ID NO: 33977 - DNA, 20 bp, Artificial Sequence
  chemically synthesized
cacgcggggattggggccgg

SEQ ID NO: 33978 - DNA, 20 bp, Artificial Sequence
  chemically synthesized
tcacgcggggattggggccg

SEQ ID NO: 33979 - DNA, 20 bp, Artificial Sequence
  chemically synthesized
ctcacgcggggattggggcc

SEQ ID NO: 33980 - DNA, 20 bp, Artificial Sequence
  chemically synthesized
cctcacgcggggattggggc

SEQ ID NO: 33981 - DNA, 20 bp, Artificial Sequence
  chemically synthesized
cgttcctcacgcggggattg

SEQ ID NO: 33982 - DNA, 20 bp, Artificial Sequence
  chemically synthesized
gcgttcctcacgcggggatt

SEQ ID NO: 33983 - DNA, 20 bp, Artificial Sequence
  chemically synthesized
cgcgttcctcacgcggggat

SEQ ID NO: 33984 - DNA, 20 bp, Artificial Sequence
  chemically synthesized
cccggccccaatccccgcgt

SEQ ID NO: 33985 - DNA, 20 bp, Artificial Sequence
  chemically synthesized
ccggccccaatccccgcgtg

SEQ ID NO: 33986 - DNA, 20 bp, Artificial Sequence
  chemically synthesized
gataacgcgttcctcacgcg

SEQ ID NO: 33987 - DNA, 20 bp, Artificial Sequence
  chemically synthesized
ggataacgcgttcctcacgc

SEQ ID NO: 33988 - DNA, 20 bp, Artificial Sequence
  chemically synthesized
gggataacgcgttcctcacg

SEQ ID NO: 33989 - DNA, 20 bp, Artificial Sequence
  chemically synthesized
gaggaacgcgttatcccctc

SEQ ID NO: 33990 - DNA, 20 bp, Artificial Sequence
  chemically synthesized
aggaacgcgttatcccctct

SEQ ID NO: 33991 - DNA, 20 bp, Artificial Sequence
  chemically synthesized
ggaacgcgttatcccctctg

SEQ ID NO: 33992 - DNA, 20 bp, Artificial Sequence
  chemically synthesized
atttctccccgtccccagag

SEQ ID NO: 33993 - DNA, 20 bp, Artificial Sequence
  chemically synthesized
gatttctccccgtccccaga

SEQ ID NO: 33994 - DNA, 20 bp, Artificial Sequence
  chemically synthesized
cgcgttatcccctctgggga

SEQ ID NO: 33995 - DNA, 20 bp, Artificial Sequence
  chemically synthesized
tgatttctccccgtccccag

SEQ ID NO: 33996 - DNA, 20 bp, Artificial Sequence
  chemically synthesized
gcgttatcccctctggggac

SEQ ID NO: 33997 - DNA, 20 bp, Artificial Sequence
  chemically synthesized
ctgatttctccccgtcccca

SEQ ID NO: 33998 - DNA, 20 bp, Artificial Sequence
  chemically synthesized
cgttatcccctctggggacg

SEQ ID NO: 33999 - DNA, 20 bp, Artificial Sequence
  chemically synthesized
agctgatttctccccgtccc

SEQ ID NO: 34000 - DNA, 20 bp, Artificial Sequence
  chemically synthesized
ttatcccctctggggacggg

SEQ ID NO: 34001 - DNA, 20 bp, Artificial Sequence
  chemically synthesized
ctctggggacggggagaaat

SEQ ID NO: 34002 - DNA, 20 bp, Artificial Sequence
  chemically synthesized
gggacgggctcggagagaaa

SEQ ID NO: 34003 - DNA, 20 bp, Artificial Sequence
  chemically synthesized
gaaatcagctttttctctcc

SEQ ID NO: 34004 - DNA, 20 bp, Artificial Sequence
  chemically synthesized
ggctttgggacgggctcgga

SEQ ID NO: 34005 - DNA, 20 bp, Artificial Sequence
  chemically synthesized
tcggctttgggacgggctcg

SEQ ID NO: 34006 - DNA, 20 bp, Artificial Sequence
  chemically synthesized
cctcggctttgggacgggct

SEQ ID NO: 34007 - DNA, 20 bp, Artificial Sequence
  chemically synthesized
ttctctccgagcccgtccca

SEQ ID NO: 34008 - DNA, 20 bp, Artificial Sequence
  chemically synthesized
tcttccctcggctttgggac

SEQ ID NO: 34009 - DNA, 20 bp, Artificial Sequence
  chemically synthesized
ctcttccctcggctttggga

SEQ ID NO: 34010 - DNA, 20 bp, Artificial Sequence
  chemically synthesized
tccgagcccgtcccaaagcc

SEQ ID NO: 34011 - DNA, 20 bp, Artificial Sequence
  chemically synthesized
ccgagcccgtcccaaagccg

SEQ ID NO: 34012 - DNA, 20 bp, Artificial Sequence
  chemically synthesized
gaacctcttccctcggcttt

SEQ ID NO: 34013 - DNA, 20 bp, Artificial Sequence
  chemically synthesized
cgagcccgtcccaaagccga

SEQ ID NO: 34014 - DNA, 20 bp, Artificial Sequence
  chemically synthesized
ggaacctcttccctcggctt

SEQ ID NO: 34015 - DNA, 20 bp, Artificial Sequence
  chemically synthesized
gcccgtcccaaagccgaggg

SEQ ID NO: 34016 - DNA, 20 bp, Artificial Sequence
  chemically synthesized
ccgtcccaaagccgagggaa

SEQ ID NO: 34017 - DNA, 20 bp, Artificial Sequence
  chemically synthesized
cgtcccaaagccgagggaag

SEQ ID NO: 34018 - DNA, 20 bp, Artificial Sequence
  chemically synthesized
agtgggggaacctcttccct

SEQ ID NO: 34019 - DNA, 20 bp, Artificial Sequence
  chemically synthesized
gagggaagaggttcccccac

SEQ ID NO: 34020 - DNA, 20 bp, Artificial Sequence
  chemically synthesized
cccaggcgccgggctagtgg

SEQ ID NO: 34021 - DNA, 20 bp, Artificial Sequence
  chemically synthesized
ccccaggcgccgggctagtg

SEQ ID NO: 34022 - DNA, 20 bp, Artificial Sequence
  chemically synthesized
aagaggttcccccactagcc

SEQ ID NO: 34023 - DNA, 20 bp, Artificial Sequence
  chemically synthesized
tccccaggcgccgggctagt

SEQ ID NO: 34024 - DNA, 20 bp, Artificial Sequence
  chemically synthesized
ctccccaggcgccgggctag

SEQ ID NO: 34025 - DNA, 20 bp, Artificial Sequence
  chemically synthesized
tttctccccaggcgccgggc

SEQ ID NO: 34026 - DNA, 20 bp, Artificial Sequence
  chemically synthesized
tcccccactagcccggcgcc

SEQ ID NO: 34027 - DNA, 20 bp, Artificial Sequence
  chemically synthesized
cccccactagcccggcgcct

SEQ ID NO: 34028 - DNA, 20 bp, Artificial Sequence
  chemically synthesized
ggggtttctccccaggcgcc

SEQ ID NO: 34029 - DNA, 20 bp, Artificial Sequence
  chemically synthesized
ccccactagcccggcgcctg

SEQ ID NO: 34030 - DNA, 20 bp, Artificial Sequence
  chemically synthesized
cggggtttctccccaggcgc

SEQ ID NO: 34031 - DNA, 20 bp, Artificial Sequence
  chemically synthesized
ccactagcccggcgcctggg

SEQ ID NO: 34032 - DNA, 20 bp, Artificial Sequence
  chemically synthesized
cgcccccggggtttctcccc

SEQ ID NO: 34033 - DNA, 20 bp, Artificial Sequence
  chemically synthesized
gcgcccccggggtttctccc

SEQ ID NO: 34034 - DNA, 20 bp, Artificial Sequence
  chemically synthesized
cggcgcctggggagaaaccc

SEQ ID NO: 34035 - DNA, 20 bp, Artificial Sequence
  chemically synthesized
ggcgcctggggagaaacccc

SEQ ID NO: 34036 - DNA, 20 bp, Artificial Sequence
  chemically synthesized
gcgcctggggagaaaccccg

SEQ ID NO: 34037 - DNA, 20 bp, Artificial Sequence
  chemically synthesized
cgcctggggagaaaccccgg

SEQ ID NO: 34038 - DNA, 20 bp, Artificial Sequence
  chemically synthesized
cggctgcaggtgcgcccccg

SEQ ID NO: 34039 - DNA, 20 bp, Artificial Sequence
  chemically synthesized
gcggctgcaggtgcgccccc

SEQ ID NO: 34040 - DNA, 20 bp, Artificial Sequence
  chemically synthesized
cgcggctgcaggtgcgcccc

SEQ ID NO: 34041 - DNA, 20 bp, Artificial Sequence
  chemically synthesized
aaaccccgggggcgcacctg

SEQ ID NO: 34042 - DNA, 20 bp, Artificial Sequence
  chemically synthesized
ggttcccgcggcgcggctgc

SEQ ID NO: 34043 - DNA, 20 bp, Artificial Sequence
  chemically synthesized
gggttcccgcggcgcggctg

SEQ ID NO: 34044 - DNA, 20 bp, Artificial Sequence
  chemically synthesized
gcgcacctgcagccgcgccg

SEQ ID NO: 34045 - DNA, 20 bp, Artificial Sequence
  chemically synthesized
cgcacctgcagccgcgccgc

SEQ ID NO: 34046 - DNA, 20 bp, Artificial Sequence
  chemically synthesized
tcccgcgggttcccgcggcg

SEQ ID NO: 34047 - DNA, 20 bp, Artificial Sequence
  chemically synthesized
acctctcccgcgggttcccg

SEQ ID NO: 34048 - DNA, 20 bp, Artificial Sequence
  chemically synthesized
agccgcgccgcgggaacccg

SEQ ID NO: 34049 - DNA, 20 bp, Artificial Sequence
  chemically synthesized
gccgcgccgcgggaacccgc

SEQ ID NO: 34050 - DNA, 20 bp, Artificial Sequence
  chemically synthesized
cgcgccgcgggaacccgcgg

SEQ ID NO: 34051 - DNA, 20 bp, Artificial Sequence
  chemically synthesized
cgccgcgggaacccgcggga

SEQ ID NO: 34052 - DNA, 20 bp, Artificial Sequence
  chemically synthesized
gccgcgggaacccgcgggag

SEQ ID NO: 34053 - DNA, 20 bp, Artificial Sequence
  chemically synthesized
cgtctaggaacctctcccgc

SEQ ID NO: 34054 - DNA, 20 bp, Artificial Sequence
  chemically synthesized
gcgtctaggaacctctcccg

SEQ ID NO: 34055 - DNA, 20 bp, Artificial Sequence
  chemically synthesized
gaacccgcgggagaggttcc

SEQ ID NO: 34056 - DNA, 20 bp, Artificial Sequence
  chemically synthesized
gggagaggttcctagacgcc

SEQ ID NO: 34057 - DNA, 20 bp, Artificial Sequence
  chemically synthesized
cgccgggcggctgggcgtct

SEQ ID NO: 34058 - DNA, 20 bp, Artificial Sequence
  chemically synthesized
gcgccgggcggctgggcgtc

SEQ ID NO: 34059 - DNA, 20 bp, Artificial Sequence
  chemically synthesized
ttcctagacgcccagccgcc

SEQ ID NO: 34060 - DNA, 20 bp, Artificial Sequence
  chemically synthesized
acccggggcgccgggcggct

SEQ ID NO: 34061 - DNA, 20 bp, Artificial Sequence
  chemically synthesized
gacccggggcgccgggcggc

SEQ ID NO: 34062 - DNA, 20 bp, Artificial Sequence
  chemically synthesized
gctggacccggggcgccggg

SEQ ID NO: 34063 - DNA, 20 bp, Artificial Sequence
  chemically synthesized
cgcccagccgcccggcgccc

SEQ ID NO: 34064 - DNA, 20 bp, Artificial Sequence
  chemically synthesized
gcggctggacccggggcgcc

SEQ ID NO: 34065 - DNA, 20 bp, Artificial Sequence
  chemically synthesized
gcccagccgcccggcgcccc

SEQ ID NO: 34066 - DNA, 20 bp, Artificial Sequence
  chemically synthesized
ggcggctggacccggggcgc

SEQ ID NO: 34067 - DNA, 20 bp, Artificial Sequence
  chemically synthesized
gccgcccggcgccccgggtc

SEQ ID NO: 34068 - DNA, 20 bp, Artificial Sequence
  chemically synthesized
aggcgcggcggctggacccg

SEQ ID NO: 34069 - DNA, 20 bp, Artificial Sequence
  chemically synthesized
caggcgcggcggctggaccc

SEQ ID NO: 34070 - DNA, 20 bp, Artificial Sequence
  chemically synthesized
acaggcgcggcggctggacc

SEQ ID NO: 34071 - DNA, 20 bp, Artificial Sequence
  chemically synthesized
acttggacaggcgcggcggc

SEQ ID NO: 34072 - DNA, 20 bp, Artificial Sequence
  chemically synthesized
caaaacttggacaggcgcgg

SEQ ID NO: 34073 - DNA, 20 bp, Artificial Sequence
  chemically synthesized
ggtcaaaacttggacaggcg

SEQ ID NO: 34074 - DNA, 20 bp, Artificial Sequence
  chemically synthesized
tccagccgccgcgcctgtcc

SEQ ID NO: 34075 - DNA, 20 bp, Artificial Sequence
  chemically synthesized
gaggcggtcaaaacttggac

SEQ ID NO: 34076 - DNA, 20 bp, Artificial Sequence
  chemically synthesized
tgaggcggtcaaaacttgga

SEQ ID NO: 34077 - DNA, 20 bp, Artificial Sequence
  chemically synthesized
aagctgaggcggtcaaaact

SEQ ID NO: 34078 - DNA, 20 bp, Artificial Sequence
  chemically synthesized
tgtccaagttttgaccgcct

SEQ ID NO: 34079 - DNA, 20 bp, Artificial Sequence
  chemically synthesized
gagcagggggcaagctgagg

SEQ ID NO: 34080 - DNA, 20 bp, Artificial Sequence
  chemically synthesized
cgcgagcagggggcaagctg

SEQ ID NO: 34081 - DNA, 20 bp, Artificial Sequence
  chemically synthesized
gcgcgagcagggggcaagct

SEQ ID NO: 34082 - DNA, 20 bp, Artificial Sequence
  chemically synthesized
ttgtggcgcgagcagggggc

SEQ ID NO: 34083 - DNA, 20 bp, Artificial Sequence
  chemically synthesized
gcacttgtggcgcgagcagg

SEQ ID NO: 34084 - DNA, 20 bp, Artificial Sequence
  chemically synthesized
tgcacttgtggcgcgagcag

SEQ ID NO: 34085 - DNA, 20 bp, Artificial Sequence
  chemically synthesized
gtgcacttgtggcgcgagca

SEQ ID NO: 34086 - DNA, 20 bp, Artificial Sequence
  chemically synthesized
cgtgcacttgtggcgcgagc

SEQ ID NO: 34087 - DNA, 20 bp, Artificial Sequence
  chemically synthesized
ccgtgcacttgtggcgcgag

SEQ ID NO: 34088 - DNA, 20 bp, Artificial Sequence
  chemically synthesized
ttgccccctgctcgcgccac

SEQ ID NO: 34089 - DNA, 20 bp, Artificial Sequence
  chemically synthesized
aatccgtgcacttgtggcgc

SEQ ID NO: 34090 - DNA, 20 bp, Artificial Sequence
  chemically synthesized
ggccgcaatccgtgcacttg

SEQ ID NO: 34091 - DNA, 20 bp, Artificial Sequence
  chemically synthesized
ctgctcgcgccacaagtgca

SEQ ID NO: 34092 - DNA, 20 bp, Artificial Sequence
  chemically synthesized
cgccacaagtgcacggattg

SEQ ID NO: 34093 - DNA, 20 bp, Artificial Sequence
  chemically synthesized
agtgcacggattgcggccat

SEQ ID NO: 34094 - DNA, 20 bp, Artificial Sequence
  chemically synthesized
cacggattgcggccatcaga

SEQ ID NO: 34095 - DNA, 20 bp, Artificial Sequence
  chemically synthesized
acggattgcggccatcagac

SEQ ID NO: 34096 - DNA, 20 bp, Artificial Sequence
  chemically synthesized
cggattgcggccatcagacg

SEQ ID NO: 34097 - DNA, 20 bp, Artificial Sequence
  chemically synthesized
gcggccccggccccgtctga

SEQ ID NO: 34098 - DNA, 20 bp, Artificial Sequence
  chemically synthesized
ttgcggccatcagacggggc

SEQ ID NO: 34099 - DNA, 20 bp, Artificial Sequence
  chemically synthesized
tgcggccatcagacggggcc

SEQ ID NO: 34100 - DNA, 20 bp, Artificial Sequence
  chemically synthesized
gcggccatcagacggggccg

SEQ ID NO: 34101 - DNA, 20 bp, Artificial Sequence
  chemically synthesized
gggtaagtggatcgcggccc

SEQ ID NO: 34102 - DNA, 20 bp, Artificial Sequence
  chemically synthesized
ctcaaagggtaagtggatcg

SEQ ID NO: 34103 - DNA, 20 bp, Artificial Sequence
  chemically synthesized
ggaacagctcaaagggtaag

SEQ ID NO: 34104 - DNA, 20 bp, Artificial Sequence
  chemically synthesized
ccgcgatccacttacccttt

SEQ ID NO: 34105 - DNA, 20 bp, Artificial Sequence
  chemically synthesized
gagggaacagctcaaagggt

SEQ ID NO: 34106 - DNA, 20 bp, Artificial Sequence
  chemically synthesized
ccatgagggaacagctcaaa

SEQ ID NO: 34107 - DNA, 20 bp, Artificial Sequence
  chemically synthesized
gccatgagggaacagctcaa

SEQ ID NO: 34108 - DNA, 20 bp, Artificial Sequence
  chemically synthesized
agccatgagggaacagctca

SEQ ID NO: 34109 - DNA, 20 bp, Artificial Sequence
  chemically synthesized
cccttgcagccatgagggaa

SEQ ID NO: 34110 - DNA, 20 bp, Artificial Sequence
  chemically synthesized
ccctttgagctgttccctca

SEQ ID NO: 34111 - DNA, 20 bp, Artificial Sequence
  chemically synthesized
cggagcccttgcagccatga

SEQ ID NO: 34112 - DNA, 20 bp, Artificial Sequence
  chemically synthesized
gcggagcccttgcagccatg

SEQ ID NO: 34113 - DNA, 20 bp, Artificial Sequence
  chemically synthesized
cgcggagcccttgcagccat

SEQ ID NO: 34114 - DNA, 20 bp, Artificial Sequence
  chemically synthesized
agctgttccctcatggctgc

SEQ ID NO: 34115 - DNA, 20 bp, Artificial Sequence
  chemically synthesized
gctgttccctcatggctgca

SEQ ID NO: 34116 - DNA, 20 bp, Artificial Sequence
  chemically synthesized
ctgttccctcatggctgcaa

SEQ ID NO: 34117 - DNA, 20 bp, Artificial Sequence
  chemically synthesized
actcgaccgcggagcccttg

SEQ ID NO: 34118 - DNA, 20 bp, Artificial Sequence
  chemically synthesized
tcatggctgcaagggctccg

SEQ ID NO: 34119 - DNA, 20 bp, Artificial Sequence
  chemically synthesized
gctgcaagggctccgcggtc

SEQ ID NO: 34120 - DNA, 20 bp, Artificial Sequence
  chemically synthesized
cgtacccacactcgaccgcg

SEQ ID NO: 34121 - DNA, 20 bp, Artificial Sequence
  chemically synthesized
ctcgtacccacactcgaccg

SEQ ID NO: 34122 - DNA, 20 bp, Artificial Sequence
  chemically synthesized
aagggctccgcggtcgagtg

SEQ ID NO: 34123 - DNA, 20 bp, Artificial Sequence
  chemically synthesized
agggctccgcggtcgagtgt

SEQ ID NO: 34124 - DNA, 20 bp, Artificial Sequence
  chemically synthesized
ccgcggtcgagtgtgggtac

SEQ ID NO: 34125 - DNA, 20 bp, Artificial Sequence
  chemically synthesized
cggtcgagtgtgggtacgag

SEQ ID NO: 34126 - DNA, 20 bp, Artificial Sequence
  chemically synthesized
gtcgagtgtgggtacgagtg

SEQ ID NO: 34127 - DNA, 20 bp, Artificial Sequence
  chemically synthesized
tcgagtgtgggtacgagtgg

SEQ ID NO: 34128 - DNA, 20 bp, Artificial Sequence
  chemically synthesized
gagtgtgggtacgagtggag

SEQ ID NO: 34129 - DNA, 20 bp, Artificial Sequence
  chemically synthesized
gtgggtacgagtggaggagt

SEQ ID NO: 34130 - DNA, 20 bp, Artificial Sequence
  chemically synthesized
gagtggaggagtgagcttcc

SEQ ID NO: 34131 - DNA, 20 bp, Artificial Sequence
  chemically synthesized
gtggaggagtgagcttccca

SEQ ID NO: 34132 - DNA, 20 bp, Artificial Sequence
  chemically synthesized
gggagcccggcggctctggg

SEQ ID NO: 34133 - DNA, 20 bp, Artificial Sequence
  chemically synthesized
tcggggagcccggcggctct

SEQ ID NO: 34134 - DNA, 20 bp, Artificial Sequence
  chemically synthesized
agtgagcttcccagagccgc

SEQ ID NO: 34135 - DNA, 20 bp, Artificial Sequence
  chemically synthesized
ttcggggagcccggcggctc

SEQ ID NO: 34136 - DNA, 20 bp, Artificial Sequence
  chemically synthesized
gtgagcttcccagagccgcc

SEQ ID NO: 34137 - DNA, 20 bp, Artificial Sequence
  chemically synthesized
tccactttcggggagcccgg

SEQ ID NO: 34138 - DNA, 20 bp, Artificial Sequence
  chemically synthesized
cgctccactttcggggagcc

SEQ ID NO: 34139 - DNA, 20 bp, Artificial Sequence
  chemically synthesized
agagccgccgggctccccga

SEQ ID NO: 34140 - DNA, 20 bp, Artificial Sequence
  chemically synthesized
ggcggcgctccactttcggg

SEQ ID NO: 34141 - DNA, 20 bp, Artificial Sequence
  chemically synthesized
gccgccgggctccccgaaag

SEQ ID NO: 34142 - DNA, 20 bp, Artificial Sequence
  chemically synthesized
gcggcggcgctccactttcg

SEQ ID NO: 34143 - DNA, 20 bp, Artificial Sequence
  chemically synthesized
cgccgggctccccgaaagtg

SEQ ID NO: 34144 - DNA, 20 bp, Artificial Sequence
  chemically synthesized
ggcggcggcgctccactttc

SEQ ID NO: 34145 - DNA, 20 bp, Artificial Sequence
  chemically synthesized
cggcggcggcgctccacttt

SEQ ID NO: 34146 - DNA, 20 bp, Artificial Sequence
  chemically synthesized
agcttgggcggcggcggcgg

SEQ ID NO: 34147 - DNA, 20 bp, Artificial Sequence
  chemically synthesized
gtgagcttgggcggcggcgg

SEQ ID NO: 34148 - DNA, 20 bp, Artificial Sequence
  chemically synthesized
gctgtgagcttgggcggcgg

SEQ ID NO: 34149 - DNA, 20 bp, Artificial Sequence
  chemically synthesized
cgccgccgccgccgccgccc

SEQ ID NO: 34150 - DNA, 20 bp, Artificial Sequence
  chemically synthesized
tcagctgtgagcttgggcgg

SEQ ID NO: 34151 - DNA, 20 bp, Artificial Sequence
  chemically synthesized
ctttcagctgtgagcttggg

SEQ ID NO: 34152 - DNA, 20 bp, Artificial Sequence
  chemically synthesized
gccgccgccgcccaagctca

SEQ ID NO: 34153 - DNA, 20 bp, Artificial Sequence
  chemically synthesized
gtgctttcagctgtgagctt

SEQ ID NO: 34154 - DNA, 20 bp, Artificial Sequence
  chemically synthesized
agtgctttcagctgtgagct

SEQ ID NO: 34155 - DNA, 20 bp, Artificial Sequence
  chemically synthesized
tccgcagtgctttcagctgt

SEQ ID NO: 34156 - DNA, 20 bp, Artificial Sequence
  chemically synthesized
ccgcccaagctcacagctga

SEQ ID NO: 34157 - DNA, 20 bp, Artificial Sequence
  chemically synthesized
cggctcctccgcagtgcttt

SEQ ID NO: 34158 - DNA, 20 bp, Artificial Sequence
  chemically synthesized
gctcacagctgaaagcactg

SEQ ID NO: 34159 - DNA, 20 bp, Artificial Sequence
  chemically synthesized
tcacagctgaaagcactgcg

SEQ ID NO: 34160 - DNA, 20 bp, Artificial Sequence
  chemically synthesized
cacagctgaaagcactgcgg

SEQ ID NO: 34161 - DNA, 20 bp, Artificial Sequence
  chemically synthesized
cagctgaaagcactgcggag

SEQ ID NO: 34162 - DNA, 20 bp, Artificial Sequence
  chemically synthesized
cgcccgcgccggctcctccg

SEQ ID NO: 34163 - DNA, 20 bp, Artificial Sequence
  chemically synthesized
tgaaagcactgcggaggagc

SEQ ID NO: 34164 - DNA, 20 bp, Artificial Sequence
  chemically synthesized
gcactgcggaggagccggcg

SEQ ID NO: 34165 - DNA, 20 bp, Artificial Sequence
  chemically synthesized
cactgcggaggagccggcgc

SEQ ID NO: 34166 - DNA, 20 bp, Artificial Sequence
  chemically synthesized
tgcggaggagccggcgcggg

SEQ ID NO: 34167 - DNA, 20 bp, Artificial Sequence
  chemically synthesized
cctccccggcccgcccgcgc

SEQ ID NO: 34168 - DNA, 20 bp, Artificial Sequence
  chemically synthesized
gcggaggagccggcgcgggc

SEQ ID NO: 34169 - DNA, 20 bp, Artificial Sequence
  chemically synthesized
aggagccggcgcgggcgggc

SEQ ID NO: 34170 - DNA, 20 bp, Artificial Sequence
  chemically synthesized
ggagccggcgcgggcgggcc

SEQ ID NO: 34171 - DNA, 20 bp, Artificial Sequence
  chemically synthesized
gagccggcgcgggcgggccg

SEQ ID NO: 34172 - DNA, 20 bp, Artificial Sequence
  chemically synthesized
gccggcgcgggcgggccggg

SEQ ID NO: 34173 - DNA, 20 bp, Artificial Sequence
  chemically synthesized
ccggcgcgggcgggccgggg

SEQ ID NO: 34174 - DNA, 20 bp, Artificial Sequence
  chemically synthesized
cggcgcgggcgggccgggga

SEQ ID NO: 34175 - DNA, 20 bp, Artificial Sequence
  chemically synthesized
ggcgcgggcgggccggggag

SEQ ID NO: 34176 - DNA, 20 bp, Artificial Sequence
  chemically synthesized
gcgcgggcgggccggggagg

SEQ ID NO: 34177 - DNA, 20 bp, Artificial Sequence
  chemically synthesized
tgcccgcagcgccccctccc

SEQ ID NO: 34178 - DNA, 20 bp, Artificial Sequence
  chemically synthesized
gggccggggagggggcgctg

SEQ ID NO: 34179 - DNA, 20 bp, Artificial Sequence
  chemically synthesized
ggccggggagggggcgctgc

SEQ ID NO: 34180 - DNA, 20 bp, Artificial Sequence
  chemically synthesized
cggggagggggcgctgcggg

SEQ ID NO: 34181 - DNA, 20 bp, Artificial Sequence
  chemically synthesized
ggccccgccccgtctgcccg

SEQ ID NO: 34182 - DNA, 20 bp, Artificial Sequence
  chemically synthesized
gagggggcgctgcgggcaga

SEQ ID NO: 34183 - DNA, 20 bp, Artificial Sequence
  chemically synthesized
agggggcgctgcgggcagac

SEQ ID NO: 34184 - DNA, 20 bp, Artificial Sequence
  chemically synthesized
gggggcgctgcgggcagacg

SEQ ID NO: 34185 - DNA, 20 bp, Artificial Sequence
  chemically synthesized
ggcgctgcgggcagacgggg

SEQ ID NO: 34186 - DNA, 20 bp, Artificial Sequence
  chemically synthesized
gcgctgcgggcagacggggc

SEQ ID NO: 34187 - DNA, 20 bp, Artificial Sequence
  chemically synthesized
cgctgcgggcagacggggcg

SEQ ID NO: 34188 - DNA, 20 bp, Artificial Sequence
  chemically synthesized
cagacggggcggggccgtgt

SEQ ID NO: 34189 - DNA, 20 bp, Artificial Sequence
  chemically synthesized
agacggggcggggccgtgtc

SEQ ID NO: 34190 - DNA, 20 bp, Artificial Sequence
  chemically synthesized
ggtgggggcggagcccgaca

SEQ ID NO: 34191 - DNA, 20 bp, Artificial Sequence
  chemically synthesized
caggtccctaggtgggggcg

SEQ ID NO: 34192 - DNA, 20 bp, Artificial Sequence
  chemically synthesized
cccaggtccctaggtggggg

SEQ ID NO: 34193 - DNA, 20 bp, Artificial Sequence
  chemically synthesized
tgtcgggctccgcccccacc

SEQ ID NO: 34194 - DNA, 20 bp, Artificial Sequence
  chemically synthesized
gtcgggctccgcccccacct

SEQ ID NO: 34195 - DNA, 20 bp, Artificial Sequence
  chemically synthesized
tcgggctccgcccccaccta

SEQ ID NO: 34196 - DNA, 20 bp, Artificial Sequence
  chemically synthesized
gttcccaggtccctaggtgg

SEQ ID NO: 34197 - DNA, 20 bp, Artificial Sequence
  chemically synthesized
ggttcccaggtccctaggtg

SEQ ID NO: 34198 - DNA, 20 bp, Artificial Sequence
  chemically synthesized
gggttcccaggtccctaggt

SEQ ID NO: 34199 - DNA, 20 bp, Artificial Sequence
  chemically synthesized
cgggttcccaggtccctagg

SEQ ID NO: 34200 - DNA, 20 bp, Artificial Sequence
  chemically synthesized
tccgcccccacctagggacc

SEQ ID NO: 34201 - DNA, 20 bp, Artificial Sequence
  chemically synthesized
gtccgggttcccaggtccct

SEQ ID NO: 34202 - DNA, 20 bp, Artificial Sequence
  chemically synthesized
ccgcccccacctagggacct

SEQ ID NO: 34203 - DNA, 20 bp, Artificial Sequence
  chemically synthesized
tgtccgggttcccaggtccc

SEQ ID NO: 34204 - DNA, 20 bp, Artificial Sequence
  chemically synthesized
cacctagggacctgggaacc

SEQ ID NO: 34205 - DNA, 20 bp, Artificial Sequence
  chemically synthesized
ctctgggtgtccgggttccc

SEQ ID NO: 34206 - DNA, 20 bp, Artificial Sequence
  chemically synthesized
tctctgggtgtccgggttcc

SEQ ID NO: 34207 - DNA, 20 bp, Artificial Sequence
  chemically synthesized
gacctgggaacccggacacc

SEQ ID NO: 34208 - DNA, 20 bp, Artificial Sequence
  chemically synthesized
tgcccagtctctgggtgtcc

SEQ ID NO: 34209 - DNA, 20 bp, Artificial Sequence
  chemically synthesized
ctgcccagtctctgggtgtc

SEQ ID NO: 34210 - DNA, 20 bp, Artificial Sequence
  chemically synthesized
cctgggaacccggacaccca

SEQ ID NO: 34211 - DNA, 20 bp, Artificial Sequence
  chemically synthesized
gaacccggacacccagagac

SEQ ID NO: 34212 - DNA, 20 bp, Artificial Sequence
  chemically synthesized
aacccggacacccagagact

SEQ ID NO: 34213 - DNA, 20 bp, Artificial Sequence
  chemically synthesized
gccccaactgcccagtctct

SEQ ID NO: 34214 - DNA, 20 bp, Artificial Sequence
  chemically synthesized
agccccaactgcccagtctc

SEQ ID NO: 34215 - DNA, 20 bp, Artificial Sequence
  chemically synthesized
ccggacacccagagactggg

SEQ ID NO: 34216 - DNA, 20 bp, Artificial Sequence
  chemically synthesized
acacccagagactgggcagt

SEQ ID NO: 34217 - DNA, 20 bp, Artificial Sequence
  chemically synthesized
cacccagagactgggcagtt

SEQ ID NO: 34218 - DNA, 20 bp, Artificial Sequence
  chemically synthesized
ttttgaaagccccaactgcc

SEQ ID NO: 34219 - DNA, 20 bp, Artificial Sequence
  chemically synthesized
acccagagactgggcagttg

SEQ ID NO: 34220 - DNA, 20 bp, Artificial Sequence
  chemically synthesized
ggcagttggggctttcaaaa

SEQ ID NO: 34221 - DNA, 20 bp, Artificial Sequence
  chemically synthesized
ctttttcctttccgttttga

SEQ ID NO: 34222 - DNA, 20 bp, Artificial Sequence
  chemically synthesized
gttggggctttcaaaacgga

SEQ ID NO: 34223 - DNA, 20 bp, Artificial Sequence
  chemically synthesized
ttggggctttcaaaacggaa

SEQ ID NO: 34224 - DNA, 20 bp, Artificial Sequence
  chemically synthesized
ctttcaaaacggaaaggaaa

SEQ ID NO: 34225 - DNA, 20 bp, Artificial Sequence
  chemically synthesized
aaaacggaaaggaaaaagaa

SEQ ID NO: 34226 - DNA, 20 bp, Artificial Sequence
  chemically synthesized
aacggaaaggaaaaagaaaa

SEQ ID NO: 34227 - DNA, 20 bp, Artificial Sequence
  chemically synthesized
gaaaggaaaaagaaaagaga

SEQ ID NO: 34228 - DNA, 20 bp, Artificial Sequence
  chemically synthesized
ggaaaaagaaaagagaaaga

SEQ ID NO: 34229 - DNA, 20 bp, Artificial Sequence
  chemically synthesized
aaagaaaagagaaagaaaga

SEQ ID NO: 34230 - DNA, 20 bp, Artificial Sequence
  chemically synthesized
aaaagagaaagaaagaaaga

SEQ ID NO: 34231 - DNA, 20 bp, Artificial Sequence
  chemically synthesized
gagaaagaaagaaagaaaga

SEQ ID NO: 34232 - DNA, 20 bp, Artificial Sequence
  chemically synthesized
aagaaagaaagaaagaaaga

SEQ ID NO: 34233 - DNA, 20 bp, Artificial Sequence
  chemically synthesized
aagaaagaaagaaagaaaga

SEQ ID NO: 34234 - DNA, 20 bp, Artificial Sequence
  chemically synthesized
gaaagaaagaaagaaagaaa

SEQ ID NO: 34235 - DNA, 20 bp, Artificial Sequence
  chemically synthesized
aaagaaagaaagaaagaaag

SEQ ID NO: 34236 - DNA, 20 bp, Artificial Sequence
  chemically synthesized
aaagaaagaaagaaagagga

SEQ ID NO: 34237 - DNA, 20 bp, Artificial Sequence
  chemically synthesized
aagaaagaaagaaagaggat

SEQ ID NO: 34238 - DNA, 20 bp, Artificial Sequence
  chemically synthesized
agaaagaaagaaagaggatg

SEQ ID NO: 34239 - DNA, 20 bp, Artificial Sequence
  chemically synthesized
aagaaagaggatggggattt

SEQ ID NO: 34240 - DNA, 20 bp, Artificial Sequence
  chemically synthesized
agaaagaggatggggattta

SEQ ID NO: 34241 - DNA, 20 bp, Artificial Sequence
  chemically synthesized
aagaggatggggatttaagg

SEQ ID NO: 34242 - DNA, 20 bp, Artificial Sequence
  chemically synthesized
atggggatttaaggtagacc

SEQ ID NO: 34243 - DNA, 20 bp, Artificial Sequence
  chemically synthesized
tggggatttaaggtagaccc

SEQ ID NO: 34244 - DNA, 20 bp, Artificial Sequence
  chemically synthesized
ttaaggtagacccaggaacc

SEQ ID NO: 34245 - DNA, 20 bp, Artificial Sequence
  chemically synthesized
tgtgtggcttccaggttcct

SEQ ID NO: 34246 - DNA, 20 bp, Artificial Sequence
  chemically synthesized
gtgtgtggcttccaggttcc

SEQ ID NO: 34247 - DNA, 20 bp, Artificial Sequence
  chemically synthesized
aggtagacccaggaacctgg

SEQ ID NO: 34248 - DNA, 20 bp, Artificial Sequence
  chemically synthesized
cagagcggtgtgtggcttcc

SEQ ID NO: 34249 - DNA, 20 bp, Artificial Sequence
  chemically synthesized
gcagagcggtgtgtggcttc

SEQ ID NO: 34250 - DNA, 20 bp, Artificial Sequence
  chemically synthesized
ggtgttagcagagcggtgtg

SEQ ID NO: 34251 - DNA, 20 bp, Artificial Sequence
  chemically synthesized
ttaaggaggtgttagcagag

SEQ ID NO: 34252 - DNA, 20 bp, Artificial Sequence
  chemically synthesized
gctttaaggaggtgttagca

SEQ ID NO: 34253 - DNA, 20 bp, Artificial Sequence
  chemically synthesized
aggctttaaggaggtgttag

SEQ ID NO: 34254 - DNA, 20 bp, Artificial Sequence
  chemically synthesized
tagaggctttaaggaggtgt

SEQ ID NO: 34255 - DNA, 20 bp, Artificial Sequence
  chemically synthesized
gctctgctaacacctcctta

SEQ ID NO: 34256 - DNA, 20 bp, Artificial Sequence
  chemically synthesized
tcttgctagaggctttaagg

SEQ ID NO: 34257 - DNA, 20 bp, Artificial Sequence
  chemically synthesized
gtcttgctagaggctttaag

SEQ ID NO: 34258 - DNA, 20 bp, Artificial Sequence
  chemically synthesized
tagtcttgctagaggcttta

SEQ ID NO: 34259 - DNA, 20 bp, Artificial Sequence
  chemically synthesized
gtagtcttgctagaggcttt

SEQ ID NO: 34260 - DNA, 20 bp, Artificial Sequence
  chemically synthesized
taacacctccttaaagcctc

SEQ ID NO: 34261 - DNA, 20 bp, Artificial Sequence
  chemically synthesized
acctccttaaagcctctagc

SEQ ID NO: 34262 - DNA, 20 bp, Artificial Sequence
  chemically synthesized
acaacaagtagtcttgctag

SEQ ID NO: 34263 - DNA, 20 bp, Artificial Sequence
  chemically synthesized
gacaacaagtagtcttgcta

SEQ ID NO: 34264 - DNA, 20 bp, Artificial Sequence
  chemically synthesized
tagacaacaagtagtcttgc

SEQ ID NO: 34265 - DNA, 20 bp, Artificial Sequence
  chemically synthesized
tcatttatttagacaacaag

SEQ ID NO: 34266 - DNA, 20 bp, Artificial Sequence
  chemically synthesized
gggtcatttatttagacaac

SEQ ID NO: 34267 - DNA, 20 bp, Artificial Sequence
  chemically synthesized
ttgcacctgggtcatttatt

SEQ ID NO: 34268 - DNA, 20 bp, Artificial Sequence
  chemically synthesized
tgttgtctaaataaatgacc

SEQ ID NO: 34269 - DNA, 20 bp, Artificial Sequence
  chemically synthesized
gttgtctaaataaatgaccc

SEQ ID NO: 34270 - DNA, 20 bp, Artificial Sequence
  chemically synthesized
ggatgaggtcatttgcacct

SEQ ID NO: 34271 - DNA, 20 bp, Artificial Sequence
  chemically synthesized
gggatgaggtcatttgcacc

SEQ ID NO: 34272 - DNA, 20 bp, Artificial Sequence
  chemically synthesized
aggtgcaaatgacctcatcc

SEQ ID NO: 34273 - DNA, 20 bp, Artificial Sequence
  chemically synthesized
actcttaattatctgggatg

SEQ ID NO: 34274 - DNA, 20 bp, Artificial Sequence
  chemically synthesized
cactcttaattatctgggat

SEQ ID NO: 34275 - DNA, 20 bp, Artificial Sequence
  chemically synthesized
gcccacactcttaattatct

SEQ ID NO: 34276 - DNA, 20 bp, Artificial Sequence
  chemically synthesized
tgacctcatcccagataatt

SEQ ID NO: 34277 - DNA, 20 bp, Artificial Sequence
  chemically synthesized
agcccacactcttaattatc

SEQ ID NO: 34278 - DNA, 20 bp, Artificial Sequence
  chemically synthesized
acctcatcccagataattaa

SEQ ID NO: 34279 - DNA, 20 bp, Artificial Sequence
  chemically synthesized
atcccagataattaagagtg

SEQ ID NO: 34280 - DNA, 20 bp, Artificial Sequence
  chemically synthesized
tcccagataattaagagtgt

SEQ ID NO: 34281 - DNA, 20 bp, Artificial Sequence
  chemically synthesized
gataattaagagtgtgggct

SEQ ID NO: 34282 - DNA, 20 bp, Artificial Sequence
  chemically synthesized
taattaagagtgtgggcttg

SEQ ID NO: 34283 - DNA, 20 bp, Artificial Sequence
  chemically synthesized
ttttttaaaaagaaaactcc

SEQ ID NO: 34284 - DNA, 20 bp, Artificial Sequence
  chemically synthesized
tttttcttttattttttaaa

SEQ ID NO: 34285 - DNA, 20 bp, Artificial Sequence
  chemically synthesized
gttttctttttaaaaaataa

SEQ ID NO: 34286 - DNA, 20 bp, Artificial Sequence
  chemically synthesized
actgaggaggaagggagagt

SEQ ID NO: 34287 - DNA, 20 bp, Artificial Sequence
  chemically synthesized
ttcaactgaggaggaaggga

SEQ ID NO: 34288 - DNA, 20 bp, Artificial Sequence
  chemically synthesized
tcttcaactgaggaggaagg

SEQ ID NO: 34289 - DNA, 20 bp, Artificial Sequence
  chemically synthesized
aatcttcaactgaggaggaa

SEQ ID NO: 34290 - DNA, 20 bp, Artificial Sequence
  chemically synthesized
tctcactctcccttcctcct

SEQ ID NO: 34291 - DNA, 20 bp, Artificial Sequence
  chemically synthesized
taatcttcaactgaggagga

SEQ ID NO: 34292 - DNA, 20 bp, Artificial Sequence
  chemically synthesized
ttaatcttcaactgaggagg

SEQ ID NO: 34293 - DNA, 20 bp, Artificial Sequence
  chemically synthesized
actttaatcttcaactgagg

SEQ ID NO: 34294 - DNA, 20 bp, Artificial Sequence
  chemically synthesized
cactttaatcttcaactgag

SEQ ID NO: 34295 - DNA, 20 bp, Artificial Sequence
  chemically synthesized
tctcccttcctcctcagttg

SEQ ID NO: 34296 - DNA, 20 bp, Artificial Sequence
  chemically synthesized
gccactttaatcttcaactg

SEQ ID NO: 34297 - DNA, 20 bp, Artificial Sequence
  chemically synthesized
ggccactttaatcttcaact

SEQ ID NO: 34298 - DNA, 20 bp, Artificial Sequence
  chemically synthesized
tcctcctcagttgaagatta

SEQ ID NO: 34299 - DNA, 20 bp, Artificial Sequence
  chemically synthesized
tcctcagttgaagattaaag

SEQ ID NO: 34300 - DNA, 20 bp, Artificial Sequence
  chemically synthesized
cagttgaagattaaagtggc

SEQ ID NO: 34301 - DNA, 20 bp, Artificial Sequence
  chemically synthesized
agattaaagtggccggcgat

SEQ ID NO: 34302 - DNA, 20 bp, Artificial Sequence
  chemically synthesized
gattaaagtggccggcgata

SEQ ID NO: 34303 - DNA, 20 bp, Artificial Sequence
  chemically synthesized
caatttcacgtccttatcgc

SEQ ID NO: 34304 - DNA, 20 bp, Artificial Sequence
  chemically synthesized
taaggacgtgaaattgccgt

SEQ ID NO: 34305 - DNA, 20 bp, Artificial Sequence
  chemically synthesized
aaggacgtgaaattgccgtt

SEQ ID NO: 34306 - DNA, 20 bp, Artificial Sequence
  chemically synthesized
ttagcccaggatgagcctaa

SEQ ID NO: 34307 - DNA, 20 bp, Artificial Sequence
  chemically synthesized
aattgccgttaggctcatcc

SEQ ID NO: 34308 - DNA, 20 bp, Artificial Sequence
  chemically synthesized
attgccgttaggctcatcct

SEQ ID NO: 34309 - DNA, 20 bp, Artificial Sequence
  chemically synthesized
aatcccttttagcccaggat

SEQ ID NO: 34310 - DNA, 20 bp, Artificial Sequence
  chemically synthesized
ttaggctcatcctgggctaa

SEQ ID NO: 34311 - DNA, 20 bp, Artificial Sequence
  chemically synthesized
ttaacaatcccttttagccc

SEQ ID NO: 34312 - DNA, 20 bp, Artificial Sequence
  chemically synthesized
taggctcatcctgggctaaa

SEQ ID NO: 34313 - DNA, 20 bp, Artificial Sequence
  chemically synthesized
tttaacaatcccttttagcc

SEQ ID NO: 34314 - DNA, 20 bp, Artificial Sequence
  chemically synthesized
aggctcatcctgggctaaaa

SEQ ID NO: 34315 - DNA, 20 bp, Artificial Sequence
  chemically synthesized
gtctttttaacaatcccttt

SEQ ID NO: 34316 - DNA, 20 bp, Artificial Sequence
  chemically synthesized
ggctaaaagggattgttaaa

SEQ ID NO: 34317 - DNA, 20 bp, Artificial Sequence
  chemically synthesized
agggattgttaaaaagactt

SEQ ID NO: 34318 - DNA, 20 bp, Artificial Sequence
  chemically synthesized
tgttaaaaagactttggatt

SEQ ID NO: 34319 - DNA, 20 bp, Artificial Sequence
  chemically synthesized
atgtcacaaatccaaatcca

SEQ ID NO: 34320 - DNA, 20 bp, Artificial Sequence
  chemically synthesized
ttggatttggatttgtgaca

SEQ ID NO: 34321 - DNA, 20 bp, Artificial Sequence
  chemically synthesized
gatttggatttgtgacatag

SEQ ID NO: 34322 - DNA, 20 bp, Artificial Sequence
  chemically synthesized
ttggatttgtgacatagcag

SEQ ID NO: 34323 - DNA, 20 bp, Artificial Sequence
  chemically synthesized
tagcagcggatctcaaaatg

SEQ ID NO: 34324 - DNA, 20 bp, Artificial Sequence
  chemically synthesized
gttcccagggtctacatttt

SEQ ID NO: 34325 - DNA, 20 bp, Artificial Sequence
  chemically synthesized
ggatctcaaaatgtagaccc

SEQ ID NO: 34326 - DNA, 20 bp, Artificial Sequence
  chemically synthesized
gatctcaaaatgtagaccct

SEQ ID NO: 34327 - DNA, 20 bp, Artificial Sequence
  chemically synthesized
caaaatgtagaccctgggaa

SEQ ID NO: 34328 - DNA, 20 bp, Artificial Sequence
  chemically synthesized
actgataactgctgttccca

SEQ ID NO: 34329 - DNA, 20 bp, Artificial Sequence
  chemically synthesized
tactgataactgctgttccc

SEQ ID NO: 34330 - DNA, 20 bp, Artificial Sequence
  chemically synthesized
aatgtagaccctgggaacag

SEQ ID NO: 34331 - DNA, 20 bp, Artificial Sequence
  chemically synthesized
atactgataactgctgttcc

SEQ ID NO: 34332 - DNA, 20 bp, Artificial Sequence
  chemically synthesized
accctgggaacagcagttat

SEQ ID NO: 34333 - DNA, 20 bp, Artificial Sequence
  chemically synthesized
ttcatttctaagaagttcgc

SEQ ID NO: 34334 - DNA, 20 bp, Artificial Sequence
  chemically synthesized
tttcatttctaagaagttcg

SEQ ID NO: 34335 - DNA, 20 bp, Artificial Sequence
  chemically synthesized
agtatcacctgcgaacttct

SEQ ID NO: 34336 - DNA, 20 bp, Artificial Sequence
  chemically synthesized
agggaattttcatttctaag

SEQ ID NO: 34337 - DNA, 20 bp, Artificial Sequence
  chemically synthesized
cccagggaattttcatttct

SEQ ID NO: 34338 - DNA, 20 bp, Artificial Sequence
  chemically synthesized
tcttagaaatgaaaattccc

SEQ ID NO: 34339 - DNA, 20 bp, Artificial Sequence
  chemically synthesized
cttagaaatgaaaattccct

SEQ ID NO: 34340 - DNA, 20 bp, Artificial Sequence
  chemically synthesized
aaatgaaaattccctgggcc

SEQ ID NO: 34341 - DNA, 20 bp, Artificial Sequence
  chemically synthesized
ataggtctgggccgggccca

SEQ ID NO: 34342 - DNA, 20 bp, Artificial Sequence
  chemically synthesized
aataggtctgggccgggccc

SEQ ID NO: 34343 - DNA, 20 bp, Artificial Sequence
  chemically synthesized
caataggtctgggccgggcc

SEQ ID NO: 34344 - DNA, 20 bp, Artificial Sequence
  chemically synthesized
aaaattccctgggcccggcc

SEQ ID NO: 34345 - DNA, 20 bp, Artificial Sequence
  chemically synthesized
tggttcaataggtctgggcc

SEQ ID NO: 34346 - DNA, 20 bp, Artificial Sequence
  chemically synthesized
ctggttcaataggtctgggc

SEQ ID NO: 34347 - DNA, 20 bp, Artificial Sequence
  chemically synthesized
gtttctggttcaataggtct

SEQ ID NO: 34348 - DNA, 20 bp, Artificial Sequence
  chemically synthesized
agtttctggttcaataggtc

SEQ ID NO: 34349 - DNA, 20 bp, Artificial Sequence
  chemically synthesized
ccggcccagacctattgaac

SEQ ID NO: 34350 - DNA, 20 bp, Artificial Sequence
  chemically synthesized
ctcagagtttctggttcaat

SEQ ID NO: 34351 - DNA, 20 bp, Artificial Sequence
  chemically synthesized
gctcagagtttctggttcaa

SEQ ID NO: 34352 - DNA, 20 bp, Artificial Sequence
  chemically synthesized
attagtatgctcagagtttc

SEQ ID NO: 34353 - DNA, 20 bp, Artificial Sequence
  chemically synthesized
cctattgaaccagaaactct

SEQ ID NO: 34354 - DNA, 20 bp, Artificial Sequence
  chemically synthesized
ctcaaacattagtatgctca

SEQ ID NO: 34355 - DNA, 20 bp, Artificial Sequence
  chemically synthesized
ttctcaaacattagtatgct

SEQ ID NO: 34356 - DNA, 20 bp, Artificial Sequence
  chemically synthesized
ctctgagcatactaatgttt

SEQ ID NO: 34357 - DNA, 20 bp, Artificial Sequence
  chemically synthesized
taccagtgattctcaaacat

SEQ ID NO: 34358 - DNA, 20 bp, Artificial Sequence
  chemically synthesized
tactaatgtttgagaatcac

SEQ ID NO: 34359 - DNA, 20 bp, Artificial Sequence
  chemically synthesized
atgtttgagaatcactggta

SEQ ID NO: 34360 - DNA, 20 bp, Artificial Sequence
  chemically synthesized
ttaatttagagagtccatac

SEQ ID NO: 34361 - DNA, 20 bp, Artificial Sequence
  chemically synthesized
tggtattgtcttaatttaga

SEQ ID NO: 34362 - DNA, 20 bp, Artificial Sequence
  chemically synthesized
tggtatggactctctaaatt

SEQ ID NO: 34363 - DNA, 20 bp, Artificial Sequence
  chemically synthesized
ggtggtattgtcttaattta

SEQ ID NO: 34364 - DNA, 20 bp, Artificial Sequence
  chemically synthesized
ctggtggtattgtcttaatt

SEQ ID NO: 34365 - DNA, 20 bp, Artificial Sequence
  chemically synthesized
ctaaattaagacaataccac

SEQ ID NO: 34366 - DNA, 20 bp, Artificial Sequence
  chemically synthesized
aaaccgtgcaacagcactgg

SEQ ID NO: 34367 - DNA, 20 bp, Artificial Sequence
  chemically synthesized
accaaaccgtgcaacagcac

SEQ ID NO: 34368 - DNA, 20 bp, Artificial Sequence
  chemically synthesized
ataccaccagtgctgttgca

SEQ ID NO: 34369 - DNA, 20 bp, Artificial Sequence
  chemically synthesized
taaaggaccaaaccgtgcaa

SEQ ID NO: 34370 - DNA, 20 bp, Artificial Sequence
  chemically synthesized
accagtgctgttgcacggtt

SEQ ID NO: 34371 - DNA, 20 bp, Artificial Sequence
  chemically synthesized
tgttgcacggtttggtcctt

SEQ ID NO: 34372 - DNA, 20 bp, Artificial Sequence
  chemically synthesized
tcttcctaaaagaatactaa

SEQ ID NO: 34373 - DNA, 20 bp, Artificial Sequence
  chemically synthesized
atcttcctaaaagaatacta

SEQ ID NO: 34374 - DNA, 20 bp, Artificial Sequence
  chemically synthesized
ttggtcctttagtattcttt

SEQ ID NO: 34375 - DNA, 20 bp, Artificial Sequence
  chemically synthesized
tggtcctttagtattctttt

SEQ ID NO: 34376 - DNA, 20 bp, Artificial Sequence
  chemically synthesized
tcctttagtattcttttagg

SEQ ID NO: 34377 - DNA, 20 bp, Artificial Sequence
  chemically synthesized
ttccttctagatcttcctaa

SEQ ID NO: 34378 - DNA, 20 bp, Artificial Sequence
  chemically synthesized
agtattcttttaggaagatc

SEQ ID NO: 34379 - DNA, 20 bp, Artificial Sequence
  chemically synthesized
attcttttaggaagatctag

SEQ ID NO: 34380 - DNA, 20 bp, Artificial Sequence
  chemically synthesized
ttcttttaggaagatctaga

SEQ ID NO: 34381 - DNA, 20 bp, Artificial Sequence
  chemically synthesized
tattagaaacaagttccttc

SEQ ID NO: 34382 - DNA, 20 bp, Artificial Sequence
  chemically synthesized
taaaatattctattagaaac

SEQ ID NO: 34383 - DNA, 20 bp, Artificial Sequence
  chemically synthesized
tagaaggaacttgtttctaa

SEQ ID NO: 34384 - DNA, 20 bp, Artificial Sequence
  chemically synthesized
tttccaataaaatattctat

SEQ ID NO: 34385 - DNA, 20 bp, Artificial Sequence
  chemically synthesized
tttctaatagaatattttat

SEQ ID NO: 34386 - DNA, 20 bp, Artificial Sequence
  chemically synthesized
aatagaatattttattggaa

SEQ ID NO: 34387 - DNA, 20 bp, Artificial Sequence
  chemically synthesized
atattttattggaaaagtta

SEQ ID NO: 34388 - DNA, 20 bp, Artificial Sequence
  chemically synthesized
tattttattggaaaagttac

SEQ ID NO: 34389 - DNA, 20 bp, Artificial Sequence
  chemically synthesized
attttattggaaaagttaca

SEQ ID NO: 34390 - DNA, 20 bp, Artificial Sequence
  chemically synthesized
gaaaagttacagggcctgaa

SEQ ID NO: 34391 - DNA, 20 bp, Artificial Sequence
  chemically synthesized
tagaattatttgaactgttc

SEQ ID NO: 34392 - DNA, 20 bp, Artificial Sequence
  chemically synthesized
ttagaattatttgaactgtt

SEQ ID NO: 34393 - DNA, 20 bp, Artificial Sequence
  chemically synthesized
agttcaaataattctaattt

SEQ ID NO: 34394 - DNA, 20 bp, Artificial Sequence
  chemically synthesized
ttcaaataattctaatttta

SEQ ID NO: 34395 - DNA, 20 bp, Artificial Sequence
  chemically synthesized
catactgcaaactctaaaat

SEQ ID NO: 34396 - DNA, 20 bp, Artificial Sequence
  chemically synthesized
aattctaattttagagtttg

SEQ ID NO: 34397 - DNA, 20 bp, Artificial Sequence
  chemically synthesized
tagagtttgcagtatgatga

SEQ ID NO: 34398 - DNA, 20 bp, Artificial Sequence
  chemically synthesized
agtttgcagtatgatgatag

SEQ ID NO: 34399 - DNA, 20 bp, Artificial Sequence
  chemically synthesized
aagcttgaaataattgtgtg

SEQ ID NO: 34400 - DNA, 20 bp, Artificial Sequence
  chemically synthesized
taactacacacaattatttc

SEQ ID NO: 34401 - DNA, 20 bp, Artificial Sequence
  chemically synthesized
acacacaattatttcaagct

SEQ ID NO: 34402 - DNA, 20 bp, Artificial Sequence
  chemically synthesized
ttcttcttttgagtatttcc

SEQ ID NO: 34403 - DNA, 20 bp, Artificial Sequence
  chemically synthesized
tcaagcttggaaatactcaa

SEQ ID NO: 34404 - DNA, 20 bp, Artificial Sequence
  chemically synthesized
agcttggaaatactcaaaag

SEQ ID NO: 34405 - DNA, 20 bp, Artificial Sequence
  chemically synthesized
gaaggctttcttcttctttt

SEQ ID NO: 34406 - DNA, 20 bp, Artificial Sequence
  chemically synthesized
ttggaaatactcaaaagaag

SEQ ID NO: 34407 - DNA, 20 bp, Artificial Sequence
  chemically synthesized
aaatactcaaaagaagaaga

SEQ ID NO: 34408 - DNA, 20 bp, Artificial Sequence
  chemically synthesized
aagaagaagaaagccttcat

SEQ ID NO: 34409 - DNA, 20 bp, Artificial Sequence
  chemically synthesized
gaaaattcttgtgctaatga

SEQ ID NO: 34410 - DNA, 20 bp, Artificial Sequence
  chemically synthesized
agaaaattcttgtgctaatg

SEQ ID NO: 34411 - DNA, 20 bp, Artificial Sequence
  chemically synthesized
aagaaagccttcattagcac

SEQ ID NO: 34412 - DNA, 20 bp, Artificial Sequence
  chemically synthesized
aaggtgttatgtgaagtttg

SEQ ID NO: 34413 - DNA, 20 bp, Artificial Sequence
  chemically synthesized
ctaatctaaggtgttatgtg

SEQ ID NO: 34414 - DNA, 20 bp, Artificial Sequence
  chemically synthesized
gcaaacttcacataacacct

SEQ ID NO: 34415 - DNA, 20 bp, Artificial Sequence
  chemically synthesized
cttcacataacaccttagat

SEQ ID NO: 34416 - DNA, 20 bp, Artificial Sequence
  chemically synthesized
gctctttggatgctaatcta

SEQ ID NO: 34417 - DNA, 20 bp, Artificial Sequence
  chemically synthesized
tgctctttggatgctaatct

SEQ ID NO: 34418 - DNA, 20 bp, Artificial Sequence
  chemically synthesized
acaccttagattagcatcca

SEQ ID NO: 34419 - DNA, 20 bp, Artificial Sequence
  chemically synthesized
accttagattagcatccaaa

SEQ ID NO: 34420 - DNA, 20 bp, Artificial Sequence
  chemically synthesized
gtttatcgtaagatgctctt

SEQ ID NO: 34421 - DNA, 20 bp, Artificial Sequence
  chemically synthesized
tatcactaacagtttatcgt

SEQ ID NO: 34422 - DNA, 20 bp, Artificial Sequence
  chemically synthesized
agcatcttacgataaactgt

SEQ ID NO: 34423 - DNA, 20 bp, Artificial Sequence
  chemically synthesized
ggcagtgaaaatatcactaa

SEQ ID NO: 34424 - DNA, 20 bp, Artificial Sequence
  chemically synthesized
aataaatggacaaagaaggg

SEQ ID NO: 34425 - DNA, 20 bp, Artificial Sequence
  chemically synthesized
caaaataaatggacaaagaa

SEQ ID NO: 34426 - DNA, 20 bp, Artificial Sequence
  chemically synthesized
acaaaataaatggacaaaga

SEQ ID NO: 34427 - DNA, 20 bp, Artificial Sequence
  chemically synthesized
aacaaaataaatggacaaag

SEQ ID NO: 34428 - DNA, 20 bp, Artificial Sequence
  chemically synthesized
gccaacaaaataaatggaca

SEQ ID NO: 34429 - DNA, 20 bp, Artificial Sequence
  chemically synthesized
aagcaagccaacaaaataaa

SEQ ID NO: 34430 - DNA, 20 bp, Artificial Sequence
  chemically synthesized
tctttgtccatttattttgt

SEQ ID NO: 34431 - DNA, 20 bp, Artificial Sequence
  chemically synthesized
aagaaaataaaaagaaaagc

SEQ ID NO: 34432 - DNA, 20 bp, Artificial Sequence
  chemically synthesized
ttgaaagaaaataaaaagaa

SEQ ID NO: 34433 - DNA, 20 bp, Artificial Sequence
  chemically synthesized
aatgtttgaaagaaaataaa

SEQ ID NO: 34434 - DNA, 20 bp, Artificial Sequence
  chemically synthesized
agtggaaagcaaatgtttga

SEQ ID NO: 34435 - DNA, 20 bp, Artificial Sequence
  chemically synthesized
caatcggaaaggagagtgga

SEQ ID NO: 34436 - DNA, 20 bp, Artificial Sequence
  chemically synthesized
gaatcaatcggaaaggagag

SEQ ID NO: 34437 - DNA, 20 bp, Artificial Sequence
  chemically synthesized
aatgaatcaatcggaaagga

SEQ ID NO: 34438 - DNA, 20 bp, Artificial Sequence
  chemically synthesized
ggaatgaatcaatcggaaag

SEQ ID NO: 34439 - DNA, 20 bp, Artificial Sequence
  chemically synthesized
gtggaatgaatcaatcggaa

SEQ ID NO: 34440 - DNA, 20 bp, Artificial Sequence
  chemically synthesized
agtggaatgaatcaatcgga

SEQ ID NO: 34441 - DNA, 20 bp, Artificial Sequence
  chemically synthesized
ccgaagtggaatgaatcaat

SEQ ID NO: 34442 - DNA, 20 bp, Artificial Sequence
  chemically synthesized
ccgattgattcattccactt

SEQ ID NO: 34443 - DNA, 20 bp, Artificial Sequence
  chemically synthesized
atttaaactgtagaccgaag

SEQ ID NO: 34444 - DNA, 20 bp, Artificial Sequence
  chemically synthesized
attcattccacttcggtcta

SEQ ID NO: 34445 - DNA, 20 bp, Artificial Sequence
  chemically synthesized
cacatttaaactgtagaccg

SEQ ID NO: 34446 - DNA, 20 bp, Artificial Sequence
  chemically synthesized
aggggaccacatttaaactg

SEQ ID NO: 34447 - DNA, 20 bp, Artificial Sequence
  chemically synthesized
ttcggtctacagtttaaatg

SEQ ID NO: 34448 - DNA, 20 bp, Artificial Sequence
  chemically synthesized
aagaaataaattttaaaaag

SEQ ID NO: 34449 - DNA, 20 bp, Artificial Sequence
  chemically synthesized
taagaaataaattttaaaaa

SEQ ID NO: 34450 - DNA, 20 bp, Artificial Sequence
  chemically synthesized
ttaagaaataaattttaaaa

SEQ ID NO: 34451 - DNA, 20 bp, Artificial Sequence
  chemically synthesized
cttaagaaataaattttaaa

SEQ ID NO: 34452 - DNA, 20 bp, Artificial Sequence
  chemically synthesized
ctttttaaaatttatttctt

SEQ ID NO: 34453 - DNA, 20 bp, Artificial Sequence
  chemically synthesized
tttttaaaatttatttctta

SEQ ID NO: 34454 - DNA, 20 bp, Artificial Sequence
  chemically synthesized
ttttaaaatttatttcttaa

SEQ ID NO: 34455 - DNA, 20 bp, Artificial Sequence
  chemically synthesized
aaaatttatttcttaaggga

SEQ ID NO: 34456 - DNA, 20 bp, Artificial Sequence
  chemically synthesized
aaatttatttcttaagggat

SEQ ID NO: 34457 - DNA, 20 bp, Artificial Sequence
  chemically synthesized
cagtgagacccccatccctt

SEQ ID NO: 34458 - DNA, 20 bp, Artificial Sequence
  chemically synthesized
aatttatttcttaagggatg

SEQ ID NO: 34459 - DNA, 20 bp, Artificial Sequence
  chemically synthesized
atttatttcttaagggatgg

SEQ ID NO: 34460 - DNA, 20 bp, Artificial Sequence
  chemically synthesized
accagcctgggcaacacagt

SEQ ID NO: 34461 - DNA, 20 bp, Artificial Sequence
  chemically synthesized
gggggtctcactgtgttgcc

SEQ ID NO: 34462 - DNA, 20 bp, Artificial Sequence
  chemically synthesized
ggagaccagcctgggcaaca

SEQ ID NO: 34463 - DNA, 20 bp, Artificial Sequence
  chemically synthesized
ggggtctcactgtgttgccc

SEQ ID NO: 34464 - DNA, 20 bp, Artificial Sequence
  chemically synthesized
tctcactgtgttgcccaggc

SEQ ID NO: 34465 - DNA, 20 bp, Artificial Sequence
  chemically synthesized
aggagttgggagaccagcct

SEQ ID NO: 34466 - DNA, 20 bp, Artificial Sequence
  chemically synthesized
caggagttgggagaccagcc

SEQ ID NO: 34467 - DNA, 20 bp, Artificial Sequence
  chemically synthesized
gagcccaggagttgggagac

SEQ ID NO: 34468 - DNA, 20 bp, Artificial Sequence
  chemically synthesized
tgcttgagcccaggagttgg

SEQ ID NO: 34469 - DNA, 20 bp, Artificial Sequence
  chemically synthesized
caggctggtctcccaactcc

SEQ ID NO: 34470 - DNA, 20 bp, Artificial Sequence
  chemically synthesized
aggctggtctcccaactcct

SEQ ID NO: 34471 - DNA, 20 bp, Artificial Sequence
  chemically synthesized
attgcttgagcccaggagtt

SEQ ID NO: 34472 - DNA, 20 bp, Artificial Sequence
  chemically synthesized
gattgcttgagcccaggagt

SEQ ID NO: 34473 - DNA, 20 bp, Artificial Sequence
  chemically synthesized
ggaggattgcttgagcccag

SEQ ID NO: 34474 - DNA, 20 bp, Artificial Sequence
  chemically synthesized
gtctcccaactcctgggctc

SEQ ID NO: 34475 - DNA, 20 bp, Artificial Sequence
  chemically synthesized
tgggaggattgcttgagccc

SEQ ID NO: 34476 - DNA, 20 bp, Artificial Sequence
  chemically synthesized
gtgggaggattgcttgagcc

SEQ ID NO: 34477 - DNA, 20 bp, Artificial Sequence
  chemically synthesized
ctgaagtgggaggattgctt

SEQ ID NO: 34478 - DNA, 20 bp, Artificial Sequence
  chemically synthesized
ctcaagcaatcctcccactt

SEQ ID NO: 34479 - DNA, 20 bp, Artificial Sequence
  chemically synthesized
cacttggaggctgaagtggg

SEQ ID NO: 34480 - DNA, 20 bp, Artificial Sequence
  chemically synthesized
gcacttggaggctgaagtgg

SEQ ID NO: 34481 - DNA, 20 bp, Artificial Sequence
  chemically synthesized
aggcacttggaggctgaagt

SEQ ID NO: 34482 - DNA, 20 bp, Artificial Sequence
  chemically synthesized
caggcacttggaggctgaag

SEQ ID NO: 34483 - DNA, 20 bp, Artificial Sequence
  chemically synthesized
tcgcaggcacttggaggctg

SEQ ID NO: 34484 - DNA, 20 bp, Artificial Sequence
  chemically synthesized
atcctcccacttcagcctcc

SEQ ID NO: 34485 - DNA, 20 bp, Artificial Sequence
  chemically synthesized
ctgtcatcgcaggcacttgg

SEQ ID NO: 34486 - DNA, 20 bp, Artificial Sequence
  chemically synthesized
cctgtcatcgcaggcacttg

SEQ ID NO: 34487 - DNA, 20 bp, Artificial Sequence
  chemically synthesized
cacctgtcatcgcaggcact

SEQ ID NO: 34488 - DNA, 20 bp, Artificial Sequence
  chemically synthesized
cctccaagtgcctgcgatga

SEQ ID NO: 34489 - DNA, 20 bp, Artificial Sequence
  chemically synthesized
tggcatgcacctgtcatcgc

SEQ ID NO: 34490 - DNA, 20 bp, Artificial Sequence
  chemically synthesized
ctccaagtgcctgcgatgac

SEQ ID NO: 34491 - DNA, 20 bp, Artificial Sequence
  chemically synthesized
gtggcatgcacctgtcatcg

SEQ ID NO: 34492 - DNA, 20 bp, Artificial Sequence
  chemically synthesized
caggtgcatgccaccatatc

SEQ ID NO: 34493 - DNA, 20 bp, Artificial Sequence
  chemically synthesized
tcaaaagaagccggatatgg

SEQ ID NO: 34494 - DNA, 20 bp, Artificial Sequence
  chemically synthesized
atttcaaaagaagccggata

SEQ ID NO: 34495 - DNA, 20 bp, Artificial Sequence
  chemically synthesized
aggattatttcaaaagaagc

SEQ ID NO: 34496 - DNA, 20 bp, Artificial Sequence
  chemically synthesized
gaaaaggattatttcaaaag

SEQ ID NO: 34497 - DNA, 20 bp, Artificial Sequence
  chemically synthesized
gcagaaaaggattatttcaa

SEQ ID NO: 34498 - DNA, 20 bp, Artificial Sequence
  chemically synthesized
ggaaaaatgttgagcagaaa

SEQ ID NO: 34499 - DNA, 20 bp, Artificial Sequence
  chemically synthesized
gggaaaaatgttgagcagaa

SEQ ID NO: 34500 - DNA, 20 bp, Artificial Sequence
  chemically synthesized
ctagggggaaaaatgttgag

SEQ ID NO: 34501 - DNA, 20 bp, Artificial Sequence
  chemically synthesized
attctagggggaaaaatgtt

SEQ ID NO: 34502 - DNA, 20 bp, Artificial Sequence
  chemically synthesized
ctgctcaacatttttccccc

SEQ ID NO: 34503 - DNA, 20 bp, Artificial Sequence
  chemically synthesized
tccacctaaaacattctagg

SEQ ID NO: 34504 - DNA, 20 bp, Artificial Sequence
  chemically synthesized
ttccacctaaaacattctag

SEQ ID NO: 34505 - DNA, 20 bp, Artificial Sequence
  chemically synthesized
cttccacctaaaacattcta

SEQ ID NO: 34506 - DNA, 20 bp, Artificial Sequence
  chemically synthesized
gcttccacctaaaacattct

SEQ ID NO: 34507 - DNA, 20 bp, Artificial Sequence
  chemically synthesized
tgcttccacctaaaacattc

SEQ ID NO: 34508 - DNA, 20 bp, Artificial Sequence
  chemically synthesized
tttttccccctagaatgttt

SEQ ID NO: 34509 - DNA, 20 bp, Artificial Sequence
  chemically synthesized
ttttccccctagaatgtttt

SEQ ID NO: 34510 - DNA, 20 bp, Artificial Sequence
  chemically synthesized
tccccctagaatgttttagg

SEQ ID NO: 34511 - DNA, 20 bp, Artificial Sequence
  chemically synthesized
ccctagaatgttttaggtgg

SEQ ID NO: 34512 - DNA, 20 bp, Artificial Sequence
  chemically synthesized
agcattagataaagcaaaac

SEQ ID NO: 34513 - DNA, 20 bp, Artificial Sequence
  chemically synthesized
tagcattagataaagcaaaa

SEQ ID NO: 34514 - DNA, 20 bp, Artificial Sequence
  chemically synthesized
ccatgctatagcattagata

SEQ ID NO: 34515 - DNA, 20 bp, Artificial Sequence
  chemically synthesized
ttttgctttatctaatgcta

SEQ ID NO: 34516 - DNA, 20 bp, Artificial Sequence
  chemically synthesized
cttttgccatgctatagcat

SEQ ID NO: 34517 - DNA, 20 bp, Artificial Sequence
  chemically synthesized
ctttatctaatgctatagca

SEQ ID NO: 34518 - DNA, 20 bp, Artificial Sequence
  chemically synthesized
ttgcctcttttgccatgcta

SEQ ID NO: 34519 - DNA, 20 bp, Artificial Sequence
  chemically synthesized
ctaatgctatagcatggcaa

SEQ ID NO: 34520 - DNA, 20 bp, Artificial Sequence
  chemically synthesized
aatgctatagcatggcaaaa

SEQ ID NO: 34521 - DNA, 20 bp, Artificial Sequence
  chemically synthesized
atgctatagcatggcaaaag

SEQ ID NO: 34522 - DNA, 20 bp, Artificial Sequence
  chemically synthesized
tggcaaaagaggcaaaaata

SEQ ID NO: 34523 - DNA, 20 bp, Artificial Sequence
  chemically synthesized
agaggcaaaaataaagtatc

SEQ ID NO: 34524 - DNA, 20 bp, Artificial Sequence
  chemically synthesized
aaaataaagtatctggacaa

SEQ ID NO: 34525 - DNA, 20 bp, Artificial Sequence
  chemically synthesized
cattcccttttgcttttgtc

SEQ ID NO: 34526 - DNA, 20 bp, Artificial Sequence
  chemically synthesized
aagtatctggacaaaagcaa

SEQ ID NO: 34527 - DNA, 20 bp, Artificial Sequence
  chemically synthesized
agtatctggacaaaagcaaa

SEQ ID NO: 34528 - DNA, 20 bp, Artificial Sequence
  chemically synthesized
gtatctggacaaaagcaaaa

SEQ ID NO: 34529 - DNA, 20 bp, Artificial Sequence
  chemically synthesized
acaaaagcaaaagggaatgc

SEQ ID NO: 34530 - DNA, 20 bp, Artificial Sequence
  chemically synthesized
caaaagcaaaagggaatgcc

SEQ ID NO: 34531 - DNA, 20 bp, Artificial Sequence
  chemically synthesized
ttaaaggtaataaagaatcc

SEQ ID NO: 34532 - DNA, 20 bp, Artificial Sequence
  chemically synthesized
ttggtttgttaaaggtaata

SEQ ID NO: 34533 - DNA, 20 bp, Artificial Sequence
  chemically synthesized
ctttatatttggtttgttaa

SEQ ID NO: 34534 - DNA, 20 bp, Artificial Sequence
  chemically synthesized
cctttatatttggtttgtta

SEQ ID NO: 34535 - DNA, 20 bp, Artificial Sequence
  chemically synthesized
cctttaacaaaccaaatata

SEQ ID NO: 34536 - DNA, 20 bp, Artificial Sequence
  chemically synthesized
ctttaacaaaccaaatataa

SEQ ID NO: 34537 - DNA, 20 bp, Artificial Sequence
  chemically synthesized
ataacatttacctttatatt

SEQ ID NO: 34538 - DNA, 20 bp, Artificial Sequence
  chemically synthesized
aaaggtaaatgttatcacta

SEQ ID NO: 34539 - DNA, 20 bp, Artificial Sequence
  chemically synthesized
tacttacatgcacatatctt

SEQ ID NO: 34540 - DNA, 20 bp, Artificial Sequence
  chemically synthesized
cactaaagatatgtgcatgt

SEQ ID NO: 34541 - DNA, 20 bp, Artificial Sequence
  chemically synthesized
tatgtgcatgtaagtatgat

SEQ ID NO: 34542 - DNA, 20 bp, Artificial Sequence
  chemically synthesized
tgatcggtattgctattttt

SEQ ID NO: 34543 - DNA, 20 bp, Artificial Sequence
  chemically synthesized
gtgccatatttgcttaaaaa

SEQ ID NO: 34544 - DNA, 20 bp, Artificial Sequence
  chemically synthesized
ttgctatttttaagcaaata

SEQ ID NO: 34545 - DNA, 20 bp, Artificial Sequence
  chemically synthesized
agcaaatatggcacttcttc

SEQ ID NO: 34546 - DNA, 20 bp, Artificial Sequence
  chemically synthesized
atgagccagaatgccagaag

SEQ ID NO: 34547 - DNA, 20 bp, Artificial Sequence
  chemically synthesized
tgtatgagccagaatgccag

SEQ ID NO: 34548 - DNA, 20 bp, Artificial Sequence
  chemically synthesized
tggcacttcttctggcattc

SEQ ID NO: 34549 - DNA, 20 bp, Artificial Sequence
  chemically synthesized
cagtgtatgagccagaatgc

SEQ ID NO: 34550 - DNA, 20 bp, Artificial Sequence
  chemically synthesized
agtaatctcagtgtatgagc

SEQ ID NO: 34551 - DNA, 20 bp, Artificial Sequence
  chemically synthesized
ggcattctggctcatacact

SEQ ID NO: 34552 - DNA, 20 bp, Artificial Sequence
  chemically synthesized
actaagtaatctcagtgtat

SEQ ID NO: 34553 - DNA, 20 bp, Artificial Sequence
  chemically synthesized
agggcaacactaagtaatct

SEQ ID NO: 34554 - DNA, 20 bp, Artificial Sequence
  chemically synthesized
gctcatacactgagattact

SEQ ID NO: 34555 - DNA, 20 bp, Artificial Sequence
  chemically synthesized
aattgctaaagggcaacact

SEQ ID NO: 34556 - DNA, 20 bp, Artificial Sequence
  chemically synthesized
gattacttagtgttgccctt

SEQ ID NO: 34557 - DNA, 20 bp, Artificial Sequence
  chemically synthesized
actagcttaaaattgctaaa

SEQ ID NO: 34558 - DNA, 20 bp, Artificial Sequence
  chemically synthesized
cactagcttaaaattgctaa

SEQ ID NO: 34559 - DNA, 20 bp, Artificial Sequence
  chemically synthesized
tcactagcttaaaattgcta

SEQ ID NO: 34560 - DNA, 20 bp, Artificial Sequence
  chemically synthesized
tgttgccctttagcaatttt

SEQ ID NO: 34561 - DNA, 20 bp, Artificial Sequence
  chemically synthesized
gccctttagcaattttaagc

SEQ ID NO: 34562 - DNA, 20 bp, Artificial Sequence
  chemically synthesized
tttagcaattttaagctagt

SEQ ID NO: 34563 - DNA, 20 bp, Artificial Sequence
  chemically synthesized
cagctgcctccacaactcac

SEQ ID NO: 34564 - DNA, 20 bp, Artificial Sequence
  chemically synthesized
aattttaagctagtgagttg

SEQ ID NO: 34565 - DNA, 20 bp, Artificial Sequence
  chemically synthesized
ttttaagctagtgagttgtg

SEQ ID NO: 34566 - DNA, 20 bp, Artificial Sequence
  chemically synthesized
tttaagctagtgagttgtgg

SEQ ID NO: 34567 - DNA, 20 bp, Artificial Sequence
  chemically synthesized
aagctagtgagttgtggagg

SEQ ID NO: 34568 - DNA, 20 bp, Artificial Sequence
  chemically synthesized
tgtggaggcagctgctatta

SEQ ID NO: 34569 - DNA, 20 bp, Artificial Sequence
  chemically synthesized
cccccctcagaccgtaatag

SEQ ID NO: 34570 - DNA, 20 bp, Artificial Sequence
  chemically synthesized
gtgcccccctcagaccgtaa

SEQ ID NO: 34571 - DNA, 20 bp, Artificial Sequence
  chemically synthesized
ggcagctgctattacggtct

SEQ ID NO: 34572 - DNA, 20 bp, Artificial Sequence
  chemically synthesized
gcagctgctattacggtctg

SEQ ID NO: 34573 - DNA, 20 bp, Artificial Sequence
  chemically synthesized
cagctgctattacggtctga

SEQ ID NO: 34574 - DNA, 20 bp, Artificial Sequence
  chemically synthesized
agctgctattacggtctgag

SEQ ID NO: 34575 - DNA, 20 bp, Artificial Sequence
  chemically synthesized
gctgctattacggtctgagg

SEQ ID NO: 34576 - DNA, 20 bp, Artificial Sequence
  chemically synthesized
ctgctattacggtctgaggg

SEQ ID NO: 34577 - DNA, 20 bp, Artificial Sequence
  chemically synthesized
aaatcttagtgtgcccccct

SEQ ID NO: 34578 - DNA, 20 bp, Artificial Sequence
  chemically synthesized
cggtctgaggggggcacact

SEQ ID NO: 34579 - DNA, 20 bp, Artificial Sequence
  chemically synthesized
acttcagccaaagcaaatct

SEQ ID NO: 34580 - DNA, 20 bp, Artificial Sequence
  chemically synthesized
gggcacactaagatttgctt

SEQ ID NO: 34581 - DNA, 20 bp, Artificial Sequence
  chemically synthesized
actaagatttgctttggctg

SEQ ID NO: 34582 - DNA, 20 bp, Artificial Sequence
  chemically synthesized
ccaagggacaacttcagcca

SEQ ID NO: 34583 - DNA, 20 bp, Artificial Sequence
  chemically synthesized
attagaccaagggacaactt

SEQ ID NO: 34584 - DNA, 20 bp, Artificial Sequence
  chemically synthesized
ctttggctgaagttgtccct

SEQ ID NO: 34585 - DNA, 20 bp, Artificial Sequence
  chemically synthesized
agaatatactattagaccaa

SEQ ID NO: 34586 - DNA, 20 bp, Artificial Sequence
  chemically synthesized
tagaatatactattagacca

SEQ ID NO: 34587 - DNA, 20 bp, Artificial Sequence
  chemically synthesized
gaagttgtcccttggtctaa

SEQ ID NO: 34588 - DNA, 20 bp, Artificial Sequence
  chemically synthesized
ctagaatatactattagacc

SEQ ID NO: 34589 - DNA, 20 bp, Artificial Sequence
  chemically synthesized
gcagacctagaatatactat

SEQ ID NO: 34590 - DNA, 20 bp, Artificial Sequence
  chemically synthesized
cttggtctaatagtatattc

SEQ ID NO: 34591 - DNA, 20 bp, Artificial Sequence
  chemically synthesized
ttggtctaatagtatattct

SEQ ID NO: 34592 - DNA, 20 bp, Artificial Sequence
  chemically synthesized
cccaaggatcggagcagacc

SEQ ID NO: 34593 - DNA, 20 bp, Artificial Sequence
  chemically synthesized
ctcttccccaaggatcggag

SEQ ID NO: 34594 - DNA, 20 bp, Artificial Sequence
  chemically synthesized
tctaggtctgctccgatcct

SEQ ID NO: 34595 - DNA, 20 bp, Artificial Sequence
  chemically synthesized
tccctcttccccaaggatcg

SEQ ID NO: 34596 - DNA, 20 bp, Artificial Sequence
  chemically synthesized
ctaggtctgctccgatcctt

SEQ ID NO: 34597 - DNA, 20 bp, Artificial Sequence
  chemically synthesized
taggtctgctccgatccttg

SEQ ID NO: 34598 - DNA, 20 bp, Artificial Sequence
  chemically synthesized
aatccctcttccccaaggat

SEQ ID NO: 34599 - DNA, 20 bp, Artificial Sequence
  chemically synthesized
gtctgctccgatccttgggg

SEQ ID NO: 34600 - DNA, 20 bp, Artificial Sequence
  chemically synthesized
ctgctccgatccttggggaa

SEQ ID NO: 34601 - DNA, 20 bp, Artificial Sequence
  chemically synthesized
acactaatccctcttcccca

SEQ ID NO: 34602 - DNA, 20 bp, Artificial Sequence
  chemically synthesized
tgctccgatccttggggaag

SEQ ID NO: 34603 - DNA, 20 bp, Artificial Sequence
  chemically synthesized
gacactaatccctcttcccc

SEQ ID NO: 34604 - DNA, 20 bp, Artificial Sequence
  chemically synthesized
gctccgatccttggggaaga

SEQ ID NO: 34605 - DNA, 20 bp, Artificial Sequence
  chemically synthesized
gatccttggggaagagggat

SEQ ID NO: 34606 - DNA, 20 bp, Artificial Sequence
  chemically synthesized
agggattagtgtcctgtaat

SEQ ID NO: 34607 - DNA, 20 bp, Artificial Sequence
  chemically synthesized
gggattagtgtcctgtaatg

SEQ ID NO: 34608 - DNA, 20 bp, Artificial Sequence
  chemically synthesized
gggcactacttcctcattac

SEQ ID NO: 34609 - DNA, 20 bp, Artificial Sequence
  chemically synthesized
agggcactacttcctcatta

SEQ ID NO: 34610 - DNA, 20 bp, Artificial Sequence
  chemically synthesized
attagtgtcctgtaatgagg

SEQ ID NO: 34611 - DNA, 20 bp, Artificial Sequence
  chemically synthesized
agtgtcctgtaatgaggaag

SEQ ID NO: 34612 - DNA, 20 bp, Artificial Sequence
  chemically synthesized
tgaggaagtagtgccctttg

SEQ ID NO: 34613 - DNA, 20 bp, Artificial Sequence
  chemically synthesized
tgtctctgatttactgcaaa

SEQ ID NO: 34614 - DNA, 20 bp, Artificial Sequence
  chemically synthesized
gtgtctctgatttactgcaa

SEQ ID NO: 34615 - DNA, 20 bp, Artificial Sequence
  chemically synthesized
ggtgtctctgatttactgca

SEQ ID NO: 34616 - DNA, 20 bp, Artificial Sequence
  chemically synthesized
tagtgccctttgcagtaaat

SEQ ID NO: 34617 - DNA, 20 bp, Artificial Sequence
  chemically synthesized
gtgccctttgcagtaaatca

SEQ ID NO: 34618 - DNA, 20 bp, Artificial Sequence
  chemically synthesized
tgccacactgacacagagat

SEQ ID NO: 34619 - DNA, 20 bp, Artificial Sequence
  chemically synthesized
agagacaccaatctctgtgt

SEQ ID NO: 34620 - DNA, 20 bp, Artificial Sequence
  chemically synthesized
tgatttgccacactgacaca

SEQ ID NO: 34621 - DNA, 20 bp, Artificial Sequence
  chemically synthesized
agtgatttgccacactgaca

SEQ ID NO: 34622 - DNA, 20 bp, Artificial Sequence
  chemically synthesized
caccaatctctgtgtcagtg

SEQ ID NO: 34623 - DNA, 20 bp, Artificial Sequence
  chemically synthesized
aataaacataaacagtagtt

SEQ ID NO: 34624 - DNA, 20 bp, Artificial Sequence
  chemically synthesized
gttgaaataaacataaacag

SEQ ID NO: 34625 - DNA, 20 bp, Artificial Sequence
  chemically synthesized
ttcgttgaaataaacataaa

SEQ ID NO: 34626 - DNA, 20 bp, Artificial Sequence
  chemically synthesized
tttatgtttatttcaacgaa

SEQ ID NO: 34627 - DNA, 20 bp, Artificial Sequence
  chemically synthesized
tgtttatttcaacgaaaaga

SEQ ID NO: 34628 - DNA, 20 bp, Artificial Sequence
  chemically synthesized
ttatttcaacgaaaagacag

SEQ ID NO: 34629 - DNA, 20 bp, Artificial Sequence
  chemically synthesized
caacgaaaagacagaagcct

SEQ ID NO: 34630 - DNA, 20 bp, Artificial Sequence
  chemically synthesized
acgaaaagacagaagcctca

SEQ ID NO: 34631 - DNA, 20 bp, Artificial Sequence
  chemically synthesized
aagacagaagcctcagagca

SEQ ID NO: 34632 - DNA, 20 bp, Artificial Sequence
  chemically synthesized
ttacaaatgtccatgctctg

SEQ ID NO: 34633 - DNA, 20 bp, Artificial Sequence
  chemically synthesized
tttacaaatgtccatgctct

SEQ ID NO: 34634 - DNA, 20 bp, Artificial Sequence
  chemically synthesized
atattacaaatcgataaact

SEQ ID NO: 34635 - DNA, 20 bp, Artificial Sequence
  chemically synthesized
tattacaaatcgataaacta

SEQ ID NO: 34636 - DNA, 20 bp, Artificial Sequence
  chemically synthesized
atccaggtgttacaaatcct

SEQ ID NO: 34637 - DNA, 20 bp, Artificial Sequence
  chemically synthesized
aactaaggatttgtaacacc

SEQ ID NO: 34638 - DNA, 20 bp, Artificial Sequence
  chemically synthesized
aaggatttgtaacacctgga

SEQ ID NO: 34639 - DNA, 20 bp, Artificial Sequence
  chemically synthesized
atttgtaacacctggatagt

SEQ ID NO: 34640 - DNA, 20 bp, Artificial Sequence
  chemically synthesized
tgacaaatgtcttactatcc

SEQ ID NO: 34641 - DNA, 20 bp, Artificial Sequence
  chemically synthesized
gtgacaaatgtcttactatc

SEQ ID NO: 34642 - DNA, 20 bp, Artificial Sequence
  chemically synthesized
caaaaaacaggaaaggaaga

SEQ ID NO: 34643 - DNA, 20 bp, Artificial Sequence
  chemically synthesized
aacaaaaaacaggaaaggaa

SEQ ID NO: 34644 - DNA, 20 bp, Artificial Sequence
  chemically synthesized
caaacaaaaaacaggaaagg

SEQ ID NO: 34645 - DNA, 20 bp, Artificial Sequence
  chemically synthesized
aaacaaacaaaaaacaggaa

SEQ ID NO: 34646 - DNA, 20 bp, Artificial Sequence
  chemically synthesized
caaacaaacaaaaaacagga

SEQ ID NO: 34647 - DNA, 20 bp, Artificial Sequence
  chemically synthesized
aaaacaaacaaacaaaaaac

SEQ ID NO: 34648 - DNA, 20 bp, Artificial Sequence
  chemically synthesized
taaaacaaacaaacaaaaaa

SEQ ID NO: 34649 - DNA, 20 bp, Artificial Sequence
  chemically synthesized
attttgagcaggtaatttaa

SEQ ID NO: 34650 - DNA, 20 bp, Artificial Sequence
  chemically synthesized
agaactcctgaattttgagc

SEQ ID NO: 34651 - DNA, 20 bp, Artificial Sequence
  chemically synthesized
cagaactcctgaattttgag

SEQ ID NO: 34652 - DNA, 20 bp, Artificial Sequence
  chemically synthesized
taaattacctgctcaaaatt

SEQ ID NO: 34653 - DNA, 20 bp, Artificial Sequence
  chemically synthesized
aaattacctgctcaaaattc

SEQ ID NO: 34654 - DNA, 20 bp, Artificial Sequence
  chemically synthesized
tgtcagaactcctgaatttt

SEQ ID NO: 34655 - DNA, 20 bp, Artificial Sequence
  chemically synthesized
attacctgctcaaaattcag

SEQ ID NO: 34656 - DNA, 20 bp, Artificial Sequence
  chemically synthesized
gcatttatagagaagcgtgt

SEQ ID NO: 34657 - DNA, 20 bp, Artificial Sequence
  chemically synthesized
agacttaagcatttatagag

SEQ ID NO: 34658 - DNA, 20 bp, Artificial Sequence
  chemically synthesized
aagagacttaagcatttata

SEQ ID NO: 34659 - DNA, 20 bp, Artificial Sequence
  chemically synthesized
aaaagagacttaagcattta

SEQ ID NO: 34660 - DNA, 20 bp, Artificial Sequence
  chemically synthesized
acgcttctctataaatgctt

SEQ ID NO: 34661 - DNA, 20 bp, Artificial Sequence
  chemically synthesized
gacactgagaaaagagactt

SEQ ID NO: 34662 - DNA, 20 bp, Artificial Sequence
  chemically synthesized
aatgcttaagtctcttttct

SEQ ID NO: 34663 - DNA, 20 bp, Artificial Sequence
  chemically synthesized
ctaattggacactgagaaaa

SEQ ID NO: 34664 - DNA, 20 bp, Artificial Sequence
  chemically synthesized
ttctaattggacactgagaa

SEQ ID NO: 34665 - DNA, 20 bp, Artificial Sequence
  chemically synthesized
tagttttctaattggacact

SEQ ID NO: 34666 - DNA, 20 bp, Artificial Sequence
  chemically synthesized
ctcttttctcagtgtccaat

SEQ ID NO: 34667 - DNA, 20 bp, Artificial Sequence
  chemically synthesized
attcttagtagttttctaat

SEQ ID NO: 34668 - DNA, 20 bp, Artificial Sequence
  chemically synthesized
tgtccaattagaaaactact

SEQ ID NO: 34669 - DNA, 20 bp, Artificial Sequence
  chemically synthesized
tgtcaacagattattcttag

SEQ ID NO: 34670 - DNA, 20 bp, Artificial Sequence
  chemically synthesized
tcttgtcaacagattattct

SEQ ID NO: 34671 - DNA, 20 bp, Artificial Sequence
  chemically synthesized
actaagaataatctgttgac

SEQ ID NO: 34672 - DNA, 20 bp, Artificial Sequence
  chemically synthesized
ccattcttttttcttgtcaa

SEQ ID NO: 34673 - DNA, 20 bp, Artificial Sequence
  chemically synthesized
ataatctgttgacaagaaaa

SEQ ID NO: 34674 - DNA, 20 bp, Artificial Sequence
  chemically synthesized
ctgttgacaagaaaaaagaa

SEQ ID NO: 34675 - DNA, 20 bp, Artificial Sequence
  chemically synthesized
acaagaaaaaagaatggaat

SEQ ID NO: 34676 - DNA, 20 bp, Artificial Sequence
  chemically synthesized
tggaataagaaatcactatt

SEQ ID NO: 34677 - DNA, 20 bp, Artificial Sequence
  chemically synthesized
atttttttaaaaagtctgaa

SEQ ID NO: 34678 - DNA, 20 bp, Artificial Sequence
  chemically synthesized
catctgtcaatttttttaaa

SEQ ID NO: 34679 - DNA, 20 bp, Artificial Sequence
  chemically synthesized
agactttttaaaaaaattga

SEQ ID NO: 34680 - DNA, 20 bp, Artificial Sequence
  chemically synthesized
tttttaaaaaaattgacaga

SEQ ID NO: 34681 - DNA, 20 bp, Artificial Sequence
  chemically synthesized
aacttaaagatgtatttttg

SEQ ID NO: 34682 - DNA, 20 bp, Artificial Sequence
  chemically synthesized
gaacttaaagatgtattttt

SEQ ID NO: 34683 - DNA, 20 bp, Artificial Sequence
  chemically synthesized
atcctcaaaaatacatcttt

SEQ ID NO: 34684 - DNA, 20 bp, Artificial Sequence
  chemically synthesized
ccagtctaaaaaagaactta

SEQ ID NO: 34685 - DNA, 20 bp, Artificial Sequence
  chemically synthesized
tacatctttaagttcttttt

SEQ ID NO: 34686 - DNA, 20 bp, Artificial Sequence
  chemically synthesized
cctataactccagtctaaaa

SEQ ID NO: 34687 - DNA, 20 bp, Artificial Sequence
  chemically synthesized
ctttaagttcttttttagac

SEQ ID NO: 34688 - DNA, 20 bp, Artificial Sequence
  chemically synthesized
ttaagttcttttttagactg

SEQ ID NO: 34689 - DNA, 20 bp, Artificial Sequence
  chemically synthesized
tcttttttagactggagtta

SEQ ID NO: 34690 - DNA, 20 bp, Artificial Sequence
  chemically synthesized
cttttttagactggagttat

SEQ ID NO: 34691 - DNA, 20 bp, Artificial Sequence
  chemically synthesized
tcttcaagtgcctataactc

SEQ ID NO: 34692 - DNA, 20 bp, Artificial Sequence
  chemically synthesized
actggagttataggcacttg

SEQ ID NO: 34693 - DNA, 20 bp, Artificial Sequence
  chemically synthesized
agatttgggaacaagtcttc

SEQ ID NO: 34694 - DNA, 20 bp, Artificial Sequence
  chemically synthesized
tgacgtcaagatttgggaac

SEQ ID NO: 34695 - DNA, 20 bp, Artificial Sequence
  chemically synthesized
ataatatgacgtcaagattt

SEQ ID NO: 34696 - DNA, 20 bp, Artificial Sequence
  chemically synthesized
tataatatgacgtcaagatt

SEQ ID NO: 34697 - DNA, 20 bp, Artificial Sequence
  chemically synthesized
tttaattataatatgacgtc

SEQ ID NO: 34698 - DNA, 20 bp, Artificial Sequence
  chemically synthesized
atattataattaaatactga

SEQ ID NO: 34699 - DNA, 20 bp, Artificial Sequence
  chemically synthesized
gcgtcatttcttaatacttt

SEQ ID NO: 34700 - DNA, 20 bp, Artificial Sequence
  chemically synthesized
aattaaatactgaaagtatt

SEQ ID NO: 34701 - DNA, 20 bp, Artificial Sequence
  chemically synthesized
gaaagtattaagaaatgacg

SEQ ID NO: 34702 - DNA, 20 bp, Artificial Sequence
  chemically synthesized
aaagtattaagaaatgacgc

SEQ ID NO: 34703 - DNA, 20 bp, Artificial Sequence
  chemically synthesized
aagaaatgacgcgggcatca

SEQ ID NO: 34704 - DNA, 20 bp, Artificial Sequence
  chemically synthesized
gaaatgacgcgggcatcaca

SEQ ID NO: 34705 - DNA, 20 bp, Artificial Sequence
  chemically synthesized
actgcaattgaacaacaaaa

SEQ ID NO: 34706 - DNA, 20 bp, Artificial Sequence
  chemically synthesized
actgttttgttgttcaattg

SEQ ID NO: 34707 - DNA, 20 bp, Artificial Sequence
  chemically synthesized
ttttgttgttcaattgcagt

SEQ ID NO: 34708 - DNA, 20 bp, Artificial Sequence
  chemically synthesized
agattatgaattttgcttat

SEQ ID NO: 34709 - DNA, 20 bp, Artificial Sequence
  chemically synthesized
attatgaattttgcttatta

SEQ ID NO: 34710 - DNA, 20 bp, Artificial Sequence
  chemically synthesized
ttatgaattttgcttattag

SEQ ID NO: 34711 - DNA, 20 bp, Artificial Sequence
  chemically synthesized
tccaaatgctttcctctaat

SEQ ID NO: 34712 - DNA, 20 bp, Artificial Sequence
  chemically synthesized
gaattttgcttattagagga

SEQ ID NO: 34713 - DNA, 20 bp, Artificial Sequence
  chemically synthesized
gcttattagaggaaagcatt

SEQ ID NO: 34714 - DNA, 20 bp, Artificial Sequence
  chemically synthesized
ttagaggaaagcatttggaa

SEQ ID NO: 34715 - DNA, 20 bp, Artificial Sequence
  chemically synthesized
ataatttacatatgacacga

SEQ ID NO: 34716 - DNA, 20 bp, Artificial Sequence
  chemically synthesized
cataatttacatatgacacg

SEQ ID NO: 34717 - DNA, 20 bp, Artificial Sequence
  chemically synthesized
cgtgtcatatgtaaattatg

SEQ ID NO: 34718 - DNA, 20 bp, Artificial Sequence
  chemically synthesized
aaacaatatattatcataca

SEQ ID NO: 34719 - DNA, 20 bp, Artificial Sequence
  chemically synthesized
gataatatattgtttgttta

SEQ ID NO: 34720 - DNA, 20 bp, Artificial Sequence
  chemically synthesized
aatatattgtttgtttatag

SEQ ID NO: 34721 - DNA, 20 bp, Artificial Sequence
  chemically synthesized
ataatcagaaggaggagaag

SEQ ID NO: 34722 - DNA, 20 bp, Artificial Sequence
  chemically synthesized
aatataatcagaaggaggag

SEQ ID NO: 34723 - DNA, 20 bp, Artificial Sequence
  chemically synthesized
aataatataatcagaaggag

SEQ ID NO: 34724 - DNA, 20 bp, Artificial Sequence
  chemically synthesized
ataataatataatcagaagg

SEQ ID NO: 34725 - DNA, 20 bp, Artificial Sequence
  chemically synthesized
aataataatataatcagaag

SEQ ID NO: 34726 - DNA, 20 bp, Artificial Sequence
  chemically synthesized
ataataataatataatcaga

SEQ ID NO: 34727 - DNA, 20 bp, Artificial Sequence
  chemically synthesized
aataataataatataatcag

SEQ ID NO: 34728 - DNA, 20 bp, Artificial Sequence
  chemically synthesized
aataataataataatataat

SEQ ID NO: 34729 - DNA, 20 bp, Artificial Sequence
  chemically synthesized
gtccgtggttcatatcaaaa

SEQ ID NO: 34730 - DNA, 20 bp, Artificial Sequence
  chemically synthesized
tactgttttgatatgaacca

SEQ ID NO: 34731 - DNA, 20 bp, Artificial Sequence
  chemically synthesized
tcaggctcttttcatgtccg

SEQ ID NO: 34732 - DNA, 20 bp, Artificial Sequence
  chemically synthesized
atatgaaccacggacatgaa

SEQ ID NO: 34733 - DNA, 20 bp, Artificial Sequence
  chemically synthesized
atgaaccacggacatgaaaa

SEQ ID NO: 34734 - DNA, 20 bp, Artificial Sequence
  chemically synthesized
acggacatgaaaagagcctg

SEQ ID NO: 34735 - DNA, 20 bp, Artificial Sequence
  chemically synthesized
tgttctggtagcagagcttc

SEQ ID NO: 34736 - DNA, 20 bp, Artificial Sequence
  chemically synthesized
ttgttctggtagcagagctt

SEQ ID NO: 34737 - DNA, 20 bp, Artificial Sequence
  chemically synthesized
agagcctgaagctctgctac

SEQ ID NO: 34738 - DNA, 20 bp, Artificial Sequence
  chemically synthesized
tgaagtttgttctggtagca

SEQ ID NO: 34739 - DNA, 20 bp, Artificial Sequence
  chemically synthesized
gctgaagtttgttctggtag

SEQ ID NO: 34740 - DNA, 20 bp, Artificial Sequence
  chemically synthesized
ttagctgaagtttgttctgg

SEQ ID NO: 34741 - DNA, 20 bp, Artificial Sequence
  chemically synthesized
attttagctgaagtttgttc

SEQ ID NO: 34742 - DNA, 20 bp, Artificial Sequence
  chemically synthesized
tctgctaccagaacaaactt

SEQ ID NO: 34743 - DNA, 20 bp, Artificial Sequence
  chemically synthesized
tgaagtcaaaattttagctg

SEQ ID NO: 34744 - DNA, 20 bp, Artificial Sequence
  chemically synthesized
tgattctgaagtcaaaattt

SEQ ID NO: 34745 - DNA, 20 bp, Artificial Sequence
  chemically synthesized
ttcagctaaaattttgactt

SEQ ID NO: 34746 - DNA, 20 bp, Artificial Sequence
  chemically synthesized
taaaattttgacttcagaat

SEQ ID NO: 34747 - DNA, 20 bp, Artificial Sequence
  chemically synthesized
gtaggtcatggctgattctg

SEQ ID NO: 34748 - DNA, 20 bp, Artificial Sequence
  chemically synthesized
tactgggaacaagtaggtca

SEQ ID NO: 34749 - DNA, 20 bp, Artificial Sequence
  chemically synthesized
cagtggtactgggaacaagt

SEQ ID NO: 34750 - DNA, 20 bp, Artificial Sequence
  chemically synthesized
acagtggtactgggaacaag

SEQ ID NO: 34751 - DNA, 20 bp, Artificial Sequence
  chemically synthesized
agccatgacctacttgttcc

SEQ ID NO: 34752 - DNA, 20 bp, Artificial Sequence
  chemically synthesized
tagacagtggtactgggaac

SEQ ID NO: 34753 - DNA, 20 bp, Artificial Sequence
  chemically synthesized
ccattctagacagtggtact

SEQ ID NO: 34754 - DNA, 20 bp, Artificial Sequence
  chemically synthesized
accattctagacagtggtac

SEQ ID NO: 34755 - DNA, 20 bp, Artificial Sequence
  chemically synthesized
ttgttcccagtaccactgtc

SEQ ID NO: 34756 - DNA, 20 bp, Artificial Sequence
  chemically synthesized
ccttgcaccattctagacag

SEQ ID NO: 34757 - DNA, 20 bp, Artificial Sequence
  chemically synthesized
cccagtaccactgtctagaa

SEQ ID NO: 34758 - DNA, 20 bp, Artificial Sequence
  chemically synthesized
aatccttgcaccattctaga

SEQ ID NO: 34759 - DNA, 20 bp, Artificial Sequence
  chemically synthesized
ttccaatccttgcaccattc

SEQ ID NO: 34760 - DNA, 20 bp, Artificial Sequence
  chemically synthesized
accactgtctagaatggtgc

SEQ ID NO: 34761 - DNA, 20 bp, Artificial Sequence
  chemically synthesized
ccactgtctagaatggtgca

SEQ ID NO: 34762 - DNA, 20 bp, Artificial Sequence
  chemically synthesized
gtctagaatggtgcaaggat

SEQ ID NO: 34763 - DNA, 20 bp, Artificial Sequence
  chemically synthesized
aatggtgcaaggattggaat

SEQ ID NO: 34764 - DNA, 20 bp, Artificial Sequence
  chemically synthesized
atggtgcaaggattggaatt

SEQ ID NO: 34765 - DNA, 20 bp, Artificial Sequence
  chemically synthesized
tggtgcaaggattggaattg

SEQ ID NO: 34766 - DNA, 20 bp, Artificial Sequence
  chemically synthesized
aggattggaattggggaatc

SEQ ID NO: 34767 - DNA, 20 bp, Artificial Sequence
  chemically synthesized
gaattggggaatccagctcg

SEQ ID NO: 34768 - DNA, 20 bp, Artificial Sequence
  chemically synthesized
aagcgcatgagtcttcgagc

SEQ ID NO: 34769 - DNA, 20 bp, Artificial Sequence
  chemically synthesized
agctaagcgcatgagtcttc

SEQ ID NO: 34770 - DNA, 20 bp, Artificial Sequence
  chemically synthesized
agctcgaagactcatgcgct

SEQ ID NO: 34771 - DNA, 20 bp, Artificial Sequence
  chemically synthesized
agcagaatagctaagcgcat

SEQ ID NO: 34772 - DNA, 20 bp, Artificial Sequence
  chemically synthesized
ggcagcatagcagaatagct

SEQ ID NO: 34773 - DNA, 20 bp, Artificial Sequence
  chemically synthesized
ttcatggcagcatagcagaa

SEQ ID NO: 34774 - DNA, 20 bp, Artificial Sequence
  chemically synthesized
gtctcttcatggcagcatag

SEQ ID NO: 34775 - DNA, 20 bp, Artificial Sequence
  chemically synthesized
catgtctcttcatggcagca

SEQ ID NO: 34776 - DNA, 20 bp, Artificial Sequence
  chemically synthesized
tattctgctatgctgccatg

SEQ ID NO: 34777 - DNA, 20 bp, Artificial Sequence
  chemically synthesized
ttctgctatgctgccatgaa

SEQ ID NO: 34778 - DNA, 20 bp, Artificial Sequence
  chemically synthesized
gaagccatgtctcttcatgg

SEQ ID NO: 34779 - DNA, 20 bp, Artificial Sequence
  chemically synthesized
aaagaagccatgtctcttca

SEQ ID NO: 34780 - DNA, 20 bp, Artificial Sequence
  chemically synthesized
tatgctgccatgaagagaca

SEQ ID NO: 34781 - DNA, 20 bp, Artificial Sequence
  chemically synthesized
gacctttctcacaggaaaag

SEQ ID NO: 34782 - DNA, 20 bp, Artificial Sequence
  chemically synthesized
gacatggcttcttttcctgt

SEQ ID NO: 34783 - DNA, 20 bp, Artificial Sequence
  chemically synthesized
acagacctttctcacaggaa

SEQ ID NO: 34784 - DNA, 20 bp, Artificial Sequence
  chemically synthesized
tggcttcttttcctgtgaga

SEQ ID NO: 34785 - DNA, 20 bp, Artificial Sequence
  chemically synthesized
ggcttcttttcctgtgagaa

SEQ ID NO: 34786 - DNA, 20 bp, Artificial Sequence
  chemically synthesized
aaaacacagacctttctcac

SEQ ID NO: 34787 - DNA, 20 bp, Artificial Sequence
  chemically synthesized
aaaaacacagacctttctca

SEQ ID NO: 34788 - DNA, 20 bp, Artificial Sequence
  chemically synthesized
tgagtatactagaaaaaaca

SEQ ID NO: 34789 - DNA, 20 bp, Artificial Sequence
  chemically synthesized
agaaaggtctgtgttttttc

SEQ ID NO: 34790 - DNA, 20 bp, Artificial Sequence
  chemically synthesized
gagattgtctatgagtatac

SEQ ID NO: 34791 - DNA, 20 bp, Artificial Sequence
  chemically synthesized
tgttttttctagtatactca

SEQ ID NO: 34792 - DNA, 20 bp, Artificial Sequence
  chemically synthesized
ccatcagtgagattgtctat

SEQ ID NO: 34793 - DNA, 20 bp, Artificial Sequence
  chemically synthesized
ctcatagacaatctcactga

SEQ ID NO: 34794 - DNA, 20 bp, Artificial Sequence
  chemically synthesized
ctctgctctgagccatcagt

SEQ ID NO: 34795 - DNA, 20 bp, Artificial Sequence
  chemically synthesized
agacaatctcactgatggct

SEQ ID NO: 34796 - DNA, 20 bp, Artificial Sequence
  chemically synthesized
tcttctctgctctgagccat

SEQ ID NO: 34797 - DNA, 20 bp, Artificial Sequence
  chemically synthesized
acaatctcactgatggctca

SEQ ID NO: 34798 - DNA, 20 bp, Artificial Sequence
  chemically synthesized
atctcactgatggctcagag

SEQ ID NO: 34799 - DNA, 20 bp, Artificial Sequence
  chemically synthesized
ctcactgatggctcagagca

SEQ ID NO: 34800 - DNA, 20 bp, Artificial Sequence
  chemically synthesized
aatttactcttctctgctct

SEQ ID NO: 34801 - DNA, 20 bp, Artificial Sequence
  chemically synthesized
actgatggctcagagcagag

SEQ ID NO: 34802 - DNA, 20 bp, Artificial Sequence
  chemically synthesized
tgatggctcagagcagagaa

SEQ ID NO: 34803 - DNA, 20 bp, Artificial Sequence
  chemically synthesized
gcagagaagagtaaatttgc

SEQ ID NO: 34804 - DNA, 20 bp, Artificial Sequence
  chemically synthesized
aagagtaaatttgctagaaa

SEQ ID NO: 34805 - DNA, 20 bp, Artificial Sequence
  chemically synthesized
gagtaaatttgctagaaata

SEQ ID NO: 34806 - DNA, 20 bp, Artificial Sequence
  chemically synthesized
ttcttctttatctctatttc

SEQ ID NO: 34807 - DNA, 20 bp, Artificial Sequence
  chemically synthesized
atttgctagaaatagagata

SEQ ID NO: 34808 - DNA, 20 bp, Artificial Sequence
  chemically synthesized
tgctagaaatagagataaag

SEQ ID NO: 34809 - DNA, 20 bp, Artificial Sequence
  chemically synthesized
gagataaagaagaaatgaaa

SEQ ID NO: 34810 - DNA, 20 bp, Artificial Sequence
  chemically synthesized
agataaagaagaaatgaaat

SEQ ID NO: 34811 - DNA, 20 bp, Artificial Sequence
  chemically synthesized
aagaagaaatgaaatgggat

SEQ ID NO: 34812 - DNA, 20 bp, Artificial Sequence
  chemically synthesized
agaagaaatgaaatgggatg

SEQ ID NO: 34813 - DNA, 20 bp, Artificial Sequence
  chemically synthesized
aatgaaatgggatgaggtca

SEQ ID NO: 34814 - DNA, 20 bp, Artificial Sequence
  chemically synthesized
gaaatgggatgaggtcaaag

SEQ ID NO: 34815 - DNA, 20 bp, Artificial Sequence
  chemically synthesized
aaatgggatgaggtcaaaga

SEQ ID NO: 34816 - DNA, 20 bp, Artificial Sequence
  chemically synthesized
tgaggtcaaagaaggcgacc

SEQ ID NO: 34817 - DNA, 20 bp, Artificial Sequence
  chemically synthesized
tggctacgggaaaatgtact

SEQ ID NO: 34818 - DNA, 20 bp, Artificial Sequence
  chemically synthesized
ttggctacgggaaaatgtac

SEQ ID NO: 34819 - DNA, 20 bp, Artificial Sequence
  chemically synthesized
cgacccagtacattttcccg

SEQ ID NO: 34820 - DNA, 20 bp, Artificial Sequence
  chemically synthesized
aagaccagagttttggctac

SEQ ID NO: 34821 - DNA, 20 bp, Artificial Sequence
  chemically synthesized
aaagaccagagttttggcta

SEQ ID NO: 34822 - DNA, 20 bp, Artificial Sequence
  chemically synthesized
ttttcccgtagccaaaactc

SEQ ID NO: 34823 - DNA, 20 bp, Artificial Sequence
  chemically synthesized
tggttcaaagaccagagttt

SEQ ID NO: 34824 - DNA, 20 bp, Artificial Sequence
  chemically synthesized
tttaagtggttcaaagacca

SEQ ID NO: 34825 - DNA, 20 bp, Artificial Sequence
  chemically synthesized
agtttaagtggttcaaagac

SEQ ID NO: 34826 - DNA, 20 bp, Artificial Sequence
  chemically synthesized
ctcaaagtttaagtggttca

SEQ ID NO: 34827 - DNA, 20 bp, Artificial Sequence
  chemically synthesized
agataccctcaaagtttaag

SEQ ID NO: 34828 - DNA, 20 bp, Artificial Sequence
  chemically synthesized
ctttgaaccacttaaacttt

SEQ ID NO: 34829 - DNA, 20 bp, Artificial Sequence
  chemically synthesized
taaagataccctcaaagttt

SEQ ID NO: 34830 - DNA, 20 bp, Artificial Sequence
  chemically synthesized
tttgaaccacttaaactttg

SEQ ID NO: 34831 - DNA, 20 bp, Artificial Sequence
  chemically synthesized
ttgaaccacttaaactttga

SEQ ID NO: 34832 - DNA, 20 bp, Artificial Sequence
  chemically synthesized
attctctaaagataccctca

SEQ ID NO: 34833 - DNA, 20 bp, Artificial Sequence
  chemically synthesized
ttaaactttgagggtatctt

SEQ ID NO: 34834 - DNA, 20 bp, Artificial Sequence
  chemically synthesized
aaactttgagggtatcttta

SEQ ID NO: 34835 - DNA, 20 bp, Artificial Sequence
  chemically synthesized
agagatgcccttattctcta

SEQ ID NO: 34836 - DNA, 20 bp, Artificial Sequence
  chemically synthesized
tgagggtatctttagagaat

SEQ ID NO: 34837 - DNA, 20 bp, Artificial Sequence
  chemically synthesized
gagggtatctttagagaata

SEQ ID NO: 34838 - DNA, 20 bp, Artificial Sequence
  chemically synthesized
agggtatctttagagaataa

SEQ ID NO: 34839 - DNA, 20 bp, Artificial Sequence
  chemically synthesized
aataagggcatctctgacct

SEQ ID NO: 34840 - DNA, 20 bp, Artificial Sequence
  chemically synthesized
ataagggcatctctgaccta

SEQ ID NO: 34841 - DNA, 20 bp, Artificial Sequence
  chemically synthesized
ctgcacagtcccttaggtca

SEQ ID NO: 34842 - DNA, 20 bp, Artificial Sequence
  chemically synthesized
taagggcatctctgacctaa

SEQ ID NO: 34843 - DNA, 20 bp, Artificial Sequence
  chemically synthesized
tcctgcacagtcccttaggt

SEQ ID NO: 34844 - DNA, 20 bp, Artificial Sequence
  chemically synthesized
agcatcctgcacagtccctt

SEQ ID NO: 34845 - DNA, 20 bp, Artificial Sequence
  chemically synthesized
aagcatcctgcacagtccct

SEQ ID NO: 34846 - DNA, 20 bp, Artificial Sequence
  chemically synthesized
ctctgacctaagggactgtg

SEQ ID NO: 34847 - DNA, 20 bp, Artificial Sequence
  chemically synthesized
tctgacctaagggactgtgc

SEQ ID NO: 34848 - DNA, 20 bp, Artificial Sequence
  chemically synthesized
gaatggggaagcatcctgca

SEQ ID NO: 34849 - DNA, 20 bp, Artificial Sequence
  chemically synthesized
agatggatgggagaatgggg

SEQ ID NO: 34850 - DNA, 20 bp, Artificial Sequence
  chemically synthesized
tagagatggatgggagaatg

SEQ ID NO: 34851 - DNA, 20 bp, Artificial Sequence
  chemically synthesized
atagagatggatgggagaat

SEQ ID NO: 34852 - DNA, 20 bp, Artificial Sequence
  chemically synthesized
aatagagatggatgggagaa

SEQ ID NO: 34853 - DNA, 20 bp, Artificial Sequence
  chemically synthesized
caaagaatagagatggatgg

SEQ ID NO: 34854 - DNA, 20 bp, Artificial Sequence
  chemically synthesized
gacaaagaatagagatggat

SEQ ID NO: 34855 - DNA, 20 bp, Artificial Sequence
  chemically synthesized
ggacaaagaatagagatgga

SEQ ID NO: 34856 - DNA, 20 bp, Artificial Sequence
  chemically synthesized
agaaggacaaagaatagaga

SEQ ID NO: 34857 - DNA, 20 bp, Artificial Sequence
  chemically synthesized
atggagaaggacaaagaata

SEQ ID NO: 34858 - DNA, 20 bp, Artificial Sequence
  chemically synthesized
gaatggagaaggacaaagaa

SEQ ID NO: 34859 - DNA, 20 bp, Artificial Sequence
  chemically synthesized
gagcagaatggagaaggaca

SEQ ID NO: 34860 - DNA, 20 bp, Artificial Sequence
  chemically synthesized
gccacagagcagaatggaga

SEQ ID NO: 34861 - DNA, 20 bp, Artificial Sequence
  chemically synthesized
ggccacagagcagaatggag

SEQ ID NO: 34862 - DNA, 20 bp, Artificial Sequence
  chemically synthesized
ctgggccacagagcagaatg

SEQ ID NO: 34863 - DNA, 20 bp, Artificial Sequence
  chemically synthesized
tcctgggccacagagcagaa

SEQ ID NO: 34864 - DNA, 20 bp, Artificial Sequence
  chemically synthesized
tccttctccattctgctctg

SEQ ID NO: 34865 - DNA, 20 bp, Artificial Sequence
  chemically synthesized
caacctcctgggccacagag

SEQ ID NO: 34866 - DNA, 20 bp, Artificial Sequence
  chemically synthesized
ctccattctgctctgtggcc

SEQ ID NO: 34867 - DNA, 20 bp, Artificial Sequence
  chemically synthesized
gtccaacctcctgggccaca

SEQ ID NO: 34868 - DNA, 20 bp, Artificial Sequence
  chemically synthesized
tccattctgctctgtggccc

SEQ ID NO: 34869 - DNA, 20 bp, Artificial Sequence
  chemically synthesized
aggtccaacctcctgggcca

SEQ ID NO: 34870 - DNA, 20 bp, Artificial Sequence
  chemically synthesized
cattctgctctgtggcccag

SEQ ID NO: 34871 - DNA, 20 bp, Artificial Sequence
  chemically synthesized
attctgctctgtggcccagg

SEQ ID NO: 34872 - DNA, 20 bp, Artificial Sequence
  chemically synthesized
tgctctgtggcccaggaggt

SEQ ID NO: 34873 - DNA, 20 bp, Artificial Sequence
  chemically synthesized
ccacagaggtccaacctcct

SEQ ID NO: 34874 - DNA, 20 bp, Artificial Sequence
  chemically synthesized
cccacagaggtccaacctcc

SEQ ID NO: 34875 - DNA, 20 bp, Artificial Sequence
  chemically synthesized
cccaggaggttggacctctg

SEQ ID NO: 34876 - DNA, 20 bp, Artificial Sequence
  chemically synthesized
ccaggaggttggacctctgt

SEQ ID NO: 34877 - DNA, 20 bp, Artificial Sequence
  chemically synthesized
caggaggttggacctctgtg

SEQ ID NO: 34878 - DNA, 20 bp, Artificial Sequence
  chemically synthesized
cctgattgatgtccccacag

SEQ ID NO: 34879 - DNA, 20 bp, Artificial Sequence
  chemically synthesized
gcctgattgatgtccccaca

SEQ ID NO: 34880 - DNA, 20 bp, Artificial Sequence
  chemically synthesized
aagcctgattgatgtcccca

SEQ ID NO: 34881 - DNA, 20 bp, Artificial Sequence
  chemically synthesized
acctctgtggggacatcaat

SEQ ID NO: 34882 - DNA, 20 bp, Artificial Sequence
  chemically synthesized
cctctgtggggacatcaatc

SEQ ID NO: 34883 - DNA, 20 bp, Artificial Sequence
  chemically synthesized
aaggaagccaaacggcagga

SEQ ID NO: 34884 - DNA, 20 bp, Artificial Sequence
  chemically synthesized
aatcaggctttcctgccgtt

SEQ ID NO: 34885 - DNA, 20 bp, Artificial Sequence
  chemically synthesized
gcaaaaggaagccaaacggc

SEQ ID NO: 34886 - DNA, 20 bp, Artificial Sequence
  chemically synthesized
agcaaaaggaagccaaacgg

SEQ ID NO: 34887 - DNA, 20 bp, Artificial Sequence
  chemically synthesized
gaaagcaaaaggaagccaaa

SEQ ID NO: 34888 - DNA, 20 bp, Artificial Sequence
  chemically synthesized
aattggctgaaagcaaaagg

SEQ ID NO: 34889 - DNA, 20 bp, Artificial Sequence
  chemically synthesized
cccaattggctgaaagcaaa

SEQ ID NO: 34890 - DNA, 20 bp, Artificial Sequence
  chemically synthesized
gtttggcttccttttgcttt

SEQ ID NO: 34891 - DNA, 20 bp, Artificial Sequence
  chemically synthesized
tcccaattggctgaaagcaa

SEQ ID NO: 34892 - DNA, 20 bp, Artificial Sequence
  chemically synthesized
actgcctcccaattggctga

SEQ ID NO: 34893 - DNA, 20 bp, Artificial Sequence
  chemically synthesized
tccttttgctttcagccaat

SEQ ID NO: 34894 - DNA, 20 bp, Artificial Sequence
  chemically synthesized
ccttttgctttcagccaatt

SEQ ID NO: 34895 - DNA, 20 bp, Artificial Sequence
  chemically synthesized
ttttgctttcagccaattgg

SEQ ID NO: 34896 - DNA, 20 bp, Artificial Sequence
  chemically synthesized
tttgctttcagccaattggg

SEQ ID NO: 34897 - DNA, 20 bp, Artificial Sequence
  chemically synthesized
tttcatcactgcctcccaat

SEQ ID NO: 34898 - DNA, 20 bp, Artificial Sequence
  chemically synthesized
gctttcagccaattgggagg

SEQ ID NO: 34899 - DNA, 20 bp, Artificial Sequence
  chemically synthesized
caattgggaggcagtgatga

SEQ ID NO: 34900 - DNA, 20 bp, Artificial Sequence
  chemically synthesized
aattgggaggcagtgatgaa

SEQ ID NO: 34901 - DNA, 20 bp, Artificial Sequence
  chemically synthesized
aggcagtgatgaaaggccta

SEQ ID NO: 34902 - DNA, 20 bp, Artificial Sequence
  chemically synthesized
cagtgatgaaaggcctacag

SEQ ID NO: 34903 - DNA, 20 bp, Artificial Sequence
  chemically synthesized
agtgatgaaaggcctacaga

SEQ ID NO: 34904 - DNA, 20 bp, Artificial Sequence
  chemically synthesized
tgatgaaaggcctacagaag

SEQ ID NO: 34905 - DNA, 20 bp, Artificial Sequence
  chemically synthesized
gtcctttcctctccttctgt

SEQ ID NO: 34906 - DNA, 20 bp, Artificial Sequence
  chemically synthesized
tgtcctttcctctccttctg

SEQ ID NO: 34907 - DNA, 20 bp, Artificial Sequence
  chemically synthesized
atgaaaggcctacagaagga

SEQ ID NO: 34908 - DNA, 20 bp, Artificial Sequence
  chemically synthesized
tgaaaggcctacagaaggag

SEQ ID NO: 34909 - DNA, 20 bp, Artificial Sequence
  chemically synthesized
aggcctacagaaggagagga

SEQ ID NO: 34910 - DNA, 20 bp, Artificial Sequence
  chemically synthesized
ggcctacagaaggagaggaa

SEQ ID NO: 34911 - DNA, 20 bp, Artificial Sequence
  chemically synthesized
tacagaaggagaggaaagga

SEQ ID NO: 34912 - DNA, 20 bp, Artificial Sequence
  chemically synthesized
acagaaggagaggaaaggac

SEQ ID NO: 34913 - DNA, 20 bp, Artificial Sequence
  chemically synthesized
agaaggagaggaaaggacag

SEQ ID NO: 34914 - DNA, 20 bp, Artificial Sequence
  chemically synthesized
gaaggagaggaaaggacagg

SEQ ID NO: 34915 - DNA, 20 bp, Artificial Sequence
  chemically synthesized
ggagaggaaaggacaggagg

SEQ ID NO: 34916 - DNA, 20 bp, Artificial Sequence
  chemically synthesized
gagaggaaaggacaggagga

SEQ ID NO: 34917 - DNA, 20 bp, Artificial Sequence
  chemically synthesized
gacaggaggaaggtgatgtt

SEQ ID NO: 34918 - DNA, 20 bp, Artificial Sequence
  chemically synthesized
acaggaggaaggtgatgttt

SEQ ID NO: 34919 - DNA, 20 bp, Artificial Sequence
  chemically synthesized
atgtttgggtatttattctt

SEQ ID NO: 34920 - DNA, 20 bp, Artificial Sequence
  chemically synthesized
tgtttgggtatttattcttc

SEQ ID NO: 34921 - DNA, 20 bp, Artificial Sequence
  chemically synthesized
gatcagtaggagggaacctg

SEQ ID NO: 34922 - DNA, 20 bp, Artificial Sequence
  chemically synthesized
caggccagagatcagtagga

SEQ ID NO: 34923 - DNA, 20 bp, Artificial Sequence
  chemically synthesized
ccaggccagagatcagtagg

SEQ ID NO: 34924 - DNA, 20 bp, Artificial Sequence
  chemically synthesized
gccaggccagagatcagtag

SEQ ID NO: 34925 - DNA, 20 bp, Artificial Sequence
  chemically synthesized
ctgccaggccagagatcagt

SEQ ID NO: 34926 - DNA, 20 bp, Artificial Sequence
  chemically synthesized
gctgccaggccagagatcag

SEQ ID NO: 34927 - DNA, 20 bp, Artificial Sequence
  chemically synthesized
ggttccctcctactgatctc

SEQ ID NO: 34928 - DNA, 20 bp, Artificial Sequence
  chemically synthesized
gcagctgccaggccagagat

SEQ ID NO: 34929 - DNA, 20 bp, Artificial Sequence
  chemically synthesized
cctcctactgatctctggcc

SEQ ID NO: 34930 - DNA, 20 bp, Artificial Sequence
  chemically synthesized
actcagcagctgccaggcca

SEQ ID NO: 34931 - DNA, 20 bp, Artificial Sequence
  chemically synthesized
cctactgatctctggcctgg

SEQ ID NO: 34932 - DNA, 20 bp, Artificial Sequence
  chemically synthesized
gaactcagcagctgccaggc

SEQ ID NO: 34933 - DNA, 20 bp, Artificial Sequence
  chemically synthesized
caaggaactcagcagctgcc

SEQ ID NO: 34934 - DNA, 20 bp, Artificial Sequence
  chemically synthesized
tcaaggaactcagcagctgc

SEQ ID NO: 34935 - DNA, 20 bp, Artificial Sequence
  chemically synthesized
tctctggcctggcagctgct

SEQ ID NO: 34936 - DNA, 20 bp, Artificial Sequence
  chemically synthesized
ctgcaggtcaaggaactcag

SEQ ID NO: 34937 - DNA, 20 bp, Artificial Sequence
  chemically synthesized
tggctgcaggtcaaggaact

SEQ ID NO: 34938 - DNA, 20 bp, Artificial Sequence
  chemically synthesized
ctgctgagttccttgacctg

SEQ ID NO: 34939 - DNA, 20 bp, Artificial Sequence
  chemically synthesized
agacttgtggctgcaggtca

SEQ ID NO: 34940 - DNA, 20 bp, Artificial Sequence
  chemically synthesized
aagacttgtggctgcaggtc

SEQ ID NO: 34941 - DNA, 20 bp, Artificial Sequence
  chemically synthesized
ccaacaagacttgtggctgc

SEQ ID NO: 34942 - DNA, 20 bp, Artificial Sequence
  chemically synthesized
gttccttgacctgcagccac

SEQ ID NO: 34943 - DNA, 20 bp, Artificial Sequence
  chemically synthesized
gccaacaagacttgtggctg

SEQ ID NO: 34944 - DNA, 20 bp, Artificial Sequence
  chemically synthesized
ggactggccaacaagacttg

SEQ ID NO: 34945 - DNA, 20 bp, Artificial Sequence
  chemically synthesized
cctgcagccacaagtcttgt

SEQ ID NO: 34946 - DNA, 20 bp, Artificial Sequence
  chemically synthesized
cagccacaagtcttgttggc

SEQ ID NO: 34947 - DNA, 20 bp, Artificial Sequence
  chemically synthesized
gtaggaaaggactggccaac

SEQ ID NO: 34948 - DNA, 20 bp, Artificial Sequence
  chemically synthesized
ctattgctgtaggaaaggac

SEQ ID NO: 34949 - DNA, 20 bp, Artificial Sequence
  chemically synthesized
tgttggccagtcctttccta

SEQ ID NO: 34950 - DNA, 20 bp, Artificial Sequence
  chemically synthesized
gaatgctattgctgtaggaa

SEQ ID NO: 34951 - DNA, 20 bp, Artificial Sequence
  chemically synthesized
ggaatgctattgctgtagga

SEQ ID NO: 34952 - DNA, 20 bp, Artificial Sequence
  chemically synthesized
ccagtcctttcctacagcaa

SEQ ID NO: 34953 - DNA, 20 bp, Artificial Sequence
  chemically synthesized
tggtggaatgctattgctgt

SEQ ID NO: 34954 - DNA, 20 bp, Artificial Sequence
  chemically synthesized
ctggtggaatgctattgctg

SEQ ID NO: 34955 - DNA, 20 bp, Artificial Sequence
  chemically synthesized
ctacagcaatagcattccac

SEQ ID NO: 34956 - DNA, 20 bp, Artificial Sequence
  chemically synthesized
ggaatggtttgcgtaactgg

SEQ ID NO: 34957 - DNA, 20 bp, Artificial Sequence
  chemically synthesized
ggaggaatggtttgcgtaac

SEQ ID NO: 34958 - DNA, 20 bp, Artificial Sequence
  chemically synthesized
caaagggataaagggaggaa

SEQ ID NO: 34959 - DNA, 20 bp, Artificial Sequence
  chemically synthesized
ttgcccaaagggataaaggg

SEQ ID NO: 34960 - DNA, 20 bp, Artificial Sequence
  chemically synthesized
tttgcccaaagggataaagg

SEQ ID NO: 34961 - DNA, 20 bp, Artificial Sequence
  chemically synthesized
cttttgcccaaagggataaa

SEQ ID NO: 34962 - DNA, 20 bp, Artificial Sequence
  chemically synthesized
acttttgcccaaagggataa

SEQ ID NO: 34963 - DNA, 20 bp, Artificial Sequence
  chemically synthesized
aacttttgcccaaagggata

SEQ ID NO: 34964 - DNA, 20 bp, Artificial Sequence
  chemically synthesized
cattcctccctttatccctt

SEQ ID NO: 34965 - DNA, 20 bp, Artificial Sequence
  chemically synthesized
attcctccctttatcccttt

SEQ ID NO: 34966 - DNA, 20 bp, Artificial Sequence
  chemically synthesized
atggtaaacttttgcccaaa

SEQ ID NO: 34967 - DNA, 20 bp, Artificial Sequence
  chemically synthesized
aatggtaaacttttgcccaa

SEQ ID NO: 34968 - DNA, 20 bp, Artificial Sequence
  chemically synthesized
ccctttatccctttgggcaa

SEQ ID NO: 34969 - DNA, 20 bp, Artificial Sequence
  chemically synthesized
gaatggtaaacttttgccca

SEQ ID NO: 34970 - DNA, 20 bp, Artificial Sequence
  chemically synthesized
aaaaaaaaaaaaacaaggaa

SEQ ID NO: 34971 - DNA, 20 bp, Artificial Sequence
  chemically synthesized
aggagaaaaaaaaaaaaaca

SEQ ID NO: 34972 - DNA, 20 bp, Artificial Sequence
  chemically synthesized
taggagaaaaaaaaaaaaac

SEQ ID NO: 34973 - DNA, 20 bp, Artificial Sequence
  chemically synthesized
ttgtttttttttttttctcc

SEQ ID NO: 34974 - DNA, 20 bp, Artificial Sequence
  chemically synthesized
caaggctctaggcaggctag

SEQ ID NO: 34975 - DNA, 20 bp, Artificial Sequence
  chemically synthesized
tacaaggctctaggcaggct

SEQ ID NO: 34976 - DNA, 20 bp, Artificial Sequence
  chemically synthesized
tttttttctcctagcctgcc

SEQ ID NO: 34977 - DNA, 20 bp, Artificial Sequence
  chemically synthesized
ttacaaggctctaggcaggc

SEQ ID NO: 34978 - DNA, 20 bp, Artificial Sequence
  chemically synthesized
tttttctcctagcctgccta

SEQ ID NO: 34979 - DNA, 20 bp, Artificial Sequence
  chemically synthesized
ctatttacaaggctctaggc

SEQ ID NO: 34980 - DNA, 20 bp, Artificial Sequence
  chemically synthesized
gctatttacaaggctctagg

SEQ ID NO: 34981 - DNA, 20 bp, Artificial Sequence
  chemically synthesized
aaggctatttacaaggctct

SEQ ID NO: 34982 - DNA, 20 bp, Artificial Sequence
  chemically synthesized
aaaggctatttacaaggctc

SEQ ID NO: 34983 - DNA, 20 bp, Artificial Sequence
  chemically synthesized
cctgcctagagccttgtaaa

SEQ ID NO: 34984 - DNA, 20 bp, Artificial Sequence
  chemically synthesized
taatgaaaaggctatttaca

SEQ ID NO: 34985 - DNA, 20 bp, Artificial Sequence
  chemically synthesized
ataatgaaaaggctatttac

SEQ ID NO: 34986 - DNA, 20 bp, Artificial Sequence
  chemically synthesized
ttgaagagagtataatgaaa

SEQ ID NO: 34987 - DNA, 20 bp, Artificial Sequence
  chemically synthesized
cttgaagagagtataatgaa

SEQ ID NO: 34988 - DNA, 20 bp, Artificial Sequence
  chemically synthesized
cttttcattatactctcttc

SEQ ID NO: 34989 - DNA, 20 bp, Artificial Sequence
  chemically synthesized
tcaaacggaacacttgaaga

SEQ ID NO: 34990 - DNA, 20 bp, Artificial Sequence
  chemically synthesized
attcaaacggaacacttgaa

SEQ ID NO: 34991 - DNA, 20 bp, Artificial Sequence
  chemically synthesized
acattcaaacggaacacttg

SEQ ID NO: 34992 - DNA, 20 bp, Artificial Sequence
  chemically synthesized
aaacagatggtacattcaaa

SEQ ID NO: 34993 - DNA, 20 bp, Artificial Sequence
  chemically synthesized
agggtcctgggagaaacaga

SEQ ID NO: 34994 - DNA, 20 bp, Artificial Sequence
  chemically synthesized
aatgtaccatctgtttctcc

SEQ ID NO: 34995 - DNA, 20 bp, Artificial Sequence
  chemically synthesized
ggtcagggtcctgggagaaa

SEQ ID NO: 34996 - DNA, 20 bp, Artificial Sequence
  chemically synthesized
atgtaccatctgtttctccc

SEQ ID NO: 34997 - DNA, 20 bp, Artificial Sequence
  chemically synthesized
cagtttggtcagggtcctgg

SEQ ID NO: 34998 - DNA, 20 bp, Artificial Sequence
  chemically synthesized
ctcagtttggtcagggtcct

SEQ ID NO: 34999 - DNA, 20 bp, Artificial Sequence
  chemically synthesized
tctcagtttggtcagggtcc

SEQ ID NO: 35000 - DNA, 20 bp, Artificial Sequence
  chemically synthesized
gatgggtctcagtttggtca

SEQ ID NO: 35001 - DNA, 20 bp, Artificial Sequence
  chemically synthesized
ggatgggtctcagtttggtc

SEQ ID NO: 35002 - DNA, 20 bp, Artificial Sequence
  chemically synthesized
tggatgggtctcagtttggt

SEQ ID NO: 35003 - DNA, 20 bp, Artificial Sequence
  chemically synthesized
cccaggaccctgaccaaact

SEQ ID NO: 35004 - DNA, 20 bp, Artificial Sequence
  chemically synthesized
tggctggatgggtctcagtt

SEQ ID NO: 35005 - DNA, 20 bp, Artificial Sequence
  chemically synthesized
ggctttggctggatgggtct

SEQ ID NO: 35006 - DNA, 20 bp, Artificial Sequence
  chemically synthesized
tgaccaaactgagacccatc

SEQ ID NO: 35007 - DNA, 20 bp, Artificial Sequence
  chemically synthesized
gagggtggctttggctggat

SEQ ID NO: 35008 - DNA, 20 bp, Artificial Sequence
  chemically synthesized
agagggtggctttggctgga

SEQ ID NO: 35009 - DNA, 20 bp, Artificial Sequence
  chemically synthesized
aactgagacccatccagcca

SEQ ID NO: 35010 - DNA, 20 bp, Artificial Sequence
  chemically synthesized
ccccagagggtggctttggc

SEQ ID NO: 35011 - DNA, 20 bp, Artificial Sequence
  chemically synthesized
attgccccagagggtggctt

SEQ ID NO: 35012 - DNA, 20 bp, Artificial Sequence
  chemically synthesized
atccagccaaagccaccctc

SEQ ID NO: 35013 - DNA, 20 bp, Artificial Sequence
  chemically synthesized
tccagccaaagccaccctct

SEQ ID NO: 35014 - DNA, 20 bp, Artificial Sequence
  chemically synthesized
ccagccaaagccaccctctg

SEQ ID NO: 35015 - DNA, 20 bp, Artificial Sequence
  chemically synthesized
aagtctattgccccagaggg

SEQ ID NO: 35016 - DNA, 20 bp, Artificial Sequence
  chemically synthesized
atcaagtctattgccccaga

SEQ ID NO: 35017 - DNA, 20 bp, Artificial Sequence
  chemically synthesized
catcaagtctattgccccag

SEQ ID NO: 35018 - DNA, 20 bp, Artificial Sequence
  chemically synthesized
gcatcaagtctattgcccca

SEQ ID NO: 35019 - DNA, 20 bp, Artificial Sequence
  chemically synthesized
aaagccaccctctggggcaa

SEQ ID NO: 35020 - DNA, 20 bp, Artificial Sequence
  chemically synthesized
cagcatcaagtctattgccc

SEQ ID NO: 35021 - DNA, 20 bp, Artificial Sequence
  chemically synthesized
ggggcaatagacttgatgct

SEQ ID NO: 35022 - DNA, 20 bp, Artificial Sequence
  chemically synthesized
agtagtccccactcagcatc

SEQ ID NO: 35023 - DNA, 20 bp, Artificial Sequence
  chemically synthesized
gcaatagacttgatgctgag

SEQ ID NO: 35024 - DNA, 20 bp, Artificial Sequence
  chemically synthesized
caatagacttgatgctgagt

SEQ ID NO: 35025 - DNA, 20 bp, Artificial Sequence
  chemically synthesized
aatagacttgatgctgagtg

SEQ ID NO: 35026 - DNA, 20 bp, Artificial Sequence
  chemically synthesized
ctctatcagtagtccccact

SEQ ID NO: 35027 - DNA, 20 bp, Artificial Sequence
  chemically synthesized
tgctgagtggggactactga

SEQ ID NO: 35028 - DNA, 20 bp, Artificial Sequence
  chemically synthesized
ctgagtggggactactgata

SEQ ID NO: 35029 - DNA, 20 bp, Artificial Sequence
  chemically synthesized
tgagtggggactactgatag

SEQ ID NO: 35030 - DNA, 20 bp, Artificial Sequence
  chemically synthesized
ctgactttctcctctatcag

SEQ ID NO: 35031 - DNA, 20 bp, Artificial Sequence
  chemically synthesized
agtggggactactgatagag

SEQ ID NO: 35032 - DNA, 20 bp, Artificial Sequence
  chemically synthesized
gatctgactttctcctctat

SEQ ID NO: 35033 - DNA, 20 bp, Artificial Sequence
  chemically synthesized
gggactactgatagaggaga

SEQ ID NO: 35034 - DNA, 20 bp, Artificial Sequence
  chemically synthesized
ctactgatagaggagaaagt

SEQ ID NO: 35035 - DNA, 20 bp, Artificial Sequence
  chemically synthesized
aaagtcagatccccccactc

SEQ ID NO: 35036 - DNA, 20 bp, Artificial Sequence
  chemically synthesized
ctttttagccccagagtggg

SEQ ID NO: 35037 - DNA, 20 bp, Artificial Sequence
  chemically synthesized
aagtcagatccccccactct

SEQ ID NO: 35038 - DNA, 20 bp, Artificial Sequence
  chemically synthesized
gctttttagccccagagtgg

SEQ ID NO: 35039 - DNA, 20 bp, Artificial Sequence
  chemically synthesized
agtcagatccccccactctg

SEQ ID NO: 35040 - DNA, 20 bp, Artificial Sequence
  chemically synthesized
tgctttttagccccagagtg

SEQ ID NO: 35041 - DNA, 20 bp, Artificial Sequence
  chemically synthesized
ctgctttttagccccagagt

SEQ ID NO: 35042 - DNA, 20 bp, Artificial Sequence
  chemically synthesized
tctgctttttagccccagag

SEQ ID NO: 35043 - DNA, 20 bp, Artificial Sequence
  chemically synthesized
tcatctgctttttagcccca

SEQ ID NO: 35044 - DNA, 20 bp, Artificial Sequence
  chemically synthesized
tctcatctgctttttagccc

SEQ ID NO: 35045 - DNA, 20 bp, Artificial Sequence
  chemically synthesized
ccccccactctggggctaaa

SEQ ID NO: 35046 - DNA, 20 bp, Artificial Sequence
  chemically synthesized
cccactctggggctaaaaag

SEQ ID NO: 35047 - DNA, 20 bp, Artificial Sequence
  chemically synthesized
actgagtctcatctgctttt

SEQ ID NO: 35048 - DNA, 20 bp, Artificial Sequence
  chemically synthesized
tctggggctaaaaagcagat

SEQ ID NO: 35049 - DNA, 20 bp, Artificial Sequence
  chemically synthesized
gctaaaaagcagatgagact

SEQ ID NO: 35050 - DNA, 20 bp, Artificial Sequence
  chemically synthesized
agcagatgagactcagtcat

SEQ ID NO: 35051 - DNA, 20 bp, Artificial Sequence
  chemically synthesized
tgaatatttatccaatgact

SEQ ID NO: 35052 - DNA, 20 bp, Artificial Sequence
  chemically synthesized
tcagtcattggataaatatt

SEQ ID NO: 35053 - DNA, 20 bp, Artificial Sequence
  chemically synthesized
agtcattggataaatattca

SEQ ID NO: 35054 - DNA, 20 bp, Artificial Sequence
  chemically synthesized
cattggataaatattcagag

SEQ ID NO: 35055 - DNA, 20 bp, Artificial Sequence
  chemically synthesized
attcagagaagcctcctctg

SEQ ID NO: 35056 - DNA, 20 bp, Artificial Sequence
  chemically synthesized
ttcagagaagcctcctctgt

SEQ ID NO: 35057 - DNA, 20 bp, Artificial Sequence
  chemically synthesized
tctttgtgggcctacagagg

SEQ ID NO: 35058 - DNA, 20 bp, Artificial Sequence
  chemically synthesized
ctctttgtgggcctacagag

SEQ ID NO: 35059 - DNA, 20 bp, Artificial Sequence
  chemically synthesized
agctctttgtgggcctacag

SEQ ID NO: 35060 - DNA, 20 bp, Artificial Sequence
  chemically synthesized
aagctctttgtgggcctaca

SEQ ID NO: 35061 - DNA, 20 bp, Artificial Sequence
  chemically synthesized
agaagctctttgtgggccta

SEQ ID NO: 35062 - DNA, 20 bp, Artificial Sequence
  chemically synthesized
gcctcctctgtaggcccaca

SEQ ID NO: 35063 - DNA, 20 bp, Artificial Sequence
  chemically synthesized
ctcctctgtaggcccacaaa

SEQ ID NO: 35064 - DNA, 20 bp, Artificial Sequence
  chemically synthesized
aaaggccagaagctctttgt

SEQ ID NO: 35065 - DNA, 20 bp, Artificial Sequence
  chemically synthesized
aaaaggccagaagctctttg

SEQ ID NO: 35066 - DNA, 20 bp, Artificial Sequence
  chemically synthesized
gtaggcccacaaagagcttc

SEQ ID NO: 35067 - DNA, 20 bp, Artificial Sequence
  chemically synthesized
ctttaccctcaaaaggccag

SEQ ID NO: 35068 - DNA, 20 bp, Artificial Sequence
  chemically synthesized
caaagagcttctggcctttt

SEQ ID NO: 35069 - DNA, 20 bp, Artificial Sequence
  chemically synthesized
tgcctttaccctcaaaaggc

SEQ ID NO: 35070 - DNA, 20 bp, Artificial Sequence
  chemically synthesized
aaagagcttctggccttttg

SEQ ID NO: 35071 - DNA, 20 bp, Artificial Sequence
  chemically synthesized
aagagcttctggccttttga

SEQ ID NO: 35072 - DNA, 20 bp, Artificial Sequence
  chemically synthesized
gatatgcctttaccctcaaa

SEQ ID NO: 35073 - DNA, 20 bp, Artificial Sequence
  chemically synthesized
tgatatgcctttaccctcaa

SEQ ID NO: 35074 - DNA, 20 bp, Artificial Sequence
  chemically synthesized
cttctggccttttgagggta

SEQ ID NO: 35075 - DNA, 20 bp, Artificial Sequence
  chemically synthesized
ttctggccttttgagggtaa

SEQ ID NO: 35076 - DNA, 20 bp, Artificial Sequence
  chemically synthesized
aggcatatcaacaattatga

SEQ ID NO: 35077 - DNA, 20 bp, Artificial Sequence
  chemically synthesized
aacaattatgatggtgacaa

SEQ ID NO: 35078 - DNA, 20 bp, Artificial Sequence
  chemically synthesized
aattatgatggtgacaacag

SEQ ID NO: 35079 - DNA, 20 bp, Artificial Sequence
  chemically synthesized
atggtgacaacagcagatgt

SEQ ID NO: 35080 - DNA, 20 bp, Artificial Sequence
  chemically synthesized
tggtgacaacagcagatgtg

SEQ ID NO: 35081 - DNA, 20 bp, Artificial Sequence
  chemically synthesized
ggtgacaacagcagatgtga

SEQ ID NO: 35082 - DNA, 20 bp, Artificial Sequence
  chemically synthesized
acagcagatgtgagggtaaa

SEQ ID NO: 35083 - DNA, 20 bp, Artificial Sequence
  chemically synthesized
cagcagatgtgagggtaaaa

SEQ ID NO: 35084 - DNA, 20 bp, Artificial Sequence
  chemically synthesized
gagggtaaaaaggatgcaac

SEQ ID NO: 35085 - DNA, 20 bp, Artificial Sequence
  chemically synthesized
agctcttgtaaagaacaagc

SEQ ID NO: 35086 - DNA, 20 bp, Artificial Sequence
  chemically synthesized
ttgaagctcttgtaaagaac

SEQ ID NO: 35087 - DNA, 20 bp, Artificial Sequence
  chemically synthesized
gcaaccagcttgttctttac

SEQ ID NO: 35088 - DNA, 20 bp, Artificial Sequence
  chemically synthesized
aaccagcttgttctttacaa

SEQ ID NO: 35089 - DNA, 20 bp, Artificial Sequence
  chemically synthesized
agaccgttgaagctcttgta

SEQ ID NO: 35090 - DNA, 20 bp, Artificial Sequence
  chemically synthesized
gttctttacaagagcttcaa

SEQ ID NO: 35091 - DNA, 20 bp, Artificial Sequence
  chemically synthesized
aaagatcaagcagaccgttg

SEQ ID NO: 35092 - DNA, 20 bp, Artificial Sequence
  chemically synthesized
attctctccaaaagatcaag

SEQ ID NO: 35093 - DNA, 20 bp, Artificial Sequence
  chemically synthesized
caacggtctgcttgatcttt

SEQ ID NO: 35094 - DNA, 20 bp, Artificial Sequence
  chemically synthesized
gacattctctccaaaagatc

SEQ ID NO: 35095 - DNA, 20 bp, Artificial Sequence
  chemically synthesized
acggtctgcttgatcttttg

SEQ ID NO: 35096 - DNA, 20 bp, Artificial Sequence
  chemically synthesized
ggtctgcttgatcttttgga

SEQ ID NO: 35097 - DNA, 20 bp, Artificial Sequence
  chemically synthesized
tatcttgacattctctccaa

SEQ ID NO: 35098 - DNA, 20 bp, Artificial Sequence
  chemically synthesized
gatcttttggagagaatgtc

SEQ ID NO: 35099 - DNA, 20 bp, Artificial Sequence
  chemically synthesized
tttggagagaatgtcaagat

SEQ ID NO: 35100 - DNA, 20 bp, Artificial Sequence
  chemically synthesized
ttggagagaatgtcaagata

SEQ ID NO: 35101 - DNA, 20 bp, Artificial Sequence
  chemically synthesized
tggagagaatgtcaagataa

SEQ ID NO: 35102 - DNA, 20 bp, Artificial Sequence
  chemically synthesized
gagaatgtcaagataagggt

SEQ ID NO: 35103 - DNA, 20 bp, Artificial Sequence
  chemically synthesized
gaatgtcaagataagggtta

SEQ ID NO: 35104 - DNA, 20 bp, Artificial Sequence
  chemically synthesized
caagataagggttagagaaa

SEQ ID NO: 35105 - DNA, 20 bp, Artificial Sequence
  chemically synthesized
aagataagggttagagaaat

SEQ ID NO: 35106 - DNA, 20 bp, Artificial Sequence
  chemically synthesized
ggttagagaaatgggcaaac

SEQ ID NO: 35107 - DNA, 20 bp, Artificial Sequence
  chemically synthesized
agagaaatgggcaaactgga

SEQ ID NO: 35108 - DNA, 20 bp, Artificial Sequence
  chemically synthesized
gagaaatgggcaaactggaa

SEQ ID NO: 35109 - DNA, 20 bp, Artificial Sequence
  chemically synthesized
agaaatgggcaaactggaaa

SEQ ID NO: 35110 - DNA, 20 bp, Artificial Sequence
  chemically synthesized
ttgtcacactaagccctttc

SEQ ID NO: 35111 - DNA, 20 bp, Artificial Sequence
  chemically synthesized
tgggcaaactggaaagggct

SEQ ID NO: 35112 - DNA, 20 bp, Artificial Sequence
  chemically synthesized
aaactccagattgtcacact

SEQ ID NO: 35113 - DNA, 20 bp, Artificial Sequence
  chemically synthesized
aagggcttagtgtgacaatc

SEQ ID NO: 35114 - DNA, 20 bp, Artificial Sequence
  chemically synthesized
gggcttagtgtgacaatctg

SEQ ID NO: 35115 - DNA, 20 bp, Artificial Sequence
  chemically synthesized
tcaggatacaagtcaaactc

SEQ ID NO: 35116 - DNA, 20 bp, Artificial Sequence
  chemically synthesized
cctcatacctttcaggatac

SEQ ID NO: 35117 - DNA, 20 bp, Artificial Sequence
  chemically synthesized
gagtttgacttgtatcctga

SEQ ID NO: 35118 - DNA, 20 bp, Artificial Sequence
  chemically synthesized
agtttgacttgtatcctgaa

SEQ ID NO: 35119 - DNA, 20 bp, Artificial Sequence
  chemically synthesized
aaagctccctcatacctttc

SEQ ID NO: 35120 - DNA, 20 bp, Artificial Sequence
  chemically synthesized
aaaagctccctcataccttt

SEQ ID NO: 35121 - DNA, 20 bp, Artificial Sequence
  chemically synthesized
acttgtatcctgaaaggtat

SEQ ID NO: 35122 - DNA, 20 bp, Artificial Sequence
  chemically synthesized
cttgtatcctgaaaggtatg

SEQ ID NO: 35123 - DNA, 20 bp, Artificial Sequence
  chemically synthesized
ttgtatcctgaaaggtatga

SEQ ID NO: 35124 - DNA, 20 bp, Artificial Sequence
  chemically synthesized
gtatcctgaaaggtatgagg

SEQ ID NO: 35125 - DNA, 20 bp, Artificial Sequence
  chemically synthesized
aaggtatgagggagcttttt

SEQ ID NO: 35126 - DNA, 20 bp, Artificial Sequence
  chemically synthesized
aggtatgagggagcttttta

SEQ ID NO: 35127 - DNA, 20 bp, Artificial Sequence
  chemically synthesized
tatgagggagctttttaagg

SEQ ID NO: 35128 - DNA, 20 bp, Artificial Sequence
  chemically synthesized
ttaattctttcttccttaaa

SEQ ID NO: 35129 - DNA, 20 bp, Artificial Sequence
  chemically synthesized
agggagctttttaaggaaga

SEQ ID NO: 35130 - DNA, 20 bp, Artificial Sequence
  chemically synthesized
ttttaaggaagaaagaatta

SEQ ID NO: 35131 - DNA, 20 bp, Artificial Sequence
  chemically synthesized
ggaagaaagaattaaagcat

SEQ ID NO: 35132 - DNA, 20 bp, Artificial Sequence
  chemically synthesized
aaagaattaaagcatgagtg

SEQ ID NO: 35133 - DNA, 20 bp, Artificial Sequence
  chemically synthesized
agcatgagtgtggctctgtc

SEQ ID NO: 35134 - DNA, 20 bp, Artificial Sequence
  chemically synthesized
tctaaaagacaaaccggaca

SEQ ID NO: 35135 - DNA, 20 bp, Artificial Sequence
  chemically synthesized
tttctaaaagacaaaccgga

SEQ ID NO: 35136 - DNA, 20 bp, Artificial Sequence
  chemically synthesized
gatttttctaaaagacaaac

SEQ ID NO: 35137 - DNA, 20 bp, Artificial Sequence
  chemically synthesized
gctctgtccggtttgtcttt

SEQ ID NO: 35138 - DNA, 20 bp, Artificial Sequence
  chemically synthesized
tgcctgagtgatttttctaa

SEQ ID NO: 35139 - DNA, 20 bp, Artificial Sequence
  chemically synthesized
tgtcttttagaaaaatcact

SEQ ID NO: 35140 - DNA, 20 bp, Artificial Sequence
  chemically synthesized
gtcttttagaaaaatcactc

SEQ ID NO: 35141 - DNA, 20 bp, Artificial Sequence
  chemically synthesized
tagaaaaatcactcaggcaa

SEQ ID NO: 35142 - DNA, 20 bp, Artificial Sequence
  chemically synthesized
aagcccccataccattgcct

SEQ ID NO: 35143 - DNA, 20 bp, Artificial Sequence
  chemically synthesized
aaatcactcaggcaatggta

SEQ ID NO: 35144 - DNA, 20 bp, Artificial Sequence
  chemically synthesized
aatcactcaggcaatggtat

SEQ ID NO: 35145 - DNA, 20 bp, Artificial Sequence
  chemically synthesized
atcactcaggcaatggtatg

SEQ ID NO: 35146 - DNA, 20 bp, Artificial Sequence
  chemically synthesized
tcactcaggcaatggtatgg

SEQ ID NO: 35147 - DNA, 20 bp, Artificial Sequence
  chemically synthesized
caatggtatgggggcttgat

SEQ ID NO: 35148 - DNA, 20 bp, Artificial Sequence
  chemically synthesized
tggtatgggggcttgatcag

SEQ ID NO: 35149 - DNA, 20 bp, Artificial Sequence
  chemically synthesized
cagactcttgtcttctgatc

SEQ ID NO: 35150 - DNA, 20 bp, Artificial Sequence
  chemically synthesized
tgggggcttgatcagaagac

SEQ ID NO: 35151 - DNA, 20 bp, Artificial Sequence
  chemically synthesized
ggggcttgatcagaagacaa

SEQ ID NO: 35152 - DNA, 20 bp, Artificial Sequence
  chemically synthesized
gaagacaagagtctgaaatt

SEQ ID NO: 35153 - DNA, 20 bp, Artificial Sequence
  chemically synthesized
tgtacctgatgtctgaattt

SEQ ID NO: 35154 - DNA, 20 bp, Artificial Sequence
  chemically synthesized
agagtctgaaattcagacat

SEQ ID NO: 35155 - DNA, 20 bp, Artificial Sequence
  chemically synthesized
gagtctgaaattcagacatc

SEQ ID NO: 35156 - DNA, 20 bp, Artificial Sequence
  chemically synthesized
gaaattcagacatcaggtac

SEQ ID NO: 35157 - DNA, 20 bp, Artificial Sequence
  chemically synthesized
aaattcagacatcaggtaca

SEQ ID NO: 35158 - DNA, 20 bp, Artificial Sequence
  chemically synthesized
attcagacatcaggtacaag

SEQ ID NO: 35159 - DNA, 20 bp, Artificial Sequence
  chemically synthesized
catcaggtacaaggagattg

SEQ ID NO: 35160 - DNA, 20 bp, Artificial Sequence
  chemically synthesized
gtacaaggagattgcagtat

SEQ ID NO: 35161 - DNA, 20 bp, Artificial Sequence
  chemically synthesized
tacaaggagattgcagtatg

SEQ ID NO: 35162 - DNA, 20 bp, Artificial Sequence
  chemically synthesized
caaggagattgcagtatgag

SEQ ID NO: 35163 - DNA, 20 bp, Artificial Sequence
  chemically synthesized
aaggagattgcagtatgagg

SEQ ID NO: 35164 - DNA, 20 bp, Artificial Sequence
  chemically synthesized
tatgaggaggatctgaatta

SEQ ID NO: 35165 - DNA, 20 bp, Artificial Sequence
  chemically synthesized
cctctgccactgctgtaatt

SEQ ID NO: 35166 - DNA, 20 bp, Artificial Sequence
  chemically synthesized
gaggaggatctgaattacag

SEQ ID NO: 35167 - DNA, 20 bp, Artificial Sequence
  chemically synthesized
gaggatctgaattacagcag

SEQ ID NO: 35168 - DNA, 20 bp, Artificial Sequence
  chemically synthesized
gatctgaattacagcagtgg

SEQ ID NO: 35169 - DNA, 20 bp, Artificial Sequence
  chemically synthesized
tctgaattacagcagtggca

SEQ ID NO: 35170 - DNA, 20 bp, Artificial Sequence
  chemically synthesized
ctgaattacagcagtggcag

SEQ ID NO: 35171 - DNA, 20 bp, Artificial Sequence
  chemically synthesized
gaattacagcagtggcagag

SEQ ID NO: 35172 - DNA, 20 bp, Artificial Sequence
  chemically synthesized
aattacagcagtggcagagg

SEQ ID NO: 35173 - DNA, 20 bp, Artificial Sequence
  chemically synthesized
tacagcagtggcagaggagg

SEQ ID NO: 35174 - DNA, 20 bp, Artificial Sequence
  chemically synthesized
cagcagtggcagaggaggtg

SEQ ID NO: 35175 - DNA, 20 bp, Artificial Sequence
  chemically synthesized
aggtggagaaatgatacaat

SEQ ID NO: 35176 - DNA, 20 bp, Artificial Sequence
  chemically synthesized
ggtggagaaatgatacaata

SEQ ID NO: 35177 - DNA, 20 bp, Artificial Sequence
  chemically synthesized
atacaataaggttccaacta

SEQ ID NO: 35178 - DNA, 20 bp, Artificial Sequence
  chemically synthesized
tacaataaggttccaactac

SEQ ID NO: 35179 - DNA, 20 bp, Artificial Sequence
  chemically synthesized
caataaggttccaactacag

SEQ ID NO: 35180 - DNA, 20 bp, Artificial Sequence
  chemically synthesized
tcagtcaagactcctgtagt

SEQ ID NO: 35181 - DNA, 20 bp, Artificial Sequence
  chemically synthesized
ccagtcagtcaagactcctg

SEQ ID NO: 35182 - DNA, 20 bp, Artificial Sequence
  chemically synthesized
ctacaggagtcttgactgac

SEQ ID NO: 35183 - DNA, 20 bp, Artificial Sequence
  chemically synthesized
attcatacatccagtcagtc

SEQ ID NO: 35184 - DNA, 20 bp, Artificial Sequence
  chemically synthesized
cttccattcatacatccagt

SEQ ID NO: 35185 - DNA, 20 bp, Artificial Sequence
  chemically synthesized
ctctcttccattcatacatc

SEQ ID NO: 35186 - DNA, 20 bp, Artificial Sequence
  chemically synthesized
tgactgactggatgtatgaa

SEQ ID NO: 35187 - DNA, 20 bp, Artificial Sequence
  chemically synthesized
ctgactggatgtatgaatgg

SEQ ID NO: 35188 - DNA, 20 bp, Artificial Sequence
  chemically synthesized
gactggatgtatgaatggaa

SEQ ID NO: 35189 - DNA, 20 bp, Artificial Sequence
  chemically synthesized
ctggatgtatgaatggaaga

SEQ ID NO: 35190 - DNA, 20 bp, Artificial Sequence
  chemically synthesized
tggatgtatgaatggaagag

SEQ ID NO: 35191 - DNA, 20 bp, Artificial Sequence
  chemically synthesized
ggatgtatgaatggaagaga

SEQ ID NO: 35192 - DNA, 20 bp, Artificial Sequence
  chemically synthesized
tgtatgaatggaagagaggg

SEQ ID NO: 35193 - DNA, 20 bp, Artificial Sequence
  chemically synthesized
atgaatggaagagagggaag

SEQ ID NO: 35194 - DNA, 20 bp, Artificial Sequence
  chemically synthesized
tggaagagagggaagaagta

SEQ ID NO: 35195 - DNA, 20 bp, Artificial Sequence
  chemically synthesized
agagggaagaagtaaagcaa

SEQ ID NO: 35196 - DNA, 20 bp, Artificial Sequence
  chemically synthesized
gaagtaaagcaatagtcctc

SEQ ID NO: 35197 - DNA, 20 bp, Artificial Sequence
  chemically synthesized
aaagcaatagtcctcaagct

SEQ ID NO: 35198 - DNA, 20 bp, Artificial Sequence
  chemically synthesized
ccaaagggcggccaagcttg

SEQ ID NO: 35199 - DNA, 20 bp, Artificial Sequence
  chemically synthesized
tccaaagggcggccaagctt

SEQ ID NO: 35200 - DNA, 20 bp, Artificial Sequence
  chemically synthesized
agtgattccaaagggcggcc

SEQ ID NO: 35201 - DNA, 20 bp, Artificial Sequence
  chemically synthesized
cctcaagcttggccgccctt

SEQ ID NO: 35202 - DNA, 20 bp, Artificial Sequence
  chemically synthesized
ccctgagtgattccaaaggg

SEQ ID NO: 35203 - DNA, 20 bp, Artificial Sequence
  chemically synthesized
aatccctgagtgattccaaa

SEQ ID NO: 35204 - DNA, 20 bp, Artificial Sequence
  chemically synthesized
caatccctgagtgattccaa

SEQ ID NO: 35205 - DNA, 20 bp, Artificial Sequence
  chemically synthesized
acaatccctgagtgattcca

SEQ ID NO: 35206 - DNA, 20 bp, Artificial Sequence
  chemically synthesized
ggccgccctttggaatcact

SEQ ID NO: 35207 - DNA, 20 bp, Artificial Sequence
  chemically synthesized
gccgccctttggaatcactc

SEQ ID NO: 35208 - DNA, 20 bp, Artificial Sequence
  chemically synthesized
ccgccctttggaatcactca

SEQ ID NO: 35209 - DNA, 20 bp, Artificial Sequence
  chemically synthesized
taaatttattaacaatccct

SEQ ID NO: 35210 - DNA, 20 bp, Artificial Sequence
  chemically synthesized
tcagggattgttaataaatt

SEQ ID NO: 35211 - DNA, 20 bp, Artificial Sequence
  chemically synthesized
tgttaataaatttagatgtt

SEQ ID NO: 35212 - DNA, 20 bp, Artificial Sequence
  chemically synthesized
gttaataaatttagatgttt

SEQ ID NO: 35213 - DNA, 20 bp, Artificial Sequence
  chemically synthesized
aattagaatctcagggtggt

SEQ ID NO: 35214 - DNA, 20 bp, Artificial Sequence
  chemically synthesized
tgtttgggtctcaccaccct

SEQ ID NO: 35215 - DNA, 20 bp, Artificial Sequence
  chemically synthesized
attaaattagaatctcaggg

SEQ ID NO: 35216 - DNA, 20 bp, Artificial Sequence
  chemically synthesized
ccaattaaattagaatctca

SEQ ID NO: 35217 - DNA, 20 bp, Artificial Sequence
  chemically synthesized
accaattaaattagaatctc

SEQ ID NO: 35218 - DNA, 20 bp, Artificial Sequence
  chemically synthesized
gaccaattaaattagaatct

SEQ ID NO: 35219 - DNA, 20 bp, Artificial Sequence
  chemically synthesized
ccctgagattctaatttaat

SEQ ID NO: 35220 - DNA, 20 bp, Artificial Sequence
  chemically synthesized
atgtccaagaccaattaaat

SEQ ID NO: 35221 - DNA, 20 bp, Artificial Sequence
  chemically synthesized
gattctaatttaattggtct

SEQ ID NO: 35222 - DNA, 20 bp, Artificial Sequence
  chemically synthesized
atttaattggtcttggacat

SEQ ID NO: 35223 - DNA, 20 bp, Artificial Sequence
  chemically synthesized
tttaattggtcttggacatt

SEQ ID NO: 35224 - DNA, 20 bp, Artificial Sequence
  chemically synthesized
tcttagaaatcctaatgtcc

SEQ ID NO: 35225 - DNA, 20 bp, Artificial Sequence
  chemically synthesized
tcttggacattaggatttct

SEQ ID NO: 35226 - DNA, 20 bp, Artificial Sequence
  chemically synthesized
tagaatcacttggagagtct

SEQ ID NO: 35227 - DNA, 20 bp, Artificial Sequence
  chemically synthesized
taggatttctaagactctcc

SEQ ID NO: 35228 - DNA, 20 bp, Artificial Sequence
  chemically synthesized
gcatattagaatcacttgga

SEQ ID NO: 35229 - DNA, 20 bp, Artificial Sequence
  chemically synthesized
ctgcatattagaatcacttg

SEQ ID NO: 35230 - DNA, 20 bp, Artificial Sequence
  chemically synthesized
cactgcatattagaatcact

SEQ ID NO: 35231 - DNA, 20 bp, Artificial Sequence
  chemically synthesized
ctccaagtgattctaatatg

SEQ ID NO: 35232 - DNA, 20 bp, Artificial Sequence
  chemically synthesized
ccttaaccttcactgcatat

SEQ ID NO: 35233 - DNA, 20 bp, Artificial Sequence
  chemically synthesized
agtgattctaatatgcagtg

SEQ ID NO: 35234 - DNA, 20 bp, Artificial Sequence
  chemically synthesized
gtgattctaatatgcagtga

SEQ ID NO: 35235 - DNA, 20 bp, Artificial Sequence
  chemically synthesized
tctaatatgcagtgaaggtt

SEQ ID NO: 35236 - DNA, 20 bp, Artificial Sequence
  chemically synthesized
ctaatatgcagtgaaggtta

SEQ ID NO: 35237 - DNA, 20 bp, Artificial Sequence
  chemically synthesized
ttgttgtcactcaaggacaa

SEQ ID NO: 35238 - DNA, 20 bp, Artificial Sequence
  chemically synthesized
ggttaaggaccattgtcctt

SEQ ID NO: 35239 - DNA, 20 bp, Artificial Sequence
  chemically synthesized
ccaatctttgttgtcactca

SEQ ID NO: 35240 - DNA, 20 bp, Artificial Sequence
  chemically synthesized
tccaatctttgttgtcactc

SEQ ID NO: 35241 - DNA, 20 bp, Artificial Sequence
  chemically synthesized
attgtccttgagtgacaaca

SEQ ID NO: 35242 - DNA, 20 bp, Artificial Sequence
  chemically synthesized
ccttgagtgacaacaaagat

SEQ ID NO: 35243 - DNA, 20 bp, Artificial Sequence
  chemically synthesized
agtgacaacaaagattggat

SEQ ID NO: 35244 - DNA, 20 bp, Artificial Sequence
  chemically synthesized
gacaacaaagattggatgag

SEQ ID NO: 35245 - DNA, 20 bp, Artificial Sequence
  chemically synthesized
ttggatgagtagcattctcc

SEQ ID NO: 35246 - DNA, 20 bp, Artificial Sequence
  chemically synthesized
atgagtagcattctccgagc

SEQ ID NO: 35247 - DNA, 20 bp, Artificial Sequence
  chemically synthesized
tgagtagcattctccgagct

SEQ ID NO: 35248 - DNA, 20 bp, Artificial Sequence
  chemically synthesized
ctcctgaaattcctagctcg

SEQ ID NO: 35249 - DNA, 20 bp, Artificial Sequence
  chemically synthesized
tcctcctgaaattcctagct

SEQ ID NO: 35250 - DNA, 20 bp, Artificial Sequence
  chemically synthesized
attctccgagctaggaattt

SEQ ID NO: 35251 - DNA, 20 bp, Artificial Sequence
  chemically synthesized
ccccctcctcctgaaattcc

SEQ ID NO: 35252 - DNA, 20 bp, Artificial Sequence
  chemically synthesized
ttctccgagctaggaatttc

SEQ ID NO: 35253 - DNA, 20 bp, Artificial Sequence
  chemically synthesized
ctccgagctaggaatttcag

SEQ ID NO: 35254 - DNA, 20 bp, Artificial Sequence
  chemically synthesized
tccgagctaggaatttcagg

SEQ ID NO: 35255 - DNA, 20 bp, Artificial Sequence
  chemically synthesized
cgagctaggaatttcaggag

SEQ ID NO: 35256 - DNA, 20 bp, Artificial Sequence
  chemically synthesized
gagctaggaatttcaggagg

SEQ ID NO: 35257 - DNA, 20 bp, Artificial Sequence
  chemically synthesized
agctaggaatttcaggagga

SEQ ID NO: 35258 - DNA, 20 bp, Artificial Sequence
  chemically synthesized
gctaggaatttcaggaggag

SEQ ID NO: 35259 - DNA, 20 bp, Artificial Sequence
  chemically synthesized
ctaggaatttcaggaggagg

SEQ ID NO: 35260 - DNA, 20 bp, Artificial Sequence
  chemically synthesized
ggaatttcaggaggaggggg

SEQ ID NO: 35261 - DNA, 20 bp, Artificial Sequence
  chemically synthesized
atttcaggaggagggggcag

SEQ ID NO: 35262 - DNA, 20 bp, Artificial Sequence
  chemically synthesized
ttcaggaggagggggcagaa

SEQ ID NO: 35263 - DNA, 20 bp, Artificial Sequence
  chemically synthesized
tcaggaggagggggcagaag

SEQ ID NO: 35264 - DNA, 20 bp, Artificial Sequence
  chemically synthesized
caggaggagggggcagaaga

SEQ ID NO: 35265 - DNA, 20 bp, Artificial Sequence
  chemically synthesized
aggagggggcagaagagggt

SEQ ID NO: 35266 - DNA, 20 bp, Artificial Sequence
  chemically synthesized
ggagggggcagaagagggtt

SEQ ID NO: 35267 - DNA, 20 bp, Artificial Sequence
  chemically synthesized
ggggcagaagagggttagga

SEQ ID NO: 35268 - DNA, 20 bp, Artificial Sequence
  chemically synthesized
ggcagaagagggttaggaaa

SEQ ID NO: 35269 - DNA, 20 bp, Artificial Sequence
  chemically synthesized
taggaaagagatgatgaatc

SEQ ID NO: 35270 - DNA, 20 bp, Artificial Sequence
  chemically synthesized
caattcattatgttcaagac

SEQ ID NO: 35271 - DNA, 20 bp, Artificial Sequence
  chemically synthesized
acctccaattcattatgttc

SEQ ID NO: 35272 - DNA, 20 bp, Artificial Sequence
  chemically synthesized
cagtcttgaacataatgaat

SEQ ID NO: 35273 - DNA, 20 bp, Artificial Sequence
  chemically synthesized
gtcttgaacataatgaattg

SEQ ID NO: 35274 - DNA, 20 bp, Artificial Sequence
  chemically synthesized
tcttgaacataatgaattgg

SEQ ID NO: 35275 - DNA, 20 bp, Artificial Sequence
  chemically synthesized
tgaacataatgaattggagg

SEQ ID NO: 35276 - DNA, 20 bp, Artificial Sequence
  chemically synthesized
aattggaggtggtgatgtaa

SEQ ID NO: 35277 - DNA, 20 bp, Artificial Sequence
  chemically synthesized
gaggtggtgatgtaaaagtg

SEQ ID NO: 35278 - DNA, 20 bp, Artificial Sequence
  chemically synthesized
aggtggtgatgtaaaagtgc

SEQ ID NO: 35279 - DNA, 20 bp, Artificial Sequence
  chemically synthesized
atgtaaaagtgcaggtatcc

SEQ ID NO: 35280 - DNA, 20 bp, Artificial Sequence
  chemically synthesized
gtaaaagtgcaggtatccaa

SEQ ID NO: 35281 - DNA, 20 bp, Artificial Sequence
  chemically synthesized
aagtgcaggtatccaagaga

SEQ ID NO: 35282 - DNA, 20 bp, Artificial Sequence
  chemically synthesized
tcagatgtccaactgtctct

SEQ ID NO: 35283 - DNA, 20 bp, Artificial Sequence
  chemically synthesized
gcaggtatccaagagacagt

SEQ ID NO: 35284 - DNA, 20 bp, Artificial Sequence
  chemically synthesized
caagagacagttggacatct

SEQ ID NO: 35285 - DNA, 20 bp, Artificial Sequence
  chemically synthesized
cagttggacatctgagtctt

SEQ ID NO: 35286 - DNA, 20 bp, Artificial Sequence
  chemically synthesized
ttccctctgagctcaagact

SEQ ID NO: 35287 - DNA, 20 bp, Artificial Sequence
  chemically synthesized
ggacatctgagtcttgagct

SEQ ID NO: 35288 - DNA, 20 bp, Artificial Sequence
  chemically synthesized
acatctgagtcttgagctca

SEQ ID NO: 35289 - DNA, 20 bp, Artificial Sequence
  chemically synthesized
gacatcttccctctgagctc

SEQ ID NO: 35290 - DNA, 20 bp, Artificial Sequence
  chemically synthesized
catctgagtcttgagctcag

SEQ ID NO: 35291 - DNA, 20 bp, Artificial Sequence
  chemically synthesized
atctgagtcttgagctcaga

SEQ ID NO: 35292 - DNA, 20 bp, Artificial Sequence
  chemically synthesized
tgagtcttgagctcagaggg

SEQ ID NO: 35293 - DNA, 20 bp, Artificial Sequence
  chemically synthesized
aattcagacatcttccctct

SEQ ID NO: 35294 - DNA, 20 bp, Artificial Sequence
  chemically synthesized
cagagggaagatgtctgaat

SEQ ID NO: 35295 - DNA, 20 bp, Artificial Sequence
  chemically synthesized
gagggaagatgtctgaattg

SEQ ID NO: 35296 - DNA, 20 bp, Artificial Sequence
  chemically synthesized
gcaaatccatagctccaatt

SEQ ID NO: 35297 - DNA, 20 bp, Artificial Sequence
  chemically synthesized
agatgtctgaattggagcta

SEQ ID NO: 35298 - DNA, 20 bp, Artificial Sequence
  chemically synthesized
aacagtacactgcaaatcca

SEQ ID NO: 35299 - DNA, 20 bp, Artificial Sequence
  chemically synthesized
gaattggagctatggatttg

SEQ ID NO: 35300 - DNA, 20 bp, Artificial Sequence
  chemically synthesized
atggatttgcagtgtactgt

SEQ ID NO: 35301 - DNA, 20 bp, Artificial Sequence
  chemically synthesized
gatttgcagtgtactgttgg

SEQ ID NO: 35302 - DNA, 20 bp, Artificial Sequence
  chemically synthesized
atttgcagtgtactgttgga

SEQ ID NO: 35303 - DNA, 20 bp, Artificial Sequence
  chemically synthesized
tttgcagtgtactgttggaa

SEQ ID NO: 35304 - DNA, 20 bp, Artificial Sequence
  chemically synthesized
cgaacccaagacccttccaa

SEQ ID NO: 35305 - DNA, 20 bp, Artificial Sequence
  chemically synthesized
gtgtactgttggaagggtct

SEQ ID NO: 35306 - DNA, 20 bp, Artificial Sequence
  chemically synthesized
tgtactgttggaagggtctt

SEQ ID NO: 35307 - DNA, 20 bp, Artificial Sequence
  chemically synthesized
agatgggctcattcgaaccc

SEQ ID NO: 35308 - DNA, 20 bp, Artificial Sequence
  chemically synthesized
gaagggtcttgggttcgaat

SEQ ID NO: 35309 - DNA, 20 bp, Artificial Sequence
  chemically synthesized
tgggttcgaatgagcccatc

SEQ ID NO: 35310 - DNA, 20 bp, Artificial Sequence
  chemically synthesized
gttcgaatgagcccatctag

SEQ ID NO: 35311 - DNA, 20 bp, Artificial Sequence
  chemically synthesized
cttcacagcctccactagat

SEQ ID NO: 35312 - DNA, 20 bp, Artificial Sequence
  chemically synthesized
tcgaatgagcccatctagtg

SEQ ID NO: 35313 - DNA, 20 bp, Artificial Sequence
  chemically synthesized
ccttcacagcctccactaga

SEQ ID NO: 35314 - DNA, 20 bp, Artificial Sequence
  chemically synthesized
cgaatgagcccatctagtgg

SEQ ID NO: 35315 - DNA, 20 bp, Artificial Sequence
  chemically synthesized
tggcccttcacagcctccac

SEQ ID NO: 35316 - DNA, 20 bp, Artificial Sequence
  chemically synthesized
cccatctagtggaggctgtg

SEQ ID NO: 35317 - DNA, 20 bp, Artificial Sequence
  chemically synthesized
ccatctagtggaggctgtga

SEQ ID NO: 35318 - DNA, 20 bp, Artificial Sequence
  chemically synthesized
catctagtggaggctgtgaa

SEQ ID NO: 35319 - DNA, 20 bp, Artificial Sequence
  chemically synthesized
tttcagctgttggcccttca

SEQ ID NO: 35320 - DNA, 20 bp, Artificial Sequence
  chemically synthesized
tggaggctgtgaagggccaa

SEQ ID NO: 35321 - DNA, 20 bp, Artificial Sequence
  chemically synthesized
aacagcctagtttcagctgt

SEQ ID NO: 35322 - DNA, 20 bp, Artificial Sequence
  chemically synthesized
gaagggccaacagctgaaac

SEQ ID NO: 35323 - DNA, 20 bp, Artificial Sequence
  chemically synthesized
aagggccaacagctgaaact

SEQ ID NO: 35324 - DNA, 20 bp, Artificial Sequence
  chemically synthesized
aggtaggaacagcctagttt

SEQ ID NO: 35325 - DNA, 20 bp, Artificial Sequence
  chemically synthesized
tgtggaaggtaggaacagcc

SEQ ID NO: 35326 - DNA, 20 bp, Artificial Sequence
  chemically synthesized
gtgtttgtggaaggtaggaa

SEQ ID NO: 35327 - DNA, 20 bp, Artificial Sequence
  chemically synthesized
aagatgtgtttgtggaaggt

SEQ ID NO: 35328 - DNA, 20 bp, Artificial Sequence
  chemically synthesized
aaagatgtgtttgtggaagg

SEQ ID NO: 35329 - DNA, 20 bp, Artificial Sequence
  chemically synthesized
gaaaaagatgtgtttgtgga

SEQ ID NO: 35330 - DNA, 20 bp, Artificial Sequence
  chemically synthesized
ggaaaaagatgtgtttgtgg

SEQ ID NO: 35331 - DNA, 20 bp, Artificial Sequence
  chemically synthesized
aaaggaaaaagatgtgtttg

SEQ ID NO: 35332 - DNA, 20 bp, Artificial Sequence
  chemically synthesized
catgcaacccagaaaggaaa

SEQ ID NO: 35333 - DNA, 20 bp, Artificial Sequence
  chemically synthesized
aaacacatctttttcctttc

SEQ ID NO: 35334 - DNA, 20 bp, Artificial Sequence
  chemically synthesized
aacacatctttttcctttct

SEQ ID NO: 35335 - DNA, 20 bp, Artificial Sequence
  chemically synthesized
aaaccacatgcaacccagaa

SEQ ID NO: 35336 - DNA, 20 bp, Artificial Sequence
  chemically synthesized
gaaaccacatgcaacccaga

SEQ ID NO: 35337 - DNA, 20 bp, Artificial Sequence
  chemically synthesized
cattgaaaccacatgcaacc

SEQ ID NO: 35338 - DNA, 20 bp, Artificial Sequence
  chemically synthesized
tttcctttctgggttgcatg

SEQ ID NO: 35339 - DNA, 20 bp, Artificial Sequence
  chemically synthesized
gttgcatgtggtttcaatgt

SEQ ID NO: 35340 - DNA, 20 bp, Artificial Sequence
  chemically synthesized
tttcaatgttggcctgatgc

SEQ ID NO: 35341 - DNA, 20 bp, Artificial Sequence
  chemically synthesized
atttttacacagctagcatc

SEQ ID NO: 35342 - DNA, 20 bp, Artificial Sequence
  chemically synthesized
catttttacacagctagcat

SEQ ID NO: 35343 - DNA, 20 bp, Artificial Sequence
  chemically synthesized
actctgcatttttacacagc

SEQ ID NO: 35344 - DNA, 20 bp, Artificial Sequence
  chemically synthesized
tgccactctgcatttttaca

SEQ ID NO: 35345 - DNA, 20 bp, Artificial Sequence
  chemically synthesized
atgctagctgtgtaaaaatg

SEQ ID NO: 35346 - DNA, 20 bp, Artificial Sequence
  chemically synthesized
gctagctgtgtaaaaatgca

SEQ ID NO: 35347 - DNA, 20 bp, Artificial Sequence
  chemically synthesized
agctgtgtaaaaatgcagag

SEQ ID NO: 35348 - DNA, 20 bp, Artificial Sequence
  chemically synthesized
tgtaaaaatgcagagtggca

SEQ ID NO: 35349 - DNA, 20 bp, Artificial Sequence
  chemically synthesized
gtaaaaatgcagagtggcat

SEQ ID NO: 35350 - DNA, 20 bp, Artificial Sequence
  chemically synthesized
aaatgcagagtggcatagga

SEQ ID NO: 35351 - DNA, 20 bp, Artificial Sequence
  chemically synthesized
aatgcagagtggcataggaa

SEQ ID NO: 35352 - DNA, 20 bp, Artificial Sequence
  chemically synthesized
gagtggcataggaaaggaca

SEQ ID NO: 35353 - DNA, 20 bp, Artificial Sequence
  chemically synthesized
gcataggaaaggacaaagac

SEQ ID NO: 35354 - DNA, 20 bp, Artificial Sequence
  chemically synthesized
cataggaaaggacaaagaca

SEQ ID NO: 35355 - DNA, 20 bp, Artificial Sequence
  chemically synthesized
gaaaggacaaagacaaggaa

SEQ ID NO: 35356 - DNA, 20 bp, Artificial Sequence
  chemically synthesized
agacaaggaatggtttgaac

SEQ ID NO: 35357 - DNA, 20 bp, Artificial Sequence
  chemically synthesized
gacaaggaatggtttgaact

SEQ ID NO: 35358 - DNA, 20 bp, Artificial Sequence
  chemically synthesized
catccctccaggcaagtacc

SEQ ID NO: 35359 - DNA, 20 bp, Artificial Sequence
  chemically synthesized
gtttgaactgggtacttgcc

SEQ ID NO: 35360 - DNA, 20 bp, Artificial Sequence
  chemically synthesized
ttgaactgggtacttgcctg

SEQ ID NO: 35361 - DNA, 20 bp, Artificial Sequence
  chemically synthesized
tgaactgggtacttgcctgg

SEQ ID NO: 35362 - DNA, 20 bp, Artificial Sequence
  chemically synthesized
gaactgggtacttgcctgga

SEQ ID NO: 35363 - DNA, 20 bp, Artificial Sequence
  chemically synthesized
tcgggaccatccctccaggc

SEQ ID NO: 35364 - DNA, 20 bp, Artificial Sequence
  chemically synthesized
tgggtacttgcctggaggga

SEQ ID NO: 35365 - DNA, 20 bp, Artificial Sequence
  chemically synthesized
tctctcgggaccatccctcc

SEQ ID NO: 35366 - DNA, 20 bp, Artificial Sequence
  chemically synthesized
gtctctcgggaccatccctc

SEQ ID NO: 35367 - DNA, 20 bp, Artificial Sequence
  chemically synthesized
ttgcctggagggatggtccc

SEQ ID NO: 35368 - DNA, 20 bp, Artificial Sequence
  chemically synthesized
gcctggagggatggtcccga

SEQ ID NO: 35369 - DNA, 20 bp, Artificial Sequence
  chemically synthesized
aggagttggtgaagtctctc

SEQ ID NO: 35370 - DNA, 20 bp, Artificial Sequence
  chemically synthesized
taggagttggtgaagtctct

SEQ ID NO: 35371 - DNA, 20 bp, Artificial Sequence
  chemically synthesized
ctgaaccctaggagttggtg

SEQ ID NO: 35372 - DNA, 20 bp, Artificial Sequence
  chemically synthesized
cgagagacttcaccaactcc

SEQ ID NO: 35373 - DNA, 20 bp, Artificial Sequence
  chemically synthesized
gagagacttcaccaactcct

SEQ ID NO: 35374 - DNA, 20 bp, Artificial Sequence
  chemically synthesized
agagacttcaccaactccta

SEQ ID NO: 35375 - DNA, 20 bp, Artificial Sequence
  chemically synthesized
agaagctgaaccctaggagt

SEQ ID NO: 35376 - DNA, 20 bp, Artificial Sequence
  chemically synthesized
agagagaagctgaaccctag

SEQ ID NO: 35377 - DNA, 20 bp, Artificial Sequence
  chemically synthesized
cttcaccaactcctagggtt

SEQ ID NO: 35378 - DNA, 20 bp, Artificial Sequence
  chemically synthesized
atagagagaagctgaaccct

SEQ ID NO: 35379 - DNA, 20 bp, Artificial Sequence
  chemically synthesized
gatagagagaagctgaaccc

SEQ ID NO: 35380 - DNA, 20 bp, Artificial Sequence
  chemically synthesized
ggcgcactatagatagagag

SEQ ID NO: 35381 - DNA, 20 bp, Artificial Sequence
  chemically synthesized
tagggcgcactatagataga

SEQ ID NO: 35382 - DNA, 20 bp, Artificial Sequence
  chemically synthesized
gttcagcttctctctatcta

SEQ ID NO: 35383 - DNA, 20 bp, Artificial Sequence
  chemically synthesized
cttagggcgcactatagata

SEQ ID NO: 35384 - DNA, 20 bp, Artificial Sequence
  chemically synthesized
aacttagggcgcactataga

SEQ ID NO: 35385 - DNA, 20 bp, Artificial Sequence
  chemically synthesized
ctaaaacttagggcgcacta

SEQ ID NO: 35386 - DNA, 20 bp, Artificial Sequence
  chemically synthesized
ctctatctatagtgcgccct

SEQ ID NO: 35387 - DNA, 20 bp, Artificial Sequence
  chemically synthesized
ctatagtgcgccctaagttt

SEQ ID NO: 35388 - DNA, 20 bp, Artificial Sequence
  chemically synthesized
gcaggttatactaaaactta

SEQ ID NO: 35389 - DNA, 20 bp, Artificial Sequence
  chemically synthesized
tgcaggttatactaaaactt

SEQ ID NO: 35390 - DNA, 20 bp, Artificial Sequence
  chemically synthesized
atgcaggttatactaaaact

SEQ ID NO: 35391 - DNA, 20 bp, Artificial Sequence
  chemically synthesized
gaatttttataaagtgatgc

SEQ ID NO: 35392 - DNA, 20 bp, Artificial Sequence
  chemically synthesized
tgaatttttataaagtgatg

SEQ ID NO: 35393 - DNA, 20 bp, Artificial Sequence
  chemically synthesized
actctaaatgaatttttata

SEQ ID NO: 35394 - DNA, 20 bp, Artificial Sequence
  chemically synthesized
tcactttataaaaattcatt

SEQ ID NO: 35395 - DNA, 20 bp, Artificial Sequence
  chemically synthesized
actttataaaaattcattta

SEQ ID NO: 35396 - DNA, 20 bp, Artificial Sequence
  chemically synthesized
ataaaaattcatttagagta

SEQ ID NO: 35397 - DNA, 20 bp, Artificial Sequence
  chemically synthesized
taaaaattcatttagagtat

SEQ ID NO: 35398 - DNA, 20 bp, Artificial Sequence
  chemically synthesized
atatgtattcgagttaattg

SEQ ID NO: 35399 - DNA, 20 bp, Artificial Sequence
  chemically synthesized
ttactatagaatatgtattc

SEQ ID NO: 35400 - DNA, 20 bp, Artificial Sequence
  chemically synthesized
taactcgaatacatattcta

SEQ ID NO: 35401 - DNA, 20 bp, Artificial Sequence
  chemically synthesized
caaatgctgacattttacta

SEQ ID NO: 35402 - DNA, 20 bp, Artificial Sequence
  chemically synthesized
catattctatagtaaaatgt

SEQ ID NO: 35403 - DNA, 20 bp, Artificial Sequence
  chemically synthesized
tatagtaaaatgtcagcatt

SEQ ID NO: 35404 - DNA, 20 bp, Artificial Sequence
  chemically synthesized
atagtaaaatgtcagcattt

SEQ ID NO: 35405 - DNA, 20 bp, Artificial Sequence
  chemically synthesized
cagcatttgggtatacaata

SEQ ID NO: 35406 - DNA, 20 bp, Artificial Sequence
  chemically synthesized
tgggtatacaataaagacat

SEQ ID NO: 35407 - DNA, 20 bp, Artificial Sequence
  chemically synthesized
gtactatgcaaagaggaata

SEQ ID NO: 35408 - DNA, 20 bp, Artificial Sequence
  chemically synthesized
attccatattcctctttgca

SEQ ID NO: 35409 - DNA, 20 bp, Artificial Sequence
  chemically synthesized
agtacttgtactatgcaaag

SEQ ID NO: 35410 - DNA, 20 bp, Artificial Sequence
  chemically synthesized
tagtacttgtactatgcaaa

SEQ ID NO: 35411 - DNA, 20 bp, Artificial Sequence
  chemically synthesized
gttagtacttgtactatgca

SEQ ID NO: 35412 - DNA, 20 bp, Artificial Sequence
  chemically synthesized
tattcctctttgcatagtac

SEQ ID NO: 35413 - DNA, 20 bp, Artificial Sequence
  chemically synthesized
tctgagtcactgttcatggt

SEQ ID NO: 35414 - DNA, 20 bp, Artificial Sequence
  chemically synthesized
gtacaagtactaaccatgaa

SEQ ID NO: 35415 - DNA, 20 bp, Artificial Sequence
  chemically synthesized
gatgtctgagtcactgttca

SEQ ID NO: 35416 - DNA, 20 bp, Artificial Sequence
  chemically synthesized
actaaccatgaacagtgact

SEQ ID NO: 35417 - DNA, 20 bp, Artificial Sequence
  chemically synthesized
aacccatttgttagatgtct

SEQ ID NO: 35418 - DNA, 20 bp, Artificial Sequence
  chemically synthesized
tgactcagacatctaacaaa

SEQ ID NO: 35419 - DNA, 20 bp, Artificial Sequence
  chemically synthesized
gactcagacatctaacaaat

SEQ ID NO: 35420 - DNA, 20 bp, Artificial Sequence
  chemically synthesized
ccatacaccaacccatttgt

SEQ ID NO: 35421 - DNA, 20 bp, Artificial Sequence
  chemically synthesized
cagacatctaacaaatgggt

SEQ ID NO: 35422 - DNA, 20 bp, Artificial Sequence
  chemically synthesized
ctaacaaatgggttggtgta

SEQ ID NO: 35423 - DNA, 20 bp, Artificial Sequence
  chemically synthesized
ggtgtatggtgaatcattgc

SEQ ID NO: 35424 - DNA, 20 bp, Artificial Sequence
  chemically synthesized
tatggtgaatcattgctggt

SEQ ID NO: 35425 - DNA, 20 bp, Artificial Sequence
  chemically synthesized
atggtgaatcattgctggtt

SEQ ID NO: 35426 - DNA, 20 bp, Artificial Sequence
  chemically synthesized
tggtgaatcattgctggtta

SEQ ID NO: 35427 - DNA, 20 bp, Artificial Sequence
  chemically synthesized
gctataatatttgccctaac

SEQ ID NO: 35428 - DNA, 20 bp, Artificial Sequence
  chemically synthesized
gctggttagggcaaatatta

SEQ ID NO: 35429 - DNA, 20 bp, Artificial Sequence
  chemically synthesized
tgttatatatatatttcaat

SEQ ID NO: 35430 - DNA, 20 bp, Artificial Sequence
  chemically synthesized
tatatatataacaatccccc

SEQ ID NO: 35431 - DNA, 20 bp, Artificial Sequence
  chemically synthesized
tggtttcagattgatctagg

SEQ ID NO: 35432 - DNA, 20 bp, Artificial Sequence
  chemically synthesized
ttggtttcagattgatctag

SEQ ID NO: 35433 - DNA, 20 bp, Artificial Sequence
  chemically synthesized
gttggtttcagattgatcta

SEQ ID NO: 35434 - DNA, 20 bp, Artificial Sequence
  chemically synthesized
tgttggtttcagattgatct

SEQ ID NO: 35435 - DNA, 20 bp, Artificial Sequence
  chemically synthesized
atgttggtttcagattgatc

SEQ ID NO: 35436 - DNA, 20 bp, Artificial Sequence
  chemically synthesized
catccagaagatgttggttt

SEQ ID NO: 35437 - DNA, 20 bp, Artificial Sequence
  chemically synthesized
ttcttacatccagaagatgt

SEQ ID NO: 35438 - DNA, 20 bp, Artificial Sequence
  chemically synthesized
aatctgaaaccaacatcttc

SEQ ID NO: 35439 - DNA, 20 bp, Artificial Sequence
  chemically synthesized
ctggatattcttacatccag

SEQ ID NO: 35440 - DNA, 20 bp, Artificial Sequence
  chemically synthesized
aaccaacatcttctggatgt

SEQ ID NO: 35441 - DNA, 20 bp, Artificial Sequence
  chemically synthesized
tggctggatattcttacatc

SEQ ID NO: 35442 - DNA, 20 bp, Artificial Sequence
  chemically synthesized
cttctggatgtaagaatatc

SEQ ID NO: 35443 - DNA, 20 bp, Artificial Sequence
  chemically synthesized
tggatgtaagaatatccagc

SEQ ID NO: 35444 - DNA, 20 bp, Artificial Sequence
  chemically synthesized
ggatgtaagaatatccagcc

SEQ ID NO: 35445 - DNA, 20 bp, Artificial Sequence
  chemically synthesized
gctggttaatgtgacctggc

SEQ ID NO: 35446 - DNA, 20 bp, Artificial Sequence
  chemically synthesized
atttgctggttaatgtgacc

SEQ ID NO: 35447 - DNA, 20 bp, Artificial Sequence
  chemically synthesized
tccagccaggtcacattaac

SEQ ID NO: 35448 - DNA, 20 bp, Artificial Sequence
  chemically synthesized
gtcacattaaccagcaaatg

SEQ ID NO: 35449 - DNA, 20 bp, Artificial Sequence
  chemically synthesized
ttagaggcctcttcatttgc

SEQ ID NO: 35450 - DNA, 20 bp, Artificial Sequence
  chemically synthesized
cacattaaccagcaaatgaa

SEQ ID NO: 35451 - DNA, 20 bp, Artificial Sequence
  chemically synthesized
acattaaccagcaaatgaag

SEQ ID NO: 35452 - DNA, 20 bp, Artificial Sequence
  chemically synthesized
cagcaaatgaagaggcctct

SEQ ID NO: 35453 - DNA, 20 bp, Artificial Sequence
  chemically synthesized
aatgaagaggcctctaagtt

SEQ ID NO: 35454 - DNA, 20 bp, Artificial Sequence
  chemically synthesized
tgctctgtgtctgaacttag

SEQ ID NO: 35455 - DNA, 20 bp, Artificial Sequence
  chemically synthesized
gtgctctgtgtctgaactta

SEQ ID NO: 35456 - DNA, 20 bp, Artificial Sequence
  chemically synthesized
aagtgctctgtgtctgaact

SEQ ID NO: 35457 - DNA, 20 bp, Artificial Sequence
  chemically synthesized
gaggcctctaagttcagaca

SEQ ID NO: 35458 - DNA, 20 bp, Artificial Sequence
  chemically synthesized
ggcctctaagttcagacaca

SEQ ID NO: 35459 - DNA, 20 bp, Artificial Sequence
  chemically synthesized
taggcttttgtgtgggtgtg

SEQ ID NO: 35460 - DNA, 20 bp, Artificial Sequence
  chemically synthesized
agcacttcacacccacacaa

SEQ ID NO: 35461 - DNA, 20 bp, Artificial Sequence
  chemically synthesized
ggaaaaataggcttttgtgt

SEQ ID NO: 35462 - DNA, 20 bp, Artificial Sequence
  chemically synthesized
tggaaaaataggcttttgtg

SEQ ID NO: 35463 - DNA, 20 bp, Artificial Sequence
  chemically synthesized
cacacaaaagcctatttttc

SEQ ID NO: 35464 - DNA, 20 bp, Artificial Sequence
  chemically synthesized
gagacagggcctggaaaaat

SEQ ID NO: 35465 - DNA, 20 bp, Artificial Sequence
  chemically synthesized
acacaaaagcctatttttcc

SEQ ID NO: 35466 - DNA, 20 bp, Artificial Sequence
  chemically synthesized
agagacagggcctggaaaaa

SEQ ID NO: 35467 - DNA, 20 bp, Artificial Sequence
  chemically synthesized
ctccctaaagagacagggcc

SEQ ID NO: 35468 - DNA, 20 bp, Artificial Sequence
  chemically synthesized
tctgcctccctaaagagaca

SEQ ID NO: 35469 - DNA, 20 bp, Artificial Sequence
  chemically synthesized
ttttccaggccctgtctctt

SEQ ID NO: 35470 - DNA, 20 bp, Artificial Sequence
  chemically synthesized
ctctgcctccctaaagagac

SEQ ID NO: 35471 - DNA, 20 bp, Artificial Sequence
  chemically synthesized
tttccaggccctgtctcttt

SEQ ID NO: 35472 - DNA, 20 bp, Artificial Sequence
  chemically synthesized
actctgcctccctaaagaga

SEQ ID NO: 35473 - DNA, 20 bp, Artificial Sequence
  chemically synthesized
ttccaggccctgtctcttta

SEQ ID NO: 35474 - DNA, 20 bp, Artificial Sequence
  chemically synthesized
ccaggccctgtctctttagg

SEQ ID NO: 35475 - DNA, 20 bp, Artificial Sequence
  chemically synthesized
caggccctgtctctttaggg

SEQ ID NO: 35476 - DNA, 20 bp, Artificial Sequence
  chemically synthesized
gcttactctgcctccctaaa

SEQ ID NO: 35477 - DNA, 20 bp, Artificial Sequence
  chemically synthesized
tggcttactctgcctcccta

SEQ ID NO: 35478 - DNA, 20 bp, Artificial Sequence
  chemically synthesized
gccctgtctctttagggagg

SEQ ID NO: 35479 - DNA, 20 bp, Artificial Sequence
  chemically synthesized
cctgtctctttagggaggca

SEQ ID NO: 35480 - DNA, 20 bp, Artificial Sequence
  chemically synthesized
tctctttagggaggcagagt

SEQ ID NO: 35481 - DNA, 20 bp, Artificial Sequence
  chemically synthesized
tttagggaggcagagtaagc

SEQ ID NO: 35482 - DNA, 20 bp, Artificial Sequence
  chemically synthesized
gaggcagagtaagccagact

SEQ ID NO: 35483 - DNA, 20 bp, Artificial Sequence
  chemically synthesized
aggcagagtaagccagactc

SEQ ID NO: 35484 - DNA, 20 bp, Artificial Sequence
  chemically synthesized
acagagaactttcctgagtc

SEQ ID NO: 35485 - DNA, 20 bp, Artificial Sequence
  chemically synthesized
agagtaagccagactcagga

SEQ ID NO: 35486 - DNA, 20 bp, Artificial Sequence
  chemically synthesized
ggctcacagagaactttcct

SEQ ID NO: 35487 - DNA, 20 bp, Artificial Sequence
  chemically synthesized
gactcaggaaagttctctgt

SEQ ID NO: 35488 - DNA, 20 bp, Artificial Sequence
  chemically synthesized
caggaaagttctctgtgagc

SEQ ID NO: 35489 - DNA, 20 bp, Artificial Sequence
  chemically synthesized
tagatggcagctggctcaca

SEQ ID NO: 35490 - DNA, 20 bp, Artificial Sequence
  chemically synthesized
tttagatggcagctggctca

SEQ ID NO: 35491 - DNA, 20 bp, Artificial Sequence
  chemically synthesized
tctctggtttagatggcagc

SEQ ID NO: 35492 - DNA, 20 bp, Artificial Sequence
  chemically synthesized
gaaatctctggtttagatgg

SEQ ID NO: 35493 - DNA, 20 bp, Artificial Sequence
  chemically synthesized
gagccagctgccatctaaac

SEQ ID NO: 35494 - DNA, 20 bp, Artificial Sequence
  chemically synthesized
ggtgaaatctctggtttaga

SEQ ID NO: 35495 - DNA, 20 bp, Artificial Sequence
  chemically synthesized
gccagctgccatctaaacca

SEQ ID NO: 35496 - DNA, 20 bp, Artificial Sequence
  chemically synthesized
gtctggtgaaatctctggtt

SEQ ID NO: 35497 - DNA, 20 bp, Artificial Sequence
  chemically synthesized
aacctgtctggtgaaatctc

SEQ ID NO: 35498 - DNA, 20 bp, Artificial Sequence
  chemically synthesized
atctaaaccagagatttcac

SEQ ID NO: 35499 - DNA, 20 bp, Artificial Sequence
  chemically synthesized
aaaccagagatttcaccaga

SEQ ID NO: 35500 - DNA, 20 bp, Artificial Sequence
  chemically synthesized
aaccagagatttcaccagac

SEQ ID NO: 35501 - DNA, 20 bp, Artificial Sequence
  chemically synthesized
gactttatctggaacctgtc

SEQ ID NO: 35502 - DNA, 20 bp, Artificial Sequence
  chemically synthesized
agatttcaccagacaggttc

SEQ ID NO: 35503 - DNA, 20 bp, Artificial Sequence
  chemically synthesized
caccagacaggttccagata

SEQ ID NO: 35504 - DNA, 20 bp, Artificial Sequence
  chemically synthesized
aagcagagctcgactttatc

SEQ ID NO: 35505 - DNA, 20 bp, Artificial Sequence
  chemically synthesized
gacaggttccagataaagtc

SEQ ID NO: 35506 - DNA, 20 bp, Artificial Sequence
  chemically synthesized
aactgtgtgagagtgaagca

SEQ ID NO: 35507 - DNA, 20 bp, Artificial Sequence
  chemically synthesized
aaaactgtgtgagagtgaag

SEQ ID NO: 35508 - DNA, 20 bp, Artificial Sequence
  chemically synthesized
aagaaaactgtgtgagagtg

SEQ ID NO: 35509 - DNA, 20 bp, Artificial Sequence
  chemically synthesized
agctctgcttcactctcaca

SEQ ID NO: 35510 - DNA, 20 bp, Artificial Sequence
  chemically synthesized
attaaaagaaaactgtgtga

SEQ ID NO: 35511 - DNA, 20 bp, Artificial Sequence
  chemically synthesized
ttattaaaagaaaactgtgt

SEQ ID NO: 35512 - DNA, 20 bp, Artificial Sequence
  chemically synthesized
tcacacagttttcttttaat

SEQ ID NO: 35513 - DNA, 20 bp, Artificial Sequence
  chemically synthesized
gctttgagaaatcttattaa

SEQ ID NO: 35514 - DNA, 20 bp, Artificial Sequence
  chemically synthesized
tcttttaataagatttctca

SEQ ID NO: 35515 - DNA, 20 bp, Artificial Sequence
  chemically synthesized
aggtggctctgtgaagcttt

SEQ ID NO: 35516 - DNA, 20 bp, Artificial Sequence
  chemically synthesized
taagatttctcaaagcttca

SEQ ID NO: 35517 - DNA, 20 bp, Artificial Sequence
  chemically synthesized
agatttctcaaagcttcaca

SEQ ID NO: 35518 - DNA, 20 bp, Artificial Sequence
  chemically synthesized
ttgatataggtggctctgtg

SEQ ID NO: 35519 - DNA, 20 bp, Artificial Sequence
  chemically synthesized
gatgttcggcttgatatagg

SEQ ID NO: 35520 - DNA, 20 bp, Artificial Sequence
  chemically synthesized
ttcacagagccacctatatc

SEQ ID NO: 35521 - DNA, 20 bp, Artificial Sequence
  chemically synthesized
ttagatgttcggcttgatat

SEQ ID NO: 35522 - DNA, 20 bp, Artificial Sequence
  chemically synthesized
tttagatgttcggcttgata

SEQ ID NO: 35523 - DNA, 20 bp, Artificial Sequence
  chemically synthesized
ttcacatctttttagatgtt

SEQ ID NO: 35524 - DNA, 20 bp, Artificial Sequence
  chemically synthesized
tatcaagccgaacatctaaa

SEQ ID NO: 35525 - DNA, 20 bp, Artificial Sequence
  chemically synthesized
tgctaaaattcacatctttt

SEQ ID NO: 35526 - DNA, 20 bp, Artificial Sequence
  chemically synthesized
atctaaaaagatgtgaattt

SEQ ID NO: 35527 - DNA, 20 bp, Artificial Sequence
  chemically synthesized
agtatggctttattttagtg

SEQ ID NO: 35528 - DNA, 20 bp, Artificial Sequence
  chemically synthesized
ttagcatcttcactaaaata

SEQ ID NO: 35529 - DNA, 20 bp, Artificial Sequence
  chemically synthesized
aatgaagtatggctttattt

SEQ ID NO: 35530 - DNA, 20 bp, Artificial Sequence
  chemically synthesized
cctgtgaggttaatgaagta

SEQ ID NO: 35531 - DNA, 20 bp, Artificial Sequence
  chemically synthesized
gtcggcctgtgaggttaatg

SEQ ID NO: 35532 - DNA, 20 bp, Artificial Sequence
  chemically synthesized
gccatacttcattaacctca

SEQ ID NO: 35533 - DNA, 20 bp, Artificial Sequence
  chemically synthesized
ccatacttcattaacctcac

SEQ ID NO: 35534 - DNA, 20 bp, Artificial Sequence
  chemically synthesized
gaagcaaccgtcggcctgtg

SEQ ID NO: 35535 - DNA, 20 bp, Artificial Sequence
  chemically synthesized
tgaagcaaccgtcggcctgt

SEQ ID NO: 35536 - DNA, 20 bp, Artificial Sequence
  chemically synthesized
tcattaacctcacaggccga

SEQ ID NO: 35537 - DNA, 20 bp, Artificial Sequence
  chemically synthesized
ctttcccatgaagcaaccgt

SEQ ID NO: 35538 - DNA, 20 bp, Artificial Sequence
  chemically synthesized
acaggccgacggttgcttca

SEQ ID NO: 35539 - DNA, 20 bp, Artificial Sequence
  chemically synthesized
caggccgacggttgcttcat

SEQ ID NO: 35540 - DNA, 20 bp, Artificial Sequence
  chemically synthesized
ccgacggttgcttcatggga

SEQ ID NO: 35541 - DNA, 20 bp, Artificial Sequence
  chemically synthesized
actccaaattctttcccatg

SEQ ID NO: 35542 - DNA, 20 bp, Artificial Sequence
  chemically synthesized
ttgcttcatgggaaagaatt

SEQ ID NO: 35543 - DNA, 20 bp, Artificial Sequence
  chemically synthesized
gcttcatgggaaagaatttg

SEQ ID NO: 35544 - DNA, 20 bp, Artificial Sequence
  chemically synthesized
aaagaatttggagtacctat

SEQ ID NO: 35545 - DNA, 20 bp, Artificial Sequence
  chemically synthesized
gctatagctggcaggctaat

SEQ ID NO: 35546 - DNA, 20 bp, Artificial Sequence
  chemically synthesized
cgctatagctggcaggctaa

SEQ ID NO: 35547 - DNA, 20 bp, Artificial Sequence
  chemically synthesized
tggagtacctattagcctgc

SEQ ID NO: 35548 - DNA, 20 bp, Artificial Sequence
  chemically synthesized
gggttatcgctatagctggc

SEQ ID NO: 35549 - DNA, 20 bp, Artificial Sequence
  chemically synthesized
acctattagcctgccagcta

SEQ ID NO: 35550 - DNA, 20 bp, Artificial Sequence
  chemically synthesized
tgggttatcgctatagctgg

SEQ ID NO: 35551 - DNA, 20 bp, Artificial Sequence
  chemically synthesized
acatgggttatcgctatagc

SEQ ID NO: 35552 - DNA, 20 bp, Artificial Sequence
  chemically synthesized
atatacatgggttatcgcta

SEQ ID NO: 35553 - DNA, 20 bp, Artificial Sequence
  chemically synthesized
gtggtgtgggtcatatacat

SEQ ID NO: 35554 - DNA, 20 bp, Artificial Sequence
  chemically synthesized
ggtggtgtgggtcatataca

SEQ ID NO: 35555 - DNA, 20 bp, Artificial Sequence
  chemically synthesized
tttttagcaggaggtggtgt

SEQ ID NO: 35556 - DNA, 20 bp, Artificial Sequence
  chemically synthesized
atttttagcaggaggtggtg

SEQ ID NO: 35557 - DNA, 20 bp, Artificial Sequence
  chemically synthesized
gatccatttttagcaggagg

SEQ ID NO: 35558 - DNA, 20 bp, Artificial Sequence
  chemically synthesized
agtgatccatttttagcagg

SEQ ID NO: 35559 - DNA, 20 bp, Artificial Sequence
  chemically synthesized
cagtgatccatttttagcag

SEQ ID NO: 35560 - DNA, 20 bp, Artificial Sequence
  chemically synthesized
accagtgatccatttttagc

SEQ ID NO: 35561 - DNA, 20 bp, Artificial Sequence
  chemically synthesized
acaccacctcctgctaaaaa

SEQ ID NO: 35562 - DNA, 20 bp, Artificial Sequence
  chemically synthesized
aaccagtgatccatttttag

SEQ ID NO: 35563 - DNA, 20 bp, Artificial Sequence
  chemically synthesized
attaaccagtgatccatttt

SEQ ID NO: 35564 - DNA, 20 bp, Artificial Sequence
  chemically synthesized
tcctgctaaaaatggatcac

SEQ ID NO: 35565 - DNA, 20 bp, Artificial Sequence
  chemically synthesized
aaatggatcactggttaatg

SEQ ID NO: 35566 - DNA, 20 bp, Artificial Sequence
  chemically synthesized
tatacttgaaccacattaac

SEQ ID NO: 35567 - DNA, 20 bp, Artificial Sequence
  chemically synthesized
atcactggttaatgtggttc

SEQ ID NO: 35568 - DNA, 20 bp, Artificial Sequence
  chemically synthesized
ggttcaagtatatctgacta

SEQ ID NO: 35569 - DNA, 20 bp, Artificial Sequence
  chemically synthesized
tagaccaggaatgctgtagt

SEQ ID NO: 35570 - DNA, 20 bp, Artificial Sequence
  chemically synthesized
aaggtagaccaggaatgctg

SEQ ID NO: 35571 - DNA, 20 bp, Artificial Sequence
  chemically synthesized
atatctgactacagcattcc

SEQ ID NO: 35572 - DNA, 20 bp, Artificial Sequence
  chemically synthesized
ttgagctgttaaggtagacc

SEQ ID NO: 35573 - DNA, 20 bp, Artificial Sequence
  chemically synthesized
tttgagctgttaaggtagac

SEQ ID NO: 35574 - DNA, 20 bp, Artificial Sequence
  chemically synthesized
gcattcctggtctaccttaa

SEQ ID NO: 35575 - DNA, 20 bp, Artificial Sequence
  chemically synthesized
acaagtttgagctgttaagg

SEQ ID NO: 35576 - DNA, 20 bp, Artificial Sequence
  chemically synthesized
gttacaagtttgagctgtta

SEQ ID NO: 35577 - DNA, 20 bp, Artificial Sequence
  chemically synthesized
agttacaagtttgagctgtt

SEQ ID NO: 35578 - DNA, 20 bp, Artificial Sequence
  chemically synthesized
agacaaatagttacaagttt

SEQ ID NO: 35579 - DNA, 20 bp, Artificial Sequence
  chemically synthesized
aaaggcagacaaatagttac

SEQ ID NO: 35580 - DNA, 20 bp, Artificial Sequence
  chemically synthesized
ggtggggaaaggcagacaaa

SEQ ID NO: 35581 - DNA, 20 bp, Artificial Sequence
  chemically synthesized
gcacaatcggtggggaaagg

SEQ ID NO: 35582 - DNA, 20 bp, Artificial Sequence
  chemically synthesized
ttggcacaatcggtggggaa

SEQ ID NO: 35583 - DNA, 20 bp, Artificial Sequence
  chemically synthesized
tttggcacaatcggtgggga

SEQ ID NO: 35584 - DNA, 20 bp, Artificial Sequence
  chemically synthesized
cttatttggcacaatcggtg

SEQ ID NO: 35585 - DNA, 20 bp, Artificial Sequence
  chemically synthesized
gcttatttggcacaatcggt

SEQ ID NO: 35586 - DNA, 20 bp, Artificial Sequence
  chemically synthesized
cgcttatttggcacaatcgg

SEQ ID NO: 35587 - DNA, 20 bp, Artificial Sequence
  chemically synthesized
ttccgcttatttggcacaat

SEQ ID NO: 35588 - DNA, 20 bp, Artificial Sequence
  chemically synthesized
ccccaccgattgtgccaaat

SEQ ID NO: 35589 - DNA, 20 bp, Artificial Sequence
  chemically synthesized
caccgattgtgccaaataag

SEQ ID NO: 35590 - DNA, 20 bp, Artificial Sequence
  chemically synthesized
gttttgaaattccgcttatt

SEQ ID NO: 35591 - DNA, 20 bp, Artificial Sequence
  chemically synthesized
aataagcggaatttcaaaac

SEQ ID NO: 35592 - DNA, 20 bp, Artificial Sequence
  chemically synthesized
ataagcggaatttcaaaact

SEQ ID NO: 35593 - DNA, 20 bp, Artificial Sequence
  chemically synthesized
agcggaatttcaaaactggg

SEQ ID NO: 35594 - DNA, 20 bp, Artificial Sequence
  chemically synthesized
agagtgtaagaatttctgcc

SEQ ID NO: 35595 - DNA, 20 bp, Artificial Sequence
  chemically synthesized
agagagattatgcagagtgt

SEQ ID NO: 35596 - DNA, 20 bp, Artificial Sequence
  chemically synthesized
agaggaagagagattatgca

SEQ ID NO: 35597 - DNA, 20 bp, Artificial Sequence
  chemically synthesized
gaagaggaagagagattatg

SEQ ID NO: 35598 - DNA, 20 bp, Artificial Sequence
  chemically synthesized
tttgtagctgaagaggaaga

SEQ ID NO: 35599 - DNA, 20 bp, Artificial Sequence
  chemically synthesized
tatttgtagctgaagaggaa

SEQ ID NO: 35600 - DNA, 20 bp, Artificial Sequence
  chemically synthesized
gcataatctctcttcctctt

SEQ ID NO: 35601 - DNA, 20 bp, Artificial Sequence
  chemically synthesized
cttatttgtagctgaagagg

SEQ ID NO: 35602 - DNA, 20 bp, Artificial Sequence
  chemically synthesized
agccttatttgtagctgaag

SEQ ID NO: 35603 - DNA, 20 bp, Artificial Sequence
  chemically synthesized
aagccttatttgtagctgaa

SEQ ID NO: 35604 - DNA, 20 bp, Artificial Sequence
  chemically synthesized
caaagccttatttgtagctg

SEQ ID NO: 35605 - DNA, 20 bp, Artificial Sequence
  chemically synthesized
cttcctcttcagctacaaat

SEQ ID NO: 35606 - DNA, 20 bp, Artificial Sequence
  chemically synthesized
ttcctcttcagctacaaata

SEQ ID NO: 35607 - DNA, 20 bp, Artificial Sequence
  chemically synthesized
cgaatacaaagccttatttg

SEQ ID NO: 35608 - DNA, 20 bp, Artificial Sequence
  chemically synthesized
tgtgagtctaatcgaataca

SEQ ID NO: 35609 - DNA, 20 bp, Artificial Sequence
  chemically synthesized
aataaggctttgtattcgat

SEQ ID NO: 35610 - DNA, 20 bp, Artificial Sequence
  chemically synthesized
tttgtattcgattagactca

SEQ ID NO: 35611 - DNA, 20 bp, Artificial Sequence
  chemically synthesized
gtattcgattagactcacag

SEQ ID NO: 35612 - DNA, 20 bp, Artificial Sequence
  chemically synthesized
tattcgattagactcacagc

SEQ ID NO: 35613 - DNA, 20 bp, Artificial Sequence
  chemically synthesized
ttggggttttcacctgctgt

SEQ ID NO: 35614 - DNA, 20 bp, Artificial Sequence
  chemically synthesized
cagcaggtgaaaaccccaat

SEQ ID NO: 35615 - DNA, 20 bp, Artificial Sequence
  chemically synthesized
cagaatgaattcactaattg

SEQ ID NO: 35616 - DNA, 20 bp, Artificial Sequence
  chemically synthesized
tcagaatgaattcactaatt

SEQ ID NO: 35617 - DNA, 20 bp, Artificial Sequence
  chemically synthesized
ctcagaatgaattcactaat

SEQ ID NO: 35618 - DNA, 20 bp, Artificial Sequence
  chemically synthesized
ccaattagtgaattcattct

SEQ ID NO: 35619 - DNA, 20 bp, Artificial Sequence
  chemically synthesized
caattagtgaattcattctg

SEQ ID NO: 35620 - DNA, 20 bp, Artificial Sequence
  chemically synthesized
tgggaggaaggtagaggcct

SEQ ID NO: 35621 - DNA, 20 bp, Artificial Sequence
  chemically synthesized
gttgtgtgggaggaaggtag

SEQ ID NO: 35622 - DNA, 20 bp, Artificial Sequence
  chemically synthesized
tgttgtgtgggaggaaggta

SEQ ID NO: 35623 - DNA, 20 bp, Artificial Sequence
  chemically synthesized
tgtgttgtgtgggaggaagg

SEQ ID NO: 35624 - DNA, 20 bp, Artificial Sequence
  chemically synthesized
aaatgtgttgtgtgggagga

SEQ ID NO: 35625 - DNA, 20 bp, Artificial Sequence
  chemically synthesized
aaaatgtgttgtgtgggagg

SEQ ID NO: 35626 - DNA, 20 bp, Artificial Sequence
  chemically synthesized
acaaaaatgtgttgtgtggg

SEQ ID NO: 35627 - DNA, 20 bp, Artificial Sequence
  chemically synthesized
tacaaaaatgtgttgtgtgg

SEQ ID NO: 35628 - DNA, 20 bp, Artificial Sequence
  chemically synthesized
tttacaaaaatgtgttgtgt

SEQ ID NO: 35629 - DNA, 20 bp, Artificial Sequence
  chemically synthesized
ttttacaaaaatgtgttgtg

SEQ ID NO: 35630 - DNA, 20 bp, Artificial Sequence
  chemically synthesized
acacatttttgtaaaaaaat

SEQ ID NO: 35631 - DNA, 20 bp, Artificial Sequence
  chemically synthesized
cacatttttgtaaaaaaatc

SEQ ID NO: 35632 - DNA, 20 bp, Artificial Sequence
  chemically synthesized
acatttttgtaaaaaaatca

SEQ ID NO: 35633 - DNA, 20 bp, Artificial Sequence
  chemically synthesized
tttttgtaaaaaaatcaggg

SEQ ID NO: 35634 - DNA, 20 bp, Artificial Sequence
  chemically synthesized
ttctgatttgagaagagacg

SEQ ID NO: 35635 - DNA, 20 bp, Artificial Sequence
  chemically synthesized
atttacttctgatttgagaa

SEQ ID NO: 35636 - DNA, 20 bp, Artificial Sequence
  chemically synthesized
gtctgcgtctcttctcaaat

SEQ ID NO: 35637 - DNA, 20 bp, Artificial Sequence
  chemically synthesized
taatttacttctgatttgag

SEQ ID NO: 35638 - DNA, 20 bp, Artificial Sequence
  chemically synthesized
tgcgtctcttctcaaatcag

SEQ ID NO: 35639 - DNA, 20 bp, Artificial Sequence
  chemically synthesized
ggttaatttacttctgattt

SEQ ID NO: 35640 - DNA, 20 bp, Artificial Sequence
  chemically synthesized
gtttgcttgggtagatcaaa

SEQ ID NO: 35641 - DNA, 20 bp, Artificial Sequence
  chemically synthesized
agtttgcttgggtagatcaa

SEQ ID NO: 35642 - DNA, 20 bp, Artificial Sequence
  chemically synthesized
tagtttgcttgggtagatca

SEQ ID NO: 35643 - DNA, 20 bp, Artificial Sequence
  chemically synthesized
attaaccctttgatctaccc

SEQ ID NO: 35644 - DNA, 20 bp, Artificial Sequence
  chemically synthesized
cagtaaatagtttgcttggg

SEQ ID NO: 35645 - DNA, 20 bp, Artificial Sequence
  chemically synthesized
atgcagtaaatagtttgctt

SEQ ID NO: 35646 - DNA, 20 bp, Artificial Sequence
  chemically synthesized
catgcagtaaatagtttgct

SEQ ID NO: 35647 - DNA, 20 bp, Artificial Sequence
  chemically synthesized
aaaagtcttcatgcagtaaa

SEQ ID NO: 35648 - DNA, 20 bp, Artificial Sequence
  chemically synthesized
agcaaactatttactgcatg

SEQ ID NO: 35649 - DNA, 20 bp, Artificial Sequence
  chemically synthesized
tgcagtgaaaagtcttcatg

SEQ ID NO: 35650 - DNA, 20 bp, Artificial Sequence
  chemically synthesized
tcctcccattttgcagtgaa

SEQ ID NO: 35651 - DNA, 20 bp, Artificial Sequence
  chemically synthesized
gaagacttttcactgcaaaa

SEQ ID NO: 35652 - DNA, 20 bp, Artificial Sequence
  chemically synthesized
aagacttttcactgcaaaat

SEQ ID NO: 35653 - DNA, 20 bp, Artificial Sequence
  chemically synthesized
ttcaacatcctcccattttg

SEQ ID NO: 35654 - DNA, 20 bp, Artificial Sequence
  chemically synthesized
gacttttcactgcaaaatgg

SEQ ID NO: 35655 - DNA, 20 bp, Artificial Sequence
  chemically synthesized
acttttcactgcaaaatggg

SEQ ID NO: 35656 - DNA, 20 bp, Artificial Sequence
  chemically synthesized
gcaaaatgggaggatgttga

SEQ ID NO: 35657 - DNA, 20 bp, Artificial Sequence
  chemically synthesized
cccttatggagtcaagaagg

SEQ ID NO: 35658 - DNA, 20 bp, Artificial Sequence
  chemically synthesized
tcccttatggagtcaagaag

SEQ ID NO: 35659 - DNA, 20 bp, Artificial Sequence
  chemically synthesized
cctcccttatggagtcaaga

SEQ ID NO: 35660 - DNA, 20 bp, Artificial Sequence
  chemically synthesized
acctcccttatggagtcaag

SEQ ID NO: 35661 - DNA, 20 bp, Artificial Sequence
  chemically synthesized
gtaacctcccttatggagtc

SEQ ID NO: 35662 - DNA, 20 bp, Artificial Sequence
  chemically synthesized
ttcctccttcttgactccat

SEQ ID NO: 35663 - DNA, 20 bp, Artificial Sequence
  chemically synthesized
tcctccttcttgactccata

SEQ ID NO: 35664 - DNA, 20 bp, Artificial Sequence
  chemically synthesized
cctccttcttgactccataa

SEQ ID NO: 35665 - DNA, 20 bp, Artificial Sequence
  chemically synthesized
tccttcttgactccataagg

SEQ ID NO: 35666 - DNA, 20 bp, Artificial Sequence
  chemically synthesized
tttctgtaacctcccttatg

SEQ ID NO: 35667 - DNA, 20 bp, Artificial Sequence
  chemically synthesized
ccttcttgactccataaggg

SEQ ID NO: 35668 - DNA, 20 bp, Artificial Sequence
  chemically synthesized
attttctgtaacctccctta

SEQ ID NO: 35669 - DNA, 20 bp, Artificial Sequence
  chemically synthesized
tgactccataagggaggtta

SEQ ID NO: 35670 - DNA, 20 bp, Artificial Sequence
  chemically synthesized
tacagaaaattctattttat

SEQ ID NO: 35671 - DNA, 20 bp, Artificial Sequence
  chemically synthesized
aacaataaagtctgataaaa

SEQ ID NO: 35672 - DNA, 20 bp, Artificial Sequence
  chemically synthesized
tggatttgaagaaaacaata

SEQ ID NO: 35673 - DNA, 20 bp, Artificial Sequence
  chemically synthesized
tgtgagtatttatggatttg

SEQ ID NO: 35674 - DNA, 20 bp, Artificial Sequence
  chemically synthesized
tcagaaaatgtgagtattta

SEQ ID NO: 35675 - DNA, 20 bp, Artificial Sequence
  chemically synthesized
ctagattgatcagaaaatgt

SEQ ID NO: 35676 - DNA, 20 bp, Artificial Sequence
  chemically synthesized
ctcacattttctgatcaatc

SEQ ID NO: 35677 - DNA, 20 bp, Artificial Sequence
  chemically synthesized
actgtaatttctagattgat

SEQ ID NO: 35678 - DNA, 20 bp, Artificial Sequence
  chemically synthesized
tctgatcaatctagaaatta

SEQ ID NO: 35679 - DNA, 20 bp, Artificial Sequence
  chemically synthesized
gaaagaaaaactgtaatttc

SEQ ID NO: 35680 - DNA, 20 bp, Artificial Sequence
  chemically synthesized
cattgtgagtgtcaggtaga

SEQ ID NO: 35681 - DNA, 20 bp, Artificial Sequence
  chemically synthesized
ttagcattgtgagtgtcagg

SEQ ID NO: 35682 - DNA, 20 bp, Artificial Sequence
  chemically synthesized
atattagcattgtgagtgtc

SEQ ID NO: 35683 - DNA, 20 bp, Artificial Sequence
  chemically synthesized
aatattagcattgtgagtgt

SEQ ID NO: 35684 - DNA, 20 bp, Artificial Sequence
  chemically synthesized
ttagataatattagcattgt

SEQ ID NO: 35685 - DNA, 20 bp, Artificial Sequence
  chemically synthesized
aatcttttgttagataatat

SEQ ID NO: 35686 - DNA, 20 bp, Artificial Sequence
  chemically synthesized
atgctaatattatctaacaa

SEQ ID NO: 35687 - DNA, 20 bp, Artificial Sequence
  chemically synthesized
actgtccattaatcttttgt

SEQ ID NO: 35688 - DNA, 20 bp, Artificial Sequence
  chemically synthesized
attatctaacaaaagattaa

SEQ ID NO: 35689 - DNA, 20 bp, Artificial Sequence
  chemically synthesized
tctaacaaaagattaatgga

SEQ ID NO: 35690 - DNA, 20 bp, Artificial Sequence
  chemically synthesized
attaatggacagtctactac

SEQ ID NO: 35691 - DNA, 20 bp, Artificial Sequence
  chemically synthesized
taatggacagtctactacaa

SEQ ID NO: 35692 - DNA, 20 bp, Artificial Sequence
  chemically synthesized
aaattaattctctcttgtag

SEQ ID NO: 35693 - DNA, 20 bp, Artificial Sequence
  chemically synthesized
atggacagtctactacaaga

SEQ ID NO: 35694 - DNA, 20 bp, Artificial Sequence
  chemically synthesized
taaaaattaattctctcttg

SEQ ID NO: 35695 - DNA, 20 bp, Artificial Sequence
  chemically synthesized
tacaagagagaattaatttt

SEQ ID NO: 35696 - DNA, 20 bp, Artificial Sequence
  chemically synthesized
ttttagttatgttcttattt

SEQ ID NO: 35697 - DNA, 20 bp, Artificial Sequence
  chemically synthesized
cacctcaaatacaccaaaat

SEQ ID NO: 35698 - DNA, 20 bp, Artificial Sequence
  chemically synthesized
gttcttattttggtgtattt

SEQ ID NO: 35699 - DNA, 20 bp, Artificial Sequence
  chemically synthesized
ttcttattttggtgtatttg

SEQ ID NO: 35700 - DNA, 20 bp, Artificial Sequence
  chemically synthesized
tattttggtgtatttgaggt

SEQ ID NO: 35701 - DNA, 20 bp, Artificial Sequence
  chemically synthesized
tgagaaaaaaaattaaattt

SEQ ID NO: 35702 - DNA, 20 bp, Artificial Sequence
  chemically synthesized
aaattaaattttagtttaaa

SEQ ID NO: 35703 - DNA, 20 bp, Artificial Sequence
  chemically synthesized
ttagtttaaacagtatgctt

SEQ ID NO: 35704 - DNA, 20 bp, Artificial Sequence
  chemically synthesized
taaacagtatgctttggcct

SEQ ID NO: 35705 - DNA, 20 bp, Artificial Sequence
  chemically synthesized
aaacagtatgctttggcctt

SEQ ID NO: 35706 - DNA, 20 bp, Artificial Sequence
  chemically synthesized
ctgtgcctttcctaaggcca

SEQ ID NO: 35707 - DNA, 20 bp, Artificial Sequence
  chemically synthesized
agtatgctttggccttagga

SEQ ID NO: 35708 - DNA, 20 bp, Artificial Sequence
  chemically synthesized
gtatgctttggccttaggaa

SEQ ID NO: 35709 - DNA, 20 bp, Artificial Sequence
  chemically synthesized
tagactctgtgcctttccta

SEQ ID NO: 35710 - DNA, 20 bp, Artificial Sequence
  chemically synthesized
atagactctgtgcctttcct

SEQ ID NO: 35711 - DNA, 20 bp, Artificial Sequence
  chemically synthesized
ctttggccttaggaaaggca

SEQ ID NO: 35712 - DNA, 20 bp, Artificial Sequence
  chemically synthesized
ttggccttaggaaaggcaca

SEQ ID NO: 35713 - DNA, 20 bp, Artificial Sequence
  chemically synthesized
tatttacaaagtatgaaata

SEQ ID NO: 35714 - DNA, 20 bp, Artificial Sequence
  chemically synthesized
ttgacaaataaatatttaca

SEQ ID NO: 35715 - DNA, 20 bp, Artificial Sequence
  chemically synthesized
ttgtaaatatttatttgtca

SEQ ID NO: 35716 - DNA, 20 bp, Artificial Sequence
  chemically synthesized
tgtcaaagaaaattcatcat

SEQ ID NO: 35717 - DNA, 20 bp, Artificial Sequence
  chemically synthesized
aagaaaattcatcattggac

SEQ ID NO: 35718 - DNA, 20 bp, Artificial Sequence
  chemically synthesized
agaaaattcatcattggaca

SEQ ID NO: 35719 - DNA, 20 bp, Artificial Sequence
  chemically synthesized
aattcatcattggacaagga

SEQ ID NO: 35720 - DNA, 20 bp, Artificial Sequence
  chemically synthesized
attggacaaggatagatgtt

SEQ ID NO: 35721 - DNA, 20 bp, Artificial Sequence
  chemically synthesized
aacattaaaaaaaatcaacg

SEQ ID NO: 35722 - DNA, 20 bp, Artificial Sequence
  chemically synthesized
aaaaaaaatcaacgcagctt

SEQ ID NO: 35723 - DNA, 20 bp, Artificial Sequence
  chemically synthesized
atcaacgcagctttagttct

SEQ ID NO: 35724 - DNA, 20 bp, Artificial Sequence
  chemically synthesized
gtaaatcactctaagaacta

SEQ ID NO: 35725 - DNA, 20 bp, Artificial Sequence
  chemically synthesized
caacgcagctttagttctta

SEQ ID NO: 35726 - DNA, 20 bp, Artificial Sequence
  chemically synthesized
aagtatgagtaaatcactct

SEQ ID NO: 35727 - DNA, 20 bp, Artificial Sequence
  chemically synthesized
agaagcaattgacaaagtat

SEQ ID NO: 35728 - DNA, 20 bp, Artificial Sequence
  chemically synthesized
ttccagagaagcaattgaca

SEQ ID NO: 35729 - DNA, 20 bp, Artificial Sequence
  chemically synthesized
tactttgtcaattgcttctc

SEQ ID NO: 35730 - DNA, 20 bp, Artificial Sequence
  chemically synthesized
gttgtgaattgtttccagag

SEQ ID NO: 35731 - DNA, 20 bp, Artificial Sequence
  chemically synthesized
taggttgtgaattgtttcca

SEQ ID NO: 35732 - DNA, 20 bp, Artificial Sequence
  chemically synthesized
actaggttgtgaattgtttc

SEQ ID NO: 35733 - DNA, 20 bp, Artificial Sequence
  chemically synthesized
tctggaaacaattcacaacc

SEQ ID NO: 35734 - DNA, 20 bp, Artificial Sequence
  chemically synthesized
atatgttcataaataaaact

SEQ ID NO: 35735 - DNA, 20 bp, Artificial Sequence
  chemically synthesized
catatgttcataaataaaac

SEQ ID NO: 35736 - DNA, 20 bp, Artificial Sequence
  chemically synthesized
atgaacatatgattaaaaaa

SEQ ID NO: 35737 - DNA, 20 bp, Artificial Sequence
  chemically synthesized
aacatatgattaaaaaacag

SEQ ID NO: 35738 - DNA, 20 bp, Artificial Sequence
  chemically synthesized
taaaacaattaaaaaagaca

SEQ ID NO: 35739 - DNA, 20 bp, Artificial Sequence
  chemically synthesized
caggactaaaacaattaaaa

SEQ ID NO: 35740 - DNA, 20 bp, Artificial Sequence
  chemically synthesized
tttgtcttttttaattgttt

SEQ ID NO: 35741 - DNA, 20 bp, Artificial Sequence
  chemically synthesized
cttgtttcaagaaaagtgac

SEQ ID NO: 35742 - DNA, 20 bp, Artificial Sequence
  chemically synthesized
acttgtttcaagaaaagtga

SEQ ID NO: 35743 - DNA, 20 bp, Artificial Sequence
  chemically synthesized
cctacgacttgtttcaagaa

SEQ ID NO: 35744 - DNA, 20 bp, Artificial Sequence
  chemically synthesized
cctgtcacttttcttgaaac

SEQ ID NO: 35745 - DNA, 20 bp, Artificial Sequence
  chemically synthesized
taagtcctacgacttgtttc

SEQ ID NO: 35746 - DNA, 20 bp, Artificial Sequence
  chemically synthesized
acttttcttgaaacaagtcg

SEQ ID NO: 35747 - DNA, 20 bp, Artificial Sequence
  chemically synthesized
cttttcttgaaacaagtcgt

SEQ ID NO: 35748 - DNA, 20 bp, Artificial Sequence
  chemically synthesized
aagtcgtaggacttacccac

SEQ ID NO: 35749 - DNA, 20 bp, Artificial Sequence
  chemically synthesized
ctcagtattttcttgtgggt

SEQ ID NO: 35750 - DNA, 20 bp, Artificial Sequence
  chemically synthesized
tatgctcagtattttcttgt

SEQ ID NO: 35751 - DNA, 20 bp, Artificial Sequence
  chemically synthesized
atatgctcagtattttcttg

SEQ ID NO: 35752 - DNA, 20 bp, Artificial Sequence
  chemically synthesized
cttacccacaagaaaatact

SEQ ID NO: 35753 - DNA, 20 bp, Artificial Sequence
  chemically synthesized
attactacttgatatatgct

SEQ ID NO: 35754 - DNA, 20 bp, Artificial Sequence
  chemically synthesized
gaaaatactgagcatatatc

SEQ ID NO: 35755 - DNA, 20 bp, Artificial Sequence
  chemically synthesized
aatactgagcatatatcaag

SEQ ID NO: 35756 - DNA, 20 bp, Artificial Sequence
  chemically synthesized
gcatatatcaagtagtaatg

SEQ ID NO: 35757 - DNA, 20 bp, Artificial Sequence
  chemically synthesized
tcaagtagtaatgcagcttt

SEQ ID NO: 35758 - DNA, 20 bp, Artificial Sequence
  chemically synthesized
agtagtaatgcagcttttag

SEQ ID NO: 35759 - DNA, 20 bp, Artificial Sequence
  chemically synthesized
agtaatgcagcttttagaag

SEQ ID NO: 35760 - DNA, 20 bp, Artificial Sequence
  chemically synthesized
taacagatgactacttctaa

SEQ ID NO: 35761 - DNA, 20 bp, Artificial Sequence
  chemically synthesized
aagtagtcatctgttactgt

SEQ ID NO: 35762 - DNA, 20 bp, Artificial Sequence
  chemically synthesized
aaatgaacctctgacagtaa

SEQ ID NO: 35763 - DNA, 20 bp, Artificial Sequence
  chemically synthesized
gtagtcatctgttactgtca

SEQ ID NO: 35764 - DNA, 20 bp, Artificial Sequence
  chemically synthesized
tagtcatctgttactgtcag

SEQ ID NO: 35765 - DNA, 20 bp, Artificial Sequence
  chemically synthesized
aaaatgaaatgaacctctga

SEQ ID NO: 35766 - DNA, 20 bp, Artificial Sequence
  chemically synthesized
tcagaggttcatttcatttt

SEQ ID NO: 35767 - DNA, 20 bp, Artificial Sequence
  chemically synthesized
aactttgcattttaattaaa

SEQ ID NO: 35768 - DNA, 20 bp, Artificial Sequence
  chemically synthesized
gtctttttaattaaaatgca

SEQ ID NO: 35769 - DNA, 20 bp, Artificial Sequence
  chemically synthesized
aatttaggcaggcatgtatg

SEQ ID NO: 35770 - DNA, 20 bp, Artificial Sequence
  chemically synthesized
cagaaaggggtaatttaggc

SEQ ID NO: 35771 - DNA, 20 bp, Artificial Sequence
  chemically synthesized
tcagaaaggggtaatttagg

SEQ ID NO: 35772 - DNA, 20 bp, Artificial Sequence
  chemically synthesized
atttcagaaaggggtaattt

SEQ ID NO: 35773 - DNA, 20 bp, Artificial Sequence
  chemically synthesized
tatttcagaaaggggtaatt

SEQ ID NO: 35774 - DNA, 20 bp, Artificial Sequence
  chemically synthesized
aatttgagtatttcagaaag

SEQ ID NO: 35775 - DNA, 20 bp, Artificial Sequence
  chemically synthesized
aaatttgagtatttcagaaa

SEQ ID NO: 35776 - DNA, 20 bp, Artificial Sequence
  chemically synthesized
gaaatttgagtatttcagaa

SEQ ID NO: 35777 - DNA, 20 bp, Artificial Sequence
  chemically synthesized
tgaaatttgagtatttcaga

SEQ ID NO: 35778 - DNA, 20 bp, Artificial Sequence
  chemically synthesized
tttttgaaatttgagtattt

SEQ ID NO: 35779 - DNA, 20 bp, Artificial Sequence
  chemically synthesized
aaaatttttttttgaaattt

SEQ ID NO: 35780 - DNA, 20 bp, Artificial Sequence
  chemically synthesized
agtattaacaatggttacat

SEQ ID NO: 35781 - DNA, 20 bp, Artificial Sequence
  chemically synthesized
caagtctagagtattaacaa

SEQ ID NO: 35782 - DNA, 20 bp, Artificial Sequence
  chemically synthesized
tgtaaccattgttaatactc

SEQ ID NO: 35783 - DNA, 20 bp, Artificial Sequence
  chemically synthesized
aatctcaagaagcaagtcta

SEQ ID NO: 35784 - DNA, 20 bp, Artificial Sequence
  chemically synthesized
caaatctcaagaagcaagtc

SEQ ID NO: 35785 - DNA, 20 bp, Artificial Sequence
  chemically synthesized
atactctagacttgcttctt

SEQ ID NO: 35786 - DNA, 20 bp, Artificial Sequence
  chemically synthesized
ttttccaaatctcaagaagc

SEQ ID NO: 35787 - DNA, 20 bp, Artificial Sequence
  chemically synthesized
acttttttccaaatctcaag

SEQ ID NO: 35788 - DNA, 20 bp, Artificial Sequence
  chemically synthesized
tagacttgcttcttgagatt

SEQ ID NO: 35789 - DNA, 20 bp, Artificial Sequence
  chemically synthesized
tttacttttttccaaatctc

SEQ ID NO: 35790 - DNA, 20 bp, Artificial Sequence
  chemically synthesized
gcttcttgagatttggaaaa

SEQ ID NO: 35791 - DNA, 20 bp, Artificial Sequence
  chemically synthesized
gatttggaaaaaagtaaaca

SEQ ID NO: 35792 - DNA, 20 bp, Artificial Sequence
  chemically synthesized
atttggaaaaaagtaaacaa

SEQ ID NO: 35793 - DNA, 20 bp, Artificial Sequence
  chemically synthesized
aaagtaaacaaaggaattac

SEQ ID NO: 35794 - DNA, 20 bp, Artificial Sequence
  chemically synthesized
aaaggaattaccagtcaatt

SEQ ID NO: 35795 - DNA, 20 bp, Artificial Sequence
  chemically synthesized
tccttgttcgcttaattgac

SEQ ID NO: 35796 - DNA, 20 bp, Artificial Sequence
  chemically synthesized
taccagtcaattaagcgaac

SEQ ID NO: 35797 - DNA, 20 bp, Artificial Sequence
  chemically synthesized
accagtcaattaagcgaaca

SEQ ID NO: 35798 - DNA, 20 bp, Artificial Sequence
  chemically synthesized
agtcaattaagcgaacaagg

SEQ ID NO: 35799 - DNA, 20 bp, Artificial Sequence
  chemically synthesized
gcgaacaaggaagtcatcct

SEQ ID NO: 35800 - DNA, 20 bp, Artificial Sequence
  chemically synthesized
ttccttatctgtttcaactt

SEQ ID NO: 35801 - DNA, 20 bp, Artificial Sequence
  chemically synthesized
tttccttatctgtttcaact

SEQ ID NO: 35802 - DNA, 20 bp, Artificial Sequence
  chemically synthesized
gaagtcatcctaagttgaaa

SEQ ID NO: 35803 - DNA, 20 bp, Artificial Sequence
  chemically synthesized
catcctaagttgaaacagat

SEQ ID NO: 35804 - DNA, 20 bp, Artificial Sequence
  chemically synthesized
atcctaagttgaaacagata

SEQ ID NO: 35805 - DNA, 20 bp, Artificial Sequence
  chemically synthesized
aatgtaataatcaaatgcta

SEQ ID NO: 35806 - DNA, 20 bp, Artificial Sequence
  chemically synthesized
ataatcaaatgctacagatg

SEQ ID NO: 35807 - DNA, 20 bp, Artificial Sequence
  chemically synthesized
aacgctggtgtcttcatctg

SEQ ID NO: 35808 - DNA, 20 bp, Artificial Sequence
  chemically synthesized
aatgctacagatgaagacac

SEQ ID NO: 35809 - DNA, 20 bp, Artificial Sequence
  chemically synthesized
aaaaaaaaaaagaaaaacgc

SEQ ID NO: 35810 - DNA, 20 bp, Artificial Sequence
  chemically synthesized
ttcatctcaggaaaaaaaaa

SEQ ID NO: 35811 - DNA, 20 bp, Artificial Sequence
  chemically synthesized
tttttctttttttttttcct

SEQ ID NO: 35812 - DNA, 20 bp, Artificial Sequence
  chemically synthesized
ttcttgtagatattcatctc

SEQ ID NO: 35813 - DNA, 20 bp, Artificial Sequence
  chemically synthesized
attcttgtagatattcatct

SEQ ID NO: 35814 - DNA, 20 bp, Artificial Sequence
  chemically synthesized
ttcctgagatgaatatctac

SEQ ID NO: 35815 - DNA, 20 bp, Artificial Sequence
  chemically synthesized
ttgataaagcgtgattcttg

SEQ ID NO: 35816 - DNA, 20 bp, Artificial Sequence
  chemically synthesized
caagaatcacgctttatcaa

SEQ ID NO: 35817 - DNA, 20 bp, Artificial Sequence
  chemically synthesized
taaggaagctgcttttgata

SEQ ID NO: 35818 - DNA, 20 bp, Artificial Sequence
  chemically synthesized
gaatcacgctttatcaaaag

SEQ ID NO: 35819 - DNA, 20 bp, Artificial Sequence
  chemically synthesized
acgcttgctgaagattaagg

SEQ ID NO: 35820 - DNA, 20 bp, Artificial Sequence
  chemically synthesized
aaagcagcttccttaatctt

SEQ ID NO: 35821 - DNA, 20 bp, Artificial Sequence
  chemically synthesized
gctacgcttgctgaagatta

SEQ ID NO: 35822 - DNA, 20 bp, Artificial Sequence
  chemically synthesized
agctacgcttgctgaagatt

SEQ ID NO: 35823 - DNA, 20 bp, Artificial Sequence
  chemically synthesized
cagcttccttaatcttcagc

SEQ ID NO: 35824 - DNA, 20 bp, Artificial Sequence
  chemically synthesized
atacacagctacgcttgctg

SEQ ID NO: 35825 - DNA, 20 bp, Artificial Sequence
  chemically synthesized
tccttaatcttcagcaagcg

SEQ ID NO: 35826 - DNA, 20 bp, Artificial Sequence
  chemically synthesized
gcaagcgtagctgtgtatta

SEQ ID NO: 35827 - DNA, 20 bp, Artificial Sequence
  chemically synthesized
catgcctttgctataataca

SEQ ID NO: 35828 - DNA, 20 bp, Artificial Sequence
  chemically synthesized
cgtagctgtgtattatagca

SEQ ID NO: 35829 - DNA, 20 bp, Artificial Sequence
  chemically synthesized
gtagctgtgtattatagcaa

SEQ ID NO: 35830 - DNA, 20 bp, Artificial Sequence
  chemically synthesized
tgtattatagcaaaggcatg

SEQ ID NO: 35831 - DNA, 20 bp, Artificial Sequence
  chemically synthesized
ttatagcaaaggcatgaaga

SEQ ID NO: 35832 - DNA, 20 bp, Artificial Sequence
  chemically synthesized
atagcaaaggcatgaagata

SEQ ID NO: 35833 - DNA, 20 bp, Artificial Sequence
  chemically synthesized
tagcaaaggcatgaagatag

SEQ ID NO: 35834 - DNA, 20 bp, Artificial Sequence
  chemically synthesized
agcaaaggcatgaagataga

SEQ ID NO: 35835 - DNA, 20 bp, Artificial Sequence
  chemically synthesized
gcaaaggcatgaagatagag

SEQ ID NO: 35836 - DNA, 20 bp, Artificial Sequence
  chemically synthesized
aaggcatgaagatagagggg

SEQ ID NO: 35837 - DNA, 20 bp, Artificial Sequence
  chemically synthesized
ggcatgaagatagaggggca

SEQ ID NO: 35838 - DNA, 20 bp, Artificial Sequence
  chemically synthesized
agatagaggggcagagtgtc

SEQ ID NO: 35839 - DNA, 20 bp, Artificial Sequence
  chemically synthesized
tctaaggggtagaattggtc

SEQ ID NO: 35840 - DNA, 20 bp, Artificial Sequence
  chemically synthesized
ccacctctaaggggtagaat

SEQ ID NO: 35841 - DNA, 20 bp, Artificial Sequence
  chemically synthesized
tccagaccaattctacccct

SEQ ID NO: 35842 - DNA, 20 bp, Artificial Sequence
  chemically synthesized
cagaccaattctacccctta

SEQ ID NO: 35843 - DNA, 20 bp, Artificial Sequence
  chemically synthesized
agtgacccacctctaagggg

SEQ ID NO: 35844 - DNA, 20 bp, Artificial Sequence
  chemically synthesized
agaccaattctaccccttag

SEQ ID NO: 35845 - DNA, 20 bp, Artificial Sequence
  chemically synthesized
ttaagtgacccacctctaag

SEQ ID NO: 35846 - DNA, 20 bp, Artificial Sequence
  chemically synthesized
ccaattctaccccttagagg

SEQ ID NO: 35847 - DNA, 20 bp, Artificial Sequence
  chemically synthesized
gttaagtgacccacctctaa

SEQ ID NO: 35848 - DNA, 20 bp, Artificial Sequence
  chemically synthesized
caattctaccccttagaggt

SEQ ID NO: 35849 - DNA, 20 bp, Artificial Sequence
  chemically synthesized
ggttaagtgacccacctcta

SEQ ID NO: 35850 - DNA, 20 bp, Artificial Sequence
  chemically synthesized
gggttaagtgacccacctct

SEQ ID NO: 35851 - DNA, 20 bp, Artificial Sequence
  chemically synthesized
tgacttgcctgtaaagggtt

SEQ ID NO: 35852 - DNA, 20 bp, Artificial Sequence
  chemically synthesized
gtgggtcacttaacccttta

SEQ ID NO: 35853 - DNA, 20 bp, Artificial Sequence
  chemically synthesized
tgggtcacttaaccctttac

SEQ ID NO: 35854 - DNA, 20 bp, Artificial Sequence
  chemically synthesized
ttaagtgacttgcctgtaaa

SEQ ID NO: 35855 - DNA, 20 bp, Artificial Sequence
  chemically synthesized
gttaagtgacttgcctgtaa

SEQ ID NO: 35856 - DNA, 20 bp, Artificial Sequence
  chemically synthesized
tcacttaaccctttacaggc

SEQ ID NO: 35857 - DNA, 20 bp, Artificial Sequence
  chemically synthesized
ggttaagtgacttgcctgta

SEQ ID NO: 35858 - DNA, 20 bp, Artificial Sequence
  chemically synthesized
aggcaagtcacttaaccact

SEQ ID NO: 35859 - DNA, 20 bp, Artificial Sequence
  chemically synthesized
acaaaagcttccaagtggtt

SEQ ID NO: 35860 - DNA, 20 bp, Artificial Sequence
  chemically synthesized
caagtcacttaaccacttgg

SEQ ID NO: 35861 - DNA, 20 bp, Artificial Sequence
  chemically synthesized
agttaacaaaagcttccaag

SEQ ID NO: 35862 - DNA, 20 bp, Artificial Sequence
  chemically synthesized
atgagttaacaaaagcttcc

SEQ ID NO: 35863 - DNA, 20 bp, Artificial Sequence
  chemically synthesized
ttctatagatgagttaacaa

SEQ ID NO: 35864 - DNA, 20 bp, Artificial Sequence
  chemically synthesized
agcttttgttaactcatcta

SEQ ID NO: 35865 - DNA, 20 bp, Artificial Sequence
  chemically synthesized
attatccacattctatagat

SEQ ID NO: 35866 - DNA, 20 bp, Artificial Sequence
  chemically synthesized
gttaactcatctatagaatg

SEQ ID NO: 35867 - DNA, 20 bp, Artificial Sequence
  chemically synthesized
gcagtattatccacattcta

SEQ ID NO: 35868 - DNA, 20 bp, Artificial Sequence
  chemically synthesized
cattttgacccacaatatgg

SEQ ID NO: 35869 - DNA, 20 bp, Artificial Sequence
  chemically synthesized
tggataatactgccatattg

SEQ ID NO: 35870 - DNA, 20 bp, Artificial Sequence
  chemically synthesized
ggataatactgccatattgt

SEQ ID NO: 35871 - DNA, 20 bp, Artificial Sequence
  chemically synthesized
tgtcattttgacccacaata

SEQ ID NO: 35872 - DNA, 20 bp, Artificial Sequence
  chemically synthesized
tgtgggtcaaaatgacacaa

SEQ ID NO: 35873 - DNA, 20 bp, Artificial Sequence
  chemically synthesized
aaatgacacaacggctctga

SEQ ID NO: 35874 - DNA, 20 bp, Artificial Sequence
  chemically synthesized
cagccttcaaattgctgtca

SEQ ID NO: 35875 - DNA, 20 bp, Artificial Sequence
  chemically synthesized
cccagccttcaaattgctgt

SEQ ID NO: 35876 - DNA, 20 bp, Artificial Sequence
  chemically synthesized
acggctctgacagcaatttg

SEQ ID NO: 35877 - DNA, 20 bp, Artificial Sequence
  chemically synthesized
cggctctgacagcaatttga

SEQ ID NO: 35878 - DNA, 20 bp, Artificial Sequence
  chemically synthesized
tctgacagcaatttgaaggc

SEQ ID NO: 35879 - DNA, 20 bp, Artificial Sequence
  chemically synthesized
ctgacagcaatttgaaggct

SEQ ID NO: 35880 - DNA, 20 bp, Artificial Sequence
  chemically synthesized
tgacagcaatttgaaggctg

SEQ ID NO: 35881 - DNA, 20 bp, Artificial Sequence
  chemically synthesized
tgcatgaacacagcattccc

SEQ ID NO: 35882 - DNA, 20 bp, Artificial Sequence
  chemically synthesized
caggctgctttgcatgaaca

SEQ ID NO: 35883 - DNA, 20 bp, Artificial Sequence
  chemically synthesized
gggaatgctgtgttcatgca

SEQ ID NO: 35884 - DNA, 20 bp, Artificial Sequence
  chemically synthesized
aatgctgtgttcatgcaaag

SEQ ID NO: 35885 - DNA, 20 bp, Artificial Sequence
  chemically synthesized
gttcatgcaaagcagcctgt

SEQ ID NO: 35886 - DNA, 20 bp, Artificial Sequence
  chemically synthesized
ttcatgcaaagcagcctgtc

SEQ ID NO: 35887 - DNA, 20 bp, Artificial Sequence
  chemically synthesized
atgcaaagcagcctgtcagg

SEQ ID NO: 35888 - DNA, 20 bp, Artificial Sequence
  chemically synthesized
tgcaaagcagcctgtcaggc

SEQ ID NO: 35889 - DNA, 20 bp, Artificial Sequence
  chemically synthesized
agaaatcatacctgcctgac

SEQ ID NO: 35890 - DNA, 20 bp, Artificial Sequence
  chemically synthesized
aagaaatcatacctgcctga

SEQ ID NO: 35891 - DNA, 20 bp, Artificial Sequence
  chemically synthesized
aggcaggtatgatttcttaa

SEQ ID NO: 35892 - DNA, 20 bp, Artificial Sequence
  chemically synthesized
gcaggtatgatttcttaaaa

SEQ ID NO: 35893 - DNA, 20 bp, Artificial Sequence
  chemically synthesized
aacatactgagttctctttt

SEQ ID NO: 35894 - DNA, 20 bp, Artificial Sequence
  chemically synthesized
tgatttcttaaaagagaact

SEQ ID NO: 35895 - DNA, 20 bp, Artificial Sequence
  chemically synthesized
taactattcctgaacatact

SEQ ID NO: 35896 - DNA, 20 bp, Artificial Sequence
  chemically synthesized
aaaagagaactcagtatgtt

SEQ ID NO: 35897 - DNA, 20 bp, Artificial Sequence
  chemically synthesized
aaagagaactcagtatgttc

SEQ ID NO: 35898 - DNA, 20 bp, Artificial Sequence
  chemically synthesized
gaactcagtatgttcaggaa

SEQ ID NO: 35899 - DNA, 20 bp, Artificial Sequence
  chemically synthesized
tcagtatgttcaggaatagt

SEQ ID NO: 35900 - DNA, 20 bp, Artificial Sequence
  chemically synthesized
cagtatgttcaggaatagtt

SEQ ID NO: 35901 - DNA, 20 bp, Artificial Sequence
  chemically synthesized
ttcaggaatagttaggtata

SEQ ID NO: 35902 - DNA, 20 bp, Artificial Sequence
  chemically synthesized
aatgttaaagtgaatttatt

SEQ ID NO: 35903 - DNA, 20 bp, Artificial Sequence
  chemically synthesized
caatctaaaacagaatgtta

SEQ ID NO: 35904 - DNA, 20 bp, Artificial Sequence
  chemically synthesized
ttcactttaacattctgttt

SEQ ID NO: 35905 - DNA, 20 bp, Artificial Sequence
  chemically synthesized
cctcacacgacaatctaaaa

SEQ ID NO: 35906 - DNA, 20 bp, Artificial Sequence
  chemically synthesized
tctgttttagattgtcgtgt

SEQ ID NO: 35907 - DNA, 20 bp, Artificial Sequence
  chemically synthesized
ctgttttagattgtcgtgtg

SEQ ID NO: 35908 - DNA, 20 bp, Artificial Sequence
  chemically synthesized
tgttttagattgtcgtgtga

SEQ ID NO: 35909 - DNA, 20 bp, Artificial Sequence
  chemically synthesized
attgtcgtgtgagggaaaat

SEQ ID NO: 35910 - DNA, 20 bp, Artificial Sequence
  chemically synthesized
tgtcgtgtgagggaaaatga

SEQ ID NO: 35911 - DNA, 20 bp, Artificial Sequence
  chemically synthesized
gtcgtgtgagggaaaatgag

SEQ ID NO: 35912 - DNA, 20 bp, Artificial Sequence
  chemically synthesized
tgagggaaaatgagaggtct

SEQ ID NO: 35913 - DNA, 20 bp, Artificial Sequence
  chemically synthesized
gaaaatgagaggtctgagtt

SEQ ID NO: 35914 - DNA, 20 bp, Artificial Sequence
  chemically synthesized
gaagagcagtttactaaact

SEQ ID NO: 35915 - DNA, 20 bp, Artificial Sequence
  chemically synthesized
aagagcagtttacagaagag

SEQ ID NO: 35916 - DNA, 20 bp, Artificial Sequence
  chemically synthesized
ctaaagagcagtttacagaa

SEQ ID NO: 35917 - DNA, 20 bp, Artificial Sequence
  chemically synthesized
tgctaaagagcagtttacag

SEQ ID NO: 35918 - DNA, 20 bp, Artificial Sequence
  chemically synthesized
aactgctaaagagcagttta

SEQ ID NO: 35919 - DNA, 20 bp, Artificial Sequence
  chemically synthesized
ctcttctgtaaactgctctt

SEQ ID NO: 35920 - DNA, 20 bp, Artificial Sequence
  chemically synthesized
ttttgtaaactgctaaagag

SEQ ID NO: 35921 - DNA, 20 bp, Artificial Sequence
  chemically synthesized
ttctgtaaactgctctttag

SEQ ID NO: 35922 - DNA, 20 bp, Artificial Sequence
  chemically synthesized
gccttttgtaaactgctaaa

SEQ ID NO: 35923 - DNA, 20 bp, Artificial Sequence
  chemically synthesized
gtgccttttgtaaactgcta

SEQ ID NO: 35924 - DNA, 20 bp, Artificial Sequence
  chemically synthesized
tgctctttagcagtttacaa

SEQ ID NO: 35925 - DNA, 20 bp, Artificial Sequence
  chemically synthesized
gctctttagcagtttacaaa

SEQ ID NO: 35926 - DNA, 20 bp, Artificial Sequence
  chemically synthesized
gtaaaaagcaaaaagaggaa

SEQ ID NO: 35927 - DNA, 20 bp, Artificial Sequence
  chemically synthesized
tgtaaaaagcaaaaagagga

SEQ ID NO: 35928 - DNA, 20 bp, Artificial Sequence
  chemically synthesized
taagtgtaaaaagcaaaaag

SEQ ID NO: 35929 - DNA, 20 bp, Artificial Sequence
  chemically synthesized
ttaagtgtaaaaagcaaaaa

SEQ ID NO: 35930 - DNA, 20 bp, Artificial Sequence
  chemically synthesized
tcttaagtgtaaaaagcaaa

SEQ ID NO: 35931 - DNA, 20 bp, Artificial Sequence
  chemically synthesized
gcttccttcttaagtgtaaa

SEQ ID NO: 35932 - DNA, 20 bp, Artificial Sequence
  chemically synthesized
tctttttgctttttacactt

SEQ ID NO: 35933 - DNA, 20 bp, Artificial Sequence
  chemically synthesized
ttttgctttttacacttaag

SEQ ID NO: 35934 - DNA, 20 bp, Artificial Sequence
  chemically synthesized
tttgctttttacacttaaga

SEQ ID NO: 35935 - DNA, 20 bp, Artificial Sequence
  chemically synthesized
gctttttacacttaagaagg

SEQ ID NO: 35936 - DNA, 20 bp, Artificial Sequence
  chemically synthesized
ttcctacttgcttccttctt

SEQ ID NO: 35937 - DNA, 20 bp, Artificial Sequence
  chemically synthesized
tttacacttaagaaggaagc

SEQ ID NO: 35938 - DNA, 20 bp, Artificial Sequence
  chemically synthesized
acacttaagaaggaagcaag

SEQ ID NO: 35939 - DNA, 20 bp, Artificial Sequence
  chemically synthesized
cacttaagaaggaagcaagt

SEQ ID NO: 35940 - DNA, 20 bp, Artificial Sequence
  chemically synthesized
aagaaggaagcaagtaggaa

SEQ ID NO: 35941 - DNA, 20 bp, Artificial Sequence
  chemically synthesized
aggaagcaagtaggaaaagt

SEQ ID NO: 35942 - DNA, 20 bp, Artificial Sequence
  chemically synthesized
gattttttttgtgtgtgtgc

SEQ ID NO: 35943 - DNA, 20 bp, Artificial Sequence
  chemically synthesized
tttttgtgtgtgtgcaagat

SEQ ID NO: 35944 - DNA, 20 bp, Artificial Sequence
  chemically synthesized
ttttgtgtgtgtgcaagata

SEQ ID NO: 35945 - DNA, 20 bp, Artificial Sequence
  chemically synthesized
gtgtgtgcaagataaggcac

SEQ ID NO: 35946 - DNA, 20 bp, Artificial Sequence
  chemically synthesized
gcaagataaggcactagctg

SEQ ID NO: 35947 - DNA, 20 bp, Artificial Sequence
  chemically synthesized
tgcctatctcaggctacagc

SEQ ID NO: 35948 - DNA, 20 bp, Artificial Sequence
  chemically synthesized
taaggcactagctgtagcct

SEQ ID NO: 35949 - DNA, 20 bp, Artificial Sequence
  chemically synthesized
tttatgcctatctcaggcta

SEQ ID NO: 35950 - DNA, 20 bp, Artificial Sequence
  chemically synthesized
gcactagctgtagcctgaga

SEQ ID NO: 35951 - DNA, 20 bp, Artificial Sequence
  chemically synthesized
cactagctgtagcctgagat

SEQ ID NO: 35952 - DNA, 20 bp, Artificial Sequence
  chemically synthesized
gtgaattttatgcctatctc

SEQ ID NO: 35953 - DNA, 20 bp, Artificial Sequence
  chemically synthesized
tgtgaattttatgcctatct

SEQ ID NO: 35954 - DNA, 20 bp, Artificial Sequence
  chemically synthesized
tgagataggcataaaattca

SEQ ID NO: 35955 - DNA, 20 bp, Artificial Sequence
  chemically synthesized
tcacagcgtttgctatcatt

SEQ ID NO: 35956 - DNA, 20 bp, Artificial Sequence
  chemically synthesized
atctcggccccactgaatga

SEQ ID NO: 35957 - DNA, 20 bp, Artificial Sequence
  chemically synthesized
cagcgtttgctatcattcag

SEQ ID NO: 35958 - DNA, 20 bp, Artificial Sequence
  chemically synthesized
agcgtttgctatcattcagt

SEQ ID NO: 35959 - DNA, 20 bp, Artificial Sequence
  chemically synthesized
gcgtttgctatcattcagtg

SEQ ID NO: 35960 - DNA, 20 bp, Artificial Sequence
  chemically synthesized
tgctatcattcagtggggcc

SEQ ID NO: 35961 - DNA, 20 bp, Artificial Sequence
  chemically synthesized
tactattcatattttaatct

SEQ ID NO: 35962 - DNA, 20 bp, Artificial Sequence
  chemically synthesized
ggccgagattaaaatatgaa

SEQ ID NO: 35963 - DNA, 20 bp, Artificial Sequence
  chemically synthesized
atagtattcacgcatgttaa

SEQ ID NO: 35964 - DNA, 20 bp, Artificial Sequence
  chemically synthesized
tagtattcacgcatgttaaa

SEQ ID NO: 35965 - DNA, 20 bp, Artificial Sequence
  chemically synthesized
gctgtctgagaatatgaaca

SEQ ID NO: 35966 - DNA, 20 bp, Artificial Sequence
  chemically synthesized
tatatccatgttcatattct

SEQ ID NO: 35967 - DNA, 20 bp, Artificial Sequence
  chemically synthesized
tccatgttcatattctcaga

SEQ ID NO: 35968 - DNA, 20 bp, Artificial Sequence
  chemically synthesized
atgttcatattctcagacag

SEQ ID NO: 35969 - DNA, 20 bp, Artificial Sequence
  chemically synthesized
actccaggtttctgctgtct

SEQ ID NO: 35970 - DNA, 20 bp, Artificial Sequence
  chemically synthesized
attctcagacagcagaaacc

SEQ ID NO: 35971 - DNA, 20 bp, Artificial Sequence
  chemically synthesized
tctcagacagcagaaacctg

SEQ ID NO: 35972 - DNA, 20 bp, Artificial Sequence
  chemically synthesized
cagacagcagaaacctggag

SEQ ID NO: 35973 - DNA, 20 bp, Artificial Sequence
  chemically synthesized
acttgctctctgactactcc

SEQ ID NO: 35974 - DNA, 20 bp, Artificial Sequence
  chemically synthesized
cagcagaaacctggagtagt

SEQ ID NO: 35975 - DNA, 20 bp, Artificial Sequence
  chemically synthesized
cacttgctctctgactactc

SEQ ID NO: 35976 - DNA, 20 bp, Artificial Sequence
  chemically synthesized
gcagaaacctggagtagtca

SEQ ID NO: 35977 - DNA, 20 bp, Artificial Sequence
  chemically synthesized
agaaacctggagtagtcaga

SEQ ID NO: 35978 - DNA, 20 bp, Artificial Sequence
  chemically synthesized
acctggagtagtcagagagc

SEQ ID NO: 35979 - DNA, 20 bp, Artificial Sequence
  chemically synthesized
agagcaagtgaatattgatt

SEQ ID NO: 35980 - DNA, 20 bp, Artificial Sequence
  chemically synthesized
gcaagtgaatattgatttgg

SEQ ID NO: 35981 - DNA, 20 bp, Artificial Sequence
  chemically synthesized
caagtgaatattgatttggt

SEQ ID NO: 35982 - DNA, 20 bp, Artificial Sequence
  chemically synthesized
aagtgaatattgatttggtg

SEQ ID NO: 35983 - DNA, 20 bp, Artificial Sequence
  chemically synthesized
agtgaatattgatttggtgg

SEQ ID NO: 35984 - DNA, 20 bp, Artificial Sequence
  chemically synthesized
aatattgatttggtggggga

SEQ ID NO: 35985 - DNA, 20 bp, Artificial Sequence
  chemically synthesized
ttgatttggtgggggacagt

SEQ ID NO: 35986 - DNA, 20 bp, Artificial Sequence
  chemically synthesized
tgatttggtgggggacagtg

SEQ ID NO: 35987 - DNA, 20 bp, Artificial Sequence
  chemically synthesized
gatttggtgggggacagtga

SEQ ID NO: 35988 - DNA, 20 bp, Artificial Sequence
  chemically synthesized
tttggtgggggacagtgagg

SEQ ID NO: 35989 - DNA, 20 bp, Artificial Sequence
  chemically synthesized
agtgagggagaaatatcccc

SEQ ID NO: 35990 - DNA, 20 bp, Artificial Sequence
  chemically synthesized
gactttctccatcaagctag

SEQ ID NO: 35991 - DNA, 20 bp, Artificial Sequence
  chemically synthesized
agactttctccatcaagcta

SEQ ID NO: 35992 - DNA, 20 bp, Artificial Sequence
  chemically synthesized
agaaatatcccctagcttga

SEQ ID NO: 35993 - DNA, 20 bp, Artificial Sequence
  chemically synthesized
gagactttctccatcaagct

SEQ ID NO: 35994 - DNA, 20 bp, Artificial Sequence
  chemically synthesized
ggagactttctccatcaagc

SEQ ID NO: 35995 - DNA, 20 bp, Artificial Sequence
  chemically synthesized
aaatatcccctagcttgatg

SEQ ID NO: 35996 - DNA, 20 bp, Artificial Sequence
  chemically synthesized
accaggagactttctccatc

SEQ ID NO: 35997 - DNA, 20 bp, Artificial Sequence
  chemically synthesized
atcccctagcttgatggaga

SEQ ID NO: 35998 - DNA, 20 bp, Artificial Sequence
  chemically synthesized
gcttgatggagaaagtctcc

SEQ ID NO: 35999 - DNA, 20 bp, Artificial Sequence
  chemically synthesized
tgatggagaaagtctcctgg

SEQ ID NO: 36000 - DNA, 20 bp, Artificial Sequence
  chemically synthesized
tgttcaaggcttgccaccag

SEQ ID NO: 36001 - DNA, 20 bp, Artificial Sequence
  chemically synthesized
ggagaaagtctcctggtggc

SEQ ID NO: 36002 - DNA, 20 bp, Artificial Sequence
  chemically synthesized
gctgttcaaggcttgccacc

SEQ ID NO: 36003 - DNA, 20 bp, Artificial Sequence
  chemically synthesized
ggctgttcaaggcttgccac

SEQ ID NO: 36004 - DNA, 20 bp, Artificial Sequence
  chemically synthesized
tcctggtggcaagccttgaa

SEQ ID NO: 36005 - DNA, 20 bp, Artificial Sequence
  chemically synthesized
tgccacttgctggctgttca

SEQ ID NO: 36006 - DNA, 20 bp, Artificial Sequence
  chemically synthesized
ggtggcaagccttgaacagc

SEQ ID NO: 36007 - DNA, 20 bp, Artificial Sequence
  chemically synthesized
ctgccacttgctggctgttc

SEQ ID NO: 36008 - DNA, 20 bp, Artificial Sequence
  chemically synthesized
gcaagccttgaacagccagc

SEQ ID NO: 36009 - DNA, 20 bp, Artificial Sequence
  chemically synthesized
agccttgaacagccagcaag

SEQ ID NO: 36010 - DNA, 20 bp, Artificial Sequence
  chemically synthesized
gtggaattcctgccacttgc

SEQ ID NO: 36011 - DNA, 20 bp, Artificial Sequence
  chemically synthesized
cttgaacagccagcaagtgg

SEQ ID NO: 36012 - DNA, 20 bp, Artificial Sequence
  chemically synthesized
ttgaacagccagcaagtggc

SEQ ID NO: 36013 - DNA, 20 bp, Artificial Sequence
  chemically synthesized
agtggcaggaattccacaca

SEQ ID NO: 36014 - DNA, 20 bp, Artificial Sequence
  chemically synthesized
tatggatccctgtctttgtg

SEQ ID NO: 36015 - DNA, 20 bp, Artificial Sequence
  chemically synthesized
gcaggaattccacacaaaga

SEQ ID NO: 36016 - DNA, 20 bp, Artificial Sequence
  chemically synthesized
caggaattccacacaaagac

SEQ ID NO: 36017 - DNA, 20 bp, Artificial Sequence
  chemically synthesized
aggaattccacacaaagaca

SEQ ID NO: 36018 - DNA, 20 bp, Artificial Sequence
  chemically synthesized
acaaagacagggatccataa

SEQ ID NO: 36019 - DNA, 20 bp, Artificial Sequence
  chemically synthesized
caaagacagggatccataaa

SEQ ID NO: 36020 - DNA, 20 bp, Artificial Sequence
  chemically synthesized
aaagacagggatccataaaa

SEQ ID NO: 36021 - DNA, 20 bp, Artificial Sequence
  chemically synthesized
aagacagggatccataaaag

SEQ ID NO: 36022 - DNA, 20 bp, Artificial Sequence
  chemically synthesized
ttatcttatttcccctttta

SEQ ID NO: 36023 - DNA, 20 bp, Artificial Sequence
  chemically synthesized
ggatccataaaaggggaaat

SEQ ID NO: 36024 - DNA, 20 bp, Artificial Sequence
  chemically synthesized
aggggaaataagataaaatc

SEQ ID NO: 36025 - DNA, 20 bp, Artificial Sequence
  chemically synthesized
agatcattaattggttaaac

SEQ ID NO: 36026 - DNA, 20 bp, Artificial Sequence
  chemically synthesized
gacattggtagatcattaat

SEQ ID NO: 36027 - DNA, 20 bp, Artificial Sequence
  chemically synthesized
gtacaagattcagacattgg

SEQ ID NO: 36028 - DNA, 20 bp, Artificial Sequence
  chemically synthesized
ggagtacaagattcagacat

SEQ ID NO: 36029 - DNA, 20 bp, Artificial Sequence
  chemically synthesized
cagagctggagtacaagatt

SEQ ID NO: 36030 - DNA, 20 bp, Artificial Sequence
  chemically synthesized
aatgtctgaatcttgtactc

SEQ ID NO: 36031 - DNA, 20 bp, Artificial Sequence
  chemically synthesized
gtaagccagagctggagtac

SEQ ID NO: 36032 - DNA, 20 bp, Artificial Sequence
  chemically synthesized
tgaatcttgtactccagctc

SEQ ID NO: 36033 - DNA, 20 bp, Artificial Sequence
  chemically synthesized
acaaaagtaagccagagctg

SEQ ID NO: 36034 - DNA, 20 bp, Artificial Sequence
  chemically synthesized
tgacaaaagtaagccagagc

SEQ ID NO: 36035 - DNA, 20 bp, Artificial Sequence
  chemically synthesized
gccttgacaaaagtaagcca

SEQ ID NO: 36036 - DNA, 20 bp, Artificial Sequence
  chemically synthesized
atgccttgacaaaagtaagc

SEQ ID NO: 36037 - DNA, 20 bp, Artificial Sequence
  chemically synthesized
aaacatgccttgacaaaagt

SEQ ID NO: 36038 - DNA, 20 bp, Artificial Sequence
  chemically synthesized
agctctggcttacttttgtc

SEQ ID NO: 36039 - DNA, 20 bp, Artificial Sequence
  chemically synthesized
gctctggcttacttttgtca

SEQ ID NO: 36040 - DNA, 20 bp, Artificial Sequence
  chemically synthesized
ttgaaaacatgccttgacaa

SEQ ID NO: 36041 - DNA, 20 bp, Artificial Sequence
  chemically synthesized
ttttgtcaaggcatgttttc

SEQ ID NO: 36042 - DNA, 20 bp, Artificial Sequence
  chemically synthesized
aaggcatgttttcaagatga

SEQ ID NO: 36043 - DNA, 20 bp, Artificial Sequence
  chemically synthesized
aggcatgttttcaagatgaa

SEQ ID NO: 36044 - DNA, 20 bp, Artificial Sequence
  chemically synthesized
ttcaagatgaaaggaaaata

SEQ ID NO: 36045 - DNA, 20 bp, Artificial Sequence
  chemically synthesized
tgaaaggaaaatacagatgc

SEQ ID NO: 36046 - DNA, 20 bp, Artificial Sequence
  chemically synthesized
gaaaggaaaatacagatgca

SEQ ID NO: 36047 - DNA, 20 bp, Artificial Sequence
  chemically synthesized
ggaaatttgtggataaataa

SEQ ID NO: 36048 - DNA, 20 bp, Artificial Sequence
  chemically synthesized
aaaacattcttggaaatttg

SEQ ID NO: 36049 - DNA, 20 bp, Artificial Sequence
  chemically synthesized
ttatttatccacaaatttcc

SEQ ID NO: 36050 - DNA, 20 bp, Artificial Sequence
  chemically synthesized
gagcacataaaaaacattct

SEQ ID NO: 36051 - DNA, 20 bp, Artificial Sequence
  chemically synthesized
tgttttttatgtgctctatc

SEQ ID NO: 36052 - DNA, 20 bp, Artificial Sequence
  chemically synthesized
agagaaacttagtctagata

SEQ ID NO: 36053 - DNA, 20 bp, Artificial Sequence
  chemically synthesized
atagagaaacttagtctaga

SEQ ID NO: 36054 - DNA, 20 bp, Artificial Sequence
  chemically synthesized
ttatgtgctctatctagact

SEQ ID NO: 36055 - DNA, 20 bp, Artificial Sequence
  chemically synthesized
tttaatagagaaacttagtc

SEQ ID NO: 36056 - DNA, 20 bp, Artificial Sequence
  chemically synthesized
taatatttaatagagaaact

SEQ ID NO: 36057 - DNA, 20 bp, Artificial Sequence
  chemically synthesized
atataggataatatttaata

SEQ ID NO: 36058 - DNA, 20 bp, Artificial Sequence
  chemically synthesized
taatataggataatatttaa

SEQ ID NO: 36059 - DNA, 20 bp, Artificial Sequence
  chemically synthesized
attaaatattatcctatatt

SEQ ID NO: 36060 - DNA, 20 bp, Artificial Sequence
  chemically synthesized
ttatttaaagaacttaatat

SEQ ID NO: 36061 - DNA, 20 bp, Artificial Sequence
  chemically synthesized
gttatttaaagaacttaata

SEQ ID NO: 36062 - DNA, 20 bp, Artificial Sequence
  chemically synthesized
actatgtttgaagttattta

SEQ ID NO: 36063 - DNA, 20 bp, Artificial Sequence
  chemically synthesized
tctttaaataacttcaaaca

SEQ ID NO: 36064 - DNA, 20 bp, Artificial Sequence
  chemically synthesized
ccataaatacactatgtttg

SEQ ID NO: 36065 - DNA, 20 bp, Artificial Sequence
  chemically synthesized
cttcaaacatagtgtattta

SEQ ID NO: 36066 - DNA, 20 bp, Artificial Sequence
  chemically synthesized
tgataagcaaatacatatgt

SEQ ID NO: 36067 - DNA, 20 bp, Artificial Sequence
  chemically synthesized
atgagaagagtttaaatgat

SEQ ID NO: 36068 - DNA, 20 bp, Artificial Sequence
  chemically synthesized
ccataaagaaaaaatgagaa

SEQ ID NO: 36069 - DNA, 20 bp, Artificial Sequence
  chemically synthesized
aaccataaagaaaaaatgag

SEQ ID NO: 36070 - DNA, 20 bp, Artificial Sequence
  chemically synthesized
accaaccataaagaaaaaat

SEQ ID NO: 36071 - DNA, 20 bp, Artificial Sequence
  chemically synthesized
ctcttctcattttttcttta

SEQ ID NO: 36072 - DNA, 20 bp, Artificial Sequence
  chemically synthesized
tctcattttttctttatggt

SEQ ID NO: 36073 - DNA, 20 bp, Artificial Sequence
  chemically synthesized
cccagtttttaccaaccata

SEQ ID NO: 36074 - DNA, 20 bp, Artificial Sequence
  chemically synthesized
tctttatggttggtaaaaac

SEQ ID NO: 36075 - DNA, 20 bp, Artificial Sequence
  chemically synthesized
ctttatggttggtaaaaact

SEQ ID NO: 36076 - DNA, 20 bp, Artificial Sequence
  chemically synthesized
tttatggttggtaaaaactg

SEQ ID NO: 36077 - DNA, 20 bp, Artificial Sequence
  chemically synthesized
tatggttggtaaaaactggg

SEQ ID NO: 36078 - DNA, 20 bp, Artificial Sequence
  chemically synthesized
gtcattctccaaacactccc

SEQ ID NO: 36079 - DNA, 20 bp, Artificial Sequence
  chemically synthesized
ggtaaaaactggggagtgtt

SEQ ID NO: 36080 - DNA, 20 bp, Artificial Sequence
  chemically synthesized
taaaaactggggagtgtttg

SEQ ID NO: 36081 - DNA, 20 bp, Artificial Sequence
  chemically synthesized
ggagtgtttggagaatgaca

SEQ ID NO: 36082 - DNA, 20 bp, Artificial Sequence
  chemically synthesized
aaaatttcaacattgtaatc

SEQ ID NO: 36083 - DNA, 20 bp, Artificial Sequence
  chemically synthesized
gatcccacttaaaaaaaaac

SEQ ID NO: 36084 - DNA, 20 bp, Artificial Sequence
  chemically synthesized
ttgtaatccagttttttttt

SEQ ID NO: 36085 - DNA, 20 bp, Artificial Sequence
  chemically synthesized
taatccagtttttttttaag

SEQ ID NO: 36086 - DNA, 20 bp, Artificial Sequence
  chemically synthesized
aatccagtttttttttaagt

SEQ ID NO: 36087 - DNA, 20 bp, Artificial Sequence
  chemically synthesized
ttttttttaagtgggatccc

SEQ ID NO: 36088 - DNA, 20 bp, Artificial Sequence
  chemically synthesized
tttttttaagtgggatccca

SEQ ID NO: 36089 - DNA, 20 bp, Artificial Sequence
  chemically synthesized
ggaaaaggccatatttcctt

SEQ ID NO: 36090 - DNA, 20 bp, Artificial Sequence
  chemically synthesized
aggaaaaggccatatttcct

SEQ ID NO: 36091 - DNA, 20 bp, Artificial Sequence
  chemically synthesized
agtgggatcccaaggaaata

SEQ ID NO: 36092 - DNA, 20 bp, Artificial Sequence
  chemically synthesized
ggaaatatggccttttcctt

SEQ ID NO: 36093 - DNA, 20 bp, Artificial Sequence
  chemically synthesized
tcataagctccttaaggaaa

SEQ ID NO: 36094 - DNA, 20 bp, Artificial Sequence
  chemically synthesized
gaaatatggccttttcctta

SEQ ID NO: 36095 - DNA, 20 bp, Artificial Sequence
  chemically synthesized
atcataagctccttaaggaa

SEQ ID NO: 36096 - DNA, 20 bp, Artificial Sequence
  chemically synthesized
aatatggccttttccttaag

SEQ ID NO: 36097 - DNA, 20 bp, Artificial Sequence
  chemically synthesized
attagatcataagctcctta

SEQ ID NO: 36098 - DNA, 20 bp, Artificial Sequence
  chemically synthesized
cattagatcataagctcctt

SEQ ID NO: 36099 - DNA, 20 bp, Artificial Sequence
  chemically synthesized
atcttctctcattagatcat

SEQ ID NO: 36100 - DNA, 20 bp, Artificial Sequence
  chemically synthesized
taaggagcttatgatctaat

SEQ ID NO: 36101 - DNA, 20 bp, Artificial Sequence
  chemically synthesized
aggagcttatgatctaatga

SEQ ID NO: 36102 - DNA, 20 bp, Artificial Sequence
  chemically synthesized
agcttatgatctaatgagag

SEQ ID NO: 36103 - DNA, 20 bp, Artificial Sequence
  chemically synthesized
atgggtctatcttctctcat

SEQ ID NO: 36104 - DNA, 20 bp, Artificial Sequence
  chemically synthesized
tatgatctaatgagagaaga

SEQ ID NO: 36105 - DNA, 20 bp, Artificial Sequence
  chemically synthesized
agagaagatagacccatata

SEQ ID NO: 36106 - DNA, 20 bp, Artificial Sequence
  chemically synthesized
tactgtgtttagctatatat

SEQ ID NO: 36107 - DNA, 20 bp, Artificial Sequence
  chemically synthesized
atactgtgtttagctatata

SEQ ID NO: 36108 - DNA, 20 bp, Artificial Sequence
  chemically synthesized
gacccatatatagctaaaca

SEQ ID NO: 36109 - DNA, 20 bp, Artificial Sequence
  chemically synthesized
aatctgtctgatactgtgtt

SEQ ID NO: 36110 - DNA, 20 bp, Artificial Sequence
  chemically synthesized
tatatagctaaacacagtat

SEQ ID NO: 36111 - DNA, 20 bp, Artificial Sequence
  chemically synthesized
tagctaaacacagtatcaga

SEQ ID NO: 36112 - DNA, 20 bp, Artificial Sequence
  chemically synthesized
cagacagattataataatta

SEQ ID NO: 36113 - DNA, 20 bp, Artificial Sequence
  chemically synthesized
gattataataattacagaaa

SEQ ID NO: 36114 - DNA, 20 bp, Artificial Sequence
  chemically synthesized
ttataataattacagaaata

SEQ ID NO: 36115 - DNA, 20 bp, Artificial Sequence
  chemically synthesized
ataataattacagaaataga

SEQ ID NO: 36116 - DNA, 20 bp, Artificial Sequence
  chemically synthesized
tacagaaatagagagaaaaa

SEQ ID NO: 36117 - DNA, 20 bp, Artificial Sequence
  chemically synthesized
agaaatagagagaaaaaaag

SEQ ID NO: 36118 - DNA, 20 bp, Artificial Sequence
  chemically synthesized
gagagaaaaaaagcagcaaa

SEQ ID NO: 36119 - DNA, 20 bp, Artificial Sequence
  chemically synthesized
agagaaaaaaagcagcaaaa

SEQ ID NO: 36120 - DNA, 20 bp, Artificial Sequence
  chemically synthesized
gagaaaaaaagcagcaaaaa

SEQ ID NO: 36121 - DNA, 20 bp, Artificial Sequence
  chemically synthesized
aaaaaagcagcaaaaaggga

SEQ ID NO: 36122 - DNA, 20 bp, Artificial Sequence
  chemically synthesized
aaaaagcagcaaaaagggaa

SEQ ID NO: 36123 - DNA, 20 bp, Artificial Sequence
  chemically synthesized
agcaaaaagggaaaggtgat

SEQ ID NO: 36124 - DNA, 20 bp, Artificial Sequence
  chemically synthesized
aaagggaaaggtgattagtt

SEQ ID NO: 36125 - DNA, 20 bp, Artificial Sequence
  chemically synthesized
aggtgattagtttggcctct

SEQ ID NO: 36126 - DNA, 20 bp, Artificial Sequence
  chemically synthesized
ggtgattagtttggcctctt

SEQ ID NO: 36127 - DNA, 20 bp, Artificial Sequence
  chemically synthesized
gcatattctctaatcccaag

SEQ ID NO: 36128 - DNA, 20 bp, Artificial Sequence
  chemically synthesized
ttagtttggcctcttgggat

SEQ ID NO: 36129 - DNA, 20 bp, Artificial Sequence
  chemically synthesized
tgcatattctctaatcccaa

SEQ ID NO: 36130 - DNA, 20 bp, Artificial Sequence
  chemically synthesized
agtttggcctcttgggatta

SEQ ID NO: 36131 - DNA, 20 bp, Artificial Sequence
  chemically synthesized
agtgcatattctctaatccc

SEQ ID NO: 36132 - DNA, 20 bp, Artificial Sequence
  chemically synthesized
gcctacttagtttttaattg

SEQ ID NO: 36133 - DNA, 20 bp, Artificial Sequence
  chemically synthesized
atgcacttcaattaaaaact

SEQ ID NO: 36134 - DNA, 20 bp, Artificial Sequence
  chemically synthesized
cacttcaattaaaaactaag

SEQ ID NO: 36135 - DNA, 20 bp, Artificial Sequence
  chemically synthesized
acttcaattaaaaactaagt

SEQ ID NO: 36136 - DNA, 20 bp, Artificial Sequence
  chemically synthesized
ctaggtgattaaagcctact

SEQ ID NO: 36137 - DNA, 20 bp, Artificial Sequence
  chemically synthesized
aagaactaactaggtgatta

SEQ ID NO: 36138 - DNA, 20 bp, Artificial Sequence
  chemically synthesized
ctaagtaggctttaatcacc

SEQ ID NO: 36139 - DNA, 20 bp, Artificial Sequence
  chemically synthesized
gtaggctttaatcacctagt

SEQ ID NO: 36140 - DNA, 20 bp, Artificial Sequence
  chemically synthesized
acctgatttaagaactaact

SEQ ID NO: 36141 - DNA, 20 bp, Artificial Sequence
  chemically synthesized
aacctgatttaagaactaac

SEQ ID NO: 36142 - DNA, 20 bp, Artificial Sequence
  chemically synthesized
cacctagttagttcttaaat

SEQ ID NO: 36143 - DNA, 20 bp, Artificial Sequence
  chemically synthesized
acctagttagttcttaaatc

SEQ ID NO: 36144 - DNA, 20 bp, Artificial Sequence
  chemically synthesized
acacacacaaaacctgattt

SEQ ID NO: 36145 - DNA, 20 bp, Artificial Sequence
  chemically synthesized
tgtgtgtgtgttctttttgc

SEQ ID NO: 36146 - DNA, 20 bp, Artificial Sequence
  chemically synthesized
actcttcatattctagcaaa

SEQ ID NO: 36147 - DNA, 20 bp, Artificial Sequence
  chemically synthesized
gttctttttgctagaatatg

SEQ ID NO: 36148 - DNA, 20 bp, Artificial Sequence
  chemically synthesized
tgtttcaactcttcatattc

SEQ ID NO: 36149 - DNA, 20 bp, Artificial Sequence
  chemically synthesized
tctttttgctagaatatgaa

SEQ ID NO: 36150 - DNA, 20 bp, Artificial Sequence
  chemically synthesized
agaatatgaagagttgaaac

SEQ ID NO: 36151 - DNA, 20 bp, Artificial Sequence
  chemically synthesized
ttagctcacagagtcaatgt

SEQ ID NO: 36152 - DNA, 20 bp, Artificial Sequence
  chemically synthesized
gtttcttacattgactctgt

SEQ ID NO: 36153 - DNA, 20 bp, Artificial Sequence
  chemically synthesized
atatgagcgattagctcaca

SEQ ID NO: 36154 - DNA, 20 bp, Artificial Sequence
  chemically synthesized
taatatgagcgattagctca

SEQ ID NO: 36155 - DNA, 20 bp, Artificial Sequence
  chemically synthesized
aaattattaatatgagcgat

SEQ ID NO: 36156 - DNA, 20 bp, Artificial Sequence
  chemically synthesized
ccttagtaaattattaatat

SEQ ID NO: 36157 - DNA, 20 bp, Artificial Sequence
  chemically synthesized
gctcatattaataatttact

SEQ ID NO: 36158 - DNA, 20 bp, Artificial Sequence
  chemically synthesized
ctcatattaataatttacta

SEQ ID NO: 36159 - DNA, 20 bp, Artificial Sequence
  chemically synthesized
attaataatttactaaggta

SEQ ID NO: 36160 - DNA, 20 bp, Artificial Sequence
  chemically synthesized
taataatttactaaggtaca

SEQ ID NO: 36161 - DNA, 20 bp, Artificial Sequence
  chemically synthesized
aacataaaaactctgtacct

SEQ ID NO: 36162 - DNA, 20 bp, Artificial Sequence
  chemically synthesized
agagtttttatgttaatata

SEQ ID NO: 36163 - DNA, 20 bp, Artificial Sequence
  chemically synthesized
cctaaactgatgtcgtaaca

SEQ ID NO: 36164 - DNA, 20 bp, Artificial Sequence
  chemically synthesized
atacagctgtgttacgacat

SEQ ID NO: 36165 - DNA, 20 bp, Artificial Sequence
  chemically synthesized
gctgtgttacgacatcagtt

SEQ ID NO: 36166 - DNA, 20 bp, Artificial Sequence
  chemically synthesized
ctgtgttacgacatcagttt

SEQ ID NO: 36167 - DNA, 20 bp, Artificial Sequence
  chemically synthesized
cgacatcagtttaggctttt

SEQ ID NO: 36168 - DNA, 20 bp, Artificial Sequence
  chemically synthesized
gacatcagtttaggcttttt

SEQ ID NO: 36169 - DNA, 20 bp, Artificial Sequence
  chemically synthesized
tacatttttgaattcctaaa

SEQ ID NO: 36170 - DNA, 20 bp, Artificial Sequence
  chemically synthesized
taggaattcaaaaatgtatt

SEQ ID NO: 36171 - DNA, 20 bp, Artificial Sequence
  chemically synthesized
aaaatgtatttggccaatat

SEQ ID NO: 36172 - DNA, 20 bp, Artificial Sequence
  chemically synthesized
caagatatcaaatccaatat

SEQ ID NO: 36173 - DNA, 20 bp, Artificial Sequence
  chemically synthesized
caatattggatttgatatct

SEQ ID NO: 36174 - DNA, 20 bp, Artificial Sequence
  chemically synthesized
aatattggatttgatatctt

SEQ ID NO: 36175 - DNA, 20 bp, Artificial Sequence
  chemically synthesized
attggatttgatatcttggg

SEQ ID NO: 36176 - DNA, 20 bp, Artificial Sequence
  chemically synthesized
ttggatttgatatcttggga

SEQ ID NO: 36177 - DNA, 20 bp, Artificial Sequence
  chemically synthesized
ttctgccagttagccttccc

SEQ ID NO: 36178 - DNA, 20 bp, Artificial Sequence
  chemically synthesized
gatatcttgggaaggctaac

SEQ ID NO: 36179 - DNA, 20 bp, Artificial Sequence
  chemically synthesized
atcttgggaaggctaactgg

SEQ ID NO: 36180 - DNA, 20 bp, Artificial Sequence
  chemically synthesized
aagtagtattttctgccagt

SEQ ID NO: 36181 - DNA, 20 bp, Artificial Sequence
  chemically synthesized
gggaaagtagtattttctgc

SEQ ID NO: 36182 - DNA, 20 bp, Artificial Sequence
  chemically synthesized
tgatgtcctaatggggaaag

SEQ ID NO: 36183 - DNA, 20 bp, Artificial Sequence
  chemically synthesized
gaaaatactactttccccat

SEQ ID NO: 36184 - DNA, 20 bp, Artificial Sequence
  chemically synthesized
ctttgatgtcctaatgggga

SEQ ID NO: 36185 - DNA, 20 bp, Artificial Sequence
  chemically synthesized
aaaatactactttccccatt

SEQ ID NO: 36186 - DNA, 20 bp, Artificial Sequence
  chemically synthesized
tgtgctttgatgtcctaatg

SEQ ID NO: 36187 - DNA, 20 bp, Artificial Sequence
  chemically synthesized
atgtgctttgatgtcctaat

SEQ ID NO: 36188 - DNA, 20 bp, Artificial Sequence
  chemically synthesized
aatgtgctttgatgtcctaa

SEQ ID NO: 36189 - DNA, 20 bp, Artificial Sequence
  chemically synthesized
ctttccccattaggacatca

SEQ ID NO: 36190 - DNA, 20 bp, Artificial Sequence
  chemically synthesized
ggacatcaaagcacattatt

SEQ ID NO: 36191 - DNA, 20 bp, Artificial Sequence
  chemically synthesized
attattgagttaatatgaac

SEQ ID NO: 36192 - DNA, 20 bp, Artificial Sequence
  chemically synthesized
atatgaacaagaccttcacg

SEQ ID NO: 36193 - DNA, 20 bp, Artificial Sequence
  chemically synthesized
tatgaacaagaccttcacgt

SEQ ID NO: 36194 - DNA, 20 bp, Artificial Sequence
  chemically synthesized
ggacttcaattcccacgtga

SEQ ID NO: 36195 - DNA, 20 bp, Artificial Sequence
  chemically synthesized
aggacttcaattcccacgtg

SEQ ID NO: 36196 - DNA, 20 bp, Artificial Sequence
  chemically synthesized
agaccttcacgtgggaattg

SEQ ID NO: 36197 - DNA, 20 bp, Artificial Sequence
  chemically synthesized
cgtgggaattgaagtcctca

SEQ ID NO: 36198 - DNA, 20 bp, Artificial Sequence
  chemically synthesized
tgagagtaggtcaagctgtg

SEQ ID NO: 36199 - DNA, 20 bp, Artificial Sequence
  chemically synthesized
atgagagtaggtcaagctgt

SEQ ID NO: 36200 - DNA, 20 bp, Artificial Sequence
  chemically synthesized
ctaagggatgagagtaggtc

SEQ ID NO: 36201 - DNA, 20 bp, Artificial Sequence
  chemically synthesized
tgtttctaagggatgagagt

SEQ ID NO: 36202 - DNA, 20 bp, Artificial Sequence
  chemically synthesized
ctgtttctaagggatgagag

SEQ ID NO: 36203 - DNA, 20 bp, Artificial Sequence
  chemically synthesized
gacctgtttctaagggatga

SEQ ID NO: 36204 - DNA, 20 bp, Artificial Sequence
  chemically synthesized
cttgacctactctcatccct

SEQ ID NO: 36205 - DNA, 20 bp, Artificial Sequence
  chemically synthesized
tcgacctgtttctaagggat

SEQ ID NO: 36206 - DNA, 20 bp, Artificial Sequence
  chemically synthesized
ctactctcatcccttagaaa

SEQ ID NO: 36207 - DNA, 20 bp, Artificial Sequence
  chemically synthesized
ctttgtcgacctgtttctaa

SEQ ID NO: 36208 - DNA, 20 bp, Artificial Sequence
  chemically synthesized
tactctcatcccttagaaac

SEQ ID NO: 36209 - DNA, 20 bp, Artificial Sequence
  chemically synthesized
tctttgtcgacctgtttcta

SEQ ID NO: 36210 - DNA, 20 bp, Artificial Sequence
  chemically synthesized
ttctttgtcgacctgtttct

SEQ ID NO: 36211 - DNA, 20 bp, Artificial Sequence
  chemically synthesized
cccttagaaacaggtcgaca

SEQ ID NO: 36212 - DNA, 20 bp, Artificial Sequence
  chemically synthesized
gaaacaggtcgacaaagaat

SEQ ID NO: 36213 - DNA, 20 bp, Artificial Sequence
  chemically synthesized
acaggtcgacaaagaattgg

SEQ ID NO: 36214 - DNA, 20 bp, Artificial Sequence
  chemically synthesized
tctatccatcatatgcaaag

SEQ ID NO: 36215 - DNA, 20 bp, Artificial Sequence
  chemically synthesized
ctctatccatcatatgcaaa

SEQ ID NO: 36216 - DNA, 20 bp, Artificial Sequence
  chemically synthesized
ttctctatccatcatatgca

SEQ ID NO: 36217 - DNA, 20 bp, Artificial Sequence
  chemically synthesized
ggaagcctctttgcatatga

SEQ ID NO: 36218 - DNA, 20 bp, Artificial Sequence
  chemically synthesized
gcctctttgcatatgatgga

SEQ ID NO: 36219 - DNA, 20 bp, Artificial Sequence
  chemically synthesized
ctctttgcatatgatggata

SEQ ID NO: 36220 - DNA, 20 bp, Artificial Sequence
  chemically synthesized
tttgcatatgatggatagag

SEQ ID NO: 36221 - DNA, 20 bp, Artificial Sequence
  chemically synthesized
atggatagagaagaaaaaat

SEQ ID NO: 36222 - DNA, 20 bp, Artificial Sequence
  chemically synthesized
aagatattcaaaagtacagg

SEQ ID NO: 36223 - DNA, 20 bp, Artificial Sequence
  chemically synthesized
agaaagatattcaaaagtac

SEQ ID NO: 36224 - DNA, 20 bp, Artificial Sequence
  chemically synthesized
aagaaagatattcaaaagta

SEQ ID NO: 36225 - DNA, 20 bp, Artificial Sequence
  chemically synthesized
ttaaaaagaaagatattcaa

SEQ ID NO: 36226 - DNA, 20 bp, Artificial Sequence
  chemically synthesized
ttaattctattttaaaaaga

SEQ ID NO: 36227 - DNA, 20 bp, Artificial Sequence
  chemically synthesized
gaatatctttctttttaaaa

SEQ ID NO: 36228 - DNA, 20 bp, Artificial Sequence
  chemically synthesized
aaatttaattctattttaaa

SEQ ID NO: 36229 - DNA, 20 bp, Artificial Sequence
  chemically synthesized
tttaaaatagaattaaattt

SEQ ID NO: 36230 - DNA, 20 bp, Artificial Sequence
  chemically synthesized
ttaaaatagaattaaatttg

SEQ ID NO: 36231 - DNA, 20 bp, Artificial Sequence
  chemically synthesized
aaatagaattaaatttgagg

SEQ ID NO: 36232 - DNA, 20 bp, Artificial Sequence
  chemically synthesized
aatagaattaaatttgaggt

SEQ ID NO: 36233 - DNA, 20 bp, Artificial Sequence
  chemically synthesized
agaattaaatttgaggtggg

SEQ ID NO: 36234 - DNA, 20 bp, Artificial Sequence
  chemically synthesized
aatttgaggtgggaagaaac

SEQ ID NO: 36235 - DNA, 20 bp, Artificial Sequence
  chemically synthesized
atttgaggtgggaagaaaca

SEQ ID NO: 36236 - DNA, 20 bp, Artificial Sequence
  chemically synthesized
tttgaggtgggaagaaacaa

SEQ ID NO: 36237 - DNA, 20 bp, Artificial Sequence
  chemically synthesized
gaggtgggaagaaacaaggg

SEQ ID NO: 36238 - DNA, 20 bp, Artificial Sequence
  chemically synthesized
gggaagaaacaagggtggaa

SEQ ID NO: 36239 - DNA, 20 bp, Artificial Sequence
  chemically synthesized
gaagaaacaagggtggaaaa

SEQ ID NO: 36240 - DNA, 20 bp, Artificial Sequence
  chemically synthesized
aagaaacaagggtggaaaag

SEQ ID NO: 36241 - DNA, 20 bp, Artificial Sequence
  chemically synthesized
agaaacaagggtggaaaaga

SEQ ID NO: 36242 - DNA, 20 bp, Artificial Sequence
  chemically synthesized
aacaagggtggaaaagaggg

SEQ ID NO: 36243 - DNA, 20 bp, Artificial Sequence
  chemically synthesized
acaagggtggaaaagagggt

SEQ ID NO: 36244 - DNA, 20 bp, Artificial Sequence
  chemically synthesized
caagggtggaaaagagggta

SEQ ID NO: 36245 - DNA, 20 bp, Artificial Sequence
  chemically synthesized
gtggaaaagagggtagggat

SEQ ID NO: 36246 - DNA, 20 bp, Artificial Sequence
  chemically synthesized
aaagagggtagggatcagaa

SEQ ID NO: 36247 - DNA, 20 bp, Artificial Sequence
  chemically synthesized
tcagaatggaaatgtatgcc

SEQ ID NO: 36248 - DNA, 20 bp, Artificial Sequence
  chemically synthesized
gaatggaaatgtatgccaag

SEQ ID NO: 36249 - DNA, 20 bp, Artificial Sequence
  chemically synthesized
ggctgttgtcatcatctact

SEQ ID NO: 36250 - DNA, 20 bp, Artificial Sequence
  chemically synthesized
tgccaagtagatgatgacaa

SEQ ID NO: 36251 - DNA, 20 bp, Artificial Sequence
  chemically synthesized
agtagatgatgacaacagcc

SEQ ID NO: 36252 - DNA, 20 bp, Artificial Sequence
  chemically synthesized
atgatgacaacagcccagtt

SEQ ID NO: 36253 - DNA, 20 bp, Artificial Sequence
  chemically synthesized
gatgacaacagcccagttaa

SEQ ID NO: 36254 - DNA, 20 bp, Artificial Sequence
  chemically synthesized
actttcatccactcttaact

SEQ ID NO: 36255 - DNA, 20 bp, Artificial Sequence
  chemically synthesized
gactttcatccactcttaac

SEQ ID NO: 36256 - DNA, 20 bp, Artificial Sequence
  chemically synthesized
gacaacagcccagttaagag

SEQ ID NO: 36257 - DNA, 20 bp, Artificial Sequence
  chemically synthesized
gcccagttaagagtggatga

SEQ ID NO: 36258 - DNA, 20 bp, Artificial Sequence
  chemically synthesized
agtggatgaaagtctgaact

SEQ ID NO: 36259 - DNA, 20 bp, Artificial Sequence
  chemically synthesized
ccagtgctcctttcttagtt

SEQ ID NO: 36260 - DNA, 20 bp, Artificial Sequence
  chemically synthesized
gatgaaagtctgaactaaga

SEQ ID NO: 36261 - DNA, 20 bp, Artificial Sequence
  chemically synthesized
atgaaagtctgaactaagaa

SEQ ID NO: 36262 - DNA, 20 bp, Artificial Sequence
  chemically synthesized
gaaagtctgaactaagaaag

SEQ ID NO: 36263 - DNA, 20 bp, Artificial Sequence
  chemically synthesized
aattcccagtgctcctttct

SEQ ID NO: 36264 - DNA, 20 bp, Artificial Sequence
  chemically synthesized
ctgaactaagaaaggagcac

SEQ ID NO: 36265 - DNA, 20 bp, Artificial Sequence
  chemically synthesized
tgaactaagaaaggagcact

SEQ ID NO: 36266 - DNA, 20 bp, Artificial Sequence
  chemically synthesized
tcagcctctccacaaattcc

SEQ ID NO: 36267 - DNA, 20 bp, Artificial Sequence
  chemically synthesized
aaaggagcactgggaatttg

SEQ ID NO: 36268 - DNA, 20 bp, Artificial Sequence
  chemically synthesized
aggagcactgggaatttgtg

SEQ ID NO: 36269 - DNA, 20 bp, Artificial Sequence
  chemically synthesized
gagcactgggaatttgtgga

SEQ ID NO: 36270 - DNA, 20 bp, Artificial Sequence
  chemically synthesized
agcactgggaatttgtggag

SEQ ID NO: 36271 - DNA, 20 bp, Artificial Sequence
  chemically synthesized
tctataacctgtcatgaatt

SEQ ID NO: 36272 - DNA, 20 bp, Artificial Sequence
  chemically synthesized
tggagaggctgaattcatga

SEQ ID NO: 36273 - DNA, 20 bp, Artificial Sequence
  chemically synthesized
ggagaggctgaattcatgac

SEQ ID NO: 36274 - DNA, 20 bp, Artificial Sequence
  chemically synthesized
gctgaattcatgacaggtta

SEQ ID NO: 36275 - DNA, 20 bp, Artificial Sequence
  chemically synthesized
ataaaatcaatgctactttt

SEQ ID NO: 36276 - DNA, 20 bp, Artificial Sequence
  chemically synthesized
acattcaattggctcaaaag

SEQ ID NO: 36277 - DNA, 20 bp, Artificial Sequence
  chemically synthesized
ctcacattcaattggctcaa

SEQ ID NO: 36278 - DNA, 20 bp, Artificial Sequence
  chemically synthesized
ctctagccctcacattcaat

SEQ ID NO: 36279 - DNA, 20 bp, Artificial Sequence
  chemically synthesized
cttttgagccaattgaatgt

SEQ ID NO: 36280 - DNA, 20 bp, Artificial Sequence
  chemically synthesized
ttttgagccaattgaatgtg

SEQ ID NO: 36281 - DNA, 20 bp, Artificial Sequence
  chemically synthesized
tttgagccaattgaatgtga

SEQ ID NO: 36282 - DNA, 20 bp, Artificial Sequence
  chemically synthesized
agccaattgaatgtgagggc

SEQ ID NO: 36283 - DNA, 20 bp, Artificial Sequence
  chemically synthesized
ccaattgaatgtgagggcta

SEQ ID NO: 36284 - DNA, 20 bp, Artificial Sequence
  chemically synthesized
caattgaatgtgagggctag

SEQ ID NO: 36285 - DNA, 20 bp, Artificial Sequence
  chemically synthesized
gaatgtgagggctagaggaa

SEQ ID NO: 36286 - DNA, 20 bp, Artificial Sequence
  chemically synthesized
aatgtgagggctagaggaaa

SEQ ID NO: 36287 - DNA, 20 bp, Artificial Sequence
  chemically synthesized
ctacacttttccttttcctc

SEQ ID NO: 36288 - DNA, 20 bp, Artificial Sequence
  chemically synthesized
gagggctagaggaaaaggaa

SEQ ID NO: 36289 - DNA, 20 bp, Artificial Sequence
  chemically synthesized
ctagaggaaaaggaaaagtg

SEQ ID NO: 36290 - DNA, 20 bp, Artificial Sequence
  chemically synthesized
tagaggaaaaggaaaagtgt

SEQ ID NO: 36291 - DNA, 20 bp, Artificial Sequence
  chemically synthesized
aagtgtaggatttttgataa

SEQ ID NO: 36292 - DNA, 20 bp, Artificial Sequence
  chemically synthesized
atttttgataatggccctat

SEQ ID NO: 36293 - DNA, 20 bp, Artificial Sequence
  chemically synthesized
ccatgaatgcacagctaata

SEQ ID NO: 36294 - DNA, 20 bp, Artificial Sequence
  chemically synthesized
tccatgaatgcacagctaat

SEQ ID NO: 36295 - DNA, 20 bp, Artificial Sequence
  chemically synthesized
atccatgaatgcacagctaa

SEQ ID NO: 36296 - DNA, 20 bp, Artificial Sequence
  chemically synthesized
aatatgaatccatgaatgca

SEQ ID NO: 36297 - DNA, 20 bp, Artificial Sequence
  chemically synthesized
ccctattagctgtgcattca

SEQ ID NO: 36298 - DNA, 20 bp, Artificial Sequence
  chemically synthesized
gcacagtataaatatgtaca

SEQ ID NO: 36299 - DNA, 20 bp, Artificial Sequence
  chemically synthesized
agcctttacagaacaatgca

SEQ ID NO: 36300 - DNA, 20 bp, Artificial Sequence
  chemically synthesized
atactgtgcattgttctgta

SEQ ID NO: 36301 - DNA, 20 bp, Artificial Sequence
  chemically synthesized
tactgtgcattgttctgtaa

SEQ ID NO: 36302 - DNA, 20 bp, Artificial Sequence
  chemically synthesized
aagttgccctaaagccttta

SEQ ID NO: 36303 - DNA, 20 bp, Artificial Sequence
  chemically synthesized
gcattgttctgtaaaggctt

SEQ ID NO: 36304 - DNA, 20 bp, Artificial Sequence
  chemically synthesized
cattgttctgtaaaggcttt

SEQ ID NO: 36305 - DNA, 20 bp, Artificial Sequence
  chemically synthesized
attgttctgtaaaggcttta

SEQ ID NO: 36306 - DNA, 20 bp, Artificial Sequence
  chemically synthesized
cattgttataagttgcccta

SEQ ID NO: 36307 - DNA, 20 bp, Artificial Sequence
  chemically synthesized
taagagttatacattgttat

SEQ ID NO: 36308 - DNA, 20 bp, Artificial Sequence
  chemically synthesized
tgggttttattaatttttaa

SEQ ID NO: 36309 - DNA, 20 bp, Artificial Sequence
  chemically synthesized
gctgggttttattaattttt

SEQ ID NO: 36310 - DNA, 20 bp, Artificial Sequence
  chemically synthesized
tcttaaaaattaataaaacc

SEQ ID NO: 36311 - DNA, 20 bp, Artificial Sequence
  chemically synthesized
aattaataaaacccagcact

SEQ ID NO: 36312 - DNA, 20 bp, Artificial Sequence
  chemically synthesized
attaataaaacccagcacta

SEQ ID NO: 36313 - DNA, 20 bp, Artificial Sequence
  chemically synthesized
atttatatttccttagtgct

SEQ ID NO: 36314 - DNA, 20 bp, Artificial Sequence
  chemically synthesized
tatttatatttccttagtgc

SEQ ID NO: 36315 - DNA, 20 bp, Artificial Sequence
  chemically synthesized
ttatgctatttatatttcct

SEQ ID NO: 36316 - DNA, 20 bp, Artificial Sequence
  chemically synthesized
cagcactaaggaaatataaa

SEQ ID NO: 36317 - DNA, 20 bp, Artificial Sequence
  chemically synthesized
tataaatagcataaaacttt

SEQ ID NO: 36318 - DNA, 20 bp, Artificial Sequence
  chemically synthesized
aaatagcataaaactttaag

SEQ ID NO: 36319 - DNA, 20 bp, Artificial Sequence
  chemically synthesized
taaattttcctcgcttctta

SEQ ID NO: 36320 - DNA, 20 bp, Artificial Sequence
  chemically synthesized
agcataaaactttaagaagc

SEQ ID NO: 36321 - DNA, 20 bp, Artificial Sequence
  chemically synthesized
gcataaaactttaagaagcg

SEQ ID NO: 36322 - DNA, 20 bp, Artificial Sequence
  chemically synthesized
tttaagaagcgaggaaaatt

SEQ ID NO: 36323 - DNA, 20 bp, Artificial Sequence
  chemically synthesized
agcgaggaaaatttagaaca

SEQ ID NO: 36324 - DNA, 20 bp, Artificial Sequence
  chemically synthesized
tgttttttgttttttgtttt

SEQ ID NO: 36325 - DNA, 20 bp, Artificial Sequence
  chemically synthesized
ttttgttttttgttttgaga

SEQ ID NO: 36326 - DNA, 20 bp, Artificial Sequence
  chemically synthesized
ttgttttttgttttgagacg

SEQ ID NO: 36327 - DNA, 20 bp, Artificial Sequence
  chemically synthesized
tccgacctgggtgacagagt

SEQ ID NO: 36328 - DNA, 20 bp, Artificial Sequence
  chemically synthesized
cggagtctcactctgtcacc

SEQ ID NO: 36329 - DNA, 20 bp, Artificial Sequence
  chemically synthesized
gctctccgacctgggtgaca

SEQ ID NO: 36330 - DNA, 20 bp, Artificial Sequence
  chemically synthesized
ggagtctcactctgtcaccc

SEQ ID NO: 36331 - DNA, 20 bp, Artificial Sequence
  chemically synthesized
ctgctctccgacctgggtga

SEQ ID NO: 36332 - DNA, 20 bp, Artificial Sequence
  chemically synthesized
tctcactctgtcacccaggt

SEQ ID NO: 36333 - DNA, 20 bp, Artificial Sequence
  chemically synthesized
tcactctgtcacccaggtcg

SEQ ID NO: 36334 - DNA, 20 bp, Artificial Sequence
  chemically synthesized
gtgccactgctctccgacct

SEQ ID NO: 36335 - DNA, 20 bp, Artificial Sequence
  chemically synthesized
actctgtcacccaggtcgga

SEQ ID NO: 36336 - DNA, 20 bp, Artificial Sequence
  chemically synthesized
cgtgccactgctctccgacc

SEQ ID NO: 36337 - DNA, 20 bp, Artificial Sequence
  chemically synthesized
ctgtcacccaggtcggagag

SEQ ID NO: 36338 - DNA, 20 bp, Artificial Sequence
  chemically synthesized
tcacccaggtcggagagcag

SEQ ID NO: 36339 - DNA, 20 bp, Artificial Sequence
  chemically synthesized
ggagagcagtggcacgatct

SEQ ID NO: 36340 - DNA, 20 bp, Artificial Sequence
  chemically synthesized
ggcagagtttgcagtgagcc

SEQ ID NO: 36341 - DNA, 20 bp, Artificial Sequence
  chemically synthesized
tgggaggcagagtttgcagt

SEQ ID NO: 36342 - DNA, 20 bp, Artificial Sequence
  chemically synthesized
aagctgggaggcagagtttg

SEQ ID NO: 36343 - DNA, 20 bp, Artificial Sequence
  chemically synthesized
tcactgcaaactctgcctcc

SEQ ID NO: 36344 - DNA, 20 bp, Artificial Sequence
  chemically synthesized
ttgcttgaagctgggaggca

SEQ ID NO: 36345 - DNA, 20 bp, Artificial Sequence
  chemically synthesized
aattgcttgaagctgggagg

SEQ ID NO: 36346 - DNA, 20 bp, Artificial Sequence
  chemically synthesized
gagaattgcttgaagctggg

SEQ ID NO: 36347 - DNA, 20 bp, Artificial Sequence
  chemically synthesized
cgagaattgcttgaagctgg

SEQ ID NO: 36348 - DNA, 20 bp, Artificial Sequence
  chemically synthesized
aaactctgcctcccagcttc

SEQ ID NO: 36349 - DNA, 20 bp, Artificial Sequence
  chemically synthesized
cacgagaattgcttgaagct

SEQ ID NO: 36350 - DNA, 20 bp, Artificial Sequence
  chemically synthesized
gcacgagaattgcttgaagc

SEQ ID NO: 36351 - DNA, 20 bp, Artificial Sequence
  chemically synthesized
tgaggcacgagaattgcttg

SEQ ID NO: 36352 - DNA, 20 bp, Artificial Sequence
  chemically synthesized
ttcaagcaattctcgtgcct

SEQ ID NO: 36353 - DNA, 20 bp, Artificial Sequence
  chemically synthesized
tacttgggaggctgaggcac

SEQ ID NO: 36354 - DNA, 20 bp, Artificial Sequence
  chemically synthesized
cccagctacttgggaggctg

SEQ ID NO: 36355 - DNA, 20 bp, Artificial Sequence
  chemically synthesized
tcccagctacttgggaggct

SEQ ID NO: 36356 - DNA, 20 bp, Artificial Sequence
  chemically synthesized
ttctcgtgcctcagcctccc

SEQ ID NO: 36357 - DNA, 20 bp, Artificial Sequence
  chemically synthesized
tcgtgcctcagcctcccaag

SEQ ID NO: 36358 - DNA, 20 bp, Artificial Sequence
  chemically synthesized
tgtaatcccagctacttggg

SEQ ID NO: 36359 - DNA, 20 bp, Artificial Sequence
  chemically synthesized
ctgtaatcccagctacttgg

SEQ ID NO: 36360 - DNA, 20 bp, Artificial Sequence
  chemically synthesized
gcctcagcctcccaagtagc

SEQ ID NO: 36361 - DNA, 20 bp, Artificial Sequence
  chemically synthesized
acctgtaatcccagctactt

SEQ ID NO: 36362 - DNA, 20 bp, Artificial Sequence
  chemically synthesized
cctcagcctcccaagtagct

SEQ ID NO: 36363 - DNA, 20 bp, Artificial Sequence
  chemically synthesized
cacctgtaatcccagctact

SEQ ID NO: 36364 - DNA, 20 bp, Artificial Sequence
  chemically synthesized
ctcccaagtagctgggatta

SEQ ID NO: 36365 - DNA, 20 bp, Artificial Sequence
  chemically synthesized
tcccaagtagctgggattac

SEQ ID NO: 36366 - DNA, 20 bp, Artificial Sequence
  chemically synthesized
gtggcaggcacctgtaatcc

SEQ ID NO: 36367 - DNA, 20 bp, Artificial Sequence
  chemically synthesized
aattagccgggcgtggtggc

SEQ ID NO: 36368 - DNA, 20 bp, Artificial Sequence
  chemically synthesized
aaattagccgggcgtggtgg

SEQ ID NO: 36369 - DNA, 20 bp, Artificial Sequence
  chemically synthesized
caggtgcctgccaccacgcc

SEQ ID NO: 36370 - DNA, 20 bp, Artificial Sequence
  chemically synthesized
aaaaaattagccgggcgtgg

SEQ ID NO: 36371 - DNA, 20 bp, Artificial Sequence
  chemically synthesized
acaaaaaaattagccgggcg

SEQ ID NO: 36372 - DNA, 20 bp, Artificial Sequence
  chemically synthesized
aaaatacaaaaaaattagcc

SEQ ID NO: 36373 - DNA, 20 bp, Artificial Sequence
  chemically synthesized
aaaaatacaaaaaaattagc

SEQ ID NO: 36374 - DNA, 20 bp, Artificial Sequence
  chemically synthesized
taccaaaaatacaaaaaaat

SEQ ID NO: 36375 - DNA, 20 bp, Artificial Sequence
  chemically synthesized
ggctaatttttttgtatttt

SEQ ID NO: 36376 - DNA, 20 bp, Artificial Sequence
  chemically synthesized
taatttttttgtatttttgg

SEQ ID NO: 36377 - DNA, 20 bp, Artificial Sequence
  chemically synthesized
atttttttgtatttttggta

SEQ ID NO: 36378 - DNA, 20 bp, Artificial Sequence
  chemically synthesized
ttttgtatttttggtagaga

SEQ ID NO: 36379 - DNA, 20 bp, Artificial Sequence
  chemically synthesized
tttgtatttttggtagagac

SEQ ID NO: 36380 - DNA, 20 bp, Artificial Sequence
  chemically synthesized
ttgtatttttggtagagacg

SEQ ID NO: 36381 - DNA, 20 bp, Artificial Sequence
  chemically synthesized
gagacggggtttcaccatgt

SEQ ID NO: 36382 - DNA, 20 bp, Artificial Sequence
  chemically synthesized
cggggtttcaccatgttggc

SEQ ID NO: 36383 - DNA, 20 bp, Artificial Sequence
  chemically synthesized
cgacaccagcccggccaaca

SEQ ID NO: 36384 - DNA, 20 bp, Artificial Sequence
  chemically synthesized
ggggtttcaccatgttggcc

SEQ ID NO: 36385 - DNA, 20 bp, Artificial Sequence
  chemically synthesized
tttcaccatgttggccgggc

SEQ ID NO: 36386 - DNA, 20 bp, Artificial Sequence
  chemically synthesized
tcaggagttcgacaccagcc

SEQ ID NO: 36387 - DNA, 20 bp, Artificial Sequence
  chemically synthesized
agaggtcaggagttcgacac

SEQ ID NO: 36388 - DNA, 20 bp, Artificial Sequence
  chemically synthesized
ggctgatcactagaggtcag

SEQ ID NO: 36389 - DNA, 20 bp, Artificial Sequence
  chemically synthesized
ggtgtcgaactcctgacctc

SEQ ID NO: 36390 - DNA, 20 bp, Artificial Sequence
  chemically synthesized
tgggctgatcactagaggtc

SEQ ID NO: 36391 - DNA, 20 bp, Artificial Sequence
  chemically synthesized
gtgggctgatcactagaggt

SEQ ID NO: 36392 - DNA, 20 bp, Artificial Sequence
  chemically synthesized
caaggtgggctgatcactag

SEQ ID NO: 36393 - DNA, 20 bp, Artificial Sequence
  chemically synthesized
aactcctgacctctagtgat

SEQ ID NO: 36394 - DNA, 20 bp, Artificial Sequence
  chemically synthesized
ccaaggtgggctgatcacta

SEQ ID NO: 36395 - DNA, 20 bp, Artificial Sequence
  chemically synthesized
ggccaaggtgggctgatcac

SEQ ID NO: 36396 - DNA, 20 bp, Artificial Sequence
  chemically synthesized
ctctagtgatcagcccacct

SEQ ID NO: 36397 - DNA, 20 bp, Artificial Sequence
  chemically synthesized
acactttgggaggccaaggt

SEQ ID NO: 36398 - DNA, 20 bp, Artificial Sequence
  chemically synthesized
tacactttgggaggccaagg

SEQ ID NO: 36399 - DNA, 20 bp, Artificial Sequence
  chemically synthesized
ccctacactttgggaggcca

SEQ ID NO: 36400 - DNA, 20 bp, Artificial Sequence
  chemically synthesized
tccctacactttgggaggcc

SEQ ID NO: 36401 - DNA, 20 bp, Artificial Sequence
  chemically synthesized
cagcccaccttggcctccca

SEQ ID NO: 36402 - DNA, 20 bp, Artificial Sequence
  chemically synthesized
tgtaatccctacactttggg

SEQ ID NO: 36403 - DNA, 20 bp, Artificial Sequence
  chemically synthesized
ctgtaatccctacactttgg

SEQ ID NO: 36404 - DNA, 20 bp, Artificial Sequence
  chemically synthesized
caccttggcctcccaaagtg

SEQ ID NO: 36405 - DNA, 20 bp, Artificial Sequence
  chemically synthesized
accttggcctcccaaagtgt

SEQ ID NO: 36406 - DNA, 20 bp, Artificial Sequence
  chemically synthesized
acctgtaatccctacacttt

SEQ ID NO: 36407 - DNA, 20 bp, Artificial Sequence
  chemically synthesized
ccttggcctcccaaagtgta

SEQ ID NO: 36408 - DNA, 20 bp, Artificial Sequence
  chemically synthesized
cacctgtaatccctacactt

SEQ ID NO: 36409 - DNA, 20 bp, Artificial Sequence
  chemically synthesized
ctcccaaagtgtagggatta

SEQ ID NO: 36410 - DNA, 20 bp, Artificial Sequence
  chemically synthesized
tcccaaagtgtagggattac

SEQ ID NO: 36411 - DNA, 20 bp, Artificial Sequence
  chemically synthesized
agtgtagggattacaggtgt

SEQ ID NO: 36412 - DNA, 20 bp, Artificial Sequence
  chemically synthesized
caggtgtgagccaccatgcc

SEQ ID NO: 36413 - DNA, 20 bp, Artificial Sequence
  chemically synthesized
tgtgttctggctgggcatgg

SEQ ID NO: 36414 - DNA, 20 bp, Artificial Sequence
  chemically synthesized
agctgtgttctggctgggca

SEQ ID NO: 36415 - DNA, 20 bp, Artificial Sequence
  chemically synthesized
tgtgagccaccatgcccagc

SEQ ID NO: 36416 - DNA, 20 bp, Artificial Sequence
  chemically synthesized
ttcaaagctgtgttctggct

SEQ ID NO: 36417 - DNA, 20 bp, Artificial Sequence
  chemically synthesized
cttcaaagctgtgttctggc

SEQ ID NO: 36418 - DNA, 20 bp, Artificial Sequence
  chemically synthesized
caccatgcccagccagaaca

SEQ ID NO: 36419 - DNA, 20 bp, Artificial Sequence
  chemically synthesized
tgatcttcaaagctgtgttc

SEQ ID NO: 36420 - DNA, 20 bp, Artificial Sequence
  chemically synthesized
ccagccagaacacagctttg

SEQ ID NO: 36421 - DNA, 20 bp, Artificial Sequence
  chemically synthesized
atcatgcactgtgatcttca

SEQ ID NO: 36422 - DNA, 20 bp, Artificial Sequence
  chemically synthesized
gaacacagctttgaagatca

SEQ ID NO: 36423 - DNA, 20 bp, Artificial Sequence
  chemically synthesized
gaagatcacagtgcatgatg

SEQ ID NO: 36424 - DNA, 20 bp, Artificial Sequence
  chemically synthesized
ctcattctggtgggtatgca

SEQ ID NO: 36425 - DNA, 20 bp, Artificial Sequence
  chemically synthesized
attttgctatgcatacccac

SEQ ID NO: 36426 - DNA, 20 bp, Artificial Sequence
  chemically synthesized
tttgtcttgctcattctggt

SEQ ID NO: 36427 - DNA, 20 bp, Artificial Sequence
  chemically synthesized
ctatgcatacccaccagaat

SEQ ID NO: 36428 - DNA, 20 bp, Artificial Sequence
  chemically synthesized
gtttgtcttgctcattctgg

SEQ ID NO: 36429 - DNA, 20 bp, Artificial Sequence
  chemically synthesized
gttgtttgtcttgctcattc

SEQ ID NO: 36430 - DNA, 20 bp, Artificial Sequence
  chemically synthesized
gcatacccaccagaatgagc

SEQ ID NO: 36431 - DNA, 20 bp, Artificial Sequence
  chemically synthesized
aatgagcaagacaaacaaca

SEQ ID NO: 36432 - DNA, 20 bp, Artificial Sequence
  chemically synthesized
atgagcaagacaaacaacac

SEQ ID NO: 36433 - DNA, 20 bp, Artificial Sequence
  chemically synthesized
tgagcaagacaaacaacaca

SEQ ID NO: 36434 - DNA, 20 bp, Artificial Sequence
  chemically synthesized
caagacaaacaacacagggt

SEQ ID NO: 36435 - DNA, 20 bp, Artificial Sequence
  chemically synthesized
acaaacaacacagggttaga

SEQ ID NO: 36436 - DNA, 20 bp, Artificial Sequence
  chemically synthesized
caaacaacacagggttagaa

SEQ ID NO: 36437 - DNA, 20 bp, Artificial Sequence
  chemically synthesized
acacagggttagaaaggatg

SEQ ID NO: 36438 - DNA, 20 bp, Artificial Sequence
  chemically synthesized
acagggttagaaaggatgtg

SEQ ID NO: 36439 - DNA, 20 bp, Artificial Sequence
  chemically synthesized
ctaacagagcatgagagttg

SEQ ID NO: 36440 - DNA, 20 bp, Artificial Sequence
  chemically synthesized
ctcctactaacagagcatga

SEQ ID NO: 36441 - DNA, 20 bp, Artificial Sequence
  chemically synthesized
cactcctactaacagagcat

SEQ ID NO: 36442 - DNA, 20 bp, Artificial Sequence
  chemically synthesized
ctacaactctcatgctctgt

SEQ ID NO: 36443 - DNA, 20 bp, Artificial Sequence
  chemically synthesized
caactctcatgctctgttag

SEQ ID NO: 36444 - DNA, 20 bp, Artificial Sequence
  chemically synthesized
aactctcatgctctgttagt

SEQ ID NO: 36445 - DNA, 20 bp, Artificial Sequence
  chemically synthesized
agtttgcactcctactaaca

SEQ ID NO: 36446 - DNA, 20 bp, Artificial Sequence
  chemically synthesized
ctctcatgctctgttagtag

SEQ ID NO: 36447 - DNA, 20 bp, Artificial Sequence
  chemically synthesized
ccagtttgcactcctactaa

SEQ ID NO: 36448 - DNA, 20 bp, Artificial Sequence
  chemically synthesized
ctgttagtaggagtgcaaac

SEQ ID NO: 36449 - DNA, 20 bp, Artificial Sequence
  chemically synthesized
gttttccaatgtggttgtac

SEQ ID NO: 36450 - DNA, 20 bp, Artificial Sequence
  chemically synthesized
gcaaactggtacaaccacat

SEQ ID NO: 36451 - DNA, 20 bp, Artificial Sequence
  chemically synthesized
ttccaaacagttttccaatg

SEQ ID NO: 36452 - DNA, 20 bp, Artificial Sequence
  chemically synthesized
aaccacattggaaaactgtt

SEQ ID NO: 36453 - DNA, 20 bp, Artificial Sequence
  chemically synthesized
cacattggaaaactgtttgg

SEQ ID NO: 36454 - DNA, 20 bp, Artificial Sequence
  chemically synthesized
cttctgtacattcttccaaa

SEQ ID NO: 36455 - DNA, 20 bp, Artificial Sequence
  chemically synthesized
aaactgtttggaagaatgta

SEQ ID NO: 36456 - DNA, 20 bp, Artificial Sequence
  chemically synthesized
ctgtttggaagaatgtacag

SEQ ID NO: 36457 - DNA, 20 bp, Artificial Sequence
  chemically synthesized
ttatagggtctgtgtgtgtt

SEQ ID NO: 36458 - DNA, 20 bp, Artificial Sequence
  chemically synthesized
gtacagaagctgaacacaca

SEQ ID NO: 36459 - DNA, 20 bp, Artificial Sequence
  chemically synthesized
cacacacagaccctataacc

SEQ ID NO: 36460 - DNA, 20 bp, Artificial Sequence
  chemically synthesized
ggtagaatttctgggttata

SEQ ID NO: 36461 - DNA, 20 bp, Artificial Sequence
  chemically synthesized
gggtagaatttctgggttat

SEQ ID NO: 36462 - DNA, 20 bp, Artificial Sequence
  chemically synthesized
ggggtagaatttctgggtta

SEQ ID NO: 36463 - DNA, 20 bp, Artificial Sequence
  chemically synthesized
tatcaaggggtagaatttct

SEQ ID NO: 36464 - DNA, 20 bp, Artificial Sequence
  chemically synthesized
atatcaaggggtagaatttc

SEQ ID NO: 36465 - DNA, 20 bp, Artificial Sequence
  chemically synthesized
ttgaggactatatcaagggg

SEQ ID NO: 36466 - DNA, 20 bp, Artificial Sequence
  chemically synthesized
agaaattctaccccttgata

SEQ ID NO: 36467 - DNA, 20 bp, Artificial Sequence
  chemically synthesized
cctttgaggactatatcaag

SEQ ID NO: 36468 - DNA, 20 bp, Artificial Sequence
  chemically synthesized
tcctttgaggactatatcaa

SEQ ID NO: 36469 - DNA, 20 bp, Artificial Sequence
  chemically synthesized
ttcctttgaggactatatca

SEQ ID NO: 36470 - DNA, 20 bp, Artificial Sequence
  chemically synthesized
attcctttgaggactatatc

SEQ ID NO: 36471 - DNA, 20 bp, Artificial Sequence
  chemically synthesized
accccttgatatagtcctca

SEQ ID NO: 36472 - DNA, 20 bp, Artificial Sequence
  chemically synthesized
ccccttgatatagtcctcaa

SEQ ID NO: 36473 - DNA, 20 bp, Artificial Sequence
  chemically synthesized
tatatgtatgcattcctttg

SEQ ID NO: 36474 - DNA, 20 bp, Artificial Sequence
  chemically synthesized
atatatgtatgcattccttt

SEQ ID NO: 36475 - DNA, 20 bp, Artificial Sequence
  chemically synthesized
gcatacatatattcatcaaa

SEQ ID NO: 36476 - DNA, 20 bp, Artificial Sequence
  chemically synthesized
attcatcaaatggcatgtct

SEQ ID NO: 36477 - DNA, 20 bp, Artificial Sequence
  chemically synthesized
aatgatgttataaacattct

SEQ ID NO: 36478 - DNA, 20 bp, Artificial Sequence
  chemically synthesized
tactgtggatgggcatttgg

SEQ ID NO: 36479 - DNA, 20 bp, Artificial Sequence
  chemically synthesized
ctctactgtggatgggcatt

SEQ ID NO: 36480 - DNA, 20 bp, Artificial Sequence
  chemically synthesized
ttctaccaaatgcccatcca

SEQ ID NO: 36481 - DNA, 20 bp, Artificial Sequence
  chemically synthesized
ttatatactctactgtggat

SEQ ID NO: 36482 - DNA, 20 bp, Artificial Sequence
  chemically synthesized
taccaaatgcccatccacag

SEQ ID NO: 36483 - DNA, 20 bp, Artificial Sequence
  chemically synthesized
attatatactctactgtgga

SEQ ID NO: 36484 - DNA, 20 bp, Artificial Sequence
  chemically synthesized
ccaaatgcccatccacagta

SEQ ID NO: 36485 - DNA, 20 bp, Artificial Sequence
  chemically synthesized
gtatattatatactctactg

SEQ ID NO: 36486 - DNA, 20 bp, Artificial Sequence
  chemically synthesized
gtagagtatataatatactg

SEQ ID NO: 36487 - DNA, 20 bp, Artificial Sequence
  chemically synthesized
tagagtatataatatactgc

SEQ ID NO: 36488 - DNA, 20 bp, Artificial Sequence
  chemically synthesized
cccattgtgtcaatatcctg

SEQ ID NO: 36489 - DNA, 20 bp, Artificial Sequence
  chemically synthesized
actgcaggatattgacacaa

SEQ ID NO: 36490 - DNA, 20 bp, Artificial Sequence
  chemically synthesized
ctgcaggatattgacacaat

SEQ ID NO: 36491 - DNA, 20 bp, Artificial Sequence
  chemically synthesized
tgacacaatgggatattaca

SEQ ID NO: 36492 - DNA, 20 bp, Artificial Sequence
  chemically synthesized
atgggatattacatagcaat

SEQ ID NO: 36493 - DNA, 20 bp, Artificial Sequence
  chemically synthesized
catgctgttgtatgaagtgg

SEQ ID NO: 36494 - DNA, 20 bp, Artificial Sequence
  chemically synthesized
atccatgctgttgtatgaag

SEQ ID NO: 36495 - DNA, 20 bp, Artificial Sequence
  chemically synthesized
caatccaccacttcatacaa

SEQ ID NO: 36496 - DNA, 20 bp, Artificial Sequence
  chemically synthesized
ttcatccatgctgttgtatg

SEQ ID NO: 36497 - DNA, 20 bp, Artificial Sequence
  chemically synthesized
caccacttcatacaacagca

SEQ ID NO: 36498 - DNA, 20 bp, Artificial Sequence
  chemically synthesized
tacaacagcatggatgaatc

SEQ ID NO: 36499 - DNA, 20 bp, Artificial Sequence
  chemically synthesized
acaacagcatggatgaatcc

SEQ ID NO: 36500 - DNA, 20 bp, Artificial Sequence
  chemically synthesized
catggatgaatccaggttta

SEQ ID NO: 36501 - DNA, 20 bp, Artificial Sequence
  chemically synthesized
gtgtctgacttctttaaacc

SEQ ID NO: 36502 - DNA, 20 bp, Artificial Sequence
  chemically synthesized
ggatgaatccaggtttaaag

SEQ ID NO: 36503 - DNA, 20 bp, Artificial Sequence
  chemically synthesized
gaatccaggtttaaagaagt

SEQ ID NO: 36504 - DNA, 20 bp, Artificial Sequence
  chemically synthesized
tttaaagaagtcagacacaa

SEQ ID NO: 36505 - DNA, 20 bp, Artificial Sequence
  chemically synthesized
taaagaagtcagacacaaaa

SEQ ID NO: 36506 - DNA, 20 bp, Artificial Sequence
  chemically synthesized
tttatataaatgaaattgca

SEQ ID NO: 36507 - DNA, 20 bp, Artificial Sequence
  chemically synthesized
tgtgcaatttcatttatata

SEQ ID NO: 36508 - DNA, 20 bp, Artificial Sequence
  chemically synthesized
gtgcaatttcatttatataa

SEQ ID NO: 36509 - DNA, 20 bp, Artificial Sequence
  chemically synthesized
atttcatttatataaaggac

SEQ ID NO: 36510 - DNA, 20 bp, Artificial Sequence
  chemically synthesized
atttatataaaggacaagaa

SEQ ID NO: 36511 - DNA, 20 bp, Artificial Sequence
  chemically synthesized
tttatataaaggacaagaac

SEQ ID NO: 36512 - DNA, 20 bp, Artificial Sequence
  chemically synthesized
tataaaggacaagaacaggc

SEQ ID NO: 36513 - DNA, 20 bp, Artificial Sequence
  chemically synthesized
ttgaacaccattaaatattc

SEQ ID NO: 36514 - DNA, 20 bp, Artificial Sequence
  chemically synthesized
gaacaggccagaatatttaa

SEQ ID NO: 36515 - DNA, 20 bp, Artificial Sequence
  chemically synthesized
atttaatggtgttcaaaatc

SEQ ID NO: 36516 - DNA, 20 bp, Artificial Sequence
  chemically synthesized
ggtgttcaaaatcaagattg

SEQ ID NO: 36517 - DNA, 20 bp, Artificial Sequence
  chemically synthesized
atcaagattgtggttaccct

SEQ ID NO: 36518 - DNA, 20 bp, Artificial Sequence
  chemically synthesized
caagattgtggttacccttg

SEQ ID NO: 36519 - DNA, 20 bp, Artificial Sequence
  chemically synthesized
aagattgtggttacccttgg

SEQ ID NO: 36520 - DNA, 20 bp, Artificial Sequence
  chemically synthesized
gatagttacctgtcctccaa

SEQ ID NO: 36521 - DNA, 20 bp, Artificial Sequence
  chemically synthesized
ttgtggttacccttggagga

SEQ ID NO: 36522 - DNA, 20 bp, Artificial Sequence
  chemically synthesized
tgatagttacctgtcctcca

SEQ ID NO: 36523 - DNA, 20 bp, Artificial Sequence
  chemically synthesized
tgtggttacccttggaggac

SEQ ID NO: 36524 - DNA, 20 bp, Artificial Sequence
  chemically synthesized
ctgatagttacctgtcctcc

SEQ ID NO: 36525 - DNA, 20 bp, Artificial Sequence
  chemically synthesized
cttggaggacaggtaactat

SEQ ID NO: 36526 - DNA, 20 bp, Artificial Sequence
  chemically synthesized
ggaggacaggtaactatcag

SEQ ID NO: 36527 - DNA, 20 bp, Artificial Sequence
  chemically synthesized
gaggacaggtaactatcaga

SEQ ID NO: 36528 - DNA, 20 bp, Artificial Sequence
  chemically synthesized
aggacaggtaactatcagaa

SEQ ID NO: 36529 - DNA, 20 bp, Artificial Sequence
  chemically synthesized
ccctttgtgtgcccttctga

SEQ ID NO: 36530 - DNA, 20 bp, Artificial Sequence
  chemically synthesized
aactatcagaagggcacaca

SEQ ID NO: 36531 - DNA, 20 bp, Artificial Sequence
  chemically synthesized
actatcagaagggcacacaa

SEQ ID NO: 36532 - DNA, 20 bp, Artificial Sequence
  chemically synthesized
ctatcagaagggcacacaaa

SEQ ID NO: 36533 - DNA, 20 bp, Artificial Sequence
  chemically synthesized
ggcacacaaagggccttcta

SEQ ID NO: 36534 - DNA, 20 bp, Artificial Sequence
  chemically synthesized
gcacacaaagggccttctaa

SEQ ID NO: 36535 - DNA, 20 bp, Artificial Sequence
  chemically synthesized
gaacattaccaacctttaga

SEQ ID NO: 36536 - DNA, 20 bp, Artificial Sequence
  chemically synthesized
agaacattaccaacctttag

SEQ ID NO: 36537 - DNA, 20 bp, Artificial Sequence
  chemically synthesized
acaaagggccttctaaaggt

SEQ ID NO: 36538 - DNA, 20 bp, Artificial Sequence
  chemically synthesized
aacagaacattaccaacctt

SEQ ID NO: 36539 - DNA, 20 bp, Artificial Sequence
  chemically synthesized
ccagcatccaaataaagaaa

SEQ ID NO: 36540 - DNA, 20 bp, Artificial Sequence
  chemically synthesized
taatgttctgtttctttatt

SEQ ID NO: 36541 - DNA, 20 bp, Artificial Sequence
  chemically synthesized
atttaaccagcatccaaata

SEQ ID NO: 36542 - DNA, 20 bp, Artificial Sequence
  chemically synthesized
ctgtttctttatttggatgc

SEQ ID NO: 36543 - DNA, 20 bp, Artificial Sequence
  chemically synthesized
tatttggatgctggttaaat

SEQ ID NO: 36544 - DNA, 20 bp, Artificial Sequence
  chemically synthesized
tctgaacacactcatttaac

SEQ ID NO: 36545 - DNA, 20 bp, Artificial Sequence
  chemically synthesized
gctggttaaatgagtgtgtt

SEQ ID NO: 36546 - DNA, 20 bp, Artificial Sequence
  chemically synthesized
tggcttaaacttatacagtt

SEQ ID NO: 36547 - DNA, 20 bp, Artificial Sequence
  chemically synthesized
gaaaattcactgaactgtat

SEQ ID NO: 36548 - DNA, 20 bp, Artificial Sequence
  chemically synthesized
aaaaatggcttaaacttata

SEQ ID NO: 36549 - DNA, 20 bp, Artificial Sequence
  chemically synthesized
tcactgaactgtataagttt

SEQ ID NO: 36550 - DNA, 20 bp, Artificial Sequence
  chemically synthesized
aattaaaaaaaaagaaaaaa

SEQ ID NO: 36551 - DNA, 20 bp, Artificial Sequence
  chemically synthesized
ttatttgtcaattaaaaaaa

SEQ ID NO: 36552 - DNA, 20 bp, Artificial Sequence
  chemically synthesized
aaaacatgttatacatgata

SEQ ID NO: 36553 - DNA, 20 bp, Artificial Sequence
  chemically synthesized
tttgaaatatgtatacactg

SEQ ID NO: 36554 - DNA, 20 bp, Artificial Sequence
  chemically synthesized
aatatgtatacactgtggaa

SEQ ID NO: 36555 - DNA, 20 bp, Artificial Sequence
  chemically synthesized
agcttggtttagccattcca

SEQ ID NO: 36556 - DNA, 20 bp, Artificial Sequence
  chemically synthesized
cactgtggaatggctaaacc

SEQ ID NO: 36557 - DNA, 20 bp, Artificial Sequence
  chemically synthesized
atatgttacttagcttggtt

SEQ ID NO: 36558 - DNA, 20 bp, Artificial Sequence
  chemically synthesized
tggaatggctaaaccaagct

SEQ ID NO: 36559 - DNA, 20 bp, Artificial Sequence
  chemically synthesized
aatgcatatgttacttagct

SEQ ID NO: 36560 - DNA, 20 bp, Artificial Sequence
  chemically synthesized
gaggtaatgcatatgttact

SEQ ID NO: 36561 - DNA, 20 bp, Artificial Sequence
  chemically synthesized
taagaaatgataagtatatg

SEQ ID NO: 36562 - DNA, 20 bp, Artificial Sequence
  chemically synthesized
ataagaaatgataagtatat

SEQ ID NO: 36563 - DNA, 20 bp, Artificial Sequence
  chemically synthesized
ttatcaccataagaaatgat

SEQ ID NO: 36564 - DNA, 20 bp, Artificial Sequence
  chemically synthesized
catatacttatcatttctta

SEQ ID NO: 36565 - DNA, 20 bp, Artificial Sequence
  chemically synthesized
gatttaagtattatcaccat

SEQ ID NO: 36566 - DNA, 20 bp, Artificial Sequence
  chemically synthesized
attgctaagagagtagattt

SEQ ID NO: 36567 - DNA, 20 bp, Artificial Sequence
  chemically synthesized
aatacttaaatctactctct

SEQ ID NO: 36568 - DNA, 20 bp, Artificial Sequence
  chemically synthesized
cttgaaaattgctaagagag

SEQ ID NO: 36569 - DNA, 20 bp, Artificial Sequence
  chemically synthesized
agtcttgaaaattgctaaga

SEQ ID NO: 36570 - DNA, 20 bp, Artificial Sequence
  chemically synthesized
atagtcttgaaaattgctaa

SEQ ID NO: 36571 - DNA, 20 bp, Artificial Sequence
  chemically synthesized
gtatagtcttgaaaattgct

SEQ ID NO: 36572 - DNA, 20 bp, Artificial Sequence
  chemically synthesized
ctactctcttagcaattttc

SEQ ID NO: 36573 - DNA, 20 bp, Artificial Sequence
  chemically synthesized
agcaattttcaagactatac

SEQ ID NO: 36574 - DNA, 20 bp, Artificial Sequence
  chemically synthesized
taggtaatgaaaatctagta

SEQ ID NO: 36575 - DNA, 20 bp, Artificial Sequence
  chemically synthesized
gactataggtaatgaaaatc

SEQ ID NO: 36576 - DNA, 20 bp, Artificial Sequence
  chemically synthesized
tactagattttcattaccta

SEQ ID NO: 36577 - DNA, 20 bp, Artificial Sequence
  chemically synthesized
ttgtacaccatggtgactat

SEQ ID NO: 36578 - DNA, 20 bp, Artificial Sequence
  chemically synthesized
attgtacaccatggtgacta

SEQ ID NO: 36579 - DNA, 20 bp, Artificial Sequence
  chemically synthesized
ttcattacctatagtcacca

SEQ ID NO: 36580 - DNA, 20 bp, Artificial Sequence
  chemically synthesized
aagagctctattgtacacca

SEQ ID NO: 36581 - DNA, 20 bp, Artificial Sequence
  chemically synthesized
atagtcaccatggtgtacaa

SEQ ID NO: 36582 - DNA, 20 bp, Artificial Sequence
  chemically synthesized
agtcaccatggtgtacaata

SEQ ID NO: 36583 - DNA, 20 bp, Artificial Sequence
  chemically synthesized
gttaggaggaataagttcaa

SEQ ID NO: 36584 - DNA, 20 bp, Artificial Sequence
  chemically synthesized
cggttaggaggaataagttc

SEQ ID NO: 36585 - DNA, 20 bp, Artificial Sequence
  chemically synthesized
aaacttcggttaggaggaat

SEQ ID NO: 36586 - DNA, 20 bp, Artificial Sequence
  chemically synthesized
gatatgaaacttcggttagg

SEQ ID NO: 36587 - DNA, 20 bp, Artificial Sequence
  chemically synthesized
gaacttattcctcctaaccg

SEQ ID NO: 36588 - DNA, 20 bp, Artificial Sequence
  chemically synthesized
ggatatgaaacttcggttag

SEQ ID NO: 36589 - DNA, 20 bp, Artificial Sequence
  chemically synthesized
aaggatatgaaacttcggtt

SEQ ID NO: 36590 - DNA, 20 bp, Artificial Sequence
  chemically synthesized
aaaggatatgaaacttcggt

SEQ ID NO: 36591 - DNA, 20 bp, Artificial Sequence
  chemically synthesized
ggttaaaggatatgaaactt

SEQ ID NO: 36592 - DNA, 20 bp, Artificial Sequence
  chemically synthesized
gaagtttcatatcctttaac

SEQ ID NO: 36593 - DNA, 20 bp, Artificial Sequence
  chemically synthesized
ataagggagatgctggttaa

SEQ ID NO: 36594 - DNA, 20 bp, Artificial Sequence
  chemically synthesized
aataagggagatgctggtta

SEQ ID NO: 36595 - DNA, 20 bp, Artificial Sequence
  chemically synthesized
gtagaaaataagggagatgc

SEQ ID NO: 36596 - DNA, 20 bp, Artificial Sequence
  chemically synthesized
taggcatgtagaaaataagg

SEQ ID NO: 36597 - DNA, 20 bp, Artificial Sequence
  chemically synthesized
attaggcatgtagaaaataa

SEQ ID NO: 36598 - DNA, 20 bp, Artificial Sequence
  chemically synthesized
tattaggcatgtagaaaata

SEQ ID NO: 36599 - DNA, 20 bp, Artificial Sequence
  chemically synthesized
atattaggcatgtagaaaat

SEQ ID NO: 36600 - DNA, 20 bp, Artificial Sequence
  chemically synthesized
actgaaatatattaggcatg

SEQ ID NO: 36601 - DNA, 20 bp, Artificial Sequence
  chemically synthesized
cttttttactgaaatatatt

SEQ ID NO: 36602 - DNA, 20 bp, Artificial Sequence
  chemically synthesized
acttttttactgaaatatat

SEQ ID NO: 36603 - DNA, 20 bp, Artificial Sequence
  chemically synthesized
tctacatgcctaatatattt

SEQ ID NO: 36604 - DNA, 20 bp, Artificial Sequence
  chemically synthesized
cctaatatatttcagtaaaa

SEQ ID NO: 36605 - DNA, 20 bp, Artificial Sequence
  chemically synthesized
tcagtaaaaaagtgttttaa

SEQ ID NO: 36606 - DNA, 20 bp, Artificial Sequence
  chemically synthesized
cagtaaaaaagtgttttaaa

SEQ ID NO: 36607 - DNA, 20 bp, Artificial Sequence
  chemically synthesized
taaaaaagtgttttaaaagg

SEQ ID NO: 36608 - DNA, 20 bp, Artificial Sequence
  chemically synthesized
aaaaaagtgttttaaaaggt

SEQ ID NO: 36609 - DNA, 20 bp, Artificial Sequence
  chemically synthesized
tttaaaaggtgggtataatt

SEQ ID NO: 36610 - DNA, 20 bp, Artificial Sequence
  chemically synthesized
aggtgggtataatttggttg

SEQ ID NO: 36611 - DNA, 20 bp, Artificial Sequence
  chemically synthesized
taatttggttgtggcctttg

SEQ ID NO: 36612 - DNA, 20 bp, Artificial Sequence
  chemically synthesized
ttttgctttgacatctacaa

SEQ ID NO: 36613 - DNA, 20 bp, Artificial Sequence
  chemically synthesized
cttttgctttgacatctaca

SEQ ID NO: 36614 - DNA, 20 bp, Artificial Sequence
  chemically synthesized
tgtggcctttgtagatgtca

SEQ ID NO: 36615 - DNA, 20 bp, Artificial Sequence
  chemically synthesized
ctttgtagatgtcaaagcaa

SEQ ID NO: 36616 - DNA, 20 bp, Artificial Sequence
  chemically synthesized
aagcaaaagaaaaaatataa

SEQ ID NO: 36617 - DNA, 20 bp, Artificial Sequence
  chemically synthesized
agcaaaagaaaaaatataaa

SEQ ID NO: 36618 - DNA, 20 bp, Artificial Sequence
  chemically synthesized
atatgatcgattttattatt

SEQ ID NO: 36619 - DNA, 20 bp, Artificial Sequence
  chemically synthesized
ttattatttggattattgat

SEQ ID NO: 36620 - DNA, 20 bp, Artificial Sequence
  chemically synthesized
tattatttggattattgata

SEQ ID NO: 36621 - DNA, 20 bp, Artificial Sequence
  chemically synthesized
ttatttggattattgataag

SEQ ID NO: 36622 - DNA, 20 bp, Artificial Sequence
  chemically synthesized
tatttggattattgataagg

SEQ ID NO: 36623 - DNA, 20 bp, Artificial Sequence
  chemically synthesized
tggattattgataaggagga

SEQ ID NO: 36624 - DNA, 20 bp, Artificial Sequence
  chemically synthesized
gattattgataaggaggaaa

SEQ ID NO: 36625 - DNA, 20 bp, Artificial Sequence
  chemically synthesized
tgataaggaggaaagagtgt

SEQ ID NO: 36626 - DNA, 20 bp, Artificial Sequence
  chemically synthesized
gaaagagtgtaagtgaaaca

SEQ ID NO: 36627 - DNA, 20 bp, Artificial Sequence
  chemically synthesized
aaagagtgtaagtgaaacaa

SEQ ID NO: 36628 - DNA, 20 bp, Artificial Sequence
  chemically synthesized
agtgaaacaaaggaaaatcc

SEQ ID NO: 36629 - DNA, 20 bp, Artificial Sequence
  chemically synthesized
aacaaaggaaaatccaagtc

SEQ ID NO: 36630 - DNA, 20 bp, Artificial Sequence
  chemically synthesized
aatctaagtcattccagact

SEQ ID NO: 36631 - DNA, 20 bp, Artificial Sequence
  chemically synthesized
ttattcaatctaagtcattc

SEQ ID NO: 36632 - DNA, 20 bp, Artificial Sequence
  chemically synthesized
aatccaagtctggaatgact

SEQ ID NO: 36633 - DNA, 20 bp, Artificial Sequence
  chemically synthesized
cagatctgtttattcaatct

SEQ ID NO: 36634 - DNA, 20 bp, Artificial Sequence
  chemically synthesized
aatgacttagattgaataaa

SEQ ID NO: 36635 - DNA, 20 bp, Artificial Sequence
  chemically synthesized
attgaataaacagatctgca

SEQ ID NO: 36636 - DNA, 20 bp, Artificial Sequence
  chemically synthesized
ttgaataaacagatctgcat

SEQ ID NO: 36637 - DNA, 20 bp, Artificial Sequence
  chemically synthesized
ctcccaccttagatcccatg

SEQ ID NO: 36638 - DNA, 20 bp, Artificial Sequence
  chemically synthesized
aacagatctgcatgggatct

SEQ ID NO: 36639 - DNA, 20 bp, Artificial Sequence
  chemically synthesized
acagatctgcatgggatcta

SEQ ID NO: 36640 - DNA, 20 bp, Artificial Sequence
  chemically synthesized
gatctgcatgggatctaagg

SEQ ID NO: 36641 - DNA, 20 bp, Artificial Sequence
  chemically synthesized
atctgcatgggatctaaggt

SEQ ID NO: 36642 - DNA, 20 bp, Artificial Sequence
  chemically synthesized
ctgcatgggatctaaggtgg

SEQ ID NO: 36643 - DNA, 20 bp, Artificial Sequence
  chemically synthesized
ccatgcagtgtctcccacct

SEQ ID NO: 36644 - DNA, 20 bp, Artificial Sequence
  chemically synthesized
ctaaggtgggagacactgca

SEQ ID NO: 36645 - DNA, 20 bp, Artificial Sequence
  chemically synthesized
ttctgaaagtcgacaccatg

SEQ ID NO: 36646 - DNA, 20 bp, Artificial Sequence
  chemically synthesized
cactgcatggtgtcgacttt

SEQ ID NO: 36647 - DNA, 20 bp, Artificial Sequence
  chemically synthesized
tgctgaagggatttttctga

SEQ ID NO: 36648 - DNA, 20 bp, Artificial Sequence
  chemically synthesized
gactttcagaaaaatccctt

SEQ ID NO: 36649 - DNA, 20 bp, Artificial Sequence
  chemically synthesized
tttcagaaaaatcccttcag

SEQ ID NO: 36650 - DNA, 20 bp, Artificial Sequence
  chemically synthesized
gggcactgaaaactgctgaa

SEQ ID NO: 36651 - DNA, 20 bp, Artificial Sequence
  chemically synthesized
ggggcactgaaaactgctga

SEQ ID NO: 36652 - DNA, 20 bp, Artificial Sequence
  chemically synthesized
aggggcactgaaaactgctg

SEQ ID NO: 36653 - DNA, 20 bp, Artificial Sequence
  chemically synthesized
aaaatcccttcagcagtttt

SEQ ID NO: 36654 - DNA, 20 bp, Artificial Sequence
  chemically synthesized
tgttcctggcttatgtcgag

SEQ ID NO: 36655 - DNA, 20 bp, Artificial Sequence
  chemically synthesized
ttttcagtgcccctcgacat

SEQ ID NO: 36656 - DNA, 20 bp, Artificial Sequence
  chemically synthesized
atgttcctggcttatgtcga

SEQ ID NO: 36657 - DNA, 20 bp, Artificial Sequence
  chemically synthesized
catgttcctggcttatgtcg

SEQ ID NO: 36658 - DNA, 20 bp, Artificial Sequence
  chemically synthesized
tcatgttcctggcttatgtc

SEQ ID NO: 36659 - DNA, 20 bp, Artificial Sequence
  chemically synthesized
cagtgcccctcgacataagc

SEQ ID NO: 36660 - DNA, 20 bp, Artificial Sequence
  chemically synthesized
agtgcccctcgacataagcc

SEQ ID NO: 36661 - DNA, 20 bp, Artificial Sequence
  chemically synthesized
gtacctcggcatcatgttcc

SEQ ID NO: 36662 - DNA, 20 bp, Artificial Sequence
  chemically synthesized
taagccaggaacatgatgcc

SEQ ID NO: 36663 - DNA, 20 bp, Artificial Sequence
  chemically synthesized
aagccaggaacatgatgccg

SEQ ID NO: 36664 - DNA, 20 bp, Artificial Sequence
  chemically synthesized
gcctcaactcaggtgtacct

SEQ ID NO: 36665 - DNA, 20 bp, Artificial Sequence
  chemically synthesized
catgatgccgaggtacacct

SEQ ID NO: 36666 - DNA, 20 bp, Artificial Sequence
  chemically synthesized
tgccgaggtacacctgagtt

SEQ ID NO: 36667 - DNA, 20 bp, Artificial Sequence
  chemically synthesized
gccgaggtacacctgagttg

SEQ ID NO: 36668 - DNA, 20 bp, Artificial Sequence
  chemically synthesized
ccataagattgcctcaactc

SEQ ID NO: 36669 - DNA, 20 bp, Artificial Sequence
  chemically synthesized
cccataagattgcctcaact

SEQ ID NO: 36670 - DNA, 20 bp, Artificial Sequence
  chemically synthesized
cctgagttgaggcaatctta

SEQ ID NO: 36671 - DNA, 20 bp, Artificial Sequence
  chemically synthesized
ctgagttgaggcaatcttat

SEQ ID NO: 36672 - DNA, 20 bp, Artificial Sequence
  chemically synthesized
tgagttgaggcaatcttatg

SEQ ID NO: 36673 - DNA, 20 bp, Artificial Sequence
  chemically synthesized
gagttgaggcaatcttatgg

SEQ ID NO: 36674 - DNA, 20 bp, Artificial Sequence
  chemically synthesized
cactttgccttggcccccat

SEQ ID NO: 36675 - DNA, 20 bp, Artificial Sequence
  chemically synthesized
gaggcaatcttatgggggcc

SEQ ID NO: 36676 - DNA, 20 bp, Artificial Sequence
  chemically synthesized
aggcaatcttatgggggcca

SEQ ID NO: 36677 - DNA, 20 bp, Artificial Sequence
  chemically synthesized
atcttatgggggccaaggca

SEQ ID NO: 36678 - DNA, 20 bp, Artificial Sequence
  chemically synthesized
attcttagaccactttgcct

SEQ ID NO: 36679 - DNA, 20 bp, Artificial Sequence
  chemically synthesized
ttatgggggccaaggcaaag

SEQ ID NO: 36680 - DNA, 20 bp, Artificial Sequence
  chemically synthesized
gggccaaggcaaagtggtct

SEQ ID NO: 36681 - DNA, 20 bp, Artificial Sequence
  chemically synthesized
ggcaaagtggtctaagaatg

SEQ ID NO: 36682 - DNA, 20 bp, Artificial Sequence
  chemically synthesized
tcatcagaaagctgcattct

SEQ ID NO: 36683 - DNA, 20 bp, Artificial Sequence
  chemically synthesized
cctcaggccaggtcatcaga

SEQ ID NO: 36684 - DNA, 20 bp, Artificial Sequence
  chemically synthesized
aatgcagctttctgatgacc

SEQ ID NO: 36685 - DNA, 20 bp, Artificial Sequence
  chemically synthesized
tccacctcaggccaggtcat

SEQ ID NO: 36686 - DNA, 20 bp, Artificial Sequence
  chemically synthesized
gctttctgatgacctggcct

SEQ ID NO: 36687 - DNA, 20 bp, Artificial Sequence
  chemically synthesized
ctttctgatgacctggcctg

SEQ ID NO: 36688 - DNA, 20 bp, Artificial Sequence
  chemically synthesized
ttttatctccacctcaggcc

SEQ ID NO: 36689 - DNA, 20 bp, Artificial Sequence
  chemically synthesized
gttttatctccacctcaggc

SEQ ID NO: 36690 - DNA, 20 bp, Artificial Sequence
  chemically synthesized
tctgatgacctggcctgagg

SEQ ID NO: 36691 - DNA, 20 bp, Artificial Sequence
  chemically synthesized
tgatgacctggcctgaggtg

SEQ ID NO: 36692 - DNA, 20 bp, Artificial Sequence
  chemically synthesized
gttagttttatctccacctc

SEQ ID NO: 36693 - DNA, 20 bp, Artificial Sequence
  chemically synthesized
agttagttttatctccacct

SEQ ID NO: 36694 - DNA, 20 bp, Artificial Sequence
  chemically synthesized
ggtggagataaaactaacta

SEQ ID NO: 36695 - DNA, 20 bp, Artificial Sequence
  chemically synthesized
agtttgaaaaacactgtagt

SEQ ID NO: 36696 - DNA, 20 bp, Artificial Sequence
  chemically synthesized
ctgcagtttgaaaaacactg

SEQ ID NO: 36697 - DNA, 20 bp, Artificial Sequence
  chemically synthesized
ctacagtgtttttcaaactg

SEQ ID NO: 36698 - DNA, 20 bp, Artificial Sequence
  chemically synthesized
tacagtgtttttcaaactgc

SEQ ID NO: 36699 - DNA, 20 bp, Artificial Sequence
  chemically synthesized
tactaagggttcatgacctg

SEQ ID NO: 36700 - DNA, 20 bp, Artificial Sequence
  chemically synthesized
aactgcaggtcatgaaccct

SEQ ID NO: 36701 - DNA, 20 bp, Artificial Sequence
  chemically synthesized
tagatttcatgacgtactaa

SEQ ID NO: 36702 - DNA, 20 bp, Artificial Sequence
  chemically synthesized
atagatttcatgacgtacta

SEQ ID NO: 36703 - DNA, 20 bp, Artificial Sequence
  chemically synthesized
tatagatttcatgacgtact

SEQ ID NO: 36704 - DNA, 20 bp, Artificial Sequence
  chemically synthesized
agtacgtcatgaaatctata

SEQ ID NO: 36705 - DNA, 20 bp, Artificial Sequence
  chemically synthesized
acgtcatgaaatctatatag

SEQ ID NO: 36706 - DNA, 20 bp, Artificial Sequence
  chemically synthesized
actggtaatgatccactata

SEQ ID NO: 36707 - DNA, 20 bp, Artificial Sequence
  chemically synthesized
tctatatagtggatcattac

SEQ ID NO: 36708 - DNA, 20 bp, Artificial Sequence
  chemically synthesized
tgtttcattaagaacaatac

SEQ ID NO: 36709 - DNA, 20 bp, Artificial Sequence
  chemically synthesized
cagtattgttcttaatgaaa

SEQ ID NO: 36710 - DNA, 20 bp, Artificial Sequence
  chemically synthesized
ctattcttttctgtttcatt

SEQ ID NO: 36711 - DNA, 20 bp, Artificial Sequence
  chemically synthesized
ttgttcttaatgaaacagaa

SEQ ID NO: 36712 - DNA, 20 bp, Artificial Sequence
  chemically synthesized
cttaatgaaacagaaaagaa

SEQ ID NO: 36713 - DNA, 20 bp, Artificial Sequence
  chemically synthesized
gaaaagaatagaaaatatga

SEQ ID NO: 36714 - DNA, 20 bp, Artificial Sequence
  chemically synthesized
gaatagaaaatatgacagtg

SEQ ID NO: 36715 - DNA, 20 bp, Artificial Sequence
  chemically synthesized
atagaaaatatgacagtgta

SEQ ID NO: 36716 - DNA, 20 bp, Artificial Sequence
  chemically synthesized
tagaaaatatgacagtgtag

SEQ ID NO: 36717 - DNA, 20 bp, Artificial Sequence
  chemically synthesized
aaatatgacagtgtagaggt

SEQ ID NO: 36718 - DNA, 20 bp, Artificial Sequence
  chemically synthesized
atatgacagtgtagaggttg

SEQ ID NO: 36719 - DNA, 20 bp, Artificial Sequence
  chemically synthesized
tgacagtgtagaggttggag

SEQ ID NO: 36720 - DNA, 20 bp, Artificial Sequence
  chemically synthesized
gacagtgtagaggttggagt

SEQ ID NO: 36721 - DNA, 20 bp, Artificial Sequence
  chemically synthesized
acagtgtagaggttggagtg

SEQ ID NO: 36722 - DNA, 20 bp, Artificial Sequence
  chemically synthesized
agaggttggagtggggaaaa

SEQ ID NO: 36723 - DNA, 20 bp, Artificial Sequence
  chemically synthesized
gaggttggagtggggaaaat

SEQ ID NO: 36724 - DNA, 20 bp, Artificial Sequence
  chemically synthesized
tgggttataaaactacctat

SEQ ID NO: 36725 - DNA, 20 bp, Artificial Sequence
  chemically synthesized
gggttataaaactacctatt

SEQ ID NO: 36726 - DNA, 20 bp, Artificial Sequence
  chemically synthesized
tgagcatagtacccaatagg

SEQ ID NO: 36727 - DNA, 20 bp, Artificial Sequence
  chemically synthesized
ttgtgagcatagtacccaat

SEQ ID NO: 36728 - DNA, 20 bp, Artificial Sequence
  chemically synthesized
attgtgagcatagtacccaa

SEQ ID NO: 36729 - DNA, 20 bp, Artificial Sequence
  chemically synthesized
tgttacccagattgtgagca

SEQ ID NO: 36730 - DNA, 20 bp, Artificial Sequence
  chemically synthesized
tgggtactatgctcacaatc

SEQ ID NO: 36731 - DNA, 20 bp, Artificial Sequence
  chemically synthesized
gggtactatgctcacaatct

SEQ ID NO: 36732 - DNA, 20 bp, Artificial Sequence
  chemically synthesized
tgacctgttacccagattgt

SEQ ID NO: 36733 - DNA, 20 bp, Artificial Sequence
  chemically synthesized
tatgctcacaatctgggtaa

SEQ ID NO: 36734 - DNA, 20 bp, Artificial Sequence
  chemically synthesized
atgctcacaatctgggtaac

SEQ ID NO: 36735 - DNA, 20 bp, Artificial Sequence
  chemically synthesized
ggggctcatgacctgttacc

SEQ ID NO: 36736 - DNA, 20 bp, Artificial Sequence
  chemically synthesized
caatctgggtaacaggtcat

SEQ ID NO: 36737 - DNA, 20 bp, Artificial Sequence
  chemically synthesized
aggtcatgagccccacacct

SEQ ID NO: 36738 - DNA, 20 bp, Artificial Sequence
  chemically synthesized
ttgcatgatgctaaggtgtg

SEQ ID NO: 36739 - DNA, 20 bp, Artificial Sequence
  chemically synthesized
attgcatgatgctaaggtgt

SEQ ID NO: 36740 - DNA, 20 bp, Artificial Sequence
  chemically synthesized
cattgcatgatgctaaggtg

SEQ ID NO: 36741 - DNA, 20 bp, Artificial Sequence
  chemically synthesized
gggaacattgcatgatgcta

SEQ ID NO: 36742 - DNA, 20 bp, Artificial Sequence
  chemically synthesized
tgggaacattgcatgatgct

SEQ ID NO: 36743 - DNA, 20 bp, Artificial Sequence
  chemically synthesized
catgtacaggtttgttacat

SEQ ID NO: 36744 - DNA, 20 bp, Artificial Sequence
  chemically synthesized
acatgtacaggtttgttaca

SEQ ID NO: 36745 - DNA, 20 bp, Artificial Sequence
  chemically synthesized
gatacaggaggtacatgtac

SEQ ID NO: 36746 - DNA, 20 bp, Artificial Sequence
  chemically synthesized
agatacaggaggtacatgta

SEQ ID NO: 36747 - DNA, 20 bp, Artificial Sequence
  chemically synthesized
acttctattttagatacagg

SEQ ID NO: 36748 - DNA, 20 bp, Artificial Sequence
  chemically synthesized
aacttctattttagatacag

SEQ ID NO: 36749 - DNA, 20 bp, Artificial Sequence
  chemically synthesized
tcaacttctattttagatac

SEQ ID NO: 36750 - DNA, 20 bp, Artificial Sequence
  chemically synthesized
ttcaacttctattttagata

SEQ ID NO: 36751 - DNA, 20 bp, Artificial Sequence
  chemically synthesized
tgtacctcctgtatctaaaa

SEQ ID NO: 36752 - DNA, 20 bp, Artificial Sequence
  chemically synthesized
acctcctgtatctaaaatag

SEQ ID NO: 36753 - DNA, 20 bp, Artificial Sequence
  chemically synthesized
tttaatttcaacttctattt

SEQ ID NO: 36754 - DNA, 20 bp, Artificial Sequence
  chemically synthesized
aaaaaaaaaaaaaaatatga

SEQ ID NO: 36755 - DNA, 20 bp, Artificial Sequence
  chemically synthesized
aaatatgaaagtgtactatt

SEQ ID NO: 36756 - DNA, 20 bp, Artificial Sequence
  chemically synthesized
tgaaagtgtactatttggta

SEQ ID NO: 36757 - DNA, 20 bp, Artificial Sequence
  chemically synthesized
cattacttacccataccaaa

SEQ ID NO: 36758 - DNA, 20 bp, Artificial Sequence
  chemically synthesized
gaaagtgtactatttggtat

SEQ ID NO: 36759 - DNA, 20 bp, Artificial Sequence
  chemically synthesized
gtgtactatttggtatgggt

SEQ ID NO: 36760 - DNA, 20 bp, Artificial Sequence
  chemically synthesized
tgcttgtatgattgaaagaa

SEQ ID NO: 36761 - DNA, 20 bp, Artificial Sequence
  chemically synthesized
attcatgcttgtatgattga

SEQ ID NO: 36762 - DNA, 20 bp, Artificial Sequence
  chemically synthesized
aacttttctttcaatcatac

SEQ ID NO: 36763 - DNA, 20 bp, Artificial Sequence
  chemically synthesized
ttcaatcatacaagcatgaa

SEQ ID NO: 36764 - DNA, 20 bp, Artificial Sequence
  chemically synthesized
atcatacaagcatgaataga

SEQ ID NO: 36765 - DNA, 20 bp, Artificial Sequence
  chemically synthesized
caagcatgaatagacagaaa

SEQ ID NO: 36766 - DNA, 20 bp, Artificial Sequence
  chemically synthesized
aatagacagaaaaagattta

SEQ ID NO: 36767 - DNA, 20 bp, Artificial Sequence
  chemically synthesized
cagaaaaagatttacagata

SEQ ID NO: 36768 - DNA, 20 bp, Artificial Sequence
  chemically synthesized
gtgtgcgtgtgtgtgtgtac

SEQ ID NO: 36769 - DNA, 20 bp, Artificial Sequence
  chemically synthesized
tgtgcgtgtgtgtgtgtacc

SEQ ID NO: 36770 - DNA, 20 bp, Artificial Sequence
  chemically synthesized
attaattttatatgtcatcc

SEQ ID NO: 36771 - DNA, 20 bp, Artificial Sequence
  chemically synthesized
acatataaaattaattttta

SEQ ID NO: 36772 - DNA, 20 bp, Artificial Sequence
  chemically synthesized
tataaaattaatttttatag

SEQ ID NO: 36773 - DNA, 20 bp, Artificial Sequence
  chemically synthesized
aattaatttttatagtggat

SEQ ID NO: 36774 - DNA, 20 bp, Artificial Sequence
  chemically synthesized
tttatagtggattggcaaaa

SEQ ID NO: 36775 - DNA, 20 bp, Artificial Sequence
  chemically synthesized
tggattggcaaaaaagatga

SEQ ID NO: 36776 - DNA, 20 bp, Artificial Sequence
  chemically synthesized
ggcaaaaaagatgaaagcta

SEQ ID NO: 36777 - DNA, 20 bp, Artificial Sequence
  chemically synthesized
gcaaaaaagatgaaagctac

SEQ ID NO: 36778 - DNA, 20 bp, Artificial Sequence
  chemically synthesized
tctttatgtagtaaagcctg

SEQ ID NO: 36779 - DNA, 20 bp, Artificial Sequence
  chemically synthesized
gtccatttctttatgtagta

SEQ ID NO: 36780 - DNA, 20 bp, Artificial Sequence
  chemically synthesized
gctacaggctttactacata

SEQ ID NO: 36781 - DNA, 20 bp, Artificial Sequence
  chemically synthesized
agtttgtccatttctttatg

SEQ ID NO: 36782 - DNA, 20 bp, Artificial Sequence
  chemically synthesized
ggctttactacataaagaaa

SEQ ID NO: 36783 - DNA, 20 bp, Artificial Sequence
  chemically synthesized
gattgtccagtgggcatgta

SEQ ID NO: 36784 - DNA, 20 bp, Artificial Sequence
  chemically synthesized
gacaaactatacatgcccac

SEQ ID NO: 36785 - DNA, 20 bp, Artificial Sequence
  chemically synthesized
atgatgcatgattgtccagt

SEQ ID NO: 36786 - DNA, 20 bp, Artificial Sequence
  chemically synthesized
aatgatgcatgattgtccag

SEQ ID NO: 36787 - DNA, 20 bp, Artificial Sequence
  chemically synthesized
tataatgatgcatgattgtc

SEQ ID NO: 36788 - DNA, 20 bp, Artificial Sequence
  chemically synthesized
atgcatcattataatttctc

SEQ ID NO: 36789 - DNA, 20 bp, Artificial Sequence
  chemically synthesized
tcattataatttctctagac

SEQ ID NO: 36790 - DNA, 20 bp, Artificial Sequence
  chemically synthesized
cattataatttctctagact

SEQ ID NO: 36791 - DNA, 20 bp, Artificial Sequence
  chemically synthesized
tctttccaaatcctagtcta

SEQ ID NO: 36792 - DNA, 20 bp, Artificial Sequence
  chemically synthesized
cttctttccaaatcctagtc

SEQ ID NO: 36793 - DNA, 20 bp, Artificial Sequence
  chemically synthesized
aatttctctagactaggatt

SEQ ID NO: 36794 - DNA, 20 bp, Artificial Sequence
  chemically synthesized
gtcaacttctttccaaatcc

SEQ ID NO: 36795 - DNA, 20 bp, Artificial Sequence
  chemically synthesized
tctctagactaggatttgga

SEQ ID NO: 36796 - DNA, 20 bp, Artificial Sequence
  chemically synthesized
ctagactaggatttggaaag

SEQ ID NO: 36797 - DNA, 20 bp, Artificial Sequence
  chemically synthesized
aggatttggaaagaagttga

SEQ ID NO: 36798 - DNA, 20 bp, Artificial Sequence
  chemically synthesized
atttggaaagaagttgacgg

SEQ ID NO: 36799 - DNA, 20 bp, Artificial Sequence
  chemically synthesized
ggaaagaagttgacggaaga

SEQ ID NO: 36800 - DNA, 20 bp, Artificial Sequence
  chemically synthesized
agttgacggaagacagtttg

SEQ ID NO: 36801 - DNA, 20 bp, Artificial Sequence
  chemically synthesized
cagtttgcagtcttattccc

SEQ ID NO: 36802 - DNA, 20 bp, Artificial Sequence
  chemically synthesized
tccagcccttaccagggaat

SEQ ID NO: 36803 - DNA, 20 bp, Artificial Sequence
  chemically synthesized
ttgcagtcttattccctggt

SEQ ID NO: 36804 - DNA, 20 bp, Artificial Sequence
  chemically synthesized
tgcagtcttattccctggta

SEQ ID NO: 36805 - DNA, 20 bp, Artificial Sequence
  chemically synthesized
gcagtcttattccctggtaa

SEQ ID NO: 36806 - DNA, 20 bp, Artificial Sequence
  chemically synthesized
taatgttccagcccttacca

SEQ ID NO: 36807 - DNA, 20 bp, Artificial Sequence
  chemically synthesized
gtaatgttccagcccttacc

SEQ ID NO: 36808 - DNA, 20 bp, Artificial Sequence
  chemically synthesized
tgtaatgttccagcccttac

SEQ ID NO: 36809 - DNA, 20 bp, Artificial Sequence
  chemically synthesized
tcttattccctggtaagggc

SEQ ID NO: 36810 - DNA, 20 bp, Artificial Sequence
  chemically synthesized
tccagtctcttgtaatgttc

SEQ ID NO: 36811 - DNA, 20 bp, Artificial Sequence
  chemically synthesized
ggtaagggctggaacattac

SEQ ID NO: 36812 - DNA, 20 bp, Artificial Sequence
  chemically synthesized
taagggctggaacattacaa

SEQ ID NO: 36813 - DNA, 20 bp, Artificial Sequence
  chemically synthesized
gctggaacattacaagagac

SEQ ID NO: 36814 - DNA, 20 bp, Artificial Sequence
  chemically synthesized
tggaacattacaagagactg

SEQ ID NO: 36815 - DNA, 20 bp, Artificial Sequence
  chemically synthesized
ggaacattacaagagactgg

SEQ ID NO: 36816 - DNA, 20 bp, Artificial Sequence
  chemically synthesized
aacattacaagagactggag

SEQ ID NO: 36817 - DNA, 20 bp, Artificial Sequence
  chemically synthesized
acattacaagagactggagg

SEQ ID NO: 36818 - DNA, 20 bp, Artificial Sequence
  chemically synthesized
tgaatcttttaatcctcctc

SEQ ID NO: 36819 - DNA, 20 bp, Artificial Sequence
  chemically synthesized
agagactggaggaggattaa

SEQ ID NO: 36820 - DNA, 20 bp, Artificial Sequence
  chemically synthesized
tggaggaggattaaaagatt

SEQ ID NO: 36821 - DNA, 20 bp, Artificial Sequence
  chemically synthesized
ggaggaggattaaaagattc

SEQ ID NO: 36822 - DNA, 20 bp, Artificial Sequence
  chemically synthesized
aggaggattaaaagattcag

SEQ ID NO: 36823 - DNA, 20 bp, Artificial Sequence
  chemically synthesized
ggaggattaaaagattcagg

SEQ ID NO: 36824 - DNA, 20 bp, Artificial Sequence
  chemically synthesized
gaggattaaaagattcagga

SEQ ID NO: 36825 - DNA, 20 bp, Artificial Sequence
  chemically synthesized
aggattaaaagattcaggag

SEQ ID NO: 36826 - DNA, 20 bp, Artificial Sequence
  chemically synthesized
ggattaaaagattcaggagg

SEQ ID NO: 36827 - DNA, 20 bp, Artificial Sequence
  chemically synthesized
attaaaagattcaggagggg

SEQ ID NO: 36828 - DNA, 20 bp, Artificial Sequence
  chemically synthesized
aaagattcaggagggggagc

SEQ ID NO: 36829 - DNA, 20 bp, Artificial Sequence
  chemically synthesized
attcaggagggggagcaagt

SEQ ID NO: 36830 - DNA, 20 bp, Artificial Sequence
  chemically synthesized
ttcaggagggggagcaagtt

SEQ ID NO: 36831 - DNA, 20 bp, Artificial Sequence
  chemically synthesized
tcaggagggggagcaagttg

SEQ ID NO: 36832 - DNA, 20 bp, Artificial Sequence
  chemically synthesized
aggagggggagcaagttggg

SEQ ID NO: 36833 - DNA, 20 bp, Artificial Sequence
  chemically synthesized
ggagggggagcaagttgggg

SEQ ID NO: 36834 - DNA, 20 bp, Artificial Sequence
  chemically synthesized
aagttggggaggcgttcatc

SEQ ID NO: 36835 - DNA, 20 bp, Artificial Sequence
  chemically synthesized
ggaggcgttcatcaagtctg

SEQ ID NO: 36836 - DNA, 20 bp, Artificial Sequence
  chemically synthesized
atctcatgtggttagaactt

SEQ ID NO: 36837 - DNA, 20 bp, Artificial Sequence
  chemically synthesized
gtctgaagttctaaccacat

SEQ ID NO: 36838 - DNA, 20 bp, Artificial Sequence
  chemically synthesized
cctgcagcatctcatgtggt

SEQ ID NO: 36839 - DNA, 20 bp, Artificial Sequence
  chemically synthesized
agcccctgcagcatctcatg

SEQ ID NO: 36840 - DNA, 20 bp, Artificial Sequence
  chemically synthesized
tctaaccacatgagatgctg

SEQ ID NO: 36841 - DNA, 20 bp, Artificial Sequence
  chemically synthesized
ctaaccacatgagatgctgc

SEQ ID NO: 36842 - DNA, 20 bp, Artificial Sequence
  chemically synthesized
taaccacatgagatgctgca

SEQ ID NO: 36843 - DNA, 20 bp, Artificial Sequence
  chemically synthesized
aaccacatgagatgctgcag

SEQ ID NO: 36844 - DNA, 20 bp, Artificial Sequence
  chemically synthesized
gagcagattctcagcccctg

SEQ ID NO: 36845 - DNA, 20 bp, Artificial Sequence
  chemically synthesized
catgagatgctgcaggggct

SEQ ID NO: 36846 - DNA, 20 bp, Artificial Sequence
  chemically synthesized
taaaacttggagcagattct

SEQ ID NO: 36847 - DNA, 20 bp, Artificial Sequence
  chemically synthesized
aggggctgagaatctgctcc

SEQ ID NO: 36848 - DNA, 20 bp, Artificial Sequence
  chemically synthesized
acaccccctaaaacttggag

SEQ ID NO: 36849 - DNA, 20 bp, Artificial Sequence
  chemically synthesized
tgagaatctgctccaagttt

SEQ ID NO: 36850 - DNA, 20 bp, Artificial Sequence
  chemically synthesized
aagacaccccctaaaacttg

SEQ ID NO: 36851 - DNA, 20 bp, Artificial Sequence
  chemically synthesized
gagaatctgctccaagtttt

SEQ ID NO: 36852 - DNA, 20 bp, Artificial Sequence
  chemically synthesized
agaatctgctccaagtttta

SEQ ID NO: 36853 - DNA, 20 bp, Artificial Sequence
  chemically synthesized
agaagacaccccctaaaact

SEQ ID NO: 36854 - DNA, 20 bp, Artificial Sequence
  chemically synthesized
gaatctgctccaagttttag

SEQ ID NO: 36855 - DNA, 20 bp, Artificial Sequence
  chemically synthesized
aatctgctccaagttttagg

SEQ ID NO: 36856 - DNA, 20 bp, Artificial Sequence
  chemically synthesized
ttagggggtgtcttctctgc

SEQ ID NO: 36857 - DNA, 20 bp, Artificial Sequence
  chemically synthesized
caaacgaacagctggcagag

SEQ ID NO: 36858 - DNA, 20 bp, Artificial Sequence
  chemically synthesized
acccaaacgaacagctggca

SEQ ID NO: 36859 - DNA, 20 bp, Artificial Sequence
  chemically synthesized
ccacccaaacgaacagctgg

SEQ ID NO: 36860 - DNA, 20 bp, Artificial Sequence
  chemically synthesized
cagccacccaaacgaacagc

SEQ ID NO: 36861 - DNA, 20 bp, Artificial Sequence
  chemically synthesized
ttctctgccagctgttcgtt

SEQ ID NO: 36862 - DNA, 20 bp, Artificial Sequence
  chemically synthesized
tctctgccagctgttcgttt

SEQ ID NO: 36863 - DNA, 20 bp, Artificial Sequence
  chemically synthesized
caaacagccacccaaacgaa

SEQ ID NO: 36864 - DNA, 20 bp, Artificial Sequence
  chemically synthesized
ctgccagctgttcgtttggg

SEQ ID NO: 36865 - DNA, 20 bp, Artificial Sequence
  chemically synthesized
tgttcgtttgggtggctgtt

SEQ ID NO: 36866 - DNA, 20 bp, Artificial Sequence
  chemically synthesized
gttcgtttgggtggctgttt

SEQ ID NO: 36867 - DNA, 20 bp, Artificial Sequence
  chemically synthesized
tcgtttgggtggctgtttgg

SEQ ID NO: 36868 - DNA, 20 bp, Artificial Sequence
  chemically synthesized
attcctggtatactcccaaa

SEQ ID NO: 36869 - DNA, 20 bp, Artificial Sequence
  chemically synthesized
gtggctgtttgggagtatac

SEQ ID NO: 36870 - DNA, 20 bp, Artificial Sequence
  chemically synthesized
tggctgtttgggagtatacc

SEQ ID NO: 36871 - DNA, 20 bp, Artificial Sequence
  chemically synthesized
caaaaaggctgagtgattcc

SEQ ID NO: 36872 - DNA, 20 bp, Artificial Sequence
  chemically synthesized
ggagtataccaggaatcact

SEQ ID NO: 36873 - DNA, 20 bp, Artificial Sequence
  chemically synthesized
tggaagaaaacaaaaaggct

SEQ ID NO: 36874 - DNA, 20 bp, Artificial Sequence
  chemically synthesized
ccatttggaagaaaacaaaa

SEQ ID NO: 36875 - DNA, 20 bp, Artificial Sequence
  chemically synthesized
gccatttggaagaaaacaaa

SEQ ID NO: 36876 - DNA, 20 bp, Artificial Sequence
  chemically synthesized
cctttttgttttcttccaaa

SEQ ID NO: 36877 - DNA, 20 bp, Artificial Sequence
  chemically synthesized
aatatcaccatgccatttgg

SEQ ID NO: 36878 - DNA, 20 bp, Artificial Sequence
  chemically synthesized
ttgttttcttccaaatggca

SEQ ID NO: 36879 - DNA, 20 bp, Artificial Sequence
  chemically synthesized
gacaatatcaccatgccatt

SEQ ID NO: 36880 - DNA, 20 bp, Artificial Sequence
  chemically synthesized
atggtgatattgtcacattg

SEQ ID NO: 36881 - DNA, 20 bp, Artificial Sequence
  chemically synthesized
tggtgatattgtcacattgc

SEQ ID NO: 36882 - DNA, 20 bp, Artificial Sequence
  chemically synthesized
gtgatattgtcacattgcag

SEQ ID NO: 36883 - DNA, 20 bp, Artificial Sequence
  chemically synthesized
tgatattgtcacattgcagg

SEQ ID NO: 36884 - DNA, 20 bp, Artificial Sequence
  chemically synthesized
aggaaaaacattgctgctaa

SEQ ID NO: 36885 - DNA, 20 bp, Artificial Sequence
  chemically synthesized
ccccttaacaatacttttag

SEQ ID NO: 36886 - DNA, 20 bp, Artificial Sequence
  chemically synthesized
actccccttaacaatacttt

SEQ ID NO: 36887 - DNA, 20 bp, Artificial Sequence
  chemically synthesized
ttgctgctaaaagtattgtt

SEQ ID NO: 36888 - DNA, 20 bp, Artificial Sequence
  chemically synthesized
tgctgctaaaagtattgtta

SEQ ID NO: 36889 - DNA, 20 bp, Artificial Sequence
  chemically synthesized
gctgctaaaagtattgttaa

SEQ ID NO: 36890 - DNA, 20 bp, Artificial Sequence
  chemically synthesized
ctgctaaaagtattgttaag

SEQ ID NO: 36891 - DNA, 20 bp, Artificial Sequence
  chemically synthesized
gctaaaagtattgttaaggg

SEQ ID NO: 36892 - DNA, 20 bp, Artificial Sequence
  chemically synthesized
agtattgttaaggggagtaa

SEQ ID NO: 36893 - DNA, 20 bp, Artificial Sequence
  chemically synthesized
gtattgttaaggggagtaac

SEQ ID NO: 36894 - DNA, 20 bp, Artificial Sequence
  chemically synthesized
ttgttaaggggagtaacagg

SEQ ID NO: 36895 - DNA, 20 bp, Artificial Sequence
  chemically synthesized
gcagttgtgtatagtagtgt

SEQ ID NO: 36896 - DNA, 20 bp, Artificial Sequence
  chemically synthesized
caacgtgcagttgtgtatag

SEQ ID NO: 36897 - DNA, 20 bp, Artificial Sequence
  chemically synthesized
aggcaacgtgcagttgtgta

SEQ ID NO: 36898 - DNA, 20 bp, Artificial Sequence
  chemically synthesized
ttgttcagacaggcaacgtg

SEQ ID NO: 36899 - DNA, 20 bp, Artificial Sequence
  chemically synthesized
ttgaagtgttttgttcagac

SEQ ID NO: 36900 - DNA, 20 bp, Artificial Sequence
  chemically synthesized
tttgaagtgttttgttcaga

SEQ ID NO: 36901 - DNA, 20 bp, Artificial Sequence
  chemically synthesized
atgttttgaagtgttttgtt

SEQ ID NO: 36902 - DNA, 20 bp, Artificial Sequence
  chemically synthesized
atttctcagtttatgttttg

SEQ ID NO: 36903 - DNA, 20 bp, Artificial Sequence
  chemically synthesized
aacacttcaaaacataaact

SEQ ID NO: 36904 - DNA, 20 bp, Artificial Sequence
  chemically synthesized
ggaagcagaagggcatttct

SEQ ID NO: 36905 - DNA, 20 bp, Artificial Sequence
  chemically synthesized
actgcaagatggaagcagaa

SEQ ID NO: 36906 - DNA, 20 bp, Artificial Sequence
  chemically synthesized
cactgcaagatggaagcaga

SEQ ID NO: 36907 - DNA, 20 bp, Artificial Sequence
  chemically synthesized
tcactgcaagatggaagcag

SEQ ID NO: 36908 - DNA, 20 bp, Artificial Sequence
  chemically synthesized
gtctcactgcaagatggaag

SEQ ID NO: 36909 - DNA, 20 bp, Artificial Sequence
  chemically synthesized
taggtctcactgcaagatgg

SEQ ID NO: 36910 - DNA, 20 bp, Artificial Sequence
  chemically synthesized
gcccttctgcttccatcttg

SEQ ID NO: 36911 - DNA, 20 bp, Artificial Sequence
  chemically synthesized
aattaggtctcactgcaaga

SEQ ID NO: 36912 - DNA, 20 bp, Artificial Sequence
  chemically synthesized
ttctgcttccatcttgcagt

SEQ ID NO: 36913 - DNA, 20 bp, Artificial Sequence
  chemically synthesized
tttgaattaggtctcactgc

SEQ ID NO: 36914 - DNA, 20 bp, Artificial Sequence
  chemically synthesized
ttgcagtgagacctaattca

SEQ ID NO: 36915 - DNA, 20 bp, Artificial Sequence
  chemically synthesized
actagcaaggactttgaatt

SEQ ID NO: 36916 - DNA, 20 bp, Artificial Sequence
  chemically synthesized
cactagcaaggactttgaat

SEQ ID NO: 36917 - DNA, 20 bp, Artificial Sequence
  chemically synthesized
acctaattcaaagtccttgc

SEQ ID NO: 36918 - DNA, 20 bp, Artificial Sequence
  chemically synthesized
tggacctgagcacactagca

SEQ ID NO: 36919 - DNA, 20 bp, Artificial Sequence
  chemically synthesized
gtggacctgagcacactagc

SEQ ID NO: 36920 - DNA, 20 bp, Artificial Sequence
  chemically synthesized
aaagtccttgctagtgtgct

SEQ ID NO: 36921 - DNA, 20 bp, Artificial Sequence
  chemically synthesized
tggcgtggacctgagcacac

SEQ ID NO: 36922 - DNA, 20 bp, Artificial Sequence
  chemically synthesized
aagtccttgctagtgtgctc

SEQ ID NO: 36923 - DNA, 20 bp, Artificial Sequence
  chemically synthesized
caatttgttggcgtggacct

SEQ ID NO: 36924 - DNA, 20 bp, Artificial Sequence
  chemically synthesized
cacttgccaatttgttggcg

SEQ ID NO: 36925 - DNA, 20 bp, Artificial Sequence
  chemically synthesized
tcaggtccacgccaacaaat

SEQ ID NO: 36926 - DNA, 20 bp, Artificial Sequence
  chemically synthesized
gcacacacttgccaatttgt

SEQ ID NO: 36927 - DNA, 20 bp, Artificial Sequence
  chemically synthesized
gtccacgccaacaaattggc

SEQ ID NO: 36928 - DNA, 20 bp, Artificial Sequence
  chemically synthesized
attggcaagtgtgtgcctga

SEQ ID NO: 36929 - DNA, 20 bp, Artificial Sequence
  chemically synthesized
caagtgtgtgcctgacagaa

SEQ ID NO: 36930 - DNA, 20 bp, Artificial Sequence
  chemically synthesized
taaaatgtgaccattctgtc

SEQ ID NO: 36931 - DNA, 20 bp, Artificial Sequence
  chemically synthesized
ctaaaatgtgaccattctgt

SEQ ID NO: 36932 - DNA, 20 bp, Artificial Sequence
  chemically synthesized
ctgacagaatggtcacattt

SEQ ID NO: 36933 - DNA, 20 bp, Artificial Sequence
  chemically synthesized
tgacagaatggtcacatttt

SEQ ID NO: 36934 - DNA, 20 bp, Artificial Sequence
  chemically synthesized
gacagaatggtcacatttta

SEQ ID NO: 36935 - DNA, 20 bp, Artificial Sequence
  chemically synthesized
gaatggtcacattttagggc

SEQ ID NO: 36936 - DNA, 20 bp, Artificial Sequence
  chemically synthesized
ggtcacattttagggctgga

SEQ ID NO: 36937 - DNA, 20 bp, Artificial Sequence
  chemically synthesized
taaatagaatggggaccatc

SEQ ID NO: 36938 - DNA, 20 bp, Artificial Sequence
  chemically synthesized
tataagcattaaatagaatg

SEQ ID NO: 36939 - DNA, 20 bp, Artificial Sequence
  chemically synthesized
ttataagcattaaatagaat

SEQ ID NO: 36940 - DNA, 20 bp, Artificial Sequence
  chemically synthesized
tttataagcattaaatagaa

SEQ ID NO: 36941 - DNA, 20 bp, Artificial Sequence
  chemically synthesized
atgaatttataagcattaaa

SEQ ID NO: 36942 - DNA, 20 bp, Artificial Sequence
  chemically synthesized
acttaataggatgaatttat

SEQ ID NO: 36943 - DNA, 20 bp, Artificial Sequence
  chemically synthesized
gcttataaattcatcctatt

SEQ ID NO: 36944 - DNA, 20 bp, Artificial Sequence
  chemically synthesized
aatttccccaagcacttaat

SEQ ID NO: 36945 - DNA, 20 bp, Artificial Sequence
  chemically synthesized
taatttccccaagcacttaa

SEQ ID NO: 36946 - DNA, 20 bp, Artificial Sequence
  chemically synthesized
aattcatcctattaagtgct

SEQ ID NO: 36947 - DNA, 20 bp, Artificial Sequence
  chemically synthesized
attcatcctattaagtgctt

SEQ ID NO: 36948 - DNA, 20 bp, Artificial Sequence
  chemically synthesized
ttcatcctattaagtgcttg

SEQ ID NO: 36949 - DNA, 20 bp, Artificial Sequence
  chemically synthesized
ttattcagattaatttcccc

SEQ ID NO: 36950 - DNA, 20 bp, Artificial Sequence
  chemically synthesized
ttggggaaattaatctgaat

SEQ ID NO: 36951 - DNA, 20 bp, Artificial Sequence
  chemically synthesized
agtcttcatggacacttatt

SEQ ID NO: 36952 - DNA, 20 bp, Artificial Sequence
  chemically synthesized
aatctgaataagtgtccatg

SEQ ID NO: 36953 - DNA, 20 bp, Artificial Sequence
  chemically synthesized
atgataattatcagtcttca

SEQ ID NO: 36954 - DNA, 20 bp, Artificial Sequence
  chemically synthesized
ttaaaaatcatgataattat

SEQ ID NO: 36955 - DNA, 20 bp, Artificial Sequence
  chemically synthesized
ataattatcatgatttttaa

SEQ ID NO: 36956 - DNA, 20 bp, Artificial Sequence
  chemically synthesized
aaatgttcctacaattatat

SEQ ID NO: 36957 - DNA, 20 bp, Artificial Sequence
  chemically synthesized
aaagtattctcatataattg

SEQ ID NO: 36958 - DNA, 20 bp, Artificial Sequence
  chemically synthesized
aagtattctcatataattgt

SEQ ID NO: 36959 - DNA, 20 bp, Artificial Sequence
  chemically synthesized
atataattgtaggaacattt

SEQ ID NO: 36960 - DNA, 20 bp, Artificial Sequence
  chemically synthesized
aattgtaggaacattttaga

SEQ ID NO: 36961 - DNA, 20 bp, Artificial Sequence
  chemically synthesized
ggaacattttagacagtctg

SEQ ID NO: 36962 - DNA, 20 bp, Artificial Sequence
  chemically synthesized
ttttagacagtctgcagcca

SEQ ID NO: 36963 - DNA, 20 bp, Artificial Sequence
  chemically synthesized
tttagacagtctgcagccat

SEQ ID NO: 36964 - DNA, 20 bp, Artificial Sequence
  chemically synthesized
gcttaatacccccatggctg

SEQ ID NO: 36965 - DNA, 20 bp, Artificial Sequence
  chemically synthesized
ttagacagtctgcagccatg

SEQ ID NO: 36966 - DNA, 20 bp, Artificial Sequence
  chemically synthesized
tagacagtctgcagccatgg

SEQ ID NO: 36967 - DNA, 20 bp, Artificial Sequence
  chemically synthesized
taatatgcttaataccccca

SEQ ID NO: 36968 - DNA, 20 bp, Artificial Sequence
  chemically synthesized
tctgcagccatgggggtatt

SEQ ID NO: 36969 - DNA, 20 bp, Artificial Sequence
  chemically synthesized
gggggtattaagcatattat

SEQ ID NO: 36970 - DNA, 20 bp, Artificial Sequence
  chemically synthesized
catattatgagtaaaaataa

SEQ ID NO: 36971 - DNA, 20 bp, Artificial Sequence
  chemically synthesized
tgagtaaaaataacagcttt

SEQ ID NO: 36972 - DNA, 20 bp, Artificial Sequence
  chemically synthesized
tgaaaggaattttattctta

SEQ ID NO: 36973 - DNA, 20 bp, Artificial Sequence
  chemically synthesized
aagaataaaattcctttcaa

SEQ ID NO: 36974 - DNA, 20 bp, Artificial Sequence
  chemically synthesized
gaataaaattcctttcaaaa

SEQ ID NO: 36975 - DNA, 20 bp, Artificial Sequence
  chemically synthesized
aagctggtcactcttttgaa

SEQ ID NO: 36976 - DNA, 20 bp, Artificial Sequence
  chemically synthesized
aaagctggtcactcttttga

SEQ ID NO: 36977 - DNA, 20 bp, Artificial Sequence
  chemically synthesized
attcctttcaaaagagtgac

SEQ ID NO: 36978 - DNA, 20 bp, Artificial Sequence
  chemically synthesized
aaaagagtgaccagctttga

SEQ ID NO: 36979 - DNA, 20 bp, Artificial Sequence
  chemically synthesized
cttctggtaactttcaaagc

SEQ ID NO: 36980 - DNA, 20 bp, Artificial Sequence
  chemically synthesized
tttccttctggtaactttca

SEQ ID NO: 36981 - DNA, 20 bp, Artificial Sequence
  chemically synthesized
tgaccagctttgaaagttac

SEQ ID NO: 36982 - DNA, 20 bp, Artificial Sequence
  chemically synthesized
ccagctttgaaagttaccag

SEQ ID NO: 36983 - DNA, 20 bp, Artificial Sequence
  chemically synthesized
cagctttgaaagttaccaga

SEQ ID NO: 36984 - DNA, 20 bp, Artificial Sequence
  chemically synthesized
aaagattgtgggtttccttc

SEQ ID NO: 36985 - DNA, 20 bp, Artificial Sequence
  chemically synthesized
actgaaaaaagaaagattgt

SEQ ID NO: 36986 - DNA, 20 bp, Artificial Sequence
  chemically synthesized
tactgaaaaaagaaagattg

SEQ ID NO: 36987 - DNA, 20 bp, Artificial Sequence
  chemically synthesized
gattaaatactgaaaaaaga

SEQ ID NO: 36988 - DNA, 20 bp, Artificial Sequence
  chemically synthesized
acccacaatctttctttttt

SEQ ID NO: 36989 - DNA, 20 bp, Artificial Sequence
  chemically synthesized
ctgtgattaaatactgaaaa

SEQ ID NO: 36990 - DNA, 20 bp, Artificial Sequence
  chemically synthesized
cttttttcagtatttaatca

SEQ ID NO: 36991 - DNA, 20 bp, Artificial Sequence
  chemically synthesized
ttttcagtatttaatcacag

SEQ ID NO: 36992 - DNA, 20 bp, Artificial Sequence
  chemically synthesized
tagtactgggaatttaatga

SEQ ID NO: 36993 - DNA, 20 bp, Artificial Sequence
  chemically synthesized
agcagctttcattaaattcc

SEQ ID NO: 36994 - DNA, 20 bp, Artificial Sequence
  chemically synthesized
gttaaccacttattagtact

SEQ ID NO: 36995 - DNA, 20 bp, Artificial Sequence
  chemically synthesized
agttaaccacttattagtac

SEQ ID NO: 36996 - DNA, 20 bp, Artificial Sequence
  chemically synthesized
attaaattcccagtactaat

SEQ ID NO: 36997 - DNA, 20 bp, Artificial Sequence
  chemically synthesized
aaattcccagtactaataag

SEQ ID NO: 36998 - DNA, 20 bp, Artificial Sequence
  chemically synthesized
aaacatagttaaccacttat

SEQ ID NO: 36999 - DNA, 20 bp, Artificial Sequence
  chemically synthesized
agaaatactgattacaaaca

SEQ ID NO: 37000 - DNA, 20 bp, Artificial Sequence
  chemically synthesized
tggttaactatgtttgtaat

SEQ ID NO: 37001 - DNA, 20 bp, Artificial Sequence
  chemically synthesized
tctagtgcttttaaaaatat

SEQ ID NO: 37002 - DNA, 20 bp, Artificial Sequence
  chemically synthesized
agtatttcttatatttttaa

SEQ ID NO: 37003 - DNA, 20 bp, Artificial Sequence
  chemically synthesized
tcttatatttttaaaagcac

SEQ ID NO: 37004 - DNA, 20 bp, Artificial Sequence
  chemically synthesized
tttttaaaagcactagatta

SEQ ID NO: 37005 - DNA, 20 bp, Artificial Sequence
  chemically synthesized
gacatacagcatccataatc

SEQ ID NO: 37006 - DNA, 20 bp, Artificial Sequence
  chemically synthesized
cacagccaatggtagacata

SEQ ID NO: 37007 - DNA, 20 bp, Artificial Sequence
  chemically synthesized
ggatgctgtatgtctaccat

SEQ ID NO: 37008 - DNA, 20 bp, Artificial Sequence
  chemically synthesized
tgtggcttcacagccaatgg

SEQ ID NO: 37009 - DNA, 20 bp, Artificial Sequence
  chemically synthesized
gtttgtggcttcacagccaa

SEQ ID NO: 37010 - DNA, 20 bp, Artificial Sequence
  chemically synthesized
tatgtctaccattggctgtg

SEQ ID NO: 37011 - DNA, 20 bp, Artificial Sequence
  chemically synthesized
ctaaactgtttgtggcttca

SEQ ID NO: 37012 - DNA, 20 bp, Artificial Sequence
  chemically synthesized
attggctgtgaagccacaaa

SEQ ID NO: 37013 - DNA, 20 bp, Artificial Sequence
  chemically synthesized
ttgctaggctaaactgtttg

SEQ ID NO: 37014 - DNA, 20 bp, Artificial Sequence
  chemically synthesized
ctgtgaagccacaaacagtt

SEQ ID NO: 37015 - DNA, 20 bp, Artificial Sequence
  chemically synthesized
aagccacaaacagtttagcc

SEQ ID NO: 37016 - DNA, 20 bp, Artificial Sequence
  chemically synthesized
ctttgtgagtaatcattgct

SEQ ID NO: 37017 - DNA, 20 bp, Artificial Sequence
  chemically synthesized
gctttgtgagtaatcattgc

SEQ ID NO: 37018 - DNA, 20 bp, Artificial Sequence
  chemically synthesized
cctagcaatgattactcaca

SEQ ID NO: 37019 - DNA, 20 bp, Artificial Sequence
  chemically synthesized
tgttaaaattcatgctttgt

SEQ ID NO: 37020 - DNA, 20 bp, Artificial Sequence
  chemically synthesized
tcacaaagcatgaattttaa

SEQ ID NO: 37021 - DNA, 20 bp, Artificial Sequence
  chemically synthesized
atttagatgtaggtaaaatg

SEQ ID NO: 37022 - DNA, 20 bp, Artificial Sequence
  chemically synthesized
gaatttagatgtaggtaaaa

SEQ ID NO: 37023 - DNA, 20 bp, Artificial Sequence
  chemically synthesized
tctcttctgaatttagatgt

SEQ ID NO: 37024 - DNA, 20 bp, Artificial Sequence
  chemically synthesized
ttctcttctgaatttagatg

SEQ ID NO: 37025 - DNA, 20 bp, Artificial Sequence
  chemically synthesized
attttacctacatctaaatt

SEQ ID NO: 37026 - DNA, 20 bp, Artificial Sequence
  chemically synthesized
ttacctacatctaaattcag

SEQ ID NO: 37027 - DNA, 20 bp, Artificial Sequence
  chemically synthesized
actaaattctcttctgaatt

SEQ ID NO: 37028 - DNA, 20 bp, Artificial Sequence
  chemically synthesized
acctacatctaaattcagaa

SEQ ID NO: 37029 - DNA, 20 bp, Artificial Sequence
  chemically synthesized
tctaaattcagaagagaatt

SEQ ID NO: 37030 - DNA, 20 bp, Artificial Sequence
  chemically synthesized
tcagaagagaatttagtcca

SEQ ID NO: 37031 - DNA, 20 bp, Artificial Sequence
  chemically synthesized
agaagagaatttagtccaca

SEQ ID NO: 37032 - DNA, 20 bp, Artificial Sequence
  chemically synthesized
gaagagaatttagtccacag

SEQ ID NO: 37033 - DNA, 20 bp, Artificial Sequence
  chemically synthesized
gttacaggaaggttcctctg

SEQ ID NO: 37034 - DNA, 20 bp, Artificial Sequence
  chemically synthesized
attcaagaaaagttacagga

SEQ ID NO: 37035 - DNA, 20 bp, Artificial Sequence
  chemically synthesized
tattcaagaaaagttacagg

SEQ ID NO: 37036 - DNA, 20 bp, Artificial Sequence
  chemically synthesized
aaatattcaagaaaagttac

SEQ ID NO: 37037 - DNA, 20 bp, Artificial Sequence
  chemically synthesized
aaaatattcaagaaaagtta

SEQ ID NO: 37038 - DNA, 20 bp, Artificial Sequence
  chemically synthesized
tatcacaaaatattcaagaa

SEQ ID NO: 37039 - DNA, 20 bp, Artificial Sequence
  chemically synthesized
caagatatcacaaaatattc

SEQ ID NO: 37040 - DNA, 20 bp, Artificial Sequence
  chemically synthesized
ttttgtgatatcttgcaaca

SEQ ID NO: 37041 - DNA, 20 bp, Artificial Sequence
  chemically synthesized
agaacttttggccatgttgc

SEQ ID NO: 37042 - DNA, 20 bp, Artificial Sequence
  chemically synthesized
atatcttgcaacatggccaa

SEQ ID NO: 37043 - DNA, 20 bp, Artificial Sequence
  chemically synthesized
tgcaacatggccaaaagttc

SEQ ID NO: 37044 - DNA, 20 bp, Artificial Sequence
  chemically synthesized
aaggagagggctagaacttt

SEQ ID NO: 37045 - DNA, 20 bp, Artificial Sequence
  chemically synthesized
ctggacaccaaggagagggc

SEQ ID NO: 37046 - DNA, 20 bp, Artificial Sequence
  chemically synthesized
aaaagttctagccctctcct

SEQ ID NO: 37047 - DNA, 20 bp, Artificial Sequence
  chemically synthesized
agagctggacaccaaggaga

SEQ ID NO: 37048 - DNA, 20 bp, Artificial Sequence
  chemically synthesized
aagagctggacaccaaggag

SEQ ID NO: 37049 - DNA, 20 bp, Artificial Sequence
  chemically synthesized
caagagctggacaccaagga

SEQ ID NO: 37050 - DNA, 20 bp, Artificial Sequence
  chemically synthesized
tgcaagagctggacaccaag

SEQ ID NO: 37051 - DNA, 20 bp, Artificial Sequence
  chemically synthesized
ctagccctctccttggtgtc

SEQ ID NO: 37052 - DNA, 20 bp, Artificial Sequence
  chemically synthesized
actgcaagagctggacacca

SEQ ID NO: 37053 - DNA, 20 bp, Artificial Sequence
  chemically synthesized
cactgcaagagctggacacc

SEQ ID NO: 37054 - DNA, 20 bp, Artificial Sequence
  chemically synthesized
tccttggtgtccagctcttg

SEQ ID NO: 37055 - DNA, 20 bp, Artificial Sequence
  chemically synthesized
caaaggcacactgcaagagc

SEQ ID NO: 37056 - DNA, 20 bp, Artificial Sequence
  chemically synthesized
gatacaaaggcacactgcaa

SEQ ID NO: 37057 - DNA, 20 bp, Artificial Sequence
  chemically synthesized
gagatacaaaggcacactgc

SEQ ID NO: 37058 - DNA, 20 bp, Artificial Sequence
  chemically synthesized
gttggtgggaagagatacaa

SEQ ID NO: 37059 - DNA, 20 bp, Artificial Sequence
  chemically synthesized
tgttggtgggaagagataca

SEQ ID NO: 37060 - DNA, 20 bp, Artificial Sequence
  chemically synthesized
actccacctgttggtgggaa

SEQ ID NO: 37061 - DNA, 20 bp, Artificial Sequence
  chemically synthesized
agactccacctgttggtggg

SEQ ID NO: 37062 - DNA, 20 bp, Artificial Sequence
  chemically synthesized
tttgtatctcttcccaccaa

SEQ ID NO: 37063 - DNA, 20 bp, Artificial Sequence
  chemically synthesized
ttgtatctcttcccaccaac

SEQ ID NO: 37064 - DNA, 20 bp, Artificial Sequence
  chemically synthesized
gaaagactccacctgttggt

SEQ ID NO: 37065 - DNA, 20 bp, Artificial Sequence
  chemically synthesized
ggaaagactccacctgttgg

SEQ ID NO: 37066 - DNA, 20 bp, Artificial Sequence
  chemically synthesized
tatctcttcccaccaacagg

SEQ ID NO: 37067 - DNA, 20 bp, Artificial Sequence
  chemically synthesized
tctcttcccaccaacaggtg

SEQ ID NO: 37068 - DNA, 20 bp, Artificial Sequence
  chemically synthesized
tggggaaagactccacctgt

SEQ ID NO: 37069 - DNA, 20 bp, Artificial Sequence
  chemically synthesized
ccagatgtaaggagtgggga

SEQ ID NO: 37070 - DNA, 20 bp, Artificial Sequence
  chemically synthesized
catcccagatgtaaggagtg

SEQ ID NO: 37071 - DNA, 20 bp, Artificial Sequence
  chemically synthesized
ccatcccagatgtaaggagt

SEQ ID NO: 37072 - DNA, 20 bp, Artificial Sequence
  chemically synthesized
gccatcccagatgtaaggag

SEQ ID NO: 37073 - DNA, 20 bp, Artificial Sequence
  chemically synthesized
agggccatcccagatgtaag

SEQ ID NO: 37074 - DNA, 20 bp, Artificial Sequence
  chemically synthesized
ctttccccactccttacatc

SEQ ID NO: 37075 - DNA, 20 bp, Artificial Sequence
  chemically synthesized
tttccccactccttacatct

SEQ ID NO: 37076 - DNA, 20 bp, Artificial Sequence
  chemically synthesized
atagggccatcccagatgta

SEQ ID NO: 37077 - DNA, 20 bp, Artificial Sequence
  chemically synthesized
catagggccatcccagatgt

SEQ ID NO: 37078 - DNA, 20 bp, Artificial Sequence
  chemically synthesized
cccactccttacatctggga

SEQ ID NO: 37079 - DNA, 20 bp, Artificial Sequence
  chemically synthesized
gtcatgtcatagggccatcc

SEQ ID NO: 37080 - DNA, 20 bp, Artificial Sequence
  chemically synthesized
ccgaagcaagtcatgtcata

SEQ ID NO: 37081 - DNA, 20 bp, Artificial Sequence
  chemically synthesized
gccgaagcaagtcatgtcat

SEQ ID NO: 37082 - DNA, 20 bp, Artificial Sequence
  chemically synthesized
agccgaagcaagtcatgtca

SEQ ID NO: 37083 - DNA, 20 bp, Artificial Sequence
  chemically synthesized
ccctatgacatgacttgctt

SEQ ID NO: 37084 - DNA, 20 bp, Artificial Sequence
  chemically synthesized
tagtgtccattagccgaagc

SEQ ID NO: 37085 - DNA, 20 bp, Artificial Sequence
  chemically synthesized
acatgacttgcttcggctaa

SEQ ID NO: 37086 - DNA, 20 bp, Artificial Sequence
  chemically synthesized
ttggtagtgtccattagccg

SEQ ID NO: 37087 - DNA, 20 bp, Artificial Sequence
  chemically synthesized
tcatgtttggtagtgtccat

SEQ ID NO: 37088 - DNA, 20 bp, Artificial Sequence
  chemically synthesized
tctgcttgtgtcatgtttgg

SEQ ID NO: 37089 - DNA, 20 bp, Artificial Sequence
  chemically synthesized
gtttctgcttgtgtcatgtt

SEQ ID NO: 37090 - DNA, 20 bp, Artificial Sequence
  chemically synthesized
gacactaccaaacatgacac

SEQ ID NO: 37091 - DNA, 20 bp, Artificial Sequence
  chemically synthesized
actaccaaacatgacacaag

SEQ ID NO: 37092 - DNA, 20 bp, Artificial Sequence
  chemically synthesized
catgacacaagcagaaacct

SEQ ID NO: 37093 - DNA, 20 bp, Artificial Sequence
  chemically synthesized
gacacaagcagaaacctgag

SEQ ID NO: 37094 - DNA, 20 bp, Artificial Sequence
  chemically synthesized
agttcacatggaaacttctc

SEQ ID NO: 37095 - DNA, 20 bp, Artificial Sequence
  chemically synthesized
tagttcacatggaaacttct

SEQ ID NO: 37096 - DNA, 20 bp, Artificial Sequence
  chemically synthesized
tgagaagtttccatgtgaac

SEQ ID NO: 37097 - DNA, 20 bp, Artificial Sequence
  chemically synthesized
ctagttcaggctagttcaca

SEQ ID NO: 37098 - DNA, 20 bp, Artificial Sequence
  chemically synthesized
tccaacatgctagttcaggc

SEQ ID NO: 37099 - DNA, 20 bp, Artificial Sequence
  chemically synthesized
ccatgtgaactagcctgaac

SEQ ID NO: 37100 - DNA, 20 bp, Artificial Sequence
  chemically synthesized
atcatccaacatgctagttc

SEQ ID NO: 37101 - DNA, 20 bp, Artificial Sequence
  chemically synthesized
catcatccaacatgctagtt

SEQ ID NO: 37102 - DNA, 20 bp, Artificial Sequence
  chemically synthesized
actagcctgaactagcatgt

SEQ ID NO: 37103 - DNA, 20 bp, Artificial Sequence
  chemically synthesized
tatctcatcatccaacatgc

SEQ ID NO: 37104 - DNA, 20 bp, Artificial Sequence
  chemically synthesized
gaactagcatgttggatgat

SEQ ID NO: 37105 - DNA, 20 bp, Artificial Sequence
  chemically synthesized
tgatgagatacacacaaacc

SEQ ID NO: 37106 - DNA, 20 bp, Artificial Sequence
  chemically synthesized
atctaggaacagatgcaact

SEQ ID NO: 37107 - DNA, 20 bp, Artificial Sequence
  chemically synthesized
catctaggaacagatgcaac

SEQ ID NO: 37108 - DNA, 20 bp, Artificial Sequence
  chemically synthesized
aacctagttgcatctgttcc

SEQ ID NO: 37109 - DNA, 20 bp, Artificial Sequence
  chemically synthesized
gacaggctgtcatctaggaa

SEQ ID NO: 37110 - DNA, 20 bp, Artificial Sequence
  chemically synthesized
ttgcatctgttcctagatga

SEQ ID NO: 37111 - DNA, 20 bp, Artificial Sequence
  chemically synthesized
tggttgacaggctgtcatct

SEQ ID NO: 37112 - DNA, 20 bp, Artificial Sequence
  chemically synthesized
atggttgacaggctgtcatc

SEQ ID NO: 37113 - DNA, 20 bp, Artificial Sequence
  chemically synthesized
tcatatgtctgatggttgac

SEQ ID NO: 37114 - DNA, 20 bp, Artificial Sequence
  chemically synthesized
ctcatatgtctgatggttga

SEQ ID NO: 37115 - DNA, 20 bp, Artificial Sequence
  chemically synthesized
gatgacagcctgtcaaccat

SEQ ID NO: 37116 - DNA, 20 bp, Artificial Sequence
  chemically synthesized
gacctgactcatatgtctga

SEQ ID NO: 37117 - DNA, 20 bp, Artificial Sequence
  chemically synthesized
ctgtcaaccatcagacatat

SEQ ID NO: 37118 - DNA, 20 bp, Artificial Sequence
  chemically synthesized
caaccatcagacatatgagt

SEQ ID NO: 37119 - DNA, 20 bp, Artificial Sequence
  chemically synthesized
aaccatcagacatatgagtc

SEQ ID NO: 37120 - DNA, 20 bp, Artificial Sequence
  chemically synthesized
acatatgagtcaggtcacga

SEQ ID NO: 37121 - DNA, 20 bp, Artificial Sequence
  chemically synthesized
tcaggtcacgatagcttatc

SEQ ID NO: 37122 - DNA, 20 bp, Artificial Sequence
  chemically synthesized
tagtcagctggcagctggat

SEQ ID NO: 37123 - DNA, 20 bp, Artificial Sequence
  chemically synthesized
acgatagcttatccagctgc

SEQ ID NO: 37124 - DNA, 20 bp, Artificial Sequence
  chemically synthesized
atctgtagtcagctggcagc

SEQ ID NO: 37125 - DNA, 20 bp, Artificial Sequence
  chemically synthesized
atgcatctgtagtcagctgg

SEQ ID NO: 37126 - DNA, 20 bp, Artificial Sequence
  chemically synthesized
cttatgcatctgtagtcagc

SEQ ID NO: 37127 - DNA, 20 bp, Artificial Sequence
  chemically synthesized
atccagctgccagctgacta

SEQ ID NO: 37128 - DNA, 20 bp, Artificial Sequence
  chemically synthesized
catgcttatgcatctgtagt

SEQ ID NO: 37129 - DNA, 20 bp, Artificial Sequence
  chemically synthesized
caggcatgcttatgcatctg

SEQ ID NO: 37130 - DNA, 20 bp, Artificial Sequence
  chemically synthesized
ccagctgactacagatgcat

SEQ ID NO: 37131 - DNA, 20 bp, Artificial Sequence
  chemically synthesized
tacagatgcataagcatgcc

SEQ ID NO: 37132 - DNA, 20 bp, Artificial Sequence
  chemically synthesized
gcataagcatgcctggcaaa

SEQ ID NO: 37133 - DNA, 20 bp, Artificial Sequence
  chemically synthesized
cagttgtactactgtttgcc

SEQ ID NO: 37134 - DNA, 20 bp, Artificial Sequence
  chemically synthesized
ccagttgtactactgtttgc

SEQ ID NO: 37135 - DNA, 20 bp, Artificial Sequence
  chemically synthesized
taagcatgcctggcaaacag

SEQ ID NO: 37136 - DNA, 20 bp, Artificial Sequence
  chemically synthesized
ctggcaaacagtagtacaac

SEQ ID NO: 37137 - DNA, 20 bp, Artificial Sequence
  chemically synthesized
ggccatttatgtggtgtgac

SEQ ID NO: 37138 - DNA, 20 bp, Artificial Sequence
  chemically synthesized
aactggtcacaccacataaa

SEQ ID NO: 37139 - DNA, 20 bp, Artificial Sequence
  chemically synthesized
ggtggattgggccatttatg

SEQ ID NO: 37140 - DNA, 20 bp, Artificial Sequence
  chemically synthesized
cactatttgatgggtggatt

SEQ ID NO: 37141 - DNA, 20 bp, Artificial Sequence
  chemically synthesized
tcactatttgatgggtggat

SEQ ID NO: 37142 - DNA, 20 bp, Artificial Sequence
  chemically synthesized
ttagctcactatttgatggg

SEQ ID NO: 37143 - DNA, 20 bp, Artificial Sequence
  chemically synthesized
ggcccaatccacccatcaaa

SEQ ID NO: 37144 - DNA, 20 bp, Artificial Sequence
  chemically synthesized
tacttagctcactatttgat

SEQ ID NO: 37145 - DNA, 20 bp, Artificial Sequence
  chemically synthesized
ttacttagctcactatttga

SEQ ID NO: 37146 - DNA, 20 bp, Artificial Sequence
  chemically synthesized
caatccacccatcaaatagt

SEQ ID NO: 37147 - DNA, 20 bp, Artificial Sequence
  chemically synthesized
cacccatcaaatagtgagct

SEQ ID NO: 37148 - DNA, 20 bp, Artificial Sequence
  chemically synthesized
caaatagtgagctaagtaaa

SEQ ID NO: 37149 - DNA, 20 bp, Artificial Sequence
  chemically synthesized
acaatggccagccatttact

SEQ ID NO: 37150 - DNA, 20 bp, Artificial Sequence
  chemically synthesized
tagtgagctaagtaaatggc

SEQ ID NO: 37151 - DNA, 20 bp, Artificial Sequence
  chemically synthesized
aaactctataacacaatggc

SEQ ID NO: 37152 - DNA, 20 bp, Artificial Sequence
  chemically synthesized
tcataaactctataacacaa

SEQ ID NO: 37153 - DNA, 20 bp, Artificial Sequence
  chemically synthesized
aatggctggccattgtgtta

SEQ ID NO: 37154 - DNA, 20 bp, Artificial Sequence
  chemically synthesized
tggctggccattgtgttata

SEQ ID NO: 37155 - DNA, 20 bp, Artificial Sequence
  chemically synthesized
catagaccaaatttgaacaa

SEQ ID NO: 37156 - DNA, 20 bp, Artificial Sequence
  chemically synthesized
tatgaactattgttcaaatt

SEQ ID NO: 37157 - DNA, 20 bp, Artificial Sequence
  chemically synthesized
tattgttcaaatttggtcta

SEQ ID NO: 37158 - DNA, 20 bp, Artificial Sequence
  chemically synthesized
ggctgtacagaagcaggcca

SEQ ID NO: 37159 - DNA, 20 bp, Artificial Sequence
  chemically synthesized
ctgagaggctgtacagaagc

SEQ ID NO: 37160 - DNA, 20 bp, Artificial Sequence
  chemically synthesized
gctgagaggctgtacagaag

SEQ ID NO: 37161 - DNA, 20 bp, Artificial Sequence
  chemically synthesized
gtctatggcctgcttctgta

SEQ ID NO: 37162 - DNA, 20 bp, Artificial Sequence
  chemically synthesized
ttagctgagaggctgtacag

SEQ ID NO: 37163 - DNA, 20 bp, Artificial Sequence
  chemically synthesized
tacttagctgagaggctgta

SEQ ID NO: 37164 - DNA, 20 bp, Artificial Sequence
  chemically synthesized
cctgcttctgtacagcctct

SEQ ID NO: 37165 - DNA, 20 bp, Artificial Sequence
  chemically synthesized
ttctgtacagcctctcagct

SEQ ID NO: 37166 - DNA, 20 bp, Artificial Sequence
  chemically synthesized
tgtagtcatacttagctgag

SEQ ID NO: 37167 - DNA, 20 bp, Artificial Sequence
  chemically synthesized
atgtagtcatacttagctga

SEQ ID NO: 37168 - DNA, 20 bp, Artificial Sequence
  chemically synthesized
aaatgtagtcatacttagct

SEQ ID NO: 37169 - DNA, 20 bp, Artificial Sequence
  chemically synthesized
tctaaaaatgtagtcatact

SEQ ID NO: 37170 - DNA, 20 bp, Artificial Sequence
  chemically synthesized
gctaagtatgactacatttt

SEQ ID NO: 37171 - DNA, 20 bp, Artificial Sequence
  chemically synthesized
tttttacaactctaaaaatg

SEQ ID NO: 37172 - DNA, 20 bp, Artificial Sequence
  chemically synthesized
taagtatgactacattttta

SEQ ID NO: 37173 - DNA, 20 bp, Artificial Sequence
  chemically synthesized
tacatttttagagttgtaaa

SEQ ID NO: 37174 - DNA, 20 bp, Artificial Sequence
  chemically synthesized
tttagagttgtaaaaagaaa

SEQ ID NO: 37175 - DNA, 20 bp, Artificial Sequence
  chemically synthesized
aagaaaaagaatgtgcaaca

SEQ ID NO: 37176 - DNA, 20 bp, Artificial Sequence
  chemically synthesized
gaatgtgcaacaaagatgca

SEQ ID NO: 37177 - DNA, 20 bp, Artificial Sequence
  chemically synthesized
aagatgcaaagtgctccaca

SEQ ID NO: 37178 - DNA, 20 bp, Artificial Sequence
  chemically synthesized
taaacactataggctttgtg

SEQ ID NO: 37179 - DNA, 20 bp, Artificial Sequence
  chemically synthesized
agtaaacactataggctttg

SEQ ID NO: 37180 - DNA, 20 bp, Artificial Sequence
  chemically synthesized
aaagtgctccacaaagccta

SEQ ID NO: 37181 - DNA, 20 bp, Artificial Sequence
  chemically synthesized
gacaacatagtaaacactat

SEQ ID NO: 37182 - DNA, 20 bp, Artificial Sequence
  chemically synthesized
ggacaacatagtaaacacta

SEQ ID NO: 37183 - DNA, 20 bp, Artificial Sequence
  chemically synthesized
attttctgtaaaggacaaca

SEQ ID NO: 37184 - DNA, 20 bp, Artificial Sequence
  chemically synthesized
gtttactatgttgtccttta

SEQ ID NO: 37185 - DNA, 20 bp, Artificial Sequence
  chemically synthesized
tcagcaaacattttctgtaa

SEQ ID NO: 37186 - DNA, 20 bp, Artificial Sequence
  chemically synthesized
gtcagcaaacattttctgta

SEQ ID NO: 37187 - DNA, 20 bp, Artificial Sequence
  chemically synthesized
cagaaaatgtttgctgacct

SEQ ID NO: 37188 - DNA, 20 bp, Artificial Sequence
  chemically synthesized
tactggcttaacactgaggt

SEQ ID NO: 37189 - DNA, 20 bp, Artificial Sequence
  chemically synthesized
tgtttgctgacctcagtgtt

SEQ ID NO: 37190 - DNA, 20 bp, Artificial Sequence
  chemically synthesized
aacttactggcttaacactg

SEQ ID NO: 37191 - DNA, 20 bp, Artificial Sequence
  chemically synthesized
aaacttactggcttaacact

SEQ ID NO: 37192 - DNA, 20 bp, Artificial Sequence
  chemically synthesized
tgctgacctcagtgttaagc

SEQ ID NO: 37193 - DNA, 20 bp, Artificial Sequence
  chemically synthesized
gacctcagtgttaagccagt

SEQ ID NO: 37194 - DNA, 20 bp, Artificial Sequence
  chemically synthesized
agaccaaccccaaaacttac

SEQ ID NO: 37195 - DNA, 20 bp, Artificial Sequence
  chemically synthesized
agtgttaagccagtaagttt

SEQ ID NO: 37196 - DNA, 20 bp, Artificial Sequence
  chemically synthesized
gtgttaagccagtaagtttt

SEQ ID NO: 37197 - DNA, 20 bp, Artificial Sequence
  chemically synthesized
tgttaagccagtaagttttg

SEQ ID NO: 37198 - DNA, 20 bp, Artificial Sequence
  chemically synthesized
aagccagtaagttttggggt

SEQ ID NO: 37199 - DNA, 20 bp, Artificial Sequence
  chemically synthesized
tttggggttggtctgttata

SEQ ID NO: 37200 - DNA, 20 bp, Artificial Sequence
  chemically synthesized
cagctacttttgctgtataa

SEQ ID NO: 37201 - DNA, 20 bp, Artificial Sequence
  chemically synthesized
gttggtctgttatacagcaa

SEQ ID NO: 37202 - DNA, 20 bp, Artificial Sequence
  chemically synthesized
ggtctgttatacagcaaaag

SEQ ID NO: 37203 - DNA, 20 bp, Artificial Sequence
  chemically synthesized
tcttgggagcagatgtgtaa

SEQ ID NO: 37204 - DNA, 20 bp, Artificial Sequence
  chemically synthesized
gctgttacacatctgctccc

SEQ ID NO: 37205 - DNA, 20 bp, Artificial Sequence
  chemically synthesized
ctaacgttctttcttgggag

SEQ ID NO: 37206 - DNA, 20 bp, Artificial Sequence
  chemically synthesized
ttacacatctgctcccaaga

SEQ ID NO: 37207 - DNA, 20 bp, Artificial Sequence
  chemically synthesized
tttctaacgttctttcttgg

SEQ ID NO: 37208 - DNA, 20 bp, Artificial Sequence
  chemically synthesized
agtttctaacgttctttctt

SEQ ID NO: 37209 - DNA, 20 bp, Artificial Sequence
  chemically synthesized
tagtttctaacgttctttct

SEQ ID NO: 37210 - DNA, 20 bp, Artificial Sequence
  chemically synthesized
ctgctcccaagaaagaacgt

SEQ ID NO: 37211 - DNA, 20 bp, Artificial Sequence
  chemically synthesized
caagaaagaacgttagaaac

SEQ ID NO: 37212 - DNA, 20 bp, Artificial Sequence
  chemically synthesized
aagaaagaacgttagaaact

SEQ ID NO: 37213 - DNA, 20 bp, Artificial Sequence
  chemically synthesized
ctgaatttgtgagaaaggcc

SEQ ID NO: 37214 - DNA, 20 bp, Artificial Sequence
  chemically synthesized
gctaactgaatttgtgagaa

SEQ ID NO: 37215 - DNA, 20 bp, Artificial Sequence
  chemically synthesized
tgctaactgaatttgtgaga

SEQ ID NO: 37216 - DNA, 20 bp, Artificial Sequence
  chemically synthesized
ctaggcctttctcacaaatt

SEQ ID NO: 37217 - DNA, 20 bp, Artificial Sequence
  chemically synthesized
taggtgctaactgaatttgt

SEQ ID NO: 37218 - DNA, 20 bp, Artificial Sequence
  chemically synthesized
gcctttctcacaaattcagt

SEQ ID NO: 37219 - DNA, 20 bp, Artificial Sequence
  chemically synthesized
tcacaaattcagttagcacc

SEQ ID NO: 37220 - DNA, 20 bp, Artificial Sequence
  chemically synthesized
gcaccaaggataaattgact

SEQ ID NO: 37221 - DNA, 20 bp, Artificial Sequence
  chemically synthesized
tgcaccaaggataaattgac

SEQ ID NO: 37222 - DNA, 20 bp, Artificial Sequence
  chemically synthesized
gcacctagtcaatttatcct

SEQ ID NO: 37223 - DNA, 20 bp, Artificial Sequence
  chemically synthesized
caactggaggacatgcacca

SEQ ID NO: 37224 - DNA, 20 bp, Artificial Sequence
  chemically synthesized
gcaactggaggacatgcacc

SEQ ID NO: 37225 - DNA, 20 bp, Artificial Sequence
  chemically synthesized
tatccttggtgcatgtcctc

SEQ ID NO: 37226 - DNA, 20 bp, Artificial Sequence
  chemically synthesized
tcttattaacaagcaactgg

SEQ ID NO: 37227 - DNA, 20 bp, Artificial Sequence
  chemically synthesized
atcttattaacaagcaactg

SEQ ID NO: 37228 - DNA, 20 bp, Artificial Sequence
  chemically synthesized
ttatcttattaacaagcaac

SEQ ID NO: 37229 - DNA, 20 bp, Artificial Sequence
  chemically synthesized
tcctccagttgcttgttaat

SEQ ID NO: 37230 - DNA, 20 bp, Artificial Sequence
  chemically synthesized
ttcagcattatcttattaac

SEQ ID NO: 37231 - DNA, 20 bp, Artificial Sequence
  chemically synthesized
taagataatgctgaaatgaa

SEQ ID NO: 37232 - DNA, 20 bp, Artificial Sequence
  chemically synthesized
tttgttctttctgttcattt

SEQ ID NO: 37233 - DNA, 20 bp, Artificial Sequence
  chemically synthesized
ataatgctgaaatgaacaga

SEQ ID NO: 37234 - DNA, 20 bp, Artificial Sequence
  chemically synthesized
gaacaaatacacatataacc

SEQ ID NO: 37235 - DNA, 20 bp, Artificial Sequence
  chemically synthesized
aacaaatacacatataacct

SEQ ID NO: 37236 - DNA, 20 bp, Artificial Sequence
  chemically synthesized
aaatacacatataacctggg

SEQ ID NO: 37237 - DNA, 20 bp, Artificial Sequence
  chemically synthesized
tattactaaaataacttccc

SEQ ID NO: 37238 - DNA, 20 bp, Artificial Sequence
  chemically synthesized
atattactaaaataacttcc

SEQ ID NO: 37239 - DNA, 20 bp, Artificial Sequence
  chemically synthesized
tataacctgggaagttattt

SEQ ID NO: 37240 - DNA, 20 bp, Artificial Sequence
  chemically synthesized
tttagtaatatgcttctcaa

SEQ ID NO: 37241 - DNA, 20 bp, Artificial Sequence
  chemically synthesized
tataaaatcttacttttgag

SEQ ID NO: 37242 - DNA, 20 bp, Artificial Sequence
  chemically synthesized
gtaatatgcttctcaaaagt

SEQ ID NO: 37243 - DNA, 20 bp, Artificial Sequence
  chemically synthesized
ccttataaaatcttactttt

SEQ ID NO: 37244 - DNA, 20 bp, Artificial Sequence
  chemically synthesized
tctcaaaagtaagattttat

SEQ ID NO: 37245 - DNA, 20 bp, Artificial Sequence
  chemically synthesized
ctcaaaagtaagattttata

SEQ ID NO: 37246 - DNA, 20 bp, Artificial Sequence
  chemically synthesized
tcaaaagtaagattttataa

SEQ ID NO: 37247 - DNA, 20 bp, Artificial Sequence
  chemically synthesized
caaaagtaagattttataag

SEQ ID NO: 37248 - DNA, 20 bp, Artificial Sequence
  chemically synthesized
aagattttataaggggtatt

SEQ ID NO: 37249 - DNA, 20 bp, Artificial Sequence
  chemically synthesized
taaggggtatttagaaaaac

SEQ ID NO: 37250 - DNA, 20 bp, Artificial Sequence
  chemically synthesized
aaaaacaagtatacaatttt

SEQ ID NO: 37251 - DNA, 20 bp, Artificial Sequence
  chemically synthesized
aacaagtatacaatttttag

SEQ ID NO: 37252 - DNA, 20 bp, Artificial Sequence
  chemically synthesized
agcttgaggatattatgaat

SEQ ID NO: 37253 - DNA, 20 bp, Artificial Sequence
  chemically synthesized
gtcttattcataatatcctc

SEQ ID NO: 37254 - DNA, 20 bp, Artificial Sequence
  chemically synthesized
tattcataatatcctcaagc

SEQ ID NO: 37255 - DNA, 20 bp, Artificial Sequence
  chemically synthesized
atgattttgtttccagcttg

SEQ ID NO: 37256 - DNA, 20 bp, Artificial Sequence
  chemically synthesized
aatgattttgtttccagctt

SEQ ID NO: 37257 - DNA, 20 bp, Artificial Sequence
  chemically synthesized
cagcataatgattttgtttc

SEQ ID NO: 37258 - DNA, 20 bp, Artificial Sequence
  chemically synthesized
aaaatcattatgctgaatat

SEQ ID NO: 37259 - DNA, 20 bp, Artificial Sequence
  chemically synthesized
aatcattatgctgaatataa

SEQ ID NO: 37260 - DNA, 20 bp, Artificial Sequence
  chemically synthesized
tgtatctggtctcttatatt

SEQ ID NO: 37261 - DNA, 20 bp, Artificial Sequence
  chemically synthesized
ttatgctgaatataagagac

SEQ ID NO: 37262 - DNA, 20 bp, Artificial Sequence
  chemically synthesized
acagtatttttgtatgtatc

SEQ ID NO: 37263 - DNA, 20 bp, Artificial Sequence
  chemically synthesized
tttctataaatagaatcata

SEQ ID NO: 37264 - DNA, 20 bp, Artificial Sequence
  chemically synthesized
atactgtatgattctattta

SEQ ID NO: 37265 - DNA, 20 bp, Artificial Sequence
  chemically synthesized
tttcaagaattttctataaa

SEQ ID NO: 37266 - DNA, 20 bp, Artificial Sequence
  chemically synthesized
gtgtattactttgcattttc

SEQ ID NO: 37267 - DNA, 20 bp, Artificial Sequence
  chemically synthesized
agaaaattcttgaaaatgca

SEQ ID NO: 37268 - DNA, 20 bp, Artificial Sequence
  chemically synthesized
tgaaaatgcaaagtaataca

SEQ ID NO: 37269 - DNA, 20 bp, Artificial Sequence
  chemically synthesized
aatgcaaagtaatacacagt

SEQ ID NO: 37270 - DNA, 20 bp, Artificial Sequence
  chemically synthesized
tgcaaagtaatacacagtga

SEQ ID NO: 37271 - DNA, 20 bp, Artificial Sequence
  chemically synthesized
aagtaatacacagtgagaga

SEQ ID NO: 37272 - DNA, 20 bp, Artificial Sequence
  chemically synthesized
cacagtgagagaaagacgat

SEQ ID NO: 37273 - DNA, 20 bp, Artificial Sequence
  chemically synthesized
agtgagagaaagacgatcag

SEQ ID NO: 37274 - DNA, 20 bp, Artificial Sequence
  chemically synthesized
aaagacgatcagtggttgcc

SEQ ID NO: 37275 - DNA, 20 bp, Artificial Sequence
  chemically synthesized
gatcagtggttgcctagaat

SEQ ID NO: 37276 - DNA, 20 bp, Artificial Sequence
  chemically synthesized
atcagtggttgcctagaatc

SEQ ID NO: 37277 - DNA, 20 bp, Artificial Sequence
  chemically synthesized
tcagtggttgcctagaatca

SEQ ID NO: 37278 - DNA, 20 bp, Artificial Sequence
  chemically synthesized
ttcctttcacccctgattct

SEQ ID NO: 37279 - DNA, 20 bp, Artificial Sequence
  chemically synthesized
cagtggttgcctagaatcag

SEQ ID NO: 37280 - DNA, 20 bp, Artificial Sequence
  chemically synthesized
tttcctttcacccctgattc

SEQ ID NO: 37281 - DNA, 20 bp, Artificial Sequence
  chemically synthesized
ttgcctagaatcaggggtga

SEQ ID NO: 37282 - DNA, 20 bp, Artificial Sequence
  chemically synthesized
tgcctagaatcaggggtgaa

SEQ ID NO: 37283 - DNA, 20 bp, Artificial Sequence
  chemically synthesized
gaaaggaaaaatgacctgca

SEQ ID NO: 37284 - DNA, 20 bp, Artificial Sequence
  chemically synthesized
aaaggaaaaatgacctgcaa

SEQ ID NO: 37285 - DNA, 20 bp, Artificial Sequence
  chemically synthesized
aaggaaaaatgacctgcaaa

SEQ ID NO: 37286 - DNA, 20 bp, Artificial Sequence
  chemically synthesized
aggaaaaatgacctgcaaag

SEQ ID NO: 37287 - DNA, 20 bp, Artificial Sequence
  chemically synthesized
gcctccttgtgcccctttgc

SEQ ID NO: 37288 - DNA, 20 bp, Artificial Sequence
  chemically synthesized
agcctccttgtgcccctttg

SEQ ID NO: 37289 - DNA, 20 bp, Artificial Sequence
  chemically synthesized
aatgacctgcaaaggggcac

SEQ ID NO: 37290 - DNA, 20 bp, Artificial Sequence
  chemically synthesized
atgacctgcaaaggggcaca

SEQ ID NO: 37291 - DNA, 20 bp, Artificial Sequence
  chemically synthesized
gacctgcaaaggggcacaag

SEQ ID NO: 37292 - DNA, 20 bp, Artificial Sequence
  chemically synthesized
acctgcaaaggggcacaagg

SEQ ID NO: 37293 - DNA, 20 bp, Artificial Sequence
  chemically synthesized
aaggggcacaaggaggcttt

SEQ ID NO: 37294 - DNA, 20 bp, Artificial Sequence
  chemically synthesized
aggggcacaaggaggctttt

SEQ ID NO: 37295 - DNA, 20 bp, Artificial Sequence
  chemically synthesized
ggggcacaaggaggcttttg

SEQ ID NO: 37296 - DNA, 20 bp, Artificial Sequence
  chemically synthesized
gggcacaaggaggcttttgg

SEQ ID NO: 37297 - DNA, 20 bp, Artificial Sequence
  chemically synthesized
gcacaaggaggcttttgggg

SEQ ID NO: 37298 - DNA, 20 bp, Artificial Sequence
  chemically synthesized
gaacgttcttactcccccaa

SEQ ID NO: 37299 - DNA, 20 bp, Artificial Sequence
  chemically synthesized
aaggaggcttttgggggagt

SEQ ID NO: 37300 - DNA, 20 bp, Artificial Sequence
  chemically synthesized
ccaccactgcagtcaaatga

SEQ ID NO: 37301 - DNA, 20 bp, Artificial Sequence
  chemically synthesized
aacgttctgtcatttgactg

SEQ ID NO: 37302 - DNA, 20 bp, Artificial Sequence
  chemically synthesized
gttctgtcatttgactgcag

SEQ ID NO: 37303 - DNA, 20 bp, Artificial Sequence
  chemically synthesized
ctgtcatttgactgcagtgg

SEQ ID NO: 37304 - DNA, 20 bp, Artificial Sequence
  chemically synthesized
tacttgtgaaaccaccactg

SEQ ID NO: 37305 - DNA, 20 bp, Artificial Sequence
  chemically synthesized
gactgcagtggtggtttcac

SEQ ID NO: 37306 - DNA, 20 bp, Artificial Sequence
  chemically synthesized
agtggttcagcgatttttgg

SEQ ID NO: 37307 - DNA, 20 bp, Artificial Sequence
  chemically synthesized
taaagtggttcagcgatttt

SEQ ID NO: 37308 - DNA, 20 bp, Artificial Sequence
  chemically synthesized
tgcctccatttaaagtggtt

SEQ ID NO: 37309 - DNA, 20 bp, Artificial Sequence
  chemically synthesized
aatcgctgaaccactttaaa

SEQ ID NO: 37310 - DNA, 20 bp, Artificial Sequence
  chemically synthesized
taaactgcctccatttaaag

SEQ ID NO: 37311 - DNA, 20 bp, Artificial Sequence
  chemically synthesized
tcgctgaaccactttaaatg

SEQ ID NO: 37312 - DNA, 20 bp, Artificial Sequence
  chemically synthesized
cgctgaaccactttaaatgg

SEQ ID NO: 37313 - DNA, 20 bp, Artificial Sequence
  chemically synthesized
cagtaaactgcctccattta

SEQ ID NO: 37314 - DNA, 20 bp, Artificial Sequence
  chemically synthesized
tgaaccactttaaatggagg

SEQ ID NO: 37315 - DNA, 20 bp, Artificial Sequence
  chemically synthesized
attaaataaaaatttacaca

SEQ ID NO: 37316 - DNA, 20 bp, Artificial Sequence
  chemically synthesized
gtgtaaatttttatttaata

SEQ ID NO: 37317 - DNA, 20 bp, Artificial Sequence
  chemically synthesized
attttaaaatttttttaaaa

SEQ ID NO: 37318 - DNA, 20 bp, Artificial Sequence
  chemically synthesized
gaatgttaaatttgatttta

SEQ ID NO: 37319 - DNA, 20 bp, Artificial Sequence
  chemically synthesized
tgaatgttaaatttgatttt

SEQ ID NO: 37320 - DNA, 20 bp, Artificial Sequence
  chemically synthesized
ttgaatgttaaatttgattt

SEQ ID NO: 37321 - DNA, 20 bp, Artificial Sequence
  chemically synthesized
aaaatgcatacaactgcaca

SEQ ID NO: 37322 - DNA, 20 bp, Artificial Sequence
  chemically synthesized
gatgcacctcattctttgtg

SEQ ID NO: 37323 - DNA, 20 bp, Artificial Sequence
  chemically synthesized
catacaactgcacaaagaat

SEQ ID NO: 37324 - DNA, 20 bp, Artificial Sequence
  chemically synthesized
atacaactgcacaaagaatg

SEQ ID NO: 37325 - DNA, 20 bp, Artificial Sequence
  chemically synthesized
aaagaatgaggtgcatcaca

SEQ ID NO: 37326 - DNA, 20 bp, Artificial Sequence
  chemically synthesized
aagaatgaggtgcatcacac

SEQ ID NO: 37327 - DNA, 20 bp, Artificial Sequence
  chemically synthesized
acaggatgtttacataaata

SEQ ID NO: 37328 - DNA, 20 bp, Artificial Sequence
  chemically synthesized
caggatgtttacataaatat

SEQ ID NO: 37329 - DNA, 20 bp, Artificial Sequence
  chemically synthesized
atgtttacataaatatagga

SEQ ID NO: 37330 - DNA, 20 bp, Artificial Sequence
  chemically synthesized
acataaatataggacagatt

SEQ ID NO: 37331 - DNA, 20 bp, Artificial Sequence
  chemically synthesized
cataaatataggacagattc

SEQ ID NO: 37332 - DNA, 20 bp, Artificial Sequence
  chemically synthesized
acagattcaggtcatgctgt

SEQ ID NO: 37333 - DNA, 20 bp, Artificial Sequence
  chemically synthesized
attaatcagaagggaactga

SEQ ID NO: 37334 - DNA, 20 bp, Artificial Sequence
  chemically synthesized
attttcggaattaatcagaa

SEQ ID NO: 37335 - DNA, 20 bp, Artificial Sequence
  chemically synthesized
tattttcggaattaatcaga

SEQ ID NO: 37336 - DNA, 20 bp, Artificial Sequence
  chemically synthesized
atattttcggaattaatcag

SEQ ID NO: 37337 - DNA, 20 bp, Artificial Sequence
  chemically synthesized
ttgatattttcggaattaat

SEQ ID NO: 37338 - DNA, 20 bp, Artificial Sequence
  chemically synthesized
atctaatgttttgatatttt

SEQ ID NO: 37339 - DNA, 20 bp, Artificial Sequence
  chemically synthesized
ttccgaaaatatcaaaacat

SEQ ID NO: 37340 - DNA, 20 bp, Artificial Sequence
  chemically synthesized
tatcaaaacattagattcac

SEQ ID NO: 37341 - DNA, 20 bp, Artificial Sequence
  chemically synthesized
tagattcacaagtgacctta

SEQ ID NO: 37342 - DNA, 20 bp, Artificial Sequence
  chemically synthesized
agattcacaagtgaccttaa

SEQ ID NO: 37343 - DNA, 20 bp, Artificial Sequence
  chemically synthesized
atataattcattaaccttta

SEQ ID NO: 37344 - DNA, 20 bp, Artificial Sequence
  chemically synthesized
gatataattcattaaccttt

SEQ ID NO: 37345 - DNA, 20 bp, Artificial Sequence
  chemically synthesized
caatttctgtattggatgag

SEQ ID NO: 37346 - DNA, 20 bp, Artificial Sequence
  chemically synthesized
gcaatttctgtattggatga

SEQ ID NO: 37347 - DNA, 20 bp, Artificial Sequence
  chemically synthesized
aggcaatttctgtattggat

SEQ ID NO: 37348 - DNA, 20 bp, Artificial Sequence
  chemically synthesized
ttatatcctctcatccaata

SEQ ID NO: 37349 - DNA, 20 bp, Artificial Sequence
  chemically synthesized
cctaaaggcaatttctgtat

SEQ ID NO: 37350 - DNA, 20 bp, Artificial Sequence
  chemically synthesized
tccaatacagaaattgcctt

SEQ ID NO: 37351 - DNA, 20 bp, Artificial Sequence
  chemically synthesized
ccaatacagaaattgccttt

SEQ ID NO: 37352 - DNA, 20 bp, Artificial Sequence
  chemically synthesized
caatacagaaattgccttta

SEQ ID NO: 37353 - DNA, 20 bp, Artificial Sequence
  chemically synthesized
aatacagaaattgcctttag

SEQ ID NO: 37354 - DNA, 20 bp, Artificial Sequence
  chemically synthesized
aatgactgtctcacccctaa

SEQ ID NO: 37355 - DNA, 20 bp, Artificial Sequence
  chemically synthesized
cagaaattgcctttaggggt

SEQ ID NO: 37356 - DNA, 20 bp, Artificial Sequence
  chemically synthesized
aaatgactgtctcaccccta

SEQ ID NO: 37357 - DNA, 20 bp, Artificial Sequence
  chemically synthesized
aattgcctttaggggtgaga

SEQ ID NO: 37358 - DNA, 20 bp, Artificial Sequence
  chemically synthesized
taggggtgagacagtcattt

SEQ ID NO: 37359 - DNA, 20 bp, Artificial Sequence
  chemically synthesized
tccctgtacagtagattttc

SEQ ID NO: 37360 - DNA, 20 bp, Artificial Sequence
  chemically synthesized
agtcttgaaaatctactgta

SEQ ID NO: 37361 - DNA, 20 bp, Artificial Sequence
  chemically synthesized
gtcttgaaaatctactgtac

SEQ ID NO: 37362 - DNA, 20 bp, Artificial Sequence
  chemically synthesized
tcttgaaaatctactgtaca

SEQ ID NO: 37363 - DNA, 20 bp, Artificial Sequence
  chemically synthesized
gcattaaactccctgtacag

SEQ ID NO: 37364 - DNA, 20 bp, Artificial Sequence
  chemically synthesized
ttgaaaatctactgtacagg

SEQ ID NO: 37365 - DNA, 20 bp, Artificial Sequence
  chemically synthesized
aaagcattaaactccctgta

SEQ ID NO: 37366 - DNA, 20 bp, Artificial Sequence
  chemically synthesized
agggagtttaatgcttttca

SEQ ID NO: 37367 - DNA, 20 bp, Artificial Sequence
  chemically synthesized
gagtttaatgcttttcaaag

SEQ ID NO: 37368 - DNA, 20 bp, Artificial Sequence
  chemically synthesized
ataaaatccgccactttgaa

SEQ ID NO: 37369 - DNA, 20 bp, Artificial Sequence
  chemically synthesized
tttaatgcttttcaaagtgg

SEQ ID NO: 37370 - DNA, 20 bp, Artificial Sequence
  chemically synthesized
aagtggcggattttattttt

SEQ ID NO: 37371 - DNA, 20 bp, Artificial Sequence
  chemically synthesized
gtggcggattttattttttg

SEQ ID NO: 37372 - DNA, 20 bp, Artificial Sequence
  chemically synthesized
ggcggattttattttttgga

SEQ ID NO: 37373 - DNA, 20 bp, Artificial Sequence
  chemically synthesized
ttaaagaaacttttgtaatc

SEQ ID NO: 37374 - DNA, 20 bp, Artificial Sequence
  chemically synthesized
tttggagagctcgattacaa

SEQ ID NO: 37375 - DNA, 20 bp, Artificial Sequence
  chemically synthesized
acaaaagtttctttaatatt

SEQ ID NO: 37376 - DNA, 20 bp, Artificial Sequence
  chemically synthesized
catattttaactaaatatta

SEQ ID NO: 37377 - DNA, 20 bp, Artificial Sequence
  chemically synthesized
gatatgtggaagttatggga

SEQ ID NO: 37378 - DNA, 20 bp, Artificial Sequence
  chemically synthesized
gctagatatgtggaagttat

SEQ ID NO: 37379 - DNA, 20 bp, Artificial Sequence
  chemically synthesized
agctagatatgtggaagtta

SEQ ID NO: 37380 - DNA, 20 bp, Artificial Sequence
  chemically synthesized
ggattgagctagatatgtgg

SEQ ID NO: 37381 - DNA, 20 bp, Artificial Sequence
  chemically synthesized
tcccataacttccacatatc

SEQ ID NO: 37382 - DNA, 20 bp, Artificial Sequence
  chemically synthesized
aatggattgagctagatatg

SEQ ID NO: 37383 - DNA, 20 bp, Artificial Sequence
  chemically synthesized
attctgagaatggattgagc

SEQ ID NO: 37384 - DNA, 20 bp, Artificial Sequence
  chemically synthesized
ttttattctgagaatggatt

SEQ ID NO: 37385 - DNA, 20 bp, Artificial Sequence
  chemically synthesized
tatctagctcaatccattct

SEQ ID NO: 37386 - DNA, 20 bp, Artificial Sequence
  chemically synthesized
ttcctgttttattctgagaa

SEQ ID NO: 37387 - DNA, 20 bp, Artificial Sequence
  chemically synthesized
tttttttcctgttttattct

SEQ ID NO: 37388 - DNA, 20 bp, Artificial Sequence
  chemically synthesized
aatccattctcagaataaaa

SEQ ID NO: 37389 - DNA, 20 bp, Artificial Sequence
  chemically synthesized
atccattctcagaataaaac

SEQ ID NO: 37390 - DNA, 20 bp, Artificial Sequence
  chemically synthesized
aaacaggaaaaaaataacaa

SEQ ID NO: 37391 - DNA, 20 bp, Artificial Sequence
  chemically synthesized
acaggaaaaaaataacaaaa

SEQ ID NO: 37392 - DNA, 20 bp, Artificial Sequence
  chemically synthesized
aggaaaaaaataacaaaaga

SEQ ID NO: 37393 - DNA, 20 bp, Artificial Sequence
  chemically synthesized
aaataacaaaagagagttca

SEQ ID NO: 37394 - DNA, 20 bp, Artificial Sequence
  chemically synthesized
taacaaaagagagttcacag

SEQ ID NO: 37395 - DNA, 20 bp, Artificial Sequence
  chemically synthesized
gagttcacagtagtaatgaa

SEQ ID NO: 37396 - DNA, 20 bp, Artificial Sequence
  chemically synthesized
agttcacagtagtaatgaat

SEQ ID NO: 37397 - DNA, 20 bp, Artificial Sequence
  chemically synthesized
tagtaatgaatgggcaaaac

SEQ ID NO: 37398 - DNA, 20 bp, Artificial Sequence
  chemically synthesized
atgggcaaaactggccaaat

SEQ ID NO: 37399 - DNA, 20 bp, Artificial Sequence
  chemically synthesized
gcctgaagacctcatttggc

SEQ ID NO: 37400 - DNA, 20 bp, Artificial Sequence
  chemically synthesized
tgggcaaaactggccaaatg

SEQ ID NO: 37401 - DNA, 20 bp, Artificial Sequence
  chemically synthesized
ctctgcctgaagacctcatt

SEQ ID NO: 37402 - DNA, 20 bp, Artificial Sequence
  chemically synthesized
aactggccaaatgaggtctt

SEQ ID NO: 37403 - DNA, 20 bp, Artificial Sequence
  chemically synthesized
actggccaaatgaggtcttc

SEQ ID NO: 37404 - DNA, 20 bp, Artificial Sequence
  chemically synthesized
ggccaaatgaggtcttcagg

SEQ ID NO: 37405 - DNA, 20 bp, Artificial Sequence
  chemically synthesized
ccaaatgaggtcttcaggca

SEQ ID NO: 37406 - DNA, 20 bp, Artificial Sequence
  chemically synthesized
caaatgaggtcttcaggcag

SEQ ID NO: 37407 - DNA, 20 bp, Artificial Sequence
  chemically synthesized
tcaactcagccctctgcctg

SEQ ID NO: 37408 - DNA, 20 bp, Artificial Sequence
  chemically synthesized
aaatgaggtcttcaggcaga

SEQ ID NO: 37409 - DNA, 20 bp, Artificial Sequence
  chemically synthesized
aggtcttcaggcagagggct

SEQ ID NO: 37410 - DNA, 20 bp, Artificial Sequence
  chemically synthesized
ttcaggcagagggctgagtt

SEQ ID NO: 37411 - DNA, 20 bp, Artificial Sequence
  chemically synthesized
gtcatctcttaagctcaact

SEQ ID NO: 37412 - DNA, 20 bp, Artificial Sequence
  chemically synthesized
cagagggctgagttgagctt

SEQ ID NO: 37413 - DNA, 20 bp, Artificial Sequence
  chemically synthesized
gagggctgagttgagcttaa

SEQ ID NO: 37414 - DNA, 20 bp, Artificial Sequence
  chemically synthesized
ttcttcttcagtcatctctt

SEQ ID NO: 37415 - DNA, 20 bp, Artificial Sequence
  chemically synthesized
ttgagcttaagagatgactg

SEQ ID NO: 37416 - DNA, 20 bp, Artificial Sequence
  chemically synthesized
agcttaagagatgactgaag

SEQ ID NO: 37417 - DNA, 20 bp, Artificial Sequence
  chemically synthesized
gcacatggctgtttcttctt

SEQ ID NO: 37418 - DNA, 20 bp, Artificial Sequence
  chemically synthesized
agagatgactgaagaagaaa

SEQ ID NO: 37419 - DNA, 20 bp, Artificial Sequence
  chemically synthesized
agaagaaacagccatgtgca

SEQ ID NO: 37420 - DNA, 20 bp, Artificial Sequence
  chemically synthesized
gaagaaacagccatgtgcaa

SEQ ID NO: 37421 - DNA, 20 bp, Artificial Sequence
  chemically synthesized
gttggccctgcctttgcaca

SEQ ID NO: 37422 - DNA, 20 bp, Artificial Sequence
  chemically synthesized
gaaacagccatgtgcaaagg

SEQ ID NO: 37423 - DNA, 20 bp, Artificial Sequence
  chemically synthesized
aaacagccatgtgcaaaggc

SEQ ID NO: 37424 - DNA, 20 bp, Artificial Sequence
  chemically synthesized
aacagccatgtgcaaaggca

SEQ ID NO: 37425 - DNA, 20 bp, Artificial Sequence
  chemically synthesized
tgcaaaggcagggccaacga

SEQ ID NO: 37426 - DNA, 20 bp, Artificial Sequence
  chemically synthesized
caaaggcagggccaacgaca

SEQ ID NO: 37427 - DNA, 20 bp, Artificial Sequence
  chemically synthesized
caaaatagagtctctgtcgt

SEQ ID NO: 37428 - DNA, 20 bp, Artificial Sequence
  chemically synthesized
atctagatcaacacaaaata

SEQ ID NO: 37429 - DNA, 20 bp, Artificial Sequence
  chemically synthesized
agatctagatcaacacaaaa

SEQ ID NO: 37430 - DNA, 20 bp, Artificial Sequence
  chemically synthesized
gactctattttgtgttgatc

SEQ ID NO: 37431 - DNA, 20 bp, Artificial Sequence
  chemically synthesized
agaatgtcaattaatagatc

SEQ ID NO: 37432 - DNA, 20 bp, Artificial Sequence
  chemically synthesized
atctaaagaatgtcaattaa

SEQ ID NO: 37433 - DNA, 20 bp, Artificial Sequence
  chemically synthesized
atctattaattgacattctt

SEQ ID NO: 37434 - DNA, 20 bp, Artificial Sequence
  chemically synthesized
tgattaaataatgacatcta

SEQ ID NO: 37435 - DNA, 20 bp, Artificial Sequence
  chemically synthesized
tttagatgtcattatttaat

SEQ ID NO: 37436 - DNA, 20 bp, Artificial Sequence
  chemically synthesized
tatttaatcagcttcaaatt

SEQ ID NO: 37437 - DNA, 20 bp, Artificial Sequence
  chemically synthesized
tggctaataggctgaatttg

SEQ ID NO: 37438 - DNA, 20 bp, Artificial Sequence
  chemically synthesized
cagcttcaaattcagcctat

SEQ ID NO: 37439 - DNA, 20 bp, Artificial Sequence
  chemically synthesized
ttcaaattcagcctattagc

SEQ ID NO: 37440 - DNA, 20 bp, Artificial Sequence
  chemically synthesized
gaacagtggggctggctaat

SEQ ID NO: 37441 - DNA, 20 bp, Artificial Sequence
  chemically synthesized
agaacagtggggctggctaa

SEQ ID NO: 37442 - DNA, 20 bp, Artificial Sequence
  chemically synthesized
aagataaagaacagtggggc

SEQ ID NO: 37443 - DNA, 20 bp, Artificial Sequence
  chemically synthesized
gtacaagataaagaacagtg

SEQ ID NO: 37444 - DNA, 20 bp, Artificial Sequence
  chemically synthesized
ggtacaagataaagaacagt

SEQ ID NO: 37445 - DNA, 20 bp, Artificial Sequence
  chemically synthesized
gggtacaagataaagaacag

SEQ ID NO: 37446 - DNA, 20 bp, Artificial Sequence
  chemically synthesized
attgggtacaagataaagaa

SEQ ID NO: 37447 - DNA, 20 bp, Artificial Sequence
  chemically synthesized
agaatattgggtacaagata

SEQ ID NO: 37448 - DNA, 20 bp, Artificial Sequence
  chemically synthesized
cttttgagaatattgggtac

SEQ ID NO: 37449 - DNA, 20 bp, Artificial Sequence
  chemically synthesized
agttctcttttgagaatatt

SEQ ID NO: 37450 - DNA, 20 bp, Artificial Sequence
  chemically synthesized
aagttctcttttgagaatat

SEQ ID NO: 37451 - DNA, 20 bp, Artificial Sequence
  chemically synthesized
cttgtacccaatattctcaa

SEQ ID NO: 37452 - DNA, 20 bp, Artificial Sequence
  chemically synthesized
tgtacccaatattctcaaaa

SEQ ID NO: 37453 - DNA, 20 bp, Artificial Sequence
  chemically synthesized
catttttcaagttctctttt

SEQ ID NO: 37454 - DNA, 20 bp, Artificial Sequence
  chemically synthesized
gattttacaccacatttttc

SEQ ID NO: 37455 - DNA, 20 bp, Artificial Sequence
  chemically synthesized
aaaagagaacttgaaaaatg

SEQ ID NO: 37456 - DNA, 20 bp, Artificial Sequence
  chemically synthesized
aaaatgtggtgtaaaatcct

SEQ ID NO: 37457 - DNA, 20 bp, Artificial Sequence
  chemically synthesized
tgttagagacagcataactt

SEQ ID NO: 37458 - DNA, 20 bp, Artificial Sequence
  chemically synthesized
ctgttagagacagcataact

SEQ ID NO: 37459 - DNA, 20 bp, Artificial Sequence
  chemically synthesized
ctaagttatgctgtctctaa

SEQ ID NO: 37460 - DNA, 20 bp, Artificial Sequence
  chemically synthesized
gatgagaagactgttagaga

SEQ ID NO: 37461 - DNA, 20 bp, Artificial Sequence
  chemically synthesized
gttagatgagaagactgtta

SEQ ID NO: 37462 - DNA, 20 bp, Artificial Sequence
  chemically synthesized
tggttagatgagaagactgt

SEQ ID NO: 37463 - DNA, 20 bp, Artificial Sequence
  chemically synthesized
ctgcttgatggttagatgag

SEQ ID NO: 37464 - DNA, 20 bp, Artificial Sequence
  chemically synthesized
tggctgcttgatggttagat

SEQ ID NO: 37465 - DNA, 20 bp, Artificial Sequence
  chemically synthesized
agtcttctcatctaaccatc

SEQ ID NO: 37466 - DNA, 20 bp, Artificial Sequence
  chemically synthesized
ttttatggctgcttgatggt

SEQ ID NO: 37467 - DNA, 20 bp, Artificial Sequence
  chemically synthesized
cttctcatctaaccatcaag

SEQ ID NO: 37468 - DNA, 20 bp, Artificial Sequence
  chemically synthesized
ttttttttatggctgcttga

SEQ ID NO: 37469 - DNA, 20 bp, Artificial Sequence
  chemically synthesized
cctcattttcatttttttta

SEQ ID NO: 37470 - DNA, 20 bp, Artificial Sequence
  chemically synthesized
gccataaaaaaaatgaaaat

SEQ ID NO: 37471 - DNA, 20 bp, Artificial Sequence
  chemically synthesized
ccataaaaaaaatgaaaatg

SEQ ID NO: 37472 - DNA, 20 bp, Artificial Sequence
  chemically synthesized
aaaatgaggtgcatgtgaca

SEQ ID NO: 37473 - DNA, 20 bp, Artificial Sequence
  chemically synthesized
atgaggtgcatgtgacatgg

SEQ ID NO: 37474 - DNA, 20 bp, Artificial Sequence
  chemically synthesized
catgtgacatggcagatttt

SEQ ID NO: 37475 - DNA, 20 bp, Artificial Sequence
  chemically synthesized
tgtgacatggcagattttga

SEQ ID NO: 37476 - DNA, 20 bp, Artificial Sequence
  chemically synthesized
gagagtatcacgctgattcc

SEQ ID NO: 37477 - DNA, 20 bp, Artificial Sequence
  chemically synthesized
gataacatgctgctgggaat

SEQ ID NO: 37478 - DNA, 20 bp, Artificial Sequence
  chemically synthesized
agtatcacgctgattcccag

SEQ ID NO: 37479 - DNA, 20 bp, Artificial Sequence
  chemically synthesized
acataggataacatgctgct

SEQ ID NO: 37480 - DNA, 20 bp, Artificial Sequence
  chemically synthesized
tacataggataacatgctgc

SEQ ID NO: 37481 - DNA, 20 bp, Artificial Sequence
  chemically synthesized
ctgattattaatgattacat

SEQ ID NO: 37482 - DNA, 20 bp, Artificial Sequence
  chemically synthesized
actgattattaatgattaca

SEQ ID NO: 37483 - DNA, 20 bp, Artificial Sequence
  chemically synthesized
cctatgtaatcattaataat

SEQ ID NO: 37484 - DNA, 20 bp, Artificial Sequence
  chemically synthesized
atcagtacgatgtcattttc

SEQ ID NO: 37485 - DNA, 20 bp, Artificial Sequence
  chemically synthesized
tcagtacgatgtcattttcc

SEQ ID NO: 37486 - DNA, 20 bp, Artificial Sequence
  chemically synthesized
gttgatgagcaacaaaatcc

SEQ ID NO: 37487 - DNA, 20 bp, Artificial Sequence
  chemically synthesized
ccaataagtttgatgttgat

SEQ ID NO: 37488 - DNA, 20 bp, Artificial Sequence
  chemically synthesized
ctcatcaacatcaaacttat

SEQ ID NO: 37489 - DNA, 20 bp, Artificial Sequence
  chemically synthesized
tttaaaatttacaaaccaat

SEQ ID NO: 37490 - DNA, 20 bp, Artificial Sequence
  chemically synthesized
tttaacgtttaaaaagtaaa

SEQ ID NO: 37491 - DNA, 20 bp, Artificial Sequence
  chemically synthesized
tttttaacgtttaaaaagta

SEQ ID NO: 37492 - DNA, 20 bp, Artificial Sequence
  chemically synthesized
acatttttttaacgtttaaa

SEQ ID NO: 37493 - DNA, 20 bp, Artificial Sequence
  chemically synthesized
gtgatgtcatataaggagat

SEQ ID NO: 37494 - DNA, 20 bp, Artificial Sequence
  chemically synthesized
gattggtgatgtcatataag

SEQ ID NO: 37495 - DNA, 20 bp, Artificial Sequence
  chemically synthesized
gggattggtgatgtcatata

SEQ ID NO: 37496 - DNA, 20 bp, Artificial Sequence
  chemically synthesized
agggattggtgatgtcatat

SEQ ID NO: 37497 - DNA, 20 bp, Artificial Sequence
  chemically synthesized
gagaaaacatgggaagggat

SEQ ID NO: 37498 - DNA, 20 bp, Artificial Sequence
  chemically synthesized
actcagagaaaacatgggaa

SEQ ID NO: 37499 - DNA, 20 bp, Artificial Sequence
  chemically synthesized
aactcagagaaaacatggga

SEQ ID NO: 37500 - DNA, 20 bp, Artificial Sequence
  chemically synthesized
aaactcagagaaaacatggg

SEQ ID NO: 37501 - DNA, 20 bp, Artificial Sequence
  chemically synthesized
ggaaaactcagagaaaacat

SEQ ID NO: 37502 - DNA, 20 bp, Artificial Sequence
  chemically synthesized
tggaaaactcagagaaaaca

SEQ ID NO: 37503 - DNA, 20 bp, Artificial Sequence
  chemically synthesized
tcccttcccatgttttctct

SEQ ID NO: 37504 - DNA, 20 bp, Artificial Sequence
  chemically synthesized
agttgccagtggaaaactca

SEQ ID NO: 37505 - DNA, 20 bp, Artificial Sequence
  chemically synthesized
agagttgccagtggaaaact

SEQ ID NO: 37506 - DNA, 20 bp, Artificial Sequence
  chemically synthesized
gttttctctgagttttccac

SEQ ID NO: 37507 - DNA, 20 bp, Artificial Sequence
  chemically synthesized
cccatgaaaagagttgccag

SEQ ID NO: 37508 - DNA, 20 bp, Artificial Sequence
  chemically synthesized
cctcccatgaaaagagttgc

SEQ ID NO: 37509 - DNA, 20 bp, Artificial Sequence
  chemically synthesized
tccactggcaactcttttca

SEQ ID NO: 37510 - DNA, 20 bp, Artificial Sequence
  chemically synthesized
ccactggcaactcttttcat

SEQ ID NO: 37511 - DNA, 20 bp, Artificial Sequence
  chemically synthesized
cactcctcctcccatgaaaa

SEQ ID NO: 37512 - DNA, 20 bp, Artificial Sequence
  chemically synthesized
actggcaactcttttcatgg

SEQ ID NO: 37513 - DNA, 20 bp, Artificial Sequence
  chemically synthesized
gtcactcctcctcccatgaa

SEQ ID NO: 37514 - DNA, 20 bp, Artificial Sequence
  chemically synthesized
ctggcaactcttttcatggg

SEQ ID NO: 37515 - DNA, 20 bp, Artificial Sequence
  chemically synthesized
ggcaactcttttcatgggag

SEQ ID NO: 37516 - DNA, 20 bp, Artificial Sequence
  chemically synthesized
gcaactcttttcatgggagg

SEQ ID NO: 37517 - DNA, 20 bp, Artificial Sequence
  chemically synthesized
aactcttttcatgggaggag

SEQ ID NO: 37518 - DNA, 20 bp, Artificial Sequence
  chemically synthesized
atgggaggaggagtgacttt

SEQ ID NO: 37519 - DNA, 20 bp, Artificial Sequence
  chemically synthesized
ggaggaggagtgacttttag

SEQ ID NO: 37520 - DNA, 20 bp, Artificial Sequence
  chemically synthesized
tcttatccagtatccactaa

SEQ ID NO: 37521 - DNA, 20 bp, Artificial Sequence
  chemically synthesized
gagtgacttttagtggatac

SEQ ID NO: 37522 - DNA, 20 bp, Artificial Sequence
  chemically synthesized
acttttagtggatactggat

SEQ ID NO: 37523 - DNA, 20 bp, Artificial Sequence
  chemically synthesized
tttagtggatactggataag

SEQ ID NO: 37524 - DNA, 20 bp, Artificial Sequence
  chemically synthesized
aggagtgcattcttcttatc

SEQ ID NO: 37525 - DNA, 20 bp, Artificial Sequence
  chemically synthesized
aagaagaatgcactcctgtt

SEQ ID NO: 37526 - DNA, 20 bp, Artificial Sequence
  chemically synthesized
gatctcattctactcaacag

SEQ ID NO: 37527 - DNA, 20 bp, Artificial Sequence
  chemically synthesized
aagaatgcactcctgttgag

SEQ ID NO: 37528 - DNA, 20 bp, Artificial Sequence
  chemically synthesized
gggatctcattctactcaac

SEQ ID NO: 37529 - DNA, 20 bp, Artificial Sequence
  chemically synthesized
tgggatctcattctactcaa

SEQ ID NO: 37530 - DNA, 20 bp, Artificial Sequence
  chemically synthesized
gcactcctgttgagtagaat

SEQ ID NO: 37531 - DNA, 20 bp, Artificial Sequence
  chemically synthesized
ttgagtagaatgagatccca

SEQ ID NO: 37532 - DNA, 20 bp, Artificial Sequence
  chemically synthesized
agtagaatgagatcccatgg

SEQ ID NO: 37533 - DNA, 20 bp, Artificial Sequence
  chemically synthesized
tttgttagaagtgctgccat

SEQ ID NO: 37534 - DNA, 20 bp, Artificial Sequence
  chemically synthesized
atttgttagaagtgctgcca

SEQ ID NO: 37535 - DNA, 20 bp, Artificial Sequence
  chemically synthesized
gactaggtctaatttgttag

SEQ ID NO: 37536 - DNA, 20 bp, Artificial Sequence
  chemically synthesized
tggcagcacttctaacaaat

SEQ ID NO: 37537 - DNA, 20 bp, Artificial Sequence
  chemically synthesized
agagactaggtctaatttgt

SEQ ID NO: 37538 - DNA, 20 bp, Artificial Sequence
  chemically synthesized
cacttctaacaaattagacc

SEQ ID NO: 37539 - DNA, 20 bp, Artificial Sequence
  chemically synthesized
attgtttttgttcagagact

SEQ ID NO: 37540 - DNA, 20 bp, Artificial Sequence
  chemically synthesized
tattgtttttgttcagagac

SEQ ID NO: 37541 - DNA, 20 bp, Artificial Sequence
  chemically synthesized
actcatattgtttttgttca

SEQ ID NO: 37542 - DNA, 20 bp, Artificial Sequence
  chemically synthesized
taactcatattgtttttgtt

SEQ ID NO: 37543 - DNA, 20 bp, Artificial Sequence
  chemically synthesized
tctctgaacaaaaacaatat

SEQ ID NO: 37544 - DNA, 20 bp, Artificial Sequence
  chemically synthesized
gaacaaaaacaatatgagtt

SEQ ID NO: 37545 - DNA, 20 bp, Artificial Sequence
  chemically synthesized
tatgagttaagatcgtccct

SEQ ID NO: 37546 - DNA, 20 bp, Artificial Sequence
  chemically synthesized
ttcttttctagataatctta

SEQ ID NO: 37547 - DNA, 20 bp, Artificial Sequence
  chemically synthesized
attcttttctagataatctt

SEQ ID NO: 37548 - DNA, 20 bp, Artificial Sequence
  chemically synthesized
gattcttttctagataatct

SEQ ID NO: 37549 - DNA, 20 bp, Artificial Sequence
  chemically synthesized
agatcgtccctaagattatc

SEQ ID NO: 37550 - DNA, 20 bp, Artificial Sequence
  chemically synthesized
gtccctaagattatctagaa

SEQ ID NO: 37551 - DNA, 20 bp, Artificial Sequence
  chemically synthesized
atgggaacgggattcttttc

SEQ ID NO: 37552 - DNA, 20 bp, Artificial Sequence
  chemically synthesized
ttactcagctttatgggaac

SEQ ID NO: 37553 - DNA, 20 bp, Artificial Sequence
  chemically synthesized
gttactcagctttatgggaa

SEQ ID NO: 37554 - DNA, 20 bp, Artificial Sequence
  chemically synthesized
aaaagaatcccgttcccata

SEQ ID NO: 37555 - DNA, 20 bp, Artificial Sequence
  chemically synthesized
aaaatgttactcagctttat

SEQ ID NO: 37556 - DNA, 20 bp, Artificial Sequence
  chemically synthesized
aatcccgttcccataaagct

SEQ ID NO: 37557 - DNA, 20 bp, Artificial Sequence
  chemically synthesized
caaaatgttactcagcttta

SEQ ID NO: 37558 - DNA, 20 bp, Artificial Sequence
  chemically synthesized
aatctgaccaaaatgttact

SEQ ID NO: 37559 - DNA, 20 bp, Artificial Sequence
  chemically synthesized
cataaagctgagtaacattt

SEQ ID NO: 37560 - DNA, 20 bp, Artificial Sequence
  chemically synthesized
aagctgagtaacattttggt

SEQ ID NO: 37561 - DNA, 20 bp, Artificial Sequence
  chemically synthesized
tcagatttgtgtcattttaa

SEQ ID NO: 37562 - DNA, 20 bp, Artificial Sequence
  chemically synthesized
tgctttttaggtaaatattt

SEQ ID NO: 37563 - DNA, 20 bp, Artificial Sequence
  chemically synthesized
agccaaaatatttacctaaa

SEQ ID NO: 37564 - DNA, 20 bp, Artificial Sequence
  chemically synthesized
aaaatatttacctaaaaagc

SEQ ID NO: 37565 - DNA, 20 bp, Artificial Sequence
  chemically synthesized
attcaaatcacttgcttttt

SEQ ID NO: 37566 - DNA, 20 bp, Artificial Sequence
  chemically synthesized
cattcaaatcacttgctttt

SEQ ID NO: 37567 - DNA, 20 bp, Artificial Sequence
  chemically synthesized
agcaagtgatttgaatgtct

SEQ ID NO: 37568 - DNA, 20 bp, Artificial Sequence
  chemically synthesized
tgatttgaatgtctcagact

SEQ ID NO: 37569 - DNA, 20 bp, Artificial Sequence
  chemically synthesized
agtaaaaaataacttagtct

SEQ ID NO: 37570 - DNA, 20 bp, Artificial Sequence
  chemically synthesized
tagatcagtaaaaaataact

SEQ ID NO: 37571 - DNA, 20 bp, Artificial Sequence
  chemically synthesized
agttattttttactgatcta

SEQ ID NO: 37572 - DNA, 20 bp, Artificial Sequence
  chemically synthesized
ctcatttgagggccatagat

SEQ ID NO: 37573 - DNA, 20 bp, Artificial Sequence
  chemically synthesized
atcaactcatttgagggcca

SEQ ID NO: 37574 - DNA, 20 bp, Artificial Sequence
  chemically synthesized
ctgatctatggccctcaaat

SEQ ID NO: 37575 - DNA, 20 bp, Artificial Sequence
  chemically synthesized
aaggtcatcaactcatttga

SEQ ID NO: 37576 - DNA, 20 bp, Artificial Sequence
  chemically synthesized
gaaggtcatcaactcatttg

SEQ ID NO: 37577 - DNA, 20 bp, Artificial Sequence
  chemically synthesized
tgaaggtcatcaactcattt

SEQ ID NO: 37578 - DNA, 20 bp, Artificial Sequence
  chemically synthesized
tcaaatgagttgatgacctt

SEQ ID NO: 37579 - DNA, 20 bp, Artificial Sequence
  chemically synthesized
aatgagttgatgaccttcag

SEQ ID NO: 37580 - DNA, 20 bp, Artificial Sequence
  chemically synthesized
tgagttgatgaccttcagta

SEQ ID NO: 37581 - DNA, 20 bp, Artificial Sequence
  chemically synthesized
aagaaccatttctctactga

SEQ ID NO: 37582 - DNA, 20 bp, Artificial Sequence
  chemically synthesized
aaagaaccatttctctactg

SEQ ID NO: 37583 - DNA, 20 bp, Artificial Sequence
  chemically synthesized
gatgaccttcagtagagaaa

SEQ ID NO: 37584 - DNA, 20 bp, Artificial Sequence
  chemically synthesized
actctcacaaatcagaaata

SEQ ID NO: 37585 - DNA, 20 bp, Artificial Sequence
  chemically synthesized
gttctttatttctgatttgt

SEQ ID NO: 37586 - DNA, 20 bp, Artificial Sequence
  chemically synthesized
gtcgcatgactctcacaaat

SEQ ID NO: 37587 - DNA, 20 bp, Artificial Sequence
  chemically synthesized
tctttatttctgatttgtga

SEQ ID NO: 37588 - DNA, 20 bp, Artificial Sequence
  chemically synthesized
gatttgtgagagtcatgcga

SEQ ID NO: 37589 - DNA, 20 bp, Artificial Sequence
  chemically synthesized
ttgtgagagtcatgcgacag

SEQ ID NO: 37590 - DNA, 20 bp, Artificial Sequence
  chemically synthesized
tgagagtcatgcgacagcag

SEQ ID NO: 37591 - DNA, 20 bp, Artificial Sequence
  chemically synthesized
agtcatgcgacagcagtgga

SEQ ID NO: 37592 - DNA, 20 bp, Artificial Sequence
  chemically synthesized
gtcatgcgacagcagtggat

SEQ ID NO: 37593 - DNA, 20 bp, Artificial Sequence
  chemically synthesized
gcgacagcagtggatgggtt

SEQ ID NO: 37594 - DNA, 20 bp, Artificial Sequence
  chemically synthesized
acagcagtggatgggttaag

SEQ ID NO: 37595 - DNA, 20 bp, Artificial Sequence
  chemically synthesized
cagcagtggatgggttaaga

SEQ ID NO: 37596 - DNA, 20 bp, Artificial Sequence
  chemically synthesized
agtggatgggttaagaaggt

SEQ ID NO: 37597 - DNA, 20 bp, Artificial Sequence
  chemically synthesized
tggatgggttaagaaggtta

SEQ ID NO: 37598 - DNA, 20 bp, Artificial Sequence
  chemically synthesized
ggatgggttaagaaggttag

SEQ ID NO: 37599 - DNA, 20 bp, Artificial Sequence
  chemically synthesized
aaatttgttacattgctttt

SEQ ID NO: 37600 - DNA, 20 bp, Artificial Sequence
  chemically synthesized
actaaaaaacaacagctaaa

SEQ ID NO: 37601 - DNA, 20 bp, Artificial Sequence
  chemically synthesized
ttcaccaaactaaaaaacaa

SEQ ID NO: 37602 - DNA, 20 bp, Artificial Sequence
  chemically synthesized
gctttttagctgttgttttt

SEQ ID NO: 37603 - DNA, 20 bp, Artificial Sequence
  chemically synthesized
ttagctgttgttttttagtt

SEQ ID NO: 37604 - DNA, 20 bp, Artificial Sequence
  chemically synthesized
ttttagtttggtgaacaaac

SEQ ID NO: 37605 - DNA, 20 bp, Artificial Sequence
  chemically synthesized
ggtgaacaaacgagataaca

SEQ ID NO: 37606 - DNA, 20 bp, Artificial Sequence
  chemically synthesized
aacaaacgagataacatagc

SEQ ID NO: 37607 - DNA, 20 bp, Artificial Sequence
  chemically synthesized
gctttatgactaaaaggcac

SEQ ID NO: 37608 - DNA, 20 bp, Artificial Sequence
  chemically synthesized
ataacatagctagtgccttt

SEQ ID NO: 37609 - DNA, 20 bp, Artificial Sequence
  chemically synthesized
atttttgctttatgactaaa

SEQ ID NO: 37610 - DNA, 20 bp, Artificial Sequence
  chemically synthesized
tatttttgctttatgactaa

SEQ ID NO: 37611 - DNA, 20 bp, Artificial Sequence
  chemically synthesized
gctagtgccttttagtcata

SEQ ID NO: 37612 - DNA, 20 bp, Artificial Sequence
  chemically synthesized
ataaagcaaaaataaaacta

SEQ ID NO: 37613 - DNA, 20 bp, Artificial Sequence
  chemically synthesized
tacaatattagaaaacactg

SEQ ID NO: 37614 - DNA, 20 bp, Artificial Sequence
  chemically synthesized
ataggtttagggtacaatat

SEQ ID NO: 37615 - DNA, 20 bp, Artificial Sequence
  chemically synthesized
tggagatttgcataggttta

SEQ ID NO: 37616 - DNA, 20 bp, Artificial Sequence
  chemically synthesized
ttggagatttgcataggttt

SEQ ID NO: 37617 - DNA, 20 bp, Artificial Sequence
  chemically synthesized
attggagatttgcataggtt

SEQ ID NO: 37618 - DNA, 20 bp, Artificial Sequence
  chemically synthesized
tgtaaattggagatttgcat

SEQ ID NO: 37619 - DNA, 20 bp, Artificial Sequence
  chemically synthesized
atgtaaattggagatttgca

SEQ ID NO: 37620 - DNA, 20 bp, Artificial Sequence
  chemically synthesized
cttgtgggtgatgtaaattg

SEQ ID NO: 37621 - DNA, 20 bp, Artificial Sequence
  chemically synthesized
ggcttgtgggtgatgtaaat

SEQ ID NO: 37622 - DNA, 20 bp, Artificial Sequence
  chemically synthesized
ctccaatttacatcacccac

SEQ ID NO: 37623 - DNA, 20 bp, Artificial Sequence
  chemically synthesized
caaaaatatagaaggcttgt

SEQ ID NO: 37624 - DNA, 20 bp, Artificial Sequence
  chemically synthesized
gcaaaaatatagaaggcttg

SEQ ID NO: 37625 - DNA, 20 bp, Artificial Sequence
  chemically synthesized
aaaatctgcaaaaatataga

SEQ ID NO: 37626 - DNA, 20 bp, Artificial Sequence
  chemically synthesized
taaaatctgcaaaaatatag

SEQ ID NO: 37627 - DNA, 20 bp, Artificial Sequence
  chemically synthesized
agttaaaatctgcaaaaata

SEQ ID NO: 37628 - DNA, 20 bp, Artificial Sequence
  chemically synthesized
acaagccttctatatttttg

SEQ ID NO: 37629 - DNA, 20 bp, Artificial Sequence
  chemically synthesized
atatttttgcagattttaac

SEQ ID NO: 37630 - DNA, 20 bp, Artificial Sequence
  chemically synthesized
atttttgcagattttaacta

SEQ ID NO: 37631 - DNA, 20 bp, Artificial Sequence
  chemically synthesized
atatgcctattatttagctc

SEQ ID NO: 37632 - DNA, 20 bp, Artificial Sequence
  chemically synthesized
ttttaactagagctaaataa

SEQ ID NO: 37633 - DNA, 20 bp, Artificial Sequence
  chemically synthesized
tttaactagagctaaataat

SEQ ID NO: 37634 - DNA, 20 bp, Artificial Sequence
  chemically synthesized
ataaatatatgcctattatt

SEQ ID NO: 37635 - DNA, 20 bp, Artificial Sequence
  chemically synthesized
cattacatttgattacaatt

SEQ ID NO: 37636 - DNA, 20 bp, Artificial Sequence
  chemically synthesized
atgtaatgacgtgtgcaaaa

SEQ ID NO: 37637 - DNA, 20 bp, Artificial Sequence
  chemically synthesized
tgtaatgacgtgtgcaaaac

SEQ ID NO: 37638 - DNA, 20 bp, Artificial Sequence
  chemically synthesized
tgcaaaacaggctttgctca

SEQ ID NO: 37639 - DNA, 20 bp, Artificial Sequence
  chemically synthesized
tataaagagcactttgagca

SEQ ID NO: 37640 - DNA, 20 bp, Artificial Sequence
  chemically synthesized
tcatctataaagagcacttt

SEQ ID NO: 37641 - DNA, 20 bp, Artificial Sequence
  chemically synthesized
tttgctcaaagtgctcttta

SEQ ID NO: 37642 - DNA, 20 bp, Artificial Sequence
  chemically synthesized
aatcatatttcatctataaa

SEQ ID NO: 37643 - DNA, 20 bp, Artificial Sequence
  chemically synthesized
ataatcatatttcatctata

SEQ ID NO: 37644 - DNA, 20 bp, Artificial Sequence
  chemically synthesized
aatatgattattgaacttga

SEQ ID NO: 37645 - DNA, 20 bp, Artificial Sequence
  chemically synthesized
atgattattgaacttgacag

SEQ ID NO: 37646 - DNA, 20 bp, Artificial Sequence
  chemically synthesized
ccaatgaatgatctactgtc

SEQ ID NO: 37647 - DNA, 20 bp, Artificial Sequence
  chemically synthesized
cttgacagtagatcattcat

SEQ ID NO: 37648 - DNA, 20 bp, Artificial Sequence
  chemically synthesized
tgacagtagatcattcattg

SEQ ID NO: 37649 - DNA, 20 bp, Artificial Sequence
  chemically synthesized
gacagtagatcattcattgg

SEQ ID NO: 37650 - DNA, 20 bp, Artificial Sequence
  chemically synthesized
acagtagatcattcattgga

SEQ ID NO: 37651 - DNA, 20 bp, Artificial Sequence
  chemically synthesized
agatcattcattggagggaa

SEQ ID NO: 37652 - DNA, 20 bp, Artificial Sequence
  chemically synthesized
aggaaggtagaggcacagag

SEQ ID NO: 37653 - DNA, 20 bp, Artificial Sequence
  chemically synthesized
ggtaggaaggtagaggcaca

SEQ ID NO: 37654 - DNA, 20 bp, Artificial Sequence
  chemically synthesized
agggtaggaaggtagaggca

SEQ ID NO: 37655 - DNA, 20 bp, Artificial Sequence
  chemically synthesized
atcaaagggtaggaaggtag

SEQ ID NO: 37656 - DNA, 20 bp, Artificial Sequence
  chemically synthesized
catcaaagggtaggaaggta

SEQ ID NO: 37657 - DNA, 20 bp, Artificial Sequence
  chemically synthesized
gtcatcaaagggtaggaagg

SEQ ID NO: 37658 - DNA, 20 bp, Artificial Sequence
  chemically synthesized
ggtgtcatcaaagggtagga

SEQ ID NO: 37659 - DNA, 20 bp, Artificial Sequence
  chemically synthesized
cggtgtcatcaaagggtagg

SEQ ID NO: 37660 - DNA, 20 bp, Artificial Sequence
  chemically synthesized
aaccggtgtcatcaaagggt

SEQ ID NO: 37661 - DNA, 20 bp, Artificial Sequence
  chemically synthesized
taaccggtgtcatcaaaggg

SEQ ID NO: 37662 - DNA, 20 bp, Artificial Sequence
  chemically synthesized
atataaccggtgtcatcaaa

SEQ ID NO: 37663 - DNA, 20 bp, Artificial Sequence
  chemically synthesized
aatataaccggtgtcatcaa

SEQ ID NO: 37664 - DNA, 20 bp, Artificial Sequence
  chemically synthesized
aaatataaccggtgtcatca

SEQ ID NO: 37665 - DNA, 20 bp, Artificial Sequence
  chemically synthesized
ttcctaccctttgatgacac

SEQ ID NO: 37666 - DNA, 20 bp, Artificial Sequence
  chemically synthesized
tgagaatcttgaaatataac

SEQ ID NO: 37667 - DNA, 20 bp, Artificial Sequence
  chemically synthesized
gatgacaccggttatatttc

SEQ ID NO: 37668 - DNA, 20 bp, Artificial Sequence
  chemically synthesized
aagtgttcatttatagcatt

SEQ ID NO: 37669 - DNA, 20 bp, Artificial Sequence
  chemically synthesized
ttcagtaaagtgttcattta

SEQ ID NO: 37670 - DNA, 20 bp, Artificial Sequence
  chemically synthesized
tataaatgaacactttactg

SEQ ID NO: 37671 - DNA, 20 bp, Artificial Sequence
  chemically synthesized
ataaagatgcttcttcagta

SEQ ID NO: 37672 - DNA, 20 bp, Artificial Sequence
  chemically synthesized
aaatgaacactttactgaag

SEQ ID NO: 37673 - DNA, 20 bp, Artificial Sequence
  chemically synthesized
attggataaagatgcttctt

SEQ ID NO: 37674 - DNA, 20 bp, Artificial Sequence
  chemically synthesized
atttcattttgcattggata

SEQ ID NO: 37675 - DNA, 20 bp, Artificial Sequence
  chemically synthesized
caacacatttcattttgcat

SEQ ID NO: 37676 - DNA, 20 bp, Artificial Sequence
  chemically synthesized
caaaatgaaatgtgttgcct

SEQ ID NO: 37677 - DNA, 20 bp, Artificial Sequence
  chemically synthesized
taaatgactttattagtctt

SEQ ID NO: 37678 - DNA, 20 bp, Artificial Sequence
  chemically synthesized
gtaaatgactttattagtct

SEQ ID NO: 37679 - DNA, 20 bp, Artificial Sequence
  chemically synthesized
tgtgttgcctaagactaata

SEQ ID NO: 37680 - DNA, 20 bp, Artificial Sequence
  chemically synthesized
aaacttgtaaatgactttat

SEQ ID NO: 37681 - DNA, 20 bp, Artificial Sequence
  chemically synthesized
agactaataaagtcatttac

SEQ ID NO: 37682 - DNA, 20 bp, Artificial Sequence
  chemically synthesized
agtcatttacaagtttcaat

SEQ ID NO: 37683 - DNA, 20 bp, Artificial Sequence
  chemically synthesized
gtcatttacaagtttcaatg

SEQ ID NO: 37684 - DNA, 20 bp, Artificial Sequence
  chemically synthesized
catttacaagtttcaatgag

SEQ ID NO: 37685 - DNA, 20 bp, Artificial Sequence
  chemically synthesized
caatgaggagcaaatataaa

SEQ ID NO: 37686 - DNA, 20 bp, Artificial Sequence
  chemically synthesized
gatttactgctgttaaataa

SEQ ID NO: 37687 - DNA, 20 bp, Artificial Sequence
  chemically synthesized
aaaaaaaatccattatttaa

SEQ ID NO: 37688 - DNA, 20 bp, Artificial Sequence
  chemically synthesized
aaaaatccattatttaacag

SEQ ID NO: 37689 - DNA, 20 bp, Artificial Sequence
  chemically synthesized
ttatttaacagcagtaaatc

SEQ ID NO: 37690 - DNA, 20 bp, Artificial Sequence
  chemically synthesized
actgttttaccaaaacatac

SEQ ID NO: 37691 - DNA, 20 bp, Artificial Sequence
  chemically synthesized
gcagtaaatccagtatgttt

SEQ ID NO: 37692 - DNA, 20 bp, Artificial Sequence
  chemically synthesized
tccagtatgttttggtaaaa

SEQ ID NO: 37693 - DNA, 20 bp, Artificial Sequence
  chemically synthesized
tgttttggtaaaacagtttt

SEQ ID NO: 37694 - DNA, 20 bp, Artificial Sequence
  chemically synthesized
ttttggtaaaacagttttca

SEQ ID NO: 37695 - DNA, 20 bp, Artificial Sequence
  chemically synthesized
tggtaaaacagttttcagag

SEQ ID NO: 37696 - DNA, 20 bp, Artificial Sequence
  chemically synthesized
aggaaaagctaacgtaagta

SEQ ID NO: 37697 - DNA, 20 bp, Artificial Sequence
  chemically synthesized
cagagaagctctacttacgt

SEQ ID NO: 37698 - DNA, 20 bp, Artificial Sequence
  chemically synthesized
ttaggaaaagctaacgtaag

SEQ ID NO: 37699 - DNA, 20 bp, Artificial Sequence
  chemically synthesized
ggtttaggaaaagctaacgt

SEQ ID NO: 37700 - DNA, 20 bp, Artificial Sequence
  chemically synthesized
tttgcagcaaggtttaggaa

SEQ ID NO: 37701 - DNA, 20 bp, Artificial Sequence
  chemically synthesized
gacactttgcagcaaggttt

SEQ ID NO: 37702 - DNA, 20 bp, Artificial Sequence
  chemically synthesized
tgacactttgcagcaaggtt

SEQ ID NO: 37703 - DNA, 20 bp, Artificial Sequence
  chemically synthesized
ttttcctaaaccttgctgca

SEQ ID NO: 37704 - DNA, 20 bp, Artificial Sequence
  chemically synthesized
agaactgacactttgcagca

SEQ ID NO: 37705 - DNA, 20 bp, Artificial Sequence
  chemically synthesized
aagaactgacactttgcagc

SEQ ID NO: 37706 - DNA, 20 bp, Artificial Sequence
  chemically synthesized
tagaaagaactgacactttg

SEQ ID NO: 37707 - DNA, 20 bp, Artificial Sequence
  chemically synthesized
taaaccttgctgcaaagtgt

SEQ ID NO: 37708 - DNA, 20 bp, Artificial Sequence
  chemically synthesized
tcctttgattgtatattaga

SEQ ID NO: 37709 - DNA, 20 bp, Artificial Sequence
  chemically synthesized
aaattcctttgattgtatat

SEQ ID NO: 37710 - DNA, 20 bp, Artificial Sequence
  chemically synthesized
ttctttctaatatacaatca

SEQ ID NO: 37711 - DNA, 20 bp, Artificial Sequence
  chemically synthesized
tctttctaatatacaatcaa

SEQ ID NO: 37712 - DNA, 20 bp, Artificial Sequence
  chemically synthesized
caatcaaaggaattttgtgt

SEQ ID NO: 37713 - DNA, 20 bp, Artificial Sequence
  chemically synthesized
aatcaaaggaattttgtgtt

SEQ ID NO: 37714 - DNA, 20 bp, Artificial Sequence
  chemically synthesized
caaaggaattttgtgttggg

SEQ ID NO: 37715 - DNA, 20 bp, Artificial Sequence
  chemically synthesized
taaatgtcctttacaaagat

SEQ ID NO: 37716 - DNA, 20 bp, Artificial Sequence
  chemically synthesized
gaacatttctcatctttgta

SEQ ID NO: 37717 - DNA, 20 bp, Artificial Sequence
  chemically synthesized
aacatttctcatctttgtaa

SEQ ID NO: 37718 - DNA, 20 bp, Artificial Sequence
  chemically synthesized
tcctctaaatgtcctttaca

SEQ ID NO: 37719 - DNA, 20 bp, Artificial Sequence
  chemically synthesized
tcatctttgtaaaggacatt

SEQ ID NO: 37720 - DNA, 20 bp, Artificial Sequence
  chemically synthesized
atctttgtaaaggacattta

SEQ ID NO: 37721 - DNA, 20 bp, Artificial Sequence
  chemically synthesized
tctttgtaaaggacatttag

SEQ ID NO: 37722 - DNA, 20 bp, Artificial Sequence
  chemically synthesized
tttgtaaaggacatttagag

SEQ ID NO: 37723 - DNA, 20 bp, Artificial Sequence
  chemically synthesized
tgtaaaggacatttagagga

SEQ ID NO: 37724 - DNA, 20 bp, Artificial Sequence
  chemically synthesized
aaggacatttagaggagaga

SEQ ID NO: 37725 - DNA, 20 bp, Artificial Sequence
  chemically synthesized
aggacatttagaggagagat

SEQ ID NO: 37726 - DNA, 20 bp, Artificial Sequence
  chemically synthesized
ggacatttagaggagagata

SEQ ID NO: 37727 - DNA, 20 bp, Artificial Sequence
  chemically synthesized
aggagagatagggaaaaaca

SEQ ID NO: 37728 - DNA, 20 bp, Artificial Sequence
  chemically synthesized
gaaaaacaaagatcatgcat

SEQ ID NO: 37729 - DNA, 20 bp, Artificial Sequence
  chemically synthesized
aaaaacaaagatcatgcatg

SEQ ID NO: 37730 - DNA, 20 bp, Artificial Sequence
  chemically synthesized
catgcatgaggattatgtgt

SEQ ID NO: 37731 - DNA, 20 bp, Artificial Sequence
  chemically synthesized
atgcatgaggattatgtgtg

SEQ ID NO: 37732 - DNA, 20 bp, Artificial Sequence
  chemically synthesized
tgcatgaggattatgtgtga

SEQ ID NO: 37733 - DNA, 20 bp, Artificial Sequence
  chemically synthesized
gaggattatgtgtgagggta

SEQ ID NO: 37734 - DNA, 20 bp, Artificial Sequence
  chemically synthesized
gtgtgagggtatggattgac

SEQ ID NO: 37735 - DNA, 20 bp, Artificial Sequence
  chemically synthesized
ttaaaataatgattgaaatc

SEQ ID NO: 37736 - DNA, 20 bp, Artificial Sequence
  chemically synthesized
gatttcaatcattattttaa

SEQ ID NO: 37737 - DNA, 20 bp, Artificial Sequence
  chemically synthesized
atttcaatcattattttaaa

SEQ ID NO: 37738 - DNA, 20 bp, Artificial Sequence
  chemically synthesized
aagaacaccttattttagat

SEQ ID NO: 37739 - DNA, 20 bp, Artificial Sequence
  chemically synthesized
ttaaaaggcttatctaaaat

SEQ ID NO: 37740 - DNA, 20 bp, Artificial Sequence
  chemically synthesized
taaaaggcttatctaaaata

SEQ ID NO: 37741 - DNA, 20 bp, Artificial Sequence
  chemically synthesized
gttcaaagaacaccttattt

SEQ ID NO: 37742 - DNA, 20 bp, Artificial Sequence
  chemically synthesized
aataaggtgttctttgaacc

SEQ ID NO: 37743 - DNA, 20 bp, Artificial Sequence
  chemically synthesized
atcagactccacttggttca

SEQ ID NO: 37744 - DNA, 20 bp, Artificial Sequence
  chemically synthesized
aaggtgttctttgaaccaag

SEQ ID NO: 37745 - DNA, 20 bp, Artificial Sequence
  chemically synthesized
ggtgttctttgaaccaagtg

SEQ ID NO: 37746 - DNA, 20 bp, Artificial Sequence
  chemically synthesized
attggaaatcagactccact

SEQ ID NO: 37747 - DNA, 20 bp, Artificial Sequence
  chemically synthesized
aacattctaaaattggaaat

SEQ ID NO: 37748 - DNA, 20 bp, Artificial Sequence
  chemically synthesized
tggagtctgatttccaattt

SEQ ID NO: 37749 - DNA, 20 bp, Artificial Sequence
  chemically synthesized
atgtggaaacattctaaaat

SEQ ID NO: 37750 - DNA, 20 bp, Artificial Sequence
  chemically synthesized
atgaatgtcagtgttaaatg

SEQ ID NO: 37751 - DNA, 20 bp, Artificial Sequence
  chemically synthesized
attttcaggataatgaatgt

SEQ ID NO: 37752 - DNA, 20 bp, Artificial Sequence
  chemically synthesized
cattcattatcctgaaaatg

SEQ ID NO: 37753 - DNA, 20 bp, Artificial Sequence
  chemically synthesized
gtgtatctgccttcattttc

SEQ ID NO: 37754 - DNA, 20 bp, Artificial Sequence
  chemically synthesized
attcattatcctgaaaatga

SEQ ID NO: 37755 - DNA, 20 bp, Artificial Sequence
  chemically synthesized
tgtgtatctgccttcatttt

SEQ ID NO: 37756 - DNA, 20 bp, Artificial Sequence
  chemically synthesized
cattatcctgaaaatgaagg

SEQ ID NO: 37757 - DNA, 20 bp, Artificial Sequence
  chemically synthesized
aattttatttaaaatacata

SEQ ID NO: 37758 - DNA, 20 bp, Artificial Sequence
  chemically synthesized
atatgtattttaaataaaat

SEQ ID NO: 37759 - DNA, 20 bp, Artificial Sequence
  chemically synthesized
tagaaaaagttatgaaattt

SEQ ID NO: 37760 - DNA, 20 bp, Artificial Sequence
  chemically synthesized
gacacattgattcatagaaa

SEQ ID NO: 37761 - DNA, 20 bp, Artificial Sequence
  chemically synthesized
tgagttgacacattgattca

SEQ ID NO: 37762 - DNA, 20 bp, Artificial Sequence
  chemically synthesized
gtttgaaaagttgaaaaaat

SEQ ID NO: 37763 - DNA, 20 bp, Artificial Sequence
  chemically synthesized
ggaatttctttcagtttgaa

SEQ ID NO: 37764 - DNA, 20 bp, Artificial Sequence
  chemically synthesized
ttttcaacttttcaaactga

SEQ ID NO: 37765 - DNA, 20 bp, Artificial Sequence
  chemically synthesized
aagatcaatggaatttcttt

SEQ ID NO: 37766 - DNA, 20 bp, Artificial Sequence
  chemically synthesized
tcattattattaaagatcaa

SEQ ID NO: 37767 - DNA, 20 bp, Artificial Sequence
  chemically synthesized
gattaaattcattattatta

SEQ ID NO: 37768 - DNA, 20 bp, Artificial Sequence
  chemically synthesized
taatgaatttaatcaaatat

SEQ ID NO: 37769 - DNA, 20 bp, Artificial Sequence
  chemically synthesized
aatgaatttaatcaaatatt

SEQ ID NO: 37770 - DNA, 20 bp, Artificial Sequence
  chemically synthesized
aaatattaggcaaaattctt

SEQ ID NO: 37771 - DNA, 20 bp, Artificial Sequence
  chemically synthesized
taggcaaaattctttagtga

SEQ ID NO: 37772 - DNA, 20 bp, Artificial Sequence
  chemically synthesized
ttctctgagttctttcacta

SEQ ID NO: 37773 - DNA, 20 bp, Artificial Sequence
  chemically synthesized
aattctttagtgaaagaact

SEQ ID NO: 37774 - DNA, 20 bp, Artificial Sequence
  chemically synthesized
ttctttagtgaaagaactca

SEQ ID NO: 37775 - DNA, 20 bp, Artificial Sequence
  chemically synthesized
ggcacctaatcaaattctct

SEQ ID NO: 37776 - DNA, 20 bp, Artificial Sequence
  chemically synthesized
aagaactcagagaatttgat

SEQ ID NO: 37777 - DNA, 20 bp, Artificial Sequence
  chemically synthesized
agaactcagagaatttgatt

SEQ ID NO: 37778 - DNA, 20 bp, Artificial Sequence
  chemically synthesized
tatgttaaaaatgacatttt

SEQ ID NO: 37779 - DNA, 20 bp, Artificial Sequence
  chemically synthesized
ttatgttaaaaatgacattt

SEQ ID NO: 37780 - DNA, 20 bp, Artificial Sequence
  chemically synthesized
tttaacataaaaattaacaa

SEQ ID NO: 37781 - DNA, 20 bp, Artificial Sequence
  chemically synthesized
tgttaatttttaagataaaa

SEQ ID NO: 37782 - DNA, 20 bp, Artificial Sequence
  chemically synthesized
aacatagcatgttaattttt

SEQ ID NO: 37783 - DNA, 20 bp, Artificial Sequence
  chemically synthesized
gctttttttgtattataaca

SEQ ID NO: 37784 - DNA, 20 bp, Artificial Sequence
  chemically synthesized
gctatgttataatacaaaaa

SEQ ID NO: 37785 - DNA, 20 bp, Artificial Sequence
  chemically synthesized
caggattctggggtagggga

SEQ ID NO: 37786 - DNA, 20 bp, Artificial Sequence
  chemically synthesized
gcaggattctggggtagggg

SEQ ID NO: 37787 - DNA, 20 bp, Artificial Sequence
  chemically synthesized
tgcaggattctggggtaggg

SEQ ID NO: 37788 - DNA, 20 bp, Artificial Sequence
  chemically synthesized
aaaaaagccctcccctaccc

SEQ ID NO: 37789 - DNA, 20 bp, Artificial Sequence
  chemically synthesized
tatgcaggattctggggtag

SEQ ID NO: 37790 - DNA, 20 bp, Artificial Sequence
  chemically synthesized
ttatgcaggattctggggta

SEQ ID NO: 37791 - DNA, 20 bp, Artificial Sequence
  chemically synthesized
cttatgcaggattctggggt

SEQ ID NO: 37792 - DNA, 20 bp, Artificial Sequence
  chemically synthesized
tcttatgcaggattctgggg

SEQ ID NO: 37793 - DNA, 20 bp, Artificial Sequence
  chemically synthesized
cattcttatgcaggattctg

SEQ ID NO: 37794 - DNA, 20 bp, Artificial Sequence
  chemically synthesized
acattcttatgcaggattct

SEQ ID NO: 37795 - DNA, 20 bp, Artificial Sequence
  chemically synthesized
cacattcttatgcaggattc

SEQ ID NO: 37796 - DNA, 20 bp, Artificial Sequence
  chemically synthesized
cctaccccagaatcctgcat

SEQ ID NO: 37797 - DNA, 20 bp, Artificial Sequence
  chemically synthesized
aaccattcacattcttatgc

SEQ ID NO: 37798 - DNA, 20 bp, Artificial Sequence
  chemically synthesized
taaccattcacattcttatg

SEQ ID NO: 37799 - DNA, 20 bp, Artificial Sequence
  chemically synthesized
atcctgcataagaatgtgaa

SEQ ID NO: 37800 - DNA, 20 bp, Artificial Sequence
  chemically synthesized
aatggttatgtttgtttgcg

SEQ ID NO: 37801 - DNA, 20 bp, Artificial Sequence
  chemically synthesized
gttatgtttgtttgcgcaga

SEQ ID NO: 37802 - DNA, 20 bp, Artificial Sequence
  chemically synthesized
ttatgtttgtttgcgcagat

SEQ ID NO: 37803 - DNA, 20 bp, Artificial Sequence
  chemically synthesized
tatgtttgtttgcgcagatg

SEQ ID NO: 37804 - DNA, 20 bp, Artificial Sequence
  chemically synthesized
ttatgtgtttcttttccatc

SEQ ID NO: 37805 - DNA, 20 bp, Artificial Sequence
  chemically synthesized
tttaaatttgctagatggaa

SEQ ID NO: 37806 - DNA, 20 bp, Artificial Sequence
  chemically synthesized
ctagatttaaatttgctaga

SEQ ID NO: 37807 - DNA, 20 bp, Artificial Sequence
  chemically synthesized
tatcctagatttaaatttgc

SEQ ID NO: 37808 - DNA, 20 bp, Artificial Sequence
  chemically synthesized
ccatctagcaaatttaaatc

SEQ ID NO: 37809 - DNA, 20 bp, Artificial Sequence
  chemically synthesized
catctagcaaatttaaatct

SEQ ID NO: 37810 - DNA, 20 bp, Artificial Sequence
  chemically synthesized
taatgactacatttgtatcc

SEQ ID NO: 37811 - DNA, 20 bp, Artificial Sequence
  chemically synthesized
ttaaatctaggatacaaatg

SEQ ID NO: 37812 - DNA, 20 bp, Artificial Sequence
  chemically synthesized
agtcattatcgtgtctgaat

SEQ ID NO: 37813 - DNA, 20 bp, Artificial Sequence
  chemically synthesized
ttgggctttcttcaccaatt

SEQ ID NO: 37814 - DNA, 20 bp, Artificial Sequence
  chemically synthesized
ttatcgtgtctgaattggtg

SEQ ID NO: 37815 - DNA, 20 bp, Artificial Sequence
  chemically synthesized
cgtgtctgaattggtgaaga

SEQ ID NO: 37816 - DNA, 20 bp, Artificial Sequence
  chemically synthesized
ggtgaagaaagcccaaaata

SEQ ID NO: 37817 - DNA, 20 bp, Artificial Sequence
  chemically synthesized
agtagatttggccatatttt

SEQ ID NO: 37818 - DNA, 20 bp, Artificial Sequence
  chemically synthesized
aagtagatttggccatattt

SEQ ID NO: 37819 - DNA, 20 bp, Artificial Sequence
  chemically synthesized
aggtagggggcaagtagatt

SEQ ID NO: 37820 - DNA, 20 bp, Artificial Sequence
  chemically synthesized
aatttaaggtagggggcaag

SEQ ID NO: 37821 - DNA, 20 bp, Artificial Sequence
  chemically synthesized
cataatttaaggtagggggc

SEQ ID NO: 37822 - DNA, 20 bp, Artificial Sequence
  chemically synthesized
aactcataatttaaggtagg

SEQ ID NO: 37823 - DNA, 20 bp, Artificial Sequence
  chemically synthesized
aaactcataatttaaggtag

SEQ ID NO: 37824 - DNA, 20 bp, Artificial Sequence
  chemically synthesized
aaaactcataatttaaggta

SEQ ID NO: 37825 - DNA, 20 bp, Artificial Sequence
  chemically synthesized
aaaaactcataatttaaggt

SEQ ID NO: 37826 - DNA, 20 bp, Artificial Sequence
  chemically synthesized
taaaaactcataatttaagg

SEQ ID NO: 37827 - DNA, 20 bp, Artificial Sequence
  chemically synthesized
ttttaaaaactcataattta

SEQ ID NO: 37828 - DNA, 20 bp, Artificial Sequence
  chemically synthesized
tgccccctaccttaaattat

SEQ ID NO: 37829 - DNA, 20 bp, Artificial Sequence
  chemically synthesized
tttttaaaaactcataattt

SEQ ID NO: 37830 - DNA, 20 bp, Artificial Sequence
  chemically synthesized
agtttttaaaaatatatttt

SEQ ID NO: 37831 - DNA, 20 bp, Artificial Sequence
  chemically synthesized
gtttttaaaaatatattttc

SEQ ID NO: 37832 - DNA, 20 bp, Artificial Sequence
  chemically synthesized
ttaaaaatatattttcaggt

SEQ ID NO: 37833 - DNA, 20 bp, Artificial Sequence
  chemically synthesized
agagctaaactcagaaaaaa

SEQ ID NO: 37834 - DNA, 20 bp, Artificial Sequence
  chemically synthesized
agaatatttctcttttttct

SEQ ID NO: 37835 - DNA, 20 bp, Artificial Sequence
  chemically synthesized
agagagctaaactcagaaaa

SEQ ID NO: 37836 - DNA, 20 bp, Artificial Sequence
  chemically synthesized
atttctcttttttctgagtt

SEQ ID NO: 37837 - DNA, 20 bp, Artificial Sequence
  chemically synthesized
ttgcttcagagagctaaact

SEQ ID NO: 37838 - DNA, 20 bp, Artificial Sequence
  chemically synthesized
tttctgagtttagctctctg

SEQ ID NO: 37839 - DNA, 20 bp, Artificial Sequence
  chemically synthesized
ttgatagcacttgcttcaga

SEQ ID NO: 37840 - DNA, 20 bp, Artificial Sequence
  chemically synthesized
tgagtttagctctctgaagc

SEQ ID NO: 37841 - DNA, 20 bp, Artificial Sequence
  chemically synthesized
aattgatagcacttgcttca

SEQ ID NO: 37842 - DNA, 20 bp, Artificial Sequence
  chemically synthesized
tgaattgatagcacttgctt

SEQ ID NO: 37843 - DNA, 20 bp, Artificial Sequence
  chemically synthesized
ttaatattttcatgaattga

SEQ ID NO: 37844 - DNA, 20 bp, Artificial Sequence
  chemically synthesized
catgaaaatattaattataa

SEQ ID NO: 37845 - DNA, 20 bp, Artificial Sequence
  chemically synthesized
aaagttttatactgacgatt

SEQ ID NO: 37846 - DNA, 20 bp, Artificial Sequence
  chemically synthesized
agttatgaggaccaaatcgt

SEQ ID NO: 37847 - DNA, 20 bp, Artificial Sequence
  chemically synthesized
accaagcaggggcagttatg

SEQ ID NO: 37848 - DNA, 20 bp, Artificial Sequence
  chemically synthesized
gaccaagcaggggcagttat

SEQ ID NO: 37849 - DNA, 20 bp, Artificial Sequence
  chemically synthesized
aaatatagaccaagcagggg

SEQ ID NO: 37850 - DNA, 20 bp, Artificial Sequence
  chemically synthesized
tcctcataactgcccctgct

SEQ ID NO: 37851 - DNA, 20 bp, Artificial Sequence
  chemically synthesized
gtgaaatatagaccaagcag

SEQ ID NO: 37852 - DNA, 20 bp, Artificial Sequence
  chemically synthesized
ggtgaaatatagaccaagca

SEQ ID NO: 37853 - DNA, 20 bp, Artificial Sequence
  chemically synthesized
aggtgaaatatagaccaagc

SEQ ID NO: 37854 - DNA, 20 bp, Artificial Sequence
  chemically synthesized
aaggtgaaatatagaccaag

SEQ ID NO: 37855 - DNA, 20 bp, Artificial Sequence
  chemically synthesized
atgaaggtgaaatatagacc

SEQ ID NO: 37856 - DNA, 20 bp, Artificial Sequence
  chemically synthesized
atcatgatgaaggtgaaata

SEQ ID NO: 37857 - DNA, 20 bp, Artificial Sequence
  chemically synthesized
tagaaaataaatcatgatga

SEQ ID NO: 37858 - DNA, 20 bp, Artificial Sequence
  chemically synthesized
ttagaaaataaatcatgatg

SEQ ID NO: 37859 - DNA, 20 bp, Artificial Sequence
  chemically synthesized
catgatttattttctaatat

SEQ ID NO: 37860 - DNA, 20 bp, Artificial Sequence
  chemically synthesized
ccttaacattaatctcatat

SEQ ID NO: 37861 - DNA, 20 bp, Artificial Sequence
  chemically synthesized
tctaatatgagattaatgtt

SEQ ID NO: 37862 - DNA, 20 bp, Artificial Sequence
  chemically synthesized
ctaatatgagattaatgtta

SEQ ID NO: 37863 - DNA, 20 bp, Artificial Sequence
  chemically synthesized
gattctcaacataacgttta

SEQ ID NO: 37864 - DNA, 20 bp, Artificial Sequence
  chemically synthesized
aggaccataaacgttatgtt

SEQ ID NO: 37865 - DNA, 20 bp, Artificial Sequence
  chemically synthesized
aaaacatgtgtgctaaattt

SEQ ID NO: 37866 - DNA, 20 bp, Artificial Sequence
  chemically synthesized
aaacatgtgtgctaaatttt

SEQ ID NO: 37867 - DNA, 20 bp, Artificial Sequence
  chemically synthesized
cgtgagctgttcccaaaatt

SEQ ID NO: 37868 - DNA, 20 bp, Artificial Sequence
  chemically synthesized
tgtgtgctaaattttgggaa

SEQ ID NO: 37869 - DNA, 20 bp, Artificial Sequence
  chemically synthesized
ttgggaacagctcacgtata

SEQ ID NO: 37870 - DNA, 20 bp, Artificial Sequence
  chemically synthesized
tcttctttctctgtatacgt

SEQ ID NO: 37871 - DNA, 20 bp, Artificial Sequence
  chemically synthesized
gggaacagctcacgtataca

SEQ ID NO: 37872 - DNA, 20 bp, Artificial Sequence
  chemically synthesized
acagctcacgtatacagaga

SEQ ID NO: 37873 - DNA, 20 bp, Artificial Sequence
  chemically synthesized
gctcacgtatacagagaaag

SEQ ID NO: 37874 - DNA, 20 bp, Artificial Sequence
  chemically synthesized
cagagaaagaagaaaataaa

SEQ ID NO: 37875 - DNA, 20 bp, Artificial Sequence
  chemically synthesized
aagaagaaaataaaaagatc

SEQ ID NO: 37876 - DNA, 20 bp, Artificial Sequence
  chemically synthesized
aagaaaataaaaagatctag

SEQ ID NO: 37877 - DNA, 20 bp, Artificial Sequence
  chemically synthesized
ataaaaagatctagcagata

SEQ ID NO: 37878 - DNA, 20 bp, Artificial Sequence
  chemically synthesized
acagtattttctttatctgc

SEQ ID NO: 37879 - DNA, 20 bp, Artificial Sequence
  chemically synthesized
gataaagaaaatactgtttt

SEQ ID NO: 37880 - DNA, 20 bp, Artificial Sequence
  chemically synthesized
tttctaaatgggaccaaaaa

SEQ ID NO: 37881 - DNA, 20 bp, Artificial Sequence
  chemically synthesized
atactgtttttggtcccatt

SEQ ID NO: 37882 - DNA, 20 bp, Artificial Sequence
  chemically synthesized
cgttaataacatttctaaat

SEQ ID NO: 37883 - DNA, 20 bp, Artificial Sequence
  chemically synthesized
ccgttaataacatttctaaa

SEQ ID NO: 37884 - DNA, 20 bp, Artificial Sequence
  chemically synthesized
ccatttagaaatgttattaa

SEQ ID NO: 37885 - DNA, 20 bp, Artificial Sequence
  chemically synthesized
tgttggaaaggaaggtgtta

SEQ ID NO: 37886 - DNA, 20 bp, Artificial Sequence
  chemically synthesized
tgccattgtgttggaaagga

SEQ ID NO: 37887 - DNA, 20 bp, Artificial Sequence
  chemically synthesized
ttgccattgtgttggaaagg

SEQ ID NO: 37888 - DNA, 20 bp, Artificial Sequence
  chemically synthesized
ggcttgccattgtgttggaa

SEQ ID NO: 37889 - DNA, 20 bp, Artificial Sequence
  chemically synthesized
tggcttgccattgtgttgga

SEQ ID NO: 37890 - DNA, 20 bp, Artificial Sequence
  chemically synthesized
caccttcctttccaacacaa

SEQ ID NO: 37891 - DNA, 20 bp, Artificial Sequence
  chemically synthesized
cccatggcttgccattgtgt

SEQ ID NO: 37892 - DNA, 20 bp, Artificial Sequence
  chemically synthesized
ttcctttccaacacaatggc

SEQ ID NO: 37893 - DNA, 20 bp, Artificial Sequence
  chemically synthesized
tccaacacaatggcaagcca

SEQ ID NO: 37894 - DNA, 20 bp, Artificial Sequence
  chemically synthesized
ccaacacaatggcaagccat

SEQ ID NO: 37895 - DNA, 20 bp, Artificial Sequence
  chemically synthesized
tcttgagcttgttcatccca

SEQ ID NO: 37896 - DNA, 20 bp, Artificial Sequence
  chemically synthesized
tggcaagccatgggatgaac

SEQ ID NO: 37897 - DNA, 20 bp, Artificial Sequence
  chemically synthesized
gccatgggatgaacaagctc

SEQ ID NO: 37898 - DNA, 20 bp, Artificial Sequence
  chemically synthesized
tatgctaccacacatgtctt

SEQ ID NO: 37899 - DNA, 20 bp, Artificial Sequence
  chemically synthesized
gaacaagctcaagacatgtg

SEQ ID NO: 37900 - DNA, 20 bp, Artificial Sequence
  chemically synthesized
caagctcaagacatgtgtgg

SEQ ID NO: 37901 - DNA, 20 bp, Artificial Sequence
  chemically synthesized
tgtgtggtagcataccaatt

SEQ ID NO: 37902 - DNA, 20 bp, Artificial Sequence
  chemically synthesized
gagtcaactgtttgcttaat

SEQ ID NO: 37903 - DNA, 20 bp, Artificial Sequence
  chemically synthesized
tagcataccaattaagcaaa

SEQ ID NO: 37904 - DNA, 20 bp, Artificial Sequence
  chemically synthesized
ttaagcaaacagttgactca

SEQ ID NO: 37905 - DNA, 20 bp, Artificial Sequence
  chemically synthesized
attgctagtaatgcatccat

SEQ ID NO: 37906 - DNA, 20 bp, Artificial Sequence
  chemically synthesized
ttgactcatggatgcattac

SEQ ID NO: 37907 - DNA, 20 bp, Artificial Sequence
  chemically synthesized
ggttggagcagaagtattgc

SEQ ID NO: 37908 - DNA, 20 bp, Artificial Sequence
  chemically synthesized
ctgtatctgggttggagcag

SEQ ID NO: 37909 - DNA, 20 bp, Artificial Sequence
  chemically synthesized
catctgtatctgggttggag

SEQ ID NO: 37910 - DNA, 20 bp, Artificial Sequence
  chemically synthesized
gcaatacttctgctccaacc

SEQ ID NO: 37911 - DNA, 20 bp, Artificial Sequence
  chemically synthesized
gagcatctgtatctgggttg

SEQ ID NO: 37912 - DNA, 20 bp, Artificial Sequence
  chemically synthesized
aagagcatctgtatctgggt

SEQ ID NO: 37913 - DNA, 20 bp, Artificial Sequence
  chemically synthesized
cttctgctccaacccagata

SEQ ID NO: 37914 - DNA, 20 bp, Artificial Sequence
  chemically synthesized
gttgaagagcatctgtatct

SEQ ID NO: 37915 - DNA, 20 bp, Artificial Sequence
  chemically synthesized
agttgaagagcatctgtatc

SEQ ID NO: 37916 - DNA, 20 bp, Artificial Sequence
  chemically synthesized
taacctcattgtaagttgaa

SEQ ID NO: 37917 - DNA, 20 bp, Artificial Sequence
  chemically synthesized
cataacctcattgtaagttg

SEQ ID NO: 37918 - DNA, 20 bp, Artificial Sequence
  chemically synthesized
gatgctcttcaacttacaat

SEQ ID NO: 37919 - DNA, 20 bp, Artificial Sequence
  chemically synthesized
atgctcttcaacttacaatg

SEQ ID NO: 37920 - DNA, 20 bp, Artificial Sequence
  chemically synthesized
ttggtacataacctcattgt

SEQ ID NO: 37921 - DNA, 20 bp, Artificial Sequence
  chemically synthesized
tcaacttatgatgagtttat

SEQ ID NO: 37922 - DNA, 20 bp, Artificial Sequence
  chemically synthesized
tgtaccaataaactcatcat

SEQ ID NO: 37923 - DNA, 20 bp, Artificial Sequence
  chemically synthesized
gaatattttcaacttatgat

SEQ ID NO: 37924 - DNA, 20 bp, Artificial Sequence
  chemically synthesized
tcataagttgaaaatattct

SEQ ID NO: 37925 - DNA, 20 bp, Artificial Sequence
  chemically synthesized
tgttaaatgcatttttgact

SEQ ID NO: 37926 - DNA, 20 bp, Artificial Sequence
  chemically synthesized
gctatgatgttgagtagatt

SEQ ID NO: 37927 - DNA, 20 bp, Artificial Sequence
  chemically synthesized
agctatgatgttgagtagat

SEQ ID NO: 37928 - DNA, 20 bp, Artificial Sequence
  chemically synthesized
ggctgagctatgatgttgag

SEQ ID NO: 37929 - DNA, 20 bp, Artificial Sequence
  chemically synthesized
acctaatctactcaacatca

SEQ ID NO: 37930 - DNA, 20 bp, Artificial Sequence
  chemically synthesized
ctaggctgagctatgatgtt

SEQ ID NO: 37931 - DNA, 20 bp, Artificial Sequence
  chemically synthesized
atctactcaacatcatagct

SEQ ID NO: 37932 - DNA, 20 bp, Artificial Sequence
  chemically synthesized
ctcaacatcatagctcagcc

SEQ ID NO: 37933 - DNA, 20 bp, Artificial Sequence
  chemically synthesized
agtttaaggtaggctaggct

SEQ ID NO: 37934 - DNA, 20 bp, Artificial Sequence
  chemically synthesized
gagtaagtttaaggtaggct

SEQ ID NO: 37935 - DNA, 20 bp, Artificial Sequence
  chemically synthesized
tgagtaagtttaaggtaggc

SEQ ID NO: 37936 - DNA, 20 bp, Artificial Sequence
  chemically synthesized
gttctgagtaagtttaaggt

SEQ ID NO: 37937 - DNA, 20 bp, Artificial Sequence
  chemically synthesized
tgttctgagtaagtttaagg

SEQ ID NO: 37938 - DNA, 20 bp, Artificial Sequence
  chemically synthesized
aagtgttctgagtaagttta

SEQ ID NO: 37939 - DNA, 20 bp, Artificial Sequence
  chemically synthesized
taagtgttctgagtaagttt

SEQ ID NO: 37940 - DNA, 20 bp, Artificial Sequence
  chemically synthesized
tagcctaccttaaacttact

SEQ ID NO: 37941 - DNA, 20 bp, Artificial Sequence
  chemically synthesized
ctaacgtaagtgttctgagt

SEQ ID NO: 37942 - DNA, 20 bp, Artificial Sequence
  chemically synthesized
taggctaacgtaagtgttct

SEQ ID NO: 37943 - DNA, 20 bp, Artificial Sequence
  chemically synthesized
cttactcagaacacttacgt

SEQ ID NO: 37944 - DNA, 20 bp, Artificial Sequence
  chemically synthesized
gcccaactgtaggctaacgt

SEQ ID NO: 37945 - DNA, 20 bp, Artificial Sequence
  chemically synthesized
agaacacttacgttagccta

SEQ ID NO: 37946 - DNA, 20 bp, Artificial Sequence
  chemically synthesized
cacttacgttagcctacagt

SEQ ID NO: 37947 - DNA, 20 bp, Artificial Sequence
  chemically synthesized
acttacgttagcctacagtt

SEQ ID NO: 37948 - DNA, 20 bp, Artificial Sequence
  chemically synthesized
agatgattttgcccaactgt

SEQ ID NO: 37949 - DNA, 20 bp, Artificial Sequence
  chemically synthesized
tagatgattttgcccaactg

SEQ ID NO: 37950 - DNA, 20 bp, Artificial Sequence
  chemically synthesized
gggcaaaatcatctaacaca

SEQ ID NO: 37951 - DNA, 20 bp, Artificial Sequence
  chemically synthesized
gtataaaataggctttgtgt

SEQ ID NO: 37952 - DNA, 20 bp, Artificial Sequence
  chemically synthesized
tcaatgctttagtataaaat

SEQ ID NO: 37953 - DNA, 20 bp, Artificial Sequence
  chemically synthesized
ttcaatgctttagtataaaa

SEQ ID NO: 37954 - DNA, 20 bp, Artificial Sequence
  chemically synthesized
acaaagcctattttatacta

SEQ ID NO: 37955 - DNA, 20 bp, Artificial Sequence
  chemically synthesized
acatgagctattcaatgctt

SEQ ID NO: 37956 - DNA, 20 bp, Artificial Sequence
  chemically synthesized
ttttatactaaagcattgaa

SEQ ID NO: 37957 - DNA, 20 bp, Artificial Sequence
  chemically synthesized
cagtattcaataaattacat

SEQ ID NO: 37958 - DNA, 20 bp, Artificial Sequence
  chemically synthesized
tttattgaatactgtactga

SEQ ID NO: 37959 - DNA, 20 bp, Artificial Sequence
  chemically synthesized
tctgtttttcactttcagta

SEQ ID NO: 37960 - DNA, 20 bp, Artificial Sequence
  chemically synthesized
acccctctgtttttcacttt

SEQ ID NO: 37961 - DNA, 20 bp, Artificial Sequence
  chemically synthesized
actgtactgaaagtgaaaaa

SEQ ID NO: 37962 - DNA, 20 bp, Artificial Sequence
  chemically synthesized
tgtactgaaagtgaaaaaca

SEQ ID NO: 37963 - DNA, 20 bp, Artificial Sequence
  chemically synthesized
gtactgaaagtgaaaaacag

SEQ ID NO: 37964 - DNA, 20 bp, Artificial Sequence
  chemically synthesized
tactgaaagtgaaaaacaga

SEQ ID NO: 37965 - DNA, 20 bp, Artificial Sequence
  chemically synthesized
actgaaagtgaaaaacagag

SEQ ID NO: 37966 - DNA, 20 bp, Artificial Sequence
  chemically synthesized
tgaaaaacagaggggttgtg

SEQ ID NO: 37967 - DNA, 20 bp, Artificial Sequence
  chemically synthesized
aggggttgtgtggatacctg

SEQ ID NO: 37968 - DNA, 20 bp, Artificial Sequence
  chemically synthesized
ttgtgtggatacctgaagta

SEQ ID NO: 37969 - DNA, 20 bp, Artificial Sequence
  chemically synthesized
ttcagtagaaaccatacttc

SEQ ID NO: 37970 - DNA, 20 bp, Artificial Sequence
  chemically synthesized
attcagtagaaaccatactt

SEQ ID NO: 37971 - DNA, 20 bp, Artificial Sequence
  chemically synthesized
caaaagtgatacacattcag

SEQ ID NO: 37972 - DNA, 20 bp, Artificial Sequence
  chemically synthesized
ctgcaaaagtgatacacatt

SEQ ID NO: 37973 - DNA, 20 bp, Artificial Sequence
  chemically synthesized
ctgaatgtgtatcacttttg

SEQ ID NO: 37974 - DNA, 20 bp, Artificial Sequence
  chemically synthesized
tttacttgataatgctgcaa

SEQ ID NO: 37975 - DNA, 20 bp, Artificial Sequence
  chemically synthesized
atcacttttgcagcattatc

SEQ ID NO: 37976 - DNA, 20 bp, Artificial Sequence
  chemically synthesized
gacttacaatggttggattt

SEQ ID NO: 37977 - DNA, 20 bp, Artificial Sequence
  chemically synthesized
tgacttacaatggttggatt

SEQ ID NO: 37978 - DNA, 20 bp, Artificial Sequence
  chemically synthesized
gatccctgacttacaatggt

SEQ ID NO: 37979 - DNA, 20 bp, Artificial Sequence
  chemically synthesized
atcctaaatccaaccattgt

SEQ ID NO: 37980 - DNA, 20 bp, Artificial Sequence
  chemically synthesized
agatgatccctgacttacaa

SEQ ID NO: 37981 - DNA, 20 bp, Artificial Sequence
  chemically synthesized
taaatccaaccattgtaagt

SEQ ID NO: 37982 - DNA, 20 bp, Artificial Sequence
  chemically synthesized
aaatccaaccattgtaagtc

SEQ ID NO: 37983 - DNA, 20 bp, Artificial Sequence
  chemically synthesized
aatccaaccattgtaagtca

SEQ ID NO: 37984 - DNA, 20 bp, Artificial Sequence
  chemically synthesized
tggggcctgtcaatcaaaca

SEQ ID NO: 37985 - DNA, 20 bp, Artificial Sequence
  chemically synthesized
gatcatctatgtttgattga

SEQ ID NO: 37986 - DNA, 20 bp, Artificial Sequence
  chemically synthesized
atcatctatgtttgattgac

SEQ ID NO: 37987 - DNA, 20 bp, Artificial Sequence
  chemically synthesized
tatgtttgattgacaggccc

SEQ ID NO: 37988 - DNA, 20 bp, Artificial Sequence
  chemically synthesized
tttgattgacaggccccagc

SEQ ID NO: 37989 - DNA, 20 bp, Artificial Sequence
  chemically synthesized
tcatttgcggatgcttgctg

SEQ ID NO: 37990 - DNA, 20 bp, Artificial Sequence
  chemically synthesized
ctcatttgcggatgcttgct

SEQ ID NO: 37991 - DNA, 20 bp, Artificial Sequence
  chemically synthesized
cctcatttgcggatgcttgc

SEQ ID NO: 37992 - DNA, 20 bp, Artificial Sequence
  chemically synthesized
cccagcaagcatccgcaaat

SEQ ID NO: 37993 - DNA, 20 bp, Artificial Sequence
  chemically synthesized
ccagcaagcatccgcaaatg

SEQ ID NO: 37994 - DNA, 20 bp, Artificial Sequence
  chemically synthesized
ctctattctttcctcatttg

SEQ ID NO: 37995 - DNA, 20 bp, Artificial Sequence
  chemically synthesized
caagcatccgcaaatgagga

SEQ ID NO: 37996 - DNA, 20 bp, Artificial Sequence
  chemically synthesized
atccgcaaatgaggaaagaa

SEQ ID NO: 37997 - DNA, 20 bp, Artificial Sequence
  chemically synthesized
ccgcaaatgaggaaagaata

SEQ ID NO: 37998 - DNA, 20 bp, Artificial Sequence
  chemically synthesized
gcaaatgaggaaagaataga

SEQ ID NO: 37999 - DNA, 20 bp, Artificial Sequence
  chemically synthesized
aaatgaggaaagaatagaga

SEQ ID NO: 38000 - DNA, 20 bp, Artificial Sequence
  chemically synthesized
aatgaggaaagaatagagag

SEQ ID NO: 38001 - DNA, 20 bp, Artificial Sequence
  chemically synthesized
tgaggaaagaatagagagag

SEQ ID NO: 38002 - DNA, 20 bp, Artificial Sequence
  chemically synthesized
gaaagaatagagagaggaga

SEQ ID NO: 38003 - DNA, 20 bp, Artificial Sequence
  chemically synthesized
gaatagagagaggagaaaga

SEQ ID NO: 38004 - DNA, 20 bp, Artificial Sequence
  chemically synthesized
agagaggagaaagaaagtac

SEQ ID NO: 38005 - DNA, 20 bp, Artificial Sequence
  chemically synthesized
gagaaagaaagtactagatg

SEQ ID NO: 38006 - DNA, 20 bp, Artificial Sequence
  chemically synthesized
aaggattctttgtcttcatc

SEQ ID NO: 38007 - DNA, 20 bp, Artificial Sequence
  chemically synthesized
gaaagtactagatgaagaca

SEQ ID NO: 38008 - DNA, 20 bp, Artificial Sequence
  chemically synthesized
agatgaagacaaagaatcct

SEQ ID NO: 38009 - DNA, 20 bp, Artificial Sequence
  chemically synthesized
agacaaagaatccttggtga

SEQ ID NO: 38010 - DNA, 20 bp, Artificial Sequence
  chemically synthesized
gacaaagaatccttggtgat

SEQ ID NO: 38011 - DNA, 20 bp, Artificial Sequence
  chemically synthesized
gtctgaagatcctatcacca

SEQ ID NO: 38012 - DNA, 20 bp, Artificial Sequence
  chemically synthesized
tgtctgaagatcctatcacc

SEQ ID NO: 38013 - DNA, 20 bp, Artificial Sequence
  chemically synthesized
atccttggtgataggatctt

SEQ ID NO: 38014 - DNA, 20 bp, Artificial Sequence
  chemically synthesized
ttggtgataggatcttcaga

SEQ ID NO: 38015 - DNA, 20 bp, Artificial Sequence
  chemically synthesized
ggtgataggatcttcagaca

SEQ ID NO: 38016 - DNA, 20 bp, Artificial Sequence
  chemically synthesized
ccctagagcctctctgtctg

SEQ ID NO: 38017 - DNA, 20 bp, Artificial Sequence
  chemically synthesized
tgataggatcttcagacaga

SEQ ID NO: 38018 - DNA, 20 bp, Artificial Sequence
  chemically synthesized
gataggatcttcagacagag

SEQ ID NO: 38019 - DNA, 20 bp, Artificial Sequence
  chemically synthesized
atcttcagacagagaggctc

SEQ ID NO: 38020 - DNA, 20 bp, Artificial Sequence
  chemically synthesized
tcttcagacagagaggctct

SEQ ID NO: 38021 - DNA, 20 bp, Artificial Sequence
  chemically synthesized
cttcagacagagaggctcta

SEQ ID NO: 38022 - DNA, 20 bp, Artificial Sequence
  chemically synthesized
ttccaggtttcaagtcccta

SEQ ID NO: 38023 - DNA, 20 bp, Artificial Sequence
  chemically synthesized
acttccaggtttcaagtccc

SEQ ID NO: 38024 - DNA, 20 bp, Artificial Sequence
  chemically synthesized
ggctctagggacttgaaacc

SEQ ID NO: 38025 - DNA, 20 bp, Artificial Sequence
  chemically synthesized
atgctgaacttccaggtttc

SEQ ID NO: 38026 - DNA, 20 bp, Artificial Sequence
  chemically synthesized
tctagggacttgaaacctgg

SEQ ID NO: 38027 - DNA, 20 bp, Artificial Sequence
  chemically synthesized
ggacttgaaacctggaagtt

SEQ ID NO: 38028 - DNA, 20 bp, Artificial Sequence
  chemically synthesized
aatgcctatgctgaacttcc

SEQ ID NO: 38029 - DNA, 20 bp, Artificial Sequence
  chemically synthesized
aaatgcctatgctgaacttc

SEQ ID NO: 38030 - DNA, 20 bp, Artificial Sequence
  chemically synthesized
tgaaacctggaagttcagca

SEQ ID NO: 38031 - DNA, 20 bp, Artificial Sequence
  chemically synthesized
gaaacctggaagttcagcat

SEQ ID NO: 38032 - DNA, 20 bp, Artificial Sequence
  chemically synthesized
ggaagttcagcataggcatt

SEQ ID NO: 38033 - DNA, 20 bp, Artificial Sequence
  chemically synthesized
ataggcatttagtatatgtt

SEQ ID NO: 38034 - DNA, 20 bp, Artificial Sequence
  chemically synthesized
atttagtatatgttgagcct

SEQ ID NO: 38035 - DNA, 20 bp, Artificial Sequence
  chemically synthesized
tttagtatatgttgagcctt

SEQ ID NO: 38036 - DNA, 20 bp, Artificial Sequence
  chemically synthesized
ttagtatatgttgagcctta

SEQ ID NO: 38037 - DNA, 20 bp, Artificial Sequence
  chemically synthesized
attgataaatgagttcccta

SEQ ID NO: 38038 - DNA, 20 bp, Artificial Sequence
  chemically synthesized
aattgataaatgagttccct

SEQ ID NO: 38039 - DNA, 20 bp, Artificial Sequence
  chemically synthesized
gtgatatcaaattgataaat

SEQ ID NO: 38040 - DNA, 20 bp, Artificial Sequence
  chemically synthesized
accatggcagtgatacaaag

SEQ ID NO: 38041 - DNA, 20 bp, Artificial Sequence
  chemically synthesized
tcaccatggcagtgatacaa

SEQ ID NO: 38042 - DNA, 20 bp, Artificial Sequence
  chemically synthesized
ttcaccatggcagtgataca

SEQ ID NO: 38043 - DNA, 20 bp, Artificial Sequence
  chemically synthesized
actcctttgtatcactgcca

SEQ ID NO: 38044 - DNA, 20 bp, Artificial Sequence
  chemically synthesized
tttctgatcattcaccatgg

SEQ ID NO: 38045 - DNA, 20 bp, Artificial Sequence
  chemically synthesized
tcctttctgatcattcacca

SEQ ID NO: 38046 - DNA, 20 bp, Artificial Sequence
  chemically synthesized
tcactgccatggtgaatgat

SEQ ID NO: 38047 - DNA, 20 bp, Artificial Sequence
  chemically synthesized
tgccatggtgaatgatcaga

SEQ ID NO: 38048 - DNA, 20 bp, Artificial Sequence
  chemically synthesized
gccatggtgaatgatcagaa

SEQ ID NO: 38049 - DNA, 20 bp, Artificial Sequence
  chemically synthesized
gaaacacaaactccttcttt

SEQ ID NO: 38050 - DNA, 20 bp, Artificial Sequence
  chemically synthesized
tattgcagttcttaaagaag

SEQ ID NO: 38051 - DNA, 20 bp, Artificial Sequence
  chemically synthesized
gttattgcagttcttaaaga

SEQ ID NO: 38052 - DNA, 20 bp, Artificial Sequence
  chemically synthesized
cgttattgcagttcttaaag

SEQ ID NO: 38053 - DNA, 20 bp, Artificial Sequence
  chemically synthesized
gttcgttattgcagttctta

SEQ ID NO: 38054 - DNA, 20 bp, Artificial Sequence
  chemically synthesized
gaagaaacagttcgttattg

SEQ ID NO: 38055 - DNA, 20 bp, Artificial Sequence
  chemically synthesized
agaagaagaagaagaagaaa

SEQ ID NO: 38056 - DNA, 20 bp, Artificial Sequence
  chemically synthesized
agaagaagaagaagaagaag

SEQ ID NO: 38057 - DNA, 20 bp, Artificial Sequence
  chemically synthesized
agaagaagaagaagaagaag

SEQ ID NO: 38058 - DNA, 20 bp, Artificial Sequence
  chemically synthesized
agaagaagaagaagaagaag

SEQ ID NO: 38059 - DNA, 20 bp, Artificial Sequence
  chemically synthesized
agaagaagaagaagaagaag

SEQ ID NO: 38060 - DNA, 20 bp, Artificial Sequence
  chemically synthesized
agaagaagaagaagaagaag

SEQ ID NO: 38061 - DNA, 20 bp, Artificial Sequence
  chemically synthesized
agaagaagaagaagaagaag

SEQ ID NO: 38062 - DNA, 20 bp, Artificial Sequence
  chemically synthesized
agaagaagaagaagaagaag

SEQ ID NO: 38063 - DNA, 20 bp, Artificial Sequence
  chemically synthesized
agaagaagaagaagaagaag

SEQ ID NO: 38064 - DNA, 20 bp, Artificial Sequence
  chemically synthesized
agaagaagaagaagaagaag

SEQ ID NO: 38065 - DNA, 20 bp, Artificial Sequence
  chemically synthesized
aaaagaagaagaagaagaag

SEQ ID NO: 38066 - DNA, 20 bp, Artificial Sequence
  chemically synthesized
aaaaaaagaagaagaagaag

SEQ ID NO: 38067 - DNA, 20 bp, Artificial Sequence
  chemically synthesized
ccaaaaaaaagaagaagaag

SEQ ID NO: 38068 - DNA, 20 bp, Artificial Sequence
  chemically synthesized
ctgccaaaaaaaagaagaag

SEQ ID NO: 38069 - DNA, 20 bp, Artificial Sequence
  chemically synthesized
cctctgccaaaaaaaagaag

SEQ ID NO: 38070 - DNA, 20 bp, Artificial Sequence
  chemically synthesized
ccacctctgccaaaaaaaag

SEQ ID NO: 38071 - DNA, 20 bp, Artificial Sequence
  chemically synthesized
cttcttcttcttcttttttt

SEQ ID NO: 38072 - DNA, 20 bp, Artificial Sequence
  chemically synthesized
accccacctctgccaaaaaa

SEQ ID NO: 38073 - DNA, 20 bp, Artificial Sequence
  chemically synthesized
cttcttcttcttttttttgg

SEQ ID NO: 38074 - DNA, 20 bp, Artificial Sequence
  chemically synthesized
tcttcttcttttttttggca

SEQ ID NO: 38075 - DNA, 20 bp, Artificial Sequence
  chemically synthesized
cttcttcttttttttggcag

SEQ ID NO: 38076 - DNA, 20 bp, Artificial Sequence
  chemically synthesized
cttcttttttttggcagagg

SEQ ID NO: 38077 - DNA, 20 bp, Artificial Sequence
  chemically synthesized
ttcttttttttggcagaggt

SEQ ID NO: 38078 - DNA, 20 bp, Artificial Sequence
  chemically synthesized
tcttttttttggcagaggtg

SEQ ID NO: 38079 - DNA, 20 bp, Artificial Sequence
  chemically synthesized
acctgcctagtcaaggtagc

SEQ ID NO: 38080 - DNA, 20 bp, Artificial Sequence
  chemically synthesized
gggtgtctcgctaccttgac

SEQ ID NO: 38081 - DNA, 20 bp, Artificial Sequence
  chemically synthesized
caagacctgcctagtcaagg

SEQ ID NO: 38082 - DNA, 20 bp, Artificial Sequence
  chemically synthesized
ggtgtctcgctaccttgact

SEQ ID NO: 38083 - DNA, 20 bp, Artificial Sequence
  chemically synthesized
gttcaagacctgcctagtca

SEQ ID NO: 38084 - DNA, 20 bp, Artificial Sequence
  chemically synthesized
gtctcgctaccttgactagg

SEQ ID NO: 38085 - DNA, 20 bp, Artificial Sequence
  chemically synthesized
agttcaagacctgcctagtc

SEQ ID NO: 38086 - DNA, 20 bp, Artificial Sequence
  chemically synthesized
tctcgctaccttgactaggc

SEQ ID NO: 38087 - DNA, 20 bp, Artificial Sequence
  chemically synthesized
ccagcagttcaagacctgcc

SEQ ID NO: 38088 - DNA, 20 bp, Artificial Sequence
  chemically synthesized
ctaggcaggtcttgaactgc

SEQ ID NO: 38089 - DNA, 20 bp, Artificial Sequence
  chemically synthesized
ttgcttgaggccagcagttc

SEQ ID NO: 38090 - DNA, 20 bp, Artificial Sequence
  chemically synthesized
ggagcattgcttgaggccag

SEQ ID NO: 38091 - DNA, 20 bp, Artificial Sequence
  chemically synthesized
ggtcttgaactgctggcctc

SEQ ID NO: 38092 - DNA, 20 bp, Artificial Sequence
  chemically synthesized
gtgggagcattgcttgaggc

SEQ ID NO: 38093 - DNA, 20 bp, Artificial Sequence
  chemically synthesized
tgaggtgggagcattgcttg

SEQ ID NO: 38094 - DNA, 20 bp, Artificial Sequence
  chemically synthesized
ctgaggtgggagcattgctt

SEQ ID NO: 38095 - DNA, 20 bp, Artificial Sequence
  chemically synthesized
ctcaagcaatgctcccacct

SEQ ID NO: 38096 - DNA, 20 bp, Artificial Sequence
  chemically synthesized
actttgggaggctgaggtgg

SEQ ID NO: 38097 - DNA, 20 bp, Artificial Sequence
  chemically synthesized
acactttgggaggctgaggt

SEQ ID NO: 38098 - DNA, 20 bp, Artificial Sequence
  chemically synthesized
aacactttgggaggctgagg

SEQ ID NO: 38099 - DNA, 20 bp, Artificial Sequence
  chemically synthesized
ccgaacactttgggaggctg

SEQ ID NO: 38100 - DNA, 20 bp, Artificial Sequence
  chemically synthesized
tccgaacactttgggaggct

SEQ ID NO: 38101 - DNA, 20 bp, Artificial Sequence
  chemically synthesized
gctcccacctcagcctccca

SEQ ID NO: 38102 - DNA, 20 bp, Artificial Sequence
  chemically synthesized
ggttatccgaacactttggg

SEQ ID NO: 38103 - DNA, 20 bp, Artificial Sequence
  chemically synthesized
cggttatccgaacactttgg

SEQ ID NO: 38104 - DNA, 20 bp, Artificial Sequence
  chemically synthesized
gccggttatccgaacacttt

SEQ ID NO: 38105 - DNA, 20 bp, Artificial Sequence
  chemically synthesized
cctcagcctcccaaagtgtt

SEQ ID NO: 38106 - DNA, 20 bp, Artificial Sequence
  chemically synthesized
tgccggttatccgaacactt

SEQ ID NO: 38107 - DNA, 20 bp, Artificial Sequence
  chemically synthesized
tcccaaagtgttcggataac

SEQ ID NO: 38108 - DNA, 20 bp, Artificial Sequence
  chemically synthesized
agtgttcggataaccggcat

SEQ ID NO: 38109 - DNA, 20 bp, Artificial Sequence
  chemically synthesized
ccagaggaggtggctaatgc

SEQ ID NO: 38110 - DNA, 20 bp, Artificial Sequence
  chemically synthesized
ccggcattagccacctcctc

SEQ ID NO: 38111 - DNA, 20 bp, Artificial Sequence
  chemically synthesized
cagttcttggccagaggagg

SEQ ID NO: 38112 - DNA, 20 bp, Artificial Sequence
  chemically synthesized
aaacagttcttggccagagg

SEQ ID NO: 38113 - DNA, 20 bp, Artificial Sequence
  chemically synthesized
gaaacagttcttggccagag

SEQ ID NO: 38114 - DNA, 20 bp, Artificial Sequence
  chemically synthesized
attagccacctcctctggcc

SEQ ID NO: 38115 - DNA, 20 bp, Artificial Sequence
  chemically synthesized
aagaaacagttcttggccag

SEQ ID NO: 38116 - DNA, 20 bp, Artificial Sequence
  chemically synthesized
aaagaaacagttcttggcca

SEQ ID NO: 38117 - DNA, 20 bp, Artificial Sequence
  chemically synthesized
caaaagaaacagttcttggc

SEQ ID NO: 38118 - DNA, 20 bp, Artificial Sequence
  chemically synthesized
taatcaaaagaaacagttct

SEQ ID NO: 38119 - DNA, 20 bp, Artificial Sequence
  chemically synthesized
caaaatttaatcaaaagaaa

SEQ ID NO: 38120 - DNA, 20 bp, Artificial Sequence
  chemically synthesized
gaagaacaaaatttaatcaa

SEQ ID NO: 38121 - DNA, 20 bp, Artificial Sequence
  chemically synthesized
ttaaggaaagttggagtagg

SEQ ID NO: 38122 - DNA, 20 bp, Artificial Sequence
  chemically synthesized
tctttaaggaaagttggagt

SEQ ID NO: 38123 - DNA, 20 bp, Artificial Sequence
  chemically synthesized
atctttaaggaaagttggag

SEQ ID NO: 38124 - DNA, 20 bp, Artificial Sequence
  chemically synthesized
attatctttaaggaaagttg

SEQ ID NO: 38125 - DNA, 20 bp, Artificial Sequence
  chemically synthesized
gcattatctttaaggaaagt

SEQ ID NO: 38126 - DNA, 20 bp, Artificial Sequence
  chemically synthesized
tcctactccaactttcctta

SEQ ID NO: 38127 - DNA, 20 bp, Artificial Sequence
  chemically synthesized
ggaagcattatctttaagga

SEQ ID NO: 38128 - DNA, 20 bp, Artificial Sequence
  chemically synthesized
ttaaggaagcattatcttta

SEQ ID NO: 38129 - DNA, 20 bp, Artificial Sequence
  chemically synthesized
tttaaggaagcattatcttt

SEQ ID NO: 38130 - DNA, 20 bp, Artificial Sequence
  chemically synthesized
ttaaagataatgcttcctta

SEQ ID NO: 38131 - DNA, 20 bp, Artificial Sequence
  chemically synthesized
cattagatttatctttaagg

SEQ ID NO: 38132 - DNA, 20 bp, Artificial Sequence
  chemically synthesized
agccattagatttatcttta

SEQ ID NO: 38133 - DNA, 20 bp, Artificial Sequence
  chemically synthesized
aagccattagatttatcttt

SEQ ID NO: 38134 - DNA, 20 bp, Artificial Sequence
  chemically synthesized
ttccttaaagataaatctaa

SEQ ID NO: 38135 - DNA, 20 bp, Artificial Sequence
  chemically synthesized
tgtgtgtgtgtttaagccat

SEQ ID NO: 38136 - DNA, 20 bp, Artificial Sequence
  chemically synthesized
gtgtgtgtgtgtgtgtgttt

SEQ ID NO: 38137 - DNA, 20 bp, Artificial Sequence
  chemically synthesized
tactttgcgtgtgtgggtgt

SEQ ID NO: 38138 - DNA, 20 bp, Artificial Sequence
  chemically synthesized
atactttgcgtgtgtgggtg

SEQ ID NO: 38139 - DNA, 20 bp, Artificial Sequence
  chemically synthesized
aatacatactttgcgtgtgt

SEQ ID NO: 38140 - DNA, 20 bp, Artificial Sequence
  chemically synthesized
gaatacatactttgcgtgtg

SEQ ID NO: 38141 - DNA, 20 bp, Artificial Sequence
  chemically synthesized
cacccacacccacacacgca

SEQ ID NO: 38142 - DNA, 20 bp, Artificial Sequence
  chemically synthesized
acaggaggagagtgataaaa

SEQ ID NO: 38143 - DNA, 20 bp, Artificial Sequence
  chemically synthesized
gtgtaagagggacaggagga

SEQ ID NO: 38144 - DNA, 20 bp, Artificial Sequence
  chemically synthesized
aggtgtaagagggacaggag

SEQ ID NO: 38145 - DNA, 20 bp, Artificial Sequence
  chemically synthesized
caaggtgtaagagggacagg

SEQ ID NO: 38146 - DNA, 20 bp, Artificial Sequence
  chemically synthesized
gcaaggtgtaagagggacag

SEQ ID NO: 38147 - DNA, 20 bp, Artificial Sequence
  chemically synthesized
aagcaaggtgtaagagggac

SEQ ID NO: 38148 - DNA, 20 bp, Artificial Sequence
  chemically synthesized
aaagcaaggtgtaagaggga

SEQ ID NO: 38149 - DNA, 20 bp, Artificial Sequence
  chemically synthesized
ttccaaagcaaggtgtaaga

SEQ ID NO: 38150 - DNA, 20 bp, Artificial Sequence
  chemically synthesized
gttccaaagcaaggtgtaag

SEQ ID NO: 38151 - DNA, 20 bp, Artificial Sequence
  chemically synthesized
agttccaaagcaaggtgtaa

SEQ ID NO: 38152 - DNA, 20 bp, Artificial Sequence
  chemically synthesized
tcagttccaaagcaaggtgt

SEQ ID NO: 38153 - DNA, 20 bp, Artificial Sequence
  chemically synthesized
gtccctcttacaccttgctt

SEQ ID NO: 38154 - DNA, 20 bp, Artificial Sequence
  chemically synthesized
caccagtcagttccaaagca

SEQ ID NO: 38155 - DNA, 20 bp, Artificial Sequence
  chemically synthesized
gcaccagtcagttccaaagc

SEQ ID NO: 38156 - DNA, 20 bp, Artificial Sequence
  chemically synthesized
caaggcaccagtcagttcca

SEQ ID NO: 38157 - DNA, 20 bp, Artificial Sequence
  chemically synthesized
caccttgctttggaactgac

SEQ ID NO: 38158 - DNA, 20 bp, Artificial Sequence
  chemically synthesized
tggagatgcaaggcaccagt

SEQ ID NO: 38159 - DNA, 20 bp, Artificial Sequence
  chemically synthesized
tgactggagatgcaaggcac

SEQ ID NO: 38160 - DNA, 20 bp, Artificial Sequence
  chemically synthesized
gataaatgactggagatgca

SEQ ID NO: 38161 - DNA, 20 bp, Artificial Sequence
  chemically synthesized
tgactggtgccttgcatctc

SEQ ID NO: 38162 - DNA, 20 bp, Artificial Sequence
  chemically synthesized
tgataaatgactggagatgc

SEQ ID NO: 38163 - DNA, 20 bp, Artificial Sequence
  chemically synthesized
cgatgtgtgataaatgactg

SEQ ID NO: 38164 - DNA, 20 bp, Artificial Sequence
  chemically synthesized
cacgatgtgtgataaatgac

SEQ ID NO: 38165 - DNA, 20 bp, Artificial Sequence
  chemically synthesized
gtcatttatcacacatcgtg

SEQ ID NO: 38166 - DNA, 20 bp, Artificial Sequence
  chemically synthesized
tatcacacatcgtgtagacc

SEQ ID NO: 38167 - DNA, 20 bp, Artificial Sequence
  chemically synthesized
tgttttaatatcgaaaatct

SEQ ID NO: 38168 - DNA, 20 bp, Artificial Sequence
  chemically synthesized
attttcgatattaaaacatt

SEQ ID NO: 38169 - DNA, 20 bp, Artificial Sequence
  chemically synthesized
gtgcttcctacgtacattgg

SEQ ID NO: 38170 - DNA, 20 bp, Artificial Sequence
  chemically synthesized
attcagtctgccaatgtacg

SEQ ID NO: 38171 - DNA, 20 bp, Artificial Sequence
  chemically synthesized
agggtgcttcctacgtacat

SEQ ID NO: 38172 - DNA, 20 bp, Artificial Sequence
  chemically synthesized
ttcagtctgccaatgtacgt

SEQ ID NO: 38173 - DNA, 20 bp, Artificial Sequence
  chemically synthesized
agtctgccaatgtacgtagg

SEQ ID NO: 38174 - DNA, 20 bp, Artificial Sequence
  chemically synthesized
tagcattttaaagacattga

SEQ ID NO: 38175 - DNA, 20 bp, Artificial Sequence
  chemically synthesized
atagcattttaaagacattg

SEQ ID NO: 38176 - DNA, 20 bp, Artificial Sequence
  chemically synthesized
aatagcattttaaagacatt

SEQ ID NO: 38177 - DNA, 20 bp, Artificial Sequence
  chemically synthesized
tgtttcagaatagcatttta

SEQ ID NO: 38178 - DNA, 20 bp, Artificial Sequence
  chemically synthesized
cctctttaaatgtttcagaa

SEQ ID NO: 38179 - DNA, 20 bp, Artificial Sequence
  chemically synthesized
atggccctctttaaatgttt

SEQ ID NO: 38180 - DNA, 20 bp, Artificial Sequence
  chemically synthesized
atgctattctgaaacattta

SEQ ID NO: 38181 - DNA, 20 bp, Artificial Sequence
  chemically synthesized
gctattctgaaacatttaaa

SEQ ID NO: 38182 - DNA, 20 bp, Artificial Sequence
  chemically synthesized
ctattctgaaacatttaaag

SEQ ID NO: 38183 - DNA, 20 bp, Artificial Sequence
  chemically synthesized
tattctgaaacatttaaaga

SEQ ID NO: 38184 - DNA, 20 bp, Artificial Sequence
  chemically synthesized
atgatcattcttattgcaga

SEQ ID NO: 38185 - DNA, 20 bp, Artificial Sequence
  chemically synthesized
taaagagggccatctgcaat

SEQ ID NO: 38186 - DNA, 20 bp, Artificial Sequence
  chemically synthesized
tctaatgatcattcttattg

SEQ ID NO: 38187 - DNA, 20 bp, Artificial Sequence
  chemically synthesized
tctgcaataagaatgatcat

SEQ ID NO: 38188 - DNA, 20 bp, Artificial Sequence
  chemically synthesized
gatcattagatgatgataaa

SEQ ID NO: 38189 - DNA, 20 bp, Artificial Sequence
  chemically synthesized
tagatgatgataaacagtac

SEQ ID NO: 38190 - DNA, 20 bp, Artificial Sequence
  chemically synthesized
agatgatgataaacagtact

SEQ ID NO: 38191 - DNA, 20 bp, Artificial Sequence
  chemically synthesized
tgataaacagtactgggtca

SEQ ID NO: 38192 - DNA, 20 bp, Artificial Sequence
  chemically synthesized
tactttctccatctgtgacc

SEQ ID NO: 38193 - DNA, 20 bp, Artificial Sequence
  chemically synthesized
aaacagtactgggtcacaga

SEQ ID NO: 38194 - DNA, 20 bp, Artificial Sequence
  chemically synthesized
acagtactgggtcacagatg

SEQ ID NO: 38195 - DNA, 20 bp, Artificial Sequence
  chemically synthesized
tactgggtcacagatggaga

SEQ ID NO: 38196 - DNA, 20 bp, Artificial Sequence
  chemically synthesized
gtcacagatggagaaagtaa

SEQ ID NO: 38197 - DNA, 20 bp, Artificial Sequence
  chemically synthesized
tggagaaagtaatagtattt

SEQ ID NO: 38198 - DNA, 20 bp, Artificial Sequence
  chemically synthesized
gagaaagtaatagtatttga

SEQ ID NO: 38199 - DNA, 20 bp, Artificial Sequence
  chemically synthesized
ctataacattaacatgaaaa

SEQ ID NO: 38200 - DNA, 20 bp, Artificial Sequence
  chemically synthesized
ccattttcatgttaatgtta

SEQ ID NO: 38201 - DNA, 20 bp, Artificial Sequence
  chemically synthesized
atgttatagattacatatta

SEQ ID NO: 38202 - DNA, 20 bp, Artificial Sequence
  chemically synthesized
tacatattaaagaaatgtgc

SEQ ID NO: 38203 - DNA, 20 bp, Artificial Sequence
  chemically synthesized
aaagaaatgtgccagtaatg

SEQ ID NO: 38204 - DNA, 20 bp, Artificial Sequence
  chemically synthesized
tttgttgtttgcttcattac

SEQ ID NO: 38205 - DNA, 20 bp, Artificial Sequence
  chemically synthesized
cagtaatgaagcaaacaaca

SEQ ID NO: 38206 - DNA, 20 bp, Artificial Sequence
  chemically synthesized
gtaatgaagcaaacaacaaa

SEQ ID NO: 38207 - DNA, 20 bp, Artificial Sequence
  chemically synthesized
taatgaagcaaacaacaaag

SEQ ID NO: 38208 - DNA, 20 bp, Artificial Sequence
  chemically synthesized
aatgaagcaaacaacaaaga

SEQ ID NO: 38209 - DNA, 20 bp, Artificial Sequence
  chemically synthesized
caaacaacaaagagggccat

SEQ ID NO: 38210 - DNA, 20 bp, Artificial Sequence
  chemically synthesized
aacaacaaagagggccattg

SEQ ID NO: 38211 - DNA, 20 bp, Artificial Sequence
  chemically synthesized
aacaaagagggccattggag

SEQ ID NO: 38212 - DNA, 20 bp, Artificial Sequence
  chemically synthesized
gcataactgttcttctccaa

SEQ ID NO: 38213 - DNA, 20 bp, Artificial Sequence
  chemically synthesized
agagggccattggagaagaa

SEQ ID NO: 38214 - DNA, 20 bp, Artificial Sequence
  chemically synthesized
aagaacagttatgctattga

SEQ ID NO: 38215 - DNA, 20 bp, Artificial Sequence
  chemically synthesized
tattatatcattgctttcaa

SEQ ID NO: 38216 - DNA, 20 bp, Artificial Sequence
  chemically synthesized
attgaaagcaatgatataat

SEQ ID NO: 38217 - DNA, 20 bp, Artificial Sequence
  chemically synthesized
gaaagcaatgatataataag

SEQ ID NO: 38218 - DNA, 20 bp, Artificial Sequence
  chemically synthesized
caatgatataataagcagaa

SEQ ID NO: 38219 - DNA, 20 bp, Artificial Sequence
  chemically synthesized
ataataagcagaatggcccc

SEQ ID NO: 38220 - DNA, 20 bp, Artificial Sequence
  chemically synthesized
ctttaaaaacagatggcttg

SEQ ID NO: 38221 - DNA, 20 bp, Artificial Sequence
  chemically synthesized
gctttaaaaacagatggctt

SEQ ID NO: 38222 - DNA, 20 bp, Artificial Sequence
  chemically synthesized
agctttaaaaacagatggct

SEQ ID NO: 38223 - DNA, 20 bp, Artificial Sequence
  chemically synthesized
tggtaagctttaaaaacaga

SEQ ID NO: 38224 - DNA, 20 bp, Artificial Sequence
  chemically synthesized
ccccaagccatctgttttta

SEQ ID NO: 38225 - DNA, 20 bp, Artificial Sequence
  chemically synthesized
aatatggtaagctttaaaaa

SEQ ID NO: 38226 - DNA, 20 bp, Artificial Sequence
  chemically synthesized
cctaacagcctaaatatggt

SEQ ID NO: 38227 - DNA, 20 bp, Artificial Sequence
  chemically synthesized
tttttaaagcttaccatatt

SEQ ID NO: 38228 - DNA, 20 bp, Artificial Sequence
  chemically synthesized
ttttaaagcttaccatattt

SEQ ID NO: 38229 - DNA, 20 bp, Artificial Sequence
  chemically synthesized
tggtcctaacagcctaaata

SEQ ID NO: 38230 - DNA, 20 bp, Artificial Sequence
  chemically synthesized
gcttaccatatttaggctgt

SEQ ID NO: 38231 - DNA, 20 bp, Artificial Sequence
  chemically synthesized
cttaccatatttaggctgtt

SEQ ID NO: 38232 - DNA, 20 bp, Artificial Sequence
  chemically synthesized
ggacagtggaatggtcctaa

SEQ ID NO: 38233 - DNA, 20 bp, Artificial Sequence
  chemically synthesized
cacctccatggacagtggaa

SEQ ID NO: 38234 - DNA, 20 bp, Artificial Sequence
  chemically synthesized
taggaccattccactgtcca

SEQ ID NO: 38235 - DNA, 20 bp, Artificial Sequence
  chemically synthesized
aatggcacctccatggacag

SEQ ID NO: 38236 - DNA, 20 bp, Artificial Sequence
  chemically synthesized
ggaccattccactgtccatg

SEQ ID NO: 38237 - DNA, 20 bp, Artificial Sequence
  chemically synthesized
gaccattccactgtccatgg

SEQ ID NO: 38238 - DNA, 20 bp, Artificial Sequence
  chemically synthesized
cagaatggcacctccatgga

SEQ ID NO: 38239 - DNA, 20 bp, Artificial Sequence
  chemically synthesized
atctcagaatggcacctcca

SEQ ID NO: 38240 - DNA, 20 bp, Artificial Sequence
  chemically synthesized
gtccatggaggtgccattct

SEQ ID NO: 38241 - DNA, 20 bp, Artificial Sequence
  chemically synthesized
acttccctgttatctcagaa

SEQ ID NO: 38242 - DNA, 20 bp, Artificial Sequence
  chemically synthesized
gaggtgccattctgagataa

SEQ ID NO: 38243 - DNA, 20 bp, Artificial Sequence
  chemically synthesized
aggtgccattctgagataac

SEQ ID NO: 38244 - DNA, 20 bp, Artificial Sequence
  chemically synthesized
tgcccacttccctgttatct

SEQ ID NO: 38245 - DNA, 20 bp, Artificial Sequence
  chemically synthesized
ggtgccattctgagataaca

SEQ ID NO: 38246 - DNA, 20 bp, Artificial Sequence
  chemically synthesized
gccattctgagataacaggg

SEQ ID NO: 38247 - DNA, 20 bp, Artificial Sequence
  chemically synthesized
attctgagataacagggaag

SEQ ID NO: 38248 - DNA, 20 bp, Artificial Sequence
  chemically synthesized
ttctgagataacagggaagt

SEQ ID NO: 38249 - DNA, 20 bp, Artificial Sequence
  chemically synthesized
gacaatggtttaatttgtat

SEQ ID NO: 38250 - DNA, 20 bp, Artificial Sequence
  chemically synthesized
aatacaaattaaaccattgt

SEQ ID NO: 38251 - DNA, 20 bp, Artificial Sequence
  chemically synthesized
atgataaaaattactgacaa

SEQ ID NO: 38252 - DNA, 20 bp, Artificial Sequence
  chemically synthesized
gcattagatatgtttgtaga

SEQ ID NO: 38253 - DNA, 20 bp, Artificial Sequence
  chemically synthesized
agcattagatatgtttgtag

SEQ ID NO: 38254 - DNA, 20 bp, Artificial Sequence
  chemically synthesized
gagcattagatatgtttgta

SEQ ID NO: 38255 - DNA, 20 bp, Artificial Sequence
  chemically synthesized
gggagcattagatatgtttg

SEQ ID NO: 38256 - DNA, 20 bp, Artificial Sequence
  chemically synthesized
atagtcagatttgggagcat

SEQ ID NO: 38257 - DNA, 20 bp, Artificial Sequence
  chemically synthesized
ttttaaatagtcagatttgg

SEQ ID NO: 38258 - DNA, 20 bp, Artificial Sequence
  chemically synthesized
ttttttaaatagtcagattt

SEQ ID NO: 38259 - DNA, 20 bp, Artificial Sequence
  chemically synthesized
tttttttaaatagtcagatt

SEQ ID NO: 38260 - DNA, 20 bp, Artificial Sequence
  chemically synthesized
gaaacatttttttaaatagt

SEQ ID NO: 38261 - DNA, 20 bp, Artificial Sequence
  chemically synthesized
ctaagaaacatttttttaaa

SEQ ID NO: 38262 - DNA, 20 bp, Artificial Sequence
  chemically synthesized
ctatttaaaaaaatgtttct

SEQ ID NO: 38263 - DNA, 20 bp, Artificial Sequence
  chemically synthesized
atatgcatacattaaggact

SEQ ID NO: 38264 - DNA, 20 bp, Artificial Sequence
  chemically synthesized
gttgtgatatgcatacatta

SEQ ID NO: 38265 - DNA, 20 bp, Artificial Sequence
  chemically synthesized
agttgtgatatgcatacatt

SEQ ID NO: 38266 - DNA, 20 bp, Artificial Sequence
  chemically synthesized
gtatgcatatcacaactctg

SEQ ID NO: 38267 - DNA, 20 bp, Artificial Sequence
  chemically synthesized
ctatacttctagtgtcttca

SEQ ID NO: 38268 - DNA, 20 bp, Artificial Sequence
  chemically synthesized
tatcacaactctgaagacac

SEQ ID NO: 38269 - DNA, 20 bp, Artificial Sequence
  chemically synthesized
gtctatacttctagtgtctt

SEQ ID NO: 38270 - DNA, 20 bp, Artificial Sequence
  chemically synthesized
cacaactctgaagacactag

SEQ ID NO: 38271 - DNA, 20 bp, Artificial Sequence
  chemically synthesized
ctctgaagacactagaagta

SEQ ID NO: 38272 - DNA, 20 bp, Artificial Sequence
  chemically synthesized
aaccctatagtctatacttc

SEQ ID NO: 38273 - DNA, 20 bp, Artificial Sequence
  chemically synthesized
gacactagaagtatagacta

SEQ ID NO: 38274 - DNA, 20 bp, Artificial Sequence
  chemically synthesized
acactagaagtatagactat

SEQ ID NO: 38275 - DNA, 20 bp, Artificial Sequence
  chemically synthesized
cactagaagtatagactata

SEQ ID NO: 38276 - DNA, 20 bp, Artificial Sequence
  chemically synthesized
ttttaagactgtgaacccta

SEQ ID NO: 38277 - DNA, 20 bp, Artificial Sequence
  chemically synthesized
agtatagactatagggttca

SEQ ID NO: 38278 - DNA, 20 bp, Artificial Sequence
  chemically synthesized
agggttcacagtcttaaaat

SEQ ID NO: 38279 - DNA, 20 bp, Artificial Sequence
  chemically synthesized
gggttcacagtcttaaaatg

SEQ ID NO: 38280 - DNA, 20 bp, Artificial Sequence
  chemically synthesized
atatctaaaatcctcatttt

SEQ ID NO: 38281 - DNA, 20 bp, Artificial Sequence
  chemically synthesized
cagtcttaaaatgaggattt

SEQ ID NO: 38282 - DNA, 20 bp, Artificial Sequence
  chemically synthesized
actgaaactattttagagga

SEQ ID NO: 38283 - DNA, 20 bp, Artificial Sequence
  chemically synthesized
agactgaaactattttagag

SEQ ID NO: 38284 - DNA, 20 bp, Artificial Sequence
  chemically synthesized
attaacgctctcctctaaaa

SEQ ID NO: 38285 - DNA, 20 bp, Artificial Sequence
  chemically synthesized
aaagactgaaactattttag

SEQ ID NO: 38286 - DNA, 20 bp, Artificial Sequence
  chemically synthesized
aaaagactgaaactatttta

SEQ ID NO: 38287 - DNA, 20 bp, Artificial Sequence
  chemically synthesized
acaaaagactgaaactattt

SEQ ID NO: 38288 - DNA, 20 bp, Artificial Sequence
  chemically synthesized
gctctcctctaaaatagttt

SEQ ID NO: 38289 - DNA, 20 bp, Artificial Sequence
  chemically synthesized
ttctaattttggaagcacaa

SEQ ID NO: 38290 - DNA, 20 bp, Artificial Sequence
  chemically synthesized
gtcttttgtgcttccaaaat

SEQ ID NO: 38291 - DNA, 20 bp, Artificial Sequence
  chemically synthesized
ggataaagttctaattttgg

SEQ ID NO: 38292 - DNA, 20 bp, Artificial Sequence
  chemically synthesized
taaggataaagttctaattt

SEQ ID NO: 38293 - DNA, 20 bp, Artificial Sequence
  chemically synthesized
caaaattagaactttatcct

SEQ ID NO: 38294 - DNA, 20 bp, Artificial Sequence
  chemically synthesized
aaaattagaactttatcctt

SEQ ID NO: 38295 - DNA, 20 bp, Artificial Sequence
  chemically synthesized
aattgcaaaacctaaggata

SEQ ID NO: 38296 - DNA, 20 bp, Artificial Sequence
  chemically synthesized
gatccaaattgcaaaaccta

SEQ ID NO: 38297 - DNA, 20 bp, Artificial Sequence
  chemically synthesized
agatccaaattgcaaaacct

SEQ ID NO: 38298 - DNA, 20 bp, Artificial Sequence
  chemically synthesized
tatccttaggttttgcaatt

SEQ ID NO: 38299 - DNA, 20 bp, Artificial Sequence
  chemically synthesized
ttttgcaatttggatcttgt

SEQ ID NO: 38300 - DNA, 20 bp, Artificial Sequence
  chemically synthesized
tttgcaatttggatcttgta

SEQ ID NO: 38301 - DNA, 20 bp, Artificial Sequence
  chemically synthesized
tgcaatttggatcttgtaag

SEQ ID NO: 38302 - DNA, 20 bp, Artificial Sequence
  chemically synthesized
ttccctctttatctccttac

SEQ ID NO: 38303 - DNA, 20 bp, Artificial Sequence
  chemically synthesized
ttggatcttgtaaggagata

SEQ ID NO: 38304 - DNA, 20 bp, Artificial Sequence
  chemically synthesized
ggatcttgtaaggagataaa

SEQ ID NO: 38305 - DNA, 20 bp, Artificial Sequence
  chemically synthesized
gatcttgtaaggagataaag

SEQ ID NO: 38306 - DNA, 20 bp, Artificial Sequence
  chemically synthesized
atcttgtaaggagataaaga

SEQ ID NO: 38307 - DNA, 20 bp, Artificial Sequence
  chemically synthesized
ttgtaaggagataaagaggg

SEQ ID NO: 38308 - DNA, 20 bp, Artificial Sequence
  chemically synthesized
agataaagagggaagaaaaa

SEQ ID NO: 38309 - DNA, 20 bp, Artificial Sequence
  chemically synthesized
aagaaaaaaagtttgtgatt

SEQ ID NO: 38310 - DNA, 20 bp, Artificial Sequence
  chemically synthesized
agaaaaaaagtttgtgattc

SEQ ID NO: 38311 - DNA, 20 bp, Artificial Sequence
  chemically synthesized
gaaaaaaagtttgtgattca

SEQ ID NO: 38312 - DNA, 20 bp, Artificial Sequence
  chemically synthesized
aaaaaaagtttgtgattcag

SEQ ID NO: 38313 - DNA, 20 bp, Artificial Sequence
  chemically synthesized
ttcaggggtgtaataaactc

SEQ ID NO: 38314 - DNA, 20 bp, Artificial Sequence
  chemically synthesized
ggggtgtaataaactccagc

SEQ ID NO: 38315 - DNA, 20 bp, Artificial Sequence
  chemically synthesized
ggctcatgatatgccagctg

SEQ ID NO: 38316 - DNA, 20 bp, Artificial Sequence
  chemically synthesized
taggctcatgatatgccagc

SEQ ID NO: 38317 - DNA, 20 bp, Artificial Sequence
  chemically synthesized
taactaggctcatgatatgc

SEQ ID NO: 38318 - DNA, 20 bp, Artificial Sequence
  chemically synthesized
aactccagctggcatatcat

SEQ ID NO: 38319 - DNA, 20 bp, Artificial Sequence
  chemically synthesized
cagctggcatatcatgagcc

SEQ ID NO: 38320 - DNA, 20 bp, Artificial Sequence
  chemically synthesized
ttatttattttgacataact

SEQ ID NO: 38321 - DNA, 20 bp, Artificial Sequence
  chemically synthesized
tttatttattttgacataac

SEQ ID NO: 38322 - DNA, 20 bp, Artificial Sequence
  chemically synthesized
gtatgtttttgttttttaat

SEQ ID NO: 38323 - DNA, 20 bp, Artificial Sequence
  chemically synthesized
attaaaaaacaaaaacatac

SEQ ID NO: 38324 - DNA, 20 bp, Artificial Sequence
  chemically synthesized
acaaaaacatactggaactt

SEQ ID NO: 38325 - DNA, 20 bp, Artificial Sequence
  chemically synthesized
aaatttattttccaaagttc

SEQ ID NO: 38326 - DNA, 20 bp, Artificial Sequence
  chemically synthesized
ttacctaaatttattttcca

SEQ ID NO: 38327 - DNA, 20 bp, Artificial Sequence
  chemically synthesized
ggaactttggaaaataaatt

SEQ ID NO: 38328 - DNA, 20 bp, Artificial Sequence
  chemically synthesized
gaactttggaaaataaattt

SEQ ID NO: 38329 - DNA, 20 bp, Artificial Sequence
  chemically synthesized
aaaataaatttaggtaaaac

SEQ ID NO: 38330 - DNA, 20 bp, Artificial Sequence
  chemically synthesized
taaaacaagtgaaatgaaaa

SEQ ID NO: 38331 - DNA, 20 bp, Artificial Sequence
  chemically synthesized
aaaacaagtgaaatgaaaat

SEQ ID NO: 38332 - DNA, 20 bp, Artificial Sequence
  chemically synthesized
acaagtgaaatgaaaatagg

SEQ ID NO: 38333 - DNA, 20 bp, Artificial Sequence
  chemically synthesized
ataggaagaatattaatatt

SEQ ID NO: 38334 - DNA, 20 bp, Artificial Sequence
  chemically synthesized
ggaagaatattaatattcag

SEQ ID NO: 38335 - DNA, 20 bp, Artificial Sequence
  chemically synthesized
ctggctaatacataatcaat

SEQ ID NO: 38336 - DNA, 20 bp, Artificial Sequence
  chemically synthesized
gaagctgattgattatgtat

SEQ ID NO: 38337 - DNA, 20 bp, Artificial Sequence
  chemically synthesized
ctgattgattatgtattagc

SEQ ID NO: 38338 - DNA, 20 bp, Artificial Sequence
  chemically synthesized
attatgtattagccagatca

SEQ ID NO: 38339 - DNA, 20 bp, Artificial Sequence
  chemically synthesized
atcacccagaggctttgatc

SEQ ID NO: 38340 - DNA, 20 bp, Artificial Sequence
  chemically synthesized
attagccagatcaaagcctc

SEQ ID NO: 38341 - DNA, 20 bp, Artificial Sequence
  chemically synthesized
ttagccagatcaaagcctct

SEQ ID NO: 38342 - DNA, 20 bp, Artificial Sequence
  chemically synthesized
agtggctcattatcacccag

SEQ ID NO: 38343 - DNA, 20 bp, Artificial Sequence
  chemically synthesized
cagtggctcattatcaccca

SEQ ID NO: 38344 - DNA, 20 bp, Artificial Sequence
  chemically synthesized
ttcagtggctcattatcacc

SEQ ID NO: 38345 - DNA, 20 bp, Artificial Sequence
  chemically synthesized
caaagcctctgggtgataat

SEQ ID NO: 38346 - DNA, 20 bp, Artificial Sequence
  chemically synthesized
ggtgataatgagccactgaa

SEQ ID NO: 38347 - DNA, 20 bp, Artificial Sequence
  chemically synthesized
gtgataatgagccactgaac

SEQ ID NO: 38348 - DNA, 20 bp, Artificial Sequence
  chemically synthesized
tgataatgagccactgaaca

SEQ ID NO: 38349 - DNA, 20 bp, Artificial Sequence
  chemically synthesized
aggtggtaatccctgttcag

SEQ ID NO: 38350 - DNA, 20 bp, Artificial Sequence
  chemically synthesized
gacaggtggtaatccctgtt

SEQ ID NO: 38351 - DNA, 20 bp, Artificial Sequence
  chemically synthesized
tgctagttgaacaggacagg

SEQ ID NO: 38352 - DNA, 20 bp, Artificial Sequence
  chemically synthesized
agctgctagttgaacaggac

SEQ ID NO: 38353 - DNA, 20 bp, Artificial Sequence
  chemically synthesized
cagctgctagttgaacagga

SEQ ID NO: 38354 - DNA, 20 bp, Artificial Sequence
  chemically synthesized
taccacctgtcctgttcaac

SEQ ID NO: 38355 - DNA, 20 bp, Artificial Sequence
  chemically synthesized
agtccagctgctagttgaac

SEQ ID NO: 38356 - DNA, 20 bp, Artificial Sequence
  chemically synthesized
aagtccagctgctagttgaa

SEQ ID NO: 38357 - DNA, 20 bp, Artificial Sequence
  chemically synthesized
cacctgtcctgttcaactag

SEQ ID NO: 38358 - DNA, 20 bp, Artificial Sequence
  chemically synthesized
tgtcctgttcaactagcagc

SEQ ID NO: 38359 - DNA, 20 bp, Artificial Sequence
  chemically synthesized
ttcttggtaagtccagctgc

SEQ ID NO: 38360 - DNA, 20 bp, Artificial Sequence
  chemically synthesized
ccagctgttcttggtaagtc

SEQ ID NO: 38361 - DNA, 20 bp, Artificial Sequence
  chemically synthesized
aactagcagctggacttacc

SEQ ID NO: 38362 - DNA, 20 bp, Artificial Sequence
  chemically synthesized
cttgtccagctgttcttggt

SEQ ID NO: 38363 - DNA, 20 bp, Artificial Sequence
  chemically synthesized
gcagctggacttaccaagaa

SEQ ID NO: 38364 - DNA, 20 bp, Artificial Sequence
  chemically synthesized
tgttcttgtccagctgttct

SEQ ID NO: 38365 - DNA, 20 bp, Artificial Sequence
  chemically synthesized
ctggacttaccaagaacagc

SEQ ID NO: 38366 - DNA, 20 bp, Artificial Sequence
  chemically synthesized
cttaccaagaacagctggac

SEQ ID NO: 38367 - DNA, 20 bp, Artificial Sequence
  chemically synthesized
tttatataagtgttcttgtc

SEQ ID NO: 38368 - DNA, 20 bp, Artificial Sequence
  chemically synthesized
tctaaaggctaattttatat

SEQ ID NO: 38369 - DNA, 20 bp, Artificial Sequence
  chemically synthesized
caagaacacttatataaaat

SEQ ID NO: 38370 - DNA, 20 bp, Artificial Sequence
  chemically synthesized
acttatataaaattagcctt

SEQ ID NO: 38371 - DNA, 20 bp, Artificial Sequence
  chemically synthesized
tatataaaattagcctttag

SEQ ID NO: 38372 - DNA, 20 bp, Artificial Sequence
  chemically synthesized
aacttagcttatgcttctaa

SEQ ID NO: 38373 - DNA, 20 bp, Artificial Sequence
  chemically synthesized
aaacttagcttatgcttcta

SEQ ID NO: 38374 - DNA, 20 bp, Artificial Sequence
  chemically synthesized
aaattagcctttagaagcat

SEQ ID NO: 38375 - DNA, 20 bp, Artificial Sequence
  chemically synthesized
agcctttagaagcataagct

SEQ ID NO: 38376 - DNA, 20 bp, Artificial Sequence
  chemically synthesized
gagaagcaggtgaaaaaact

SEQ ID NO: 38377 - DNA, 20 bp, Artificial Sequence
  chemically synthesized
aagttttttcacctgcttct

SEQ ID NO: 38378 - DNA, 20 bp, Artificial Sequence
  chemically synthesized
aagatgccgatctgagaagc

SEQ ID NO: 38379 - DNA, 20 bp, Artificial Sequence
  chemically synthesized
aaagatgccgatctgagaag

SEQ ID NO: 38380 - DNA, 20 bp, Artificial Sequence
  chemically synthesized
ttttcacctgcttctcagat

SEQ ID NO: 38381 - DNA, 20 bp, Artificial Sequence
  chemically synthesized
gataaagatgccgatctgag

SEQ ID NO: 38382 - DNA, 20 bp, Artificial Sequence
  chemically synthesized
agtgataaagatgccgatct

SEQ ID NO: 38383 - DNA, 20 bp, Artificial Sequence
  chemically synthesized
tacttctggcatgagtgata

SEQ ID NO: 38384 - DNA, 20 bp, Artificial Sequence
  chemically synthesized
ggcatctttatcactcatgc

SEQ ID NO: 38385 - DNA, 20 bp, Artificial Sequence
  chemically synthesized
atctttatcactcatgccag

SEQ ID NO: 38386 - DNA, 20 bp, Artificial Sequence
  chemically synthesized
aagctttttacttctggcat

SEQ ID NO: 38387 - DNA, 20 bp, Artificial Sequence
  chemically synthesized
tatgaaaagctttttacttc

SEQ ID NO: 38388 - DNA, 20 bp, Artificial Sequence
  chemically synthesized
tcactcatgccagaagtaaa

SEQ ID NO: 38389 - DNA, 20 bp, Artificial Sequence
  chemically synthesized
aaacagcatcaaaatatgaa

SEQ ID NO: 38390 - DNA, 20 bp, Artificial Sequence
  chemically synthesized
tgctttcctgaaggcaaaaa

SEQ ID NO: 38391 - DNA, 20 bp, Artificial Sequence
  chemically synthesized
tttgatgctgtttttgcctt

SEQ ID NO: 38392 - DNA, 20 bp, Artificial Sequence
  chemically synthesized
ttgatgctgtttttgccttc

SEQ ID NO: 38393 - DNA, 20 bp, Artificial Sequence
  chemically synthesized
tgctgtttttgccttcagga

SEQ ID NO: 38394 - DNA, 20 bp, Artificial Sequence
  chemically synthesized
tcaaagctgtgctttcctga

SEQ ID NO: 38395 - DNA, 20 bp, Artificial Sequence
  chemically synthesized
ttcaaagctgtgctttcctg

SEQ ID NO: 38396 - DNA, 20 bp, Artificial Sequence
  chemically synthesized
tttttgccttcaggaaagca

SEQ ID NO: 38397 - DNA, 20 bp, Artificial Sequence
  chemically synthesized
gctgggaatattggtgttca

SEQ ID NO: 38398 - DNA, 20 bp, Artificial Sequence
  chemically synthesized
gctttgaacaccaatattcc

SEQ ID NO: 38399 - DNA, 20 bp, Artificial Sequence
  chemically synthesized
tagcaagcggctgggaatat

SEQ ID NO: 38400 - DNA, 20 bp, Artificial Sequence
  chemically synthesized
ttacttggtagcaagcggct

SEQ ID NO: 38401 - DNA, 20 bp, Artificial Sequence
  chemically synthesized
attacttggtagcaagcggc

SEQ ID NO: 38402 - DNA, 20 bp, Artificial Sequence
  chemically synthesized
ctccattacttggtagcaag

SEQ ID NO: 38403 - DNA, 20 bp, Artificial Sequence
  chemically synthesized
attcccagccgcttgctacc

SEQ ID NO: 38404 - DNA, 20 bp, Artificial Sequence
  chemically synthesized
aacctccattacttggtagc

SEQ ID NO: 38405 - DNA, 20 bp, Artificial Sequence
  chemically synthesized
agacaacctccattacttgg

SEQ ID NO: 38406 - DNA, 20 bp, Artificial Sequence
  chemically synthesized
agccgcttgctaccaagtaa

SEQ ID NO: 38407 - DNA, 20 bp, Artificial Sequence
  chemically synthesized
ccgcttgctaccaagtaatg

SEQ ID NO: 38408 - DNA, 20 bp, Artificial Sequence
  chemically synthesized
agaagacaacctccattact

SEQ ID NO: 38409 - DNA, 20 bp, Artificial Sequence
  chemically synthesized
cgcttgctaccaagtaatgg

SEQ ID NO: 38410 - DNA, 20 bp, Artificial Sequence
  chemically synthesized
aagtaatggaggttgtcttc

SEQ ID NO: 38411 - DNA, 20 bp, Artificial Sequence
  chemically synthesized
tcttagcttattaggtctag

SEQ ID NO: 38412 - DNA, 20 bp, Artificial Sequence
  chemically synthesized
acatcttagcttattaggtc

SEQ ID NO: 38413 - DNA, 20 bp, Artificial Sequence
  chemically synthesized
ggttgtcttctagacctaat

SEQ ID NO: 38414 - DNA, 20 bp, Artificial Sequence
  chemically synthesized
atctgacatcttagcttatt

SEQ ID NO: 38415 - DNA, 20 bp, Artificial Sequence
  chemically synthesized
tcttctagacctaataagct

SEQ ID NO: 38416 - DNA, 20 bp, Artificial Sequence
  chemically synthesized
catctgacatcttagcttat

SEQ ID NO: 38417 - DNA, 20 bp, Artificial Sequence
  chemically synthesized
gacctaataagctaagatgt

SEQ ID NO: 38418 - DNA, 20 bp, Artificial Sequence
  chemically synthesized
accaagtgcatctgacatct

SEQ ID NO: 38419 - DNA, 20 bp, Artificial Sequence
  chemically synthesized
gctaagatgtcagatgcact

SEQ ID NO: 38420 - DNA, 20 bp, Artificial Sequence
  chemically synthesized
agccagtgacaggaaaaacc

SEQ ID NO: 38421 - DNA, 20 bp, Artificial Sequence
  chemically synthesized
cacttggtttttcctgtcac

SEQ ID NO: 38422 - DNA, 20 bp, Artificial Sequence
  chemically synthesized
gcacaagatgagccagtgac

SEQ ID NO: 38423 - DNA, 20 bp, Artificial Sequence
  chemically synthesized
agcacaagatgagccagtga

SEQ ID NO: 38424 - DNA, 20 bp, Artificial Sequence
  chemically synthesized
cataagagcacaagatgagc

SEQ ID NO: 38425 - DNA, 20 bp, Artificial Sequence
  chemically synthesized
taaacataagagcacaagat

SEQ ID NO: 38426 - DNA, 20 bp, Artificial Sequence
  chemically synthesized
tggcttaaacataagagcac

SEQ ID NO: 38427 - DNA, 20 bp, Artificial Sequence
  chemically synthesized
ttgtagtggcttaaacataa

SEQ ID NO: 38428 - DNA, 20 bp, Artificial Sequence
  chemically synthesized
catcttgtgctcttatgttt

SEQ ID NO: 38429 - DNA, 20 bp, Artificial Sequence
  chemically synthesized
atttgtagtggcttaaacat

SEQ ID NO: 38430 - DNA, 20 bp, Artificial Sequence
  chemically synthesized
tcttttgaaagaatttgtag

SEQ ID NO: 38431 - DNA, 20 bp, Artificial Sequence
  chemically synthesized
ctttcttttgaaagaatttg

SEQ ID NO: 38432 - DNA, 20 bp, Artificial Sequence
  chemically synthesized
gccactacaaattctttcaa

SEQ ID NO: 38433 - DNA, 20 bp, Artificial Sequence
  chemically synthesized
atatttctactttcttttga

SEQ ID NO: 38434 - DNA, 20 bp, Artificial Sequence
  chemically synthesized
ctacaaattctttcaaaaga

SEQ ID NO: 38435 - DNA, 20 bp, Artificial Sequence
  chemically synthesized
caaattctttcaaaagaaag

SEQ ID NO: 38436 - DNA, 20 bp, Artificial Sequence
  chemically synthesized
aagtagaaatataaattata

SEQ ID NO: 38437 - DNA, 20 bp, Artificial Sequence
  chemically synthesized
agaaatataaattataaaga

SEQ ID NO: 38438 - DNA, 20 bp, Artificial Sequence
  chemically synthesized
agattcgtgagtaagaatat

SEQ ID NO: 38439 - DNA, 20 bp, Artificial Sequence
  chemically synthesized
aagattcgtgagtaagaata

SEQ ID NO: 38440 - DNA, 20 bp, Artificial Sequence
  chemically synthesized
taaaatgaagattcgtgagt

SEQ ID NO: 38441 - DNA, 20 bp, Artificial Sequence
  chemically synthesized
tcaataaaatgaagattcgt

SEQ ID NO: 38442 - DNA, 20 bp, Artificial Sequence
  chemically synthesized
aaataggtttcaataaaatg

SEQ ID NO: 38443 - DNA, 20 bp, Artificial Sequence
  chemically synthesized
tatatattgtcattttaaat

SEQ ID NO: 38444 - DNA, 20 bp, Artificial Sequence
  chemically synthesized
atatatattgtcattttaaa

SEQ ID NO: 38445 - DNA, 20 bp, Artificial Sequence
  chemically synthesized
tgacaatatatatgcacact

SEQ ID NO: 38446 - DNA, 20 bp, Artificial Sequence
  chemically synthesized
gacaatatatatgcacactt

SEQ ID NO: 38447 - DNA, 20 bp, Artificial Sequence
  chemically synthesized
aatatatatgcacacttggg

SEQ ID NO: 38448 - DNA, 20 bp, Artificial Sequence
  chemically synthesized
aattatctgataaacttccc

SEQ ID NO: 38449 - DNA, 20 bp, Artificial Sequence
  chemically synthesized
tgcacacttgggaagtttat

SEQ ID NO: 38450 - DNA, 20 bp, Artificial Sequence
  chemically synthesized
ttatcagataattttgatat

SEQ ID NO: 38451 - DNA, 20 bp, Artificial Sequence
  chemically synthesized
ataattttgatataagacga

SEQ ID NO: 38452 - DNA, 20 bp, Artificial Sequence
  chemically synthesized
taattttgatataagacgat

SEQ ID NO: 38453 - DNA, 20 bp, Artificial Sequence
  chemically synthesized
taagacgataggttaaaaat

SEQ ID NO: 38454 - DNA, 20 bp, Artificial Sequence
  chemically synthesized
aagacgataggttaaaaata

SEQ ID NO: 38455 - DNA, 20 bp, Artificial Sequence
  chemically synthesized
ggcatatgacaatctttatt

SEQ ID NO: 38456 - DNA, 20 bp, Artificial Sequence
  chemically synthesized
acaattcagagcaccaaata

SEQ ID NO: 38457 - DNA, 20 bp, Artificial Sequence
  chemically synthesized
ggtgactttaatacaattca

SEQ ID NO: 38458 - DNA, 20 bp, Artificial Sequence
  chemically synthesized
ctggtgactttaatacaatt

SEQ ID NO: 38459 - DNA, 20 bp, Artificial Sequence
  chemically synthesized
tggtgctctgaattgtatta

SEQ ID NO: 38460 - DNA, 20 bp, Artificial Sequence
  chemically synthesized
ctgaattgtattaaagtcac

SEQ ID NO: 38461 - DNA, 20 bp, Artificial Sequence
  chemically synthesized
tgataactcttaaaacagac

SEQ ID NO: 38462 - DNA, 20 bp, Artificial Sequence
  chemically synthesized
taaagtcaccagtctgtttt

SEQ ID NO: 38463 - DNA, 20 bp, Artificial Sequence
  chemically synthesized
aagtcaccagtctgttttaa

SEQ ID NO: 38464 - DNA, 20 bp, Artificial Sequence
  chemically synthesized
ttccatgataactcttaaaa

SEQ ID NO: 38465 - DNA, 20 bp, Artificial Sequence
  chemically synthesized
gtctgttttaagagttatca

SEQ ID NO: 38466 - DNA, 20 bp, Artificial Sequence
  chemically synthesized
tttaagagttatcatggaac

SEQ ID NO: 38467 - DNA, 20 bp, Artificial Sequence
  chemically synthesized
ttatcatggaacaagtgaat

SEQ ID NO: 38468 - DNA, 20 bp, Artificial Sequence
  chemically synthesized
aagtgaatgagtaaatataa

SEQ ID NO: 38469 - DNA, 20 bp, Artificial Sequence
  chemically synthesized
cactttgagaaggaaggaag

SEQ ID NO: 38470 - DNA, 20 bp, Artificial Sequence
  chemically synthesized
ccacactttgagaaggaagg

SEQ ID NO: 38471 - DNA, 20 bp, Artificial Sequence
  chemically synthesized
caaccacactttgagaagga

SEQ ID NO: 38472 - DNA, 20 bp, Artificial Sequence
  chemically synthesized
ccaaccacactttgagaagg

SEQ ID NO: 38473 - DNA, 20 bp, Artificial Sequence
  chemically synthesized
gtctacttccttccttctca

SEQ ID NO: 38474 - DNA, 20 bp, Artificial Sequence
  chemically synthesized
ggaccaaccacactttgaga

SEQ ID NO: 38475 - DNA, 20 bp, Artificial Sequence
  chemically synthesized
tggaccaaccacactttgag

SEQ ID NO: 38476 - DNA, 20 bp, Artificial Sequence
  chemically synthesized
cttccttccttctcaaagtg

SEQ ID NO: 38477 - DNA, 20 bp, Artificial Sequence
  chemically synthesized
ctgtggaccaaccacacttt

SEQ ID NO: 38478 - DNA, 20 bp, Artificial Sequence
  chemically synthesized
cttccttctcaaagtgtggt

SEQ ID NO: 38479 - DNA, 20 bp, Artificial Sequence
  chemically synthesized
ctcaaagtgtggttggtcca

SEQ ID NO: 38480 - DNA, 20 bp, Artificial Sequence
  chemically synthesized
agtgtggttggtccacagat

SEQ ID NO: 38481 - DNA, 20 bp, Artificial Sequence
  chemically synthesized
atgctaatgctgctaatctg

SEQ ID NO: 38482 - DNA, 20 bp, Artificial Sequence
  chemically synthesized
gtggttggtccacagattag

SEQ ID NO: 38483 - DNA, 20 bp, Artificial Sequence
  chemically synthesized
ggtccacagattagcagcat

SEQ ID NO: 38484 - DNA, 20 bp, Artificial Sequence
  chemically synthesized
gcagcattagcatcacctgt

SEQ ID NO: 38485 - DNA, 20 bp, Artificial Sequence
  chemically synthesized
tgatgttctgcatttctaac

SEQ ID NO: 38486 - DNA, 20 bp, Artificial Sequence
  chemically synthesized
atgatgttctgcatttctaa

SEQ ID NO: 38487 - DNA, 20 bp, Artificial Sequence
  chemically synthesized
agcatcacctgttagaaatg

SEQ ID NO: 38488 - DNA, 20 bp, Artificial Sequence
  chemically synthesized
cagaacatcatgtctcattt

SEQ ID NO: 38489 - DNA, 20 bp, Artificial Sequence
  chemically synthesized
tgagccagtgggtctaaaat

SEQ ID NO: 38490 - DNA, 20 bp, Artificial Sequence
  chemically synthesized
atgtctcattttagacccac

SEQ ID NO: 38491 - DNA, 20 bp, Artificial Sequence
  chemically synthesized
aatccagattatgagccagt

SEQ ID NO: 38492 - DNA, 20 bp, Artificial Sequence
  chemically synthesized
aaatccagattatgagccag

SEQ ID NO: 38493 - DNA, 20 bp, Artificial Sequence
  chemically synthesized
ttaaaatccagattatgagc

SEQ ID NO: 38494 - DNA, 20 bp, Artificial Sequence
  chemically synthesized
agacccactggctcataatc

SEQ ID NO: 38495 - DNA, 20 bp, Artificial Sequence
  chemically synthesized
cttgttaaaatccagattat

SEQ ID NO: 38496 - DNA, 20 bp, Artificial Sequence
  chemically synthesized
ctgggaatcttgttaaaatc

SEQ ID NO: 38497 - DNA, 20 bp, Artificial Sequence
  chemically synthesized
ctcataatctggattttaac

SEQ ID NO: 38498 - DNA, 20 bp, Artificial Sequence
  chemically synthesized
ctggattttaacaagattcc

SEQ ID NO: 38499 - DNA, 20 bp, Artificial Sequence
  chemically synthesized
aatgtgcatacaaattgtct

SEQ ID NO: 38500 - DNA, 20 bp, Artificial Sequence
  chemically synthesized
taatgtgcatacaaattgtc

SEQ ID NO: 38501 - DNA, 20 bp, Artificial Sequence
  chemically synthesized
ttgtatgcacattaaaattt

SEQ ID NO: 38502 - DNA, 20 bp, Artificial Sequence
  chemically synthesized
tatgcacattaaaatttgag

SEQ ID NO: 38503 - DNA, 20 bp, Artificial Sequence
  chemically synthesized
ttgagaagcaatgttcctgt

SEQ ID NO: 38504 - DNA, 20 bp, Artificial Sequence
  chemically synthesized
gaggatctgattaagctcac

SEQ ID NO: 38505 - DNA, 20 bp, Artificial Sequence
  chemically synthesized
agaggatctgattaagctca

SEQ ID NO: 38506 - DNA, 20 bp, Artificial Sequence
  chemically synthesized
aatgttcctgtgagcttaat

SEQ ID NO: 38507 - DNA, 20 bp, Artificial Sequence
  chemically synthesized
aagaaagagaggatctgatt

SEQ ID NO: 38508 - DNA, 20 bp, Artificial Sequence
  chemically synthesized
aaacgtgtagaaagaaagag

SEQ ID NO: 38509 - DNA, 20 bp, Artificial Sequence
  chemically synthesized
aaaacgtgtagaaagaaaga

SEQ ID NO: 38510 - DNA, 20 bp, Artificial Sequence
  chemically synthesized
aaaaaacgtgtagaaagaaa

SEQ ID NO: 38511 - DNA, 20 bp, Artificial Sequence
  chemically synthesized
agaaaaaacgtgtagaaaga

SEQ ID NO: 38512 - DNA, 20 bp, Artificial Sequence
  chemically synthesized
agaaagaaaaaacgtgtaga

SEQ ID NO: 38513 - DNA, 20 bp, Artificial Sequence
  chemically synthesized
aaaaagaaagaaaaaacgtg

SEQ ID NO: 38514 - DNA, 20 bp, Artificial Sequence
  chemically synthesized
actctgtctcaaaaaaaaga

SEQ ID NO: 38515 - DNA, 20 bp, Artificial Sequence
  chemically synthesized
gttttttctttctttttttt

SEQ ID NO: 38516 - DNA, 20 bp, Artificial Sequence
  chemically synthesized
tgagactctgtctcaaaaaa

SEQ ID NO: 38517 - DNA, 20 bp, Artificial Sequence
  chemically synthesized
tttctttcttttttttgaga

SEQ ID NO: 38518 - DNA, 20 bp, Artificial Sequence
  chemically synthesized
tctttcttttttttgagaca

SEQ ID NO: 38519 - DNA, 20 bp, Artificial Sequence
  chemically synthesized
gtaagcctcggtaacagagt

SEQ ID NO: 38520 - DNA, 20 bp, Artificial Sequence
  chemically synthesized
cagagtctcactctgttacc

SEQ ID NO: 38521 - DNA, 20 bp, Artificial Sequence
  chemically synthesized
tttggtaagcctcggtaaca

SEQ ID NO: 38522 - DNA, 20 bp, Artificial Sequence
  chemically synthesized
agagtctcactctgttaccg

SEQ ID NO: 38523 - DNA, 20 bp, Artificial Sequence
  chemically synthesized
gctttggtaagcctcggtaa

SEQ ID NO: 38524 - DNA, 20 bp, Artificial Sequence
  chemically synthesized
actccagctttggtaagcct

SEQ ID NO: 38525 - DNA, 20 bp, Artificial Sequence
  chemically synthesized
tctgttaccgaggcttacca

SEQ ID NO: 38526 - DNA, 20 bp, Artificial Sequence
  chemically synthesized
cgctgcactccagctttggt

SEQ ID NO: 38527 - DNA, 20 bp, Artificial Sequence
  chemically synthesized
ttaccgaggcttaccaaagc

SEQ ID NO: 38528 - DNA, 20 bp, Artificial Sequence
  chemically synthesized
accgaggcttaccaaagctg

SEQ ID NO: 38529 - DNA, 20 bp, Artificial Sequence
  chemically synthesized
acgccgctgcactccagctt

SEQ ID NO: 38530 - DNA, 20 bp, Artificial Sequence
  chemically synthesized
ggcttaccaaagctggagtg

SEQ ID NO: 38531 - DNA, 20 bp, Artificial Sequence
  chemically synthesized
gagatcacgccgctgcactc

SEQ ID NO: 38532 - DNA, 20 bp, Artificial Sequence
  chemically synthesized
ttaccaaagctggagtgcag

SEQ ID NO: 38533 - DNA, 20 bp, Artificial Sequence
  chemically synthesized
ggagtgcagcggcgtgatct

SEQ ID NO: 38534 - DNA, 20 bp, Artificial Sequence
  chemically synthesized
ggcggaggttgcagtgagcc

SEQ ID NO: 38535 - DNA, 20 bp, Artificial Sequence
  chemically synthesized
tgggaggcggaggttgcagt

SEQ ID NO: 38536 - DNA, 20 bp, Artificial Sequence
  chemically synthesized
aacatgggaggcggaggttg

SEQ ID NO: 38537 - DNA, 20 bp, Artificial Sequence
  chemically synthesized
cacttgaacatgggaggcgg

SEQ ID NO: 38538 - DNA, 20 bp, Artificial Sequence
  chemically synthesized
tcacttgaacatgggaggcg

SEQ ID NO: 38539 - DNA, 20 bp, Artificial Sequence
  chemically synthesized
aatcacttgaacatgggagg

SEQ ID NO: 38540 - DNA, 20 bp, Artificial Sequence
  chemically synthesized
gagaatcacttgaacatggg

SEQ ID NO: 38541 - DNA, 20 bp, Artificial Sequence
  chemically synthesized
tgagaatcacttgaacatgg

SEQ ID NO: 38542 - DNA, 20 bp, Artificial Sequence
  chemically synthesized
aacctccgcctcccatgttc

SEQ ID NO: 38543 - DNA, 20 bp, Artificial Sequence
  chemically synthesized
tatgagaatcacttgaacat

SEQ ID NO: 38544 - DNA, 20 bp, Artificial Sequence
  chemically synthesized
ttatgagaatcacttgaaca

SEQ ID NO: 38545 - DNA, 20 bp, Artificial Sequence
  chemically synthesized
ttcaagtgattctcataact

SEQ ID NO: 38546 - DNA, 20 bp, Artificial Sequence
  chemically synthesized
gtaatcccaggctgagttat

SEQ ID NO: 38547 - DNA, 20 bp, Artificial Sequence
  chemically synthesized
gtgattctcataactcagcc

SEQ ID NO: 38548 - DNA, 20 bp, Artificial Sequence
  chemically synthesized
tgattctcataactcagcct

SEQ ID NO: 38549 - DNA, 20 bp, Artificial Sequence
  chemically synthesized
cccagctgtaatcccaggct

SEQ ID NO: 38550 - DNA, 20 bp, Artificial Sequence
  chemically synthesized
cataactcagcctgggatta

SEQ ID NO: 38551 - DNA, 20 bp, Artificial Sequence
  chemically synthesized
gtaatcccagctgtaatccc

SEQ ID NO: 38552 - DNA, 20 bp, Artificial Sequence
  chemically synthesized
tgtaatcccagctgtaatcc

SEQ ID NO: 38553 - DNA, 20 bp, Artificial Sequence
  chemically synthesized
actcagcctgggattacagc

SEQ ID NO: 38554 - DNA, 20 bp, Artificial Sequence
  chemically synthesized
ctcagcctgggattacagct

SEQ ID NO: 38555 - DNA, 20 bp, Artificial Sequence
  chemically synthesized
tgggattacagctgggatta

SEQ ID NO: 38556 - DNA, 20 bp, Artificial Sequence
  chemically synthesized
gggattacagctgggattac

SEQ ID NO: 38557 - DNA, 20 bp, Artificial Sequence
  chemically synthesized
gcggcacatgcctgtaatcc

SEQ ID NO: 38558 - DNA, 20 bp, Artificial Sequence
  chemically synthesized
caggcatgtgccgccatgcc

SEQ ID NO: 38559 - DNA, 20 bp, Artificial Sequence
  chemically synthesized
caaaacttagccgggcatgg

SEQ ID NO: 38560 - DNA, 20 bp, Artificial Sequence
  chemically synthesized
atacaaaacttagccgggca

SEQ ID NO: 38561 - DNA, 20 bp, Artificial Sequence
  chemically synthesized
atgtgccgccatgcccggct

SEQ ID NO: 38562 - DNA, 20 bp, Artificial Sequence
  chemically synthesized
taaaaatacaaaacttagcc

SEQ ID NO: 38563 - DNA, 20 bp, Artificial Sequence
  chemically synthesized
ctaaaaatacaaaacttagc

SEQ ID NO: 38564 - DNA, 20 bp, Artificial Sequence
  chemically synthesized
tctactaaaaatacaaaact

SEQ ID NO: 38565 - DNA, 20 bp, Artificial Sequence
  chemically synthesized
ccggctaagttttgtatttt

SEQ ID NO: 38566 - DNA, 20 bp, Artificial Sequence
  chemically synthesized
gctaagttttgtatttttag

SEQ ID NO: 38567 - DNA, 20 bp, Artificial Sequence
  chemically synthesized
taagttttgtatttttagta

SEQ ID NO: 38568 - DNA, 20 bp, Artificial Sequence
  chemically synthesized
ttttgtatttttagtagaga

SEQ ID NO: 38569 - DNA, 20 bp, Artificial Sequence
  chemically synthesized
tttgtatttttagtagagac

SEQ ID NO: 38570 - DNA, 20 bp, Artificial Sequence
  chemically synthesized
agagacaggtttcgccatgt

SEQ ID NO: 38571 - DNA, 20 bp, Artificial Sequence
  chemically synthesized
acaggtttcgccatgttggc

SEQ ID NO: 38572 - DNA, 20 bp, Artificial Sequence
  chemically synthesized
ttagaccagcctggccaaca

SEQ ID NO: 38573 - DNA, 20 bp, Artificial Sequence
  chemically synthesized
caggtttcgccatgttggcc

SEQ ID NO: 38574 - DNA, 20 bp, Artificial Sequence
  chemically synthesized
tttcgccatgttggccaggc

SEQ ID NO: 38575 - DNA, 20 bp, Artificial Sequence
  chemically synthesized
ccaggaggtttagaccagcc

SEQ ID NO: 38576 - DNA, 20 bp, Artificial Sequence
  chemically synthesized
taatcccaggaggtttagac

SEQ ID NO: 38577 - DNA, 20 bp, Artificial Sequence
  chemically synthesized
ccaggctggtctaaacctcc

SEQ ID NO: 38578 - DNA, 20 bp, Artificial Sequence
  chemically synthesized
tcgcttaatcccaggaggtt

SEQ ID NO: 38579 - DNA, 20 bp, Artificial Sequence
  chemically synthesized
caggctggtctaaacctcct

SEQ ID NO: 38580 - DNA, 20 bp, Artificial Sequence
  chemically synthesized
gcagatcgcttaatcccagg

SEQ ID NO: 38581 - DNA, 20 bp, Artificial Sequence
  chemically synthesized
ggcagatcgcttaatcccag

SEQ ID NO: 38582 - DNA, 20 bp, Artificial Sequence
  chemically synthesized
ggtctaaacctcctgggatt

SEQ ID NO: 38583 - DNA, 20 bp, Artificial Sequence
  chemically synthesized
agggcagatcgcttaatccc

SEQ ID NO: 38584 - DNA, 20 bp, Artificial Sequence
  chemically synthesized
gagggcagatcgcttaatcc

SEQ ID NO: 38585 - DNA, 20 bp, Artificial Sequence
  chemically synthesized
attaagcgatctgccctcct

SEQ ID NO: 38586 - DNA, 20 bp, Artificial Sequence
  chemically synthesized
ctttgggaggccgaggaggg

SEQ ID NO: 38587 - DNA, 20 bp, Artificial Sequence
  chemically synthesized
aggctttgggaggccgagga

SEQ ID NO: 38588 - DNA, 20 bp, Artificial Sequence
  chemically synthesized
caggctttgggaggccgagg

SEQ ID NO: 38589 - DNA, 20 bp, Artificial Sequence
  chemically synthesized
acaggctttgggaggccgag

SEQ ID NO: 38590 - DNA, 20 bp, Artificial Sequence
  chemically synthesized
caacaggctttgggaggccg

SEQ ID NO: 38591 - DNA, 20 bp, Artificial Sequence
  chemically synthesized
ccaacaggctttgggaggcc

SEQ ID NO: 38592 - DNA, 20 bp, Artificial Sequence
  chemically synthesized
ctgccctcctcggcctccca

SEQ ID NO: 38593 - DNA, 20 bp, Artificial Sequence
  chemically synthesized
taatcccaacaggctttggg

SEQ ID NO: 38594 - DNA, 20 bp, Artificial Sequence
  chemically synthesized
gtaatcccaacaggctttgg

SEQ ID NO: 38595 - DNA, 20 bp, Artificial Sequence
  chemically synthesized
ctgtaatcccaacaggcttt

SEQ ID NO: 38596 - DNA, 20 bp, Artificial Sequence
  chemically synthesized
cctgtaatcccaacaggctt

SEQ ID NO: 38597 - DNA, 20 bp, Artificial Sequence
  chemically synthesized
ctcggcctcccaaagcctgt

SEQ ID NO: 38598 - DNA, 20 bp, Artificial Sequence
  chemically synthesized
tcggcctcccaaagcctgtt

SEQ ID NO: 38599 - DNA, 20 bp, Artificial Sequence
  chemically synthesized
cttaagcctgtaatcccaac

SEQ ID NO: 38600 - DNA, 20 bp, Artificial Sequence
  chemically synthesized
gcttaagcctgtaatcccaa

SEQ ID NO: 38601 - DNA, 20 bp, Artificial Sequence
  chemically synthesized
cccaaagcctgttgggatta

SEQ ID NO: 38602 - DNA, 20 bp, Artificial Sequence
  chemically synthesized
ccaaagcctgttgggattac

SEQ ID NO: 38603 - DNA, 20 bp, Artificial Sequence
  chemically synthesized
cctgttgggattacaggctt

SEQ ID NO: 38604 - DNA, 20 bp, Artificial Sequence
  chemically synthesized
agggacaggcatggtggctt

SEQ ID NO: 38605 - DNA, 20 bp, Artificial Sequence
  chemically synthesized
agaaacagggacaggcatgg

SEQ ID NO: 38606 - DNA, 20 bp, Artificial Sequence
  chemically synthesized
tggagaaacagggacaggca

SEQ ID NO: 38607 - DNA, 20 bp, Artificial Sequence
  chemically synthesized
caaagtggagaaacagggac

SEQ ID NO: 38608 - DNA, 20 bp, Artificial Sequence
  chemically synthesized
acaaagtggagaaacaggga

SEQ ID NO: 38609 - DNA, 20 bp, Artificial Sequence
  chemically synthesized
caatacaaagtggagaaaca

SEQ ID NO: 38610 - DNA, 20 bp, Artificial Sequence
  chemically synthesized
ccaatacaaagtggagaaac

SEQ ID NO: 38611 - DNA, 20 bp, Artificial Sequence
  chemically synthesized
tccaatacaaagtggagaaa

SEQ ID NO: 38612 - DNA, 20 bp, Artificial Sequence
  chemically synthesized
aagcattccaatacaaagtg

SEQ ID NO: 38613 - DNA, 20 bp, Artificial Sequence
  chemically synthesized
aaaagcattccaatacaaag

SEQ ID NO: 38614 - DNA, 20 bp, Artificial Sequence
  chemically synthesized
cctgtttctccactttgtat

SEQ ID NO: 38615 - DNA, 20 bp, Artificial Sequence
  chemically synthesized
aataaaagcattccaataca

SEQ ID NO: 38616 - DNA, 20 bp, Artificial Sequence
  chemically synthesized
aaaacatcatattcaaataa

SEQ ID NO: 38617 - DNA, 20 bp, Artificial Sequence
  chemically synthesized
tttatttgaatatgatgttt

SEQ ID NO: 38618 - DNA, 20 bp, Artificial Sequence
  chemically synthesized
tgatgttttagtacaaacca

SEQ ID NO: 38619 - DNA, 20 bp, Artificial Sequence
  chemically synthesized
ttttagtacaaaccacagcc

SEQ ID NO: 38620 - DNA, 20 bp, Artificial Sequence
  chemically synthesized
tttagtacaaaccacagcct

SEQ ID NO: 38621 - DNA, 20 bp, Artificial Sequence
  chemically synthesized
aacccaggcctcctaggctg

SEQ ID NO: 38622 - DNA, 20 bp, Artificial Sequence
  chemically synthesized
tagtacaaaccacagcctag

SEQ ID NO: 38623 - DNA, 20 bp, Artificial Sequence
  chemically synthesized
agtacaaaccacagcctagg

SEQ ID NO: 38624 - DNA, 20 bp, Artificial Sequence
  chemically synthesized
ctttaaaacccaggcctcct

SEQ ID NO: 38625 - DNA, 20 bp, Artificial Sequence
  chemically synthesized
aaaccacagcctaggaggcc

SEQ ID NO: 38626 - DNA, 20 bp, Artificial Sequence
  chemically synthesized
actttaaaacccaggcctcc

SEQ ID NO: 38627 - DNA, 20 bp, Artificial Sequence
  chemically synthesized
aaccacagcctaggaggcct

SEQ ID NO: 38628 - DNA, 20 bp, Artificial Sequence
  chemically synthesized
tattagttactttaaaaccc

SEQ ID NO: 38629 - DNA, 20 bp, Artificial Sequence
  chemically synthesized
cctaggaggcctgggtttta

SEQ ID NO: 38630 - DNA, 20 bp, Artificial Sequence
  chemically synthesized
atattagttactttaaaacc

SEQ ID NO: 38631 - DNA, 20 bp, Artificial Sequence
  chemically synthesized
tttaaagtaactaatattga

SEQ ID NO: 38632 - DNA, 20 bp, Artificial Sequence
  chemically synthesized
ggcatagtagccatcaatat

SEQ ID NO: 38633 - DNA, 20 bp, Artificial Sequence
  chemically synthesized
cttatacatagcaggcatag

SEQ ID NO: 38634 - DNA, 20 bp, Artificial Sequence
  chemically synthesized
acacttatacatagcaggca

SEQ ID NO: 38635 - DNA, 20 bp, Artificial Sequence
  chemically synthesized
acgttacacttatacatagc

SEQ ID NO: 38636 - DNA, 20 bp, Artificial Sequence
  chemically synthesized
tacgttacacttatacatag

SEQ ID NO: 38637 - DNA, 20 bp, Artificial Sequence
  chemically synthesized
ctactatgcctgctatgtat

SEQ ID NO: 38638 - DNA, 20 bp, Artificial Sequence
  chemically synthesized
gtgtacgttacacttataca

SEQ ID NO: 38639 - DNA, 20 bp, Artificial Sequence
  chemically synthesized
atgtataagtgtaacgtaca

SEQ ID NO: 38640 - DNA, 20 bp, Artificial Sequence
  chemically synthesized
tgtataagtgtaacgtacac

SEQ ID NO: 38641 - DNA, 20 bp, Artificial Sequence
  chemically synthesized
acgtacacaggttgaacata

SEQ ID NO: 38642 - DNA, 20 bp, Artificial Sequence
  chemically synthesized
gtacacaggttgaacataaa

SEQ ID NO: 38643 - DNA, 20 bp, Artificial Sequence
  chemically synthesized
tacacaggttgaacataaag

SEQ ID NO: 38644 - DNA, 20 bp, Artificial Sequence
  chemically synthesized
cacaggttgaacataaagag

SEQ ID NO: 38645 - DNA, 20 bp, Artificial Sequence
  chemically synthesized
acaggttgaacataaagagg

SEQ ID NO: 38646 - DNA, 20 bp, Artificial Sequence
  chemically synthesized
ataaagaggaggtttcacat

SEQ ID NO: 38647 - DNA, 20 bp, Artificial Sequence
  chemically synthesized
ggtttcacataagaatatta

SEQ ID NO: 38648 - DNA, 20 bp, Artificial Sequence
  chemically synthesized
gtttcacataagaatattat

SEQ ID NO: 38649 - DNA, 20 bp, Artificial Sequence
  chemically synthesized
ttcacataagaatattatag

SEQ ID NO: 38650 - DNA, 20 bp, Artificial Sequence
  chemically synthesized
tcacataagaatattatagg

SEQ ID NO: 38651 - DNA, 20 bp, Artificial Sequence
  chemically synthesized
tataggaggtatcgtgacct

SEQ ID NO: 38652 - DNA, 20 bp, Artificial Sequence
  chemically synthesized
acagatgtacagatgttcta

SEQ ID NO: 38653 - DNA, 20 bp, Artificial Sequence
  chemically synthesized
tacagatgtacagatgttct

SEQ ID NO: 38654 - DNA, 20 bp, Artificial Sequence
  chemically synthesized
ggttccattatacagatgta

SEQ ID NO: 38655 - DNA, 20 bp, Artificial Sequence
  chemically synthesized
acatctgtacatctgtataa

SEQ ID NO: 38656 - DNA, 20 bp, Artificial Sequence
  chemically synthesized
aagaaataggttccattata

SEQ ID NO: 38657 - DNA, 20 bp, Artificial Sequence
  chemically synthesized
tggggtctaatgaaagaaat

SEQ ID NO: 38658 - DNA, 20 bp, Artificial Sequence
  chemically synthesized
ttggggtctaatgaaagaaa

SEQ ID NO: 38659 - DNA, 20 bp, Artificial Sequence
  chemically synthesized
atggaacctatttctttcat

SEQ ID NO: 38660 - DNA, 20 bp, Artificial Sequence
  chemically synthesized
ttcagattggggtctaatga

SEQ ID NO: 38661 - DNA, 20 bp, Artificial Sequence
  chemically synthesized
acagagaaattttcagattg

SEQ ID NO: 38662 - DNA, 20 bp, Artificial Sequence
  chemically synthesized
gacagagaaattttcagatt

SEQ ID NO: 38663 - DNA, 20 bp, Artificial Sequence
  chemically synthesized
agacagagaaattttcagat

SEQ ID NO: 38664 - DNA, 20 bp, Artificial Sequence
  chemically synthesized
ttggcagacagagaaatttt

SEQ ID NO: 38665 - DNA, 20 bp, Artificial Sequence
  chemically synthesized
tctgtttcttttggcagaca

SEQ ID NO: 38666 - DNA, 20 bp, Artificial Sequence
  chemically synthesized
tctctgtttcttttggcaga

SEQ ID NO: 38667 - DNA, 20 bp, Artificial Sequence
  chemically synthesized
aaaatttctctgtctgccaa

SEQ ID NO: 38668 - DNA, 20 bp, Artificial Sequence
  chemically synthesized
ggattctctgtttcttttgg

SEQ ID NO: 38669 - DNA, 20 bp, Artificial Sequence
  chemically synthesized
tctctgtctgccaaaagaaa

SEQ ID NO: 38670 - DNA, 20 bp, Artificial Sequence
  chemically synthesized
gaaggattctctgtttcttt

SEQ ID NO: 38671 - DNA, 20 bp, Artificial Sequence
  chemically synthesized
tctgtctgccaaaagaaaca

SEQ ID NO: 38672 - DNA, 20 bp, Artificial Sequence
  chemically synthesized
tcttgcgttgtgggagtaga

SEQ ID NO: 38673 - DNA, 20 bp, Artificial Sequence
  chemically synthesized
ctcttgcgttgtgggagtag

SEQ ID NO: 38674 - DNA, 20 bp, Artificial Sequence
  chemically synthesized
cctctcttgcgttgtgggag

SEQ ID NO: 38675 - DNA, 20 bp, Artificial Sequence
  chemically synthesized
tttcctctcttgcgttgtgg

SEQ ID NO: 38676 - DNA, 20 bp, Artificial Sequence
  chemically synthesized
tccttctactcccacaacgc

SEQ ID NO: 38677 - DNA, 20 bp, Artificial Sequence
  chemically synthesized
cttttcctctcttgcgttgt

SEQ ID NO: 38678 - DNA, 20 bp, Artificial Sequence
  chemically synthesized
tcttttcctctcttgcgttg

SEQ ID NO: 38679 - DNA, 20 bp, Artificial Sequence
  chemically synthesized
cttctactcccacaacgcaa

SEQ ID NO: 38680 - DNA, 20 bp, Artificial Sequence
  chemically synthesized
tctactcccacaacgcaaga

SEQ ID NO: 38681 - DNA, 20 bp, Artificial Sequence
  chemically synthesized
ctactcccacaacgcaagag

SEQ ID NO: 38682 - DNA, 20 bp, Artificial Sequence
  chemically synthesized
cccacaacgcaagagaggaa

SEQ ID NO: 38683 - DNA, 20 bp, Artificial Sequence
  chemically synthesized
ggaaaagaaaaacacattct

SEQ ID NO: 38684 - DNA, 20 bp, Artificial Sequence
  chemically synthesized
aaagaaaaacacattctaag

SEQ ID NO: 38685 - DNA, 20 bp, Artificial Sequence
  chemically synthesized
aaaaacacattctaagtggc

SEQ ID NO: 38686 - DNA, 20 bp, Artificial Sequence
  chemically synthesized
gctgccagttacttgccact

SEQ ID NO: 38687 - DNA, 20 bp, Artificial Sequence
  chemically synthesized
cattctaagtggcaagtaac

SEQ ID NO: 38688 - DNA, 20 bp, Artificial Sequence
  chemically synthesized
tctaagtggcaagtaactgg

SEQ ID NO: 38689 - DNA, 20 bp, Artificial Sequence
  chemically synthesized
aagtggcaagtaactggcag

SEQ ID NO: 38690 - DNA, 20 bp, Artificial Sequence
  chemically synthesized
agtggcaagtaactggcagc

SEQ ID NO: 38691 - DNA, 20 bp, Artificial Sequence
  chemically synthesized
ttatacaaagtgcctgctgc

SEQ ID NO: 38692 - DNA, 20 bp, Artificial Sequence
  chemically synthesized
ctacttttggtatttataca

SEQ ID NO: 38693 - DNA, 20 bp, Artificial Sequence
  chemically synthesized
gcactttgtataaataccaa

SEQ ID NO: 38694 - DNA, 20 bp, Artificial Sequence
  chemically synthesized
ctttgtataaataccaaaag

SEQ ID NO: 38695 - DNA, 20 bp, Artificial Sequence
  chemically synthesized
gtgctaacgcgtgctacttt

SEQ ID NO: 38696 - DNA, 20 bp, Artificial Sequence
  chemically synthesized
ataccaaaagtagcacgcgt

SEQ ID NO: 38697 - DNA, 20 bp, Artificial Sequence
  chemically synthesized
aagtgcaggtttgaaataag

SEQ ID NO: 38698 - DNA, 20 bp, Artificial Sequence
  chemically synthesized
ccaagtgcaggtttgaaata

SEQ ID NO: 38699 - DNA, 20 bp, Artificial Sequence
  chemically synthesized
tccaagtgcaggtttgaaat

SEQ ID NO: 38700 - DNA, 20 bp, Artificial Sequence
  chemically synthesized
ccttatttcaaacctgcact

SEQ ID NO: 38701 - DNA, 20 bp, Artificial Sequence
  chemically synthesized
tctgcagttgttccaagtgc

SEQ ID NO: 38702 - DNA, 20 bp, Artificial Sequence
  chemically synthesized
atctgcagttgttccaagtg

SEQ ID NO: 38703 - DNA, 20 bp, Artificial Sequence
  chemically synthesized
tctctatctgcagttgttcc

SEQ ID NO: 38704 - DNA, 20 bp, Artificial Sequence
  chemically synthesized
acctgcacttggaacaactg

SEQ ID NO: 38705 - DNA, 20 bp, Artificial Sequence
  chemically synthesized
gcacttggaacaactgcaga

SEQ ID NO: 38706 - DNA, 20 bp, Artificial Sequence
  chemically synthesized
acttggaacaactgcagata

SEQ ID NO: 38707 - DNA, 20 bp, Artificial Sequence
  chemically synthesized
gaattattagtctctatctg

SEQ ID NO: 38708 - DNA, 20 bp, Artificial Sequence
  chemically synthesized
tacacattgacaagaattat

SEQ ID NO: 38709 - DNA, 20 bp, Artificial Sequence
  chemically synthesized
agcttttaatacacattgac

SEQ ID NO: 38710 - DNA, 20 bp, Artificial Sequence
  chemically synthesized
ttcttgtcaatgtgtattaa

SEQ ID NO: 38711 - DNA, 20 bp, Artificial Sequence
  chemically synthesized
atgtgtattaaaagctctga

SEQ ID NO: 38712 - DNA, 20 bp, Artificial Sequence
  chemically synthesized
tgtgtattaaaagctctgac

SEQ ID NO: 38713 - DNA, 20 bp, Artificial Sequence
  chemically synthesized
tgtattaaaagctctgacag

SEQ ID NO: 38714 - DNA, 20 bp, Artificial Sequence
  chemically synthesized
caagttgttttctcctgtca

SEQ ID NO: 38715 - DNA, 20 bp, Artificial Sequence
  chemically synthesized
cacaagttgttttctcctgt

SEQ ID NO: 38716 - DNA, 20 bp, Artificial Sequence
  chemically synthesized
acaggagaaaacaacttgtg

SEQ ID NO: 38717 - DNA, 20 bp, Artificial Sequence
  chemically synthesized
ctttcaatcttgagctgcac

SEQ ID NO: 38718 - DNA, 20 bp, Artificial Sequence
  chemically synthesized
gaaaacaacttgtgcagctc

SEQ ID NO: 38719 - DNA, 20 bp, Artificial Sequence
  chemically synthesized
ttgtgctttctttcaatctt

SEQ ID NO: 38720 - DNA, 20 bp, Artificial Sequence
  chemically synthesized
cttgtgcagctcaagattga

SEQ ID NO: 38721 - DNA, 20 bp, Artificial Sequence
  chemically synthesized
tgcagctcaagattgaaaga

SEQ ID NO: 38722 - DNA, 20 bp, Artificial Sequence
  chemically synthesized
agattgaaagaaagcacaat

SEQ ID NO: 38723 - DNA, 20 bp, Artificial Sequence
  chemically synthesized
gattgaaagaaagcacaatg

SEQ ID NO: 38724 - DNA, 20 bp, Artificial Sequence
  chemically synthesized
ttgaaagaaagcacaatgag

SEQ ID NO: 38725 - DNA, 20 bp, Artificial Sequence
  chemically synthesized
tgaggagattcaattaaaac

SEQ ID NO: 38726 - DNA, 20 bp, Artificial Sequence
  chemically synthesized
attcaattaaaactggatga

SEQ ID NO: 38727 - DNA, 20 bp, Artificial Sequence
  chemically synthesized
ttcaattaaaactggatgat

SEQ ID NO: 38728 - DNA, 20 bp, Artificial Sequence
  chemically synthesized
tgctttcttctcccatcatc

SEQ ID NO: 38729 - DNA, 20 bp, Artificial Sequence
  chemically synthesized
caattaaaactggatgatgg

SEQ ID NO: 38730 - DNA, 20 bp, Artificial Sequence
  chemically synthesized
ttaaaactggatgatgggag

SEQ ID NO: 38731 - DNA, 20 bp, Artificial Sequence
  chemically synthesized
aactggatgatgggagaaga

SEQ ID NO: 38732 - DNA, 20 bp, Artificial Sequence
  chemically synthesized
ggagaagaaagcataatcta

SEQ ID NO: 38733 - DNA, 20 bp, Artificial Sequence
  chemically synthesized
gagaagaaagcataatctat

SEQ ID NO: 38734 - DNA, 20 bp, Artificial Sequence
  chemically synthesized
gaagaaagcataatctatag

SEQ ID NO: 38735 - DNA, 20 bp, Artificial Sequence
  chemically synthesized
aagaaagcataatctatagg

SEQ ID NO: 38736 - DNA, 20 bp, Artificial Sequence
  chemically synthesized
gatttatacctgtcctccta

SEQ ID NO: 38737 - DNA, 20 bp, Artificial Sequence
  chemically synthesized
aagcataatctataggagga

SEQ ID NO: 38738 - DNA, 20 bp, Artificial Sequence
  chemically synthesized
agcataatctataggaggac

SEQ ID NO: 38739 - DNA, 20 bp, Artificial Sequence
  chemically synthesized
actggacaaatcagaaaaag

SEQ ID NO: 38740 - DNA, 20 bp, Artificial Sequence
  chemically synthesized
gactggacaaatcagaaaaa

SEQ ID NO: 38741 - DNA, 20 bp, Artificial Sequence
  chemically synthesized
gagactggacaaatcagaaa

SEQ ID NO: 38742 - DNA, 20 bp, Artificial Sequence
  chemically synthesized
tcctctttttctgatttgtc

SEQ ID NO: 38743 - DNA, 20 bp, Artificial Sequence
  chemically synthesized
ttagtagagactggacaaat

SEQ ID NO: 38744 - DNA, 20 bp, Artificial Sequence
  chemically synthesized
caatctcttttagtagagac

SEQ ID NO: 38745 - DNA, 20 bp, Artificial Sequence
  chemically synthesized
atttgtccagtctctactaa

SEQ ID NO: 38746 - DNA, 20 bp, Artificial Sequence
  chemically synthesized
gctttcaatctcttttagta

SEQ ID NO: 38747 - DNA, 20 bp, Artificial Sequence
  chemically synthesized
ttgtccagtctctactaaaa

SEQ ID NO: 38748 - DNA, 20 bp, Artificial Sequence
  chemically synthesized
cagctttcaatctcttttag

SEQ ID NO: 38749 - DNA, 20 bp, Artificial Sequence
  chemically synthesized
tatcagctttcaatctcttt

SEQ ID NO: 38750 - DNA, 20 bp, Artificial Sequence
  chemically synthesized
tctctactaaaagagattga

SEQ ID NO: 38751 - DNA, 20 bp, Artificial Sequence
  chemically synthesized
aagagattgaaagctgatat

SEQ ID NO: 38752 - DNA, 20 bp, Artificial Sequence
  chemically synthesized
atggcaaaggattctgatat

SEQ ID NO: 38753 - DNA, 20 bp, Artificial Sequence
  chemically synthesized
gcctataactagcatggcaa

SEQ ID NO: 38754 - DNA, 20 bp, Artificial Sequence
  chemically synthesized
tgcctataactagcatggca

SEQ ID NO: 38755 - DNA, 20 bp, Artificial Sequence
  chemically synthesized
atcagaatcctttgccatgc

SEQ ID NO: 38756 - DNA, 20 bp, Artificial Sequence
  chemically synthesized
ataaatgcctataactagca

SEQ ID NO: 38757 - DNA, 20 bp, Artificial Sequence
  chemically synthesized
atcctttgccatgctagtta

SEQ ID NO: 38758 - DNA, 20 bp, Artificial Sequence
  chemically synthesized
tcctttgccatgctagttat

SEQ ID NO: 38759 - DNA, 20 bp, Artificial Sequence
  chemically synthesized
aataaataaatgcctataac

SEQ ID NO: 38760 - DNA, 20 bp, Artificial Sequence
  chemically synthesized
gttataggcatttatttatt

SEQ ID NO: 38761 - DNA, 20 bp, Artificial Sequence
  chemically synthesized
ttataggcatttatttattt

SEQ ID NO: 38762 - DNA, 20 bp, Artificial Sequence
  chemically synthesized
tgaagcatgattatacataa

SEQ ID NO: 38763 - DNA, 20 bp, Artificial Sequence
  chemically synthesized
atttgctgtacacgtaattg

SEQ ID NO: 38764 - DNA, 20 bp, Artificial Sequence
  chemically synthesized
tcatgcttcaattacgtgta

SEQ ID NO: 38765 - DNA, 20 bp, Artificial Sequence
  chemically synthesized
tcaattacgtgtacagcaaa

SEQ ID NO: 38766 - DNA, 20 bp, Artificial Sequence
  chemically synthesized
tgacctcatgttatataaat

SEQ ID NO: 38767 - DNA, 20 bp, Artificial Sequence
  chemically synthesized
atttctcatttatataacat

SEQ ID NO: 38768 - DNA, 20 bp, Artificial Sequence
  chemically synthesized
tttctcatttatataacatg

SEQ ID NO: 38769 - DNA, 20 bp, Artificial Sequence
  chemically synthesized
tcatttatataacatgaggt

SEQ ID NO: 38770 - DNA, 20 bp, Artificial Sequence
  chemically synthesized
ggcaccagaaaagattcatt

SEQ ID NO: 38771 - DNA, 20 bp, Artificial Sequence
  chemically synthesized
aggcaccagaaaagattcat

SEQ ID NO: 38772 - DNA, 20 bp, Artificial Sequence
  chemically synthesized
cattcctaatgaatcttttc

SEQ ID NO: 38773 - DNA, 20 bp, Artificial Sequence
  chemically synthesized
gaggttttaaggcaccagaa

SEQ ID NO: 38774 - DNA, 20 bp, Artificial Sequence
  chemically synthesized
attgggaggttttaaggcac

SEQ ID NO: 38775 - DNA, 20 bp, Artificial Sequence
  chemically synthesized
tctttaattgggaggtttta

SEQ ID NO: 38776 - DNA, 20 bp, Artificial Sequence
  chemically synthesized
gtctttaattgggaggtttt

SEQ ID NO: 38777 - DNA, 20 bp, Artificial Sequence
  chemically synthesized
tgaaggagtctttaattggg

SEQ ID NO: 38778 - DNA, 20 bp, Artificial Sequence
  chemically synthesized
gccttaaaacctcccaatta

SEQ ID NO: 38779 - DNA, 20 bp, Artificial Sequence
  chemically synthesized
ttgaaggagtctttaattgg

SEQ ID NO: 38780 - DNA, 20 bp, Artificial Sequence
  chemically synthesized
atttgaaggagtctttaatt

SEQ ID NO: 38781 - DNA, 20 bp, Artificial Sequence
  chemically synthesized
tatttgaaggagtctttaat

SEQ ID NO: 38782 - DNA, 20 bp, Artificial Sequence
  chemically synthesized
tttgactggagtatttgaag

SEQ ID NO: 38783 - DNA, 20 bp, Artificial Sequence
  chemically synthesized
tctttgactggagtatttga

SEQ ID NO: 38784 - DNA, 20 bp, Artificial Sequence
  chemically synthesized
gtctttgactggagtatttg

SEQ ID NO: 38785 - DNA, 20 bp, Artificial Sequence
  chemically synthesized
aaagactccttcaaatactc

SEQ ID NO: 38786 - DNA, 20 bp, Artificial Sequence
  chemically synthesized
tccttcaaatactccagtca

SEQ ID NO: 38787 - DNA, 20 bp, Artificial Sequence
  chemically synthesized
ttaattggtgtctttgactg

SEQ ID NO: 38788 - DNA, 20 bp, Artificial Sequence
  chemically synthesized
ccttaattggtgtctttgac

SEQ ID NO: 38789 - DNA, 20 bp, Artificial Sequence
  chemically synthesized
tccagtcaaagacaccaatt

SEQ ID NO: 38790 - DNA, 20 bp, Artificial Sequence
  chemically synthesized
ccagtcaaagacaccaatta

SEQ ID NO: 38791 - DNA, 20 bp, Artificial Sequence
  chemically synthesized
tattaagaggaatccttaat

SEQ ID NO: 38792 - DNA, 20 bp, Artificial Sequence
  chemically synthesized
caattaaggattcctcttaa

SEQ ID NO: 38793 - DNA, 20 bp, Artificial Sequence
  chemically synthesized
ttggatatttatctattaag

SEQ ID NO: 38794 - DNA, 20 bp, Artificial Sequence
  chemically synthesized
tttggatatttatctattaa

SEQ ID NO: 38795 - DNA, 20 bp, Artificial Sequence
  chemically synthesized
ggtttggatatttatctatt

SEQ ID NO: 38796 - DNA, 20 bp, Artificial Sequence
  chemically synthesized
taatagataaatatccaaac

SEQ ID NO: 38797 - DNA, 20 bp, Artificial Sequence
  chemically synthesized
aatagataaatatccaaacc

SEQ ID NO: 38798 - DNA, 20 bp, Artificial Sequence
  chemically synthesized
attttgaggacagcctggtt

SEQ ID NO: 38799 - DNA, 20 bp, Artificial Sequence
  chemically synthesized
ttatcattttgaggacagcc

SEQ ID NO: 38800 - DNA, 20 bp, Artificial Sequence
  chemically synthesized
actggttatcattttgagga

SEQ ID NO: 38801 - DNA, 20 bp, Artificial Sequence
  chemically synthesized
tgacactggttatcattttg

SEQ ID NO: 38802 - DNA, 20 bp, Artificial Sequence
  chemically synthesized
ttgacactggttatcatttt

SEQ ID NO: 38803 - DNA, 20 bp, Artificial Sequence
  chemically synthesized
gctgtcctcaaaatgataac

SEQ ID NO: 38804 - DNA, 20 bp, Artificial Sequence
  chemically synthesized
tcaaaatgataaccagtgtc

SEQ ID NO: 38805 - DNA, 20 bp, Artificial Sequence
  chemically synthesized
gaacactggaatcttgacac

SEQ ID NO: 38806 - DNA, 20 bp, Artificial Sequence
  chemically synthesized
gataaccagtgtcaagattc

SEQ ID NO: 38807 - DNA, 20 bp, Artificial Sequence
  chemically synthesized
gatctgtcttttttgaacac

SEQ ID NO: 38808 - DNA, 20 bp, Artificial Sequence
  chemically synthesized
caagattccagtgttcaaaa

SEQ ID NO: 38809 - DNA, 20 bp, Artificial Sequence
  chemically synthesized
attccagtgttcaaaaaaga

SEQ ID NO: 38810 - DNA, 20 bp, Artificial Sequence
  chemically synthesized
agtgttcaaaaaagacagat

SEQ ID NO: 38811 - DNA, 20 bp, Artificial Sequence
  chemically synthesized
ttcaaaaaagacagatcagt

SEQ ID NO: 38812 - DNA, 20 bp, Artificial Sequence
  chemically synthesized
aaaaaagacagatcagtaag

SEQ ID NO: 38813 - DNA, 20 bp, Artificial Sequence
  chemically synthesized
agatcagtaagcagtctccc

SEQ ID NO: 38814 - DNA, 20 bp, Artificial Sequence
  chemically synthesized
cacacagtcaattggcttgg

SEQ ID NO: 38815 - DNA, 20 bp, Artificial Sequence
  chemically synthesized
ggcacacagtcaattggctt

SEQ ID NO: 38816 - DNA, 20 bp, Artificial Sequence
  chemically synthesized
tggcacacagtcaattggct

SEQ ID NO: 38817 - DNA, 20 bp, Artificial Sequence
  chemically synthesized
ggaattggcacacagtcaat

SEQ ID NO: 38818 - DNA, 20 bp, Artificial Sequence
  chemically synthesized
ccaagggtggaattggcaca

SEQ ID NO: 38819 - DNA, 20 bp, Artificial Sequence
  chemically synthesized
ccttcaaccaagggtggaat

SEQ ID NO: 38820 - DNA, 20 bp, Artificial Sequence
  chemically synthesized
ctgtgtgccaattccaccct

SEQ ID NO: 38821 - DNA, 20 bp, Artificial Sequence
  chemically synthesized
tctctcccttcaaccaaggg

SEQ ID NO: 38822 - DNA, 20 bp, Artificial Sequence
  chemically synthesized
gccaattccacccttggttg

SEQ ID NO: 38823 - DNA, 20 bp, Artificial Sequence
  chemically synthesized
ttttctctcccttcaaccaa

SEQ ID NO: 38824 - DNA, 20 bp, Artificial Sequence
  chemically synthesized
ccaattccacccttggttga

SEQ ID NO: 38825 - DNA, 20 bp, Artificial Sequence
  chemically synthesized
attttctctcccttcaacca

SEQ ID NO: 38826 - DNA, 20 bp, Artificial Sequence
  chemically synthesized
caattccacccttggttgaa

SEQ ID NO: 38827 - DNA, 20 bp, Artificial Sequence
  chemically synthesized
cattttctctcccttcaacc

SEQ ID NO: 38828 - DNA, 20 bp, Artificial Sequence
  chemically synthesized
attccacccttggttgaagg

SEQ ID NO: 38829 - DNA, 20 bp, Artificial Sequence
  chemically synthesized
tccacccttggttgaaggga

SEQ ID NO: 38830 - DNA, 20 bp, Artificial Sequence
  chemically synthesized
gggagagaaaatgattgctt

SEQ ID NO: 38831 - DNA, 20 bp, Artificial Sequence
  chemically synthesized
gagagaaaatgattgcttca

SEQ ID NO: 38832 - DNA, 20 bp, Artificial Sequence
  chemically synthesized
agaaaatgattgcttcagag

SEQ ID NO: 38833 - DNA, 20 bp, Artificial Sequence
  chemically synthesized
ccaccgttgcttctgctctg

SEQ ID NO: 38834 - DNA, 20 bp, Artificial Sequence
  chemically synthesized
aaatgattgcttcagagcag

SEQ ID NO: 38835 - DNA, 20 bp, Artificial Sequence
  chemically synthesized
ttgcttcagagcagaagcaa

SEQ ID NO: 38836 - DNA, 20 bp, Artificial Sequence
  chemically synthesized
cttcagagcagaagcaacgg

SEQ ID NO: 38837 - DNA, 20 bp, Artificial Sequence
  chemically synthesized
cagagcagaagcaacggtgg

SEQ ID NO: 38838 - DNA, 20 bp, Artificial Sequence
  chemically synthesized
agcagaagcaacggtggaag

SEQ ID NO: 38839 - DNA, 20 bp, Artificial Sequence
  chemically synthesized
agaagcaacggtggaagcag

SEQ ID NO: 38840 - DNA, 20 bp, Artificial Sequence
  chemically synthesized
aacggtggaagcagaagaaa

SEQ ID NO: 38841 - DNA, 20 bp, Artificial Sequence
  chemically synthesized
agaagaaacagacaaaaaaa

SEQ ID NO: 38842 - DNA, 20 bp, Artificial Sequence
  chemically synthesized
agaaacagacaaaaaaaaag

SEQ ID NO: 38843 - DNA, 20 bp, Artificial Sequence
  chemically synthesized
gaaacagacaaaaaaaaagt

SEQ ID NO: 38844 - DNA, 20 bp, Artificial Sequence
  chemically synthesized
aaacagacaaaaaaaaagtg

SEQ ID NO: 38845 - DNA, 20 bp, Artificial Sequence
  chemically synthesized
aacagacaaaaaaaaagtgg

SEQ ID NO: 38846 - DNA, 20 bp, Artificial Sequence
  chemically synthesized
agacaaaaaaaaagtggggg

SEQ ID NO: 38847 - DNA, 20 bp, Artificial Sequence
  chemically synthesized
gacaaaaaaaaagtgggggc

SEQ ID NO: 38848 - DNA, 20 bp, Artificial Sequence
  chemically synthesized
caaaaaaaaagtgggggcgg

SEQ ID NO: 38849 - DNA, 20 bp, Artificial Sequence
  chemically synthesized
aaaaaaaagtgggggcggga

SEQ ID NO: 38850 - DNA, 20 bp, Artificial Sequence
  chemically synthesized
aaaaaaagtgggggcgggag

SEQ ID NO: 38851 - DNA, 20 bp, Artificial Sequence
  chemically synthesized
aaaaagtgggggcgggagag

SEQ ID NO: 38852 - DNA, 20 bp, Artificial Sequence
  chemically synthesized
aaagtgggggcgggagagga

SEQ ID NO: 38853 - DNA, 20 bp, Artificial Sequence
  chemically synthesized
agtgggggcgggagaggaga

SEQ ID NO: 38854 - DNA, 20 bp, Artificial Sequence
  chemically synthesized
gtgggggcgggagaggagag

SEQ ID NO: 38855 - DNA, 20 bp, Artificial Sequence
  chemically synthesized
tgggggcgggagaggagaga

SEQ ID NO: 38856 - DNA, 20 bp, Artificial Sequence
  chemically synthesized
gcgggagaggagagagggtt

SEQ ID NO: 38857 - DNA, 20 bp, Artificial Sequence
  chemically synthesized
gagagagggttaagatgcaa

SEQ ID NO: 38858 - DNA, 20 bp, Artificial Sequence
  chemically synthesized
agagagggttaagatgcaat

SEQ ID NO: 38859 - DNA, 20 bp, Artificial Sequence
  chemically synthesized
agggttaagatgcaatggga

SEQ ID NO: 38860 - DNA, 20 bp, Artificial Sequence
  chemically synthesized
ttaagatgcaatgggacagt

SEQ ID NO: 38861 - DNA, 20 bp, Artificial Sequence
  chemically synthesized
aatgggacagtaagatgttg

SEQ ID NO: 38862 - DNA, 20 bp, Artificial Sequence
  chemically synthesized
tgggacagtaagatgttgtg

SEQ ID NO: 38863 - DNA, 20 bp, Artificial Sequence
  chemically synthesized
gacagtaagatgttgtggag

SEQ ID NO: 38864 - DNA, 20 bp, Artificial Sequence
  chemically synthesized
gttgtggagtagtgtgaacc

SEQ ID NO: 38865 - DNA, 20 bp, Artificial Sequence
  chemically synthesized
ctatttcccaattgatttcc

SEQ ID NO: 38866 - DNA, 20 bp, Artificial Sequence
  chemically synthesized
tctatttcccaattgatttc

SEQ ID NO: 38867 - DNA, 20 bp, Artificial Sequence
  chemically synthesized
gtgtgaacccggaaatcaat

SEQ ID NO: 38868 - DNA, 20 bp, Artificial Sequence
  chemically synthesized
tgtgaacccggaaatcaatt

SEQ ID NO: 38869 - DNA, 20 bp, Artificial Sequence
  chemically synthesized
cccggaaatcaattgggaaa

SEQ ID NO: 38870 - DNA, 20 bp, Artificial Sequence
  chemically synthesized
attgggaaatagaacatcaa

SEQ ID NO: 38871 - DNA, 20 bp, Artificial Sequence
  chemically synthesized
agaacatcaaaagaacacgc

SEQ ID NO: 38872 - DNA, 20 bp, Artificial Sequence
  chemically synthesized
aaagaacacgccagtatttt

SEQ ID NO: 38873 - DNA, 20 bp, Artificial Sequence
  chemically synthesized
aaacaaaaacccaaaaatac

SEQ ID NO: 38874 - DNA, 20 bp, Artificial Sequence
  chemically synthesized
aagaacacgccagtattttt

SEQ ID NO: 38875 - DNA, 20 bp, Artificial Sequence
  chemically synthesized
tttttgtttgctcctctcta

SEQ ID NO: 38876 - DNA, 20 bp, Artificial Sequence
  chemically synthesized
agaattttttctttagagag

SEQ ID NO: 38877 - DNA, 20 bp, Artificial Sequence
  chemically synthesized
acagaattttttctttagag

SEQ ID NO: 38878 - DNA, 20 bp, Artificial Sequence
  chemically synthesized
gacagaattttttctttaga

SEQ ID NO: 38879 - DNA, 20 bp, Artificial Sequence
  chemically synthesized
tagacagaattttttcttta

SEQ ID NO: 38880 - DNA, 20 bp, Artificial Sequence
  chemically synthesized
ggtagacagaattttttctt

SEQ ID NO: 38881 - DNA, 20 bp, Artificial Sequence
  chemically synthesized
agaaaaaattctgtctacct

SEQ ID NO: 38882 - DNA, 20 bp, Artificial Sequence
  chemically synthesized
aagtgcttgtctaaggtaga

SEQ ID NO: 38883 - DNA, 20 bp, Artificial Sequence
  chemically synthesized
ggtgaagtgcttgtctaagg

SEQ ID NO: 38884 - DNA, 20 bp, Artificial Sequence
  chemically synthesized
aaattctgtctaccttagac

SEQ ID NO: 38885 - DNA, 20 bp, Artificial Sequence
  chemically synthesized
actggtgaagtgcttgtcta

SEQ ID NO: 38886 - DNA, 20 bp, Artificial Sequence
  chemically synthesized
aactggtgaagtgcttgtct

SEQ ID NO: 38887 - DNA, 20 bp, Artificial Sequence
  chemically synthesized
accttagacaagcacttcac

SEQ ID NO: 38888 - DNA, 20 bp, Artificial Sequence
  chemically synthesized
tcccacagacttaactggtg

SEQ ID NO: 38889 - DNA, 20 bp, Artificial Sequence
  chemically synthesized
agacaagcacttcaccagtt

SEQ ID NO: 38890 - DNA, 20 bp, Artificial Sequence
  chemically synthesized
atgcttcccacagacttaac

SEQ ID NO: 38891 - DNA, 20 bp, Artificial Sequence
  chemically synthesized
cacttcaccagttaagtctg

SEQ ID NO: 38892 - DNA, 20 bp, Artificial Sequence
  chemically synthesized
acttcaccagttaagtctgt

SEQ ID NO: 38893 - DNA, 20 bp, Artificial Sequence
  chemically synthesized
tcaccagttaagtctgtggg

SEQ ID NO: 38894 - DNA, 20 bp, Artificial Sequence
  chemically synthesized
ccctaagtagatgcttccca

SEQ ID NO: 38895 - DNA, 20 bp, Artificial Sequence
  chemically synthesized
gtctgtgggaagcatctact

SEQ ID NO: 38896 - DNA, 20 bp, Artificial Sequence
  chemically synthesized
tctgtgggaagcatctactt

SEQ ID NO: 38897 - DNA, 20 bp, Artificial Sequence
  chemically synthesized
ctgtgggaagcatctactta

SEQ ID NO: 38898 - DNA, 20 bp, Artificial Sequence
  chemically synthesized
tgggaagcatctacttaggg

SEQ ID NO: 38899 - DNA, 20 bp, Artificial Sequence
  chemically synthesized
attggcctacctgccctaag

SEQ ID NO: 38900 - DNA, 20 bp, Artificial Sequence
  chemically synthesized
gggaagcatctacttagggc

SEQ ID NO: 38901 - DNA, 20 bp, Artificial Sequence
  chemically synthesized
ccaattggcctacctgccct

SEQ ID NO: 38902 - DNA, 20 bp, Artificial Sequence
  chemically synthesized
aagcatctacttagggcagg

SEQ ID NO: 38903 - DNA, 20 bp, Artificial Sequence
  chemically synthesized
agcatctacttagggcaggt

SEQ ID NO: 38904 - DNA, 20 bp, Artificial Sequence
  chemically synthesized
cttagggcaggtaggccaat

SEQ ID NO: 38905 - DNA, 20 bp, Artificial Sequence
  chemically synthesized
aaaagattgaagataccaat

SEQ ID NO: 38906 - DNA, 20 bp, Artificial Sequence
  chemically synthesized
taagcctttgaaaaagattg

SEQ ID NO: 38907 - DNA, 20 bp, Artificial Sequence
  chemically synthesized
ggtatcttcaatctttttca

SEQ ID NO: 38908 - DNA, 20 bp, Artificial Sequence
  chemically synthesized
gtatcttcaatctttttcaa

SEQ ID NO: 38909 - DNA, 20 bp, Artificial Sequence
  chemically synthesized
ctaaatttaagcctttgaaa

SEQ ID NO: 38910 - DNA, 20 bp, Artificial Sequence
  chemically synthesized
ctttttcaaaggcttaaatt

SEQ ID NO: 38911 - DNA, 20 bp, Artificial Sequence
  chemically synthesized
tttttcaaaggcttaaattt

SEQ ID NO: 38912 - DNA, 20 bp, Artificial Sequence
  chemically synthesized
tcctggatgtgcctaaattt

SEQ ID NO: 38913 - DNA, 20 bp, Artificial Sequence
  chemically synthesized
ggcttaaatttaggcacatc

SEQ ID NO: 38914 - DNA, 20 bp, Artificial Sequence
  chemically synthesized
gcttaaatttaggcacatcc

SEQ ID NO: 38915 - DNA, 20 bp, Artificial Sequence
  chemically synthesized
ttaaatttaggcacatccag

SEQ ID NO: 38916 - DNA, 20 bp, Artificial Sequence
  chemically synthesized
atttaggcacatccaggagt

SEQ ID NO: 38917 - DNA, 20 bp, Artificial Sequence
  chemically synthesized
gggaaggactttcttactcc

SEQ ID NO: 38918 - DNA, 20 bp, Artificial Sequence
  chemically synthesized
aggcacatccaggagtaaga

SEQ ID NO: 38919 - DNA, 20 bp, Artificial Sequence
  chemically synthesized
tcttgcacgtagtgaaggga

SEQ ID NO: 38920 - DNA, 20 bp, Artificial Sequence
  chemically synthesized
atcttgcacgtagtgaaggg

SEQ ID NO: 38921 - DNA, 20 bp, Artificial Sequence
  chemically synthesized
tttatcttgcacgtagtgaa

SEQ ID NO: 38922 - DNA, 20 bp, Artificial Sequence
  chemically synthesized
ctttatcttgcacgtagtga

SEQ ID NO: 38923 - DNA, 20 bp, Artificial Sequence
  chemically synthesized
gctttatcttgcacgtagtg

SEQ ID NO: 38924 - DNA, 20 bp, Artificial Sequence
  chemically synthesized
tccttcccttcactacgtgc

SEQ ID NO: 38925 - DNA, 20 bp, Artificial Sequence
  chemically synthesized
gaccagctttatcttgcacg

SEQ ID NO: 38926 - DNA, 20 bp, Artificial Sequence
  chemically synthesized
ccttcactacgtgcaagata

SEQ ID NO: 38927 - DNA, 20 bp, Artificial Sequence
  chemically synthesized
cactacgtgcaagataaagc

SEQ ID NO: 38928 - DNA, 20 bp, Artificial Sequence
  chemically synthesized
gctggggctcaacgattgac

SEQ ID NO: 38929 - DNA, 20 bp, Artificial Sequence
  chemically synthesized
gataaagctggtcaatcgtt

SEQ ID NO: 38930 - DNA, 20 bp, Artificial Sequence
  chemically synthesized
gctggtcaatcgttgagccc

SEQ ID NO: 38931 - DNA, 20 bp, Artificial Sequence
  chemically synthesized
acataaaatttagtcagctg

SEQ ID NO: 38932 - DNA, 20 bp, Artificial Sequence
  chemically synthesized
gacataaaatttagtcagct

SEQ ID NO: 38933 - DNA, 20 bp, Artificial Sequence
  chemically synthesized
tgacataaaatttagtcagc

SEQ ID NO: 38934 - DNA, 20 bp, Artificial Sequence
  chemically synthesized
tacctgacataaaatttagt

SEQ ID NO: 38935 - DNA, 20 bp, Artificial Sequence
  chemically synthesized
cctttacctgacataaaatt

SEQ ID NO: 38936 - DNA, 20 bp, Artificial Sequence
  chemically synthesized
cagctgactaaattttatgt

SEQ ID NO: 38937 - DNA, 20 bp, Artificial Sequence
  chemically synthesized
agctgactaaattttatgtc

SEQ ID NO: 38938 - DNA, 20 bp, Artificial Sequence
  chemically synthesized
actaaattttatgtcaggta

SEQ ID NO: 38939 - DNA, 20 bp, Artificial Sequence
  chemically synthesized
ctaaattttatgtcaggtaa

SEQ ID NO: 38940 - DNA, 20 bp, Artificial Sequence
  chemically synthesized
aattttatgtcaggtaaagg

SEQ ID NO: 38941 - DNA, 20 bp, Artificial Sequence
  chemically synthesized
gtcaggtaaaggaagcaatg

SEQ ID NO: 38942 - DNA, 20 bp, Artificial Sequence
  chemically synthesized
tcaggtaaaggaagcaatgt

SEQ ID NO: 38943 - DNA, 20 bp, Artificial Sequence
  chemically synthesized
tggttatctgataaattgtc

SEQ ID NO: 38944 - DNA, 20 bp, Artificial Sequence
  chemically synthesized
ttggttatctgataaattgt

SEQ ID NO: 38945 - DNA, 20 bp, Artificial Sequence
  chemically synthesized
gtatgttcccgacaatttat

SEQ ID NO: 38946 - DNA, 20 bp, Artificial Sequence
  chemically synthesized
cgacaatttatcagataacc

SEQ ID NO: 38947 - DNA, 20 bp, Artificial Sequence
  chemically synthesized
tatcttaatgggattgtact

SEQ ID NO: 38948 - DNA, 20 bp, Artificial Sequence
  chemically synthesized
taaccaagtacaatcccatt

SEQ ID NO: 38949 - DNA, 20 bp, Artificial Sequence
  chemically synthesized
actatagccgttatcttaat

SEQ ID NO: 38950 - DNA, 20 bp, Artificial Sequence
  chemically synthesized
gactatagccgttatcttaa

SEQ ID NO: 38951 - DNA, 20 bp, Artificial Sequence
  chemically synthesized
gtacaatcccattaagataa

SEQ ID NO: 38952 - DNA, 20 bp, Artificial Sequence
  chemically synthesized
tcccattaagataacggcta

SEQ ID NO: 38953 - DNA, 20 bp, Artificial Sequence
  chemically synthesized
agtcttcaattcaaggacta

SEQ ID NO: 38954 - DNA, 20 bp, Artificial Sequence
  chemically synthesized
cggctatagtccttgaattg

SEQ ID NO: 38955 - DNA, 20 bp, Artificial Sequence
  chemically synthesized
ccctataagtcttcaattca

SEQ ID NO: 38956 - DNA, 20 bp, Artificial Sequence
  chemically synthesized
gccctataagtcttcaattc

SEQ ID NO: 38957 - DNA, 20 bp, Artificial Sequence
  chemically synthesized
gtccttgaattgaagactta

SEQ ID NO: 38958 - DNA, 20 bp, Artificial Sequence
  chemically synthesized
tccttgaattgaagacttat

SEQ ID NO: 38959 - DNA, 20 bp, Artificial Sequence
  chemically synthesized
ccttgaattgaagacttata

SEQ ID NO: 38960 - DNA, 20 bp, Artificial Sequence
  chemically synthesized
ccacctctacatggccctat

SEQ ID NO: 38961 - DNA, 20 bp, Artificial Sequence
  chemically synthesized
tgaagacttatagggccatg

SEQ ID NO: 38962 - DNA, 20 bp, Artificial Sequence
  chemically synthesized
aagacttatagggccatgta

SEQ ID NO: 38963 - DNA, 20 bp, Artificial Sequence
  chemically synthesized
agacttatagggccatgtag

SEQ ID NO: 38964 - DNA, 20 bp, Artificial Sequence
  chemically synthesized
agacaaaagccacctctaca

SEQ ID NO: 38965 - DNA, 20 bp, Artificial Sequence
  chemically synthesized
cttatagggccatgtagagg

SEQ ID NO: 38966 - DNA, 20 bp, Artificial Sequence
  chemically synthesized
cctttgtcctttttagacaa

SEQ ID NO: 38967 - DNA, 20 bp, Artificial Sequence
  chemically synthesized
agaggtggcttttgtctaaa

SEQ ID NO: 38968 - DNA, 20 bp, Artificial Sequence
  chemically synthesized
gaggtggcttttgtctaaaa

SEQ ID NO: 38969 - DNA, 20 bp, Artificial Sequence
  chemically synthesized
ttcagttcctttgtcctttt

SEQ ID NO: 38970 - DNA, 20 bp, Artificial Sequence
  chemically synthesized
gcttttgtctaaaaaggaca

SEQ ID NO: 38971 - DNA, 20 bp, Artificial Sequence
  chemically synthesized
cttttgtctaaaaaggacaa

SEQ ID NO: 38972 - DNA, 20 bp, Artificial Sequence
  chemically synthesized
gacaaaggaactgaataatg

SEQ ID NO: 38973 - DNA, 20 bp, Artificial Sequence
  chemically synthesized
agagaactgaccacattatt

SEQ ID NO: 38974 - DNA, 20 bp, Artificial Sequence
  chemically synthesized
aaggaactgaataatgtggt

SEQ ID NO: 38975 - DNA, 20 bp, Artificial Sequence
  chemically synthesized
atgtggtcagttctctgcca

SEQ ID NO: 38976 - DNA, 20 bp, Artificial Sequence
  chemically synthesized
gtggtcagttctctgccaca

SEQ ID NO: 38977 - DNA, 20 bp, Artificial Sequence
  chemically synthesized
gtcttcatgtctctgtggca

SEQ ID NO: 38978 - DNA, 20 bp, Artificial Sequence
  chemically synthesized
tcgtcttcatgtctctgtgg

SEQ ID NO: 38979 - DNA, 20 bp, Artificial Sequence
  chemically synthesized
ggttcgtcttcatgtctctg

SEQ ID NO: 38980 - DNA, 20 bp, Artificial Sequence
  chemically synthesized
ttctctgccacagagacatg

SEQ ID NO: 38981 - DNA, 20 bp, Artificial Sequence
  chemically synthesized
cagagacatgaagacgaacc

SEQ ID NO: 38982 - DNA, 20 bp, Artificial Sequence
  chemically synthesized
gagacatgaagacgaaccaa

SEQ ID NO: 38983 - DNA, 20 bp, Artificial Sequence
  chemically synthesized
caaacacacataaaatctct

SEQ ID NO: 38984 - DNA, 20 bp, Artificial Sequence
  chemically synthesized
tgtgtgtttgctcattttgt

SEQ ID NO: 38985 - DNA, 20 bp, Artificial Sequence
  chemically synthesized
cctgttgtttctgacaaaat

SEQ ID NO: 38986 - DNA, 20 bp, Artificial Sequence
  chemically synthesized
gctcattttgtcagaaacaa

SEQ ID NO: 38987 - DNA, 20 bp, Artificial Sequence
  chemically synthesized
ctcattttgtcagaaacaac

SEQ ID NO: 38988 - DNA, 20 bp, Artificial Sequence
  chemically synthesized
caacaggtgacttaattaca

SEQ ID NO: 38989 - DNA, 20 bp, Artificial Sequence
  chemically synthesized
gaactgaagtctatgtaatt

SEQ ID NO: 38990 - DNA, 20 bp, Artificial Sequence
  chemically synthesized
tgacttaattacatagactt

SEQ ID NO: 38991 - DNA, 20 bp, Artificial Sequence
  chemically synthesized
attcttagcattttgaactg

SEQ ID NO: 38992 - DNA, 20 bp, Artificial Sequence
  chemically synthesized
agacttcagttcaaaatgct

SEQ ID NO: 38993 - DNA, 20 bp, Artificial Sequence
  chemically synthesized
tgtcagttgtcagttattct

SEQ ID NO: 38994 - DNA, 20 bp, Artificial Sequence
  chemically synthesized
cctccaaagttgtcagttgt

SEQ ID NO: 38995 - DNA, 20 bp, Artificial Sequence
  chemically synthesized
taactgacaactgacaactt

SEQ ID NO: 38996 - DNA, 20 bp, Artificial Sequence
  chemically synthesized
aatctgtcctccaaagttgt

SEQ ID NO: 38997 - DNA, 20 bp, Artificial Sequence
  chemically synthesized
actgacaactgacaactttg

SEQ ID NO: 38998 - DNA, 20 bp, Artificial Sequence
  chemically synthesized
ctgacaactgacaactttgg

SEQ ID NO: 38999 - DNA, 20 bp, Artificial Sequence
  chemically synthesized
caactgacaactttggagga

SEQ ID NO: 39000 - DNA, 20 bp, Artificial Sequence
  chemically synthesized
tggtaggaatctgtcctcca

SEQ ID NO: 39001 - DNA, 20 bp, Artificial Sequence
  chemically synthesized
tggaggacagattcctacca

SEQ ID NO: 39002 - DNA, 20 bp, Artificial Sequence
  chemically synthesized
actaatgtgattactttggt

SEQ ID NO: 39003 - DNA, 20 bp, Artificial Sequence
  chemically synthesized
cactaatgtgattactttgg

SEQ ID NO: 39004 - DNA, 20 bp, Artificial Sequence
  chemically synthesized
cagcactaatgtgattactt

SEQ ID NO: 39005 - DNA, 20 bp, Artificial Sequence
  chemically synthesized
tcctaccaaagtaatcacat

SEQ ID NO: 39006 - DNA, 20 bp, Artificial Sequence
  chemically synthesized
aatcacattagtgctgctct

SEQ ID NO: 39007 - DNA, 20 bp, Artificial Sequence
  chemically synthesized
actaattgaatgactgagag

SEQ ID NO: 39008 - DNA, 20 bp, Artificial Sequence
  chemically synthesized
taaactaattgaatgactga

SEQ ID NO: 39009 - DNA, 20 bp, Artificial Sequence
  chemically synthesized
cataaactaattgaatgact

SEQ ID NO: 39010 - DNA, 20 bp, Artificial Sequence
  chemically synthesized
gctgctctcagtcattcaat

SEQ ID NO: 39011 - DNA, 20 bp, Artificial Sequence
  chemically synthesized
ataaatgaataatcatataa

SEQ ID NO: 39012 - DNA, 20 bp, Artificial Sequence
  chemically synthesized
aaaacctaaaaataagattt

SEQ ID NO: 39013 - DNA, 20 bp, Artificial Sequence
  chemically synthesized
ataatccaaaatcttatttt

SEQ ID NO: 39014 - DNA, 20 bp, Artificial Sequence
  chemically synthesized
taatccaaaatcttattttt

SEQ ID NO: 39015 - DNA, 20 bp, Artificial Sequence
  chemically synthesized
tatacaaaaaacctaaaaat

SEQ ID NO: 39016 - DNA, 20 bp, Artificial Sequence
  chemically synthesized
aggttttttgtatatataac

SEQ ID NO: 39017 - DNA, 20 bp, Artificial Sequence
  chemically synthesized
ttgacagagagggttaatac

SEQ ID NO: 39018 - DNA, 20 bp, Artificial Sequence
  chemically synthesized
agcaaaaatgttgacagaga

SEQ ID NO: 39019 - DNA, 20 bp, Artificial Sequence
  chemically synthesized
aagcaaaaatgttgacagag

SEQ ID NO: 39020 - DNA, 20 bp, Artificial Sequence
  chemically synthesized
aaagcaaaaatgttgacaga

SEQ ID NO: 39021 - DNA, 20 bp, Artificial Sequence
  chemically synthesized
ggaaagcaaaaatgttgaca

SEQ ID NO: 39022 - DNA, 20 bp, Artificial Sequence
  chemically synthesized
aaggaaagcaaaaatgttga

SEQ ID NO: 39023 - DNA, 20 bp, Artificial Sequence
  chemically synthesized
caacatttttgctttcctta

SEQ ID NO: 39024 - DNA, 20 bp, Artificial Sequence
  chemically synthesized
ttcttatatttctttaagga

SEQ ID NO: 39025 - DNA, 20 bp, Artificial Sequence
  chemically synthesized
tatgttcttatatttcttta

SEQ ID NO: 39026 - DNA, 20 bp, Artificial Sequence
  chemically synthesized
ttatgttcttatatttcttt

SEQ ID NO: 39027 - DNA, 20 bp, Artificial Sequence
  chemically synthesized
tgctttccttaaagaaatat

SEQ ID NO: 39028 - DNA, 20 bp, Artificial Sequence
  chemically synthesized
aatataagaacataaaattt

SEQ ID NO: 39029 - DNA, 20 bp, Artificial Sequence
  chemically synthesized
aagaacataaaattttagtc

SEQ ID NO: 39030 - DNA, 20 bp, Artificial Sequence
  chemically synthesized
agaacataaaattttagtct

SEQ ID NO: 39031 - DNA, 20 bp, Artificial Sequence
  chemically synthesized
ataaaattttagtctaggtg

SEQ ID NO: 39032 - DNA, 20 bp, Artificial Sequence
  chemically synthesized
aaattttagtctaggtgtgg

SEQ ID NO: 39033 - DNA, 20 bp, Artificial Sequence
  chemically synthesized
cagatgtgagccgccacacc

SEQ ID NO: 39034 - DNA, 20 bp, Artificial Sequence
  chemically synthesized
cgtgccaggattacagatgt

SEQ ID NO: 39035 - DNA, 20 bp, Artificial Sequence
  chemically synthesized
gcggctcacatctgtaatcc

SEQ ID NO: 39036 - DNA, 20 bp, Artificial Sequence
  chemically synthesized
ctcccaacgtgccaggatta

SEQ ID NO: 39037 - DNA, 20 bp, Artificial Sequence
  chemically synthesized
catctgtaatcctggcacgt

SEQ ID NO: 39038 - DNA, 20 bp, Artificial Sequence
  chemically synthesized
cctcgacctcccaacgtgcc

SEQ ID NO: 39039 - DNA, 20 bp, Artificial Sequence
  chemically synthesized
atctgtaatcctggcacgtt

SEQ ID NO: 39040 - DNA, 20 bp, Artificial Sequence
  chemically synthesized
gcctcgacctcccaacgtgc

SEQ ID NO: 39041 - DNA, 20 bp, Artificial Sequence
  chemically synthesized
ctgtaatcctggcacgttgg

SEQ ID NO: 39042 - DNA, 20 bp, Artificial Sequence
  chemically synthesized
tgtaatcctggcacgttggg

SEQ ID NO: 39043 - DNA, 20 bp, Artificial Sequence
  chemically synthesized
tcctggcacgttgggaggtc

SEQ ID NO: 39044 - DNA, 20 bp, Artificial Sequence
  chemically synthesized
cctggcacgttgggaggtcg

SEQ ID NO: 39045 - DNA, 20 bp, Artificial Sequence
  chemically synthesized
ggcacgttgggaggtcgagg

SEQ ID NO: 39046 - DNA, 20 bp, Artificial Sequence
  chemically synthesized
gcacgttgggaggtcgaggc

SEQ ID NO: 39047 - DNA, 20 bp, Artificial Sequence
  chemically synthesized
cgttgggaggtcgaggcggg

SEQ ID NO: 39048 - DNA, 20 bp, Artificial Sequence
  chemically synthesized
tcgaggcgggtggatcatct

SEQ ID NO: 39049 - DNA, 20 bp, Artificial Sequence
  chemically synthesized
cgaggcgggtggatcatcta

SEQ ID NO: 39050 - DNA, 20 bp, Artificial Sequence
  chemically synthesized
gcgggtggatcatctaaggc

SEQ ID NO: 39051 - DNA, 20 bp, Artificial Sequence
  chemically synthesized
cgggtggatcatctaaggcc

SEQ ID NO: 39052 - DNA, 20 bp, Artificial Sequence
  chemically synthesized
ggtggatcatctaaggccag

SEQ ID NO: 39053 - DNA, 20 bp, Artificial Sequence
  chemically synthesized
tggtctcaaactcctggcct

SEQ ID NO: 39054 - DNA, 20 bp, Artificial Sequence
  chemically synthesized
tcatctaaggccaggagttt

SEQ ID NO: 39055 - DNA, 20 bp, Artificial Sequence
  chemically synthesized
ccaggttggtctcaaactcc

SEQ ID NO: 39056 - DNA, 20 bp, Artificial Sequence
  chemically synthesized
ccaggagtttgagaccaacc

SEQ ID NO: 39057 - DNA, 20 bp, Artificial Sequence
  chemically synthesized
tttcaccatgttggccaggt

SEQ ID NO: 39058 - DNA, 20 bp, Artificial Sequence
  chemically synthesized
agagtttcaccatgttggcc

SEQ ID NO: 39059 - DNA, 20 bp, Artificial Sequence
  chemically synthesized
tgagaccaacctggccaaca

SEQ ID NO: 39060 - DNA, 20 bp, Artificial Sequence
  chemically synthesized
tagagtttcaccatgttggc

SEQ ID NO: 39061 - DNA, 20 bp, Artificial Sequence
  chemically synthesized
gagatagagtttcaccatgt

SEQ ID NO: 39062 - DNA, 20 bp, Artificial Sequence
  chemically synthesized
tttgtatttttatagagata

SEQ ID NO: 39063 - DNA, 20 bp, Artificial Sequence
  chemically synthesized
tttttgtatttttatagaga

SEQ ID NO: 39064 - DNA, 20 bp, Artificial Sequence
  chemically synthesized
ctaatttttgtatttttata

SEQ ID NO: 39065 - DNA, 20 bp, Artificial Sequence
  chemically synthesized
agctaatttttgtattttta

SEQ ID NO: 39066 - DNA, 20 bp, Artificial Sequence
  chemically synthesized
ctctataaaaatacaaaaat

SEQ ID NO: 39067 - DNA, 20 bp, Artificial Sequence
  chemically synthesized
ataaaaatacaaaaattagc

SEQ ID NO: 39068 - DNA, 20 bp, Artificial Sequence
  chemically synthesized
taaaaatacaaaaattagct

SEQ ID NO: 39069 - DNA, 20 bp, Artificial Sequence
  chemically synthesized
caaaaattagctgggcatga

SEQ ID NO: 39070 - DNA, 20 bp, Artificial Sequence
  chemically synthesized
caggcacccgccatcatgcc

SEQ ID NO: 39071 - DNA, 20 bp, Artificial Sequence
  chemically synthesized
aaattagctgggcatgatgg

SEQ ID NO: 39072 - DNA, 20 bp, Artificial Sequence
  chemically synthesized
aattagctgggcatgatggc

SEQ ID NO: 39073 - DNA, 20 bp, Artificial Sequence
  chemically synthesized
atggcgggtgcctgtaatcc

SEQ ID NO: 39074 - DNA, 20 bp, Artificial Sequence
  chemically synthesized
tctcgagtggctgggattac

SEQ ID NO: 39075 - DNA, 20 bp, Artificial Sequence
  chemically synthesized
ctctcgagtggctgggatta

SEQ ID NO: 39076 - DNA, 20 bp, Artificial Sequence
  chemically synthesized
cctcagcctctcgagtggct

SEQ ID NO: 39077 - DNA, 20 bp, Artificial Sequence
  chemically synthesized
gcctgtaatcccagccactc

SEQ ID NO: 39078 - DNA, 20 bp, Artificial Sequence
  chemically synthesized
gcctcagcctctcgagtggc

SEQ ID NO: 39079 - DNA, 20 bp, Artificial Sequence
  chemically synthesized
ctgtaatcccagccactcga

SEQ ID NO: 39080 - DNA, 20 bp, Artificial Sequence
  chemically synthesized
tgtaatcccagccactcgag

SEQ ID NO: 39081 - DNA, 20 bp, Artificial Sequence
  chemically synthesized
tcccgcctcagcctctcgag

SEQ ID NO: 39082 - DNA, 20 bp, Artificial Sequence
  chemically synthesized
ttctcccgcctcagcctctc

SEQ ID NO: 39083 - DNA, 20 bp, Artificial Sequence
  chemically synthesized
tcccagccactcgagaggct

SEQ ID NO: 39084 - DNA, 20 bp, Artificial Sequence
  chemically synthesized
cccagccactcgagaggctg

SEQ ID NO: 39085 - DNA, 20 bp, Artificial Sequence
  chemically synthesized
agccactcgagaggctgagg

SEQ ID NO: 39086 - DNA, 20 bp, Artificial Sequence
  chemically synthesized
gccactcgagaggctgaggc

SEQ ID NO: 39087 - DNA, 20 bp, Artificial Sequence
  chemically synthesized
cactcgagaggctgaggcgg

SEQ ID NO: 39088 - DNA, 20 bp, Artificial Sequence
  chemically synthesized
ttcaagtgattctcccgcct

SEQ ID NO: 39089 - DNA, 20 bp, Artificial Sequence
  chemically synthesized
gcgggagaatcacttgaacc

SEQ ID NO: 39090 - DNA, 20 bp, Artificial Sequence
  chemically synthesized
aacctccacctgctgggttc

SEQ ID NO: 39091 - DNA, 20 bp, Artificial Sequence
  chemically synthesized
ggagaatcacttgaacccag

SEQ ID NO: 39092 - DNA, 20 bp, Artificial Sequence
  chemically synthesized
gagaatcacttgaacccagc

SEQ ID NO: 39093 - DNA, 20 bp, Artificial Sequence
  chemically synthesized
aatcacttgaacccagcagg

SEQ ID NO: 39094 - DNA, 20 bp, Artificial Sequence
  chemically synthesized
gactgcaacctccacctgct

SEQ ID NO: 39095 - DNA, 20 bp, Artificial Sequence
  chemically synthesized
tcacttgaacccagcaggtg

SEQ ID NO: 39096 - DNA, 20 bp, Artificial Sequence
  chemically synthesized
ggactgcaacctccacctgc

SEQ ID NO: 39097 - DNA, 20 bp, Artificial Sequence
  chemically synthesized
cacttgaacccagcaggtgg

SEQ ID NO: 39098 - DNA, 20 bp, Artificial Sequence
  chemically synthesized
aacccagcaggtggaggttg

SEQ ID NO: 39099 - DNA, 20 bp, Artificial Sequence
  chemically synthesized
tcacccaggctggagtgcag

SEQ ID NO: 39100 - DNA, 20 bp, Artificial Sequence
  chemically synthesized
ggttgcagtccactgcactc

SEQ ID NO: 39101 - DNA, 20 bp, Artificial Sequence
  chemically synthesized
ctgtcacccaggctggagtg

SEQ ID NO: 39102 - DNA, 20 bp, Artificial Sequence
  chemically synthesized
cagtccactgcactccagcc

SEQ ID NO: 39103 - DNA, 20 bp, Artificial Sequence
  chemically synthesized
agtccactgcactccagcct

SEQ ID NO: 39104 - DNA, 20 bp, Artificial Sequence
  chemically synthesized
ttgctctgtcacccaggctg

SEQ ID NO: 39105 - DNA, 20 bp, Artificial Sequence
  chemically synthesized
ttttgctctgtcacccaggc

SEQ ID NO: 39106 - DNA, 20 bp, Artificial Sequence
  chemically synthesized
ctgcactccagcctgggtga

SEQ ID NO: 39107 - DNA, 20 bp, Artificial Sequence
  chemically synthesized
ttttttttgctctgtcaccc

SEQ ID NO: 39108 - DNA, 20 bp, Artificial Sequence
  chemically synthesized
gcactccagcctgggtgaca

SEQ ID NO: 39109 - DNA, 20 bp, Artificial Sequence
  chemically synthesized
tttttttttgctctgtcacc

SEQ ID NO: 39110 - DNA, 20 bp, Artificial Sequence
  chemically synthesized
tgatttttttttttttgaga

SEQ ID NO: 39111 - DNA, 20 bp, Artificial Sequence
  chemically synthesized
attttgattttttttttttt

SEQ ID NO: 39112 - DNA, 20 bp, Artificial Sequence
  chemically synthesized
ataattataatggtatatca

SEQ ID NO: 39113 - DNA, 20 bp, Artificial Sequence
  chemically synthesized
aaataattataatggtatat

SEQ ID NO: 39114 - DNA, 20 bp, Artificial Sequence
  chemically synthesized
attacaataaataattataa

SEQ ID NO: 39115 - DNA, 20 bp, Artificial Sequence
  chemically synthesized
caaatacaattttgcttatt

SEQ ID NO: 39116 - DNA, 20 bp, Artificial Sequence
  chemically synthesized
aacgaacagaacaaccaaat

SEQ ID NO: 39117 - DNA, 20 bp, Artificial Sequence
  chemically synthesized
tgtactccatttacaacgaa

SEQ ID NO: 39118 - DNA, 20 bp, Artificial Sequence
  chemically synthesized
gttgttctgttcgttgtaaa

SEQ ID NO: 39119 - DNA, 20 bp, Artificial Sequence
  chemically synthesized
tgttctgttcgttgtaaatg

SEQ ID NO: 39120 - DNA, 20 bp, Artificial Sequence
  chemically synthesized
gatttagagctaacaaaaat

SEQ ID NO: 39121 - DNA, 20 bp, Artificial Sequence
  chemically synthesized
gtacaaattctaatttttgt

SEQ ID NO: 39122 - DNA, 20 bp, Artificial Sequence
  chemically synthesized
tacttttaaaatttgattta

SEQ ID NO: 39123 - DNA, 20 bp, Artificial Sequence
  chemically synthesized
tttacttttaaaatttgatt

SEQ ID NO: 39124 - DNA, 20 bp, Artificial Sequence
  chemically synthesized
agctctaaatcaaattttaa

SEQ ID NO: 39125 - DNA, 20 bp, Artificial Sequence
  chemically synthesized
aatcaaattttaaaagtaaa

SEQ ID NO: 39126 - DNA, 20 bp, Artificial Sequence
  chemically synthesized
aaaagtaaacagaatgttta

SEQ ID NO: 39127 - DNA, 20 bp, Artificial Sequence
  chemically synthesized
cttgttttaagtgttatgtt

SEQ ID NO: 39128 - DNA, 20 bp, Artificial Sequence
  chemically synthesized
cttaacataacacttaaaac

SEQ ID NO: 39129 - DNA, 20 bp, Artificial Sequence
  chemically synthesized
tttgctgttcatcttgtttt

SEQ ID NO: 39130 - DNA, 20 bp, Artificial Sequence
  chemically synthesized
aacacttaaaacaagatgaa

SEQ ID NO: 39131 - DNA, 20 bp, Artificial Sequence
  chemically synthesized
caagatgaacagcaaaatat

SEQ ID NO: 39132 - DNA, 20 bp, Artificial Sequence
  chemically synthesized
tgaacagcaaaatataagac

SEQ ID NO: 39133 - DNA, 20 bp, Artificial Sequence
  chemically synthesized
gaacagcaaaatataagacc

SEQ ID NO: 39134 - DNA, 20 bp, Artificial Sequence
  chemically synthesized
cagctcagtggattcaggcc

SEQ ID NO: 39135 - DNA, 20 bp, Artificial Sequence
  chemically synthesized
ggagacagctcagtggattc

SEQ ID NO: 39136 - DNA, 20 bp, Artificial Sequence
  chemically synthesized
aggagacagctcagtggatt

SEQ ID NO: 39137 - DNA, 20 bp, Artificial Sequence
  chemically synthesized
agaccaggcctgaatccact

SEQ ID NO: 39138 - DNA, 20 bp, Artificial Sequence
  chemically synthesized
tcatagaggagacagctcag

SEQ ID NO: 39139 - DNA, 20 bp, Artificial Sequence
  chemically synthesized
agttcatagaggagacagct

SEQ ID NO: 39140 - DNA, 20 bp, Artificial Sequence
  chemically synthesized
tatgaagttcatagaggaga

SEQ ID NO: 39141 - DNA, 20 bp, Artificial Sequence
  chemically synthesized
gccttatgaagttcatagag

SEQ ID NO: 39142 - DNA, 20 bp, Artificial Sequence
  chemically synthesized
atgccttatgaagttcatag

SEQ ID NO: 39143 - DNA, 20 bp, Artificial Sequence
  chemically synthesized
gatgccttatgaagttcata

SEQ ID NO: 39144 - DNA, 20 bp, Artificial Sequence
  chemically synthesized
aagatgccttatgaagttca

SEQ ID NO: 39145 - DNA, 20 bp, Artificial Sequence
  chemically synthesized
gtctcctctatgaacttcat

SEQ ID NO: 39146 - DNA, 20 bp, Artificial Sequence
  chemically synthesized
tctcctctatgaacttcata

SEQ ID NO: 39147 - DNA, 20 bp, Artificial Sequence
  chemically synthesized
tctatgtaagatgccttatg

SEQ ID NO: 39148 - DNA, 20 bp, Artificial Sequence
  chemically synthesized
acttcataaggcatcttaca

SEQ ID NO: 39149 - DNA, 20 bp, Artificial Sequence
  chemically synthesized
ttcataaggcatcttacata

SEQ ID NO: 39150 - DNA, 20 bp, Artificial Sequence
  chemically synthesized
tctgtctgcttactctatgt

SEQ ID NO: 39151 - DNA, 20 bp, Artificial Sequence
  chemically synthesized
taaggcatcttacatagagt

SEQ ID NO: 39152 - DNA, 20 bp, Artificial Sequence
  chemically synthesized
ggcatcttacatagagtaag

SEQ ID NO: 39153 - DNA, 20 bp, Artificial Sequence
  chemically synthesized
tcttacatagagtaagcaga

SEQ ID NO: 39154 - DNA, 20 bp, Artificial Sequence
  chemically synthesized
agagtaagcagacagacttc

SEQ ID NO: 39155 - DNA, 20 bp, Artificial Sequence
  chemically synthesized
ttttctaactgtaagtctgg

SEQ ID NO: 39156 - DNA, 20 bp, Artificial Sequence
  chemically synthesized
cagacagacttccagactta

SEQ ID NO: 39157 - DNA, 20 bp, Artificial Sequence
  chemically synthesized
gcattttctaactgtaagtc

SEQ ID NO: 39158 - DNA, 20 bp, Artificial Sequence
  chemically synthesized
cagacttccagacttacagt

SEQ ID NO: 39159 - DNA, 20 bp, Artificial Sequence
  chemically synthesized
aaccagcattttctaactgt

SEQ ID NO: 39160 - DNA, 20 bp, Artificial Sequence
  chemically synthesized
gacttacagttagaaaatgc

SEQ ID NO: 39161 - DNA, 20 bp, Artificial Sequence
  chemically synthesized
gttagagcccaggttcaaac

SEQ ID NO: 39162 - DNA, 20 bp, Artificial Sequence
  chemically synthesized
agaaaatgctggtttgaacc

SEQ ID NO: 39163 - DNA, 20 bp, Artificial Sequence
  chemically synthesized
gaaaatgctggtttgaacct

SEQ ID NO: 39164 - DNA, 20 bp, Artificial Sequence
  chemically synthesized
gtatcacagtgttagagccc

SEQ ID NO: 39165 - DNA, 20 bp, Artificial Sequence
  chemically synthesized
agtatcacagtgttagagcc

SEQ ID NO: 39166 - DNA, 20 bp, Artificial Sequence
  chemically synthesized
cccccagtatcacagtgtta

SEQ ID NO: 39167 - DNA, 20 bp, Artificial Sequence
  chemically synthesized
ttcccccagtatcacagtgt

SEQ ID NO: 39168 - DNA, 20 bp, Artificial Sequence
  chemically synthesized
gggctctaacactgtgatac

SEQ ID NO: 39169 - DNA, 20 bp, Artificial Sequence
  chemically synthesized
ggctctaacactgtgatact

SEQ ID NO: 39170 - DNA, 20 bp, Artificial Sequence
  chemically synthesized
ttttttttcccccagtatca

SEQ ID NO: 39171 - DNA, 20 bp, Artificial Sequence
  chemically synthesized
gctctaacactgtgatactg

SEQ ID NO: 39172 - DNA, 20 bp, Artificial Sequence
  chemically synthesized
ctctaacactgtgatactgg

SEQ ID NO: 39173 - DNA, 20 bp, Artificial Sequence
  chemically synthesized
ttatgtgattttttttcccc

SEQ ID NO: 39174 - DNA, 20 bp, Artificial Sequence
  chemically synthesized
acataatgtattgaaataat

SEQ ID NO: 39175 - DNA, 20 bp, Artificial Sequence
  chemically synthesized
aagtattgttgactataaaa

SEQ ID NO: 39176 - DNA, 20 bp, Artificial Sequence
  chemically synthesized
taggatagatttccatttta

SEQ ID NO: 39177 - DNA, 20 bp, Artificial Sequence
  chemically synthesized
atatcgtaaaatatgtagga

SEQ ID NO: 39178 - DNA, 20 bp, Artificial Sequence
  chemically synthesized
aagaatatcgtaaaatatgt

SEQ ID NO: 39179 - DNA, 20 bp, Artificial Sequence
  chemically synthesized
aaagaatatcgtaaaatatg

SEQ ID NO: 39180 - DNA, 20 bp, Artificial Sequence
  chemically synthesized
attacttcatttaattttaa

SEQ ID NO: 39181 - DNA, 20 bp, Artificial Sequence
  chemically synthesized
tattcttttaaaattaaatg

SEQ ID NO: 39182 - DNA, 20 bp, Artificial Sequence
  chemically synthesized
taatatatgcaactttatgt

SEQ ID NO: 39183 - DNA, 20 bp, Artificial Sequence
  chemically synthesized
ataaagtacctacttacata

SEQ ID NO: 39184 - DNA, 20 bp, Artificial Sequence
  chemically synthesized
tatatgcaactttatgtaag

SEQ ID NO: 39185 - DNA, 20 bp, Artificial Sequence
  chemically synthesized
atatgcaactttatgtaagt

SEQ ID NO: 39186 - DNA, 20 bp, Artificial Sequence
  chemically synthesized
taagtaggtactttataaac

SEQ ID NO: 39187 - DNA, 20 bp, Artificial Sequence
  chemically synthesized
atttaattttctagtttata

SEQ ID NO: 39188 - DNA, 20 bp, Artificial Sequence
  chemically synthesized
ttagcagttatttaattttc

SEQ ID NO: 39189 - DNA, 20 bp, Artificial Sequence
  chemically synthesized
taaactaaaaaataaattag

SEQ ID NO: 39190 - DNA, 20 bp, Artificial Sequence
  chemically synthesized
tactaaactaaaaaataaat

SEQ ID NO: 39191 - DNA, 20 bp, Artificial Sequence
  chemically synthesized
ataactgctaatttattttt

SEQ ID NO: 39192 - DNA, 20 bp, Artificial Sequence
  chemically synthesized
tgctaatttattttttagtt

SEQ ID NO: 39193 - DNA, 20 bp, Artificial Sequence
  chemically synthesized
atttattttttagtttagta

SEQ ID NO: 39194 - DNA, 20 bp, Artificial Sequence
  chemically synthesized
atagttaagtgatgtttttg

SEQ ID NO: 39195 - DNA, 20 bp, Artificial Sequence
  chemically synthesized
actatatttgatatatagtt

SEQ ID NO: 39196 - DNA, 20 bp, Artificial Sequence
  chemically synthesized
aagtgactatatttgatata

SEQ ID NO: 39197 - DNA, 20 bp, Artificial Sequence
  chemically synthesized
acttaactatatatcaaata

SEQ ID NO: 39198 - DNA, 20 bp, Artificial Sequence
  chemically synthesized
atatatcaaatatagtcact

SEQ ID NO: 39199 - DNA, 20 bp, Artificial Sequence
  chemically synthesized
tatatcaaatatagtcactt

SEQ ID NO: 39200 - DNA, 20 bp, Artificial Sequence
  chemically synthesized
aataaacagaataataacct

SEQ ID NO: 39201 - DNA, 20 bp, Artificial Sequence
  chemically synthesized
ataataataataataataaa

SEQ ID NO: 39202 - DNA, 20 bp, Artificial Sequence
  chemically synthesized
tattattattattattattt

SEQ ID NO: 39203 - DNA, 20 bp, Artificial Sequence
  chemically synthesized
attattattattatttgaga

SEQ ID NO: 39204 - DNA, 20 bp, Artificial Sequence
  chemically synthesized
tattattattatttgagaca

SEQ ID NO: 39205 - DNA, 20 bp, Artificial Sequence
  chemically synthesized
tccagcctgggcgacagagt

SEQ ID NO: 39206 - DNA, 20 bp, Artificial Sequence
  chemically synthesized
cagagtctcactctgtcgcc

SEQ ID NO: 39207 - DNA, 20 bp, Artificial Sequence
  chemically synthesized
gcactccagcctgggcgaca

SEQ ID NO: 39208 - DNA, 20 bp, Artificial Sequence
  chemically synthesized
agagtctcactctgtcgccc

SEQ ID NO: 39209 - DNA, 20 bp, Artificial Sequence
  chemically synthesized
ctgcactccagcctgggcga

SEQ ID NO: 39210 - DNA, 20 bp, Artificial Sequence
  chemically synthesized
tctcactctgtcgcccaggc

SEQ ID NO: 39211 - DNA, 20 bp, Artificial Sequence
  chemically synthesized
tcactctgtcgcccaggctg

SEQ ID NO: 39212 - DNA, 20 bp, Artificial Sequence
  chemically synthesized
atgccactgcactccagcct

SEQ ID NO: 39213 - DNA, 20 bp, Artificial Sequence
  chemically synthesized
catgccactgcactccagcc

SEQ ID NO: 39214 - DNA, 20 bp, Artificial Sequence
  chemically synthesized
ctgtcgcccaggctggagtg

SEQ ID NO: 39215 - DNA, 20 bp, Artificial Sequence
  chemically synthesized
gagatcatgccactgcactc

SEQ ID NO: 39216 - DNA, 20 bp, Artificial Sequence
  chemically synthesized
tcgcccaggctggagtgcag

SEQ ID NO: 39217 - DNA, 20 bp, Artificial Sequence
  chemically synthesized
ggcggaggttgcagtgagca

SEQ ID NO: 39218 - DNA, 20 bp, Artificial Sequence
  chemically synthesized
gaggcggaggttgcagtgag

SEQ ID NO: 39219 - DNA, 20 bp, Artificial Sequence
  chemically synthesized
caggaggcggaggttgcagt

SEQ ID NO: 39220 - DNA, 20 bp, Artificial Sequence
  chemically synthesized
aacccaggaggcggaggttg

SEQ ID NO: 39221 - DNA, 20 bp, Artificial Sequence
  chemically synthesized
tgcttgaacccaggaggcgg

SEQ ID NO: 39222 - DNA, 20 bp, Artificial Sequence
  chemically synthesized
tcactgcaacctccgcctcc

SEQ ID NO: 39223 - DNA, 20 bp, Artificial Sequence
  chemically synthesized
ttgcttgaacccaggaggcg

SEQ ID NO: 39224 - DNA, 20 bp, Artificial Sequence
  chemically synthesized
cactgcaacctccgcctcct

SEQ ID NO: 39225 - DNA, 20 bp, Artificial Sequence
  chemically synthesized
aattgcttgaacccaggagg

SEQ ID NO: 39226 - DNA, 20 bp, Artificial Sequence
  chemically synthesized
gagaattgcttgaacccagg

SEQ ID NO: 39227 - DNA, 20 bp, Artificial Sequence
  chemically synthesized
tgagaattgcttgaacccag

SEQ ID NO: 39228 - DNA, 20 bp, Artificial Sequence
  chemically synthesized
aacctccgcctcctgggttc

SEQ ID NO: 39229 - DNA, 20 bp, Artificial Sequence
  chemically synthesized
catgagaattgcttgaaccc

SEQ ID NO: 39230 - DNA, 20 bp, Artificial Sequence
  chemically synthesized
gcatgagaattgcttgaacc

SEQ ID NO: 39231 - DNA, 20 bp, Artificial Sequence
  chemically synthesized
ttcaagcaattctcatgcct

SEQ ID NO: 39232 - DNA, 20 bp, Artificial Sequence
  chemically synthesized
tactcgggaggctgaggcat

SEQ ID NO: 39233 - DNA, 20 bp, Artificial Sequence
  chemically synthesized
cccagctactcgggaggctg

SEQ ID NO: 39234 - DNA, 20 bp, Artificial Sequence
  chemically synthesized
tcccagctactcgggaggct

SEQ ID NO: 39235 - DNA, 20 bp, Artificial Sequence
  chemically synthesized
ttctcatgcctcagcctccc

SEQ ID NO: 39236 - DNA, 20 bp, Artificial Sequence
  chemically synthesized
tcatgcctcagcctcccgag

SEQ ID NO: 39237 - DNA, 20 bp, Artificial Sequence
  chemically synthesized
tgtaatcccagctactcggg

SEQ ID NO: 39238 - DNA, 20 bp, Artificial Sequence
  chemically synthesized
ctgtaatcccagctactcgg

SEQ ID NO: 39239 - DNA, 20 bp, Artificial Sequence
  chemically synthesized
gcctcagcctcccgagtagc

SEQ ID NO: 39240 - DNA, 20 bp, Artificial Sequence
  chemically synthesized
acctgtaatcccagctactc

SEQ ID NO: 39241 - DNA, 20 bp, Artificial Sequence
  chemically synthesized
cctcagcctcccgagtagct

SEQ ID NO: 39242 - DNA, 20 bp, Artificial Sequence
  chemically synthesized
cacctgtaatcccagctact

SEQ ID NO: 39243 - DNA, 20 bp, Artificial Sequence
  chemically synthesized
ctcccgagtagctgggatta

SEQ ID NO: 39244 - DNA, 20 bp, Artificial Sequence
  chemically synthesized
tcccgagtagctgggattac

SEQ ID NO: 39245 - DNA, 20 bp, Artificial Sequence
  chemically synthesized
gtggcgtgcacctgtaatcc

SEQ ID NO: 39246 - DNA, 20 bp, Artificial Sequence
  chemically synthesized
caggtgcacgccaccatgcc

SEQ ID NO: 39247 - DNA, 20 bp, Artificial Sequence
  chemically synthesized
taaaaatcagccaggcatgg

SEQ ID NO: 39248 - DNA, 20 bp, Artificial Sequence
  chemically synthesized
atataaaaatcagccaggca

SEQ ID NO: 39249 - DNA, 20 bp, Artificial Sequence
  chemically synthesized
taaaaatataaaaatcagcc

SEQ ID NO: 39250 - DNA, 20 bp, Artificial Sequence
  chemically synthesized
ctaaaaatataaaaatcagc

SEQ ID NO: 39251 - DNA, 20 bp, Artificial Sequence
  chemically synthesized
tctactaaaaatataaaaat

SEQ ID NO: 39252 - DNA, 20 bp, Artificial Sequence
  chemically synthesized
ctggctgatttttatatttt

SEQ ID NO: 39253 - DNA, 20 bp, Artificial Sequence
  chemically synthesized
gctgatttttatatttttag

SEQ ID NO: 39254 - DNA, 20 bp, Artificial Sequence
  chemically synthesized
tgatttttatatttttagta

SEQ ID NO: 39255 - DNA, 20 bp, Artificial Sequence
  chemically synthesized
ttttatatttttagtagaga

SEQ ID NO: 39256 - DNA, 20 bp, Artificial Sequence
  chemically synthesized
tttatatttttagtagagat

SEQ ID NO: 39257 - DNA, 20 bp, Artificial Sequence
  chemically synthesized
ttatatttttagtagagatg

SEQ ID NO: 39258 - DNA, 20 bp, Artificial Sequence
  chemically synthesized
tttttagtagagatggggtt

SEQ ID NO: 39259 - DNA, 20 bp, Artificial Sequence
  chemically synthesized
gagatggggtttagccatgt

SEQ ID NO: 39260 - DNA, 20 bp, Artificial Sequence
  chemically synthesized
tggggtttagccatgttggc

SEQ ID NO: 39261 - DNA, 20 bp, Artificial Sequence
  chemically synthesized
caagaccagcctggccaaca

SEQ ID NO: 39262 - DNA, 20 bp, Artificial Sequence
  chemically synthesized
ggggtttagccatgttggcc

SEQ ID NO: 39263 - DNA, 20 bp, Artificial Sequence
  chemically synthesized
tttagccatgttggccaggc

SEQ ID NO: 39264 - DNA, 20 bp, Artificial Sequence
  chemically synthesized
ccaggagttcaagaccagcc

SEQ ID NO: 39265 - DNA, 20 bp, Artificial Sequence
  chemically synthesized
tgatgccaggagttcaagac

SEQ ID NO: 39266 - DNA, 20 bp, Artificial Sequence
  chemically synthesized
ccaggctggtcttgaactcc

SEQ ID NO: 39267 - DNA, 20 bp, Artificial Sequence
  chemically synthesized
ttgcttgatgccaggagttc

SEQ ID NO: 39268 - DNA, 20 bp, Artificial Sequence
  chemically synthesized
ggtagattgcttgatgccag

SEQ ID NO: 39269 - DNA, 20 bp, Artificial Sequence
  chemically synthesized
ggtcttgaactcctggcatc

SEQ ID NO: 39270 - DNA, 20 bp, Artificial Sequence
  chemically synthesized
cgggtagattgcttgatgcc

SEQ ID NO: 39271 - DNA, 20 bp, Artificial Sequence
  chemically synthesized
gcgggtagattgcttgatgc

SEQ ID NO: 39272 - DNA, 20 bp, Artificial Sequence
  chemically synthesized
atcaagcaatctacccgcct

SEQ ID NO: 39273 - DNA, 20 bp, Artificial Sequence
  chemically synthesized
ctttgggaggccgaggcggg

SEQ ID NO: 39274 - DNA, 20 bp, Artificial Sequence
  chemically synthesized
gcactttgggaggccgaggc

SEQ ID NO: 39275 - DNA, 20 bp, Artificial Sequence
  chemically synthesized
agcactttgggaggccgagg

SEQ ID NO: 39276 - DNA, 20 bp, Artificial Sequence
  chemically synthesized
cctagcactttgggaggccg

SEQ ID NO: 39277 - DNA, 20 bp, Artificial Sequence
  chemically synthesized
tcctagcactttgggaggcc

SEQ ID NO: 39278 - DNA, 20 bp, Artificial Sequence
  chemically synthesized
ctacccgcctcggcctccca

SEQ ID NO: 39279 - DNA, 20 bp, Artificial Sequence
  chemically synthesized
tgtagtcctagcactttggg

SEQ ID NO: 39280 - DNA, 20 bp, Artificial Sequence
  chemically synthesized
ctgtagtcctagcactttgg

SEQ ID NO: 39281 - DNA, 20 bp, Artificial Sequence
  chemically synthesized
gcctcggcctcccaaagtgc

SEQ ID NO: 39282 - DNA, 20 bp, Artificial Sequence
  chemically synthesized
gcctgtagtcctagcacttt

SEQ ID NO: 39283 - DNA, 20 bp, Artificial Sequence
  chemically synthesized
cctcggcctcccaaagtgct

SEQ ID NO: 39284 - DNA, 20 bp, Artificial Sequence
  chemically synthesized
tgcctgtagtcctagcactt

SEQ ID NO: 39285 - DNA, 20 bp, Artificial Sequence
  chemically synthesized
ctcccaaagtgctaggacta

SEQ ID NO: 39286 - DNA, 20 bp, Artificial Sequence
  chemically synthesized
tcccaaagtgctaggactac

SEQ ID NO: 39287 - DNA, 20 bp, Artificial Sequence
  chemically synthesized
gtggctcatgcctgtagtcc

SEQ ID NO: 39288 - DNA, 20 bp, Artificial Sequence
  chemically synthesized
agtgctaggactacaggcat

SEQ ID NO: 39289 - DNA, 20 bp, Artificial Sequence
  chemically synthesized
ggcatggtggctcatgcctg

SEQ ID NO: 39290 - DNA, 20 bp, Artificial Sequence
  chemically synthesized
caggcatgagccaccatgcc

SEQ ID NO: 39291 - DNA, 20 bp, Artificial Sequence
  chemically synthesized
gtaaataagactgggcatgg

SEQ ID NO: 39292 - DNA, 20 bp, Artificial Sequence
  chemically synthesized
atagtaaataagactgggca

SEQ ID NO: 39293 - DNA, 20 bp, Artificial Sequence
  chemically synthesized
aaataatagtaaataagact

SEQ ID NO: 39294 - DNA, 20 bp, Artificial Sequence
  chemically synthesized
aaaataatagtaaataagac

SEQ ID NO: 39295 - DNA, 20 bp, Artificial Sequence
  chemically synthesized
ataataaaataatagtaaat

SEQ ID NO: 39296 - DNA, 20 bp, Artificial Sequence
  chemically synthesized
tttttaaaataataaaataa

SEQ ID NO: 39297 - DNA, 20 bp, Artificial Sequence
  chemically synthesized
caggaaaaattcaggaaatt

SEQ ID NO: 39298 - DNA, 20 bp, Artificial Sequence
  chemically synthesized
ccaggaaaaattcaggaaat

SEQ ID NO: 39299 - DNA, 20 bp, Artificial Sequence
  chemically synthesized
tgcatttccaggaaaaattc

SEQ ID NO: 39300 - DNA, 20 bp, Artificial Sequence
  chemically synthesized
ctgcatttccaggaaaaatt

SEQ ID NO: 39301 - DNA, 20 bp, Artificial Sequence
  chemically synthesized
ctaatttcctgaatttttcc

SEQ ID NO: 39302 - DNA, 20 bp, Artificial Sequence
  chemically synthesized
ctgaatttttcctggaaatg

SEQ ID NO: 39303 - DNA, 20 bp, Artificial Sequence
  chemically synthesized
acctacttatctgcatttcc

SEQ ID NO: 39304 - DNA, 20 bp, Artificial Sequence
  chemically synthesized
tacctacttatctgcatttc

SEQ ID NO: 39305 - DNA, 20 bp, Artificial Sequence
  chemically synthesized
tttttcctggaaatgcagat

SEQ ID NO: 39306 - DNA, 20 bp, Artificial Sequence
  chemically synthesized
ttcctggaaatgcagataag

SEQ ID NO: 39307 - DNA, 20 bp, Artificial Sequence
  chemically synthesized
tcctggaaatgcagataagt

SEQ ID NO: 39308 - DNA, 20 bp, Artificial Sequence
  chemically synthesized
agataagtaggtaatgcatt

SEQ ID NO: 39309 - DNA, 20 bp, Artificial Sequence
  chemically synthesized
gtaggtaatgcatttggtga

SEQ ID NO: 39310 - DNA, 20 bp, Artificial Sequence
  chemically synthesized
ggtaatgcatttggtgatgg

SEQ ID NO: 39311 - DNA, 20 bp, Artificial Sequence
  chemically synthesized
tttggtgatggtagtattaa

SEQ ID NO: 39312 - DNA, 20 bp, Artificial Sequence
  chemically synthesized
atggtagtattaatagtaat

SEQ ID NO: 39313 - DNA, 20 bp, Artificial Sequence
  chemically synthesized
ctattttcaggatgaggtat

SEQ ID NO: 39314 - DNA, 20 bp, Artificial Sequence
  chemically synthesized
tttgagctattttcaggatg

SEQ ID NO: 39315 - DNA, 20 bp, Artificial Sequence
  chemically synthesized
ctttgagctattttcaggat

SEQ ID NO: 39316 - DNA, 20 bp, Artificial Sequence
  chemically synthesized
ctaatacctcatcctgaaaa

SEQ ID NO: 39317 - DNA, 20 bp, Artificial Sequence
  chemically synthesized
gtaatctttgagctattttc

SEQ ID NO: 39318 - DNA, 20 bp, Artificial Sequence
  chemically synthesized
ggtaatctttgagctatttt

SEQ ID NO: 39319 - DNA, 20 bp, Artificial Sequence
  chemically synthesized
ctcatcctgaaaatagctca

SEQ ID NO: 39320 - DNA, 20 bp, Artificial Sequence
  chemically synthesized
atgtacttaaggtaatcttt

SEQ ID NO: 39321 - DNA, 20 bp, Artificial Sequence
  chemically synthesized
aatagctcaaagattacctt

SEQ ID NO: 39322 - DNA, 20 bp, Artificial Sequence
  chemically synthesized
agggagtcaatatgtactta

SEQ ID NO: 39323 - DNA, 20 bp, Artificial Sequence
  chemically synthesized
tagggagtcaatatgtactt

SEQ ID NO: 39324 - DNA, 20 bp, Artificial Sequence
  chemically synthesized
ttgttattcacatatttagg

SEQ ID NO: 39325 - DNA, 20 bp, Artificial Sequence
  chemically synthesized
atttgttattcacatattta

SEQ ID NO: 39326 - DNA, 20 bp, Artificial Sequence
  chemically synthesized
tatttgttattcacatattt

SEQ ID NO: 39327 - DNA, 20 bp, Artificial Sequence
  chemically synthesized
atatttgttattcacatatt

SEQ ID NO: 39328 - DNA, 20 bp, Artificial Sequence
  chemically synthesized
aaatatttgcaaattgtatt

SEQ ID NO: 39329 - DNA, 20 bp, Artificial Sequence
  chemically synthesized
tgcaaatattttgattgttt

SEQ ID NO: 39330 - DNA, 20 bp, Artificial Sequence
  chemically synthesized
gcaaatattttgattgttta

SEQ ID NO: 39331 - DNA, 20 bp, Artificial Sequence
  chemically synthesized
attgtttaaggttgtatttt

SEQ ID NO: 39332 - DNA, 20 bp, Artificial Sequence
  chemically synthesized
attttcagtgtactatttaa

SEQ ID NO: 39333 - DNA, 20 bp, Artificial Sequence
  chemically synthesized
agatatgtataactgttaaa

SEQ ID NO: 39334 - DNA, 20 bp, Artificial Sequence
  chemically synthesized
aacagttatacatatcttat

SEQ ID NO: 39335 - DNA, 20 bp, Artificial Sequence
  chemically synthesized
ctaaagtcttgtagactaat

SEQ ID NO: 39336 - DNA, 20 bp, Artificial Sequence
  chemically synthesized
tacatatcttattagtctac

SEQ ID NO: 39337 - DNA, 20 bp, Artificial Sequence
  chemically synthesized
ccttgtagtctaaagtcttg

SEQ ID NO: 39338 - DNA, 20 bp, Artificial Sequence
  chemically synthesized
cttattagtctacaagactt

SEQ ID NO: 39339 - DNA, 20 bp, Artificial Sequence
  chemically synthesized
actactgtccttgtagtcta

SEQ ID NO: 39340 - DNA, 20 bp, Artificial Sequence
  chemically synthesized
tctacaagactttagactac

SEQ ID NO: 39341 - DNA, 20 bp, Artificial Sequence
  chemically synthesized
ctacaagactttagactaca

SEQ ID NO: 39342 - DNA, 20 bp, Artificial Sequence
  chemically synthesized
aagactttagactacaagga

SEQ ID NO: 39343 - DNA, 20 bp, Artificial Sequence
  chemically synthesized
catgaagactactgtccttg

SEQ ID NO: 39344 - DNA, 20 bp, Artificial Sequence
  chemically synthesized
actttagactacaaggacag

SEQ ID NO: 39345 - DNA, 20 bp, Artificial Sequence
  chemically synthesized
tacaaggacagtagtcttca

SEQ ID NO: 39346 - DNA, 20 bp, Artificial Sequence
  chemically synthesized
ctaggcaggtagggaccatg

SEQ ID NO: 39347 - DNA, 20 bp, Artificial Sequence
  chemically synthesized
gctgccatactaggcaggta

SEQ ID NO: 39348 - DNA, 20 bp, Artificial Sequence
  chemically synthesized
cttcatggtccctacctgcc

SEQ ID NO: 39349 - DNA, 20 bp, Artificial Sequence
  chemically synthesized
agctgccatactaggcaggt

SEQ ID NO: 39350 - DNA, 20 bp, Artificial Sequence
  chemically synthesized
tagctgccatactaggcagg

SEQ ID NO: 39351 - DNA, 20 bp, Artificial Sequence
  chemically synthesized
tcatagctgccatactaggc

SEQ ID NO: 39352 - DNA, 20 bp, Artificial Sequence
  chemically synthesized
tggtccctacctgcctagta

SEQ ID NO: 39353 - DNA, 20 bp, Artificial Sequence
  chemically synthesized
atcatagctgccatactagg

SEQ ID NO: 39354 - DNA, 20 bp, Artificial Sequence
  chemically synthesized
tccctacctgcctagtatgg

SEQ ID NO: 39355 - DNA, 20 bp, Artificial Sequence
  chemically synthesized
ataatcatagctgccatact

SEQ ID NO: 39356 - DNA, 20 bp, Artificial Sequence
  chemically synthesized
aataatcatagctgccatac

SEQ ID NO: 39357 - DNA, 20 bp, Artificial Sequence
  chemically synthesized
attcattcagcaaataatca

SEQ ID NO: 39358 - DNA, 20 bp, Artificial Sequence
  chemically synthesized
gagtattatttttattcatt

SEQ ID NO: 39359 - DNA, 20 bp, Artificial Sequence
  chemically synthesized
aataaaaataatactctaaa

SEQ ID NO: 39360 - DNA, 20 bp, Artificial Sequence
  chemically synthesized
tcatatgaacacacttttta

SEQ ID NO: 39361 - DNA, 20 bp, Artificial Sequence
  chemically synthesized
attcatatgaacacactttt

SEQ ID NO: 39362 - DNA, 20 bp, Artificial Sequence
  chemically synthesized
attcatgatgcctctatcct

SEQ ID NO: 39363 - DNA, 20 bp, Artificial Sequence
  chemically synthesized
atataagatgcttaggatag

SEQ ID NO: 39364 - DNA, 20 bp, Artificial Sequence
  chemically synthesized
tatataagatgcttaggata

SEQ ID NO: 39365 - DNA, 20 bp, Artificial Sequence
  chemically synthesized
tatatataagatgcttagga

SEQ ID NO: 39366 - DNA, 20 bp, Artificial Sequence
  chemically synthesized
atcctatatataagatgctt

SEQ ID NO: 39367 - DNA, 20 bp, Artificial Sequence
  chemically synthesized
gatcctatatataagatgct

SEQ ID NO: 39368 - DNA, 20 bp, Artificial Sequence
  chemically synthesized
tatcctaagcatcttatata

SEQ ID NO: 39369 - DNA, 20 bp, Artificial Sequence
  chemically synthesized
atcctaagcatcttatatat

SEQ ID NO: 39370 - DNA, 20 bp, Artificial Sequence
  chemically synthesized
tggattaagatcctatatat

SEQ ID NO: 39371 - DNA, 20 bp, Artificial Sequence
  chemically synthesized
atatataggatcttaatcca

SEQ ID NO: 39372 - DNA, 20 bp, Artificial Sequence
  chemically synthesized
aattcagattgctgtggatt

SEQ ID NO: 39373 - DNA, 20 bp, Artificial Sequence
  chemically synthesized
gcagggaattcagattgctg

SEQ ID NO: 39374 - DNA, 20 bp, Artificial Sequence
  chemically synthesized
tttaatttttgcagggaatt

SEQ ID NO: 39375 - DNA, 20 bp, Artificial Sequence
  chemically synthesized
gacttcttttaatttttgca

SEQ ID NO: 39376 - DNA, 20 bp, Artificial Sequence
  chemically synthesized
agacttcttttaatttttgc

SEQ ID NO: 39377 - DNA, 20 bp, Artificial Sequence
  chemically synthesized
cagacttcttttaatttttg

SEQ ID NO: 39378 - DNA, 20 bp, Artificial Sequence
  chemically synthesized
gaattccctgcaaaaattaa

SEQ ID NO: 39379 - DNA, 20 bp, Artificial Sequence
  chemically synthesized
ttccctgcaaaaattaaaag

SEQ ID NO: 39380 - DNA, 20 bp, Artificial Sequence
  chemically synthesized
tatatagagtgaaggaatat

SEQ ID NO: 39381 - DNA, 20 bp, Artificial Sequence
  chemically synthesized
ttcaaggttatatagagtga

SEQ ID NO: 39382 - DNA, 20 bp, Artificial Sequence
  chemically synthesized
tttcaaggttatatagagtg

SEQ ID NO: 39383 - DNA, 20 bp, Artificial Sequence
  chemically synthesized
tttcttttcaaggttatata

SEQ ID NO: 39384 - DNA, 20 bp, Artificial Sequence
  chemically synthesized
tgtttcttttcaaggttata

SEQ ID NO: 39385 - DNA, 20 bp, Artificial Sequence
  chemically synthesized
tcactctatataaccttgaa

SEQ ID NO: 39386 - DNA, 20 bp, Artificial Sequence
  chemically synthesized
ttttgccttgtttcttttca

SEQ ID NO: 39387 - DNA, 20 bp, Artificial Sequence
  chemically synthesized
cttttgccttgtttcttttc

SEQ ID NO: 39388 - DNA, 20 bp, Artificial Sequence
  chemically synthesized
atataaccttgaaaagaaac

SEQ ID NO: 39389 - DNA, 20 bp, Artificial Sequence
  chemically synthesized
tataaccttgaaaagaaaca

SEQ ID NO: 39390 - DNA, 20 bp, Artificial Sequence
  chemically synthesized
cttgaaaagaaacaaggcaa

SEQ ID NO: 39391 - DNA, 20 bp, Artificial Sequence
  chemically synthesized
aaacaaacaaacaaaaaatc

SEQ ID NO: 39392 - DNA, 20 bp, Artificial Sequence
  chemically synthesized
gtagtctcatttcaagttac

SEQ ID NO: 39393 - DNA, 20 bp, Artificial Sequence
  chemically synthesized
aaaatccagtaacttgaaat

SEQ ID NO: 39394 - DNA, 20 bp, Artificial Sequence
  chemically synthesized
aaacctggtagtctcatttc

SEQ ID NO: 39395 - DNA, 20 bp, Artificial Sequence
  chemically synthesized
gtaacttgaaatgagactac

SEQ ID NO: 39396 - DNA, 20 bp, Artificial Sequence
  chemically synthesized
taacttgaaatgagactacc

SEQ ID NO: 39397 - DNA, 20 bp, Artificial Sequence
  chemically synthesized
cttgcctaaagcaaacctgg

SEQ ID NO: 39398 - DNA, 20 bp, Artificial Sequence
  chemically synthesized
taccttgcctaaagcaaacc

SEQ ID NO: 39399 - DNA, 20 bp, Artificial Sequence
  chemically synthesized
tgagactaccaggtttgctt

SEQ ID NO: 39400 - DNA, 20 bp, Artificial Sequence
  chemically synthesized
gagactaccaggtttgcttt

SEQ ID NO: 39401 - DNA, 20 bp, Artificial Sequence
  chemically synthesized
ctaccaggtttgctttaggc

SEQ ID NO: 39402 - DNA, 20 bp, Artificial Sequence
  chemically synthesized
taccaggtttgctttaggca

SEQ ID NO: 39403 - DNA, 20 bp, Artificial Sequence
  chemically synthesized
ttcatagcctaccttgccta

SEQ ID NO: 39404 - DNA, 20 bp, Artificial Sequence
  chemically synthesized
caggtttgctttaggcaagg

SEQ ID NO: 39405 - DNA, 20 bp, Artificial Sequence
  chemically synthesized
aggtttgctttaggcaaggt

SEQ ID NO: 39406 - DNA, 20 bp, Artificial Sequence
  chemically synthesized
ggcaaggtaggctatgaact

SEQ ID NO: 39407 - DNA, 20 bp, Artificial Sequence
  chemically synthesized
ctttaaaattgcttagttca

SEQ ID NO: 39408 - DNA, 20 bp, Artificial Sequence
  chemically synthesized
ctccaagctttaaaattgct

SEQ ID NO: 39409 - DNA, 20 bp, Artificial Sequence
  chemically synthesized
ctatgaactaagcaatttta

SEQ ID NO: 39410 - DNA, 20 bp, Artificial Sequence
  chemically synthesized
aactaagcaattttaaagct

SEQ ID NO: 39411 - DNA, 20 bp, Artificial Sequence
  chemically synthesized
ctaagcaattttaaagcttg

SEQ ID NO: 39412 - DNA, 20 bp, Artificial Sequence
  chemically synthesized
gcaattttaaagcttggagt

SEQ ID NO: 39413 - DNA, 20 bp, Artificial Sequence
  chemically synthesized
caattttaaagcttggagtg

SEQ ID NO: 39414 - DNA, 20 bp, Artificial Sequence
  chemically synthesized
acttaaattgtcctcactcc

SEQ ID NO: 39415 - DNA, 20 bp, Artificial Sequence
  chemically synthesized
gcttggagtgaggacaattt

SEQ ID NO: 39416 - DNA, 20 bp, Artificial Sequence
  chemically synthesized
gaggacaatttaagtcaaat

SEQ ID NO: 39417 - DNA, 20 bp, Artificial Sequence
  chemically synthesized
tttaagtcaaatcagttttt

SEQ ID NO: 39418 - DNA, 20 bp, Artificial Sequence
  chemically synthesized
cagttttttggaatgtccac

SEQ ID NO: 39419 - DNA, 20 bp, Artificial Sequence
  chemically synthesized
atgatatacttagtgtcttg

SEQ ID NO: 39420 - DNA, 20 bp, Artificial Sequence
  chemically synthesized
tggaatgtccacaagacact

SEQ ID NO: 39421 - DNA, 20 bp, Artificial Sequence
  chemically synthesized
tgttattttcatgatatact

SEQ ID NO: 39422 - DNA, 20 bp, Artificial Sequence
  chemically synthesized
atatcatgaaaataacattt

SEQ ID NO: 39423 - DNA, 20 bp, Artificial Sequence
  chemically synthesized
tatcatgaaaataacattta

SEQ ID NO: 39424 - DNA, 20 bp, Artificial Sequence
  chemically synthesized
aataacatttaaggaaaaat

SEQ ID NO: 39425 - DNA, 20 bp, Artificial Sequence
  chemically synthesized
aaaaataagtacacaaacat

SEQ ID NO: 39426 - DNA, 20 bp, Artificial Sequence
  chemically synthesized
aaataagtacacaaacatga

SEQ ID NO: 39427 - DNA, 20 bp, Artificial Sequence
  chemically synthesized
gagagtaaatgaaaatattc

SEQ ID NO: 39428 - DNA, 20 bp, Artificial Sequence
  chemically synthesized
catccaagtctgcaaataac

SEQ ID NO: 39429 - DNA, 20 bp, Artificial Sequence
  chemically synthesized
gaaaatattctagttatttg

SEQ ID NO: 39430 - DNA, 20 bp, Artificial Sequence
  chemically synthesized
attctagttatttgcagact

SEQ ID NO: 39431 - DNA, 20 bp, Artificial Sequence
  chemically synthesized
gtttagattttaagacatcc

SEQ ID NO: 39432 - DNA, 20 bp, Artificial Sequence
  chemically synthesized
attaaaaaagtttagatttt

SEQ ID NO: 39433 - DNA, 20 bp, Artificial Sequence
  chemically synthesized
tttaccatattaaaaaagtt

SEQ ID NO: 39434 - DNA, 20 bp, Artificial Sequence
  chemically synthesized
tttaatttaccatattaaaa

SEQ ID NO: 39435 - DNA, 20 bp, Artificial Sequence
  chemically synthesized
aaatctaaacttttttaata

SEQ ID NO: 39436 - DNA, 20 bp, Artificial Sequence
  chemically synthesized
taaatgacaaattcatattt

SEQ ID NO: 39437 - DNA, 20 bp, Artificial Sequence
  chemically synthesized
caaataatataattcattta

SEQ ID NO: 39438 - DNA, 20 bp, Artificial Sequence
  chemically synthesized
tgaattatattatttgaaaa

SEQ ID NO: 39439 - DNA, 20 bp, Artificial Sequence
  chemically synthesized
taatgaaaagcgtaatagca

SEQ ID NO: 39440 - DNA, 20 bp, Artificial Sequence
  chemically synthesized
tcaactaatgaaaagcgtaa

SEQ ID NO: 39441 - DNA, 20 bp, Artificial Sequence
  chemically synthesized
tgtgctattacgcttttcat

SEQ ID NO: 39442 - DNA, 20 bp, Artificial Sequence
  chemically synthesized
ttgtactttcaactaatgaa

SEQ ID NO: 39443 - DNA, 20 bp, Artificial Sequence
  chemically synthesized
ttacgcttttcattagttga

SEQ ID NO: 39444 - DNA, 20 bp, Artificial Sequence
  chemically synthesized
ttttcattagttgaaagtac

SEQ ID NO: 39445 - DNA, 20 bp, Artificial Sequence
  chemically synthesized
tgaaagtacaagttgcaaac

SEQ ID NO: 39446 - DNA, 20 bp, Artificial Sequence
  chemically synthesized
aagtacaagttgcaaactag

SEQ ID NO: 39447 - DNA, 20 bp, Artificial Sequence
  chemically synthesized
aaatttagcccaaagtctgc

SEQ ID NO: 39448 - DNA, 20 bp, Artificial Sequence
  chemically synthesized
agttgcaaactagcagactt

SEQ ID NO: 39449 - DNA, 20 bp, Artificial Sequence
  chemically synthesized
gttgcaaactagcagacttt

SEQ ID NO: 39450 - DNA, 20 bp, Artificial Sequence
  chemically synthesized
tgcatgccaaatttagccca

SEQ ID NO: 39451 - DNA, 20 bp, Artificial Sequence
  chemically synthesized
agcagactttgggctaaatt

SEQ ID NO: 39452 - DNA, 20 bp, Artificial Sequence
  chemically synthesized
acatttgtgcatgccaaatt

SEQ ID NO: 39453 - DNA, 20 bp, Artificial Sequence
  chemically synthesized
gcatgcacaaatgttttgat

SEQ ID NO: 39454 - DNA, 20 bp, Artificial Sequence
  chemically synthesized
aatgttttgattagcccaca

SEQ ID NO: 39455 - DNA, 20 bp, Artificial Sequence
  chemically synthesized
taaaaaaaaaaaaactgtgt

SEQ ID NO: 39456 - DNA, 20 bp, Artificial Sequence
  chemically synthesized
ttaaaaaaaaaaaaactgtg

SEQ ID NO: 39457 - DNA, 20 bp, Artificial Sequence
  chemically synthesized
tatttaaatgttgagtaatt

SEQ ID NO: 39458 - DNA, 20 bp, Artificial Sequence
  chemically synthesized
tctctgaatatttaaatgtt

SEQ ID NO: 39459 - DNA, 20 bp, Artificial Sequence
  chemically synthesized
ttactcaacatttaaatatt

SEQ ID NO: 39460 - DNA, 20 bp, Artificial Sequence
  chemically synthesized
actcaacatttaaatattca

SEQ ID NO: 39461 - DNA, 20 bp, Artificial Sequence
  chemically synthesized
aaatattcagagatatttta

SEQ ID NO: 39462 - DNA, 20 bp, Artificial Sequence
  chemically synthesized
taaatgagaagtcagaaggt

SEQ ID NO: 39463 - DNA, 20 bp, Artificial Sequence
  chemically synthesized
cttttaaatgagaagtcaga

SEQ ID NO: 39464 - DNA, 20 bp, Artificial Sequence
  chemically synthesized
ccttttaaatgagaagtcag

SEQ ID NO: 39465 - DNA, 20 bp, Artificial Sequence
  chemically synthesized
attccttttaaatgagaagt

SEQ ID NO: 39466 - DNA, 20 bp, Artificial Sequence
  chemically synthesized
aatcattccttttaaatgag

SEQ ID NO: 39467 - DNA, 20 bp, Artificial Sequence
  chemically synthesized
ccttctgacttctcatttaa

SEQ ID NO: 39468 - DNA, 20 bp, Artificial Sequence
  chemically synthesized
cttctgacttctcatttaaa

SEQ ID NO: 39469 - DNA, 20 bp, Artificial Sequence
  chemically synthesized
acaaatcattccttttaaat

SEQ ID NO: 39470 - DNA, 20 bp, Artificial Sequence
  chemically synthesized
aaggaatgatttgtccatgc

SEQ ID NO: 39471 - DNA, 20 bp, Artificial Sequence
  chemically synthesized
aggaatgatttgtccatgct

SEQ ID NO: 39472 - DNA, 20 bp, Artificial Sequence
  chemically synthesized
gcaagaataggagcccagca

SEQ ID NO: 39473 - DNA, 20 bp, Artificial Sequence
  chemically synthesized
gtcatgcaagaataggagcc

SEQ ID NO: 39474 - DNA, 20 bp, Artificial Sequence
  chemically synthesized
ttattgtcatgcaagaatag

SEQ ID NO: 39475 - DNA, 20 bp, Artificial Sequence
  chemically synthesized
agttattgtcatgcaagaat

SEQ ID NO: 39476 - DNA, 20 bp, Artificial Sequence
  chemically synthesized
aagttattgtcatgcaagaa

SEQ ID NO: 39477 - DNA, 20 bp, Artificial Sequence
  chemically synthesized
ccggaaagttattgtcatgc

SEQ ID NO: 39478 - DNA, 20 bp, Artificial Sequence
  chemically synthesized
cttgcatgacaataactttc

SEQ ID NO: 39479 - DNA, 20 bp, Artificial Sequence
  chemically synthesized
tgcatgacaataactttccg

SEQ ID NO: 39480 - DNA, 20 bp, Artificial Sequence
  chemically synthesized
tatagaatggtggctccgga

SEQ ID NO: 39481 - DNA, 20 bp, Artificial Sequence
  chemically synthesized
ccgttatagaatggtggctc

SEQ ID NO: 39482 - DNA, 20 bp, Artificial Sequence
  chemically synthesized
catgtgccgttatagaatgg

SEQ ID NO: 39483 - DNA, 20 bp, Artificial Sequence
  chemically synthesized
atacatgtgccgttatagaa

SEQ ID NO: 39484 - DNA, 20 bp, Artificial Sequence
  chemically synthesized
ccggagccaccattctataa

SEQ ID NO: 39485 - DNA, 20 bp, Artificial Sequence
  chemically synthesized
atagaatacatgtgccgtta

SEQ ID NO: 39486 - DNA, 20 bp, Artificial Sequence
  chemically synthesized
ataacggcacatgtattcta

SEQ ID NO: 39487 - DNA, 20 bp, Artificial Sequence
  chemically synthesized
atgggagctggtagggacta

SEQ ID NO: 39488 - DNA, 20 bp, Artificial Sequence
  chemically synthesized
atgtattctatagtccctac

SEQ ID NO: 39489 - DNA, 20 bp, Artificial Sequence
  chemically synthesized
taagttaatgggagctggta

SEQ ID NO: 39490 - DNA, 20 bp, Artificial Sequence
  chemically synthesized
gtaagttaatgggagctggt

SEQ ID NO: 39491 - DNA, 20 bp, Artificial Sequence
  chemically synthesized
cgtaagttaatgggagctgg

SEQ ID NO: 39492 - DNA, 20 bp, Artificial Sequence
  chemically synthesized
aagcgtaagttaatgggagc

SEQ ID NO: 39493 - DNA, 20 bp, Artificial Sequence
  chemically synthesized
agcgaagcgtaagttaatgg

SEQ ID NO: 39494 - DNA, 20 bp, Artificial Sequence
  chemically synthesized
ctagcgaagcgtaagttaat

SEQ ID NO: 39495 - DNA, 20 bp, Artificial Sequence
  chemically synthesized
gctagcgaagcgtaagttaa

SEQ ID NO: 39496 - DNA, 20 bp, Artificial Sequence
  chemically synthesized
gggcaaggctagcgaagcgt

SEQ ID NO: 39497 - DNA, 20 bp, Artificial Sequence
  chemically synthesized
cccattaacttacgcttcgc

SEQ ID NO: 39498 - DNA, 20 bp, Artificial Sequence
  chemically synthesized
gtaactgggcaaggctagcg

SEQ ID NO: 39499 - DNA, 20 bp, Artificial Sequence
  chemically synthesized
ctactgtaactgggcaaggc

SEQ ID NO: 39500 - DNA, 20 bp, Artificial Sequence
  chemically synthesized
tacgcttcgctagccttgcc

SEQ ID NO: 39501 - DNA, 20 bp, Artificial Sequence
  chemically synthesized
cctgctactgtaactgggca

SEQ ID NO: 39502 - DNA, 20 bp, Artificial Sequence
  chemically synthesized
gcctgctactgtaactgggc

SEQ ID NO: 39503 - DNA, 20 bp, Artificial Sequence
  chemically synthesized
tcgctagccttgcccagtta

SEQ ID NO: 39504 - DNA, 20 bp, Artificial Sequence
  chemically synthesized
gctagcctgctactgtaact

SEQ ID NO: 39505 - DNA, 20 bp, Artificial Sequence
  chemically synthesized
ctagccttgcccagttacag

SEQ ID NO: 39506 - DNA, 20 bp, Artificial Sequence
  chemically synthesized
ggctagcctgctactgtaac

SEQ ID NO: 39507 - DNA, 20 bp, Artificial Sequence
  chemically synthesized
gccttgcccagttacagtag

SEQ ID NO: 39508 - DNA, 20 bp, Artificial Sequence
  chemically synthesized
ccttgcccagttacagtagc

SEQ ID NO: 39509 - DNA, 20 bp, Artificial Sequence
  chemically synthesized
gcccagttacagtagcaggc

SEQ ID NO: 39510 - DNA, 20 bp, Artificial Sequence
  chemically synthesized
tgaaatgccaacagaggggc

SEQ ID NO: 39511 - DNA, 20 bp, Artificial Sequence
  chemically synthesized
tagcaggctagcccctctgt

SEQ ID NO: 39512 - DNA, 20 bp, Artificial Sequence
  chemically synthesized
aaactgaaatgccaacagag

SEQ ID NO: 39513 - DNA, 20 bp, Artificial Sequence
  chemically synthesized
caaactgaaatgccaacaga

SEQ ID NO: 39514 - DNA, 20 bp, Artificial Sequence
  chemically synthesized
gcaaactgaaatgccaacag

SEQ ID NO: 39515 - DNA, 20 bp, Artificial Sequence
  chemically synthesized
tgcaaactgaaatgccaaca

SEQ ID NO: 39516 - DNA, 20 bp, Artificial Sequence
  chemically synthesized
gttgcaaactgaaatgccaa

SEQ ID NO: 39517 - DNA, 20 bp, Artificial Sequence
  chemically synthesized
tagcccctctgttggcattt

SEQ ID NO: 39518 - DNA, 20 bp, Artificial Sequence
  chemically synthesized
gcatttcagtttgcaacctc

SEQ ID NO: 39519 - DNA, 20 bp, Artificial Sequence
  chemically synthesized
tcagtttgcaacctctggtt

SEQ ID NO: 39520 - DNA, 20 bp, Artificial Sequence
  chemically synthesized
cctttgctggtctaaaccag

SEQ ID NO: 39521 - DNA, 20 bp, Artificial Sequence
  chemically synthesized
gcctttgctggtctaaacca

SEQ ID NO: 39522 - DNA, 20 bp, Artificial Sequence
  chemically synthesized
cagcctttgctggtctaaac

SEQ ID NO: 39523 - DNA, 20 bp, Artificial Sequence
  chemically synthesized
ttgcaacctctggtttagac

SEQ ID NO: 39524 - DNA, 20 bp, Artificial Sequence
  chemically synthesized
acctctggtttagaccagca

SEQ ID NO: 39525 - DNA, 20 bp, Artificial Sequence
  chemically synthesized
cctctggtttagaccagcaa

SEQ ID NO: 39526 - DNA, 20 bp, Artificial Sequence
  chemically synthesized
ttgctatggtcagcctttgc

SEQ ID NO: 39527 - DNA, 20 bp, Artificial Sequence
  chemically synthesized
agaccagcaaaggctgacca

SEQ ID NO: 39528 - DNA, 20 bp, Artificial Sequence
  chemically synthesized
tactctaagattgctatggt

SEQ ID NO: 39529 - DNA, 20 bp, Artificial Sequence
  chemically synthesized
aagatactctaagattgcta

SEQ ID NO: 39530 - DNA, 20 bp, Artificial Sequence
  chemically synthesized
aaggctgaccatagcaatct

SEQ ID NO: 39531 - DNA, 20 bp, Artificial Sequence
  chemically synthesized
ggctgaccatagcaatctta

SEQ ID NO: 39532 - DNA, 20 bp, Artificial Sequence
  chemically synthesized
aaagcacactaagatactct

SEQ ID NO: 39533 - DNA, 20 bp, Artificial Sequence
  chemically synthesized
atagcaatcttagagtatct

SEQ ID NO: 39534 - DNA, 20 bp, Artificial Sequence
  chemically synthesized
cagttgacttaaagcacact

SEQ ID NO: 39535 - DNA, 20 bp, Artificial Sequence
  chemically synthesized
agagtatcttagtgtgcttt

SEQ ID NO: 39536 - DNA, 20 bp, Artificial Sequence
  chemically synthesized
tgtcagtgtcagttgactta

SEQ ID NO: 39537 - DNA, 20 bp, Artificial Sequence
  chemically synthesized
atttcttcttttgtcagtgt

SEQ ID NO: 39538 - DNA, 20 bp, Artificial Sequence
  chemically synthesized
aagtcaactgacactgacaa

SEQ ID NO: 39539 - DNA, 20 bp, Artificial Sequence
  chemically synthesized
tcaactgacactgacaaaag

SEQ ID NO: 39540 - DNA, 20 bp, Artificial Sequence
  chemically synthesized
ttttctatttcttcttttgt

SEQ ID NO: 39541 - DNA, 20 bp, Artificial Sequence
  chemically synthesized
gacactgacaaaagaagaaa

SEQ ID NO: 39542 - DNA, 20 bp, Artificial Sequence
  chemically synthesized
caaaagaagaaatagaaaat

SEQ ID NO: 39543 - DNA, 20 bp, Artificial Sequence
  chemically synthesized
gaagaaatagaaaattggaa

SEQ ID NO: 39544 - DNA, 20 bp, Artificial Sequence
  chemically synthesized
tttatttcttaaatagtaca

SEQ ID NO: 39545 - DNA, 20 bp, Artificial Sequence
  chemically synthesized
gtttatttcttaaatagtac

SEQ ID NO: 39546 - DNA, 20 bp, Artificial Sequence
  chemically synthesized
tgtttatttcttaaatagta

SEQ ID NO: 39547 - DNA, 20 bp, Artificial Sequence
  chemically synthesized
ggaatagccctgtactattt

SEQ ID NO: 39548 - DNA, 20 bp, Artificial Sequence
  chemically synthesized
tacagtgtttatttcttaaa

SEQ ID NO: 39549 - DNA, 20 bp, Artificial Sequence
  chemically synthesized
agtgggaaaatttataatta

SEQ ID NO: 39550 - DNA, 20 bp, Artificial Sequence
  chemically synthesized
gtaattataaattttcccac

SEQ ID NO: 39551 - DNA, 20 bp, Artificial Sequence
  chemically synthesized
taattataaattttcccact

SEQ ID NO: 39552 - DNA, 20 bp, Artificial Sequence
  chemically synthesized
ggccttggaattttcctagt

SEQ ID NO: 39553 - DNA, 20 bp, Artificial Sequence
  chemically synthesized
tggccttggaattttcctag

SEQ ID NO: 39554 - DNA, 20 bp, Artificial Sequence
  chemically synthesized
atttggccttggaattttcc

SEQ ID NO: 39555 - DNA, 20 bp, Artificial Sequence
  chemically synthesized
tttcccactaggaaaattcc

SEQ ID NO: 39556 - DNA, 20 bp, Artificial Sequence
  chemically synthesized
ttcccactaggaaaattcca

SEQ ID NO: 39557 - DNA, 20 bp, Artificial Sequence
  chemically synthesized
ccagtgatatgatttggcct

SEQ ID NO: 39558 - DNA, 20 bp, Artificial Sequence
  chemically synthesized
tttctgccagtgatatgatt

SEQ ID NO: 39559 - DNA, 20 bp, Artificial Sequence
  chemically synthesized
ccaaggccaaatcatatcac

SEQ ID NO: 39560 - DNA, 20 bp, Artificial Sequence
  chemically synthesized
aggccaaatcatatcactgg

SEQ ID NO: 39561 - DNA, 20 bp, Artificial Sequence
  chemically synthesized
tttaagattggtatttctgc

SEQ ID NO: 39562 - DNA, 20 bp, Artificial Sequence
  chemically synthesized
tggcagaaataccaatctta

SEQ ID NO: 39563 - DNA, 20 bp, Artificial Sequence
  chemically synthesized
tggaagagtttctttaagat

SEQ ID NO: 39564 - DNA, 20 bp, Artificial Sequence
  chemically synthesized
gtctctggaagagtttcttt

SEQ ID NO: 39565 - DNA, 20 bp, Artificial Sequence
  chemically synthesized
caatcttaaagaaactcttc

SEQ ID NO: 39566 - DNA, 20 bp, Artificial Sequence
  chemically synthesized
atcttaaagaaactcttcca

SEQ ID NO: 39567 - DNA, 20 bp, Artificial Sequence
  chemically synthesized
gcctcttctagtctctggaa

SEQ ID NO: 39568 - DNA, 20 bp, Artificial Sequence
  chemically synthesized
ttgcctcttctagtctctgg

SEQ ID NO: 39569 - DNA, 20 bp, Artificial Sequence
  chemically synthesized
aaagaaactcttccagagac

SEQ ID NO: 39570 - DNA, 20 bp, Artificial Sequence
  chemically synthesized
gcattgcctcttctagtctc

SEQ ID NO: 39571 - DNA, 20 bp, Artificial Sequence
  chemically synthesized
gaaactcttccagagactag

SEQ ID NO: 39572 - DNA, 20 bp, Artificial Sequence
  chemically synthesized
aactcttccagagactagaa

SEQ ID NO: 39573 - DNA, 20 bp, Artificial Sequence
  chemically synthesized
actcttccagagactagaag

SEQ ID NO: 39574 - DNA, 20 bp, Artificial Sequence
  chemically synthesized
tagggaagcattgcctcttc

SEQ ID NO: 39575 - DNA, 20 bp, Artificial Sequence
  chemically synthesized
tttcataaaggcaagtaggg

SEQ ID NO: 39576 - DNA, 20 bp, Artificial Sequence
  chemically synthesized
tggtttcataaaggcaagta

SEQ ID NO: 39577 - DNA, 20 bp, Artificial Sequence
  chemically synthesized
ctggtttcataaaggcaagt

SEQ ID NO: 39578 - DNA, 20 bp, Artificial Sequence
  chemically synthesized
tctggtttcataaaggcaag

SEQ ID NO: 39579 - DNA, 20 bp, Artificial Sequence
  chemically synthesized
tattctggtttcataaaggc

SEQ ID NO: 39580 - DNA, 20 bp, Artificial Sequence
  chemically synthesized
ggattattctggtttcataa

SEQ ID NO: 39581 - DNA, 20 bp, Artificial Sequence
  chemically synthesized
tggattattctggtttcata

SEQ ID NO: 39582 - DNA, 20 bp, Artificial Sequence
  chemically synthesized
cctacttgcctttatgaaac

SEQ ID NO: 39583 - DNA, 20 bp, Artificial Sequence
  chemically synthesized
gtttggtatgtggattattc

SEQ ID NO: 39584 - DNA, 20 bp, Artificial Sequence
  chemically synthesized
tcttgtcaaggtttggtatg

SEQ ID NO: 39585 - DNA, 20 bp, Artificial Sequence
  chemically synthesized
ctgccattcttgtcaaggtt

SEQ ID NO: 39586 - DNA, 20 bp, Artificial Sequence
  chemically synthesized
tccacataccaaaccttgac

SEQ ID NO: 39587 - DNA, 20 bp, Artificial Sequence
  chemically synthesized
ttggtctgccattcttgtca

SEQ ID NO: 39588 - DNA, 20 bp, Artificial Sequence
  chemically synthesized
attggtctgccattcttgtc

SEQ ID NO: 39589 - DNA, 20 bp, Artificial Sequence
  chemically synthesized
ataccaaaccttgacaagaa

SEQ ID NO: 39590 - DNA, 20 bp, Artificial Sequence
  chemically synthesized
ccaaaccttgacaagaatgg

SEQ ID NO: 39591 - DNA, 20 bp, Artificial Sequence
  chemically synthesized
tctgtgtttattagttatat

SEQ ID NO: 39592 - DNA, 20 bp, Artificial Sequence
  chemically synthesized
accaatataactaataaaca

SEQ ID NO: 39593 - DNA, 20 bp, Artificial Sequence
  chemically synthesized
gttattgcatctgtgtttat

SEQ ID NO: 39594 - DNA, 20 bp, Artificial Sequence
  chemically synthesized
acacagatgcaataactcta

SEQ ID NO: 39595 - DNA, 20 bp, Artificial Sequence
  chemically synthesized
cacagatgcaataactctaa

SEQ ID NO: 39596 - DNA, 20 bp, Artificial Sequence
  chemically synthesized
atttgatagtatttccttta

SEQ ID NO: 39597 - DNA, 20 bp, Artificial Sequence
  chemically synthesized
tcatttgatagtatttcctt

SEQ ID NO: 39598 - DNA, 20 bp, Artificial Sequence
  chemically synthesized
ttcatttagaattcatttga

SEQ ID NO: 39599 - DNA, 20 bp, Artificial Sequence
  chemically synthesized
cttgatgctaaacattcatt

SEQ ID NO: 39600 - DNA, 20 bp, Artificial Sequence
  chemically synthesized
atgaattctaaatgaatgtt

SEQ ID NO: 39601 - DNA, 20 bp, Artificial Sequence
  chemically synthesized
ctaaatgaatgtttagcatc

SEQ ID NO: 39602 - DNA, 20 bp, Artificial Sequence
  chemically synthesized
gaatgtttagcatcaagtac

SEQ ID NO: 39603 - DNA, 20 bp, Artificial Sequence
  chemically synthesized
aatgtttagcatcaagtact

SEQ ID NO: 39604 - DNA, 20 bp, Artificial Sequence
  chemically synthesized
gcatcaagtactgggccaac

SEQ ID NO: 39605 - DNA, 20 bp, Artificial Sequence
  chemically synthesized
atatggatatctagttggcc

SEQ ID NO: 39606 - DNA, 20 bp, Artificial Sequence
  chemically synthesized
tcataatatggatatctagt

SEQ ID NO: 39607 - DNA, 20 bp, Artificial Sequence
  chemically synthesized
tttttcataatatggatatc

SEQ ID NO: 39608 - DNA, 20 bp, Artificial Sequence
  chemically synthesized
gagttttatttttcataata

SEQ ID NO: 39609 - DNA, 20 bp, Artificial Sequence
  chemically synthesized
taatatgtgagatagagatt

SEQ ID NO: 39610 - DNA, 20 bp, Artificial Sequence
  chemically synthesized
tttgtgtaatatgtgagata

SEQ ID NO: 39611 - DNA, 20 bp, Artificial Sequence
  chemically synthesized
cttttgtgtaatatgtgaga

SEQ ID NO: 39612 - DNA, 20 bp, Artificial Sequence
  chemically synthesized
tgaccttttgtgtaatatgt

SEQ ID NO: 39613 - DNA, 20 bp, Artificial Sequence
  chemically synthesized
ctatctcacatattacacaa

SEQ ID NO: 39614 - DNA, 20 bp, Artificial Sequence
  chemically synthesized
tatctcacatattacacaaa

SEQ ID NO: 39615 - DNA, 20 bp, Artificial Sequence
  chemically synthesized
attacacaaaaggtcaattc

SEQ ID NO: 39616 - DNA, 20 bp, Artificial Sequence
  chemically synthesized
ttacacaaaaggtcaattcc

SEQ ID NO: 39617 - DNA, 20 bp, Artificial Sequence
  chemically synthesized
atttagatatatagtacacc

SEQ ID NO: 39618 - DNA, 20 bp, Artificial Sequence
  chemically synthesized
aacttttccatttagatata

SEQ ID NO: 39619 - DNA, 20 bp, Artificial Sequence
  chemically synthesized
aggtgtactatatatctaaa

SEQ ID NO: 39620 - DNA, 20 bp, Artificial Sequence
  chemically synthesized
tactatatatctaaatggaa

SEQ ID NO: 39621 - DNA, 20 bp, Artificial Sequence
  chemically synthesized
tattttttaacttttccatt

SEQ ID NO: 39622 - DNA, 20 bp, Artificial Sequence
  chemically synthesized
taaatggaaaagttaaaaaa

SEQ ID NO: 39623 - DNA, 20 bp, Artificial Sequence
  chemically synthesized
tggaaaagttaaaaaatagt

SEQ ID NO: 39624 - DNA, 20 bp, Artificial Sequence
  chemically synthesized
gttaaaaaatagtaagtttc

SEQ ID NO: 39625 - DNA, 20 bp, Artificial Sequence
  chemically synthesized
aaaaaatagtaagtttctag

SEQ ID NO: 39626 - DNA, 20 bp, Artificial Sequence
  chemically synthesized
tatcctcttttattatcttc

SEQ ID NO: 39627 - DNA, 20 bp, Artificial Sequence
  chemically synthesized
aagtttctagaagataataa

SEQ ID NO: 39628 - DNA, 20 bp, Artificial Sequence
  chemically synthesized
gtttctagaagataataaaa

SEQ ID NO: 39629 - DNA, 20 bp, Artificial Sequence
  chemically synthesized
tttctagaagataataaaag

SEQ ID NO: 39630 - DNA, 20 bp, Artificial Sequence
  chemically synthesized
atacattcattatcttgtat

SEQ ID NO: 39631 - DNA, 20 bp, Artificial Sequence
  chemically synthesized
tacattcattatcttgtatt

SEQ ID NO: 39632 - DNA, 20 bp, Artificial Sequence
  chemically synthesized
taagaaatctttcctaatac

SEQ ID NO: 39633 - DNA, 20 bp, Artificial Sequence
  chemically synthesized
ttcattatcttgtattagga

SEQ ID NO: 39634 - DNA, 20 bp, Artificial Sequence
  chemically synthesized
gtattaggaaagatttctta

SEQ ID NO: 39635 - DNA, 20 bp, Artificial Sequence
  chemically synthesized
attaggaaagatttcttaaa

SEQ ID NO: 39636 - DNA, 20 bp, Artificial Sequence
  chemically synthesized
ttaggaaagatttcttaaag

SEQ ID NO: 39637 - DNA, 20 bp, Artificial Sequence
  chemically synthesized
aattcttttgtgtcctcttt

SEQ ID NO: 39638 - DNA, 20 bp, Artificial Sequence
  chemically synthesized
atttcttaaagaggacacaa

SEQ ID NO: 39639 - DNA, 20 bp, Artificial Sequence
  chemically synthesized
gacacaaaagaattaaccct

SEQ ID NO: 39640 - DNA, 20 bp, Artificial Sequence
  chemically synthesized
acacaaaagaattaacccta

SEQ ID NO: 39641 - DNA, 20 bp, Artificial Sequence
  chemically synthesized
aatatgtaaatttttcctta

SEQ ID NO: 39642 - DNA, 20 bp, Artificial Sequence
  chemically synthesized
caatatgtaaatttttcctt

SEQ ID NO: 39643 - DNA, 20 bp, Artificial Sequence
  chemically synthesized
ccaatatgtaaatttttcct

SEQ ID NO: 39644 - DNA, 20 bp, Artificial Sequence
  chemically synthesized
ctaaggaaaaatttacatat

SEQ ID NO: 39645 - DNA, 20 bp, Artificial Sequence
  chemically synthesized
ttacatattggactatatta

SEQ ID NO: 39646 - DNA, 20 bp, Artificial Sequence
  chemically synthesized
gatagttcttaactttaata

SEQ ID NO: 39647 - DNA, 20 bp, Artificial Sequence
  chemically synthesized
tattggactatattaaagtt

SEQ ID NO: 39648 - DNA, 20 bp, Artificial Sequence
  chemically synthesized
taaattgtttttttgattga

SEQ ID NO: 39649 - DNA, 20 bp, Artificial Sequence
  chemically synthesized
caaaaaaacaatttaattaa

SEQ ID NO: 39650 - DNA, 20 bp, Artificial Sequence
  chemically synthesized
aaaaaaacaatttaattaaa

SEQ ID NO: 39651 - DNA, 20 bp, Artificial Sequence
  chemically synthesized
aaacaatttaattaaaagga

SEQ ID NO: 39652 - DNA, 20 bp, Artificial Sequence
  chemically synthesized
ttaaaaggaaagctataaaa

SEQ ID NO: 39653 - DNA, 20 bp, Artificial Sequence
  chemically synthesized
taaaaggaaagctataaaat

SEQ ID NO: 39654 - DNA, 20 bp, Artificial Sequence
  chemically synthesized
aaatatcttctcccatttta

SEQ ID NO: 39655 - DNA, 20 bp, Artificial Sequence
  chemically synthesized
aaaggaaagctataaaatgg

SEQ ID NO: 39656 - DNA, 20 bp, Artificial Sequence
  chemically synthesized
ggaaagctataaaatgggag

SEQ ID NO: 39657 - DNA, 20 bp, Artificial Sequence
  chemically synthesized
tgcaacacatacaatttaca

SEQ ID NO: 39658 - DNA, 20 bp, Artificial Sequence
  chemically synthesized
gcaacacatacaatttacaa

SEQ ID NO: 39659 - DNA, 20 bp, Artificial Sequence
  chemically synthesized
caacacatacaatttacaaa

SEQ ID NO: 39660 - DNA, 20 bp, Artificial Sequence
  chemically synthesized
atttacaaagggctacaaac

SEQ ID NO: 39661 - DNA, 20 bp, Artificial Sequence
  chemically synthesized
tttttacatattctagtttg

SEQ ID NO: 39662 - DNA, 20 bp, Artificial Sequence
  chemically synthesized
ggagttttttttacatattc

SEQ ID NO: 39663 - DNA, 20 bp, Artificial Sequence
  chemically synthesized
atatgtaaaaaaaactccta

SEQ ID NO: 39664 - DNA, 20 bp, Artificial Sequence
  chemically synthesized
tttttcttattgatctgtag

SEQ ID NO: 39665 - DNA, 20 bp, Artificial Sequence
  chemically synthesized
tctttttcttattgatctgt

SEQ ID NO: 39666 - DNA, 20 bp, Artificial Sequence
  chemically synthesized
ttctttttcttattgatctg

SEQ ID NO: 39667 - DNA, 20 bp, Artificial Sequence
  chemically synthesized
aaaaactcctacagatcaat

SEQ ID NO: 39668 - DNA, 20 bp, Artificial Sequence
  chemically synthesized
tcctacagatcaataagaaa

SEQ ID NO: 39669 - DNA, 20 bp, Artificial Sequence
  chemically synthesized
tacagatcaataagaaaaag

SEQ ID NO: 39670 - DNA, 20 bp, Artificial Sequence
  chemically synthesized
acagatcaataagaaaaaga

SEQ ID NO: 39671 - DNA, 20 bp, Artificial Sequence
  chemically synthesized
ggatgaatcaataaaaaaaa

SEQ ID NO: 39672 - DNA, 20 bp, Artificial Sequence
  chemically synthesized
gatgaatcaataaaaaaaat

SEQ ID NO: 39673 - DNA, 20 bp, Artificial Sequence
  chemically synthesized
aatcaataaaaaaaataggc

SEQ ID NO: 39674 - DNA, 20 bp, Artificial Sequence
  chemically synthesized
tcaataaaaaaaataggcaa

SEQ ID NO: 39675 - DNA, 20 bp, Artificial Sequence
  chemically synthesized
aaaataggcaagagactgaa

SEQ ID NO: 39676 - DNA, 20 bp, Artificial Sequence
  chemically synthesized
tgttgtgtgaagtatctatt

SEQ ID NO: 39677 - DNA, 20 bp, Artificial Sequence
  chemically synthesized
tgaatagatacttcacacaa

SEQ ID NO: 39678 - DNA, 20 bp, Artificial Sequence
  chemically synthesized
tttggatatcctgttgtgtg

SEQ ID NO: 39679 - DNA, 20 bp, Artificial Sequence
  chemically synthesized
gaatagatacttcacacaac

SEQ ID NO: 39680 - DNA, 20 bp, Artificial Sequence
  chemically synthesized
acacaacaggatatccaaaa

SEQ ID NO: 39681 - DNA, 20 bp, Artificial Sequence
  chemically synthesized
cgtgtatttattgaccattt

SEQ ID NO: 39682 - DNA, 20 bp, Artificial Sequence
  chemically synthesized
gtaaaaatattcaacctcat

SEQ ID NO: 39683 - DNA, 20 bp, Artificial Sequence
  chemically synthesized
caattgtctgattacttatg

SEQ ID NO: 39684 - DNA, 20 bp, Artificial Sequence
  chemically synthesized
gcaattgtctgattacttat

SEQ ID NO: 39685 - DNA, 20 bp, Artificial Sequence
  chemically synthesized
tattcaacctcataagtaat

SEQ ID NO: 39686 - DNA, 20 bp, Artificial Sequence
  chemically synthesized
ttgcaaattaaaataacaat

SEQ ID NO: 39687 - DNA, 20 bp, Artificial Sequence
  chemically synthesized
cattgcagtgagtgtgtgag

SEQ ID NO: 39688 - DNA, 20 bp, Artificial Sequence
  chemically synthesized
cgccattgcagtgagtgtgt

SEQ ID NO: 39689 - DNA, 20 bp, Artificial Sequence
  chemically synthesized
tactcacacactcactgcaa

SEQ ID NO: 39690 - DNA, 20 bp, Artificial Sequence
  chemically synthesized
aaaattttcgccattgcagt

SEQ ID NO: 39691 - DNA, 20 bp, Artificial Sequence
  chemically synthesized
ctttaaaattttcgccattg

SEQ ID NO: 39692 - DNA, 20 bp, Artificial Sequence
  chemically synthesized
ctgcaatggcgaaaatttta

SEQ ID NO: 39693 - DNA, 20 bp, Artificial Sequence
  chemically synthesized
cgaaaattttaaagactaac

SEQ ID NO: 39694 - DNA, 20 bp, Artificial Sequence
  chemically synthesized
caacaatacttgatacttgt

SEQ ID NO: 39695 - DNA, 20 bp, Artificial Sequence
  chemically synthesized
tttaaagactaacaagtatc

SEQ ID NO: 39696 - DNA, 20 bp, Artificial Sequence
  chemically synthesized
aacaagtatcaagtattgtt

SEQ ID NO: 39697 - DNA, 20 bp, Artificial Sequence
  chemically synthesized
tatcaagtattgttgagatg

SEQ ID NO: 39698 - DNA, 20 bp, Artificial Sequence
  chemically synthesized
tcaagtattgttgagatgtg

SEQ ID NO: 39699 - DNA, 20 bp, Artificial Sequence
  chemically synthesized
ttgttgagatgtggagctac

SEQ ID NO: 39700 - DNA, 20 bp, Artificial Sequence
  chemically synthesized
gcagtatatgaaagttctag

SEQ ID NO: 39701 - DNA, 20 bp, Artificial Sequence
  chemically synthesized
ttagcagtatatgaaagttc

SEQ ID NO: 39702 - DNA, 20 bp, Artificial Sequence
  chemically synthesized
ccatcattagcagtatatga

SEQ ID NO: 39703 - DNA, 20 bp, Artificial Sequence
  chemically synthesized
ctttcatatactgctaatga

SEQ ID NO: 39704 - DNA, 20 bp, Artificial Sequence
  chemically synthesized
ccagtttacaccatcattag

SEQ ID NO: 39705 - DNA, 20 bp, Artificial Sequence
  chemically synthesized
gtaccagtttacaccatcat

SEQ ID NO: 39706 - DNA, 20 bp, Artificial Sequence
  chemically synthesized
ctgctaatgatggtgtaaac

SEQ ID NO: 39707 - DNA, 20 bp, Artificial Sequence
  chemically synthesized
gttttccaaagtggttgtac

SEQ ID NO: 39708 - DNA, 20 bp, Artificial Sequence
  chemically synthesized
gtaaactggtacaaccactt

SEQ ID NO: 39709 - DNA, 20 bp, Artificial Sequence
  chemically synthesized
atactcctggttttccaaag

SEQ ID NO: 39710 - DNA, 20 bp, Artificial Sequence
  chemically synthesized
tagatactcctggttttcca

SEQ ID NO: 39711 - DNA, 20 bp, Artificial Sequence
  chemically synthesized
gtacaaccactttggaaaac

SEQ ID NO: 39712 - DNA, 20 bp, Artificial Sequence
  chemically synthesized
tacaaccactttggaaaacc

SEQ ID NO: 39713 - DNA, 20 bp, Artificial Sequence
  chemically synthesized
caaccactttggaaaaccag

SEQ ID NO: 39714 - DNA, 20 bp, Artificial Sequence
  chemically synthesized
tgagctttagtagatactcc

SEQ ID NO: 39715 - DNA, 20 bp, Artificial Sequence
  chemically synthesized
aaaaccaggagtatctacta

SEQ ID NO: 39716 - DNA, 20 bp, Artificial Sequence
  chemically synthesized
aggcatatgctgagctttag

SEQ ID NO: 39717 - DNA, 20 bp, Artificial Sequence
  chemically synthesized
caggagtatctactaaagct

SEQ ID NO: 39718 - DNA, 20 bp, Artificial Sequence
  chemically synthesized
ggtaggcatatgctgagctt

SEQ ID NO: 39719 - DNA, 20 bp, Artificial Sequence
  chemically synthesized
gttgagggtaggcatatgct

SEQ ID NO: 39720 - DNA, 20 bp, Artificial Sequence
  chemically synthesized
aaattgcctatgttgagggt

SEQ ID NO: 39721 - DNA, 20 bp, Artificial Sequence
  chemically synthesized
aaaattgcctatgttgaggg

SEQ ID NO: 39722 - DNA, 20 bp, Artificial Sequence
  chemically synthesized
gcatatgcctaccctcaaca

SEQ ID NO: 39723 - DNA, 20 bp, Artificial Sequence
  chemically synthesized
catatgcctaccctcaacat

SEQ ID NO: 39724 - DNA, 20 bp, Artificial Sequence
  chemically synthesized
agtaaaattgcctatgttga

SEQ ID NO: 39725 - DNA, 20 bp, Artificial Sequence
  chemically synthesized
cagtaaaattgcctatgttg

SEQ ID NO: 39726 - DNA, 20 bp, Artificial Sequence
  chemically synthesized
gcagtaaaattgcctatgtt

SEQ ID NO: 39727 - DNA, 20 bp, Artificial Sequence
  chemically synthesized
acataggcaattttactgca

SEQ ID NO: 39728 - DNA, 20 bp, Artificial Sequence
  chemically synthesized
tgtgtttggtatatactttg

SEQ ID NO: 39729 - DNA, 20 bp, Artificial Sequence
  chemically synthesized
tgcaaagtatataccaaaca

SEQ ID NO: 39730 - DNA, 20 bp, Artificial Sequence
  chemically synthesized
cacgtgtgtacaactgtgtt

SEQ ID NO: 39731 - DNA, 20 bp, Artificial Sequence
  chemically synthesized
acattctttaatgcgttttt

SEQ ID NO: 39732 - DNA, 20 bp, Artificial Sequence
  chemically synthesized
gtgtgccaaaaaacgcatta

SEQ ID NO: 39733 - DNA, 20 bp, Artificial Sequence
  chemically synthesized
aacgcattaaagaatgttca

SEQ ID NO: 39734 - DNA, 20 bp, Artificial Sequence
  chemically synthesized
acgcattaaagaatgttcat

SEQ ID NO: 39735 - DNA, 20 bp, Artificial Sequence
  chemically synthesized
gcattaaagaatgttcatag

SEQ ID NO: 39736 - DNA, 20 bp, Artificial Sequence
  chemically synthesized
cattaaagaatgttcatagg

SEQ ID NO: 39737 - DNA, 20 bp, Artificial Sequence
  chemically synthesized
gtttgaagacattatgaata

SEQ ID NO: 39738 - DNA, 20 bp, Artificial Sequence
  chemically synthesized
agtttgaagacattatgaat

SEQ ID NO: 39739 - DNA, 20 bp, Artificial Sequence
  chemically synthesized
tattcataatgtcttcaaac

SEQ ID NO: 39740 - DNA, 20 bp, Artificial Sequence
  chemically synthesized
ttttggttctttccagtttg

SEQ ID NO: 39741 - DNA, 20 bp, Artificial Sequence
  chemically synthesized
cataatgtcttcaaactgga

SEQ ID NO: 39742 - DNA, 20 bp, Artificial Sequence
  chemically synthesized
gggaacattttggttctttc

SEQ ID NO: 39743 - DNA, 20 bp, Artificial Sequence
  chemically synthesized
tctattgttggggaacattt

SEQ ID NO: 39744 - DNA, 20 bp, Artificial Sequence
  chemically synthesized
accaaaatgttccccaacaa

SEQ ID NO: 39745 - DNA, 20 bp, Artificial Sequence
  chemically synthesized
atttatccattctattgttg

SEQ ID NO: 39746 - DNA, 20 bp, Artificial Sequence
  chemically synthesized
aatttatccattctattgtt

SEQ ID NO: 39747 - DNA, 20 bp, Artificial Sequence
  chemically synthesized
taatttatccattctattgt

SEQ ID NO: 39748 - DNA, 20 bp, Artificial Sequence
  chemically synthesized
aatgttccccaacaatagaa

SEQ ID NO: 39749 - DNA, 20 bp, Artificial Sequence
  chemically synthesized
acaatagaatggataaatta

SEQ ID NO: 39750 - DNA, 20 bp, Artificial Sequence
  chemically synthesized
attatagtatacattttaaa

SEQ ID NO: 39751 - DNA, 20 bp, Artificial Sequence
  chemically synthesized
ttatagtatacattttaaat

SEQ ID NO: 39752 - DNA, 20 bp, Artificial Sequence
  chemically synthesized
attgcaatgaaaatgtatga

SEQ ID NO: 39753 - DNA, 20 bp, Artificial Sequence
  chemically synthesized
acagattcatgcaacaacat

SEQ ID NO: 39754 - DNA, 20 bp, Artificial Sequence
  chemically synthesized
ggactcaacattgtgtttat

SEQ ID NO: 39755 - DNA, 20 bp, Artificial Sequence
  chemically synthesized
aatctcataaacacaatgtt

SEQ ID NO: 39756 - DNA, 20 bp, Artificial Sequence
  chemically synthesized
ataaacacaatgttgagtcc

SEQ ID NO: 39757 - DNA, 20 bp, Artificial Sequence
  chemically synthesized
gtatataaccttttgtatct

SEQ ID NO: 39758 - DNA, 20 bp, Artificial Sequence
  chemically synthesized
atgttgagtcctagatacaa

SEQ ID NO: 39759 - DNA, 20 bp, Artificial Sequence
  chemically synthesized
agtatataaccttttgtatc

SEQ ID NO: 39760 - DNA, 20 bp, Artificial Sequence
  chemically synthesized
tgttgagtcctagatacaaa

SEQ ID NO: 39761 - DNA, 20 bp, Artificial Sequence
  chemically synthesized
tctataaaaatggaattgta

SEQ ID NO: 39762 - DNA, 20 bp, Artificial Sequence
  chemically synthesized
actgtacaattccattttta

SEQ ID NO: 39763 - DNA, 20 bp, Artificial Sequence
  chemically synthesized
ttatttgaactctataaaaa

SEQ ID NO: 39764 - DNA, 20 bp, Artificial Sequence
  chemically synthesized
tgtacaattccatttttata

SEQ ID NO: 39765 - DNA, 20 bp, Artificial Sequence
  chemically synthesized
ttttatagagttcaaataaa

SEQ ID NO: 39766 - DNA, 20 bp, Artificial Sequence
  chemically synthesized
tttatagagttcaaataaac

SEQ ID NO: 39767 - DNA, 20 bp, Artificial Sequence
  chemically synthesized
aaacaggcaaaactcaacca

SEQ ID NO: 39768 - DNA, 20 bp, Artificial Sequence
  chemically synthesized
tgccttataacactatggtt

SEQ ID NO: 39769 - DNA, 20 bp, Artificial Sequence
  chemically synthesized
tactctgccttataacacta

SEQ ID NO: 39770 - DNA, 20 bp, Artificial Sequence
  chemically synthesized
aaactcaaccatagtgttat

SEQ ID NO: 39771 - DNA, 20 bp, Artificial Sequence
  chemically synthesized
aactcaaccatagtgttata

SEQ ID NO: 39772 - DNA, 20 bp, Artificial Sequence
  chemically synthesized
tcaaccatagtgttataagg

SEQ ID NO: 39773 - DNA, 20 bp, Artificial Sequence
  chemically synthesized
aaccatagtgttataaggca

SEQ ID NO: 39774 - DNA, 20 bp, Artificial Sequence
  chemically synthesized
catagtgttataaggcagag

SEQ ID NO: 39775 - DNA, 20 bp, Artificial Sequence
  chemically synthesized
agtgttataaggcagagtag

SEQ ID NO: 39776 - DNA, 20 bp, Artificial Sequence
  chemically synthesized
gcagagtagcagttaccttt

SEQ ID NO: 39777 - DNA, 20 bp, Artificial Sequence
  chemically synthesized
gtagcagttacctttaagat

SEQ ID NO: 39778 - DNA, 20 bp, Artificial Sequence
  chemically synthesized
ctattcctccctcatcttaa

SEQ ID NO: 39779 - DNA, 20 bp, Artificial Sequence
  chemically synthesized
tagcagttacctttaagatg

SEQ ID NO: 39780 - DNA, 20 bp, Artificial Sequence
  chemically synthesized
actattcctccctcatctta

SEQ ID NO: 39781 - DNA, 20 bp, Artificial Sequence
  chemically synthesized
agcagttacctttaagatga

SEQ ID NO: 39782 - DNA, 20 bp, Artificial Sequence
  chemically synthesized
cagttacctttaagatgagg

SEQ ID NO: 39783 - DNA, 20 bp, Artificial Sequence
  chemically synthesized
agttacctttaagatgaggg

SEQ ID NO: 39784 - DNA, 20 bp, Artificial Sequence
  chemically synthesized
cctttaagatgagggaggaa

SEQ ID NO: 39785 - DNA, 20 bp, Artificial Sequence
  chemically synthesized
gatgagggaggaatagtgat

SEQ ID NO: 39786 - DNA, 20 bp, Artificial Sequence
  chemically synthesized
atgagggaggaatagtgatt

SEQ ID NO: 39787 - DNA, 20 bp, Artificial Sequence
  chemically synthesized
gagggaggaatagtgattgg

SEQ ID NO: 39788 - DNA, 20 bp, Artificial Sequence
  chemically synthesized
gggaggaatagtgattggga

SEQ ID NO: 39789 - DNA, 20 bp, Artificial Sequence
  chemically synthesized
ggaggaatagtgattgggag

SEQ ID NO: 39790 - DNA, 20 bp, Artificial Sequence
  chemically synthesized
gaggaatagtgattgggaga

SEQ ID NO: 39791 - DNA, 20 bp, Artificial Sequence
  chemically synthesized
agtgattgggagagggaatg

SEQ ID NO: 39792 - DNA, 20 bp, Artificial Sequence
  chemically synthesized
gtgattgggagagggaatgt

SEQ ID NO: 39793 - DNA, 20 bp, Artificial Sequence
  chemically synthesized
ttgggagagggaatgtgggt

SEQ ID NO: 39794 - DNA, 20 bp, Artificial Sequence
  chemically synthesized
tgggagagggaatgtgggtg

SEQ ID NO: 39795 - DNA, 20 bp, Artificial Sequence
  chemically synthesized
gagagggaatgtgggtgagg

SEQ ID NO: 39796 - DNA, 20 bp, Artificial Sequence
  chemically synthesized
agagggaatgtgggtgaggt

SEQ ID NO: 39797 - DNA, 20 bp, Artificial Sequence
  chemically synthesized
gagggaatgtgggtgaggta

SEQ ID NO: 39798 - DNA, 20 bp, Artificial Sequence
  chemically synthesized
ggaatgtgggtgaggtaggg

SEQ ID NO: 39799 - DNA, 20 bp, Artificial Sequence
  chemically synthesized
gaggtagggtggtgatttct

SEQ ID NO: 39800 - DNA, 20 bp, Artificial Sequence
  chemically synthesized
aggtagggtggtgatttctg

SEQ ID NO: 39801 - DNA, 20 bp, Artificial Sequence
  chemically synthesized
tagggtggtgatttctgagg

SEQ ID NO: 39802 - DNA, 20 bp, Artificial Sequence
  chemically synthesized
ggtggtgatttctgaggtag

SEQ ID NO: 39803 - DNA, 20 bp, Artificial Sequence
  chemically synthesized
atagaatataaccactacct

SEQ ID NO: 39804 - DNA, 20 bp, Artificial Sequence
  chemically synthesized
gaaaagcttgaggagaaaca

SEQ ID NO: 39805 - DNA, 20 bp, Artificial Sequence
  chemically synthesized
tatattctatgtttctcctc

SEQ ID NO: 39806 - DNA, 20 bp, Artificial Sequence
  chemically synthesized
ttcaaaatgaaaagcttgag

SEQ ID NO: 39807 - DNA, 20 bp, Artificial Sequence
  chemically synthesized
ttttcaaaatgaaaagcttg

SEQ ID NO: 39808 - DNA, 20 bp, Artificial Sequence
  chemically synthesized
attttcaaaatgaaaagctt

SEQ ID NO: 39809 - DNA, 20 bp, Artificial Sequence
  chemically synthesized
tttaaaattttcaaaatgaa

SEQ ID NO: 39810 - DNA, 20 bp, Artificial Sequence
  chemically synthesized
tgttcttttaacatttcaat

SEQ ID NO: 39811 - DNA, 20 bp, Artificial Sequence
  chemically synthesized
taaaccaattgaaatgttaa

SEQ ID NO: 39812 - DNA, 20 bp, Artificial Sequence
  chemically synthesized
agtctaagtgaatggtttat

SEQ ID NO: 39813 - DNA, 20 bp, Artificial Sequence
  chemically synthesized
gagtctaagtgaatggttta

SEQ ID NO: 39814 - DNA, 20 bp, Artificial Sequence
  chemically synthesized
acacccataaaccattcact

SEQ ID NO: 39815 - DNA, 20 bp, Artificial Sequence
  chemically synthesized
agttggggagtctaagtgaa

SEQ ID NO: 39816 - DNA, 20 bp, Artificial Sequence
  chemically synthesized
tgttaacagttggggagtct

SEQ ID NO: 39817 - DNA, 20 bp, Artificial Sequence
  chemically synthesized
atattatgttaacagttggg

SEQ ID NO: 39818 - DNA, 20 bp, Artificial Sequence
  chemically synthesized
gaatattatgttaacagttg

SEQ ID NO: 39819 - DNA, 20 bp, Artificial Sequence
  chemically synthesized
cgaatattatgttaacagtt

SEQ ID NO: 39820 - DNA, 20 bp, Artificial Sequence
  chemically synthesized
gcgaatattatgttaacagt

SEQ ID NO: 39821 - DNA, 20 bp, Artificial Sequence
  chemically synthesized
gaaagcgaatattatgttaa

SEQ ID NO: 39822 - DNA, 20 bp, Artificial Sequence
  chemically synthesized
tggtgagagagagagagaga

SEQ ID NO: 39823 - DNA, 20 bp, Artificial Sequence
  chemically synthesized
ggagtggtgagagagagaga

SEQ ID NO: 39824 - DNA, 20 bp, Artificial Sequence
  chemically synthesized
ggggagtggtgagagagaga

SEQ ID NO: 39825 - DNA, 20 bp, Artificial Sequence
  chemically synthesized
tgggggagtggtgagagaga

SEQ ID NO: 39826 - DNA, 20 bp, Artificial Sequence
  chemically synthesized
gttgggggagtggtgagaga

SEQ ID NO: 39827 - DNA, 20 bp, Artificial Sequence
  chemically synthesized
gggttgggggagtggtgaga

SEQ ID NO: 39828 - DNA, 20 bp, Artificial Sequence
  chemically synthesized
ccgggttgggggagtggtga

SEQ ID NO: 39829 - DNA, 20 bp, Artificial Sequence
  chemically synthesized
caccgggttgggggagtggt

SEQ ID NO: 39830 - DNA, 20 bp, Artificial Sequence
  chemically synthesized
cacacaccgggttgggggag

SEQ ID NO: 39831 - DNA, 20 bp, Artificial Sequence
  chemically synthesized
acacacacaccgggttgggg

SEQ ID NO: 39832 - DNA, 20 bp, Artificial Sequence
  chemically synthesized
ctctcaccactcccccaacc

SEQ ID NO: 39833 - DNA, 20 bp, Artificial Sequence
  chemically synthesized
acacacacacaccgggttgg

SEQ ID NO: 39834 - DNA, 20 bp, Artificial Sequence
  chemically synthesized
cacacacacacaccgggttg

SEQ ID NO: 39835 - DNA, 20 bp, Artificial Sequence
  chemically synthesized
acacacacacacaccgggtt

SEQ ID NO: 39836 - DNA, 20 bp, Artificial Sequence
  chemically synthesized
cacacacacacacaccgggt

SEQ ID NO: 39837 - DNA, 20 bp, Artificial Sequence
  chemically synthesized
cacacacacacacacacacc

SEQ ID NO: 39838 - DNA, 20 bp, Artificial Sequence
  chemically synthesized
acacacacacacacacacac

SEQ ID NO: 39839 - DNA, 20 bp, Artificial Sequence
  chemically synthesized
tgtgtgtgtgtgtgtgtgtg

SEQ ID NO: 39840 - DNA, 20 bp, Artificial Sequence
  chemically synthesized
gtgtgtgtgtgtgtgtagtc

SEQ ID NO: 39841 - DNA, 20 bp, Artificial Sequence
  chemically synthesized
tgtgtgtgtgtagtctggtt

SEQ ID NO: 39842 - DNA, 20 bp, Artificial Sequence
  chemically synthesized
cacacacacacacactaaac

SEQ ID NO: 39843 - DNA, 20 bp, Artificial Sequence
  chemically synthesized
gtgtgtgtgtgtgtgtaatc

SEQ ID NO: 39844 - DNA, 20 bp, Artificial Sequence
  chemically synthesized
tgtgtgtgtgtaatctggtt

SEQ ID NO: 39845 - DNA, 20 bp, Artificial Sequence
  chemically synthesized
gtgtgtgtgtaatctggttt

SEQ ID NO: 39846 - DNA, 20 bp, Artificial Sequence
  chemically synthesized
tgtgtgtgtaatctggttta

SEQ ID NO: 39847 - DNA, 20 bp, Artificial Sequence
  chemically synthesized
cattatcagtagccctaaac

SEQ ID NO: 39848 - DNA, 20 bp, Artificial Sequence
  chemically synthesized
agtaaataaaacattatcag

SEQ ID NO: 39849 - DNA, 20 bp, Artificial Sequence
  chemically synthesized
gacagtaaataaaacattat

SEQ ID NO: 39850 - DNA, 20 bp, Artificial Sequence
  chemically synthesized
taatgttttatttactgtcc

SEQ ID NO: 39851 - DNA, 20 bp, Artificial Sequence
  chemically synthesized
gttttatttactgtcctaga

SEQ ID NO: 39852 - DNA, 20 bp, Artificial Sequence
  chemically synthesized
cctatgttcgccatctagga

SEQ ID NO: 39853 - DNA, 20 bp, Artificial Sequence
  chemically synthesized
tacacctatgttcgccatct

SEQ ID NO: 39854 - DNA, 20 bp, Artificial Sequence
  chemically synthesized
atacacctatgttcgccatc

SEQ ID NO: 39855 - DNA, 20 bp, Artificial Sequence
  chemically synthesized
actgtcctagatggcgaaca

SEQ ID NO: 39856 - DNA, 20 bp, Artificial Sequence
  chemically synthesized
ctgtcctagatggcgaacat

SEQ ID NO: 39857 - DNA, 20 bp, Artificial Sequence
  chemically synthesized
cattttgtgataattgcatt

SEQ ID NO: 39858 - DNA, 20 bp, Artificial Sequence
  chemically synthesized
gtatacagatgaaacatgtt

SEQ ID NO: 39859 - DNA, 20 bp, Artificial Sequence
  chemically synthesized
acccacattcagaaagtata

SEQ ID NO: 39860 - DNA, 20 bp, Artificial Sequence
  chemically synthesized
aagaatgacccacattcaga

SEQ ID NO: 39861 - DNA, 20 bp, Artificial Sequence
  chemically synthesized
atctgtatactttctgaatg

SEQ ID NO: 39862 - DNA, 20 bp, Artificial Sequence
  chemically synthesized
tctgtatactttctgaatgt

SEQ ID NO: 39863 - DNA, 20 bp, Artificial Sequence
  chemically synthesized
cttgaagaatgacccacatt

SEQ ID NO: 39864 - DNA, 20 bp, Artificial Sequence
  chemically synthesized
ctgaatgtgggtcattcttc

SEQ ID NO: 39865 - DNA, 20 bp, Artificial Sequence
  chemically synthesized
gaatctcttttttttgcttg

SEQ ID NO: 39866 - DNA, 20 bp, Artificial Sequence
  chemically synthesized
gtcattcttcaagcaaaaaa

SEQ ID NO: 39867 - DNA, 20 bp, Artificial Sequence
  chemically synthesized
cattcttcaagcaaaaaaaa

SEQ ID NO: 39868 - DNA, 20 bp, Artificial Sequence
  chemically synthesized
cgagggcgttttcaaaaaat

SEQ ID NO: 39869 - DNA, 20 bp, Artificial Sequence
  chemically synthesized
attgaatgcattgttttcga

SEQ ID NO: 39870 - DNA, 20 bp, Artificial Sequence
  chemically synthesized
tattgaatgcattgttttcg

SEQ ID NO: 39871 - DNA, 20 bp, Artificial Sequence
  chemically synthesized
gtattgaatgcattgttttc

SEQ ID NO: 39872 - DNA, 20 bp, Artificial Sequence
  chemically synthesized
aatcattacccatagtattt

SEQ ID NO: 39873 - DNA, 20 bp, Artificial Sequence
  chemically synthesized
aacacattactgaaatacta

SEQ ID NO: 39874 - DNA, 20 bp, Artificial Sequence
  chemically synthesized
acacattactgaaatactat

SEQ ID NO: 39875 - DNA, 20 bp, Artificial Sequence
  chemically synthesized
caacaaaaaatcattaccca

SEQ ID NO: 39876 - DNA, 20 bp, Artificial Sequence
  chemically synthesized
gattttttgttgttgctgtt

SEQ ID NO: 39877 - DNA, 20 bp, Artificial Sequence
  chemically synthesized
ttttgttgttgctgtttaga

SEQ ID NO: 39878 - DNA, 20 bp, Artificial Sequence
  chemically synthesized
tttccctaacgctgtctaaa

SEQ ID NO: 39879 - DNA, 20 bp, Artificial Sequence
  chemically synthesized
tgttgctgtttagacagcgt

SEQ ID NO: 39880 - DNA, 20 bp, Artificial Sequence
  chemically synthesized
gttgctgtttagacagcgtt

SEQ ID NO: 39881 - DNA, 20 bp, Artificial Sequence
  chemically synthesized
ttgctgtttagacagcgtta

SEQ ID NO: 39882 - DNA, 20 bp, Artificial Sequence
  chemically synthesized
atagatcagaaaatatggtg

SEQ ID NO: 39883 - DNA, 20 bp, Artificial Sequence
  chemically synthesized
aataaatagatcagaaaata

SEQ ID NO: 39884 - DNA, 20 bp, Artificial Sequence
  chemically synthesized
tccttgttcaataaatagat

SEQ ID NO: 39885 - DNA, 20 bp, Artificial Sequence
  chemically synthesized
aggtatccttgttcaataaa

SEQ ID NO: 39886 - DNA, 20 bp, Artificial Sequence
  chemically synthesized
ttctgatctatttattgaac

SEQ ID NO: 39887 - DNA, 20 bp, Artificial Sequence
  chemically synthesized
tctgatctatttattgaaca

SEQ ID NO: 39888 - DNA, 20 bp, Artificial Sequence
  chemically synthesized
tgaacaaggatacctcaatg

SEQ ID NO: 39889 - DNA, 20 bp, Artificial Sequence
  chemically synthesized
caagcctcactgccacattg

SEQ ID NO: 39890 - DNA, 20 bp, Artificial Sequence
  chemically synthesized
acaaggatacctcaatgtgg

SEQ ID NO: 39891 - DNA, 20 bp, Artificial Sequence
  chemically synthesized
ccaagcctcactgccacatt

SEQ ID NO: 39892 - DNA, 20 bp, Artificial Sequence
  chemically synthesized
ggatacctcaatgtggcagt

SEQ ID NO: 39893 - DNA, 20 bp, Artificial Sequence
  chemically synthesized
gatacctcaatgtggcagtg

SEQ ID NO: 39894 - DNA, 20 bp, Artificial Sequence
  chemically synthesized
ctcaatgtggcagtgaggct

SEQ ID NO: 39895 - DNA, 20 bp, Artificial Sequence
  chemically synthesized
tcaatgtggcagtgaggctt

SEQ ID NO: 39896 - DNA, 20 bp, Artificial Sequence
  chemically synthesized
tgacataacaattttaaccc

SEQ ID NO: 39897 - DNA, 20 bp, Artificial Sequence
  chemically synthesized
gggttaaaattgttatgtca

SEQ ID NO: 39898 - DNA, 20 bp, Artificial Sequence
  chemically synthesized
tatgtcacagcctcacctgc

SEQ ID NO: 39899 - DNA, 20 bp, Artificial Sequence
  chemically synthesized
cggaaaacaaccagcaggtg

SEQ ID NO: 39900 - DNA, 20 bp, Artificial Sequence
  chemically synthesized
acggaaaacaaccagcaggt

SEQ ID NO: 39901 - DNA, 20 bp, Artificial Sequence
  chemically synthesized
ggctacggaaaacaaccagc

SEQ ID NO: 39902 - DNA, 20 bp, Artificial Sequence
  chemically synthesized
tggctacggaaaacaaccag

SEQ ID NO: 39903 - DNA, 20 bp, Artificial Sequence
  chemically synthesized
gtatggctacggaaaacaac

SEQ ID NO: 39904 - DNA, 20 bp, Artificial Sequence
  chemically synthesized
cacctgctggttgttttccg

SEQ ID NO: 39905 - DNA, 20 bp, Artificial Sequence
  chemically synthesized
gcaagtgtagagtatggcta

SEQ ID NO: 39906 - DNA, 20 bp, Artificial Sequence
  chemically synthesized
acagaagcaagtgtagagta

SEQ ID NO: 39907 - DNA, 20 bp, Artificial Sequence
  chemically synthesized
ataatacagaagcaagtgta

SEQ ID NO: 39908 - DNA, 20 bp, Artificial Sequence
  chemically synthesized
atataatacagaagcaagtg

SEQ ID NO: 39909 - DNA, 20 bp, Artificial Sequence
  chemically synthesized
tctccatataatacagaagc

SEQ ID NO: 39910 - DNA, 20 bp, Artificial Sequence
  chemically synthesized
cttatctccatataatacag

SEQ ID NO: 39911 - DNA, 20 bp, Artificial Sequence
  chemically synthesized
acacttgcttctgtattata

SEQ ID NO: 39912 - DNA, 20 bp, Artificial Sequence
  chemically synthesized
tttcttatctccatataata

SEQ ID NO: 39913 - DNA, 20 bp, Artificial Sequence
  chemically synthesized
acttgcttctgtattatatg

SEQ ID NO: 39914 - DNA, 20 bp, Artificial Sequence
  chemically synthesized
cttctgtattatatggagat

SEQ ID NO: 39915 - DNA, 20 bp, Artificial Sequence
  chemically synthesized
ttaaaagcagcaagtatggg

SEQ ID NO: 39916 - DNA, 20 bp, Artificial Sequence
  chemically synthesized
ttttaaaagcagcaagtatg

SEQ ID NO: 39917 - DNA, 20 bp, Artificial Sequence
  chemically synthesized
attttaaaagcagcaagtat

SEQ ID NO: 39918 - DNA, 20 bp, Artificial Sequence
  chemically synthesized
cattttaaaagcagcaagta

SEQ ID NO: 39919 - DNA, 20 bp, Artificial Sequence
  chemically synthesized
aaaaacattttaaaagcagc

SEQ ID NO: 39920 - DNA, 20 bp, Artificial Sequence
  chemically synthesized
tcttaaaaacattttaaaag

SEQ ID NO: 39921 - DNA, 20 bp, Artificial Sequence
  chemically synthesized
ttgtcttaaaaacattttaa

SEQ ID NO: 39922 - DNA, 20 bp, Artificial Sequence
  chemically synthesized
gctgcttttaaaatgttttt

SEQ ID NO: 39923 - DNA, 20 bp, Artificial Sequence
  chemically synthesized
ttttaaaatgtttttaagac

SEQ ID NO: 39924 - DNA, 20 bp, Artificial Sequence
  chemically synthesized
tttaaaatgtttttaagaca

SEQ ID NO: 39925 - DNA, 20 bp, Artificial Sequence
  chemically synthesized
gtttttaagacaaggttgtt

SEQ ID NO: 39926 - DNA, 20 bp, Artificial Sequence
  chemically synthesized
tttttaagacaaggttgttc

SEQ ID NO: 39927 - DNA, 20 bp, Artificial Sequence
  chemically synthesized
ttttaagacaaggttgttca

SEQ ID NO: 39928 - DNA, 20 bp, Artificial Sequence
  chemically synthesized
agacaaggttgttcagggca

SEQ ID NO: 39929 - DNA, 20 bp, Artificial Sequence
  chemically synthesized
ggttgttcagggcacagaat

SEQ ID NO: 39930 - DNA, 20 bp, Artificial Sequence
  chemically synthesized
tcagggcacagaatgagaca

SEQ ID NO: 39931 - DNA, 20 bp, Artificial Sequence
  chemically synthesized
agggcacagaatgagacaca

SEQ ID NO: 39932 - DNA, 20 bp, Artificial Sequence
  chemically synthesized
gcacagaatgagacacagag

SEQ ID NO: 39933 - DNA, 20 bp, Artificial Sequence
  chemically synthesized
cacagaatgagacacagagc

SEQ ID NO: 39934 - DNA, 20 bp, Artificial Sequence
  chemically synthesized
acagaatgagacacagagcg

SEQ ID NO: 39935 - DNA, 20 bp, Artificial Sequence
  chemically synthesized
tgagacacagagcggggcta

SEQ ID NO: 39936 - DNA, 20 bp, Artificial Sequence
  chemically synthesized
gagacacagagcggggctat

SEQ ID NO: 39937 - DNA, 20 bp, Artificial Sequence
  chemically synthesized
agacacagagcggggctatg

SEQ ID NO: 39938 - DNA, 20 bp, Artificial Sequence
  chemically synthesized
gacacagagcggggctatgg

SEQ ID NO: 39939 - DNA, 20 bp, Artificial Sequence
  chemically synthesized
tgcactggcagtaaccccca

SEQ ID NO: 39940 - DNA, 20 bp, Artificial Sequence
  chemically synthesized
ggggctatgggggttactgc

SEQ ID NO: 39941 - DNA, 20 bp, Artificial Sequence
  chemically synthesized
tatgggggttactgccagtg

SEQ ID NO: 39942 - DNA, 20 bp, Artificial Sequence
  chemically synthesized
atgggggttactgccagtgc

SEQ ID NO: 39943 - DNA, 20 bp, Artificial Sequence
  chemically synthesized
taatatctaccctgcactgg

SEQ ID NO: 39944 - DNA, 20 bp, Artificial Sequence
  chemically synthesized
tgggggttactgccagtgca

SEQ ID NO: 39945 - DNA, 20 bp, Artificial Sequence
  chemically synthesized
atttaatatctaccctgcac

SEQ ID NO: 39946 - DNA, 20 bp, Artificial Sequence
  chemically synthesized
gggttactgccagtgcaggg

SEQ ID NO: 39947 - DNA, 20 bp, Artificial Sequence
  chemically synthesized
tagatattaaattgtcctat

SEQ ID NO: 39948 - DNA, 20 bp, Artificial Sequence
  chemically synthesized
tacttagtcgattaactgat

SEQ ID NO: 39949 - DNA, 20 bp, Artificial Sequence
  chemically synthesized
ttacttagtcgattaactga

SEQ ID NO: 39950 - DNA, 20 bp, Artificial Sequence
  chemically synthesized
gtcctatcagttaatcgact

SEQ ID NO: 39951 - DNA, 20 bp, Artificial Sequence
  chemically synthesized
agtcagaactgtgttttact

SEQ ID NO: 39952 - DNA, 20 bp, Artificial Sequence
  chemically synthesized
ttaatcgactaagtaaaaca

SEQ ID NO: 39953 - DNA, 20 bp, Artificial Sequence
  chemically synthesized
atttgtttggcagggggagt

SEQ ID NO: 39954 - DNA, 20 bp, Artificial Sequence
  chemically synthesized
aaccatttgtttggcagggg

SEQ ID NO: 39955 - DNA, 20 bp, Artificial Sequence
  chemically synthesized
ttaaccatttgtttggcagg

SEQ ID NO: 39956 - DNA, 20 bp, Artificial Sequence
  chemically synthesized
tttaaccatttgtttggcag

SEQ ID NO: 39957 - DNA, 20 bp, Artificial Sequence
  chemically synthesized
gtttaaccatttgtttggca

SEQ ID NO: 39958 - DNA, 20 bp, Artificial Sequence
  chemically synthesized
cgtttaaccatttgtttggc

SEQ ID NO: 39959 - DNA, 20 bp, Artificial Sequence
  chemically synthesized
tcgtttaaccatttgtttgg

SEQ ID NO: 39960 - DNA, 20 bp, Artificial Sequence
  chemically synthesized
gactccccctgccaaacaaa

SEQ ID NO: 39961 - DNA, 20 bp, Artificial Sequence
  chemically synthesized
tgctcgtttaaccatttgtt

SEQ ID NO: 39962 - DNA, 20 bp, Artificial Sequence
  chemically synthesized
tgccaaacaaatggttaaac

SEQ ID NO: 39963 - DNA, 20 bp, Artificial Sequence
  chemically synthesized
aaacaaatggttaaacgagc

SEQ ID NO: 39964 - DNA, 20 bp, Artificial Sequence
  chemically synthesized
atggttaaacgagcaagcta

SEQ ID NO: 39965 - DNA, 20 bp, Artificial Sequence
  chemically synthesized
ttaaacgagcaagctaaaga

SEQ ID NO: 39966 - DNA, 20 bp, Artificial Sequence
  chemically synthesized
taaacgagcaagctaaagaa

SEQ ID NO: 39967 - DNA, 20 bp, Artificial Sequence
  chemically synthesized
ggcctattatgtcctttctt

SEQ ID NO: 39968 - DNA, 20 bp, Artificial Sequence
  chemically synthesized
aagctaaagaaaggacataa

SEQ ID NO: 39969 - DNA, 20 bp, Artificial Sequence
  chemically synthesized
agctaaagaaaggacataat

SEQ ID NO: 39970 - DNA, 20 bp, Artificial Sequence
  chemically synthesized
aaagaaaggacataataggc

SEQ ID NO: 39971 - DNA, 20 bp, Artificial Sequence
  chemically synthesized
aagaaaggacataataggcc

SEQ ID NO: 39972 - DNA, 20 bp, Artificial Sequence
  chemically synthesized
aggacataataggccaggtg

SEQ ID NO: 39973 - DNA, 20 bp, Artificial Sequence
  chemically synthesized
acataataggccaggtgtgg

SEQ ID NO: 39974 - DNA, 20 bp, Artificial Sequence
  chemically synthesized
caggcgtgagccaccacacc

SEQ ID NO: 39975 - DNA, 20 bp, Artificial Sequence
  chemically synthesized
agtgctgggattacaggcgt

SEQ ID NO: 39976 - DNA, 20 bp, Artificial Sequence
  chemically synthesized
gtggctcacgcctgtaatcc

SEQ ID NO: 39977 - DNA, 20 bp, Artificial Sequence
  chemically synthesized
tcccaaagtgctgggattac

SEQ ID NO: 39978 - DNA, 20 bp, Artificial Sequence
  chemically synthesized
atcccaaagtgctgggatta

SEQ ID NO: 39979 - DNA, 20 bp, Artificial Sequence
  chemically synthesized
cgcctgtaatcccagcactt

SEQ ID NO: 39980 - DNA, 20 bp, Artificial Sequence
  chemically synthesized
ccttggcatcccaaagtgct

SEQ ID NO: 39981 - DNA, 20 bp, Artificial Sequence
  chemically synthesized
gcctgtaatcccagcacttt

SEQ ID NO: 39982 - DNA, 20 bp, Artificial Sequence
  chemically synthesized
gccttggcatcccaaagtgc

SEQ ID NO: 39983 - DNA, 20 bp, Artificial Sequence
  chemically synthesized
cctcctgccttggcatccca

SEQ ID NO: 39984 - DNA, 20 bp, Artificial Sequence
  chemically synthesized
tcccagcactttgggatgcc

SEQ ID NO: 39985 - DNA, 20 bp, Artificial Sequence
  chemically synthesized
cccagcactttgggatgcca

SEQ ID NO: 39986 - DNA, 20 bp, Artificial Sequence
  chemically synthesized
agcactttgggatgccaagg

SEQ ID NO: 39987 - DNA, 20 bp, Artificial Sequence
  chemically synthesized
gcactttgggatgccaaggc

SEQ ID NO: 39988 - DNA, 20 bp, Artificial Sequence
  chemically synthesized
actttgggatgccaaggcag

SEQ ID NO: 39989 - DNA, 20 bp, Artificial Sequence
  chemically synthesized
ctttgggatgccaaggcagg

SEQ ID NO: 39990 - DNA, 20 bp, Artificial Sequence
  chemically synthesized
ctcaagcgatcctcctgcct

SEQ ID NO: 39991 - DNA, 20 bp, Artificial Sequence
  chemically synthesized
ccaaggcaggaggatcgctt

SEQ ID NO: 39992 - DNA, 20 bp, Artificial Sequence
  chemically synthesized
gcaggaggatcgcttgagcc

SEQ ID NO: 39993 - DNA, 20 bp, Artificial Sequence
  chemically synthesized
caggaggatcgcttgagcca

SEQ ID NO: 39994 - DNA, 20 bp, Artificial Sequence
  chemically synthesized
gacctcgaactccttggctc

SEQ ID NO: 39995 - DNA, 20 bp, Artificial Sequence
  chemically synthesized
ggaggatcgcttgagccaag

SEQ ID NO: 39996 - DNA, 20 bp, Artificial Sequence
  chemically synthesized
caggctgacctcgaactcct

SEQ ID NO: 39997 - DNA, 20 bp, Artificial Sequence
  chemically synthesized
tcgcttgagccaaggagttc

SEQ ID NO: 39998 - DNA, 20 bp, Artificial Sequence
  chemically synthesized
cgcttgagccaaggagttcg

SEQ ID NO: 39999 - DNA, 20 bp, Artificial Sequence
  chemically synthesized
tgagccaaggagttcgaggt

SEQ ID NO: 40000 - DNA, 20 bp, Artificial Sequence
  chemically synthesized
caaggagttcgaggtcagcc

SEQ ID NO: 40001 - DNA, 20 bp, Artificial Sequence
  chemically synthesized
aaggagttcgaggtcagcct

SEQ ID NO: 40002 - DNA, 20 bp, Artificial Sequence
  chemically synthesized
gtagtctcaccatgttgccc

SEQ ID NO: 40003 - DNA, 20 bp, Artificial Sequence
  chemically synthesized
cgaggtcagcctgggcaaca

SEQ ID NO: 40004 - DNA, 20 bp, Artificial Sequence
  chemically synthesized
ggtagtctcaccatgttgcc

SEQ ID NO: 40005 - DNA, 20 bp, Artificial Sequence
  chemically synthesized
gtcagcctgggcaacatggt

SEQ ID NO: 40006 - DNA, 20 bp, Artificial Sequence
  chemically synthesized
gtagagatggcagcaggggg

SEQ ID NO: 40007 - DNA, 20 bp, Artificial Sequence
  chemically synthesized
ttcgtagagatggcagcagg

SEQ ID NO: 40008 - DNA, 20 bp, Artificial Sequence
  chemically synthesized
tttcgtagagatggcagcag

SEQ ID NO: 40009 - DNA, 20 bp, Artificial Sequence
  chemically synthesized
ttttcgtagagatggcagca

SEQ ID NO: 40010 - DNA, 20 bp, Artificial Sequence
  chemically synthesized
cttttcgtagagatggcagc

SEQ ID NO: 40011 - DNA, 20 bp, Artificial Sequence
  chemically synthesized
tcttttcgtagagatggcag

SEQ ID NO: 40012 - DNA, 20 bp, Artificial Sequence
  chemically synthesized
ttttcttttcgtagagatgg

SEQ ID NO: 40013 - DNA, 20 bp, Artificial Sequence
  chemically synthesized
gtattttcttttcgtagaga

SEQ ID NO: 40014 - DNA, 20 bp, Artificial Sequence
  chemically synthesized
cctgctgccatctctacgaa

SEQ ID NO: 40015 - DNA, 20 bp, Artificial Sequence
  chemically synthesized
ttttgtattttcttttcgta

SEQ ID NO: 40016 - DNA, 20 bp, Artificial Sequence
  chemically synthesized
ttttttgtattttcttttcg

SEQ ID NO: 40017 - DNA, 20 bp, Artificial Sequence
  chemically synthesized
cgaaaagaaaatacaaaaaa

SEQ ID NO: 40018 - DNA, 20 bp, Artificial Sequence
  chemically synthesized
gaaaagaaaatacaaaaaaa

SEQ ID NO: 40019 - DNA, 20 bp, Artificial Sequence
  chemically synthesized
agaaaatacaaaaaaaagga

SEQ ID NO: 40020 - DNA, 20 bp, Artificial Sequence
  chemically synthesized
aaagcacataatattttcca

SEQ ID NO: 40021 - DNA, 20 bp, Artificial Sequence
  chemically synthesized
acataatattttccaaagct

SEQ ID NO: 40022 - DNA, 20 bp, Artificial Sequence
  chemically synthesized
cctactttttatctaagctt

SEQ ID NO: 40023 - DNA, 20 bp, Artificial Sequence
  chemically synthesized
ttttccaaagcttagataaa

SEQ ID NO: 40024 - DNA, 20 bp, Artificial Sequence
  chemically synthesized
atctatcctactttttatct

SEQ ID NO: 40025 - DNA, 20 bp, Artificial Sequence
  chemically synthesized
tccaaagcttagataaaaag

SEQ ID NO: 40026 - DNA, 20 bp, Artificial Sequence
  chemically synthesized
ccaaagcttagataaaaagt

SEQ ID NO: 40027 - DNA, 20 bp, Artificial Sequence
  chemically synthesized
agcttagataaaaagtagga

SEQ ID NO: 40028 - DNA, 20 bp, Artificial Sequence
  chemically synthesized
aaaagtaggatagatgacct

SEQ ID NO: 40029 - DNA, 20 bp, Artificial Sequence
  chemically synthesized
aaagtaggatagatgacctg

SEQ ID NO: 40030 - DNA, 20 bp, Artificial Sequence
  chemically synthesized
tatgtttctttttcatcctc

SEQ ID NO: 40031 - DNA, 20 bp, Artificial Sequence
  chemically synthesized
ttatgtttctttttcatcct

SEQ ID NO: 40032 - DNA, 20 bp, Artificial Sequence
  chemically synthesized
tagatgacctgaggatgaaa

SEQ ID NO: 40033 - DNA, 20 bp, Artificial Sequence
  chemically synthesized
atgaaaaagaaacataatta

SEQ ID NO: 40034 - DNA, 20 bp, Artificial Sequence
  chemically synthesized
aaaaagaaacataattatag

SEQ ID NO: 40035 - DNA, 20 bp, Artificial Sequence
  chemically synthesized
tctgttggtaaacaacacaa

SEQ ID NO: 40036 - DNA, 20 bp, Artificial Sequence
  chemically synthesized
ttctgttggtaaacaacaca

SEQ ID NO: 40037 - DNA, 20 bp, Artificial Sequence
  chemically synthesized
tcctttgtgttgtttaccaa

SEQ ID NO: 40038 - DNA, 20 bp, Artificial Sequence
  chemically synthesized
tattgttaattcatttctgt

SEQ ID NO: 40039 - DNA, 20 bp, Artificial Sequence
  chemically synthesized
acagaaatgaattaacaata

SEQ ID NO: 40040 - DNA, 20 bp, Artificial Sequence
  chemically synthesized
gaattaacaatacggcacaa

SEQ ID NO: 40041 - DNA, 20 bp, Artificial Sequence
  chemically synthesized
ggcacaacagaacaaacaca

SEQ ID NO: 40042 - DNA, 20 bp, Artificial Sequence
  chemically synthesized
aacagaacaaacacacagct

SEQ ID NO: 40043 - DNA, 20 bp, Artificial Sequence
  chemically synthesized
caaacacacagcttagacaa

SEQ ID NO: 40044 - DNA, 20 bp, Artificial Sequence
  chemically synthesized
ggactaagttgcttttgtct

SEQ ID NO: 40045 - DNA, 20 bp, Artificial Sequence
  chemically synthesized
cagcttagacaaaagcaact

SEQ ID NO: 40046 - DNA, 20 bp, Artificial Sequence
  chemically synthesized
agacaaaagcaacttagtcc

SEQ ID NO: 40047 - DNA, 20 bp, Artificial Sequence
  chemically synthesized
atggactagaatctgggact

SEQ ID NO: 40048 - DNA, 20 bp, Artificial Sequence
  chemically synthesized
agcaacttagtcccagattc

SEQ ID NO: 40049 - DNA, 20 bp, Artificial Sequence
  chemically synthesized
tttgctatggactagaatct

SEQ ID NO: 40050 - DNA, 20 bp, Artificial Sequence
  chemically synthesized
atttgctatggactagaatc

SEQ ID NO: 40051 - DNA, 20 bp, Artificial Sequence
  chemically synthesized
tagtcccagattctagtcca

SEQ ID NO: 40052 - DNA, 20 bp, Artificial Sequence
  chemically synthesized
ttagatcatttgctatggac

SEQ ID NO: 40053 - DNA, 20 bp, Artificial Sequence
  chemically synthesized
ctatcttagatcatttgcta

SEQ ID NO: 40054 - DNA, 20 bp, Artificial Sequence
  chemically synthesized
tagtccatagcaaatgatct

SEQ ID NO: 40055 - DNA, 20 bp, Artificial Sequence
  chemically synthesized
ccatagcaaatgatctaaga

SEQ ID NO: 40056 - DNA, 20 bp, Artificial Sequence
  chemically synthesized
tgagatgtctggatctatct

SEQ ID NO: 40057 - DNA, 20 bp, Artificial Sequence
  chemically synthesized
caaatgatctaagatagatc

SEQ ID NO: 40058 - DNA, 20 bp, Artificial Sequence
  chemically synthesized
aactgaggctttgagatgtc

SEQ ID NO: 40059 - DNA, 20 bp, Artificial Sequence
  chemically synthesized
agatagatccagacatctca

SEQ ID NO: 40060 - DNA, 20 bp, Artificial Sequence
  chemically synthesized
atccagacatctcaaagcct

SEQ ID NO: 40061 - DNA, 20 bp, Artificial Sequence
  chemically synthesized
gacttggaaactgaggcttt

SEQ ID NO: 40062 - DNA, 20 bp, Artificial Sequence
  chemically synthesized
tcccacagacttggaaactg

SEQ ID NO: 40063 - DNA, 20 bp, Artificial Sequence
  chemically synthesized
atctcaaagcctcagtttcc

SEQ ID NO: 40064 - DNA, 20 bp, Artificial Sequence
  chemically synthesized
ttcccacagacttggaaact

SEQ ID NO: 40065 - DNA, 20 bp, Artificial Sequence
  chemically synthesized
agcctcagtttccaagtctg

SEQ ID NO: 40066 - DNA, 20 bp, Artificial Sequence
  chemically synthesized
gcctcagtttccaagtctgt

SEQ ID NO: 40067 - DNA, 20 bp, Artificial Sequence
  chemically synthesized
tattcttattcccacagact

SEQ ID NO: 40068 - DNA, 20 bp, Artificial Sequence
  chemically synthesized
gtttccaagtctgtgggaat

SEQ ID NO: 40069 - DNA, 20 bp, Artificial Sequence
  chemically synthesized
tatgattattcttattccca

SEQ ID NO: 40070 - DNA, 20 bp, Artificial Sequence
  chemically synthesized
caatatcccatggaatgttt

SEQ ID NO: 40071 - DNA, 20 bp, Artificial Sequence
  chemically synthesized
tatgatactcaaacattcca

SEQ ID NO: 40072 - DNA, 20 bp, Artificial Sequence
  chemically synthesized
atgatactcaaacattccat

SEQ ID NO: 40073 - DNA, 20 bp, Artificial Sequence
  chemically synthesized
ttgattcttacaatatccca

SEQ ID NO: 40074 - DNA, 20 bp, Artificial Sequence
  chemically synthesized
aacattccatgggatattgt

SEQ ID NO: 40075 - DNA, 20 bp, Artificial Sequence
  chemically synthesized
catgggatattgtaagaatc

SEQ ID NO: 40076 - DNA, 20 bp, Artificial Sequence
  chemically synthesized
gtaagaatcaagtgtgataa

SEQ ID NO: 40077 - DNA, 20 bp, Artificial Sequence
  chemically synthesized
aagaatcaagtgtgataata

SEQ ID NO: 40078 - DNA, 20 bp, Artificial Sequence
  chemically synthesized
agaatcaagtgtgataatag

SEQ ID NO: 40079 - DNA, 20 bp, Artificial Sequence
  chemically synthesized
aagtgtgataatagaggtga

SEQ ID NO: 40080 - DNA, 20 bp, Artificial Sequence
  chemically synthesized
agaggtgaaagtgttcgata

SEQ ID NO: 40081 - DNA, 20 bp, Artificial Sequence
  chemically synthesized
gatagccccatgtgtttgta

SEQ ID NO: 40082 - DNA, 20 bp, Artificial Sequence
  chemically synthesized
taaagtgctatacaaacaca

SEQ ID NO: 40083 - DNA, 20 bp, Artificial Sequence
  chemically synthesized
aaagtgctatacaaacacat

SEQ ID NO: 40084 - DNA, 20 bp, Artificial Sequence
  chemically synthesized
aagtgctatacaaacacatg

SEQ ID NO: 40085 - DNA, 20 bp, Artificial Sequence
  chemically synthesized
aaacacatggggctatctat

SEQ ID NO: 40086 - DNA, 20 bp, Artificial Sequence
  chemically synthesized
tcaggtagataacttataga

SEQ ID NO: 40087 - DNA, 20 bp, Artificial Sequence
  chemically synthesized
atattcaggtagataactta

SEQ ID NO: 40088 - DNA, 20 bp, Artificial Sequence
  chemically synthesized
gggtagaggatatattcagg

SEQ ID NO: 40089 - DNA, 20 bp, Artificial Sequence
  chemically synthesized
ttcgggtagaggatatattc

SEQ ID NO: 40090 - DNA, 20 bp, Artificial Sequence
  chemically synthesized
gttcgggtagaggatatatt

SEQ ID NO: 40091 - DNA, 20 bp, Artificial Sequence
  chemically synthesized
tgccatggatgttcgggtag

SEQ ID NO: 40092 - DNA, 20 bp, Artificial Sequence
  chemically synthesized
atgccatggatgttcgggta

SEQ ID NO: 40093 - DNA, 20 bp, Artificial Sequence
  chemically synthesized
taatgccatggatgttcggg

SEQ ID NO: 40094 - DNA, 20 bp, Artificial Sequence
  chemically synthesized
ttctaatgccatggatgttc

SEQ ID NO: 40095 - DNA, 20 bp, Artificial Sequence
  chemically synthesized
tttctaatgccatggatgtt

SEQ ID NO: 40096 - DNA, 20 bp, Artificial Sequence
  chemically synthesized
atcctctacccgaacatcca

SEQ ID NO: 40097 - DNA, 20 bp, Artificial Sequence
  chemically synthesized
tacccgaacatccatggcat

SEQ ID NO: 40098 - DNA, 20 bp, Artificial Sequence
  chemically synthesized
ccatggtctttctaatgcca

SEQ ID NO: 40099 - DNA, 20 bp, Artificial Sequence
  chemically synthesized
cgaacatccatggcattaga

SEQ ID NO: 40100 - DNA, 20 bp, Artificial Sequence
  chemically synthesized
ccatggcattagaaagacca

SEQ ID NO: 40101 - DNA, 20 bp, Artificial Sequence
  chemically synthesized
catggcattagaaagaccat

SEQ ID NO: 40102 - DNA, 20 bp, Artificial Sequence
  chemically synthesized
cattagaaagaccatgggat

SEQ ID NO: 40103 - DNA, 20 bp, Artificial Sequence
  chemically synthesized
attagaaagaccatgggatc

SEQ ID NO: 40104 - DNA, 20 bp, Artificial Sequence
  chemically synthesized
tcttctgatacctgatccca

SEQ ID NO: 40105 - DNA, 20 bp, Artificial Sequence
  chemically synthesized
aagaccatgggatcaggtat

SEQ ID NO: 40106 - DNA, 20 bp, Artificial Sequence
  chemically synthesized
accatgggatcaggtatcag

SEQ ID NO: 40107 - DNA, 20 bp, Artificial Sequence
  chemically synthesized
ggatcaggtatcagaagatc

SEQ ID NO: 40108 - DNA, 20 bp, Artificial Sequence
  chemically synthesized
tatcagaagatctggttttc

SEQ ID NO: 40109 - DNA, 20 bp, Artificial Sequence
  chemically synthesized
gctaaactggtctagaaaac

SEQ ID NO: 40110 - DNA, 20 bp, Artificial Sequence
  chemically synthesized
gaagatctggttttctagac

SEQ ID NO: 40111 - DNA, 20 bp, Artificial Sequence
  chemically synthesized
gtaacatggctaaactggtc

SEQ ID NO: 40112 - DNA, 20 bp, Artificial Sequence
  chemically synthesized
tctggttttctagaccagtt

SEQ ID NO: 40113 - DNA, 20 bp, Artificial Sequence
  chemically synthesized
ttttagtaacatggctaaac

SEQ ID NO: 40114 - DNA, 20 bp, Artificial Sequence
  chemically synthesized
ggaaagtaattttagtaaca

SEQ ID NO: 40115 - DNA, 20 bp, Artificial Sequence
  chemically synthesized
ccaaaaggggaaagtaattt

SEQ ID NO: 40116 - DNA, 20 bp, Artificial Sequence
  chemically synthesized
aatggaagtccaaaagggga

SEQ ID NO: 40117 - DNA, 20 bp, Artificial Sequence
  chemically synthesized
ctaaaattactttccccttt

SEQ ID NO: 40118 - DNA, 20 bp, Artificial Sequence
  chemically synthesized
ggaaaatggaagtccaaaag

SEQ ID NO: 40119 - DNA, 20 bp, Artificial Sequence
  chemically synthesized
aggaaaatggaagtccaaaa

SEQ ID NO: 40120 - DNA, 20 bp, Artificial Sequence
  chemically synthesized
taggaaaatggaagtccaaa

SEQ ID NO: 40121 - DNA, 20 bp, Artificial Sequence
  chemically synthesized
ataggaaaatggaagtccaa

SEQ ID NO: 40122 - DNA, 20 bp, Artificial Sequence
  chemically synthesized
tcttacagataggaaaatgg

SEQ ID NO: 40123 - DNA, 20 bp, Artificial Sequence
  chemically synthesized
tcatcttacagataggaaaa

SEQ ID NO: 40124 - DNA, 20 bp, Artificial Sequence
  chemically synthesized
acttccattttcctatctgt

SEQ ID NO: 40125 - DNA, 20 bp, Artificial Sequence
  chemically synthesized
aaactcttcatcttacagat

SEQ ID NO: 40126 - DNA, 20 bp, Artificial Sequence
  chemically synthesized
caaactcttcatcttacaga

SEQ ID NO: 40127 - DNA, 20 bp, Artificial Sequence
  chemically synthesized
attttcctatctgtaagatg

SEQ ID NO: 40128 - DNA, 20 bp, Artificial Sequence
  chemically synthesized
aacccaaactcttcatctta

SEQ ID NO: 40129 - DNA, 20 bp, Artificial Sequence
  chemically synthesized
tttcctatctgtaagatgaa

SEQ ID NO: 40130 - DNA, 20 bp, Artificial Sequence
  chemically synthesized
tatctgtaagatgaagagtt

SEQ ID NO: 40131 - DNA, 20 bp, Artificial Sequence
  chemically synthesized
atctgtaagatgaagagttt

SEQ ID NO: 40132 - DNA, 20 bp, Artificial Sequence
  chemically synthesized
gtaagatgaagagtttgggt

SEQ ID NO: 40133 - DNA, 20 bp, Artificial Sequence
  chemically synthesized
aagaggaagaaagaatgtca

SEQ ID NO: 40134 - DNA, 20 bp, Artificial Sequence
  chemically synthesized
tgtgaaatgtaagaggaaga

SEQ ID NO: 40135 - DNA, 20 bp, Artificial Sequence
  chemically synthesized
aaattgtgaaatgtaagagg

SEQ ID NO: 40136 - DNA, 20 bp, Artificial Sequence
  chemically synthesized
ataaaattgtgaaatgtaag

SEQ ID NO: 40137 - DNA, 20 bp, Artificial Sequence
  chemically synthesized
gataaaattgtgaaatgtaa

SEQ ID NO: 40138 - DNA, 20 bp, Artificial Sequence
  chemically synthesized
gagataaaattgtgaaatgt

SEQ ID NO: 40139 - DNA, 20 bp, Artificial Sequence
  chemically synthesized
tacgtttactcaaatgtgag

SEQ ID NO: 40140 - DNA, 20 bp, Artificial Sequence
  chemically synthesized
aattttatctcctcacattt

SEQ ID NO: 40141 - DNA, 20 bp, Artificial Sequence
  chemically synthesized
agtacgtttactcaaatgtg

SEQ ID NO: 40142 - DNA, 20 bp, Artificial Sequence
  chemically synthesized
aagtacgtttactcaaatgt

SEQ ID NO: 40143 - DNA, 20 bp, Artificial Sequence
  chemically synthesized
tttgagtaaacgtacttctg

SEQ ID NO: 40144 - DNA, 20 bp, Artificial Sequence
  chemically synthesized
gtcagctaattagactgcag

SEQ ID NO: 40145 - DNA, 20 bp, Artificial Sequence
  chemically synthesized
tcagtcagctaattagactg

SEQ ID NO: 40146 - DNA, 20 bp, Artificial Sequence
  chemically synthesized
acgtacttctgcagtctaat

SEQ ID NO: 40147 - DNA, 20 bp, Artificial Sequence
  chemically synthesized
tcagtattcagtcagctaat

SEQ ID NO: 40148 - DNA, 20 bp, Artificial Sequence
  chemically synthesized
acgggtcatcagtattcagt

SEQ ID NO: 40149 - DNA, 20 bp, Artificial Sequence
  chemically synthesized
tataacgggtcatcagtatt

SEQ ID NO: 40150 - DNA, 20 bp, Artificial Sequence
  chemically synthesized
acacctctataacgggtcat

SEQ ID NO: 40151 - DNA, 20 bp, Artificial Sequence
  chemically synthesized
tgaatactgatgacccgtta

SEQ ID NO: 40152 - DNA, 20 bp, Artificial Sequence
  chemically synthesized
aatactgatgacccgttata

SEQ ID NO: 40153 - DNA, 20 bp, Artificial Sequence
  chemically synthesized
atactgatgacccgttatag

SEQ ID NO: 40154 - DNA, 20 bp, Artificial Sequence
  chemically synthesized
tgaaagcacacctctataac

SEQ ID NO: 40155 - DNA, 20 bp, Artificial Sequence
  chemically synthesized
ctgaaagcacacctctataa

SEQ ID NO: 40156 - DNA, 20 bp, Artificial Sequence
  chemically synthesized
ccgttatagaggtgtgcttt

SEQ ID NO: 40157 - DNA, 20 bp, Artificial Sequence
  chemically synthesized
gttatagaggtgtgctttca

SEQ ID NO: 40158 - DNA, 20 bp, Artificial Sequence
  chemically synthesized
gtcctttaacttatctctga

SEQ ID NO: 40159 - DNA, 20 bp, Artificial Sequence
  chemically synthesized
agaggtgtgctttcagagat

SEQ ID NO: 40160 - DNA, 20 bp, Artificial Sequence
  chemically synthesized
gtgctttcagagataagtta

SEQ ID NO: 40161 - DNA, 20 bp, Artificial Sequence
  chemically synthesized
tgctttcagagataagttaa

SEQ ID NO: 40162 - DNA, 20 bp, Artificial Sequence
  chemically synthesized
tcagagataagttaaaggac

SEQ ID NO: 40163 - DNA, 20 bp, Artificial Sequence
  chemically synthesized
aaaggacaagcttgtaatct

SEQ ID NO: 40164 - DNA, 20 bp, Artificial Sequence
  chemically synthesized
aactgttaccctaagattac

SEQ ID NO: 40165 - DNA, 20 bp, Artificial Sequence
  chemically synthesized
aaggacaagcttgtaatctt

SEQ ID NO: 40166 - DNA, 20 bp, Artificial Sequence
  chemically synthesized
aggacaagcttgtaatctta

SEQ ID NO: 40167 - DNA, 20 bp, Artificial Sequence
  chemically synthesized
agcttgtaatcttagggtaa

SEQ ID NO: 40168 - DNA, 20 bp, Artificial Sequence
  chemically synthesized
tctcccaaaactgttaccct

SEQ ID NO: 40169 - DNA, 20 bp, Artificial Sequence
  chemically synthesized
taatcttagggtaacagttt

SEQ ID NO: 40170 - DNA, 20 bp, Artificial Sequence
  chemically synthesized
aatcttagggtaacagtttt

SEQ ID NO: 40171 - DNA, 20 bp, Artificial Sequence
  chemically synthesized
tcttagggtaacagttttgg

SEQ ID NO: 40172 - DNA, 20 bp, Artificial Sequence
  chemically synthesized
tagggtaacagttttgggag

SEQ ID NO: 40173 - DNA, 20 bp, Artificial Sequence
  chemically synthesized
agggtaacagttttgggaga

SEQ ID NO: 40174 - DNA, 20 bp, Artificial Sequence
  chemically synthesized
ggtaacagttttgggagaag

SEQ ID NO: 40175 - DNA, 20 bp, Artificial Sequence
  chemically synthesized
gccattatcatttaagggaa

SEQ ID NO: 40176 - DNA, 20 bp, Artificial Sequence
  chemically synthesized
tttctgccattatcatttaa

SEQ ID NO: 40177 - DNA, 20 bp, Artificial Sequence
  chemically synthesized
atttctgccattatcattta

SEQ ID NO: 40178 - DNA, 20 bp, Artificial Sequence
  chemically synthesized
catttctgccattatcattt

SEQ ID NO: 40179 - DNA, 20 bp, Artificial Sequence
  chemically synthesized
tccattcccttaaatgataa

SEQ ID NO: 40180 - DNA, 20 bp, Artificial Sequence
  chemically synthesized
attcccttaaatgataatgg

SEQ ID NO: 40181 - DNA, 20 bp, Artificial Sequence
  chemically synthesized
aatggcagaaatgaccacta

SEQ ID NO: 40182 - DNA, 20 bp, Artificial Sequence
  chemically synthesized
atggcagaaatgaccactaa

SEQ ID NO: 40183 - DNA, 20 bp, Artificial Sequence
  chemically synthesized
gcagaaatgaccactaaagg

SEQ ID NO: 40184 - DNA, 20 bp, Artificial Sequence
  chemically synthesized
tacttcttgccttcctttag

SEQ ID NO: 40185 - DNA, 20 bp, Artificial Sequence
  chemically synthesized
cagaaatgaccactaaagga

SEQ ID NO: 40186 - DNA, 20 bp, Artificial Sequence
  chemically synthesized
agatacttcttgccttcctt

SEQ ID NO: 40187 - DNA, 20 bp, Artificial Sequence
  chemically synthesized
aatgaccactaaaggaaggc

SEQ ID NO: 40188 - DNA, 20 bp, Artificial Sequence
  chemically synthesized
gaccactaaaggaaggcaag

SEQ ID NO: 40189 - DNA, 20 bp, Artificial Sequence
  chemically synthesized
aaaggaaggcaagaagtatc

SEQ ID NO: 40190 - DNA, 20 bp, Artificial Sequence
  chemically synthesized
ggcaagaagtatctggttta

SEQ ID NO: 40191 - DNA, 20 bp, Artificial Sequence
  chemically synthesized
agattcagaatgccataaac

SEQ ID NO: 40192 - DNA, 20 bp, Artificial Sequence
  chemically synthesized
tccatttggggaaatagatt

SEQ ID NO: 40193 - DNA, 20 bp, Artificial Sequence
  chemically synthesized
ctgatttccatttggggaaa

SEQ ID NO: 40194 - DNA, 20 bp, Artificial Sequence
  chemically synthesized
tctgaatctatttccccaaa

SEQ ID NO: 40195 - DNA, 20 bp, Artificial Sequence
  chemically synthesized
ttacatctgatttccatttg

SEQ ID NO: 40196 - DNA, 20 bp, Artificial Sequence
  chemically synthesized
tttacatctgatttccattt

SEQ ID NO: 40197 - DNA, 20 bp, Artificial Sequence
  chemically synthesized
ttttacatctgatttccatt

SEQ ID NO: 40198 - DNA, 20 bp, Artificial Sequence
  chemically synthesized
ctatttccccaaatggaaat

SEQ ID NO: 40199 - DNA, 20 bp, Artificial Sequence
  chemically synthesized
agatgtaaaattcttgtgct

SEQ ID NO: 40200 - DNA, 20 bp, Artificial Sequence
  chemically synthesized
atgtaaaattcttgtgctca

SEQ ID NO: 40201 - DNA, 20 bp, Artificial Sequence
  chemically synthesized
aacactacgtctctgagcac

SEQ ID NO: 40202 - DNA, 20 bp, Artificial Sequence
  chemically synthesized
aattcttgtgctcagagacg

SEQ ID NO: 40203 - DNA, 20 bp, Artificial Sequence
  chemically synthesized
tcaatcaacactacgtctct

SEQ ID NO: 40204 - DNA, 20 bp, Artificial Sequence
  chemically synthesized
cagagacgtagtgttgattg

SEQ ID NO: 40205 - DNA, 20 bp, Artificial Sequence
  chemically synthesized
gagacgtagtgttgattgaa

SEQ ID NO: 40206 - DNA, 20 bp, Artificial Sequence
  chemically synthesized
gtagtgttgattgaagagtg

SEQ ID NO: 40207 - DNA, 20 bp, Artificial Sequence
  chemically synthesized
atgacactaagagaatcacg

SEQ ID NO: 40208 - DNA, 20 bp, Artificial Sequence
  chemically synthesized
gcagatccacgtgattctct

SEQ ID NO: 40209 - DNA, 20 bp, Artificial Sequence
  chemically synthesized
acacatgaatatgacactaa

SEQ ID NO: 40210 - DNA, 20 bp, Artificial Sequence
  chemically synthesized
acacacatgaatatgacact

SEQ ID NO: 40211 - DNA, 20 bp, Artificial Sequence
  chemically synthesized
tgtcatattcatgtgtgttt

SEQ ID NO: 40212 - DNA, 20 bp, Artificial Sequence
  chemically synthesized
catattcatgtgtgtttcag

SEQ ID NO: 40213 - DNA, 20 bp, Artificial Sequence
  chemically synthesized
gtgtttcagtagtgtaaact

SEQ ID NO: 40214 - DNA, 20 bp, Artificial Sequence
  chemically synthesized
acaggcaactattcaattcc

SEQ ID NO: 40215 - DNA, 20 bp, Artificial Sequence
  chemically synthesized
agtgtaaactcggaattgaa

SEQ ID NO: 40216 - DNA, 20 bp, Artificial Sequence
  chemically synthesized
acaatgtctcttacaaacac

SEQ ID NO: 40217 - DNA, 20 bp, Artificial Sequence
  chemically synthesized
gaatagttgcctgtgtttgt

SEQ ID NO: 40218 - DNA, 20 bp, Artificial Sequence
  chemically synthesized
tacaatgtctcttacaaaca

SEQ ID NO: 40219 - DNA, 20 bp, Artificial Sequence
  chemically synthesized
atagttgcctgtgtttgtaa

SEQ ID NO: 40220 - DNA, 20 bp, Artificial Sequence
  chemically synthesized
tgtgtttgtaagagacattg

SEQ ID NO: 40221 - DNA, 20 bp, Artificial Sequence
  chemically synthesized
gtgtttgtaagagacattgt

SEQ ID NO: 40222 - DNA, 20 bp, Artificial Sequence
  chemically synthesized
aagaaaaaataaaaataaaa

SEQ ID NO: 40223 - DNA, 20 bp, Artificial Sequence
  chemically synthesized
ttatttttattttttctttt

SEQ ID NO: 40224 - DNA, 20 bp, Artificial Sequence
  chemically synthesized
ttttattttttcttttgaga

SEQ ID NO: 40225 - DNA, 20 bp, Artificial Sequence
  chemically synthesized
agagtgagactccatctcaa

SEQ ID NO: 40226 - DNA, 20 bp, Artificial Sequence
  chemically synthesized
ttattttttcttttgagatg

SEQ ID NO: 40227 - DNA, 20 bp, Artificial Sequence
  chemically synthesized
tacagcctgggcaacagagt

SEQ ID NO: 40228 - DNA, 20 bp, Artificial Sequence
  chemically synthesized
tggagtctcactctgttgcc

SEQ ID NO: 40229 - DNA, 20 bp, Artificial Sequence
  chemically synthesized
gcactacagcctgggcaaca

SEQ ID NO: 40230 - DNA, 20 bp, Artificial Sequence
  chemically synthesized
ggagtctcactctgttgccc

SEQ ID NO: 40231 - DNA, 20 bp, Artificial Sequence
  chemically synthesized
ctgcactacagcctgggcaa

SEQ ID NO: 40232 - DNA, 20 bp, Artificial Sequence
  chemically synthesized
tcactctgttgcccaggctg

SEQ ID NO: 40233 - DNA, 20 bp, Artificial Sequence
  chemically synthesized
gcgctactgcactacagcct

SEQ ID NO: 40234 - DNA, 20 bp, Artificial Sequence
  chemically synthesized
cgcgctactgcactacagcc

SEQ ID NO: 40235 - DNA, 20 bp, Artificial Sequence
  chemically synthesized
ctgttgcccaggctgtagtg

SEQ ID NO: 40236 - DNA, 20 bp, Artificial Sequence
  chemically synthesized
gagatcgcgctactgcacta

SEQ ID NO: 40237 - DNA, 20 bp, Artificial Sequence
  chemically synthesized
ttgcccaggctgtagtgcag

SEQ ID NO: 40238 - DNA, 20 bp, Artificial Sequence
  chemically synthesized
gtagtgcagtagcgcgatct

SEQ ID NO: 40239 - DNA, 20 bp, Artificial Sequence
  chemically synthesized
gctggagcttgcagtgagcc

SEQ ID NO: 40240 - DNA, 20 bp, Artificial Sequence
  chemically synthesized
gcgcgatctcggctcactgc

SEQ ID NO: 40241 - DNA, 20 bp, Artificial Sequence
  chemically synthesized
ccggggctggagcttgcagt

SEQ ID NO: 40242 - DNA, 20 bp, Artificial Sequence
  chemically synthesized
tctcggctcactgcaagctc

SEQ ID NO: 40243 - DNA, 20 bp, Artificial Sequence
  chemically synthesized
gaacccggggctggagcttg

SEQ ID NO: 40244 - DNA, 20 bp, Artificial Sequence
  chemically synthesized
ctcactgcaagctccagccc

SEQ ID NO: 40245 - DNA, 20 bp, Artificial Sequence
  chemically synthesized
tcactgcaagctccagcccc

SEQ ID NO: 40246 - DNA, 20 bp, Artificial Sequence
  chemically synthesized
atggcgtgaacccggggctg

SEQ ID NO: 40247 - DNA, 20 bp, Artificial Sequence
  chemically synthesized
gaatggcgtgaacccggggc

SEQ ID NO: 40248 - DNA, 20 bp, Artificial Sequence
  chemically synthesized
aggagaatggcgtgaacccg

SEQ ID NO: 40249 - DNA, 20 bp, Artificial Sequence
  chemically synthesized
caggagaatggcgtgaaccc

SEQ ID NO: 40250 - DNA, 20 bp, Artificial Sequence
  chemically synthesized
gcaggagaatggcgtgaacc

SEQ ID NO: 40251 - DNA, 20 bp, Artificial Sequence
  chemically synthesized
gggaggctgaggcaggagaa

SEQ ID NO: 40252 - DNA, 20 bp, Artificial Sequence
  chemically synthesized
ttcacgccattctcctgcct

SEQ ID NO: 40253 - DNA, 20 bp, Artificial Sequence
  chemically synthesized
tactcgggaggctgaggcag

SEQ ID NO: 40254 - DNA, 20 bp, Artificial Sequence
  chemically synthesized
gatactcgggaggctgaggc

SEQ ID NO: 40255 - DNA, 20 bp, Artificial Sequence
  chemically synthesized
agatactcgggaggctgagg

SEQ ID NO: 40256 - DNA, 20 bp, Artificial Sequence
  chemically synthesized
cccagatactcgggaggctg

SEQ ID NO: 40257 - DNA, 20 bp, Artificial Sequence
  chemically synthesized
tcccagatactcgggaggct

SEQ ID NO: 40258 - DNA, 20 bp, Artificial Sequence
  chemically synthesized
ttctcctgcctcagcctccc

SEQ ID NO: 40259 - DNA, 20 bp, Artificial Sequence
  chemically synthesized
tgtagtcccagatactcggg

SEQ ID NO: 40260 - DNA, 20 bp, Artificial Sequence
  chemically synthesized
ctgtagtcccagatactcgg

SEQ ID NO: 40261 - DNA, 20 bp, Artificial Sequence
  chemically synthesized
gcctcagcctcccgagtatc

SEQ ID NO: 40262 - DNA, 20 bp, Artificial Sequence
  chemically synthesized
gcctgtagtcccagatactc

SEQ ID NO: 40263 - DNA, 20 bp, Artificial Sequence
  chemically synthesized
cctcagcctcccgagtatct

SEQ ID NO: 40264 - DNA, 20 bp, Artificial Sequence
  chemically synthesized
cgcctgtagtcccagatact

SEQ ID NO: 40265 - DNA, 20 bp, Artificial Sequence
  chemically synthesized
ctcccgagtatctgggacta

SEQ ID NO: 40266 - DNA, 20 bp, Artificial Sequence
  chemically synthesized
tcccgagtatctgggactac

SEQ ID NO: 40267 - DNA, 20 bp, Artificial Sequence
  chemically synthesized
gtggtggacgcctgtagtcc

SEQ ID NO: 40268 - DNA, 20 bp, Artificial Sequence
  chemically synthesized
ggtgtggtggtggacgcctg

SEQ ID NO: 40269 - DNA, 20 bp, Artificial Sequence
  chemically synthesized
aaattagccaggtgtggtgg

SEQ ID NO: 40270 - DNA, 20 bp, Artificial Sequence
  chemically synthesized
caggcgtccaccaccacacc

SEQ ID NO: 40271 - DNA, 20 bp, Artificial Sequence
  chemically synthesized
aaaaaattagccaggtgtgg

SEQ ID NO: 40272 - DNA, 20 bp, Artificial Sequence
  chemically synthesized
tacaaaaaattagccaggtg

SEQ ID NO: 40273 - DNA, 20 bp, Artificial Sequence
  chemically synthesized
aaaaatacaaaaaattagcc

SEQ ID NO: 40274 - DNA, 20 bp, Artificial Sequence
  chemically synthesized
taaaaatacaaaaaattagc

SEQ ID NO: 40275 - DNA, 20 bp, Artificial Sequence
  chemically synthesized
ctactaaaaatacaaaaaat

SEQ ID NO: 40276 - DNA, 20 bp, Artificial Sequence
  chemically synthesized
tggctaattttttgtatttt

SEQ ID NO: 40277 - DNA, 20 bp, Artificial Sequence
  chemically synthesized
ctaattttttgtatttttag

SEQ ID NO: 40278 - DNA, 20 bp, Artificial Sequence
  chemically synthesized
aattttttgtatttttagta

SEQ ID NO: 40279 - DNA, 20 bp, Artificial Sequence
  chemically synthesized
tttgtatttttagtagagac

SEQ ID NO: 40280 - DNA, 20 bp, Artificial Sequence
  chemically synthesized
ttgtatttttagtagagact

SEQ ID NO: 40281 - DNA, 20 bp, Artificial Sequence
  chemically synthesized
ctggctaacacggtgaaacc

SEQ ID NO: 40282 - DNA, 20 bp, Artificial Sequence
  chemically synthesized
gagactgggtttcaccgtgt

SEQ ID NO: 40283 - DNA, 20 bp, Artificial Sequence
  chemically synthesized
ctgggtttcaccgtgttagc

SEQ ID NO: 40284 - DNA, 20 bp, Artificial Sequence
  chemically synthesized
cgagatcatcctggctaaca

SEQ ID NO: 40285 - DNA, 20 bp, Artificial Sequence
  chemically synthesized
tgggtttcaccgtgttagcc

SEQ ID NO: 40286 - DNA, 20 bp, Artificial Sequence
  chemically synthesized
tcgggagatcgagatcatcc

SEQ ID NO: 40287 - DNA, 20 bp, Artificial Sequence
  chemically synthesized
gatcacaaggtcgggagatc

SEQ ID NO: 40288 - DNA, 20 bp, Artificial Sequence
  chemically synthesized
tgggcggatcacaaggtcgg

SEQ ID NO: 40289 - DNA, 20 bp, Artificial Sequence
  chemically synthesized
ggtgggcggatcacaaggtc

SEQ ID NO: 40290 - DNA, 20 bp, Artificial Sequence
  chemically synthesized
aggtgggcggatcacaaggt

SEQ ID NO: 40291 - DNA, 20 bp, Artificial Sequence
  chemically synthesized
gccgaggtgggcggatcaca

SEQ ID NO: 40292 - DNA, 20 bp, Artificial Sequence
  chemically synthesized
ggccgaggtgggcggatcac

SEQ ID NO: 40293 - DNA, 20 bp, Artificial Sequence
  chemically synthesized
accttgtgatccgcccacct

SEQ ID NO: 40294 - DNA, 20 bp, Artificial Sequence
  chemically synthesized
ctttgtgaggccgaggtggg

SEQ ID NO: 40295 - DNA, 20 bp, Artificial Sequence
  chemically synthesized
gcactttgtgaggccgaggt

SEQ ID NO: 40296 - DNA, 20 bp, Artificial Sequence
  chemically synthesized
agcactttgtgaggccgagg

SEQ ID NO: 40297 - DNA, 20 bp, Artificial Sequence
  chemically synthesized
cccagcactttgtgaggccg

SEQ ID NO: 40298 - DNA, 20 bp, Artificial Sequence
  chemically synthesized
tcccagcactttgtgaggcc

SEQ ID NO: 40299 - DNA, 20 bp, Artificial Sequence
  chemically synthesized
ccgcccacctcggcctcaca

SEQ ID NO: 40300 - DNA, 20 bp, Artificial Sequence
  chemically synthesized
tgtaatcccagcactttgtg

SEQ ID NO: 40301 - DNA, 20 bp, Artificial Sequence
  chemically synthesized
ctgtaatcccagcactttgt

SEQ ID NO: 40302 - DNA, 20 bp, Artificial Sequence
  chemically synthesized
acctcggcctcacaaagtgc

SEQ ID NO: 40303 - DNA, 20 bp, Artificial Sequence
  chemically synthesized
cctcggcctcacaaagtgct

SEQ ID NO: 40304 - DNA, 20 bp, Artificial Sequence
  chemically synthesized
ctcacaaagtgctgggatta

SEQ ID NO: 40305 - DNA, 20 bp, Artificial Sequence
  chemically synthesized
tcacaaagtgctgggattac

SEQ ID NO: 40306 - DNA, 20 bp, Artificial Sequence
  chemically synthesized
gtggctcacacctgtaatcc

SEQ ID NO: 40307 - DNA, 20 bp, Artificial Sequence
  chemically synthesized
agtgctgggattacaggtgt

SEQ ID NO: 40308 - DNA, 20 bp, Artificial Sequence
  chemically synthesized
caggtgtgagccaccgcgcc

SEQ ID NO: 40309 - DNA, 20 bp, Artificial Sequence
  chemically synthesized
aaacctacggccgggcgcgg

SEQ ID NO: 40310 - DNA, 20 bp, Artificial Sequence
  chemically synthesized
agcaaacctacggccgggcg

SEQ ID NO: 40311 - DNA, 20 bp, Artificial Sequence
  chemically synthesized
tgagccaccgcgcccggccg

SEQ ID NO: 40312 - DNA, 20 bp, Artificial Sequence
  chemically synthesized
gagccaccgcgcccggccgt

SEQ ID NO: 40313 - DNA, 20 bp, Artificial Sequence
  chemically synthesized
ttaaaagcaaacctacggcc

SEQ ID NO: 40314 - DNA, 20 bp, Artificial Sequence
  chemically synthesized
attaaaagcaaacctacggc

SEQ ID NO: 40315 - DNA, 20 bp, Artificial Sequence
  chemically synthesized
gtatattaaaagcaaaccta

SEQ ID NO: 40316 - DNA, 20 bp, Artificial Sequence
  chemically synthesized
acattctgaaagtatattaa

SEQ ID NO: 40317 - DNA, 20 bp, Artificial Sequence
  chemically synthesized
gtttgcttttaatatacttt

SEQ ID NO: 40318 - DNA, 20 bp, Artificial Sequence
  chemically synthesized
tgctaacacacacattctga

SEQ ID NO: 40319 - DNA, 20 bp, Artificial Sequence
  chemically synthesized
tactttcagaatgtgtgtgt

SEQ ID NO: 40320 - DNA, 20 bp, Artificial Sequence
  chemically synthesized
agcatttttttttcatataa

SEQ ID NO: 40321 - DNA, 20 bp, Artificial Sequence
  chemically synthesized
atgtatactaaatgtcaata

SEQ ID NO: 40322 - DNA, 20 bp, Artificial Sequence
  chemically synthesized
ataacagctttattgacatt

SEQ ID NO: 40323 - DNA, 20 bp, Artificial Sequence
  chemically synthesized
ccttaaatgggcgaatcgta

SEQ ID NO: 40324 - DNA, 20 bp, Artificial Sequence
  chemically synthesized
accatacgattcgcccattt

SEQ ID NO: 40325 - DNA, 20 bp, Artificial Sequence
  chemically synthesized
ccatacgattcgcccattta

SEQ ID NO: 40326 - DNA, 20 bp, Artificial Sequence
  chemically synthesized
ttgaattgtacaccttaaat

SEQ ID NO: 40327 - DNA, 20 bp, Artificial Sequence
  chemically synthesized
attgaattgtacaccttaaa

SEQ ID NO: 40328 - DNA, 20 bp, Artificial Sequence
  chemically synthesized
tttttgtttgtttgtttgtt

SEQ ID NO: 40329 - DNA, 20 bp, Artificial Sequence
  chemically synthesized
tctagcctgggtgacagagc

SEQ ID NO: 40330 - DNA, 20 bp, Artificial Sequence
  chemically synthesized
ttgagactcgctctgtcacc

SEQ ID NO: 40331 - DNA, 20 bp, Artificial Sequence
  chemically synthesized
gcactctagcctgggtgaca

SEQ ID NO: 40332 - DNA, 20 bp, Artificial Sequence
  chemically synthesized
tgagactcgctctgtcaccc

SEQ ID NO: 40333 - DNA, 20 bp, Artificial Sequence
  chemically synthesized
ttgcactctagcctgggtga

SEQ ID NO: 40334 - DNA, 20 bp, Artificial Sequence
  chemically synthesized
actcgctctgtcacccaggc

SEQ ID NO: 40335 - DNA, 20 bp, Artificial Sequence
  chemically synthesized
tcgctctgtcacccaggcta

SEQ ID NO: 40336 - DNA, 20 bp, Artificial Sequence
  chemically synthesized
atgccattgcactctagcct

SEQ ID NO: 40337 - DNA, 20 bp, Artificial Sequence
  chemically synthesized
catgccattgcactctagcc

SEQ ID NO: 40338 - DNA, 20 bp, Artificial Sequence
  chemically synthesized
aagatcatgccattgcactc

SEQ ID NO: 40339 - DNA, 20 bp, Artificial Sequence
  chemically synthesized
tcacccaggctagagtgcaa

SEQ ID NO: 40340 - DNA, 20 bp, Artificial Sequence
  chemically synthesized
agagtgcaatggcatgatct

SEQ ID NO: 40341 - DNA, 20 bp, Artificial Sequence
  chemically synthesized
ggtggaggttgcagtgagcc

SEQ ID NO: 40342 - DNA, 20 bp, Artificial Sequence
  chemically synthesized
tgggaggtggaggttgcagt

SEQ ID NO: 40343 - DNA, 20 bp, Artificial Sequence
  chemically synthesized
gacttgggaggtggaggttg

SEQ ID NO: 40344 - DNA, 20 bp, Artificial Sequence
  chemically synthesized
cgcttggacttgggaggtgg

SEQ ID NO: 40345 - DNA, 20 bp, Artificial Sequence
  chemically synthesized
tcgcttggacttgggaggtg

SEQ ID NO: 40346 - DNA, 20 bp, Artificial Sequence
  chemically synthesized
cactgcaacctccacctccc

SEQ ID NO: 40347 - DNA, 20 bp, Artificial Sequence
  chemically synthesized
aatcgcttggacttgggagg

SEQ ID NO: 40348 - DNA, 20 bp, Artificial Sequence
  chemically synthesized
gagaatcgcttggacttggg

SEQ ID NO: 40349 - DNA, 20 bp, Artificial Sequence
  chemically synthesized
ggagaatcgcttggacttgg

SEQ ID NO: 40350 - DNA, 20 bp, Artificial Sequence
  chemically synthesized
aacctccacctcccaagtcc

SEQ ID NO: 40351 - DNA, 20 bp, Artificial Sequence
  chemically synthesized
caggagaatcgcttggactt

SEQ ID NO: 40352 - DNA, 20 bp, Artificial Sequence
  chemically synthesized
gcaggagaatcgcttggact

SEQ ID NO: 40353 - DNA, 20 bp, Artificial Sequence
  chemically synthesized
gctgaggcaggagaatcgct

SEQ ID NO: 40354 - DNA, 20 bp, Artificial Sequence
  chemically synthesized
tccaagcgattctcctgcct

SEQ ID NO: 40355 - DNA, 20 bp, Artificial Sequence
  chemically synthesized
tacttgggaggctgaggcag

SEQ ID NO: 40356 - DNA, 20 bp, Artificial Sequence
  chemically synthesized
gctacttgggaggctgaggc

SEQ ID NO: 40357 - DNA, 20 bp, Artificial Sequence
  chemically synthesized
agctacttgggaggctgagg

SEQ ID NO: 40358 - DNA, 20 bp, Artificial Sequence
  chemically synthesized
cccagctacttgggaggctg

SEQ ID NO: 40359 - DNA, 20 bp, Artificial Sequence
  chemically synthesized
tcccagctacttgggaggct

SEQ ID NO: 40360 - DNA, 20 bp, Artificial Sequence
  chemically synthesized
ttctcctgcctcagcctccc

SEQ ID NO: 40361 - DNA, 20 bp, Artificial Sequence
  chemically synthesized
tcctgcctcagcctcccaag

SEQ ID NO: 40362 - DNA, 20 bp, Artificial Sequence
  chemically synthesized
tgtaatcccagctacttggg

SEQ ID NO: 40363 - DNA, 20 bp, Artificial Sequence
  chemically synthesized
ttgtaatcccagctacttgg

SEQ ID NO: 40364 - DNA, 20 bp, Artificial Sequence
  chemically synthesized
gcctcagcctcccaagtagc

SEQ ID NO: 40365 - DNA, 20 bp, Artificial Sequence
  chemically synthesized
gcttgtaatcccagctactt

SEQ ID NO: 40366 - DNA, 20 bp, Artificial Sequence
  chemically synthesized
cctcagcctcccaagtagct

SEQ ID NO: 40367 - DNA, 20 bp, Artificial Sequence
  chemically synthesized
cgcttgtaatcccagctact

SEQ ID NO: 40368 - DNA, 20 bp, Artificial Sequence
  chemically synthesized
tcccaagtagctgggattac

SEQ ID NO: 40369 - DNA, 20 bp, Artificial Sequence
  chemically synthesized
atagcgagcgcttgtaatcc

SEQ ID NO: 40370 - DNA, 20 bp, Artificial Sequence
  chemically synthesized
attagccaggcgttcatagc

SEQ ID NO: 40371 - DNA, 20 bp, Artificial Sequence
  chemically synthesized
aaacattagccaggcgttca

SEQ ID NO: 40372 - DNA, 20 bp, Artificial Sequence
  chemically synthesized
aagcgctcgctatgaacgcc

SEQ ID NO: 40373 - DNA, 20 bp, Artificial Sequence
  chemically synthesized
taaaaatacaaacattagcc

SEQ ID NO: 40374 - DNA, 20 bp, Artificial Sequence
  chemically synthesized
ctaaaaatacaaacattagc

SEQ ID NO: 40375 - DNA, 20 bp, Artificial Sequence
  chemically synthesized
tctactaaaaatacaaacat

SEQ ID NO: 40376 - DNA, 20 bp, Artificial Sequence
  chemically synthesized
ctggctaatgtttgtatttt

SEQ ID NO: 40377 - DNA, 20 bp, Artificial Sequence
  chemically synthesized
gctaatgtttgtatttttag

SEQ ID NO: 40378 - DNA, 20 bp, Artificial Sequence
  chemically synthesized
taatgtttgtatttttagta

SEQ ID NO: 40379 - DNA, 20 bp, Artificial Sequence
  chemically synthesized
gtttgtatttttagtagaga

SEQ ID NO: 40380 - DNA, 20 bp, Artificial Sequence
  chemically synthesized
tttgtatttttagtagagat

SEQ ID NO: 40381 - DNA, 20 bp, Artificial Sequence
  chemically synthesized
ttgtatttttagtagagatg

SEQ ID NO: 40382 - DNA, 20 bp, Artificial Sequence
  chemically synthesized
gagatggggtttcaccatgt

SEQ ID NO: 40383 - DNA, 20 bp, Artificial Sequence
  chemically synthesized
tggggtttcaccatgttggt

SEQ ID NO: 40384 - DNA, 20 bp, Artificial Sequence
  chemically synthesized
cgagaccagcctgaccaaca

SEQ ID NO: 40385 - DNA, 20 bp, Artificial Sequence
  chemically synthesized
ggggtttcaccatgttggtc

SEQ ID NO: 40386 - DNA, 20 bp, Artificial Sequence
  chemically synthesized
tttcaccatgttggtcaggc

SEQ ID NO: 40387 - DNA, 20 bp, Artificial Sequence
  chemically synthesized
tgatgtcaggagttcgagac

SEQ ID NO: 40388 - DNA, 20 bp, Artificial Sequence
  chemically synthesized
tcacttgatgtcaggagttc

SEQ ID NO: 40389 - DNA, 20 bp, Artificial Sequence
  chemically synthesized
ggcagatcacttgatgtcag

SEQ ID NO: 40390 - DNA, 20 bp, Artificial Sequence
  chemically synthesized
ggtctcgaactcctgacatc

SEQ ID NO: 40391 - DNA, 20 bp, Artificial Sequence
  chemically synthesized
cgggcagatcacttgatgtc

SEQ ID NO: 40392 - DNA, 20 bp, Artificial Sequence
  chemically synthesized
gcgggcagatcacttgatgt

SEQ ID NO: 40393 - DNA, 20 bp, Artificial Sequence
  chemically synthesized
atcaagtgatctgcccgcct

SEQ ID NO: 40394 - DNA, 20 bp, Artificial Sequence
  chemically synthesized
ctttgggaggccaaggcggg

SEQ ID NO: 40395 - DNA, 20 bp, Artificial Sequence
  chemically synthesized
gcactttgggaggccaaggc

SEQ ID NO: 40396 - DNA, 20 bp, Artificial Sequence
  chemically synthesized
agcactttgggaggccaagg

SEQ ID NO: 40397 - DNA, 20 bp, Artificial Sequence
  chemically synthesized
gcaagcactttgggaggcca

SEQ ID NO: 40398 - DNA, 20 bp, Artificial Sequence
  chemically synthesized
tgcaagcactttgggaggcc

SEQ ID NO: 40399 - DNA, 20 bp, Artificial Sequence
  chemically synthesized
ctgcccgccttggcctccca

SEQ ID NO: 40400 - DNA, 20 bp, Artificial Sequence
  chemically synthesized
tgtaatgcaagcactttggg

SEQ ID NO: 40401 - DNA, 20 bp, Artificial Sequence
  chemically synthesized
ctgtaatgcaagcactttgg

SEQ ID NO: 40402 - DNA, 20 bp, Artificial Sequence
  chemically synthesized
gcctgtaatgcaagcacttt

SEQ ID NO: 40403 - DNA, 20 bp, Artificial Sequence
  chemically synthesized
cgcctgtaatgcaagcactt

SEQ ID NO: 40404 - DNA, 20 bp, Artificial Sequence
  chemically synthesized
ctcccaaagtgcttgcatta

SEQ ID NO: 40405 - DNA, 20 bp, Artificial Sequence
  chemically synthesized
tcccaaagtgcttgcattac

SEQ ID NO: 40406 - DNA, 20 bp, Artificial Sequence
  chemically synthesized
ggtggctacgcctgtaatgc

SEQ ID NO: 40407 - DNA, 20 bp, Artificial Sequence
  chemically synthesized
aagtgcttgcattacaggcg

SEQ ID NO: 40408 - DNA, 20 bp, Artificial Sequence
  chemically synthesized
acaggcgtagccaccacacc

SEQ ID NO: 40409 - DNA, 20 bp, Artificial Sequence
  chemically synthesized
taagtcaaggccgggtgtgg

SEQ ID NO: 40410 - DNA, 20 bp, Artificial Sequence
  chemically synthesized
tactaagtcaaggccgggtg

SEQ ID NO: 40411 - DNA, 20 bp, Artificial Sequence
  chemically synthesized
caaagtactaagtcaaggcc

SEQ ID NO: 40412 - DNA, 20 bp, Artificial Sequence
  chemically synthesized
acaaagtactaagtcaaggc

SEQ ID NO: 40413 - DNA, 20 bp, Artificial Sequence
  chemically synthesized
caccacacccggccttgact

SEQ ID NO: 40414 - DNA, 20 bp, Artificial Sequence
  chemically synthesized
caatacaaagtactaagtca

SEQ ID NO: 40415 - DNA, 20 bp, Artificial Sequence
  chemically synthesized
ccaatacaaagtactaagtc

SEQ ID NO: 40416 - DNA, 20 bp, Artificial Sequence
  chemically synthesized
tatcaccaatacaaagtact

SEQ ID NO: 40417 - DNA, 20 bp, Artificial Sequence
  chemically synthesized
cttgacttagtactttgtat

SEQ ID NO: 40418 - DNA, 20 bp, Artificial Sequence
  chemically synthesized
ttccatatatcaccaataca

SEQ ID NO: 40419 - DNA, 20 bp, Artificial Sequence
  chemically synthesized
tactttgtattggtgatata

SEQ ID NO: 40420 - DNA, 20 bp, Artificial Sequence
  chemically synthesized
ttcaacattttttgccattc

SEQ ID NO: 40421 - DNA, 20 bp, Artificial Sequence
  chemically synthesized
tcaacattttttgccattct

SEQ ID NO: 40422 - DNA, 20 bp, Artificial Sequence
  chemically synthesized
caacattttttgccattcta

SEQ ID NO: 40423 - DNA, 20 bp, Artificial Sequence
  chemically synthesized
gtagcactttcaccctagaa

SEQ ID NO: 40424 - DNA, 20 bp, Artificial Sequence
  chemically synthesized
tttttgccattctagggtga

SEQ ID NO: 40425 - DNA, 20 bp, Artificial Sequence
  chemically synthesized
ttattgtagcactttcaccc

SEQ ID NO: 40426 - DNA, 20 bp, Artificial Sequence
  chemically synthesized
tataaggttttaatttattg

SEQ ID NO: 40427 - DNA, 20 bp, Artificial Sequence
  chemically synthesized
aataaattaaaaccttatac

SEQ ID NO: 40428 - DNA, 20 bp, Artificial Sequence
  chemically synthesized
cctcttctttggctggtata

SEQ ID NO: 40429 - DNA, 20 bp, Artificial Sequence
  chemically synthesized
gcctcttctttggctggtat

SEQ ID NO: 40430 - DNA, 20 bp, Artificial Sequence
  chemically synthesized
ttaaaaccttataccagcca

SEQ ID NO: 40431 - DNA, 20 bp, Artificial Sequence
  chemically synthesized
aaaccttataccagccaaag

SEQ ID NO: 40432 - DNA, 20 bp, Artificial Sequence
  chemically synthesized
agagctgcctcttctttggc

SEQ ID NO: 40433 - DNA, 20 bp, Artificial Sequence
  chemically synthesized
accttataccagccaaagaa

SEQ ID NO: 40434 - DNA, 20 bp, Artificial Sequence
  chemically synthesized
ccttataccagccaaagaag

SEQ ID NO: 40435 - DNA, 20 bp, Artificial Sequence
  chemically synthesized
attgagagctgcctcttctt

SEQ ID NO: 40436 - DNA, 20 bp, Artificial Sequence
  chemically synthesized
tataccagccaaagaagagg

SEQ ID NO: 40437 - DNA, 20 bp, Artificial Sequence
  chemically synthesized
ttctcaacattcacaattga

SEQ ID NO: 40438 - DNA, 20 bp, Artificial Sequence
  chemically synthesized
tattctcaacattcacaatt

SEQ ID NO: 40439 - DNA, 20 bp, Artificial Sequence
  chemically synthesized
agctctcaattgtgaatgtt

SEQ ID NO: 40440 - DNA, 20 bp, Artificial Sequence
  chemically synthesized
aatgttgagaatatacttac

SEQ ID NO: 40441 - DNA, 20 bp, Artificial Sequence
  chemically synthesized
caaagttaaatttttcttgt

SEQ ID NO: 40442 - DNA, 20 bp, Artificial Sequence
  chemically synthesized
ttacaagaaaaatttaactt

SEQ ID NO: 40443 - DNA, 20 bp, Artificial Sequence
  chemically synthesized
atgaagctattacatcacca

SEQ ID NO: 40444 - DNA, 20 bp, Artificial Sequence
  chemically synthesized
atttaactttggtgatgtaa

SEQ ID NO: 40445 - DNA, 20 bp, Artificial Sequence
  chemically synthesized
agctttaggtaatgcaaatg

SEQ ID NO: 40446 - DNA, 20 bp, Artificial Sequence
  chemically synthesized
agcttcatttgcattaccta

SEQ ID NO: 40447 - DNA, 20 bp, Artificial Sequence
  chemically synthesized
agcttttgacttcaagcttt

SEQ ID NO: 40448 - DNA, 20 bp, Artificial Sequence
  chemically synthesized
tttgcattacctaaagcttg

SEQ ID NO: 40449 - DNA, 20 bp, Artificial Sequence
  chemically synthesized
tagcttttgacttcaagctt

SEQ ID NO: 40450 - DNA, 20 bp, Artificial Sequence
  chemically synthesized
atactttagcttttgacttc

SEQ ID NO: 40451 - DNA, 20 bp, Artificial Sequence
  chemically synthesized
tacctaaagcttgaagtcaa

SEQ ID NO: 40452 - DNA, 20 bp, Artificial Sequence
  chemically synthesized
aagcttgaagtcaaaagcta

SEQ ID NO: 40453 - DNA, 20 bp, Artificial Sequence
  chemically synthesized
aagtcaaaagctaaagtatt

SEQ ID NO: 40454 - DNA, 20 bp, Artificial Sequence
  chemically synthesized
cttctgtacgcttaatactt

SEQ ID NO: 40455 - DNA, 20 bp, Artificial Sequence
  chemically synthesized
aagctaaagtattaagcgta

SEQ ID NO: 40456 - DNA, 20 bp, Artificial Sequence
  chemically synthesized
ctaaagtattaagcgtacag

SEQ ID NO: 40457 - DNA, 20 bp, Artificial Sequence
  chemically synthesized
gtattaagcgtacagaagca

SEQ ID NO: 40458 - DNA, 20 bp, Artificial Sequence
  chemically synthesized
cagaagcatggactctatga

SEQ ID NO: 40459 - DNA, 20 bp, Artificial Sequence
  chemically synthesized
tttggattgtttctttcata

SEQ ID NO: 40460 - DNA, 20 bp, Artificial Sequence
  chemically synthesized
tttttggattgtttctttca

SEQ ID NO: 40461 - DNA, 20 bp, Artificial Sequence
  chemically synthesized
tatgaaagaaacaatccaaa

SEQ ID NO: 40462 - DNA, 20 bp, Artificial Sequence
  chemically synthesized
aaaaaaaaaaagtcactttt

SEQ ID NO: 40463 - DNA, 20 bp, Artificial Sequence
  chemically synthesized
gtaaaaaaaaaaaaaaaaaa

SEQ ID NO: 40464 - DNA, 20 bp, Artificial Sequence
  chemically synthesized
ttttttttttttttttacaa

SEQ ID NO: 40465 - DNA, 20 bp, Artificial Sequence
  chemically synthesized
tttttttttttttttacaat

SEQ ID NO: 40466 - DNA, 20 bp, Artificial Sequence
  chemically synthesized
tttttttttttttacaatgg

SEQ ID NO: 40467 - DNA, 20 bp, Artificial Sequence
  chemically synthesized
tttttacaatgggagacatt

SEQ ID NO: 40468 - DNA, 20 bp, Artificial Sequence
  chemically synthesized
atgggagacattaagaactt

SEQ ID NO: 40469 - DNA, 20 bp, Artificial Sequence
  chemically synthesized
tattgaagagttagttacca

SEQ ID NO: 40470 - DNA, 20 bp, Artificial Sequence
  chemically synthesized
tcagggacatattgaagagt

SEQ ID NO: 40471 - DNA, 20 bp, Artificial Sequence
  chemically synthesized
gtcatcagggacatattgaa

SEQ ID NO: 40472 - DNA, 20 bp, Artificial Sequence
  chemically synthesized
ctgtcatcagggacatattg

SEQ ID NO: 40473 - DNA, 20 bp, Artificial Sequence
  chemically synthesized
cttcaatatgtccctgatga

SEQ ID NO: 40474 - DNA, 20 bp, Artificial Sequence
  chemically synthesized
aaatccttggtctgtcatca

SEQ ID NO: 40475 - DNA, 20 bp, Artificial Sequence
  chemically synthesized
taaatccttggtctgtcatc

SEQ ID NO: 40476 - DNA, 20 bp, Artificial Sequence
  chemically synthesized
ataaatccttggtctgtcat

SEQ ID NO: 40477 - DNA, 20 bp, Artificial Sequence
  chemically synthesized
tatgtccctgatgacagacc

SEQ ID NO: 40478 - DNA, 20 bp, Artificial Sequence
  chemically synthesized
atgtccctgatgacagacca

SEQ ID NO: 40479 - DNA, 20 bp, Artificial Sequence
  chemically synthesized
ttcttctggtcataaatcct

SEQ ID NO: 40480 - DNA, 20 bp, Artificial Sequence
  chemically synthesized
acagaccaaggatttatgac

SEQ ID NO: 40481 - DNA, 20 bp, Artificial Sequence
  chemically synthesized
gaccaaggatttatgaccag

SEQ ID NO: 40482 - DNA, 20 bp, Artificial Sequence
  chemically synthesized
caaggatttatgaccagaag

SEQ ID NO: 40483 - DNA, 20 bp, Artificial Sequence
  chemically synthesized
attttcttaatagcttcttc

SEQ ID NO: 40484 - DNA, 20 bp, Artificial Sequence
  chemically synthesized
tatgaccagaagaagctatt

SEQ ID NO: 40485 - DNA, 20 bp, Artificial Sequence
  chemically synthesized
cctcaggaagattttcttaa

SEQ ID NO: 40486 - DNA, 20 bp, Artificial Sequence
  chemically synthesized
gctattaagaaaatcttcct

SEQ ID NO: 40487 - DNA, 20 bp, Artificial Sequence
  chemically synthesized
ctattaagaaaatcttcctg

SEQ ID NO: 40488 - DNA, 20 bp, Artificial Sequence
  chemically synthesized
tcaatgtttaacacctcagg

SEQ ID NO: 40489 - DNA, 20 bp, Artificial Sequence
  chemically synthesized
tgttcaatgtttaacacctc

SEQ ID NO: 40490 - DNA, 20 bp, Artificial Sequence
  chemically synthesized
atgttcaatgtttaacacct

SEQ ID NO: 40491 - DNA, 20 bp, Artificial Sequence
  chemically synthesized
gaggtgttaaacattgaaca

SEQ ID NO: 40492 - DNA, 20 bp, Artificial Sequence
  chemically synthesized
gaacatggattattcatgaa

SEQ ID NO: 40493 - DNA, 20 bp, Artificial Sequence
  chemically synthesized
atggattattcatgaaaaga

SEQ ID NO: 40494 - DNA, 20 bp, Artificial Sequence
  chemically synthesized
tggattattcatgaaaagat

SEQ ID NO: 40495 - DNA, 20 bp, Artificial Sequence
  chemically synthesized
ctctcttctgattcagaaaa

SEQ ID NO: 40496 - DNA, 20 bp, Artificial Sequence
  chemically synthesized
tactctcttctgattcagaa

SEQ ID NO: 40497 - DNA, 20 bp, Artificial Sequence
  chemically synthesized
aggaaatctcttttctgaat

SEQ ID NO: 40498 - DNA, 20 bp, Artificial Sequence
  chemically synthesized
aaatctcttttctgaatcag

SEQ ID NO: 40499 - DNA, 20 bp, Artificial Sequence
  chemically synthesized
gaatctactctcttctgatt

SEQ ID NO: 40500 - DNA, 20 bp, Artificial Sequence
  chemically synthesized
atctcttttctgaatcagaa

SEQ ID NO: 40501 - DNA, 20 bp, Artificial Sequence
  chemically synthesized
ctcttttctgaatcagaaga

SEQ ID NO: 40502 - DNA, 20 bp, Artificial Sequence
  chemically synthesized
ttttctgaatcagaagagag

SEQ ID NO: 40503 - DNA, 20 bp, Artificial Sequence
  chemically synthesized
agagtagattcttgttgatc

SEQ ID NO: 40504 - DNA, 20 bp, Artificial Sequence
  chemically synthesized
ggaaaccactccagatcaac

SEQ ID NO: 40505 - DNA, 20 bp, Artificial Sequence
  chemically synthesized
agtagattcttgttgatctg

SEQ ID NO: 40506 - DNA, 20 bp, Artificial Sequence
  chemically synthesized
agattcttgttgatctggag

SEQ ID NO: 40507 - DNA, 20 bp, Artificial Sequence
  chemically synthesized
gaagtaaatggaaaccactc

SEQ ID NO: 40508 - DNA, 20 bp, Artificial Sequence
  chemically synthesized
attcccatggcagaagtaaa

SEQ ID NO: 40509 - DNA, 20 bp, Artificial Sequence
  chemically synthesized
gtttccatttacttctgcca

SEQ ID NO: 40510 - DNA, 20 bp, Artificial Sequence
  chemically synthesized
tttccatttacttctgccat

SEQ ID NO: 40511 - DNA, 20 bp, Artificial Sequence
  chemically synthesized
tcagtttattcccatggcag

SEQ ID NO: 40512 - DNA, 20 bp, Artificial Sequence
  chemically synthesized
cattcagtttattcccatgg

SEQ ID NO: 40513 - DNA, 20 bp, Artificial Sequence
  chemically synthesized
aatcattcagtttattccca

SEQ ID NO: 40514 - DNA, 20 bp, Artificial Sequence
  chemically synthesized
tcaattatagagcaatcatt

SEQ ID NO: 40515 - DNA, 20 bp, Artificial Sequence
  chemically synthesized
taaaagactattcaattata

SEQ ID NO: 40516 - DNA, 20 bp, Artificial Sequence
  chemically synthesized
tttaaaagactattcaatta

SEQ ID NO: 40517 - DNA, 20 bp, Artificial Sequence
  chemically synthesized
atgattgctctataattgaa

SEQ ID NO: 40518 - DNA, 20 bp, Artificial Sequence
  chemically synthesized
atttatagagtatggtttaa

SEQ ID NO: 40519 - DNA, 20 bp, Artificial Sequence
  chemically synthesized
gttatagaatttatagagta

SEQ ID NO: 40520 - DNA, 20 bp, Artificial Sequence
  chemically synthesized
agatagttatagaatttata

SEQ ID NO: 40521 - DNA, 20 bp, Artificial Sequence
  chemically synthesized
taagatagttatagaattta

SEQ ID NO: 40522 - DNA, 20 bp, Artificial Sequence
  chemically synthesized
ccatacttataagatagtta

SEQ ID NO: 40523 - DNA, 20 bp, Artificial Sequence
  chemically synthesized
aaattctataactatcttat

SEQ ID NO: 40524 - DNA, 20 bp, Artificial Sequence
  chemically synthesized
tagataccatacttataaga

SEQ ID NO: 40525 - DNA, 20 bp, Artificial Sequence
  chemically synthesized
ctataactatcttataagta

SEQ ID NO: 40526 - DNA, 20 bp, Artificial Sequence
  chemically synthesized
tttttagataccatacttat

SEQ ID NO: 40527 - DNA, 20 bp, Artificial Sequence
  chemically synthesized
taagtatggtatctaaaaat

SEQ ID NO: 40528 - DNA, 20 bp, Artificial Sequence
  chemically synthesized
caagctatcagtcttatttt

SEQ ID NO: 40529 - DNA, 20 bp, Artificial Sequence
  chemically synthesized
gtatctaaaaataagactga

SEQ ID NO: 40530 - DNA, 20 bp, Artificial Sequence
  chemically synthesized
aaaaataagactgatagctt

SEQ ID NO: 40531 - DNA, 20 bp, Artificial Sequence
  chemically synthesized
actatgagtcctcaagctat

SEQ ID NO: 40532 - DNA, 20 bp, Artificial Sequence
  chemically synthesized
aaaataagactgatagcttg

SEQ ID NO: 40533 - DNA, 20 bp, Artificial Sequence
  chemically synthesized
tttcacaactatgagtcctc

SEQ ID NO: 40534 - DNA, 20 bp, Artificial Sequence
  chemically synthesized
actgatagcttgaggactca

SEQ ID NO: 40535 - DNA, 20 bp, Artificial Sequence
  chemically synthesized
caatagtttttcacaactat

SEQ ID NO: 40536 - DNA, 20 bp, Artificial Sequence
  chemically synthesized
tagttgtgaaaaactattga

SEQ ID NO: 40537 - DNA, 20 bp, Artificial Sequence
  chemically synthesized
cttttcaatgatactttcaa

SEQ ID NO: 40538 - DNA, 20 bp, Artificial Sequence
  chemically synthesized
ctattgaaagtatcattgaa

SEQ ID NO: 40539 - DNA, 20 bp, Artificial Sequence
  chemically synthesized
tattgaaagtatcattgaaa

SEQ ID NO: 40540 - DNA, 20 bp, Artificial Sequence
  chemically synthesized
ttttgaaaatagaaaacgtt

SEQ ID NO: 40541 - DNA, 20 bp, Artificial Sequence
  chemically synthesized
taccattagctttttgaaaa

SEQ ID NO: 40542 - DNA, 20 bp, Artificial Sequence
  chemically synthesized
caacgttttctattttcaaa

SEQ ID NO: 40543 - DNA, 20 bp, Artificial Sequence
  chemically synthesized
ttctattttcaaaaagctaa

SEQ ID NO: 40544 - DNA, 20 bp, Artificial Sequence
  chemically synthesized
attttcaaaaagctaatggt

SEQ ID NO: 40545 - DNA, 20 bp, Artificial Sequence
  chemically synthesized
attaaaaaatagcttaccat

SEQ ID NO: 40546 - DNA, 20 bp, Artificial Sequence
  chemically synthesized
tcatccattggattaaaaaa

SEQ ID NO: 40547 - DNA, 20 bp, Artificial Sequence
  chemically synthesized
taagctattttttaatccaa

SEQ ID NO: 40548 - DNA, 20 bp, Artificial Sequence
  chemically synthesized
ttactgaaaccatcatccat

SEQ ID NO: 40549 - DNA, 20 bp, Artificial Sequence
  chemically synthesized
ttttttaatccaatggatga

SEQ ID NO: 40550 - DNA, 20 bp, Artificial Sequence
  chemically synthesized
aatccaatggatgatggttt

SEQ ID NO: 40551 - DNA, 20 bp, Artificial Sequence
  chemically synthesized
aatggatgatggtttcagta

SEQ ID NO: 40552 - DNA, 20 bp, Artificial Sequence
  chemically synthesized
atggatgatggtttcagtaa

SEQ ID NO: 40553 - DNA, 20 bp, Artificial Sequence
  chemically synthesized
gtaaaggcaattttgtcaca

SEQ ID NO: 40554 - DNA, 20 bp, Artificial Sequence
  chemically synthesized
ttttgtcacaaagattttta

SEQ ID NO: 40555 - DNA, 20 bp, Artificial Sequence
  chemically synthesized
tttgtcacaaagatttttat

SEQ ID NO: 40556 - DNA, 20 bp, Artificial Sequence
  chemically synthesized
aagatttttatgggaatctg

SEQ ID NO: 40557 - DNA, 20 bp, Artificial Sequence
  chemically synthesized
ttatgggaatctgcagtatg

SEQ ID NO: 40558 - DNA, 20 bp, Artificial Sequence
  chemically synthesized
gagaatctttctacatactg

SEQ ID NO: 40559 - DNA, 20 bp, Artificial Sequence
  chemically synthesized
gggaatctgcagtatgtaga

SEQ ID NO: 40560 - DNA, 20 bp, Artificial Sequence
  chemically synthesized
gtatgtagaaagattctcct

SEQ ID NO: 40561 - DNA, 20 bp, Artificial Sequence
  chemically synthesized
tatgtagaaagattctcctg

SEQ ID NO: 40562 - DNA, 20 bp, Artificial Sequence
  chemically synthesized
cagtaagcacgtttcctcag

SEQ ID NO: 40563 - DNA, 20 bp, Artificial Sequence
  chemically synthesized
agcagtaagcacgtttcctc

SEQ ID NO: 40564 - DNA, 20 bp, Artificial Sequence
  chemically synthesized
gagcagtaagcacgtttcct

SEQ ID NO: 40565 - DNA, 20 bp, Artificial Sequence
  chemically synthesized
cctactgtaaagggagcagt

SEQ ID NO: 40566 - DNA, 20 bp, Artificial Sequence
  chemically synthesized
ttgacctactgtaaagggag

SEQ ID NO: 40567 - DNA, 20 bp, Artificial Sequence
  chemically synthesized
cgtgcttactgctcccttta

SEQ ID NO: 40568 - DNA, 20 bp, Artificial Sequence
  chemically synthesized
ctcttgacctactgtaaagg

SEQ ID NO: 40569 - DNA, 20 bp, Artificial Sequence
  chemically synthesized
gcttactgctccctttacag

SEQ ID NO: 40570 - DNA, 20 bp, Artificial Sequence
  chemically synthesized
gactcttgacctactgtaaa

SEQ ID NO: 40571 - DNA, 20 bp, Artificial Sequence
  chemically synthesized
cttactgctccctttacagt

SEQ ID NO: 40572 - DNA, 20 bp, Artificial Sequence
  chemically synthesized
agactcttgacctactgtaa

SEQ ID NO: 40573 - DNA, 20 bp, Artificial Sequence
  chemically synthesized
gagactcttgacctactgta

SEQ ID NO: 40574 - DNA, 20 bp, Artificial Sequence
  chemically synthesized
tgctccctttacagtaggtc

SEQ ID NO: 40575 - DNA, 20 bp, Artificial Sequence
  chemically synthesized
ctccctttacagtaggtcaa

SEQ ID NO: 40576 - DNA, 20 bp, Artificial Sequence
  chemically synthesized
ggtcaagagtctctgatttc

SEQ ID NO: 40577 - DNA, 20 bp, Artificial Sequence
  chemically synthesized
tagttctgtgctagaaatca

SEQ ID NO: 40578 - DNA, 20 bp, Artificial Sequence
  chemically synthesized
aatagttctgtgctagaaat

SEQ ID NO: 40579 - DNA, 20 bp, Artificial Sequence
  chemically synthesized
agagtctctgatttctagca

SEQ ID NO: 40580 - DNA, 20 bp, Artificial Sequence
  chemically synthesized
cctagaaaatagttctgtgc

SEQ ID NO: 40581 - DNA, 20 bp, Artificial Sequence
  chemically synthesized
tctagcacagaactattttc

SEQ ID NO: 40582 - DNA, 20 bp, Artificial Sequence
  chemically synthesized
ctagcacagaactattttct

SEQ ID NO: 40583 - DNA, 20 bp, Artificial Sequence
  chemically synthesized
tttaaaagatgcctagaaaa

SEQ ID NO: 40584 - DNA, 20 bp, Artificial Sequence
  chemically synthesized
gtagggttttaaaagatgcc

SEQ ID NO: 40585 - DNA, 20 bp, Artificial Sequence
  chemically synthesized
gcctttaggtagggttttaa

SEQ ID NO: 40586 - DNA, 20 bp, Artificial Sequence
  chemically synthesized
atcttttaaaaccctaccta

SEQ ID NO: 40587 - DNA, 20 bp, Artificial Sequence
  chemically synthesized
tcttttaaaaccctacctaa

SEQ ID NO: 40588 - DNA, 20 bp, Artificial Sequence
  chemically synthesized
cactcatctgcctttaggta

SEQ ID NO: 40589 - DNA, 20 bp, Artificial Sequence
  chemically synthesized
ccactcatctgcctttaggt

SEQ ID NO: 40590 - DNA, 20 bp, Artificial Sequence
  chemically synthesized
cccactcatctgcctttagg

SEQ ID NO: 40591 - DNA, 20 bp, Artificial Sequence
  chemically synthesized
tttaaaaccctacctaaagg

SEQ ID NO: 40592 - DNA, 20 bp, Artificial Sequence
  chemically synthesized
gggcccactcatctgccttt

SEQ ID NO: 40593 - DNA, 20 bp, Artificial Sequence
  chemically synthesized
agggcccactcatctgcctt

SEQ ID NO: 40594 - DNA, 20 bp, Artificial Sequence
  chemically synthesized
aaccctacctaaaggcagat

SEQ ID NO: 40595 - DNA, 20 bp, Artificial Sequence
  chemically synthesized
cctacctaaaggcagatgag

SEQ ID NO: 40596 - DNA, 20 bp, Artificial Sequence
  chemically synthesized
ctacctaaaggcagatgagt

SEQ ID NO: 40597 - DNA, 20 bp, Artificial Sequence
  chemically synthesized
agtagttctttgtaacatta

SEQ ID NO: 40598 - DNA, 20 bp, Artificial Sequence
  chemically synthesized
gagtagttctttgtaacatt

SEQ ID NO: 40599 - DNA, 20 bp, Artificial Sequence
  chemically synthesized
agagtagttctttgtaacat

SEQ ID NO: 40600 - DNA, 20 bp, Artificial Sequence
  chemically synthesized
gagtgggccctaatgttaca

SEQ ID NO: 40601 - DNA, 20 bp, Artificial Sequence
  chemically synthesized
atgttacaaagaactactct

SEQ ID NO: 40602 - DNA, 20 bp, Artificial Sequence
  chemically synthesized
ttctttcacttagctcagag

SEQ ID NO: 40603 - DNA, 20 bp, Artificial Sequence
  chemically synthesized
acaaagaactactctgagct

SEQ ID NO: 40604 - DNA, 20 bp, Artificial Sequence
  chemically synthesized
taattctttcacttagctca

SEQ ID NO: 40605 - DNA, 20 bp, Artificial Sequence
  chemically synthesized
tgtaattctttcacttagct

SEQ ID NO: 40606 - DNA, 20 bp, Artificial Sequence
  chemically synthesized
aactactctgagctaagtga

SEQ ID NO: 40607 - DNA, 20 bp, Artificial Sequence
  chemically synthesized
ccaactgtaattctttcact

SEQ ID NO: 40608 - DNA, 20 bp, Artificial Sequence
  chemically synthesized
tgagctaagtgaaagaatta

SEQ ID NO: 40609 - DNA, 20 bp, Artificial Sequence
  chemically synthesized
ctaagtgaaagaattacagt

SEQ ID NO: 40610 - DNA, 20 bp, Artificial Sequence
  chemically synthesized
tgaaagaattacagttggac

SEQ ID NO: 40611 - DNA, 20 bp, Artificial Sequence
  chemically synthesized
aagaattacagttggacaag

SEQ ID NO: 40612 - DNA, 20 bp, Artificial Sequence
  chemically synthesized
agaattacagttggacaagt

SEQ ID NO: 40613 - DNA, 20 bp, Artificial Sequence
  chemically synthesized
acaagtgggaacaaataaca

SEQ ID NO: 40614 - DNA, 20 bp, Artificial Sequence
  chemically synthesized
ggaacaaataacatggttca

SEQ ID NO: 40615 - DNA, 20 bp, Artificial Sequence
  chemically synthesized
attcatgtgagcagtaattg

SEQ ID NO: 40616 - DNA, 20 bp, Artificial Sequence
  chemically synthesized
ataagtaaaattcatgtgag

SEQ ID NO: 40617 - DNA, 20 bp, Artificial Sequence
  chemically synthesized
attataagtaaaattcatgt

SEQ ID NO: 40618 - DNA, 20 bp, Artificial Sequence
  chemically synthesized
cttggcatcaggaatattat

SEQ ID NO: 40619 - DNA, 20 bp, Artificial Sequence
  chemically synthesized
cttataatattcctgatgcc

SEQ ID NO: 40620 - DNA, 20 bp, Artificial Sequence
  chemically synthesized
agcatttatgacttggcatc

SEQ ID NO: 40621 - DNA, 20 bp, Artificial Sequence
  chemically synthesized
gagcatttatgacttggcat

SEQ ID NO: 40622 - DNA, 20 bp, Artificial Sequence
  chemically synthesized
tgttgagagcatttatgact

SEQ ID NO: 40623 - DNA, 20 bp, Artificial Sequence
  chemically synthesized
ccagtcagatgagatgttga

SEQ ID NO: 40624 - DNA, 20 bp, Artificial Sequence
  chemically synthesized
taccagtcagatgagatgtt

SEQ ID NO: 40625 - DNA, 20 bp, Artificial Sequence
  chemically synthesized
ctctcaacatctcatctgac

SEQ ID NO: 40626 - DNA, 20 bp, Artificial Sequence
  chemically synthesized
gaaagttctaccagtcagat

SEQ ID NO: 40627 - DNA, 20 bp, Artificial Sequence
  chemically synthesized
tcaacatctcatctgactgg

SEQ ID NO: 40628 - DNA, 20 bp, Artificial Sequence
  chemically synthesized
agtaagaaagttctaccagt

SEQ ID NO: 40629 - DNA, 20 bp, Artificial Sequence
  chemically synthesized
tgccagtaagaaagttctac

SEQ ID NO: 40630 - DNA, 20 bp, Artificial Sequence
  chemically synthesized
gactggtagaactttcttac

SEQ ID NO: 40631 - DNA, 20 bp, Artificial Sequence
  chemically synthesized
ggaatctcatgccagtaaga

SEQ ID NO: 40632 - DNA, 20 bp, Artificial Sequence
  chemically synthesized
cctaggaatctcatgccagt

SEQ ID NO: 40633 - DNA, 20 bp, Artificial Sequence
  chemically synthesized
tagaactttcttactggcat

SEQ ID NO: 40634 - DNA, 20 bp, Artificial Sequence
  chemically synthesized
aaatcctaggaatctcatgc

SEQ ID NO: 40635 - DNA, 20 bp, Artificial Sequence
  chemically synthesized
tcttactggcatgagattcc

SEQ ID NO: 40636 - DNA, 20 bp, Artificial Sequence
  chemically synthesized
cttactggcatgagattcct

SEQ ID NO: 40637 - DNA, 20 bp, Artificial Sequence
  chemically synthesized
taaaggataacaaaaatcct

SEQ ID NO: 40638 - DNA, 20 bp, Artificial Sequence
  chemically synthesized
ctaaaggataacaaaaatcc

SEQ ID NO: 40639 - DNA, 20 bp, Artificial Sequence
  chemically synthesized
ctaggatttttgttatcctt

SEQ ID NO: 40640 - DNA, 20 bp, Artificial Sequence
  chemically synthesized
gtgtagaatataaaagctaa

SEQ ID NO: 40641 - DNA, 20 bp, Artificial Sequence
  chemically synthesized
ggtgtagaatataaaagcta

SEQ ID NO: 40642 - DNA, 20 bp, Artificial Sequence
  chemically synthesized
atccatggtgtagaatataa

SEQ ID NO: 40643 - DNA, 20 bp, Artificial Sequence
  chemically synthesized
agcttttatattctacacca

SEQ ID NO: 40644 - DNA, 20 bp, Artificial Sequence
  chemically synthesized
agtggtaccaatccatggtg

SEQ ID NO: 40645 - DNA, 20 bp, Artificial Sequence
  chemically synthesized
ttatattctacaccatggat

SEQ ID NO: 40646 - DNA, 20 bp, Artificial Sequence
  chemically synthesized
tttagagtggtaccaatcca

SEQ ID NO: 40647 - DNA, 20 bp, Artificial Sequence
  chemically synthesized
aaatttgatccaatttagag

SEQ ID NO: 40648 - DNA, 20 bp, Artificial Sequence
  chemically synthesized
ggattggtaccactctaaat

SEQ ID NO: 40649 - DNA, 20 bp, Artificial Sequence
  chemically synthesized
ccaaaatttgatccaattta

SEQ ID NO: 40650 - DNA, 20 bp, Artificial Sequence
  chemically synthesized
ttccaaaatttgatccaatt

SEQ ID NO: 40651 - DNA, 20 bp, Artificial Sequence
  chemically synthesized
ctctaaattggatcaaattt

SEQ ID NO: 40652 - DNA, 20 bp, Artificial Sequence
  chemically synthesized
tggatcaaattttggaacaa

SEQ ID NO: 40653 - DNA, 20 bp, Artificial Sequence
  chemically synthesized
attttggaacaatagacatc

SEQ ID NO: 40654 - DNA, 20 bp, Artificial Sequence
  chemically synthesized
tggaacaatagacatcaagt

SEQ ID NO: 40655 - DNA, 20 bp, Artificial Sequence
  chemically synthesized
gtaagatgtttctaaacaat

SEQ ID NO: 40656 - DNA, 20 bp, Artificial Sequence
  chemically synthesized
actaagaatagctaattgtt

SEQ ID NO: 40657 - DNA, 20 bp, Artificial Sequence
  chemically synthesized
tctaaacaattagctattct

SEQ ID NO: 40658 - DNA, 20 bp, Artificial Sequence
  chemically synthesized
gaaattcaaatgactaagaa

SEQ ID NO: 40659 - DNA, 20 bp, Artificial Sequence
  chemically synthesized
acatagaaattcaaatgact

SEQ ID NO: 40660 - DNA, 20 bp, Artificial Sequence
  chemically synthesized
ccaaagcatgtgttatgaca

SEQ ID NO: 40661 - DNA, 20 bp, Artificial Sequence
  chemically synthesized
ctatgtcataacacatgctt

SEQ ID NO: 40662 - DNA, 20 bp, Artificial Sequence
  chemically synthesized
aggttactctataaatgcca

SEQ ID NO: 40663 - DNA, 20 bp, Artificial Sequence
  chemically synthesized
aacacatgctttggcattta

SEQ ID NO: 40664 - DNA, 20 bp, Artificial Sequence
  chemically synthesized
cacatgctttggcatttata

SEQ ID NO: 40665 - DNA, 20 bp, Artificial Sequence
  chemically synthesized
ttatagagtaacctactctt

SEQ ID NO: 40666 - DNA, 20 bp, Artificial Sequence
  chemically synthesized
gattattttttcttaagagt

SEQ ID NO: 40667 - DNA, 20 bp, Artificial Sequence
  chemically synthesized
agattattttttcttaagag

SEQ ID NO: 40668 - DNA, 20 bp, Artificial Sequence
  chemically synthesized
aagagattattttttcttaa

SEQ ID NO: 40669 - DNA, 20 bp, Artificial Sequence
  chemically synthesized
agaagagattattttttctt

SEQ ID NO: 40670 - DNA, 20 bp, Artificial Sequence
  chemically synthesized
agaaaaaataatctcttcta

SEQ ID NO: 40671 - DNA, 20 bp, Artificial Sequence
  chemically synthesized
attaaatacgggctttagaa

SEQ ID NO: 40672 - DNA, 20 bp, Artificial Sequence
  chemically synthesized
aaattaaatacgggctttag

SEQ ID NO: 40673 - DNA, 20 bp, Artificial Sequence
  chemically synthesized
gtaaaattaaatacgggctt

SEQ ID NO: 40674 - DNA, 20 bp, Artificial Sequence
  chemically synthesized
acaattgtaaaattaaatac

SEQ ID NO: 40675 - DNA, 20 bp, Artificial Sequence
  chemically synthesized
cacaattgtaaaattaaata

SEQ ID NO: 40676 - DNA, 20 bp, Artificial Sequence
  chemically synthesized
tacacaattgtgtatgtata

SEQ ID NO: 40677 - DNA, 20 bp, Artificial Sequence
  chemically synthesized
caattgtgtatgtatatagt

SEQ ID NO: 40678 - DNA, 20 bp, Artificial Sequence
  chemically synthesized
gtgtatgtatatagtaagca

SEQ ID NO: 40679 - DNA, 20 bp, Artificial Sequence
  chemically synthesized
gctgagacattagcatttgt

SEQ ID NO: 40680 - DNA, 20 bp, Artificial Sequence
  chemically synthesized
actgacaaatgctaatgtct

SEQ ID NO: 40681 - DNA, 20 bp, Artificial Sequence
  chemically synthesized
aatttccctggctgagacat

SEQ ID NO: 40682 - DNA, 20 bp, Artificial Sequence
  chemically synthesized
acaaatgctaatgtctcagc

SEQ ID NO: 40683 - DNA, 20 bp, Artificial Sequence
  chemically synthesized
caaatgctaatgtctcagcc

SEQ ID NO: 40684 - DNA, 20 bp, Artificial Sequence
  chemically synthesized
aaatgctaatgtctcagcca

SEQ ID NO: 40685 - DNA, 20 bp, Artificial Sequence
  chemically synthesized
gtcaatcaatttccctggct

SEQ ID NO: 40686 - DNA, 20 bp, Artificial Sequence
  chemically synthesized
ttcctgtcaatcaatttccc

SEQ ID NO: 40687 - DNA, 20 bp, Artificial Sequence
  chemically synthesized
cagccagggaaattgattga

SEQ ID NO: 40688 - DNA, 20 bp, Artificial Sequence
  chemically synthesized
agccagggaaattgattgac

SEQ ID NO: 40689 - DNA, 20 bp, Artificial Sequence
  chemically synthesized
gaaattgattgacaggaaac

SEQ ID NO: 40690 - DNA, 20 bp, Artificial Sequence
  chemically synthesized
aattgattgacaggaaactg

SEQ ID NO: 40691 - DNA, 20 bp, Artificial Sequence
  chemically synthesized
tgattgacaggaaactggag

SEQ ID NO: 40692 - DNA, 20 bp, Artificial Sequence
  chemically synthesized
attgacaggaaactggagaa

SEQ ID NO: 40693 - DNA, 20 bp, Artificial Sequence
  chemically synthesized
agttttcaggggctcttctc

SEQ ID NO: 40694 - DNA, 20 bp, Artificial Sequence
  chemically synthesized
ttacagacttgagttttcag

SEQ ID NO: 40695 - DNA, 20 bp, Artificial Sequence
  chemically synthesized
attacagacttgagttttca

SEQ ID NO: 40696 - DNA, 20 bp, Artificial Sequence
  chemically synthesized
aattacagacttgagttttc

SEQ ID NO: 40697 - DNA, 20 bp, Artificial Sequence
  chemically synthesized
agaagagcccctgaaaactc

SEQ ID NO: 40698 - DNA, 20 bp, Artificial Sequence
  chemically synthesized
taattacagacttgagtttt

SEQ ID NO: 40699 - DNA, 20 bp, Artificial Sequence
  chemically synthesized
tagtatataattacagactt

SEQ ID NO: 40700 - DNA, 20 bp, Artificial Sequence
  chemically synthesized
acagatgtagtatataatta

SEQ ID NO: 40701 - DNA, 20 bp, Artificial Sequence
  chemically synthesized
taattatatactacatctgt

SEQ ID NO: 40702 - DNA, 20 bp, Artificial Sequence
  chemically synthesized
aggtagtccactcacagatg

SEQ ID NO: 40703 - DNA, 20 bp, Artificial Sequence
  chemically synthesized
ttatatactacatctgtgag

SEQ ID NO: 40704 - DNA, 20 bp, Artificial Sequence
  chemically synthesized
tgatacaggtagtccactca

SEQ ID NO: 40705 - DNA, 20 bp, Artificial Sequence
  chemically synthesized
tgtgagtggactacctgtat

SEQ ID NO: 40706 - DNA, 20 bp, Artificial Sequence
  chemically synthesized
ggtgtataaactgatacagg

SEQ ID NO: 40707 - DNA, 20 bp, Artificial Sequence
  chemically synthesized
gatggtgtataaactgatac

SEQ ID NO: 40708 - DNA, 20 bp, Artificial Sequence
  chemically synthesized
agatggtgtataaactgata

SEQ ID NO: 40709 - DNA, 20 bp, Artificial Sequence
  chemically synthesized
aaactttgggatttggaaga

SEQ ID NO: 40710 - DNA, 20 bp, Artificial Sequence
  chemically synthesized
cactaaactttgggatttgg

SEQ ID NO: 40711 - DNA, 20 bp, Artificial Sequence
  chemically synthesized
acaccatcttccaaatccca

SEQ ID NO: 40712 - DNA, 20 bp, Artificial Sequence
  chemically synthesized
taccactaaactttgggatt

SEQ ID NO: 40713 - DNA, 20 bp, Artificial Sequence
  chemically synthesized
atcttccaaatcccaaagtt

SEQ ID NO: 40714 - DNA, 20 bp, Artificial Sequence
  chemically synthesized
ttagtttaccactaaacttt

SEQ ID NO: 40715 - DNA, 20 bp, Artificial Sequence
  chemically synthesized
tttagtttaccactaaactt

SEQ ID NO: 40716 - DNA, 20 bp, Artificial Sequence
  chemically synthesized
ttccaaatcccaaagtttag

SEQ ID NO: 40717 - DNA, 20 bp, Artificial Sequence
  chemically synthesized
acagggcatcagacaaggtt

SEQ ID NO: 40718 - DNA, 20 bp, Artificial Sequence
  chemically synthesized
accatacagggcatcagaca

SEQ ID NO: 40719 - DNA, 20 bp, Artificial Sequence
  chemically synthesized
gaccatacagggcatcagac

SEQ ID NO: 40720 - DNA, 20 bp, Artificial Sequence
  chemically synthesized
ttttagaccatacagggcat

SEQ ID NO: 40721 - DNA, 20 bp, Artificial Sequence
  chemically synthesized
accttgtctgatgccctgta

SEQ ID NO: 40722 - DNA, 20 bp, Artificial Sequence
  chemically synthesized
cctcttttttagaccataca

SEQ ID NO: 40723 - DNA, 20 bp, Artificial Sequence
  chemically synthesized
tcctcttttttagaccatac

SEQ ID NO: 40724 - DNA, 20 bp, Artificial Sequence
  chemically synthesized
ctcctcttttttagaccata

SEQ ID NO: 40725 - DNA, 20 bp, Artificial Sequence
  chemically synthesized
atgccctgtatggtctaaaa

SEQ ID NO: 40726 - DNA, 20 bp, Artificial Sequence
  chemically synthesized
gccctgtatggtctaaaaaa

SEQ ID NO: 40727 - DNA, 20 bp, Artificial Sequence
  chemically synthesized
ccctgtatggtctaaaaaag

SEQ ID NO: 40728 - DNA, 20 bp, Artificial Sequence
  chemically synthesized
tcaacccctctcctcttttt

SEQ ID NO: 40729 - DNA, 20 bp, Artificial Sequence
  chemically synthesized
ctgtatggtctaaaaaagag

SEQ ID NO: 40730 - DNA, 20 bp, Artificial Sequence
  chemically synthesized
gtatggtctaaaaaagagga

SEQ ID NO: 40731 - DNA, 20 bp, Artificial Sequence
  chemically synthesized
tatggtctaaaaaagaggag

SEQ ID NO: 40732 - DNA, 20 bp, Artificial Sequence
  chemically synthesized
atggtctaaaaaagaggaga

SEQ ID NO: 40733 - DNA, 20 bp, Artificial Sequence
  chemically synthesized
tggtctaaaaaagaggagag

SEQ ID NO: 40734 - DNA, 20 bp, Artificial Sequence
  chemically synthesized
aaaagaggagaggggttgaa

SEQ ID NO: 40735 - DNA, 20 bp, Artificial Sequence
  chemically synthesized
aagaggagaggggttgaaaa

SEQ ID NO: 40736 - DNA, 20 bp, Artificial Sequence
  chemically synthesized
ggagaggggttgaaaagagc

SEQ ID NO: 40737 - DNA, 20 bp, Artificial Sequence
  chemically synthesized
agaggggttgaaaagagcaa

SEQ ID NO: 40738 - DNA, 20 bp, Artificial Sequence
  chemically synthesized
gaggggttgaaaagagcaag

SEQ ID NO: 40739 - DNA, 20 bp, Artificial Sequence
  chemically synthesized
gggttgaaaagagcaagagg

SEQ ID NO: 40740 - DNA, 20 bp, Artificial Sequence
  chemically synthesized
gttgaaaagagcaagaggta

SEQ ID NO: 40741 - DNA, 20 bp, Artificial Sequence
  chemically synthesized
gaaaagagcaagaggtagag

SEQ ID NO: 40742 - DNA, 20 bp, Artificial Sequence
  chemically synthesized
aaagagcaagaggtagagta

SEQ ID NO: 40743 - DNA, 20 bp, Artificial Sequence
  chemically synthesized
tagagtagagatgcaatctg

SEQ ID NO: 40744 - DNA, 20 bp, Artificial Sequence
  chemically synthesized
actctgggaatagcggtctt

SEQ ID NO: 40745 - DNA, 20 bp, Artificial Sequence
  chemically synthesized
aatctgaagaccgctattcc

SEQ ID NO: 40746 - DNA, 20 bp, Artificial Sequence
  chemically synthesized
ctctatcactctgggaatag

SEQ ID NO: 40747 - DNA, 20 bp, Artificial Sequence
  chemically synthesized
tctgaagaccgctattccca

SEQ ID NO: 40748 - DNA, 20 bp, Artificial Sequence
  chemically synthesized
ttgctctatcactctgggaa

SEQ ID NO: 40749 - DNA, 20 bp, Artificial Sequence
  chemically synthesized
gaccgctattcccagagtga

SEQ ID NO: 40750 - DNA, 20 bp, Artificial Sequence
  chemically synthesized
gtcacttgctctatcactct

SEQ ID NO: 40751 - DNA, 20 bp, Artificial Sequence
  chemically synthesized
agtcacttgctctatcactc

SEQ ID NO: 40752 - DNA, 20 bp, Artificial Sequence
  chemically synthesized
ccgctattcccagagtgata

SEQ ID NO: 40753 - DNA, 20 bp, Artificial Sequence
  chemically synthesized
tattcccagagtgatagagc

SEQ ID NO: 40754 - DNA, 20 bp, Artificial Sequence
  chemically synthesized
agagtgatagagcaagtgac

SEQ ID NO: 40755 - DNA, 20 bp, Artificial Sequence
  chemically synthesized
gtgatagagcaagtgactag

SEQ ID NO: 40756 - DNA, 20 bp, Artificial Sequence
  chemically synthesized
aggtccctcacattcactac

SEQ ID NO: 40757 - DNA, 20 bp, Artificial Sequence
  chemically synthesized
aagtgactagtagtgaatgt

SEQ ID NO: 40758 - DNA, 20 bp, Artificial Sequence
  chemically synthesized
agtgactagtagtgaatgtg

SEQ ID NO: 40759 - DNA, 20 bp, Artificial Sequence
  chemically synthesized
gtgactagtagtgaatgtga

SEQ ID NO: 40760 - DNA, 20 bp, Artificial Sequence
  chemically synthesized
agacaaaccacacaaacagg

SEQ ID NO: 40761 - DNA, 20 bp, Artificial Sequence
  chemically synthesized
cagacaaaccacacaaacag

SEQ ID NO: 40762 - DNA, 20 bp, Artificial Sequence
  chemically synthesized
tgagggacctcctgtttgtg

SEQ ID NO: 40763 - DNA, 20 bp, Artificial Sequence
  chemically synthesized
gacagacaaaccacacaaac

SEQ ID NO: 40764 - DNA, 20 bp, Artificial Sequence
  chemically synthesized
tgacagacaaaccacacaaa

SEQ ID NO: 40765 - DNA, 20 bp, Artificial Sequence
  chemically synthesized
aagtttcaagatttatatga

SEQ ID NO: 40766 - DNA, 20 bp, Artificial Sequence
  chemically synthesized
taaaaatctatgtaagtttc

SEQ ID NO: 40767 - DNA, 20 bp, Artificial Sequence
  chemically synthesized
tataaatcttgaaacttaca

SEQ ID NO: 40768 - DNA, 20 bp, Artificial Sequence
  chemically synthesized
tcccttataaaaatctatgt

SEQ ID NO: 40769 - DNA, 20 bp, Artificial Sequence
  chemically synthesized
aaacttacatagatttttat

SEQ ID NO: 40770 - DNA, 20 bp, Artificial Sequence
  chemically synthesized
aacttacatagatttttata

SEQ ID NO: 40771 - DNA, 20 bp, Artificial Sequence
  chemically synthesized
acttacatagatttttataa

SEQ ID NO: 40772 - DNA, 20 bp, Artificial Sequence
  chemically synthesized
atttttataagggaaaacat

SEQ ID NO: 40773 - DNA, 20 bp, Artificial Sequence
  chemically synthesized
agggaaaacatcagcatatc

SEQ ID NO: 40774 - DNA, 20 bp, Artificial Sequence
  chemically synthesized
gaaaacatcagcatatcgag

SEQ ID NO: 40775 - DNA, 20 bp, Artificial Sequence
  chemically synthesized
acatcagcatatcgagaaga

SEQ ID NO: 40776 - DNA, 20 bp, Artificial Sequence
  chemically synthesized
agaagaaagatataatgttt

SEQ ID NO: 40777 - DNA, 20 bp, Artificial Sequence
  chemically synthesized
gaagaaagatataatgttta

SEQ ID NO: 40778 - DNA, 20 bp, Artificial Sequence
  chemically synthesized
aagaaagatataatgtttaa

SEQ ID NO: 40779 - DNA, 20 bp, Artificial Sequence
  chemically synthesized
agaaagatataatgtttaag

SEQ ID NO: 40780 - DNA, 20 bp, Artificial Sequence
  chemically synthesized
tttaaggggatcattgccac

SEQ ID NO: 40781 - DNA, 20 bp, Artificial Sequence
  chemically synthesized
aaaatctaaataaagtccag

SEQ ID NO: 40782 - DNA, 20 bp, Artificial Sequence
  chemically synthesized
gccaaaatctaaataaagtc

SEQ ID NO: 40783 - DNA, 20 bp, Artificial Sequence
  chemically synthesized
cattgccactggactttatt

SEQ ID NO: 40784 - DNA, 20 bp, Artificial Sequence
  chemically synthesized
tgcaagccaaaatctaaata

SEQ ID NO: 40785 - DNA, 20 bp, Artificial Sequence
  chemically synthesized
actggactttatttagattt

SEQ ID NO: 40786 - DNA, 20 bp, Artificial Sequence
  chemically synthesized
ttcattctgatagaatgtgc

SEQ ID NO: 40787 - DNA, 20 bp, Artificial Sequence
  chemically synthesized
ttttggcttgcacattctat

SEQ ID NO: 40788 - DNA, 20 bp, Artificial Sequence
  chemically synthesized
atgttggcttttcattctga

SEQ ID NO: 40789 - DNA, 20 bp, Artificial Sequence
  chemically synthesized
gcacattctatcagaatgaa

SEQ ID NO: 40790 - DNA, 20 bp, Artificial Sequence
  chemically synthesized
tgatgaaaagatttcaatgt

SEQ ID NO: 40791 - DNA, 20 bp, Artificial Sequence
  chemically synthesized
tttttctcttatatgatgaa

SEQ ID NO: 40792 - DNA, 20 bp, Artificial Sequence
  chemically synthesized
ttgaaatcttttcatcatat

SEQ ID NO: 40793 - DNA, 20 bp, Artificial Sequence
  chemically synthesized
gaaatcttttcatcatataa

SEQ ID NO: 40794 - DNA, 20 bp, Artificial Sequence
  chemically synthesized
ttttcatcatataagagaaa

SEQ ID NO: 40795 - DNA, 20 bp, Artificial Sequence
  chemically synthesized
tttcatcatataagagaaaa

SEQ ID NO: 40796 - DNA, 20 bp, Artificial Sequence
  chemically synthesized
catcatataagagaaaaagg

SEQ ID NO: 40797 - DNA, 20 bp, Artificial Sequence
  chemically synthesized
atataagagaaaaaggaaga

SEQ ID NO: 40798 - DNA, 20 bp, Artificial Sequence
  chemically synthesized
taagagaaaaaggaagatag

SEQ ID NO: 40799 - DNA, 20 bp, Artificial Sequence
  chemically synthesized
aagagaaaaaggaagatagt

SEQ ID NO: 40800 - DNA, 20 bp, Artificial Sequence
  chemically synthesized
aaaaggaagatagtaggtgc

SEQ ID NO: 40801 - DNA, 20 bp, Artificial Sequence
  chemically synthesized
atagtaggtgctggtatcac

SEQ ID NO: 40802 - DNA, 20 bp, Artificial Sequence
  chemically synthesized
cgcttctagccttgtgatac

SEQ ID NO: 40803 - DNA, 20 bp, Artificial Sequence
  chemically synthesized
tagtaggtgctggtatcaca

SEQ ID NO: 40804 - DNA, 20 bp, Artificial Sequence
  chemically synthesized
aggtgctggtatcacaaggc

SEQ ID NO: 40805 - DNA, 20 bp, Artificial Sequence
  chemically synthesized
tgctggtatcacaaggctag

SEQ ID NO: 40806 - DNA, 20 bp, Artificial Sequence
  chemically synthesized
tggtatcacaaggctagaag

SEQ ID NO: 40807 - DNA, 20 bp, Artificial Sequence
  chemically synthesized
actactatgaaaaccgcttc

SEQ ID NO: 40808 - DNA, 20 bp, Artificial Sequence
  chemically synthesized
aaggctagaagcggttttca

SEQ ID NO: 40809 - DNA, 20 bp, Artificial Sequence
  chemically synthesized
gctagaagcggttttcatag

SEQ ID NO: 40810 - DNA, 20 bp, Artificial Sequence
  chemically synthesized
gaagcggttttcatagtagt

SEQ ID NO: 40811 - DNA, 20 bp, Artificial Sequence
  chemically synthesized
actcataagggaaagattaa

SEQ ID NO: 40812 - DNA, 20 bp, Artificial Sequence
  chemically synthesized
taactcaaactcataaggga

SEQ ID NO: 40813 - DNA, 20 bp, Artificial Sequence
  chemically synthesized
gccattaatctttcccttat

SEQ ID NO: 40814 - DNA, 20 bp, Artificial Sequence
  chemically synthesized
aggataactcaaactcataa

SEQ ID NO: 40815 - DNA, 20 bp, Artificial Sequence
  chemically synthesized
taggataactcaaactcata

SEQ ID NO: 40816 - DNA, 20 bp, Artificial Sequence
  chemically synthesized
ttaggataactcaaactcat

SEQ ID NO: 40817 - DNA, 20 bp, Artificial Sequence
  chemically synthesized
aatctttcccttatgagttt

SEQ ID NO: 40818 - DNA, 20 bp, Artificial Sequence
  chemically synthesized
tttataatatgcacaatgtt

SEQ ID NO: 40819 - DNA, 20 bp, Artificial Sequence
  chemically synthesized
atttataatatgcacaatgt

SEQ ID NO: 40820 - DNA, 20 bp, Artificial Sequence
  chemically synthesized
cattgtgcatattataaata

SEQ ID NO: 40821 - DNA, 20 bp, Artificial Sequence
  chemically synthesized
tataaatacagacacctgct

SEQ ID NO: 40822 - DNA, 20 bp, Artificial Sequence
  chemically synthesized
agaggcagtacaagccaagc

SEQ ID NO: 40823 - DNA, 20 bp, Artificial Sequence
  chemically synthesized
gagaggcagtacaagccaag

SEQ ID NO: 40824 - DNA, 20 bp, Artificial Sequence
  chemically synthesized
gttgagaggcagtacaagcc

SEQ ID NO: 40825 - DNA, 20 bp, Artificial Sequence
  chemically synthesized
actttgttgagaggcagtac

SEQ ID NO: 40826 - DNA, 20 bp, Artificial Sequence
  chemically synthesized
gccatcactttgttgagagg

SEQ ID NO: 40827 - DNA, 20 bp, Artificial Sequence
  chemically synthesized
gcttgtactgcctctcaaca

SEQ ID NO: 40828 - DNA, 20 bp, Artificial Sequence
  chemically synthesized
tctgccatcactttgttgag

SEQ ID NO: 40829 - DNA, 20 bp, Artificial Sequence
  chemically synthesized
gtctgccatcactttgttga

SEQ ID NO: 40830 - DNA, 20 bp, Artificial Sequence
  chemically synthesized
ctgtctgccatcactttgtt

SEQ ID NO: 40831 - DNA, 20 bp, Artificial Sequence
  chemically synthesized
actgcctctcaacaaagtga

SEQ ID NO: 40832 - DNA, 20 bp, Artificial Sequence
  chemically synthesized
gcctctcaacaaagtgatgg

SEQ ID NO: 40833 - DNA, 20 bp, Artificial Sequence
  chemically synthesized
ctcaacaaagtgatggcaga

SEQ ID NO: 40834 - DNA, 20 bp, Artificial Sequence
  chemically synthesized
ggcagacagaaaacctaaaa

SEQ ID NO: 40835 - DNA, 20 bp, Artificial Sequence
  chemically synthesized
gtccagaaaagaactttttt

SEQ ID NO: 40836 - DNA, 20 bp, Artificial Sequence
  chemically synthesized
agtccagaaaagaacttttt

SEQ ID NO: 40837 - DNA, 20 bp, Artificial Sequence
  chemically synthesized
aacctaaaaaagttcttttc

SEQ ID NO: 40838 - DNA, 20 bp, Artificial Sequence
  chemically synthesized
aatccacagctagtccagaa

SEQ ID NO: 40839 - DNA, 20 bp, Artificial Sequence
  chemically synthesized
aaaaaagttcttttctggac

SEQ ID NO: 40840 - DNA, 20 bp, Artificial Sequence
  chemically synthesized
ggcctaatccacagctagtc

SEQ ID NO: 40841 - DNA, 20 bp, Artificial Sequence
  chemically synthesized
gttcttttctggactagctg

SEQ ID NO: 40842 - DNA, 20 bp, Artificial Sequence
  chemically synthesized
atctaggcctaatccacagc

SEQ ID NO: 40843 - DNA, 20 bp, Artificial Sequence
  chemically synthesized
tttctggactagctgtggat

SEQ ID NO: 40844 - DNA, 20 bp, Artificial Sequence
  chemically synthesized
ttctggactagctgtggatt

SEQ ID NO: 40845 - DNA, 20 bp, Artificial Sequence
  chemically synthesized
tccaatctaggcctaatcca

SEQ ID NO: 40846 - DNA, 20 bp, Artificial Sequence
  chemically synthesized
gactagctgtggattaggcc

SEQ ID NO: 40847 - DNA, 20 bp, Artificial Sequence
  chemically synthesized
gctgtggattaggcctagat

SEQ ID NO: 40848 - DNA, 20 bp, Artificial Sequence
  chemically synthesized
ttctaatggcgatccaatct

SEQ ID NO: 40849 - DNA, 20 bp, Artificial Sequence
  chemically synthesized
tttctaatggcgatccaatc

SEQ ID NO: 40850 - DNA, 20 bp, Artificial Sequence
  chemically synthesized
ggcctagattggatcgccat

SEQ ID NO: 40851 - DNA, 20 bp, Artificial Sequence
  chemically synthesized
agattggatcgccattagaa

SEQ ID NO: 40852 - DNA, 20 bp, Artificial Sequence
  chemically synthesized
tgcattccccacttttctaa

SEQ ID NO: 40853 - DNA, 20 bp, Artificial Sequence
  chemically synthesized
ttggatcgccattagaaaag

SEQ ID NO: 40854 - DNA, 20 bp, Artificial Sequence
  chemically synthesized
tggatcgccattagaaaagt

SEQ ID NO: 40855 - DNA, 20 bp, Artificial Sequence
  chemically synthesized
ggatcgccattagaaaagtg

SEQ ID NO: 40856 - DNA, 20 bp, Artificial Sequence
  chemically synthesized
atgcatgtgtgcatacatac

SEQ ID NO: 40857 - DNA, 20 bp, Artificial Sequence
  chemically synthesized
gtgcatacatacaagttcta

SEQ ID NO: 40858 - DNA, 20 bp, Artificial Sequence
  chemically synthesized
tgcatacatacaagttctat

SEQ ID NO: 40859 - DNA, 20 bp, Artificial Sequence
  chemically synthesized
actccaggactgtaggccca

SEQ ID NO: 40860 - DNA, 20 bp, Artificial Sequence
  chemically synthesized
atacaagttctatgggccta

SEQ ID NO: 40861 - DNA, 20 bp, Artificial Sequence
  chemically synthesized
gttctatgggcctacagtcc

SEQ ID NO: 40862 - DNA, 20 bp, Artificial Sequence
  chemically synthesized
agtgtgcactccaggactgt

SEQ ID NO: 40863 - DNA, 20 bp, Artificial Sequence
  chemically synthesized
cagtgtgcactccaggactg

SEQ ID NO: 40864 - DNA, 20 bp, Artificial Sequence
  chemically synthesized
tctatgggcctacagtcctg

SEQ ID NO: 40865 - DNA, 20 bp, Artificial Sequence
  chemically synthesized
catgtctcagtgtgcactcc

SEQ ID NO: 40866 - DNA, 20 bp, Artificial Sequence
  chemically synthesized
acatgtctcagtgtgcactc

SEQ ID NO: 40867 - DNA, 20 bp, Artificial Sequence
  chemically synthesized
acagtcctggagtgcacact

SEQ ID NO: 40868 - DNA, 20 bp, Artificial Sequence
  chemically synthesized
ggagtgcacactgagacatg

SEQ ID NO: 40869 - DNA, 20 bp, Artificial Sequence
  chemically synthesized
cccccagaagccacatgtct

SEQ ID NO: 40870 - DNA, 20 bp, Artificial Sequence
  chemically synthesized
acactgagacatgtggcttc

SEQ ID NO: 40871 - DNA, 20 bp, Artificial Sequence
  chemically synthesized
cactgagacatgtggcttct

SEQ ID NO: 40872 - DNA, 20 bp, Artificial Sequence
  chemically synthesized
actgagacatgtggcttctg

SEQ ID NO: 40873 - DNA, 20 bp, Artificial Sequence
  chemically synthesized
ctgagacatgtggcttctgg

SEQ ID NO: 40874 - DNA, 20 bp, Artificial Sequence
  chemically synthesized
tgaaaggcagcaacccccag

SEQ ID NO: 40875 - DNA, 20 bp, Artificial Sequence
  chemically synthesized
tattgaaaggcagcaacccc

SEQ ID NO: 40876 - DNA, 20 bp, Artificial Sequence
  chemically synthesized
gattctgtggtattgaaagg

SEQ ID NO: 40877 - DNA, 20 bp, Artificial Sequence
  chemically synthesized
agtgattctgtggtattgaa

SEQ ID NO: 40878 - DNA, 20 bp, Artificial Sequence
  chemically synthesized
cagtgattctgtggtattga

SEQ ID NO: 40879 - DNA, 20 bp, Artificial Sequence
  chemically synthesized
gttgctgcctttcaatacca

SEQ ID NO: 40880 - DNA, 20 bp, Artificial Sequence
  chemically synthesized
gctgtaacccagtgattctg

SEQ ID NO: 40881 - DNA, 20 bp, Artificial Sequence
  chemically synthesized
tttcaataccacagaatcac

SEQ ID NO: 40882 - DNA, 20 bp, Artificial Sequence
  chemically synthesized
ttcaataccacagaatcact

SEQ ID NO: 40883 - DNA, 20 bp, Artificial Sequence
  chemically synthesized
accacagaatcactgggtta

SEQ ID NO: 40884 - DNA, 20 bp, Artificial Sequence
  chemically synthesized
tcagccaatgggctgtaacc

SEQ ID NO: 40885 - DNA, 20 bp, Artificial Sequence
  chemically synthesized
atcactgggttacagcccat

SEQ ID NO: 40886 - DNA, 20 bp, Artificial Sequence
  chemically synthesized
tgggttacagcccattggct

SEQ ID NO: 40887 - DNA, 20 bp, Artificial Sequence
  chemically synthesized
acttgaactactcagccaat

SEQ ID NO: 40888 - DNA, 20 bp, Artificial Sequence
  chemically synthesized
aacttgaactactcagccaa

SEQ ID NO: 40889 - DNA, 20 bp, Artificial Sequence
  chemically synthesized
gttacagcccattggctgag

SEQ ID NO: 40890 - DNA, 20 bp, Artificial Sequence
  chemically synthesized
tatagataacttgaactact

SEQ ID NO: 40891 - DNA, 20 bp, Artificial Sequence
  chemically synthesized
gcccattggctgagtagttc

SEQ ID NO: 40892 - DNA, 20 bp, Artificial Sequence
  chemically synthesized
tgagtagttcaagttatcta

SEQ ID NO: 40893 - DNA, 20 bp, Artificial Sequence
  chemically synthesized
tcacataataaatgagtcta

SEQ ID NO: 40894 - DNA, 20 bp, Artificial Sequence
  chemically synthesized
agctctgtcacataataaat

SEQ ID NO: 40895 - DNA, 20 bp, Artificial Sequence
  chemically synthesized
tagactcatttattatgtga

SEQ ID NO: 40896 - DNA, 20 bp, Artificial Sequence
  chemically synthesized
gactcatttattatgtgaca

SEQ ID NO: 40897 - DNA, 20 bp, Artificial Sequence
  chemically synthesized
ttatgtgacagagctgatga

SEQ ID NO: 40898 - DNA, 20 bp, Artificial Sequence
  chemically synthesized
ggatgcatctatgctatcat

SEQ ID NO: 40899 - DNA, 20 bp, Artificial Sequence
  chemically synthesized
tgacagagctgatgatagca

SEQ ID NO: 40900 - DNA, 20 bp, Artificial Sequence
  chemically synthesized
atagatgcatccctgattga

SEQ ID NO: 40901 - DNA, 20 bp, Artificial Sequence
  chemically synthesized
atctatctggctttcaatca

SEQ ID NO: 40902 - DNA, 20 bp, Artificial Sequence
  chemically synthesized
gatctatctggctttcaatc

SEQ ID NO: 40903 - DNA, 20 bp, Artificial Sequence
  chemically synthesized
ggatctatctggctttcaat

SEQ ID NO: 40904 - DNA, 20 bp, Artificial Sequence
  chemically synthesized
atgcatccctgattgaaagc

SEQ ID NO: 40905 - DNA, 20 bp, Artificial Sequence
  chemically synthesized
atccctgattgaaagccaga

SEQ ID NO: 40906 - DNA, 20 bp, Artificial Sequence
  chemically synthesized
aatgaagcaaaggatctatc

SEQ ID NO: 40907 - DNA, 20 bp, Artificial Sequence
  chemically synthesized
aacaaagcaaaatgaagcaa

SEQ ID NO: 40908 - DNA, 20 bp, Artificial Sequence
  chemically synthesized
taacaaagcaaaatgaagca

SEQ ID NO: 40909 - DNA, 20 bp, Artificial Sequence
  chemically synthesized
cacactaacaaagcaaaatg

SEQ ID NO: 40910 - DNA, 20 bp, Artificial Sequence
  chemically synthesized
tttgcttcattttgctttgt

SEQ ID NO: 40911 - DNA, 20 bp, Artificial Sequence
  chemically synthesized
tgtgctagcccacactaaca

SEQ ID NO: 40912 - DNA, 20 bp, Artificial Sequence
  chemically synthesized
ttcattttgctttgttagtg

SEQ ID NO: 40913 - DNA, 20 bp, Artificial Sequence
  chemically synthesized
tcattttgctttgttagtgt

SEQ ID NO: 40914 - DNA, 20 bp, Artificial Sequence
  chemically synthesized
tttgctttgttagtgtgggc

SEQ ID NO: 40915 - DNA, 20 bp, Artificial Sequence
  chemically synthesized
tttgttagtgtgggctagca

SEQ ID NO: 40916 - DNA, 20 bp, Artificial Sequence
  chemically synthesized
ttgttagtgtgggctagcac

SEQ ID NO: 40917 - DNA, 20 bp, Artificial Sequence
  chemically synthesized
acctaaaggcaagcctgtgc

SEQ ID NO: 40918 - DNA, 20 bp, Artificial Sequence
  chemically synthesized
ggctagcacaggcttgcctt

SEQ ID NO: 40919 - DNA, 20 bp, Artificial Sequence
  chemically synthesized
gctagcacaggcttgccttt

SEQ ID NO: 40920 - DNA, 20 bp, Artificial Sequence
  chemically synthesized
ccactcaggtacctaaaggc

SEQ ID NO: 40921 - DNA, 20 bp, Artificial Sequence
  chemically synthesized
cattccactcaggtacctaa

SEQ ID NO: 40922 - DNA, 20 bp, Artificial Sequence
  chemically synthesized
acattccactcaggtaccta

SEQ ID NO: 40923 - DNA, 20 bp, Artificial Sequence
  chemically synthesized
aggcttgcctttaggtacct

SEQ ID NO: 40924 - DNA, 20 bp, Artificial Sequence
  chemically synthesized
cttgcctttaggtacctgag

SEQ ID NO: 40925 - DNA, 20 bp, Artificial Sequence
  chemically synthesized
agaagttgtacattccactc

SEQ ID NO: 40926 - DNA, 20 bp, Artificial Sequence
  chemically synthesized
tagaagttgtacattccact

SEQ ID NO: 40927 - DNA, 20 bp, Artificial Sequence
  chemically synthesized
tgagtggaatgtacaacttc

SEQ ID NO: 40928 - DNA, 20 bp, Artificial Sequence
  chemically synthesized
ccattacatgtaaggactag

SEQ ID NO: 40929 - DNA, 20 bp, Artificial Sequence
  chemically synthesized
tctccattacatgtaaggac

SEQ ID NO: 40930 - DNA, 20 bp, Artificial Sequence
  chemically synthesized
agtcttctccattacatgta

SEQ ID NO: 40931 - DNA, 20 bp, Artificial Sequence
  chemically synthesized
cagtcttctccattacatgt

SEQ ID NO: 40932 - DNA, 20 bp, Artificial Sequence
  chemically synthesized
cttctagtccttacatgtaa

SEQ ID NO: 40933 - DNA, 20 bp, Artificial Sequence
  chemically synthesized
tctagtccttacatgtaatg

SEQ ID NO: 40934 - DNA, 20 bp, Artificial Sequence
  chemically synthesized
agtccttacatgtaatggag

SEQ ID NO: 40935 - DNA, 20 bp, Artificial Sequence
  chemically synthesized
cttttcaagatgaatcatag

SEQ ID NO: 40936 - DNA, 20 bp, Artificial Sequence
  chemically synthesized
ttacttttcaagatgaatca

SEQ ID NO: 40937 - DNA, 20 bp, Artificial Sequence
  chemically synthesized
ctgctatgattcatcttgaa

SEQ ID NO: 40938 - DNA, 20 bp, Artificial Sequence
  chemically synthesized
gtgtgtacattttacttttc

SEQ ID NO: 40939 - DNA, 20 bp, Artificial Sequence
  chemically synthesized
ccccaagcttggatatagac

SEQ ID NO: 40940 - DNA, 20 bp, Artificial Sequence
  chemically synthesized
cccccaagcttggatataga

SEQ ID NO: 40941 - DNA, 20 bp, Artificial Sequence
  chemically synthesized
acacatacctgtctatatcc

SEQ ID NO: 40942 - DNA, 20 bp, Artificial Sequence
  chemically synthesized
gttacccccaagcttggata

SEQ ID NO: 40943 - DNA, 20 bp, Artificial Sequence
  chemically synthesized
tacctgtctatatccaagct

SEQ ID NO: 40944 - DNA, 20 bp, Artificial Sequence
  chemically synthesized
acctgtctatatccaagctt

SEQ ID NO: 40945 - DNA, 20 bp, Artificial Sequence
  chemically synthesized
cctgtctatatccaagcttg

SEQ ID NO: 40946 - DNA, 20 bp, Artificial Sequence
  chemically synthesized
ctgtctatatccaagcttgg

SEQ ID NO: 40947 - DNA, 20 bp, Artificial Sequence
  chemically synthesized
agaagtgttacccccaagct

SEQ ID NO: 40948 - DNA, 20 bp, Artificial Sequence
  chemically synthesized
aacccagaagtgttaccccc

SEQ ID NO: 40949 - DNA, 20 bp, Artificial Sequence
  chemically synthesized
aagcttgggggtaacacttc

SEQ ID NO: 40950 - DNA, 20 bp, Artificial Sequence
  chemically synthesized
agcttgggggtaacacttct

SEQ ID NO: 40951 - DNA, 20 bp, Artificial Sequence
  chemically synthesized
atgtcatagctcaaacccag

SEQ ID NO: 40952 - DNA, 20 bp, Artificial Sequence
  chemically synthesized
ggggtaacacttctgggttt

SEQ ID NO: 40953 - DNA, 20 bp, Artificial Sequence
  chemically synthesized
aaaatgtcatagctcaaacc

SEQ ID NO: 40954 - DNA, 20 bp, Artificial Sequence
  chemically synthesized
tttattatacaaaaatgtca

SEQ ID NO: 40955 - DNA, 20 bp, Artificial Sequence
  chemically synthesized
gtaattatgaaattcaaatg

SEQ ID NO: 40956 - DNA, 20 bp, Artificial Sequence
  chemically synthesized
atttcataattacctactac

SEQ ID NO: 40957 - DNA, 20 bp, Artificial Sequence
  chemically synthesized
ttctaaatcacaccagtagt

SEQ ID NO: 40958 - DNA, 20 bp, Artificial Sequence
  chemically synthesized
cttctaaatcacaccagtag

SEQ ID NO: 40959 - DNA, 20 bp, Artificial Sequence
  chemically synthesized
ctgcttctaaatcacaccag

SEQ ID NO: 40960 - DNA, 20 bp, Artificial Sequence
  chemically synthesized
cagctgcttctaaatcacac

SEQ ID NO: 40961 - DNA, 20 bp, Artificial Sequence
  chemically synthesized
tacctactactggtgtgatt

SEQ ID NO: 40962 - DNA, 20 bp, Artificial Sequence
  chemically synthesized
ctactactggtgtgatttag

SEQ ID NO: 40963 - DNA, 20 bp, Artificial Sequence
  chemically synthesized
ctactggtgtgatttagaag

SEQ ID NO: 40964 - DNA, 20 bp, Artificial Sequence
  chemically synthesized
tggtgtgatttagaagcagc

SEQ ID NO: 40965 - DNA, 20 bp, Artificial Sequence
  chemically synthesized
tgtgatttagaagcagctgg

SEQ ID NO: 40966 - DNA, 20 bp, Artificial Sequence
  chemically synthesized
gtgatttagaagcagctggt

SEQ ID NO: 40967 - DNA, 20 bp, Artificial Sequence
  chemically synthesized
agagcaccatattgacctac

SEQ ID NO: 40968 - DNA, 20 bp, Artificial Sequence
  chemically synthesized
aagcagctggtaggtcaata

SEQ ID NO: 40969 - DNA, 20 bp, Artificial Sequence
  chemically synthesized
cagtactaaaatgcataaaa

SEQ ID NO: 40970 - DNA, 20 bp, Artificial Sequence
  chemically synthesized
ctcagtactaaaatgcataa

SEQ ID NO: 40971 - DNA, 20 bp, Artificial Sequence
  chemically synthesized
tggtgctcttttatgcattt

SEQ ID NO: 40972 - DNA, 20 bp, Artificial Sequence
  chemically synthesized
cttttatgcattttagtact

SEQ ID NO: 40973 - DNA, 20 bp, Artificial Sequence
  chemically synthesized
tctagcacttatgtttttct

SEQ ID NO: 40974 - DNA, 20 bp, Artificial Sequence
  chemically synthesized
tttagtactgagaaaaacat

SEQ ID NO: 40975 - DNA, 20 bp, Artificial Sequence
  chemically synthesized
actgagaaaaacataagtgc

SEQ ID NO: 40976 - DNA, 20 bp, Artificial Sequence
  chemically synthesized
aactttaaaagtggcatatc

SEQ ID NO: 40977 - DNA, 20 bp, Artificial Sequence
  chemically synthesized
tgctagatatgccactttta

SEQ ID NO: 40978 - DNA, 20 bp, Artificial Sequence
  chemically synthesized
attctgggaaactttaaaag

SEQ ID NO: 40979 - DNA, 20 bp, Artificial Sequence
  chemically synthesized
aatattctgggaaactttaa

SEQ ID NO: 40980 - DNA, 20 bp, Artificial Sequence
  chemically synthesized
atgccacttttaaagtttcc

SEQ ID NO: 40981 - DNA, 20 bp, Artificial Sequence
  chemically synthesized
tttaaagtttcccagaatat

SEQ ID NO: 40982 - DNA, 20 bp, Artificial Sequence
  chemically synthesized
tgtttgaattctaatattct

SEQ ID NO: 40983 - DNA, 20 bp, Artificial Sequence
  chemically synthesized
gtgtttgaattctaatattc

SEQ ID NO: 40984 - DNA, 20 bp, Artificial Sequence
  chemically synthesized
cacatacacacacacacata

SEQ ID NO: 40985 - DNA, 20 bp, Artificial Sequence
  chemically synthesized
catacacacacacacataca

SEQ ID NO: 40986 - DNA, 20 bp, Artificial Sequence
  chemically synthesized
cacacacacatacagagtaa

SEQ ID NO: 40987 - DNA, 20 bp, Artificial Sequence
  chemically synthesized
acacacatacagagtaatag

SEQ ID NO: 40988 - DNA, 20 bp, Artificial Sequence
  chemically synthesized
aatagtggtaataccactgc

SEQ ID NO: 40989 - DNA, 20 bp, Artificial Sequence
  chemically synthesized
tagtggtaataccactgcca

SEQ ID NO: 40990 - DNA, 20 bp, Artificial Sequence
  chemically synthesized
cttaactgagtctctggcag

SEQ ID NO: 40991 - DNA, 20 bp, Artificial Sequence
  chemically synthesized
tatcttaactgagtctctgg

SEQ ID NO: 40992 - DNA, 20 bp, Artificial Sequence
  chemically synthesized
taataccactgccagagact

SEQ ID NO: 40993 - DNA, 20 bp, Artificial Sequence
  chemically synthesized
tattatcttaactgagtctc

SEQ ID NO: 40994 - DNA, 20 bp, Artificial Sequence
  chemically synthesized
ccactgccagagactcagtt

SEQ ID NO: 40995 - DNA, 20 bp, Artificial Sequence
  chemically synthesized
agaacaatattatcttaact

SEQ ID NO: 40996 - DNA, 20 bp, Artificial Sequence
  chemically synthesized
aattaaagaggagtcaaata

SEQ ID NO: 40997 - DNA, 20 bp, Artificial Sequence
  chemically synthesized
ggaattaaagaggagtcaaa

SEQ ID NO: 40998 - DNA, 20 bp, Artificial Sequence
  chemically synthesized
gtttagacggaattaaagag

SEQ ID NO: 40999 - DNA, 20 bp, Artificial Sequence
  chemically synthesized
atgtttagacggaattaaag

SEQ ID NO: 41000 - DNA, 20 bp, Artificial Sequence
  chemically synthesized
catgtttagacggaattaaa

SEQ ID NO: 41001 - DNA, 20 bp, Artificial Sequence
  chemically synthesized
ttcatgtttagacggaatta

SEQ ID NO: 41002 - DNA, 20 bp, Artificial Sequence
  chemically synthesized
tattctcattcatgtttaga

SEQ ID NO: 41003 - DNA, 20 bp, Artificial Sequence
  chemically synthesized
tgattattctcattcatgtt

SEQ ID NO: 41004 - DNA, 20 bp, Artificial Sequence
  chemically synthesized
aattccgtctaaacatgaat

SEQ ID NO: 41005 - DNA, 20 bp, Artificial Sequence
  chemically synthesized
tttagtcatgttgtagatat

SEQ ID NO: 41006 - DNA, 20 bp, Artificial Sequence
  chemically synthesized
atttagtcatgttgtagata

SEQ ID NO: 41007 - DNA, 20 bp, Artificial Sequence
  chemically synthesized
gaactcatttagtcatgttg

SEQ ID NO: 41008 - DNA, 20 bp, Artificial Sequence
  chemically synthesized
tatctacaacatgactaaat

SEQ ID NO: 41009 - DNA, 20 bp, Artificial Sequence
  chemically synthesized
gatcctctggtgaactcatt

SEQ ID NO: 41010 - DNA, 20 bp, Artificial Sequence
  chemically synthesized
acatgactaaatgagttcac

SEQ ID NO: 41011 - DNA, 20 bp, Artificial Sequence
  chemically synthesized
atgactaaatgagttcacca

SEQ ID NO: 41012 - DNA, 20 bp, Artificial Sequence
  chemically synthesized
tgactaaatgagttcaccag

SEQ ID NO: 41013 - DNA, 20 bp, Artificial Sequence
  chemically synthesized
atttatgctgttagatcctc

SEQ ID NO: 41014 - DNA, 20 bp, Artificial Sequence
  chemically synthesized
gagttcaccagaggatctaa

SEQ ID NO: 41015 - DNA, 20 bp, Artificial Sequence
  chemically synthesized
ggaaaatagatttatgctgt

SEQ ID NO: 41016 - DNA, 20 bp, Artificial Sequence
  chemically synthesized
ttaatttaattcatggaaaa

SEQ ID NO: 41017 - DNA, 20 bp, Artificial Sequence
  chemically synthesized
tgagtttttaatttaattca

SEQ ID NO: 41018 - DNA, 20 bp, Artificial Sequence
  chemically synthesized
aaagtattatgtgtattcat

SEQ ID NO: 41019 - DNA, 20 bp, Artificial Sequence
  chemically synthesized
atgaatacacataatacttt

SEQ ID NO: 41020 - DNA, 20 bp, Artificial Sequence
  chemically synthesized
aaatatttggttcaatctaa

SEQ ID NO: 41021 - DNA, 20 bp, Artificial Sequence
  chemically synthesized
tctgtattcatgaaaatatt

SEQ ID NO: 41022 - DNA, 20 bp, Artificial Sequence
  chemically synthesized
accaaatattttcatgaata

SEQ ID NO: 41023 - DNA, 20 bp, Artificial Sequence
  chemically synthesized
gtttcctacgtggatgaaga

SEQ ID NO: 41024 - DNA, 20 bp, Artificial Sequence
  chemically synthesized
gggtttcctacgtggatgaa

SEQ ID NO: 41025 - DNA, 20 bp, Artificial Sequence
  chemically synthesized
tagggtttcctacgtggatg

SEQ ID NO: 41026 - DNA, 20 bp, Artificial Sequence
  chemically synthesized
acagactctcttcatccacg

SEQ ID NO: 41027 - DNA, 20 bp, Artificial Sequence
  chemically synthesized
cagactctcttcatccacgt

SEQ ID NO: 41028 - DNA, 20 bp, Artificial Sequence
  chemically synthesized
caccaatagggtttcctacg

SEQ ID NO: 41029 - DNA, 20 bp, Artificial Sequence
  chemically synthesized
atccacgtaggaaaccctat

SEQ ID NO: 41030 - DNA, 20 bp, Artificial Sequence
  chemically synthesized
acgtaggaaaccctattggt

SEQ ID NO: 41031 - DNA, 20 bp, Artificial Sequence
  chemically synthesized
caacctgctgctcaccaata

SEQ ID NO: 41032 - DNA, 20 bp, Artificial Sequence
  chemically synthesized
ccaacctgctgctcaccaat

SEQ ID NO: 41033 - DNA, 20 bp, Artificial Sequence
  chemically synthesized
gccaacctgctgctcaccaa

SEQ ID NO: 41034 - DNA, 20 bp, Artificial Sequence
  chemically synthesized
taggaaaccctattggtgag

SEQ ID NO: 41035 - DNA, 20 bp, Artificial Sequence
  chemically synthesized
gaaaccctattggtgagcag

SEQ ID NO: 41036 - DNA, 20 bp, Artificial Sequence
  chemically synthesized
aaaccctattggtgagcagc

SEQ ID NO: 41037 - DNA, 20 bp, Artificial Sequence
  chemically synthesized
cctattggtgagcagcaggt

SEQ ID NO: 41038 - DNA, 20 bp, Artificial Sequence
  chemically synthesized
gtgagcagcaggttggcaat

SEQ ID NO: 41039 - DNA, 20 bp, Artificial Sequence
  chemically synthesized
ggcaatgagtaaatgctgct

SEQ ID NO: 41040 - DNA, 20 bp, Artificial Sequence
  chemically synthesized
aatgagtaaatgctgctcag

SEQ ID NO: 41041 - DNA, 20 bp, Artificial Sequence
  chemically synthesized
atgagtaaatgctgctcagc

SEQ ID NO: 41042 - DNA, 20 bp, Artificial Sequence
  chemically synthesized
tacacgtctgacctgctgag

SEQ ID NO: 41043 - DNA, 20 bp, Artificial Sequence
  chemically synthesized
gtaaatgctgctcagcaggt

SEQ ID NO: 41044 - DNA, 20 bp, Artificial Sequence
  chemically synthesized
ctgtacacgtctgacctgct

SEQ ID NO: 41045 - DNA, 20 bp, Artificial Sequence
  chemically synthesized
ctcagcaggtcagacgtgta

SEQ ID NO: 41046 - DNA, 20 bp, Artificial Sequence
  chemically synthesized
gcaggtcagacgtgtacagc

SEQ ID NO: 41047 - DNA, 20 bp, Artificial Sequence
  chemically synthesized
aggtcagacgtgtacagctg

SEQ ID NO: 41048 - DNA, 20 bp, Artificial Sequence
  chemically synthesized
cagacgtgtacagctggaga

SEQ ID NO: 41049 - DNA, 20 bp, Artificial Sequence
  chemically synthesized
taaatttcatgatctttctc

SEQ ID NO: 41050 - DNA, 20 bp, Artificial Sequence
  chemically synthesized
tggagaaagatcatgaaatt

SEQ ID NO: 41051 - DNA, 20 bp, Artificial Sequence
  chemically synthesized
gaaagatcatgaaatttagc

SEQ ID NO: 41052 - DNA, 20 bp, Artificial Sequence
  chemically synthesized
atgaaatttagctagtatac

SEQ ID NO: 41053 - DNA, 20 bp, Artificial Sequence
  chemically synthesized
tgaaatttagctagtatact

SEQ ID NO: 41054 - DNA, 20 bp, Artificial Sequence
  chemically synthesized
ttgtgttttgcctagtatac

SEQ ID NO: 41055 - DNA, 20 bp, Artificial Sequence
  chemically synthesized
ttccagatttgtgttttgcc

SEQ ID NO: 41056 - DNA, 20 bp, Artificial Sequence
  chemically synthesized
tactaggcaaaacacaaatc

SEQ ID NO: 41057 - DNA, 20 bp, Artificial Sequence
  chemically synthesized
aggcaaaacacaaatctgga

SEQ ID NO: 41058 - DNA, 20 bp, Artificial Sequence
  chemically synthesized
ggcaaaacacaaatctggaa

SEQ ID NO: 41059 - DNA, 20 bp, Artificial Sequence
  chemically synthesized
caaaacacaaatctggaaag

SEQ ID NO: 41060 - DNA, 20 bp, Artificial Sequence
  chemically synthesized
aatgtggatcatctcctttc

SEQ ID NO: 41061 - DNA, 20 bp, Artificial Sequence
  chemically synthesized
tttttttaaaaattgcaatg

SEQ ID NO: 41062 - DNA, 20 bp, Artificial Sequence
  chemically synthesized
tttttaaaaaaaattctatg

SEQ ID NO: 41063 - DNA, 20 bp, Artificial Sequence
  chemically synthesized
actagacctctaagtctaca

SEQ ID NO: 41064 - DNA, 20 bp, Artificial Sequence
  chemically synthesized
aaaaaaattctatgtagact

SEQ ID NO: 41065 - DNA, 20 bp, Artificial Sequence
  chemically synthesized
aaaaattctatgtagactta

SEQ ID NO: 41066 - DNA, 20 bp, Artificial Sequence
  chemically synthesized
aaaattctatgtagacttag

SEQ ID NO: 41067 - DNA, 20 bp, Artificial Sequence
  chemically synthesized
tctatgtagacttagaggtc

SEQ ID NO: 41068 - DNA, 20 bp, Artificial Sequence
  chemically synthesized
gtgtactgtactagacctct

SEQ ID NO: 41069 - DNA, 20 bp, Artificial Sequence
  chemically synthesized
gtagacttagaggtctagta

SEQ ID NO: 41070 - DNA, 20 bp, Artificial Sequence
  chemically synthesized
tgtgtgtatgtgtactgtac

SEQ ID NO: 41071 - DNA, 20 bp, Artificial Sequence
  chemically synthesized
agtacagtacacatacacac

SEQ ID NO: 41072 - DNA, 20 bp, Artificial Sequence
  chemically synthesized
gtacagtacacatacacaca

SEQ ID NO: 41073 - DNA, 20 bp, Artificial Sequence
  chemically synthesized
aaggaacataaatatcttct

SEQ ID NO: 41074 - DNA, 20 bp, Artificial Sequence
  chemically synthesized
ggaacataaatatcttctga

SEQ ID NO: 41075 - DNA, 20 bp, Artificial Sequence
  chemically synthesized
aacataaatatcttctgaga

SEQ ID NO: 41076 - DNA, 20 bp, Artificial Sequence
  chemically synthesized
gcctacagaaactctctcag

SEQ ID NO: 41077 - DNA, 20 bp, Artificial Sequence
  chemically synthesized
aaagcctacagaaactctct

SEQ ID NO: 41078 - DNA, 20 bp, Artificial Sequence
  chemically synthesized
atcttctgagagagtttctg

SEQ ID NO: 41079 - DNA, 20 bp, Artificial Sequence
  chemically synthesized
tcttctgagagagtttctgt

SEQ ID NO: 41080 - DNA, 20 bp, Artificial Sequence
  chemically synthesized
aacttcaaaggtaaagccta

SEQ ID NO: 41081 - DNA, 20 bp, Artificial Sequence
  chemically synthesized
agaaaaaaacttcaaaggta

SEQ ID NO: 41082 - DNA, 20 bp, Artificial Sequence
  chemically synthesized
ttctgtaggctttacctttg

SEQ ID NO: 41083 - DNA, 20 bp, Artificial Sequence
  chemically synthesized
gaaaaagaaaaaaacttcaa

SEQ ID NO: 41084 - DNA, 20 bp, Artificial Sequence
  chemically synthesized
agaaaaagaaaaaaacttca

SEQ ID NO: 41085 - DNA, 20 bp, Artificial Sequence
  chemically synthesized
ttgtttcccaaaaaaagaaa

SEQ ID NO: 41086 - DNA, 20 bp, Artificial Sequence
  chemically synthesized
tttttttctttttctttttt

SEQ ID NO: 41087 - DNA, 20 bp, Artificial Sequence
  chemically synthesized
ttttttctttttcttttttt

SEQ ID NO: 41088 - DNA, 20 bp, Artificial Sequence
  chemically synthesized
tgtgttttgtttcccaaaaa

SEQ ID NO: 41089 - DNA, 20 bp, Artificial Sequence
  chemically synthesized
ttagcattcagggcaacagg

SEQ ID NO: 41090 - DNA, 20 bp, Artificial Sequence
  chemically synthesized
attagcattcagggcaacag

SEQ ID NO: 41091 - DNA, 20 bp, Artificial Sequence
  chemically synthesized
tcattagcattcagggcaac

SEQ ID NO: 41092 - DNA, 20 bp, Artificial Sequence
  chemically synthesized
atcattagcattcagggcaa

SEQ ID NO: 41093 - DNA, 20 bp, Artificial Sequence
  chemically synthesized
tcttccatcattagcattca

SEQ ID NO: 41094 - DNA, 20 bp, Artificial Sequence
  chemically synthesized
gtcttccatcattagcattc

SEQ ID NO: 41095 - DNA, 20 bp, Artificial Sequence
  chemically synthesized
agtcttccatcattagcatt

SEQ ID NO: 41096 - DNA, 20 bp, Artificial Sequence
  chemically synthesized
gttgccctgaatgctaatga

SEQ ID NO: 41097 - DNA, 20 bp, Artificial Sequence
  chemically synthesized
gccctgaatgctaatgatgg

SEQ ID NO: 41098 - DNA, 20 bp, Artificial Sequence
  chemically synthesized
tagcaacagtcttccatcat

SEQ ID NO: 41099 - DNA, 20 bp, Artificial Sequence
  chemically synthesized
atgatggaagactgttgcta

SEQ ID NO: 41100 - DNA, 20 bp, Artificial Sequence
  chemically synthesized
aattagcatcaccatagcaa

SEQ ID NO: 41101 - DNA, 20 bp, Artificial Sequence
  chemically synthesized
tgttgaaattagcatcacca

SEQ ID NO: 41102 - DNA, 20 bp, Artificial Sequence
  chemically synthesized
acaggcaacggtgttgaaat

SEQ ID NO: 41103 - DNA, 20 bp, Artificial Sequence
  chemically synthesized
aatttcaacaccgttgcctg

SEQ ID NO: 41104 - DNA, 20 bp, Artificial Sequence
  chemically synthesized
catgtgaagtccacaggcaa

SEQ ID NO: 41105 - DNA, 20 bp, Artificial Sequence
  chemically synthesized
cgagttcatgtgaagtccac

SEQ ID NO: 41106 - DNA, 20 bp, Artificial Sequence
  chemically synthesized
gcgagttcatgtgaagtcca

SEQ ID NO: 41107 - DNA, 20 bp, Artificial Sequence
  chemically synthesized
taaaacagcgagttcatgtg

SEQ ID NO: 41108 - DNA, 20 bp, Artificial Sequence
  chemically synthesized
tttgcagaagttaaaacagc

SEQ ID NO: 41109 - DNA, 20 bp, Artificial Sequence
  chemically synthesized
gacatttgcagaagttaaaa

SEQ ID NO: 41110 - DNA, 20 bp, Artificial Sequence
  chemically synthesized
tttgtaaatgacatttgcag

SEQ ID NO: 41111 - DNA, 20 bp, Artificial Sequence
  chemically synthesized
cattttgtaaatgacatttg

SEQ ID NO: 41112 - DNA, 20 bp, Artificial Sequence
  chemically synthesized
tgccctcgctaatcattaat

SEQ ID NO: 41113 - DNA, 20 bp, Artificial Sequence
  chemically synthesized
gtgccctcgctaatcattaa

SEQ ID NO: 41114 - DNA, 20 bp, Artificial Sequence
  chemically synthesized
aatgaaaacccattaatgat

SEQ ID NO: 41115 - DNA, 20 bp, Artificial Sequence
  chemically synthesized
aaaacccattaatgattagc

SEQ ID NO: 41116 - DNA, 20 bp, Artificial Sequence
  chemically synthesized
aaacccattaatgattagcg

SEQ ID NO: 41117 - DNA, 20 bp, Artificial Sequence
  chemically synthesized
aacccattaatgattagcga

SEQ ID NO: 41118 - DNA, 20 bp, Artificial Sequence
  chemically synthesized
gcacaatgttccactttaat

SEQ ID NO: 41119 - DNA, 20 bp, Artificial Sequence
  chemically synthesized
ccttattattctaattaaag

SEQ ID NO: 41120 - DNA, 20 bp, Artificial Sequence
  chemically synthesized
attccttattattctaatta

SEQ ID NO: 41121 - DNA, 20 bp, Artificial Sequence
  chemically synthesized
tccactttaattagaataat

SEQ ID NO: 41122 - DNA, 20 bp, Artificial Sequence
  chemically synthesized
ccactttaattagaataata

SEQ ID NO: 41123 - DNA, 20 bp, Artificial Sequence
  chemically synthesized
caaacctgtattttgtgcat

SEQ ID NO: 41124 - DNA, 20 bp, Artificial Sequence
  chemically synthesized
gaatgctgatgcacaaaata

SEQ ID NO: 41125 - DNA, 20 bp, Artificial Sequence
  chemically synthesized
aatgctgatgcacaaaatac

SEQ ID NO: 41126 - DNA, 20 bp, Artificial Sequence
  chemically synthesized
caggtttgtgaatcactact

SEQ ID NO: 41127 - DNA, 20 bp, Artificial Sequence
  chemically synthesized
ttttgacagtgtaggctcag

SEQ ID NO: 41128 - DNA, 20 bp, Artificial Sequence
  chemically synthesized
taattttgacagtgtaggct

SEQ ID NO: 41129 - DNA, 20 bp, Artificial Sequence
  chemically synthesized
gtaattaattttgacagtgt

SEQ ID NO: 41130 - DNA, 20 bp, Artificial Sequence
  chemically synthesized
agtaattaattttgacagtg

SEQ ID NO: 41131 - DNA, 20 bp, Artificial Sequence
  chemically synthesized
tccgtagtaattaattttga

SEQ ID NO: 41132 - DNA, 20 bp, Artificial Sequence
  chemically synthesized
actgtcaaaattaattacta

SEQ ID NO: 41133 - DNA, 20 bp, Artificial Sequence
  chemically synthesized
caaaattaattactacggat

SEQ ID NO: 41134 - DNA, 20 bp, Artificial Sequence
  chemically synthesized
aaaattaattactacggatg

SEQ ID NO: 41135 - DNA, 20 bp, Artificial Sequence
  chemically synthesized
aagtaccaaatcctcatccg

SEQ ID NO: 41136 - DNA, 20 bp, Artificial Sequence
  chemically synthesized
aattactacggatgaggatt

SEQ ID NO: 41137 - DNA, 20 bp, Artificial Sequence
  chemically synthesized
agctttctttaaaaaaagaa

SEQ ID NO: 41138 - DNA, 20 bp, Artificial Sequence
  chemically synthesized
ttggtacttttcttttttta

SEQ ID NO: 41139 - DNA, 20 bp, Artificial Sequence
  chemically synthesized
tctaaagctttctttaaaaa

SEQ ID NO: 41140 - DNA, 20 bp, Artificial Sequence
  chemically synthesized
tacttttctttttttaaaga

SEQ ID NO: 41141 - DNA, 20 bp, Artificial Sequence
  chemically synthesized
tctttttttaaagaaagctt

SEQ ID NO: 41142 - DNA, 20 bp, Artificial Sequence
  chemically synthesized
tttttttaaagaaagcttta

SEQ ID NO: 41143 - DNA, 20 bp, Artificial Sequence
  chemically synthesized
ttttaaagaaagctttagag

SEQ ID NO: 41144 - DNA, 20 bp, Artificial Sequence
  chemically synthesized
aatacaactgttctactcta

SEQ ID NO: 41145 - DNA, 20 bp, Artificial Sequence
  chemically synthesized
aagaaagctttagagtagaa

SEQ ID NO: 41146 - DNA, 20 bp, Artificial Sequence
  chemically synthesized
acagttgtattttgacttaa

SEQ ID NO: 41147 - DNA, 20 bp, Artificial Sequence
  chemically synthesized
cagttgtattttgacttaaa

SEQ ID NO: 41148 - DNA, 20 bp, Artificial Sequence
  chemically synthesized
gagagttttcaattcctttt

SEQ ID NO: 41149 - DNA, 20 bp, Artificial Sequence
  chemically synthesized
accttcaaatttaaaagaga

SEQ ID NO: 41150 - DNA, 20 bp, Artificial Sequence
  chemically synthesized
ttaccttcaaatttaaaaga

SEQ ID NO: 41151 - DNA, 20 bp, Artificial Sequence
  chemically synthesized
ttttaccttcaaatttaaaa

SEQ ID NO: 41152 - DNA, 20 bp, Artificial Sequence
  chemically synthesized
ttttttaccttcaaatttaa

SEQ ID NO: 41153 - DNA, 20 bp, Artificial Sequence
  chemically synthesized
aactctctcttttaaatttg

SEQ ID NO: 41154 - DNA, 20 bp, Artificial Sequence
  chemically synthesized
actctctcttttaaatttga

SEQ ID NO: 41155 - DNA, 20 bp, Artificial Sequence
  chemically synthesized
taaatttgaaggtaaaaaaa

SEQ ID NO: 41156 - DNA, 20 bp, Artificial Sequence
  chemically synthesized
aaaaaagcacatctccctaa

SEQ ID NO: 41157 - DNA, 20 bp, Artificial Sequence
  chemically synthesized
tttttatgtgtactgttagg

SEQ ID NO: 41158 - DNA, 20 bp, Artificial Sequence
  chemically synthesized
agtttttatgtgtactgtta

SEQ ID NO: 41159 - DNA, 20 bp, Artificial Sequence
  chemically synthesized
tagtttttatgtgtactgtt

SEQ ID NO: 41160 - DNA, 20 bp, Artificial Sequence
  chemically synthesized
ttagtttttatgtgtactgt

SEQ ID NO: 41161 - DNA, 20 bp, Artificial Sequence
  chemically synthesized
acacataaaaactaactgca

SEQ ID NO: 41162 - DNA, 20 bp, Artificial Sequence
  chemically synthesized
tttgttttgctctttgcagt

SEQ ID NO: 41163 - DNA, 20 bp, Artificial Sequence
  chemically synthesized
acataaaaactaactgcaaa

SEQ ID NO: 41164 - DNA, 20 bp, Artificial Sequence
  chemically synthesized
aacttttgttttgctctttg

SEQ ID NO: 41165 - DNA, 20 bp, Artificial Sequence
  chemically synthesized
aactgcaaagagcaaaacaa

SEQ ID NO: 41166 - DNA, 20 bp, Artificial Sequence
  chemically synthesized
gcaaagagcaaaacaaaagt

SEQ ID NO: 41167 - DNA, 20 bp, Artificial Sequence
  chemically synthesized
gcaaaacaaaagttggaacc

SEQ ID NO: 41168 - DNA, 20 bp, Artificial Sequence
  chemically synthesized
caaaacaaaagttggaacct

SEQ ID NO: 41169 - DNA, 20 bp, Artificial Sequence
  chemically synthesized
aaaacaaaagttggaaccta

SEQ ID NO: 41170 - DNA, 20 bp, Artificial Sequence
  chemically synthesized
caaaagttggaacctagggt

SEQ ID NO: 41171 - DNA, 20 bp, Artificial Sequence
  chemically synthesized
actcagaaatatctgaccct

SEQ ID NO: 41172 - DNA, 20 bp, Artificial Sequence
  chemically synthesized
tactcagaaatatctgaccc

SEQ ID NO: 41173 - DNA, 20 bp, Artificial Sequence
  chemically synthesized
acctagggtcagatatttct

SEQ ID NO: 41174 - DNA, 20 bp, Artificial Sequence
  chemically synthesized
agggtcagatatttctgagt

SEQ ID NO: 41175 - DNA, 20 bp, Artificial Sequence
  chemically synthesized
acttttcttcagttcttact

SEQ ID NO: 41176 - DNA, 20 bp, Artificial Sequence
  chemically synthesized
atatttctgagtaagaactg

SEQ ID NO: 41177 - DNA, 20 bp, Artificial Sequence
  chemically synthesized
tctgagtaagaactgaagaa

SEQ ID NO: 41178 - DNA, 20 bp, Artificial Sequence
  chemically synthesized
acaattagttgacttttctt

SEQ ID NO: 41179 - DNA, 20 bp, Artificial Sequence
  chemically synthesized
ctattttctaaacgaacaat

SEQ ID NO: 41180 - DNA, 20 bp, Artificial Sequence
  chemically synthesized
aagtcaactaattgttcgtt

SEQ ID NO: 41181 - DNA, 20 bp, Artificial Sequence
  chemically synthesized
ctaattgttcgtttagaaaa

SEQ ID NO: 41182 - DNA, 20 bp, Artificial Sequence
  chemically synthesized
taattgttcgtttagaaaat

SEQ ID NO: 41183 - DNA, 20 bp, Artificial Sequence
  chemically synthesized
aattgttcgtttagaaaata

SEQ ID NO: 41184 - DNA, 20 bp, Artificial Sequence
  chemically synthesized
tgttcgtttagaaaataggg

SEQ ID NO: 41185 - DNA, 20 bp, Artificial Sequence
  chemically synthesized
gttcgtttagaaaatagggt

SEQ ID NO: 41186 - DNA, 20 bp, Artificial Sequence
  chemically synthesized
gtttagaaaatagggtaggc

SEQ ID NO: 41187 - DNA, 20 bp, Artificial Sequence
  chemically synthesized
tttagaaaatagggtaggct

SEQ ID NO: 41188 - DNA, 20 bp, Artificial Sequence
  chemically synthesized
atagggtaggctgggtgtga

SEQ ID NO: 41189 - DNA, 20 bp, Artificial Sequence
  chemically synthesized
caggcgtgagccatcacacc

SEQ ID NO: 41190 - DNA, 20 bp, Artificial Sequence
  chemically synthesized
agtgctgggattacaggcgt

SEQ ID NO: 41191 - DNA, 20 bp, Artificial Sequence
  chemically synthesized
atggctcacgcctgtaatcc

SEQ ID NO: 41192 - DNA, 20 bp, Artificial Sequence
  chemically synthesized
tcccaaagtgctgggattac

SEQ ID NO: 41193 - DNA, 20 bp, Artificial Sequence
  chemically synthesized
gtcccaaagtgctgggatta

SEQ ID NO: 41194 - DNA, 20 bp, Artificial Sequence
  chemically synthesized
cgcctgtaatcccagcactt

SEQ ID NO: 41195 - DNA, 20 bp, Artificial Sequence
  chemically synthesized
cctcagcgtcccaaagtgct

SEQ ID NO: 41196 - DNA, 20 bp, Artificial Sequence
  chemically synthesized
gcctgtaatcccagcacttt

SEQ ID NO: 41197 - DNA, 20 bp, Artificial Sequence
  chemically synthesized
acctcagcgtcccaaagtgc

SEQ ID NO: 41198 - DNA, 20 bp, Artificial Sequence
  chemically synthesized
ccacccacctcagcgtccca

SEQ ID NO: 41199 - DNA, 20 bp, Artificial Sequence
  chemically synthesized
tcccagcactttgggacgct

SEQ ID NO: 41200 - DNA, 20 bp, Artificial Sequence
  chemically synthesized
cccagcactttgggacgctg

SEQ ID NO: 41201 - DNA, 20 bp, Artificial Sequence
  chemically synthesized
agcactttgggacgctgagg

SEQ ID NO: 41202 - DNA, 20 bp, Artificial Sequence
  chemically synthesized
gcactttgggacgctgaggt

SEQ ID NO: 41203 - DNA, 20 bp, Artificial Sequence
  chemically synthesized
ctttgggacgctgaggtggg

SEQ ID NO: 41204 - DNA, 20 bp, Artificial Sequence
  chemically synthesized
acctcatgatccacccacct

SEQ ID NO: 41205 - DNA, 20 bp, Artificial Sequence
  chemically synthesized
cgctgaggtgggtggatcat

SEQ ID NO: 41206 - DNA, 20 bp, Artificial Sequence
  chemically synthesized
gctgaggtgggtggatcatg

SEQ ID NO: 41207 - DNA, 20 bp, Artificial Sequence
  chemically synthesized
ggtgggtggatcatgaggtc

SEQ ID NO: 41208 - DNA, 20 bp, Artificial Sequence
  chemically synthesized
tgggtggatcatgaggtcaa

SEQ ID NO: 41209 - DNA, 20 bp, Artificial Sequence
  chemically synthesized
gatcatgaggtcaagagatc

SEQ ID NO: 41210 - DNA, 20 bp, Artificial Sequence
  chemically synthesized
tcaagagatcaagaccatcc

SEQ ID NO: 41211 - DNA, 20 bp, Artificial Sequence
  chemically synthesized
tttcaccaatttggccagga

SEQ ID NO: 41212 - DNA, 20 bp, Artificial Sequence
  chemically synthesized
agggtttcaccaatttggcc

SEQ ID NO: 41213 - DNA, 20 bp, Artificial Sequence
  chemically synthesized
caagaccatcctggccaaat

SEQ ID NO: 41214 - DNA, 20 bp, Artificial Sequence
  chemically synthesized
cagggtttcaccaatttggc

SEQ ID NO: 41215 - DNA, 20 bp, Artificial Sequence
  chemically synthesized
gagacagggtttcaccaatt

SEQ ID NO: 41216 - DNA, 20 bp, Artificial Sequence
  chemically synthesized
ttgtatttttagtagagaca

SEQ ID NO: 41217 - DNA, 20 bp, Artificial Sequence
  chemically synthesized
tttgtatttttagtagagac

SEQ ID NO: 41218 - DNA, 20 bp, Artificial Sequence
  chemically synthesized
ttttgtatttttagtagaga

SEQ ID NO: 41219 - DNA, 20 bp, Artificial Sequence
  chemically synthesized
taatttttgtatttttagta

SEQ ID NO: 41220 - DNA, 20 bp, Artificial Sequence
  chemically synthesized
gctaatttttgtatttttag

SEQ ID NO: 41221 - DNA, 20 bp, Artificial Sequence
  chemically synthesized
ccagctaatttttgtatttt

SEQ ID NO: 41222 - DNA, 20 bp, Artificial Sequence
  chemically synthesized
tctactaaaaatacaaaaat

SEQ ID NO: 41223 - DNA, 20 bp, Artificial Sequence
  chemically synthesized
ctaaaaatacaaaaattagc

SEQ ID NO: 41224 - DNA, 20 bp, Artificial Sequence
  chemically synthesized
taaaaatacaaaaattagct

SEQ ID NO: 41225 - DNA, 20 bp, Artificial Sequence
  chemically synthesized
atacaaaaattagctgggta

SEQ ID NO: 41226 - DNA, 20 bp, Artificial Sequence
  chemically synthesized
caaaaattagctgggtatgg

SEQ ID NO: 41227 - DNA, 20 bp, Artificial Sequence
  chemically synthesized
cagttgcatgccaccatacc

SEQ ID NO: 41228 - DNA, 20 bp, Artificial Sequence
  chemically synthesized
ggtatggtggcatgcaactg

SEQ ID NO: 41229 - DNA, 20 bp, Artificial Sequence
  chemically synthesized
gtggcatgcaactgtagtcc

SEQ ID NO: 41230 - DNA, 20 bp, Artificial Sequence
  chemically synthesized
ctcccaagtagctgggacta

SEQ ID NO: 41231 - DNA, 20 bp, Artificial Sequence
  chemically synthesized
caactgtagtcccagctact

SEQ ID NO: 41232 - DNA, 20 bp, Artificial Sequence
  chemically synthesized
cctcagcctcccaagtagct

SEQ ID NO: 41233 - DNA, 20 bp, Artificial Sequence
  chemically synthesized
aactgtagtcccagctactt

SEQ ID NO: 41234 - DNA, 20 bp, Artificial Sequence
  chemically synthesized
gcctcagcctcccaagtagc

SEQ ID NO: 41235 - DNA, 20 bp, Artificial Sequence
  chemically synthesized
ctgtagtcccagctacttgg

SEQ ID NO: 41236 - DNA, 20 bp, Artificial Sequence
  chemically synthesized
tgtagtcccagctacttggg

SEQ ID NO: 41237 - DNA, 20 bp, Artificial Sequence
  chemically synthesized
tcctgcctcagcctcccaag

SEQ ID NO: 41238 - DNA, 20 bp, Artificial Sequence
  chemically synthesized
ttctcctgcctcagcctccc

SEQ ID NO: 41239 - DNA, 20 bp, Artificial Sequence
  chemically synthesized
tcccagctacttgggaggct

SEQ ID NO: 41240 - DNA, 20 bp, Artificial Sequence
  chemically synthesized
cccagctacttgggaggctg

SEQ ID NO: 41241 - DNA, 20 bp, Artificial Sequence
  chemically synthesized
agctacttgggaggctgagg

SEQ ID NO: 41242 - DNA, 20 bp, Artificial Sequence
  chemically synthesized
gctacttgggaggctgaggc

SEQ ID NO: 41243 - DNA, 20 bp, Artificial Sequence
  chemically synthesized
tacttgggaggctgaggcag

SEQ ID NO: 41244 - DNA, 20 bp, Artificial Sequence
  chemically synthesized
ttcaagcgattctcctgcct

SEQ ID NO: 41245 - DNA, 20 bp, Artificial Sequence
  chemically synthesized
gcaggagaatcgcttgaacc

SEQ ID NO: 41246 - DNA, 20 bp, Artificial Sequence
  chemically synthesized
caggagaatcgcttgaacct

SEQ ID NO: 41247 - DNA, 20 bp, Artificial Sequence
  chemically synthesized
aacctccacctcccaggttc

SEQ ID NO: 41248 - DNA, 20 bp, Artificial Sequence
  chemically synthesized
ggagaatcgcttgaacctgg

SEQ ID NO: 41249 - DNA, 20 bp, Artificial Sequence
  chemically synthesized
gagaatcgcttgaacctggg

SEQ ID NO: 41250 - DNA, 20 bp, Artificial Sequence
  chemically synthesized
aatcgcttgaacctgggagg

SEQ ID NO: 41251 - DNA, 20 bp, Artificial Sequence
  chemically synthesized
cactgcaacctccacctccc

SEQ ID NO: 41252 - DNA, 20 bp, Artificial Sequence
  chemically synthesized
tcgcttgaacctgggaggtg

SEQ ID NO: 41253 - DNA, 20 bp, Artificial Sequence
  chemically synthesized
tcactgcaacctccacctcc

SEQ ID NO: 41254 - DNA, 20 bp, Artificial Sequence
  chemically synthesized
cgcttgaacctgggaggtgg

SEQ ID NO: 41255 - DNA, 20 bp, Artificial Sequence
  chemically synthesized
aacctgggaggtggaggttg

SEQ ID NO: 41256 - DNA, 20 bp, Artificial Sequence
  chemically synthesized
tgggaggtggaggttgcagt

SEQ ID NO: 41257 - DNA, 20 bp, Artificial Sequence
  chemically synthesized
ggtggaggttgcagtgagcc

SEQ ID NO: 41258 - DNA, 20 bp, Artificial Sequence
  chemically synthesized
ggagtgcagtggtgcgatct

SEQ ID NO: 41259 - DNA, 20 bp, Artificial Sequence
  chemically synthesized
gtcaccaggctggagtgcag

SEQ ID NO: 41260 - DNA, 20 bp, Artificial Sequence
  chemically synthesized
gagatcgcaccactgcactc

SEQ ID NO: 41261 - DNA, 20 bp, Artificial Sequence
  chemically synthesized
tctgtcaccaggctggagtg

SEQ ID NO: 41262 - DNA, 20 bp, Artificial Sequence
  chemically synthesized
cgcaccactgcactccagcc

SEQ ID NO: 41263 - DNA, 20 bp, Artificial Sequence
  chemically synthesized
cttcctctgtcaccaggctg

SEQ ID NO: 41264 - DNA, 20 bp, Artificial Sequence
  chemically synthesized
gtcttcctctgtcaccaggc

SEQ ID NO: 41265 - DNA, 20 bp, Artificial Sequence
  chemically synthesized
actgcactccagcctggtga

SEQ ID NO: 41266 - DNA, 20 bp, Artificial Sequence
  chemically synthesized
tgcactccagcctggtgaca

SEQ ID NO: 41267 - DNA, 20 bp, Artificial Sequence
  chemically synthesized
cggagtcttcctctgtcacc

SEQ ID NO: 41268 - DNA, 20 bp, Artificial Sequence
  chemically synthesized
gcactccagcctggtgacag

SEQ ID NO: 41269 - DNA, 20 bp, Artificial Sequence
  chemically synthesized
acggagtcttcctctgtcac

SEQ ID NO: 41270 - DNA, 20 bp, Artificial Sequence
  chemically synthesized
ctccagcctggtgacagagg

SEQ ID NO: 41271 - DNA, 20 bp, Artificial Sequence
  chemically synthesized
ttttttttttttttaagacg

SEQ ID NO: 41272 - DNA, 20 bp, Artificial Sequence
  chemically synthesized
ttttttttttttttttaaga

SEQ ID NO: 41273 - DNA, 20 bp, Artificial Sequence
  chemically synthesized
tttttttttttttttttttt

SEQ ID NO: 41274 - DNA, 20 bp, Artificial Sequence
  chemically synthesized
aaaaaaaaaaaaaaaaaaaa

SEQ ID NO: 41275 - DNA, 20 bp, Artificial Sequence
  chemically synthesized
aaaaaaaaaaaaaaaaaaaa

SEQ ID NO: 41276 - DNA, 20 bp, Artificial Sequence
  chemically synthesized
aaaaaaaaaaaaaaaaagga

SEQ ID NO: 41277 - DNA, 20 bp, Artificial Sequence
  chemically synthesized
aaaaaaaaaaaaaaaaggat

SEQ ID NO: 41278 - DNA, 20 bp, Artificial Sequence
  chemically synthesized
aaaaaaaaaaaaaaaggatg

SEQ ID NO: 41279 - DNA, 20 bp, Artificial Sequence
  chemically synthesized
aaaaaaaaaaaaaaggatgg

SEQ ID NO: 41280 - DNA, 20 bp, Artificial Sequence
  chemically synthesized
aaaaaaaaaaaaaggatggg

SEQ ID NO: 41281 - DNA, 20 bp, Artificial Sequence
  chemically synthesized
aaaaaaaaaaaaggatgggg

SEQ ID NO: 41282 - DNA, 20 bp, Artificial Sequence
  chemically synthesized
aaaggatgggggggatgata

SEQ ID NO: 41283 - DNA, 20 bp, Artificial Sequence
  chemically synthesized
aaggatgggggggatgatac

SEQ ID NO: 41284 - DNA, 20 bp, Artificial Sequence
  chemically synthesized
atgggggggatgatacaggt

SEQ ID NO: 41285 - DNA, 20 bp, Artificial Sequence
  chemically synthesized
tattttttgaaatattcaaa

SEQ ID NO: 41286 - DNA, 20 bp, Artificial Sequence
  chemically synthesized
atttcaaaaaataactatct

SEQ ID NO: 41287 - DNA, 20 bp, Artificial Sequence
  chemically synthesized
tttcaaaaaataactatctg

SEQ ID NO: 41288 - DNA, 20 bp, Artificial Sequence
  chemically synthesized
tgcagcactttttcctcaga

SEQ ID NO: 41289 - DNA, 20 bp, Artificial Sequence
  chemically synthesized
aaaataactatctgaggaaa

SEQ ID NO: 41290 - DNA, 20 bp, Artificial Sequence
  chemically synthesized
catatgcagcactttttcct

SEQ ID NO: 41291 - DNA, 20 bp, Artificial Sequence
  chemically synthesized
tgaggaaaaagtgctgcata

SEQ ID NO: 41292 - DNA, 20 bp, Artificial Sequence
  chemically synthesized
atcaaggtatttaccatatg

SEQ ID NO: 41293 - DNA, 20 bp, Artificial Sequence
  chemically synthesized
tatggtaaataccttgatat

SEQ ID NO: 41294 - DNA, 20 bp, Artificial Sequence
  chemically synthesized
tccaaatatatctaatatca

SEQ ID NO: 41295 - DNA, 20 bp, Artificial Sequence
  chemically synthesized
atccaaatatatctaatatc

SEQ ID NO: 41296 - DNA, 20 bp, Artificial Sequence
  chemically synthesized
accttgatattagatatatt

SEQ ID NO: 41297 - DNA, 20 bp, Artificial Sequence
  chemically synthesized
ttggatttatgtgtccacac

SEQ ID NO: 41298 - DNA, 20 bp, Artificial Sequence
  chemically synthesized
tggatttatgtgtccacaca

SEQ ID NO: 41299 - DNA, 20 bp, Artificial Sequence
  chemically synthesized
atgttctctgtttccttgtg

SEQ ID NO: 41300 - DNA, 20 bp, Artificial Sequence
  chemically synthesized
tatgtgtccacacaaggaaa

SEQ ID NO: 41301 - DNA, 20 bp, Artificial Sequence
  chemically synthesized
tgtgtccacacaaggaaaca

SEQ ID NO: 41302 - DNA, 20 bp, Artificial Sequence
  chemically synthesized
acagagaacatttaaacaac

SEQ ID NO: 41303 - DNA, 20 bp, Artificial Sequence
  chemically synthesized
cagagaacatttaaacaact

SEQ ID NO: 41304 - DNA, 20 bp, Artificial Sequence
  chemically synthesized
tgtttcctcttgtatattcc

SEQ ID NO: 41305 - DNA, 20 bp, Artificial Sequence
  chemically synthesized
ttaaacaactgggaatatac

SEQ ID NO: 41306 - DNA, 20 bp, Artificial Sequence
  chemically synthesized
aaacaactgggaatatacaa

SEQ ID NO: 41307 - DNA, 20 bp, Artificial Sequence
  chemically synthesized
aacaactgggaatatacaag

SEQ ID NO: 41308 - DNA, 20 bp, Artificial Sequence
  chemically synthesized
tcttttaccattggagagaa

SEQ ID NO: 41309 - DNA, 20 bp, Artificial Sequence
  chemically synthesized
aataattctattctctccaa

SEQ ID NO: 41310 - DNA, 20 bp, Artificial Sequence
  chemically synthesized
ctcaatcttttaccattgga

SEQ ID NO: 41311 - DNA, 20 bp, Artificial Sequence
  chemically synthesized
aactcaatcttttaccattg

SEQ ID NO: 41312 - DNA, 20 bp, Artificial Sequence
  chemically synthesized
tctattctctccaatggtaa

SEQ ID NO: 41313 - DNA, 20 bp, Artificial Sequence
  chemically synthesized
gtaactcaatcttttaccat

SEQ ID NO: 41314 - DNA, 20 bp, Artificial Sequence
  chemically synthesized
ctctccaatggtaaaagatt

SEQ ID NO: 41315 - DNA, 20 bp, Artificial Sequence
  chemically synthesized
gattgagttaccttaaaata

SEQ ID NO: 41316 - DNA, 20 bp, Artificial Sequence
  chemically synthesized
aaaaaaaaatctttatttta

SEQ ID NO: 41317 - DNA, 20 bp, Artificial Sequence
  chemically synthesized
gaaaaaaaaatctttatttt

SEQ ID NO: 41318 - DNA, 20 bp, Artificial Sequence
  chemically synthesized
tgttgctttaaaatttgtgc

SEQ ID NO: 41319 - DNA, 20 bp, Artificial Sequence
  chemically synthesized
atgttgctttaaaatttgtg

SEQ ID NO: 41320 - DNA, 20 bp, Artificial Sequence
  chemically synthesized
tttcacctgcacaaatttta

SEQ ID NO: 41321 - DNA, 20 bp, Artificial Sequence
  chemically synthesized
aaattttaaagcaacatctg

SEQ ID NO: 41322 - DNA, 20 bp, Artificial Sequence
  chemically synthesized
ttaaagcaacatctgaagat

SEQ ID NO: 41323 - DNA, 20 bp, Artificial Sequence
  chemically synthesized
tactctttccaactcatctt

SEQ ID NO: 41324 - DNA, 20 bp, Artificial Sequence
  chemically synthesized
agcaacatctgaagatgagt

SEQ ID NO: 41325 - DNA, 20 bp, Artificial Sequence
  chemically synthesized
acatctgaagatgagttgga

SEQ ID NO: 41326 - DNA, 20 bp, Artificial Sequence
  chemically synthesized
atctgaagatgagttggaaa

SEQ ID NO: 41327 - DNA, 20 bp, Artificial Sequence
  chemically synthesized
tgtggaaacaaatttaaata

SEQ ID NO: 41328 - DNA, 20 bp, Artificial Sequence
  chemically synthesized
tatttaaatttgtttccaca

SEQ ID NO: 41329 - DNA, 20 bp, Artificial Sequence
  chemically synthesized
agtctttgcagcaaaccatg

SEQ ID NO: 41330 - DNA, 20 bp, Artificial Sequence
  chemically synthesized
tttccacatggtttgctgca

SEQ ID NO: 41331 - DNA, 20 bp, Artificial Sequence
  chemically synthesized
atcaaccgacgcagtctttg

SEQ ID NO: 41332 - DNA, 20 bp, Artificial Sequence
  chemically synthesized
gtttgctgcaaagactgcgt

SEQ ID NO: 41333 - DNA, 20 bp, Artificial Sequence
  chemically synthesized
gaaaataaaatcaaccgacg

SEQ ID NO: 41334 - DNA, 20 bp, Artificial Sequence
  chemically synthesized
tgacccagaatggaaatgta

SEQ ID NO: 41335 - DNA, 20 bp, Artificial Sequence
  chemically synthesized
ggtgacccagaatggaaatg

SEQ ID NO: 41336 - DNA, 20 bp, Artificial Sequence
  chemically synthesized
gatgctctacatttccattc

SEQ ID NO: 41337 - DNA, 20 bp, Artificial Sequence
  chemically synthesized
atgctctacatttccattct

SEQ ID NO: 41338 - DNA, 20 bp, Artificial Sequence
  chemically synthesized
gaatagggggtgacccagaa

SEQ ID NO: 41339 - DNA, 20 bp, Artificial Sequence
  chemically synthesized
tcactgaatagggggtgacc

SEQ ID NO: 41340 - DNA, 20 bp, Artificial Sequence
  chemically synthesized
attctgggtcaccccctatt

SEQ ID NO: 41341 - DNA, 20 bp, Artificial Sequence
  chemically synthesized
aaatgatttcactgaatagg

SEQ ID NO: 41342 - DNA, 20 bp, Artificial Sequence
  chemically synthesized
aaaatgatttcactgaatag

SEQ ID NO: 41343 - DNA, 20 bp, Artificial Sequence
  chemically synthesized
taaaatgatttcactgaata

SEQ ID NO: 41344 - DNA, 20 bp, Artificial Sequence
  chemically synthesized
ataaaatgatttcactgaat

SEQ ID NO: 41345 - DNA, 20 bp, Artificial Sequence
  chemically synthesized
cataaaatgatttcactgaa

SEQ ID NO: 41346 - DNA, 20 bp, Artificial Sequence
  chemically synthesized
gtgaaatcattttatgtcat

SEQ ID NO: 41347 - DNA, 20 bp, Artificial Sequence
  chemically synthesized
atcattttatgtcattggtg

SEQ ID NO: 41348 - DNA, 20 bp, Artificial Sequence
  chemically synthesized
atacaccatcggttttttgt

SEQ ID NO: 41349 - DNA, 20 bp, Artificial Sequence
  chemically synthesized
tgcagccaacaaaaaaccga

SEQ ID NO: 41350 - DNA, 20 bp, Artificial Sequence
  chemically synthesized
atatccagcaaatacaccat

SEQ ID NO: 41351 - DNA, 20 bp, Artificial Sequence
  chemically synthesized
aaaaccgatggtgtatttgc

SEQ ID NO: 41352 - DNA, 20 bp, Artificial Sequence
  chemically synthesized
gatggtgtatttgctggata

SEQ ID NO: 41353 - DNA, 20 bp, Artificial Sequence
  chemically synthesized
ggtgtatttgctggatatgg

SEQ ID NO: 41354 - DNA, 20 bp, Artificial Sequence
  chemically synthesized
cgtgttgcaccttccatatc

SEQ ID NO: 41355 - DNA, 20 bp, Artificial Sequence
  chemically synthesized
gtgtatttgctggatatgga

SEQ ID NO: 41356 - DNA, 20 bp, Artificial Sequence
  chemically synthesized
atgttacaaaaatcttccta

SEQ ID NO: 41357 - DNA, 20 bp, Artificial Sequence
  chemically synthesized
ttacaaaaatcttcctacag

SEQ ID NO: 41358 - DNA, 20 bp, Artificial Sequence
  chemically synthesized
aggtttggaacttctgtagg

SEQ ID NO: 41359 - DNA, 20 bp, Artificial Sequence
  chemically synthesized
aacaggtttggaacttctgt

SEQ ID NO: 41360 - DNA, 20 bp, Artificial Sequence
  chemically synthesized
caacaggtttggaacttctg

SEQ ID NO: 41361 - DNA, 20 bp, Artificial Sequence
  chemically synthesized
tacagaagttccaaacctgt

SEQ ID NO: 41362 - DNA, 20 bp, Artificial Sequence
  chemically synthesized
cttgccaaatccaacaggtt

SEQ ID NO: 41363 - DNA, 20 bp, Artificial Sequence
  chemically synthesized
catatcttgccaaatccaac

SEQ ID NO: 41364 - DNA, 20 bp, Artificial Sequence
  chemically synthesized
agttccaaacctgttggatt

SEQ ID NO: 41365 - DNA, 20 bp, Artificial Sequence
  chemically synthesized
tcatatcttgccaaatccaa

SEQ ID NO: 41366 - DNA, 20 bp, Artificial Sequence
  chemically synthesized
ccaaacctgttggatttggc

SEQ ID NO: 41367 - DNA, 20 bp, Artificial Sequence
  chemically synthesized
ggatttggcaagatatgatg

SEQ ID NO: 41368 - DNA, 20 bp, Artificial Sequence
  chemically synthesized
gatttggcaagatatgatga

SEQ ID NO: 41369 - DNA, 20 bp, Artificial Sequence
  chemically synthesized
atttggcaagatatgatgaa

SEQ ID NO: 41370 - DNA, 20 bp, Artificial Sequence
  chemically synthesized
ttggcaagatatgatgaagg

SEQ ID NO: 41371 - DNA, 20 bp, Artificial Sequence
  chemically synthesized
ctagaaactatataaagtat

SEQ ID NO: 41372 - DNA, 20 bp, Artificial Sequence
  chemically synthesized
gatgataccaatactttata

SEQ ID NO: 41373 - DNA, 20 bp, Artificial Sequence
  chemically synthesized
attactctagaaactatata

SEQ ID NO: 41374 - DNA, 20 bp, Artificial Sequence
  chemically synthesized
ccaatactttatatagtttc

SEQ ID NO: 41375 - DNA, 20 bp, Artificial Sequence
  chemically synthesized
aatactttatatagtttcta

SEQ ID NO: 41376 - DNA, 20 bp, Artificial Sequence
  chemically synthesized
aagtctttcaaggattactc

SEQ ID NO: 41377 - DNA, 20 bp, Artificial Sequence
  chemically synthesized
gtttctagagtaatccttga

SEQ ID NO: 41378 - DNA, 20 bp, Artificial Sequence
  chemically synthesized
cccagaatacaagtctttca

SEQ ID NO: 41379 - DNA, 20 bp, Artificial Sequence
  chemically synthesized
acccagaatacaagtctttc

SEQ ID NO: 41380 - DNA, 20 bp, Artificial Sequence
  chemically synthesized
tccttgaaagacttgtattc

SEQ ID NO: 41381 - DNA, 20 bp, Artificial Sequence
  chemically synthesized
ccttgaaagacttgtattct

SEQ ID NO: 41382 - DNA, 20 bp, Artificial Sequence
  chemically synthesized
tgactgaagacccagaatac

SEQ ID NO: 41383 - DNA, 20 bp, Artificial Sequence
  chemically synthesized
agacttgtattctgggtctt

SEQ ID NO: 41384 - DNA, 20 bp, Artificial Sequence
  chemically synthesized
atattacttgactgaagacc

SEQ ID NO: 41385 - DNA, 20 bp, Artificial Sequence
  chemically synthesized
tgtattctgggtcttcagtc

SEQ ID NO: 41386 - DNA, 20 bp, Artificial Sequence
  chemically synthesized
cctataatattacttgactg

SEQ ID NO: 41387 - DNA, 20 bp, Artificial Sequence
  chemically synthesized
tcttcagtcaagtaatatta

SEQ ID NO: 41388 - DNA, 20 bp, Artificial Sequence
  chemically synthesized
cttcagtcaagtaatattat

SEQ ID NO: 41389 - DNA, 20 bp, Artificial Sequence
  chemically synthesized
ttcagtcaagtaatattata

SEQ ID NO: 41390 - DNA, 20 bp, Artificial Sequence
  chemically synthesized
aagtaatattatagggtctg

SEQ ID NO: 41391 - DNA, 20 bp, Artificial Sequence
  chemically synthesized
caggtaatttgatagttcta

SEQ ID NO: 41392 - DNA, 20 bp, Artificial Sequence
  chemically synthesized
caataacacaggtaatttga

SEQ ID NO: 41393 - DNA, 20 bp, Artificial Sequence
  chemically synthesized
acctttcacctcaataacac

SEQ ID NO: 41394 - DNA, 20 bp, Artificial Sequence
  chemically synthesized
atcaaattacctgtgttatt

SEQ ID NO: 41395 - DNA, 20 bp, Artificial Sequence
  chemically synthesized
cacctttcacctcaataaca

SEQ ID NO: 41396 - DNA, 20 bp, Artificial Sequence
  chemically synthesized
tcaaattacctgtgttattg

SEQ ID NO: 41397 - DNA, 20 bp, Artificial Sequence
  chemically synthesized
tacctgtgttattgaggtga

SEQ ID NO: 41398 - DNA, 20 bp, Artificial Sequence
  chemically synthesized
acctgtgttattgaggtgaa

SEQ ID NO: 41399 - DNA, 20 bp, Artificial Sequence
  chemically synthesized
tgaggtgaaaggtgaatttg

SEQ ID NO: 41400 - DNA, 20 bp, Artificial Sequence
  chemically synthesized
ggtgaaaggtgaatttgtgg

SEQ ID NO: 41401 - DNA, 20 bp, Artificial Sequence
  chemically synthesized
taatatcaggtagacaaata

SEQ ID NO: 41402 - DNA, 20 bp, Artificial Sequence
  chemically synthesized
ttaatatcaggtagacaaat

SEQ ID NO: 41403 - DNA, 20 bp, Artificial Sequence
  chemically synthesized
acccttggcttaatatcagg

SEQ ID NO: 41404 - DNA, 20 bp, Artificial Sequence
  chemically synthesized
ttatttgtctacctgatatt

SEQ ID NO: 41405 - DNA, 20 bp, Artificial Sequence
  chemically synthesized
agtacccttggcttaatatc

SEQ ID NO: 41406 - DNA, 20 bp, Artificial Sequence
  chemically synthesized
cagtacccttggcttaatat

SEQ ID NO: 41407 - DNA, 20 bp, Artificial Sequence
  chemically synthesized
tgtctacctgatattaagcc

SEQ ID NO: 41408 - DNA, 20 bp, Artificial Sequence
  chemically synthesized
gtctacctgatattaagcca

SEQ ID NO: 41409 - DNA, 20 bp, Artificial Sequence
  chemically synthesized
tctacctgatattaagccaa

SEQ ID NO: 41410 - DNA, 20 bp, Artificial Sequence
  chemically synthesized
cttcccaagtgcagtaccct

SEQ ID NO: 41411 - DNA, 20 bp, Artificial Sequence
  chemically synthesized
taagccaagggtactgcact

SEQ ID NO: 41412 - DNA, 20 bp, Artificial Sequence
  chemically synthesized
aagccaagggtactgcactt

SEQ ID NO: 41413 - DNA, 20 bp, Artificial Sequence
  chemically synthesized
gtcagctgtcttcccaagtg

SEQ ID NO: 41414 - DNA, 20 bp, Artificial Sequence
  chemically synthesized
ccaagggtactgcacttggg

SEQ ID NO: 41415 - DNA, 20 bp, Artificial Sequence
  chemically synthesized
gggtactgcacttgggaaga

SEQ ID NO: 41416 - DNA, 20 bp, Artificial Sequence
  chemically synthesized
cagatgtcagctgtcttccc

SEQ ID NO: 41417 - DNA, 20 bp, Artificial Sequence
  chemically synthesized
acatttttgacggcagatgt

SEQ ID NO: 41418 - DNA, 20 bp, Artificial Sequence
  chemically synthesized
ctactttacatttttgacgg

SEQ ID NO: 41419 - DNA, 20 bp, Artificial Sequence
  chemically synthesized
ttcctactttacatttttga

SEQ ID NO: 41420 - DNA, 20 bp, Artificial Sequence
  chemically synthesized
catctgccgtcaaaaatgta

SEQ ID NO: 41421 - DNA, 20 bp, Artificial Sequence
  chemically synthesized
ctgccgtcaaaaatgtaaag

SEQ ID NO: 41422 - DNA, 20 bp, Artificial Sequence
  chemically synthesized
tgccgtcaaaaatgtaaagt

SEQ ID NO: 41423 - DNA, 20 bp, Artificial Sequence
  chemically synthesized
cgtcaaaaatgtaaagtagg

SEQ ID NO: 41424 - DNA, 20 bp, Artificial Sequence
  chemically synthesized
aaaaatgtaaagtaggaagt

SEQ ID NO: 41425 - DNA, 20 bp, Artificial Sequence
  chemically synthesized
aaatgtaaagtaggaagtta

SEQ ID NO: 41426 - DNA, 20 bp, Artificial Sequence
  chemically synthesized
agttagagtatcttcgtatt

SEQ ID NO: 41427 - DNA, 20 bp, Artificial Sequence
  chemically synthesized
gttagagtatcttcgtattt

SEQ ID NO: 41428 - DNA, 20 bp, Artificial Sequence
  chemically synthesized
caagtttaaacctaaatacg

SEQ ID NO: 41429 - DNA, 20 bp, Artificial Sequence
  chemically synthesized
taccttttcttgagcaatgc

SEQ ID NO: 41430 - DNA, 20 bp, Artificial Sequence
  chemically synthesized
ggtttaaacttgcattgctc

SEQ ID NO: 41431 - DNA, 20 bp, Artificial Sequence
  chemically synthesized
aaacttgcattgctcaagaa

SEQ ID NO: 41432 - DNA, 20 bp, Artificial Sequence
  chemically synthesized
aacttgcattgctcaagaaa

SEQ ID NO: 41433 - DNA, 20 bp, Artificial Sequence
  chemically synthesized
tttgtatcctaccttttctt

SEQ ID NO: 41434 - DNA, 20 bp, Artificial Sequence
  chemically synthesized
ttgcattgctcaagaaaagg

SEQ ID NO: 41435 - DNA, 20 bp, Artificial Sequence
  chemically synthesized
tgcattgctcaagaaaaggt

SEQ ID NO: 41436 - DNA, 20 bp, Artificial Sequence
  chemically synthesized
tcaagaaaaggtaggataca

SEQ ID NO: 41437 - DNA, 20 bp, Artificial Sequence
  chemically synthesized
aatctgctgataaaatacaa

SEQ ID NO: 41438 - DNA, 20 bp, Artificial Sequence
  chemically synthesized
caatatcttttgtattttat

SEQ ID NO: 41439 - DNA, 20 bp, Artificial Sequence
  chemically synthesized
tatcttttgtattttatcag

SEQ ID NO: 41440 - DNA, 20 bp, Artificial Sequence
  chemically synthesized
atcagcagattttaaaaaac

SEQ ID NO: 41441 - DNA, 20 bp, Artificial Sequence
  chemically synthesized
agcagattttaaaaaactgg

SEQ ID NO: 41442 - DNA, 20 bp, Artificial Sequence
  chemically synthesized
agattttaaaaaactggaag

SEQ ID NO: 41443 - DNA, 20 bp, Artificial Sequence
  chemically synthesized
atgttggtaatgtcttcttc

SEQ ID NO: 41444 - DNA, 20 bp, Artificial Sequence
  chemically synthesized
gacaactgcaatgaacatgt

SEQ ID NO: 41445 - DNA, 20 bp, Artificial Sequence
  chemically synthesized
cattaccaacatgttcattg

SEQ ID NO: 41446 - DNA, 20 bp, Artificial Sequence
  chemically synthesized
acatgttcattgcagttgtc

SEQ ID NO: 41447 - DNA, 20 bp, Artificial Sequence
  chemically synthesized
catgttcattgcagttgtct

SEQ ID NO: 41448 - DNA, 20 bp, Artificial Sequence
  chemically synthesized
gttcattgcagttgtctagg

SEQ ID NO: 41449 - DNA, 20 bp, Artificial Sequence
  chemically synthesized
tttaagtgcccatcaccacc

SEQ ID NO: 41450 - DNA, 20 bp, Artificial Sequence
  chemically synthesized
tgcagttgtctaggtggtga

SEQ ID NO: 41451 - DNA, 20 bp, Artificial Sequence
  chemically synthesized
gcagttgtctaggtggtgat

SEQ ID NO: 41452 - DNA, 20 bp, Artificial Sequence
  chemically synthesized
gaaaaagattaaaaatattt

SEQ ID NO: 41453 - DNA, 20 bp, Artificial Sequence
  chemically synthesized
cactgtggaaaacatagaaa

SEQ ID NO: 41454 - DNA, 20 bp, Artificial Sequence
  chemically synthesized
aatgttcactgtggaaaaca

SEQ ID NO: 41455 - DNA, 20 bp, Artificial Sequence
  chemically synthesized
atctttttctatgttttcca

SEQ ID NO: 41456 - DNA, 20 bp, Artificial Sequence
  chemically synthesized
aaaataataaatgttcactg

SEQ ID NO: 41457 - DNA, 20 bp, Artificial Sequence
  chemically synthesized
ttattatttttgttatgaca

SEQ ID NO: 41458 - DNA, 20 bp, Artificial Sequence
  chemically synthesized
ttttagaaattaatatttgt

SEQ ID NO: 41459 - DNA, 20 bp, Artificial Sequence
  chemically synthesized
gaagtctgagcaatacattt

SEQ ID NO: 41460 - DNA, 20 bp, Artificial Sequence
  chemically synthesized
aatttctaaaatgtattgct

SEQ ID NO: 41461 - DNA, 20 bp, Artificial Sequence
  chemically synthesized
aaatgtattgctcagacttc

SEQ ID NO: 41462 - DNA, 20 bp, Artificial Sequence
  chemically synthesized
caagttgaaactggaagtct

SEQ ID NO: 41463 - DNA, 20 bp, Artificial Sequence
  chemically synthesized
catctccaagttgaaactgg

SEQ ID NO: 41464 - DNA, 20 bp, Artificial Sequence
  chemically synthesized
ctccatctccaagttgaaac

SEQ ID NO: 41465 - DNA, 20 bp, Artificial Sequence
  chemically synthesized
tcagacttccagtttcaact

SEQ ID NO: 41466 - DNA, 20 bp, Artificial Sequence
  chemically synthesized
agacttccagtttcaacttg

SEQ ID NO: 41467 - DNA, 20 bp, Artificial Sequence
  chemically synthesized
ttccagtttcaacttggaga

SEQ ID NO: 41468 - DNA, 20 bp, Artificial Sequence
  chemically synthesized
ccagtttcaacttggagatg

SEQ ID NO: 41469 - DNA, 20 bp, Artificial Sequence
  chemically synthesized
agctctccatctccatctcc

SEQ ID NO: 41470 - DNA, 20 bp, Artificial Sequence
  chemically synthesized
tttcaacttggagatggaga

SEQ ID NO: 41471 - DNA, 20 bp, Artificial Sequence
  chemically synthesized
tcaacttggagatggagatg

SEQ ID NO: 41472 - DNA, 20 bp, Artificial Sequence
  chemically synthesized
aacttggagatggagatgga

SEQ ID NO: 41473 - DNA, 20 bp, Artificial Sequence
  chemically synthesized
gatggagatggagagctgca

SEQ ID NO: 41474 - DNA, 20 bp, Artificial Sequence
  chemically synthesized
tggagatggagagctgcaaa

SEQ ID NO: 41475 - DNA, 20 bp, Artificial Sequence
  chemically synthesized
ggagatggagagctgcaaag

SEQ ID NO: 41476 - DNA, 20 bp, Artificial Sequence
  chemically synthesized
gtatgggagcaacctctttg

SEQ ID NO: 41477 - DNA, 20 bp, Artificial Sequence
  chemically synthesized
ttttcttgctacaagtatgg

SEQ ID NO: 41478 - DNA, 20 bp, Artificial Sequence
  chemically synthesized
agaggttgctcccatacttg

SEQ ID NO: 41479 - DNA, 20 bp, Artificial Sequence
  chemically synthesized
agttttcttgctacaagtat

SEQ ID NO: 41480 - DNA, 20 bp, Artificial Sequence
  chemically synthesized
cagttttcttgctacaagta

SEQ ID NO: 41481 - DNA, 20 bp, Artificial Sequence
  chemically synthesized
gttgctcccatacttgtagc

SEQ ID NO: 41482 - DNA, 20 bp, Artificial Sequence
  chemically synthesized
tccagcagttttcttgctac

SEQ ID NO: 41483 - DNA, 20 bp, Artificial Sequence
  chemically synthesized
acttgtagcaagaaaactgc

SEQ ID NO: 41484 - DNA, 20 bp, Artificial Sequence
  chemically synthesized
gtagcaagaaaactgctgga

SEQ ID NO: 41485 - DNA, 20 bp, Artificial Sequence
  chemically synthesized
tcattaatttatctgtccag

SEQ ID NO: 41486 - DNA, 20 bp, Artificial Sequence
  chemically synthesized
aagtcattaatttatctgtc

SEQ ID NO: 41487 - DNA, 20 bp, Artificial Sequence
  chemically synthesized
ataaattaatgacttttcat

SEQ ID NO: 41488 - DNA, 20 bp, Artificial Sequence
  chemically synthesized
ttctctgatggactgatgaa

SEQ ID NO: 41489 - DNA, 20 bp, Artificial Sequence
  chemically synthesized
atgacttttcatcagtccat

SEQ ID NO: 41490 - DNA, 20 bp, Artificial Sequence
  chemically synthesized
gacttttcatcagtccatca

SEQ ID NO: 41491 - DNA, 20 bp, Artificial Sequence
  chemically synthesized
ctataatgtcatttctctga

SEQ ID NO: 41492 - DNA, 20 bp, Artificial Sequence
  chemically synthesized
ccatcagagaaatgacatta

SEQ ID NO: 41493 - DNA, 20 bp, Artificial Sequence
  chemically synthesized
ttatagaacaacctgaaatc

SEQ ID NO: 41494 - DNA, 20 bp, Artificial Sequence
  chemically synthesized
ccaatctctctccagatttc

SEQ ID NO: 41495 - DNA, 20 bp, Artificial Sequence
  chemically synthesized
atagaacaacctgaaatctg

SEQ ID NO: 41496 - DNA, 20 bp, Artificial Sequence
  chemically synthesized
gccaatctctctccagattt

SEQ ID NO: 41497 - DNA, 20 bp, Artificial Sequence
  chemically synthesized
agaacaacctgaaatctgga

SEQ ID NO: 41498 - DNA, 20 bp, Artificial Sequence
  chemically synthesized
aacaacctgaaatctggaga

SEQ ID NO: 41499 - DNA, 20 bp, Artificial Sequence
  chemically synthesized
gctaaaggccaatctctctc

SEQ ID NO: 41500 - DNA, 20 bp, Artificial Sequence
  chemically synthesized
cctgaaatctggagagagat

SEQ ID NO: 41501 - DNA, 20 bp, Artificial Sequence
  chemically synthesized
tctggagagagattggcctt

SEQ ID NO: 41502 - DNA, 20 bp, Artificial Sequence
  chemically synthesized
gagagagattggcctttagc

SEQ ID NO: 41503 - DNA, 20 bp, Artificial Sequence
  chemically synthesized
caggcactgcttctggctaa

SEQ ID NO: 41504 - DNA, 20 bp, Artificial Sequence
  chemically synthesized
agagattggcctttagccag

SEQ ID NO: 41505 - DNA, 20 bp, Artificial Sequence
  chemically synthesized
tcaggcactgcttctggcta

SEQ ID NO: 41506 - DNA, 20 bp, Artificial Sequence
  chemically synthesized
gattggcctttagccagaag

SEQ ID NO: 41507 - DNA, 20 bp, Artificial Sequence
  chemically synthesized
aaatgctcaggcactgcttc

SEQ ID NO: 41508 - DNA, 20 bp, Artificial Sequence
  chemically synthesized
tttagccagaagcagtgcct

SEQ ID NO: 41509 - DNA, 20 bp, Artificial Sequence
  chemically synthesized
agaagcagtgcctgagcatt

SEQ ID NO: 41510 - DNA, 20 bp, Artificial Sequence
  chemically synthesized
ctccagggatccaaatgctc

SEQ ID NO: 41511 - DNA, 20 bp, Artificial Sequence
  chemically synthesized
gctccagggatccaaatgct

SEQ ID NO: 41512 - DNA, 20 bp, Artificial Sequence
  chemically synthesized
tgcctgagcatttggatccc

SEQ ID NO: 41513 - DNA, 20 bp, Artificial Sequence
  chemically synthesized
cctgagcatttggatccctg

SEQ ID NO: 41514 - DNA, 20 bp, Artificial Sequence
  chemically synthesized
gagcatttggatccctggag

SEQ ID NO: 41515 - DNA, 20 bp, Artificial Sequence
  chemically synthesized
tttatatggcatctgctcca

SEQ ID NO: 41516 - DNA, 20 bp, Artificial Sequence
  chemically synthesized
gtttatatggcatctgctcc

SEQ ID NO: 41517 - DNA, 20 bp, Artificial Sequence
  chemically synthesized
agtttatatggcatctgctc

SEQ ID NO: 41518 - DNA, 20 bp, Artificial Sequence
  chemically synthesized
ggagcagatgccatataaac

SEQ ID NO: 41519 - DNA, 20 bp, Artificial Sequence
  chemically synthesized
aatctccctactagtttata

SEQ ID NO: 41520 - DNA, 20 bp, Artificial Sequence
  chemically synthesized
gcagatgccatataaactag

SEQ ID NO: 41521 - DNA, 20 bp, Artificial Sequence
  chemically synthesized
cagatgccatataaactagt

SEQ ID NO: 41522 - DNA, 20 bp, Artificial Sequence
  chemically synthesized
agatgccatataaactagta

SEQ ID NO: 41523 - DNA, 20 bp, Artificial Sequence
  chemically synthesized
atgccatataaactagtagg

SEQ ID NO: 41524 - DNA, 20 bp, Artificial Sequence
  chemically synthesized
caacaatttaatctccctac

SEQ ID NO: 41525 - DNA, 20 bp, Artificial Sequence
  chemically synthesized
tagtagggagattaaattgt

SEQ ID NO: 41526 - DNA, 20 bp, Artificial Sequence
  chemically synthesized
agtagggagattaaattgtt

SEQ ID NO: 41527 - DNA, 20 bp, Artificial Sequence
  chemically synthesized
gtagggagattaaattgttg

SEQ ID NO: 41528 - DNA, 20 bp, Artificial Sequence
  chemically synthesized
tagggagattaaattgttgg

SEQ ID NO: 41529 - DNA, 20 bp, Artificial Sequence
  chemically synthesized
ttaaattgttgggggacatg

SEQ ID NO: 41530 - DNA, 20 bp, Artificial Sequence
  chemically synthesized
taaattgttgggggacatgt

SEQ ID NO: 41531 - DNA, 20 bp, Artificial Sequence
  chemically synthesized
aattgttgggggacatgtgg

SEQ ID NO: 41532 - DNA, 20 bp, Artificial Sequence
  chemically synthesized
gttgggggacatgtgggagc

SEQ ID NO: 41533 - DNA, 20 bp, Artificial Sequence
  chemically synthesized
ggacatgtgggagctagcct

SEQ ID NO: 41534 - DNA, 20 bp, Artificial Sequence
  chemically synthesized
acatgtgggagctagcctga

SEQ ID NO: 41535 - DNA, 20 bp, Artificial Sequence
  chemically synthesized
ggatcttcacactctcaggc

SEQ ID NO: 41536 - DNA, 20 bp, Artificial Sequence
  chemically synthesized
cccaggatcttcacactctc

SEQ ID NO: 41537 - DNA, 20 bp, Artificial Sequence
  chemically synthesized
ccccaggatcttcacactct

SEQ ID NO: 41538 - DNA, 20 bp, Artificial Sequence
  chemically synthesized
ggagctagcctgagagtgtg

SEQ ID NO: 41539 - DNA, 20 bp, Artificial Sequence
  chemically synthesized
gcctgagagtgtgaagatcc

SEQ ID NO: 41540 - DNA, 20 bp, Artificial Sequence
  chemically synthesized
cctgagagtgtgaagatcct

SEQ ID NO: 41541 - DNA, 20 bp, Artificial Sequence
  chemically synthesized
ctgagagtgtgaagatcctg

SEQ ID NO: 41542 - DNA, 20 bp, Artificial Sequence
  chemically synthesized
tgagagtgtgaagatcctgg

SEQ ID NO: 41543 - DNA, 20 bp, Artificial Sequence
  chemically synthesized
cacctatggcagtagccccc

SEQ ID NO: 41544 - DNA, 20 bp, Artificial Sequence
  chemically synthesized
ccacctatggcagtagcccc

SEQ ID NO: 41545 - DNA, 20 bp, Artificial Sequence
  chemically synthesized
gatcctgggggctactgcca

SEQ ID NO: 41546 - DNA, 20 bp, Artificial Sequence
  chemically synthesized
atcctgggggctactgccat

SEQ ID NO: 41547 - DNA, 20 bp, Artificial Sequence
  chemically synthesized
tgggactccacctatggcag

SEQ ID NO: 41548 - DNA, 20 bp, Artificial Sequence
  chemically synthesized
ctgggggctactgccatagg

SEQ ID NO: 41549 - DNA, 20 bp, Artificial Sequence
  chemically synthesized
ggttgggactccacctatgg

SEQ ID NO: 41550 - DNA, 20 bp, Artificial Sequence
  chemically synthesized
gggggctactgccataggtg

SEQ ID NO: 41551 - DNA, 20 bp, Artificial Sequence
  chemically synthesized
aaaggttgggactccaccta

SEQ ID NO: 41552 - DNA, 20 bp, Artificial Sequence
  chemically synthesized
gaagaagcttgcaaaaggtt

SEQ ID NO: 41553 - DNA, 20 bp, Artificial Sequence
  chemically synthesized
ggaagaagcttgcaaaaggt

SEQ ID NO: 41554 - DNA, 20 bp, Artificial Sequence
  chemically synthesized
gtggagtcccaaccttttgc

SEQ ID NO: 41555 - DNA, 20 bp, Artificial Sequence
  chemically synthesized
tgaaggaagaagcttgcaaa

SEQ ID NO: 41556 - DNA, 20 bp, Artificial Sequence
  chemically synthesized
ctgaaggaagaagcttgcaa

SEQ ID NO: 41557 - DNA, 20 bp, Artificial Sequence
  chemically synthesized
cttttgcaagcttcttcctt

SEQ ID NO: 41558 - DNA, 20 bp, Artificial Sequence
  chemically synthesized
ggtacagttcctgaaggaag

SEQ ID NO: 41559 - DNA, 20 bp, Artificial Sequence
  chemically synthesized
ttttgcaagcttcttccttc

SEQ ID NO: 41560 - DNA, 20 bp, Artificial Sequence
  chemically synthesized
caaggtacagttcctgaagg

SEQ ID NO: 41561 - DNA, 20 bp, Artificial Sequence
  chemically synthesized
aggcaaggtacagttcctga

SEQ ID NO: 41562 - DNA, 20 bp, Artificial Sequence
  chemically synthesized
aaggcaaggtacagttcctg

SEQ ID NO: 41563 - DNA, 20 bp, Artificial Sequence
  chemically synthesized
ctccttgtgaaggcaaggta

SEQ ID NO: 41564 - DNA, 20 bp, Artificial Sequence
  chemically synthesized
gcatcctccttgtgaaggca

SEQ ID NO: 41565 - DNA, 20 bp, Artificial Sequence
  chemically synthesized
cgcatcctccttgtgaaggc

SEQ ID NO: 41566 - DNA, 20 bp, Artificial Sequence
  chemically synthesized
gaactgtaccttgccttcac

SEQ ID NO: 41567 - DNA, 20 bp, Artificial Sequence
  chemically synthesized
aactgtaccttgccttcaca

SEQ ID NO: 41568 - DNA, 20 bp, Artificial Sequence
  chemically synthesized
ctgtaccttgccttcacaag

SEQ ID NO: 41569 - DNA, 20 bp, Artificial Sequence
  chemically synthesized
tcttcgcatcctccttgtga

SEQ ID NO: 41570 - DNA, 20 bp, Artificial Sequence
  chemically synthesized
tgtaccttgccttcacaagg

SEQ ID NO: 41571 - DNA, 20 bp, Artificial Sequence
  chemically synthesized
ttcttcgcatcctccttgtg

SEQ ID NO: 41572 - DNA, 20 bp, Artificial Sequence
  chemically synthesized
gccttcacaaggaggatgcg

SEQ ID NO: 41573 - DNA, 20 bp, Artificial Sequence
  chemically synthesized
caaggaggatgcgaagaatc

SEQ ID NO: 41574 - DNA, 20 bp, Artificial Sequence
  chemically synthesized
aggaggatgcgaagaatctg

SEQ ID NO: 41575 - DNA, 20 bp, Artificial Sequence
  chemically synthesized
ggatgcgaagaatctggaga

SEQ ID NO: 41576 - DNA, 20 bp, Artificial Sequence
  chemically synthesized
ggtgttggggaggctttctc

SEQ ID NO: 41577 - DNA, 20 bp, Artificial Sequence
  chemically synthesized
caacacagagggtgttgggg

SEQ ID NO: 41578 - DNA, 20 bp, Artificial Sequence
  chemically synthesized
gcaacacagagggtgttggg

SEQ ID NO: 41579 - DNA, 20 bp, Artificial Sequence
  chemically synthesized
cagcaacacagagggtgttg

SEQ ID NO: 41580 - DNA, 20 bp, Artificial Sequence
  chemically synthesized
tcagcaacacagagggtgtt

SEQ ID NO: 41581 - DNA, 20 bp, Artificial Sequence
  chemically synthesized
atcagcaacacagagggtgt

SEQ ID NO: 41582 - DNA, 20 bp, Artificial Sequence
  chemically synthesized
tccccaatcagcaacacaga

SEQ ID NO: 41583 - DNA, 20 bp, Artificial Sequence
  chemically synthesized
ttccccaatcagcaacacag

SEQ ID NO: 41584 - DNA, 20 bp, Artificial Sequence
  chemically synthesized
cttccccaatcagcaacaca

SEQ ID NO: 41585 - DNA, 20 bp, Artificial Sequence
  chemically synthesized
cccttccccaatcagcaaca

SEQ ID NO: 41586 - DNA, 20 bp, Artificial Sequence
  chemically synthesized
acaccctctgtgttgctgat

SEQ ID NO: 41587 - DNA, 20 bp, Artificial Sequence
  chemically synthesized
caccctctgtgttgctgatt

SEQ ID NO: 41588 - DNA, 20 bp, Artificial Sequence
  chemically synthesized
accctctgtgttgctgattg

SEQ ID NO: 41589 - DNA, 20 bp, Artificial Sequence
  chemically synthesized
ctctgtgttgctgattgggg

SEQ ID NO: 41590 - DNA, 20 bp, Artificial Sequence
  chemically synthesized
tactgtgacccttccccaat

SEQ ID NO: 41591 - DNA, 20 bp, Artificial Sequence
  chemically synthesized
tctgtgttgctgattgggga

SEQ ID NO: 41592 - DNA, 20 bp, Artificial Sequence
  chemically synthesized
ctgtgttgctgattggggaa

SEQ ID NO: 41593 - DNA, 20 bp, Artificial Sequence
  chemically synthesized
tgctgattggggaagggtca

SEQ ID NO: 41594 - DNA, 20 bp, Artificial Sequence
  chemically synthesized
tgattggggaagggtcacag

SEQ ID NO: 41595 - DNA, 20 bp, Artificial Sequence
  chemically synthesized
tggggaagggtcacagtagc

SEQ ID NO: 41596 - DNA, 20 bp, Artificial Sequence
  chemically synthesized
ataagcagattcatggtgac

SEQ ID NO: 41597 - DNA, 20 bp, Artificial Sequence
  chemically synthesized
gaagggtataagcagattca

SEQ ID NO: 41598 - DNA, 20 bp, Artificial Sequence
  chemically synthesized
tctgaagagaagggtataag

SEQ ID NO: 41599 - DNA, 20 bp, Artificial Sequence
  chemically synthesized
tcctctgaagagaagggtat

SEQ ID NO: 41600 - DNA, 20 bp, Artificial Sequence
  chemically synthesized
tctgcttatacccttctctt

SEQ ID NO: 41601 - DNA, 20 bp, Artificial Sequence
  chemically synthesized
gtcttttcctctgaagagaa

SEQ ID NO: 41602 - DNA, 20 bp, Artificial Sequence
  chemically synthesized
tgtcttttcctctgaagaga

SEQ ID NO: 41603 - DNA, 20 bp, Artificial Sequence
  chemically synthesized
tgcttatacccttctcttca

SEQ ID NO: 41604 - DNA, 20 bp, Artificial Sequence
  chemically synthesized
atgtcttttcctctgaagag

SEQ ID NO: 41605 - DNA, 20 bp, Artificial Sequence
  chemically synthesized
gcttatacccttctcttcag

SEQ ID NO: 41606 - DNA, 20 bp, Artificial Sequence
  chemically synthesized
gtgatgtcttttcctctgaa

SEQ ID NO: 41607 - DNA, 20 bp, Artificial Sequence
  chemically synthesized
atgtgatgtcttttcctctg

SEQ ID NO: 41608 - DNA, 20 bp, Artificial Sequence
  chemically synthesized
tacccttctcttcagaggaa

SEQ ID NO: 41609 - DNA, 20 bp, Artificial Sequence
  chemically synthesized
aaagacatcacattgctata

SEQ ID NO: 41610 - DNA, 20 bp, Artificial Sequence
  chemically synthesized
cagtcacgggtagttcttta

SEQ ID NO: 41611 - DNA, 20 bp, Artificial Sequence
  chemically synthesized
ataaactacccagtcacggg

SEQ ID NO: 41612 - DNA, 20 bp, Artificial Sequence
  chemically synthesized
tataaagaactacccgtgac

SEQ ID NO: 41613 - DNA, 20 bp, Artificial Sequence
  chemically synthesized
ataaagaactacccgtgact

SEQ ID NO: 41614 - DNA, 20 bp, Artificial Sequence
  chemically synthesized
tttataaactacccagtcac

SEQ ID NO: 41615 - DNA, 20 bp, Artificial Sequence
  chemically synthesized
ctttataaactacccagtca

SEQ ID NO: 41616 - DNA, 20 bp, Artificial Sequence
  chemically synthesized
aagaactacccgtgactggg

SEQ ID NO: 41617 - DNA, 20 bp, Artificial Sequence
  chemically synthesized
tctttgctttataaactacc

SEQ ID NO: 41618 - DNA, 20 bp, Artificial Sequence
  chemically synthesized
ccgtgactgggtagtttata

SEQ ID NO: 41619 - DNA, 20 bp, Artificial Sequence
  chemically synthesized
actgggtagtttataaagca

SEQ ID NO: 41620 - DNA, 20 bp, Artificial Sequence
  chemically synthesized
tgggtagtttataaagcaaa

SEQ ID NO: 41621 - DNA, 20 bp, Artificial Sequence
  chemically synthesized
gggtagtttataaagcaaag

SEQ ID NO: 41622 - DNA, 20 bp, Artificial Sequence
  chemically synthesized
aaagaggtttaattgactca

SEQ ID NO: 41623 - DNA, 20 bp, Artificial Sequence
  chemically synthesized
tatacagcctgcagaactgt

SEQ ID NO: 41624 - DNA, 20 bp, Artificial Sequence
  chemically synthesized
ttaattgactcacagttctg

SEQ ID NO: 41625 - DNA, 20 bp, Artificial Sequence
  chemically synthesized
taattgactcacagttctgc

SEQ ID NO: 41626 - DNA, 20 bp, Artificial Sequence
  chemically synthesized
catgcctcctatacagcctg

SEQ ID NO: 41627 - DNA, 20 bp, Artificial Sequence
  chemically synthesized
tcacagttctgcaggctgta

SEQ ID NO: 41628 - DNA, 20 bp, Artificial Sequence
  chemically synthesized
cacagttctgcaggctgtat

SEQ ID NO: 41629 - DNA, 20 bp, Artificial Sequence
  chemically synthesized
cagttctgcaggctgtatag

SEQ ID NO: 41630 - DNA, 20 bp, Artificial Sequence
  chemically synthesized
agttctgcaggctgtatagg

SEQ ID NO: 41631 - DNA, 20 bp, Artificial Sequence
  chemically synthesized
ccccagccatgcctcctata

SEQ ID NO: 41632 - DNA, 20 bp, Artificial Sequence
  chemically synthesized
tgcaggctgtataggaggca

SEQ ID NO: 41633 - DNA, 20 bp, Artificial Sequence
  chemically synthesized
ggctgtataggaggcatggc

SEQ ID NO: 41634 - DNA, 20 bp, Artificial Sequence
  chemically synthesized
gctgtataggaggcatggct

SEQ ID NO: 41635 - DNA, 20 bp, Artificial Sequence
  chemically synthesized
ctgtataggaggcatggctg

SEQ ID NO: 41636 - DNA, 20 bp, Artificial Sequence
  chemically synthesized
gtataggaggcatggctggg

SEQ ID NO: 41637 - DNA, 20 bp, Artificial Sequence
  chemically synthesized
taagcttcctgagggctccc

SEQ ID NO: 41638 - DNA, 20 bp, Artificial Sequence
  chemically synthesized
aggcatggctggggagccct

SEQ ID NO: 41639 - DNA, 20 bp, Artificial Sequence
  chemically synthesized
ggcatggctggggagccctc

SEQ ID NO: 41640 - DNA, 20 bp, Artificial Sequence
  chemically synthesized
atggctggggagccctcagg

SEQ ID NO: 41641 - DNA, 20 bp, Artificial Sequence
  chemically synthesized
catgattttaagcttcctga

SEQ ID NO: 41642 - DNA, 20 bp, Artificial Sequence
  chemically synthesized
ccatgattttaagcttcctg

SEQ ID NO: 41643 - DNA, 20 bp, Artificial Sequence
  chemically synthesized
gccatgattttaagcttcct

SEQ ID NO: 41644 - DNA, 20 bp, Artificial Sequence
  chemically synthesized
cctcaggaagcttaaaatca

SEQ ID NO: 41645 - DNA, 20 bp, Artificial Sequence
  chemically synthesized
ttgccttctgccatgatttt

SEQ ID NO: 41646 - DNA, 20 bp, Artificial Sequence
  chemically synthesized
caggaagcttaaaatcatgg

SEQ ID NO: 41647 - DNA, 20 bp, Artificial Sequence
  chemically synthesized
gaagcttaaaatcatggcag

SEQ ID NO: 41648 - DNA, 20 bp, Artificial Sequence
  chemically synthesized
aagcttaaaatcatggcaga

SEQ ID NO: 41649 - DNA, 20 bp, Artificial Sequence
  chemically synthesized
taaaatcatggcagaaggca

SEQ ID NO: 41650 - DNA, 20 bp, Artificial Sequence
  chemically synthesized
aaaatcatggcagaaggcaa

SEQ ID NO: 41651 - DNA, 20 bp, Artificial Sequence
  chemically synthesized
aaatcatggcagaaggcaaa

SEQ ID NO: 41652 - DNA, 20 bp, Artificial Sequence
  chemically synthesized
aatcatggcagaaggcaaag

SEQ ID NO: 41653 - DNA, 20 bp, Artificial Sequence
  chemically synthesized
catggcagaaggcaaagggg

SEQ ID NO: 41654 - DNA, 20 bp, Artificial Sequence
  chemically synthesized
gcagaaggcaaaggggaagc

SEQ ID NO: 41655 - DNA, 20 bp, Artificial Sequence
  chemically synthesized
gaagcaagcacatcttcaca

SEQ ID NO: 41656 - DNA, 20 bp, Artificial Sequence
  chemically synthesized
gcaagcacatcttcacacag

SEQ ID NO: 41657 - DNA, 20 bp, Artificial Sequence
  chemically synthesized
gtctatcctgctgctgtgtg

SEQ ID NO: 41658 - DNA, 20 bp, Artificial Sequence
  chemically synthesized
agcacatcttcacacagcag

SEQ ID NO: 41659 - DNA, 20 bp, Artificial Sequence
  chemically synthesized
gcacatcttcacacagcagc

SEQ ID NO: 41660 - DNA, 20 bp, Artificial Sequence
  chemically synthesized
atcttcacacagcagcagga

SEQ ID NO: 41661 - DNA, 20 bp, Artificial Sequence
  chemically synthesized
acacagcagcaggatagaca

SEQ ID NO: 41662 - DNA, 20 bp, Artificial Sequence
  chemically synthesized
gcagcaggatagacacagtg

SEQ ID NO: 41663 - DNA, 20 bp, Artificial Sequence
  chemically synthesized
cagcaggatagacacagtga

SEQ ID NO: 41664 - DNA, 20 bp, Artificial Sequence
  chemically synthesized
agcaggatagacacagtgaa

SEQ ID NO: 41665 - DNA, 20 bp, Artificial Sequence
  chemically synthesized
gcaggatagacacagtgaag

SEQ ID NO: 41666 - DNA, 20 bp, Artificial Sequence
  chemically synthesized
gatagacacagtgaagggga

SEQ ID NO: 41667 - DNA, 20 bp, Artificial Sequence
  chemically synthesized
ctagttatttgagagtatgt

SEQ ID NO: 41668 - DNA, 20 bp, Artificial Sequence
  chemically synthesized
tctagttatttgagagtatg

SEQ ID NO: 41669 - DNA, 20 bp, Artificial Sequence
  chemically synthesized
caagagatctagttatttga

SEQ ID NO: 41670 - DNA, 20 bp, Artificial Sequence
  chemically synthesized
cctacatactctcaaataac

SEQ ID NO: 41671 - DNA, 20 bp, Artificial Sequence
  chemically synthesized
ctcaagagatctagttattt

SEQ ID NO: 41672 - DNA, 20 bp, Artificial Sequence
  chemically synthesized
gagtgagttctcaagagatc

SEQ ID NO: 41673 - DNA, 20 bp, Artificial Sequence
  chemically synthesized
ctcaaataactagatctctt

SEQ ID NO: 41674 - DNA, 20 bp, Artificial Sequence
  chemically synthesized
gatagtgagtgagttctcaa

SEQ ID NO: 41675 - DNA, 20 bp, Artificial Sequence
  chemically synthesized
gtgatagtgagtgagttctc

SEQ ID NO: 41676 - DNA, 20 bp, Artificial Sequence
  chemically synthesized
ctgtacttgtgatagtgagt

SEQ ID NO: 41677 - DNA, 20 bp, Artificial Sequence
  chemically synthesized
gttgctgtacttgtgatagt

SEQ ID NO: 41678 - DNA, 20 bp, Artificial Sequence
  chemically synthesized
gagaactcactcactatcac

SEQ ID NO: 41679 - DNA, 20 bp, Artificial Sequence
  chemically synthesized
ctccgttgctgtacttgtga

SEQ ID NO: 41680 - DNA, 20 bp, Artificial Sequence
  chemically synthesized
ctcactcactatcacaagta

SEQ ID NO: 41681 - DNA, 20 bp, Artificial Sequence
  chemically synthesized
cactatcacaagtacagcaa

SEQ ID NO: 41682 - DNA, 20 bp, Artificial Sequence
  chemically synthesized
ctatcacaagtacagcaacg

SEQ ID NO: 41683 - DNA, 20 bp, Artificial Sequence
  chemically synthesized
aggtgaatgaatcatggggg

SEQ ID NO: 41684 - DNA, 20 bp, Artificial Sequence
  chemically synthesized
gggaggtgaatgaatcatgg

SEQ ID NO: 41685 - DNA, 20 bp, Artificial Sequence
  chemically synthesized
tgggaggtgaatgaatcatg

SEQ ID NO: 41686 - DNA, 20 bp, Artificial Sequence
  chemically synthesized
atgggaggtgaatgaatcat

SEQ ID NO: 41687 - DNA, 20 bp, Artificial Sequence
  chemically synthesized
gatgggaggtgaatgaatca

SEQ ID NO: 41688 - DNA, 20 bp, Artificial Sequence
  chemically synthesized
atgattcattcacctcccat

SEQ ID NO: 41689 - DNA, 20 bp, Artificial Sequence
  chemically synthesized
tgattcattcacctcccatc

SEQ ID NO: 41690 - DNA, 20 bp, Artificial Sequence
  chemically synthesized
tggaggaggggcctgatggg

SEQ ID NO: 41691 - DNA, 20 bp, Artificial Sequence
  chemically synthesized
ttggaggaggggcctgatgg

SEQ ID NO: 41692 - DNA, 20 bp, Artificial Sequence
  chemically synthesized
tgttggaggaggggcctgat

SEQ ID NO: 41693 - DNA, 20 bp, Artificial Sequence
  chemically synthesized
atgttggaggaggggcctga

SEQ ID NO: 41694 - DNA, 20 bp, Artificial Sequence
  chemically synthesized
atccccacatgttggaggag

SEQ ID NO: 41695 - DNA, 20 bp, Artificial Sequence
  chemically synthesized
aatccccacatgttggagga

SEQ ID NO: 41696 - DNA, 20 bp, Artificial Sequence
  chemically synthesized
taatccccacatgttggagg

SEQ ID NO: 41697 - DNA, 20 bp, Artificial Sequence
  chemically synthesized
gtaatccccacatgttggag

SEQ ID NO: 41698 - DNA, 20 bp, Artificial Sequence
  chemically synthesized
ttgtaatccccacatgttgg

SEQ ID NO: 41699 - DNA, 20 bp, Artificial Sequence
  chemically synthesized
caggcccctcctccaacatg

SEQ ID NO: 41700 - DNA, 20 bp, Artificial Sequence
  chemically synthesized
attgtaatccccacatgttg

SEQ ID NO: 41701 - DNA, 20 bp, Artificial Sequence
  chemically synthesized
aggcccctcctccaacatgt

SEQ ID NO: 41702 - DNA, 20 bp, Artificial Sequence
  chemically synthesized
ggcccctcctccaacatgtg

SEQ ID NO: 41703 - DNA, 20 bp, Artificial Sequence
  chemically synthesized
aaattgtaatccccacatgt

SEQ ID NO: 41704 - DNA, 20 bp, Artificial Sequence
  chemically synthesized
ttacaatttgacatgacatt

SEQ ID NO: 41705 - DNA, 20 bp, Artificial Sequence
  chemically synthesized
tacaatttgacatgacattt

SEQ ID NO: 41706 - DNA, 20 bp, Artificial Sequence
  chemically synthesized
aatttgacatgacatttggg

SEQ ID NO: 41707 - DNA, 20 bp, Artificial Sequence
  chemically synthesized
tttgacatgacatttgggtg

SEQ ID NO: 41708 - DNA, 20 bp, Artificial Sequence
  chemically synthesized
atgacatttgggtggagaca

SEQ ID NO: 41709 - DNA, 20 bp, Artificial Sequence
  chemically synthesized
cctcagtgcctgatatggtt

SEQ ID NO: 41710 - DNA, 20 bp, Artificial Sequence
  chemically synthesized
gacacagaaccaaaccatat

SEQ ID NO: 41711 - DNA, 20 bp, Artificial Sequence
  chemically synthesized
acacagaaccaaaccatatc

SEQ ID NO: 41712 - DNA, 20 bp, Artificial Sequence
  chemically synthesized
tatttcctcagtgcctgata

SEQ ID NO: 41713 - DNA, 20 bp, Artificial Sequence
  chemically synthesized
accaaaccatatcaggcact

SEQ ID NO: 41714 - DNA, 20 bp, Artificial Sequence
  chemically synthesized
ccaaaccatatcaggcactg

SEQ ID NO: 41715 - DNA, 20 bp, Artificial Sequence
  chemically synthesized
aaaatgcagtggtatttcct

SEQ ID NO: 41716 - DNA, 20 bp, Artificial Sequence
  chemically synthesized
tcccttcccctaaaatgcag

SEQ ID NO: 41717 - DNA, 20 bp, Artificial Sequence
  chemically synthesized
gaggaaataccactgcattt

SEQ ID NO: 41718 - DNA, 20 bp, Artificial Sequence
  chemically synthesized
aggaaataccactgcatttt

SEQ ID NO: 41719 - DNA, 20 bp, Artificial Sequence
  chemically synthesized
ggaaataccactgcatttta

SEQ ID NO: 41720 - DNA, 20 bp, Artificial Sequence
  chemically synthesized
tgttcccttcccctaaaatg

SEQ ID NO: 41721 - DNA, 20 bp, Artificial Sequence
  chemically synthesized
gaaataccactgcattttag

SEQ ID NO: 41722 - DNA, 20 bp, Artificial Sequence
  chemically synthesized
ataccactgcattttagggg

SEQ ID NO: 41723 - DNA, 20 bp, Artificial Sequence
  chemically synthesized
taccactgcattttagggga

SEQ ID NO: 41724 - DNA, 20 bp, Artificial Sequence
  chemically synthesized
accactgcattttaggggaa

SEQ ID NO: 41725 - DNA, 20 bp, Artificial Sequence
  chemically synthesized
attttaggggaagggaacac

SEQ ID NO: 41726 - DNA, 20 bp, Artificial Sequence
  chemically synthesized
aaccacacatagatgagatc

SEQ ID NO: 41727 - DNA, 20 bp, Artificial Sequence
  chemically synthesized
aaacaaaaccacacatagat

SEQ ID NO: 41728 - DNA, 20 bp, Artificial Sequence
  chemically synthesized
caccagatctcatctatgtg

SEQ ID NO: 41729 - DNA, 20 bp, Artificial Sequence
  chemically synthesized
gaacaaaacaaaaccacaca

SEQ ID NO: 41730 - DNA, 20 bp, Artificial Sequence
  chemically synthesized
caaaaaaaaacaaacaaaaa

SEQ ID NO: 41731 - DNA, 20 bp, Artificial Sequence
  chemically synthesized
ttgttgttgttgttgttttt

SEQ ID NO: 41732 - DNA, 20 bp, Artificial Sequence
  chemically synthesized
tgttgtttttcagccttatg

SEQ ID NO: 41733 - DNA, 20 bp, Artificial Sequence
  chemically synthesized
gttgtttttcagccttatgc

SEQ ID NO: 41734 - DNA, 20 bp, Artificial Sequence
  chemically synthesized
tgtttttcagccttatgcag

SEQ ID NO: 41735 - DNA, 20 bp, Artificial Sequence
  chemically synthesized
aaggccctttctcctgcata

SEQ ID NO: 41736 - DNA, 20 bp, Artificial Sequence
  chemically synthesized
caaggccctttctcctgcat

SEQ ID NO: 41737 - DNA, 20 bp, Artificial Sequence
  chemically synthesized
tttcagccttatgcaggaga

SEQ ID NO: 41738 - DNA, 20 bp, Artificial Sequence
  chemically synthesized
ttcagccttatgcaggagaa

SEQ ID NO: 41739 - DNA, 20 bp, Artificial Sequence
  chemically synthesized
tcagccttatgcaggagaaa

SEQ ID NO: 41740 - DNA, 20 bp, Artificial Sequence
  chemically synthesized
ttatgcaggagaaagggcct

SEQ ID NO: 41741 - DNA, 20 bp, Artificial Sequence
  chemically synthesized
tatgcaggagaaagggcctt

SEQ ID NO: 41742 - DNA, 20 bp, Artificial Sequence
  chemically synthesized
atgcaggagaaagggccttg

SEQ ID NO: 41743 - DNA, 20 bp, Artificial Sequence
  chemically synthesized
gttctcagtctatggcccca

SEQ ID NO: 41744 - DNA, 20 bp, Artificial Sequence
  chemically synthesized
gagaaagggccttggggcca

SEQ ID NO: 41745 - DNA, 20 bp, Artificial Sequence
  chemically synthesized
tgttctcagtctatggcccc

SEQ ID NO: 41746 - DNA, 20 bp, Artificial Sequence
  chemically synthesized
gggccttggggccatagact

SEQ ID NO: 41747 - DNA, 20 bp, Artificial Sequence
  chemically synthesized
ccaccagtgttctcagtcta

SEQ ID NO: 41748 - DNA, 20 bp, Artificial Sequence
  chemically synthesized
gggccatagactgagaacac

SEQ ID NO: 41749 - DNA, 20 bp, Artificial Sequence
  chemically synthesized
tggatatccaccagtgttct

SEQ ID NO: 41750 - DNA, 20 bp, Artificial Sequence
  chemically synthesized
ccatagactgagaacactgg

SEQ ID NO: 41751 - DNA, 20 bp, Artificial Sequence
  chemically synthesized
gagctgcagtggatatccac

SEQ ID NO: 41752 - DNA, 20 bp, Artificial Sequence
  chemically synthesized
acactggtggatatccactg

SEQ ID NO: 41753 - DNA, 20 bp, Artificial Sequence
  chemically synthesized
ttcccttcctggagctgcag

SEQ ID NO: 41754 - DNA, 20 bp, Artificial Sequence
  chemically synthesized
gtggatatccactgcagctc

SEQ ID NO: 41755 - DNA, 20 bp, Artificial Sequence
  chemically synthesized
tggatatccactgcagctcc

SEQ ID NO: 41756 - DNA, 20 bp, Artificial Sequence
  chemically synthesized
ccattcccttcctggagctg

SEQ ID NO: 41757 - DNA, 20 bp, Artificial Sequence
  chemically synthesized
atatccactgcagctccagg

SEQ ID NO: 41758 - DNA, 20 bp, Artificial Sequence
  chemically synthesized
tatccactgcagctccagga

SEQ ID NO: 41759 - DNA, 20 bp, Artificial Sequence
  chemically synthesized
atccactgcagctccaggaa

SEQ ID NO: 41760 - DNA, 20 bp, Artificial Sequence
  chemically synthesized
aacctcccattcccttcctg

SEQ ID NO: 41761 - DNA, 20 bp, Artificial Sequence
  chemically synthesized
tcaacctcccattcccttcc

SEQ ID NO: 41762 - DNA, 20 bp, Artificial Sequence
  chemically synthesized
ctgcagctccaggaagggaa

SEQ ID NO: 41763 - DNA, 20 bp, Artificial Sequence
  chemically synthesized
tgcagctccaggaagggaat

SEQ ID NO: 41764 - DNA, 20 bp, Artificial Sequence
  chemically synthesized
cagctccaggaagggaatgg

SEQ ID NO: 41765 - DNA, 20 bp, Artificial Sequence
  chemically synthesized
agctccaggaagggaatggg

SEQ ID NO: 41766 - DNA, 20 bp, Artificial Sequence
  chemically synthesized
aggaagggaatgggaggttg

SEQ ID NO: 41767 - DNA, 20 bp, Artificial Sequence
  chemically synthesized
ggttgaagttactctacctc

SEQ ID NO: 41768 - DNA, 20 bp, Artificial Sequence
  chemically synthesized
tttcccttcctccagaggta

SEQ ID NO: 41769 - DNA, 20 bp, Artificial Sequence
  chemically synthesized
ttgaagttactctacctctg

SEQ ID NO: 41770 - DNA, 20 bp, Artificial Sequence
  chemically synthesized
tgaagttactctacctctgg

SEQ ID NO: 41771 - DNA, 20 bp, Artificial Sequence
  chemically synthesized
tctttcccttcctccagagg

SEQ ID NO: 41772 - DNA, 20 bp, Artificial Sequence
  chemically synthesized
agttactctacctctggagg

SEQ ID NO: 41773 - DNA, 20 bp, Artificial Sequence
  chemically synthesized
atttctttcccttcctccag

SEQ ID NO: 41774 - DNA, 20 bp, Artificial Sequence
  chemically synthesized
gttactctacctctggagga

SEQ ID NO: 41775 - DNA, 20 bp, Artificial Sequence
  chemically synthesized
tatttctttcccttcctcca

SEQ ID NO: 41776 - DNA, 20 bp, Artificial Sequence
  chemically synthesized
ttactctacctctggaggaa

SEQ ID NO: 41777 - DNA, 20 bp, Artificial Sequence
  chemically synthesized
attatttctttcccttcctc

SEQ ID NO: 41778 - DNA, 20 bp, Artificial Sequence
  chemically synthesized
tctacctctggaggaaggga

SEQ ID NO: 41779 - DNA, 20 bp, Artificial Sequence
  chemically synthesized
aagggaaagaaataattgta

SEQ ID NO: 41780 - DNA, 20 bp, Artificial Sequence
  chemically synthesized
attgtaaagaccacatcccc

SEQ ID NO: 41781 - DNA, 20 bp, Artificial Sequence
  chemically synthesized
tggcctgggtcttggggatg

SEQ ID NO: 41782 - DNA, 20 bp, Artificial Sequence
  chemically synthesized
aagaccacatccccaagacc

SEQ ID NO: 41783 - DNA, 20 bp, Artificial Sequence
  chemically synthesized
cacagttggcctgggtcttg

SEQ ID NO: 41784 - DNA, 20 bp, Artificial Sequence
  chemically synthesized
agaccacatccccaagaccc

SEQ ID NO: 41785 - DNA, 20 bp, Artificial Sequence
  chemically synthesized
acacagttggcctgggtctt

SEQ ID NO: 41786 - DNA, 20 bp, Artificial Sequence
  chemically synthesized
tacacagttggcctgggtct

SEQ ID NO: 41787 - DNA, 20 bp, Artificial Sequence
  chemically synthesized
aattaatacacagttggcct

SEQ ID NO: 41788 - DNA, 20 bp, Artificial Sequence
  chemically synthesized
gaattaatacacagttggcc

SEQ ID NO: 41789 - DNA, 20 bp, Artificial Sequence
  chemically synthesized
tgtttgaattaatacacagt

SEQ ID NO: 41790 - DNA, 20 bp, Artificial Sequence
  chemically synthesized
ctaatgtttgaattaataca

SEQ ID NO: 41791 - DNA, 20 bp, Artificial Sequence
  chemically synthesized
ctgtgtattaattcaaacat

SEQ ID NO: 41792 - DNA, 20 bp, Artificial Sequence
  chemically synthesized
gtgtattaattcaaacatta

SEQ ID NO: 41793 - DNA, 20 bp, Artificial Sequence
  chemically synthesized
agtggttgagtgtcgggcag

SEQ ID NO: 41794 - DNA, 20 bp, Artificial Sequence
  chemically synthesized
tagtggttgagtgtcgggca

SEQ ID NO: 41795 - DNA, 20 bp, Artificial Sequence
  chemically synthesized
tgtagtggttgagtgtcggg

SEQ ID NO: 41796 - DNA, 20 bp, Artificial Sequence
  chemically synthesized
tagtgtagtggttgagtgtc

SEQ ID NO: 41797 - DNA, 20 bp, Artificial Sequence
  chemically synthesized
ttagtgtagtggttgagtgt

SEQ ID NO: 41798 - DNA, 20 bp, Artificial Sequence
  chemically synthesized
agcttgttagtgtagtggtt

SEQ ID NO: 41799 - DNA, 20 bp, Artificial Sequence
  chemically synthesized
ttggaagcttgttagtgtag

SEQ ID NO: 41800 - DNA, 20 bp, Artificial Sequence
  chemically synthesized
cactcaaccactacactaac

SEQ ID NO: 41801 - DNA, 20 bp, Artificial Sequence
  chemically synthesized
tcattggaagcttgttagtg

SEQ ID NO: 41802 - DNA, 20 bp, Artificial Sequence
  chemically synthesized
tttcctcattggaagcttgt

SEQ ID NO: 41803 - DNA, 20 bp, Artificial Sequence
  chemically synthesized
tacactaacaagcttccaat

SEQ ID NO: 41804 - DNA, 20 bp, Artificial Sequence
  chemically synthesized
acactaacaagcttccaatg

SEQ ID NO: 41805 - DNA, 20 bp, Artificial Sequence
  chemically synthesized
taactttgtttcctcattgg

SEQ ID NO: 41806 - DNA, 20 bp, Artificial Sequence
  chemically synthesized
tggtaactttgtttcctcat

SEQ ID NO: 41807 - DNA, 20 bp, Artificial Sequence
  chemically synthesized
aagcttccaatgaggaaaca

SEQ ID NO: 41808 - DNA, 20 bp, Artificial Sequence
  chemically synthesized
caatgaggaaacaaagttac

SEQ ID NO: 41809 - DNA, 20 bp, Artificial Sequence
  chemically synthesized
atgaggaaacaaagttacca

SEQ ID NO: 41810 - DNA, 20 bp, Artificial Sequence
  chemically synthesized
tgaggaaacaaagttaccag

SEQ ID NO: 41811 - DNA, 20 bp, Artificial Sequence
  chemically synthesized
ccagagacttcaaattcctc

SEQ ID NO: 41812 - DNA, 20 bp, Artificial Sequence
  chemically synthesized
aaagttaccagaggaatttg

SEQ ID NO: 41813 - DNA, 20 bp, Artificial Sequence
  chemically synthesized
ccagaggaatttgaagtctc

SEQ ID NO: 41814 - DNA, 20 bp, Artificial Sequence
  chemically synthesized
gaggaatttgaagtctctgg

SEQ ID NO: 41815 - DNA, 20 bp, Artificial Sequence
  chemically synthesized
tgttgctgctgtggccacca

SEQ ID NO: 41816 - DNA, 20 bp, Artificial Sequence
  chemically synthesized
tttgaagtctctggtggcca

SEQ ID NO: 41817 - DNA, 20 bp, Artificial Sequence
  chemically synthesized
tttgttgctgctgtggccac

SEQ ID NO: 41818 - DNA, 20 bp, Artificial Sequence
  chemically synthesized
gaagtctctggtggccacag

SEQ ID NO: 41819 - DNA, 20 bp, Artificial Sequence
  chemically synthesized
gttgagttttgttgctgctg

SEQ ID NO: 41820 - DNA, 20 bp, Artificial Sequence
  chemically synthesized
ttgctttggttgtcattgtt

SEQ ID NO: 41821 - DNA, 20 bp, Artificial Sequence
  chemically synthesized
aaactcaacaatgacaacca

SEQ ID NO: 41822 - DNA, 20 bp, Artificial Sequence
  chemically synthesized
tttgatgttggtagttgctt

SEQ ID NO: 41823 - DNA, 20 bp, Artificial Sequence
  chemically synthesized
tgggctgtgtttgatgttgg

SEQ ID NO: 41824 - DNA, 20 bp, Artificial Sequence
  chemically synthesized
aattgggctgtgtttgatgt

SEQ ID NO: 41825 - DNA, 20 bp, Artificial Sequence
  chemically synthesized
gcaactaccaacatcaaaca

SEQ ID NO: 41826 - DNA, 20 bp, Artificial Sequence
  chemically synthesized
atcaaacacagcccaattcc

SEQ ID NO: 41827 - DNA, 20 bp, Artificial Sequence
  chemically synthesized
tcttaatctgactgggaatt

SEQ ID NO: 41828 - DNA, 20 bp, Artificial Sequence
  chemically synthesized
atcttaatctgactgggaat

SEQ ID NO: 41829 - DNA, 20 bp, Artificial Sequence
  chemically synthesized
aacacagcccaattcccagt

SEQ ID NO: 41830 - DNA, 20 bp, Artificial Sequence
  chemically synthesized
taatttatcttaatctgact

SEQ ID NO: 41831 - DNA, 20 bp, Artificial Sequence
  chemically synthesized
gtaatttatcttaatctgac

SEQ ID NO: 41832 - DNA, 20 bp, Artificial Sequence
  chemically synthesized
gcccaattcccagtcagatt

SEQ ID NO: 41833 - DNA, 20 bp, Artificial Sequence
  chemically synthesized
taagataaattaccatgtca

SEQ ID NO: 41834 - DNA, 20 bp, Artificial Sequence
  chemically synthesized
aagataaattaccatgtcaa

SEQ ID NO: 41835 - DNA, 20 bp, Artificial Sequence
  chemically synthesized
aggtaaataaacctttgaca

SEQ ID NO: 41836 - DNA, 20 bp, Artificial Sequence
  chemically synthesized
tgtcaaaggtttatttacct

SEQ ID NO: 41837 - DNA, 20 bp, Artificial Sequence
  chemically synthesized
agatagcgtaatagatactg

SEQ ID NO: 41838 - DNA, 20 bp, Artificial Sequence
  chemically synthesized
tagatagcgtaatagatact

SEQ ID NO: 41839 - DNA, 20 bp, Artificial Sequence
  chemically synthesized
aggcatcttagatagcgtaa

SEQ ID NO: 41840 - DNA, 20 bp, Artificial Sequence
  chemically synthesized
cagtatctattacgctatct

SEQ ID NO: 41841 - DNA, 20 bp, Artificial Sequence
  chemically synthesized
taaaagtcaggcatcttaga

SEQ ID NO: 41842 - DNA, 20 bp, Artificial Sequence
  chemically synthesized
ggggtaaaagtcaggcatct

SEQ ID NO: 41843 - DNA, 20 bp, Artificial Sequence
  chemically synthesized
gtatctcaggggtaaaagtc

SEQ ID NO: 41844 - DNA, 20 bp, Artificial Sequence
  chemically synthesized
tgtatctcaggggtaaaagt

SEQ ID NO: 41845 - DNA, 20 bp, Artificial Sequence
  chemically synthesized
gctttgtatctcaggggtaa

SEQ ID NO: 41846 - DNA, 20 bp, Artificial Sequence
  chemically synthesized
gatgcctgacttttacccct

SEQ ID NO: 41847 - DNA, 20 bp, Artificial Sequence
  chemically synthesized
aggcatgctttgtatctcag

SEQ ID NO: 41848 - DNA, 20 bp, Artificial Sequence
  chemically synthesized
taggcatgctttgtatctca

SEQ ID NO: 41849 - DNA, 20 bp, Artificial Sequence
  chemically synthesized
ttaggcatgctttgtatctc

SEQ ID NO: 41850 - DNA, 20 bp, Artificial Sequence
  chemically synthesized
acttttacccctgagataca

SEQ ID NO: 41851 - DNA, 20 bp, Artificial Sequence
  chemically synthesized
cttaggcatgctttgtatct

SEQ ID NO: 41852 - DNA, 20 bp, Artificial Sequence
  chemically synthesized
ctgagatacaaagcatgcct

SEQ ID NO: 41853 - DNA, 20 bp, Artificial Sequence
  chemically synthesized
gatacaaagcatgcctaagc

SEQ ID NO: 41854 - DNA, 20 bp, Artificial Sequence
  chemically synthesized
gactgtgatttttcttgctt

SEQ ID NO: 41855 - DNA, 20 bp, Artificial Sequence
  chemically synthesized
agactgtgatttttcttgct

SEQ ID NO: 41856 - DNA, 20 bp, Artificial Sequence
  chemically synthesized
tgcctaagcaagaaaaatca

SEQ ID NO: 41857 - DNA, 20 bp, Artificial Sequence
  chemically synthesized
agcaagaaaaatcacagtct

SEQ ID NO: 41858 - DNA, 20 bp, Artificial Sequence
  chemically synthesized
gcaagaaaaatcacagtcta

SEQ ID NO: 41859 - DNA, 20 bp, Artificial Sequence
  chemically synthesized
aagaaaaatcacagtctaag

SEQ ID NO: 41860 - DNA, 20 bp, Artificial Sequence
  chemically synthesized
tgattcttgctttgtctcct

SEQ ID NO: 41861 - DNA, 20 bp, Artificial Sequence
  chemically synthesized
aatcacagtctaaggagaca

SEQ ID NO: 41862 - DNA, 20 bp, Artificial Sequence
  chemically synthesized
acagtctaaggagacaaagc

SEQ ID NO: 41863 - DNA, 20 bp, Artificial Sequence
  chemically synthesized
taaggagacaaagcaagaat

SEQ ID NO: 41864 - DNA, 20 bp, Artificial Sequence
  chemically synthesized
gacaaagcaagaatcagaac

SEQ ID NO: 41865 - DNA, 20 bp, Artificial Sequence
  chemically synthesized
gcaagaatcagaaccagact

SEQ ID NO: 41866 - DNA, 20 bp, Artificial Sequence
  chemically synthesized
aactgttacatatctaagtc

SEQ ID NO: 41867 - DNA, 20 bp, Artificial Sequence
  chemically synthesized
ccaacaactgttacatatct

SEQ ID NO: 41868 - DNA, 20 bp, Artificial Sequence
  chemically synthesized
aaccagacttagatatgtaa

SEQ ID NO: 41869 - DNA, 20 bp, Artificial Sequence
  chemically synthesized
cttagatatgtaacagttgt

SEQ ID NO: 41870 - DNA, 20 bp, Artificial Sequence
  chemically synthesized
gtaacagttgttggaactat

SEQ ID NO: 41871 - DNA, 20 bp, Artificial Sequence
  chemically synthesized
cagttgttggaactatcaga

SEQ ID NO: 41872 - DNA, 20 bp, Artificial Sequence
  chemically synthesized
agttgttggaactatcagac

SEQ ID NO: 41873 - DNA, 20 bp, Artificial Sequence
  chemically synthesized
attttaaatttcctgtctga

SEQ ID NO: 41874 - DNA, 20 bp, Artificial Sequence
  chemically synthesized
agtctttaaaatattaatta

SEQ ID NO: 41875 - DNA, 20 bp, Artificial Sequence
  chemically synthesized
taaccataattaatatttta

SEQ ID NO: 41876 - DNA, 20 bp, Artificial Sequence
  chemically synthesized
ttaatattttaaagactctt

SEQ ID NO: 41877 - DNA, 20 bp, Artificial Sequence
  chemically synthesized
taatattttaaagactcttg

SEQ ID NO: 41878 - DNA, 20 bp, Artificial Sequence
  chemically synthesized
aatattttaaagactcttga

SEQ ID NO: 41879 - DNA, 20 bp, Artificial Sequence
  chemically synthesized
ttgtctttcttttccctcaa

SEQ ID NO: 41880 - DNA, 20 bp, Artificial Sequence
  chemically synthesized
tttaaagactcttgagggaa

SEQ ID NO: 41881 - DNA, 20 bp, Artificial Sequence
  chemically synthesized
tattgtctttcttttccctc

SEQ ID NO: 41882 - DNA, 20 bp, Artificial Sequence
  chemically synthesized
aagactcttgagggaaaaga

SEQ ID NO: 41883 - DNA, 20 bp, Artificial Sequence
  chemically synthesized
ggaaaagaaagacaatatgc

SEQ ID NO: 41884 - DNA, 20 bp, Artificial Sequence
  chemically synthesized
agaaagacaatatgcaagat

SEQ ID NO: 41885 - DNA, 20 bp, Artificial Sequence
  chemically synthesized
agacaatatgcaagattaga

SEQ ID NO: 41886 - DNA, 20 bp, Artificial Sequence
  chemically synthesized
agattagatagaaaatatgt

SEQ ID NO: 41887 - DNA, 20 bp, Artificial Sequence
  chemically synthesized
agatagaaaatatgtaagat

SEQ ID NO: 41888 - DNA, 20 bp, Artificial Sequence
  chemically synthesized
tagaaaatatgtaagattag

SEQ ID NO: 41889 - DNA, 20 bp, Artificial Sequence
  chemically synthesized
aagattagaagacaatatgc

SEQ ID NO: 41890 - DNA, 20 bp, Artificial Sequence
  chemically synthesized
tagaagacaatatgcaagat

SEQ ID NO: 41891 - DNA, 20 bp, Artificial Sequence
  chemically synthesized
ttagatttgattcactctta

SEQ ID NO: 41892 - DNA, 20 bp, Artificial Sequence
  chemically synthesized
tatagagctggaaactataa

SEQ ID NO: 41893 - DNA, 20 bp, Artificial Sequence
  chemically synthesized
aatatagagctggaaactat

SEQ ID NO: 41894 - DNA, 20 bp, Artificial Sequence
  chemically synthesized
tgattcactcttatagtttc

SEQ ID NO: 41895 - DNA, 20 bp, Artificial Sequence
  chemically synthesized
aatatactgaaatatagagc

SEQ ID NO: 41896 - DNA, 20 bp, Artificial Sequence
  chemically synthesized
tagtttccagctctatattt

SEQ ID NO: 41897 - DNA, 20 bp, Artificial Sequence
  chemically synthesized
ctgaaatatactgaaatata

SEQ ID NO: 41898 - DNA, 20 bp, Artificial Sequence
  chemically synthesized
tactgaaatatactgaaata

SEQ ID NO: 41899 - DNA, 20 bp, Artificial Sequence
  chemically synthesized
ctctatatttcagtatattt

SEQ ID NO: 41900 - DNA, 20 bp, Artificial Sequence
  chemically synthesized
tatttcagtatatttcagta

SEQ ID NO: 41901 - DNA, 20 bp, Artificial Sequence
  chemically synthesized
tttcagtatatttcagtata

SEQ ID NO: 41902 - DNA, 20 bp, Artificial Sequence
  chemically synthesized
agtatatttcagtatagagc

SEQ ID NO: 41903 - DNA, 20 bp, Artificial Sequence
  chemically synthesized
tttgattcacttatagtttc

SEQ ID NO: 41904 - DNA, 20 bp, Artificial Sequence
  chemically synthesized
agtatagagctggaaactat

SEQ ID NO: 41905 - DNA, 20 bp, Artificial Sequence
  chemically synthesized
atttccatttgattcactta

SEQ ID NO: 41906 - DNA, 20 bp, Artificial Sequence
  chemically synthesized
gaaactataagtgaatcaaa

SEQ ID NO: 41907 - DNA, 20 bp, Artificial Sequence
  chemically synthesized
agtgaatcaaatggaaatgc

SEQ ID NO: 41908 - DNA, 20 bp, Artificial Sequence
  chemically synthesized
ctgttactgcttttaatttc

SEQ ID NO: 41909 - DNA, 20 bp, Artificial Sequence
  chemically synthesized
atggaaatgctagaaattaa

SEQ ID NO: 41910 - DNA, 20 bp, Artificial Sequence
  chemically synthesized
gaaatgctagaaattaaaag

SEQ ID NO: 41911 - DNA, 20 bp, Artificial Sequence
  chemically synthesized
ctagaaattaaaagcagtaa

SEQ ID NO: 41912 - DNA, 20 bp, Artificial Sequence
  chemically synthesized
aattaaaagcagtaacagaa

SEQ ID NO: 41913 - DNA, 20 bp, Artificial Sequence
  chemically synthesized
aacagaaaagaaaaatacct

SEQ ID NO: 41914 - DNA, 20 bp, Artificial Sequence
  chemically synthesized
gaaaagaaaaataccttaga

SEQ ID NO: 41915 - DNA, 20 bp, Artificial Sequence
  chemically synthesized
aaaagaaaaataccttagat

SEQ ID NO: 41916 - DNA, 20 bp, Artificial Sequence
  chemically synthesized
tctacagatgagcccatcta

SEQ ID NO: 41917 - DNA, 20 bp, Artificial Sequence
  chemically synthesized
atctacagatgagcccatct

SEQ ID NO: 41918 - DNA, 20 bp, Artificial Sequence
  chemically synthesized
accttagatgggctcatctg

SEQ ID NO: 41919 - DNA, 20 bp, Artificial Sequence
  chemically synthesized
tctttgttgaatctacagat

SEQ ID NO: 41920 - DNA, 20 bp, Artificial Sequence
  chemically synthesized
ccttgtctttgttgaatcta

SEQ ID NO: 41921 - DNA, 20 bp, Artificial Sequence
  chemically synthesized
gctcatctgtagattcaaca

SEQ ID NO: 41922 - DNA, 20 bp, Artificial Sequence
  chemically synthesized
tctgtagattcaacaaagac

SEQ ID NO: 41923 - DNA, 20 bp, Artificial Sequence
  chemically synthesized
ctgtagattcaacaaagaca

SEQ ID NO: 41924 - DNA, 20 bp, Artificial Sequence
  chemically synthesized
agattcaacaaagacaagga

SEQ ID NO: 41925 - DNA, 20 bp, Artificial Sequence
  chemically synthesized
aacaaagacaaggaaagaac

SEQ ID NO: 41926 - DNA, 20 bp, Artificial Sequence
  chemically synthesized
taccctatattcaagttcac

SEQ ID NO: 41927 - DNA, 20 bp, Artificial Sequence
  chemically synthesized
agaaccagtgaacttgaata

SEQ ID NO: 41928 - DNA, 20 bp, Artificial Sequence
  chemically synthesized
gaaccagtgaacttgaatat

SEQ ID NO: 41929 - DNA, 20 bp, Artificial Sequence
  chemically synthesized
aaccagtgaacttgaatata

SEQ ID NO: 41930 - DNA, 20 bp, Artificial Sequence
  chemically synthesized
atttctgttaccctatattc

SEQ ID NO: 41931 - DNA, 20 bp, Artificial Sequence
  chemically synthesized
tgaacttgaatatagggtaa

SEQ ID NO: 41932 - DNA, 20 bp, Artificial Sequence
  chemically synthesized
cagaaattatacaaactgaa

SEQ ID NO: 41933 - DNA, 20 bp, Artificial Sequence
  chemically synthesized
aaattatacaaactgaaaag

SEQ ID NO: 41934 - DNA, 20 bp, Artificial Sequence
  chemically synthesized
aattatacaaactgaaaagc

SEQ ID NO: 41935 - DNA, 20 bp, Artificial Sequence
  chemically synthesized
attatacaaactgaaaagca

SEQ ID NO: 41936 - DNA, 20 bp, Artificial Sequence
  chemically synthesized
ttacttttccccctgctttt

SEQ ID NO: 41937 - DNA, 20 bp, Artificial Sequence
  chemically synthesized
ttatacaaactgaaaagcag

SEQ ID NO: 41938 - DNA, 20 bp, Artificial Sequence
  chemically synthesized
tatacaaactgaaaagcagg

SEQ ID NO: 41939 - DNA, 20 bp, Artificial Sequence
  chemically synthesized
aaactgaaaagcagggggaa

SEQ ID NO: 41940 - DNA, 20 bp, Artificial Sequence
  chemically synthesized
atgcaattgcaatacaaaca

SEQ ID NO: 41941 - DNA, 20 bp, Artificial Sequence
  chemically synthesized
caattgcaatacaaacacag

SEQ ID NO: 41942 - DNA, 20 bp, Artificial Sequence
  chemically synthesized
aattgcaatacaaacacagt

SEQ ID NO: 41943 - DNA, 20 bp, Artificial Sequence
  chemically synthesized
atacaaacacagtaggtttt

SEQ ID NO: 41944 - DNA, 20 bp, Artificial Sequence
  chemically synthesized
cacagtaggttttcagtatt

SEQ ID NO: 41945 - DNA, 20 bp, Artificial Sequence
  chemically synthesized
agtaggttttcagtattaag

SEQ ID NO: 41946 - DNA, 20 bp, Artificial Sequence
  chemically synthesized
gtaggttttcagtattaagt

SEQ ID NO: 41947 - DNA, 20 bp, Artificial Sequence
  chemically synthesized
taggttttcagtattaagta

SEQ ID NO: 41948 - DNA, 20 bp, Artificial Sequence
  chemically synthesized
ttcagtattaagtagggctc

SEQ ID NO: 41949 - DNA, 20 bp, Artificial Sequence
  chemically synthesized
tcagtattaagtagggctct

SEQ ID NO: 41950 - DNA, 20 bp, Artificial Sequence
  chemically synthesized
ttaagtagggctctaggaaa

SEQ ID NO: 41951 - DNA, 20 bp, Artificial Sequence
  chemically synthesized
tgaaaaatagctgtttccta

SEQ ID NO: 41952 - DNA, 20 bp, Artificial Sequence
  chemically synthesized
tctgaaaaatagctgtttcc

SEQ ID NO: 41953 - DNA, 20 bp, Artificial Sequence
  chemically synthesized
tctaggaaacagctattttt

SEQ ID NO: 41954 - DNA, 20 bp, Artificial Sequence
  chemically synthesized
ctgttacttaatctgaaaaa

SEQ ID NO: 41955 - DNA, 20 bp, Artificial Sequence
  chemically synthesized
aaacagctatttttcagatt

SEQ ID NO: 41956 - DNA, 20 bp, Artificial Sequence
  chemically synthesized
ctatttttcagattaagtaa

SEQ ID NO: 41957 - DNA, 20 bp, Artificial Sequence
  chemically synthesized
tttcagattaagtaacagtt

SEQ ID NO: 41958 - DNA, 20 bp, Artificial Sequence
  chemically synthesized
ttggtgcaattatgctgatc

SEQ ID NO: 41959 - DNA, 20 bp, Artificial Sequence
  chemically synthesized
tatagttctttatgcttgat

SEQ ID NO: 41960 - DNA, 20 bp, Artificial Sequence
  chemically synthesized
aattatgctgatcaagcata

SEQ ID NO: 41961 - DNA, 20 bp, Artificial Sequence
  chemically synthesized
gcataaagaactataaatta

SEQ ID NO: 41962 - DNA, 20 bp, Artificial Sequence
  chemically synthesized
tgagtgaagtctttaattta

SEQ ID NO: 41963 - DNA, 20 bp, Artificial Sequence
  chemically synthesized
taaattaaagacttcactca

SEQ ID NO: 41964 - DNA, 20 bp, Artificial Sequence
  chemically synthesized
tcagaggtcttctttgagtg

SEQ ID NO: 41965 - DNA, 20 bp, Artificial Sequence
  chemically synthesized
attaaagacttcactcaaag

SEQ ID NO: 41966 - DNA, 20 bp, Artificial Sequence
  chemically synthesized
gcttgtcagaggtcttcttt

SEQ ID NO: 41967 - DNA, 20 bp, Artificial Sequence
  chemically synthesized
actcaaagaagacctctgac

SEQ ID NO: 41968 - DNA, 20 bp, Artificial Sequence
  chemically synthesized
gcaacttggttgcttgtcag

SEQ ID NO: 41969 - DNA, 20 bp, Artificial Sequence
  chemically synthesized
agcaacttggttgcttgtca

SEQ ID NO: 41970 - DNA, 20 bp, Artificial Sequence
  chemically synthesized
gtagcaacttggttgcttgt

SEQ ID NO: 41971 - DNA, 20 bp, Artificial Sequence
  chemically synthesized
aagacctctgacaagcaacc

SEQ ID NO: 41972 - DNA, 20 bp, Artificial Sequence
  chemically synthesized
ttaaatactttgtagcaact

SEQ ID NO: 41973 - DNA, 20 bp, Artificial Sequence
  chemically synthesized
caagcaaccaagttgctaca

SEQ ID NO: 41974 - DNA, 20 bp, Artificial Sequence
  chemically synthesized
ctagctttttaaatactttg

SEQ ID NO: 41975 - DNA, 20 bp, Artificial Sequence
  chemically synthesized
gttgctacaaagtatttaaa

SEQ ID NO: 41976 - DNA, 20 bp, Artificial Sequence
  chemically synthesized
ctacaaagtatttaaaaagc

SEQ ID NO: 41977 - DNA, 20 bp, Artificial Sequence
  chemically synthesized
gtaaacaactggttggtcac

SEQ ID NO: 41978 - DNA, 20 bp, Artificial Sequence
  chemically synthesized
ttaaaaagctagtgaccaac

SEQ ID NO: 41979 - DNA, 20 bp, Artificial Sequence
  chemically synthesized
tatcactgtaaacaactggt

SEQ ID NO: 41980 - DNA, 20 bp, Artificial Sequence
  chemically synthesized
aatatatcactgtaaacaac

SEQ ID NO: 41981 - DNA, 20 bp, Artificial Sequence
  chemically synthesized
agtgaccaaccagttgttta

SEQ ID NO: 41982 - DNA, 20 bp, Artificial Sequence
  chemically synthesized
atattttgcaatatttgatt

SEQ ID NO: 41983 - DNA, 20 bp, Artificial Sequence
  chemically synthesized
tgcaatatttgatttagatt

SEQ ID NO: 41984 - DNA, 20 bp, Artificial Sequence
  chemically synthesized
caatatttgatttagattaa

SEQ ID NO: 41985 - DNA, 20 bp, Artificial Sequence
  chemically synthesized
ttgatttagattaagagttc

SEQ ID NO: 41986 - DNA, 20 bp, Artificial Sequence
  chemically synthesized
tgatttagattaagagttct

SEQ ID NO: 41987 - DNA, 20 bp, Artificial Sequence
  chemically synthesized
gtggatctttttgtatttcc

SEQ ID NO: 41988 - DNA, 20 bp, Artificial Sequence
  chemically synthesized
agagttctaggaaatacaaa

SEQ ID NO: 41989 - DNA, 20 bp, Artificial Sequence
  chemically synthesized
aggaaatacaaaaagatcca

SEQ ID NO: 41990 - DNA, 20 bp, Artificial Sequence
  chemically synthesized
acatttgtttttttgtactg

SEQ ID NO: 41991 - DNA, 20 bp, Artificial Sequence
  chemically synthesized
tgttaattctgagcattaga

SEQ ID NO: 41992 - DNA, 20 bp, Artificial Sequence
  chemically synthesized
atgttaattctgagcattag

SEQ ID NO: 41993 - DNA, 20 bp, Artificial Sequence
  chemically synthesized
aatgtgttccttctaatgct

SEQ ID NO: 41994 - DNA, 20 bp, Artificial Sequence
  chemically synthesized
aaaatgttaattctgagcat

SEQ ID NO: 41995 - DNA, 20 bp, Artificial Sequence
  chemically synthesized
aaagataaaatgttaattct

SEQ ID NO: 41996 - DNA, 20 bp, Artificial Sequence
  chemically synthesized
taacattttatctttgctca

SEQ ID NO: 41997 - DNA, 20 bp, Artificial Sequence
  chemically synthesized
ttcaaaagaagctttgagca

SEQ ID NO: 41998 - DNA, 20 bp, Artificial Sequence
  chemically synthesized
tttatttcaaaagaagcttt

SEQ ID NO: 41999 - DNA, 20 bp, Artificial Sequence
  chemically synthesized
ggtgtattttatttcaaaag

SEQ ID NO: 42000 - DNA, 20 bp, Artificial Sequence
  chemically synthesized
aatggtgtattttatttcaa

SEQ ID NO: 42001 - DNA, 20 bp, Artificial Sequence
  chemically synthesized
tgaaataaaatacaccattc

SEQ ID NO: 42002 - DNA, 20 bp, Artificial Sequence
  chemically synthesized
gatcggaatttcatcttgaa

SEQ ID NO: 42003 - DNA, 20 bp, Artificial Sequence
  chemically synthesized
gagggggcatcagagaggat

SEQ ID NO: 42004 - DNA, 20 bp, Artificial Sequence
  chemically synthesized
tgggagagggggcatcagag

SEQ ID NO: 42005 - DNA, 20 bp, Artificial Sequence
  chemically synthesized
atgggagagggggcatcaga

SEQ ID NO: 42006 - DNA, 20 bp, Artificial Sequence
  chemically synthesized
gtatgggagagggggcatca

SEQ ID NO: 42007 - DNA, 20 bp, Artificial Sequence
  chemically synthesized
tagtatgggagagggggcat

SEQ ID NO: 42008 - DNA, 20 bp, Artificial Sequence
  chemically synthesized
tagttgtagtatgggagagg

SEQ ID NO: 42009 - DNA, 20 bp, Artificial Sequence
  chemically synthesized
ctagttgtagtatgggagag

SEQ ID NO: 42010 - DNA, 20 bp, Artificial Sequence
  chemically synthesized
actagttgtagtatgggaga

SEQ ID NO: 42011 - DNA, 20 bp, Artificial Sequence
  chemically synthesized
tactagttgtagtatgggag

SEQ ID NO: 42012 - DNA, 20 bp, Artificial Sequence
  chemically synthesized
atactagttgtagtatggga

SEQ ID NO: 42013 - DNA, 20 bp, Artificial Sequence
  chemically synthesized
tgatactagttgtagtatgg

SEQ ID NO: 42014 - DNA, 20 bp, Artificial Sequence
  chemically synthesized
tatgatactagttgtagtat

SEQ ID NO: 42015 - DNA, 20 bp, Artificial Sequence
  chemically synthesized
ttatgatactagttgtagta

SEQ ID NO: 42016 - DNA, 20 bp, Artificial Sequence
  chemically synthesized
cccctctcccatactacaac

SEQ ID NO: 42017 - DNA, 20 bp, Artificial Sequence
  chemically synthesized
caaagttatgatactagttg

SEQ ID NO: 42018 - DNA, 20 bp, Artificial Sequence
  chemically synthesized
aaacaccaaagttatgatac

SEQ ID NO: 42019 - DNA, 20 bp, Artificial Sequence
  chemically synthesized
tacaactagtatcataactt

SEQ ID NO: 42020 - DNA, 20 bp, Artificial Sequence
  chemically synthesized
gcctggaaagataaacacca

SEQ ID NO: 42021 - DNA, 20 bp, Artificial Sequence
  chemically synthesized
aactttggtgtttatctttc

SEQ ID NO: 42022 - DNA, 20 bp, Artificial Sequence
  chemically synthesized
actttggtgtttatctttcc

SEQ ID NO: 42023 - DNA, 20 bp, Artificial Sequence
  chemically synthesized
attaaaatgaaaagcctgga

SEQ ID NO: 42024 - DNA, 20 bp, Artificial Sequence
  chemically synthesized
ttaaattaaaatgaaaagcc

SEQ ID NO: 42025 - DNA, 20 bp, Artificial Sequence
  chemically synthesized
aaaaattaaattaaaatgaa

SEQ ID NO: 42026 - DNA, 20 bp, Artificial Sequence
  chemically synthesized
ttaatttaatttttaaaaat

SEQ ID NO: 42027 - DNA, 20 bp, Artificial Sequence
  chemically synthesized
gtgcaatactaaaaataaaa

SEQ ID NO: 42028 - DNA, 20 bp, Artificial Sequence
  chemically synthesized
aaattagtcttttttatttt

SEQ ID NO: 42029 - DNA, 20 bp, Artificial Sequence
  chemically synthesized
tgttttgctttttgaagtac

SEQ ID NO: 42030 - DNA, 20 bp, Artificial Sequence
  chemically synthesized
gtgttttgctttttgaagta

SEQ ID NO: 42031 - DNA, 20 bp, Artificial Sequence
  chemically synthesized
tattgcacctgtacttcaaa

SEQ ID NO: 42032 - DNA, 20 bp, Artificial Sequence
  chemically synthesized
ttaaagtgttttgctttttg

SEQ ID NO: 42033 - DNA, 20 bp, Artificial Sequence
  chemically synthesized
aaaaagcaaaacactttaaa

SEQ ID NO: 42034 - DNA, 20 bp, Artificial Sequence
  chemically synthesized
ttctggaaggtcacttttta

SEQ ID NO: 42035 - DNA, 20 bp, Artificial Sequence
  chemically synthesized
cactttaaaaagtgaccttc

SEQ ID NO: 42036 - DNA, 20 bp, Artificial Sequence
  chemically synthesized
ttctgatgctaaattctgga

SEQ ID NO: 42037 - DNA, 20 bp, Artificial Sequence
  chemically synthesized
attctgatgctaaattctgg

SEQ ID NO: 42038 - DNA, 20 bp, Artificial Sequence
  chemically synthesized
aaaagtgaccttccagaatt

SEQ ID NO: 42039 - DNA, 20 bp, Artificial Sequence
  chemically synthesized
gagattctgatgctaaattc

SEQ ID NO: 42040 - DNA, 20 bp, Artificial Sequence
  chemically synthesized
gaccttccagaatttagcat

SEQ ID NO: 42041 - DNA, 20 bp, Artificial Sequence
  chemically synthesized
ctgaaaccatgagtgtgaat

SEQ ID NO: 42042 - DNA, 20 bp, Artificial Sequence
  chemically synthesized
cagaatctcattcacactca

SEQ ID NO: 42043 - DNA, 20 bp, Artificial Sequence
  chemically synthesized
ctcattcacactcatggttt

SEQ ID NO: 42044 - DNA, 20 bp, Artificial Sequence
  chemically synthesized
tagctagtaactgaaaccat

SEQ ID NO: 42045 - DNA, 20 bp, Artificial Sequence
  chemically synthesized
acactcatggtttcagttac

SEQ ID NO: 42046 - DNA, 20 bp, Artificial Sequence
  chemically synthesized
acatattacttgtatatagc

SEQ ID NO: 42047 - DNA, 20 bp, Artificial Sequence
  chemically synthesized
ttcagttactagctatatac

SEQ ID NO: 42048 - DNA, 20 bp, Artificial Sequence
  chemically synthesized
atttacatattacttgtata

SEQ ID NO: 42049 - DNA, 20 bp, Artificial Sequence
  chemically synthesized
tatacaagtaatatgtaaat

SEQ ID NO: 42050 - DNA, 20 bp, Artificial Sequence
  chemically synthesized
gtaaattagtgactccaacc

SEQ ID NO: 42051 - DNA, 20 bp, Artificial Sequence
  chemically synthesized
aaggaggcgcatctgggttg

SEQ ID NO: 42052 - DNA, 20 bp, Artificial Sequence
  chemically synthesized
agaaggaggcgcatctgggt

SEQ ID NO: 42053 - DNA, 20 bp, Artificial Sequence
  chemically synthesized
agaaagaaggaggcgcatct

SEQ ID NO: 42054 - DNA, 20 bp, Artificial Sequence
  chemically synthesized
aagaaagaaggaggcgcatc

SEQ ID NO: 42055 - DNA, 20 bp, Artificial Sequence
  chemically synthesized
gtgcacctaaagaaagaagg

SEQ ID NO: 42056 - DNA, 20 bp, Artificial Sequence
  chemically synthesized
tgtgcacctaaagaaagaag

SEQ ID NO: 42057 - DNA, 20 bp, Artificial Sequence
  chemically synthesized
agtgtgcacctaaagaaaga

SEQ ID NO: 42058 - DNA, 20 bp, Artificial Sequence
  chemically synthesized
gatgcgcctccttctttctt

SEQ ID NO: 42059 - DNA, 20 bp, Artificial Sequence
  chemically synthesized
tagtgtgcacctaaagaaag

SEQ ID NO: 42060 - DNA, 20 bp, Artificial Sequence
  chemically synthesized
atgcgcctccttctttcttt

SEQ ID NO: 42061 - DNA, 20 bp, Artificial Sequence
  chemically synthesized
agatagtgtgcacctaaaga

SEQ ID NO: 42062 - DNA, 20 bp, Artificial Sequence
  chemically synthesized
agacagatagtgtgcaccta

SEQ ID NO: 42063 - DNA, 20 bp, Artificial Sequence
  chemically synthesized
aagcactgtaaatagacaga

SEQ ID NO: 42064 - DNA, 20 bp, Artificial Sequence
  chemically synthesized
caaaaagcactgtaaataga

SEQ ID NO: 42065 - DNA, 20 bp, Artificial Sequence
  chemically synthesized
gcacactatctgtctattta

SEQ ID NO: 42066 - DNA, 20 bp, Artificial Sequence
  chemically synthesized
catccaaaaagcactgtaaa

SEQ ID NO: 42067 - DNA, 20 bp, Artificial Sequence
  chemically synthesized
tgtctatttacagtgctttt

SEQ ID NO: 42068 - DNA, 20 bp, Artificial Sequence
  chemically synthesized
aatgattggtgacatccaaa

SEQ ID NO: 42069 - DNA, 20 bp, Artificial Sequence
  chemically synthesized
atgtttggatttcaaatgat

SEQ ID NO: 42070 - DNA, 20 bp, Artificial Sequence
  chemically synthesized
gcaatttgattgtaaatgtt

SEQ ID NO: 42071 - DNA, 20 bp, Artificial Sequence
  chemically synthesized
aagaaagatcagatttaggg

SEQ ID NO: 42072 - DNA, 20 bp, Artificial Sequence
  chemically synthesized
ctaaagaaagatcagattta

SEQ ID NO: 42073 - DNA, 20 bp, Artificial Sequence
  chemically synthesized
tctaaagaaagatcagattt

SEQ ID NO: 42074 - DNA, 20 bp, Artificial Sequence
  chemically synthesized
ctctaaagaaagatcagatt

SEQ ID NO: 42075 - DNA, 20 bp, Artificial Sequence
  chemically synthesized
agggaactctaaagaaagat

SEQ ID NO: 42076 - DNA, 20 bp, Artificial Sequence
  chemically synthesized
ccctaaatctgatctttctt

SEQ ID NO: 42077 - DNA, 20 bp, Artificial Sequence
  chemically synthesized
ctaaatctgatctttcttta

SEQ ID NO: 42078 - DNA, 20 bp, Artificial Sequence
  chemically synthesized
gagttagggaactctaaaga

SEQ ID NO: 42079 - DNA, 20 bp, Artificial Sequence
  chemically synthesized
cagtgagttagggaactcta

SEQ ID NO: 42080 - DNA, 20 bp, Artificial Sequence
  chemically synthesized
taattctttacagtgagtta

SEQ ID NO: 42081 - DNA, 20 bp, Artificial Sequence
  chemically synthesized
gtaattctttacagtgagtt

SEQ ID NO: 42082 - DNA, 20 bp, Artificial Sequence
  chemically synthesized
ggtaattctttacagtgagt

SEQ ID NO: 42083 - DNA, 20 bp, Artificial Sequence
  chemically synthesized
gagttccctaactcactgta

SEQ ID NO: 42084 - DNA, 20 bp, Artificial Sequence
  chemically synthesized
agttggtaattctttacagt

SEQ ID NO: 42085 - DNA, 20 bp, Artificial Sequence
  chemically synthesized
gcacagttggtaattcttta

SEQ ID NO: 42086 - DNA, 20 bp, Artificial Sequence
  chemically synthesized
atttctgggcaatgcacagt

SEQ ID NO: 42087 - DNA, 20 bp, Artificial Sequence
  chemically synthesized
ctagatttctgggcaatgca

SEQ ID NO: 42088 - DNA, 20 bp, Artificial Sequence
  chemically synthesized
attaccaactgtgcattgcc

SEQ ID NO: 42089 - DNA, 20 bp, Artificial Sequence
  chemically synthesized
ctgtgcattgcccagaaatc

SEQ ID NO: 42090 - DNA, 20 bp, Artificial Sequence
  chemically synthesized
ggaatcacacctagatttct

SEQ ID NO: 42091 - DNA, 20 bp, Artificial Sequence
  chemically synthesized
tgtgcattgcccagaaatct

SEQ ID NO: 42092 - DNA, 20 bp, Artificial Sequence
  chemically synthesized
aggaatcacacctagatttc

SEQ ID NO: 42093 - DNA, 20 bp, Artificial Sequence
  chemically synthesized
acatgtcaaggaatcacacc

SEQ ID NO: 42094 - DNA, 20 bp, Artificial Sequence
  chemically synthesized
agagaaagcaaaacatgtca

SEQ ID NO: 42095 - DNA, 20 bp, Artificial Sequence
  chemically synthesized
aagagaaagcaaaacatgtc

SEQ ID NO: 42096 - DNA, 20 bp, Artificial Sequence
  chemically synthesized
ggaggaagggcgcaaagaga

SEQ ID NO: 42097 - DNA, 20 bp, Artificial Sequence
  chemically synthesized
cataggaggaagggcgcaaa

SEQ ID NO: 42098 - DNA, 20 bp, Artificial Sequence
  chemically synthesized
atcataggaggaagggcgca

SEQ ID NO: 42099 - DNA, 20 bp, Artificial Sequence
  chemically synthesized
gatagatatcataggaggaa

SEQ ID NO: 42100 - DNA, 20 bp, Artificial Sequence
  chemically synthesized
ggatagatatcataggagga

SEQ ID NO: 42101 - DNA, 20 bp, Artificial Sequence
  chemically synthesized
aggatagatatcataggagg

SEQ ID NO: 42102 - DNA, 20 bp, Artificial Sequence
  chemically synthesized
ttgaggatagatatcatagg

SEQ ID NO: 42103 - DNA, 20 bp, Artificial Sequence
  chemically synthesized
tttgaggatagatatcatag

SEQ ID NO: 42104 - DNA, 20 bp, Artificial Sequence
  chemically synthesized
gatttgaggatagatatcat

SEQ ID NO: 42105 - DNA, 20 bp, Artificial Sequence
  chemically synthesized
agatttgaggatagatatca

SEQ ID NO: 42106 - DNA, 20 bp, Artificial Sequence
  chemically synthesized
aaatccttaagatttgagga

SEQ ID NO: 42107 - DNA, 20 bp, Artificial Sequence
  chemically synthesized
gtaaaaatccttaagatttg

SEQ ID NO: 42108 - DNA, 20 bp, Artificial Sequence
  chemically synthesized
gatatctatcctcaaatctt

SEQ ID NO: 42109 - DNA, 20 bp, Artificial Sequence
  chemically synthesized
ggtaaaaatccttaagattt

SEQ ID NO: 42110 - DNA, 20 bp, Artificial Sequence
  chemically synthesized
atatctatcctcaaatctta

SEQ ID NO: 42111 - DNA, 20 bp, Artificial Sequence
  chemically synthesized
tttaggaggtaaaaatcctt

SEQ ID NO: 42112 - DNA, 20 bp, Artificial Sequence
  chemically synthesized
agatttgagagatttttagg

SEQ ID NO: 42113 - DNA, 20 bp, Artificial Sequence
  chemically synthesized
tagatttgagagatttttag

SEQ ID NO: 42114 - DNA, 20 bp, Artificial Sequence
  chemically synthesized
catagatttgagagattttt

SEQ ID NO: 42115 - DNA, 20 bp, Artificial Sequence
  chemically synthesized
gcatagatttgagagatttt

SEQ ID NO: 42116 - DNA, 20 bp, Artificial Sequence
  chemically synthesized
tgagaaaggcatagatttga

SEQ ID NO: 42117 - DNA, 20 bp, Artificial Sequence
  chemically synthesized
ggtgagaaaggcatagattt

SEQ ID NO: 42118 - DNA, 20 bp, Artificial Sequence
  chemically synthesized
tggatatggtgagaaaggca

SEQ ID NO: 42119 - DNA, 20 bp, Artificial Sequence
  chemically synthesized
tagtttggatatggtgagaa

SEQ ID NO: 42120 - DNA, 20 bp, Artificial Sequence
  chemically synthesized
atagtttggatatggtgaga

SEQ ID NO: 42121 - DNA, 20 bp, Artificial Sequence
  chemically synthesized
gatgatagtttggatatggt

SEQ ID NO: 42122 - DNA, 20 bp, Artificial Sequence
  chemically synthesized
agatgatgatagtttggata

SEQ ID NO: 42123 - DNA, 20 bp, Artificial Sequence
  chemically synthesized
ggaccaagatgatgatagtt

SEQ ID NO: 42124 - DNA, 20 bp, Artificial Sequence
  chemically synthesized
gatttggaccaagatgatga

SEQ ID NO: 42125 - DNA, 20 bp, Artificial Sequence
  chemically synthesized
tatccaaactatcatcatct

SEQ ID NO: 42126 - DNA, 20 bp, Artificial Sequence
  chemically synthesized
gagaagatgggatttggacc

SEQ ID NO: 42127 - DNA, 20 bp, Artificial Sequence
  chemically synthesized
aggtgagagaagatgggatt

SEQ ID NO: 42128 - DNA, 20 bp, Artificial Sequence
  chemically synthesized
aaagccaggtgagagaagat

SEQ ID NO: 42129 - DNA, 20 bp, Artificial Sequence
  chemically synthesized
gaaagccaggtgagagaaga

SEQ ID NO: 42130 - DNA, 20 bp, Artificial Sequence
  chemically synthesized
tgatgaaagccaggtgagag

SEQ ID NO: 42131 - DNA, 20 bp, Artificial Sequence
  chemically synthesized
aaatcccatcttctctcacc

SEQ ID NO: 42132 - DNA, 20 bp, Artificial Sequence
  chemically synthesized
tactgatgaaagccaggtga

SEQ ID NO: 42133 - DNA, 20 bp, Artificial Sequence
  chemically synthesized
gttactgatgaaagccaggt

SEQ ID NO: 42134 - DNA, 20 bp, Artificial Sequence
  chemically synthesized
gaaggttactgatgaaagcc

SEQ ID NO: 42135 - DNA, 20 bp, Artificial Sequence
  chemically synthesized
tgaaggttactgatgaaagc

SEQ ID NO: 42136 - DNA, 20 bp, Artificial Sequence
  chemically synthesized
ttctctcacctggctttcat

SEQ ID NO: 42137 - DNA, 20 bp, Artificial Sequence
  chemically synthesized
cgtttgaaggttactgatga

SEQ ID NO: 42138 - DNA, 20 bp, Artificial Sequence
  chemically synthesized
ctatgaatacaaacgtttga

SEQ ID NO: 42139 - DNA, 20 bp, Artificial Sequence
  chemically synthesized
cctatgaatacaaacgtttg

SEQ ID NO: 42140 - DNA, 20 bp, Artificial Sequence
  chemically synthesized
ccttcaaacgtttgtattca

SEQ ID NO: 42141 - DNA, 20 bp, Artificial Sequence
  chemically synthesized
cttcaaacgtttgtattcat

SEQ ID NO: 42142 - DNA, 20 bp, Artificial Sequence
  chemically synthesized
atgcaaatgaattggatgag

SEQ ID NO: 42143 - DNA, 20 bp, Artificial Sequence
  chemically synthesized
tgatgcaaatgaattggatg

SEQ ID NO: 42144 - DNA, 20 bp, Artificial Sequence
  chemically synthesized
ctgatgcaaatgaattggat

SEQ ID NO: 42145 - DNA, 20 bp, Artificial Sequence
  chemically synthesized
tctggctgatgcaaatgaat

SEQ ID NO: 42146 - DNA, 20 bp, Artificial Sequence
  chemically synthesized
ctcatccaattcatttgcat

SEQ ID NO: 42147 - DNA, 20 bp, Artificial Sequence
  chemically synthesized
tccaattcatttgcatcagc

SEQ ID NO: 42148 - DNA, 20 bp, Artificial Sequence
  chemically synthesized
caattcatttgcatcagcca

SEQ ID NO: 42149 - DNA, 20 bp, Artificial Sequence
  chemically synthesized
aattcatttgcatcagccag

SEQ ID NO: 42150 - DNA, 20 bp, Artificial Sequence
  chemically synthesized
agaaaactcaaaaagtcctc

SEQ ID NO: 42151 - DNA, 20 bp, Artificial Sequence
  chemically synthesized
catcagccagaggacttttt

SEQ ID NO: 42152 - DNA, 20 bp, Artificial Sequence
  chemically synthesized
aggtgaggagaaaactcaaa

SEQ ID NO: 42153 - DNA, 20 bp, Artificial Sequence
  chemically synthesized
ctagggctggaggaggtgag

SEQ ID NO: 42154 - DNA, 20 bp, Artificial Sequence
  chemically synthesized
gactagggctggaggaggtg

SEQ ID NO: 42155 - DNA, 20 bp, Artificial Sequence
  chemically synthesized
tgactagggctggaggaggt

SEQ ID NO: 42156 - DNA, 20 bp, Artificial Sequence
  chemically synthesized
agttttctcctcacctcctc

SEQ ID NO: 42157 - DNA, 20 bp, Artificial Sequence
  chemically synthesized
agcatgactagggctggagg

SEQ ID NO: 42158 - DNA, 20 bp, Artificial Sequence
  chemically synthesized
cagcatgactagggctggag

SEQ ID NO: 42159 - DNA, 20 bp, Artificial Sequence
  chemically synthesized
ctcctcacctcctccagccc

SEQ ID NO: 42160 - DNA, 20 bp, Artificial Sequence
  chemically synthesized
gacagcatgactagggctgg

SEQ ID NO: 42161 - DNA, 20 bp, Artificial Sequence
  chemically synthesized
ggacagcatgactagggctg

SEQ ID NO: 42162 - DNA, 20 bp, Artificial Sequence
  chemically synthesized
aaggacagcatgactagggc

SEQ ID NO: 42163 - DNA, 20 bp, Artificial Sequence
  chemically synthesized
ttaaaaggacagcatgacta

SEQ ID NO: 42164 - DNA, 20 bp, Artificial Sequence
  chemically synthesized
attaaaaggacagcatgact

SEQ ID NO: 42165 - DNA, 20 bp, Artificial Sequence
  chemically synthesized
gattaaaaggacagcatgac

SEQ ID NO: 42166 - DNA, 20 bp, Artificial Sequence
  chemically synthesized
aatacaagggattaaaagga

SEQ ID NO: 42167 - DNA, 20 bp, Artificial Sequence
  chemically synthesized
tgtcaatacaagggattaaa

SEQ ID NO: 42168 - DNA, 20 bp, Artificial Sequence
  chemically synthesized
ttgtcaatacaagggattaa

SEQ ID NO: 42169 - DNA, 20 bp, Artificial Sequence
  chemically synthesized
gagggaacttgtcaatacaa

SEQ ID NO: 42170 - DNA, 20 bp, Artificial Sequence
  chemically synthesized
ggagggaacttgtcaataca

SEQ ID NO: 42171 - DNA, 20 bp, Artificial Sequence
  chemically synthesized
aggagggaacttgtcaatac

SEQ ID NO: 42172 - DNA, 20 bp, Artificial Sequence
  chemically synthesized
ttttaatcccttgtattgac

SEQ ID NO: 42173 - DNA, 20 bp, Artificial Sequence
  chemically synthesized
gtcaaggcaatttagcagga

SEQ ID NO: 42174 - DNA, 20 bp, Artificial Sequence
  chemically synthesized
tgtcaaggcaatttagcagg

SEQ ID NO: 42175 - DNA, 20 bp, Artificial Sequence
  chemically synthesized
gtgtcaaggcaatttagcag

SEQ ID NO: 42176 - DNA, 20 bp, Artificial Sequence
  chemically synthesized
atgtgtcaaggcaatttagc

SEQ ID NO: 42177 - DNA, 20 bp, Artificial Sequence
  chemically synthesized
catgtgtcaaggcaatttag

SEQ ID NO: 42178 - DNA, 20 bp, Artificial Sequence
  chemically synthesized
agtcatgtgtcaaggcaatt

SEQ ID NO: 42179 - DNA, 20 bp, Artificial Sequence
  chemically synthesized
agagagagagtcatgtgtca

SEQ ID NO: 42180 - DNA, 20 bp, Artificial Sequence
  chemically synthesized
gagagagagagtcatgtgtc

SEQ ID NO: 42181 - DNA, 20 bp, Artificial Sequence
  chemically synthesized
ttaacacaaaaagagagaga

SEQ ID NO: 42182 - DNA, 20 bp, Artificial Sequence
  chemically synthesized
tattaacacaaaaagagaga

SEQ ID NO: 42183 - DNA, 20 bp, Artificial Sequence
  chemically synthesized
catattaacacaaaaagaga

SEQ ID NO: 42184 - DNA, 20 bp, Artificial Sequence
  chemically synthesized
tacatattaacacaaaaaga

SEQ ID NO: 42185 - DNA, 20 bp, Artificial Sequence
  chemically synthesized
aatacatattaacacaaaaa

SEQ ID NO: 42186 - DNA, 20 bp, Artificial Sequence
  chemically synthesized
tgaatacatattaacacaaa

SEQ ID NO: 42187 - DNA, 20 bp, Artificial Sequence
  chemically synthesized
tgttaatatgtattcattct

SEQ ID NO: 42188 - DNA, 20 bp, Artificial Sequence
  chemically synthesized
tagataatggaaatgacact

SEQ ID NO: 42189 - DNA, 20 bp, Artificial Sequence
  chemically synthesized
tatagccagggaatagataa

SEQ ID NO: 42190 - DNA, 20 bp, Artificial Sequence
  chemically synthesized
catttccattatctattccc

SEQ ID NO: 42191 - DNA, 20 bp, Artificial Sequence
  chemically synthesized
tccaaagtatagccagggaa

SEQ ID NO: 42192 - DNA, 20 bp, Artificial Sequence
  chemically synthesized
atacctccaaagtatagcca

SEQ ID NO: 42193 - DNA, 20 bp, Artificial Sequence
  chemically synthesized
gatacctccaaagtatagcc

SEQ ID NO: 42194 - DNA, 20 bp, Artificial Sequence
  chemically synthesized
tgatacctccaaagtatagc

SEQ ID NO: 42195 - DNA, 20 bp, Artificial Sequence
  chemically synthesized
tctattccctggctatactt

SEQ ID NO: 42196 - DNA, 20 bp, Artificial Sequence
  chemically synthesized
tattccctggctatactttg

SEQ ID NO: 42197 - DNA, 20 bp, Artificial Sequence
  chemically synthesized
tgcatgatacctccaaagta

SEQ ID NO: 42198 - DNA, 20 bp, Artificial Sequence
  chemically synthesized
attccctggctatactttgg

SEQ ID NO: 42199 - DNA, 20 bp, Artificial Sequence
  chemically synthesized
caacatgcatgatacctcca

SEQ ID NO: 42200 - DNA, 20 bp, Artificial Sequence
  chemically synthesized
atgtaaagggtacatttggt

SEQ ID NO: 42201 - DNA, 20 bp, Artificial Sequence
  chemically synthesized
ctagatgtaaagggtacatt

SEQ ID NO: 42202 - DNA, 20 bp, Artificial Sequence
  chemically synthesized
gatacattgctagatgtaaa

SEQ ID NO: 42203 - DNA, 20 bp, Artificial Sequence
  chemically synthesized
ccaaatgtaccctttacatc

SEQ ID NO: 42204 - DNA, 20 bp, Artificial Sequence
  chemically synthesized
agatacattgctagatgtaa

SEQ ID NO: 42205 - DNA, 20 bp, Artificial Sequence
  chemically synthesized
cagatacattgctagatgta

SEQ ID NO: 42206 - DNA, 20 bp, Artificial Sequence
  chemically synthesized
atgtgcaccagatacattgc

SEQ ID NO: 42207 - DNA, 20 bp, Artificial Sequence
  chemically synthesized
tttacatctagcaatgtatc

SEQ ID NO: 42208 - DNA, 20 bp, Artificial Sequence
  chemically synthesized
atttatcagaatatgtgcac

SEQ ID NO: 42209 - DNA, 20 bp, Artificial Sequence
  chemically synthesized
gtcaatagatgtttatttat

SEQ ID NO: 42210 - DNA, 20 bp, Artificial Sequence
  chemically synthesized
ttcattgattcatttgtcaa

SEQ ID NO: 42211 - DNA, 20 bp, Artificial Sequence
  chemically synthesized
aaatgaatcaatgaatgaat

SEQ ID NO: 42212 - DNA, 20 bp, Artificial Sequence
  chemically synthesized
aatcaatgaatgaatcagtc

SEQ ID NO: 42213 - DNA, 20 bp, Artificial Sequence
  chemically synthesized
tcaatgaatgaatcagtcaa

SEQ ID NO: 42214 - DNA, 20 bp, Artificial Sequence
  chemically synthesized
atcagtcaagagtatatctt

SEQ ID NO: 42215 - DNA, 20 bp, Artificial Sequence
  chemically synthesized
ctaagaaaaacatttatcta

SEQ ID NO: 42216 - DNA, 20 bp, Artificial Sequence
  chemically synthesized
ctttagataaatgtttttct

SEQ ID NO: 42217 - DNA, 20 bp, Artificial Sequence
  chemically synthesized
tttagataaatgtttttctt

SEQ ID NO: 42218 - DNA, 20 bp, Artificial Sequence
  chemically synthesized
gataaatgtttttcttaggt

SEQ ID NO: 42219 - DNA, 20 bp, Artificial Sequence
  chemically synthesized
ataaatgtttttcttaggta

SEQ ID NO: 42220 - DNA, 20 bp, Artificial Sequence
  chemically synthesized
aaatgtttttcttaggtaag

SEQ ID NO: 42221 - DNA, 20 bp, Artificial Sequence
  chemically synthesized
tggtttgattctccttacct

SEQ ID NO: 42222 - DNA, 20 bp, Artificial Sequence
  chemically synthesized
taaggagaatcaaaccattt

SEQ ID NO: 42223 - DNA, 20 bp, Artificial Sequence
  chemically synthesized
ttaattctaatgcacttaaa

SEQ ID NO: 42224 - DNA, 20 bp, Artificial Sequence
  chemically synthesized
atcaaaccatttaagtgcat

SEQ ID NO: 42225 - DNA, 20 bp, Artificial Sequence
  chemically synthesized
ttaagtgcattagaattaaa

SEQ ID NO: 42226 - DNA, 20 bp, Artificial Sequence
  chemically synthesized
attagaattaaaaagcattt

SEQ ID NO: 42227 - DNA, 20 bp, Artificial Sequence
  chemically synthesized
aaaagcattttagcatttgt

SEQ ID NO: 42228 - DNA, 20 bp, Artificial Sequence
  chemically synthesized
gcatttgtgagaaattctga

SEQ ID NO: 42229 - DNA, 20 bp, Artificial Sequence
  chemically synthesized
tttgtgagaaattctgaaag

SEQ ID NO: 42230 - DNA, 20 bp, Artificial Sequence
  chemically synthesized
ctgctacttgttactgcttt

SEQ ID NO: 42231 - DNA, 20 bp, Artificial Sequence
  chemically synthesized
gaaattctgaaagcagtaac

SEQ ID NO: 42232 - DNA, 20 bp, Artificial Sequence
  chemically synthesized
attctgaaagcagtaacaag

SEQ ID NO: 42233 - DNA, 20 bp, Artificial Sequence
  chemically synthesized
ctgaaagcagtaacaagtag

SEQ ID NO: 42234 - DNA, 20 bp, Artificial Sequence
  chemically synthesized
ctcagttatatttgtaaaag

SEQ ID NO: 42235 - DNA, 20 bp, Artificial Sequence
  chemically synthesized
aacctcagttatatttgtaa

SEQ ID NO: 42236 - DNA, 20 bp, Artificial Sequence
  chemically synthesized
ctacttttacaaatataact

SEQ ID NO: 42237 - DNA, 20 bp, Artificial Sequence
  chemically synthesized
tacttttacaaatataactg

SEQ ID NO: 42238 - DNA, 20 bp, Artificial Sequence
  chemically synthesized
gggtatattttgtttaacct

SEQ ID NO: 42239 - DNA, 20 bp, Artificial Sequence
  chemically synthesized
gaggttaaacaaaatatacc

SEQ ID NO: 42240 - DNA, 20 bp, Artificial Sequence
  chemically synthesized
gtaagaagttattttttact

SEQ ID NO: 42241 - DNA, 20 bp, Artificial Sequence
  chemically synthesized
agtaagaagttattttttac

SEQ ID NO: 42242 - DNA, 20 bp, Artificial Sequence
  chemically synthesized
taattagccaagttagtaag

SEQ ID NO: 42243 - DNA, 20 bp, Artificial Sequence
  chemically synthesized
aaaataacttcttactaact

SEQ ID NO: 42244 - DNA, 20 bp, Artificial Sequence
  chemically synthesized
ccataattagccaagttagt

SEQ ID NO: 42245 - DNA, 20 bp, Artificial Sequence
  chemically synthesized
tcacccataattagccaagt

SEQ ID NO: 42246 - DNA, 20 bp, Artificial Sequence
  chemically synthesized
aatttcacccataattagcc

SEQ ID NO: 42247 - DNA, 20 bp, Artificial Sequence
  chemically synthesized
cttactaacttggctaatta

SEQ ID NO: 42248 - DNA, 20 bp, Artificial Sequence
  chemically synthesized
ttactaacttggctaattat

SEQ ID NO: 42249 - DNA, 20 bp, Artificial Sequence
  chemically synthesized
tgaccaatttcacccataat

SEQ ID NO: 42250 - DNA, 20 bp, Artificial Sequence
  chemically synthesized
tggctaattatgggtgaaat

SEQ ID NO: 42251 - DNA, 20 bp, Artificial Sequence
  chemically synthesized
ggtgtctctgatcattgtca

SEQ ID NO: 42252 - DNA, 20 bp, Artificial Sequence
  chemically synthesized
atttatgctgtgacaatgat

SEQ ID NO: 42253 - DNA, 20 bp, Artificial Sequence
  chemically synthesized
ttatgctgtgacaatgatca

SEQ ID NO: 42254 - DNA, 20 bp, Artificial Sequence
  chemically synthesized
acaatgatcagagacaccct

SEQ ID NO: 42255 - DNA, 20 bp, Artificial Sequence
  chemically synthesized
taaagaagcatagtttccaa

SEQ ID NO: 42256 - DNA, 20 bp, Artificial Sequence
  chemically synthesized
ttaaagaagcatagtttcca

SEQ ID NO: 42257 - DNA, 20 bp, Artificial Sequence
  chemically synthesized
cttaaagaagcatagtttcc

SEQ ID NO: 42258 - DNA, 20 bp, Artificial Sequence
  chemically synthesized
cattattccttaaagaagca

SEQ ID NO: 42259 - DNA, 20 bp, Artificial Sequence
  chemically synthesized
cttggaaactatgcttcttt

SEQ ID NO: 42260 - DNA, 20 bp, Artificial Sequence
  chemically synthesized
ttggaaactatgcttcttta

SEQ ID NO: 42261 - DNA, 20 bp, Artificial Sequence
  chemically synthesized
ggcatcattattccttaaag

SEQ ID NO: 42262 - DNA, 20 bp, Artificial Sequence
  chemically synthesized
aatggcatcattattcctta

SEQ ID NO: 42263 - DNA, 20 bp, Artificial Sequence
  chemically synthesized
ggaataatgatgccatttta

SEQ ID NO: 42264 - DNA, 20 bp, Artificial Sequence
  chemically synthesized
gaaagcataaaactataaaa

SEQ ID NO: 42265 - DNA, 20 bp, Artificial Sequence
  chemically synthesized
atagttttatgctttcattt

SEQ ID NO: 42266 - DNA, 20 bp, Artificial Sequence
  chemically synthesized
gttctcaaatgctaaaatga

SEQ ID NO: 42267 - DNA, 20 bp, Artificial Sequence
  chemically synthesized
atgctttcattttagcattt

SEQ ID NO: 42268 - DNA, 20 bp, Artificial Sequence
  chemically synthesized
ttcattttagcatttgagaa

SEQ ID NO: 42269 - DNA, 20 bp, Artificial Sequence
  chemically synthesized
atatcattgcagagattaat

SEQ ID NO: 42270 - DNA, 20 bp, Artificial Sequence
  chemically synthesized
aggagtacaatatcattgca

SEQ ID NO: 42271 - DNA, 20 bp, Artificial Sequence
  chemically synthesized
ataggagtacaatatcattg

SEQ ID NO: 42272 - DNA, 20 bp, Artificial Sequence
  chemically synthesized
tgaattggcctgtaatatag

SEQ ID NO: 42273 - DNA, 20 bp, Artificial Sequence
  chemically synthesized
gatattgtactcctatatta

SEQ ID NO: 42274 - DNA, 20 bp, Artificial Sequence
  chemically synthesized
atattgtactcctatattac

SEQ ID NO: 42275 - DNA, 20 bp, Artificial Sequence
  chemically synthesized
cttgaattggcctgtaatat

SEQ ID NO: 42276 - DNA, 20 bp, Artificial Sequence
  chemically synthesized
tcttgaattggcctgtaata

SEQ ID NO: 42277 - DNA, 20 bp, Artificial Sequence
  chemically synthesized
cctatattacaggccaattc

SEQ ID NO: 42278 - DNA, 20 bp, Artificial Sequence
  chemically synthesized
tgtgatttactttcttgaat

SEQ ID NO: 42279 - DNA, 20 bp, Artificial Sequence
  chemically synthesized
tattacaggccaattcaaga

SEQ ID NO: 42280 - DNA, 20 bp, Artificial Sequence
  chemically synthesized
attcaagaaagtaaatcaca

SEQ ID NO: 42281 - DNA, 20 bp, Artificial Sequence
  chemically synthesized
gtaaatcacacagatttcaa

SEQ ID NO: 42282 - DNA, 20 bp, Artificial Sequence
  chemically synthesized
tcacacagatttcaaaagca

SEQ ID NO: 42283 - DNA, 20 bp, Artificial Sequence
  chemically synthesized
cacacagatttcaaaagcat

SEQ ID NO: 42284 - DNA, 20 bp, Artificial Sequence
  chemically synthesized
aaaagcataggaaaaatttt

SEQ ID NO: 42285 - DNA, 20 bp, Artificial Sequence
  chemically synthesized
ggaaaaatttttagatgcct

SEQ ID NO: 42286 - DNA, 20 bp, Artificial Sequence
  chemically synthesized
gaggtaaagagtatattctt

SEQ ID NO: 42287 - DNA, 20 bp, Artificial Sequence
  chemically synthesized
ggaggtaaagagtatattct

SEQ ID NO: 42288 - DNA, 20 bp, Artificial Sequence
  chemically synthesized
aacaaggtacaggaggtaaa

SEQ ID NO: 42289 - DNA, 20 bp, Artificial Sequence
  chemically synthesized
ataacaaggtacaggaggta

SEQ ID NO: 42290 - DNA, 20 bp, Artificial Sequence
  chemically synthesized
catatataacaaggtacagg

SEQ ID NO: 42291 - DNA, 20 bp, Artificial Sequence
  chemically synthesized
acatatataacaaggtacag

SEQ ID NO: 42292 - DNA, 20 bp, Artificial Sequence
  chemically synthesized
agacatatataacaaggtac

SEQ ID NO: 42293 - DNA, 20 bp, Artificial Sequence
  chemically synthesized
aagacatatataacaaggta

SEQ ID NO: 42294 - DNA, 20 bp, Artificial Sequence
  chemically synthesized
ctataaagacatatataaca

SEQ ID NO: 42295 - DNA, 20 bp, Artificial Sequence
  chemically synthesized
actataaagacatatataac

SEQ ID NO: 42296 - DNA, 20 bp, Artificial Sequence
  chemically synthesized
ccttgttatatatgtcttta

SEQ ID NO: 42297 - DNA, 20 bp, Artificial Sequence
  chemically synthesized
aagatctatctaagactata

SEQ ID NO: 42298 - DNA, 20 bp, Artificial Sequence
  chemically synthesized
tatatatgtctttatagtct

SEQ ID NO: 42299 - DNA, 20 bp, Artificial Sequence
  chemically synthesized
tatgtctttatagtcttaga

SEQ ID NO: 42300 - DNA, 20 bp, Artificial Sequence
  chemically synthesized
tctttattaaagatctatct

SEQ ID NO: 42301 - DNA, 20 bp, Artificial Sequence
  chemically synthesized
tcttagatagatctttaata

SEQ ID NO: 42302 - DNA, 20 bp, Artificial Sequence
  chemically synthesized
tctgtttcaattctttatta

SEQ ID NO: 42303 - DNA, 20 bp, Artificial Sequence
  chemically synthesized
tctttaataaagaattgaaa

SEQ ID NO: 42304 - DNA, 20 bp, Artificial Sequence
  chemically synthesized
ataaagaattgaaacagaaa

SEQ ID NO: 42305 - DNA, 20 bp, Artificial Sequence
  chemically synthesized
aaagaattgaaacagaaaca

SEQ ID NO: 42306 - DNA, 20 bp, Artificial Sequence
  chemically synthesized
agaaacagagatccttattt

SEQ ID NO: 42307 - DNA, 20 bp, Artificial Sequence
  chemically synthesized
tacataaaggagctaaaata

SEQ ID NO: 42308 - DNA, 20 bp, Artificial Sequence
  chemically synthesized
ttacataaaggagctaaaat

SEQ ID NO: 42309 - DNA, 20 bp, Artificial Sequence
  chemically synthesized
tgcatatgatttacataaag

SEQ ID NO: 42310 - DNA, 20 bp, Artificial Sequence
  chemically synthesized
tatgcatatgatttacataa

SEQ ID NO: 42311 - DNA, 20 bp, Artificial Sequence
  chemically synthesized
atatgcatatgatttacata

SEQ ID NO: 42312 - DNA, 20 bp, Artificial Sequence
  chemically synthesized
tcatatgcatatttatgact

SEQ ID NO: 42313 - DNA, 20 bp, Artificial Sequence
  chemically synthesized
gctcacaaaataaaggaact

SEQ ID NO: 42314 - DNA, 20 bp, Artificial Sequence
  chemically synthesized
ataaaatgctcacaaaataa

SEQ ID NO: 42315 - DNA, 20 bp, Artificial Sequence
  chemically synthesized
tataaaatgctcacaaaata

SEQ ID NO: 42316 - DNA, 20 bp, Artificial Sequence
  chemically synthesized
acttagttcctttattttgt

SEQ ID NO: 42317 - DNA, 20 bp, Artificial Sequence
  chemically synthesized
ataaaatataaaatttacaa

SEQ ID NO: 42318 - DNA, 20 bp, Artificial Sequence
  chemically synthesized
aatataaaatttacaatagc

SEQ ID NO: 42319 - DNA, 20 bp, Artificial Sequence
  chemically synthesized
atttacaatagctggtacaa

SEQ ID NO: 42320 - DNA, 20 bp, Artificial Sequence
  chemically synthesized
tttattgggggctattgtac

SEQ ID NO: 42321 - DNA, 20 bp, Artificial Sequence
  chemically synthesized
aagcaaactatatttattgg

SEQ ID NO: 42322 - DNA, 20 bp, Artificial Sequence
  chemically synthesized
taagcaaactatatttattg

SEQ ID NO: 42323 - DNA, 20 bp, Artificial Sequence
  chemically synthesized
ttaagcaaactatatttatt

SEQ ID NO: 42324 - DNA, 20 bp, Artificial Sequence
  chemically synthesized
acaatagcccccaataaata

SEQ ID NO: 42325 - DNA, 20 bp, Artificial Sequence
  chemically synthesized
attaagcaaactatatttat

SEQ ID NO: 42326 - DNA, 20 bp, Artificial Sequence
  chemically synthesized
atgaattcattacattaatt

SEQ ID NO: 42327 - DNA, 20 bp, Artificial Sequence
  chemically synthesized
gctagtttctgttttgcaaa

SEQ ID NO: 42328 - DNA, 20 bp, Artificial Sequence
  chemically synthesized
agctagtttctgttttgcaa

SEQ ID NO: 42329 - DNA, 20 bp, Artificial Sequence
  chemically synthesized
tacatttgccttttgcaaaa

SEQ ID NO: 42330 - DNA, 20 bp, Artificial Sequence
  chemically synthesized
gccttttgcaaaacagaaac

SEQ ID NO: 42331 - DNA, 20 bp, Artificial Sequence
  chemically synthesized
gggacttcacaatatcgagc

SEQ ID NO: 42332 - DNA, 20 bp, Artificial Sequence
  chemically synthesized
ccctgggacttcacaatatc

SEQ ID NO: 42333 - DNA, 20 bp, Artificial Sequence
  chemically synthesized
gaaactagctcgatattgtg

SEQ ID NO: 42334 - DNA, 20 bp, Artificial Sequence
  chemically synthesized
agctcgatattgtgaagtcc

SEQ ID NO: 42335 - DNA, 20 bp, Artificial Sequence
  chemically synthesized
gctcgatattgtgaagtccc

SEQ ID NO: 42336 - DNA, 20 bp, Artificial Sequence
  chemically synthesized
ctcgatattgtgaagtccca

SEQ ID NO: 42337 - DNA, 20 bp, Artificial Sequence
  chemically synthesized
gggatgagggaggaaaccct

SEQ ID NO: 42338 - DNA, 20 bp, Artificial Sequence
  chemically synthesized
tgggatgagggaggaaaccc

SEQ ID NO: 42339 - DNA, 20 bp, Artificial Sequence
  chemically synthesized
ccatcatattgggatgaggg

SEQ ID NO: 42340 - DNA, 20 bp, Artificial Sequence
  chemically synthesized
gccatcatattgggatgagg

SEQ ID NO: 42341 - DNA, 20 bp, Artificial Sequence
  chemically synthesized
atgccatcatattgggatga

SEQ ID NO: 42342 - DNA, 20 bp, Artificial Sequence
  chemically synthesized
gatgccatcatattgggatg

SEQ ID NO: 42343 - DNA, 20 bp, Artificial Sequence
  chemically synthesized
ggatgccatcatattgggat

SEQ ID NO: 42344 - DNA, 20 bp, Artificial Sequence
  chemically synthesized
cctccctcatcccaatatga

SEQ ID NO: 42345 - DNA, 20 bp, Artificial Sequence
  chemically synthesized
gggtgggatgccatcatatt

SEQ ID NO: 42346 - DNA, 20 bp, Artificial Sequence
  chemically synthesized
ggggtgggatgccatcatat

SEQ ID NO: 42347 - DNA, 20 bp, Artificial Sequence
  chemically synthesized
ccttcttagagtcatggggt

SEQ ID NO: 42348 - DNA, 20 bp, Artificial Sequence
  chemically synthesized
tccttcttagagtcatgggg

SEQ ID NO: 42349 - DNA, 20 bp, Artificial Sequence
  chemically synthesized
acatccttcttagagtcatg

SEQ ID NO: 42350 - DNA, 20 bp, Artificial Sequence
  chemically synthesized
tacatccttcttagagtcat

SEQ ID NO: 42351 - DNA, 20 bp, Artificial Sequence
  chemically synthesized
gcatcccaccccatgactct

SEQ ID NO: 42352 - DNA, 20 bp, Artificial Sequence
  chemically synthesized
atacatccttcttagagtca

SEQ ID NO: 42353 - DNA, 20 bp, Artificial Sequence
  chemically synthesized
tcccaccccatgactctaag

SEQ ID NO: 42354 - DNA, 20 bp, Artificial Sequence
  chemically synthesized
cccaccccatgactctaaga

SEQ ID NO: 42355 - DNA, 20 bp, Artificial Sequence
  chemically synthesized
caatatatacatccttctta

SEQ ID NO: 42356 - DNA, 20 bp, Artificial Sequence
  chemically synthesized
atcaatatatacatccttct

SEQ ID NO: 42357 - DNA, 20 bp, Artificial Sequence
  chemically synthesized
gtatatattgatgattacaa

SEQ ID NO: 42358 - DNA, 20 bp, Artificial Sequence
  chemically synthesized
attgatgattacaaaagtta

SEQ ID NO: 42359 - DNA, 20 bp, Artificial Sequence
  chemically synthesized
aggggaagacgtcaggacaa

SEQ ID NO: 42360 - DNA, 20 bp, Artificial Sequence
  chemically synthesized
ctaggggaagacgtcaggac

SEQ ID NO: 42361 - DNA, 20 bp, Artificial Sequence
  chemically synthesized
tgaagctaggggaagacgtc

SEQ ID NO: 42362 - DNA, 20 bp, Artificial Sequence
  chemically synthesized
ctgaagctaggggaagacgt

SEQ ID NO: 42363 - DNA, 20 bp, Artificial Sequence
  chemically synthesized
cttgtcctgacgtcttcccc

SEQ ID NO: 42364 - DNA, 20 bp, Artificial Sequence
  chemically synthesized
tttggatctgaagctagggg

SEQ ID NO: 42365 - DNA, 20 bp, Artificial Sequence
  chemically synthesized
ctgacgtcttcccctagctt

SEQ ID NO: 42366 - DNA, 20 bp, Artificial Sequence
  chemically synthesized
aaatttggatctgaagctag

SEQ ID NO: 42367 - DNA, 20 bp, Artificial Sequence
  chemically synthesized
aaaatttggatctgaagcta

SEQ ID NO: 42368 - DNA, 20 bp, Artificial Sequence
  chemically synthesized
caaaatttggatctgaagct

SEQ ID NO: 42369 - DNA, 20 bp, Artificial Sequence
  chemically synthesized
tcaaaatttggatctgaagc

SEQ ID NO: 42370 - DNA, 20 bp, Artificial Sequence
  chemically synthesized
cagttcaaaatttggatctg

SEQ ID NO: 42371 - DNA, 20 bp, Artificial Sequence
  chemically synthesized
tagctgtgcagttcaaaatt

SEQ ID NO: 42372 - DNA, 20 bp, Artificial Sequence
  chemically synthesized
gatccaaattttgaactgca

SEQ ID NO: 42373 - DNA, 20 bp, Artificial Sequence
  chemically synthesized
caaattttgaactgcacagc

SEQ ID NO: 42374 - DNA, 20 bp, Artificial Sequence
  chemically synthesized
ttattgggtatctagctgtg

SEQ ID NO: 42375 - DNA, 20 bp, Artificial Sequence
  chemically synthesized
tgaggtacttattgggtatc

SEQ ID NO: 42376 - DNA, 20 bp, Artificial Sequence
  chemically synthesized
tgcacagctagatacccaat

SEQ ID NO: 42377 - DNA, 20 bp, Artificial Sequence
  chemically synthesized
ttaagtttgaggtacttatt

SEQ ID NO: 42378 - DNA, 20 bp, Artificial Sequence
  chemically synthesized
tttaagtttgaggtacttat

SEQ ID NO: 42379 - DNA, 20 bp, Artificial Sequence
  chemically synthesized
tttagacatgtttaagtttg

SEQ ID NO: 42380 - DNA, 20 bp, Artificial Sequence
  chemically synthesized
gtttagacatgtttaagttt

SEQ ID NO: 42381 - DNA, 20 bp, Artificial Sequence
  chemically synthesized
gcctgggtttagacatgttt

SEQ ID NO: 42382 - DNA, 20 bp, Artificial Sequence
  chemically synthesized
aacttaaacatgtctaaacc

SEQ ID NO: 42383 - DNA, 20 bp, Artificial Sequence
  chemically synthesized
acttaaacatgtctaaaccc

SEQ ID NO: 42384 - DNA, 20 bp, Artificial Sequence
  chemically synthesized
accctagagctgcctgggtt

SEQ ID NO: 42385 - DNA, 20 bp, Artificial Sequence
  chemically synthesized
taaacatgtctaaacccagg

SEQ ID NO: 42386 - DNA, 20 bp, Artificial Sequence
  chemically synthesized
tagaaaccctagagctgcct

SEQ ID NO: 42387 - DNA, 20 bp, Artificial Sequence
  chemically synthesized
gtagaaaccctagagctgcc

SEQ ID NO: 42388 - DNA, 20 bp, Artificial Sequence
  chemically synthesized
tgtctaaacccaggcagctc

SEQ ID NO: 42389 - DNA, 20 bp, Artificial Sequence
  chemically synthesized
gtctaaacccaggcagctct

SEQ ID NO: 42390 - DNA, 20 bp, Artificial Sequence
  chemically synthesized
tctaaacccaggcagctcta

SEQ ID NO: 42391 - DNA, 20 bp, Artificial Sequence
  chemically synthesized
tcttccgtgtagaaacccta

SEQ ID NO: 42392 - DNA, 20 bp, Artificial Sequence
  chemically synthesized
actcttccgtgtagaaaccc

SEQ ID NO: 42393 - DNA, 20 bp, Artificial Sequence
  chemically synthesized
gcagctctagggtttctaca

SEQ ID NO: 42394 - DNA, 20 bp, Artificial Sequence
  chemically synthesized
gctctagggtttctacacgg

SEQ ID NO: 42395 - DNA, 20 bp, Artificial Sequence
  chemically synthesized
tctagggtttctacacggaa

SEQ ID NO: 42396 - DNA, 20 bp, Artificial Sequence
  chemically synthesized
tagatagctactcttccgtg

SEQ ID NO: 42397 - DNA, 20 bp, Artificial Sequence
  chemically synthesized
agggtttctacacggaagag

SEQ ID NO: 42398 - DNA, 20 bp, Artificial Sequence
  chemically synthesized
tacacggaagagtagctatc

SEQ ID NO: 42399 - DNA, 20 bp, Artificial Sequence
  chemically synthesized
aaaattgcttgtcaactaga

SEQ ID NO: 42400 - DNA, 20 bp, Artificial Sequence
  chemically synthesized
agagtagctatctagttgac

SEQ ID NO: 42401 - DNA, 20 bp, Artificial Sequence
  chemically synthesized
aaaaaaaattgcttgtcaac

SEQ ID NO: 42402 - DNA, 20 bp, Artificial Sequence
  chemically synthesized
acaagcaatttttttttgtt

SEQ ID NO: 42403 - DNA, 20 bp, Artificial Sequence
  chemically synthesized
actttgcttccagcaacaac

SEQ ID NO: 42404 - DNA, 20 bp, Artificial Sequence
  chemically synthesized
aaatgttttcctgttgttgc

SEQ ID NO: 42405 - DNA, 20 bp, Artificial Sequence
  chemically synthesized
tactttgcttccagcaacaa

SEQ ID NO: 42406 - DNA, 20 bp, Artificial Sequence
  chemically synthesized
tgttttcctgttgttgctgg

SEQ ID NO: 42407 - DNA, 20 bp, Artificial Sequence
  chemically synthesized
tcctgttgttgctggaagca

SEQ ID NO: 42408 - DNA, 20 bp, Artificial Sequence
  chemically synthesized
cattagccatactttgcttc

SEQ ID NO: 42409 - DNA, 20 bp, Artificial Sequence
  chemically synthesized
ttgttgctggaagcaaagta

SEQ ID NO: 42410 - DNA, 20 bp, Artificial Sequence
  chemically synthesized
tggaagcaaagtatggctaa

SEQ ID NO: 42411 - DNA, 20 bp, Artificial Sequence
  chemically synthesized
ggaagcaaagtatggctaat

SEQ ID NO: 42412 - DNA, 20 bp, Artificial Sequence
  chemically synthesized
agcaaagtatggctaatggg

SEQ ID NO: 42413 - DNA, 20 bp, Artificial Sequence
  chemically synthesized
gcaaagtatggctaatgggc

SEQ ID NO: 42414 - DNA, 20 bp, Artificial Sequence
  chemically synthesized
ctccaataatacctgcccat

SEQ ID NO: 42415 - DNA, 20 bp, Artificial Sequence
  chemically synthesized
ggctaatgggcaggtattat

SEQ ID NO: 42416 - DNA, 20 bp, Artificial Sequence
  chemically synthesized
ctaatgggcaggtattattg

SEQ ID NO: 42417 - DNA, 20 bp, Artificial Sequence
  chemically synthesized
gggcaggtattattggagca

SEQ ID NO: 42418 - DNA, 20 bp, Artificial Sequence
  chemically synthesized
caggtattattggagcacag

SEQ ID NO: 42419 - DNA, 20 bp, Artificial Sequence
  chemically synthesized
ttggagcacagaagctcttc

SEQ ID NO: 42420 - DNA, 20 bp, Artificial Sequence
  chemically synthesized
gtcttaaagggtggcttgaa

SEQ ID NO: 42421 - DNA, 20 bp, Artificial Sequence
  chemically synthesized
atgtcttaaagggtggcttg

SEQ ID NO: 42422 - DNA, 20 bp, Artificial Sequence
  chemically synthesized
agctcttcaagccacccttt

SEQ ID NO: 42423 - DNA, 20 bp, Artificial Sequence
  chemically synthesized
taaagagatgtcttaaaggg

SEQ ID NO: 42424 - DNA, 20 bp, Artificial Sequence
  chemically synthesized
ttttaaagagatgtcttaaa

SEQ ID NO: 42425 - DNA, 20 bp, Artificial Sequence
  chemically synthesized
tttttaaagagatgtcttaa

SEQ ID NO: 42426 - DNA, 20 bp, Artificial Sequence
  chemically synthesized
ttttttaaagagatgtctta

SEQ ID NO: 42427 - DNA, 20 bp, Artificial Sequence
  chemically synthesized
gaaataaataattttttaaa

SEQ ID NO: 42428 - DNA, 20 bp, Artificial Sequence
  chemically synthesized
atgaaataaataatttttta

SEQ ID NO: 42429 - DNA, 20 bp, Artificial Sequence
  chemically synthesized
tatttgtaattgacaaataa

SEQ ID NO: 42430 - DNA, 20 bp, Artificial Sequence
  chemically synthesized
aataatagtttgtatattta

SEQ ID NO: 42431 - DNA, 20 bp, Artificial Sequence
  chemically synthesized
ataatagtttgtatatttat

SEQ ID NO: 42432 - DNA, 20 bp, Artificial Sequence
  chemically synthesized
acgatgtgatgttttgatct

SEQ ID NO: 42433 - DNA, 20 bp, Artificial Sequence
  chemically synthesized
ctctttctacaatatatacc

SEQ ID NO: 42434 - DNA, 20 bp, Artificial Sequence
  chemically synthesized
tttgatcttggtatatattg

SEQ ID NO: 42435 - DNA, 20 bp, Artificial Sequence
  chemically synthesized
atcttggtatatattgtaga

SEQ ID NO: 42436 - DNA, 20 bp, Artificial Sequence
  chemically synthesized
cttggtatatattgtagaaa

SEQ ID NO: 42437 - DNA, 20 bp, Artificial Sequence
  chemically synthesized
tattgtagaaagagttgatc

SEQ ID NO: 42438 - DNA, 20 bp, Artificial Sequence
  chemically synthesized
gaggtaatggatacgttaat

SEQ ID NO: 42439 - DNA, 20 bp, Artificial Sequence
  chemically synthesized
atgatatgttggtgaggtaa

SEQ ID NO: 42440 - DNA, 20 bp, Artificial Sequence
  chemically synthesized
aaataaatgatatgttggtg

SEQ ID NO: 42441 - DNA, 20 bp, Artificial Sequence
  chemically synthesized
aaaataaatgatatgttggt

SEQ ID NO: 42442 - DNA, 20 bp, Artificial Sequence
  chemically synthesized
gcaaaaaataaatgatatgt

SEQ ID NO: 42443 - DNA, 20 bp, Artificial Sequence
  chemically synthesized
aacatatcatttattttttg

SEQ ID NO: 42444 - DNA, 20 bp, Artificial Sequence
  chemically synthesized
tatcatttattttttgcggt

SEQ ID NO: 42445 - DNA, 20 bp, Artificial Sequence
  chemically synthesized
acattaaaaatctattcttt

SEQ ID NO: 42446 - DNA, 20 bp, Artificial Sequence
  chemically synthesized
tttcaaaattgctaaaagaa

SEQ ID NO: 42447 - DNA, 20 bp, Artificial Sequence
  chemically synthesized
atatatttcaaaattgctaa

SEQ ID NO: 42448 - DNA, 20 bp, Artificial Sequence
  chemically synthesized
ttagcaattttgaaatatat

SEQ ID NO: 42449 - DNA, 20 bp, Artificial Sequence
  chemically synthesized
aatatatgagacattattat

SEQ ID NO: 42450 - DNA, 20 bp, Artificial Sequence
  chemically synthesized
tgagacattattattagcca

SEQ ID NO: 42451 - DNA, 20 bp, Artificial Sequence
  chemically synthesized
attgcagtacatggtaacca

SEQ ID NO: 42452 - DNA, 20 bp, Artificial Sequence
  chemically synthesized
tagtgttccattgcagtaca

SEQ ID NO: 42453 - DNA, 20 bp, Artificial Sequence
  chemically synthesized
atggttaccatgtactgcaa

SEQ ID NO: 42454 - DNA, 20 bp, Artificial Sequence
  chemically synthesized
caagttttagtgttccattg

SEQ ID NO: 42455 - DNA, 20 bp, Artificial Sequence
  chemically synthesized
tggtagggaaaatcaagttt

SEQ ID NO: 42456 - DNA, 20 bp, Artificial Sequence
  chemically synthesized
caaatttggtagggaaaatc

SEQ ID NO: 42457 - DNA, 20 bp, Artificial Sequence
  chemically synthesized
aaagaggaacaaatttggta

SEQ ID NO: 42458 - DNA, 20 bp, Artificial Sequence
  chemically synthesized
taaagaggaacaaatttggt

SEQ ID NO: 42459 - DNA, 20 bp, Artificial Sequence
  chemically synthesized
ttaaagaggaacaaatttgg

SEQ ID NO: 42460 - DNA, 20 bp, Artificial Sequence
  chemically synthesized
tacttaaagaggaacaaatt

SEQ ID NO: 42461 - DNA, 20 bp, Artificial Sequence
  chemically synthesized
taccaaatttgttcctcttt

SEQ ID NO: 42462 - DNA, 20 bp, Artificial Sequence
  chemically synthesized
gcaggaacaggtacttaaag

SEQ ID NO: 42463 - DNA, 20 bp, Artificial Sequence
  chemically synthesized
agcaggaacaggtacttaaa

SEQ ID NO: 42464 - DNA, 20 bp, Artificial Sequence
  chemically synthesized
tcagcaggaacaggtactta

SEQ ID NO: 42465 - DNA, 20 bp, Artificial Sequence
  chemically synthesized
cctcggctttcagcaggaac

SEQ ID NO: 42466 - DNA, 20 bp, Artificial Sequence
  chemically synthesized
tcctcggctttcagcaggaa

SEQ ID NO: 42467 - DNA, 20 bp, Artificial Sequence
  chemically synthesized
taagtacctgttcctgctga

SEQ ID NO: 42468 - DNA, 20 bp, Artificial Sequence
  chemically synthesized
gtgtctcctcggctttcagc

SEQ ID NO: 42469 - DNA, 20 bp, Artificial Sequence
  chemically synthesized
ggtgtctcctcggctttcag

SEQ ID NO: 42470 - DNA, 20 bp, Artificial Sequence
  chemically synthesized
acctgttcctgctgaaagcc

SEQ ID NO: 42471 - DNA, 20 bp, Artificial Sequence
  chemically synthesized
cctgttcctgctgaaagccg

SEQ ID NO: 42472 - DNA, 20 bp, Artificial Sequence
  chemically synthesized
ccaggtgtctcctcggcttt

SEQ ID NO: 42473 - DNA, 20 bp, Artificial Sequence
  chemically synthesized
tgttcctgctgaaagccgag

SEQ ID NO: 42474 - DNA, 20 bp, Artificial Sequence
  chemically synthesized
gggcaatccaggtgtctcct

SEQ ID NO: 42475 - DNA, 20 bp, Artificial Sequence
  chemically synthesized
ctgaaagccgaggagacacc

SEQ ID NO: 42476 - DNA, 20 bp, Artificial Sequence
  chemically synthesized
ggacagaaagagggcaatcc

SEQ ID NO: 42477 - DNA, 20 bp, Artificial Sequence
  chemically synthesized
gggacagaaagagggcaatc

SEQ ID NO: 42478 - DNA, 20 bp, Artificial Sequence
  chemically synthesized
ggtcaggagggacagaaaga

SEQ ID NO: 42479 - DNA, 20 bp, Artificial Sequence
  chemically synthesized
aggtcaggagggacagaaag

SEQ ID NO: 42480 - DNA, 20 bp, Artificial Sequence
  chemically synthesized
gaggtcaggagggacagaaa

SEQ ID NO: 42481 - DNA, 20 bp, Artificial Sequence
  chemically synthesized
tggaggtcaggagggacaga

SEQ ID NO: 42482 - DNA, 20 bp, Artificial Sequence
  chemically synthesized
gcattggaggtcaggaggga

SEQ ID NO: 42483 - DNA, 20 bp, Artificial Sequence
  chemically synthesized
tgatgcattggaggtcagga

SEQ ID NO: 42484 - DNA, 20 bp, Artificial Sequence
  chemically synthesized
ctgatgcattggaggtcagg

SEQ ID NO: 42485 - DNA, 20 bp, Artificial Sequence
  chemically synthesized
gctgatgcattggaggtcag

SEQ ID NO: 42486 - DNA, 20 bp, Artificial Sequence
  chemically synthesized
ttgctgatgcattggaggtc

SEQ ID NO: 42487 - DNA, 20 bp, Artificial Sequence
  chemically synthesized
cttgctgatgcattggaggt

SEQ ID NO: 42488 - DNA, 20 bp, Artificial Sequence
  chemically synthesized
aggtcttgctgatgcattgg

SEQ ID NO: 42489 - DNA, 20 bp, Artificial Sequence
  chemically synthesized
caggtcttgctgatgcattg

SEQ ID NO: 42490 - DNA, 20 bp, Artificial Sequence
  chemically synthesized
cctcctgacctccaatgcat

SEQ ID NO: 42491 - DNA, 20 bp, Artificial Sequence
  chemically synthesized
cacaggtcttgctgatgcat

SEQ ID NO: 42492 - DNA, 20 bp, Artificial Sequence
  chemically synthesized
ctgacctccaatgcatcagc

SEQ ID NO: 42493 - DNA, 20 bp, Artificial Sequence
  chemically synthesized
tatggtttagaaacaatcac

SEQ ID NO: 42494 - DNA, 20 bp, Artificial Sequence
  chemically synthesized
atatggtttagaaacaatca

SEQ ID NO: 42495 - DNA, 20 bp, Artificial Sequence
  chemically synthesized
tggaatcagggaatatggtt

SEQ ID NO: 42496 - DNA, 20 bp, Artificial Sequence
  chemically synthesized
gtggttggaatcagggaata

SEQ ID NO: 42497 - DNA, 20 bp, Artificial Sequence
  chemically synthesized
acaagaggtggttggaatca

SEQ ID NO: 42498 - DNA, 20 bp, Artificial Sequence
  chemically synthesized
cacaagaggtggttggaatc

SEQ ID NO: 42499 - DNA, 20 bp, Artificial Sequence
  chemically synthesized
tcacaagaggtggttggaat

SEQ ID NO: 42500 - DNA, 20 bp, Artificial Sequence
  chemically synthesized
tggagatcacaagaggtggt

SEQ ID NO: 42501 - DNA, 20 bp, Artificial Sequence
  chemically synthesized
gcagtggagatcacaagagg

SEQ ID NO: 42502 - DNA, 20 bp, Artificial Sequence
  chemically synthesized
gtagcagtggagatcacaag

SEQ ID NO: 42503 - DNA, 20 bp, Artificial Sequence
  chemically synthesized
ggtagcagtggagatcacaa

SEQ ID NO: 42504 - DNA, 20 bp, Artificial Sequence
  chemically synthesized
aaggtagcagtggagatcac

SEQ ID NO: 42505 - DNA, 20 bp, Artificial Sequence
  chemically synthesized
tctagataaaggtagcagtg

SEQ ID NO: 42506 - DNA, 20 bp, Artificial Sequence
  chemically synthesized
gatctagataaaggtagcag

SEQ ID NO: 42507 - DNA, 20 bp, Artificial Sequence
  chemically synthesized
taagatctagataaaggtag

SEQ ID NO: 42508 - DNA, 20 bp, Artificial Sequence
  chemically synthesized
agataagatctagataaagg

SEQ ID NO: 42509 - DNA, 20 bp, Artificial Sequence
  chemically synthesized
tctccactgctacctttatc

SEQ ID NO: 42510 - DNA, 20 bp, Artificial Sequence
  chemically synthesized
gttagataagatctagataa

SEQ ID NO: 42511 - DNA, 20 bp, Artificial Sequence
  chemically synthesized
tgttagataagatctagata

SEQ ID NO: 42512 - DNA, 20 bp, Artificial Sequence
  chemically synthesized
cactggtgttagataagatc

SEQ ID NO: 42513 - DNA, 20 bp, Artificial Sequence
  chemically synthesized
gggaagcactggtgttagat

SEQ ID NO: 42514 - DNA, 20 bp, Artificial Sequence
  chemically synthesized
atctagatcttatctaacac

SEQ ID NO: 42515 - DNA, 20 bp, Artificial Sequence
  chemically synthesized
agtgtgggaagcactggtgt

SEQ ID NO: 42516 - DNA, 20 bp, Artificial Sequence
  chemically synthesized
gatagtagtgtgggaagcac

SEQ ID NO: 42517 - DNA, 20 bp, Artificial Sequence
  chemically synthesized
agaccagatagtagtgtggg

SEQ ID NO: 42518 - DNA, 20 bp, Artificial Sequence
  chemically synthesized
gggagaccagatagtagtgt

SEQ ID NO: 42519 - DNA, 20 bp, Artificial Sequence
  chemically synthesized
agggagaccagatagtagtg

SEQ ID NO: 42520 - DNA, 20 bp, Artificial Sequence
  chemically synthesized
gtgcttcccacactactatc

SEQ ID NO: 42521 - DNA, 20 bp, Artificial Sequence
  chemically synthesized
gaagcagggagaccagatag

SEQ ID NO: 42522 - DNA, 20 bp, Artificial Sequence
  chemically synthesized
gtggaagcagggagaccaga

SEQ ID NO: 42523 - DNA, 20 bp, Artificial Sequence
  chemically synthesized
cagagtggaagcagggagac

SEQ ID NO: 42524 - DNA, 20 bp, Artificial Sequence
  chemically synthesized
agagccagagtggaagcagg

SEQ ID NO: 42525 - DNA, 20 bp, Artificial Sequence
  chemically synthesized
gaagagccagagtggaagca

SEQ ID NO: 42526 - DNA, 20 bp, Artificial Sequence
  chemically synthesized
tgaagagccagagtggaagc

SEQ ID NO: 42527 - DNA, 20 bp, Artificial Sequence
  chemically synthesized
atgaagagccagagtggaag

SEQ ID NO: 42528 - DNA, 20 bp, Artificial Sequence
  chemically synthesized
tggtctccctgcttccactc

SEQ ID NO: 42529 - DNA, 20 bp, Artificial Sequence
  chemically synthesized
aatatgaagagccagagtgg

SEQ ID NO: 42530 - DNA, 20 bp, Artificial Sequence
  chemically synthesized
ggaaatatgaagagccagag

SEQ ID NO: 42531 - DNA, 20 bp, Artificial Sequence
  chemically synthesized
tgaggaaatatgaagagcca

SEQ ID NO: 42532 - DNA, 20 bp, Artificial Sequence
  chemically synthesized
ggtgaggaaatatgaagagc

SEQ ID NO: 42533 - DNA, 20 bp, Artificial Sequence
  chemically synthesized
taggggtgaggaaatatgaa

SEQ ID NO: 42534 - DNA, 20 bp, Artificial Sequence
  chemically synthesized
gttaggggtgaggaaatatg

SEQ ID NO: 42535 - DNA, 20 bp, Artificial Sequence
  chemically synthesized
gaacacgtgagttaggggtg

SEQ ID NO: 42536 - DNA, 20 bp, Artificial Sequence
  chemically synthesized
ggaacacgtgagttaggggt

SEQ ID NO: 42537 - DNA, 20 bp, Artificial Sequence
  chemically synthesized
tggtggaacacgtgagttag

SEQ ID NO: 42538 - DNA, 20 bp, Artificial Sequence
  chemically synthesized
ttggtggaacacgtgagtta

SEQ ID NO: 42539 - DNA, 20 bp, Artificial Sequence
  chemically synthesized
tttggtggaacacgtgagtt

SEQ ID NO: 42540 - DNA, 20 bp, Artificial Sequence
  chemically synthesized
atttggtggaacacgtgagt

SEQ ID NO: 42541 - DNA, 20 bp, Artificial Sequence
  chemically synthesized
atgcatttggtggaacacgt

SEQ ID NO: 42542 - DNA, 20 bp, Artificial Sequence
  chemically synthesized
tgtgtggagaatgcatttgg

SEQ ID NO: 42543 - DNA, 20 bp, Artificial Sequence
  chemically synthesized
tgctgtgtggagaatgcatt

SEQ ID NO: 42544 - DNA, 20 bp, Artificial Sequence
  chemically synthesized
caccaaatgcattctccaca

SEQ ID NO: 42545 - DNA, 20 bp, Artificial Sequence
  chemically synthesized
caaatgcattctccacacag

SEQ ID NO: 42546 - DNA, 20 bp, Artificial Sequence
  chemically synthesized
acataattggctgctgtgtg

SEQ ID NO: 42547 - DNA, 20 bp, Artificial Sequence
  chemically synthesized
agacataattggctgctgtg

SEQ ID NO: 42548 - DNA, 20 bp, Artificial Sequence
  chemically synthesized
ctagattggcaagacataat

SEQ ID NO: 42549 - DNA, 20 bp, Artificial Sequence
  chemically synthesized
ccaattatgtcttgccaatc

SEQ ID NO: 42550 - DNA, 20 bp, Artificial Sequence
  chemically synthesized
tgaaagtagactagattggc

SEQ ID NO: 42551 - DNA, 20 bp, Artificial Sequence
  chemically synthesized
agtttgaaagtagactagat

SEQ ID NO: 42552 - DNA, 20 bp, Artificial Sequence
  chemically synthesized
aatgcagtttgaaagtagac

SEQ ID NO: 42553 - DNA, 20 bp, Artificial Sequence
  chemically synthesized
gttataatgcagtttgaaag

SEQ ID NO: 42554 - DNA, 20 bp, Artificial Sequence
  chemically synthesized
tttgttataatgcagtttga

SEQ ID NO: 42555 - DNA, 20 bp, Artificial Sequence
  chemically synthesized
gctggtgctttgttataatg

SEQ ID NO: 42556 - DNA, 20 bp, Artificial Sequence
  chemically synthesized
tttcaaactgcattataaca

SEQ ID NO: 42557 - DNA, 20 bp, Artificial Sequence
  chemically synthesized
actgcattataacaaagcac

SEQ ID NO: 42558 - DNA, 20 bp, Artificial Sequence
  chemically synthesized
ggaggtgtttggttttttgc

SEQ ID NO: 42559 - DNA, 20 bp, Artificial Sequence
  chemically synthesized
tgaagtttgttggaggtgtt

SEQ ID NO: 42560 - DNA, 20 bp, Artificial Sequence
  chemically synthesized
gcctaggtgaagtttgttgg

SEQ ID NO: 42561 - DNA, 20 bp, Artificial Sequence
  chemically synthesized
agcctaggtgaagtttgttg

SEQ ID NO: 42562 - DNA, 20 bp, Artificial Sequence
  chemically synthesized
aaagcctaggtgaagtttgt

SEQ ID NO: 42563 - DNA, 20 bp, Artificial Sequence
  chemically synthesized
cacctccaacaaacttcacc

SEQ ID NO: 42564 - DNA, 20 bp, Artificial Sequence
  chemically synthesized
acctccaacaaacttcacct

SEQ ID NO: 42565 - DNA, 20 bp, Artificial Sequence
  chemically synthesized
cctttatcaaagcctaggtg

SEQ ID NO: 42566 - DNA, 20 bp, Artificial Sequence
  chemically synthesized
cttgacctttatcaaagcct

SEQ ID NO: 42567 - DNA, 20 bp, Artificial Sequence
  chemically synthesized
ccttgacctttatcaaagcc

SEQ ID NO: 42568 - DNA, 20 bp, Artificial Sequence
  chemically synthesized
acttcacctaggctttgata

SEQ ID NO: 42569 - DNA, 20 bp, Artificial Sequence
  chemically synthesized
cttcacctaggctttgataa

SEQ ID NO: 42570 - DNA, 20 bp, Artificial Sequence
  chemically synthesized
gcaaaccttgacctttatca

SEQ ID NO: 42571 - DNA, 20 bp, Artificial Sequence
  chemically synthesized
cctaggctttgataaaggtc

SEQ ID NO: 42572 - DNA, 20 bp, Artificial Sequence
  chemically synthesized
ctaggctttgataaaggtca

SEQ ID NO: 42573 - DNA, 20 bp, Artificial Sequence
  chemically synthesized
atttcaaaaattttcctctt

SEQ ID NO: 42574 - DNA, 20 bp, Artificial Sequence
  chemically synthesized
ttcaaaaattttcctctttg

SEQ ID NO: 42575 - DNA, 20 bp, Artificial Sequence
  chemically synthesized
tcttttctgcaactccaaag

SEQ ID NO: 42576 - DNA, 20 bp, Artificial Sequence
  chemically synthesized
ttcttttctgcaactccaaa

SEQ ID NO: 42577 - DNA, 20 bp, Artificial Sequence
  chemically synthesized
atttcttttctgcaactcca

SEQ ID NO: 42578 - DNA, 20 bp, Artificial Sequence
  chemically synthesized
aattttcctctttggagttg

SEQ ID NO: 42579 - DNA, 20 bp, Artificial Sequence
  chemically synthesized
tcctctttggagttgcagaa

SEQ ID NO: 42580 - DNA, 20 bp, Artificial Sequence
  chemically synthesized
agttgcagaaaagaaatatt

SEQ ID NO: 42581 - DNA, 20 bp, Artificial Sequence
  chemically synthesized
gttgcagaaaagaaatattc

SEQ ID NO: 42582 - DNA, 20 bp, Artificial Sequence
  chemically synthesized
ttgcagaaaagaaatattca

SEQ ID NO: 42583 - DNA, 20 bp, Artificial Sequence
  chemically synthesized
aaatattcagggctgaattt

SEQ ID NO: 42584 - DNA, 20 bp, Artificial Sequence
  chemically synthesized
ataagaaggttgctgaaatt

SEQ ID NO: 42585 - DNA, 20 bp, Artificial Sequence
  chemically synthesized
aatttcagcaaccttcttat

SEQ ID NO: 42586 - DNA, 20 bp, Artificial Sequence
  chemically synthesized
gtttgtaaatactaataaga

SEQ ID NO: 42587 - DNA, 20 bp, Artificial Sequence
  chemically synthesized
agtttgtaaatactaataag

SEQ ID NO: 42588 - DNA, 20 bp, Artificial Sequence
  chemically synthesized
actagtttgtaaatactaat

SEQ ID NO: 42589 - DNA, 20 bp, Artificial Sequence
  chemically synthesized
tcttattagtatttacaaac

SEQ ID NO: 42590 - DNA, 20 bp, Artificial Sequence
  chemically synthesized
acaaattagccaagtataac

SEQ ID NO: 42591 - DNA, 20 bp, Artificial Sequence
  chemically synthesized
atttacaaactagttatact

SEQ ID NO: 42592 - DNA, 20 bp, Artificial Sequence
  chemically synthesized
aatggtgttacaaattagcc

SEQ ID NO: 42593 - DNA, 20 bp, Artificial Sequence
  chemically synthesized
ctttcaatggtgttacaaat

SEQ ID NO: 42594 - DNA, 20 bp, Artificial Sequence
  chemically synthesized
ctaatttgtaacaccattga

SEQ ID NO: 42595 - DNA, 20 bp, Artificial Sequence
  chemically synthesized
ttgccaaacctcactttcaa

SEQ ID NO: 42596 - DNA, 20 bp, Artificial Sequence
  chemically synthesized
tttgtaacaccattgaaagt

SEQ ID NO: 42597 - DNA, 20 bp, Artificial Sequence
  chemically synthesized
ttgtaacaccattgaaagtg

SEQ ID NO: 42598 - DNA, 20 bp, Artificial Sequence
  chemically synthesized
acaccattgaaagtgaggtt

SEQ ID NO: 42599 - DNA, 20 bp, Artificial Sequence
  chemically synthesized
tgaaagtgaggtttggcaat

SEQ ID NO: 42600 - DNA, 20 bp, Artificial Sequence
  chemically synthesized
tttttaatgttcacaatgta

SEQ ID NO: 42601 - DNA, 20 bp, Artificial Sequence
  chemically synthesized
tgtgaacattaaaaacaaac

SEQ ID NO: 42602 - DNA, 20 bp, Artificial Sequence
  chemically synthesized
aacaaacaagacatattgtc

SEQ ID NO: 42603 - DNA, 20 bp, Artificial Sequence
  chemically synthesized
aacagcaaaaaatattttgc

SEQ ID NO: 42604 - DNA, 20 bp, Artificial Sequence
  chemically synthesized
atttcaaacaacaacaacaa

SEQ ID NO: 42605 - DNA, 20 bp, Artificial Sequence
  chemically synthesized
atatatttgaactaccttaa

SEQ ID NO: 42606 - DNA, 20 bp, Artificial Sequence
  chemically synthesized
cctctgattatcttttaagg

SEQ ID NO: 42607 - DNA, 20 bp, Artificial Sequence
  chemically synthesized
cttcctctgattatctttta

SEQ ID NO: 42608 - DNA, 20 bp, Artificial Sequence
  chemically synthesized
acttcctctgattatctttt

SEQ ID NO: 42609 - DNA, 20 bp, Artificial Sequence
  chemically synthesized
gaactaccttaaaagataat

SEQ ID NO: 42610 - DNA, 20 bp, Artificial Sequence
  chemically synthesized
actaccttaaaagataatca

SEQ ID NO: 42611 - DNA, 20 bp, Artificial Sequence
  chemically synthesized
ctaccttaaaagataatcag

SEQ ID NO: 42612 - DNA, 20 bp, Artificial Sequence
  chemically synthesized
ccttaaaagataatcagagg

SEQ ID NO: 42613 - DNA, 20 bp, Artificial Sequence
  chemically synthesized
aagataatcagaggaagtcc

SEQ ID NO: 42614 - DNA, 20 bp, Artificial Sequence
  chemically synthesized
agataatcagaggaagtccc

SEQ ID NO: 42615 - DNA, 20 bp, Artificial Sequence
  chemically synthesized
taatcagaggaagtcccagg

SEQ ID NO: 42616 - DNA, 20 bp, Artificial Sequence
  chemically synthesized
cagaggaagtcccaggtagc

SEQ ID NO: 42617 - DNA, 20 bp, Artificial Sequence
  chemically synthesized
ttttaaatgtccagctacct

SEQ ID NO: 42618 - DNA, 20 bp, Artificial Sequence
  chemically synthesized
cttttaaatgtccagctacc

SEQ ID NO: 42619 - DNA, 20 bp, Artificial Sequence
  chemically synthesized
aagacaaacttttaaatgtc

SEQ ID NO: 42620 - DNA, 20 bp, Artificial Sequence
  chemically synthesized
ccaggtagctggacatttaa

SEQ ID NO: 42621 - DNA, 20 bp, Artificial Sequence
  chemically synthesized
tgtattattttcaaagaaaa

SEQ ID NO: 42622 - DNA, 20 bp, Artificial Sequence
  chemically synthesized
agtttcatgtattattttca

SEQ ID NO: 42623 - DNA, 20 bp, Artificial Sequence
  chemically synthesized
tgaaaataatacatgaaact

SEQ ID NO: 42624 - DNA, 20 bp, Artificial Sequence
  chemically synthesized
aatacatgaaacttggaaat

SEQ ID NO: 42625 - DNA, 20 bp, Artificial Sequence
  chemically synthesized
atacatgaaacttggaaatt

SEQ ID NO: 42626 - DNA, 20 bp, Artificial Sequence
  chemically synthesized
aatatgttttcccaatttcc

SEQ ID NO: 42627 - DNA, 20 bp, Artificial Sequence
  chemically synthesized
attctttgacttgaatatta

SEQ ID NO: 42628 - DNA, 20 bp, Artificial Sequence
  chemically synthesized
acatatttactataatattc

SEQ ID NO: 42629 - DNA, 20 bp, Artificial Sequence
  chemically synthesized
ttactataatattcaagtca

SEQ ID NO: 42630 - DNA, 20 bp, Artificial Sequence
  chemically synthesized
ataatattcaagtcaaagaa

SEQ ID NO: 42631 - DNA, 20 bp, Artificial Sequence
  chemically synthesized
aatattcaagtcaaagaatg

SEQ ID NO: 42632 - DNA, 20 bp, Artificial Sequence
  chemically synthesized
agaatggagaattgcccaat

SEQ ID NO: 42633 - DNA, 20 bp, Artificial Sequence
  chemically synthesized
gaatggagaattgcccaatt

SEQ ID NO: 42634 - DNA, 20 bp, Artificial Sequence
  chemically synthesized
aatggagaattgcccaatta

SEQ ID NO: 42635 - DNA, 20 bp, Artificial Sequence
  chemically synthesized
attttatataaaccctaatt

SEQ ID NO: 42636 - DNA, 20 bp, Artificial Sequence
  chemically synthesized
aattttatataaaccctaat

SEQ ID NO: 42637 - DNA, 20 bp, Artificial Sequence
  chemically synthesized
aattagggtttatataaaat

SEQ ID NO: 42638 - DNA, 20 bp, Artificial Sequence
  chemically synthesized
ttcaaatttaaaaaaaaatc

SEQ ID NO: 42639 - DNA, 20 bp, Artificial Sequence
  chemically synthesized
tataaagatataatttagtc

SEQ ID NO: 42640 - DNA, 20 bp, Artificial Sequence
  chemically synthesized
tacattataaagatataatt

SEQ ID NO: 42641 - DNA, 20 bp, Artificial Sequence
  chemically synthesized
cttaagggttatacattata

SEQ ID NO: 42642 - DNA, 20 bp, Artificial Sequence
  chemically synthesized
ctttataatgtataaccctt

SEQ ID NO: 42643 - DNA, 20 bp, Artificial Sequence
  chemically synthesized
ttataatgtataacccttaa

SEQ ID NO: 42644 - DNA, 20 bp, Artificial Sequence
  chemically synthesized
gatatataaacaactcttaa

SEQ ID NO: 42645 - DNA, 20 bp, Artificial Sequence
  chemically synthesized
agatatataaacaactctta

SEQ ID NO: 42646 - DNA, 20 bp, Artificial Sequence
  chemically synthesized
aagatatataaacaactctt

SEQ ID NO: 42647 - DNA, 20 bp, Artificial Sequence
  chemically synthesized
agagttgtttatatatcttc

SEQ ID NO: 42648 - DNA, 20 bp, Artificial Sequence
  chemically synthesized
ttgtttatatatcttctggt

SEQ ID NO: 42649 - DNA, 20 bp, Artificial Sequence
  chemically synthesized
tccgcttatgaaccaaccag

SEQ ID NO: 42650 - DNA, 20 bp, Artificial Sequence
  chemically synthesized
tcttccgcttatgaaccaac

SEQ ID NO: 42651 - DNA, 20 bp, Artificial Sequence
  chemically synthesized
atatcttctggttggttcat

SEQ ID NO: 42652 - DNA, 20 bp, Artificial Sequence
  chemically synthesized
tcttctggttggttcataag

SEQ ID NO: 42653 - DNA, 20 bp, Artificial Sequence
  chemically synthesized
tctggttggttcataagcgg

SEQ ID NO: 42654 - DNA, 20 bp, Artificial Sequence
  chemically synthesized
tggttggttcataagcggaa

SEQ ID NO: 42655 - DNA, 20 bp, Artificial Sequence
  chemically synthesized
aatgatactgaacagtgcag

SEQ ID NO: 42656 - DNA, 20 bp, Artificial Sequence
  chemically synthesized
ggaagagctgctgcactgtt

SEQ ID NO: 42657 - DNA, 20 bp, Artificial Sequence
  chemically synthesized
ggaaatgatactgaacagtg

SEQ ID NO: 42658 - DNA, 20 bp, Artificial Sequence
  chemically synthesized
tatggggaaatgatactgaa

SEQ ID NO: 42659 - DNA, 20 bp, Artificial Sequence
  chemically synthesized
tcatttctcagtgaaatatg

SEQ ID NO: 42660 - DNA, 20 bp, Artificial Sequence
  chemically synthesized
ttcatttctcagtgaaatat

SEQ ID NO: 42661 - DNA, 20 bp, Artificial Sequence
  chemically synthesized
cttcatttctcagtgaaata

SEQ ID NO: 42662 - DNA, 20 bp, Artificial Sequence
  chemically synthesized
tcatttccccatatttcact

SEQ ID NO: 42663 - DNA, 20 bp, Artificial Sequence
  chemically synthesized
ccatatttcactgagaaatg

SEQ ID NO: 42664 - DNA, 20 bp, Artificial Sequence
  chemically synthesized
actctctgaacttcatttct

SEQ ID NO: 42665 - DNA, 20 bp, Artificial Sequence
  chemically synthesized
tttcactgagaaatgaagtt

SEQ ID NO: 42666 - DNA, 20 bp, Artificial Sequence
  chemically synthesized
tcactgagaaatgaagttca

SEQ ID NO: 42667 - DNA, 20 bp, Artificial Sequence
  chemically synthesized
actgagaaatgaagttcaga

SEQ ID NO: 42668 - DNA, 20 bp, Artificial Sequence
  chemically synthesized
agagagtaatgaaattatgt

SEQ ID NO: 42669 - DNA, 20 bp, Artificial Sequence
  chemically synthesized
gagagtaatgaaattatgta

SEQ ID NO: 42670 - DNA, 20 bp, Artificial Sequence
  chemically synthesized
agagtaatgaaattatgtaa

SEQ ID NO: 42671 - DNA, 20 bp, Artificial Sequence
  chemically synthesized
atattattttataacatcta

SEQ ID NO: 42672 - DNA, 20 bp, Artificial Sequence
  chemically synthesized
gtccaaagatgtaaattcta

SEQ ID NO: 42673 - DNA, 20 bp, Artificial Sequence
  chemically synthesized
atctatagaatttacatctt

SEQ ID NO: 42674 - DNA, 20 bp, Artificial Sequence
  chemically synthesized
aatttaggcatgagagtcca

SEQ ID NO: 42675 - DNA, 20 bp, Artificial Sequence
  chemically synthesized
gaaattaaatttaggcatga

SEQ ID NO: 42676 - DNA, 20 bp, Artificial Sequence
  chemically synthesized
aggaaattaaatttaggcat

SEQ ID NO: 42677 - DNA, 20 bp, Artificial Sequence
  chemically synthesized
accaataggaaattaaattt

SEQ ID NO: 42678 - DNA, 20 bp, Artificial Sequence
  chemically synthesized
aaccaataggaaattaaatt

SEQ ID NO: 42679 - DNA, 20 bp, Artificial Sequence
  chemically synthesized
gcctaaatttaatttcctat

SEQ ID NO: 42680 - DNA, 20 bp, Artificial Sequence
  chemically synthesized
agatgaaataataaaccaat

SEQ ID NO: 42681 - DNA, 20 bp, Artificial Sequence
  chemically synthesized
gagatgaaataataaaccaa

SEQ ID NO: 42682 - DNA, 20 bp, Artificial Sequence
  chemically synthesized
taaaacacagaagtcaggcg

SEQ ID NO: 42683 - DNA, 20 bp, Artificial Sequence
  chemically synthesized
tataaaacacagaagtcagg

SEQ ID NO: 42684 - DNA, 20 bp, Artificial Sequence
  chemically synthesized
ggatataaaacacagaagtc

SEQ ID NO: 42685 - DNA, 20 bp, Artificial Sequence
  chemically synthesized
gggatataaaacacagaagt

SEQ ID NO: 42686 - DNA, 20 bp, Artificial Sequence
  chemically synthesized
atttgggatataaaacacag

SEQ ID NO: 42687 - DNA, 20 bp, Artificial Sequence
  chemically synthesized
ttaatttgggatataaaaca

SEQ ID NO: 42688 - DNA, 20 bp, Artificial Sequence
  chemically synthesized
atctgtgggaaatttaattt

SEQ ID NO: 42689 - DNA, 20 bp, Artificial Sequence
  chemically synthesized
aatctgtgggaaatttaatt

SEQ ID NO: 42690 - DNA, 20 bp, Artificial Sequence
  chemically synthesized
atcccaaattaaatttccca

SEQ ID NO: 42691 - DNA, 20 bp, Artificial Sequence
  chemically synthesized
atatacctaaggaaatctgt

SEQ ID NO: 42692 - DNA, 20 bp, Artificial Sequence
  chemically synthesized
aatatacctaaggaaatctg

SEQ ID NO: 42693 - DNA, 20 bp, Artificial Sequence
  chemically synthesized
aaatttcccacagatttcct

SEQ ID NO: 42694 - DNA, 20 bp, Artificial Sequence
  chemically synthesized
aatttcccacagatttcctt

SEQ ID NO: 42695 - DNA, 20 bp, Artificial Sequence
  chemically synthesized
atagagtaataatataccta

SEQ ID NO: 42696 - DNA, 20 bp, Artificial Sequence
  chemically synthesized
tatagagtaataatatacct

SEQ ID NO: 42697 - DNA, 20 bp, Artificial Sequence
  chemically synthesized
tatattattactctataaaa

SEQ ID NO: 42698 - DNA, 20 bp, Artificial Sequence
  chemically synthesized
cagattattgccattttata

SEQ ID NO: 42699 - DNA, 20 bp, Artificial Sequence
  chemically synthesized
aacagattattgccatttta

SEQ ID NO: 42700 - DNA, 20 bp, Artificial Sequence
  chemically synthesized
tggcaataatctgttcacta

SEQ ID NO: 42701 - DNA, 20 bp, Artificial Sequence
  chemically synthesized
atagtgttggctatagtgaa

SEQ ID NO: 42702 - DNA, 20 bp, Artificial Sequence
  chemically synthesized
ttaagcaatagtgttggcta

SEQ ID NO: 42703 - DNA, 20 bp, Artificial Sequence
  chemically synthesized
agatgattaagcaatagtgt

SEQ ID NO: 42704 - DNA, 20 bp, Artificial Sequence
  chemically synthesized
ttacaaagatgattaagcaa

SEQ ID NO: 42705 - DNA, 20 bp, Artificial Sequence
  chemically synthesized
aaataattacaaagatgatt

SEQ ID NO: 42706 - DNA, 20 bp, Artificial Sequence
  chemically synthesized
gaaatgataaaataattaca

SEQ ID NO: 42707 - DNA, 20 bp, Artificial Sequence
  chemically synthesized
gtattacaaaacaaaaaata

SEQ ID NO: 42708 - DNA, 20 bp, Artificial Sequence
  chemically synthesized
gtgtattacaaaacaaaaaa

SEQ ID NO: 42709 - DNA, 20 bp, Artificial Sequence
  chemically synthesized
tgttttgtaatacacatatt

SEQ ID NO: 42710 - DNA, 20 bp, Artificial Sequence
  chemically synthesized
gttttgtaatacacatattt

SEQ ID NO: 42711 - DNA, 20 bp, Artificial Sequence
  chemically synthesized
tgtaatacacatatttagga

SEQ ID NO: 42712 - DNA, 20 bp, Artificial Sequence
  chemically synthesized
gtaatacacatatttaggaa

SEQ ID NO: 42713 - DNA, 20 bp, Artificial Sequence
  chemically synthesized
acacatatttaggaaaggac

SEQ ID NO: 42714 - DNA, 20 bp, Artificial Sequence
  chemically synthesized
actttgtcaatttaggaatt

SEQ ID NO: 42715 - DNA, 20 bp, Artificial Sequence
  chemically synthesized
acgtagtactttgtcaattt

SEQ ID NO: 42716 - DNA, 20 bp, Artificial Sequence
  chemically synthesized
tacgtagtactttgtcaatt

SEQ ID NO: 42717 - DNA, 20 bp, Artificial Sequence
  chemically synthesized
accaaattcctaaattgaca

SEQ ID NO: 42718 - DNA, 20 bp, Artificial Sequence
  chemically synthesized
acttctgtttaatttatacg

SEQ ID NO: 42719 - DNA, 20 bp, Artificial Sequence
  chemically synthesized
agtactacgtataaattaaa

SEQ ID NO: 42720 - DNA, 20 bp, Artificial Sequence
  chemically synthesized
actacgtataaattaaacag

SEQ ID NO: 42721 - DNA, 20 bp, Artificial Sequence
  chemically synthesized
cgtataaattaaacagaagt

SEQ ID NO: 42722 - DNA, 20 bp, Artificial Sequence
  chemically synthesized
aaattaaacagaagttggta

SEQ ID NO: 42723 - DNA, 20 bp, Artificial Sequence
  chemically synthesized
aaacagaagttggtacagtc

SEQ ID NO: 42724 - DNA, 20 bp, Artificial Sequence
  chemically synthesized
caagcatgaatctctgaata

SEQ ID NO: 42725 - DNA, 20 bp, Artificial Sequence
  chemically synthesized
aaagttggtggctttattca

SEQ ID NO: 42726 - DNA, 20 bp, Artificial Sequence
  chemically synthesized
tcaaagttggtggctttatt

SEQ ID NO: 42727 - DNA, 20 bp, Artificial Sequence
  chemically synthesized
gaaacacttctcaaagttgg

SEQ ID NO: 42728 - DNA, 20 bp, Artificial Sequence
  chemically synthesized
tgaataaagccaccaacttt

SEQ ID NO: 42729 - DNA, 20 bp, Artificial Sequence
  chemically synthesized
ttggaaacacttctcaaagt

SEQ ID NO: 42730 - DNA, 20 bp, Artificial Sequence
  chemically synthesized
ataaagccaccaactttgag

SEQ ID NO: 42731 - DNA, 20 bp, Artificial Sequence
  chemically synthesized
gttgttggaaacacttctca

SEQ ID NO: 42732 - DNA, 20 bp, Artificial Sequence
  chemically synthesized
aaaaaagtacttgaggttgt

SEQ ID NO: 42733 - DNA, 20 bp, Artificial Sequence
  chemically synthesized
gaagtgtttccaacaacctc

SEQ ID NO: 42734 - DNA, 20 bp, Artificial Sequence
  chemically synthesized
gtgaagaaaaaaagtacttg

SEQ ID NO: 42735 - DNA, 20 bp, Artificial Sequence
  chemically synthesized
agtgaagaaaaaaagtactt

SEQ ID NO: 42736 - DNA, 20 bp, Artificial Sequence
  chemically synthesized
aagagtggagtgaagaaaaa

SEQ ID NO: 42737 - DNA, 20 bp, Artificial Sequence
  chemically synthesized
gttttataaagagtggagtg

SEQ ID NO: 42738 - DNA, 20 bp, Artificial Sequence
  chemically synthesized
accaagttttataaagagtg

SEQ ID NO: 42739 - DNA, 20 bp, Artificial Sequence
  chemically synthesized
tcaccaagttttataaagag

SEQ ID NO: 42740 - DNA, 20 bp, Artificial Sequence
  chemically synthesized
ttatcaccaagttttataaa

SEQ ID NO: 42741 - DNA, 20 bp, Artificial Sequence
  chemically synthesized
ctttatcaccaagttttata

SEQ ID NO: 42742 - DNA, 20 bp, Artificial Sequence
  chemically synthesized
actccactctttataaaact

SEQ ID NO: 42743 - DNA, 20 bp, Artificial Sequence
  chemically synthesized
ctttataaaacttggtgata

SEQ ID NO: 42744 - DNA, 20 bp, Artificial Sequence
  chemically synthesized
tcgtgaacacctttatcacc

SEQ ID NO: 42745 - DNA, 20 bp, Artificial Sequence
  chemically synthesized
tttataaaacttggtgataa

SEQ ID NO: 42746 - DNA, 20 bp, Artificial Sequence
  chemically synthesized
ggtgataaaggtgttcacga

SEQ ID NO: 42747 - DNA, 20 bp, Artificial Sequence
  chemically synthesized
ggtgttcacgatggaactaa

SEQ ID NO: 42748 - DNA, 20 bp, Artificial Sequence
  chemically synthesized
attttaatccaaataacttt

SEQ ID NO: 42749 - DNA, 20 bp, Artificial Sequence
  chemically synthesized
cgatggaactaaaagttatt

SEQ ID NO: 42750 - DNA, 20 bp, Artificial Sequence
  chemically synthesized
tatttggattaaaatattgc

SEQ ID NO: 42751 - DNA, 20 bp, Artificial Sequence
  chemically synthesized
ggattaaaatattgctggtc

SEQ ID NO: 42752 - DNA, 20 bp, Artificial Sequence
  chemically synthesized
gattaaaatattgctggtct

SEQ ID NO: 42753 - DNA, 20 bp, Artificial Sequence
  chemically synthesized
gggaagcatgaatcccagac

SEQ ID NO: 42754 - DNA, 20 bp, Artificial Sequence
  chemically synthesized
gcttggggaagcatgaatcc

SEQ ID NO: 42755 - DNA, 20 bp, Artificial Sequence
  chemically synthesized
tctgggattcatgcttcccc

SEQ ID NO: 42756 - DNA, 20 bp, Artificial Sequence
  chemically synthesized
caaatcaatattgcttgggg

SEQ ID NO: 42757 - DNA, 20 bp, Artificial Sequence
  chemically synthesized
tagcaaatcaatattgcttg

SEQ ID NO: 42758 - DNA, 20 bp, Artificial Sequence
  chemically synthesized
ctagcaaatcaatattgctt

SEQ ID NO: 42759 - DNA, 20 bp, Artificial Sequence
  chemically synthesized
cctagcaaatcaatattgct

SEQ ID NO: 42760 - DNA, 20 bp, Artificial Sequence
  chemically synthesized
cccaagcaatattgatttgc

SEQ ID NO: 42761 - DNA, 20 bp, Artificial Sequence
  chemically synthesized
ccaagcaatattgatttgct

SEQ ID NO: 42762 - DNA, 20 bp, Artificial Sequence
  chemically synthesized
caagcaatattgatttgcta

SEQ ID NO: 42763 - DNA, 20 bp, Artificial Sequence
  chemically synthesized
aagcaatattgatttgctag

SEQ ID NO: 42764 - DNA, 20 bp, Artificial Sequence
  chemically synthesized
aagaacagaaaaaaatcccc

SEQ ID NO: 42765 - DNA, 20 bp, Artificial Sequence
  chemically synthesized
ttaaaaagactgaataagaa

SEQ ID NO: 42766 - DNA, 20 bp, Artificial Sequence
  chemically synthesized
gatttttttctgttcttatt

SEQ ID NO: 42767 - DNA, 20 bp, Artificial Sequence
  chemically synthesized
ttaaattaaaaagactgaat

SEQ ID NO: 42768 - DNA, 20 bp, Artificial Sequence
  chemically synthesized
ataaaatattttaaattaaa

SEQ ID NO: 42769 - DNA, 20 bp, Artificial Sequence
  chemically synthesized
tcagtaaaacatcagaaaaa

SEQ ID NO: 42770 - DNA, 20 bp, Artificial Sequence
  chemically synthesized
gaattaattcagtaaaacat

SEQ ID NO: 42771 - DNA, 20 bp, Artificial Sequence
  chemically synthesized
tggaaactatagaattaatt

SEQ ID NO: 42772 - DNA, 20 bp, Artificial Sequence
  chemically synthesized
gttttactgaattaattcta

SEQ ID NO: 42773 - DNA, 20 bp, Artificial Sequence
  chemically synthesized
tgaattaattctatagtttc

SEQ ID NO: 42774 - DNA, 20 bp, Artificial Sequence
  chemically synthesized
ttgccgtggcctggaaacta

SEQ ID NO: 42775 - DNA, 20 bp, Artificial Sequence
  chemically synthesized
gaattaattctatagtttcc

SEQ ID NO: 42776 - DNA, 20 bp, Artificial Sequence
  chemically synthesized
attctatagtttccaggcca

SEQ ID NO: 42777 - DNA, 20 bp, Artificial Sequence
  chemically synthesized
ttacagtagttgccgtggcc

SEQ ID NO: 42778 - DNA, 20 bp, Artificial Sequence
  chemically synthesized
tacccttacagtagttgccg

SEQ ID NO: 42779 - DNA, 20 bp, Artificial Sequence
  chemically synthesized
caggccacggcaactactgt

SEQ ID NO: 42780 - DNA, 20 bp, Artificial Sequence
  chemically synthesized
aggccacggcaactactgta

SEQ ID NO: 42781 - DNA, 20 bp, Artificial Sequence
  chemically synthesized
ggccacggcaactactgtaa

SEQ ID NO: 42782 - DNA, 20 bp, Artificial Sequence
  chemically synthesized
tatgggccatacccttacag

SEQ ID NO: 42783 - DNA, 20 bp, Artificial Sequence
  chemically synthesized
cagtatgggccataccctta

SEQ ID NO: 42784 - DNA, 20 bp, Artificial Sequence
  chemically synthesized
cggcaactactgtaagggta

SEQ ID NO: 42785 - DNA, 20 bp, Artificial Sequence
  chemically synthesized
aagggtatggcccatactgt

SEQ ID NO: 42786 - DNA, 20 bp, Artificial Sequence
  chemically synthesized
ataatataatctgacagtat

SEQ ID NO: 42787 - DNA, 20 bp, Artificial Sequence
  chemically synthesized
aataatataatctgacagta

SEQ ID NO: 42788 - DNA, 20 bp, Artificial Sequence
  chemically synthesized
cactgaataatataatctga

SEQ ID NO: 42789 - DNA, 20 bp, Artificial Sequence
  chemically synthesized
tactgtcagattatattatt

SEQ ID NO: 42790 - DNA, 20 bp, Artificial Sequence
  chemically synthesized
gaaggatctgagatgagcag

SEQ ID NO: 42791 - DNA, 20 bp, Artificial Sequence
  chemically synthesized
tgaaggatctgagatgagca

SEQ ID NO: 42792 - DNA, 20 bp, Artificial Sequence
  chemically synthesized
cagtgttcctctgctcatct

SEQ ID NO: 42793 - DNA, 20 bp, Artificial Sequence
  chemically synthesized
tctgaaggatctgagatgag

SEQ ID NO: 42794 - DNA, 20 bp, Artificial Sequence
  chemically synthesized
gcctctgaaggatctgagat

SEQ ID NO: 42795 - DNA, 20 bp, Artificial Sequence
  chemically synthesized
tagcagcctctgaaggatct

SEQ ID NO: 42796 - DNA, 20 bp, Artificial Sequence
  chemically synthesized
tctgctcatctcagatcctt

SEQ ID NO: 42797 - DNA, 20 bp, Artificial Sequence
  chemically synthesized
tgctcatctcagatccttca

SEQ ID NO: 42798 - DNA, 20 bp, Artificial Sequence
  chemically synthesized
gctcatctcagatccttcag

SEQ ID NO: 42799 - DNA, 20 bp, Artificial Sequence
  chemically synthesized
gtaaaaatagcagcctctga

SEQ ID NO: 42800 - DNA, 20 bp, Artificial Sequence
  chemically synthesized
tgtaaaaatagcagcctctg

SEQ ID NO: 42801 - DNA, 20 bp, Artificial Sequence
  chemically synthesized
aatagaacgtgtaaaaatag

SEQ ID NO: 42802 - DNA, 20 bp, Artificial Sequence
  chemically synthesized
tgtaatagaacgtgtaaaaa

SEQ ID NO: 42803 - DNA, 20 bp, Artificial Sequence
  chemically synthesized
ctaaaagtcctgatgtgtaa

SEQ ID NO: 42804 - DNA, 20 bp, Artificial Sequence
  chemically synthesized
ttacacgttctattacacat

SEQ ID NO: 42805 - DNA, 20 bp, Artificial Sequence
  chemically synthesized
tacacgttctattacacatc

SEQ ID NO: 42806 - DNA, 20 bp, Artificial Sequence
  chemically synthesized
ctattacacatcaggacttt

SEQ ID NO: 42807 - DNA, 20 bp, Artificial Sequence
  chemically synthesized
tattacacatcaggactttt

SEQ ID NO: 42808 - DNA, 20 bp, Artificial Sequence
  chemically synthesized
tctttaaaattaaaacctaa

SEQ ID NO: 42809 - DNA, 20 bp, Artificial Sequence
  chemically synthesized
acttttaggttttaatttta

SEQ ID NO: 42810 - DNA, 20 bp, Artificial Sequence
  chemically synthesized
tttaggttttaattttaaag

SEQ ID NO: 42811 - DNA, 20 bp, Artificial Sequence
  chemically synthesized
taaagaagtgttccacattt

SEQ ID NO: 42812 - DNA, 20 bp, Artificial Sequence
  chemically synthesized
tatatcagagggctcaaatg

SEQ ID NO: 42813 - DNA, 20 bp, Artificial Sequence
  chemically synthesized
ataactcagggtatatcaga

SEQ ID NO: 42814 - DNA, 20 bp, Artificial Sequence
  chemically synthesized
tataactcagggtatatcag

SEQ ID NO: 42815 - DNA, 20 bp, Artificial Sequence
  chemically synthesized
ctataactcagggtatatca

SEQ ID NO: 42816 - DNA, 20 bp, Artificial Sequence
  chemically synthesized
aactataactcagggtatat

SEQ ID NO: 42817 - DNA, 20 bp, Artificial Sequence
  chemically synthesized
tgagccctctgatataccct

SEQ ID NO: 42818 - DNA, 20 bp, Artificial Sequence
  chemically synthesized
ctctgatataccctgagtta

SEQ ID NO: 42819 - DNA, 20 bp, Artificial Sequence
  chemically synthesized
gtaactgtaactataactca

SEQ ID NO: 42820 - DNA, 20 bp, Artificial Sequence
  chemically synthesized
tgtaactgtaactataactc

SEQ ID NO: 42821 - DNA, 20 bp, Artificial Sequence
  chemically synthesized
ctgtaactgtaactataact

SEQ ID NO: 42822 - DNA, 20 bp, Artificial Sequence
  chemically synthesized
tataccctgagttatagtta

SEQ ID NO: 42823 - DNA, 20 bp, Artificial Sequence
  chemically synthesized
ctgagttatagttacagtta

SEQ ID NO: 42824 - DNA, 20 bp, Artificial Sequence
  chemically synthesized
tatagttacagttacagtta

SEQ ID NO: 42825 - DNA, 20 bp, Artificial Sequence
  chemically synthesized
gttacagttacagttacagt

SEQ ID NO: 42826 - DNA, 20 bp, Artificial Sequence
  chemically synthesized
gttacagtcagataacttct

SEQ ID NO: 42827 - DNA, 20 bp, Artificial Sequence
  chemically synthesized
acaaagtcattttttctgag

SEQ ID NO: 42828 - DNA, 20 bp, Artificial Sequence
  chemically synthesized
actacaaagtcattttttct

SEQ ID NO: 42829 - DNA, 20 bp, Artificial Sequence
  chemically synthesized
tctcagaaaaaatgactttg

SEQ ID NO: 42830 - DNA, 20 bp, Artificial Sequence
  chemically synthesized
gaaaacatgttcaaactaca

SEQ ID NO: 42831 - DNA, 20 bp, Artificial Sequence
  chemically synthesized
aaaattaacatggagggatg

SEQ ID NO: 42832 - DNA, 20 bp, Artificial Sequence
  chemically synthesized
aaaaaattaacatggaggga

SEQ ID NO: 42833 - DNA, 20 bp, Artificial Sequence
  chemically synthesized
ctggaaaaaattaacatgga

SEQ ID NO: 42834 - DNA, 20 bp, Artificial Sequence
  chemically synthesized
actggaaaaaattaacatgg

SEQ ID NO: 42835 - DNA, 20 bp, Artificial Sequence
  chemically synthesized
aactggaaaaaattaacatg

SEQ ID NO: 42836 - DNA, 20 bp, Artificial Sequence
  chemically synthesized
tgaactggaaaaaattaaca

SEQ ID NO: 42837 - DNA, 20 bp, Artificial Sequence
  chemically synthesized
ccctccatgttaattttttc

SEQ ID NO: 42838 - DNA, 20 bp, Artificial Sequence
  chemically synthesized
gttaattttttccagttcac

SEQ ID NO: 42839 - DNA, 20 bp, Artificial Sequence
  chemically synthesized
tcttgttttcacttgtgaac

SEQ ID NO: 42840 - DNA, 20 bp, Artificial Sequence
  chemically synthesized
tccagttcacaagtgaaaac

SEQ ID NO: 42841 - DNA, 20 bp, Artificial Sequence
  chemically synthesized
ttcacaagtgaaaacaagat

SEQ ID NO: 42842 - DNA, 20 bp, Artificial Sequence
  chemically synthesized
catactgactggtagattca

SEQ ID NO: 42843 - DNA, 20 bp, Artificial Sequence
  chemically synthesized
ttagtatgctctgaatctac

SEQ ID NO: 42844 - DNA, 20 bp, Artificial Sequence
  chemically synthesized
aacatactgactggtagatt

SEQ ID NO: 42845 - DNA, 20 bp, Artificial Sequence
  chemically synthesized
tatgctctgaatctaccagt

SEQ ID NO: 42846 - DNA, 20 bp, Artificial Sequence
  chemically synthesized
agatgaaacatactgactgg

SEQ ID NO: 42847 - DNA, 20 bp, Artificial Sequence
  chemically synthesized
ggaagatgaaacatactgac

SEQ ID NO: 42848 - DNA, 20 bp, Artificial Sequence
  chemically synthesized
gcagttcaatgttgaggtgg

SEQ ID NO: 42849 - DNA, 20 bp, Artificial Sequence
  chemically synthesized
gaagcagttcaatgttgagg

SEQ ID NO: 42850 - DNA, 20 bp, Artificial Sequence
  chemically synthesized
aaggaagcagttcaatgttg

SEQ ID NO: 42851 - DNA, 20 bp, Artificial Sequence
  chemically synthesized
aaaggaagcagttcaatgtt

SEQ ID NO: 42852 - DNA, 20 bp, Artificial Sequence
  chemically synthesized
atgtataaggtgaaaggaag

SEQ ID NO: 42853 - DNA, 20 bp, Artificial Sequence
  chemically synthesized
aagatgtataaggtgaaagg

SEQ ID NO: 42854 - DNA, 20 bp, Artificial Sequence
  chemically synthesized
aaaaagatgtataaggtgaa

SEQ ID NO: 42855 - DNA, 20 bp, Artificial Sequence
  chemically synthesized
taaaaagatgtataaggtga

SEQ ID NO: 42856 - DNA, 20 bp, Artificial Sequence
  chemically synthesized
attgtttaaaaagatgtata

SEQ ID NO: 42857 - DNA, 20 bp, Artificial Sequence
  chemically synthesized
tattgtttaaaaagatgtat

SEQ ID NO: 42858 - DNA, 20 bp, Artificial Sequence
  chemically synthesized
ccttgaatgtattgtttaaa

SEQ ID NO: 42859 - DNA, 20 bp, Artificial Sequence
  chemically synthesized
tctttttaaacaatacattc

SEQ ID NO: 42860 - DNA, 20 bp, Artificial Sequence
  chemically synthesized
ctttttaaacaatacattca

SEQ ID NO: 42861 - DNA, 20 bp, Artificial Sequence
  chemically synthesized
aaacaatacattcaaggact

SEQ ID NO: 42862 - DNA, 20 bp, Artificial Sequence
  chemically synthesized
aaaattgccaattatattcc

SEQ ID NO: 42863 - DNA, 20 bp, Artificial Sequence
  chemically synthesized
tcaaggacttggaatataat

SEQ ID NO: 42864 - DNA, 20 bp, Artificial Sequence
  chemically synthesized
caattttgttgatgatgaat

SEQ ID NO: 42865 - DNA, 20 bp, Artificial Sequence
  chemically synthesized
aattttgttgatgatgaatg

SEQ ID NO: 42866 - DNA, 20 bp, Artificial Sequence
  chemically synthesized
tgttgatgatgaatgaggct

SEQ ID NO: 42867 - DNA, 20 bp, Artificial Sequence
  chemically synthesized
aaaggcatcattatattgct

SEQ ID NO: 42868 - DNA, 20 bp, Artificial Sequence
  chemically synthesized
aagcactatagagtagcaaa

SEQ ID NO: 42869 - DNA, 20 bp, Artificial Sequence
  chemically synthesized
aaagcactatagagtagcaa

SEQ ID NO: 42870 - DNA, 20 bp, Artificial Sequence
  chemically synthesized
tgatgccttttgctactcta

SEQ ID NO: 42871 - DNA, 20 bp, Artificial Sequence
  chemically synthesized
ttactgaaagcactatagag

SEQ ID NO: 42872 - DNA, 20 bp, Artificial Sequence
  chemically synthesized
tttttactgaaagcactata

SEQ ID NO: 42873 - DNA, 20 bp, Artificial Sequence
  chemically synthesized
tctttttactgaaagcacta

SEQ ID NO: 42874 - DNA, 20 bp, Artificial Sequence
  chemically synthesized
ttgctactctatagtgcttt

SEQ ID NO: 42875 - DNA, 20 bp, Artificial Sequence
  chemically synthesized
aagccatttctttttactga

SEQ ID NO: 42876 - DNA, 20 bp, Artificial Sequence
  chemically synthesized
tctatagtgctttcagtaaa

SEQ ID NO: 42877 - DNA, 20 bp, Artificial Sequence
  chemically synthesized
gtgctttcagtaaaaagaaa

SEQ ID NO: 42878 - DNA, 20 bp, Artificial Sequence
  chemically synthesized
tcagtaaaaagaaatggctt

SEQ ID NO: 42879 - DNA, 20 bp, Artificial Sequence
  chemically synthesized
cagtaaaaagaaatggcttg

SEQ ID NO: 42880 - DNA, 20 bp, Artificial Sequence
  chemically synthesized
aaagaaatggcttgaggact

SEQ ID NO: 42881 - DNA, 20 bp, Artificial Sequence
  chemically synthesized
ttcatatactcttagtcctc

SEQ ID NO: 42882 - DNA, 20 bp, Artificial Sequence
  chemically synthesized
agaaatggcttgaggactaa

SEQ ID NO: 42883 - DNA, 20 bp, Artificial Sequence
  chemically synthesized
actcatatttcatatactct

SEQ ID NO: 42884 - DNA, 20 bp, Artificial Sequence
  chemically synthesized
actaagagtatatgaaatat

SEQ ID NO: 42885 - DNA, 20 bp, Artificial Sequence
  chemically synthesized
agagtatatgaaatatgagt

SEQ ID NO: 42886 - DNA, 20 bp, Artificial Sequence
  chemically synthesized
agtatatgaaatatgagtga

SEQ ID NO: 42887 - DNA, 20 bp, Artificial Sequence
  chemically synthesized
tgaaatatgagtgagagaaa

SEQ ID NO: 42888 - DNA, 20 bp, Artificial Sequence
  chemically synthesized
tgagtgagagaaaaagctct

SEQ ID NO: 42889 - DNA, 20 bp, Artificial Sequence
  chemically synthesized
gagtgagagaaaaagctcta

SEQ ID NO: 42890 - DNA, 20 bp, Artificial Sequence
  chemically synthesized
ctttattatcaaggacctta

SEQ ID NO: 42891 - DNA, 20 bp, Artificial Sequence
  chemically synthesized
tgctttattatcaaggacct

SEQ ID NO: 42892 - DNA, 20 bp, Artificial Sequence
  chemically synthesized
ttaaaggtgctttattatca

SEQ ID NO: 42893 - DNA, 20 bp, Artificial Sequence
  chemically synthesized
ctctaaggtccttgataata

SEQ ID NO: 42894 - DNA, 20 bp, Artificial Sequence
  chemically synthesized
tttaaaggtgctttattatc

SEQ ID NO: 42895 - DNA, 20 bp, Artificial Sequence
  chemically synthesized
atctcatgatatcgttttaa

SEQ ID NO: 42896 - DNA, 20 bp, Artificial Sequence
  chemically synthesized
catctcatgatatcgtttta

SEQ ID NO: 42897 - DNA, 20 bp, Artificial Sequence
  chemically synthesized
cacctttaaaacgatatcat

SEQ ID NO: 42898 - DNA, 20 bp, Artificial Sequence
  chemically synthesized
tttggggtttttttggtagg

SEQ ID NO: 42899 - DNA, 20 bp, Artificial Sequence
  chemically synthesized
tttttggggtttttttggta

SEQ ID NO: 42900 - DNA, 20 bp, Artificial Sequence
  chemically synthesized
ttttttggggtttttttggt

SEQ ID NO: 42901 - DNA, 20 bp, Artificial Sequence
  chemically synthesized
gttttttggggtttttttgg

SEQ ID NO: 42902 - DNA, 20 bp, Artificial Sequence
  chemically synthesized
atagttttttggggtttttt

SEQ ID NO: 42903 - DNA, 20 bp, Artificial Sequence
  chemically synthesized
ttttcacacatagttttttg

SEQ ID NO: 42904 - DNA, 20 bp, Artificial Sequence
  chemically synthesized
tttttcacacatagtttttt

SEQ ID NO: 42905 - DNA, 20 bp, Artificial Sequence
  chemically synthesized
ttttttcacacatagttttt

SEQ ID NO: 42906 - DNA, 20 bp, Artificial Sequence
  chemically synthesized
gccgatttttttttcacaca

SEQ ID NO: 42907 - DNA, 20 bp, Artificial Sequence
  chemically synthesized
actatgtgtgaaaaaaaaat

SEQ ID NO: 42908 - DNA, 20 bp, Artificial Sequence
  chemically synthesized
tgcccgatgttgatacaaga

SEQ ID NO: 42909 - DNA, 20 bp, Artificial Sequence
  chemically synthesized
aatgcccgatgttgatacaa

SEQ ID NO: 42910 - DNA, 20 bp, Artificial Sequence
  chemically synthesized
tgaatgcccgatgttgatac

SEQ ID NO: 42911 - DNA, 20 bp, Artificial Sequence
  chemically synthesized
cggctctcttgtatcaacat

SEQ ID NO: 42912 - DNA, 20 bp, Artificial Sequence
  chemically synthesized
ggctctcttgtatcaacatc

SEQ ID NO: 42913 - DNA, 20 bp, Artificial Sequence
  chemically synthesized
tcattaccagacacatacaa

SEQ ID NO: 42914 - DNA, 20 bp, Artificial Sequence
  chemically synthesized
taaaatcttttgtatgtgtc

SEQ ID NO: 42915 - DNA, 20 bp, Artificial Sequence
  chemically synthesized
taaatattagatatcattac

SEQ ID NO: 42916 - DNA, 20 bp, Artificial Sequence
  chemically synthesized
tgcctttctctgttaaatat

SEQ ID NO: 42917 - DNA, 20 bp, Artificial Sequence
  chemically synthesized
taatgatatctaatatttaa

SEQ ID NO: 42918 - DNA, 20 bp, Artificial Sequence
  chemically synthesized
atgatatctaatatttaaca

SEQ ID NO: 42919 - DNA, 20 bp, Artificial Sequence
  chemically synthesized
tatctaatatttaacagaga

SEQ ID NO: 42920 - DNA, 20 bp, Artificial Sequence
  chemically synthesized
atctaatatttaacagagaa

SEQ ID NO: 42921 - DNA, 20 bp, Artificial Sequence
  chemically synthesized
taacagagaaaggcaaaaac

SEQ ID NO: 42922 - DNA, 20 bp, Artificial Sequence
  chemically synthesized
gagaaaggcaaaaactggtt

SEQ ID NO: 42923 - DNA, 20 bp, Artificial Sequence
  chemically synthesized
agaattcagttatactcaac

SEQ ID NO: 42924 - DNA, 20 bp, Artificial Sequence
  chemically synthesized
aagacttcaagtttagaatt

SEQ ID NO: 42925 - DNA, 20 bp, Artificial Sequence
  chemically synthesized
ataactgaattctaaacttg

SEQ ID NO: 42926 - DNA, 20 bp, Artificial Sequence
  chemically synthesized
ggaagaaaagacttcaagtt

SEQ ID NO: 42927 - DNA, 20 bp, Artificial Sequence
  chemically synthesized
agtagggaagaaaagacttc

SEQ ID NO: 42928 - DNA, 20 bp, Artificial Sequence
  chemically synthesized
tggtatccagtagggaagaa

SEQ ID NO: 42929 - DNA, 20 bp, Artificial Sequence
  chemically synthesized
tgaagtcttttcttccctac

SEQ ID NO: 42930 - DNA, 20 bp, Artificial Sequence
  chemically synthesized
tgcagtggtatccagtaggg

SEQ ID NO: 42931 - DNA, 20 bp, Artificial Sequence
  chemically synthesized
agctgcagtggtatccagta

SEQ ID NO: 42932 - DNA, 20 bp, Artificial Sequence
  chemically synthesized
gagctgcagtggtatccagt

SEQ ID NO: 42933 - DNA, 20 bp, Artificial Sequence
  chemically synthesized
agagctgcagtggtatccag

SEQ ID NO: 42934 - DNA, 20 bp, Artificial Sequence
  chemically synthesized
ggcagagctgcagtggtatc

SEQ ID NO: 42935 - DNA, 20 bp, Artificial Sequence
  chemically synthesized
ttccctactggataccactg

SEQ ID NO: 42936 - DNA, 20 bp, Artificial Sequence
  chemically synthesized
acattgaggcagagctgcag

SEQ ID NO: 42937 - DNA, 20 bp, Artificial Sequence
  chemically synthesized
catacattgaggcagagctg

SEQ ID NO: 42938 - DNA, 20 bp, Artificial Sequence
  chemically synthesized
ctaagacatacattgaggca

SEQ ID NO: 42939 - DNA, 20 bp, Artificial Sequence
  chemically synthesized
tcctaagacatacattgagg

SEQ ID NO: 42940 - DNA, 20 bp, Artificial Sequence
  chemically synthesized
aaatcctaagacatacattg

SEQ ID NO: 42941 - DNA, 20 bp, Artificial Sequence
  chemically synthesized
taaatcctaagacatacatt

SEQ ID NO: 42942 - DNA, 20 bp, Artificial Sequence
  chemically synthesized
ctctgcctcaatgtatgtct

SEQ ID NO: 42943 - DNA, 20 bp, Artificial Sequence
  chemically synthesized
tctgcctcaatgtatgtctt

SEQ ID NO: 42944 - DNA, 20 bp, Artificial Sequence
  chemically synthesized
taaggtaagtggtaaatcct

SEQ ID NO: 42945 - DNA, 20 bp, Artificial Sequence
  chemically synthesized
aaaagttggagtaaggtaag

SEQ ID NO: 42946 - DNA, 20 bp, Artificial Sequence
  chemically synthesized
gaaaaaagttggagtaaggt

SEQ ID NO: 42947 - DNA, 20 bp, Artificial Sequence
  chemically synthesized
tcttgaaaaaagttggagta

SEQ ID NO: 42948 - DNA, 20 bp, Artificial Sequence
  chemically synthesized
atcttgaaaaaagttggagt

SEQ ID NO: 42949 - DNA, 20 bp, Artificial Sequence
  chemically synthesized
atagatcttgaaaaaagttg

SEQ ID NO: 42950 - DNA, 20 bp, Artificial Sequence
  chemically synthesized
taatagatcttgaaaaaagt

SEQ ID NO: 42951 - DNA, 20 bp, Artificial Sequence
  chemically synthesized
accttactccaacttttttc

SEQ ID NO: 42952 - DNA, 20 bp, Artificial Sequence
  chemically synthesized
gtcttaatagatcttgaaaa

SEQ ID NO: 42953 - DNA, 20 bp, Artificial Sequence
  chemically synthesized
aacttttttcaagatctatt

SEQ ID NO: 42954 - DNA, 20 bp, Artificial Sequence
  chemically synthesized
tttttcaagatctattaaga

SEQ ID NO: 42955 - DNA, 20 bp, Artificial Sequence
  chemically synthesized
gctggggaccactgtcttaa

SEQ ID NO: 42956 - DNA, 20 bp, Artificial Sequence
  chemically synthesized
ttcaagatctattaagacag

SEQ ID NO: 42957 - DNA, 20 bp, Artificial Sequence
  chemically synthesized
tctattaagacagtggtccc

SEQ ID NO: 42958 - DNA, 20 bp, Artificial Sequence
  chemically synthesized
gcctggtgccaaaaaggctg

SEQ ID NO: 42959 - DNA, 20 bp, Artificial Sequence
  chemically synthesized
tgcctggtgccaaaaaggct

SEQ ID NO: 42960 - DNA, 20 bp, Artificial Sequence
  chemically synthesized
acagtggtccccagcctttt

SEQ ID NO: 42961 - DNA, 20 bp, Artificial Sequence
  chemically synthesized
atgcctggtgccaaaaaggc

SEQ ID NO: 42962 - DNA, 20 bp, Artificial Sequence
  chemically synthesized
actcatgcctggtgccaaaa

SEQ ID NO: 42963 - DNA, 20 bp, Artificial Sequence
  chemically synthesized
aactcatgcctggtgccaaa

SEQ ID NO: 42964 - DNA, 20 bp, Artificial Sequence
  chemically synthesized
gtccccagcctttttggcac

SEQ ID NO: 42965 - DNA, 20 bp, Artificial Sequence
  chemically synthesized
tccccagcctttttggcacc

SEQ ID NO: 42966 - DNA, 20 bp, Artificial Sequence
  chemically synthesized
gcctttttggcaccaggcat

SEQ ID NO: 42967 - DNA, 20 bp, Artificial Sequence
  chemically synthesized
tcttccagaaaactcatgcc

SEQ ID NO: 42968 - DNA, 20 bp, Artificial Sequence
  chemically synthesized
ggcaccaggcatgagttttc

SEQ ID NO: 42969 - DNA, 20 bp, Artificial Sequence
  chemically synthesized
accaggcatgagttttctgg

SEQ ID NO: 42970 - DNA, 20 bp, Artificial Sequence
  chemically synthesized
tctgtggaaaaattgtcttc

SEQ ID NO: 42971 - DNA, 20 bp, Artificial Sequence
  chemically synthesized
tctggaagacaatttttcca

SEQ ID NO: 42972 - DNA, 20 bp, Artificial Sequence
  chemically synthesized
aagacaatttttccacagac

SEQ ID NO: 42973 - DNA, 20 bp, Artificial Sequence
  chemically synthesized
agacaatttttccacagact

SEQ ID NO: 42974 - DNA, 20 bp, Artificial Sequence
  chemically synthesized
cgcccctgcctcccagtctg

SEQ ID NO: 42975 - DNA, 20 bp, Artificial Sequence
  chemically synthesized
acaatttttccacagactgg

SEQ ID NO: 42976 - DNA, 20 bp, Artificial Sequence
  chemically synthesized
caatttttccacagactggg

SEQ ID NO: 42977 - DNA, 20 bp, Artificial Sequence
  chemically synthesized
tttttccacagactgggagg

SEQ ID NO: 42978 - DNA, 20 bp, Artificial Sequence
  chemically synthesized
ttttccacagactgggaggc

SEQ ID NO: 42979 - DNA, 20 bp, Artificial Sequence
  chemically synthesized
tttccacagactgggaggca

SEQ ID NO: 42980 - DNA, 20 bp, Artificial Sequence
  chemically synthesized
atacccccgcccctgcctcc

SEQ ID NO: 42981 - DNA, 20 bp, Artificial Sequence
  chemically synthesized
ttccacagactgggaggcag

SEQ ID NO: 42982 - DNA, 20 bp, Artificial Sequence
  chemically synthesized
cacagactgggaggcagggg

SEQ ID NO: 42983 - DNA, 20 bp, Artificial Sequence
  chemically synthesized
acagactgggaggcaggggc

SEQ ID NO: 42984 - DNA, 20 bp, Artificial Sequence
  chemically synthesized
cagactgggaggcaggggcg

SEQ ID NO: 42985 - DNA, 20 bp, Artificial Sequence
  chemically synthesized
agactgggaggcaggggcgg

SEQ ID NO: 42986 - DNA, 20 bp, Artificial Sequence
  chemically synthesized
gggaggcaggggcgggggta

SEQ ID NO: 42987 - DNA, 20 bp, Artificial Sequence
  chemically synthesized
aggggcgggggtatggtttc

SEQ ID NO: 42988 - DNA, 20 bp, Artificial Sequence
  chemically synthesized
cctgatgatctgaggtggaa

SEQ ID NO: 42989 - DNA, 20 bp, Artificial Sequence
  chemically synthesized
gagatgaaaccgttccacct

SEQ ID NO: 42990 - DNA, 20 bp, Artificial Sequence
  chemically synthesized
taatgcctgatgatctgagg

SEQ ID NO: 42991 - DNA, 20 bp, Artificial Sequence
  chemically synthesized
aactaatgcctgatgatctg

SEQ ID NO: 42992 - DNA, 20 bp, Artificial Sequence
  chemically synthesized
accgttccacctcagatcat

SEQ ID NO: 42993 - DNA, 20 bp, Artificial Sequence
  chemically synthesized
aaactaatgcctgatgatct

SEQ ID NO: 42994 - DNA, 20 bp, Artificial Sequence
  chemically synthesized
ccgttccacctcagatcatc

SEQ ID NO: 42995 - DNA, 20 bp, Artificial Sequence
  chemically synthesized
cacctcagatcatcaggcat

SEQ ID NO: 42996 - DNA, 20 bp, Artificial Sequence
  chemically synthesized
tcaggcattagtttctcata

SEQ ID NO: 42997 - DNA, 20 bp, Artificial Sequence
  chemically synthesized
aggcattagtttctcataaa

SEQ ID NO: 42998 - DNA, 20 bp, Artificial Sequence
  chemically synthesized
ggcattagtttctcataaag

SEQ ID NO: 42999 - DNA, 20 bp, Artificial Sequence
  chemically synthesized
ctaggttgtgacctctttat

SEQ ID NO: 43000 - DNA, 20 bp, Artificial Sequence
  chemically synthesized
ctcataaagaggtcacaacc

SEQ ID NO: 43001 - DNA, 20 bp, Artificial Sequence
  chemically synthesized
actatgtatgcgagggatct

SEQ ID NO: 43002 - DNA, 20 bp, Artificial Sequence
  chemically synthesized
aactatgtatgcgagggatc

SEQ ID NO: 43003 - DNA, 20 bp, Artificial Sequence
  chemically synthesized
attgtgaactatgtatgcga

SEQ ID NO: 43004 - DNA, 20 bp, Artificial Sequence
  chemically synthesized
tattgtgaactatgtatgcg

SEQ ID NO: 43005 - DNA, 20 bp, Artificial Sequence
  chemically synthesized
acctagatccctcgcataca

SEQ ID NO: 43006 - DNA, 20 bp, Artificial Sequence
  chemically synthesized
ctattgtgaactatgtatgc

SEQ ID NO: 43007 - DNA, 20 bp, Artificial Sequence
  chemically synthesized
ctcgcatacatagttcacaa

SEQ ID NO: 43008 - DNA, 20 bp, Artificial Sequence
  chemically synthesized
tcgcatacatagttcacaat

SEQ ID NO: 43009 - DNA, 20 bp, Artificial Sequence
  chemically synthesized
cgcatacatagttcacaata

SEQ ID NO: 43010 - DNA, 20 bp, Artificial Sequence
  chemically synthesized
ttagattatcgtaggtgcac

SEQ ID NO: 43011 - DNA, 20 bp, Artificial Sequence
  chemically synthesized
tcgtggcattagattatcgt

SEQ ID NO: 43012 - DNA, 20 bp, Artificial Sequence
  chemically synthesized
gtcgtggcattagattatcg

SEQ ID NO: 43013 - DNA, 20 bp, Artificial Sequence
  chemically synthesized
tgtcagatcagtcgtggcat

SEQ ID NO: 43014 - DNA, 20 bp, Artificial Sequence
  chemically synthesized
gcctcctgtcagatcagtcg

SEQ ID NO: 43015 - DNA, 20 bp, Artificial Sequence
  chemically synthesized
taatgccacgactgatctga

SEQ ID NO: 43016 - DNA, 20 bp, Artificial Sequence
  chemically synthesized
aatgccacgactgatctgac

SEQ ID NO: 43017 - DNA, 20 bp, Artificial Sequence
  chemically synthesized
agctctgcctcctgtcagat

SEQ ID NO: 43018 - DNA, 20 bp, Artificial Sequence
  chemically synthesized
tgccacgactgatctgacag

SEQ ID NO: 43019 - DNA, 20 bp, Artificial Sequence
  chemically synthesized
gccacgactgatctgacagg

SEQ ID NO: 43020 - DNA, 20 bp, Artificial Sequence
  chemically synthesized
gcctgagctctgcctcctgt

SEQ ID NO: 43021 - DNA, 20 bp, Artificial Sequence
  chemically synthesized
acgactgatctgacaggagg

SEQ ID NO: 43022 - DNA, 20 bp, Artificial Sequence
  chemically synthesized
gactgatctgacaggaggca

SEQ ID NO: 43023 - DNA, 20 bp, Artificial Sequence
  chemically synthesized
atctgacaggaggcagagct

SEQ ID NO: 43024 - DNA, 20 bp, Artificial Sequence
  chemically synthesized
tctgacaggaggcagagctc

SEQ ID NO: 43025 - DNA, 20 bp, Artificial Sequence
  chemically synthesized
gacaggaggcagagctcagg

SEQ ID NO: 43026 - DNA, 20 bp, Artificial Sequence
  chemically synthesized
gcaagtgaacattactgcct

SEQ ID NO: 43027 - DNA, 20 bp, Artificial Sequence
  chemically synthesized
gcaggaggtgagtggtgagc

SEQ ID NO: 43028 - DNA, 20 bp, Artificial Sequence
  chemically synthesized
aacagcaggaggtgagtggt

SEQ ID NO: 43029 - DNA, 20 bp, Artificial Sequence
  chemically synthesized
ctggaacagcaggaggtgag

SEQ ID NO: 43030 - DNA, 20 bp, Artificial Sequence
  chemically synthesized
ggactggaacagcaggaggt

SEQ ID NO: 43031 - DNA, 20 bp, Artificial Sequence
  chemically synthesized
ccatggactggaacagcagg

SEQ ID NO: 43032 - DNA, 20 bp, Artificial Sequence
  chemically synthesized
accatggactggaacagcag

SEQ ID NO: 43033 - DNA, 20 bp, Artificial Sequence
  chemically synthesized
ccactcacctcctgctgttc

SEQ ID NO: 43034 - DNA, 20 bp, Artificial Sequence
  chemically synthesized
ggaccatggactggaacagc

SEQ ID NO: 43035 - DNA, 20 bp, Artificial Sequence
  chemically synthesized
tggaccatggactggaacag

SEQ ID NO: 43036 - DNA, 20 bp, Artificial Sequence
  chemically synthesized
ctctggaccatggactggaa

SEQ ID NO: 43037 - DNA, 20 bp, Artificial Sequence
  chemically synthesized
cctcctgctgttccagtcca

SEQ ID NO: 43038 - DNA, 20 bp, Artificial Sequence
  chemically synthesized
ctaacctctggaccatggac

SEQ ID NO: 43039 - DNA, 20 bp, Artificial Sequence
  chemically synthesized
tgctgttccagtccatggtc

SEQ ID NO: 43040 - DNA, 20 bp, Artificial Sequence
  chemically synthesized
ctgttccagtccatggtcca

SEQ ID NO: 43041 - DNA, 20 bp, Artificial Sequence
  chemically synthesized
gatccctaacctctggacca

SEQ ID NO: 43042 - DNA, 20 bp, Artificial Sequence
  chemically synthesized
tgttccagtccatggtccag

SEQ ID NO: 43043 - DNA, 20 bp, Artificial Sequence
  chemically synthesized
ccagtccatggtccagaggt

SEQ ID NO: 43044 - DNA, 20 bp, Artificial Sequence
  chemically synthesized
cagtccatggtccagaggtt

SEQ ID NO: 43045 - DNA, 20 bp, Artificial Sequence
  chemically synthesized
agtccatggtccagaggtta

SEQ ID NO: 43046 - DNA, 20 bp, Artificial Sequence
  chemically synthesized
atagagggatccctaacctc

SEQ ID NO: 43047 - DNA, 20 bp, Artificial Sequence
  chemically synthesized
aggttagggatccctctatt

SEQ ID NO: 43048 - DNA, 20 bp, Artificial Sequence
  chemically synthesized
taagcctatgtcttaataga

SEQ ID NO: 43049 - DNA, 20 bp, Artificial Sequence
  chemically synthesized
gtaagcctatgtcttaatag

SEQ ID NO: 43050 - DNA, 20 bp, Artificial Sequence
  chemically synthesized
tgtaagcctatgtcttaata

SEQ ID NO: 43051 - DNA, 20 bp, Artificial Sequence
  chemically synthesized
catgtaagcctatgtcttaa

SEQ ID NO: 43052 - DNA, 20 bp, Artificial Sequence
  chemically synthesized
gggatccctctattaagaca

SEQ ID NO: 43053 - DNA, 20 bp, Artificial Sequence
  chemically synthesized
ggatccctctattaagacat

SEQ ID NO: 43054 - DNA, 20 bp, Artificial Sequence
  chemically synthesized
attgttcagtgaatgcatgt

SEQ ID NO: 43055 - DNA, 20 bp, Artificial Sequence
  chemically synthesized
cttcaggagccagcattgtt

SEQ ID NO: 43056 - DNA, 20 bp, Artificial Sequence
  chemically synthesized
atgcattcactgaacaatgc

SEQ ID NO: 43057 - DNA, 20 bp, Artificial Sequence
  chemically synthesized
ctgaacaatgctggctcctg

SEQ ID NO: 43058 - DNA, 20 bp, Artificial Sequence
  chemically synthesized
cccaagctttcttcaggagc

SEQ ID NO: 43059 - DNA, 20 bp, Artificial Sequence
  chemically synthesized
acaatgctggctcctgaaga

SEQ ID NO: 43060 - DNA, 20 bp, Artificial Sequence
  chemically synthesized
aactcccaagctttcttcag

SEQ ID NO: 43061 - DNA, 20 bp, Artificial Sequence
  chemically synthesized
aaaactcccaagctttcttc

SEQ ID NO: 43062 - DNA, 20 bp, Artificial Sequence
  chemically synthesized
caaaactcccaagctttctt

SEQ ID NO: 43063 - DNA, 20 bp, Artificial Sequence
  chemically synthesized
gctggctcctgaagaaagct

SEQ ID NO: 43064 - DNA, 20 bp, Artificial Sequence
  chemically synthesized
ctggctcctgaagaaagctt

SEQ ID NO: 43065 - DNA, 20 bp, Artificial Sequence
  chemically synthesized
ggctcctgaagaaagcttgg

SEQ ID NO: 43066 - DNA, 20 bp, Artificial Sequence
  chemically synthesized
cctcttctatcaaaactccc

SEQ ID NO: 43067 - DNA, 20 bp, Artificial Sequence
  chemically synthesized
agaaagcttgggagttttga

SEQ ID NO: 43068 - DNA, 20 bp, Artificial Sequence
  chemically synthesized
aagcttgggagttttgatag

SEQ ID NO: 43069 - DNA, 20 bp, Artificial Sequence
  chemically synthesized
gcttgggagttttgatagaa

SEQ ID NO: 43070 - DNA, 20 bp, Artificial Sequence
  chemically synthesized
cttgggagttttgatagaag

SEQ ID NO: 43071 - DNA, 20 bp, Artificial Sequence
  chemically synthesized
ttttgatagaagaggatttt

SEQ ID NO: 43072 - DNA, 20 bp, Artificial Sequence
  chemically synthesized
tttgatagaagaggatttta

SEQ ID NO: 43073 - DNA, 20 bp, Artificial Sequence
  chemically synthesized
ggattttaaggtgttttcct

SEQ ID NO: 43074 - DNA, 20 bp, Artificial Sequence
  chemically synthesized
aactgttgtgagaatatctt

SEQ ID NO: 43075 - DNA, 20 bp, Artificial Sequence
  chemically synthesized
aaactgttgtgagaatatct

SEQ ID NO: 43076 - DNA, 20 bp, Artificial Sequence
  chemically synthesized
ttcctaagatattctcacaa

SEQ ID NO: 43077 - DNA, 20 bp, Artificial Sequence
  chemically synthesized
cctattaccaaaactgttgt

SEQ ID NO: 43078 - DNA, 20 bp, Artificial Sequence
  chemically synthesized
agatattctcacaacagttt

SEQ ID NO: 43079 - DNA, 20 bp, Artificial Sequence
  chemically synthesized
tctcacaacagttttggtaa

SEQ ID NO: 43080 - DNA, 20 bp, Artificial Sequence
  chemically synthesized
ctcacaacagttttggtaat

SEQ ID NO: 43081 - DNA, 20 bp, Artificial Sequence
  chemically synthesized
cacaacagttttggtaatag

SEQ ID NO: 43082 - DNA, 20 bp, Artificial Sequence
  chemically synthesized
tttggtaataggagctactg

SEQ ID NO: 43083 - DNA, 20 bp, Artificial Sequence
  chemically synthesized
ttggtaataggagctactga

SEQ ID NO: 43084 - DNA, 20 bp, Artificial Sequence
  chemically synthesized
aagtgaatatattccttcag

SEQ ID NO: 43085 - DNA, 20 bp, Artificial Sequence
  chemically synthesized
tttaagtgaatatattcctt

SEQ ID NO: 43086 - DNA, 20 bp, Artificial Sequence
  chemically synthesized
tgaaggaatatattcactta

SEQ ID NO: 43087 - DNA, 20 bp, Artificial Sequence
  chemically synthesized
gttttgaagaaagcatcttt

SEQ ID NO: 43088 - DNA, 20 bp, Artificial Sequence
  chemically synthesized
gaaagttactgttttgaaga

SEQ ID NO: 43089 - DNA, 20 bp, Artificial Sequence
  chemically synthesized
taaagatgctttcttcaaaa

SEQ ID NO: 43090 - DNA, 20 bp, Artificial Sequence
  chemically synthesized
ctttgaaagttactgttttg

SEQ ID NO: 43091 - DNA, 20 bp, Artificial Sequence
  chemically synthesized
cttcaaaacagtaactttca

SEQ ID NO: 43092 - DNA, 20 bp, Artificial Sequence
  chemically synthesized
tataaactataaatctttga

SEQ ID NO: 43093 - DNA, 20 bp, Artificial Sequence
  chemically synthesized
cagtaactttcaaagattta

SEQ ID NO: 43094 - DNA, 20 bp, Artificial Sequence
  chemically synthesized
tttcaaagatttatagttta

SEQ ID NO: 43095 - DNA, 20 bp, Artificial Sequence
  chemically synthesized
ttatagtttatagcataatc

SEQ ID NO: 43096 - DNA, 20 bp, Artificial Sequence
  chemically synthesized
agtttatagcataatctagc

SEQ ID NO: 43097 - DNA, 20 bp, Artificial Sequence
  chemically synthesized
gtttatagcataatctagcc

SEQ ID NO: 43098 - DNA, 20 bp, Artificial Sequence
  chemically synthesized
gatggggttgattgcctggc

SEQ ID NO: 43099 - DNA, 20 bp, Artificial Sequence
  chemically synthesized
tgttgatggggttgattgcc

SEQ ID NO: 43100 - DNA, 20 bp, Artificial Sequence
  chemically synthesized
gatggggttgagtgttgatg

SEQ ID NO: 43101 - DNA, 20 bp, Artificial Sequence
  chemically synthesized
agatggggttgagtgttgat

SEQ ID NO: 43102 - DNA, 20 bp, Artificial Sequence
  chemically synthesized
cagatggggttgagtgttga

SEQ ID NO: 43103 - DNA, 20 bp, Artificial Sequence
  chemically synthesized
tgttgagagcagatggggtt

SEQ ID NO: 43104 - DNA, 20 bp, Artificial Sequence
  chemically synthesized
cagtttgttgagagcagatg

SEQ ID NO: 43105 - DNA, 20 bp, Artificial Sequence
  chemically synthesized
tcagtttgttgagagcagat

SEQ ID NO: 43106 - DNA, 20 bp, Artificial Sequence
  chemically synthesized
ttcagtttgttgagagcaga

SEQ ID NO: 43107 - DNA, 20 bp, Artificial Sequence
  chemically synthesized
atatttcagtttgttgagag

SEQ ID NO: 43108 - DNA, 20 bp, Artificial Sequence
  chemically synthesized
tgtatatttcagtttgttga

SEQ ID NO: 43109 - DNA, 20 bp, Artificial Sequence
  chemically synthesized
tttgtatatttcagtttgtt

SEQ ID NO: 43110 - DNA, 20 bp, Artificial Sequence
  chemically synthesized
tccatttattttgtatattt

SEQ ID NO: 43111 - DNA, 20 bp, Artificial Sequence
  chemically synthesized
actgaaatatacaaaataaa

SEQ ID NO: 43112 - DNA, 20 bp, Artificial Sequence
  chemically synthesized
atttggaagcgattttttag

SEQ ID NO: 43113 - DNA, 20 bp, Artificial Sequence
  chemically synthesized
tacatttggaagcgattttt

SEQ ID NO: 43114 - DNA, 20 bp, Artificial Sequence
  chemically synthesized
gtttattaaattacatttgg

SEQ ID NO: 43115 - DNA, 20 bp, Artificial Sequence
  chemically synthesized
acagtttattaaattacatt

SEQ ID NO: 43116 - DNA, 20 bp, Artificial Sequence
  chemically synthesized
aatttaataaactgtaacac

SEQ ID NO: 43117 - DNA, 20 bp, Artificial Sequence
  chemically synthesized
agatagccccactggtgtta

SEQ ID NO: 43118 - DNA, 20 bp, Artificial Sequence
  chemically synthesized
ttaataaactgtaacaccag

SEQ ID NO: 43119 - DNA, 20 bp, Artificial Sequence
  chemically synthesized
taataaactgtaacaccagt

SEQ ID NO: 43120 - DNA, 20 bp, Artificial Sequence
  chemically synthesized
aataaactgtaacaccagtg

SEQ ID NO: 43121 - DNA, 20 bp, Artificial Sequence
  chemically synthesized
taaattctagatagccccac

SEQ ID NO: 43122 - DNA, 20 bp, Artificial Sequence
  chemically synthesized
gtaacaccagtggggctatc

SEQ ID NO: 43123 - DNA, 20 bp, Artificial Sequence
  chemically synthesized
ttatttttttaaattctaga

SEQ ID NO: 43124 - DNA, 20 bp, Artificial Sequence
  chemically synthesized
catgttatttttttaaattc

SEQ ID NO: 43125 - DNA, 20 bp, Artificial Sequence
  chemically synthesized
tagaatttaaaaaaataaca

SEQ ID NO: 43126 - DNA, 20 bp, Artificial Sequence
  chemically synthesized
atagacaataacagataaag

SEQ ID NO: 43127 - DNA, 20 bp, Artificial Sequence
  chemically synthesized
aaaatagacaataacagata

SEQ ID NO: 43128 - DNA, 20 bp, Artificial Sequence
  chemically synthesized
ttttaaaaaatagacaataa

SEQ ID NO: 43129 - DNA, 20 bp, Artificial Sequence
  chemically synthesized
aataaataatttttaaaaaa

SEQ ID NO: 43130 - DNA, 20 bp, Artificial Sequence
  chemically synthesized
tttatttatttatttatttc

SEQ ID NO: 43131 - DNA, 20 bp, Artificial Sequence
  chemically synthesized
tttatttatttatttctaga

SEQ ID NO: 43132 - DNA, 20 bp, Artificial Sequence
  chemically synthesized
tatttatttatttctagatg

SEQ ID NO: 43133 - DNA, 20 bp, Artificial Sequence
  chemically synthesized
caatatagcaagactccatc

SEQ ID NO: 43134 - DNA, 20 bp, Artificial Sequence
  chemically synthesized
accaggctgagcaatatagc

SEQ ID NO: 43135 - DNA, 20 bp, Artificial Sequence
  chemically synthesized
tggagtcttgctatattgct

SEQ ID NO: 43136 - DNA, 20 bp, Artificial Sequence
  chemically synthesized
tgagaccaggctgagcaata

SEQ ID NO: 43137 - DNA, 20 bp, Artificial Sequence
  chemically synthesized
tcttgctatattgctcagcc

SEQ ID NO: 43138 - DNA, 20 bp, Artificial Sequence
  chemically synthesized
caggagtttgagaccaggct

SEQ ID NO: 43139 - DNA, 20 bp, Artificial Sequence
  chemically synthesized
gagtccaggagtttgagacc

SEQ ID NO: 43140 - DNA, 20 bp, Artificial Sequence
  chemically synthesized
tgagtccaggagtttgagac

SEQ ID NO: 43141 - DNA, 20 bp, Artificial Sequence
  chemically synthesized
tcagcctggtctcaaactcc

SEQ ID NO: 43142 - DNA, 20 bp, Artificial Sequence
  chemically synthesized
tcacttgagtccaggagttt

SEQ ID NO: 43143 - DNA, 20 bp, Artificial Sequence
  chemically synthesized
ggaagatcacttgagtccag

SEQ ID NO: 43144 - DNA, 20 bp, Artificial Sequence
  chemically synthesized
ggtctcaaactcctggactc

SEQ ID NO: 43145 - DNA, 20 bp, Artificial Sequence
  chemically synthesized
caggaagatcacttgagtcc

SEQ ID NO: 43146 - DNA, 20 bp, Artificial Sequence
  chemically synthesized
gcaggaagatcacttgagtc

SEQ ID NO: 43147 - DNA, 20 bp, Artificial Sequence
  chemically synthesized
ccgaagcaggaagatcactt

SEQ ID NO: 43148 - DNA, 20 bp, Artificial Sequence
  chemically synthesized
ctcaagtgatcttcctgctt

SEQ ID NO: 43149 - DNA, 20 bp, Artificial Sequence
  chemically synthesized
ctttgggaagccgaagcagg

SEQ ID NO: 43150 - DNA, 20 bp, Artificial Sequence
  chemically synthesized
acactttgggaagccgaagc

SEQ ID NO: 43151 - DNA, 20 bp, Artificial Sequence
  chemically synthesized
aacactttgggaagccgaag

SEQ ID NO: 43152 - DNA, 20 bp, Artificial Sequence
  chemically synthesized
cccaacactttgggaagccg

SEQ ID NO: 43153 - DNA, 20 bp, Artificial Sequence
  chemically synthesized
cttcctgcttcggcttccca

SEQ ID NO: 43154 - DNA, 20 bp, Artificial Sequence
  chemically synthesized
tgcagtcccaacactttggg

SEQ ID NO: 43155 - DNA, 20 bp, Artificial Sequence
  chemically synthesized
gcttcggcttcccaaagtgt

SEQ ID NO: 43156 - DNA, 20 bp, Artificial Sequence
  chemically synthesized
gcctgcagtcccaacacttt

SEQ ID NO: 43157 - DNA, 20 bp, Artificial Sequence
  chemically synthesized
cttcggcttcccaaagtgtt

SEQ ID NO: 43158 - DNA, 20 bp, Artificial Sequence
  chemically synthesized
tgcctgcagtcccaacactt

SEQ ID NO: 43159 - DNA, 20 bp, Artificial Sequence
  chemically synthesized
ttcccaaagtgttgggactg

SEQ ID NO: 43160 - DNA, 20 bp, Artificial Sequence
  chemically synthesized
tcccaaagtgttgggactgc

SEQ ID NO: 43161 - DNA, 20 bp, Artificial Sequence
  chemically synthesized
agtgttgggactgcaggcat

SEQ ID NO: 43162 - DNA, 20 bp, Artificial Sequence
  chemically synthesized
ggcacagcagcttatgcctg

SEQ ID NO: 43163 - DNA, 20 bp, Artificial Sequence
  chemically synthesized
aaatagatggcacggcacag

SEQ ID NO: 43164 - DNA, 20 bp, Artificial Sequence
  chemically synthesized
aaaaaatagatggcacggca

SEQ ID NO: 43165 - DNA, 20 bp, Artificial Sequence
  chemically synthesized
acacaaaaaaatagatggca

SEQ ID NO: 43166 - DNA, 20 bp, Artificial Sequence
  chemically synthesized
atcacacacaaaaaaataga

SEQ ID NO: 43167 - DNA, 20 bp, Artificial Sequence
  chemically synthesized
aaaaatcacacacaaaaaaa

SEQ ID NO: 43168 - DNA, 20 bp, Artificial Sequence
  chemically synthesized
tgtgtgattttttttttctt

SEQ ID NO: 43169 - DNA, 20 bp, Artificial Sequence
  chemically synthesized
tgtgattttttttttctttg

SEQ ID NO: 43170 - DNA, 20 bp, Artificial Sequence
  chemically synthesized
attttttttttctttggaga

SEQ ID NO: 43171 - DNA, 20 bp, Artificial Sequence
  chemically synthesized
gagttgagactccatctcca

SEQ ID NO: 43172 - DNA, 20 bp, Artificial Sequence
  chemically synthesized
tttttttttctttggagatg

SEQ ID NO: 43173 - DNA, 20 bp, Artificial Sequence
  chemically synthesized
tcagccagggcgacagagtt

SEQ ID NO: 43174 - DNA, 20 bp, Artificial Sequence
  chemically synthesized
gcacttcagccagggcgaca

SEQ ID NO: 43175 - DNA, 20 bp, Artificial Sequence
  chemically synthesized
gagtctcaactctgtcgccc

SEQ ID NO: 43176 - DNA, 20 bp, Artificial Sequence
  chemically synthesized
ttgcacttcagccagggcga

SEQ ID NO: 43177 - DNA, 20 bp, Artificial Sequence
  chemically synthesized
caactctgtcgccctggctg

SEQ ID NO: 43178 - DNA, 20 bp, Artificial Sequence
  chemically synthesized
gcaccattgcacttcagcca

SEQ ID NO: 43179 - DNA, 20 bp, Artificial Sequence
  chemically synthesized
cgcaccattgcacttcagcc

SEQ ID NO: 43180 - DNA, 20 bp, Artificial Sequence
  chemically synthesized
tcgcaccattgcacttcagc

SEQ ID NO: 43181 - DNA, 20 bp, Artificial Sequence
  chemically synthesized
gagatcgcaccattgcactt

SEQ ID NO: 43182 - DNA, 20 bp, Artificial Sequence
  chemically synthesized
tcgccctggctgaagtgcaa

SEQ ID NO: 43183 - DNA, 20 bp, Artificial Sequence
  chemically synthesized
gaagtgcaatggtgcgatct

SEQ ID NO: 43184 - DNA, 20 bp, Artificial Sequence
  chemically synthesized
ggcagaggttgcagtgagcc

SEQ ID NO: 43185 - DNA, 20 bp, Artificial Sequence
  chemically synthesized
ctggaggcagaggttgcagt

SEQ ID NO: 43186 - DNA, 20 bp, Artificial Sequence
  chemically synthesized
aaccctggaggcagaggttg

SEQ ID NO: 43187 - DNA, 20 bp, Artificial Sequence
  chemically synthesized
ctcactgcaacctctgcctc

SEQ ID NO: 43188 - DNA, 20 bp, Artificial Sequence
  chemically synthesized
cacttgaaccctggaggcag

SEQ ID NO: 43189 - DNA, 20 bp, Artificial Sequence
  chemically synthesized
tcactgcaacctctgcctcc

SEQ ID NO: 43190 - DNA, 20 bp, Artificial Sequence
  chemically synthesized
tcacttgaaccctggaggca

SEQ ID NO: 43191 - DNA, 20 bp, Artificial Sequence
  chemically synthesized
cactgcaacctctgcctcca

SEQ ID NO: 43192 - DNA, 20 bp, Artificial Sequence
  chemically synthesized
aatcacttgaaccctggagg

SEQ ID NO: 43193 - DNA, 20 bp, Artificial Sequence
  chemically synthesized
gagaatcacttgaaccctgg

SEQ ID NO: 43194 - DNA, 20 bp, Artificial Sequence
  chemically synthesized
ggagaatcacttgaaccctg

SEQ ID NO: 43195 - DNA, 20 bp, Artificial Sequence
  chemically synthesized
aacctctgcctccagggttc

SEQ ID NO: 43196 - DNA, 20 bp, Artificial Sequence
  chemically synthesized
caggagaatcacttgaaccc

SEQ ID NO: 43197 - DNA, 20 bp, Artificial Sequence
  chemically synthesized
ttcaagtgattctcctgcct

SEQ ID NO: 43198 - DNA, 20 bp, Artificial Sequence
  chemically synthesized
tactcaggaggctgaggcag

SEQ ID NO: 43199 - DNA, 20 bp, Artificial Sequence
  chemically synthesized
actactcaggaggctgaggc

SEQ ID NO: 43200 - DNA, 20 bp, Artificial Sequence
  chemically synthesized
cactactcaggaggctgagg

SEQ ID NO: 43201 - DNA, 20 bp, Artificial Sequence
  chemically synthesized
ccccactactcaggaggctg

SEQ ID NO: 43202 - DNA, 20 bp, Artificial Sequence
  chemically synthesized
tccccactactcaggaggct

SEQ ID NO: 43203 - DNA, 20 bp, Artificial Sequence
  chemically synthesized
ttctcctgcctcagcctcct

SEQ ID NO: 43204 - DNA, 20 bp, Artificial Sequence
  chemically synthesized
tcctgcctcagcctcctgag

SEQ ID NO: 43205 - DNA, 20 bp, Artificial Sequence
  chemically synthesized
tgtaatccccactactcagg

SEQ ID NO: 43206 - DNA, 20 bp, Artificial Sequence
  chemically synthesized
ctgtaatccccactactcag

SEQ ID NO: 43207 - DNA, 20 bp, Artificial Sequence
  chemically synthesized
tgcctcagcctcctgagtag

SEQ ID NO: 43208 - DNA, 20 bp, Artificial Sequence
  chemically synthesized
gcctcagcctcctgagtagt

SEQ ID NO: 43209 - DNA, 20 bp, Artificial Sequence
  chemically synthesized
gcctgtaatccccactactc

SEQ ID NO: 43210 - DNA, 20 bp, Artificial Sequence
  chemically synthesized
cctcagcctcctgagtagtg

SEQ ID NO: 43211 - DNA, 20 bp, Artificial Sequence
  chemically synthesized
tgcctgtaatccccactact

SEQ ID NO: 43212 - DNA, 20 bp, Artificial Sequence
  chemically synthesized
ctcctgagtagtggggatta

SEQ ID NO: 43213 - DNA, 20 bp, Artificial Sequence
  chemically synthesized
tcctgagtagtggggattac

SEQ ID NO: 43214 - DNA, 20 bp, Artificial Sequence
  chemically synthesized
aaattagtctggtgtggtgg

SEQ ID NO: 43215 - DNA, 20 bp, Artificial Sequence
  chemically synthesized
acaggcatctgccaccacac

SEQ ID NO: 43216 - DNA, 20 bp, Artificial Sequence
  chemically synthesized
caaaaattagtctggtgtgg

SEQ ID NO: 43217 - DNA, 20 bp, Artificial Sequence
  chemically synthesized
atacaaaaattagtctggtg

SEQ ID NO: 43218 - DNA, 20 bp, Artificial Sequence
  chemically synthesized
taaaaatacaaaaattagtc

SEQ ID NO: 43219 - DNA, 20 bp, Artificial Sequence
  chemically synthesized
tctactaaaaatacaaaaat

SEQ ID NO: 43220 - DNA, 20 bp, Artificial Sequence
  chemically synthesized
cagactaatttttgtatttt

SEQ ID NO: 43221 - DNA, 20 bp, Artificial Sequence
  chemically synthesized
actaatttttgtatttttag

SEQ ID NO: 43222 - DNA, 20 bp, Artificial Sequence
  chemically synthesized
taatttttgtatttttagta

SEQ ID NO: 43223 - DNA, 20 bp, Artificial Sequence
  chemically synthesized
ttttgtatttttagtagaga

SEQ ID NO: 43224 - DNA, 20 bp, Artificial Sequence
  chemically synthesized
tttgtatttttagtagagac

SEQ ID NO: 43225 - DNA, 20 bp, Artificial Sequence
  chemically synthesized
ttgtatttttagtagagacg

SEQ ID NO: 43226 - DNA, 20 bp, Artificial Sequence
  chemically synthesized
agagacggggttcaccatct

SEQ ID NO: 43227 - DNA, 20 bp, Artificial Sequence
  chemically synthesized
acggggttcaccatcttgga

SEQ ID NO: 43228 - DNA, 20 bp, Artificial Sequence
  chemically synthesized
caagaccagcctgtccaaga

SEQ ID NO: 43229 - DNA, 20 bp, Artificial Sequence
  chemically synthesized
cggggttcaccatcttggac

SEQ ID NO: 43230 - DNA, 20 bp, Artificial Sequence
  chemically synthesized
agttcaagaccagcctgtcc

SEQ ID NO: 43231 - DNA, 20 bp, Artificial Sequence
  chemically synthesized
gttcaccatcttggacaggc

SEQ ID NO: 43232 - DNA, 20 bp, Artificial Sequence
  chemically synthesized
tgaggtcaggagttcaagac

SEQ ID NO: 43233 - DNA, 20 bp, Artificial Sequence
  chemically synthesized
tcacctgaggtcaggagttc

SEQ ID NO: 43234 - DNA, 20 bp, Artificial Sequence
  chemically synthesized
tggtcttgaactcctgacct

SEQ ID NO: 43235 - DNA, 20 bp, Artificial Sequence
  chemically synthesized
ggcaaatcacctgaggtcag

SEQ ID NO: 43236 - DNA, 20 bp, Artificial Sequence
  chemically synthesized
ggtcttgaactcctgacctc

SEQ ID NO: 43237 - DNA, 20 bp, Artificial Sequence
  chemically synthesized
tgggcaaatcacctgaggtc

SEQ ID NO: 43238 - DNA, 20 bp, Artificial Sequence
  chemically synthesized
gtgggcaaatcacctgaggt

SEQ ID NO: 43239 - DNA, 20 bp, Artificial Sequence
  chemically synthesized
tgaggtgggcaaatcacctg

SEQ ID NO: 43240 - DNA, 20 bp, Artificial Sequence
  chemically synthesized
ctgaggtgggcaaatcacct

SEQ ID NO: 43241 - DNA, 20 bp, Artificial Sequence
  chemically synthesized
ctcaggtgatttgcccacct

SEQ ID NO: 43242 - DNA, 20 bp, Artificial Sequence
  chemically synthesized
gcactttgggaggctgaggt

SEQ ID NO: 43243 - DNA, 20 bp, Artificial Sequence
  chemically synthesized
agcactttgggaggctgagg

SEQ ID NO: 43244 - DNA, 20 bp, Artificial Sequence
  chemically synthesized
cctagcactttgggaggctg

SEQ ID NO: 43245 - DNA, 20 bp, Artificial Sequence
  chemically synthesized
tcctagcactttgggaggct

SEQ ID NO: 43246 - DNA, 20 bp, Artificial Sequence
  chemically synthesized
ttgcccacctcagcctccca

SEQ ID NO: 43247 - DNA, 20 bp, Artificial Sequence
  chemically synthesized
tgtaatcctagcactttggg

SEQ ID NO: 43248 - DNA, 20 bp, Artificial Sequence
  chemically synthesized
ctgtaatcctagcactttgg

SEQ ID NO: 43249 - DNA, 20 bp, Artificial Sequence
  chemically synthesized
acctcagcctcccaaagtgc

SEQ ID NO: 43250 - DNA, 20 bp, Artificial Sequence
  chemically synthesized
acctgtaatcctagcacttt

SEQ ID NO: 43251 - DNA, 20 bp, Artificial Sequence
  chemically synthesized
cctcagcctcccaaagtgct

SEQ ID NO: 43252 - DNA, 20 bp, Artificial Sequence
  chemically synthesized
cacctgtaatcctagcactt

SEQ ID NO: 43253 - DNA, 20 bp, Artificial Sequence
  chemically synthesized
ctcccaaagtgctaggatta

SEQ ID NO: 43254 - DNA, 20 bp, Artificial Sequence
  chemically synthesized
tcccaaagtgctaggattac

SEQ ID NO: 43255 - DNA, 20 bp, Artificial Sequence
  chemically synthesized
gtggctcacacctgtaatcc

SEQ ID NO: 43256 - DNA, 20 bp, Artificial Sequence
  chemically synthesized
agtgctaggattacaggtgt

SEQ ID NO: 43257 - DNA, 20 bp, Artificial Sequence
  chemically synthesized
caggtgtgagccaccacgcc

SEQ ID NO: 43258 - DNA, 20 bp, Artificial Sequence
  chemically synthesized
agatggcagtccaggcgtgg

SEQ ID NO: 43259 - DNA, 20 bp, Artificial Sequence
  chemically synthesized
aatagatggcagtccaggcg

SEQ ID NO: 43260 - DNA, 20 bp, Artificial Sequence
  chemically synthesized
agaaaaatagatggcagtcc

SEQ ID NO: 43261 - DNA, 20 bp, Artificial Sequence
  chemically synthesized
aagaaaaatagatggcagtc

SEQ ID NO: 43262 - DNA, 20 bp, Artificial Sequence
  chemically synthesized
atttaaagaaaaatagatgg

SEQ ID NO: 43263 - DNA, 20 bp, Artificial Sequence
  chemically synthesized
cttatttaaagaaaaataga

SEQ ID NO: 43264 - DNA, 20 bp, Artificial Sequence
  chemically synthesized
tatgcttatttaaagaaaaa

SEQ ID NO: 43265 - DNA, 20 bp, Artificial Sequence
  chemically synthesized
ccatctatttttctttaaat

SEQ ID NO: 43266 - DNA, 20 bp, Artificial Sequence
  chemically synthesized
ccaataggtatgcttattta

SEQ ID NO: 43267 - DNA, 20 bp, Artificial Sequence
  chemically synthesized
ctttaaataagcatacctat

SEQ ID NO: 43268 - DNA, 20 bp, Artificial Sequence
  chemically synthesized
tttaaataagcatacctatt

SEQ ID NO: 43269 - DNA, 20 bp, Artificial Sequence
  chemically synthesized
agctgagctatgatcccaat

SEQ ID NO: 43270 - DNA, 20 bp, Artificial Sequence
  chemically synthesized
aagctgagctatgatcccaa

SEQ ID NO: 43271 - DNA, 20 bp, Artificial Sequence
  chemically synthesized
aagcatacctattgggatca

SEQ ID NO: 43272 - DNA, 20 bp, Artificial Sequence
  chemically synthesized
tacctattgggatcatagct

SEQ ID NO: 43273 - DNA, 20 bp, Artificial Sequence
  chemically synthesized
tgggatcatagctcagcttc

SEQ ID NO: 43274 - DNA, 20 bp, Artificial Sequence
  chemically synthesized
atgattaagcactggaagct

SEQ ID NO: 43275 - DNA, 20 bp, Artificial Sequence
  chemically synthesized
ttttgatgattaagcactgg

SEQ ID NO: 43276 - DNA, 20 bp, Artificial Sequence
  chemically synthesized
tgattttgatgattaagcac

SEQ ID NO: 43277 - DNA, 20 bp, Artificial Sequence
  chemically synthesized
ttgttttgattttgatgatt

SEQ ID NO: 43278 - DNA, 20 bp, Artificial Sequence
  chemically synthesized
caaaatcaaaacaaatgatc

SEQ ID NO: 43279 - DNA, 20 bp, Artificial Sequence
  chemically synthesized
ttattattatttttacatgt

SEQ ID NO: 43280 - DNA, 20 bp, Artificial Sequence
  chemically synthesized
gtgagatatataatacatgc

SEQ ID NO: 43281 - DNA, 20 bp, Artificial Sequence
  chemically synthesized
tgagatatataatacatgct

SEQ ID NO: 43282 - DNA, 20 bp, Artificial Sequence
  chemically synthesized
gagatatataatacatgcta

SEQ ID NO: 43283 - DNA, 20 bp, Artificial Sequence
  chemically synthesized
atgcatctttgcatcatccc

SEQ ID NO: 43284 - DNA, 20 bp, Artificial Sequence
  chemically synthesized
tacatgctagggatgatgca

SEQ ID NO: 43285 - DNA, 20 bp, Artificial Sequence
  chemically synthesized
gggatgatgcaaagatgcat

SEQ ID NO: 43286 - DNA, 20 bp, Artificial Sequence
  chemically synthesized
ggatgatgcaaagatgcata

SEQ ID NO: 43287 - DNA, 20 bp, Artificial Sequence
  chemically synthesized
tgcaaagatgcataaggcac

SEQ ID NO: 43288 - DNA, 20 bp, Artificial Sequence
  chemically synthesized
gcataaggcacaagcgttgt

SEQ ID NO: 43289 - DNA, 20 bp, Artificial Sequence
  chemically synthesized
ataaggcacaagcgttgtca

SEQ ID NO: 43290 - DNA, 20 bp, Artificial Sequence
  chemically synthesized
aaggcacaagcgttgtcaga

SEQ ID NO: 43291 - DNA, 20 bp, Artificial Sequence
  chemically synthesized
aagcgttgtcagagagttta

SEQ ID NO: 43292 - DNA, 20 bp, Artificial Sequence
  chemically synthesized
agagagtttacagctgaact

SEQ ID NO: 43293 - DNA, 20 bp, Artificial Sequence
  chemically synthesized
gagagtttacagctgaactg

SEQ ID NO: 43294 - DNA, 20 bp, Artificial Sequence
  chemically synthesized
gagtttacagctgaactgag

SEQ ID NO: 43295 - DNA, 20 bp, Artificial Sequence
  chemically synthesized
gatcccttgtctcctcagtt

SEQ ID NO: 43296 - DNA, 20 bp, Artificial Sequence
  chemically synthesized
tacagctgaactgaggagac

SEQ ID NO: 43297 - DNA, 20 bp, Artificial Sequence
  chemically synthesized
tttcagatcccttgtctcct

SEQ ID NO: 43298 - DNA, 20 bp, Artificial Sequence
  chemically synthesized
acagctgaactgaggagaca

SEQ ID NO: 43299 - DNA, 20 bp, Artificial Sequence
  chemically synthesized
cagctgaactgaggagacaa

SEQ ID NO: 43300 - DNA, 20 bp, Artificial Sequence
  chemically synthesized
tgaaatattttgttaatttt

SEQ ID NO: 43301 - DNA, 20 bp, Artificial Sequence
  chemically synthesized
gaaaattaacaaaatatttc

SEQ ID NO: 43302 - DNA, 20 bp, Artificial Sequence
  chemically synthesized
aaattaacaaaatatttcaa

SEQ ID NO: 43303 - DNA, 20 bp, Artificial Sequence
  chemically synthesized
aaatatttcaagagttaaac

SEQ ID NO: 43304 - DNA, 20 bp, Artificial Sequence
  chemically synthesized
atttcaagagttaaacaaga

SEQ ID NO: 43305 - DNA, 20 bp, Artificial Sequence
  chemically synthesized
gttaaacaagaaagaaaact

SEQ ID NO: 43306 - DNA, 20 bp, Artificial Sequence
  chemically synthesized
ttaaacaagaaagaaaactt

SEQ ID NO: 43307 - DNA, 20 bp, Artificial Sequence
  chemically synthesized
taaacaagaaagaaaacttg

SEQ ID NO: 43308 - DNA, 20 bp, Artificial Sequence
  chemically synthesized
agaaagaaaacttggggtct

SEQ ID NO: 43309 - DNA, 20 bp, Artificial Sequence
  chemically synthesized
aacgtcccagctaagacccc

SEQ ID NO: 43310 - DNA, 20 bp, Artificial Sequence
  chemically synthesized
agaaaacttggggtcttagc

SEQ ID NO: 43311 - DNA, 20 bp, Artificial Sequence
  chemically synthesized
gaaaacttggggtcttagct

SEQ ID NO: 43312 - DNA, 20 bp, Artificial Sequence
  chemically synthesized
gcctctataacgtcccagct

SEQ ID NO: 43313 - DNA, 20 bp, Artificial Sequence
  chemically synthesized
caagagcctctataacgtcc

SEQ ID NO: 43314 - DNA, 20 bp, Artificial Sequence
  chemically synthesized
gggtcttagctgggacgtta

SEQ ID NO: 43315 - DNA, 20 bp, Artificial Sequence
  chemically synthesized
gtcttagctgggacgttata

SEQ ID NO: 43316 - DNA, 20 bp, Artificial Sequence
  chemically synthesized
tcttagctgggacgttatag

SEQ ID NO: 43317 - DNA, 20 bp, Artificial Sequence
  chemically synthesized
gcagatcctagaaatagcaa

SEQ ID NO: 43318 - DNA, 20 bp, Artificial Sequence
  chemically synthesized
aagcagatcctagaaatagc

SEQ ID NO: 43319 - DNA, 20 bp, Artificial Sequence
  chemically synthesized
atagaggctcttgctatttc

SEQ ID NO: 43320 - DNA, 20 bp, Artificial Sequence
  chemically synthesized
tagaggctcttgctatttct

SEQ ID NO: 43321 - DNA, 20 bp, Artificial Sequence
  chemically synthesized
ttttaagcagatcctagaaa

SEQ ID NO: 43322 - DNA, 20 bp, Artificial Sequence
  chemically synthesized
accttattttaagcagatcc

SEQ ID NO: 43323 - DNA, 20 bp, Artificial Sequence
  chemically synthesized
atttttaaccttattttaag

SEQ ID NO: 43324 - DNA, 20 bp, Artificial Sequence
  chemically synthesized
ttctaggatctgcttaaaat

SEQ ID NO: 43325 - DNA, 20 bp, Artificial Sequence
  chemically synthesized
tctaggatctgcttaaaata

SEQ ID NO: 43326 - DNA, 20 bp, Artificial Sequence
  chemically synthesized
ttaatttttaaccttatttt

SEQ ID NO: 43327 - DNA, 20 bp, Artificial Sequence
  chemically synthesized
gtctacctttaaaattatat

SEQ ID NO: 43328 - DNA, 20 bp, Artificial Sequence
  chemically synthesized
ttattacttatataatttta

SEQ ID NO: 43329 - DNA, 20 bp, Artificial Sequence
  chemically synthesized
tattacttatataattttaa

SEQ ID NO: 43330 - DNA, 20 bp, Artificial Sequence
  chemically synthesized
tacttatataattttaaagg

SEQ ID NO: 43331 - DNA, 20 bp, Artificial Sequence
  chemically synthesized
aggactaggaagtgatataa

SEQ ID NO: 43332 - DNA, 20 bp, Artificial Sequence
  chemically synthesized
ataactgttatatcacttcc

SEQ ID NO: 43333 - DNA, 20 bp, Artificial Sequence
  chemically synthesized
aggccagggtcaggactagg

SEQ ID NO: 43334 - DNA, 20 bp, Artificial Sequence
  chemically synthesized
aaaaggccagggtcaggact

SEQ ID NO: 43335 - DNA, 20 bp, Artificial Sequence
  chemically synthesized
gaaaaggccagggtcaggac

SEQ ID NO: 43336 - DNA, 20 bp, Artificial Sequence
  chemically synthesized
tcacttcctagtcctgaccc

SEQ ID NO: 43337 - DNA, 20 bp, Artificial Sequence
  chemically synthesized
tctaagaaaaggccagggtc

SEQ ID NO: 43338 - DNA, 20 bp, Artificial Sequence
  chemically synthesized
gtctaagaaaaggccagggt

SEQ ID NO: 43339 - DNA, 20 bp, Artificial Sequence
  chemically synthesized
acaagtctaagaaaaggcca

SEQ ID NO: 43340 - DNA, 20 bp, Artificial Sequence
  chemically synthesized
cacaagtctaagaaaaggcc

SEQ ID NO: 43341 - DNA, 20 bp, Artificial Sequence
  chemically synthesized
tcacaagtctaagaaaaggc

SEQ ID NO: 43342 - DNA, 20 bp, Artificial Sequence
  chemically synthesized
tcctgaccctggccttttct

SEQ ID NO: 43343 - DNA, 20 bp, Artificial Sequence
  chemically synthesized
gaaatcacaagtctaagaaa

SEQ ID NO: 43344 - DNA, 20 bp, Artificial Sequence
  chemically synthesized
ggaaatcacaagtctaagaa

SEQ ID NO: 43345 - DNA, 20 bp, Artificial Sequence
  chemically synthesized
ttttaggaaatcacaagtct

SEQ ID NO: 43346 - DNA, 20 bp, Artificial Sequence
  chemically synthesized
cccaagttttaggaaatcac

SEQ ID NO: 43347 - DNA, 20 bp, Artificial Sequence
  chemically synthesized
acttgtgatttcctaaaact

SEQ ID NO: 43348 - DNA, 20 bp, Artificial Sequence
  chemically synthesized
cttgtgatttcctaaaactt

SEQ ID NO: 43349 - DNA, 20 bp, Artificial Sequence
  chemically synthesized
aacatcttgtcccaagtttt

SEQ ID NO: 43350 - DNA, 20 bp, Artificial Sequence
  chemically synthesized
taacatcttgtcccaagttt

SEQ ID NO: 43351 - DNA, 20 bp, Artificial Sequence
  chemically synthesized
gatttcctaaaacttgggac

SEQ ID NO: 43352 - DNA, 20 bp, Artificial Sequence
  chemically synthesized
tttccttaacatcttgtccc

SEQ ID NO: 43353 - DNA, 20 bp, Artificial Sequence
  chemically synthesized
aaaacttgggacaagatgtt

SEQ ID NO: 43354 - DNA, 20 bp, Artificial Sequence
  chemically synthesized
aaacttgggacaagatgtta

SEQ ID NO: 43355 - DNA, 20 bp, Artificial Sequence
  chemically synthesized
agatgttaaggaaaaatatg

SEQ ID NO: 43356 - DNA, 20 bp, Artificial Sequence
  chemically synthesized
gatgttaaggaaaaatatgt

SEQ ID NO: 43357 - DNA, 20 bp, Artificial Sequence
  chemically synthesized
ggaaaaaaaggaggatgagc

SEQ ID NO: 43358 - DNA, 20 bp, Artificial Sequence
  chemically synthesized
gggaaaaaaaggaggatgag

SEQ ID NO: 43359 - DNA, 20 bp, Artificial Sequence
  chemically synthesized
gaggggaaaaaaaggaggat

SEQ ID NO: 43360 - DNA, 20 bp, Artificial Sequence
  chemically synthesized
agcaagaggggaaaaaaagg

SEQ ID NO: 43361 - DNA, 20 bp, Artificial Sequence
  chemically synthesized
gagcaagaggggaaaaaaag

SEQ ID NO: 43362 - DNA, 20 bp, Artificial Sequence
  chemically synthesized
atgagcaagaggggaaaaaa

SEQ ID NO: 43363 - DNA, 20 bp, Artificial Sequence
  chemically synthesized
catgagcaagaggggaaaaa

SEQ ID NO: 43364 - DNA, 20 bp, Artificial Sequence
  chemically synthesized
atctttgccatgagcaagag

SEQ ID NO: 43365 - DNA, 20 bp, Artificial Sequence
  chemically synthesized
tatctttgccatgagcaaga

SEQ ID NO: 43366 - DNA, 20 bp, Artificial Sequence
  chemically synthesized
ttatctttgccatgagcaag

SEQ ID NO: 43367 - DNA, 20 bp, Artificial Sequence
  chemically synthesized
tttttttcccctcttgctca

SEQ ID NO: 43368 - DNA, 20 bp, Artificial Sequence
  chemically synthesized
attatctttgccatgagcaa

SEQ ID NO: 43369 - DNA, 20 bp, Artificial Sequence
  chemically synthesized
aaattatctttgccatgagc

SEQ ID NO: 43370 - DNA, 20 bp, Artificial Sequence
  chemically synthesized
ttcccctcttgctcatggca

SEQ ID NO: 43371 - DNA, 20 bp, Artificial Sequence
  chemically synthesized
ttaaaaattatctttgccat

SEQ ID NO: 43372 - DNA, 20 bp, Artificial Sequence
  chemically synthesized
tacacaatttgtgtttattt

SEQ ID NO: 43373 - DNA, 20 bp, Artificial Sequence
  chemically synthesized
aaaataaacacaaattgtgt

SEQ ID NO: 43374 - DNA, 20 bp, Artificial Sequence
  chemically synthesized
aattgtgtaagtataacatt

SEQ ID NO: 43375 - DNA, 20 bp, Artificial Sequence
  chemically synthesized
ataacatttggatctcacat

SEQ ID NO: 43376 - DNA, 20 bp, Artificial Sequence
  chemically synthesized
gatttgtgtgagtctgatgt

SEQ ID NO: 43377 - DNA, 20 bp, Artificial Sequence
  chemically synthesized
taagaatctgagatttgtgt

SEQ ID NO: 43378 - DNA, 20 bp, Artificial Sequence
  chemically synthesized
catcagactcacacaaatct

SEQ ID NO: 43379 - DNA, 20 bp, Artificial Sequence
  chemically synthesized
ttggtactagataagaatct

SEQ ID NO: 43380 - DNA, 20 bp, Artificial Sequence
  chemically synthesized
acaaatctcagattcttatc

SEQ ID NO: 43381 - DNA, 20 bp, Artificial Sequence
  chemically synthesized
aataaagattggtactagat

SEQ ID NO: 43382 - DNA, 20 bp, Artificial Sequence
  chemically synthesized
tcattaataaagattggtac

SEQ ID NO: 43383 - DNA, 20 bp, Artificial Sequence
  chemically synthesized
tttcagtcattaataaagat

SEQ ID NO: 43384 - DNA, 20 bp, Artificial Sequence
  chemically synthesized
aattctttcagtcattaata

SEQ ID NO: 43385 - DNA, 20 bp, Artificial Sequence
  chemically synthesized
caatctttattaatgactga

SEQ ID NO: 43386 - DNA, 20 bp, Artificial Sequence
  chemically synthesized
gcacttccctataattcttt

SEQ ID NO: 43387 - DNA, 20 bp, Artificial Sequence
  chemically synthesized
attaatgactgaaagaatta

SEQ ID NO: 43388 - DNA, 20 bp, Artificial Sequence
  chemically synthesized
ttaatgactgaaagaattat

SEQ ID NO: 43389 - DNA, 20 bp, Artificial Sequence
  chemically synthesized
taatgactgaaagaattata

SEQ ID NO: 43390 - DNA, 20 bp, Artificial Sequence
  chemically synthesized
tgactgaaagaattataggg

SEQ ID NO: 43391 - DNA, 20 bp, Artificial Sequence
  chemically synthesized
aaagaattatagggaagtgc

SEQ ID NO: 43392 - DNA, 20 bp, Artificial Sequence
  chemically synthesized
aagaattatagggaagtgct

SEQ ID NO: 43393 - DNA, 20 bp, Artificial Sequence
  chemically synthesized
ttatagggaagtgctgggca

SEQ ID NO: 43394 - DNA, 20 bp, Artificial Sequence
  chemically synthesized
aataatgttctatctgtgcc

SEQ ID NO: 43395 - DNA, 20 bp, Artificial Sequence
  chemically synthesized
agggaagtgctgggcacaga

SEQ ID NO: 43396 - DNA, 20 bp, Artificial Sequence
  chemically synthesized
cagatagaacattatttccc

SEQ ID NO: 43397 - DNA, 20 bp, Artificial Sequence
  chemically synthesized
agatagaacattatttccct

SEQ ID NO: 43398 - DNA, 20 bp, Artificial Sequence
  chemically synthesized
gatagaacattatttccctg

SEQ ID NO: 43399 - DNA, 20 bp, Artificial Sequence
  chemically synthesized
tgattatttcaggttcccca

SEQ ID NO: 43400 - DNA, 20 bp, Artificial Sequence
  chemically synthesized
gtgattatttcaggttcccc

SEQ ID NO: 43401 - DNA, 20 bp, Artificial Sequence
  chemically synthesized
tgtgattatttcaggttccc

SEQ ID NO: 43402 - DNA, 20 bp, Artificial Sequence
  chemically synthesized
aacgcatgtgtgattatttc

SEQ ID NO: 43403 - DNA, 20 bp, Artificial Sequence
  chemically synthesized
aaacgcatgtgtgattattt

SEQ ID NO: 43404 - DNA, 20 bp, Artificial Sequence
  chemically synthesized
gggaaataacatggatgttt

SEQ ID NO: 43405 - DNA, 20 bp, Artificial Sequence
  chemically synthesized
catcataatgggaaataaca

SEQ ID NO: 43406 - DNA, 20 bp, Artificial Sequence
  chemically synthesized
aaaccaaagcacatcataat

SEQ ID NO: 43407 - DNA, 20 bp, Artificial Sequence
  chemically synthesized
gaaaccaaagcacatcataa

SEQ ID NO: 43408 - DNA, 20 bp, Artificial Sequence
  chemically synthesized
tttcccattatgatgtgctt

SEQ ID NO: 43409 - DNA, 20 bp, Artificial Sequence
  chemically synthesized
tatctgttaatatgaaacca

SEQ ID NO: 43410 - DNA, 20 bp, Artificial Sequence
  chemically synthesized
gtgctttggtttcatattaa

SEQ ID NO: 43411 - DNA, 20 bp, Artificial Sequence
  chemically synthesized
tacgtttttaaaaatttaca

SEQ ID NO: 43412 - DNA, 20 bp, Artificial Sequence
  chemically synthesized
aatttacacagaaacattga

SEQ ID NO: 43413 - DNA, 20 bp, Artificial Sequence
  chemically synthesized
atttacacagaaacattgaa

SEQ ID NO: 43414 - DNA, 20 bp, Artificial Sequence
  chemically synthesized
acattgaaaggaaatcattt

SEQ ID NO: 43415 - DNA, 20 bp, Artificial Sequence
  chemically synthesized
ggaaatcatttcagtctcaa

SEQ ID NO: 43416 - DNA, 20 bp, Artificial Sequence
  chemically synthesized
ttataaaatggaaaactttt

SEQ ID NO: 43417 - DNA, 20 bp, Artificial Sequence
  chemically synthesized
gtaattgacagattataaaa

SEQ ID NO: 43418 - DNA, 20 bp, Artificial Sequence
  chemically synthesized
ttttctatttttgtaattga

SEQ ID NO: 43419 - DNA, 20 bp, Artificial Sequence
  chemically synthesized
taatctgtcaattacaaaaa

SEQ ID NO: 43420 - DNA, 20 bp, Artificial Sequence
  chemically synthesized
aaaatagaaaaacgttcatg

SEQ ID NO: 43421 - DNA, 20 bp, Artificial Sequence
  chemically synthesized
gctggctggagaatagggca

SEQ ID NO: 43422 - DNA, 20 bp, Artificial Sequence
  chemically synthesized
tgtagctatgccctattctc

SEQ ID NO: 43423 - DNA, 20 bp, Artificial Sequence
  chemically synthesized
tcgtggctggctggagaata

SEQ ID NO: 43424 - DNA, 20 bp, Artificial Sequence
  chemically synthesized
gtcgtggctggctggagaat

SEQ ID NO: 43425 - DNA, 20 bp, Artificial Sequence
  chemically synthesized
agtcgtggctggctggagaa

SEQ ID NO: 43426 - DNA, 20 bp, Artificial Sequence
  chemically synthesized
gctatgccctattctccagc

SEQ ID NO: 43427 - DNA, 20 bp, Artificial Sequence
  chemically synthesized
ttatgagtcgtggctggctg

SEQ ID NO: 43428 - DNA, 20 bp, Artificial Sequence
  chemically synthesized
atttatgagtcgtggctggc

SEQ ID NO: 43429 - DNA, 20 bp, Artificial Sequence
  chemically synthesized
ttggatttatgagtcgtggc

SEQ ID NO: 43430 - DNA, 20 bp, Artificial Sequence
  chemically synthesized
atgtttggatttatgagtcg

SEQ ID NO: 43431 - DNA, 20 bp, Artificial Sequence
  chemically synthesized
cctggaatgtttggatttat

SEQ ID NO: 43432 - DNA, 20 bp, Artificial Sequence
  chemically synthesized
actcataaatccaaacattc

SEQ ID NO: 43433 - DNA, 20 bp, Artificial Sequence
  chemically synthesized
gtaaataaacctggaatgtt

SEQ ID NO: 43434 - DNA, 20 bp, Artificial Sequence
  chemically synthesized
ctcataaatccaaacattcc

SEQ ID NO: 43435 - DNA, 20 bp, Artificial Sequence
  chemically synthesized
tagcttattgtaaataaacc

SEQ ID NO: 43436 - DNA, 20 bp, Artificial Sequence
  chemically synthesized
attccaggtttatttacaat

SEQ ID NO: 43437 - DNA, 20 bp, Artificial Sequence
  chemically synthesized
tttatttacaataagctatc

SEQ ID NO: 43438 - DNA, 20 bp, Artificial Sequence
  chemically synthesized
tttacaataagctatctagc

SEQ ID NO: 43439 - DNA, 20 bp, Artificial Sequence
  chemically synthesized
ttacaataagctatctagcc

SEQ ID NO: 43440 - DNA, 20 bp, Artificial Sequence
  chemically synthesized
gtatacctggcctggctaga

SEQ ID NO: 43441 - DNA, 20 bp, Artificial Sequence
  chemically synthesized
aataagctatctagccaggc

SEQ ID NO: 43442 - DNA, 20 bp, Artificial Sequence
  chemically synthesized
tagggtatacctggcctggc

SEQ ID NO: 43443 - DNA, 20 bp, Artificial Sequence
  chemically synthesized
ataagctatctagccaggcc

SEQ ID NO: 43444 - DNA, 20 bp, Artificial Sequence
  chemically synthesized
ttagtagggtatacctggcc

SEQ ID NO: 43445 - DNA, 20 bp, Artificial Sequence
  chemically synthesized
tgattttagtagggtatacc

SEQ ID NO: 43446 - DNA, 20 bp, Artificial Sequence
  chemically synthesized
tctataaaatgattttagta

SEQ ID NO: 43447 - DNA, 20 bp, Artificial Sequence
  chemically synthesized
atctataaaatgattttagt

SEQ ID NO: 43448 - DNA, 20 bp, Artificial Sequence
  chemically synthesized
tatctataaaatgattttag

SEQ ID NO: 43449 - DNA, 20 bp, Artificial Sequence
  chemically synthesized
ccctatctataaaatgattt

SEQ ID NO: 43450 - DNA, 20 bp, Artificial Sequence
  chemically synthesized
accctactaaaatcatttta

SEQ ID NO: 43451 - DNA, 20 bp, Artificial Sequence
  chemically synthesized
tactaaaatcattttataga

SEQ ID NO: 43452 - DNA, 20 bp, Artificial Sequence
  chemically synthesized
actaaaatcattttatagat

SEQ ID NO: 43453 - DNA, 20 bp, Artificial Sequence
  chemically synthesized
ctaaaatcattttatagata

SEQ ID NO: 43454 - DNA, 20 bp, Artificial Sequence
  chemically synthesized
attttatagatagggatttg

SEQ ID NO: 43455 - DNA, 20 bp, Artificial Sequence
  chemically synthesized
ttttatagatagggatttgc

SEQ ID NO: 43456 - DNA, 20 bp, Artificial Sequence
  chemically synthesized
atttgcaggtatctttcctc

SEQ ID NO: 43457 - DNA, 20 bp, Artificial Sequence
  chemically synthesized
aatagtggttaactagagga

SEQ ID NO: 43458 - DNA, 20 bp, Artificial Sequence
  chemically synthesized
tgttaatagtggttaactag

SEQ ID NO: 43459 - DNA, 20 bp, Artificial Sequence
  chemically synthesized
ttgttaatagtggttaacta

SEQ ID NO: 43460 - DNA, 20 bp, Artificial Sequence
  chemically synthesized
tcttgttaatagtggttaac

SEQ ID NO: 43461 - DNA, 20 bp, Artificial Sequence
  chemically synthesized
cttgtttatcttgttaatag

SEQ ID NO: 43462 - DNA, 20 bp, Artificial Sequence
  chemically synthesized
tctagttaaccactattaac

SEQ ID NO: 43463 - DNA, 20 bp, Artificial Sequence
  chemically synthesized
cttcttgtttatcttgttaa

SEQ ID NO: 43464 - DNA, 20 bp, Artificial Sequence
  chemically synthesized
ccactattaacaagataaac

SEQ ID NO: 43465 - DNA, 20 bp, Artificial Sequence
  chemically synthesized
ctattaacaagataaacaag

SEQ ID NO: 43466 - DNA, 20 bp, Artificial Sequence
  chemically synthesized
tattaacaagataaacaaga

SEQ ID NO: 43467 - DNA, 20 bp, Artificial Sequence
  chemically synthesized
acaagataaacaagaaggtc

SEQ ID NO: 43468 - DNA, 20 bp, Artificial Sequence
  chemically synthesized
caagataaacaagaaggtct

SEQ ID NO: 43469 - DNA, 20 bp, Artificial Sequence
  chemically synthesized
agataaacaagaaggtctgg

SEQ ID NO: 43470 - DNA, 20 bp, Artificial Sequence
  chemically synthesized
gataaacaagaaggtctggg

SEQ ID NO: 43471 - DNA, 20 bp, Artificial Sequence
  chemically synthesized
taaacatgttaatgacctcc

SEQ ID NO: 43472 - DNA, 20 bp, Artificial Sequence
  chemically synthesized
aggtcattaacatgtttatg

SEQ ID NO: 43473 - DNA, 20 bp, Artificial Sequence
  chemically synthesized
tcattaacatgtttatgaag

SEQ ID NO: 43474 - DNA, 20 bp, Artificial Sequence
  chemically synthesized
tgtttatgaagtggtctatt

SEQ ID NO: 43475 - DNA, 20 bp, Artificial Sequence
  chemically synthesized
gtttatgaagtggtctatta

SEQ ID NO: 43476 - DNA, 20 bp, Artificial Sequence
  chemically synthesized
aagggaataaatgaccttaa

SEQ ID NO: 43477 - DNA, 20 bp, Artificial Sequence
  chemically synthesized
tattccctgggggatgtgaa

SEQ ID NO: 43478 - DNA, 20 bp, Artificial Sequence
  chemically synthesized
ttattccctgggggatgtga

SEQ ID NO: 43479 - DNA, 20 bp, Artificial Sequence
  chemically synthesized
cttattccctgggggatgtg

SEQ ID NO: 43480 - DNA, 20 bp, Artificial Sequence
  chemically synthesized
tttattcccttcacatcccc

SEQ ID NO: 43481 - DNA, 20 bp, Artificial Sequence
  chemically synthesized
ttattcccttcacatccccc

SEQ ID NO: 43482 - DNA, 20 bp, Artificial Sequence
  chemically synthesized
tattcccttcacatccccca

SEQ ID NO: 43483 - DNA, 20 bp, Artificial Sequence
  chemically synthesized
gtctgtgacttattccctgg

SEQ ID NO: 43484 - DNA, 20 bp, Artificial Sequence
  chemically synthesized
ggtctgtgacttattccctg

SEQ ID NO: 43485 - DNA, 20 bp, Artificial Sequence
  chemically synthesized
cttcacatcccccagggaat

SEQ ID NO: 43486 - DNA, 20 bp, Artificial Sequence
  chemically synthesized
aggtctgtgacttattccct

SEQ ID NO: 43487 - DNA, 20 bp, Artificial Sequence
  chemically synthesized
caggtctgtgacttattccc

SEQ ID NO: 43488 - DNA, 20 bp, Artificial Sequence
  chemically synthesized
atcccccagggaataagtca

SEQ ID NO: 43489 - DNA, 20 bp, Artificial Sequence
  chemically synthesized
gaataaagggtattaacagc

SEQ ID NO: 43490 - DNA, 20 bp, Artificial Sequence
  chemically synthesized
agaataaagggtattaacag

SEQ ID NO: 43491 - DNA, 20 bp, Artificial Sequence
  chemically synthesized
aagagaataaagggtattaa

SEQ ID NO: 43492 - DNA, 20 bp, Artificial Sequence
  chemically synthesized
aggaaactaaagagaataaa

SEQ ID NO: 43493 - DNA, 20 bp, Artificial Sequence
  chemically synthesized
gaggaaactaaagagaataa

SEQ ID NO: 43494 - DNA, 20 bp, Artificial Sequence
  chemically synthesized
agaggaaactaaagagaata

SEQ ID NO: 43495 - DNA, 20 bp, Artificial Sequence
  chemically synthesized
ttaataccctttattctctt

SEQ ID NO: 43496 - DNA, 20 bp, Artificial Sequence
  chemically synthesized
acaacgaagaggaaactaaa

SEQ ID NO: 43497 - DNA, 20 bp, Artificial Sequence
  chemically synthesized
ggacaacgaagaggaaacta

SEQ ID NO: 43498 - DNA, 20 bp, Artificial Sequence
  chemically synthesized
agagagagaggacaacgaag

SEQ ID NO: 43499 - DNA, 20 bp, Artificial Sequence
  chemically synthesized
gagagagagaggacaacgaa

SEQ ID NO: 43500 - DNA, 20 bp, Artificial Sequence
  chemically synthesized
gagagagagagaggacaacg

SEQ ID NO: 43501 - DNA, 20 bp, Artificial Sequence
  chemically synthesized
agagagagagagagagagag

SEQ ID NO: 43502 - DNA, 20 bp, Artificial Sequence
  chemically synthesized
gagagagagagagagagaga

SEQ ID NO: 43503 - DNA, 20 bp, Artificial Sequence
  chemically synthesized
gagagagagagagagagaga

SEQ ID NO: 43504 - DNA, 20 bp, Artificial Sequence
  chemically synthesized
gagagagagagagagagaga

SEQ ID NO: 43505 - DNA, 20 bp, Artificial Sequence
  chemically synthesized
gagagagagagagagagaga

SEQ ID NO: 43506 - DNA, 20 bp, Artificial Sequence
  chemically synthesized
tggagagagagagagagaga

SEQ ID NO: 43507 - DNA, 20 bp, Artificial Sequence
  chemically synthesized
tatggagagagagagagaga

SEQ ID NO: 43508 - DNA, 20 bp, Artificial Sequence
  chemically synthesized
tatatggagagagagagaga

SEQ ID NO: 43509 - DNA, 20 bp, Artificial Sequence
  chemically synthesized
tatatatggagagagagaga

SEQ ID NO: 43510 - DNA, 20 bp, Artificial Sequence
  chemically synthesized
tatatatatggagagagaga

SEQ ID NO: 43511 - DNA, 20 bp, Artificial Sequence
  chemically synthesized
tatatatatatggagagaga

SEQ ID NO: 43512 - DNA, 20 bp, Artificial Sequence
  chemically synthesized
tatatatatatatggagaga

SEQ ID NO: 43513 - DNA, 20 bp, Artificial Sequence
  chemically synthesized
tatatatatatatatggaga

SEQ ID NO: 43514 - DNA, 20 bp, Artificial Sequence
  chemically synthesized
tatatatatatatatatgga

SEQ ID NO: 43515 - DNA, 20 bp, Artificial Sequence
  chemically synthesized
tatatatatatatatatatg

SEQ ID NO: 43516 - DNA, 20 bp, Artificial Sequence
  chemically synthesized
catatatatatatatatata

SEQ ID NO: 43517 - DNA, 20 bp, Artificial Sequence
  chemically synthesized
tgtacacatacatacataca

SEQ ID NO: 43518 - DNA, 20 bp, Artificial Sequence
  chemically synthesized
tatgtatgtatgtgtacata

SEQ ID NO: 43519 - DNA, 20 bp, Artificial Sequence
  chemically synthesized
atgtgtacatatagatatat

SEQ ID NO: 43520 - DNA, 20 bp, Artificial Sequence
  chemically synthesized
gtacacaaattacttttaat

SEQ ID NO: 43521 - DNA, 20 bp, Artificial Sequence
  chemically synthesized
atctttatgcatccaattaa

SEQ ID NO: 43522 - DNA, 20 bp, Artificial Sequence
  chemically synthesized
tacttttaattggatgcata

SEQ ID NO: 43523 - DNA, 20 bp, Artificial Sequence
  chemically synthesized
ggcacagcaaaagttcaagg

SEQ ID NO: 43524 - DNA, 20 bp, Artificial Sequence
  chemically synthesized
gcaggcacagcaaaagttca

SEQ ID NO: 43525 - DNA, 20 bp, Artificial Sequence
  chemically synthesized
agcaggcacagcaaaagttc

SEQ ID NO: 43526 - DNA, 20 bp, Artificial Sequence
  chemically synthesized
gggctgagcaggcacagcaa

SEQ ID NO: 43527 - DNA, 20 bp, Artificial Sequence
  chemically synthesized
caggaggggctgagcaggca

SEQ ID NO: 43528 - DNA, 20 bp, Artificial Sequence
  chemically synthesized
gaacttttgctgtgcctgct

SEQ ID NO: 43529 - DNA, 20 bp, Artificial Sequence
  chemically synthesized
tagagcaggaggggctgagc

SEQ ID NO: 43530 - DNA, 20 bp, Artificial Sequence
  chemically synthesized
atagagcaggaggggctgag

SEQ ID NO: 43531 - DNA, 20 bp, Artificial Sequence
  chemically synthesized
tagatagagcaggaggggct

SEQ ID NO: 43532 - DNA, 20 bp, Artificial Sequence
  chemically synthesized
aatcctagatagagcaggag

SEQ ID NO: 43533 - DNA, 20 bp, Artificial Sequence
  chemically synthesized
gaatcctagatagagcagga

SEQ ID NO: 43534 - DNA, 20 bp, Artificial Sequence
  chemically synthesized
tgaatcctagatagagcagg

SEQ ID NO: 43535 - DNA, 20 bp, Artificial Sequence
  chemically synthesized
atgaatcctagatagagcag

SEQ ID NO: 43536 - DNA, 20 bp, Artificial Sequence
  chemically synthesized
gaatgaatcctagatagagc

SEQ ID NO: 43537 - DNA, 20 bp, Artificial Sequence
  chemically synthesized
tcagcccctcctgctctatc

SEQ ID NO: 43538 - DNA, 20 bp, Artificial Sequence
  chemically synthesized
agaatgaatcctagatagag

SEQ ID NO: 43539 - DNA, 20 bp, Artificial Sequence
  chemically synthesized
cagcccctcctgctctatct

SEQ ID NO: 43540 - DNA, 20 bp, Artificial Sequence
  chemically synthesized
aaaagaatgaatcctagata

SEQ ID NO: 43541 - DNA, 20 bp, Artificial Sequence
  chemically synthesized
agaaaagaatgaatcctaga

SEQ ID NO: 43542 - DNA, 20 bp, Artificial Sequence
  chemically synthesized
taatagaaaagaatgaatcc

SEQ ID NO: 43543 - DNA, 20 bp, Artificial Sequence
  chemically synthesized
aaaaaaatcaaataatagaa

SEQ ID NO: 43544 - DNA, 20 bp, Artificial Sequence
  chemically synthesized
caaaaaaaaaaatcaaataa

SEQ ID NO: 43545 - DNA, 20 bp, Artificial Sequence
  chemically synthesized
tattatttgatttttttttt

SEQ ID NO: 43546 - DNA, 20 bp, Artificial Sequence
  chemically synthesized
tatttgatttttttttttgg

SEQ ID NO: 43547 - DNA, 20 bp, Artificial Sequence
  chemically synthesized
gatttttttttttggcagaa

SEQ ID NO: 43548 - DNA, 20 bp, Artificial Sequence
  chemically synthesized
ttttggcagaaaagttcttg

SEQ ID NO: 43549 - DNA, 20 bp, Artificial Sequence
  chemically synthesized
cttacttatatcaatactac

SEQ ID NO: 43550 - DNA, 20 bp, Artificial Sequence
  chemically synthesized
agttcttgtagtattgatat

SEQ ID NO: 43551 - DNA, 20 bp, Artificial Sequence
  chemically synthesized
cttgtagtattgatataagt

SEQ ID NO: 43552 - DNA, 20 bp, Artificial Sequence
  chemically synthesized
tgtagtattgatataagtaa

SEQ ID NO: 43553 - DNA, 20 bp, Artificial Sequence
  chemically synthesized
gtattgatataagtaagagc

SEQ ID NO: 43554 - DNA, 20 bp, Artificial Sequence
  chemically synthesized
gcgagaaaaaacaattaatc

SEQ ID NO: 43555 - DNA, 20 bp, Artificial Sequence
  chemically synthesized
gtgctttatcaaataaaggc

SEQ ID NO: 43556 - DNA, 20 bp, Artificial Sequence
  chemically synthesized
acaagtgctttatcaaataa

SEQ ID NO: 43557 - DNA, 20 bp, Artificial Sequence
  chemically synthesized
tacaagtgctttatcaaata

SEQ ID NO: 43558 - DNA, 20 bp, Artificial Sequence
  chemically synthesized
aatctagcctttatttgata

SEQ ID NO: 43559 - DNA, 20 bp, Artificial Sequence
  chemically synthesized
ctgtgttaatatgtaaatac

SEQ ID NO: 43560 - DNA, 20 bp, Artificial Sequence
  chemically synthesized
cttgtatttacatattaaca

SEQ ID NO: 43561 - DNA, 20 bp, Artificial Sequence
  chemically synthesized
ttgtatttacatattaacac

SEQ ID NO: 43562 - DNA, 20 bp, Artificial Sequence
  chemically synthesized
tgtatttacatattaacaca

SEQ ID NO: 43563 - DNA, 20 bp, Artificial Sequence
  chemically synthesized
aatctctatccgaaaaatgt

SEQ ID NO: 43564 - DNA, 20 bp, Artificial Sequence
  chemically synthesized
cacagggtgcctacattttt

SEQ ID NO: 43565 - DNA, 20 bp, Artificial Sequence
  chemically synthesized
aaatctctatccgaaaaatg

SEQ ID NO: 43566 - DNA, 20 bp, Artificial Sequence
  chemically synthesized
gggtgcctacatttttcgga

SEQ ID NO: 43567 - DNA, 20 bp, Artificial Sequence
  chemically synthesized
gtgcctacatttttcggata

SEQ ID NO: 43568 - DNA, 20 bp, Artificial Sequence
  chemically synthesized
aaaaaaaaaagaagaaagaa

SEQ ID NO: 43569 - DNA, 20 bp, Artificial Sequence
  chemically synthesized
ggaataaaaaaaaaagaaga

SEQ ID NO: 43570 - DNA, 20 bp, Artificial Sequence
  chemically synthesized
tctaggaataaaaaaaaaag

SEQ ID NO: 43571 - DNA, 20 bp, Artificial Sequence
  chemically synthesized
gtctctaggaataaaaaaaa

SEQ ID NO: 43572 - DNA, 20 bp, Artificial Sequence
  chemically synthesized
tcttcttttttttttattcc

SEQ ID NO: 43573 - DNA, 20 bp, Artificial Sequence
  chemically synthesized
ttcttttttttttattccta

SEQ ID NO: 43574 - DNA, 20 bp, Artificial Sequence
  chemically synthesized
tttttttttattcctagaga

SEQ ID NO: 43575 - DNA, 20 bp, Artificial Sequence
  chemically synthesized
tttttttattcctagagaca

SEQ ID NO: 43576 - DNA, 20 bp, Artificial Sequence
  chemically synthesized
cacagcaagactctgtctct

SEQ ID NO: 43577 - DNA, 20 bp, Artificial Sequence
  chemically synthesized
acacagcaagactctgtctc

SEQ ID NO: 43578 - DNA, 20 bp, Artificial Sequence
  chemically synthesized
tccagcttgggcaacacagc

SEQ ID NO: 43579 - DNA, 20 bp, Artificial Sequence
  chemically synthesized
gcactccagcttgggcaaca

SEQ ID NO: 43580 - DNA, 20 bp, Artificial Sequence
  chemically synthesized
agagtcttgctgtgttgccc

SEQ ID NO: 43581 - DNA, 20 bp, Artificial Sequence
  chemically synthesized
tcttgctgtgttgcccaagc

SEQ ID NO: 43582 - DNA, 20 bp, Artificial Sequence
  chemically synthesized
ttgctgtgttgcccaagctg

SEQ ID NO: 43583 - DNA, 20 bp, Artificial Sequence
  chemically synthesized
gtgccactgcactccagctt

SEQ ID NO: 43584 - DNA, 20 bp, Artificial Sequence
  chemically synthesized
tgtgccactgcactccagct

SEQ ID NO: 43585 - DNA, 20 bp, Artificial Sequence
  chemically synthesized
gtgttgcccaagctggagtg

SEQ ID NO: 43586 - DNA, 20 bp, Artificial Sequence
  chemically synthesized
gtgtttgtgccactgcactc

SEQ ID NO: 43587 - DNA, 20 bp, Artificial Sequence
  chemically synthesized
ttgcccaagctggagtgcag

SEQ ID NO: 43588 - DNA, 20 bp, Artificial Sequence
  chemically synthesized
ggagtgcagtggcacaaaca

SEQ ID NO: 43589 - DNA, 20 bp, Artificial Sequence
  chemically synthesized
ggcacaaacacggttcacta

SEQ ID NO: 43590 - DNA, 20 bp, Artificial Sequence
  chemically synthesized
ggggccgaaagttgaggcta

SEQ ID NO: 43591 - DNA, 20 bp, Artificial Sequence
  chemically synthesized
ttcactatagcctcaacttt

SEQ ID NO: 43592 - DNA, 20 bp, Artificial Sequence
  chemically synthesized
gcccagggggccgaaagttg

SEQ ID NO: 43593 - DNA, 20 bp, Artificial Sequence
  chemically synthesized
agcccagggggccgaaagtt

SEQ ID NO: 43594 - DNA, 20 bp, Artificial Sequence
  chemically synthesized
gcttgagcccagggggccga

SEQ ID NO: 43595 - DNA, 20 bp, Artificial Sequence
  chemically synthesized
agcctcaactttcggccccc

SEQ ID NO: 43596 - DNA, 20 bp, Artificial Sequence
  chemically synthesized
gcctcaactttcggccccct

SEQ ID NO: 43597 - DNA, 20 bp, Artificial Sequence
  chemically synthesized
gaggattgcttgagcccagg

SEQ ID NO: 43598 - DNA, 20 bp, Artificial Sequence
  chemically synthesized
ggaggattgcttgagcccag

SEQ ID NO: 43599 - DNA, 20 bp, Artificial Sequence
  chemically synthesized
actttcggccccctgggctc

SEQ ID NO: 43600 - DNA, 20 bp, Artificial Sequence
  chemically synthesized
aggaggattgcttgagccca

SEQ ID NO: 43601 - DNA, 20 bp, Artificial Sequence
  chemically synthesized
caggaggattgcttgagccc

SEQ ID NO: 43602 - DNA, 20 bp, Artificial Sequence
  chemically synthesized
gcaggaggattgcttgagcc

SEQ ID NO: 43603 - DNA, 20 bp, Artificial Sequence
  chemically synthesized
ctgaggcaggaggattgctt

SEQ ID NO: 43604 - DNA, 20 bp, Artificial Sequence
  chemically synthesized
ctcaagcaatcctcctgcct

SEQ ID NO: 43605 - DNA, 20 bp, Artificial Sequence
  chemically synthesized
acacaggatgctgaggcagg

SEQ ID NO: 43606 - DNA, 20 bp, Artificial Sequence
  chemically synthesized
cacacaggatgctgaggcag

SEQ ID NO: 43607 - DNA, 20 bp, Artificial Sequence
  chemically synthesized
ggcacacaggatgctgaggc

SEQ ID NO: 43608 - DNA, 20 bp, Artificial Sequence
  chemically synthesized
aggcacacaggatgctgagg

SEQ ID NO: 43609 - DNA, 20 bp, Artificial Sequence
  chemically synthesized
cccaggcacacaggatgctg

SEQ ID NO: 43610 - DNA, 20 bp, Artificial Sequence
  chemically synthesized
tcccaggcacacaggatgct

SEQ ID NO: 43611 - DNA, 20 bp, Artificial Sequence
  chemically synthesized
gcctcagcatcctgtgtgcc

SEQ ID NO: 43612 - DNA, 20 bp, Artificial Sequence
  chemically synthesized
gcttgtggtcccaggcacac

SEQ ID NO: 43613 - DNA, 20 bp, Artificial Sequence
  chemically synthesized
cctcagcatcctgtgtgcct

SEQ ID NO: 43614 - DNA, 20 bp, Artificial Sequence
  chemically synthesized
tgcttgtggtcccaggcaca

SEQ ID NO: 43615 - DNA, 20 bp, Artificial Sequence
  chemically synthesized
tggcatgtgcttgtggtccc

SEQ ID NO: 43616 - DNA, 20 bp, Artificial Sequence
  chemically synthesized
tcctgtgtgcctgggaccac

SEQ ID NO: 43617 - DNA, 20 bp, Artificial Sequence
  chemically synthesized
gtggcatgtgcttgtggtcc

SEQ ID NO: 43618 - DNA, 20 bp, Artificial Sequence
  chemically synthesized
ggcatggtggcatgtgcttg

SEQ ID NO: 43619 - DNA, 20 bp, Artificial Sequence
  chemically synthesized
caagcacatgccaccatgcc

SEQ ID NO: 43620 - DNA, 20 bp, Artificial Sequence
  chemically synthesized
aaaaaaaatccttggcatgg

SEQ ID NO: 43621 - DNA, 20 bp, Artificial Sequence
  chemically synthesized
aagcacatgccaccatgcca

SEQ ID NO: 43622 - DNA, 20 bp, Artificial Sequence
  chemically synthesized
aaaaaaaaaaatccttggca

SEQ ID NO: 43623 - DNA, 20 bp, Artificial Sequence
  chemically synthesized
aaaaaaaaaaaaaaaatcct

SEQ ID NO: 43624 - DNA, 20 bp, Artificial Sequence
  chemically synthesized
tttttttttttttttttttg

SEQ ID NO: 43625 - DNA, 20 bp, Artificial Sequence
  chemically synthesized
tttttttttttttttttgta

SEQ ID NO: 43626 - DNA, 20 bp, Artificial Sequence
  chemically synthesized
ttttttttttttgtagagac

SEQ ID NO: 43627 - DNA, 20 bp, Artificial Sequence
  chemically synthesized
tttttttttttgtagagacc

SEQ ID NO: 43628 - DNA, 20 bp, Artificial Sequence
  chemically synthesized
ctgagcaacaaaatgatacc

SEQ ID NO: 43629 - DNA, 20 bp, Artificial Sequence
  chemically synthesized
ccaggtatcattttgttgct

SEQ ID NO: 43630 - DNA, 20 bp, Artificial Sequence
  chemically synthesized
caggtatcattttgttgctc

SEQ ID NO: 43631 - DNA, 20 bp, Artificial Sequence
  chemically synthesized
tatcattttgttgctcaggc

SEQ ID NO: 43632 - DNA, 20 bp, Artificial Sequence
  chemically synthesized
caggagttcgaagccagcct

SEQ ID NO: 43633 - DNA, 20 bp, Artificial Sequence
  chemically synthesized
taagcccaggagttcgaagc

SEQ ID NO: 43634 - DNA, 20 bp, Artificial Sequence
  chemically synthesized
cacttaagcccaggagttcg

SEQ ID NO: 43635 - DNA, 20 bp, Artificial Sequence
  chemically synthesized
tcaggctggcttcgaactcc

SEQ ID NO: 43636 - DNA, 20 bp, Artificial Sequence
  chemically synthesized
caggctggcttcgaactcct

SEQ ID NO: 43637 - DNA, 20 bp, Artificial Sequence
  chemically synthesized
gaaggaacacttaagcccag

SEQ ID NO: 43638 - DNA, 20 bp, Artificial Sequence
  chemically synthesized
ggcttcgaactcctgggctt

SEQ ID NO: 43639 - DNA, 20 bp, Artificial Sequence
  chemically synthesized
cagaaggaacacttaagccc

SEQ ID NO: 43640 - DNA, 20 bp, Artificial Sequence
  chemically synthesized
gcagaaggaacacttaagcc

SEQ ID NO: 43641 - DNA, 20 bp, Artificial Sequence
  chemically synthesized
tcaaagcagaaggaacactt

SEQ ID NO: 43642 - DNA, 20 bp, Artificial Sequence
  chemically synthesized
ctttggggggtcaaagcaga

SEQ ID NO: 43643 - DNA, 20 bp, Artificial Sequence
  chemically synthesized
actttggggggtcaaagcag

SEQ ID NO: 43644 - DNA, 20 bp, Artificial Sequence
  chemically synthesized
agcactttggggggtcaaag

SEQ ID NO: 43645 - DNA, 20 bp, Artificial Sequence
  chemically synthesized
cccagcactttggggggtca

SEQ ID NO: 43646 - DNA, 20 bp, Artificial Sequence
  chemically synthesized
ccttctgctttgacccccca

SEQ ID NO: 43647 - DNA, 20 bp, Artificial Sequence
  chemically synthesized
tgtaatcccagcactttggg

SEQ ID NO: 43648 - DNA, 20 bp, Artificial Sequence
  chemically synthesized
gtgtaatcccagcactttgg

SEQ ID NO: 43649 - DNA, 20 bp, Artificial Sequence
  chemically synthesized
cgtgtaatcccagcactttg

SEQ ID NO: 43650 - DNA, 20 bp, Artificial Sequence
  chemically synthesized
gctttgaccccccaaagtgc

SEQ ID NO: 43651 - DNA, 20 bp, Artificial Sequence
  chemically synthesized
gcgtgtaatcccagcacttt

SEQ ID NO: 43652 - DNA, 20 bp, Artificial Sequence
  chemically synthesized
ctttgaccccccaaagtgct

SEQ ID NO: 43653 - DNA, 20 bp, Artificial Sequence
  chemically synthesized
agcgtgtaatcccagcactt

SEQ ID NO: 43654 - DNA, 20 bp, Artificial Sequence
  chemically synthesized
gtgtctcaagcgtgtaatcc

SEQ ID NO: 43655 - DNA, 20 bp, Artificial Sequence
  chemically synthesized
agtgctgggattacacgctt

SEQ ID NO: 43656 - DNA, 20 bp, Artificial Sequence
  chemically synthesized
atagctgggcacagtgtctc

SEQ ID NO: 43657 - DNA, 20 bp, Artificial Sequence
  chemically synthesized
cacgcttgagacactgtgcc

SEQ ID NO: 43658 - DNA, 20 bp, Artificial Sequence
  chemically synthesized
tgtctgaatatagctgggca

SEQ ID NO: 43659 - DNA, 20 bp, Artificial Sequence
  chemically synthesized
atctctgtctgaatatagct

SEQ ID NO: 43660 - DNA, 20 bp, Artificial Sequence
  chemically synthesized
aatctctgtctgaatatagc

SEQ ID NO: 43661 - DNA, 20 bp, Artificial Sequence
  chemically synthesized
acactgtgcccagctatatt

SEQ ID NO: 43662 - DNA, 20 bp, Artificial Sequence
  chemically synthesized
gaaaaatctctgtctgaata

SEQ ID NO: 43663 - DNA, 20 bp, Artificial Sequence
  chemically synthesized
tgtgcccagctatattcaga

SEQ ID NO: 43664 - DNA, 20 bp, Artificial Sequence
  chemically synthesized
tgcccagctatattcagaca

SEQ ID NO: 43665 - DNA, 20 bp, Artificial Sequence
  chemically synthesized
cagagatttttcttaatctt

SEQ ID NO: 43666 - DNA, 20 bp, Artificial Sequence
  chemically synthesized
gcttatgttttctgaagatt

SEQ ID NO: 43667 - DNA, 20 bp, Artificial Sequence
  chemically synthesized
ataatggcttatgttttctg

SEQ ID NO: 43668 - DNA, 20 bp, Artificial Sequence
  chemically synthesized
tcttaatcttcagaaaacat

SEQ ID NO: 43669 - DNA, 20 bp, Artificial Sequence
  chemically synthesized
atgtttttgaagataaataa

SEQ ID NO: 43670 - DNA, 20 bp, Artificial Sequence
  chemically synthesized
gggcaattaatatgtttttg

SEQ ID NO: 43671 - DNA, 20 bp, Artificial Sequence
  chemically synthesized
tcaaaaacatattaattgcc

SEQ ID NO: 43672 - DNA, 20 bp, Artificial Sequence
  chemically synthesized
caaaattacaaaagcaatct

SEQ ID NO: 43673 - DNA, 20 bp, Artificial Sequence
  chemically synthesized
tcaaaattacaaaagcaatc

SEQ ID NO: 43674 - DNA, 20 bp, Artificial Sequence
  chemically synthesized
ataatgactcaaaattacaa

SEQ ID NO: 43675 - DNA, 20 bp, Artificial Sequence
  chemically synthesized
cagattgcttttgtaatttt

SEQ ID NO: 43676 - DNA, 20 bp, Artificial Sequence
  chemically synthesized
ttgtaattttgagtcattat

SEQ ID NO: 43677 - DNA, 20 bp, Artificial Sequence
  chemically synthesized
ttttgagtcattatgagaaa

SEQ ID NO: 43678 - DNA, 20 bp, Artificial Sequence
  chemically synthesized
gtcattatgagaaaaagtat

SEQ ID NO: 43679 - DNA, 20 bp, Artificial Sequence
  chemically synthesized
ataactacatggtgcaaaag

SEQ ID NO: 43680 - DNA, 20 bp, Artificial Sequence
  chemically synthesized
attataactacatggtgcaa

SEQ ID NO: 43681 - DNA, 20 bp, Artificial Sequence
  chemically synthesized
aatacttcttttgcaccatg

SEQ ID NO: 43682 - DNA, 20 bp, Artificial Sequence
  chemically synthesized
tttttatcattataactaca

SEQ ID NO: 43683 - DNA, 20 bp, Artificial Sequence
  chemically synthesized
agttataatgataaaaaata

SEQ ID NO: 43684 - DNA, 20 bp, Artificial Sequence
  chemically synthesized
atgataaaaaataaagacta

SEQ ID NO: 43685 - DNA, 20 bp, Artificial Sequence
  chemically synthesized
tattgcagagtgatattctt

SEQ ID NO: 43686 - DNA, 20 bp, Artificial Sequence
  chemically synthesized
gaatgatattcattattgca

SEQ ID NO: 43687 - DNA, 20 bp, Artificial Sequence
  chemically synthesized
cagaatgatattcattattg

SEQ ID NO: 43688 - DNA, 20 bp, Artificial Sequence
  chemically synthesized
aatgaatatcattctgcaat

SEQ ID NO: 43689 - DNA, 20 bp, Artificial Sequence
  chemically synthesized
atgatactttattcttattg

SEQ ID NO: 43690 - DNA, 20 bp, Artificial Sequence
  chemically synthesized
atcattctgcaataagaata

SEQ ID NO: 43691 - DNA, 20 bp, Artificial Sequence
  chemically synthesized
ataaagtatcattctgcaat

SEQ ID NO: 43692 - DNA, 20 bp, Artificial Sequence
  chemically synthesized
cagaacatttcatcttattg

SEQ ID NO: 43693 - DNA, 20 bp, Artificial Sequence
  chemically synthesized
gtctgcccatgtattacatg

SEQ ID NO: 43694 - DNA, 20 bp, Artificial Sequence
  chemically synthesized
aatgttctgcatgtaataca

SEQ ID NO: 43695 - DNA, 20 bp, Artificial Sequence
  chemically synthesized
atgttctgcatgtaatacat

SEQ ID NO: 43696 - DNA, 20 bp, Artificial Sequence
  chemically synthesized
ttctgcatgtaatacatggg

SEQ ID NO: 43697 - DNA, 20 bp, Artificial Sequence
  chemically synthesized
atgtaatacatgggcagact

SEQ ID NO: 43698 - DNA, 20 bp, Artificial Sequence
  chemically synthesized
ccttgagctgggggaatact

SEQ ID NO: 43699 - DNA, 20 bp, Artificial Sequence
  chemically synthesized
gggcagactcagtattcccc

SEQ ID NO: 43700 - DNA, 20 bp, Artificial Sequence
  chemically synthesized
actcagtattcccccagctc

SEQ ID NO: 43701 - DNA, 20 bp, Artificial Sequence
  chemically synthesized
tctcccaagccttgagctgg

SEQ ID NO: 43702 - DNA, 20 bp, Artificial Sequence
  chemically synthesized
ctcagtattcccccagctca

SEQ ID NO: 43703 - DNA, 20 bp, Artificial Sequence
  chemically synthesized
ttctcccaagccttgagctg

SEQ ID NO: 43704 - DNA, 20 bp, Artificial Sequence
  chemically synthesized
tttctcccaagccttgagct

SEQ ID NO: 43705 - DNA, 20 bp, Artificial Sequence
  chemically synthesized
atttctcccaagccttgagc

SEQ ID NO: 43706 - DNA, 20 bp, Artificial Sequence
  chemically synthesized
tattcccccagctcaaggct

SEQ ID NO: 43707 - DNA, 20 bp, Artificial Sequence
  chemically synthesized
attcccccagctcaaggctt

SEQ ID NO: 43708 - DNA, 20 bp, Artificial Sequence
  chemically synthesized
cacaatttctcccaagcctt

SEQ ID NO: 43709 - DNA, 20 bp, Artificial Sequence
  chemically synthesized
tcccccagctcaaggcttgg

SEQ ID NO: 43710 - DNA, 20 bp, Artificial Sequence
  chemically synthesized
tataagtcacaatttctccc

SEQ ID NO: 43711 - DNA, 20 bp, Artificial Sequence
  chemically synthesized
ttgggagaaattgtgactta

SEQ ID NO: 43712 - DNA, 20 bp, Artificial Sequence
  chemically synthesized
gaaattgtgacttatagcca

SEQ ID NO: 43713 - DNA, 20 bp, Artificial Sequence
  chemically synthesized
tatatatggtctgtggctat

SEQ ID NO: 43714 - DNA, 20 bp, Artificial Sequence
  chemically synthesized
aggcaaatatatatggtctg

SEQ ID NO: 43715 - DNA, 20 bp, Artificial Sequence
  chemically synthesized
ctttactaggcaaatatata

SEQ ID NO: 43716 - DNA, 20 bp, Artificial Sequence
  chemically synthesized
acagaccatatatatttgcc

SEQ ID NO: 43717 - DNA, 20 bp, Artificial Sequence
  chemically synthesized
ccatatatatttgcctagta

SEQ ID NO: 43718 - DNA, 20 bp, Artificial Sequence
  chemically synthesized
cctatggttctagctttact

SEQ ID NO: 43719 - DNA, 20 bp, Artificial Sequence
  chemically synthesized
atatatttgcctagtaaagc

SEQ ID NO: 43720 - DNA, 20 bp, Artificial Sequence
  chemically synthesized
gcctatggttctagctttac

SEQ ID NO: 43721 - DNA, 20 bp, Artificial Sequence
  chemically synthesized
gcctagtaaagctagaacca

SEQ ID NO: 43722 - DNA, 20 bp, Artificial Sequence
  chemically synthesized
cctagtaaagctagaaccat

SEQ ID NO: 43723 - DNA, 20 bp, Artificial Sequence
  chemically synthesized
aagccagaggcctatggttc

SEQ ID NO: 43724 - DNA, 20 bp, Artificial Sequence
  chemically synthesized
tcccttaagccagaggccta

SEQ ID NO: 43725 - DNA, 20 bp, Artificial Sequence
  chemically synthesized
aagctagaaccataggcctc

SEQ ID NO: 43726 - DNA, 20 bp, Artificial Sequence
  chemically synthesized
gaaccataggcctctggctt

SEQ ID NO: 43727 - DNA, 20 bp, Artificial Sequence
  chemically synthesized
tcatccttcccttaagccag

SEQ ID NO: 43728 - DNA, 20 bp, Artificial Sequence
  chemically synthesized
aaccataggcctctggctta

SEQ ID NO: 43729 - DNA, 20 bp, Artificial Sequence
  chemically synthesized
ctcatccttcccttaagcca

SEQ ID NO: 43730 - DNA, 20 bp, Artificial Sequence
  chemically synthesized
accataggcctctggcttaa

SEQ ID NO: 43731 - DNA, 20 bp, Artificial Sequence
  chemically synthesized
gtctcatccttcccttaagc

SEQ ID NO: 43732 - DNA, 20 bp, Artificial Sequence
  chemically synthesized
ataggcctctggcttaaggg

SEQ ID NO: 43733 - DNA, 20 bp, Artificial Sequence
  chemically synthesized
taggcctctggcttaaggga

SEQ ID NO: 43734 - DNA, 20 bp, Artificial Sequence
  chemically synthesized
gatcgtctcatccttccctt

SEQ ID NO: 43735 - DNA, 20 bp, Artificial Sequence
  chemically synthesized
ctctggcttaagggaaggat

SEQ ID NO: 43736 - DNA, 20 bp, Artificial Sequence
  chemically synthesized
aaggatgagacgatctgttc

SEQ ID NO: 43737 - DNA, 20 bp, Artificial Sequence
  chemically synthesized
ccccgccccccattccagaa

SEQ ID NO: 43738 - DNA, 20 bp, Artificial Sequence
  chemically synthesized
tgagacgatctgttctggaa

SEQ ID NO: 43739 - DNA, 20 bp, Artificial Sequence
  chemically synthesized
gagacgatctgttctggaat

SEQ ID NO: 43740 - DNA, 20 bp, Artificial Sequence
  chemically synthesized
agacgatctgttctggaatg

SEQ ID NO: 43741 - DNA, 20 bp, Artificial Sequence
  chemically synthesized
gacgatctgttctggaatgg

SEQ ID NO: 43742 - DNA, 20 bp, Artificial Sequence
  chemically synthesized
acgatctgttctggaatggg

SEQ ID NO: 43743 - DNA, 20 bp, Artificial Sequence
  chemically synthesized
ccaccccccgccccccattc

SEQ ID NO: 43744 - DNA, 20 bp, Artificial Sequence
  chemically synthesized
atctgttctggaatgggggg

SEQ ID NO: 43745 - DNA, 20 bp, Artificial Sequence
  chemically synthesized
tctgttctggaatggggggc

SEQ ID NO: 43746 - DNA, 20 bp, Artificial Sequence
  chemically synthesized
ctgttctggaatggggggcg

SEQ ID NO: 43747 - DNA, 20 bp, Artificial Sequence
  chemically synthesized
tgttctggaatggggggcgg

SEQ ID NO: 43748 - DNA, 20 bp, Artificial Sequence
  chemically synthesized
gttctggaatggggggcggg

SEQ ID NO: 43749 - DNA, 20 bp, Artificial Sequence
  chemically synthesized
ctggaatggggggcgggggg

SEQ ID NO: 43750 - DNA, 20 bp, Artificial Sequence
  chemically synthesized
cggggggtggtgtcaaaatc

SEQ ID NO: 43751 - DNA, 20 bp, Artificial Sequence
  chemically synthesized
ggggggtggtgtcaaaatca

SEQ ID NO: 43752 - DNA, 20 bp, Artificial Sequence
  chemically synthesized
ggacatgcacaaatgttgca

SEQ ID NO: 43753 - DNA, 20 bp, Artificial Sequence
  chemically synthesized
gacatgcacaaatgttgcaa

SEQ ID NO: 43754 - DNA, 20 bp, Artificial Sequence
  chemically synthesized
aaatgttgcaaaggctcctg

SEQ ID NO: 43755 - DNA, 20 bp, Artificial Sequence
  chemically synthesized
atgttgcaaaggctcctgca

SEQ ID NO: 43756 - DNA, 20 bp, Artificial Sequence
  chemically synthesized
ggacaagaagtgctctgcag

SEQ ID NO: 43757 - DNA, 20 bp, Artificial Sequence
  chemically synthesized
atggacaagaagtgctctgc

SEQ ID NO: 43758 - DNA, 20 bp, Artificial Sequence
  chemically synthesized
gatggacaagaagtgctctg

SEQ ID NO: 43759 - DNA, 20 bp, Artificial Sequence
  chemically synthesized
ggtcaatttagatggacaag

SEQ ID NO: 43760 - DNA, 20 bp, Artificial Sequence
  chemically synthesized
cgtggtcaatttagatggac

SEQ ID NO: 43761 - DNA, 20 bp, Artificial Sequence
  chemically synthesized
tagcgcgtggtcaatttaga

SEQ ID NO: 43762 - DNA, 20 bp, Artificial Sequence
  chemically synthesized
aaggtagcgcgtggtcaatt

SEQ ID NO: 43763 - DNA, 20 bp, Artificial Sequence
  chemically synthesized
tctttctgaaaggtagcgcg

SEQ ID NO: 43764 - DNA, 20 bp, Artificial Sequence
  chemically synthesized
attgaccacgcgctaccttt

SEQ ID NO: 43765 - DNA, 20 bp, Artificial Sequence
  chemically synthesized
ttgtaagtctttctgaaagg

SEQ ID NO: 43766 - DNA, 20 bp, Artificial Sequence
  chemically synthesized
accacgcgctacctttcaga

SEQ ID NO: 43767 - DNA, 20 bp, Artificial Sequence
  chemically synthesized
caattgtaagtctttctgaa

SEQ ID NO: 43768 - DNA, 20 bp, Artificial Sequence
  chemically synthesized
tcaattgtaagtctttctga

SEQ ID NO: 43769 - DNA, 20 bp, Artificial Sequence
  chemically synthesized
tttcagaaagacttacaatt

SEQ ID NO: 43770 - DNA, 20 bp, Artificial Sequence
  chemically synthesized
ttcagaaagacttacaattg

SEQ ID NO: 43771 - DNA, 20 bp, Artificial Sequence
  chemically synthesized
ctcttcataccctcaattgt

SEQ ID NO: 43772 - DNA, 20 bp, Artificial Sequence
  chemically synthesized
tcagaaagacttacaattga

SEQ ID NO: 43773 - DNA, 20 bp, Artificial Sequence
  chemically synthesized
gacttacaattgagggtatg

SEQ ID NO: 43774 - DNA, 20 bp, Artificial Sequence
  chemically synthesized
cttacaattgagggtatgaa

SEQ ID NO: 43775 - DNA, 20 bp, Artificial Sequence
  chemically synthesized
accatacttaataaatgtca

SEQ ID NO: 43776 - DNA, 20 bp, Artificial Sequence
  chemically synthesized
cacattccatgacatttatt

SEQ ID NO: 43777 - DNA, 20 bp, Artificial Sequence
  chemically synthesized
tccatgacatttattaagta

SEQ ID NO: 43778 - DNA, 20 bp, Artificial Sequence
  chemically synthesized
acatttattaagtatggtct

SEQ ID NO: 43779 - DNA, 20 bp, Artificial Sequence
  chemically synthesized
ctaagatagagagtatggcc

SEQ ID NO: 43780 - DNA, 20 bp, Artificial Sequence
  chemically synthesized
cttccctaagatagagagta

SEQ ID NO: 43781 - DNA, 20 bp, Artificial Sequence
  chemically synthesized
cttggccatactctctatct

SEQ ID NO: 43782 - DNA, 20 bp, Artificial Sequence
  chemically synthesized
cagggcttccctaagataga

SEQ ID NO: 43783 - DNA, 20 bp, Artificial Sequence
  chemically synthesized
ttggccatactctctatctt

SEQ ID NO: 43784 - DNA, 20 bp, Artificial Sequence
  chemically synthesized
tggccatactctctatctta

SEQ ID NO: 43785 - DNA, 20 bp, Artificial Sequence
  chemically synthesized
atcagggcttccctaagata

SEQ ID NO: 43786 - DNA, 20 bp, Artificial Sequence
  chemically synthesized
ccatcagggcttccctaaga

SEQ ID NO: 43787 - DNA, 20 bp, Artificial Sequence
  chemically synthesized
ccatactctctatcttaggg

SEQ ID NO: 43788 - DNA, 20 bp, Artificial Sequence
  chemically synthesized
acctccatcagggcttccct

SEQ ID NO: 43789 - DNA, 20 bp, Artificial Sequence
  chemically synthesized
ctatcttagggaagccctga

SEQ ID NO: 43790 - DNA, 20 bp, Artificial Sequence
  chemically synthesized
atcttagggaagccctgatg

SEQ ID NO: 43791 - DNA, 20 bp, Artificial Sequence
  chemically synthesized
tcttagggaagccctgatgg

SEQ ID NO: 43792 - DNA, 20 bp, Artificial Sequence
  chemically synthesized
atattccaccacctccatca

SEQ ID NO: 43793 - DNA, 20 bp, Artificial Sequence
  chemically synthesized
catattccaccacctccatc

SEQ ID NO: 43794 - DNA, 20 bp, Artificial Sequence
  chemically synthesized
tagggaagccctgatggagg

SEQ ID NO: 43795 - DNA, 20 bp, Artificial Sequence
  chemically synthesized
tcatattccaccacctccat

SEQ ID NO: 43796 - DNA, 20 bp, Artificial Sequence
  chemically synthesized
ggaagccctgatggaggtgg

SEQ ID NO: 43797 - DNA, 20 bp, Artificial Sequence
  chemically synthesized
ggaggtggtggaatatgact

SEQ ID NO: 43798 - DNA, 20 bp, Artificial Sequence
  chemically synthesized
cagaaaagcaaaggatttct

SEQ ID NO: 43799 - DNA, 20 bp, Artificial Sequence
  chemically synthesized
ccaatggagcagaaaagcaa

SEQ ID NO: 43800 - DNA, 20 bp, Artificial Sequence
  chemically synthesized
accaatggagcagaaaagca

SEQ ID NO: 43801 - DNA, 20 bp, Artificial Sequence
  chemically synthesized
tatagaccaatggagcagaa

SEQ ID NO: 43802 - DNA, 20 bp, Artificial Sequence
  chemically synthesized
cctttgcttttctgctccat

SEQ ID NO: 43803 - DNA, 20 bp, Artificial Sequence
  chemically synthesized
agacatatagaccaatggag

SEQ ID NO: 43804 - DNA, 20 bp, Artificial Sequence
  chemically synthesized
aacagacatatagaccaatg

SEQ ID NO: 43805 - DNA, 20 bp, Artificial Sequence
  chemically synthesized
aaaacagacatatagaccaa

SEQ ID NO: 43806 - DNA, 20 bp, Artificial Sequence
  chemically synthesized
ctggtaccaaaacagacata

SEQ ID NO: 43807 - DNA, 20 bp, Artificial Sequence
  chemically synthesized
attggtctatatgtctgttt

SEQ ID NO: 43808 - DNA, 20 bp, Artificial Sequence
  chemically synthesized
gcatggtactggtaccaaaa

SEQ ID NO: 43809 - DNA, 20 bp, Artificial Sequence
  chemically synthesized
ctatatgtctgttttggtac

SEQ ID NO: 43810 - DNA, 20 bp, Artificial Sequence
  chemically synthesized
taaccaaaacagcatggtac

SEQ ID NO: 43811 - DNA, 20 bp, Artificial Sequence
  chemically synthesized
ctacagtaaccaaaacagca

SEQ ID NO: 43812 - DNA, 20 bp, Artificial Sequence
  chemically synthesized
gtaccagtaccatgctgttt

SEQ ID NO: 43813 - DNA, 20 bp, Artificial Sequence
  chemically synthesized
caaggctacagtaaccaaaa

SEQ ID NO: 43814 - DNA, 20 bp, Artificial Sequence
  chemically synthesized
ccatgctgttttggttactg

SEQ ID NO: 43815 - DNA, 20 bp, Artificial Sequence
  chemically synthesized
caaactatactacaaggcta

SEQ ID NO: 43816 - DNA, 20 bp, Artificial Sequence
  chemically synthesized
ttttggttactgtagccttg

SEQ ID NO: 43817 - DNA, 20 bp, Artificial Sequence
  chemically synthesized
gttactgtagccttgtagta

SEQ ID NO: 43818 - DNA, 20 bp, Artificial Sequence
  chemically synthesized
tgaattcaaactatactaca

SEQ ID NO: 43819 - DNA, 20 bp, Artificial Sequence
  chemically synthesized
ctgaattcaaactatactac

SEQ ID NO: 43820 - DNA, 20 bp, Artificial Sequence
  chemically synthesized
cttgtagtatagtttgaatt

SEQ ID NO: 43821 - DNA, 20 bp, Artificial Sequence
  chemically synthesized
ttgtagtatagtttgaattc

SEQ ID NO: 43822 - DNA, 20 bp, Artificial Sequence
  chemically synthesized
tagtatagtttgaattcagg

SEQ ID NO: 43823 - DNA, 20 bp, Artificial Sequence
  chemically synthesized
ttcaggtggtgtgatgcctc

SEQ ID NO: 43824 - DNA, 20 bp, Artificial Sequence
  chemically synthesized
agcaaaaagaacaaagctag

SEQ ID NO: 43825 - DNA, 20 bp, Artificial Sequence
  chemically synthesized
aagcaaaaagaacaaagcta

SEQ ID NO: 43826 - DNA, 20 bp, Artificial Sequence
  chemically synthesized
ctaagcaaaaagaacaaagc

SEQ ID NO: 43827 - DNA, 20 bp, Artificial Sequence
  chemically synthesized
aattctaagcaaaaagaaca

SEQ ID NO: 43828 - DNA, 20 bp, Artificial Sequence
  chemically synthesized
ctagctttgttctttttgct

SEQ ID NO: 43829 - DNA, 20 bp, Artificial Sequence
  chemically synthesized
ccaagacaattctaagcaaa

SEQ ID NO: 43830 - DNA, 20 bp, Artificial Sequence
  chemically synthesized
cgtatagccaagacaattct

SEQ ID NO: 43831 - DNA, 20 bp, Artificial Sequence
  chemically synthesized
ctttttgcttagaattgtct

SEQ ID NO: 43832 - DNA, 20 bp, Artificial Sequence
  chemically synthesized
ttagaattgtcttggctata

SEQ ID NO: 43833 - DNA, 20 bp, Artificial Sequence
  chemically synthesized
aaagaagaccccgtatagcc

SEQ ID NO: 43834 - DNA, 20 bp, Artificial Sequence
  chemically synthesized
tagaattgtcttggctatac

SEQ ID NO: 43835 - DNA, 20 bp, Artificial Sequence
  chemically synthesized
agaattgtcttggctatacg

SEQ ID NO: 43836 - DNA, 20 bp, Artificial Sequence
  chemically synthesized
gaatcaaagaagaccccgta

SEQ ID NO: 43837 - DNA, 20 bp, Artificial Sequence
  chemically synthesized
aatttcatgtggaatcaaag

SEQ ID NO: 43838 - DNA, 20 bp, Artificial Sequence
  chemically synthesized
ttaaatttcatgtggaatca

SEQ ID NO: 43839 - DNA, 20 bp, Artificial Sequence
  chemically synthesized
aaactgttttaaatttcatg

SEQ ID NO: 43840 - DNA, 20 bp, Artificial Sequence
  chemically synthesized
attccacatgaaatttaaaa

SEQ ID NO: 43841 - DNA, 20 bp, Artificial Sequence
  chemically synthesized
gttttttttttaattctgtg

SEQ ID NO: 43842 - DNA, 20 bp, Artificial Sequence
  chemically synthesized
ttttttttaattctgtgaag

SEQ ID NO: 43843 - DNA, 20 bp, Artificial Sequence
  chemically synthesized
tttttttaattctgtgaaga

SEQ ID NO: 43844 - DNA, 20 bp, Artificial Sequence
  chemically synthesized
aactaccatgaccttcttca

SEQ ID NO: 43845 - DNA, 20 bp, Artificial Sequence
  chemically synthesized
taattctgtgaagaaggtca

SEQ ID NO: 43846 - DNA, 20 bp, Artificial Sequence
  chemically synthesized
ttctgtgaagaaggtcatgg

SEQ ID NO: 43847 - DNA, 20 bp, Artificial Sequence
  chemically synthesized
agaaggtcatggtagtttga

SEQ ID NO: 43848 - DNA, 20 bp, Artificial Sequence
  chemically synthesized
gaaggtcatggtagtttgat

SEQ ID NO: 43849 - DNA, 20 bp, Artificial Sequence
  chemically synthesized
tcatggtagtttgatgggaa

SEQ ID NO: 43850 - DNA, 20 bp, Artificial Sequence
  chemically synthesized
atactgcccaaagtaattta

SEQ ID NO: 43851 - DNA, 20 bp, Artificial Sequence
  chemically synthesized
attgaatctataaattactt

SEQ ID NO: 43852 - DNA, 20 bp, Artificial Sequence
  chemically synthesized
ttgaatctataaattacttt

SEQ ID NO: 43853 - DNA, 20 bp, Artificial Sequence
  chemically synthesized
aatctataaattactttggg

SEQ ID NO: 43854 - DNA, 20 bp, Artificial Sequence
  chemically synthesized
gaaaatggttatactgccca

SEQ ID NO: 43855 - DNA, 20 bp, Artificial Sequence
  chemically synthesized
aagaatcaatatcgtgaaaa

SEQ ID NO: 43856 - DNA, 20 bp, Artificial Sequence
  chemically synthesized
tgaggtctttcatggatagg

SEQ ID NO: 43857 - DNA, 20 bp, Artificial Sequence
  chemically synthesized
ttctgaggtctttcatggat

SEQ ID NO: 43858 - DNA, 20 bp, Artificial Sequence
  chemically synthesized
ttgattcttcctatccatga

SEQ ID NO: 43859 - DNA, 20 bp, Artificial Sequence
  chemically synthesized
tttctgaggtctttcatgga

SEQ ID NO: 43860 - DNA, 20 bp, Artificial Sequence
  chemically synthesized
attatttctgaggtctttca

SEQ ID NO: 43861 - DNA, 20 bp, Artificial Sequence
  chemically synthesized
ttcctatccatgaaagacct

SEQ ID NO: 43862 - DNA, 20 bp, Artificial Sequence
  chemically synthesized
gatgtgtggtattatttctg

SEQ ID NO: 43863 - DNA, 20 bp, Artificial Sequence
  chemically synthesized
agatgtgtggtattatttct

SEQ ID NO: 43864 - DNA, 20 bp, Artificial Sequence
  chemically synthesized
atcagatgtttgtagatgtg

SEQ ID NO: 43865 - DNA, 20 bp, Artificial Sequence
  chemically synthesized
tatcaaagatcagatgtttg

SEQ ID NO: 43866 - DNA, 20 bp, Artificial Sequence
  chemically synthesized
ttgtcaggtttatcaaagat

SEQ ID NO: 43867 - DNA, 20 bp, Artificial Sequence
  chemically synthesized
tgtttttgtcaggtttatca

SEQ ID NO: 43868 - DNA, 20 bp, Artificial Sequence
  chemically synthesized
ccccattgcttgtttttgtc

SEQ ID NO: 43869 - DNA, 20 bp, Artificial Sequence
  chemically synthesized
tccccattgcttgtttttgt

SEQ ID NO: 43870 - DNA, 20 bp, Artificial Sequence
  chemically synthesized
ttgataaacctgacaaaaac

SEQ ID NO: 43871 - DNA, 20 bp, Artificial Sequence
  chemically synthesized
aacctgacaaaaacaagcaa

SEQ ID NO: 43872 - DNA, 20 bp, Artificial Sequence
  chemically synthesized
acctgacaaaaacaagcaat

SEQ ID NO: 43873 - DNA, 20 bp, Artificial Sequence
  chemically synthesized
cctgacaaaaacaagcaatg

SEQ ID NO: 43874 - DNA, 20 bp, Artificial Sequence
  chemically synthesized
acaaaaacaagcaatgggga

SEQ ID NO: 43875 - DNA, 20 bp, Artificial Sequence
  chemically synthesized
caaaaacaagcaatggggaa

SEQ ID NO: 43876 - DNA, 20 bp, Artificial Sequence
  chemically synthesized
tggggaaaggatctcctatt

SEQ ID NO: 43877 - DNA, 20 bp, Artificial Sequence
  chemically synthesized
cagcaccgtttactgaatag

SEQ ID NO: 43878 - DNA, 20 bp, Artificial Sequence
  chemically synthesized
cccagcaccgtttactgaat

SEQ ID NO: 43879 - DNA, 20 bp, Artificial Sequence
  chemically synthesized
tcccagcaccgtttactgaa

SEQ ID NO: 43880 - DNA, 20 bp, Artificial Sequence
  chemically synthesized
aggatctcctattcagtaaa

SEQ ID NO: 43881 - DNA, 20 bp, Artificial Sequence
  chemically synthesized
tcctattcagtaaacggtgc

SEQ ID NO: 43882 - DNA, 20 bp, Artificial Sequence
  chemically synthesized
cctattcagtaaacggtgct

SEQ ID NO: 43883 - DNA, 20 bp, Artificial Sequence
  chemically synthesized
atatggctagagagttttcc

SEQ ID NO: 43884 - DNA, 20 bp, Artificial Sequence
  chemically synthesized
acggtgctgggaaaactctc

SEQ ID NO: 43885 - DNA, 20 bp, Artificial Sequence
  chemically synthesized
gttttctgcatatggctaga

SEQ ID NO: 43886 - DNA, 20 bp, Artificial Sequence
  chemically synthesized
ctgttttctgcatatggcta

SEQ ID NO: 43887 - DNA, 20 bp, Artificial Sequence
  chemically synthesized
ttctgttttctgcatatggc

SEQ ID NO: 43888 - DNA, 20 bp, Artificial Sequence
  chemically synthesized
gaaaactctctagccatatg

SEQ ID NO: 43889 - DNA, 20 bp, Artificial Sequence
  chemically synthesized
cagtttctgttttctgcata

SEQ ID NO: 43890 - DNA, 20 bp, Artificial Sequence
  chemically synthesized
ctctagccatatgcagaaaa

SEQ ID NO: 43891 - DNA, 20 bp, Artificial Sequence
  chemically synthesized
catatgcagaaaacagaaac

SEQ ID NO: 43892 - DNA, 20 bp, Artificial Sequence
  chemically synthesized
taagctgtaagggaggggtc

SEQ ID NO: 43893 - DNA, 20 bp, Artificial Sequence
  chemically synthesized
ttgtgtaagctgtaagggag

SEQ ID NO: 43894 - DNA, 20 bp, Artificial Sequence
  chemically synthesized
gaaactggacccctccctta

SEQ ID NO: 43895 - DNA, 20 bp, Artificial Sequence
  chemically synthesized
tttgtgtaagctgtaaggga

SEQ ID NO: 43896 - DNA, 20 bp, Artificial Sequence
  chemically synthesized
ttttgtgtaagctgtaaggg

SEQ ID NO: 43897 - DNA, 20 bp, Artificial Sequence
  chemically synthesized
tttttgtgtaagctgtaagg

SEQ ID NO: 43898 - DNA, 20 bp, Artificial Sequence
  chemically synthesized
aatttttgtgtaagctgtaa

SEQ ID NO: 43899 - DNA, 20 bp, Artificial Sequence
  chemically synthesized
taatttttgtgtaagctgta

SEQ ID NO: 43900 - DNA, 20 bp, Artificial Sequence
  chemically synthesized
ttaatttttgtgtaagctgt

SEQ ID NO: 43901 - DNA, 20 bp, Artificial Sequence
  chemically synthesized
tcttgagttaatttttgtgt

SEQ ID NO: 43902 - DNA, 20 bp, Artificial Sequence
  chemically synthesized
gcttacacaaaaattaactc

SEQ ID NO: 43903 - DNA, 20 bp, Artificial Sequence
  chemically synthesized
acacaaaaattaactcaaga

SEQ ID NO: 43904 - DNA, 20 bp, Artificial Sequence
  chemically synthesized
ttaagtctttaatccatctt

SEQ ID NO: 43905 - DNA, 20 bp, Artificial Sequence
  chemically synthesized
aattaactcaagatggatta

SEQ ID NO: 43906 - DNA, 20 bp, Artificial Sequence
  chemically synthesized
ggatttggggttttacattt

SEQ ID NO: 43907 - DNA, 20 bp, Artificial Sequence
  chemically synthesized
tctagggtttttaggatttg

SEQ ID NO: 43908 - DNA, 20 bp, Artificial Sequence
  chemically synthesized
ttctagggtttttaggattt

SEQ ID NO: 43909 - DNA, 20 bp, Artificial Sequence
  chemically synthesized
cttctagggtttttaggatt

SEQ ID NO: 43910 - DNA, 20 bp, Artificial Sequence
  chemically synthesized
ggtttccttctagggttttt

SEQ ID NO: 43911 - DNA, 20 bp, Artificial Sequence
  chemically synthesized
accccaaatcctaaaaaccc

SEQ ID NO: 43912 - DNA, 20 bp, Artificial Sequence
  chemically synthesized
aggtttccttctagggtttt

SEQ ID NO: 43913 - DNA, 20 bp, Artificial Sequence
  chemically synthesized
ccaaatcctaaaaaccctag

SEQ ID NO: 43914 - DNA, 20 bp, Artificial Sequence
  chemically synthesized
caaatcctaaaaaccctaga

SEQ ID NO: 43915 - DNA, 20 bp, Artificial Sequence
  chemically synthesized
attgcctaggtttccttcta

SEQ ID NO: 43916 - DNA, 20 bp, Artificial Sequence
  chemically synthesized
tattgcctaggtttccttct

SEQ ID NO: 43917 - DNA, 20 bp, Artificial Sequence
  chemically synthesized
gtattgcctaggtttccttc

SEQ ID NO: 43918 - DNA, 20 bp, Artificial Sequence
  chemically synthesized
aaaaaccctagaaggaaacc

SEQ ID NO: 43919 - DNA, 20 bp, Artificial Sequence
  chemically synthesized
aaaaccctagaaggaaacct

SEQ ID NO: 43920 - DNA, 20 bp, Artificial Sequence
  chemically synthesized
tgtcttaaatggtattgcct

SEQ ID NO: 43921 - DNA, 20 bp, Artificial Sequence
  chemically synthesized
atgtcttaaatggtattgcc

SEQ ID NO: 43922 - DNA, 20 bp, Artificial Sequence
  chemically synthesized
aaacctaggcaataccattt

SEQ ID NO: 43923 - DNA, 20 bp, Artificial Sequence
  chemically synthesized
gcccatgcctatgtcttaaa

SEQ ID NO: 43924 - DNA, 20 bp, Artificial Sequence
  chemically synthesized
aggcaataccatttaagaca

SEQ ID NO: 43925 - DNA, 20 bp, Artificial Sequence
  chemically synthesized
ggcaataccatttaagacat

SEQ ID NO: 43926 - DNA, 20 bp, Artificial Sequence
  chemically synthesized
taccatttaagacataggca

SEQ ID NO: 43927 - DNA, 20 bp, Artificial Sequence
  chemically synthesized
accatttaagacataggcat

SEQ ID NO: 43928 - DNA, 20 bp, Artificial Sequence
  chemically synthesized
ttaagacataggcatgggca

SEQ ID NO: 43929 - DNA, 20 bp, Artificial Sequence
  chemically synthesized
cttttggcgtttttgtcatg

SEQ ID NO: 43930 - DNA, 20 bp, Artificial Sequence
  chemically synthesized
cttcatgacaaaaacgccaa

SEQ ID NO: 43931 - DNA, 20 bp, Artificial Sequence
  chemically synthesized
tcttttgttgcagttgcttt

SEQ ID NO: 43932 - DNA, 20 bp, Artificial Sequence
  chemically synthesized
gccaaaagcaactgcaacaa

SEQ ID NO: 43933 - DNA, 20 bp, Artificial Sequence
  chemically synthesized
ctcaattttgtcttttgttg

SEQ ID NO: 43934 - DNA, 20 bp, Artificial Sequence
  chemically synthesized
ctgcaacaaaagacaaaatt

SEQ ID NO: 43935 - DNA, 20 bp, Artificial Sequence
  chemically synthesized
caaaagacaaaattgagaaa

SEQ ID NO: 43936 - DNA, 20 bp, Artificial Sequence
  chemically synthesized
cagaagctctttagtttaat

SEQ ID NO: 43937 - DNA, 20 bp, Artificial Sequence
  chemically synthesized
aatggaatctaattaaacta

SEQ ID NO: 43938 - DNA, 20 bp, Artificial Sequence
  chemically synthesized
tggaatctaattaaactaaa

SEQ ID NO: 43939 - DNA, 20 bp, Artificial Sequence
  chemically synthesized
tttgctgtgcagaagctctt

SEQ ID NO: 43940 - DNA, 20 bp, Artificial Sequence
  chemically synthesized
taaactaaagagcttctgca

SEQ ID NO: 43941 - DNA, 20 bp, Artificial Sequence
  chemically synthesized
tagtttcttttgctgtgcag

SEQ ID NO: 43942 - DNA, 20 bp, Artificial Sequence
  chemically synthesized
tgatagtttcttttgctgtg

SEQ ID NO: 43943 - DNA, 20 bp, Artificial Sequence
  chemically synthesized
aaagagcttctgcacagcaa

SEQ ID NO: 43944 - DNA, 20 bp, Artificial Sequence
  chemically synthesized
agcaaaagaaactatcatca

SEQ ID NO: 43945 - DNA, 20 bp, Artificial Sequence
  chemically synthesized
ttgcctattcactttgatga

SEQ ID NO: 43946 - DNA, 20 bp, Artificial Sequence
  chemically synthesized
gaaactatcatcaaagtgaa

SEQ ID NO: 43947 - DNA, 20 bp, Artificial Sequence
  chemically synthesized
aaactatcatcaaagtgaat

SEQ ID NO: 43948 - DNA, 20 bp, Artificial Sequence
  chemically synthesized
caaagtgaataggcaaccta

SEQ ID NO: 43949 - DNA, 20 bp, Artificial Sequence
  chemically synthesized
tgaataggcaacctacagaa

SEQ ID NO: 43950 - DNA, 20 bp, Artificial Sequence
  chemically synthesized
gaataggcaacctacagaat

SEQ ID NO: 43951 - DNA, 20 bp, Artificial Sequence
  chemically synthesized
aaaatgttttcccattctgt

SEQ ID NO: 43952 - DNA, 20 bp, Artificial Sequence
  chemically synthesized
aaaaatgttttcccattctg

SEQ ID NO: 43953 - DNA, 20 bp, Artificial Sequence
  chemically synthesized
ttagacctttgtcagatggg

SEQ ID NO: 43954 - DNA, 20 bp, Artificial Sequence
  chemically synthesized
atattagacctttgtcagat

SEQ ID NO: 43955 - DNA, 20 bp, Artificial Sequence
  chemically synthesized
ttcaatctacccatctgaca

SEQ ID NO: 43956 - DNA, 20 bp, Artificial Sequence
  chemically synthesized
gatattagacctttgtcaga

SEQ ID NO: 43957 - DNA, 20 bp, Artificial Sequence
  chemically synthesized
tcaatctacccatctgacaa

SEQ ID NO: 43958 - DNA, 20 bp, Artificial Sequence
  chemically synthesized
tctggatattagacctttgt

SEQ ID NO: 43959 - DNA, 20 bp, Artificial Sequence
  chemically synthesized
tctgacaaaggtctaatatc

SEQ ID NO: 43960 - DNA, 20 bp, Artificial Sequence
  chemically synthesized
tccttgtaaattctggatat

SEQ ID NO: 43961 - DNA, 20 bp, Artificial Sequence
  chemically synthesized
tttaagttccttgtaaattc

SEQ ID NO: 43962 - DNA, 20 bp, Artificial Sequence
  chemically synthesized
gtctaatatccagaatttac

SEQ ID NO: 43963 - DNA, 20 bp, Artificial Sequence
  chemically synthesized
tctaatatccagaatttaca

SEQ ID NO: 43964 - DNA, 20 bp, Artificial Sequence
  chemically synthesized
tttttcttgtgaatatgttt

SEQ ID NO: 43965 - DNA, 20 bp, Artificial Sequence
  chemically synthesized
aggaacttaaacatattcac

SEQ ID NO: 43966 - DNA, 20 bp, Artificial Sequence
  chemically synthesized
ttaaacatattcacaagaaa

SEQ ID NO: 43967 - DNA, 20 bp, Artificial Sequence
  chemically synthesized
agacaaacaaccctatcaaa

SEQ ID NO: 43968 - DNA, 20 bp, Artificial Sequence
  chemically synthesized
cctttgcccactttttgata

SEQ ID NO: 43969 - DNA, 20 bp, Artificial Sequence
  chemically synthesized
tcctttgcccactttttgat

SEQ ID NO: 43970 - DNA, 20 bp, Artificial Sequence
  chemically synthesized
atcctttgcccactttttga

SEQ ID NO: 43971 - DNA, 20 bp, Artificial Sequence
  chemically synthesized
caaacaaccctatcaaaaag

SEQ ID NO: 43972 - DNA, 20 bp, Artificial Sequence
  chemically synthesized
aaacaaccctatcaaaaagt

SEQ ID NO: 43973 - DNA, 20 bp, Artificial Sequence
  chemically synthesized
accctatcaaaaagtgggca

SEQ ID NO: 43974 - DNA, 20 bp, Artificial Sequence
  chemically synthesized
ccctatcaaaaagtgggcaa

SEQ ID NO: 43975 - DNA, 20 bp, Artificial Sequence
  chemically synthesized
aagtgggcaaaggatatgaa

SEQ ID NO: 43976 - DNA, 20 bp, Artificial Sequence
  chemically synthesized
tatgaacagacacttctcaa

SEQ ID NO: 43977 - DNA, 20 bp, Artificial Sequence
  chemically synthesized
tgtaaatgtcttcttttgag

SEQ ID NO: 43978 - DNA, 20 bp, Artificial Sequence
  chemically synthesized
gaacagacacttctcaaaag

SEQ ID NO: 43979 - DNA, 20 bp, Artificial Sequence
  chemically synthesized
ccatgtaaatgtcttctttt

SEQ ID NO: 43980 - DNA, 20 bp, Artificial Sequence
  chemically synthesized
ctcaaaagaagacatttaca

SEQ ID NO: 43981 - DNA, 20 bp, Artificial Sequence
  chemically synthesized
gctttttttcatatgtttgt

SEQ ID NO: 43982 - DNA, 20 bp, Artificial Sequence
  chemically synthesized
gccaacaaacatatgaaaaa

SEQ ID NO: 43983 - DNA, 20 bp, Artificial Sequence
  chemically synthesized
ctctgatgatcagtgatgtt

SEQ ID NO: 43984 - DNA, 20 bp, Artificial Sequence
  chemically synthesized
agctcaacatcactgatcat

SEQ ID NO: 43985 - DNA, 20 bp, Artificial Sequence
  chemically synthesized
ctcaacatcactgatcatca

SEQ ID NO: 43986 - DNA, 20 bp, Artificial Sequence
  chemically synthesized
atttgcatttctctgatgat

SEQ ID NO: 43987 - DNA, 20 bp, Artificial Sequence
  chemically synthesized
atgcaaatgaaaaccacaat

SEQ ID NO: 43988 - DNA, 20 bp, Artificial Sequence
  chemically synthesized
tgtgagatggtatctcattg

SEQ ID NO: 43989 - DNA, 20 bp, Artificial Sequence
  chemically synthesized
ccattctgactggtgtgaga

SEQ ID NO: 43990 - DNA, 20 bp, Artificial Sequence
  chemically synthesized
aatgagataccatctcacac

SEQ ID NO: 43991 - DNA, 20 bp, Artificial Sequence
  chemically synthesized
atcaccattctgactggtgt

SEQ ID NO: 43992 - DNA, 20 bp, Artificial Sequence
  chemically synthesized
agataccatctcacaccagt

SEQ ID NO: 43993 - DNA, 20 bp, Artificial Sequence
  chemically synthesized
ccatctcacaccagtcagaa

SEQ ID NO: 43994 - DNA, 20 bp, Artificial Sequence
  chemically synthesized
ttaataatcaccattctgac

SEQ ID NO: 43995 - DNA, 20 bp, Artificial Sequence
  chemically synthesized
tcagaatggtgattattaaa

SEQ ID NO: 43996 - DNA, 20 bp, Artificial Sequence
  chemically synthesized
aatggtgattattaaaaagt

SEQ ID NO: 43997 - DNA, 20 bp, Artificial Sequence
  chemically synthesized
atggtgattattaaaaagtc

SEQ ID NO: 43998 - DNA, 20 bp, Artificial Sequence
  chemically synthesized
attaaaaagtcaggaaacaa

SEQ ID NO: 43999 - DNA, 20 bp, Artificial Sequence
  chemically synthesized
agtcaggaaacaacagatgc

SEQ ID NO: 44000 - DNA, 20 bp, Artificial Sequence
  chemically synthesized
aggaaacaacagatgctggc

SEQ ID NO: 44001 - DNA, 20 bp, Artificial Sequence
  chemically synthesized
ggaaacaacagatgctggct

SEQ ID NO: 44002 - DNA, 20 bp, Artificial Sequence
  chemically synthesized
ccatttctccacagcctagc

SEQ ID NO: 44003 - DNA, 20 bp, Artificial Sequence
  chemically synthesized
aacagatgctggctaggctg

SEQ ID NO: 44004 - DNA, 20 bp, Artificial Sequence
  chemically synthesized
cagatgctggctaggctgtg

SEQ ID NO: 44005 - DNA, 20 bp, Artificial Sequence
  chemically synthesized
gttcccatttctccacagcc

SEQ ID NO: 44006 - DNA, 20 bp, Artificial Sequence
  chemically synthesized
aaagcgttcccatttctcca

SEQ ID NO: 44007 - DNA, 20 bp, Artificial Sequence
  chemically synthesized
ctggctaggctgtggagaaa

SEQ ID NO: 44008 - DNA, 20 bp, Artificial Sequence
  chemically synthesized
tggctaggctgtggagaaat

SEQ ID NO: 44009 - DNA, 20 bp, Artificial Sequence
  chemically synthesized
cattcccatcaacagttcaa

SEQ ID NO: 44010 - DNA, 20 bp, Artificial Sequence
  chemically synthesized
gaacgcttttgaactgttga

SEQ ID NO: 44011 - DNA, 20 bp, Artificial Sequence
  chemically synthesized
aacgcttttgaactgttgat

SEQ ID NO: 44012 - DNA, 20 bp, Artificial Sequence
  chemically synthesized
ctaatttacattcccatcaa

SEQ ID NO: 44013 - DNA, 20 bp, Artificial Sequence
  chemically synthesized
ctgttgatgggaatgtaaat

SEQ ID NO: 44014 - DNA, 20 bp, Artificial Sequence
  chemically synthesized
gtaaattagttcaaccattg

SEQ ID NO: 44015 - DNA, 20 bp, Artificial Sequence
  chemically synthesized
tgccatactgttttccacaa

SEQ ID NO: 44016 - DNA, 20 bp, Artificial Sequence
  chemically synthesized
agttcaaccattgtggaaaa

SEQ ID NO: 44017 - DNA, 20 bp, Artificial Sequence
  chemically synthesized
aaccattgtggaaaacagta

SEQ ID NO: 44018 - DNA, 20 bp, Artificial Sequence
  chemically synthesized
aaacagtatggcaattcctc

SEQ ID NO: 44019 - DNA, 20 bp, Artificial Sequence
  chemically synthesized
aacagtatggcaattcctca

SEQ ID NO: 44020 - DNA, 20 bp, Artificial Sequence
  chemically synthesized
tttctggttctagatccttg

SEQ ID NO: 44021 - DNA, 20 bp, Artificial Sequence
  chemically synthesized
atggcaattcctcaaggatc

SEQ ID NO: 44022 - DNA, 20 bp, Artificial Sequence
  chemically synthesized
atttctggttctagatcctt

SEQ ID NO: 44023 - DNA, 20 bp, Artificial Sequence
  chemically synthesized
attcctcaaggatctagaac

SEQ ID NO: 44024 - DNA, 20 bp, Artificial Sequence
  chemically synthesized
ccaaatggtatttctggttc

SEQ ID NO: 44025 - DNA, 20 bp, Artificial Sequence
  chemically synthesized
gctgggccaaatggtatttc

SEQ ID NO: 44026 - DNA, 20 bp, Artificial Sequence
  chemically synthesized
ctagaaccagaaataccatt

SEQ ID NO: 44027 - DNA, 20 bp, Artificial Sequence
  chemically synthesized
accagaaataccatttggcc

SEQ ID NO: 44028 - DNA, 20 bp, Artificial Sequence
  chemically synthesized
aatgggatggctgggccaaa

SEQ ID NO: 44029 - DNA, 20 bp, Artificial Sequence
  chemically synthesized
tacccagtaatgggatggct

SEQ ID NO: 44030 - DNA, 20 bp, Artificial Sequence
  chemically synthesized
atacccagtaatgggatggc

SEQ ID NO: 44031 - DNA, 20 bp, Artificial Sequence
  chemically synthesized
gtgtatacccagtaatggga

SEQ ID NO: 44032 - DNA, 20 bp, Artificial Sequence
  chemically synthesized
tggcccagccatcccattac

SEQ ID NO: 44033 - DNA, 20 bp, Artificial Sequence
  chemically synthesized
ggcccagccatcccattact

SEQ ID NO: 44034 - DNA, 20 bp, Artificial Sequence
  chemically synthesized
ttgggtgtatacccagtaat

SEQ ID NO: 44035 - DNA, 20 bp, Artificial Sequence
  chemically synthesized
tttgggtgtatacccagtaa

SEQ ID NO: 44036 - DNA, 20 bp, Artificial Sequence
  chemically synthesized
tattcctttgggtgtatacc

SEQ ID NO: 44037 - DNA, 20 bp, Artificial Sequence
  chemically synthesized
cattactgggtatacaccca

SEQ ID NO: 44038 - DNA, 20 bp, Artificial Sequence
  chemically synthesized
attactgggtatacacccaa

SEQ ID NO: 44039 - DNA, 20 bp, Artificial Sequence
  chemically synthesized
agaatgatttatattccttt

SEQ ID NO: 44040 - DNA, 20 bp, Artificial Sequence
  chemically synthesized
tagaatgatttatattcctt

SEQ ID NO: 44041 - DNA, 20 bp, Artificial Sequence
  chemically synthesized
atataaatcattctactata

SEQ ID NO: 44042 - DNA, 20 bp, Artificial Sequence
  chemically synthesized
atatgcatgtgtctttatag

SEQ ID NO: 44043 - DNA, 20 bp, Artificial Sequence
  chemically synthesized
tacatatgcatgtgtcttta

SEQ ID NO: 44044 - DNA, 20 bp, Artificial Sequence
  chemically synthesized
atgcatatgtatgtttattg

SEQ ID NO: 44045 - DNA, 20 bp, Artificial Sequence
  chemically synthesized
tattgcagcactatttacaa

SEQ ID NO: 44046 - DNA, 20 bp, Artificial Sequence
  chemically synthesized
catgtctttgctattgtaaa

SEQ ID NO: 44047 - DNA, 20 bp, Artificial Sequence
  chemically synthesized
cagcactatttacaatagca

SEQ ID NO: 44048 - DNA, 20 bp, Artificial Sequence
  chemically synthesized
tatttacaatagcaaagaca

SEQ ID NO: 44049 - DNA, 20 bp, Artificial Sequence
  chemically synthesized
tcattgatgggcatttgggt

SEQ ID NO: 44050 - DNA, 20 bp, Artificial Sequence
  chemically synthesized
tctatcattgatgggcattt

SEQ ID NO: 44051 - DNA, 20 bp, Artificial Sequence
  chemically synthesized
gtctatcattgatgggcatt

SEQ ID NO: 44052 - DNA, 20 bp, Artificial Sequence
  chemically synthesized
ttatccagtctatcattgat

SEQ ID NO: 44053 - DNA, 20 bp, Artificial Sequence
  chemically synthesized
acccaaatgcccatcaatga

SEQ ID NO: 44054 - DNA, 20 bp, Artificial Sequence
  chemically synthesized
tttatccagtctatcattga

SEQ ID NO: 44055 - DNA, 20 bp, Artificial Sequence
  chemically synthesized
aatgcccatcaatgatagac

SEQ ID NO: 44056 - DNA, 20 bp, Artificial Sequence
  chemically synthesized
catcaatgatagactggata

SEQ ID NO: 44057 - DNA, 20 bp, Artificial Sequence
  chemically synthesized
tgtaccacattttctttatc

SEQ ID NO: 44058 - DNA, 20 bp, Artificial Sequence
  chemically synthesized
tagactggataaagaaaatg

SEQ ID NO: 44059 - DNA, 20 bp, Artificial Sequence
  chemically synthesized
aatgtggtacatataaacca

SEQ ID NO: 44060 - DNA, 20 bp, Artificial Sequence
  chemically synthesized
tatggctgcgtagtattcca

SEQ ID NO: 44061 - DNA, 20 bp, Artificial Sequence
  chemically synthesized
ataaaccatggaatactacg

SEQ ID NO: 44062 - DNA, 20 bp, Artificial Sequence
  chemically synthesized
cattcctttttatggctgcg

SEQ ID NO: 44063 - DNA, 20 bp, Artificial Sequence
  chemically synthesized
gaatactacgcagccataaa

SEQ ID NO: 44064 - DNA, 20 bp, Artificial Sequence
  chemically synthesized
aatactacgcagccataaaa

SEQ ID NO: 44065 - DNA, 20 bp, Artificial Sequence
  chemically synthesized
cgtgatctcattccttttta

SEQ ID NO: 44066 - DNA, 20 bp, Artificial Sequence
  chemically synthesized
acgcagccataaaaaggaat

SEQ ID NO: 44067 - DNA, 20 bp, Artificial Sequence
  chemically synthesized
gaatgagatcacgtcctttg

SEQ ID NO: 44068 - DNA, 20 bp, Artificial Sequence
  chemically synthesized
aatgagatcacgtcctttgc

SEQ ID NO: 44069 - DNA, 20 bp, Artificial Sequence
  chemically synthesized
atgagatcacgtcctttgca

SEQ ID NO: 44070 - DNA, 20 bp, Artificial Sequence
  chemically synthesized
ccagtttcatgtccctgcaa

SEQ ID NO: 44071 - DNA, 20 bp, Artificial Sequence
  chemically synthesized
tccagtttcatgtccctgca

SEQ ID NO: 44072 - DNA, 20 bp, Artificial Sequence
  chemically synthesized
cctttgcagggacatgaaac

SEQ ID NO: 44073 - DNA, 20 bp, Artificial Sequence
  chemically synthesized
ttgcagggacatgaaactgg

SEQ ID NO: 44074 - DNA, 20 bp, Artificial Sequence
  chemically synthesized
ttgctgaggatgatggcttc

SEQ ID NO: 44075 - DNA, 20 bp, Artificial Sequence
  chemically synthesized
aaactggaagccatcatcct

SEQ ID NO: 44076 - DNA, 20 bp, Artificial Sequence
  chemically synthesized
tgttagtttgctgaggatga

SEQ ID NO: 44077 - DNA, 20 bp, Artificial Sequence
  chemically synthesized
gttcctgtgttagtttgctg

SEQ ID NO: 44078 - DNA, 20 bp, Artificial Sequence
  chemically synthesized
tgttcctgtgttagtttgct

SEQ ID NO: 44079 - DNA, 20 bp, Artificial Sequence
  chemically synthesized
tcatcctcagcaaactaaca

SEQ ID NO: 44080 - DNA, 20 bp, Artificial Sequence
  chemically synthesized
catcctcagcaaactaacac

SEQ ID NO: 44081 - DNA, 20 bp, Artificial Sequence
  chemically synthesized
ttggttttctgttcctgtgt

SEQ ID NO: 44082 - DNA, 20 bp, Artificial Sequence
  chemically synthesized
tcagcaaactaacacaggaa

SEQ ID NO: 44083 - DNA, 20 bp, Artificial Sequence
  chemically synthesized
gagtgagaacatgcagcgtt

SEQ ID NO: 44084 - DNA, 20 bp, Artificial Sequence
  chemically synthesized
cacttgtgagtgagaacatg

SEQ ID NO: 44085 - DNA, 20 bp, Artificial Sequence
  chemically synthesized
cgctgcatgttctcactcac

SEQ ID NO: 44086 - DNA, 20 bp, Artificial Sequence
  chemically synthesized
ttcaactctcacttgtgagt

SEQ ID NO: 44087 - DNA, 20 bp, Artificial Sequence
  chemically synthesized
gcatgttctcactcacaagt

SEQ ID NO: 44088 - DNA, 20 bp, Artificial Sequence
  chemically synthesized
aatgttcaactctcacttgt

SEQ ID NO: 44089 - DNA, 20 bp, Artificial Sequence
  chemically synthesized
atgttctcactcacaagtga

SEQ ID NO: 44090 - DNA, 20 bp, Artificial Sequence
  chemically synthesized
acaagtgagagttgaacatt

SEQ ID NO: 44091 - DNA, 20 bp, Artificial Sequence
  chemically synthesized
agttgaacattaagaacaca

SEQ ID NO: 44092 - DNA, 20 bp, Artificial Sequence
  chemically synthesized
acattaagaacacatggaca

SEQ ID NO: 44093 - DNA, 20 bp, Artificial Sequence
  chemically synthesized
attaagaacacatggacaca

SEQ ID NO: 44094 - DNA, 20 bp, Artificial Sequence
  chemically synthesized
taagaacacatggacacaga

SEQ ID NO: 44095 - DNA, 20 bp, Artificial Sequence
  chemically synthesized
aagaacacatggacacagag

SEQ ID NO: 44096 - DNA, 20 bp, Artificial Sequence
  chemically synthesized
agaacacatggacacagaga

SEQ ID NO: 44097 - DNA, 20 bp, Artificial Sequence
  chemically synthesized
gagagggaaacaatgcacac

SEQ ID NO: 44098 - DNA, 20 bp, Artificial Sequence
  chemically synthesized
agagggaaacaatgcacacc

SEQ ID NO: 44099 - DNA, 20 bp, Artificial Sequence
  chemically synthesized
gagggaaacaatgcacacca

SEQ ID NO: 44100 - DNA, 20 bp, Artificial Sequence
  chemically synthesized
ccccaaaccccaacaggccc

SEQ ID NO: 44101 - DNA, 20 bp, Artificial Sequence
  chemically synthesized
caatgcacaccagggcctgt

SEQ ID NO: 44102 - DNA, 20 bp, Artificial Sequence
  chemically synthesized
aatgcacaccagggcctgtt

SEQ ID NO: 44103 - DNA, 20 bp, Artificial Sequence
  chemically synthesized
atgcacaccagggcctgttg

SEQ ID NO: 44104 - DNA, 20 bp, Artificial Sequence
  chemically synthesized
ttcaacccccaaaccccaac

SEQ ID NO: 44105 - DNA, 20 bp, Artificial Sequence
  chemically synthesized
cttcaacccccaaaccccaa

SEQ ID NO: 44106 - DNA, 20 bp, Artificial Sequence
  chemically synthesized
caccagggcctgttggggtt

SEQ ID NO: 44107 - DNA, 20 bp, Artificial Sequence
  chemically synthesized
accagggcctgttggggttt

SEQ ID NO: 44108 - DNA, 20 bp, Artificial Sequence
  chemically synthesized
ccagggcctgttggggtttg

SEQ ID NO: 44109 - DNA, 20 bp, Artificial Sequence
  chemically synthesized
cagggcctgttggggtttgg

SEQ ID NO: 44110 - DNA, 20 bp, Artificial Sequence
  chemically synthesized
ctgttggggtttgggggttg

SEQ ID NO: 44111 - DNA, 20 bp, Artificial Sequence
  chemically synthesized
tgttggggtttgggggttga

SEQ ID NO: 44112 - DNA, 20 bp, Artificial Sequence
  chemically synthesized
gttggggtttgggggttgaa

SEQ ID NO: 44113 - DNA, 20 bp, Artificial Sequence
  chemically synthesized
tggggtttgggggttgaagg

SEQ ID NO: 44114 - DNA, 20 bp, Artificial Sequence
  chemically synthesized
ggggtttgggggttgaaggg

SEQ ID NO: 44115 - DNA, 20 bp, Artificial Sequence
  chemically synthesized
gggtttgggggttgaaggga

SEQ ID NO: 44116 - DNA, 20 bp, Artificial Sequence
  chemically synthesized
ggggttgaagggagggaact

SEQ ID NO: 44117 - DNA, 20 bp, Artificial Sequence
  chemically synthesized
aagggagggaacttagacga

SEQ ID NO: 44118 - DNA, 20 bp, Artificial Sequence
  chemically synthesized
agggagggaacttagacgat

SEQ ID NO: 44119 - DNA, 20 bp, Artificial Sequence
  chemically synthesized
cacctaatgacccatcgtct

SEQ ID NO: 44120 - DNA, 20 bp, Artificial Sequence
  chemically synthesized
gaacttagacgatgggtcat

SEQ ID NO: 44121 - DNA, 20 bp, Artificial Sequence
  chemically synthesized
aacttagacgatgggtcatt

SEQ ID NO: 44122 - DNA, 20 bp, Artificial Sequence
  chemically synthesized
agacgatgggtcattaggtg

SEQ ID NO: 44123 - DNA, 20 bp, Artificial Sequence
  chemically synthesized
cgatgggtcattaggtgcag

SEQ ID NO: 44124 - DNA, 20 bp, Artificial Sequence
  chemically synthesized
ttaggtgcagcagaccacca

SEQ ID NO: 44125 - DNA, 20 bp, Artificial Sequence
  chemically synthesized
taggtatatgtatgccatgg

SEQ ID NO: 44126 - DNA, 20 bp, Artificial Sequence
  chemically synthesized
acataggtatatgtatgcca

SEQ ID NO: 44127 - DNA, 20 bp, Artificial Sequence
  chemically synthesized
aacgtgcaggtttgttacat

SEQ ID NO: 44128 - DNA, 20 bp, Artificial Sequence
  chemically synthesized
gaacgtgcaggtttgttaca

SEQ ID NO: 44129 - DNA, 20 bp, Artificial Sequence
  chemically synthesized
gatacatgtgcagaacgtgc

SEQ ID NO: 44130 - DNA, 20 bp, Artificial Sequence
  chemically synthesized
agatacatgtgcagaacgtg

SEQ ID NO: 44131 - DNA, 20 bp, Artificial Sequence
  chemically synthesized
aaaaaaccgagatacatgtg

SEQ ID NO: 44132 - DNA, 20 bp, Artificial Sequence
  chemically synthesized
cacgttctgcacatgtatct

SEQ ID NO: 44133 - DNA, 20 bp, Artificial Sequence
  chemically synthesized
gcacatgtatctcggttttt

SEQ ID NO: 44134 - DNA, 20 bp, Artificial Sequence
  chemically synthesized
aaaaaacacaccaaaaaacc

SEQ ID NO: 44135 - DNA, 20 bp, Artificial Sequence
  chemically synthesized
tttggtgtgttttttttttt

SEQ ID NO: 44136 - DNA, 20 bp, Artificial Sequence
  chemically synthesized
ggtgtgttttttttttttag

SEQ ID NO: 44137 - DNA, 20 bp, Artificial Sequence
  chemically synthesized
ttttttttttagaagaaaaa

SEQ ID NO: 44138 - DNA, 20 bp, Artificial Sequence
  chemically synthesized
tttagaagaaaaaaagaaaa

SEQ ID NO: 44139 - DNA, 20 bp, Artificial Sequence
  chemically synthesized
agaagaaaaaaagaaaaaag

SEQ ID NO: 44140 - DNA, 20 bp, Artificial Sequence
  chemically synthesized
gaagaaaaaaagaaaaaaga

SEQ ID NO: 44141 - DNA, 20 bp, Artificial Sequence
  chemically synthesized
aagaaaaaaagaaaaaagaa

SEQ ID NO: 44142 - DNA, 20 bp, Artificial Sequence
  chemically synthesized
agaaaaaaagaaaaaagaag

SEQ ID NO: 44143 - DNA, 20 bp, Artificial Sequence
  chemically synthesized
gaaaaaaagaaaaaagaagg

SEQ ID NO: 44144 - DNA, 20 bp, Artificial Sequence
  chemically synthesized
aaaaaaagaaaaaagaaggg

SEQ ID NO: 44145 - DNA, 20 bp, Artificial Sequence
  chemically synthesized
aaaaagaaaaaagaaggggg

SEQ ID NO: 44146 - DNA, 20 bp, Artificial Sequence
  chemically synthesized
tggtctaaatcaattaaaat

SEQ ID NO: 44147 - DNA, 20 bp, Artificial Sequence
  chemically synthesized
agatctcattttaattgatt

SEQ ID NO: 44148 - DNA, 20 bp, Artificial Sequence
  chemically synthesized
tcattttaattgatttagac

SEQ ID NO: 44149 - DNA, 20 bp, Artificial Sequence
  chemically synthesized
atttttaaaatgtttgattc

SEQ ID NO: 44150 - DNA, 20 bp, Artificial Sequence
  chemically synthesized
taaaaattaaaaaaaaaaaa

SEQ ID NO: 44151 - DNA, 20 bp, Artificial Sequence
  chemically synthesized
ccctgcaggctgagaaaaca

SEQ ID NO: 44152 - DNA, 20 bp, Artificial Sequence
  chemically synthesized
aaagaaatactttgttttct

SEQ ID NO: 44153 - DNA, 20 bp, Artificial Sequence
  chemically synthesized
tactttgttttctcagcctg

SEQ ID NO: 44154 - DNA, 20 bp, Artificial Sequence
  chemically synthesized
actttgttttctcagcctgc

SEQ ID NO: 44155 - DNA, 20 bp, Artificial Sequence
  chemically synthesized
cttctacctccctgcaggct

SEQ ID NO: 44156 - DNA, 20 bp, Artificial Sequence
  chemically synthesized
ctttgttttctcagcctgca

SEQ ID NO: 44157 - DNA, 20 bp, Artificial Sequence
  chemically synthesized
ttgttttctcagcctgcagg

SEQ ID NO: 44158 - DNA, 20 bp, Artificial Sequence
  chemically synthesized
tgttttctcagcctgcaggg

SEQ ID NO: 44159 - DNA, 20 bp, Artificial Sequence
  chemically synthesized
gcactcttctacctccctgc

SEQ ID NO: 44160 - DNA, 20 bp, Artificial Sequence
  chemically synthesized
agcactcttctacctccctg

SEQ ID NO: 44161 - DNA, 20 bp, Artificial Sequence
  chemically synthesized
tttctcagcctgcagggagg

SEQ ID NO: 44162 - DNA, 20 bp, Artificial Sequence
  chemically synthesized
ctcagcctgcagggaggtag

SEQ ID NO: 44163 - DNA, 20 bp, Artificial Sequence
  chemically synthesized
cagcctgcagggaggtagaa

SEQ ID NO: 44164 - DNA, 20 bp, Artificial Sequence
  chemically synthesized
aggtagaagagtgcttacat

SEQ ID NO: 44165 - DNA, 20 bp, Artificial Sequence
  chemically synthesized
ggtagaagagtgcttacatc

SEQ ID NO: 44166 - DNA, 20 bp, Artificial Sequence
  chemically synthesized
gtagaagagtgcttacatca

SEQ ID NO: 44167 - DNA, 20 bp, Artificial Sequence
  chemically synthesized
aacttggccagccctgatgt

SEQ ID NO: 44168 - DNA, 20 bp, Artificial Sequence
  chemically synthesized
aagagtgcttacatcagggc

SEQ ID NO: 44169 - DNA, 20 bp, Artificial Sequence
  chemically synthesized
tgcttacatcagggctggcc

SEQ ID NO: 44170 - DNA, 20 bp, Artificial Sequence
  chemically synthesized
aaatgaaacaaaaacttggc

SEQ ID NO: 44171 - DNA, 20 bp, Artificial Sequence
  chemically synthesized
aacaaaatgaaacaaaaact

SEQ ID NO: 44172 - DNA, 20 bp, Artificial Sequence
  chemically synthesized
tgctgctttgggcaataaag

SEQ ID NO: 44173 - DNA, 20 bp, Artificial Sequence
  chemically synthesized
ttgctgctttgggcaataaa

SEQ ID NO: 44174 - DNA, 20 bp, Artificial Sequence
  chemically synthesized
tttgctgctttgggcaataa

SEQ ID NO: 44175 - DNA, 20 bp, Artificial Sequence
  chemically synthesized
ctttgctgctttgggcaata

SEQ ID NO: 44176 - DNA, 20 bp, Artificial Sequence
  chemically synthesized
ttgttcccctttattgccca

SEQ ID NO: 44177 - DNA, 20 bp, Artificial Sequence
  chemically synthesized
ttcccctttattgcccaaag

SEQ ID NO: 44178 - DNA, 20 bp, Artificial Sequence
  chemically synthesized
aagttactctttgctgcttt

SEQ ID NO: 44179 - DNA, 20 bp, Artificial Sequence
  chemically synthesized
taagttactctttgctgctt

SEQ ID NO: 44180 - DNA, 20 bp, Artificial Sequence
  chemically synthesized
ctttattgcccaaagcagca

SEQ ID NO: 44181 - DNA, 20 bp, Artificial Sequence
  chemically synthesized
ttattgcccaaagcagcaaa

SEQ ID NO: 44182 - DNA, 20 bp, Artificial Sequence
  chemically synthesized
caaagcagcaaagagtaact

SEQ ID NO: 44183 - DNA, 20 bp, Artificial Sequence
  chemically synthesized
aaagcagcaaagagtaactt

SEQ ID NO: 44184 - DNA, 20 bp, Artificial Sequence
  chemically synthesized
caatcaagttgcagagacct

SEQ ID NO: 44185 - DNA, 20 bp, Artificial Sequence
  chemically synthesized
atcttcgcaatcaagttgca

SEQ ID NO: 44186 - DNA, 20 bp, Artificial Sequence
  chemically synthesized
gtatcttcgcaatcaagttg

SEQ ID NO: 44187 - DNA, 20 bp, Artificial Sequence
  chemically synthesized
gtctctgcaacttgattgcg

SEQ ID NO: 44188 - DNA, 20 bp, Artificial Sequence
  chemically synthesized
cttggcgtatcttcgcaatc

SEQ ID NO: 44189 - DNA, 20 bp, Artificial Sequence
  chemically synthesized
cttgattgcgaagatacgcc

SEQ ID NO: 44190 - DNA, 20 bp, Artificial Sequence
  chemically synthesized
ttgattgcgaagatacgcca

SEQ ID NO: 44191 - DNA, 20 bp, Artificial Sequence
  chemically synthesized
actgttaggtggattttcct

SEQ ID NO: 44192 - DNA, 20 bp, Artificial Sequence
  chemically synthesized
gccaaggaaaatccacctaa

SEQ ID NO: 44193 - DNA, 20 bp, Artificial Sequence
  chemically synthesized
tccttccctgcactgttagg

SEQ ID NO: 44194 - DNA, 20 bp, Artificial Sequence
  chemically synthesized
ggaaaatccacctaacagtg

SEQ ID NO: 44195 - DNA, 20 bp, Artificial Sequence
  chemically synthesized
tagtccttccctgcactgtt

SEQ ID NO: 44196 - DNA, 20 bp, Artificial Sequence
  chemically synthesized
gaaaatccacctaacagtgc

SEQ ID NO: 44197 - DNA, 20 bp, Artificial Sequence
  chemically synthesized
gtagtccttccctgcactgt

SEQ ID NO: 44198 - DNA, 20 bp, Artificial Sequence
  chemically synthesized
aaaatccacctaacagtgca

SEQ ID NO: 44199 - DNA, 20 bp, Artificial Sequence
  chemically synthesized
atccacctaacagtgcaggg

SEQ ID NO: 44200 - DNA, 20 bp, Artificial Sequence
  chemically synthesized
tccacctaacagtgcaggga

SEQ ID NO: 44201 - DNA, 20 bp, Artificial Sequence
  chemically synthesized
acagtgcagggaaggactac

SEQ ID NO: 44202 - DNA, 20 bp, Artificial Sequence
  chemically synthesized
agtgcagggaaggactacta

SEQ ID NO: 44203 - DNA, 20 bp, Artificial Sequence
  chemically synthesized
gcagggaaggactactagag

SEQ ID NO: 44204 - DNA, 20 bp, Artificial Sequence
  chemically synthesized
catcaccaaaactactctag

SEQ ID NO: 44205 - DNA, 20 bp, Artificial Sequence
  chemically synthesized
gggcatcaccaaaactactc

SEQ ID NO: 44206 - DNA, 20 bp, Artificial Sequence
  chemically synthesized
aaggactactagagtagttt

SEQ ID NO: 44207 - DNA, 20 bp, Artificial Sequence
  chemically synthesized
gagtagttttggtgatgccc

SEQ ID NO: 44208 - DNA, 20 bp, Artificial Sequence
  chemically synthesized
agttttggtgatgcccaaga

SEQ ID NO: 44209 - DNA, 20 bp, Artificial Sequence
  chemically synthesized
tttggtgatgcccaagatgg

SEQ ID NO: 44210 - DNA, 20 bp, Artificial Sequence
  chemically synthesized
cactgtgaggctgccatctt

SEQ ID NO: 44211 - DNA, 20 bp, Artificial Sequence
  chemically synthesized
ccactgtgaggctgccatct

SEQ ID NO: 44212 - DNA, 20 bp, Artificial Sequence
  chemically synthesized
tgcccaagatggcagcctca

SEQ ID NO: 44213 - DNA, 20 bp, Artificial Sequence
  chemically synthesized
ccaagatggcagcctcacag

SEQ ID NO: 44214 - DNA, 20 bp, Artificial Sequence
  chemically synthesized
gtggccaatccaccactgtg

SEQ ID NO: 44215 - DNA, 20 bp, Artificial Sequence
  chemically synthesized
agatggcagcctcacagtgg

SEQ ID NO: 44216 - DNA, 20 bp, Artificial Sequence
  chemically synthesized
tgtggccaatccaccactgt

SEQ ID NO: 44217 - DNA, 20 bp, Artificial Sequence
  chemically synthesized
gcagcctcacagtggtggat

SEQ ID NO: 44218 - DNA, 20 bp, Artificial Sequence
  chemically synthesized
agtggtggattggccacatt

SEQ ID NO: 44219 - DNA, 20 bp, Artificial Sequence
  chemically synthesized
gccatttgtataaccaaatg

SEQ ID NO: 44220 - DNA, 20 bp, Artificial Sequence
  chemically synthesized
gccacatttggttatacaaa

SEQ ID NO: 44221 - DNA, 20 bp, Artificial Sequence
  chemically synthesized
catttggttatacaaatggc

SEQ ID NO: 44222 - DNA, 20 bp, Artificial Sequence
  chemically synthesized
taatgtttttgattgaaaac

SEQ ID NO: 44223 - DNA, 20 bp, Artificial Sequence
  chemically synthesized
cagttttcaatcaaaaacat

SEQ ID NO: 44224 - DNA, 20 bp, Artificial Sequence
  chemically synthesized
tttcaatcaaaaacattaga

SEQ ID NO: 44225 - DNA, 20 bp, Artificial Sequence
  chemically synthesized
aaaacattagaaagttgaaa

SEQ ID NO: 44226 - DNA, 20 bp, Artificial Sequence
  chemically synthesized
cattagaaagttgaaacagc

SEQ ID NO: 44227 - DNA, 20 bp, Artificial Sequence
  chemically synthesized
tagaaagttgaaacagctag

SEQ ID NO: 44228 - DNA, 20 bp, Artificial Sequence
  chemically synthesized
gttgaaacagctagaagcaa

SEQ ID NO: 44229 - DNA, 20 bp, Artificial Sequence
  chemically synthesized
atcatctcagctattgcttc

SEQ ID NO: 44230 - DNA, 20 bp, Artificial Sequence
  chemically synthesized
aacagctagaagcaatagct

SEQ ID NO: 44231 - DNA, 20 bp, Artificial Sequence
  chemically synthesized
taaaataatcatcatcatct

SEQ ID NO: 44232 - DNA, 20 bp, Artificial Sequence
  chemically synthesized
ttttattcgtataaatttct

SEQ ID NO: 44233 - DNA, 20 bp, Artificial Sequence
  chemically synthesized
tttattcgtataaatttctg

SEQ ID NO: 44234 - DNA, 20 bp, Artificial Sequence
  chemically synthesized
cgtataaatttctgaggtac

SEQ ID NO: 44235 - DNA, 20 bp, Artificial Sequence
  chemically synthesized
acaaaactgcacttgtacct

SEQ ID NO: 44236 - DNA, 20 bp, Artificial Sequence
  chemically synthesized
aaatttctgaggtacaagtg

SEQ ID NO: 44237 - DNA, 20 bp, Artificial Sequence
  chemically synthesized
gtacaagtgcagttttgtta

SEQ ID NO: 44238 - DNA, 20 bp, Artificial Sequence
  chemically synthesized
tacaagtgcagttttgttac

SEQ ID NO: 44239 - DNA, 20 bp, Artificial Sequence
  chemically synthesized
acaagtgcagttttgttaca

SEQ ID NO: 44240 - DNA, 20 bp, Artificial Sequence
  chemically synthesized
tgttacagggatgtattgca

SEQ ID NO: 44241 - DNA, 20 bp, Artificial Sequence
  chemically synthesized
tacagggatgtattgcatag

SEQ ID NO: 44242 - DNA, 20 bp, Artificial Sequence
  chemically synthesized
gtattgcatagtggtgaacc

SEQ ID NO: 44243 - DNA, 20 bp, Artificial Sequence
  chemically synthesized
tattgcatagtggtgaacct

SEQ ID NO: 44244 - DNA, 20 bp, Artificial Sequence
  chemically synthesized
tagtggtgaacctgggcttt

SEQ ID NO: 44245 - DNA, 20 bp, Artificial Sequence
  chemically synthesized
gatggatacactaaaagccc

SEQ ID NO: 44246 - DNA, 20 bp, Artificial Sequence
  chemically synthesized
tgatggatacactaaaagcc

SEQ ID NO: 44247 - DNA, 20 bp, Artificial Sequence
  chemically synthesized
tttggtgatggatacactaa

SEQ ID NO: 44248 - DNA, 20 bp, Artificial Sequence
  chemically synthesized
ttttagtgtatccatcacca

SEQ ID NO: 44249 - DNA, 20 bp, Artificial Sequence
  chemically synthesized
aaggtgcactactttggtga

SEQ ID NO: 44250 - DNA, 20 bp, Artificial Sequence
  chemically synthesized
tagtgtatccatcaccaaag

SEQ ID NO: 44251 - DNA, 20 bp, Artificial Sequence
  chemically synthesized
gggtacaaggtgcactactt

SEQ ID NO: 44252 - DNA, 20 bp, Artificial Sequence
  chemically synthesized
gacattacttaatgggtaca

SEQ ID NO: 44253 - DNA, 20 bp, Artificial Sequence
  chemically synthesized
agacattacttaatgggtac

SEQ ID NO: 44254 - DNA, 20 bp, Artificial Sequence
  chemically synthesized
tagtgcaccttgtacccatt

SEQ ID NO: 44255 - DNA, 20 bp, Artificial Sequence
  chemically synthesized
ataatgagacattacttaat

SEQ ID NO: 44256 - DNA, 20 bp, Artificial Sequence
  chemically synthesized
gataatgagacattacttaa

SEQ ID NO: 44257 - DNA, 20 bp, Artificial Sequence
  chemically synthesized
ctgggtgaggggtggataat

SEQ ID NO: 44258 - DNA, 20 bp, Artificial Sequence
  chemically synthesized
gcagaatgctgggtgagggg

SEQ ID NO: 44259 - DNA, 20 bp, Artificial Sequence
  chemically synthesized
ctcattatccacccctcacc

SEQ ID NO: 44260 - DNA, 20 bp, Artificial Sequence
  chemically synthesized
agggcagaatgctgggtgag

SEQ ID NO: 44261 - DNA, 20 bp, Artificial Sequence
  chemically synthesized
aagggcagaatgctgggtga

SEQ ID NO: 44262 - DNA, 20 bp, Artificial Sequence
  chemically synthesized
gaagggcagaatgctgggtg

SEQ ID NO: 44263 - DNA, 20 bp, Artificial Sequence
  chemically synthesized
agaagggcagaatgctgggt

SEQ ID NO: 44264 - DNA, 20 bp, Artificial Sequence
  chemically synthesized
attcagaagggcagaatgct

SEQ ID NO: 44265 - DNA, 20 bp, Artificial Sequence
  chemically synthesized
gattcagaagggcagaatgc

SEQ ID NO: 44266 - DNA, 20 bp, Artificial Sequence
  chemically synthesized
acattggagattcagaaggg

SEQ ID NO: 44267 - DNA, 20 bp, Artificial Sequence
  chemically synthesized
tagacattggagattcagaa

SEQ ID NO: 44268 - DNA, 20 bp, Artificial Sequence
  chemically synthesized
atagacattggagattcaga

SEQ ID NO: 44269 - DNA, 20 bp, Artificial Sequence
  chemically synthesized
gatagacattggagattcag

SEQ ID NO: 44270 - DNA, 20 bp, Artificial Sequence
  chemically synthesized
aaggatagacattggagatt

SEQ ID NO: 44271 - DNA, 20 bp, Artificial Sequence
  chemically synthesized
gataagaaggatagacattg

SEQ ID NO: 44272 - DNA, 20 bp, Artificial Sequence
  chemically synthesized
atgataagaaggatagacat

SEQ ID NO: 44273 - DNA, 20 bp, Artificial Sequence
  chemically synthesized
aatcatcatgataagaagga

SEQ ID NO: 44274 - DNA, 20 bp, Artificial Sequence
  chemically synthesized
ttaaaatcatcatgataaga

SEQ ID NO: 44275 - DNA, 20 bp, Artificial Sequence
  chemically synthesized
cttaaaatcatcatgataag

SEQ ID NO: 44276 - DNA, 20 bp, Artificial Sequence
  chemically synthesized
atacttaaaatcatcatgat

SEQ ID NO: 44277 - DNA, 20 bp, Artificial Sequence
  chemically synthesized
cttcttatcatgatgatttt

SEQ ID NO: 44278 - DNA, 20 bp, Artificial Sequence
  chemically synthesized
ttctaataaaggggaggggg

SEQ ID NO: 44279 - DNA, 20 bp, Artificial Sequence
  chemically synthesized
cattctaataaaggggaggg

SEQ ID NO: 44280 - DNA, 20 bp, Artificial Sequence
  chemically synthesized
tcattctaataaaggggagg

SEQ ID NO: 44281 - DNA, 20 bp, Artificial Sequence
  chemically synthesized
gtcattctaataaaggggag

SEQ ID NO: 44282 - DNA, 20 bp, Artificial Sequence
  chemically synthesized
agtcattctaataaagggga

SEQ ID NO: 44283 - DNA, 20 bp, Artificial Sequence
  chemically synthesized
aagtcattctaataaagggg

SEQ ID NO: 44284 - DNA, 20 bp, Artificial Sequence
  chemically synthesized
caagtcattctaataaaggg

SEQ ID NO: 44285 - DNA, 20 bp, Artificial Sequence
  chemically synthesized
ttctcccccctcccctttat

SEQ ID NO: 44286 - DNA, 20 bp, Artificial Sequence
  chemically synthesized
tccaagtcattctaataaag

SEQ ID NO: 44287 - DNA, 20 bp, Artificial Sequence
  chemically synthesized
atccaagtcattctaataaa

SEQ ID NO: 44288 - DNA, 20 bp, Artificial Sequence
  chemically synthesized
tatccaagtcattctaataa

SEQ ID NO: 44289 - DNA, 20 bp, Artificial Sequence
  chemically synthesized
ttatccaagtcattctaata

SEQ ID NO: 44290 - DNA, 20 bp, Artificial Sequence
  chemically synthesized
tcccctttattagaatgact

SEQ ID NO: 44291 - DNA, 20 bp, Artificial Sequence
  chemically synthesized
tttattagaatgacttggat

SEQ ID NO: 44292 - DNA, 20 bp, Artificial Sequence
  chemically synthesized
aaaaagttggaggcttatcc

SEQ ID NO: 44293 - DNA, 20 bp, Artificial Sequence
  chemically synthesized
ctgagattcaaaaaagttgg

SEQ ID NO: 44294 - DNA, 20 bp, Artificial Sequence
  chemically synthesized
gctgagattcaaaaaagttg

SEQ ID NO: 44295 - DNA, 20 bp, Artificial Sequence
  chemically synthesized
cagctgagattcaaaaaagt

SEQ ID NO: 44296 - DNA, 20 bp, Artificial Sequence
  chemically synthesized
gaaacagctgagattcaaaa

SEQ ID NO: 44297 - DNA, 20 bp, Artificial Sequence
  chemically synthesized
cctccaacttttttgaatct

SEQ ID NO: 44298 - DNA, 20 bp, Artificial Sequence
  chemically synthesized
aaaaaaaggaagaaacagct

SEQ ID NO: 44299 - DNA, 20 bp, Artificial Sequence
  chemically synthesized
aaaaaaaaaaaaggaagaaa

SEQ ID NO: 44300 - DNA, 20 bp, Artificial Sequence
  chemically synthesized
agttaaaaaaaaaaaaaagg

SEQ ID NO: 44301 - DNA, 20 bp, Artificial Sequence
  chemically synthesized
aaaagttaaaaaaaaaaaaa

SEQ ID NO: 44302 - DNA, 20 bp, Artificial Sequence
  chemically synthesized
taaaagttaaaaaaaaaaaa

SEQ ID NO: 44303 - DNA, 20 bp, Artificial Sequence
  chemically synthesized
caaaataaataaataaataa

SEQ ID NO: 44304 - DNA, 20 bp, Artificial Sequence
  chemically synthesized
tttatttatttatttatttt

SEQ ID NO: 44305 - DNA, 20 bp, Artificial Sequence
  chemically synthesized
tttatttatttattttgaga

SEQ ID NO: 44306 - DNA, 20 bp, Artificial Sequence
  chemically synthesized
ttatttatttattttgagat

SEQ ID NO: 44307 - DNA, 20 bp, Artificial Sequence
  chemically synthesized
tatttatttattttgagatg

SEQ ID NO: 44308 - DNA, 20 bp, Artificial Sequence
  chemically synthesized
tccagcctgggtgacagagt

SEQ ID NO: 44309 - DNA, 20 bp, Artificial Sequence
  chemically synthesized
tggggtctcactctgtcacc

SEQ ID NO: 44310 - DNA, 20 bp, Artificial Sequence
  chemically synthesized
gcactccagcctgggtgaca

SEQ ID NO: 44311 - DNA, 20 bp, Artificial Sequence
  chemically synthesized
ggggtctcactctgtcaccc

SEQ ID NO: 44312 - DNA, 20 bp, Artificial Sequence
  chemically synthesized
ctgcactccagcctgggtga

SEQ ID NO: 44313 - DNA, 20 bp, Artificial Sequence
  chemically synthesized
tctcactctgtcacccaggc

SEQ ID NO: 44314 - DNA, 20 bp, Artificial Sequence
  chemically synthesized
tcactctgtcacccaggctg

SEQ ID NO: 44315 - DNA, 20 bp, Artificial Sequence
  chemically synthesized
acaccactgcactccagcct

SEQ ID NO: 44316 - DNA, 20 bp, Artificial Sequence
  chemically synthesized
cacaccactgcactccagcc

SEQ ID NO: 44317 - DNA, 20 bp, Artificial Sequence
  chemically synthesized
ctgtcacccaggctggagtg

SEQ ID NO: 44318 - DNA, 20 bp, Artificial Sequence
  chemically synthesized
gagatcacaccactgcactc

SEQ ID NO: 44319 - DNA, 20 bp, Artificial Sequence
  chemically synthesized
tcacccaggctggagtgcag

SEQ ID NO: 44320 - DNA, 20 bp, Artificial Sequence
  chemically synthesized
ggagtgcagtggtgtgatct

SEQ ID NO: 44321 - DNA, 20 bp, Artificial Sequence
  chemically synthesized
ggcggaggttgcagtgagcc

SEQ ID NO: 44322 - DNA, 20 bp, Artificial Sequence
  chemically synthesized
agggaggcggaggttgcagt

SEQ ID NO: 44323 - DNA, 20 bp, Artificial Sequence
  chemically synthesized
aaccagggaggcggaggttg

SEQ ID NO: 44324 - DNA, 20 bp, Artificial Sequence
  chemically synthesized
cccttgaaccagggaggcgg

SEQ ID NO: 44325 - DNA, 20 bp, Artificial Sequence
  chemically synthesized
tcccttgaaccagggaggcg

SEQ ID NO: 44326 - DNA, 20 bp, Artificial Sequence
  chemically synthesized
cactgcaacctccgcctccc

SEQ ID NO: 44327 - DNA, 20 bp, Artificial Sequence
  chemically synthesized
aatcccttgaaccagggagg

SEQ ID NO: 44328 - DNA, 20 bp, Artificial Sequence
  chemically synthesized
gggaatcccttgaaccaggg

SEQ ID NO: 44329 - DNA, 20 bp, Artificial Sequence
  chemically synthesized
ggggaatcccttgaaccagg

SEQ ID NO: 44330 - DNA, 20 bp, Artificial Sequence
  chemically synthesized
aacctccgcctccctggttc

SEQ ID NO: 44331 - DNA, 20 bp, Artificial Sequence
  chemically synthesized
acctccgcctccctggttca

SEQ ID NO: 44332 - DNA, 20 bp, Artificial Sequence
  chemically synthesized
caggggaatcccttgaacca

SEQ ID NO: 44333 - DNA, 20 bp, Artificial Sequence
  chemically synthesized
cctccgcctccctggttcaa

SEQ ID NO: 44334 - DNA, 20 bp, Artificial Sequence
  chemically synthesized
gcaggggaatcccttgaacc

SEQ ID NO: 44335 - DNA, 20 bp, Artificial Sequence
  chemically synthesized
ggcaggggaatcccttgaac

SEQ ID NO: 44336 - DNA, 20 bp, Artificial Sequence
  chemically synthesized
ttcaagggattcccctgccc

SEQ ID NO: 44337 - DNA, 20 bp, Artificial Sequence
  chemically synthesized
tactcaggaggctggggcag

SEQ ID NO: 44338 - DNA, 20 bp, Artificial Sequence
  chemically synthesized
ctactcaggaggctggggca

SEQ ID NO: 44339 - DNA, 20 bp, Artificial Sequence
  chemically synthesized
gctactcaggaggctggggc

SEQ ID NO: 44340 - DNA, 20 bp, Artificial Sequence
  chemically synthesized
agctactcaggaggctgggg

SEQ ID NO: 44341 - DNA, 20 bp, Artificial Sequence
  chemically synthesized
cccagctactcaggaggctg

SEQ ID NO: 44342 - DNA, 20 bp, Artificial Sequence
  chemically synthesized
tcccagctactcaggaggct

SEQ ID NO: 44343 - DNA, 20 bp, Artificial Sequence
  chemically synthesized
ttcccctgccccagcctcct

SEQ ID NO: 44344 - DNA, 20 bp, Artificial Sequence
  chemically synthesized
gtcccagctactcaggaggc

SEQ ID NO: 44345 - DNA, 20 bp, Artificial Sequence
  chemically synthesized
ccctgccccagcctcctgag

SEQ ID NO: 44346 - DNA, 20 bp, Artificial Sequence
  chemically synthesized
tgtggtcccagctactcagg

SEQ ID NO: 44347 - DNA, 20 bp, Artificial Sequence
  chemically synthesized
ctgtggtcccagctactcag

SEQ ID NO: 44348 - DNA, 20 bp, Artificial Sequence
  chemically synthesized
gccccagcctcctgagtagc

SEQ ID NO: 44349 - DNA, 20 bp, Artificial Sequence
  chemically synthesized
acctgtggtcccagctactc

SEQ ID NO: 44350 - DNA, 20 bp, Artificial Sequence
  chemically synthesized
ccccagcctcctgagtagct

SEQ ID NO: 44351 - DNA, 20 bp, Artificial Sequence
  chemically synthesized
cacctgtggtcccagctact

SEQ ID NO: 44352 - DNA, 20 bp, Artificial Sequence
  chemically synthesized
ctcctgagtagctgggacca

SEQ ID NO: 44353 - DNA, 20 bp, Artificial Sequence
  chemically synthesized
tcctgagtagctgggaccac

SEQ ID NO: 44354 - DNA, 20 bp, Artificial Sequence
  chemically synthesized
gtggcatgcacctgtggtcc

SEQ ID NO: 44355 - DNA, 20 bp, Artificial Sequence
  chemically synthesized
aatgtagtggcatgcacctg

SEQ ID NO: 44356 - DNA, 20 bp, Artificial Sequence
  chemically synthesized
caggtgcatgccactacatt

SEQ ID NO: 44357 - DNA, 20 bp, Artificial Sequence
  chemically synthesized
aaaacagtagctgaatgtag

SEQ ID NO: 44358 - DNA, 20 bp, Artificial Sequence
  chemically synthesized
tacaaaacagtagctgaatg

SEQ ID NO: 44359 - DNA, 20 bp, Artificial Sequence
  chemically synthesized
ctaccaaagatacaaaacag

SEQ ID NO: 44360 - DNA, 20 bp, Artificial Sequence
  chemically synthesized
tctctaccaaagatacaaaa

SEQ ID NO: 44361 - DNA, 20 bp, Artificial Sequence
  chemically synthesized
cagctactgttttgtatctt

SEQ ID NO: 44362 - DNA, 20 bp, Artificial Sequence
  chemically synthesized
ctactgttttgtatctttgg

SEQ ID NO: 44363 - DNA, 20 bp, Artificial Sequence
  chemically synthesized
actgttttgtatctttggta

SEQ ID NO: 44364 - DNA, 20 bp, Artificial Sequence
  chemically synthesized
gcgaaaccccatctctacca

SEQ ID NO: 44365 - DNA, 20 bp, Artificial Sequence
  chemically synthesized
ttttgtatctttggtagaga

SEQ ID NO: 44366 - DNA, 20 bp, Artificial Sequence
  chemically synthesized
tttgtatctttggtagagat

SEQ ID NO: 44367 - DNA, 20 bp, Artificial Sequence
  chemically synthesized
ttgtatctttggtagagatg

SEQ ID NO: 44368 - DNA, 20 bp, Artificial Sequence
  chemically synthesized
tggggtttcgccatgttgcc

SEQ ID NO: 44369 - DNA, 20 bp, Artificial Sequence
  chemically synthesized
caagaccagcctgggcaaca

SEQ ID NO: 44370 - DNA, 20 bp, Artificial Sequence
  chemically synthesized
ggggtttcgccatgttgccc

SEQ ID NO: 44371 - DNA, 20 bp, Artificial Sequence
  chemically synthesized
tttcgccatgttgcccaggc

SEQ ID NO: 44372 - DNA, 20 bp, Artificial Sequence
  chemically synthesized
cagcagttcaagaccagcct

SEQ ID NO: 44373 - DNA, 20 bp, Artificial Sequence
  chemically synthesized
tcagcagttcaagaccagcc

SEQ ID NO: 44374 - DNA, 20 bp, Artificial Sequence
  chemically synthesized
tgagctcagcagttcaagac

SEQ ID NO: 44375 - DNA, 20 bp, Artificial Sequence
  chemically synthesized
tcacttgagctcagcagttc

SEQ ID NO: 44376 - DNA, 20 bp, Artificial Sequence
  chemically synthesized
caggctggtcttgaactgct

SEQ ID NO: 44377 - DNA, 20 bp, Artificial Sequence
  chemically synthesized
ggtggatcacttgagctcag

SEQ ID NO: 44378 - DNA, 20 bp, Artificial Sequence
  chemically synthesized
ggtcttgaactgctgagctc

SEQ ID NO: 44379 - DNA, 20 bp, Artificial Sequence
  chemically synthesized
gtgggtggatcacttgagct

SEQ ID NO: 44380 - DNA, 20 bp, Artificial Sequence
  chemically synthesized
ccaaggtgggtggatcactt

SEQ ID NO: 44381 - DNA, 20 bp, Artificial Sequence
  chemically synthesized
ctcaagtgatccacccacct

SEQ ID NO: 44382 - DNA, 20 bp, Artificial Sequence
  chemically synthesized
ctttggcaggccaaggtggg

SEQ ID NO: 44383 - DNA, 20 bp, Artificial Sequence
  chemically synthesized
gcactttggcaggccaaggt

SEQ ID NO: 44384 - DNA, 20 bp, Artificial Sequence
  chemically synthesized
agcactttggcaggccaagg

SEQ ID NO: 44385 - DNA, 20 bp, Artificial Sequence
  chemically synthesized
cccagcactttggcaggcca

SEQ ID NO: 44386 - DNA, 20 bp, Artificial Sequence
  chemically synthesized
tcccagcactttggcaggcc

SEQ ID NO: 44387 - DNA, 20 bp, Artificial Sequence
  chemically synthesized
ccacccaccttggcctgcca

SEQ ID NO: 44388 - DNA, 20 bp, Artificial Sequence
  chemically synthesized
tgtaatcccagcactttggc

SEQ ID NO: 44389 - DNA, 20 bp, Artificial Sequence
  chemically synthesized
ctgtaatcccagcactttgg

SEQ ID NO: 44390 - DNA, 20 bp, Artificial Sequence
  chemically synthesized
accttggcctgccaaagtgc

SEQ ID NO: 44391 - DNA, 20 bp, Artificial Sequence
  chemically synthesized
ccttggcctgccaaagtgct

SEQ ID NO: 44392 - DNA, 20 bp, Artificial Sequence
  chemically synthesized
tgcctgtaatcccagcactt

SEQ ID NO: 44393 - DNA, 20 bp, Artificial Sequence
  chemically synthesized
ctgccaaagtgctgggatta

SEQ ID NO: 44394 - DNA, 20 bp, Artificial Sequence
  chemically synthesized
tgccaaagtgctgggattac

SEQ ID NO: 44395 - DNA, 20 bp, Artificial Sequence
  chemically synthesized
gtggctcatgcctgtaatcc

SEQ ID NO: 44396 - DNA, 20 bp, Artificial Sequence
  chemically synthesized
agtgctgggattacaggcat

SEQ ID NO: 44397 - DNA, 20 bp, Artificial Sequence
  chemically synthesized
cggctatcagtcgggcgtgg

SEQ ID NO: 44398 - DNA, 20 bp, Artificial Sequence
  chemically synthesized
aaacggctatcagtcgggcg

SEQ ID NO: 44399 - DNA, 20 bp, Artificial Sequence
  chemically synthesized
gagccaccacgcccgactga

SEQ ID NO: 44400 - DNA, 20 bp, Artificial Sequence
  chemically synthesized
gaaaaaaacggctatcagtc

SEQ ID NO: 44401 - DNA, 20 bp, Artificial Sequence
  chemically synthesized
agaaaaaaacggctatcagt

SEQ ID NO: 44402 - DNA, 20 bp, Artificial Sequence
  chemically synthesized
ataaagaaaaaaacggctat

SEQ ID NO: 44403 - DNA, 20 bp, Artificial Sequence
  chemically synthesized
ttatccaataaagaaaaaaa

SEQ ID NO: 44404 - DNA, 20 bp, Artificial Sequence
  chemically synthesized
atagccgtttttttctttat

SEQ ID NO: 44405 - DNA, 20 bp, Artificial Sequence
  chemically synthesized
actccacttattatccaata

SEQ ID NO: 44406 - DNA, 20 bp, Artificial Sequence
  chemically synthesized
ttttttctttattggataat

SEQ ID NO: 44407 - DNA, 20 bp, Artificial Sequence
  chemically synthesized
tttctttattggataataag

SEQ ID NO: 44408 - DNA, 20 bp, Artificial Sequence
  chemically synthesized
tctttattggataataagtg

SEQ ID NO: 44409 - DNA, 20 bp, Artificial Sequence
  chemically synthesized
gataataagtggagtgttac

SEQ ID NO: 44410 - DNA, 20 bp, Artificial Sequence
  chemically synthesized
ataataagtggagtgttaca

SEQ ID NO: 44411 - DNA, 20 bp, Artificial Sequence
  chemically synthesized
ggagtgttacaaggattaaa

SEQ ID NO: 44412 - DNA, 20 bp, Artificial Sequence
  chemically synthesized
gagtgttacaaggattaaat

SEQ ID NO: 44413 - DNA, 20 bp, Artificial Sequence
  chemically synthesized
tgttacaaggattaaatggg

SEQ ID NO: 44414 - DNA, 20 bp, Artificial Sequence
  chemically synthesized
aaggattaaatgggaagata

SEQ ID NO: 44415 - DNA, 20 bp, Artificial Sequence
  chemically synthesized
agatgaaacactttgtcatt

SEQ ID NO: 44416 - DNA, 20 bp, Artificial Sequence
  chemically synthesized
ctactatgtgctaaatgaca

SEQ ID NO: 44417 - DNA, 20 bp, Artificial Sequence
  chemically synthesized
acactttgtcatttagcaca

SEQ ID NO: 44418 - DNA, 20 bp, Artificial Sequence
  chemically synthesized
ctttgtcatttagcacatag

SEQ ID NO: 44419 - DNA, 20 bp, Artificial Sequence
  chemically synthesized
tttgtcatttagcacatagt

SEQ ID NO: 44420 - DNA, 20 bp, Artificial Sequence
  chemically synthesized
gctagacaggaagaaaagca

SEQ ID NO: 44421 - DNA, 20 bp, Artificial Sequence
  chemically synthesized
aatctgctagacaggaagaa

SEQ ID NO: 44422 - DNA, 20 bp, Artificial Sequence
  chemically synthesized
actttgcttttcttcctgtc

SEQ ID NO: 44423 - DNA, 20 bp, Artificial Sequence
  chemically synthesized
catgtaatctgctagacagg

SEQ ID NO: 44424 - DNA, 20 bp, Artificial Sequence
  chemically synthesized
ttgcttttcttcctgtctag

SEQ ID NO: 44425 - DNA, 20 bp, Artificial Sequence
  chemically synthesized
gtccatgtaatctgctagac

SEQ ID NO: 44426 - DNA, 20 bp, Artificial Sequence
  chemically synthesized
agtccatgtaatctgctaga

SEQ ID NO: 44427 - DNA, 20 bp, Artificial Sequence
  chemically synthesized
gataagtccatgtaatctgc

SEQ ID NO: 44428 - DNA, 20 bp, Artificial Sequence
  chemically synthesized
ttcctgtctagcagattaca

SEQ ID NO: 44429 - DNA, 20 bp, Artificial Sequence
  chemically synthesized
gattacatggacttatctat

SEQ ID NO: 44430 - DNA, 20 bp, Artificial Sequence
  chemically synthesized
aaacagtgtgtctcatagat

SEQ ID NO: 44431 - DNA, 20 bp, Artificial Sequence
  chemically synthesized
tctgtaaacagtgtgtctca

SEQ ID NO: 44432 - DNA, 20 bp, Artificial Sequence
  chemically synthesized
tctatgagacacactgttta

SEQ ID NO: 44433 - DNA, 20 bp, Artificial Sequence
  chemically synthesized
gttcatgagttttctgtaaa

SEQ ID NO: 44434 - DNA, 20 bp, Artificial Sequence
  chemically synthesized
tttacagaaaactcatgaac

SEQ ID NO: 44435 - DNA, 20 bp, Artificial Sequence
  chemically synthesized
ggtcactatttcttgttcat

SEQ ID NO: 44436 - DNA, 20 bp, Artificial Sequence
  chemically synthesized
gaaaactcatgaacaagaaa

SEQ ID NO: 44437 - DNA, 20 bp, Artificial Sequence
  chemically synthesized
gaacaagaaatagtgaccaa

SEQ ID NO: 44438 - DNA, 20 bp, Artificial Sequence
  chemically synthesized
aacaagaaatagtgaccaaa

SEQ ID NO: 44439 - DNA, 20 bp, Artificial Sequence
  chemically synthesized
agaaatagtgaccaaaagga

SEQ ID NO: 44440 - DNA, 20 bp, Artificial Sequence
  chemically synthesized
tttgttgttttctttccttt

SEQ ID NO: 44441 - DNA, 20 bp, Artificial Sequence
  chemically synthesized
caacaaaacgattccttcta

SEQ ID NO: 44442 - DNA, 20 bp, Artificial Sequence
  chemically synthesized
tgcttctttgttgctttaga

SEQ ID NO: 44443 - DNA, 20 bp, Artificial Sequence
  chemically synthesized
ttgcttctttgttgctttag

SEQ ID NO: 44444 - DNA, 20 bp, Artificial Sequence
  chemically synthesized
aacttgcttctttgttgctt

SEQ ID NO: 44445 - DNA, 20 bp, Artificial Sequence
  chemically synthesized
cgattccttctaaagcaaca

SEQ ID NO: 44446 - DNA, 20 bp, Artificial Sequence
  chemically synthesized
ttccttctaaagcaacaaag

SEQ ID NO: 44447 - DNA, 20 bp, Artificial Sequence
  chemically synthesized
ttctaaagcaacaaagaagc

SEQ ID NO: 44448 - DNA, 20 bp, Artificial Sequence
  chemically synthesized
gccattgcatgtcagatggt

SEQ ID NO: 44449 - DNA, 20 bp, Artificial Sequence
  chemically synthesized
caaagccattgcatgtcaga

SEQ ID NO: 44450 - DNA, 20 bp, Artificial Sequence
  chemically synthesized
tccccaaagccattgcatgt

SEQ ID NO: 44451 - DNA, 20 bp, Artificial Sequence
  chemically synthesized
actgaccatctgacatgcaa

SEQ ID NO: 44452 - DNA, 20 bp, Artificial Sequence
  chemically synthesized
catctgacatgcaatggctt

SEQ ID NO: 44453 - DNA, 20 bp, Artificial Sequence
  chemically synthesized
atctgacatgcaatggcttt

SEQ ID NO: 44454 - DNA, 20 bp, Artificial Sequence
  chemically synthesized
tctgacatgcaatggctttg

SEQ ID NO: 44455 - DNA, 20 bp, Artificial Sequence
  chemically synthesized
cacatccatcttggtcccca

SEQ ID NO: 44456 - DNA, 20 bp, Artificial Sequence
  chemically synthesized
atgcaatggctttggggacc

SEQ ID NO: 44457 - DNA, 20 bp, Artificial Sequence
  chemically synthesized
aatggctttggggaccaaga

SEQ ID NO: 44458 - DNA, 20 bp, Artificial Sequence
  chemically synthesized
cagcttatccacatccatct

SEQ ID NO: 44459 - DNA, 20 bp, Artificial Sequence
  chemically synthesized
tttggggaccaagatggatg

SEQ ID NO: 44460 - DNA, 20 bp, Artificial Sequence
  chemically synthesized
ggaccaagatggatgtggat

SEQ ID NO: 44461 - DNA, 20 bp, Artificial Sequence
  chemically synthesized
aagatggatgtggataagct

SEQ ID NO: 44462 - DNA, 20 bp, Artificial Sequence
  chemically synthesized
tggatgtggataagctgaga

SEQ ID NO: 44463 - DNA, 20 bp, Artificial Sequence
  chemically synthesized
ttttttctgtttttctttct

SEQ ID NO: 44464 - DNA, 20 bp, Artificial Sequence
  chemically synthesized
gataagctgagaaagaaaaa

SEQ ID NO: 44465 - DNA, 20 bp, Artificial Sequence
  chemically synthesized
tgagaaagaaaaacagaaaa

SEQ ID NO: 44466 - DNA, 20 bp, Artificial Sequence
  chemically synthesized
gaaagaaaaacagaaaaaag

SEQ ID NO: 44467 - DNA, 20 bp, Artificial Sequence
  chemically synthesized
aaaaacagaaaaaagcagtt

SEQ ID NO: 44468 - DNA, 20 bp, Artificial Sequence
  chemically synthesized
aaacagaaaaaagcagttga

SEQ ID NO: 44469 - DNA, 20 bp, Artificial Sequence
  chemically synthesized
aaaaaagcagttgagagttt

SEQ ID NO: 44470 - DNA, 20 bp, Artificial Sequence
  chemically synthesized
aaaaagcagttgagagtttc

SEQ ID NO: 44471 - DNA, 20 bp, Artificial Sequence
  chemically synthesized
aagcagttgagagtttcagg

SEQ ID NO: 44472 - DNA, 20 bp, Artificial Sequence
  chemically synthesized
gcagttgagagtttcaggaa

SEQ ID NO: 44473 - DNA, 20 bp, Artificial Sequence
  chemically synthesized
gttgagagtttcaggaagag

SEQ ID NO: 44474 - DNA, 20 bp, Artificial Sequence
  chemically synthesized
agagtttcaggaagagcagc

SEQ ID NO: 44475 - DNA, 20 bp, Artificial Sequence
  chemically synthesized
gagtttcaggaagagcagcg

SEQ ID NO: 44476 - DNA, 20 bp, Artificial Sequence
  chemically synthesized
ggaagagcagcgaggctttt

SEQ ID NO: 44477 - DNA, 20 bp, Artificial Sequence
  chemically synthesized
cctggggggatgaaactgaa

SEQ ID NO: 44478 - DNA, 20 bp, Artificial Sequence
  chemically synthesized
gcttttcagtttcatccccc

SEQ ID NO: 44479 - DNA, 20 bp, Artificial Sequence
  chemically synthesized
cttttcagtttcatcccccc

SEQ ID NO: 44480 - DNA, 20 bp, Artificial Sequence
  chemically synthesized
tttcagtttcatccccccag

SEQ ID NO: 44481 - DNA, 20 bp, Artificial Sequence
  chemically synthesized
tgataccattaactcctggg

SEQ ID NO: 44482 - DNA, 20 bp, Artificial Sequence
  chemically synthesized
gtgataccattaactcctgg

SEQ ID NO: 44483 - DNA, 20 bp, Artificial Sequence
  chemically synthesized
tgtgataccattaactcctg

SEQ ID NO: 44484 - DNA, 20 bp, Artificial Sequence
  chemically synthesized
ctgtgataccattaactcct

SEQ ID NO: 44485 - DNA, 20 bp, Artificial Sequence
  chemically synthesized
tctgtgataccattaactcc

SEQ ID NO: 44486 - DNA, 20 bp, Artificial Sequence
  chemically synthesized
ttcatccccccaggagttaa

SEQ ID NO: 44487 - DNA, 20 bp, Artificial Sequence
  chemically synthesized
cccaggagttaatggtatca

SEQ ID NO: 44488 - DNA, 20 bp, Artificial Sequence
  chemically synthesized
cttagctcactgtcggcatt

SEQ ID NO: 44489 - DNA, 20 bp, Artificial Sequence
  chemically synthesized
gatcatttgccgaatgccga

SEQ ID NO: 44490 - DNA, 20 bp, Artificial Sequence
  chemically synthesized
atttgccgaatgccgacagt

SEQ ID NO: 44491 - DNA, 20 bp, Artificial Sequence
  chemically synthesized
gatgagacttagctcactgt

SEQ ID NO: 44492 - DNA, 20 bp, Artificial Sequence
  chemically synthesized
ccgaatgccgacagtgagct

SEQ ID NO: 44493 - DNA, 20 bp, Artificial Sequence
  chemically synthesized
agcaggtcctagatgagact

SEQ ID NO: 44494 - DNA, 20 bp, Artificial Sequence
  chemically synthesized
acagtgagctaagtctcatc

SEQ ID NO: 44495 - DNA, 20 bp, Artificial Sequence
  chemically synthesized
cagtgagctaagtctcatct

SEQ ID NO: 44496 - DNA, 20 bp, Artificial Sequence
  chemically synthesized
tctaagagcaggtcctagat

SEQ ID NO: 44497 - DNA, 20 bp, Artificial Sequence
  chemically synthesized
aagcttctaagagcaggtcc

SEQ ID NO: 44498 - DNA, 20 bp, Artificial Sequence
  chemically synthesized
tctcatctaggacctgctct

SEQ ID NO: 44499 - DNA, 20 bp, Artificial Sequence
  chemically synthesized
tctggaaagcttctaagagc

SEQ ID NO: 44500 - DNA, 20 bp, Artificial Sequence
  chemically synthesized
catctaggacctgctcttag

SEQ ID NO: 44501 - DNA, 20 bp, Artificial Sequence
  chemically synthesized
ctctggaaagcttctaagag

SEQ ID NO: 44502 - DNA, 20 bp, Artificial Sequence
  chemically synthesized
tgactctggaaagcttctaa

SEQ ID NO: 44503 - DNA, 20 bp, Artificial Sequence
  chemically synthesized
attgactctggaaagcttct

SEQ ID NO: 44504 - DNA, 20 bp, Artificial Sequence
  chemically synthesized
acctgctcttagaagctttc

SEQ ID NO: 44505 - DNA, 20 bp, Artificial Sequence
  chemically synthesized
ctgctcttagaagctttcca

SEQ ID NO: 44506 - DNA, 20 bp, Artificial Sequence
  chemically synthesized
ctctggatattgactctgga

SEQ ID NO: 44507 - DNA, 20 bp, Artificial Sequence
  chemically synthesized
gtatctctggatattgactc

SEQ ID NO: 44508 - DNA, 20 bp, Artificial Sequence
  chemically synthesized
agctttccagagtcaatatc

SEQ ID NO: 44509 - DNA, 20 bp, Artificial Sequence
  chemically synthesized
ctttccagagtcaatatcca

SEQ ID NO: 44510 - DNA, 20 bp, Artificial Sequence
  chemically synthesized
agatagaaaaacagtatctc

SEQ ID NO: 44511 - DNA, 20 bp, Artificial Sequence
  chemically synthesized
cgttgtacaagatagaaaaa

SEQ ID NO: 44512 - DNA, 20 bp, Artificial Sequence
  chemically synthesized
ttttaaaccgttgtacaaga

SEQ ID NO: 44513 - DNA, 20 bp, Artificial Sequence
  chemically synthesized
tgtttttctatcttgtacaa

SEQ ID NO: 44514 - DNA, 20 bp, Artificial Sequence
  chemically synthesized
aattttttaaaccgttgtac

SEQ ID NO: 44515 - DNA, 20 bp, Artificial Sequence
  chemically synthesized
ttaaaaaatttgcaacgtga

SEQ ID NO: 44516 - DNA, 20 bp, Artificial Sequence
  chemically synthesized
tgtgagtgcattgtataaat

SEQ ID NO: 44517 - DNA, 20 bp, Artificial Sequence
  chemically synthesized
tgatttatacaatgcactca

SEQ ID NO: 44518 - DNA, 20 bp, Artificial Sequence
  chemically synthesized
tttttaaagaaatagactgt

SEQ ID NO: 44519 - DNA, 20 bp, Artificial Sequence
  chemically synthesized
tgtattcttttttaaagaaa

SEQ ID NO: 44520 - DNA, 20 bp, Artificial Sequence
  chemically synthesized
cacagtctatttctttaaaa

SEQ ID NO: 44521 - DNA, 20 bp, Artificial Sequence
  chemically synthesized
tgtgtatgtattctttttta

SEQ ID NO: 44522 - DNA, 20 bp, Artificial Sequence
  chemically synthesized
tttaaaaaagaatacataca

SEQ ID NO: 44523 - DNA, 20 bp, Artificial Sequence
  chemically synthesized
taaaaaagaatacatacaca

SEQ ID NO: 44524 - DNA, 20 bp, Artificial Sequence
  chemically synthesized
aaaaagaatacatacacaga

SEQ ID NO: 44525 - DNA, 20 bp, Artificial Sequence
  chemically synthesized
aaagaatacatacacagaga

SEQ ID NO: 44526 - DNA, 20 bp, Artificial Sequence
  chemically synthesized
agaatacatacacagagaga

SEQ ID NO: 44527 - DNA, 20 bp, Artificial Sequence
  chemically synthesized
aatacatacacagagagaga

SEQ ID NO: 44528 - DNA, 20 bp, Artificial Sequence
  chemically synthesized
tacatacacagagagagaga

SEQ ID NO: 44529 - DNA, 20 bp, Artificial Sequence
  chemically synthesized
catacacagagagagagaga

SEQ ID NO: 44530 - DNA, 20 bp, Artificial Sequence
  chemically synthesized
tacacagagagagagagaga

SEQ ID NO: 44531 - DNA, 20 bp, Artificial Sequence
  chemically synthesized
cacagagagagagagagaga

SEQ ID NO: 44532 - DNA, 20 bp, Artificial Sequence
  chemically synthesized
cagagagagagagagagaga

SEQ ID NO: 44533 - DNA, 20 bp, Artificial Sequence
  chemically synthesized
gagagagagagagagagaga

SEQ ID NO: 44534 - DNA, 20 bp, Artificial Sequence
  chemically synthesized
gagagagagagagagagaga

SEQ ID NO: 44535 - DNA, 20 bp, Artificial Sequence
  chemically synthesized
gagagagagagagagagaga

SEQ ID NO: 44536 - DNA, 20 bp, Artificial Sequence
  chemically synthesized
gagagagagagagagagaga

SEQ ID NO: 44537 - DNA, 20 bp, Artificial Sequence
  chemically synthesized
gagagagagagagagagaga

SEQ ID NO: 44538 - DNA, 20 bp, Artificial Sequence
  chemically synthesized
gagagagagagagagagaga

SEQ ID NO: 44539 - DNA, 20 bp, Artificial Sequence
  chemically synthesized
gagagagagagagagagaga

SEQ ID NO: 44540 - DNA, 20 bp, Artificial Sequence
  chemically synthesized
gagagagagagagagagaga

SEQ ID NO: 44541 - DNA, 20 bp, Artificial Sequence
  chemically synthesized
cttcaggaaaaatgttaaca

SEQ ID NO: 44542 - DNA, 20 bp, Artificial Sequence
  chemically synthesized
ccgtgttaacatttttcctg

SEQ ID NO: 44543 - DNA, 20 bp, Artificial Sequence
  chemically synthesized
gttaacatttttcctgaaga

SEQ ID NO: 44544 - DNA, 20 bp, Artificial Sequence
  chemically synthesized
gggtattaaatactttcttc

SEQ ID NO: 44545 - DNA, 20 bp, Artificial Sequence
  chemically synthesized
agggtattaaatactttctt

SEQ ID NO: 44546 - DNA, 20 bp, Artificial Sequence
  chemically synthesized
gggagtagggggtagggaga

SEQ ID NO: 44547 - DNA, 20 bp, Artificial Sequence
  chemically synthesized
ggggagtagggggtagggag

SEQ ID NO: 44548 - DNA, 20 bp, Artificial Sequence
  chemically synthesized
gggggagtagggggtaggga

SEQ ID NO: 44549 - DNA, 20 bp, Artificial Sequence
  chemically synthesized
gtgggggagtagggggtagg

SEQ ID NO: 44550 - DNA, 20 bp, Artificial Sequence
  chemically synthesized
gggtgggggagtagggggta

SEQ ID NO: 44551 - DNA, 20 bp, Artificial Sequence
  chemically synthesized
agggtgggggagtagggggt

SEQ ID NO: 44552 - DNA, 20 bp, Artificial Sequence
  chemically synthesized
tagggtgggggagtaggggg

SEQ ID NO: 44553 - DNA, 20 bp, Artificial Sequence
  chemically synthesized
ggatagggtgggggagtagg

SEQ ID NO: 44554 - DNA, 20 bp, Artificial Sequence
  chemically synthesized
gggatagggtgggggagtag

SEQ ID NO: 44555 - DNA, 20 bp, Artificial Sequence
  chemically synthesized
ggggatagggtgggggagta

SEQ ID NO: 44556 - DNA, 20 bp, Artificial Sequence
  chemically synthesized
aggggatagggtgggggagt

SEQ ID NO: 44557 - DNA, 20 bp, Artificial Sequence
  chemically synthesized
caggggatagggtgggggag

SEQ ID NO: 44558 - DNA, 20 bp, Artificial Sequence
  chemically synthesized
ttccaggggatagggtgggg

SEQ ID NO: 44559 - DNA, 20 bp, Artificial Sequence
  chemically synthesized
ccttccaggggatagggtgg

SEQ ID NO: 44560 - DNA, 20 bp, Artificial Sequence
  chemically synthesized
tccttccaggggatagggtg

SEQ ID NO: 44561 - DNA, 20 bp, Artificial Sequence
  chemically synthesized
ttccttccaggggatagggt

SEQ ID NO: 44562 - DNA, 20 bp, Artificial Sequence
  chemically synthesized
cttccttccaggggataggg

SEQ ID NO: 44563 - DNA, 20 bp, Artificial Sequence
  chemically synthesized
tactcccccaccctatcccc

SEQ ID NO: 44564 - DNA, 20 bp, Artificial Sequence
  chemically synthesized
ctccttccttccaggggata

SEQ ID NO: 44565 - DNA, 20 bp, Artificial Sequence
  chemically synthesized
cctccttccttccaggggat

SEQ ID NO: 44566 - DNA, 20 bp, Artificial Sequence
  chemically synthesized
ccctccttccttccagggga

SEQ ID NO: 44567 - DNA, 20 bp, Artificial Sequence
  chemically synthesized
tcccccaccctatcccctgg

SEQ ID NO: 44568 - DNA, 20 bp, Artificial Sequence
  chemically synthesized
cccccaccctatcccctgga

SEQ ID NO: 44569 - DNA, 20 bp, Artificial Sequence
  chemically synthesized
cttcccctccttccttccag

SEQ ID NO: 44570 - DNA, 20 bp, Artificial Sequence
  chemically synthesized
ccaccctatcccctggaagg

SEQ ID NO: 44571 - DNA, 20 bp, Artificial Sequence
  chemically synthesized
tcttcccctccttccttcca

SEQ ID NO: 44572 - DNA, 20 bp, Artificial Sequence
  chemically synthesized
caccctatcccctggaagga

SEQ ID NO: 44573 - DNA, 20 bp, Artificial Sequence
  chemically synthesized
gtcttcccctccttccttcc

SEQ ID NO: 44574 - DNA, 20 bp, Artificial Sequence
  chemically synthesized
agtcttcccctccttccttc

SEQ ID NO: 44575 - DNA, 20 bp, Artificial Sequence
  chemically synthesized
ccctatcccctggaaggaag

SEQ ID NO: 44576 - DNA, 20 bp, Artificial Sequence
  chemically synthesized
cctatcccctggaaggaagg

SEQ ID NO: 44577 - DNA, 20 bp, Artificial Sequence
  chemically synthesized
ctatcccctggaaggaagga

SEQ ID NO: 44578 - DNA, 20 bp, Artificial Sequence
  chemically synthesized
tatcccctggaaggaaggag

SEQ ID NO: 44579 - DNA, 20 bp, Artificial Sequence
  chemically synthesized
cccctggaaggaaggagggg

SEQ ID NO: 44580 - DNA, 20 bp, Artificial Sequence
  chemically synthesized
ggaaggaggggaagactgaa

SEQ ID NO: 44581 - DNA, 20 bp, Artificial Sequence
  chemically synthesized
gaaggaggggaagactgaat

SEQ ID NO: 44582 - DNA, 20 bp, Artificial Sequence
  chemically synthesized
ggaaaactccaaatcccatt

SEQ ID NO: 44583 - DNA, 20 bp, Artificial Sequence
  chemically synthesized
ggggaagactgaatgggatt

SEQ ID NO: 44584 - DNA, 20 bp, Artificial Sequence
  chemically synthesized
ggaagactgaatgggatttg

SEQ ID NO: 44585 - DNA, 20 bp, Artificial Sequence
  chemically synthesized
ggatttggagttttcccact

SEQ ID NO: 44586 - DNA, 20 bp, Artificial Sequence
  chemically synthesized
ttggagttttcccactgaga

SEQ ID NO: 44587 - DNA, 20 bp, Artificial Sequence
  chemically synthesized
gaaaatgcccctttctcagt

SEQ ID NO: 44588 - DNA, 20 bp, Artificial Sequence
  chemically synthesized
tggagttttcccactgagaa

SEQ ID NO: 44589 - DNA, 20 bp, Artificial Sequence
  chemically synthesized
agaaaatgcccctttctcag

SEQ ID NO: 44590 - DNA, 20 bp, Artificial Sequence
  chemically synthesized
ggagttttcccactgagaaa

SEQ ID NO: 44591 - DNA, 20 bp, Artificial Sequence
  chemically synthesized
gagttttcccactgagaaag

SEQ ID NO: 44592 - DNA, 20 bp, Artificial Sequence
  chemically synthesized
tgcagaaaatgcccctttct

SEQ ID NO: 44593 - DNA, 20 bp, Artificial Sequence
  chemically synthesized
aaaggggcattttctgcaac

SEQ ID NO: 44594 - DNA, 20 bp, Artificial Sequence
  chemically synthesized
aaggggcattttctgcaacc

SEQ ID NO: 44595 - DNA, 20 bp, Artificial Sequence
  chemically synthesized
tttgaacactgacctggttg

SEQ ID NO: 44596 - DNA, 20 bp, Artificial Sequence
  chemically synthesized
ggcattttctgcaaccaggt

SEQ ID NO: 44597 - DNA, 20 bp, Artificial Sequence
  chemically synthesized
tagtcctttgaacactgacc

SEQ ID NO: 44598 - DNA, 20 bp, Artificial Sequence
  chemically synthesized
tgcaaccaggtcagtgttca

SEQ ID NO: 44599 - DNA, 20 bp, Artificial Sequence
  chemically synthesized
gcaaccaggtcagtgttcaa

SEQ ID NO: 44600 - DNA, 20 bp, Artificial Sequence
  chemically synthesized
gttcaaaggactaatgctct

SEQ ID NO: 44601 - DNA, 20 bp, Artificial Sequence
  chemically synthesized
ggataatttccttagagcat

SEQ ID NO: 44602 - DNA, 20 bp, Artificial Sequence
  chemically synthesized
ttcaaaggactaatgctcta

SEQ ID NO: 44603 - DNA, 20 bp, Artificial Sequence
  chemically synthesized
tctttgggataatttcctta

SEQ ID NO: 44604 - DNA, 20 bp, Artificial Sequence
  chemically synthesized
cttctttgggataatttcct

SEQ ID NO: 44605 - DNA, 20 bp, Artificial Sequence
  chemically synthesized
gctctaaggaaattatccca

SEQ ID NO: 44606 - DNA, 20 bp, Artificial Sequence
  chemically synthesized
ctaaggaaattatcccaaag

SEQ ID NO: 44607 - DNA, 20 bp, Artificial Sequence
  chemically synthesized
aaggaaattatcccaaagaa

SEQ ID NO: 44608 - DNA, 20 bp, Artificial Sequence
  chemically synthesized
gaactgcctctctcttcttt

SEQ ID NO: 44609 - DNA, 20 bp, Artificial Sequence
  chemically synthesized
ggaaattatcccaaagaaga

SEQ ID NO: 44610 - DNA, 20 bp, Artificial Sequence
  chemically synthesized
tgaactgcctctctcttctt

SEQ ID NO: 44611 - DNA, 20 bp, Artificial Sequence
  chemically synthesized
aaattatcccaaagaagaga

SEQ ID NO: 44612 - DNA, 20 bp, Artificial Sequence
  chemically synthesized
aattatcccaaagaagagag

SEQ ID NO: 44613 - DNA, 20 bp, Artificial Sequence
  chemically synthesized
tatcccaaagaagagagagg

SEQ ID NO: 44614 - DNA, 20 bp, Artificial Sequence
  chemically synthesized
caaagaagagagaggcagtt

SEQ ID NO: 44615 - DNA, 20 bp, Artificial Sequence
  chemically synthesized
aaagaagagagaggcagttc

SEQ ID NO: 44616 - DNA, 20 bp, Artificial Sequence
  chemically synthesized
aagaagagagaggcagttca

SEQ ID NO: 44617 - DNA, 20 bp, Artificial Sequence
  chemically synthesized
agaggcagttcagggttatt

SEQ ID NO: 44618 - DNA, 20 bp, Artificial Sequence
  chemically synthesized
agttattttaaaacattgcc

SEQ ID NO: 44619 - DNA, 20 bp, Artificial Sequence
  chemically synthesized
gttattttaaaacattgcct

SEQ ID NO: 44620 - DNA, 20 bp, Artificial Sequence
  chemically synthesized
aaggtcagcagcaacagccc

SEQ ID NO: 44621 - DNA, 20 bp, Artificial Sequence
  chemically synthesized
aaaggtcagcagcaacagcc

SEQ ID NO: 44622 - DNA, 20 bp, Artificial Sequence
  chemically synthesized
ttcacaaaggtcagcagcaa

SEQ ID NO: 44623 - DNA, 20 bp, Artificial Sequence
  chemically synthesized
gttcccttcacaaaggtcag

SEQ ID NO: 44624 - DNA, 20 bp, Artificial Sequence
  chemically synthesized
cctgttcccttcacaaaggt

SEQ ID NO: 44625 - DNA, 20 bp, Artificial Sequence
  chemically synthesized
tgttgctgctgacctttgtg

SEQ ID NO: 44626 - DNA, 20 bp, Artificial Sequence
  chemically synthesized
gttgctgctgacctttgtga

SEQ ID NO: 44627 - DNA, 20 bp, Artificial Sequence
  chemically synthesized
ttgctgctgacctttgtgaa

SEQ ID NO: 44628 - DNA, 20 bp, Artificial Sequence
  chemically synthesized
gcatcctgttcccttcacaa

SEQ ID NO: 44629 - DNA, 20 bp, Artificial Sequence
  chemically synthesized
agcatcctgttcccttcaca

SEQ ID NO: 44630 - DNA, 20 bp, Artificial Sequence
  chemically synthesized
gctgacctttgtgaagggaa

SEQ ID NO: 44631 - DNA, 20 bp, Artificial Sequence
  chemically synthesized
ctgacctttgtgaagggaac

SEQ ID NO: 44632 - DNA, 20 bp, Artificial Sequence
  chemically synthesized
gggaacaggatgctgcttcc

SEQ ID NO: 44633 - DNA, 20 bp, Artificial Sequence
  chemically synthesized
ggaacaggatgctgcttccc

SEQ ID NO: 44634 - DNA, 20 bp, Artificial Sequence
  chemically synthesized
gaacaggatgctgcttccca

SEQ ID NO: 44635 - DNA, 20 bp, Artificial Sequence
  chemically synthesized
tattctgttcccctgggaag

SEQ ID NO: 44636 - DNA, 20 bp, Artificial Sequence
  chemically synthesized
aacaggatgctgcttcccag

SEQ ID NO: 44637 - DNA, 20 bp, Artificial Sequence
  chemically synthesized
tcttattctgttcccctggg

SEQ ID NO: 44638 - DNA, 20 bp, Artificial Sequence
  chemically synthesized
gatgctgcttcccaggggaa

SEQ ID NO: 44639 - DNA, 20 bp, Artificial Sequence
  chemically synthesized
gcttcttattctgttcccct

SEQ ID NO: 44640 - DNA, 20 bp, Artificial Sequence
  chemically synthesized
tgcttcttattctgttcccc

SEQ ID NO: 44641 - DNA, 20 bp, Artificial Sequence
  chemically synthesized
gcttcccaggggaacagaat

SEQ ID NO: 44642 - DNA, 20 bp, Artificial Sequence
  chemically synthesized
tcccaggggaacagaataag

SEQ ID NO: 44643 - DNA, 20 bp, Artificial Sequence
  chemically synthesized
ggaacagaataagaagcaat

SEQ ID NO: 44644 - DNA, 20 bp, Artificial Sequence
  chemically synthesized
aacagaataagaagcaatta

SEQ ID NO: 44645 - DNA, 20 bp, Artificial Sequence
  chemically synthesized
agaataagaagcaattagag

SEQ ID NO: 44646 - DNA, 20 bp, Artificial Sequence
  chemically synthesized
aagaagcaattagagaagcc

SEQ ID NO: 44647 - DNA, 20 bp, Artificial Sequence
  chemically synthesized
agaagcaattagagaagcct

SEQ ID NO: 44648 - DNA, 20 bp, Artificial Sequence
  chemically synthesized
aagcaattagagaagcctag

SEQ ID NO: 44649 - DNA, 20 bp, Artificial Sequence
  chemically synthesized
gcaattagagaagcctagga

SEQ ID NO: 44650 - DNA, 20 bp, Artificial Sequence
  chemically synthesized
caattagagaagcctaggag

SEQ ID NO: 44651 - DNA, 20 bp, Artificial Sequence
  chemically synthesized
aacattcccgggcctctcct

SEQ ID NO: 44652 - DNA, 20 bp, Artificial Sequence
  chemically synthesized
aaacattcccgggcctctcc

SEQ ID NO: 44653 - DNA, 20 bp, Artificial Sequence
  chemically synthesized
agagaagcctaggagaggcc

SEQ ID NO: 44654 - DNA, 20 bp, Artificial Sequence
  chemically synthesized
gagaagcctaggagaggccc

SEQ ID NO: 44655 - DNA, 20 bp, Artificial Sequence
  chemically synthesized
gtgaattcccaaacattccc

SEQ ID NO: 44656 - DNA, 20 bp, Artificial Sequence
  chemically synthesized
tgtgaattcccaaacattcc

SEQ ID NO: 44657 - DNA, 20 bp, Artificial Sequence
  chemically synthesized
aggagaggcccgggaatgtt

SEQ ID NO: 44658 - DNA, 20 bp, Artificial Sequence
  chemically synthesized
ggagaggcccgggaatgttt

SEQ ID NO: 44659 - DNA, 20 bp, Artificial Sequence
  chemically synthesized
tagcgttcccacgtaatttg

SEQ ID NO: 44660 - DNA, 20 bp, Artificial Sequence
  chemically synthesized
ttagcgttcccacgtaattt

SEQ ID NO: 44661 - DNA, 20 bp, Artificial Sequence
  chemically synthesized
cacacataccccaaattacg

SEQ ID NO: 44662 - DNA, 20 bp, Artificial Sequence
  chemically synthesized
cttagcgttcccacgtaatt

SEQ ID NO: 44663 - DNA, 20 bp, Artificial Sequence
  chemically synthesized
acacataccccaaattacgt

SEQ ID NO: 44664 - DNA, 20 bp, Artificial Sequence
  chemically synthesized
ccaaattacgtgggaacgct

SEQ ID NO: 44665 - DNA, 20 bp, Artificial Sequence
  chemically synthesized
agttagtttattttcattct

SEQ ID NO: 44666 - DNA, 20 bp, Artificial Sequence
  chemically synthesized
aatatgtccctaatcaaagt

SEQ ID NO: 44667 - DNA, 20 bp, Artificial Sequence
  chemically synthesized
gaaaataaactaactttgat

SEQ ID NO: 44668 - DNA, 20 bp, Artificial Sequence
  chemically synthesized
aaaataaactaactttgatt

SEQ ID NO: 44669 - DNA, 20 bp, Artificial Sequence
  chemically synthesized
aaataaactaactttgatta

SEQ ID NO: 44670 - DNA, 20 bp, Artificial Sequence
  chemically synthesized
cccaaatatgtccctaatca

SEQ ID NO: 44671 - DNA, 20 bp, Artificial Sequence
  chemically synthesized
actttgattagggacatatt

SEQ ID NO: 44672 - DNA, 20 bp, Artificial Sequence
  chemically synthesized
ctttgattagggacatattt

SEQ ID NO: 44673 - DNA, 20 bp, Artificial Sequence
  chemically synthesized
ttagggacatatttgggttc

SEQ ID NO: 44674 - DNA, 20 bp, Artificial Sequence
  chemically synthesized
tgcatttttagaatattttc

SEQ ID NO: 44675 - DNA, 20 bp, Artificial Sequence
  chemically synthesized
tagaaaatattctaaaaatg

SEQ ID NO: 44676 - DNA, 20 bp, Artificial Sequence
  chemically synthesized
cccagtgtgagctgcatttt

SEQ ID NO: 44677 - DNA, 20 bp, Artificial Sequence
  chemically synthesized
tctaaaaatgcagctcacac

SEQ ID NO: 44678 - DNA, 20 bp, Artificial Sequence
  chemically synthesized
ctaaaaatgcagctcacact

SEQ ID NO: 44679 - DNA, 20 bp, Artificial Sequence
  chemically synthesized
taaaaatgcagctcacactg

SEQ ID NO: 44680 - DNA, 20 bp, Artificial Sequence
  chemically synthesized
tagagatatagccccagtgt

SEQ ID NO: 44681 - DNA, 20 bp, Artificial Sequence
  chemically synthesized
cactcatagagatatagccc

SEQ ID NO: 44682 - DNA, 20 bp, Artificial Sequence
  chemically synthesized
ggaaaacactcatagagata

SEQ ID NO: 44683 - DNA, 20 bp, Artificial Sequence
  chemically synthesized
cactggggctatatctctat

SEQ ID NO: 44684 - DNA, 20 bp, Artificial Sequence
  chemically synthesized
tttttaggaaaacactcata

SEQ ID NO: 44685 - DNA, 20 bp, Artificial Sequence
  chemically synthesized
ggtttttaggaaaacactca

SEQ ID NO: 44686 - DNA, 20 bp, Artificial Sequence
  chemically synthesized
tactgagtgttcaggttttt

SEQ ID NO: 44687 - DNA, 20 bp, Artificial Sequence
  chemically synthesized
atactgagtgttcaggtttt

SEQ ID NO: 44688 - DNA, 20 bp, Artificial Sequence
  chemically synthesized
ttcctaaaaacctgaacact

SEQ ID NO: 44689 - DNA, 20 bp, Artificial Sequence
  chemically synthesized
ctattagatactgagtgttc

SEQ ID NO: 44690 - DNA, 20 bp, Artificial Sequence
  chemically synthesized
tctattagatactgagtgtt

SEQ ID NO: 44691 - DNA, 20 bp, Artificial Sequence
  chemically synthesized
attgacctctattagatact

SEQ ID NO: 44692 - DNA, 20 bp, Artificial Sequence
  chemically synthesized
cctgaacactcagtatctaa

SEQ ID NO: 44693 - DNA, 20 bp, Artificial Sequence
  chemically synthesized
tgaacactcagtatctaata

SEQ ID NO: 44694 - DNA, 20 bp, Artificial Sequence
  chemically synthesized
gaacactcagtatctaatag

SEQ ID NO: 44695 - DNA, 20 bp, Artificial Sequence
  chemically synthesized
gaagtcttattgacctctat

SEQ ID NO: 44696 - DNA, 20 bp, Artificial Sequence
  chemically synthesized
agtatctaatagaggtcaat

SEQ ID NO: 44697 - DNA, 20 bp, Artificial Sequence
  chemically synthesized
aggtcaataagacttcaatc

SEQ ID NO: 44698 - DNA, 20 bp, Artificial Sequence
  chemically synthesized
tctcctctgaaactggattg

SEQ ID NO: 44699 - DNA, 20 bp, Artificial Sequence
  chemically synthesized
ataagacttcaatccagttt

SEQ ID NO: 44700 - DNA, 20 bp, Artificial Sequence
  chemically synthesized
aagacttcaatccagtttca

SEQ ID NO: 44701 - DNA, 20 bp, Artificial Sequence
  chemically synthesized
agacttcaatccagtttcag

SEQ ID NO: 44702 - DNA, 20 bp, Artificial Sequence
  chemically synthesized
ttccttttctcctctgaaac

SEQ ID NO: 44703 - DNA, 20 bp, Artificial Sequence
  chemically synthesized
acttcaatccagtttcagag

SEQ ID NO: 44704 - DNA, 20 bp, Artificial Sequence
  chemically synthesized
aatccagtttcagaggagaa

SEQ ID NO: 44705 - DNA, 20 bp, Artificial Sequence
  chemically synthesized
atccagtttcagaggagaaa

SEQ ID NO: 44706 - DNA, 20 bp, Artificial Sequence
  chemically synthesized
agtttcagaggagaaaagga

SEQ ID NO: 44707 - DNA, 20 bp, Artificial Sequence
  chemically synthesized
attgcttaagaaatgttaat

SEQ ID NO: 44708 - DNA, 20 bp, Artificial Sequence
  chemically synthesized
aaagccaattaacatttctt

SEQ ID NO: 44709 - DNA, 20 bp, Artificial Sequence
  chemically synthesized
acacataaggaatattgctt

SEQ ID NO: 44710 - DNA, 20 bp, Artificial Sequence
  chemically synthesized
attctactttatgacacata

SEQ ID NO: 44711 - DNA, 20 bp, Artificial Sequence
  chemically synthesized
cattctactttatgacacat

SEQ ID NO: 44712 - DNA, 20 bp, Artificial Sequence
  chemically synthesized
aatattccttatgtgtcata

SEQ ID NO: 44713 - DNA, 20 bp, Artificial Sequence
  chemically synthesized
attccttatgtgtcataaag

SEQ ID NO: 44714 - DNA, 20 bp, Artificial Sequence
  chemically synthesized
ttatgtgtcataaagtagaa

SEQ ID NO: 44715 - DNA, 20 bp, Artificial Sequence
  chemically synthesized
tatgtgtcataaagtagaat

SEQ ID NO: 44716 - DNA, 20 bp, Artificial Sequence
  chemically synthesized
agtagaatgggtgtcacgtt

SEQ ID NO: 44717 - DNA, 20 bp, Artificial Sequence
  chemically synthesized
tgggtgtcacgttaagcaaa

SEQ ID NO: 44718 - DNA, 20 bp, Artificial Sequence
  chemically synthesized
aagcaaatggctcaaacgaa

SEQ ID NO: 44719 - DNA, 20 bp, Artificial Sequence
  chemically synthesized
tatcccaactctgttcgttt

SEQ ID NO: 44720 - DNA, 20 bp, Artificial Sequence
  chemically synthesized
gcaaatggctcaaacgaaca

SEQ ID NO: 44721 - DNA, 20 bp, Artificial Sequence
  chemically synthesized
atggctcaaacgaacagagt

SEQ ID NO: 44722 - DNA, 20 bp, Artificial Sequence
  chemically synthesized
tggctcaaacgaacagagtt

SEQ ID NO: 44723 - DNA, 20 bp, Artificial Sequence
  chemically synthesized
aacagagttgggatatgata

SEQ ID NO: 44724 - DNA, 20 bp, Artificial Sequence
  chemically synthesized
tgatacagttgtttcaaatg

SEQ ID NO: 44725 - DNA, 20 bp, Artificial Sequence
  chemically synthesized
gatttatttgatgtgactac

SEQ ID NO: 44726 - DNA, 20 bp, Artificial Sequence
  chemically synthesized
acgtgttagaaaaaaaccag

SEQ ID NO: 44727 - DNA, 20 bp, Artificial Sequence
  chemically synthesized
atcacgtgttagaaaaaaac

SEQ ID NO: 44728 - DNA, 20 bp, Artificial Sequence
  chemically synthesized
tttcttacataatcacgtgt

SEQ ID NO: 44729 - DNA, 20 bp, Artificial Sequence
  chemically synthesized
tttctaacacgtgattatgt

SEQ ID NO: 44730 - DNA, 20 bp, Artificial Sequence
  chemically synthesized
taacacgtgattatgtaaga

SEQ ID NO: 44731 - DNA, 20 bp, Artificial Sequence
  chemically synthesized
atgtaagaaagtgcatgttt

SEQ ID NO: 44732 - DNA, 20 bp, Artificial Sequence
  chemically synthesized
aagaaagtgcatgtttaaga

SEQ ID NO: 44733 - DNA, 20 bp, Artificial Sequence
  chemically synthesized
aagtgcatgtttaagaaagt

SEQ ID NO: 44734 - DNA, 20 bp, Artificial Sequence
  chemically synthesized
atgtttaagaaagttagaaa

SEQ ID NO: 44735 - DNA, 20 bp, Artificial Sequence
  chemically synthesized
agaaagttagaaaaagaaaa

SEQ ID NO: 44736 - DNA, 20 bp, Artificial Sequence
  chemically synthesized
gaaagttagaaaaagaaaat

SEQ ID NO: 44737 - DNA, 20 bp, Artificial Sequence
  chemically synthesized
aaagttagaaaaagaaaatg

SEQ ID NO: 44738 - DNA, 20 bp, Artificial Sequence
  chemically synthesized
agaaaaagaaaatggggaaa

SEQ ID NO: 44739 - DNA, 20 bp, Artificial Sequence
  chemically synthesized
agaagaggagtaaattattt

SEQ ID NO: 44740 - DNA, 20 bp, Artificial Sequence
  chemically synthesized
tggtttatccaaaagaagag

SEQ ID NO: 44741 - DNA, 20 bp, Artificial Sequence
  chemically synthesized
ataatttactcctcttcttt

SEQ ID NO: 44742 - DNA, 20 bp, Artificial Sequence
  chemically synthesized
gttggtttatccaaaagaag

SEQ ID NO: 44743 - DNA, 20 bp, Artificial Sequence
  chemically synthesized
agttggtttatccaaaagaa

SEQ ID NO: 44744 - DNA, 20 bp, Artificial Sequence
  chemically synthesized
caagttggtttatccaaaag

SEQ ID NO: 44745 - DNA, 20 bp, Artificial Sequence
  chemically synthesized
attcaagttggtttatccaa

SEQ ID NO: 44746 - DNA, 20 bp, Artificial Sequence
  chemically synthesized
agcatagaacatattcaagt

SEQ ID NO: 44747 - DNA, 20 bp, Artificial Sequence
  chemically synthesized
aatgagcatagaacatattc

SEQ ID NO: 44748 - DNA, 20 bp, Artificial Sequence
  chemically synthesized
tggaaatgtgagaatgagca

SEQ ID NO: 44749 - DNA, 20 bp, Artificial Sequence
  chemically synthesized
acttttggaaatgtgagaat

SEQ ID NO: 44750 - DNA, 20 bp, Artificial Sequence
  chemically synthesized
cgtggcacttttggaaatgt

SEQ ID NO: 44751 - DNA, 20 bp, Artificial Sequence
  chemically synthesized
gctcattctcacatttccaa

SEQ ID NO: 44752 - DNA, 20 bp, Artificial Sequence
  chemically synthesized
tgcctcattcgtggcacttt

SEQ ID NO: 44753 - DNA, 20 bp, Artificial Sequence
  chemically synthesized
tttccaaaagtgccacgaat

SEQ ID NO: 44754 - DNA, 20 bp, Artificial Sequence
  chemically synthesized
ttccaaaagtgccacgaatg

SEQ ID NO: 44755 - DNA, 20 bp, Artificial Sequence
  chemically synthesized
agcattccctgcctcattcg

SEQ ID NO: 44756 - DNA, 20 bp, Artificial Sequence
  chemically synthesized
caaaagtgccacgaatgagg

SEQ ID NO: 44757 - DNA, 20 bp, Artificial Sequence
  chemically synthesized
aaaagtgccacgaatgaggc

SEQ ID NO: 44758 - DNA, 20 bp, Artificial Sequence
  chemically synthesized
aaagtgccacgaatgaggca

SEQ ID NO: 44759 - DNA, 20 bp, Artificial Sequence
  chemically synthesized
gtattataatacacatggta

SEQ ID NO: 44760 - DNA, 20 bp, Artificial Sequence
  chemically synthesized
atcctgtattataatacaca

SEQ ID NO: 44761 - DNA, 20 bp, Artificial Sequence
  chemically synthesized
ataccatgtgtattataata

SEQ ID NO: 44762 - DNA, 20 bp, Artificial Sequence
  chemically synthesized
taccatgtgtattataatac

SEQ ID NO: 44763 - DNA, 20 bp, Artificial Sequence
  chemically synthesized
taaaatttaatgtgtgtatg

SEQ ID NO: 44764 - DNA, 20 bp, Artificial Sequence
  chemically synthesized
ctaaaatttaatgtgtgtat

SEQ ID NO: 44765 - DNA, 20 bp, Artificial Sequence
  chemically synthesized
gctaaaatttaatgtgtgta

SEQ ID NO: 44766 - DNA, 20 bp, Artificial Sequence
  chemically synthesized
cccatacacacattaaattt

SEQ ID NO: 44767 - DNA, 20 bp, Artificial Sequence
  chemically synthesized
acatacacctatacatgtgg

SEQ ID NO: 44768 - DNA, 20 bp, Artificial Sequence
  chemically synthesized
aattttagctgccacatgta

SEQ ID NO: 44769 - DNA, 20 bp, Artificial Sequence
  chemically synthesized
attttagctgccacatgtat

SEQ ID NO: 44770 - DNA, 20 bp, Artificial Sequence
  chemically synthesized
tatacatacacctatacatg

SEQ ID NO: 44771 - DNA, 20 bp, Artificial Sequence
  chemically synthesized
gcatatgtcatgtggaaagg

SEQ ID NO: 44772 - DNA, 20 bp, Artificial Sequence
  chemically synthesized
atggcatatgtcatgtggaa

SEQ ID NO: 44773 - DNA, 20 bp, Artificial Sequence
  chemically synthesized
tatggcatatgtcatgtgga

SEQ ID NO: 44774 - DNA, 20 bp, Artificial Sequence
  chemically synthesized
tctatatggcatatgtcatg

SEQ ID NO: 44775 - DNA, 20 bp, Artificial Sequence
  chemically synthesized
tccacatgacatatgccata

SEQ ID NO: 44776 - DNA, 20 bp, Artificial Sequence
  chemically synthesized
aaatgttgtaacattctata

SEQ ID NO: 44777 - DNA, 20 bp, Artificial Sequence
  chemically synthesized
aatgatacatttttatttta

SEQ ID NO: 44778 - DNA, 20 bp, Artificial Sequence
  chemically synthesized
atcattgatgacattctgtt

SEQ ID NO: 44779 - DNA, 20 bp, Artificial Sequence
  chemically synthesized
tagtagccactgagtcttaa

SEQ ID NO: 44780 - DNA, 20 bp, Artificial Sequence
  chemically synthesized
gatgacattctgttaagact

SEQ ID NO: 44781 - DNA, 20 bp, Artificial Sequence
  chemically synthesized
gacattctgttaagactcag

SEQ ID NO: 44782 - DNA, 20 bp, Artificial Sequence
  chemically synthesized
gccaggatatagtagccact

SEQ ID NO: 44783 - DNA, 20 bp, Artificial Sequence
  chemically synthesized
ctttttgggccaggatatag

SEQ ID NO: 44784 - DNA, 20 bp, Artificial Sequence
  chemically synthesized
actcagtggctactatatcc

SEQ ID NO: 44785 - DNA, 20 bp, Artificial Sequence
  chemically synthesized
ctactttttgggccaggata

SEQ ID NO: 44786 - DNA, 20 bp, Artificial Sequence
  chemically synthesized
caggacctactttttgggcc

SEQ ID NO: 44787 - DNA, 20 bp, Artificial Sequence
  chemically synthesized
ctactatatcctggcccaaa

SEQ ID NO: 44788 - DNA, 20 bp, Artificial Sequence
  chemically synthesized
acaggacctactttttgggc

SEQ ID NO: 44789 - DNA, 20 bp, Artificial Sequence
  chemically synthesized
ctatatcctggcccaaaaag

SEQ ID NO: 44790 - DNA, 20 bp, Artificial Sequence
  chemically synthesized
tatatcctggcccaaaaagt

SEQ ID NO: 44791 - DNA, 20 bp, Artificial Sequence
  chemically synthesized
gtggacaggacctacttttt

SEQ ID NO: 44792 - DNA, 20 bp, Artificial Sequence
  chemically synthesized
tgtggacaggacctactttt

SEQ ID NO: 44793 - DNA, 20 bp, Artificial Sequence
  chemically synthesized
tttcactgagcattgtggac

SEQ ID NO: 44794 - DNA, 20 bp, Artificial Sequence
  chemically synthesized
ttttcactgagcattgtgga

SEQ ID NO: 44795 - DNA, 20 bp, Artificial Sequence
  chemically synthesized
taggtcctgtccacaatgct

SEQ ID NO: 44796 - DNA, 20 bp, Artificial Sequence
  chemically synthesized
ctgtttttcactgagcattg

SEQ ID NO: 44797 - DNA, 20 bp, Artificial Sequence
  chemically synthesized
atcaactactgtttttcact

SEQ ID NO: 44798 - DNA, 20 bp, Artificial Sequence
  chemically synthesized
ccacaatgctcagtgaaaaa

SEQ ID NO: 44799 - DNA, 20 bp, Artificial Sequence
  chemically synthesized
caatgctcagtgaaaaacag

SEQ ID NO: 44800 - DNA, 20 bp, Artificial Sequence
  chemically synthesized
aacagtagttgatcaattta

SEQ ID NO: 44801 - DNA, 20 bp, Artificial Sequence
  chemically synthesized
tggttttctagtggtcaata

SEQ ID NO: 44802 - DNA, 20 bp, Artificial Sequence
  chemically synthesized
tctggttttctagtggtcaa

SEQ ID NO: 44803 - DNA, 20 bp, Artificial Sequence
  chemically synthesized
tttaaagctctattgaccac

SEQ ID NO: 44804 - DNA, 20 bp, Artificial Sequence
  chemically synthesized
ggcttcttctggttttctag

SEQ ID NO: 44805 - DNA, 20 bp, Artificial Sequence
  chemically synthesized
tctattgaccactagaaaac

SEQ ID NO: 44806 - DNA, 20 bp, Artificial Sequence
  chemically synthesized
tgaggcttcttctggttttc

SEQ ID NO: 44807 - DNA, 20 bp, Artificial Sequence
  chemically synthesized
attgaccactagaaaaccag

SEQ ID NO: 44808 - DNA, 20 bp, Artificial Sequence
  chemically synthesized
gaccactagaaaaccagaag

SEQ ID NO: 44809 - DNA, 20 bp, Artificial Sequence
  chemically synthesized
atcattcatgaggcttcttc

SEQ ID NO: 44810 - DNA, 20 bp, Artificial Sequence
  chemically synthesized
tttcctaaatatcattcatg

SEQ ID NO: 44811 - DNA, 20 bp, Artificial Sequence
  chemically synthesized
ttttcctaaatatcattcat

SEQ ID NO: 44812 - DNA, 20 bp, Artificial Sequence
  chemically synthesized
gaagcctcatgaatgatatt

SEQ ID NO: 44813 - DNA, 20 bp, Artificial Sequence
  chemically synthesized
aagcctcatgaatgatattt

SEQ ID NO: 44814 - DNA, 20 bp, Artificial Sequence
  chemically synthesized
tgaatgatatttaggaaaaa

SEQ ID NO: 44815 - DNA, 20 bp, Artificial Sequence
  chemically synthesized
tatttaggaaaaacagactc

SEQ ID NO: 44816 - DNA, 20 bp, Artificial Sequence
  chemically synthesized
gctttgtttcagtagaacta

SEQ ID NO: 44817 - DNA, 20 bp, Artificial Sequence
  chemically synthesized
tagctttgtttcagtagaac

SEQ ID NO: 44818 - DNA, 20 bp, Artificial Sequence
  chemically synthesized
cagctctagctttgtttcag

SEQ ID NO: 44819 - DNA, 20 bp, Artificial Sequence
  chemically synthesized
actctagttctactgaaaca

SEQ ID NO: 44820 - DNA, 20 bp, Artificial Sequence
  chemically synthesized
tctcagctctagctttgttt

SEQ ID NO: 44821 - DNA, 20 bp, Artificial Sequence
  chemically synthesized
tagttctactgaaacaaagc

SEQ ID NO: 44822 - DNA, 20 bp, Artificial Sequence
  chemically synthesized
gttctactgaaacaaagcta

SEQ ID NO: 44823 - DNA, 20 bp, Artificial Sequence
  chemically synthesized
actgaaacaaagctagagct

SEQ ID NO: 44824 - DNA, 20 bp, Artificial Sequence
  chemically synthesized
tgaaacaaagctagagctga

SEQ ID NO: 44825 - DNA, 20 bp, Artificial Sequence
  chemically synthesized
cctgggaccactctcagctc

SEQ ID NO: 44826 - DNA, 20 bp, Artificial Sequence
  chemically synthesized
aacaaagctagagctgagag

SEQ ID NO: 44827 - DNA, 20 bp, Artificial Sequence
  chemically synthesized
ataatgcctgggaccactct

SEQ ID NO: 44828 - DNA, 20 bp, Artificial Sequence
  chemically synthesized
gctagagctgagagtggtcc

SEQ ID NO: 44829 - DNA, 20 bp, Artificial Sequence
  chemically synthesized
ctagagctgagagtggtccc

SEQ ID NO: 44830 - DNA, 20 bp, Artificial Sequence
  chemically synthesized
ggttgaactagataatgcct

SEQ ID NO: 44831 - DNA, 20 bp, Artificial Sequence
  chemically synthesized
aggttgaactagataatgcc

SEQ ID NO: 44832 - DNA, 20 bp, Artificial Sequence
  chemically synthesized
gagtggtcccaggcattatc

SEQ ID NO: 44833 - DNA, 20 bp, Artificial Sequence
  chemically synthesized
cctcaatgagaaggttgaac

SEQ ID NO: 44834 - DNA, 20 bp, Artificial Sequence
  chemically synthesized
tctagttcaaccttctcatt

SEQ ID NO: 44835 - DNA, 20 bp, Artificial Sequence
  chemically synthesized
ttagctcaacctcaatgaga

SEQ ID NO: 44836 - DNA, 20 bp, Artificial Sequence
  chemically synthesized
ctagttcaaccttctcattg

SEQ ID NO: 44837 - DNA, 20 bp, Artificial Sequence
  chemically synthesized
cttagctcaacctcaatgag

SEQ ID NO: 44838 - DNA, 20 bp, Artificial Sequence
  chemically synthesized
taacttagctcaacctcaat

SEQ ID NO: 44839 - DNA, 20 bp, Artificial Sequence
  chemically synthesized
tcaaccttctcattgaggtt

SEQ ID NO: 44840 - DNA, 20 bp, Artificial Sequence
  chemically synthesized
cttctcattgaggttgagct

SEQ ID NO: 44841 - DNA, 20 bp, Artificial Sequence
  chemically synthesized
atatgataaggagtataact

SEQ ID NO: 44842 - DNA, 20 bp, Artificial Sequence
  chemically synthesized
taatctaacaatatgataag

SEQ ID NO: 44843 - DNA, 20 bp, Artificial Sequence
  chemically synthesized
cttaatctaacaatatgata

SEQ ID NO: 44844 - DNA, 20 bp, Artificial Sequence
  chemically synthesized
tcttaatctaacaatatgat

SEQ ID NO: 44845 - DNA, 20 bp, Artificial Sequence
  chemically synthesized
tatactccttatcatattgt

SEQ ID NO: 44846 - DNA, 20 bp, Artificial Sequence
  chemically synthesized
ccttatcatattgttagatt

SEQ ID NO: 44847 - DNA, 20 bp, Artificial Sequence
  chemically synthesized
atcatattgttagattaaga

SEQ ID NO: 44848 - DNA, 20 bp, Artificial Sequence
  chemically synthesized
attgttagattaagatagaa

SEQ ID NO: 44849 - DNA, 20 bp, Artificial Sequence
  chemically synthesized
gattaagatagaacggaatc

SEQ ID NO: 44850 - DNA, 20 bp, Artificial Sequence
  chemically synthesized
acataccaaaacatgagttc

SEQ ID NO: 44851 - DNA, 20 bp, Artificial Sequence
  chemically synthesized
ggaatctagaactcatgttt

SEQ ID NO: 44852 - DNA, 20 bp, Artificial Sequence
  chemically synthesized
aatggtacataccaaaacat

SEQ ID NO: 44853 - DNA, 20 bp, Artificial Sequence
  chemically synthesized
ccttggcatggatgtatgaa

SEQ ID NO: 44854 - DNA, 20 bp, Artificial Sequence
  chemically synthesized
accattcatacatccatgcc

SEQ ID NO: 44855 - DNA, 20 bp, Artificial Sequence
  chemically synthesized
ccattcatacatccatgcca

SEQ ID NO: 44856 - DNA, 20 bp, Artificial Sequence
  chemically synthesized
ttaagggacagtccttggca

SEQ ID NO: 44857 - DNA, 20 bp, Artificial Sequence
  chemically synthesized
ggtgcttaagggacagtcct

SEQ ID NO: 44858 - DNA, 20 bp, Artificial Sequence
  chemically synthesized
catgccaaggactgtccctt

SEQ ID NO: 44859 - DNA, 20 bp, Artificial Sequence
  chemically synthesized
acagtttggtgcttaaggga

SEQ ID NO: 44860 - DNA, 20 bp, Artificial Sequence
  chemically synthesized
tcctacagtttggtgcttaa

SEQ ID NO: 44861 - DNA, 20 bp, Artificial Sequence
  chemically synthesized
ctcctacagtttggtgctta

SEQ ID NO: 44862 - DNA, 20 bp, Artificial Sequence
  chemically synthesized
gctcctacagtttggtgctt

SEQ ID NO: 44863 - DNA, 20 bp, Artificial Sequence
  chemically synthesized
gtcccttaagcaccaaactg

SEQ ID NO: 44864 - DNA, 20 bp, Artificial Sequence
  chemically synthesized
tcccttaagcaccaaactgt

SEQ ID NO: 44865 - DNA, 20 bp, Artificial Sequence
  chemically synthesized
ttctcatagctcctacagtt

SEQ ID NO: 44866 - DNA, 20 bp, Artificial Sequence
  chemically synthesized
ccttaagcaccaaactgtag

SEQ ID NO: 44867 - DNA, 20 bp, Artificial Sequence
  chemically synthesized
agagtttctcatagctccta

SEQ ID NO: 44868 - DNA, 20 bp, Artificial Sequence
  chemically synthesized
caccaaactgtaggagctat

SEQ ID NO: 44869 - DNA, 20 bp, Artificial Sequence
  chemically synthesized
gtgtttgatagagtttctca

SEQ ID NO: 44870 - DNA, 20 bp, Artificial Sequence
  chemically synthesized
agcatgccgagtgtttgata

SEQ ID NO: 44871 - DNA, 20 bp, Artificial Sequence
  chemically synthesized
gaagcatgccgagtgtttga

SEQ ID NO: 44872 - DNA, 20 bp, Artificial Sequence
  chemically synthesized
gagaaactctatcaaacact

SEQ ID NO: 44873 - DNA, 20 bp, Artificial Sequence
  chemically synthesized
ttagtgttaggaagcatgcc

SEQ ID NO: 44874 - DNA, 20 bp, Artificial Sequence
  chemically synthesized
acatgaactttagtgttagg

SEQ ID NO: 44875 - DNA, 20 bp, Artificial Sequence
  chemically synthesized
cggcatgcttcctaacacta

SEQ ID NO: 44876 - DNA, 20 bp, Artificial Sequence
  chemically synthesized
tagacatgaactttagtgtt

SEQ ID NO: 44877 - DNA, 20 bp, Artificial Sequence
  chemically synthesized
ctagacatgaactttagtgt

SEQ ID NO: 44878 - DNA, 20 bp, Artificial Sequence
  chemically synthesized
tgccctctagacatgaactt

SEQ ID NO: 44879 - DNA, 20 bp, Artificial Sequence
  chemically synthesized
ctaacactaaagttcatgtc

SEQ ID NO: 44880 - DNA, 20 bp, Artificial Sequence
  chemically synthesized
aacactaaagttcatgtcta

SEQ ID NO: 44881 - DNA, 20 bp, Artificial Sequence
  chemically synthesized
acactaaagttcatgtctag

SEQ ID NO: 44882 - DNA, 20 bp, Artificial Sequence
  chemically synthesized
cactaaagttcatgtctaga

SEQ ID NO: 44883 - DNA, 20 bp, Artificial Sequence
  chemically synthesized
aatccatctctcatgccctc

SEQ ID NO: 44884 - DNA, 20 bp, Artificial Sequence
  chemically synthesized
agttcatgtctagagggcat

SEQ ID NO: 44885 - DNA, 20 bp, Artificial Sequence
  chemically synthesized
ttcatgtctagagggcatga

SEQ ID NO: 44886 - DNA, 20 bp, Artificial Sequence
  chemically synthesized
tgtctagagggcatgagaga

SEQ ID NO: 44887 - DNA, 20 bp, Artificial Sequence
  chemically synthesized
agggcatgagagatggattt

SEQ ID NO: 44888 - DNA, 20 bp, Artificial Sequence
  chemically synthesized
gcatgagagatggatttgag

SEQ ID NO: 44889 - DNA, 20 bp, Artificial Sequence
  chemically synthesized
gtagtatttgtgtgtcaatt

SEQ ID NO: 44890 - DNA, 20 bp, Artificial Sequence
  chemically synthesized
aattgacacacaaatactac

SEQ ID NO: 44891 - DNA, 20 bp, Artificial Sequence
  chemically synthesized
tcaccttcaaaacaatcttg

SEQ ID NO: 44892 - DNA, 20 bp, Artificial Sequence
  chemically synthesized
aatactacaagattgttttg

SEQ ID NO: 44893 - DNA, 20 bp, Artificial Sequence
  chemically synthesized
atactacaagattgttttga

SEQ ID NO: 44894 - DNA, 20 bp, Artificial Sequence
  chemically synthesized
gattgttttgaaggtgaaat

SEQ ID NO: 44895 - DNA, 20 bp, Artificial Sequence
  chemically synthesized
gttttgaaggtgaaatgagt

SEQ ID NO: 44896 - DNA, 20 bp, Artificial Sequence
  chemically synthesized
aaatgagtcagcaaactgaa

SEQ ID NO: 44897 - DNA, 20 bp, Artificial Sequence
  chemically synthesized
cagtaattctatgtgctttt

SEQ ID NO: 44898 - DNA, 20 bp, Artificial Sequence
  chemically synthesized
tcagcaaactgaaaagcaca

SEQ ID NO: 44899 - DNA, 20 bp, Artificial Sequence
  chemically synthesized
atgaattcatgaacatatgt

SEQ ID NO: 44900 - DNA, 20 bp, Artificial Sequence
  chemically synthesized
aacaggtacttggtaaatat

SEQ ID NO: 44901 - DNA, 20 bp, Artificial Sequence
  chemically synthesized
aattcattccaatatttacc

SEQ ID NO: 44902 - DNA, 20 bp, Artificial Sequence
  chemically synthesized
cctcacagataacaggtact

SEQ ID NO: 44903 - DNA, 20 bp, Artificial Sequence
  chemically synthesized
catagtgcctcacagataac

SEQ ID NO: 44904 - DNA, 20 bp, Artificial Sequence
  chemically synthesized
gcatagtgcctcacagataa

SEQ ID NO: 44905 - DNA, 20 bp, Artificial Sequence
  chemically synthesized
accaagtacctgttatctgt

SEQ ID NO: 44906 - DNA, 20 bp, Artificial Sequence
  chemically synthesized
ccaagtacctgttatctgtg

SEQ ID NO: 44907 - DNA, 20 bp, Artificial Sequence
  chemically synthesized
ttttctagcatagtgcctca

SEQ ID NO: 44908 - DNA, 20 bp, Artificial Sequence
  chemically synthesized
ttatctgtgaggcactatgc

SEQ ID NO: 44909 - DNA, 20 bp, Artificial Sequence
  chemically synthesized
tgttatctctttttctagca

SEQ ID NO: 44910 - DNA, 20 bp, Artificial Sequence
  chemically synthesized
gtgaggcactatgctagaaa

SEQ ID NO: 44911 - DNA, 20 bp, Artificial Sequence
  chemically synthesized
gaggcactatgctagaaaaa

SEQ ID NO: 44912 - DNA, 20 bp, Artificial Sequence
  chemically synthesized
gctgttgttatctctttttc

SEQ ID NO: 44913 - DNA, 20 bp, Artificial Sequence
  chemically synthesized
gctagaaaaagagataacaa

SEQ ID NO: 44914 - DNA, 20 bp, Artificial Sequence
  chemically synthesized
gataacaacagctatcctcc

SEQ ID NO: 44915 - DNA, 20 bp, Artificial Sequence
  chemically synthesized
aataacagactccaggagga

SEQ ID NO: 44916 - DNA, 20 bp, Artificial Sequence
  chemically synthesized
taacaacagctatcctcctg

SEQ ID NO: 44917 - DNA, 20 bp, Artificial Sequence
  chemically synthesized
ctgaaataacagactccagg

SEQ ID NO: 44918 - DNA, 20 bp, Artificial Sequence
  chemically synthesized
actgaaataacagactccag

SEQ ID NO: 44919 - DNA, 20 bp, Artificial Sequence
  chemically synthesized
tgactgaaataacagactcc

SEQ ID NO: 44920 - DNA, 20 bp, Artificial Sequence
  chemically synthesized
ttgactgaaataacagactc

SEQ ID NO: 44921 - DNA, 20 bp, Artificial Sequence
  chemically synthesized
cctcctggagtctgttattt

SEQ ID NO: 44922 - DNA, 20 bp, Artificial Sequence
  chemically synthesized
tatcaccttgactgaaataa

SEQ ID NO: 44923 - DNA, 20 bp, Artificial Sequence
  chemically synthesized
tggagtctgttatttcagtc

SEQ ID NO: 44924 - DNA, 20 bp, Artificial Sequence
  chemically synthesized
ggagtctgttatttcagtca

SEQ ID NO: 44925 - DNA, 20 bp, Artificial Sequence
  chemically synthesized
tcagtcaaggtgatacaaat

SEQ ID NO: 44926 - DNA, 20 bp, Artificial Sequence
  chemically synthesized
atccttttttgtagtttcat

SEQ ID NO: 44927 - DNA, 20 bp, Artificial Sequence
  chemically synthesized
cagcttatgaaactacaaaa

SEQ ID NO: 44928 - DNA, 20 bp, Artificial Sequence
  chemically synthesized
agcttatgaaactacaaaaa

SEQ ID NO: 44929 - DNA, 20 bp, Artificial Sequence
  chemically synthesized
aaccctcacatccttttttg

SEQ ID NO: 44930 - DNA, 20 bp, Artificial Sequence
  chemically synthesized
gaaactacaaaaaaggatgt

SEQ ID NO: 44931 - DNA, 20 bp, Artificial Sequence
  chemically synthesized
aaactacaaaaaaggatgtg

SEQ ID NO: 44932 - DNA, 20 bp, Artificial Sequence
  chemically synthesized
aactacaaaaaaggatgtga

SEQ ID NO: 44933 - DNA, 20 bp, Artificial Sequence
  chemically synthesized
ggtttttttcatgaacctat

SEQ ID NO: 44934 - DNA, 20 bp, Artificial Sequence
  chemically synthesized
tgatatcatctgtgtctcat

SEQ ID NO: 44935 - DNA, 20 bp, Artificial Sequence
  chemically synthesized
tttcatgaacctatgagaca

SEQ ID NO: 44936 - DNA, 20 bp, Artificial Sequence
  chemically synthesized
ttgatatcatctgtgtctca

SEQ ID NO: 44937 - DNA, 20 bp, Artificial Sequence
  chemically synthesized
atagatcttgttgggagatg

SEQ ID NO: 44938 - DNA, 20 bp, Artificial Sequence
  chemically synthesized
caacatctacatctcccaac

SEQ ID NO: 44939 - DNA, 20 bp, Artificial Sequence
  chemically synthesized
ggttttatagatcttgttgg

SEQ ID NO: 44940 - DNA, 20 bp, Artificial Sequence
  chemically synthesized
ttggttttatagatcttgtt

SEQ ID NO: 44941 - DNA, 20 bp, Artificial Sequence
  chemically synthesized
tttggttttatagatcttgt

SEQ ID NO: 44942 - DNA, 20 bp, Artificial Sequence
  chemically synthesized
tgagtctggttttggtttta

SEQ ID NO: 44943 - DNA, 20 bp, Artificial Sequence
  chemically synthesized
aagatctataaaaccaaaac

SEQ ID NO: 44944 - DNA, 20 bp, Artificial Sequence
  chemically synthesized
cagagtgctgagtctggttt

SEQ ID NO: 44945 - DNA, 20 bp, Artificial Sequence
  chemically synthesized
tataaaaccaaaaccagact

SEQ ID NO: 44946 - DNA, 20 bp, Artificial Sequence
  chemically synthesized
gttgtgcagagtgctgagtc

SEQ ID NO: 44947 - DNA, 20 bp, Artificial Sequence
  chemically synthesized
atagtgttgtgcagagtgct

SEQ ID NO: 44948 - DNA, 20 bp, Artificial Sequence
  chemically synthesized
gggtgccatagtgttgtgca

SEQ ID NO: 44949 - DNA, 20 bp, Artificial Sequence
  chemically synthesized
aggggtgccatagtgttgtg

SEQ ID NO: 44950 - DNA, 20 bp, Artificial Sequence
  chemically synthesized
cagcactctgcacaacacta

SEQ ID NO: 44951 - DNA, 20 bp, Artificial Sequence
  chemically synthesized
agagagtgaaaggggtgcca

SEQ ID NO: 44952 - DNA, 20 bp, Artificial Sequence
  chemically synthesized
taactgaaagagagtgaaag

SEQ ID NO: 44953 - DNA, 20 bp, Artificial Sequence
  chemically synthesized
ttaactgaaagagagtgaaa

SEQ ID NO: 44954 - DNA, 20 bp, Artificial Sequence
  chemically synthesized
attaactgaaagagagtgaa

SEQ ID NO: 44955 - DNA, 20 bp, Artificial Sequence
  chemically synthesized
tattaactgaaagagagtga

SEQ ID NO: 44956 - DNA, 20 bp, Artificial Sequence
  chemically synthesized
gcacccctttcactctcttt

SEQ ID NO: 44957 - DNA, 20 bp, Artificial Sequence
  chemically synthesized
ttaagatattaactgaaaga

SEQ ID NO: 44958 - DNA, 20 bp, Artificial Sequence
  chemically synthesized
ggttaagatattaactgaaa

SEQ ID NO: 44959 - DNA, 20 bp, Artificial Sequence
  chemically synthesized
caggttaagatattaactga

SEQ ID NO: 44960 - DNA, 20 bp, Artificial Sequence
  chemically synthesized
tcatgaaaacaattcaggtt

SEQ ID NO: 44961 - DNA, 20 bp, Artificial Sequence
  chemically synthesized
tataatcatgaaaacaattc

SEQ ID NO: 44962 - DNA, 20 bp, Artificial Sequence
  chemically synthesized
atataatcatgaaaacaatt

SEQ ID NO: 44963 - DNA, 20 bp, Artificial Sequence
  chemically synthesized
aaccacaatgaaggaatagt

SEQ ID NO: 44964 - DNA, 20 bp, Artificial Sequence
  chemically synthesized
ctggaaccacaatgaaggaa

SEQ ID NO: 44965 - DNA, 20 bp, Artificial Sequence
  chemically synthesized
taccaactattccttcattg

SEQ ID NO: 44966 - DNA, 20 bp, Artificial Sequence
  chemically synthesized
aagctctggaaccacaatga

SEQ ID NO: 44967 - DNA, 20 bp, Artificial Sequence
  chemically synthesized
taagctctggaaccacaatg

SEQ ID NO: 44968 - DNA, 20 bp, Artificial Sequence
  chemically synthesized
ctattccttcattgtggttc

SEQ ID NO: 44969 - DNA, 20 bp, Artificial Sequence
  chemically synthesized
attccttcattgtggttcca

SEQ ID NO: 44970 - DNA, 20 bp, Artificial Sequence
  chemically synthesized
acctgagtctcagtaagctc

SEQ ID NO: 44971 - DNA, 20 bp, Artificial Sequence
  chemically synthesized
ttgtggttccagagcttact

SEQ ID NO: 44972 - DNA, 20 bp, Artificial Sequence
  chemically synthesized
cacgttacctgagtctcagt

SEQ ID NO: 44973 - DNA, 20 bp, Artificial Sequence
  chemically synthesized
ttccagagcttactgagact

SEQ ID NO: 44974 - DNA, 20 bp, Artificial Sequence
  chemically synthesized
tccagagcttactgagactc

SEQ ID NO: 44975 - DNA, 20 bp, Artificial Sequence
  chemically synthesized
aggtcacgttacctgagtct

SEQ ID NO: 44976 - DNA, 20 bp, Artificial Sequence
  chemically synthesized
tttcaaaggtcacgttacct

SEQ ID NO: 44977 - DNA, 20 bp, Artificial Sequence
  chemically synthesized
ctgccatttgatggtttcaa

SEQ ID NO: 44978 - DNA, 20 bp, Artificial Sequence
  chemically synthesized
tctgccatttgatggtttca

SEQ ID NO: 44979 - DNA, 20 bp, Artificial Sequence
  chemically synthesized
tgacctttgaaaccatcaaa

SEQ ID NO: 44980 - DNA, 20 bp, Artificial Sequence
  chemically synthesized
ttttctcctctgccatttga

SEQ ID NO: 44981 - DNA, 20 bp, Artificial Sequence
  chemically synthesized
cctttgaaaccatcaaatgg

SEQ ID NO: 44982 - DNA, 20 bp, Artificial Sequence
  chemically synthesized
tttgaaaccatcaaatggca

SEQ ID NO: 44983 - DNA, 20 bp, Artificial Sequence
  chemically synthesized
ttgaaaccatcaaatggcag

SEQ ID NO: 44984 - DNA, 20 bp, Artificial Sequence
  chemically synthesized
gaaaccatcaaatggcagag

SEQ ID NO: 44985 - DNA, 20 bp, Artificial Sequence
  chemically synthesized
aaatggcagaggagaaaaca

SEQ ID NO: 44986 - DNA, 20 bp, Artificial Sequence
  chemically synthesized
tggcagaggagaaaacacag

SEQ ID NO: 44987 - DNA, 20 bp, Artificial Sequence
  chemically synthesized
gcagaggagaaaacacagca

SEQ ID NO: 44988 - DNA, 20 bp, Artificial Sequence
  chemically synthesized
gaggagaaaacacagcagag

SEQ ID NO: 44989 - DNA, 20 bp, Artificial Sequence
  chemically synthesized
cagcagagaagattgacctc

SEQ ID NO: 44990 - DNA, 20 bp, Artificial Sequence
  chemically synthesized
agcagagaagattgacctct

SEQ ID NO: 44991 - DNA, 20 bp, Artificial Sequence
  chemically synthesized
agtacacaaagataacccag

SEQ ID NO: 44992 - DNA, 20 bp, Artificial Sequence
  chemically synthesized
tagtacacaaagataaccca

SEQ ID NO: 44993 - DNA, 20 bp, Artificial Sequence
  chemically synthesized
tttagtacacaaagataacc

SEQ ID NO: 44994 - DNA, 20 bp, Artificial Sequence
  chemically synthesized
tcaaaaggctttagtacaca

SEQ ID NO: 44995 - DNA, 20 bp, Artificial Sequence
  chemically synthesized
tgggttatctttgtgtacta

SEQ ID NO: 44996 - DNA, 20 bp, Artificial Sequence
  chemically synthesized
tctgacttttcaaaaggctt

SEQ ID NO: 44997 - DNA, 20 bp, Artificial Sequence
  chemically synthesized
gtgtactaaagccttttgaa

SEQ ID NO: 44998 - DNA, 20 bp, Artificial Sequence
  chemically synthesized
tgatgctctgacttttcaaa

SEQ ID NO: 44999 - DNA, 20 bp, Artificial Sequence
  chemically synthesized
ctgatgctctgacttttcaa

SEQ ID NO: 45000 - DNA, 20 bp, Artificial Sequence
  chemically synthesized
actaaagccttttgaaaagt

SEQ ID NO: 45001 - DNA, 20 bp, Artificial Sequence
  chemically synthesized
taaagccttttgaaaagtca

SEQ ID NO: 45002 - DNA, 20 bp, Artificial Sequence
  chemically synthesized
cttttgaaaagtcagagcat

SEQ ID NO: 45003 - DNA, 20 bp, Artificial Sequence
  chemically synthesized
ttttgaaaagtcagagcatc

SEQ ID NO: 45004 - DNA, 20 bp, Artificial Sequence
  chemically synthesized
aagtcagagcatcaggcttt

SEQ ID NO: 45005 - DNA, 20 bp, Artificial Sequence
  chemically synthesized
tcagagcatcaggcttttgg

SEQ ID NO: 45006 - DNA, 20 bp, Artificial Sequence
  chemically synthesized
atttttgaaatcactgccaa

SEQ ID NO: 45007 - DNA, 20 bp, Artificial Sequence
  chemically synthesized
ggatgctggtgaatgattcg

SEQ ID NO: 45008 - DNA, 20 bp, Artificial Sequence
  chemically synthesized
aggatgctggtgaatgattc

SEQ ID NO: 45009 - DNA, 20 bp, Artificial Sequence
  chemically synthesized
gaggatgctggtgaatgatt

SEQ ID NO: 45010 - DNA, 20 bp, Artificial Sequence
  chemically synthesized
aattaccccgaatcattcac

SEQ ID NO: 45011 - DNA, 20 bp, Artificial Sequence
  chemically synthesized
ctgtcagtctttgaggatgc

SEQ ID NO: 45012 - DNA, 20 bp, Artificial Sequence
  chemically synthesized
atcattcaccagcatcctca

SEQ ID NO: 45013 - DNA, 20 bp, Artificial Sequence
  chemically synthesized
atttgatctgtcagtctttg

SEQ ID NO: 45014 - DNA, 20 bp, Artificial Sequence
  chemically synthesized
aatttgatctgtcagtcttt

SEQ ID NO: 45015 - DNA, 20 bp, Artificial Sequence
  chemically synthesized
ccagcatcctcaaagactga

SEQ ID NO: 45016 - DNA, 20 bp, Artificial Sequence
  chemically synthesized
agctgtctaatttgatctgt

SEQ ID NO: 45017 - DNA, 20 bp, Artificial Sequence
  chemically synthesized
caaagactgacagatcaaat

SEQ ID NO: 45018 - DNA, 20 bp, Artificial Sequence
  chemically synthesized
gactgacagatcaaattaga

SEQ ID NO: 45019 - DNA, 20 bp, Artificial Sequence
  chemically synthesized
aagtggatgcaacagagaat

SEQ ID NO: 45020 - DNA, 20 bp, Artificial Sequence
  chemically synthesized
gataagaagtggatgcaaca

SEQ ID NO: 45021 - DNA, 20 bp, Artificial Sequence
  chemically synthesized
atgataagaagtggatgcaa

SEQ ID NO: 45022 - DNA, 20 bp, Artificial Sequence
  chemically synthesized
gcactattgatgataagaag

SEQ ID NO: 45023 - DNA, 20 bp, Artificial Sequence
  chemically synthesized
ttagcactattgatgataag

SEQ ID NO: 45024 - DNA, 20 bp, Artificial Sequence
  chemically synthesized
tatttagcactattgatgat

SEQ ID NO: 45025 - DNA, 20 bp, Artificial Sequence
  chemically synthesized
catccacttcttatcatcaa

SEQ ID NO: 45026 - DNA, 20 bp, Artificial Sequence
  chemically synthesized
ttatcatcaatagtgctaaa

SEQ ID NO: 45027 - DNA, 20 bp, Artificial Sequence
  chemically synthesized
atcaatagtgctaaatagtt

SEQ ID NO: 45028 - DNA, 20 bp, Artificial Sequence
  chemically synthesized
aaatgtttcacttaactatt

SEQ ID NO: 45029 - DNA, 20 bp, Artificial Sequence
  chemically synthesized
tcaatcttatcgggatagaa

SEQ ID NO: 45030 - DNA, 20 bp, Artificial Sequence
  chemically synthesized
atcaatcttatcgggataga

SEQ ID NO: 45031 - DNA, 20 bp, Artificial Sequence
  chemically synthesized
tttgtcctttctatcccgat

SEQ ID NO: 45032 - DNA, 20 bp, Artificial Sequence
  chemically synthesized
caccatcaatcttatcggga

SEQ ID NO: 45033 - DNA, 20 bp, Artificial Sequence
  chemically synthesized
attgcaccatcaatcttatc

SEQ ID NO: 45034 - DNA, 20 bp, Artificial Sequence
  chemically synthesized
tattgcaccatcaatcttat

SEQ ID NO: 45035 - DNA, 20 bp, Artificial Sequence
  chemically synthesized
ttctatcccgataagattga

SEQ ID NO: 45036 - DNA, 20 bp, Artificial Sequence
  chemically synthesized
gataagattgatggtgcaat

SEQ ID NO: 45037 - DNA, 20 bp, Artificial Sequence
  chemically synthesized
atggtgcaataagaatcctc

SEQ ID NO: 45038 - DNA, 20 bp, Artificial Sequence
  chemically synthesized
tggtgcaataagaatcctca

SEQ ID NO: 45039 - DNA, 20 bp, Artificial Sequence
  chemically synthesized
ggtgcaataagaatcctcaa

SEQ ID NO: 45040 - DNA, 20 bp, Artificial Sequence
  chemically synthesized
gaatcttcatattgcccttg

SEQ ID NO: 45041 - DNA, 20 bp, Artificial Sequence
  chemically synthesized
tgaatcttcatattgccctt

SEQ ID NO: 45042 - DNA, 20 bp, Artificial Sequence
  chemically synthesized
gaatcctcaagggcaatatg

SEQ ID NO: 45043 - DNA, 20 bp, Artificial Sequence
  chemically synthesized
aagattcattttcacttctc

SEQ ID NO: 45044 - DNA, 20 bp, Artificial Sequence
  chemically synthesized
tttgtgatcattttccagag

SEQ ID NO: 45045 - DNA, 20 bp, Artificial Sequence
  chemically synthesized
ttgtttgtgatcattttcca

SEQ ID NO: 45046 - DNA, 20 bp, Artificial Sequence
  chemically synthesized
aattgtttgtgatcattttc

SEQ ID NO: 45047 - DNA, 20 bp, Artificial Sequence
  chemically synthesized
cacaaacaatttctatttcg

SEQ ID NO: 45048 - DNA, 20 bp, Artificial Sequence
  chemically synthesized
tgtgaatgttgacttcgaaa

SEQ ID NO: 45049 - DNA, 20 bp, Artificial Sequence
  chemically synthesized
gaagtcaacattcacaaaat

SEQ ID NO: 45050 - DNA, 20 bp, Artificial Sequence
  chemically synthesized
ttcacaaaatcagaaaatgt

SEQ ID NO: 45051 - DNA, 20 bp, Artificial Sequence
  chemically synthesized
aaatcagaaaatgttagtac

SEQ ID NO: 45052 - DNA, 20 bp, Artificial Sequence
  chemically synthesized
atgatatcataggtcatttc

SEQ ID NO: 45053 - DNA, 20 bp, Artificial Sequence
  chemically synthesized
gcagaatgacatgatatcat

SEQ ID NO: 45054 - DNA, 20 bp, Artificial Sequence
  chemically synthesized
agcagaatgacatgatatca

SEQ ID NO: 45055 - DNA, 20 bp, Artificial Sequence
  chemically synthesized
ccctctgtcatttaaggaag

SEQ ID NO: 45056 - DNA, 20 bp, Artificial Sequence
  chemically synthesized
tctccctctgtcatttaagg

SEQ ID NO: 45057 - DNA, 20 bp, Artificial Sequence
  chemically synthesized
cattctgcttccttaaatga

SEQ ID NO: 45058 - DNA, 20 bp, Artificial Sequence
  chemically synthesized
gtttctccctctgtcattta

SEQ ID NO: 45059 - DNA, 20 bp, Artificial Sequence
  chemically synthesized
agtttctccctctgtcattt

SEQ ID NO: 45060 - DNA, 20 bp, Artificial Sequence
  chemically synthesized
ttctgcttccttaaatgaca

SEQ ID NO: 45061 - DNA, 20 bp, Artificial Sequence
  chemically synthesized
tctgcttccttaaatgacag

SEQ ID NO: 45062 - DNA, 20 bp, Artificial Sequence
  chemically synthesized
ctgcttccttaaatgacaga

SEQ ID NO: 45063 - DNA, 20 bp, Artificial Sequence
  chemically synthesized
gcttccttaaatgacagagg

SEQ ID NO: 45064 - DNA, 20 bp, Artificial Sequence
  chemically synthesized
aaatgacagagggagaaact

SEQ ID NO: 45065 - DNA, 20 bp, Artificial Sequence
  chemically synthesized
aatgacagagggagaaactg

SEQ ID NO: 45066 - DNA, 20 bp, Artificial Sequence
  chemically synthesized
gagggagaaactgaggccca

SEQ ID NO: 45067 - DNA, 20 bp, Artificial Sequence
  chemically synthesized
tgcttattttctgtgggcct

SEQ ID NO: 45068 - DNA, 20 bp, Artificial Sequence
  chemically synthesized
ggaaattgcttattttctgt

SEQ ID NO: 45069 - DNA, 20 bp, Artificial Sequence
  chemically synthesized
gggaaattgcttattttctg

SEQ ID NO: 45070 - DNA, 20 bp, Artificial Sequence
  chemically synthesized
aactgaggcccacagaaaat

SEQ ID NO: 45071 - DNA, 20 bp, Artificial Sequence
  chemically synthesized
gaaaataagcaatttcccat

SEQ ID NO: 45072 - DNA, 20 bp, Artificial Sequence
  chemically synthesized
taagcaatttcccattggtc

SEQ ID NO: 45073 - DNA, 20 bp, Artificial Sequence
  chemically synthesized
gctattaatacttgaccaat

SEQ ID NO: 45074 - DNA, 20 bp, Artificial Sequence
  chemically synthesized
agctattaatacttgaccaa

SEQ ID NO: 45075 - DNA, 20 bp, Artificial Sequence
  chemically synthesized
tcccattggtcaagtattaa

SEQ ID NO: 45076 - DNA, 20 bp, Artificial Sequence
  chemically synthesized
attggtcaagtattaatagc

SEQ ID NO: 45077 - DNA, 20 bp, Artificial Sequence
  chemically synthesized
ttggtcaagtattaatagct

SEQ ID NO: 45078 - DNA, 20 bp, Artificial Sequence
  chemically synthesized
aagtattaatagctaggtga

SEQ ID NO: 45079 - DNA, 20 bp, Artificial Sequence
  chemically synthesized
gttccagctttactgtcacc

SEQ ID NO: 45080 - DNA, 20 bp, Artificial Sequence
  chemically synthesized
ttaatagctaggtgacagta

SEQ ID NO: 45081 - DNA, 20 bp, Artificial Sequence
  chemically synthesized
tagctaggtgacagtaaagc

SEQ ID NO: 45082 - DNA, 20 bp, Artificial Sequence
  chemically synthesized
ggtgacagtaaagctggaac

SEQ ID NO: 45083 - DNA, 20 bp, Artificial Sequence
  chemically synthesized
caagacttgaattctagttc

SEQ ID NO: 45084 - DNA, 20 bp, Artificial Sequence
  chemically synthesized
taaagctggaactagaattc

SEQ ID NO: 45085 - DNA, 20 bp, Artificial Sequence
  chemically synthesized
gcatcgcaagacttgaattc

SEQ ID NO: 45086 - DNA, 20 bp, Artificial Sequence
  chemically synthesized
ttaaataggctaggcatcgc

SEQ ID NO: 45087 - DNA, 20 bp, Artificial Sequence
  chemically synthesized
aattcaagtcttgcgatgcc

SEQ ID NO: 45088 - DNA, 20 bp, Artificial Sequence
  chemically synthesized
ggggaaattttaaataggct

SEQ ID NO: 45089 - DNA, 20 bp, Artificial Sequence
  chemically synthesized
aggggaaattttaaataggc

SEQ ID NO: 45090 - DNA, 20 bp, Artificial Sequence
  chemically synthesized
aaataggggaaattttaaat

SEQ ID NO: 45091 - DNA, 20 bp, Artificial Sequence
  chemically synthesized
taaataggggaaattttaaa

SEQ ID NO: 45092 - DNA, 20 bp, Artificial Sequence
  chemically synthesized
gctaagacaacattaaatag

SEQ ID NO: 45093 - DNA, 20 bp, Artificial Sequence
  chemically synthesized
agctaagacaacattaaata

SEQ ID NO: 45094 - DNA, 20 bp, Artificial Sequence
  chemically synthesized
cagctaagacaacattaaat

SEQ ID NO: 45095 - DNA, 20 bp, Artificial Sequence
  chemically synthesized
gcagctaagacaacattaaa

SEQ ID NO: 45096 - DNA, 20 bp, Artificial Sequence
  chemically synthesized
tcccctatttaatgttgtct

SEQ ID NO: 45097 - DNA, 20 bp, Artificial Sequence
  chemically synthesized
aaatataccttttagcagct

SEQ ID NO: 45098 - DNA, 20 bp, Artificial Sequence
  chemically synthesized
aatgttgtcttagctgctaa

SEQ ID NO: 45099 - DNA, 20 bp, Artificial Sequence
  chemically synthesized
atgttgtcttagctgctaaa

SEQ ID NO: 45100 - DNA, 20 bp, Artificial Sequence
  chemically synthesized
cttcaaaatataccttttag

SEQ ID NO: 45101 - DNA, 20 bp, Artificial Sequence
  chemically synthesized
tttcttcaaaatataccttt

SEQ ID NO: 45102 - DNA, 20 bp, Artificial Sequence
  chemically synthesized
ctgctaaaaggtatattttg

SEQ ID NO: 45103 - DNA, 20 bp, Artificial Sequence
  chemically synthesized
ttttgaagaaaaatatacat

SEQ ID NO: 45104 - DNA, 20 bp, Artificial Sequence
  chemically synthesized
tgaagaaaaatatacataag

SEQ ID NO: 45105 - DNA, 20 bp, Artificial Sequence
  chemically synthesized
gaagaaaaatatacataaga

SEQ ID NO: 45106 - DNA, 20 bp, Artificial Sequence
  chemically synthesized
atacataagaaggatcttac

SEQ ID NO: 45107 - DNA, 20 bp, Artificial Sequence
  chemically synthesized
aattttgtgctatttctggt

SEQ ID NO: 45108 - DNA, 20 bp, Artificial Sequence
  chemically synthesized
aagaaggatcttaccagaaa

SEQ ID NO: 45109 - DNA, 20 bp, Artificial Sequence
  chemically synthesized
atataattttgtgctatttc

SEQ ID NO: 45110 - DNA, 20 bp, Artificial Sequence
  chemically synthesized
tacaatgtgaacacatcatg

SEQ ID NO: 45111 - DNA, 20 bp, Artificial Sequence
  chemically synthesized
gatgtgttcacattgtatga

SEQ ID NO: 45112 - DNA, 20 bp, Artificial Sequence
  chemically synthesized
ctgacattgggtttgaaaat

SEQ ID NO: 45113 - DNA, 20 bp, Artificial Sequence
  chemically synthesized
ctgattttcaaacccaatgt

SEQ ID NO: 45114 - DNA, 20 bp, Artificial Sequence
  chemically synthesized
gatacaagtcttctgacatt

SEQ ID NO: 45115 - DNA, 20 bp, Artificial Sequence
  chemically synthesized
attttcaaacccaatgtcag

SEQ ID NO: 45116 - DNA, 20 bp, Artificial Sequence
  chemically synthesized
tgatacaagtcttctgacat

SEQ ID NO: 45117 - DNA, 20 bp, Artificial Sequence
  chemically synthesized
cactcttctaagaatgatac

SEQ ID NO: 45118 - DNA, 20 bp, Artificial Sequence
  chemically synthesized
cagaagacttgtatcattct

SEQ ID NO: 45119 - DNA, 20 bp, Artificial Sequence
  chemically synthesized
aagacttgtatcattcttag

SEQ ID NO: 45120 - DNA, 20 bp, Artificial Sequence
  chemically synthesized
gacttgtatcattcttagaa

SEQ ID NO: 45121 - DNA, 20 bp, Artificial Sequence
  chemically synthesized
tccagacacctcactcttct

SEQ ID NO: 45122 - DNA, 20 bp, Artificial Sequence
  chemically synthesized
tgtatcattcttagaagagt

SEQ ID NO: 45123 - DNA, 20 bp, Artificial Sequence
  chemically synthesized
gtatcattcttagaagagtg

SEQ ID NO: 45124 - DNA, 20 bp, Artificial Sequence
  chemically synthesized
tcttagaagagtgaggtgtc

SEQ ID NO: 45125 - DNA, 20 bp, Artificial Sequence
  chemically synthesized
aagagtgaggtgtctggaat

SEQ ID NO: 45126 - DNA, 20 bp, Artificial Sequence
  chemically synthesized
aatttcctcatttcttattc

SEQ ID NO: 45127 - DNA, 20 bp, Artificial Sequence
  chemically synthesized
aggtgtctggaataagaaat

SEQ ID NO: 45128 - DNA, 20 bp, Artificial Sequence
  chemically synthesized
ggtgtctggaataagaaatg

SEQ ID NO: 45129 - DNA, 20 bp, Artificial Sequence
  chemically synthesized
tttttttttttttttttttt

SEQ ID NO: 45130 - DNA, 20 bp, Artificial Sequence
  chemically synthesized
tttttttttttttttttttg

SEQ ID NO: 45131 - DNA, 20 bp, Artificial Sequence
  chemically synthesized
ttttttttttttttttgagg

SEQ ID NO: 45132 - DNA, 20 bp, Artificial Sequence
  chemically synthesized
ttttttttttttttgaggca

SEQ ID NO: 45133 - DNA, 20 bp, Artificial Sequence
  chemically synthesized
tccagcctgggtgacagagc

SEQ ID NO: 45134 - DNA, 20 bp, Artificial Sequence
  chemically synthesized
cagagtcttgctctgtcacc

SEQ ID NO: 45135 - DNA, 20 bp, Artificial Sequence
  chemically synthesized
gcactccagcctgggtgaca

SEQ ID NO: 45136 - DNA, 20 bp, Artificial Sequence
  chemically synthesized
agagtcttgctctgtcaccc

SEQ ID NO: 45137 - DNA, 20 bp, Artificial Sequence
  chemically synthesized
ctgcactccagcctgggtga

SEQ ID NO: 45138 - DNA, 20 bp, Artificial Sequence
  chemically synthesized
tcttgctctgtcacccaggc

SEQ ID NO: 45139 - DNA, 20 bp, Artificial Sequence
  chemically synthesized
ttgctctgtcacccaggctg

SEQ ID NO: 45140 - DNA, 20 bp, Artificial Sequence
  chemically synthesized
gcgccactgcactccagcct

SEQ ID NO: 45141 - DNA, 20 bp, Artificial Sequence
  chemically synthesized
cgcgccactgcactccagcc

SEQ ID NO: 45142 - DNA, 20 bp, Artificial Sequence
  chemically synthesized
ctgtcacccaggctggagtg

SEQ ID NO: 45143 - DNA, 20 bp, Artificial Sequence
  chemically synthesized
gagatcgcgccactgcactc

SEQ ID NO: 45144 - DNA, 20 bp, Artificial Sequence
  chemically synthesized
tcacccaggctggagtgcag

SEQ ID NO: 45145 - DNA, 20 bp, Artificial Sequence
  chemically synthesized
aagcggagcatgcagtggac

SEQ ID NO: 45146 - DNA, 20 bp, Artificial Sequence
  chemically synthesized
ccgggaagcggagcatgcag

SEQ ID NO: 45147 - DNA, 20 bp, Artificial Sequence
  chemically synthesized
aacccgggaagcggagcatg

SEQ ID NO: 45148 - DNA, 20 bp, Artificial Sequence
  chemically synthesized
ccactgcatgctccgcttcc

SEQ ID NO: 45149 - DNA, 20 bp, Artificial Sequence
  chemically synthesized
tggcgtaaacccgggaagcg

SEQ ID NO: 45150 - DNA, 20 bp, Artificial Sequence
  chemically synthesized
cactgcatgctccgcttccc

SEQ ID NO: 45151 - DNA, 20 bp, Artificial Sequence
  chemically synthesized
aatggcgtaaacccgggaag

SEQ ID NO: 45152 - DNA, 20 bp, Artificial Sequence
  chemically synthesized
gagaatggcgtaaacccggg

SEQ ID NO: 45153 - DNA, 20 bp, Artificial Sequence
  chemically synthesized
caggagaatggcgtaaaccc

SEQ ID NO: 45154 - DNA, 20 bp, Artificial Sequence
  chemically synthesized
gcaggagaatggcgtaaacc

SEQ ID NO: 45155 - DNA, 20 bp, Artificial Sequence
  chemically synthesized
gggaggctgaggcaggagaa

SEQ ID NO: 45156 - DNA, 20 bp, Artificial Sequence
  chemically synthesized
tttacgccattctcctgcct

SEQ ID NO: 45157 - DNA, 20 bp, Artificial Sequence
  chemically synthesized
tacttgggaggctgaggcag

SEQ ID NO: 45158 - DNA, 20 bp, Artificial Sequence
  chemically synthesized
gctacttgggaggctgaggc

SEQ ID NO: 45159 - DNA, 20 bp, Artificial Sequence
  chemically synthesized
agctacttgggaggctgagg

SEQ ID NO: 45160 - DNA, 20 bp, Artificial Sequence
  chemically synthesized
cccagctacttgggaggctg

SEQ ID NO: 45161 - DNA, 20 bp, Artificial Sequence
  chemically synthesized
tcccagctacttgggaggct

SEQ ID NO: 45162 - DNA, 20 bp, Artificial Sequence
  chemically synthesized
ttctcctgcctcagcctccc

SEQ ID NO: 45163 - DNA, 20 bp, Artificial Sequence
  chemically synthesized
tcctgcctcagcctcccaag

SEQ ID NO: 45164 - DNA, 20 bp, Artificial Sequence
  chemically synthesized
tgtagtcccagctacttggg

SEQ ID NO: 45165 - DNA, 20 bp, Artificial Sequence
  chemically synthesized
ctgtagtcccagctacttgg

SEQ ID NO: 45166 - DNA, 20 bp, Artificial Sequence
  chemically synthesized
gcctcagcctcccaagtagc

SEQ ID NO: 45167 - DNA, 20 bp, Artificial Sequence
  chemically synthesized
gcctgtagtcccagctactt

SEQ ID NO: 45168 - DNA, 20 bp, Artificial Sequence
  chemically synthesized
cctcagcctcccaagtagct

SEQ ID NO: 45169 - DNA, 20 bp, Artificial Sequence
  chemically synthesized
cgcctgtagtcccagctact

SEQ ID NO: 45170 - DNA, 20 bp, Artificial Sequence
  chemically synthesized
ctcccaagtagctgggacta

SEQ ID NO: 45171 - DNA, 20 bp, Artificial Sequence
  chemically synthesized
tcccaagtagctgggactac

SEQ ID NO: 45172 - DNA, 20 bp, Artificial Sequence
  chemically synthesized
gtggcgggcgcctgtagtcc

SEQ ID NO: 45173 - DNA, 20 bp, Artificial Sequence
  chemically synthesized
ggcgtggtggcgggcgcctg

SEQ ID NO: 45174 - DNA, 20 bp, Artificial Sequence
  chemically synthesized
aattagctgggcgtggtggc

SEQ ID NO: 45175 - DNA, 20 bp, Artificial Sequence
  chemically synthesized
aaattagctgggcgtggtgg

SEQ ID NO: 45176 - DNA, 20 bp, Artificial Sequence
  chemically synthesized
caggcgcccgccaccacgcc

SEQ ID NO: 45177 - DNA, 20 bp, Artificial Sequence
  chemically synthesized
aaaaaattagctgggcgtgg

SEQ ID NO: 45178 - DNA, 20 bp, Artificial Sequence
  chemically synthesized
tacaaaaaattagctgggcg

SEQ ID NO: 45179 - DNA, 20 bp, Artificial Sequence
  chemically synthesized
aaaaatacaaaaaattagct

SEQ ID NO: 45180 - DNA, 20 bp, Artificial Sequence
  chemically synthesized
taaaaatacaaaaaattagc

SEQ ID NO: 45181 - DNA, 20 bp, Artificial Sequence
  chemically synthesized
ctactaaaaatacaaaaaat

SEQ ID NO: 45182 - DNA, 20 bp, Artificial Sequence
  chemically synthesized
cagctaattttttgtatttt

SEQ ID NO: 45183 - DNA, 20 bp, Artificial Sequence
  chemically synthesized
ctaattttttgtatttttag

SEQ ID NO: 45184 - DNA, 20 bp, Artificial Sequence
  chemically synthesized
aattttttgtatttttagta

SEQ ID NO: 45185 - DNA, 20 bp, Artificial Sequence
  chemically synthesized
ttttgtatttttagtagaga

SEQ ID NO: 45186 - DNA, 20 bp, Artificial Sequence
  chemically synthesized
tttgtatttttagtagagac

SEQ ID NO: 45187 - DNA, 20 bp, Artificial Sequence
  chemically synthesized
ttgtatttttagtagagacg

SEQ ID NO: 45188 - DNA, 20 bp, Artificial Sequence
  chemically synthesized
gagacggggtttcaccatgt

SEQ ID NO: 45189 - DNA, 20 bp, Artificial Sequence
  chemically synthesized
cggggtttcaccatgttagc

SEQ ID NO: 45190 - DNA, 20 bp, Artificial Sequence
  chemically synthesized
ggagaccatcctggctaaca

SEQ ID NO: 45191 - DNA, 20 bp, Artificial Sequence
  chemically synthesized
ggggtttcaccatgttagcc

SEQ ID NO: 45192 - DNA, 20 bp, Artificial Sequence
  chemically synthesized
tttcaccatgttagccagga

SEQ ID NO: 45193 - DNA, 20 bp, Artificial Sequence
  chemically synthesized
tcaggagatggagaccatcc

SEQ ID NO: 45194 - DNA, 20 bp, Artificial Sequence
  chemically synthesized
gatcacgaggtcaggagatg

SEQ ID NO: 45195 - DNA, 20 bp, Artificial Sequence
  chemically synthesized
cagatcacgaggtcaggaga

SEQ ID NO: 45196 - DNA, 20 bp, Artificial Sequence
  chemically synthesized
caggcagatcacgaggtcag

SEQ ID NO: 45197 - DNA, 20 bp, Artificial Sequence
  chemically synthesized
ggcaggcagatcacgaggtc

SEQ ID NO: 45198 - DNA, 20 bp, Artificial Sequence
  chemically synthesized
aggcaggcagatcacgaggt

SEQ ID NO: 45199 - DNA, 20 bp, Artificial Sequence
  chemically synthesized
gctgaggcaggcagatcacg

SEQ ID NO: 45200 - DNA, 20 bp, Artificial Sequence
  chemically synthesized
ggctgaggcaggcagatcac

SEQ ID NO: 45201 - DNA, 20 bp, Artificial Sequence
  chemically synthesized
acctcgtgatctgcctgcct

SEQ ID NO: 45202 - DNA, 20 bp, Artificial Sequence
  chemically synthesized
ctttgggaggctgaggcagg

SEQ ID NO: 45203 - DNA, 20 bp, Artificial Sequence
  chemically synthesized
gcactttgggaggctgaggc

SEQ ID NO: 45204 - DNA, 20 bp, Artificial Sequence
  chemically synthesized
agcactttgggaggctgagg

SEQ ID NO: 45205 - DNA, 20 bp, Artificial Sequence
  chemically synthesized
cccagcactttgggaggctg

SEQ ID NO: 45206 - DNA, 20 bp, Artificial Sequence
  chemically synthesized
tcccagcactttgggaggct

SEQ ID NO: 45207 - DNA, 20 bp, Artificial Sequence
  chemically synthesized
ctgcctgcctcagcctccca

SEQ ID NO: 45208 - DNA, 20 bp, Artificial Sequence
  chemically synthesized
tgtaatcccagcactttggg

SEQ ID NO: 45209 - DNA, 20 bp, Artificial Sequence
  chemically synthesized
ctgtaatcccagcactttgg

SEQ ID NO: 45210 - DNA, 20 bp, Artificial Sequence
  chemically synthesized
gcctcagcctcccaaagtgc

SEQ ID NO: 45211 - DNA, 20 bp, Artificial Sequence
  chemically synthesized
gcctgtaatcccagcacttt

SEQ ID NO: 45212 - DNA, 20 bp, Artificial Sequence
  chemically synthesized
cctcagcctcccaaagtgct

SEQ ID NO: 45213 - DNA, 20 bp, Artificial Sequence
  chemically synthesized
cgcctgtaatcccagcactt

SEQ ID NO: 45214 - DNA, 20 bp, Artificial Sequence
  chemically synthesized
ctcccaaagtgctgggatta

SEQ ID NO: 45215 - DNA, 20 bp, Artificial Sequence
  chemically synthesized
tcccaaagtgctgggattac

SEQ ID NO: 45216 - DNA, 20 bp, Artificial Sequence
  chemically synthesized
gtggctcacgcctgtaatcc

SEQ ID NO: 45217 - DNA, 20 bp, Artificial Sequence
  chemically synthesized
agtgctgggattacaggcgt

SEQ ID NO: 45218 - DNA, 20 bp, Artificial Sequence
  chemically synthesized
caggcgtgagccaccgcacc

SEQ ID NO: 45219 - DNA, 20 bp, Artificial Sequence
  chemically synthesized
tttcctcaggccgggtgcgg

SEQ ID NO: 45220 - DNA, 20 bp, Artificial Sequence
  chemically synthesized
acatttcctcaggccgggtg

SEQ ID NO: 45221 - DNA, 20 bp, Artificial Sequence
  chemically synthesized
tgagccaccgcacccggcct

SEQ ID NO: 45222 - DNA, 20 bp, Artificial Sequence
  chemically synthesized
gagccaccgcacccggcctg

SEQ ID NO: 45223 - DNA, 20 bp, Artificial Sequence
  chemically synthesized
agaaaacatttcctcaggcc

SEQ ID NO: 45224 - DNA, 20 bp, Artificial Sequence
  chemically synthesized
tagaaaacatttcctcaggc

SEQ ID NO: 45225 - DNA, 20 bp, Artificial Sequence
  chemically synthesized
aacatagaaaacatttcctc

SEQ ID NO: 45226 - DNA, 20 bp, Artificial Sequence
  chemically synthesized
caacatagaaaacatttcct

SEQ ID NO: 45227 - DNA, 20 bp, Artificial Sequence
  chemically synthesized
actggagtatgatatcaaca

SEQ ID NO: 45228 - DNA, 20 bp, Artificial Sequence
  chemically synthesized
tctatgttgatatcatactc

SEQ ID NO: 45229 - DNA, 20 bp, Artificial Sequence
  chemically synthesized
ctcttattataaagaaactg

SEQ ID NO: 45230 - DNA, 20 bp, Artificial Sequence
  chemically synthesized
ggctcttattataaagaaac

SEQ ID NO: 45231 - DNA, 20 bp, Artificial Sequence
  chemically synthesized
tactccagtttctttataat

SEQ ID NO: 45232 - DNA, 20 bp, Artificial Sequence
  chemically synthesized
tgagatgggctcttattata

SEQ ID NO: 45233 - DNA, 20 bp, Artificial Sequence
  chemically synthesized
ctccagtttctttataataa

SEQ ID NO: 45234 - DNA, 20 bp, Artificial Sequence
  chemically synthesized
acgtcttctgacaatgagat

SEQ ID NO: 45235 - DNA, 20 bp, Artificial Sequence
  chemically synthesized
cacgtcttctgacaatgaga

SEQ ID NO: 45236 - DNA, 20 bp, Artificial Sequence
  chemically synthesized
ataagagcccatctcattgt

SEQ ID NO: 45237 - DNA, 20 bp, Artificial Sequence
  chemically synthesized
tagacacgtcttctgacaat

SEQ ID NO: 45238 - DNA, 20 bp, Artificial Sequence
  chemically synthesized
agagcccatctcattgtcag

SEQ ID NO: 45239 - DNA, 20 bp, Artificial Sequence
  chemically synthesized
ctgtgttggctggtttgcag

SEQ ID NO: 45240 - DNA, 20 bp, Artificial Sequence
  chemically synthesized
aagacgtgtctactgcaaac

SEQ ID NO: 45241 - DNA, 20 bp, Artificial Sequence
  chemically synthesized
tccctgtgttggctggtttg

SEQ ID NO: 45242 - DNA, 20 bp, Artificial Sequence
  chemically synthesized
ctactgcaaaccagccaaca

SEQ ID NO: 45243 - DNA, 20 bp, Artificial Sequence
  chemically synthesized
ttaaatatccctgtgttggc

SEQ ID NO: 45244 - DNA, 20 bp, Artificial Sequence
  chemically synthesized
tactgcaaaccagccaacac

SEQ ID NO: 45245 - DNA, 20 bp, Artificial Sequence
  chemically synthesized
actgcaaaccagccaacaca

SEQ ID NO: 45246 - DNA, 20 bp, Artificial Sequence
  chemically synthesized
cgtgttaaatatccctgtgt

SEQ ID NO: 45247 - DNA, 20 bp, Artificial Sequence
  chemically synthesized
ttaacacgttgattgctgtt

SEQ ID NO: 45248 - DNA, 20 bp, Artificial Sequence
  chemically synthesized
taacacgttgattgctgtta

SEQ ID NO: 45249 - DNA, 20 bp, Artificial Sequence
  chemically synthesized
taactacatcttagccttaa

SEQ ID NO: 45250 - DNA, 20 bp, Artificial Sequence
  chemically synthesized
cgttgattgctgttaaggct

SEQ ID NO: 45251 - DNA, 20 bp, Artificial Sequence
  chemically synthesized
ttgctgttaaggctaagatg

SEQ ID NO: 45252 - DNA, 20 bp, Artificial Sequence
  chemically synthesized
agcagtgcctaactacatct

SEQ ID NO: 45253 - DNA, 20 bp, Artificial Sequence
  chemically synthesized
tgttaaggctaagatgtagt

SEQ ID NO: 45254 - DNA, 20 bp, Artificial Sequence
  chemically synthesized
gttaaggctaagatgtagtt

SEQ ID NO: 45255 - DNA, 20 bp, Artificial Sequence
  chemically synthesized
gtatttatatacagagggag

SEQ ID NO: 45256 - DNA, 20 bp, Artificial Sequence
  chemically synthesized
cctgtatttatatacagagg

SEQ ID NO: 45257 - DNA, 20 bp, Artificial Sequence
  chemically synthesized
tacctgtatttatatacaga

SEQ ID NO: 45258 - DNA, 20 bp, Artificial Sequence
  chemically synthesized
gtacctgtatttatatacag

SEQ ID NO: 45259 - DNA, 20 bp, Artificial Sequence
  chemically synthesized
agtacctgtatttatataca

SEQ ID NO: 45260 - DNA, 20 bp, Artificial Sequence
  chemically synthesized
tcagtacctgtatttatata

SEQ ID NO: 45261 - DNA, 20 bp, Artificial Sequence
  chemically synthesized
gctccctctgtatataaata

SEQ ID NO: 45262 - DNA, 20 bp, Artificial Sequence
  chemically synthesized
ctccctctgtatataaatac

SEQ ID NO: 45263 - DNA, 20 bp, Artificial Sequence
  chemically synthesized
tataaatacaggtactgaaa

SEQ ID NO: 45264 - DNA, 20 bp, Artificial Sequence
  chemically synthesized
cataatattgattgctattt

SEQ ID NO: 45265 - DNA, 20 bp, Artificial Sequence
  chemically synthesized
aaatagcaatcaatattatg

SEQ ID NO: 45266 - DNA, 20 bp, Artificial Sequence
  chemically synthesized
aatagcaatcaatattatga

SEQ ID NO: 45267 - DNA, 20 bp, Artificial Sequence
  chemically synthesized
agcaatcaatattatgaagg

SEQ ID NO: 45268 - DNA, 20 bp, Artificial Sequence
  chemically synthesized
gctccaattcaagttttggt

SEQ ID NO: 45269 - DNA, 20 bp, Artificial Sequence
  chemically synthesized
cattgctccaattcaagttt

SEQ ID NO: 45270 - DNA, 20 bp, Artificial Sequence
  chemically synthesized
caaccaaccaaaacttgaat

SEQ ID NO: 45271 - DNA, 20 bp, Artificial Sequence
  chemically synthesized
accaaccaaaacttgaattg

SEQ ID NO: 45272 - DNA, 20 bp, Artificial Sequence
  chemically synthesized
accaggcattgctccaattc

SEQ ID NO: 45273 - DNA, 20 bp, Artificial Sequence
  chemically synthesized
acttgaattggagcaatgcc

SEQ ID NO: 45274 - DNA, 20 bp, Artificial Sequence
  chemically synthesized
ttctagcccctgttggtacc

SEQ ID NO: 45275 - DNA, 20 bp, Artificial Sequence
  chemically synthesized
ggagcaatgcctggtaccaa

SEQ ID NO: 45276 - DNA, 20 bp, Artificial Sequence
  chemically synthesized
gttctagcccctgttggtac

SEQ ID NO: 45277 - DNA, 20 bp, Artificial Sequence
  chemically synthesized
gagcaatgcctggtaccaac

SEQ ID NO: 45278 - DNA, 20 bp, Artificial Sequence
  chemically synthesized
agcaatgcctggtaccaaca

SEQ ID NO: 45279 - DNA, 20 bp, Artificial Sequence
  chemically synthesized
gcaatgcctggtaccaacag

SEQ ID NO: 45280 - DNA, 20 bp, Artificial Sequence
  chemically synthesized
attcttgttctagcccctgt

SEQ ID NO: 45281 - DNA, 20 bp, Artificial Sequence
  chemically synthesized
tgcctggtaccaacaggggc

SEQ ID NO: 45282 - DNA, 20 bp, Artificial Sequence
  chemically synthesized
gtaccaacaggggctagaac

SEQ ID NO: 45283 - DNA, 20 bp, Artificial Sequence
  chemically synthesized
tcttgctctcattcttgttc

SEQ ID NO: 45284 - DNA, 20 bp, Artificial Sequence
  chemically synthesized
acaggggctagaacaagaat

SEQ ID NO: 45285 - DNA, 20 bp, Artificial Sequence
  chemically synthesized
aggggctagaacaagaatga

SEQ ID NO: 45286 - DNA, 20 bp, Artificial Sequence
  chemically synthesized
gctagaacaagaatgagagc

SEQ ID NO: 45287 - DNA, 20 bp, Artificial Sequence
  chemically synthesized
atgagagcaagatatgcttt

SEQ ID NO: 45288 - DNA, 20 bp, Artificial Sequence
  chemically synthesized
agcaagatatgctttaagca

SEQ ID NO: 45289 - DNA, 20 bp, Artificial Sequence
  chemically synthesized
gcaagatatgctttaagcat

SEQ ID NO: 45290 - DNA, 20 bp, Artificial Sequence
  chemically synthesized
ccaaatatgtcccatgctta

SEQ ID NO: 45291 - DNA, 20 bp, Artificial Sequence
  chemically synthesized
ctttaagcatgggacatatt

SEQ ID NO: 45292 - DNA, 20 bp, Artificial Sequence
  chemically synthesized
tactttcatggcaatttttt

SEQ ID NO: 45293 - DNA, 20 bp, Artificial Sequence
  chemically synthesized
atccgaaaaaattgccatga

SEQ ID NO: 45294 - DNA, 20 bp, Artificial Sequence
  chemically synthesized
cgaaaaaattgccatgaaag

SEQ ID NO: 45295 - DNA, 20 bp, Artificial Sequence
  chemically synthesized
tgcctctattactactttca

SEQ ID NO: 45296 - DNA, 20 bp, Artificial Sequence
  chemically synthesized
aattgccatgaaagtagtaa

SEQ ID NO: 45297 - DNA, 20 bp, Artificial Sequence
  chemically synthesized
ttgccatgaaagtagtaata

SEQ ID NO: 45298 - DNA, 20 bp, Artificial Sequence
  chemically synthesized
tgccatgaaagtagtaatag

SEQ ID NO: 45299 - DNA, 20 bp, Artificial Sequence
  chemically synthesized
aagtagtaatagaggcaata

SEQ ID NO: 45300 - DNA, 20 bp, Artificial Sequence
  chemically synthesized
tagtaatagaggcaatacag

SEQ ID NO: 45301 - DNA, 20 bp, Artificial Sequence
  chemically synthesized
agtaatagaggcaatacagt

SEQ ID NO: 45302 - DNA, 20 bp, Artificial Sequence
  chemically synthesized
gtaatagaggcaatacagta

SEQ ID NO: 45303 - DNA, 20 bp, Artificial Sequence
  chemically synthesized
taatagaggcaatacagtag

SEQ ID NO: 45304 - DNA, 20 bp, Artificial Sequence
  chemically synthesized
aatagaggcaatacagtagg

SEQ ID NO: 45305 - DNA, 20 bp, Artificial Sequence
  chemically synthesized
agaggcaatacagtaggggg

SEQ ID NO: 45306 - DNA, 20 bp, Artificial Sequence
  chemically synthesized
gaggcaatacagtagggggc

SEQ ID NO: 45307 - DNA, 20 bp, Artificial Sequence
  chemically synthesized
aggcaatacagtagggggca

SEQ ID NO: 45308 - DNA, 20 bp, Artificial Sequence
  chemically synthesized
ggcaatacagtagggggcag

SEQ ID NO: 45309 - DNA, 20 bp, Artificial Sequence
  chemically synthesized
aatacagtagggggcagggg

SEQ ID NO: 45310 - DNA, 20 bp, Artificial Sequence
  chemically synthesized
atacagtagggggcagggga

SEQ ID NO: 45311 - DNA, 20 bp, Artificial Sequence
  chemically synthesized
cagtagggggcaggggaagg

SEQ ID NO: 45312 - DNA, 20 bp, Artificial Sequence
  chemically synthesized
gggcaggggaaggtggtgtc

SEQ ID NO: 45313 - DNA, 20 bp, Artificial Sequence
  chemically synthesized
gggaaggtggtgtcaagatt

SEQ ID NO: 45314 - DNA, 20 bp, Artificial Sequence
  chemically synthesized
tgtcaagattcagatgctac

SEQ ID NO: 45315 - DNA, 20 bp, Artificial Sequence
  chemically synthesized
tcaagattcagatgctactg

SEQ ID NO: 45316 - DNA, 20 bp, Artificial Sequence
  chemically synthesized
gattcagatgctactggagt

SEQ ID NO: 45317 - DNA, 20 bp, Artificial Sequence
  chemically synthesized
cagtgttcccctaactccag

SEQ ID NO: 45318 - DNA, 20 bp, Artificial Sequence
  chemically synthesized
attcagatgctactggagtt

SEQ ID NO: 45319 - DNA, 20 bp, Artificial Sequence
  chemically synthesized
ttcagatgctactggagtta

SEQ ID NO: 45320 - DNA, 20 bp, Artificial Sequence
  chemically synthesized
tcagatgctactggagttag

SEQ ID NO: 45321 - DNA, 20 bp, Artificial Sequence
  chemically synthesized
taccagtgttcccctaactc

SEQ ID NO: 45322 - DNA, 20 bp, Artificial Sequence
  chemically synthesized
tactggagttaggggaacac

SEQ ID NO: 45323 - DNA, 20 bp, Artificial Sequence
  chemically synthesized
cttggtctggtttttagtac

SEQ ID NO: 45324 - DNA, 20 bp, Artificial Sequence
  chemically synthesized
ggaacactggtactaaaaac

SEQ ID NO: 45325 - DNA, 20 bp, Artificial Sequence
  chemically synthesized
acggatcttggtctggtttt

SEQ ID NO: 45326 - DNA, 20 bp, Artificial Sequence
  chemically synthesized
ctggtactaaaaaccagacc

SEQ ID NO: 45327 - DNA, 20 bp, Artificial Sequence
  chemically synthesized
tgaactcacggatcttggtc

SEQ ID NO: 45328 - DNA, 20 bp, Artificial Sequence
  chemically synthesized
tggtttgaactcacggatct

SEQ ID NO: 45329 - DNA, 20 bp, Artificial Sequence
  chemically synthesized
aaaaccagaccaagatccgt

SEQ ID NO: 45330 - DNA, 20 bp, Artificial Sequence
  chemically synthesized
tacattctggtttgaactca

SEQ ID NO: 45331 - DNA, 20 bp, Artificial Sequence
  chemically synthesized
caagatccgtgagttcaaac

SEQ ID NO: 45332 - DNA, 20 bp, Artificial Sequence
  chemically synthesized
cgtgagttcaaaccagaatg

SEQ ID NO: 45333 - DNA, 20 bp, Artificial Sequence
  chemically synthesized
tatcctgttggtctacattc

SEQ ID NO: 45334 - DNA, 20 bp, Artificial Sequence
  chemically synthesized
caaaccagaatgtagaccaa

SEQ ID NO: 45335 - DNA, 20 bp, Artificial Sequence
  chemically synthesized
aaaccagaatgtagaccaac

SEQ ID NO: 45336 - DNA, 20 bp, Artificial Sequence
  chemically synthesized
tgtggctctctgtatcctgt

SEQ ID NO: 45337 - DNA, 20 bp, Artificial Sequence
  chemically synthesized
gaatgtagaccaacaggata

SEQ ID NO: 45338 - DNA, 20 bp, Artificial Sequence
  chemically synthesized
atgtagaccaacaggataca

SEQ ID NO: 45339 - DNA, 20 bp, Artificial Sequence
  chemically synthesized
gtagaccaacaggatacaga

SEQ ID NO: 45340 - DNA, 20 bp, Artificial Sequence
  chemically synthesized
gatttaccttttggtatatg

SEQ ID NO: 45341 - DNA, 20 bp, Artificial Sequence
  chemically synthesized
cagagagccacatataccaa

SEQ ID NO: 45342 - DNA, 20 bp, Artificial Sequence
  chemically synthesized
agagagccacatataccaaa

SEQ ID NO: 45343 - DNA, 20 bp, Artificial Sequence
  chemically synthesized
atctgtctagatttaccttt

SEQ ID NO: 45344 - DNA, 20 bp, Artificial Sequence
  chemically synthesized
catataccaaaaggtaaatc

SEQ ID NO: 45345 - DNA, 20 bp, Artificial Sequence
  chemically synthesized
taccaaaaggtaaatctaga

SEQ ID NO: 45346 - DNA, 20 bp, Artificial Sequence
  chemically synthesized
aaaaggtaaatctagacaga

SEQ ID NO: 45347 - DNA, 20 bp, Artificial Sequence
  chemically synthesized
tggaactgtggccatctgtc

SEQ ID NO: 45348 - DNA, 20 bp, Artificial Sequence
  chemically synthesized
taaatctagacagatggcca

SEQ ID NO: 45349 - DNA, 20 bp, Artificial Sequence
  chemically synthesized
tagacagatggccacagttc

SEQ ID NO: 45350 - DNA, 20 bp, Artificial Sequence
  chemically synthesized
agacagatggccacagttcc

SEQ ID NO: 45351 - DNA, 20 bp, Artificial Sequence
  chemically synthesized
tgactctctgcctggaactg

SEQ ID NO: 45352 - DNA, 20 bp, Artificial Sequence
  chemically synthesized
cagatggccacagttccagg

SEQ ID NO: 45353 - DNA, 20 bp, Artificial Sequence
  chemically synthesized
gatggccacagttccaggca

SEQ ID NO: 45354 - DNA, 20 bp, Artificial Sequence
  chemically synthesized
tggccacagttccaggcaga

SEQ ID NO: 45355 - DNA, 20 bp, Artificial Sequence
  chemically synthesized
cgagtatttgactctctgcc

SEQ ID NO: 45356 - DNA, 20 bp, Artificial Sequence
  chemically synthesized
gagtcaaatactcgtacaaa

SEQ ID NO: 45357 - DNA, 20 bp, Artificial Sequence
  chemically synthesized
tcctatagctctatttgtac

SEQ ID NO: 45358 - DNA, 20 bp, Artificial Sequence
  chemically synthesized
gtcaaatactcgtacaaata

SEQ ID NO: 45359 - DNA, 20 bp, Artificial Sequence
  chemically synthesized
tactcgtacaaatagagcta

SEQ ID NO: 45360 - DNA, 20 bp, Artificial Sequence
  chemically synthesized
actcgtacaaatagagctat

SEQ ID NO: 45361 - DNA, 20 bp, Artificial Sequence
  chemically synthesized
tacaaatagagctataggaa

SEQ ID NO: 45362 - DNA, 20 bp, Artificial Sequence
  chemically synthesized
cttatggcctaccattccta

SEQ ID NO: 45363 - DNA, 20 bp, Artificial Sequence
  chemically synthesized
aaatagagctataggaatgg

SEQ ID NO: 45364 - DNA, 20 bp, Artificial Sequence
  chemically synthesized
aatagagctataggaatggt

SEQ ID NO: 45365 - DNA, 20 bp, Artificial Sequence
  chemically synthesized
ctataggaatggtaggccat

SEQ ID NO: 45366 - DNA, 20 bp, Artificial Sequence
  chemically synthesized
taggaatggtaggccataag

SEQ ID NO: 45367 - DNA, 20 bp, Artificial Sequence
  chemically synthesized
ctgactgtcctgtcttctta

SEQ ID NO: 45368 - DNA, 20 bp, Artificial Sequence
  chemically synthesized
aatggtaggccataagaaga

SEQ ID NO: 45369 - DNA, 20 bp, Artificial Sequence
  chemically synthesized
atggtaggccataagaagac

SEQ ID NO: 45370 - DNA, 20 bp, Artificial Sequence
  chemically synthesized
taggccataagaagacagga

SEQ ID NO: 45371 - DNA, 20 bp, Artificial Sequence
  chemically synthesized
ccataagaagacaggacagt

SEQ ID NO: 45372 - DNA, 20 bp, Artificial Sequence
  chemically synthesized
aggacagtcagaacccaaat

SEQ ID NO: 45373 - DNA, 20 bp, Artificial Sequence
  chemically synthesized
gctgacaaaattgctgattt

SEQ ID NO: 45374 - DNA, 20 bp, Artificial Sequence
  chemically synthesized
tgctgacaaaattgctgatt

SEQ ID NO: 45375 - DNA, 20 bp, Artificial Sequence
  chemically synthesized
acccaaatcagcaattttgt

SEQ ID NO: 45376 - DNA, 20 bp, Artificial Sequence
  chemically synthesized
agcaattttgtcagcacaaa

SEQ ID NO: 45377 - DNA, 20 bp, Artificial Sequence
  chemically synthesized
tttgtcagcacaaacagcaa

SEQ ID NO: 45378 - DNA, 20 bp, Artificial Sequence
  chemically synthesized
gcacaaacagcaacagtaac

SEQ ID NO: 45379 - DNA, 20 bp, Artificial Sequence
  chemically synthesized
gtaacaagaaatgttgactg

SEQ ID NO: 45380 - DNA, 20 bp, Artificial Sequence
  chemically synthesized
gatgaagttaacagttgctt

SEQ ID NO: 45381 - DNA, 20 bp, Artificial Sequence
  chemically synthesized
accttattggatgaagttaa

SEQ ID NO: 45382 - DNA, 20 bp, Artificial Sequence
  chemically synthesized
atataaaaccttattggatg

SEQ ID NO: 45383 - DNA, 20 bp, Artificial Sequence
  chemically synthesized
aactgttaacttcatccaat

SEQ ID NO: 45384 - DNA, 20 bp, Artificial Sequence
  chemically synthesized
actgttaacttcatccaata

SEQ ID NO: 45385 - DNA, 20 bp, Artificial Sequence
  chemically synthesized
aatgcgatataaaaccttat

SEQ ID NO: 45386 - DNA, 20 bp, Artificial Sequence
  chemically synthesized
gttttatatcgcattttgct

SEQ ID NO: 45387 - DNA, 20 bp, Artificial Sequence
  chemically synthesized
ttatatcgcattttgctaag

SEQ ID NO: 45388 - DNA, 20 bp, Artificial Sequence
  chemically synthesized
tatatcgcattttgctaagc

SEQ ID NO: 45389 - DNA, 20 bp, Artificial Sequence
  chemically synthesized
atcgcattttgctaagcagg

SEQ ID NO: 45390 - DNA, 20 bp, Artificial Sequence
  chemically synthesized
actttctgctgcttcctgct

SEQ ID NO: 45391 - DNA, 20 bp, Artificial Sequence
  chemically synthesized
gcattttgctaagcaggaag

SEQ ID NO: 45392 - DNA, 20 bp, Artificial Sequence
  chemically synthesized
ttttgctaagcaggaagcag

SEQ ID NO: 45393 - DNA, 20 bp, Artificial Sequence
  chemically synthesized
gctaagcaggaagcagcaga

SEQ ID NO: 45394 - DNA, 20 bp, Artificial Sequence
  chemically synthesized
aggaagcagcagaaagttgt

SEQ ID NO: 45395 - DNA, 20 bp, Artificial Sequence
  chemically synthesized
agaaagttgtgagcaaaact

SEQ ID NO: 45396 - DNA, 20 bp, Artificial Sequence
  chemically synthesized
cacaaccatttattgcatct

SEQ ID NO: 45397 - DNA, 20 bp, Artificial Sequence
  chemically synthesized
caaaactcagatgcaataaa

SEQ ID NO: 45398 - DNA, 20 bp, Artificial Sequence
  chemically synthesized
tcagatgcaataaatggttg

SEQ ID NO: 45399 - DNA, 20 bp, Artificial Sequence
  chemically synthesized
atggttgtggaaacatgcct

SEQ ID NO: 45400 - DNA, 20 bp, Artificial Sequence
  chemically synthesized
gtggaaacatgcctgagatt

SEQ ID NO: 45401 - DNA, 20 bp, Artificial Sequence
  chemically synthesized
ttctcttcactctcaatctc

SEQ ID NO: 45402 - DNA, 20 bp, Artificial Sequence
  chemically synthesized
ggaaacatgcctgagattga

SEQ ID NO: 45403 - DNA, 20 bp, Artificial Sequence
  chemically synthesized
cttctcttcactctcaatct

SEQ ID NO: 45404 - DNA, 20 bp, Artificial Sequence
  chemically synthesized
catgcctgagattgagagtg

SEQ ID NO: 45405 - DNA, 20 bp, Artificial Sequence
  chemically synthesized
tgcctgagattgagagtgaa

SEQ ID NO: 45406 - DNA, 20 bp, Artificial Sequence
  chemically synthesized
ctgagattgagagtgaagag

SEQ ID NO: 45407 - DNA, 20 bp, Artificial Sequence
  chemically synthesized
tgagattgagagtgaagaga

SEQ ID NO: 45408 - DNA, 20 bp, Artificial Sequence
  chemically synthesized
gagattgagagtgaagagaa

SEQ ID NO: 45409 - DNA, 20 bp, Artificial Sequence
  chemically synthesized
agtgaagagaagggtcgatc

SEQ ID NO: 45410 - DNA, 20 bp, Artificial Sequence
  chemically synthesized
gtgaagagaagggtcgatca

SEQ ID NO: 45411 - DNA, 20 bp, Artificial Sequence
  chemically synthesized
gaagggtcgatcaaggtcat

SEQ ID NO: 45412 - DNA, 20 bp, Artificial Sequence
  chemically synthesized
aagggtcgatcaaggtcatc

SEQ ID NO: 45413 - DNA, 20 bp, Artificial Sequence
  chemically synthesized
aggtcatcaggcaacatata

SEQ ID NO: 45414 - DNA, 20 bp, Artificial Sequence
  chemically synthesized
tatacaacattcaaaattac

SEQ ID NO: 45415 - DNA, 20 bp, Artificial Sequence
  chemically synthesized
acaacattcaaaattaccag

SEQ ID NO: 45416 - DNA, 20 bp, Artificial Sequence
  chemically synthesized
caacattcaaaattaccagc

SEQ ID NO: 45417 - DNA, 20 bp, Artificial Sequence
  chemically synthesized
ttcaaaattaccagcaggaa

SEQ ID NO: 45418 - DNA, 20 bp, Artificial Sequence
  chemically synthesized
gagtgtttatcttttcctgc

SEQ ID NO: 45419 - DNA, 20 bp, Artificial Sequence
  chemically synthesized
ggaaaagataaacactcctt

SEQ ID NO: 45420 - DNA, 20 bp, Artificial Sequence
  chemically synthesized
gaagcaactcatgtccaaag

SEQ ID NO: 45421 - DNA, 20 bp, Artificial Sequence
  chemically synthesized
aagaagcaactcatgtccaa

SEQ ID NO: 45422 - DNA, 20 bp, Artificial Sequence
  chemically synthesized
ataaacactcctttggacat

SEQ ID NO: 45423 - DNA, 20 bp, Artificial Sequence
  chemically synthesized
caagaagcaactcatgtcca

SEQ ID NO: 45424 - DNA, 20 bp, Artificial Sequence
  chemically synthesized
ttggacatgagttgcttctt

SEQ ID NO: 45425 - DNA, 20 bp, Artificial Sequence
  chemically synthesized
ttttacatgcaatgctcaag

SEQ ID NO: 45426 - DNA, 20 bp, Artificial Sequence
  chemically synthesized
tttttttacatgcaatgctc

SEQ ID NO: 45427 - DNA, 20 bp, Artificial Sequence
  chemically synthesized
ttgagcattgcatgtaaaaa

SEQ ID NO: 45428 - DNA, 20 bp, Artificial Sequence
  chemically synthesized
cattgcatgtaaaaaaagct

SEQ ID NO: 45429 - DNA, 20 bp, Artificial Sequence
  chemically synthesized
tgcatgtaaaaaaagctgag

SEQ ID NO: 45430 - DNA, 20 bp, Artificial Sequence
  chemically synthesized
tgtaaaaaaagctgagcagt

SEQ ID NO: 45431 - DNA, 20 bp, Artificial Sequence
  chemically synthesized
ttgggaacttgctaactgct

SEQ ID NO: 45432 - DNA, 20 bp, Artificial Sequence
  chemically synthesized
aaaaaagctgagcagttagc

SEQ ID NO: 45433 - DNA, 20 bp, Artificial Sequence
  chemically synthesized
tgagcagttagcaagttccc

SEQ ID NO: 45434 - DNA, 20 bp, Artificial Sequence
  chemically synthesized
gagtgaaagatggggttctt

SEQ ID NO: 45435 - DNA, 20 bp, Artificial Sequence
  chemically synthesized
agagtgaaagatggggttct

SEQ ID NO: 45436 - DNA, 20 bp, Artificial Sequence
  chemically synthesized
tcacagaagagtgaaagatg

SEQ ID NO: 45437 - DNA, 20 bp, Artificial Sequence
  chemically synthesized
ttcacagaagagtgaaagat

SEQ ID NO: 45438 - DNA, 20 bp, Artificial Sequence
  chemically synthesized
cttcacagaagagtgaaaga

SEQ ID NO: 45439 - DNA, 20 bp, Artificial Sequence
  chemically synthesized
agcccttcacagaagagtga

SEQ ID NO: 45440 - DNA, 20 bp, Artificial Sequence
  chemically synthesized
ccatctttcactcttctgtg

SEQ ID NO: 45441 - DNA, 20 bp, Artificial Sequence
  chemically synthesized
ctctgaagcccttcacagaa

SEQ ID NO: 45442 - DNA, 20 bp, Artificial Sequence
  chemically synthesized
catctttcactcttctgtga

SEQ ID NO: 45443 - DNA, 20 bp, Artificial Sequence
  chemically synthesized
atctttcactcttctgtgaa

SEQ ID NO: 45444 - DNA, 20 bp, Artificial Sequence
  chemically synthesized
atctctgaagcccttcacag

SEQ ID NO: 45445 - DNA, 20 bp, Artificial Sequence
  chemically synthesized
aatatctctgaagcccttca

SEQ ID NO: 45446 - DNA, 20 bp, Artificial Sequence
  chemically synthesized
cactcttctgtgaagggctt

SEQ ID NO: 45447 - DNA, 20 bp, Artificial Sequence
  chemically synthesized
ctcttctgtgaagggcttca

SEQ ID NO: 45448 - DNA, 20 bp, Artificial Sequence
  chemically synthesized
tccctttcgaaatatctctg

SEQ ID NO: 45449 - DNA, 20 bp, Artificial Sequence
  chemically synthesized
gggcttcagagatatttcga

SEQ ID NO: 45450 - DNA, 20 bp, Artificial Sequence
  chemically synthesized
ggcttcagagatatttcgaa

SEQ ID NO: 45451 - DNA, 20 bp, Artificial Sequence
  chemically synthesized
gcttcagagatatttcgaaa

SEQ ID NO: 45452 - DNA, 20 bp, Artificial Sequence
  chemically synthesized
cagcagtaatgcatttcatc

SEQ ID NO: 45453 - DNA, 20 bp, Artificial Sequence
  chemically synthesized
tcagcagtaatgcatttcat

SEQ ID NO: 45454 - DNA, 20 bp, Artificial Sequence
  chemically synthesized
atgaaatgcattactgctga

SEQ ID NO: 45455 - DNA, 20 bp, Artificial Sequence
  chemically synthesized
gaaatgcattactgctgatg

SEQ ID NO: 45456 - DNA, 20 bp, Artificial Sequence
  chemically synthesized
aaacctgctgactccatcag

SEQ ID NO: 45457 - DNA, 20 bp, Artificial Sequence
  chemically synthesized
tgcattactgctgatggagt

SEQ ID NO: 45458 - DNA, 20 bp, Artificial Sequence
  chemically synthesized
agtaaacctgctgactccat

SEQ ID NO: 45459 - DNA, 20 bp, Artificial Sequence
  chemically synthesized
attactgctgatggagtcag

SEQ ID NO: 45460 - DNA, 20 bp, Artificial Sequence
  chemically synthesized
ttactgctgatggagtcagc

SEQ ID NO: 45461 - DNA, 20 bp, Artificial Sequence
  chemically synthesized
gagtcagcaggtttactcct

SEQ ID NO: 45462 - DNA, 20 bp, Artificial Sequence
  chemically synthesized
aattcactaatgaaactcag

SEQ ID NO: 45463 - DNA, 20 bp, Artificial Sequence
  chemically synthesized
agaattcactaatgaaactc

SEQ ID NO: 45464 - DNA, 20 bp, Artificial Sequence
  chemically synthesized
aagaattcactaatgaaact

SEQ ID NO: 45465 - DNA, 20 bp, Artificial Sequence
  chemically synthesized
ggtttactcctgagtttcat

SEQ ID NO: 45466 - DNA, 20 bp, Artificial Sequence
  chemically synthesized
tgtggttgctaaatattggg

SEQ ID NO: 45467 - DNA, 20 bp, Artificial Sequence
  chemically synthesized
agtgaattcttcccaatatt

SEQ ID NO: 45468 - DNA, 20 bp, Artificial Sequence
  chemically synthesized
cgctgtggttgctaaatatt

SEQ ID NO: 45469 - DNA, 20 bp, Artificial Sequence
  chemically synthesized
acgctgtggttgctaaatat

SEQ ID NO: 45470 - DNA, 20 bp, Artificial Sequence
  chemically synthesized
ttcccaatatttagcaacca

SEQ ID NO: 45471 - DNA, 20 bp, Artificial Sequence
  chemically synthesized
ttcctccttcaaagacgctg

SEQ ID NO: 45472 - DNA, 20 bp, Artificial Sequence
  chemically synthesized
tagcaaccacagcgtctttg

SEQ ID NO: 45473 - DNA, 20 bp, Artificial Sequence
  chemically synthesized
agcaaccacagcgtctttga

SEQ ID NO: 45474 - DNA, 20 bp, Artificial Sequence
  chemically synthesized
caaccacagcgtctttgaag

SEQ ID NO: 45475 - DNA, 20 bp, Artificial Sequence
  chemically synthesized
aaccacagcgtctttgaagg

SEQ ID NO: 45476 - DNA, 20 bp, Artificial Sequence
  chemically synthesized
gctggtcctttcctccttca

SEQ ID NO: 45477 - DNA, 20 bp, Artificial Sequence
  chemically synthesized
acagcgtctttgaaggagga

SEQ ID NO: 45478 - DNA, 20 bp, Artificial Sequence
  chemically synthesized
cagcgtctttgaaggaggaa

SEQ ID NO: 45479 - DNA, 20 bp, Artificial Sequence
  chemically synthesized
tctttgaaggaggaaaggac

SEQ ID NO: 45480 - DNA, 20 bp, Artificial Sequence
  chemically synthesized
gatttgatttttagacaagc

SEQ ID NO: 45481 - DNA, 20 bp, Artificial Sequence
  chemically synthesized
gaaggatttgatttttagac

SEQ ID NO: 45482 - DNA, 20 bp, Artificial Sequence
  chemically synthesized
cttaggaaggatttgatttt

SEQ ID NO: 45483 - DNA, 20 bp, Artificial Sequence
  chemically synthesized
ctaaaaatcaaatccttcct

SEQ ID NO: 45484 - DNA, 20 bp, Artificial Sequence
  chemically synthesized
taaaaatcaaatccttccta

SEQ ID NO: 45485 - DNA, 20 bp, Artificial Sequence
  chemically synthesized
aaaaatcaaatccttcctaa

SEQ ID NO: 45486 - DNA, 20 bp, Artificial Sequence
  chemically synthesized
ctgccagctgtcccttagga

SEQ ID NO: 45487 - DNA, 20 bp, Artificial Sequence
  chemically synthesized
tctgccagctgtcccttagg

SEQ ID NO: 45488 - DNA, 20 bp, Artificial Sequence
  chemically synthesized
atcaaatccttcctaaggga

SEQ ID NO: 45489 - DNA, 20 bp, Artificial Sequence
  chemically synthesized
atttctgccagctgtccctt

SEQ ID NO: 45490 - DNA, 20 bp, Artificial Sequence
  chemically synthesized
tatttctgccagctgtccct

SEQ ID NO: 45491 - DNA, 20 bp, Artificial Sequence
  chemically synthesized
aatccttcctaagggacagc

SEQ ID NO: 45492 - DNA, 20 bp, Artificial Sequence
  chemically synthesized
ccttcctaagggacagctgg

SEQ ID NO: 45493 - DNA, 20 bp, Artificial Sequence
  chemically synthesized
gtttgaccttatatttctgc

SEQ ID NO: 45494 - DNA, 20 bp, Artificial Sequence
  chemically synthesized
gggacagctggcagaaatat

SEQ ID NO: 45495 - DNA, 20 bp, Artificial Sequence
  chemically synthesized
ggacagctggcagaaatata

SEQ ID NO: 45496 - DNA, 20 bp, Artificial Sequence
  chemically synthesized
ataaggtcaaacacttttgc

SEQ ID NO: 45497 - DNA, 20 bp, Artificial Sequence
  chemically synthesized
cttttctgtaataccagcaa

SEQ ID NO: 45498 - DNA, 20 bp, Artificial Sequence
  chemically synthesized
aaacacttttgctggtatta

SEQ ID NO: 45499 - DNA, 20 bp, Artificial Sequence
  chemically synthesized
ctgctacttttctgtaatac

SEQ ID NO: 45500 - DNA, 20 bp, Artificial Sequence
  chemically synthesized
cttttgctggtattacagaa

SEQ ID NO: 45501 - DNA, 20 bp, Artificial Sequence
  chemically synthesized
ttgctggtattacagaaaag

SEQ ID NO: 45502 - DNA, 20 bp, Artificial Sequence
  chemically synthesized
ctggtattacagaaaagtag

SEQ ID NO: 45503 - DNA, 20 bp, Artificial Sequence
  chemically synthesized
agtagcagaaaaccaacctt

SEQ ID NO: 45504 - DNA, 20 bp, Artificial Sequence
  chemically synthesized
tattagttctagccgaaggt

SEQ ID NO: 45505 - DNA, 20 bp, Artificial Sequence
  chemically synthesized
gcagaaaaccaaccttcggc

SEQ ID NO: 45506 - DNA, 20 bp, Artificial Sequence
  chemically synthesized
catatattagttctagccga

SEQ ID NO: 45507 - DNA, 20 bp, Artificial Sequence
  chemically synthesized
gcatatattagttctagccg

SEQ ID NO: 45508 - DNA, 20 bp, Artificial Sequence
  chemically synthesized
tcttctgcatatattagttc

SEQ ID NO: 45509 - DNA, 20 bp, Artificial Sequence
  chemically synthesized
tcggctagaactaatatatg

SEQ ID NO: 45510 - DNA, 20 bp, Artificial Sequence
  chemically synthesized
ataacctcttctgcatatat

SEQ ID NO: 45511 - DNA, 20 bp, Artificial Sequence
  chemically synthesized
gctagaactaatatatgcag

SEQ ID NO: 45512 - DNA, 20 bp, Artificial Sequence
  chemically synthesized
tagaactaatatatgcagaa

SEQ ID NO: 45513 - DNA, 20 bp, Artificial Sequence
  chemically synthesized
agaactaatatatgcagaag

SEQ ID NO: 45514 - DNA, 20 bp, Artificial Sequence
  chemically synthesized
agaaatggagagatcaattg

SEQ ID NO: 45515 - DNA, 20 bp, Artificial Sequence
  chemically synthesized
cagaaatggagagatcaatt

SEQ ID NO: 45516 - DNA, 20 bp, Artificial Sequence
  chemically synthesized
cccattggtgcagaaatgga

SEQ ID NO: 45517 - DNA, 20 bp, Artificial Sequence
  chemically synthesized
ctcccattggtgcagaaatg

SEQ ID NO: 45518 - DNA, 20 bp, Artificial Sequence
  chemically synthesized
gtctcccattggtgcagaaa

SEQ ID NO: 45519 - DNA, 20 bp, Artificial Sequence
  chemically synthesized
tctctccatttctgcaccaa

SEQ ID NO: 45520 - DNA, 20 bp, Artificial Sequence
  chemically synthesized
ctctccatttctgcaccaat

SEQ ID NO: 45521 - DNA, 20 bp, Artificial Sequence
  chemically synthesized
tttgctgtctcccattggtg

SEQ ID NO: 45522 - DNA, 20 bp, Artificial Sequence
  chemically synthesized
ctccatttctgcaccaatgg

SEQ ID NO: 45523 - DNA, 20 bp, Artificial Sequence
  chemically synthesized
tgttatttgctgtctcccat

SEQ ID NO: 45524 - DNA, 20 bp, Artificial Sequence
  chemically synthesized
atttctgcaccaatgggaga

SEQ ID NO: 45525 - DNA, 20 bp, Artificial Sequence
  chemically synthesized
ataacatttactttcttcat

SEQ ID NO: 45526 - DNA, 20 bp, Artificial Sequence
  chemically synthesized
tttccactcactcatgaaga

SEQ ID NO: 45527 - DNA, 20 bp, Artificial Sequence
  chemically synthesized
catttactttcttcatgagt

SEQ ID NO: 45528 - DNA, 20 bp, Artificial Sequence
  chemically synthesized
ctagtttccactcactcatg

SEQ ID NO: 45529 - DNA, 20 bp, Artificial Sequence
  chemically synthesized
ttactttcttcatgagtgag

SEQ ID NO: 45530 - DNA, 20 bp, Artificial Sequence
  chemically synthesized
cttcatgagtgagtggaaac

SEQ ID NO: 45531 - DNA, 20 bp, Artificial Sequence
  chemically synthesized
tcatgagtgagtggaaacta

SEQ ID NO: 45532 - DNA, 20 bp, Artificial Sequence
  chemically synthesized
aaatttgttagcattgtctc

SEQ ID NO: 45533 - DNA, 20 bp, Artificial Sequence
  chemically synthesized
atattggttatgaaatttgt

SEQ ID NO: 45534 - DNA, 20 bp, Artificial Sequence
  chemically synthesized
caaatttcataaccaatatt

SEQ ID NO: 45535 - DNA, 20 bp, Artificial Sequence
  chemically synthesized
aaatttcataaccaatattt

SEQ ID NO: 45536 - DNA, 20 bp, Artificial Sequence
  chemically synthesized
gactagggtggcccaaatat

SEQ ID NO: 45537 - DNA, 20 bp, Artificial Sequence
  chemically synthesized
aaccaatatttgggccaccc

SEQ ID NO: 45538 - DNA, 20 bp, Artificial Sequence
  chemically synthesized
ttgggatgtcgtgactaggg

SEQ ID NO: 45539 - DNA, 20 bp, Artificial Sequence
  chemically synthesized
tctttgggatgtcgtgacta

SEQ ID NO: 45540 - DNA, 20 bp, Artificial Sequence
  chemically synthesized
ttctttgggatgtcgtgact

SEQ ID NO: 45541 - DNA, 20 bp, Artificial Sequence
  chemically synthesized
cttctttgggatgtcgtgac

SEQ ID NO: 45542 - DNA, 20 bp, Artificial Sequence
  chemically synthesized
accctagtcacgacatccca

SEQ ID NO: 45543 - DNA, 20 bp, Artificial Sequence
  chemically synthesized
ctagtcacgacatcccaaag

SEQ ID NO: 45544 - DNA, 20 bp, Artificial Sequence
  chemically synthesized
agctctgttatatcttcttt

SEQ ID NO: 45545 - DNA, 20 bp, Artificial Sequence
  chemically synthesized
cagctctgttatatcttctt

SEQ ID NO: 45546 - DNA, 20 bp, Artificial Sequence
  chemically synthesized
acatcccaaagaagatataa

SEQ ID NO: 45547 - DNA, 20 bp, Artificial Sequence
  chemically synthesized
atcccaaagaagatataaca

SEQ ID NO: 45548 - DNA, 20 bp, Artificial Sequence
  chemically synthesized
caaagaagatataacagagc

SEQ ID NO: 45549 - DNA, 20 bp, Artificial Sequence
  chemically synthesized
aagatataacagagctggaa

SEQ ID NO: 45550 - DNA, 20 bp, Artificial Sequence
  chemically synthesized
gtttttccctggatcttttc

SEQ ID NO: 45551 - DNA, 20 bp, Artificial Sequence
  chemically synthesized
taacagagctggaaaagatc

SEQ ID NO: 45552 - DNA, 20 bp, Artificial Sequence
  chemically synthesized
aacagagctggaaaagatcc

SEQ ID NO: 45553 - DNA, 20 bp, Artificial Sequence
  chemically synthesized
acagagctggaaaagatcca

SEQ ID NO: 45554 - DNA, 20 bp, Artificial Sequence
  chemically synthesized
ttatcttagttgtttttccc

SEQ ID NO: 45555 - DNA, 20 bp, Artificial Sequence
  chemically synthesized
agatccagggaaaaacaact

SEQ ID NO: 45556 - DNA, 20 bp, Artificial Sequence
  chemically synthesized
agctttccccttgattatct

SEQ ID NO: 45557 - DNA, 20 bp, Artificial Sequence
  chemically synthesized
gaaaaacaactaagataatc

SEQ ID NO: 45558 - DNA, 20 bp, Artificial Sequence
  chemically synthesized
aaaaacaactaagataatca

SEQ ID NO: 45559 - DNA, 20 bp, Artificial Sequence
  chemically synthesized
aaaacaactaagataatcaa

SEQ ID NO: 45560 - DNA, 20 bp, Artificial Sequence
  chemically synthesized
aaacaactaagataatcaag

SEQ ID NO: 45561 - DNA, 20 bp, Artificial Sequence
  chemically synthesized
aactaagataatcaagggga

SEQ ID NO: 45562 - DNA, 20 bp, Artificial Sequence
  chemically synthesized
tctgtccttgacggaaagat

SEQ ID NO: 45563 - DNA, 20 bp, Artificial Sequence
  chemically synthesized
ggaaagcttatctttccgtc

SEQ ID NO: 45564 - DNA, 20 bp, Artificial Sequence
  chemically synthesized
gaaagcttatctttccgtca

SEQ ID NO: 45565 - DNA, 20 bp, Artificial Sequence
  chemically synthesized
tttagtctgtccttgacgga

SEQ ID NO: 45566 - DNA, 20 bp, Artificial Sequence
  chemically synthesized
gcttatctttccgtcaagga

SEQ ID NO: 45567 - DNA, 20 bp, Artificial Sequence
  chemically synthesized
gtcttttagtctgtccttga

SEQ ID NO: 45568 - DNA, 20 bp, Artificial Sequence
  chemically synthesized
ttccgtcaaggacagactaa

SEQ ID NO: 45569 - DNA, 20 bp, Artificial Sequence
  chemically synthesized
tctaatcctttttagtcttt

SEQ ID NO: 45570 - DNA, 20 bp, Artificial Sequence
  chemically synthesized
ggacagactaaaagactaaa

SEQ ID NO: 45571 - DNA, 20 bp, Artificial Sequence
  chemically synthesized
gacagactaaaagactaaaa

SEQ ID NO: 45572 - DNA, 20 bp, Artificial Sequence
  chemically synthesized
tgagaaattctaatcctttt

SEQ ID NO: 45573 - DNA, 20 bp, Artificial Sequence
  chemically synthesized
actaaaagactaaaaaggat

SEQ ID NO: 45574 - DNA, 20 bp, Artificial Sequence
  chemically synthesized
taaaaaggattagaatttct

SEQ ID NO: 45575 - DNA, 20 bp, Artificial Sequence
  chemically synthesized
aggattagaatttctcagac

SEQ ID NO: 45576 - DNA, 20 bp, Artificial Sequence
  chemically synthesized
ggattagaatttctcagact

SEQ ID NO: 45577 - DNA, 20 bp, Artificial Sequence
  chemically synthesized
cattttcatcttcccagtct

SEQ ID NO: 45578 - DNA, 20 bp, Artificial Sequence
  chemically synthesized
ttagaatttctcagactggg

SEQ ID NO: 45579 - DNA, 20 bp, Artificial Sequence
  chemically synthesized
gcttttcattttcatcttcc

SEQ ID NO: 45580 - DNA, 20 bp, Artificial Sequence
  chemically synthesized
actgggaagatgaaaatgaa

SEQ ID NO: 45581 - DNA, 20 bp, Artificial Sequence
  chemically synthesized
aagatgaaaatgaaaagcat

SEQ ID NO: 45582 - DNA, 20 bp, Artificial Sequence
  chemically synthesized
atgaaaatgaaaagcattag

SEQ ID NO: 45583 - DNA, 20 bp, Artificial Sequence
  chemically synthesized
tgaaaatgaaaagcattagt

SEQ ID NO: 45584 - DNA, 20 bp, Artificial Sequence
  chemically synthesized
gaaaatgaaaagcattagta

SEQ ID NO: 45585 - DNA, 20 bp, Artificial Sequence
  chemically synthesized
aaaatgaaaagcattagtag

SEQ ID NO: 45586 - DNA, 20 bp, Artificial Sequence
  chemically synthesized
aagcattagtaggggaatgt

SEQ ID NO: 45587 - DNA, 20 bp, Artificial Sequence
  chemically synthesized
agcattagtaggggaatgtg

SEQ ID NO: 45588 - DNA, 20 bp, Artificial Sequence
  chemically synthesized
agtaggggaatgtgaggcta

SEQ ID NO: 45589 - DNA, 20 bp, Artificial Sequence
  chemically synthesized
tatttatccagagtcgactt

SEQ ID NO: 45590 - DNA, 20 bp, Artificial Sequence
  chemically synthesized
tgtgaggctaaagtcgactc

SEQ ID NO: 45591 - DNA, 20 bp, Artificial Sequence
  chemically synthesized
aaaacatttatatttatcca

SEQ ID NO: 45592 - DNA, 20 bp, Artificial Sequence
  chemically synthesized
taaaaacatttatatttatc

SEQ ID NO: 45593 - DNA, 20 bp, Artificial Sequence
  chemically synthesized
aatgtttttactgaatttca

SEQ ID NO: 45594 - DNA, 20 bp, Artificial Sequence
  chemically synthesized
taattaaattctttgaaatt

SEQ ID NO: 45595 - DNA, 20 bp, Artificial Sequence
  chemically synthesized
gaatttcaaagaatttaatt

SEQ ID NO: 45596 - DNA, 20 bp, Artificial Sequence
  chemically synthesized
aatttcaaagaatttaatta

SEQ ID NO: 45597 - DNA, 20 bp, Artificial Sequence
  chemically synthesized
tttaattaaggccattcctt

SEQ ID NO: 45598 - DNA, 20 bp, Artificial Sequence
  chemically synthesized
ttaattaaggccattccttg

SEQ ID NO: 45599 - DNA, 20 bp, Artificial Sequence
  chemically synthesized
catcctttaacctcaaggaa

SEQ ID NO: 45600 - DNA, 20 bp, Artificial Sequence
  chemically synthesized
atctgcatcctttaacctca

SEQ ID NO: 45601 - DNA, 20 bp, Artificial Sequence
  chemically synthesized
aaggccattccttgaggtta

SEQ ID NO: 45602 - DNA, 20 bp, Artificial Sequence
  chemically synthesized
aatctgcatcctttaacctc

SEQ ID NO: 45603 - DNA, 20 bp, Artificial Sequence
  chemically synthesized
aggccattccttgaggttaa

SEQ ID NO: 45604 - DNA, 20 bp, Artificial Sequence
  chemically synthesized
ttccttgaggttaaaggatg

SEQ ID NO: 45605 - DNA, 20 bp, Artificial Sequence
  chemically synthesized
aggttaaaggatgcagattc

SEQ ID NO: 45606 - DNA, 20 bp, Artificial Sequence
  chemically synthesized
gttaaaggatgcagattcaa

SEQ ID NO: 45607 - DNA, 20 bp, Artificial Sequence
  chemically synthesized
accgacttctatataaatat

SEQ ID NO: 45608 - DNA, 20 bp, Artificial Sequence
  chemically synthesized
taccgacttctatataaata

SEQ ID NO: 45609 - DNA, 20 bp, Artificial Sequence
  chemically synthesized
ttaaaatgcctatatttata

SEQ ID NO: 45610 - DNA, 20 bp, Artificial Sequence
  chemically synthesized
aaatgcctatatttatatag

SEQ ID NO: 45611 - DNA, 20 bp, Artificial Sequence
  chemically synthesized
gcctatatttatatagaagt

SEQ ID NO: 45612 - DNA, 20 bp, Artificial Sequence
  chemically synthesized
tatagaagtcggtacattta

SEQ ID NO: 45613 - DNA, 20 bp, Artificial Sequence
  chemically synthesized
ttatggaacatattattatt

SEQ ID NO: 45614 - DNA, 20 bp, Artificial Sequence
  chemically synthesized
aacatattattattaagaca

SEQ ID NO: 45615 - DNA, 20 bp, Artificial Sequence
  chemically synthesized
ttattattaagacaaagctg

SEQ ID NO: 45616 - DNA, 20 bp, Artificial Sequence
  chemically synthesized
ttattaagacaaagctgaag

SEQ ID NO: 45617 - DNA, 20 bp, Artificial Sequence
  chemically synthesized
tattaagacaaagctgaagt

SEQ ID NO: 45618 - DNA, 20 bp, Artificial Sequence
  chemically synthesized
attaagacaaagctgaagtg

SEQ ID NO: 45619 - DNA, 20 bp, Artificial Sequence
  chemically synthesized
acttttcctattccccactt

SEQ ID NO: 45620 - DNA, 20 bp, Artificial Sequence
  chemically synthesized
gacaaagctgaagtggggaa

SEQ ID NO: 45621 - DNA, 20 bp, Artificial Sequence
  chemically synthesized
acaaagctgaagtggggaat

SEQ ID NO: 45622 - DNA, 20 bp, Artificial Sequence
  chemically synthesized
gctgaagtggggaataggaa

SEQ ID NO: 45623 - DNA, 20 bp, Artificial Sequence
  chemically synthesized
taggaaaagtttgacaccat

SEQ ID NO: 45624 - DNA, 20 bp, Artificial Sequence
  chemically synthesized
ctggcagtgagtttatccaa

SEQ ID NO: 45625 - DNA, 20 bp, Artificial Sequence
  chemically synthesized
ccattggataaactcactgc

SEQ ID NO: 45626 - DNA, 20 bp, Artificial Sequence
  chemically synthesized
attgtaaatcaactggcagt

SEQ ID NO: 45627 - DNA, 20 bp, Artificial Sequence
  chemically synthesized
atgcattgtaaatcaactgg

SEQ ID NO: 45628 - DNA, 20 bp, Artificial Sequence
  chemically synthesized
ataatgcattgtaaatcaac

SEQ ID NO: 45629 - DNA, 20 bp, Artificial Sequence
  chemically synthesized
ttgatttacaatgcattatt

SEQ ID NO: 45630 - DNA, 20 bp, Artificial Sequence
  chemically synthesized
atttacaatgcattattaag

SEQ ID NO: 45631 - DNA, 20 bp, Artificial Sequence
  chemically synthesized
tacaatgcattattaagaag

SEQ ID NO: 45632 - DNA, 20 bp, Artificial Sequence
  chemically synthesized
catgatgtatccgaattttt

SEQ ID NO: 45633 - DNA, 20 bp, Artificial Sequence
  chemically synthesized
tacattttaccttaaaaatt

SEQ ID NO: 45634 - DNA, 20 bp, Artificial Sequence
  chemically synthesized
atgatgtatccgaattttta

SEQ ID NO: 45635 - DNA, 20 bp, Artificial Sequence
  chemically synthesized
atttttaaggtaaaatgtac

SEQ ID NO: 45636 - DNA, 20 bp, Artificial Sequence
  chemically synthesized
tttttaaggtaaaatgtact

SEQ ID NO: 45637 - DNA, 20 bp, Artificial Sequence
  chemically synthesized
ggttgttttgtcaggtaacc

SEQ ID NO: 45638 - DNA, 20 bp, Artificial Sequence
  chemically synthesized
ataccaatggttgttttgtc

SEQ ID NO: 45639 - DNA, 20 bp, Artificial Sequence
  chemically synthesized
gataccaatggttgttttgt

SEQ ID NO: 45640 - DNA, 20 bp, Artificial Sequence
  chemically synthesized
ttacctgacaaaacaaccat

SEQ ID NO: 45641 - DNA, 20 bp, Artificial Sequence
  chemically synthesized
gtcccagatgaagataccaa

SEQ ID NO: 45642 - DNA, 20 bp, Artificial Sequence
  chemically synthesized
caaccattggtatcttcatc

SEQ ID NO: 45643 - DNA, 20 bp, Artificial Sequence
  chemically synthesized
aaccattggtatcttcatct

SEQ ID NO: 45644 - DNA, 20 bp, Artificial Sequence
  chemically synthesized
ccggaactctgtcccagatg

SEQ ID NO: 45645 - DNA, 20 bp, Artificial Sequence
  chemically synthesized
attggtatcttcatctggga

SEQ ID NO: 45646 - DNA, 20 bp, Artificial Sequence
  chemically synthesized
tggtatcttcatctgggaca

SEQ ID NO: 45647 - DNA, 20 bp, Artificial Sequence
  chemically synthesized
actagcccggaactctgtcc

SEQ ID NO: 45648 - DNA, 20 bp, Artificial Sequence
  chemically synthesized
cttcatctgggacagagttc

SEQ ID NO: 45649 - DNA, 20 bp, Artificial Sequence
  chemically synthesized
ttcatctgggacagagttcc

SEQ ID NO: 45650 - DNA, 20 bp, Artificial Sequence
  chemically synthesized
tctgggacagagttccgggc

SEQ ID NO: 45651 - DNA, 20 bp, Artificial Sequence
  chemically synthesized
gaccaacagggcaactagcc

SEQ ID NO: 45652 - DNA, 20 bp, Artificial Sequence
  chemically synthesized
ggtcagaccaacagggcaac

SEQ ID NO: 45653 - DNA, 20 bp, Artificial Sequence
  chemically synthesized
ttccgggctagttgccctgt

SEQ ID NO: 45654 - DNA, 20 bp, Artificial Sequence
  chemically synthesized
cacactgggtcagaccaaca

SEQ ID NO: 45655 - DNA, 20 bp, Artificial Sequence
  chemically synthesized
tcacactgggtcagaccaac

SEQ ID NO: 45656 - DNA, 20 bp, Artificial Sequence
  chemically synthesized
atcacactgggtcagaccaa

SEQ ID NO: 45657 - DNA, 20 bp, Artificial Sequence
  chemically synthesized
gttgccctgttggtctgacc

SEQ ID NO: 45658 - DNA, 20 bp, Artificial Sequence
  chemically synthesized
taagaaatatcacactgggt

SEQ ID NO: 45659 - DNA, 20 bp, Artificial Sequence
  chemically synthesized
agcataagaaatatcacact

SEQ ID NO: 45660 - DNA, 20 bp, Artificial Sequence
  chemically synthesized
aagcataagaaatatcacac

SEQ ID NO: 45661 - DNA, 20 bp, Artificial Sequence
  chemically synthesized
agatgtcataataaaagcat

SEQ ID NO: 45662 - DNA, 20 bp, Artificial Sequence
  chemically synthesized
cagtatagatgtcataataa

SEQ ID NO: 45663 - DNA, 20 bp, Artificial Sequence
  chemically synthesized
ttttattatgacatctatac

SEQ ID NO: 45664 - DNA, 20 bp, Artificial Sequence
  chemically synthesized
gcatgcaggatgttccagta

SEQ ID NO: 45665 - DNA, 20 bp, Artificial Sequence
  chemically synthesized
aacatgcatgcaggatgttc

SEQ ID NO: 45666 - DNA, 20 bp, Artificial Sequence
  chemically synthesized
ggaatcccaaacatgcatgc

SEQ ID NO: 45667 - DNA, 20 bp, Artificial Sequence
  chemically synthesized
aggaatcccaaacatgcatg

SEQ ID NO: 45668 - DNA, 20 bp, Artificial Sequence
  chemically synthesized
gaacatcctgcatgcatgtt

SEQ ID NO: 45669 - DNA, 20 bp, Artificial Sequence
  chemically synthesized
aacatcctgcatgcatgttt

SEQ ID NO: 45670 - DNA, 20 bp, Artificial Sequence
  chemically synthesized
ctggactgtcaaaagaattt

SEQ ID NO: 45671 - DNA, 20 bp, Artificial Sequence
  chemically synthesized
tctggactgtcaaaagaatt

SEQ ID NO: 45672 - DNA, 20 bp, Artificial Sequence
  chemically synthesized
ggattcctaaattcttttga

SEQ ID NO: 45673 - DNA, 20 bp, Artificial Sequence
  chemically synthesized
tctgtattctggactgtcaa

SEQ ID NO: 45674 - DNA, 20 bp, Artificial Sequence
  chemically synthesized
cctaaattcttttgacagtc

SEQ ID NO: 45675 - DNA, 20 bp, Artificial Sequence
  chemically synthesized
tcttttgacagtccagaata

SEQ ID NO: 45676 - DNA, 20 bp, Artificial Sequence
  chemically synthesized
aaaattgttcttctgtattc

SEQ ID NO: 45677 - DNA, 20 bp, Artificial Sequence
  chemically synthesized
tttgacagtccagaatacag

SEQ ID NO: 45678 - DNA, 20 bp, Artificial Sequence
  chemically synthesized
gaacaattttctaactcatt

SEQ ID NO: 45679 - DNA, 20 bp, Artificial Sequence
  chemically synthesized
ctcttgctttcttaatgagt

SEQ ID NO: 45680 - DNA, 20 bp, Artificial Sequence
  chemically synthesized
aattttctaactcattaaga

SEQ ID NO: 45681 - DNA, 20 bp, Artificial Sequence
  chemically synthesized
gactctcttgctttcttaat

SEQ ID NO: 45682 - DNA, 20 bp, Artificial Sequence
  chemically synthesized
ttctaactcattaagaaagc

SEQ ID NO: 45683 - DNA, 20 bp, Artificial Sequence
  chemically synthesized
ctaactcattaagaaagcaa

SEQ ID NO: 45684 - DNA, 20 bp, Artificial Sequence
  chemically synthesized
aactcattaagaaagcaaga

SEQ ID NO: 45685 - DNA, 20 bp, Artificial Sequence
  chemically synthesized
ttaagaaagcaagagagtcc

SEQ ID NO: 45686 - DNA, 20 bp, Artificial Sequence
  chemically synthesized
agcaagagagtcccagctct

SEQ ID NO: 45687 - DNA, 20 bp, Artificial Sequence
  chemically synthesized
accaaacagagccaagagct

SEQ ID NO: 45688 - DNA, 20 bp, Artificial Sequence
  chemically synthesized
aaccaaacagagccaagagc

SEQ ID NO: 45689 - DNA, 20 bp, Artificial Sequence
  chemically synthesized
ggtaaaccaaacagagccaa

SEQ ID NO: 45690 - DNA, 20 bp, Artificial Sequence
  chemically synthesized
tgggtaaaccaaacagagcc

SEQ ID NO: 45691 - DNA, 20 bp, Artificial Sequence
  chemically synthesized
tcccagctcttggctctgtt

SEQ ID NO: 45692 - DNA, 20 bp, Artificial Sequence
  chemically synthesized
ccatatgggtaaaccaaaca

SEQ ID NO: 45693 - DNA, 20 bp, Artificial Sequence
  chemically synthesized
tcccatatgggtaaaccaaa

SEQ ID NO: 45694 - DNA, 20 bp, Artificial Sequence
  chemically synthesized
ctctgtttggtttacccata

SEQ ID NO: 45695 - DNA, 20 bp, Artificial Sequence
  chemically synthesized
tctgtttggtttacccatat

SEQ ID NO: 45696 - DNA, 20 bp, Artificial Sequence
  chemically synthesized
tgtttggtttacccatatgg

SEQ ID NO: 45697 - DNA, 20 bp, Artificial Sequence
  chemically synthesized
tatgttgcatgctcccatat

SEQ ID NO: 45698 - DNA, 20 bp, Artificial Sequence
  chemically synthesized
ttatgttgcatgctcccata

SEQ ID NO: 45699 - DNA, 20 bp, Artificial Sequence
  chemically synthesized
atgggagcatgcaacataaa

SEQ ID NO: 45700 - DNA, 20 bp, Artificial Sequence
  chemically synthesized
tgggagcatgcaacataaaa

SEQ ID NO: 45701 - DNA, 20 bp, Artificial Sequence
  chemically synthesized
catgcaacataaaaaggtga

SEQ ID NO: 45702 - DNA, 20 bp, Artificial Sequence
  chemically synthesized
aaaggtgaaagaaatcctaa

SEQ ID NO: 45703 - DNA, 20 bp, Artificial Sequence
  chemically synthesized
accagctgctgcattctgtt

SEQ ID NO: 45704 - DNA, 20 bp, Artificial Sequence
  chemically synthesized
aaccagctgctgcattctgt

SEQ ID NO: 45705 - DNA, 20 bp, Artificial Sequence
  chemically synthesized
aaagaaatcctaacagaatg

SEQ ID NO: 45706 - DNA, 20 bp, Artificial Sequence
  chemically synthesized
gaaatcctaacagaatgcag

SEQ ID NO: 45707 - DNA, 20 bp, Artificial Sequence
  chemically synthesized
tcctaacagaatgcagcagc

SEQ ID NO: 45708 - DNA, 20 bp, Artificial Sequence
  chemically synthesized
cagaatgcagcagctggtta

SEQ ID NO: 45709 - DNA, 20 bp, Artificial Sequence
  chemically synthesized
agaatgcagcagctggttaa

SEQ ID NO: 45710 - DNA, 20 bp, Artificial Sequence
  chemically synthesized
tcaatataatagcctttaac

SEQ ID NO: 45711 - DNA, 20 bp, Artificial Sequence
  chemically synthesized
tcatgaaaatttcaatataa

SEQ ID NO: 45712 - DNA, 20 bp, Artificial Sequence
  chemically synthesized
tattatattgaaattttcat

SEQ ID NO: 45713 - DNA, 20 bp, Artificial Sequence
  chemically synthesized
tgaaattttcatgagtttga

SEQ ID NO: 45714 - DNA, 20 bp, Artificial Sequence
  chemically synthesized
aattttcatgagtttgacag

SEQ ID NO: 45715 - DNA, 20 bp, Artificial Sequence
  chemically synthesized
attttcatgagtttgacagt

SEQ ID NO: 45716 - DNA, 20 bp, Artificial Sequence
  chemically synthesized
tctgccattttgtagttttt

SEQ ID NO: 45717 - DNA, 20 bp, Artificial Sequence
  chemically synthesized
taggccaaaaaactacaaaa

SEQ ID NO: 45718 - DNA, 20 bp, Artificial Sequence
  chemically synthesized
ttctactctctgccattttg

SEQ ID NO: 45719 - DNA, 20 bp, Artificial Sequence
  chemically synthesized
gccaaaaaactacaaaatgg

SEQ ID NO: 45720 - DNA, 20 bp, Artificial Sequence
  chemically synthesized
caaaaaactacaaaatggca

SEQ ID NO: 45721 - DNA, 20 bp, Artificial Sequence
  chemically synthesized
aaaaactacaaaatggcaga

SEQ ID NO: 45722 - DNA, 20 bp, Artificial Sequence
  chemically synthesized
aactacaaaatggcagagag

SEQ ID NO: 45723 - DNA, 20 bp, Artificial Sequence
  chemically synthesized
caaaatggcagagagtagaa

SEQ ID NO: 45724 - DNA, 20 bp, Artificial Sequence
  chemically synthesized
aaaatggcagagagtagaaa

SEQ ID NO: 45725 - DNA, 20 bp, Artificial Sequence
  chemically synthesized
atggcagagagtagaaaagg

SEQ ID NO: 45726 - DNA, 20 bp, Artificial Sequence
  chemically synthesized
agtagaaaaggcagttgtaa

SEQ ID NO: 45727 - DNA, 20 bp, Artificial Sequence
  chemically synthesized
gtagaaaaggcagttgtaac

SEQ ID NO: 45728 - DNA, 20 bp, Artificial Sequence
  chemically synthesized
tgtaacaggttgaacattgt

SEQ ID NO: 45729 - DNA, 20 bp, Artificial Sequence
  chemically synthesized
attgttggtgattatttttt

SEQ ID NO: 45730 - DNA, 20 bp, Artificial Sequence
  chemically synthesized
gttggtgattattttttcag

SEQ ID NO: 45731 - DNA, 20 bp, Artificial Sequence
  chemically synthesized
tattttttcagtggcaatga

SEQ ID NO: 45732 - DNA, 20 bp, Artificial Sequence
  chemically synthesized
tctttcaggttatttgatta

SEQ ID NO: 45733 - DNA, 20 bp, Artificial Sequence
  chemically synthesized
gctgtaatcaaataacctga

SEQ ID NO: 45734 - DNA, 20 bp, Artificial Sequence
  chemically synthesized
tgtaatcaaataacctgaaa

SEQ ID NO: 45735 - DNA, 20 bp, Artificial Sequence
  chemically synthesized
ttcctgccagcatctctttc

SEQ ID NO: 45736 - DNA, 20 bp, Artificial Sequence
  chemically synthesized
attcctgccagcatctcttt

SEQ ID NO: 45737 - DNA, 20 bp, Artificial Sequence
  chemically synthesized
aaataacctgaaagagatgc

SEQ ID NO: 45738 - DNA, 20 bp, Artificial Sequence
  chemically synthesized
taacctgaaagagatgctgg

SEQ ID NO: 45739 - DNA, 20 bp, Artificial Sequence
  chemically synthesized
aacctgaaagagatgctggc

SEQ ID NO: 45740 - DNA, 20 bp, Artificial Sequence
  chemically synthesized
tggggctcccttattcctgc

SEQ ID NO: 45741 - DNA, 20 bp, Artificial Sequence
  chemically synthesized
aaagagatgctggcaggaat

SEQ ID NO: 45742 - DNA, 20 bp, Artificial Sequence
  chemically synthesized
aagagatgctggcaggaata

SEQ ID NO: 45743 - DNA, 20 bp, Artificial Sequence
  chemically synthesized
agagatgctggcaggaataa

SEQ ID NO: 45744 - DNA, 20 bp, Artificial Sequence
  chemically synthesized
agatgctggcaggaataagg

SEQ ID NO: 45745 - DNA, 20 bp, Artificial Sequence
  chemically synthesized
ggcaggaataagggagcccc

SEQ ID NO: 45746 - DNA, 20 bp, Artificial Sequence
  chemically synthesized
gcaggaataagggagcccca

SEQ ID NO: 45747 - DNA, 20 bp, Artificial Sequence
  chemically synthesized
caggaataagggagccccaa

SEQ ID NO: 45748 - DNA, 20 bp, Artificial Sequence
  chemically synthesized
ggaataagggagccccaagg

SEQ ID NO: 45749 - DNA, 20 bp, Artificial Sequence
  chemically synthesized
aataagggagccccaaggga

SEQ ID NO: 45750 - DNA, 20 bp, Artificial Sequence
  chemically synthesized
ttcatattccctctcccttg

SEQ ID NO: 45751 - DNA, 20 bp, Artificial Sequence
  chemically synthesized
ataagggagccccaagggag

SEQ ID NO: 45752 - DNA, 20 bp, Artificial Sequence
  chemically synthesized
tttcatattccctctccctt

SEQ ID NO: 45753 - DNA, 20 bp, Artificial Sequence
  chemically synthesized
taagggagccccaagggaga

SEQ ID NO: 45754 - DNA, 20 bp, Artificial Sequence
  chemically synthesized
ttttcatattccctctccct

SEQ ID NO: 45755 - DNA, 20 bp, Artificial Sequence
  chemically synthesized
cacagcatacatcattgtta

SEQ ID NO: 45756 - DNA, 20 bp, Artificial Sequence
  chemically synthesized
tgtaacaatgatgtatgctg

SEQ ID NO: 45757 - DNA, 20 bp, Artificial Sequence
  chemically synthesized
ttgtctagtttatttgtcca

SEQ ID NO: 45758 - DNA, 20 bp, Artificial Sequence
  chemically synthesized
tatgctgtggacaaataaac

SEQ ID NO: 45759 - DNA, 20 bp, Artificial Sequence
  chemically synthesized
cttcaaactacgtgtttgtc

SEQ ID NO: 45760 - DNA, 20 bp, Artificial Sequence
  chemically synthesized
aaataaactagacaaacacg

SEQ ID NO: 45761 - DNA, 20 bp, Artificial Sequence
  chemically synthesized
ctagacaaacacgtagtttg

SEQ ID NO: 45762 - DNA, 20 bp, Artificial Sequence
  chemically synthesized
tagtttgaagtatcaaaatc

SEQ ID NO: 45763 - DNA, 20 bp, Artificial Sequence
  chemically synthesized
agtttgaagtatcaaaatca

SEQ ID NO: 45764 - DNA, 20 bp, Artificial Sequence
  chemically synthesized
agtatcaaaatcaaggttct

SEQ ID NO: 45765 - DNA, 20 bp, Artificial Sequence
  chemically synthesized
tcagcttttcatatgaggct

SEQ ID NO: 45766 - DNA, 20 bp, Artificial Sequence
  chemically synthesized
tgacatcagcttttcatatg

SEQ ID NO: 45767 - DNA, 20 bp, Artificial Sequence
  chemically synthesized
ggttcttagcctcatatgaa

SEQ ID NO: 45768 - DNA, 20 bp, Artificial Sequence
  chemically synthesized
ctgacatcagcttttcatat

SEQ ID NO: 45769 - DNA, 20 bp, Artificial Sequence
  chemically synthesized
ctcatatgaaaagctgatgt

SEQ ID NO: 45770 - DNA, 20 bp, Artificial Sequence
  chemically synthesized
tcatatgaaaagctgatgtc

SEQ ID NO: 45771 - DNA, 20 bp, Artificial Sequence
  chemically synthesized
ttatgcctgcatcctgacat

SEQ ID NO: 45772 - DNA, 20 bp, Artificial Sequence
  chemically synthesized
gaaaagctgatgtcaggatg

SEQ ID NO: 45773 - DNA, 20 bp, Artificial Sequence
  chemically synthesized
aaaagctgatgtcaggatgc

SEQ ID NO: 45774 - DNA, 20 bp, Artificial Sequence
  chemically synthesized
gctctagtttgcaaatcagg

SEQ ID NO: 45775 - DNA, 20 bp, Artificial Sequence
  chemically synthesized
tttgctctagtttgcaaatc

SEQ ID NO: 45776 - DNA, 20 bp, Artificial Sequence
  chemically synthesized
ttttgctctagtttgcaaat

SEQ ID NO: 45777 - DNA, 20 bp, Artificial Sequence
  chemically synthesized
acactgcctgatttgcaaac

SEQ ID NO: 45778 - DNA, 20 bp, Artificial Sequence
  chemically synthesized
actgcctgatttgcaaacta

SEQ ID NO: 45779 - DNA, 20 bp, Artificial Sequence
  chemically synthesized
tgatttgcaaactagagcaa

SEQ ID NO: 45780 - DNA, 20 bp, Artificial Sequence
  chemically synthesized
gtcattaacatcttttgctc

SEQ ID NO: 45781 - DNA, 20 bp, Artificial Sequence
  chemically synthesized
gcactcattcttgagatttt

SEQ ID NO: 45782 - DNA, 20 bp, Artificial Sequence
  chemically synthesized
tgttaatgacttaaaatctc

SEQ ID NO: 45783 - DNA, 20 bp, Artificial Sequence
  chemically synthesized
tgacttaaaatctcaagaat

SEQ ID NO: 45784 - DNA, 20 bp, Artificial Sequence
  chemically synthesized
tgaattgtgcactcattctt

SEQ ID NO: 45785 - DNA, 20 bp, Artificial Sequence
  chemically synthesized
gtgcacaattcaacaaccaa

SEQ ID NO: 45786 - DNA, 20 bp, Artificial Sequence
  chemically synthesized
tgcacaattcaacaaccaac

SEQ ID NO: 45787 - DNA, 20 bp, Artificial Sequence
  chemically synthesized
accagtggcacagttcctgt

SEQ ID NO: 45788 - DNA, 20 bp, Artificial Sequence
  chemically synthesized
accaacaggaactgtgccac

SEQ ID NO: 45789 - DNA, 20 bp, Artificial Sequence
  chemically synthesized
aggtttctataccagtggca

SEQ ID NO: 45790 - DNA, 20 bp, Artificial Sequence
  chemically synthesized
caggaactgtgccactggta

SEQ ID NO: 45791 - DNA, 20 bp, Artificial Sequence
  chemically synthesized
acaagaggtttctataccag

SEQ ID NO: 45792 - DNA, 20 bp, Artificial Sequence
  chemically synthesized
ataacaagaggtttctatac

SEQ ID NO: 45793 - DNA, 20 bp, Artificial Sequence
  chemically synthesized
gggatcgcccacataacaag

SEQ ID NO: 45794 - DNA, 20 bp, Artificial Sequence
  chemically synthesized
agggatcgcccacataacaa

SEQ ID NO: 45795 - DNA, 20 bp, Artificial Sequence
  chemically synthesized
tatagaaacctcttgttatg

SEQ ID NO: 45796 - DNA, 20 bp, Artificial Sequence
  chemically synthesized
atagaaacctcttgttatgt

SEQ ID NO: 45797 - DNA, 20 bp, Artificial Sequence
  chemically synthesized
aaagggatcgcccacataac

SEQ ID NO: 45798 - DNA, 20 bp, Artificial Sequence
  chemically synthesized
tgtgggcgatccctttatcc

SEQ ID NO: 45799 - DNA, 20 bp, Artificial Sequence
  chemically synthesized
cttttcaatgctgggataaa

SEQ ID NO: 45800 - DNA, 20 bp, Artificial Sequence
  chemically synthesized
tcttttcaatgctgggataa

SEQ ID NO: 45801 - DNA, 20 bp, Artificial Sequence
  chemically synthesized
ttcttttcaatgctgggata

SEQ ID NO: 45802 - DNA, 20 bp, Artificial Sequence
  chemically synthesized
aactttttcttttcaatgct

SEQ ID NO: 45803 - DNA, 20 bp, Artificial Sequence
  chemically synthesized
taactttttcttttcaatgc

SEQ ID NO: 45804 - DNA, 20 bp, Artificial Sequence
  chemically synthesized
ccctttatcccagcattgaa

SEQ ID NO: 45805 - DNA, 20 bp, Artificial Sequence
  chemically synthesized
atcccagcattgaaaagaaa

SEQ ID NO: 45806 - DNA, 20 bp, Artificial Sequence
  chemically synthesized
attgaaaagaaaaagttaca

SEQ ID NO: 45807 - DNA, 20 bp, Artificial Sequence
  chemically synthesized
gttacaaagcattaaaaaca

SEQ ID NO: 45808 - DNA, 20 bp, Artificial Sequence
  chemically synthesized
caaagcattaaaaacatagc

SEQ ID NO: 45809 - DNA, 20 bp, Artificial Sequence
  chemically synthesized
aagcattaaaaacatagcca

SEQ ID NO: 45810 - DNA, 20 bp, Artificial Sequence
  chemically synthesized
cattaaaaacatagccagag

SEQ ID NO: 45811 - DNA, 20 bp, Artificial Sequence
  chemically synthesized
gcaaaaccaggtgtcttctc

SEQ ID NO: 45812 - DNA, 20 bp, Artificial Sequence
  chemically synthesized
acatagccagagaagacacc

SEQ ID NO: 45813 - DNA, 20 bp, Artificial Sequence
  chemically synthesized
agagaagacacctggttttg

SEQ ID NO: 45814 - DNA, 20 bp, Artificial Sequence
  chemically synthesized
agatgcccagctgcaaaacc

SEQ ID NO: 45815 - DNA, 20 bp, Artificial Sequence
  chemically synthesized
cagatgcccagctgcaaaac

SEQ ID NO: 45816 - DNA, 20 bp, Artificial Sequence
  chemically synthesized
aagacacctggttttgcagc

SEQ ID NO: 45817 - DNA, 20 bp, Artificial Sequence
  chemically synthesized
agacacctggttttgcagct

SEQ ID NO: 45818 - DNA, 20 bp, Artificial Sequence
  chemically synthesized
gagtttttaccacagatgcc

SEQ ID NO: 45819 - DNA, 20 bp, Artificial Sequence
  chemically synthesized
gttttgcagctgggcatctg

SEQ ID NO: 45820 - DNA, 20 bp, Artificial Sequence
  chemically synthesized
ccagtcaagagtttttacca

SEQ ID NO: 45821 - DNA, 20 bp, Artificial Sequence
  chemically synthesized
ctgtggtaaaaactcttgac

SEQ ID NO: 45822 - DNA, 20 bp, Artificial Sequence
  chemically synthesized
ttgtcttgacttccagtcaa

SEQ ID NO: 45823 - DNA, 20 bp, Artificial Sequence
  chemically synthesized
tggtaaaaactcttgactgg

SEQ ID NO: 45824 - DNA, 20 bp, Artificial Sequence
  chemically synthesized
gtttgtcttgacttccagtc

SEQ ID NO: 45825 - DNA, 20 bp, Artificial Sequence
  chemically synthesized
aaaactcttgactggaagtc

SEQ ID NO: 45826 - DNA, 20 bp, Artificial Sequence
  chemically synthesized
atcttgtttgtcttgacttc

SEQ ID NO: 45827 - DNA, 20 bp, Artificial Sequence
  chemically synthesized
gactggaagtcaagacaaac

SEQ ID NO: 45828 - DNA, 20 bp, Artificial Sequence
  chemically synthesized
tcaagacaaacaagataaaa

SEQ ID NO: 45829 - DNA, 20 bp, Artificial Sequence
  chemically synthesized
aagacaaacaagataaaaaa

SEQ ID NO: 45830 - DNA, 20 bp, Artificial Sequence
  chemically synthesized
agacaaacaagataaaaaag

SEQ ID NO: 45831 - DNA, 20 bp, Artificial Sequence
  chemically synthesized
agataaaaaagaggaaaaat

SEQ ID NO: 45832 - DNA, 20 bp, Artificial Sequence
  chemically synthesized
gataaaaaagaggaaaaatg

SEQ ID NO: 45833 - DNA, 20 bp, Artificial Sequence
  chemically synthesized
aaaagaggaaaaatgaggac

SEQ ID NO: 45834 - DNA, 20 bp, Artificial Sequence
  chemically synthesized
ggaaaaatgaggactggttg

SEQ ID NO: 45835 - DNA, 20 bp, Artificial Sequence
  chemically synthesized
tacagtgacagtgcttcaac

SEQ ID NO: 45836 - DNA, 20 bp, Artificial Sequence
  chemically synthesized
caaaaatacgtttacagtga

SEQ ID NO: 45837 - DNA, 20 bp, Artificial Sequence
  chemically synthesized
aaagaacaaaaatacgttta

SEQ ID NO: 45838 - DNA, 20 bp, Artificial Sequence
  chemically synthesized
aaacgtatttttgttctttt

SEQ ID NO: 45839 - DNA, 20 bp, Artificial Sequence
  chemically synthesized
agatgccgtcttggtctaaa

SEQ ID NO: 45840 - DNA, 20 bp, Artificial Sequence
  chemically synthesized
atttttgttctttttagacc

SEQ ID NO: 45841 - DNA, 20 bp, Artificial Sequence
  chemically synthesized
ttgttctttttagaccaaga

SEQ ID NO: 45842 - DNA, 20 bp, Artificial Sequence
  chemically synthesized
cataatctgagatgccgtct

SEQ ID NO: 45843 - DNA, 20 bp, Artificial Sequence
  chemically synthesized
tttagaccaagacggcatct

SEQ ID NO: 45844 - DNA, 20 bp, Artificial Sequence
  chemically synthesized
cttaatgccgttcataatct

SEQ ID NO: 45845 - DNA, 20 bp, Artificial Sequence
  chemically synthesized
acggcatctcagattatgaa

SEQ ID NO: 45846 - DNA, 20 bp, Artificial Sequence
  chemically synthesized
ctcagattatgaacggcatt

SEQ ID NO: 45847 - DNA, 20 bp, Artificial Sequence
  chemically synthesized
acggcattaagctgtgcata

SEQ ID NO: 45848 - DNA, 20 bp, Artificial Sequence
  chemically synthesized
ggttcggtggactttatgca

SEQ ID NO: 45849 - DNA, 20 bp, Artificial Sequence
  chemically synthesized
atttgatgtacaaggttcgg

SEQ ID NO: 45850 - DNA, 20 bp, Artificial Sequence
  chemically synthesized
ttaatttgatgtacaaggtt

SEQ ID NO: 45851 - DNA, 20 bp, Artificial Sequence
  chemically synthesized
ccaaattaatttgatgtaca

SEQ ID NO: 45852 - DNA, 20 bp, Artificial Sequence
  chemically synthesized
accaaattaatttgatgtac

SEQ ID NO: 45853 - DNA, 20 bp, Artificial Sequence
  chemically synthesized
ccttgtacatcaaattaatt

SEQ ID NO: 45854 - DNA, 20 bp, Artificial Sequence
  chemically synthesized
tcaaattaatttggtttcca

SEQ ID NO: 45855 - DNA, 20 bp, Artificial Sequence
  chemically synthesized
ctattatctaaaatgttcta

SEQ ID NO: 45856 - DNA, 20 bp, Artificial Sequence
  chemically synthesized
ttggtttccatagaacattt

SEQ ID NO: 45857 - DNA, 20 bp, Artificial Sequence
  chemically synthesized
ccatagaacattttagataa

SEQ ID NO: 45858 - DNA, 20 bp, Artificial Sequence
  chemically synthesized
aacattttagataatagtaa

SEQ ID NO: 45859 - DNA, 20 bp, Artificial Sequence
  chemically synthesized
agataatagtaatggctaat

SEQ ID NO: 45860 - DNA, 20 bp, Artificial Sequence
  chemically synthesized
taatggcacttgtgtcttat

SEQ ID NO: 45861 - DNA, 20 bp, Artificial Sequence
  chemically synthesized
agtaatggctaataagacac

SEQ ID NO: 45862 - DNA, 20 bp, Artificial Sequence
  chemically synthesized
gtcagtaagcagatgattaa

SEQ ID NO: 45863 - DNA, 20 bp, Artificial Sequence
  chemically synthesized
aaatgaacattgtcagtaag

SEQ ID NO: 45864 - DNA, 20 bp, Artificial Sequence
  chemically synthesized
ataaaatgaacattgtcagt

SEQ ID NO: 45865 - DNA, 20 bp, Artificial Sequence
  chemically synthesized
gtttataaaatgaacattgt

SEQ ID NO: 45866 - DNA, 20 bp, Artificial Sequence
  chemically synthesized
tgtatgttttccctatatta

SEQ ID NO: 45867 - DNA, 20 bp, Artificial Sequence
  chemically synthesized
aaatgttaaactgtaatata

SEQ ID NO: 45868 - DNA, 20 bp, Artificial Sequence
  chemically synthesized
aaaatgttaaactgtaatat

SEQ ID NO: 45869 - DNA, 20 bp, Artificial Sequence
  chemically synthesized
taaaatgttaaactgtaata

SEQ ID NO: 45870 - DNA, 20 bp, Artificial Sequence
  chemically synthesized
aacattttacactcatattt

SEQ ID NO: 45871 - DNA, 20 bp, Artificial Sequence
  chemically synthesized
tggtataatttctcaaatat

SEQ ID NO: 45872 - DNA, 20 bp, Artificial Sequence
  chemically synthesized
aatctctttgaaattaggga

SEQ ID NO: 45873 - DNA, 20 bp, Artificial Sequence
  chemically synthesized
ttataatctctttgaaatta

SEQ ID NO: 45874 - DNA, 20 bp, Artificial Sequence
  chemically synthesized
ttataccatccctaatttca

SEQ ID NO: 45875 - DNA, 20 bp, Artificial Sequence
  chemically synthesized
attataatctctttgaaatt

SEQ ID NO: 45876 - DNA, 20 bp, Artificial Sequence
  chemically synthesized
aattataatctctttgaaat

SEQ ID NO: 45877 - DNA, 20 bp, Artificial Sequence
  chemically synthesized
ataccatccctaatttcaaa

SEQ ID NO: 45878 - DNA, 20 bp, Artificial Sequence
  chemically synthesized
tttcaaagagattataattg

SEQ ID NO: 45879 - DNA, 20 bp, Artificial Sequence
  chemically synthesized
tcaaagagattataattgta

SEQ ID NO: 45880 - DNA, 20 bp, Artificial Sequence
  chemically synthesized
aaagagattataattgtaga

SEQ ID NO: 45881 - DNA, 20 bp, Artificial Sequence
  chemically synthesized
tagagagaattgctctccat

SEQ ID NO: 45882 - DNA, 20 bp, Artificial Sequence
  chemically synthesized
agagagaattgctctccata

SEQ ID NO: 45883 - DNA, 20 bp, Artificial Sequence
  chemically synthesized
tatctctgaaaccttatgga

SEQ ID NO: 45884 - DNA, 20 bp, Artificial Sequence
  chemically synthesized
aatatctctgaaaccttatg

SEQ ID NO: 45885 - DNA, 20 bp, Artificial Sequence
  chemically synthesized
aaaatatctctgaaacctta

SEQ ID NO: 45886 - DNA, 20 bp, Artificial Sequence
  chemically synthesized
aattgctctccataaggttt

SEQ ID NO: 45887 - DNA, 20 bp, Artificial Sequence
  chemically synthesized
ttgctctccataaggtttca

SEQ ID NO: 45888 - DNA, 20 bp, Artificial Sequence
  chemically synthesized
aaggtttcagagatattttt

SEQ ID NO: 45889 - DNA, 20 bp, Artificial Sequence
  chemically synthesized
ttacgtaatttcctcatttc

SEQ ID NO: 45890 - DNA, 20 bp, Artificial Sequence
  chemically synthesized
tacgtaatttcctcatttca

SEQ ID NO: 45891 - DNA, 20 bp, Artificial Sequence
  chemically synthesized
ataatcagttccttgaaatg

SEQ ID NO: 45892 - DNA, 20 bp, Artificial Sequence
  chemically synthesized
aataatcagttccttgaaat

SEQ ID NO: 45893 - DNA, 20 bp, Artificial Sequence
  chemically synthesized
tttcaaggaactgattattt

SEQ ID NO: 45894 - DNA, 20 bp, Artificial Sequence
  chemically synthesized
ttaaaagcctctgaaataat

SEQ ID NO: 45895 - DNA, 20 bp, Artificial Sequence
  chemically synthesized
tcaaggaactgattatttca

SEQ ID NO: 45896 - DNA, 20 bp, Artificial Sequence
  chemically synthesized
caaggaactgattatttcag

SEQ ID NO: 45897 - DNA, 20 bp, Artificial Sequence
  chemically synthesized
tgattatttcagaggctttt

SEQ ID NO: 45898 - DNA, 20 bp, Artificial Sequence
  chemically synthesized
gattatttcagaggctttta

SEQ ID NO: 45899 - DNA, 20 bp, Artificial Sequence
  chemically synthesized
ggtgagtatggagaccttaa

SEQ ID NO: 45900 - DNA, 20 bp, Artificial Sequence
  chemically synthesized
tttgccaaaaggtgagtatg

SEQ ID NO: 45901 - DNA, 20 bp, Artificial Sequence
  chemically synthesized
aatttgccaaaaggtgagta

SEQ ID NO: 45902 - DNA, 20 bp, Artificial Sequence
  chemically synthesized
aggtctccatactcaccttt

SEQ ID NO: 45903 - DNA, 20 bp, Artificial Sequence
  chemically synthesized
aggaaaatttgccaaaaggt

SEQ ID NO: 45904 - DNA, 20 bp, Artificial Sequence
  chemically synthesized
aggcaggaaaatttgccaaa

SEQ ID NO: 45905 - DNA, 20 bp, Artificial Sequence
  chemically synthesized
taggcaggaaaatttgccaa

SEQ ID NO: 45906 - DNA, 20 bp, Artificial Sequence
  chemically synthesized
agagagagagaacaataggc

SEQ ID NO: 45907 - DNA, 20 bp, Artificial Sequence
  chemically synthesized
aagagagagagaacaatagg

SEQ ID NO: 45908 - DNA, 20 bp, Artificial Sequence
  chemically synthesized
gataagagagagagaacaat

SEQ ID NO: 45909 - DNA, 20 bp, Artificial Sequence
  chemically synthesized
tgataagagagagagaacaa

SEQ ID NO: 45910 - DNA, 20 bp, Artificial Sequence
  chemically synthesized
ctggctcatgataagagaga

SEQ ID NO: 45911 - DNA, 20 bp, Artificial Sequence
  chemically synthesized
tcctggctcatgataagaga

SEQ ID NO: 45912 - DNA, 20 bp, Artificial Sequence
  chemically synthesized
cttcctggctcatgataaga

SEQ ID NO: 45913 - DNA, 20 bp, Artificial Sequence
  chemically synthesized
tgttctctctctcttatcat

SEQ ID NO: 45914 - DNA, 20 bp, Artificial Sequence
  chemically synthesized
tgcttcctggctcatgataa

SEQ ID NO: 45915 - DNA, 20 bp, Artificial Sequence
  chemically synthesized
tatgcttcctggctcatgat

SEQ ID NO: 45916 - DNA, 20 bp, Artificial Sequence
  chemically synthesized
ctctctctcttatcatgagc

SEQ ID NO: 45917 - DNA, 20 bp, Artificial Sequence
  chemically synthesized
tctctctcttatcatgagcc

SEQ ID NO: 45918 - DNA, 20 bp, Artificial Sequence
  chemically synthesized
ctctcttatcatgagccagg

SEQ ID NO: 45919 - DNA, 20 bp, Artificial Sequence
  chemically synthesized
tttaggattattatgcttcc

SEQ ID NO: 45920 - DNA, 20 bp, Artificial Sequence
  chemically synthesized
caaatcttggtatataattt

SEQ ID NO: 45921 - DNA, 20 bp, Artificial Sequence
  chemically synthesized
tcaaatcttggtatataatt

SEQ ID NO: 45922 - DNA, 20 bp, Artificial Sequence
  chemically synthesized
ataatcctaaattatatacc

SEQ ID NO: 45923 - DNA, 20 bp, Artificial Sequence
  chemically synthesized
taaattatataccaagattt

SEQ ID NO: 45924 - DNA, 20 bp, Artificial Sequence
  chemically synthesized
tctttaaagagctcaaatct

SEQ ID NO: 45925 - DNA, 20 bp, Artificial Sequence
  chemically synthesized
accaagatttgagctcttta

SEQ ID NO: 45926 - DNA, 20 bp, Artificial Sequence
  chemically synthesized
caagatttgagctctttaaa

SEQ ID NO: 45927 - DNA, 20 bp, Artificial Sequence
  chemically synthesized
aagatttgagctctttaaag

SEQ ID NO: 45928 - DNA, 20 bp, Artificial Sequence
  chemically synthesized
tcaccacacacctctttaaa

SEQ ID NO: 45929 - DNA, 20 bp, Artificial Sequence
  chemically synthesized
tttcaccacacacctcttta

SEQ ID NO: 45930 - DNA, 20 bp, Artificial Sequence
  chemically synthesized
gagctctttaaagaggtgtg

SEQ ID NO: 45931 - DNA, 20 bp, Artificial Sequence
  chemically synthesized
aaagaggtgtgtggtgaaat

SEQ ID NO: 45932 - DNA, 20 bp, Artificial Sequence
  chemically synthesized
agaggtgtgtggtgaaattg

SEQ ID NO: 45933 - DNA, 20 bp, Artificial Sequence
  chemically synthesized
ggtgtgtggtgaaattggag

SEQ ID NO: 45934 - DNA, 20 bp, Artificial Sequence
  chemically synthesized
gtgtgtggtgaaattggagt

SEQ ID NO: 45935 - DNA, 20 bp, Artificial Sequence
  chemically synthesized
gtgaaattggagtgggttga

SEQ ID NO: 45936 - DNA, 20 bp, Artificial Sequence
  chemically synthesized
tgaaattggagtgggttgat

SEQ ID NO: 45937 - DNA, 20 bp, Artificial Sequence
  chemically synthesized
gaaattggagtgggttgata

SEQ ID NO: 45938 - DNA, 20 bp, Artificial Sequence
  chemically synthesized
gggttgatagggcatatcta

SEQ ID NO: 45939 - DNA, 20 bp, Artificial Sequence
  chemically synthesized
ttccactgtttaattagctt

SEQ ID NO: 45940 - DNA, 20 bp, Artificial Sequence
  chemically synthesized
catatctaaagctaattaaa

SEQ ID NO: 45941 - DNA, 20 bp, Artificial Sequence
  chemically synthesized
ttatttttccactgtttaat

SEQ ID NO: 45942 - DNA, 20 bp, Artificial Sequence
  chemically synthesized
atctaaagctaattaaacag

SEQ ID NO: 45943 - DNA, 20 bp, Artificial Sequence
  chemically synthesized
aaattcttactttaaaaaac

SEQ ID NO: 45944 - DNA, 20 bp, Artificial Sequence
  chemically synthesized
aataaaattcctgtttttta

SEQ ID NO: 45945 - DNA, 20 bp, Artificial Sequence
  chemically synthesized
taaattcttactttaaaaaa

SEQ ID NO: 45946 - DNA, 20 bp, Artificial Sequence
  chemically synthesized
aaattcctgttttttaaagt

SEQ ID NO: 45947 - DNA, 20 bp, Artificial Sequence
  chemically synthesized
aataatgaattttaaaaata

SEQ ID NO: 45948 - DNA, 20 bp, Artificial Sequence
  chemically synthesized
ataaagatattatcgaacaa

SEQ ID NO: 45949 - DNA, 20 bp, Artificial Sequence
  chemically synthesized
gatattatcgaacaaaagct

SEQ ID NO: 45950 - DNA, 20 bp, Artificial Sequence
  chemically synthesized
cgaacaaaagctgagatctt

SEQ ID NO: 45951 - DNA, 20 bp, Artificial Sequence
  chemically synthesized
aacttaaaaaccgaagatct

SEQ ID NO: 45952 - DNA, 20 bp, Artificial Sequence
  chemically synthesized
ctgtccaaacttaaaaaccg

SEQ ID NO: 45953 - DNA, 20 bp, Artificial Sequence
  chemically synthesized
agctgagatcttcggttttt

SEQ ID NO: 45954 - DNA, 20 bp, Artificial Sequence
  chemically synthesized
agatcttcggtttttaagtt

SEQ ID NO: 45955 - DNA, 20 bp, Artificial Sequence
  chemically synthesized
cttcggtttttaagtttgga

SEQ ID NO: 45956 - DNA, 20 bp, Artificial Sequence
  chemically synthesized
ttcggtttttaagtttggac

SEQ ID NO: 45957 - DNA, 20 bp, Artificial Sequence
  chemically synthesized
tttggacaggacaactgaat

SEQ ID NO: 45958 - DNA, 20 bp, Artificial Sequence
  chemically synthesized
cgtaatgagcatgactcatt

SEQ ID NO: 45959 - DNA, 20 bp, Artificial Sequence
  chemically synthesized
ttttagctctaagacgtaat

SEQ ID NO: 45960 - DNA, 20 bp, Artificial Sequence
  chemically synthesized
gagtcatgctcattacgtct

SEQ ID NO: 45961 - DNA, 20 bp, Artificial Sequence
  chemically synthesized
gtcatgctcattacgtctta

SEQ ID NO: 45962 - DNA, 20 bp, Artificial Sequence
  chemically synthesized
ctaagatcctttttagctct

SEQ ID NO: 45963 - DNA, 20 bp, Artificial Sequence
  chemically synthesized
cattacgtcttagagctaaa

SEQ ID NO: 45964 - DNA, 20 bp, Artificial Sequence
  chemically synthesized
attacgtcttagagctaaaa

SEQ ID NO: 45965 - DNA, 20 bp, Artificial Sequence
  chemically synthesized
atgatatctaagatcctttt

SEQ ID NO: 45966 - DNA, 20 bp, Artificial Sequence
  chemically synthesized
cttagagctaaaaaggatct

SEQ ID NO: 45967 - DNA, 20 bp, Artificial Sequence
  chemically synthesized
agttggactagatgatatct

SEQ ID NO: 45968 - DNA, 20 bp, Artificial Sequence
  chemically synthesized
aaaggatcttagatatcatc

SEQ ID NO: 45969 - DNA, 20 bp, Artificial Sequence
  chemically synthesized
tataaaataaagagttggac

SEQ ID NO: 45970 - DNA, 20 bp, Artificial Sequence
  chemically synthesized
taatttataaaataaagagt

SEQ ID NO: 45971 - DNA, 20 bp, Artificial Sequence
  chemically synthesized
tttctaatttataaaataaa

SEQ ID NO: 45972 - DNA, 20 bp, Artificial Sequence
  chemically synthesized
ggtttctaatttataaaata

SEQ ID NO: 45973 - DNA, 20 bp, Artificial Sequence
  chemically synthesized
caactctttattttataaat

SEQ ID NO: 45974 - DNA, 20 bp, Artificial Sequence
  chemically synthesized
tattttataaattagaaacc

SEQ ID NO: 45975 - DNA, 20 bp, Artificial Sequence
  chemically synthesized
attttataaattagaaacca

SEQ ID NO: 45976 - DNA, 20 bp, Artificial Sequence
  chemically synthesized
ataaattagaaaccaaggtt

SEQ ID NO: 45977 - DNA, 20 bp, Artificial Sequence
  chemically synthesized
caccatgcccagccaaacct

SEQ ID NO: 45978 - DNA, 20 bp, Artificial Sequence
  chemically synthesized
attagaaaccaaggtttggc

SEQ ID NO: 45979 - DNA, 20 bp, Artificial Sequence
  chemically synthesized
ttagaaaccaaggtttggct

SEQ ID NO: 45980 - DNA, 20 bp, Artificial Sequence
  chemically synthesized
aaccaaggtttggctgggca

SEQ ID NO: 45981 - DNA, 20 bp, Artificial Sequence
  chemically synthesized
caaggtttggctgggcatgg

SEQ ID NO: 45982 - DNA, 20 bp, Artificial Sequence
  chemically synthesized
caggcttgagccaccatgcc

SEQ ID NO: 45983 - DNA, 20 bp, Artificial Sequence
  chemically synthesized
ttggctgggcatggtggctc

SEQ ID NO: 45984 - DNA, 20 bp, Artificial Sequence
  chemically synthesized
agtgctgggattacaggctt

SEQ ID NO: 45985 - DNA, 20 bp, Artificial Sequence
  chemically synthesized
gtggctcaagcctgtaatcc

SEQ ID NO: 45986 - DNA, 20 bp, Artificial Sequence
  chemically synthesized
tcccaaagtgctgggattac

SEQ ID NO: 45987 - DNA, 20 bp, Artificial Sequence
  chemically synthesized
ctcccaaagtgctgggatta

SEQ ID NO: 45988 - DNA, 20 bp, Artificial Sequence
  chemically synthesized
agcctgtaatcccagcactt

SEQ ID NO: 45989 - DNA, 20 bp, Artificial Sequence
  chemically synthesized
cctcggcctcccaaagtgct

SEQ ID NO: 45990 - DNA, 20 bp, Artificial Sequence
  chemically synthesized
gcctgtaatcccagcacttt

SEQ ID NO: 45991 - DNA, 20 bp, Artificial Sequence
  chemically synthesized
gcctcggcctcccaaagtgc

SEQ ID NO: 45992 - DNA, 20 bp, Artificial Sequence
  chemically synthesized
ctgtaatcccagcactttgg

SEQ ID NO: 45993 - DNA, 20 bp, Artificial Sequence
  chemically synthesized
tgtaatcccagcactttggg

SEQ ID NO: 45994 - DNA, 20 bp, Artificial Sequence
  chemically synthesized
ccacccgcctcggcctccca

SEQ ID NO: 45995 - DNA, 20 bp, Artificial Sequence
  chemically synthesized
tcccagcactttgggaggcc

SEQ ID NO: 45996 - DNA, 20 bp, Artificial Sequence
  chemically synthesized
cccagcactttgggaggccg

SEQ ID NO: 45997 - DNA, 20 bp, Artificial Sequence
  chemically synthesized
agcactttgggaggccgagg

SEQ ID NO: 45998 - DNA, 20 bp, Artificial Sequence
  chemically synthesized
gcactttgggaggccgaggc

SEQ ID NO: 45999 - DNA, 20 bp, Artificial Sequence
  chemically synthesized
ctttgggaggccgaggcggg

SEQ ID NO: 46000 - DNA, 20 bp, Artificial Sequence
  chemically synthesized
ctcaggtgatccacccgcct

SEQ ID NO: 46001 - DNA, 20 bp, Artificial Sequence
  chemically synthesized
ccgaggcgggtggatcacct

SEQ ID NO: 46002 - DNA, 20 bp, Artificial Sequence
  chemically synthesized
cgaggcgggtggatcacctg

SEQ ID NO: 46003 - DNA, 20 bp, Artificial Sequence
  chemically synthesized
gcgggtggatcacctgaggt

SEQ ID NO: 46004 - DNA, 20 bp, Artificial Sequence
  chemically synthesized
cgggtggatcacctgaggtc

SEQ ID NO: 46005 - DNA, 20 bp, Artificial Sequence
  chemically synthesized
cgtctcgaactcctgacctc

SEQ ID NO: 46006 - DNA, 20 bp, Artificial Sequence
  chemically synthesized
ggtggatcacctgaggtcag

SEQ ID NO: 46007 - DNA, 20 bp, Artificial Sequence
  chemically synthesized
tcgtctcgaactcctgacct

SEQ ID NO: 46008 - DNA, 20 bp, Artificial Sequence
  chemically synthesized
tcacctgaggtcaggagttc

SEQ ID NO: 46009 - DNA, 20 bp, Artificial Sequence
  chemically synthesized
tgaggtcaggagttcgagac

SEQ ID NO: 46010 - DNA, 20 bp, Artificial Sequence
  chemically synthesized
gaggtttcaccatattggtc

SEQ ID NO: 46011 - DNA, 20 bp, Artificial Sequence
  chemically synthesized
cgagacgagcctgaccaata

SEQ ID NO: 46012 - DNA, 20 bp, Artificial Sequence
  chemically synthesized
cgaggtttcaccatattggt

SEQ ID NO: 46013 - DNA, 20 bp, Artificial Sequence
  chemically synthesized
gagacgaggtttcaccatat

SEQ ID NO: 46014 - DNA, 20 bp, Artificial Sequence
  chemically synthesized
ttgtatttttagtagagacg

SEQ ID NO: 46015 - DNA, 20 bp, Artificial Sequence
  chemically synthesized
tttgtatttttagtagagac

SEQ ID NO: 46016 - DNA, 20 bp, Artificial Sequence
  chemically synthesized
taatttttgtatttttagta

SEQ ID NO: 46017 - DNA, 20 bp, Artificial Sequence
  chemically synthesized
gctaatttttgtatttttag

SEQ ID NO: 46018 - DNA, 20 bp, Artificial Sequence
  chemically synthesized
ttggctaatttttgtatttt

SEQ ID NO: 46019 - DNA, 20 bp, Artificial Sequence
  chemically synthesized
tctactaaaaatacaaaaat

SEQ ID NO: 46020 - DNA, 20 bp, Artificial Sequence
  chemically synthesized
taaaaatacaaaaattagcc

SEQ ID NO: 46021 - DNA, 20 bp, Artificial Sequence
  chemically synthesized
atacaaaaattagccaagca

SEQ ID NO: 46022 - DNA, 20 bp, Artificial Sequence
  chemically synthesized
caaaaattagccaagcatgg

SEQ ID NO: 46023 - DNA, 20 bp, Artificial Sequence
  chemically synthesized
caggcacctgccaccatgct

SEQ ID NO: 46024 - DNA, 20 bp, Artificial Sequence
  chemically synthesized
aaattagccaagcatggtgg

SEQ ID NO: 46025 - DNA, 20 bp, Artificial Sequence
  chemically synthesized
aattagccaagcatggtggc

SEQ ID NO: 46026 - DNA, 20 bp, Artificial Sequence
  chemically synthesized
agcatggtggcaggtgcctg

SEQ ID NO: 46027 - DNA, 20 bp, Artificial Sequence
  chemically synthesized
gtggcaggtgcctgtagtct

SEQ ID NO: 46028 - DNA, 20 bp, Artificial Sequence
  chemically synthesized
tcccgagtagctgagactac

SEQ ID NO: 46029 - DNA, 20 bp, Artificial Sequence
  chemically synthesized
ctcccgagtagctgagacta

SEQ ID NO: 46030 - DNA, 20 bp, Artificial Sequence
  chemically synthesized
tgcctgtagtctcagctact

SEQ ID NO: 46031 - DNA, 20 bp, Artificial Sequence
  chemically synthesized
gtcttagctcccgagtagct

SEQ ID NO: 46032 - DNA, 20 bp, Artificial Sequence
  chemically synthesized
gcctgtagtctcagctactc

SEQ ID NO: 46033 - DNA, 20 bp, Artificial Sequence
  chemically synthesized
ctgtagtctcagctactcgg

SEQ ID NO: 46034 - DNA, 20 bp, Artificial Sequence
  chemically synthesized
ctttcgtcttagctcccgag

SEQ ID NO: 46035 - DNA, 20 bp, Artificial Sequence
  chemically synthesized
gtctcagctactcgggagct

SEQ ID NO: 46036 - DNA, 20 bp, Artificial Sequence
  chemically synthesized
attctttcgtcttagctccc

SEQ ID NO: 46037 - DNA, 20 bp, Artificial Sequence
  chemically synthesized
ctactcgggagctaagacga

SEQ ID NO: 46038 - DNA, 20 bp, Artificial Sequence
  chemically synthesized
ttcaagcaattctttcgtct

SEQ ID NO: 46039 - DNA, 20 bp, Artificial Sequence
  chemically synthesized
acgaaagaattgcttgaacc

SEQ ID NO: 46040 - DNA, 20 bp, Artificial Sequence
  chemically synthesized
cgaaagaattgcttgaaccc

SEQ ID NO: 46041 - DNA, 20 bp, Artificial Sequence
  chemically synthesized
aacccctgcctcccgggttc

SEQ ID NO: 46042 - DNA, 20 bp, Artificial Sequence
  chemically synthesized
aaagaattgcttgaacccgg

SEQ ID NO: 46043 - DNA, 20 bp, Artificial Sequence
  chemically synthesized
aagaattgcttgaacccggg

SEQ ID NO: 46044 - DNA, 20 bp, Artificial Sequence
  chemically synthesized
aattgcttgaacccgggagg

SEQ ID NO: 46045 - DNA, 20 bp, Artificial Sequence
  chemically synthesized
attgcttgaacccgggaggc

SEQ ID NO: 46046 - DNA, 20 bp, Artificial Sequence
  chemically synthesized
cactgcaacccctgcctccc

SEQ ID NO: 46047 - DNA, 20 bp, Artificial Sequence
  chemically synthesized
ttgcttgaacccgggaggca

SEQ ID NO: 46048 - DNA, 20 bp, Artificial Sequence
  chemically synthesized
tcactgcaacccctgcctcc

SEQ ID NO: 46049 - DNA, 20 bp, Artificial Sequence
  chemically synthesized
tgcttgaacccgggaggcag

SEQ ID NO: 46050 - DNA, 20 bp, Artificial Sequence
  chemically synthesized
aacccgggaggcaggggttg

SEQ ID NO: 46051 - DNA, 20 bp, Artificial Sequence
  chemically synthesized
cgggaggcaggggttgcagt

SEQ ID NO: 46052 - DNA, 20 bp, Artificial Sequence
  chemically synthesized
ggcaggggttgcagtgagcc

SEQ ID NO: 46053 - DNA, 20 bp, Artificial Sequence
  chemically synthesized
gggttgcagtgagccgagat

SEQ ID NO: 46054 - DNA, 20 bp, Artificial Sequence
  chemically synthesized
ggttgcagtgagccgagatc

SEQ ID NO: 46055 - DNA, 20 bp, Artificial Sequence
  chemically synthesized
ggagtgcagtggcccgatct

SEQ ID NO: 46056 - DNA, 20 bp, Artificial Sequence
  chemically synthesized
ttgcccaggctggagtgcag

SEQ ID NO: 46057 - DNA, 20 bp, Artificial Sequence
  chemically synthesized
gagatcgggccactgcactc

SEQ ID NO: 46058 - DNA, 20 bp, Artificial Sequence
  chemically synthesized
ctgttgcccaggctggagtg

SEQ ID NO: 46059 - DNA, 20 bp, Artificial Sequence
  chemically synthesized
cgggccactgcactccagcc

SEQ ID NO: 46060 - DNA, 20 bp, Artificial Sequence
  chemically synthesized
gggccactgcactccagcct

SEQ ID NO: 46061 - DNA, 20 bp, Artificial Sequence
  chemically synthesized
tcactctgttgcccaggctg

SEQ ID NO: 46062 - DNA, 20 bp, Artificial Sequence
  chemically synthesized
tttcactctgttgcccaggc

SEQ ID NO: 46063 - DNA, 20 bp, Artificial Sequence
  chemically synthesized
ctgcactccagcctgggcaa

SEQ ID NO: 46064 - DNA, 20 bp, Artificial Sequence
  chemically synthesized
ggagtttcactctgttgccc

SEQ ID NO: 46065 - DNA, 20 bp, Artificial Sequence
  chemically synthesized
gcactccagcctgggcaaca

SEQ ID NO: 46066 - DNA, 20 bp, Artificial Sequence
  chemically synthesized
tggagtttcactctgttgcc

SEQ ID NO: 46067 - DNA, 20 bp, Artificial Sequence
  chemically synthesized
ttttttttttttttgagatg

SEQ ID NO: 46068 - DNA, 20 bp, Artificial Sequence
  chemically synthesized
ttttttttttttttttgaga

SEQ ID NO: 46069 - DNA, 20 bp, Artificial Sequence
  chemically synthesized
tttttttttttttttttttt

SEQ ID NO: 46070 - DNA, 20 bp, Artificial Sequence
  chemically synthesized
aaaaaaaaaaaaaaaaaaaa

SEQ ID NO: 46071 - DNA, 20 bp, Artificial Sequence
  chemically synthesized
aaaaaaaaaaaaaaaaaaga

SEQ ID NO: 46072 - DNA, 20 bp, Artificial Sequence
  chemically synthesized
aaaaaaaaaagaaagaaacc

SEQ ID NO: 46073 - DNA, 20 bp, Artificial Sequence
  chemically synthesized
cacttaacctataaaaatct

SEQ ID NO: 46074 - DNA, 20 bp, Artificial Sequence
  chemically synthesized
gaaagaaaccaagattttta

SEQ ID NO: 46075 - DNA, 20 bp, Artificial Sequence
  chemically synthesized
aaagaaaccaagatttttat

SEQ ID NO: 46076 - DNA, 20 bp, Artificial Sequence
  chemically synthesized
aaccaagatttttataggtt

SEQ ID NO: 46077 - DNA, 20 bp, Artificial Sequence
  chemically synthesized
taggttaagtgacttgccta

SEQ ID NO: 46078 - DNA, 20 bp, Artificial Sequence
  chemically synthesized
gcgactgtatggctttaggc

SEQ ID NO: 46079 - DNA, 20 bp, Artificial Sequence
  chemically synthesized
ttaggcgactgtatggcttt

SEQ ID NO: 46080 - DNA, 20 bp, Artificial Sequence
  chemically synthesized
attaggcgactgtatggctt

SEQ ID NO: 46081 - DNA, 20 bp, Artificial Sequence
  chemically synthesized
gtgacttgcctaaagccata

SEQ ID NO: 46082 - DNA, 20 bp, Artificial Sequence
  chemically synthesized
tctgtcattaggcgactgta

SEQ ID NO: 46083 - DNA, 20 bp, Artificial Sequence
  chemically synthesized
gccatacagtcgcctaatga

SEQ ID NO: 46084 - DNA, 20 bp, Artificial Sequence
  chemically synthesized
catacagtcgcctaatgaca

SEQ ID NO: 46085 - DNA, 20 bp, Artificial Sequence
  chemically synthesized
gtcttagaggctctgtcatt

SEQ ID NO: 46086 - DNA, 20 bp, Artificial Sequence
  chemically synthesized
agtcttagaggctctgtcat

SEQ ID NO: 46087 - DNA, 20 bp, Artificial Sequence
  chemically synthesized
cgcctaatgacagagcctct

SEQ ID NO: 46088 - DNA, 20 bp, Artificial Sequence
  chemically synthesized
aatgacagagcctctaagac

SEQ ID NO: 46089 - DNA, 20 bp, Artificial Sequence
  chemically synthesized
gtcctccagtctagtcttag

SEQ ID NO: 46090 - DNA, 20 bp, Artificial Sequence
  chemically synthesized
agtcctccagtctagtctta

SEQ ID NO: 46091 - DNA, 20 bp, Artificial Sequence
  chemically synthesized
ttagtcctccagtctagtct

SEQ ID NO: 46092 - DNA, 20 bp, Artificial Sequence
  chemically synthesized
cagagcctctaagactagac

SEQ ID NO: 46093 - DNA, 20 bp, Artificial Sequence
  chemically synthesized
gagcctctaagactagactg

SEQ ID NO: 46094 - DNA, 20 bp, Artificial Sequence
  chemically synthesized
agcctctaagactagactgg

SEQ ID NO: 46095 - DNA, 20 bp, Artificial Sequence
  chemically synthesized
tcaattttagtcctccagtc

SEQ ID NO: 46096 - DNA, 20 bp, Artificial Sequence
  chemically synthesized
aaacttcaattttagtcctc

SEQ ID NO: 46097 - DNA, 20 bp, Artificial Sequence
  chemically synthesized
agactggaggactaaaattg

SEQ ID NO: 46098 - DNA, 20 bp, Artificial Sequence
  chemically synthesized
gaataagaaaacttcaattt

SEQ ID NO: 46099 - DNA, 20 bp, Artificial Sequence
  chemically synthesized
aattgaagttttcttattca

SEQ ID NO: 46100 - DNA, 20 bp, Artificial Sequence
  chemically synthesized
aagggcacagatctatgaat

SEQ ID NO: 46101 - DNA, 20 bp, Artificial Sequence
  chemically synthesized
tgatggtattgataagggca

SEQ ID NO: 46102 - DNA, 20 bp, Artificial Sequence
  chemically synthesized
catggtgatggtattgataa

SEQ ID NO: 46103 - DNA, 20 bp, Artificial Sequence
  chemically synthesized
ccatggtgatggtattgata

SEQ ID NO: 46104 - DNA, 20 bp, Artificial Sequence
  chemically synthesized
accatggtgatggtattgat

SEQ ID NO: 46105 - DNA, 20 bp, Artificial Sequence
  chemically synthesized
ccttatcaataccatcacca

SEQ ID NO: 46106 - DNA, 20 bp, Artificial Sequence
  chemically synthesized
gtacctaaagaccatggtga

SEQ ID NO: 46107 - DNA, 20 bp, Artificial Sequence
  chemically synthesized
aataccatcaccatggtctt

SEQ ID NO: 46108 - DNA, 20 bp, Artificial Sequence
  chemically synthesized
cttcatgtacctaaagacca

SEQ ID NO: 46109 - DNA, 20 bp, Artificial Sequence
  chemically synthesized
ataccatcaccatggtcttt

SEQ ID NO: 46110 - DNA, 20 bp, Artificial Sequence
  chemically synthesized
aatgctccttcatgtaccta

SEQ ID NO: 46111 - DNA, 20 bp, Artificial Sequence
  chemically synthesized
ccatggtctttaggtacatg

SEQ ID NO: 46112 - DNA, 20 bp, Artificial Sequence
  chemically synthesized
catggtctttaggtacatga

SEQ ID NO: 46113 - DNA, 20 bp, Artificial Sequence
  chemically synthesized
tggtctttaggtacatgaag

SEQ ID NO: 46114 - DNA, 20 bp, Artificial Sequence
  chemically synthesized
ttaggtacatgaaggagcat

SEQ ID NO: 46115 - DNA, 20 bp, Artificial Sequence
  chemically synthesized
atgaaggagcattggacaaa

SEQ ID NO: 46116 - DNA, 20 bp, Artificial Sequence
  chemically synthesized
tgaaggagcattggacaaat

SEQ ID NO: 46117 - DNA, 20 bp, Artificial Sequence
  chemically synthesized
cattggacaaataggatatg

SEQ ID NO: 46118 - DNA, 20 bp, Artificial Sequence
  chemically synthesized
ttctcagtggaattagagag

SEQ ID NO: 46119 - DNA, 20 bp, Artificial Sequence
  chemically synthesized
tgtttctcagtggaattaga

SEQ ID NO: 46120 - DNA, 20 bp, Artificial Sequence
  chemically synthesized
gctgtttctcagtggaatta

SEQ ID NO: 46121 - DNA, 20 bp, Artificial Sequence
  chemically synthesized
ttgctgtttctcagtggaat

SEQ ID NO: 46122 - DNA, 20 bp, Artificial Sequence
  chemically synthesized
agctgctctctaattccact

SEQ ID NO: 46123 - DNA, 20 bp, Artificial Sequence
  chemically synthesized
agtctcttgctgtttctcag

SEQ ID NO: 46124 - DNA, 20 bp, Artificial Sequence
  chemically synthesized
tctctaattccactgagaaa

SEQ ID NO: 46125 - DNA, 20 bp, Artificial Sequence
  chemically synthesized
attagtctcttgctgtttct

SEQ ID NO: 46126 - DNA, 20 bp, Artificial Sequence
  chemically synthesized
taattccactgagaaacagc

SEQ ID NO: 46127 - DNA, 20 bp, Artificial Sequence
  chemically synthesized
attccactgagaaacagcaa

SEQ ID NO: 46128 - DNA, 20 bp, Artificial Sequence
  chemically synthesized
aacagcaagagactaataca

SEQ ID NO: 46129 - DNA, 20 bp, Artificial Sequence
  chemically synthesized
tgtaattcccttctgtgtat

SEQ ID NO: 46130 - DNA, 20 bp, Artificial Sequence
  chemically synthesized
agcaagagactaatacacag

SEQ ID NO: 46131 - DNA, 20 bp, Artificial Sequence
  chemically synthesized
gcaagagactaatacacaga

SEQ ID NO: 46132 - DNA, 20 bp, Artificial Sequence
  chemically synthesized
caagagactaatacacagaa

SEQ ID NO: 46133 - DNA, 20 bp, Artificial Sequence
  chemically synthesized
taatacacagaagggaatta

SEQ ID NO: 46134 - DNA, 20 bp, Artificial Sequence
  chemically synthesized
gaagggaattacagcttttc

SEQ ID NO: 46135 - DNA, 20 bp, Artificial Sequence
  chemically synthesized
taaagagacaaattccagaa

SEQ ID NO: 46136 - DNA, 20 bp, Artificial Sequence
  chemically synthesized
aataataaagagacaaattc

SEQ ID NO: 46137 - DNA, 20 bp, Artificial Sequence
  chemically synthesized
tccgtccaaaaaataataaa

SEQ ID NO: 46138 - DNA, 20 bp, Artificial Sequence
  chemically synthesized
actccgtccaaaaaataata

SEQ ID NO: 46139 - DNA, 20 bp, Artificial Sequence
  chemically synthesized
tttgtctctttattattttt

SEQ ID NO: 46140 - DNA, 20 bp, Artificial Sequence
  chemically synthesized
tctctttattattttttgga

SEQ ID NO: 46141 - DNA, 20 bp, Artificial Sequence
  chemically synthesized
tctttattattttttggacg

SEQ ID NO: 46142 - DNA, 20 bp, Artificial Sequence
  chemically synthesized
agtacattgctgtgagggaa

SEQ ID NO: 46143 - DNA, 20 bp, Artificial Sequence
  chemically synthesized
agttcatttccattccctca

SEQ ID NO: 46144 - DNA, 20 bp, Artificial Sequence
  chemically synthesized
atcccagtacattgctgtga

SEQ ID NO: 46145 - DNA, 20 bp, Artificial Sequence
  chemically synthesized
gatcccagtacattgctgtg

SEQ ID NO: 46146 - DNA, 20 bp, Artificial Sequence
  chemically synthesized
agatcccagtacattgctgt

SEQ ID NO: 46147 - DNA, 20 bp, Artificial Sequence
  chemically synthesized
attccctcacagcaatgtac

SEQ ID NO: 46148 - DNA, 20 bp, Artificial Sequence
  chemically synthesized
ttccctcacagcaatgtact

SEQ ID NO: 46149 - DNA, 20 bp, Artificial Sequence
  chemically synthesized
acttctactacaagagatcc

SEQ ID NO: 46150 - DNA, 20 bp, Artificial Sequence
  chemically synthesized
caatgtactgggatctcttg

SEQ ID NO: 46151 - DNA, 20 bp, Artificial Sequence
  chemically synthesized
tgtactgggatctcttgtag

SEQ ID NO: 46152 - DNA, 20 bp, Artificial Sequence
  chemically synthesized
tgatgttacttctactacaa

SEQ ID NO: 46153 - DNA, 20 bp, Artificial Sequence
  chemically synthesized
actgggatctcttgtagtag

SEQ ID NO: 46154 - DNA, 20 bp, Artificial Sequence
  chemically synthesized
cctgatgttacttctactac

SEQ ID NO: 46155 - DNA, 20 bp, Artificial Sequence
  chemically synthesized
tcttgtagtagaagtaacat

SEQ ID NO: 46156 - DNA, 20 bp, Artificial Sequence
  chemically synthesized
cttgtagtagaagtaacatc

SEQ ID NO: 46157 - DNA, 20 bp, Artificial Sequence
  chemically synthesized
ttgtagtagaagtaacatca

SEQ ID NO: 46158 - DNA, 20 bp, Artificial Sequence
  chemically synthesized
gtagtagaagtaacatcagg

SEQ ID NO: 46159 - DNA, 20 bp, Artificial Sequence
  chemically synthesized
gtagaagtaacatcagggag

SEQ ID NO: 46160 - DNA, 20 bp, Artificial Sequence
  chemically synthesized
tcagggagaagatgaatata

SEQ ID NO: 46161 - DNA, 20 bp, Artificial Sequence
  chemically synthesized
cagggagaagatgaatatat

SEQ ID NO: 46162 - DNA, 20 bp, Artificial Sequence
  chemically synthesized
agggagaagatgaatatata

SEQ ID NO: 46163 - DNA, 20 bp, Artificial Sequence
  chemically synthesized
agaagatgaatatataggga

SEQ ID NO: 46164 - DNA, 20 bp, Artificial Sequence
  chemically synthesized
gaagatgaatatatagggaa

SEQ ID NO: 46165 - DNA, 20 bp, Artificial Sequence
  chemically synthesized
aatatatagggaaaggacaa

SEQ ID NO: 46166 - DNA, 20 bp, Artificial Sequence
  chemically synthesized
atatatagggaaaggacaat

SEQ ID NO: 46167 - DNA, 20 bp, Artificial Sequence
  chemically synthesized
tagggaaaggacaatgggac

SEQ ID NO: 46168 - DNA, 20 bp, Artificial Sequence
  chemically synthesized
agggaaaggacaatgggacc

SEQ ID NO: 46169 - DNA, 20 bp, Artificial Sequence
  chemically synthesized
gggaaaggacaatgggaccg

SEQ ID NO: 46170 - DNA, 20 bp, Artificial Sequence
  chemically synthesized
gaaaggacaatgggaccggg

SEQ ID NO: 46171 - DNA, 20 bp, Artificial Sequence
  chemically synthesized
atggattgctagggtctccc

SEQ ID NO: 46172 - DNA, 20 bp, Artificial Sequence
  chemically synthesized
caatgggaccggggagaccc

SEQ ID NO: 46173 - DNA, 20 bp, Artificial Sequence
  chemically synthesized
aggtctcacatggattgcta

SEQ ID NO: 46174 - DNA, 20 bp, Artificial Sequence
  chemically synthesized
gaggtctcacatggattgct

SEQ ID NO: 46175 - DNA, 20 bp, Artificial Sequence
  chemically synthesized
agaggtctcacatggattgc

SEQ ID NO: 46176 - DNA, 20 bp, Artificial Sequence
  chemically synthesized
gagaccctagcaatccatgt

SEQ ID NO: 46177 - DNA, 20 bp, Artificial Sequence
  chemically synthesized
ggctcactagaggtctcaca

SEQ ID NO: 46178 - DNA, 20 bp, Artificial Sequence
  chemically synthesized
agcaatccatgtgagacctc

SEQ ID NO: 46179 - DNA, 20 bp, Artificial Sequence
  chemically synthesized
atccatgtgagacctctagt

SEQ ID NO: 46180 - DNA, 20 bp, Artificial Sequence
  chemically synthesized
acttgtttggggctcactag

SEQ ID NO: 46181 - DNA, 20 bp, Artificial Sequence
  chemically synthesized
tacttgtttggggctcacta

SEQ ID NO: 46182 - DNA, 20 bp, Artificial Sequence
  chemically synthesized
actacttgtttggggctcac

SEQ ID NO: 46183 - DNA, 20 bp, Artificial Sequence
  chemically synthesized
acctctagtgagccccaaac

SEQ ID NO: 46184 - DNA, 20 bp, Artificial Sequence
  chemically synthesized
tccaaatgactacttgtttg

SEQ ID NO: 46185 - DNA, 20 bp, Artificial Sequence
  chemically synthesized
tctagtgagccccaaacaag

SEQ ID NO: 46186 - DNA, 20 bp, Artificial Sequence
  chemically synthesized
ctccaaatgactacttgttt

SEQ ID NO: 46187 - DNA, 20 bp, Artificial Sequence
  chemically synthesized
tctccaaatgactacttgtt

SEQ ID NO: 46188 - DNA, 20 bp, Artificial Sequence
  chemically synthesized
gccccaaacaagtagtcatt

SEQ ID NO: 46189 - DNA, 20 bp, Artificial Sequence
  chemically synthesized
cccaaacaagtagtcatttg

SEQ ID NO: 46190 - DNA, 20 bp, Artificial Sequence
  chemically synthesized
agtagtcatttggagaataa

SEQ ID NO: 46191 - DNA, 20 bp, Artificial Sequence
  chemically synthesized
atttggagaataatagctta

SEQ ID NO: 46192 - DNA, 20 bp, Artificial Sequence
  chemically synthesized
tttggagaataatagcttaa

SEQ ID NO: 46193 - DNA, 20 bp, Artificial Sequence
  chemically synthesized
ggagaattcaagacaccttt

SEQ ID NO: 46194 - DNA, 20 bp, Artificial Sequence
  chemically synthesized
ttaggatcactggagaattc

SEQ ID NO: 46195 - DNA, 20 bp, Artificial Sequence
  chemically synthesized
taaaggtgtcttgaattctc

SEQ ID NO: 46196 - DNA, 20 bp, Artificial Sequence
  chemically synthesized
atgaggttttaggatcactg

SEQ ID NO: 46197 - DNA, 20 bp, Artificial Sequence
  chemically synthesized
agatgaggttttaggatcac

SEQ ID NO: 46198 - DNA, 20 bp, Artificial Sequence
  chemically synthesized
cctttcatagatgaggtttt

SEQ ID NO: 46199 - DNA, 20 bp, Artificial Sequence
  chemically synthesized
tcctttcatagatgaggttt

SEQ ID NO: 46200 - DNA, 20 bp, Artificial Sequence
  chemically synthesized
tttttctcctttcatagatg

SEQ ID NO: 46201 - DNA, 20 bp, Artificial Sequence
  chemically synthesized
ctttttctcctttcatagat

SEQ ID NO: 46202 - DNA, 20 bp, Artificial Sequence
  chemically synthesized
tcctaaaacctcatctatga

SEQ ID NO: 46203 - DNA, 20 bp, Artificial Sequence
  chemically synthesized
cctaaaacctcatctatgaa

SEQ ID NO: 46204 - DNA, 20 bp, Artificial Sequence
  chemically synthesized
taaaacctcatctatgaaag

SEQ ID NO: 46205 - DNA, 20 bp, Artificial Sequence
  chemically synthesized
agactctttttctcctttca

SEQ ID NO: 46206 - DNA, 20 bp, Artificial Sequence
  chemically synthesized
ctcatctatgaaaggagaaa

SEQ ID NO: 46207 - DNA, 20 bp, Artificial Sequence
  chemically synthesized
catctatgaaaggagaaaaa

SEQ ID NO: 46208 - DNA, 20 bp, Artificial Sequence
  chemically synthesized
gagaaaaagagtctttattt

SEQ ID NO: 46209 - DNA, 20 bp, Artificial Sequence
  chemically synthesized
ttcctttatgagctgaaata

SEQ ID NO: 46210 - DNA, 20 bp, Artificial Sequence
  chemically synthesized
agtctttatttcagctcata

SEQ ID NO: 46211 - DNA, 20 bp, Artificial Sequence
  chemically synthesized
gtctttatttcagctcataa

SEQ ID NO: 46212 - DNA, 20 bp, Artificial Sequence
  chemically synthesized
cttttatccaattcctttat

SEQ ID NO: 46213 - DNA, 20 bp, Artificial Sequence
  chemically synthesized
atttcagctcataaaggaat

SEQ ID NO: 46214 - DNA, 20 bp, Artificial Sequence
  chemically synthesized
ctcataaaggaattggataa

SEQ ID NO: 46215 - DNA, 20 bp, Artificial Sequence
  chemically synthesized
taaaggaattggataaaagt

SEQ ID NO: 46216 - DNA, 20 bp, Artificial Sequence
  chemically synthesized
aaggaattggataaaagtga

SEQ ID NO: 46217 - DNA, 20 bp, Artificial Sequence
  chemically synthesized
aaagtgagagctttatgaat

SEQ ID NO: 46218 - DNA, 20 bp, Artificial Sequence
  chemically synthesized
acttcttcaaccaattcata

SEQ ID NO: 46219 - DNA, 20 bp, Artificial Sequence
  chemically synthesized
agagctttatgaattggttg

SEQ ID NO: 46220 - DNA, 20 bp, Artificial Sequence
  chemically synthesized
gctttatgaattggttgaag

SEQ ID NO: 46221 - DNA, 20 bp, Artificial Sequence
  chemically synthesized
ttatgaattggttgaagaag

SEQ ID NO: 46222 - DNA, 20 bp, Artificial Sequence
  chemically synthesized
tgaattggttgaagaagtag

SEQ ID NO: 46223 - DNA, 20 bp, Artificial Sequence
  chemically synthesized
gaattggttgaagaagtagc

SEQ ID NO: 46224 - DNA, 20 bp, Artificial Sequence
  chemically synthesized
tatttccgactaagatgttt

SEQ ID NO: 46225 - DNA, 20 bp, Artificial Sequence
  chemically synthesized
gtagcaggtctcaaacatct

SEQ ID NO: 46226 - DNA, 20 bp, Artificial Sequence
  chemically synthesized
caggtctcaaacatcttagt

SEQ ID NO: 46227 - DNA, 20 bp, Artificial Sequence
  chemically synthesized
acaaatttttatttccgact

SEQ ID NO: 46228 - DNA, 20 bp, Artificial Sequence
  chemically synthesized
agtcggaaataaaaatttgt

SEQ ID NO: 46229 - DNA, 20 bp, Artificial Sequence
  chemically synthesized
gtcggaaataaaaatttgtg

SEQ ID NO: 46230 - DNA, 20 bp, Artificial Sequence
  chemically synthesized
aataaaaatttgtgaggaca

SEQ ID NO: 46231 - DNA, 20 bp, Artificial Sequence
  chemically synthesized
tgaggacaaagacactgatg

SEQ ID NO: 46232 - DNA, 20 bp, Artificial Sequence
  chemically synthesized
gaggacaaagacactgatgt

SEQ ID NO: 46233 - DNA, 20 bp, Artificial Sequence
  chemically synthesized
tagacagtgatttcctacat

SEQ ID NO: 46234 - DNA, 20 bp, Artificial Sequence
  chemically synthesized
tgatgtaggaaatcactgtc

SEQ ID NO: 46235 - DNA, 20 bp, Artificial Sequence
  chemically synthesized
atgtaggaaatcactgtcta

SEQ ID NO: 46236 - DNA, 20 bp, Artificial Sequence
  chemically synthesized
aattttcttcaaactctaga

SEQ ID NO: 46237 - DNA, 20 bp, Artificial Sequence
  chemically synthesized
aaatcactgtctagagtttg

SEQ ID NO: 46238 - DNA, 20 bp, Artificial Sequence
  chemically synthesized
gaacaattttcttcaaactc

SEQ ID NO: 46239 - DNA, 20 bp, Artificial Sequence
  chemically synthesized
tacatccactgtatatttta

SEQ ID NO: 46240 - DNA, 20 bp, Artificial Sequence
  chemically synthesized
aaattgttccataaaatata

SEQ ID NO: 46241 - DNA, 20 bp, Artificial Sequence
  chemically synthesized
ttgttccataaaatatacag

SEQ ID NO: 46242 - DNA, 20 bp, Artificial Sequence
  chemically synthesized
ataaaatatacagtggatgt

SEQ ID NO: 46243 - DNA, 20 bp, Artificial Sequence
  chemically synthesized
taaaatatacagtggatgta

SEQ ID NO: 46244 - DNA, 20 bp, Artificial Sequence
  chemically synthesized
agtggatgtaaggtaatata

SEQ ID NO: 46245 - DNA, 20 bp, Artificial Sequence
  chemically synthesized
taatatacagtgcatgtcta

SEQ ID NO: 46246 - DNA, 20 bp, Artificial Sequence
  chemically synthesized
tattaaataatatattgctg

SEQ ID NO: 46247 - DNA, 20 bp, Artificial Sequence
  chemically synthesized
cagcaatatattatttaata

SEQ ID NO: 46248 - DNA, 20 bp, Artificial Sequence
  chemically synthesized
aataaagcatgtgatttaaa

SEQ ID NO: 46249 - DNA, 20 bp, Artificial Sequence
  chemically synthesized
ataaagcatgtgatttaaat

SEQ ID NO: 46250 - DNA, 20 bp, Artificial Sequence
  chemically synthesized
aaataggtatttaaaatgta

SEQ ID NO: 46251 - DNA, 20 bp, Artificial Sequence
  chemically synthesized
tatttaaaatgtacagtttt

SEQ ID NO: 46252 - DNA, 20 bp, Artificial Sequence
  chemically synthesized
tattgttatatttaattcat

SEQ ID NO: 46253 - DNA, 20 bp, Artificial Sequence
  chemically synthesized
cataaaatatgaaaactaaa

SEQ ID NO: 46254 - DNA, 20 bp, Artificial Sequence
  chemically synthesized
aaaatatgaaaactaaaaag

SEQ ID NO: 46255 - DNA, 20 bp, Artificial Sequence
  chemically synthesized
gtatgtttgattctgctttt

SEQ ID NO: 46256 - DNA, 20 bp, Artificial Sequence
  chemically synthesized
cagaatcaaacatactaaaa

SEQ ID NO: 46257 - DNA, 20 bp, Artificial Sequence
  chemically synthesized
ttaacttgaaaattcttttt

SEQ ID NO: 46258 - DNA, 20 bp, Artificial Sequence
  chemically synthesized
catactaaaaaagaattttc

SEQ ID NO: 46259 - DNA, 20 bp, Artificial Sequence
  chemically synthesized
taaaaaagaattttcaagtt

SEQ ID NO: 46260 - DNA, 20 bp, Artificial Sequence
  chemically synthesized
aaaaagaattttcaagttaa

SEQ ID NO: 46261 - DNA, 20 bp, Artificial Sequence
  chemically synthesized
aagttaagagatacctcatc

SEQ ID NO: 46262 - DNA, 20 bp, Artificial Sequence
  chemically synthesized
ttattacatttttccagatg

SEQ ID NO: 46263 - DNA, 20 bp, Artificial Sequence
  chemically synthesized
cttattacatttttccagat

SEQ ID NO: 46264 - DNA, 20 bp, Artificial Sequence
  chemically synthesized
tttgtcttattacatttttc

SEQ ID NO: 46265 - DNA, 20 bp, Artificial Sequence
  chemically synthesized
ctcatctggaaaaatgtaat

SEQ ID NO: 46266 - DNA, 20 bp, Artificial Sequence
  chemically synthesized
gaaaaatgtaataagacaaa

SEQ ID NO: 46267 - DNA, 20 bp, Artificial Sequence
  chemically synthesized
aaatggtaaaccgtttccta

SEQ ID NO: 46268 - DNA, 20 bp, Artificial Sequence
  chemically synthesized
gaaatacatactttaggaaa

SEQ ID NO: 46269 - DNA, 20 bp, Artificial Sequence
  chemically synthesized
tcaggagaaatacatacttt

SEQ ID NO: 46270 - DNA, 20 bp, Artificial Sequence
  chemically synthesized
ttcaggagaaatacatactt

SEQ ID NO: 46271 - DNA, 20 bp, Artificial Sequence
  chemically synthesized
aaagtatgtatttctcctga

SEQ ID NO: 46272 - DNA, 20 bp, Artificial Sequence
  chemically synthesized
agtatgtatttctcctgaaa

SEQ ID NO: 46273 - DNA, 20 bp, Artificial Sequence
  chemically synthesized
tagtcttttgactctttcag

SEQ ID NO: 46274 - DNA, 20 bp, Artificial Sequence
  chemically synthesized
ggtagtcttttgactctttc

SEQ ID NO: 46275 - DNA, 20 bp, Artificial Sequence
  chemically synthesized
aggtagtcttttgactcttt

SEQ ID NO: 46276 - DNA, 20 bp, Artificial Sequence
  chemically synthesized
atttctcctgaaagagtcaa

SEQ ID NO: 46277 - DNA, 20 bp, Artificial Sequence
  chemically synthesized
cagaaaaatgggagtgaagg

SEQ ID NO: 46278 - DNA, 20 bp, Artificial Sequence
  chemically synthesized
actcagaaaaatgggagtga

SEQ ID NO: 46279 - DNA, 20 bp, Artificial Sequence
  chemically synthesized
aactcagaaaaatgggagtg

SEQ ID NO: 46280 - DNA, 20 bp, Artificial Sequence
  chemically synthesized
ttgttaactcagaaaaatgg

SEQ ID NO: 46281 - DNA, 20 bp, Artificial Sequence
  chemically synthesized
ttttgttaactcagaaaaat

SEQ ID NO: 46282 - DNA, 20 bp, Artificial Sequence
  chemically synthesized
accttcactcccatttttct

SEQ ID NO: 46283 - DNA, 20 bp, Artificial Sequence
  chemically synthesized
attttgttaactcagaaaaa

SEQ ID NO: 46284 - DNA, 20 bp, Artificial Sequence
  chemically synthesized
atgcctctattttgttaact

SEQ ID NO: 46285 - DNA, 20 bp, Artificial Sequence
  chemically synthesized
atttttctgagttaacaaaa

SEQ ID NO: 46286 - DNA, 20 bp, Artificial Sequence
  chemically synthesized
ttttctgagttaacaaaata

SEQ ID NO: 46287 - DNA, 20 bp, Artificial Sequence
  chemically synthesized
tttctgagttaacaaaatag

SEQ ID NO: 46288 - DNA, 20 bp, Artificial Sequence
  chemically synthesized
ggcataaaatcaaatttctt

SEQ ID NO: 46289 - DNA, 20 bp, Artificial Sequence
  chemically synthesized
gcataaaatcaaatttcttg

SEQ ID NO: 46290 - DNA, 20 bp, Artificial Sequence
  chemically synthesized
tcttcattactacagtcctc

SEQ ID NO: 46291 - DNA, 20 bp, Artificial Sequence
  chemically synthesized
atcaaatttcttgaggactg

SEQ ID NO: 46292 - DNA, 20 bp, Artificial Sequence
  chemically synthesized
gtcctagatcttcattacta

SEQ ID NO: 46293 - DNA, 20 bp, Artificial Sequence
  chemically synthesized
tcttgaggactgtagtaatg

SEQ ID NO: 46294 - DNA, 20 bp, Artificial Sequence
  chemically synthesized
ggactgtagtaatgaagatc

SEQ ID NO: 46295 - DNA, 20 bp, Artificial Sequence
  chemically synthesized
gactgtagtaatgaagatct

SEQ ID NO: 46296 - DNA, 20 bp, Artificial Sequence
  chemically synthesized
taaagcaataacagcagtcc

SEQ ID NO: 46297 - DNA, 20 bp, Artificial Sequence
  chemically synthesized
cggttctaaagcaataacag

SEQ ID NO: 46298 - DNA, 20 bp, Artificial Sequence
  chemically synthesized
attcggttctaaagcaataa

SEQ ID NO: 46299 - DNA, 20 bp, Artificial Sequence
  chemically synthesized
taggactgctgttattgctt

SEQ ID NO: 46300 - DNA, 20 bp, Artificial Sequence
  chemically synthesized
ttcttcttaattcggttcta

SEQ ID NO: 46301 - DNA, 20 bp, Artificial Sequence
  chemically synthesized
tattgctttagaaccgaatt

SEQ ID NO: 46302 - DNA, 20 bp, Artificial Sequence
  chemically synthesized
tgctttagaaccgaattaag

SEQ ID NO: 46303 - DNA, 20 bp, Artificial Sequence
  chemically synthesized
tccatcaattcttcttaatt

SEQ ID NO: 46304 - DNA, 20 bp, Artificial Sequence
  chemically synthesized
accgaattaagaagaattga

SEQ ID NO: 46305 - DNA, 20 bp, Artificial Sequence
  chemically synthesized
aattaagaagaattgatgga

SEQ ID NO: 46306 - DNA, 20 bp, Artificial Sequence
  chemically synthesized
gaagaattgatggacagtga

SEQ ID NO: 46307 - DNA, 20 bp, Artificial Sequence
  chemically synthesized
ggacagtgaaagaataaaaa

SEQ ID NO: 46308 - DNA, 20 bp, Artificial Sequence
  chemically synthesized
aataaaaacagattcgataa

SEQ ID NO: 46309 - DNA, 20 bp, Artificial Sequence
  chemically synthesized
aaaacagattcgataaaaga

SEQ ID NO: 46310 - DNA, 20 bp, Artificial Sequence
  chemically synthesized
acagattcgataaaagatgg

SEQ ID NO: 46311 - DNA, 20 bp, Artificial Sequence
  chemically synthesized
cagattcgataaaagatggc

SEQ ID NO: 46312 - DNA, 20 bp, Artificial Sequence
  chemically synthesized
attcgataaaagatggcagg

SEQ ID NO: 46313 - DNA, 20 bp, Artificial Sequence
  chemically synthesized
agatggcaggcggaaaaaaa

SEQ ID NO: 46314 - DNA, 20 bp, Artificial Sequence
  chemically synthesized
gatggcaggcggaaaaaaat

SEQ ID NO: 46315 - DNA, 20 bp, Artificial Sequence
  chemically synthesized
gggaaaacatctaatatttt

SEQ ID NO: 46316 - DNA, 20 bp, Artificial Sequence
  chemically synthesized
atgagtctgactaaaaatat

SEQ ID NO: 46317 - DNA, 20 bp, Artificial Sequence
  chemically synthesized
aaacatctaatatttttagt

SEQ ID NO: 46318 - DNA, 20 bp, Artificial Sequence
  chemically synthesized
aatatttttagtcagactca

SEQ ID NO: 46319 - DNA, 20 bp, Artificial Sequence
  chemically synthesized
atttttagtcagactcatgg

SEQ ID NO: 46320 - DNA, 20 bp, Artificial Sequence
  chemically synthesized
tttagtcagactcatggcag

SEQ ID NO: 46321 - DNA, 20 bp, Artificial Sequence
  chemically synthesized
tttgaacttgcttctgccat

SEQ ID NO: 46322 - DNA, 20 bp, Artificial Sequence
  chemically synthesized
gtcagactcatggcagaagc

SEQ ID NO: 46323 - DNA, 20 bp, Artificial Sequence
  chemically synthesized
tcatggcagaagcaagttca

SEQ ID NO: 46324 - DNA, 20 bp, Artificial Sequence
  chemically synthesized
agaagcaagttcaaagactt

SEQ ID NO: 46325 - DNA, 20 bp, Artificial Sequence
  chemically synthesized
gcaagttcaaagacttcggt

SEQ ID NO: 46326 - DNA, 20 bp, Artificial Sequence
  chemically synthesized
atagtcctcgataccaaccg

SEQ ID NO: 46327 - DNA, 20 bp, Artificial Sequence
  chemically synthesized
caaagacttcggttggtatc

SEQ ID NO: 46328 - DNA, 20 bp, Artificial Sequence
  chemically synthesized
aaagacttcggttggtatcg

SEQ ID NO: 46329 - DNA, 20 bp, Artificial Sequence
  chemically synthesized
aatttactgggttcataaaa

SEQ ID NO: 46330 - DNA, 20 bp, Artificial Sequence
  chemically synthesized
cgaggactattttatgaacc

SEQ ID NO: 46331 - DNA, 20 bp, Artificial Sequence
  chemically synthesized
aacaacaattacaatttact

SEQ ID NO: 46332 - DNA, 20 bp, Artificial Sequence
  chemically synthesized
caacaacaattacaatttac

SEQ ID NO: 46333 - DNA, 20 bp, Artificial Sequence
  chemically synthesized
agtaaattgtaattgttgtt

SEQ ID NO: 46334 - DNA, 20 bp, Artificial Sequence
  chemically synthesized
gtaaattgtaattgttgttg

SEQ ID NO: 46335 - DNA, 20 bp, Artificial Sequence
  chemically synthesized
ttgttgaggtttccaattca

SEQ ID NO: 46336 - DNA, 20 bp, Artificial Sequence
  chemically synthesized
acttaaatttaactttgaat

SEQ ID NO: 46337 - DNA, 20 bp, Artificial Sequence
  chemically synthesized
tccaattcaaagttaaattt

SEQ ID NO: 46338 - DNA, 20 bp, Artificial Sequence
  chemically synthesized
attcaaagttaaatttaagt

SEQ ID NO: 46339 - DNA, 20 bp, Artificial Sequence
  chemically synthesized
gttaaatttaagttagactc

SEQ ID NO: 46340 - DNA, 20 bp, Artificial Sequence
  chemically synthesized
ctctcatccattgtgcacta

SEQ ID NO: 46341 - DNA, 20 bp, Artificial Sequence
  chemically synthesized
gtctctcatccattgtgcac

SEQ ID NO: 46342 - DNA, 20 bp, Artificial Sequence
  chemically synthesized
agttagactctagtgcacaa

SEQ ID NO: 46343 - DNA, 20 bp, Artificial Sequence
  chemically synthesized
gactctagtgcacaatggat

SEQ ID NO: 46344 - DNA, 20 bp, Artificial Sequence
  chemically synthesized
ctctagtgcacaatggatga

SEQ ID NO: 46345 - DNA, 20 bp, Artificial Sequence
  chemically synthesized
acaatggatgagagactgtg

SEQ ID NO: 46346 - DNA, 20 bp, Artificial Sequence
  chemically synthesized
caatggatgagagactgtga

SEQ ID NO: 46347 - DNA, 20 bp, Artificial Sequence
  chemically synthesized
gagtgattacgataccttca

SEQ ID NO: 46348 - DNA, 20 bp, Artificial Sequence
  chemically synthesized
gagagaggagagaggatatt

SEQ ID NO: 46349 - DNA, 20 bp, Artificial Sequence
  chemically synthesized
acgtggaagagagaggagag

SEQ ID NO: 46350 - DNA, 20 bp, Artificial Sequence
  chemically synthesized
aacgtggaagagagaggaga

SEQ ID NO: 46351 - DNA, 20 bp, Artificial Sequence
  chemically synthesized
tcaacgtggaagagagagga

SEQ ID NO: 46352 - DNA, 20 bp, Artificial Sequence
  chemically synthesized
ggtcaacgtggaagagagag

SEQ ID NO: 46353 - DNA, 20 bp, Artificial Sequence
  chemically synthesized
tgggtcaacgtggaagagag

SEQ ID NO: 46354 - DNA, 20 bp, Artificial Sequence
  chemically synthesized
ttgggtcaacgtggaagaga

SEQ ID NO: 46355 - DNA, 20 bp, Artificial Sequence
  chemically synthesized
cattgggtcaacgtggaaga

SEQ ID NO: 46356 - DNA, 20 bp, Artificial Sequence
  chemically synthesized
tacattgggtcaacgtggaa

SEQ ID NO: 46357 - DNA, 20 bp, Artificial Sequence
  chemically synthesized
aatacattgggtcaacgtgg

SEQ ID NO: 46358 - DNA, 20 bp, Artificial Sequence
  chemically synthesized
gacaatacattgggtcaacg

SEQ ID NO: 46359 - DNA, 20 bp, Artificial Sequence
  chemically synthesized
aatataaatgacaatacatt

SEQ ID NO: 46360 - DNA, 20 bp, Artificial Sequence
  chemically synthesized
aaatataaatgacaatacat

SEQ ID NO: 46361 - DNA, 20 bp, Artificial Sequence
  chemically synthesized
atatttcatgcaaaatacta

SEQ ID NO: 46362 - DNA, 20 bp, Artificial Sequence
  chemically synthesized
tttcatgcaaaatactacag

SEQ ID NO: 46363 - DNA, 20 bp, Artificial Sequence
  chemically synthesized
ttcatgcaaaatactacaga

SEQ ID NO: 46364 - DNA, 20 bp, Artificial Sequence
  chemically synthesized
gtgcttggaagcaccttctg

SEQ ID NO: 46365 - DNA, 20 bp, Artificial Sequence
  chemically synthesized
atactacagaaggtgcttcc

SEQ ID NO: 46366 - DNA, 20 bp, Artificial Sequence
  chemically synthesized
aaaagaatacgagtgcttgg

SEQ ID NO: 46367 - DNA, 20 bp, Artificial Sequence
  chemically synthesized
gtcaaaagaatacgagtgct

SEQ ID NO: 46368 - DNA, 20 bp, Artificial Sequence
  chemically synthesized
tgtgccagtcaaaagaatac

SEQ ID NO: 46369 - DNA, 20 bp, Artificial Sequence
  chemically synthesized
agcactcgtattcttttgac

SEQ ID NO: 46370 - DNA, 20 bp, Artificial Sequence
  chemically synthesized
gaaacatttgtgccagtcaa

SEQ ID NO: 46371 - DNA, 20 bp, Artificial Sequence
  chemically synthesized
ttttctggaaacatttgtgc

SEQ ID NO: 46372 - DNA, 20 bp, Artificial Sequence
  chemically synthesized
ttgactggcacaaatgtttc

SEQ ID NO: 46373 - DNA, 20 bp, Artificial Sequence
  chemically synthesized
gcacaaatgtttccagaaaa

SEQ ID NO: 46374 - DNA, 20 bp, Artificial Sequence
  chemically synthesized
aacagaaagatactgttttc

SEQ ID NO: 46375 - DNA, 20 bp, Artificial Sequence
  chemically synthesized
atttgtcacctaacaacaga

SEQ ID NO: 46376 - DNA, 20 bp, Artificial Sequence
  chemically synthesized
aaacagtatctttctgttgt

SEQ ID NO: 46377 - DNA, 20 bp, Artificial Sequence
  chemically synthesized
aacagtatctttctgttgtt

SEQ ID NO: 46378 - DNA, 20 bp, Artificial Sequence
  chemically synthesized
cagtatttgtcacctaacaa

SEQ ID NO: 46379 - DNA, 20 bp, Artificial Sequence
  chemically synthesized
gttgttaggtgacaaatact

SEQ ID NO: 46380 - DNA, 20 bp, Artificial Sequence
  chemically synthesized
cattcttgatacataacact

SEQ ID NO: 46381 - DNA, 20 bp, Artificial Sequence
  chemically synthesized
aatactgagtgttatgtatc

SEQ ID NO: 46382 - DNA, 20 bp, Artificial Sequence
  chemically synthesized
tgtatcaagaatgaacaact

SEQ ID NO: 46383 - DNA, 20 bp, Artificial Sequence
  chemically synthesized
agtcctcgactcgtagggct

SEQ ID NO: 46384 - DNA, 20 bp, Artificial Sequence
  chemically synthesized
aatgaacaactaagccctac

SEQ ID NO: 46385 - DNA, 20 bp, Artificial Sequence
  chemically synthesized
gcagcagtcctcgactcgta

SEQ ID NO: 46386 - DNA, 20 bp, Artificial Sequence
  chemically synthesized
acaactaagccctacgagtc

SEQ ID NO: 46387 - DNA, 20 bp, Artificial Sequence
  chemically synthesized
agcagcagtcctcgactcgt

SEQ ID NO: 46388 - DNA, 20 bp, Artificial Sequence
  chemically synthesized
caactaagccctacgagtcg

SEQ ID NO: 46389 - DNA, 20 bp, Artificial Sequence
  chemically synthesized
aagcagcagtcctcgactcg

SEQ ID NO: 46390 - DNA, 20 bp, Artificial Sequence
  chemically synthesized
ttccaaaaggcagaaagcag

SEQ ID NO: 46391 - DNA, 20 bp, Artificial Sequence
  chemically synthesized
tgtttccaaaaggcagaaag

SEQ ID NO: 46392 - DNA, 20 bp, Artificial Sequence
  chemically synthesized
acatgtttccaaaaggcaga

SEQ ID NO: 46393 - DNA, 20 bp, Artificial Sequence
  chemically synthesized
gactgctgctttctgccttt

SEQ ID NO: 46394 - DNA, 20 bp, Artificial Sequence
  chemically synthesized
tactacatgtttccaaaagg

SEQ ID NO: 46395 - DNA, 20 bp, Artificial Sequence
  chemically synthesized
gaatactacatgtttccaaa

SEQ ID NO: 46396 - DNA, 20 bp, Artificial Sequence
  chemically synthesized
tgaatactacatgtttccaa

SEQ ID NO: 46397 - DNA, 20 bp, Artificial Sequence
  chemically synthesized
ttctgccttttggaaacatg

SEQ ID NO: 46398 - DNA, 20 bp, Artificial Sequence
  chemically synthesized
tagtattcattcacccaaaa

SEQ ID NO: 46399 - DNA, 20 bp, Artificial Sequence
  chemically synthesized
tatatgtacacaactgtttt

SEQ ID NO: 46400 - DNA, 20 bp, Artificial Sequence
  chemically synthesized
ttatatgtacacaactgttt

SEQ ID NO: 46401 - DNA, 20 bp, Artificial Sequence
  chemically synthesized
cagttgtgtacatataactg

SEQ ID NO: 46402 - DNA, 20 bp, Artificial Sequence
  chemically synthesized
tcaaagatagaagatttccg

SEQ ID NO: 46403 - DNA, 20 bp, Artificial Sequence
  chemically synthesized
tcttcttccgtcaaagatag

SEQ ID NO: 46404 - DNA, 20 bp, Artificial Sequence
  chemically synthesized
cggaaatcttctatctttga

SEQ ID NO: 46405 - DNA, 20 bp, Artificial Sequence
  chemically synthesized
atttcttcttccgtcaaaga

SEQ ID NO: 46406 - DNA, 20 bp, Artificial Sequence
  chemically synthesized
aaatcttctatctttgacgg

SEQ ID NO: 46407 - DNA, 20 bp, Artificial Sequence
  chemically synthesized
tcacatttcttcttccgtca

SEQ ID NO: 46408 - DNA, 20 bp, Artificial Sequence
  chemically synthesized
tcttctatctttgacggaag

SEQ ID NO: 46409 - DNA, 20 bp, Artificial Sequence
  chemically synthesized
tttgacggaagaagaaatgt

SEQ ID NO: 46410 - DNA, 20 bp, Artificial Sequence
  chemically synthesized
gaacaatttcttttatttag

SEQ ID NO: 46411 - DNA, 20 bp, Artificial Sequence
  chemically synthesized
gtgagaaaacccctaaataa

SEQ ID NO: 46412 - DNA, 20 bp, Artificial Sequence
  chemically synthesized
agaacaatttcttttattta

SEQ ID NO: 46413 - DNA, 20 bp, Artificial Sequence
  chemically synthesized
gagaacaatttcttttattt

SEQ ID NO: 46414 - DNA, 20 bp, Artificial Sequence
  chemically synthesized
cgagaacaatttcttttatt

SEQ ID NO: 46415 - DNA, 20 bp, Artificial Sequence
  chemically synthesized
taaaagaaattgttctcgca

SEQ ID NO: 46416 - DNA, 20 bp, Artificial Sequence
  chemically synthesized
tagtgggagtcaatctttgc

SEQ ID NO: 46417 - DNA, 20 bp, Artificial Sequence
  chemically synthesized
gataattttattgatagtgg

SEQ ID NO: 46418 - DNA, 20 bp, Artificial Sequence
  chemically synthesized
cagataattttattgatagt

SEQ ID NO: 46419 - DNA, 20 bp, Artificial Sequence
  chemically synthesized
ccagataattttattgatag

SEQ ID NO: 46420 - DNA, 20 bp, Artificial Sequence
  chemically synthesized
gctccagataattttattga

SEQ ID NO: 46421 - DNA, 20 bp, Artificial Sequence
  chemically synthesized
ccactatcaataaaattatc

SEQ ID NO: 46422 - DNA, 20 bp, Artificial Sequence
  chemically synthesized
actatcaataaaattatctg

SEQ ID NO: 46423 - DNA, 20 bp, Artificial Sequence
  chemically synthesized
ataaaattatctggagcttt

SEQ ID NO: 46424 - DNA, 20 bp, Artificial Sequence
  chemically synthesized
cacaatagaaccaaaagctc

SEQ ID NO: 46425 - DNA, 20 bp, Artificial Sequence
  chemically synthesized
atttttcacaatagaaccaa

SEQ ID NO: 46426 - DNA, 20 bp, Artificial Sequence
  chemically synthesized
agggggcggatttttcacaa

SEQ ID NO: 46427 - DNA, 20 bp, Artificial Sequence
  chemically synthesized
gtgttttgtgacagaggggg

SEQ ID NO: 46428 - DNA, 20 bp, Artificial Sequence
  chemically synthesized
ggtgtgttttgtgacagagg

SEQ ID NO: 46429 - DNA, 20 bp, Artificial Sequence
  chemically synthesized
tggtgtgttttgtgacagag

SEQ ID NO: 46430 - DNA, 20 bp, Artificial Sequence
  chemically synthesized
atggtgtgttttgtgacaga

SEQ ID NO: 46431 - DNA, 20 bp, Artificial Sequence
  chemically synthesized
tatggtgtgttttgtgacag

SEQ ID NO: 46432 - DNA, 20 bp, Artificial Sequence
  chemically synthesized
atatggtgtgttttgtgaca

SEQ ID NO: 46433 - DNA, 20 bp, Artificial Sequence
  chemically synthesized
atatatggtgtgttttgtga

SEQ ID NO: 46434 - DNA, 20 bp, Artificial Sequence
  chemically synthesized
tttatttaatgcaggatata

SEQ ID NO: 46435 - DNA, 20 bp, Artificial Sequence
  chemically synthesized
aagaaaagtttatttaatgc

SEQ ID NO: 46436 - DNA, 20 bp, Artificial Sequence
  chemically synthesized
taagaaaagtttatttaatg

SEQ ID NO: 46437 - DNA, 20 bp, Artificial Sequence
  chemically synthesized
attaaataaacttttcttaa

SEQ ID NO: 46438 - DNA, 20 bp, Artificial Sequence
  chemically synthesized
tggggaacgacttttaagaa

SEQ ID NO: 46439 - DNA, 20 bp, Artificial Sequence
  chemically synthesized
tgcaatggggaacgactttt

SEQ ID NO: 46440 - DNA, 20 bp, Artificial Sequence
  chemically synthesized
gtaaatttgctgatgcaatg

SEQ ID NO: 46441 - DNA, 20 bp, Artificial Sequence
  chemically synthesized
aaagtcgttccccattgcat

SEQ ID NO: 46442 - DNA, 20 bp, Artificial Sequence
  chemically synthesized
tgtaaatttgctgatgcaat

SEQ ID NO: 46443 - DNA, 20 bp, Artificial Sequence
  chemically synthesized
ttgtaaatttgctgatgcaa

SEQ ID NO: 46444 - DNA, 20 bp, Artificial Sequence
  chemically synthesized
ttgcatcagcaaatttacaa

SEQ ID NO: 46445 - DNA, 20 bp, Artificial Sequence
  chemically synthesized
caaatttacaatggtaattt

SEQ ID NO: 46446 - DNA, 20 bp, Artificial Sequence
  chemically synthesized
tacaatggtaattttagaat

SEQ ID NO: 46447 - DNA, 20 bp, Artificial Sequence
  chemically synthesized
ttagaataagttttttatcc

SEQ ID NO: 46448 - DNA, 20 bp, Artificial Sequence
  chemically synthesized
ttttttttcctgaggaagct

SEQ ID NO: 46449 - DNA, 20 bp, Artificial Sequence
  chemically synthesized
gttttttatccaagcttcct

SEQ ID NO: 46450 - DNA, 20 bp, Artificial Sequence
  chemically synthesized
ttttttatccaagcttcctc

SEQ ID NO: 46451 - DNA, 20 bp, Artificial Sequence
  chemically synthesized
gtgtcttttttttcctgagg

SEQ ID NO: 46452 - DNA, 20 bp, Artificial Sequence
  chemically synthesized
cctgtgtcttttttttcctg

SEQ ID NO: 46453 - DNA, 20 bp, Artificial Sequence
  chemically synthesized
acctgtgtcttttttttcct

SEQ ID NO: 46454 - DNA, 20 bp, Artificial Sequence
  chemically synthesized
caagcttcctcaggaaaaaa

SEQ ID NO: 46455 - DNA, 20 bp, Artificial Sequence
  chemically synthesized
tcctcaggaaaaaaaagaca

SEQ ID NO: 46456 - DNA, 20 bp, Artificial Sequence
  chemically synthesized
cctcaggaaaaaaaagacac

SEQ ID NO: 46457 - DNA, 20 bp, Artificial Sequence
  chemically synthesized
aaaaaaagacacaggtattg

SEQ ID NO: 46458 - DNA, 20 bp, Artificial Sequence
  chemically synthesized
aaaaaagacacaggtattgt

SEQ ID NO: 46459 - DNA, 20 bp, Artificial Sequence
  chemically synthesized
aagacacaggtattgtaggc

SEQ ID NO: 46460 - DNA, 20 bp, Artificial Sequence
  chemically synthesized
agacacaggtattgtaggcc

SEQ ID NO: 46461 - DNA, 20 bp, Artificial Sequence
  chemically synthesized
tttaaaatgcgacattagcc

SEQ ID NO: 46462 - DNA, 20 bp, Artificial Sequence
  chemically synthesized
ttatttttaaaatgcgacat

SEQ ID NO: 46463 - DNA, 20 bp, Artificial Sequence
  chemically synthesized
taacctgtatattcacaagt

SEQ ID NO: 46464 - DNA, 20 bp, Artificial Sequence
  chemically synthesized
tgactaacctgtatattcac

SEQ ID NO: 46465 - DNA, 20 bp, Artificial Sequence
  chemically synthesized
taaactcacttgtgaatata

SEQ ID NO: 46466 - DNA, 20 bp, Artificial Sequence
  chemically synthesized
aaactcacttgtgaatatac

SEQ ID NO: 46467 - DNA, 20 bp, Artificial Sequence
  chemically synthesized
tcacttgtgaatatacaggt

SEQ ID NO: 46468 - DNA, 20 bp, Artificial Sequence
  chemically synthesized
gaagtatcacatttttaaaa

SEQ ID NO: 46469 - DNA, 20 bp, Artificial Sequence
  chemically synthesized
tggaagtatcacatttttaa

SEQ ID NO: 46470 - DNA, 20 bp, Artificial Sequence
  chemically synthesized
tactatatcaagtaagttgg

SEQ ID NO: 46471 - DNA, 20 bp, Artificial Sequence
  chemically synthesized
ccctactatatcaagtaagt

SEQ ID NO: 46472 - DNA, 20 bp, Artificial Sequence
  chemically synthesized
agtgccctactatatcaagt

SEQ ID NO: 46473 - DNA, 20 bp, Artificial Sequence
  chemically synthesized
tacttccaacttacttgata

SEQ ID NO: 46474 - DNA, 20 bp, Artificial Sequence
  chemically synthesized
ttccaacttacttgatatag

SEQ ID NO: 46475 - DNA, 20 bp, Artificial Sequence
  chemically synthesized
acaaagtgccctactatatc

SEQ ID NO: 46476 - DNA, 20 bp, Artificial Sequence
  chemically synthesized
tccaacttacttgatatagt

SEQ ID NO: 46477 - DNA, 20 bp, Artificial Sequence
  chemically synthesized
ccaacttacttgatatagta

SEQ ID NO: 46478 - DNA, 20 bp, Artificial Sequence
  chemically synthesized
atatagtagggcactttgtt

SEQ ID NO: 46479 - DNA, 20 bp, Artificial Sequence
  chemically synthesized
gagagccatctcgccaaaca

SEQ ID NO: 46480 - DNA, 20 bp, Artificial Sequence
  chemically synthesized
agtagggcactttgtttggc

SEQ ID NO: 46481 - DNA, 20 bp, Artificial Sequence
  chemically synthesized
gggcactttgtttggcgaga

SEQ ID NO: 46482 - DNA, 20 bp, Artificial Sequence
  chemically synthesized
ttggcgagatggctctctcc

SEQ ID NO: 46483 - DNA, 20 bp, Artificial Sequence
  chemically synthesized
tggcgagatggctctctccc

SEQ ID NO: 46484 - DNA, 20 bp, Artificial Sequence
  chemically synthesized
ggcgagatggctctctccca

SEQ ID NO: 46485 - DNA, 20 bp, Artificial Sequence
  chemically synthesized
tgtccagggtccctgggaga

SEQ ID NO: 46486 - DNA, 20 bp, Artificial Sequence
  chemically synthesized
tctgtccagggtccctggga

SEQ ID NO: 46487 - DNA, 20 bp, Artificial Sequence
  chemically synthesized
cgtctgtccagggtccctgg

SEQ ID NO: 46488 - DNA, 20 bp, Artificial Sequence
  chemically synthesized
agcgtctgtccagggtccct

SEQ ID NO: 46489 - DNA, 20 bp, Artificial Sequence
  chemically synthesized
tggctctctcccagggaccc

SEQ ID NO: 46490 - DNA, 20 bp, Artificial Sequence
  chemically synthesized
cagcgtctgtccagggtccc

SEQ ID NO: 46491 - DNA, 20 bp, Artificial Sequence
  chemically synthesized
tctctcccagggaccctgga

SEQ ID NO: 46492 - DNA, 20 bp, Artificial Sequence
  chemically synthesized
ttcttttcagcgtctgtcca

SEQ ID NO: 46493 - DNA, 20 bp, Artificial Sequence
  chemically synthesized
cttcttttcagcgtctgtcc

SEQ ID NO: 46494 - DNA, 20 bp, Artificial Sequence
  chemically synthesized
ccttcttttcagcgtctgtc

SEQ ID NO: 46495 - DNA, 20 bp, Artificial Sequence
  chemically synthesized
gaccctggacagacgctgaa

SEQ ID NO: 46496 - DNA, 20 bp, Artificial Sequence
  chemically synthesized
cctggacagacgctgaaaag

SEQ ID NO: 46497 - DNA, 20 bp, Artificial Sequence
  chemically synthesized
ctggacagacgctgaaaaga

SEQ ID NO: 46498 - DNA, 20 bp, Artificial Sequence
  chemically synthesized
tggacagacgctgaaaagaa

SEQ ID NO: 46499 - DNA, 20 bp, Artificial Sequence
  chemically synthesized
tttttttcctcccttctttt

SEQ ID NO: 46500 - DNA, 20 bp, Artificial Sequence
  chemically synthesized
gacagacgctgaaaagaagg

SEQ ID NO: 46501 - DNA, 20 bp, Artificial Sequence
  chemically synthesized
acagacgctgaaaagaaggg

SEQ ID NO: 46502 - DNA, 20 bp, Artificial Sequence
  chemically synthesized
tgaaaagaagggaggaaaaa

SEQ ID NO: 46503 - DNA, 20 bp, Artificial Sequence
  chemically synthesized
aagaagggaggaaaaaaaga

SEQ ID NO: 46504 - DNA, 20 bp, Artificial Sequence
  chemically synthesized
agaagggaggaaaaaaagaa

SEQ ID NO: 46505 - DNA, 20 bp, Artificial Sequence
  chemically synthesized
gggaggaaaaaaagaaaggc

SEQ ID NO: 46506 - DNA, 20 bp, Artificial Sequence
  chemically synthesized
ggaggaaaaaaagaaaggca

SEQ ID NO: 46507 - DNA, 20 bp, Artificial Sequence
  chemically synthesized
aggaaaaaaagaaaggcaag

SEQ ID NO: 46508 - DNA, 20 bp, Artificial Sequence
  chemically synthesized
ggaaaaaaagaaaggcaagg

SEQ ID NO: 46509 - DNA, 20 bp, Artificial Sequence
  chemically synthesized
gaggtcaaattcatcgcaaa

SEQ ID NO: 46510 - DNA, 20 bp, Artificial Sequence
  chemically synthesized
aggtcaaattcatcgcaaac

SEQ ID NO: 46511 - DNA, 20 bp, Artificial Sequence
  chemically synthesized
caaattcatcgcaaacagga

SEQ ID NO: 46512 - DNA, 20 bp, Artificial Sequence
  chemically synthesized
ggaaagacaacattaatctc

SEQ ID NO: 46513 - DNA, 20 bp, Artificial Sequence
  chemically synthesized
agtgtaaaattgtaattctg

SEQ ID NO: 46514 - DNA, 20 bp, Artificial Sequence
  chemically synthesized
tcagtgtaaaattgtaattc

SEQ ID NO: 46515 - DNA, 20 bp, Artificial Sequence
  chemically synthesized
ttacaattttacactgatat

SEQ ID NO: 46516 - DNA, 20 bp, Artificial Sequence
  chemically synthesized
ctgagcaaacagaccaatat

SEQ ID NO: 46517 - DNA, 20 bp, Artificial Sequence
  chemically synthesized
ctgatattggtctgtttgct

SEQ ID NO: 46518 - DNA, 20 bp, Artificial Sequence
  chemically synthesized
ttcatgggcagctgagcaaa

SEQ ID NO: 46519 - DNA, 20 bp, Artificial Sequence
  chemically synthesized
tcctgtcttcatgggcagct

SEQ ID NO: 46520 - DNA, 20 bp, Artificial Sequence
  chemically synthesized
tgtttgctcagctgcccatg

SEQ ID NO: 46521 - DNA, 20 bp, Artificial Sequence
  chemically synthesized
atccatcctgtcttcatggg

SEQ ID NO: 46522 - DNA, 20 bp, Artificial Sequence
  chemically synthesized
tgctcagctgcccatgaaga

SEQ ID NO: 46523 - DNA, 20 bp, Artificial Sequence
  chemically synthesized
ttaatccatcctgtcttcat

SEQ ID NO: 46524 - DNA, 20 bp, Artificial Sequence
  chemically synthesized
gctcagctgcccatgaagac

SEQ ID NO: 46525 - DNA, 20 bp, Artificial Sequence
  chemically synthesized
gttaatccatcctgtcttca

SEQ ID NO: 46526 - DNA, 20 bp, Artificial Sequence
  chemically synthesized
agctgcccatgaagacagga

SEQ ID NO: 46527 - DNA, 20 bp, Artificial Sequence
  chemically synthesized
gacagaaatttcagaacagc

SEQ ID NO: 46528 - DNA, 20 bp, Artificial Sequence
  chemically synthesized
ggacagaaatttcagaacag

SEQ ID NO: 46529 - DNA, 20 bp, Artificial Sequence
  chemically synthesized
ttaggacagaaatttcagaa

SEQ ID NO: 46530 - DNA, 20 bp, Artificial Sequence
  chemically synthesized
ttagattaggacagaaattt

SEQ ID NO: 46531 - DNA, 20 bp, Artificial Sequence
  chemically synthesized
cagtttcgcttagattagga

SEQ ID NO: 46532 - DNA, 20 bp, Artificial Sequence
  chemically synthesized
tgaaatttctgtcctaatct

SEQ ID NO: 46533 - DNA, 20 bp, Artificial Sequence
  chemically synthesized
agttcagtttcgcttagatt

SEQ ID NO: 46534 - DNA, 20 bp, Artificial Sequence
  chemically synthesized
gagttcagtttcgcttagat

SEQ ID NO: 46535 - DNA, 20 bp, Artificial Sequence
  chemically synthesized
tgaatgagttcagtttcgct

SEQ ID NO: 46536 - DNA, 20 bp, Artificial Sequence
  chemically synthesized
tctttgtgcctgaatgagtt

SEQ ID NO: 46537 - DNA, 20 bp, Artificial Sequence
  chemically synthesized
taagcgaaactgaactcatt

SEQ ID NO: 46538 - DNA, 20 bp, Artificial Sequence
  chemically synthesized
aagcgaaactgaactcattc

SEQ ID NO: 46539 - DNA, 20 bp, Artificial Sequence
  chemically synthesized
atttatctttgtgcctgaat

SEQ ID NO: 46540 - DNA, 20 bp, Artificial Sequence
  chemically synthesized
actgaactcattcaggcaca

SEQ ID NO: 46541 - DNA, 20 bp, Artificial Sequence
  chemically synthesized
caggcacaaagataaatgcg

SEQ ID NO: 46542 - DNA, 20 bp, Artificial Sequence
  chemically synthesized
ttagcagtggaaatgtttgt

SEQ ID NO: 46543 - DNA, 20 bp, Artificial Sequence
  chemically synthesized
tttagcagtggaaatgtttg

SEQ ID NO: 46544 - DNA, 20 bp, Artificial Sequence
  chemically synthesized
ctgttctataggtttagcag

SEQ ID NO: 46545 - DNA, 20 bp, Artificial Sequence
  chemically synthesized
tatctgttctataggtttag

SEQ ID NO: 46546 - DNA, 20 bp, Artificial Sequence
  chemically synthesized
catttccactgctaaaccta

SEQ ID NO: 46547 - DNA, 20 bp, Artificial Sequence
  chemically synthesized
tcttatctgttctataggtt

SEQ ID NO: 46548 - DNA, 20 bp, Artificial Sequence
  chemically synthesized
ccactgctaaacctatagaa

SEQ ID NO: 46549 - DNA, 20 bp, Artificial Sequence
  chemically synthesized
cagtttcttatctgttctat

SEQ ID NO: 46550 - DNA, 20 bp, Artificial Sequence
  chemically synthesized
tcagtttcttatctgttcta

SEQ ID NO: 46551 - DNA, 20 bp, Artificial Sequence
  chemically synthesized
gctaaacctatagaacagat

SEQ ID NO: 46552 - DNA, 20 bp, Artificial Sequence
  chemically synthesized
gaacagataagaaactgaat

SEQ ID NO: 46553 - DNA, 20 bp, Artificial Sequence
  chemically synthesized
cagataagaaactgaatgag

SEQ ID NO: 46554 - DNA, 20 bp, Artificial Sequence
  chemically synthesized
accccgtcagtctactcatt

SEQ ID NO: 46555 - DNA, 20 bp, Artificial Sequence
  chemically synthesized
aaactgaatgagtagactga

SEQ ID NO: 46556 - DNA, 20 bp, Artificial Sequence
  chemically synthesized
aactgaatgagtagactgac

SEQ ID NO: 46557 - DNA, 20 bp, Artificial Sequence
  chemically synthesized
actgaatgagtagactgacg

SEQ ID NO: 46558 - DNA, 20 bp, Artificial Sequence
  chemically synthesized
acacatacaagaaaccccgt

SEQ ID NO: 46559 - DNA, 20 bp, Artificial Sequence
  chemically synthesized
cactcaagggagacacatac

SEQ ID NO: 46560 - DNA, 20 bp, Artificial Sequence
  chemically synthesized
ttcttgtatgtgtctccctt

SEQ ID NO: 46561 - DNA, 20 bp, Artificial Sequence
  chemically synthesized
ataaaaaaaagcactcaagg

SEQ ID NO: 46562 - DNA, 20 bp, Artificial Sequence
  chemically synthesized
ttataaaaaaaagcactcaa

SEQ ID NO: 46563 - DNA, 20 bp, Artificial Sequence
  chemically synthesized
attataaaaaaaagcactca

SEQ ID NO: 46564 - DNA, 20 bp, Artificial Sequence
  chemically synthesized
tattataaaaaaaagcactc

SEQ ID NO: 46565 - DNA, 20 bp, Artificial Sequence
  chemically synthesized
acaggaagtattataaaaaa

SEQ ID NO: 46566 - DNA, 20 bp, Artificial Sequence
  chemically synthesized
tattgagaaccagcaacagg

SEQ ID NO: 46567 - DNA, 20 bp, Artificial Sequence
  chemically synthesized
tttataatacttcctgttgc

SEQ ID NO: 46568 - DNA, 20 bp, Artificial Sequence
  chemically synthesized
aaatattgagaaccagcaac

SEQ ID NO: 46569 - DNA, 20 bp, Artificial Sequence
  chemically synthesized
aaaatattgagaaccagcaa

SEQ ID NO: 46570 - DNA, 20 bp, Artificial Sequence
  chemically synthesized
tagtaaaaaatattgagaac

SEQ ID NO: 46571 - DNA, 20 bp, Artificial Sequence
  chemically synthesized
gtcaaatagtaaaaaatatt

SEQ ID NO: 46572 - DNA, 20 bp, Artificial Sequence
  chemically synthesized
ataaaatccagtcagtcaaa

SEQ ID NO: 46573 - DNA, 20 bp, Artificial Sequence
  chemically synthesized
ttttttactatttgactgac

SEQ ID NO: 46574 - DNA, 20 bp, Artificial Sequence
  chemically synthesized
ctgaaataataaaatccagt

SEQ ID NO: 46575 - DNA, 20 bp, Artificial Sequence
  chemically synthesized
gctactgaaataataaaatc

SEQ ID NO: 46576 - DNA, 20 bp, Artificial Sequence
  chemically synthesized
ctgactggattttattattt

SEQ ID NO: 46577 - DNA, 20 bp, Artificial Sequence
  chemically synthesized
actggattttattatttcag

SEQ ID NO: 46578 - DNA, 20 bp, Artificial Sequence
  chemically synthesized
tatatcacagagggatattt

SEQ ID NO: 46579 - DNA, 20 bp, Artificial Sequence
  chemically synthesized
gaatgtaaatatatcacaga

SEQ ID NO: 46580 - DNA, 20 bp, Artificial Sequence
  chemically synthesized
agaatgtaaatatatcacag

SEQ ID NO: 46581 - DNA, 20 bp, Artificial Sequence
  chemically synthesized
tagaatgtaaatatatcaca

SEQ ID NO: 46582 - DNA, 20 bp, Artificial Sequence
  chemically synthesized
cttagaatgtaaatatatca

SEQ ID NO: 46583 - DNA, 20 bp, Artificial Sequence
  chemically synthesized
ctgtgatatatttacattct

SEQ ID NO: 46584 - DNA, 20 bp, Artificial Sequence
  chemically synthesized
ttactttagcttcaataact

SEQ ID NO: 46585 - DNA, 20 bp, Artificial Sequence
  chemically synthesized
atttacattctaagttattg

SEQ ID NO: 46586 - DNA, 20 bp, Artificial Sequence
  chemically synthesized
attctaagttattgaagcta

SEQ ID NO: 46587 - DNA, 20 bp, Artificial Sequence
  chemically synthesized
gagtgataagcatattactt

SEQ ID NO: 46588 - DNA, 20 bp, Artificial Sequence
  chemically synthesized
aacaaccatatcagagtgat

SEQ ID NO: 46589 - DNA, 20 bp, Artificial Sequence
  chemically synthesized
atatgcttatcactctgata

SEQ ID NO: 46590 - DNA, 20 bp, Artificial Sequence
  chemically synthesized
agataaaaacaaccatatca

SEQ ID NO: 46591 - DNA, 20 bp, Artificial Sequence
  chemically synthesized
aaagataaaaacaaccatat

SEQ ID NO: 46592 - DNA, 20 bp, Artificial Sequence
  chemically synthesized
atggttgtttttatctttat

SEQ ID NO: 46593 - DNA, 20 bp, Artificial Sequence
  chemically synthesized
ggattctctttaaaccaata

SEQ ID NO: 46594 - DNA, 20 bp, Artificial Sequence
  chemically synthesized
tttttatctttattggttta

SEQ ID NO: 46595 - DNA, 20 bp, Artificial Sequence
  chemically synthesized
tttatctttattggtttaaa

SEQ ID NO: 46596 - DNA, 20 bp, Artificial Sequence
  chemically synthesized
atctatttggtaagtgaatt

SEQ ID NO: 46597 - DNA, 20 bp, Artificial Sequence
  chemically synthesized
atccaaattcacttaccaaa

SEQ ID NO: 46598 - DNA, 20 bp, Artificial Sequence
  chemically synthesized
aaattaagcatctatttggt

SEQ ID NO: 46599 - DNA, 20 bp, Artificial Sequence
  chemically synthesized
caccaaattaagcatctatt

SEQ ID NO: 46600 - DNA, 20 bp, Artificial Sequence
  chemically synthesized
taccaaatagatgcttaatt

SEQ ID NO: 46601 - DNA, 20 bp, Artificial Sequence
  chemically synthesized
acattttgaggcaccaaatt

SEQ ID NO: 46602 - DNA, 20 bp, Artificial Sequence
  chemically synthesized
actggtcagctgacattttg

SEQ ID NO: 46603 - DNA, 20 bp, Artificial Sequence
  chemically synthesized
aatttggtgcctcaaaatgt

SEQ ID NO: 46604 - DNA, 20 bp, Artificial Sequence
  chemically synthesized
cactggtcagctgacatttt

SEQ ID NO: 46605 - DNA, 20 bp, Artificial Sequence
  chemically synthesized
gcctcaaaatgtcagctgac

SEQ ID NO: 46606 - DNA, 20 bp, Artificial Sequence
  chemically synthesized
tctaataagatcacactggt

SEQ ID NO: 46607 - DNA, 20 bp, Artificial Sequence
  chemically synthesized
cttttctaataagatcacac

SEQ ID NO: 46608 - DNA, 20 bp, Artificial Sequence
  chemically synthesized
gctgaccagtgtgatcttat

SEQ ID NO: 46609 - DNA, 20 bp, Artificial Sequence
  chemically synthesized
ccagtgtgatcttattagaa

SEQ ID NO: 46610 - DNA, 20 bp, Artificial Sequence
  chemically synthesized
ttttggtcaccttttctaat

SEQ ID NO: 46611 - DNA, 20 bp, Artificial Sequence
  chemically synthesized
cagtgtgatcttattagaaa

SEQ ID NO: 46612 - DNA, 20 bp, Artificial Sequence
  chemically synthesized
ttattagaaaaggtgaccaa

SEQ ID NO: 46613 - DNA, 20 bp, Artificial Sequence
  chemically synthesized
tagaaaaggtgaccaaaagt

SEQ ID NO: 46614 - DNA, 20 bp, Artificial Sequence
  chemically synthesized
agaaaaggtgaccaaaagtg

SEQ ID NO: 46615 - DNA, 20 bp, Artificial Sequence
  chemically synthesized
gaaaaggtgaccaaaagtga

SEQ ID NO: 46616 - DNA, 20 bp, Artificial Sequence
  chemically synthesized
agtagacattccctcacttt

SEQ ID NO: 46617 - DNA, 20 bp, Artificial Sequence
  chemically synthesized
gagggaatgtctactgatat

SEQ ID NO: 46618 - DNA, 20 bp, Artificial Sequence
  chemically synthesized
ttattacgctctgatatcag

SEQ ID NO: 46619 - DNA, 20 bp, Artificial Sequence
  chemically synthesized
gggaatgtctactgatatca

SEQ ID NO: 46620 - DNA, 20 bp, Artificial Sequence
  chemically synthesized
gtcttattacgctctgatat

SEQ ID NO: 46621 - DNA, 20 bp, Artificial Sequence
  chemically synthesized
tactgatatcagagcgtaat

SEQ ID NO: 46622 - DNA, 20 bp, Artificial Sequence
  chemically synthesized
cgtaataagacttttgttat

SEQ ID NO: 46623 - DNA, 20 bp, Artificial Sequence
  chemically synthesized
ggattcatcactcataacaa

SEQ ID NO: 46624 - DNA, 20 bp, Artificial Sequence
  chemically synthesized
tgaaatgaaatttcacgtat

SEQ ID NO: 46625 - DNA, 20 bp, Artificial Sequence
  chemically synthesized
gtgaaatgaaatttcacgta

SEQ ID NO: 46626 - DNA, 20 bp, Artificial Sequence
  chemically synthesized
tgaaatttcatttcacatac

SEQ ID NO: 46627 - DNA, 20 bp, Artificial Sequence
  chemically synthesized
gaaatttcatttcacatact

SEQ ID NO: 46628 - DNA, 20 bp, Artificial Sequence
  chemically synthesized
gtcataataaaacaaattcc

SEQ ID NO: 46629 - DNA, 20 bp, Artificial Sequence
  chemically synthesized
catttgaccaatacacagtg

SEQ ID NO: 46630 - DNA, 20 bp, Artificial Sequence
  chemically synthesized
attatgacttcactgtgtat

SEQ ID NO: 46631 - DNA, 20 bp, Artificial Sequence
  chemically synthesized
tcattcatttgaccaataca

SEQ ID NO: 46632 - DNA, 20 bp, Artificial Sequence
  chemically synthesized
aaaaaaaaaaaaacaatgca

SEQ ID NO: 46633 - DNA, 20 bp, Artificial Sequence
  chemically synthesized
tgcattgttttttttttttt

SEQ ID NO: 46634 - DNA, 20 bp, Artificial Sequence
  chemically synthesized
gcattgtttttttttttttc

SEQ ID NO: 46635 - DNA, 20 bp, Artificial Sequence
  chemically synthesized
tttttttttttttcaggctt

SEQ ID NO: 46636 - DNA, 20 bp, Artificial Sequence
  chemically synthesized
tttttttcaggcttaagttg

SEQ ID NO: 46637 - DNA, 20 bp, Artificial Sequence
  chemically synthesized
ttttttcaggcttaagttgt

SEQ ID NO: 46638 - DNA, 20 bp, Artificial Sequence
  chemically synthesized
gggaagaaatcctacaactt

SEQ ID NO: 46639 - DNA, 20 bp, Artificial Sequence
  chemically synthesized
gttgtaggatttcttcccta

SEQ ID NO: 46640 - DNA, 20 bp, Artificial Sequence
  chemically synthesized
gtagaggttcagctttaggg

SEQ ID NO: 46641 - DNA, 20 bp, Artificial Sequence
  chemically synthesized
tttgtagaggttcagcttta

SEQ ID NO: 46642 - DNA, 20 bp, Artificial Sequence
  chemically synthesized
atttgtagaggttcagcttt

SEQ ID NO: 46643 - DNA, 20 bp, Artificial Sequence
  chemically synthesized
tatttgtagaggttcagctt

SEQ ID NO: 46644 - DNA, 20 bp, Artificial Sequence
  chemically synthesized
aaaatatatttgtagaggtt

SEQ ID NO: 46645 - DNA, 20 bp, Artificial Sequence
  chemically synthesized
tatataaaatatatttgtag

SEQ ID NO: 46646 - DNA, 20 bp, Artificial Sequence
  chemically synthesized
gtatataaaatatatttgta

SEQ ID NO: 46647 - DNA, 20 bp, Artificial Sequence
  chemically synthesized
cagtatataaaatatatttg

SEQ ID NO: 46648 - DNA, 20 bp, Artificial Sequence
  chemically synthesized
aaaaaaaccatcagatcaaa

SEQ ID NO: 46649 - DNA, 20 bp, Artificial Sequence
  chemically synthesized
ttatatactgtttgatctga

SEQ ID NO: 46650 - DNA, 20 bp, Artificial Sequence
  chemically synthesized
aaagaaagaaaaaaaaccat

SEQ ID NO: 46651 - DNA, 20 bp, Artificial Sequence
  chemically synthesized
atggttttttttctttcttt

SEQ ID NO: 46652 - DNA, 20 bp, Artificial Sequence
  chemically synthesized
agattattttgtcttaaaga

SEQ ID NO: 46653 - DNA, 20 bp, Artificial Sequence
  chemically synthesized
aacaagattattttgtctta

SEQ ID NO: 46654 - DNA, 20 bp, Artificial Sequence
  chemically synthesized
taagacaaaataatcttgtt

SEQ ID NO: 46655 - DNA, 20 bp, Artificial Sequence
  chemically synthesized
aagacaaaataatcttgttg

SEQ ID NO: 46656 - DNA, 20 bp, Artificial Sequence
  chemically synthesized
gacaaaataatcttgttgag

SEQ ID NO: 46657 - DNA, 20 bp, Artificial Sequence
  chemically synthesized
acaaaataatcttgttgagg

SEQ ID NO: 46658 - DNA, 20 bp, Artificial Sequence
  chemically synthesized
tgttatagtgcctcctcaac

SEQ ID NO: 46659 - DNA, 20 bp, Artificial Sequence
  chemically synthesized
atattgttgaggaaatgtta

SEQ ID NO: 46660 - DNA, 20 bp, Artificial Sequence
  chemically synthesized
ggaggaagattatattgttg

SEQ ID NO: 46661 - DNA, 20 bp, Artificial Sequence
  chemically synthesized
aggaggaagattatattgtt

SEQ ID NO: 46662 - DNA, 20 bp, Artificial Sequence
  chemically synthesized
ttaaaactatattcaggagg

SEQ ID NO: 46663 - DNA, 20 bp, Artificial Sequence
  chemically synthesized
gtcttaaaactatattcagg

SEQ ID NO: 46664 - DNA, 20 bp, Artificial Sequence
  chemically synthesized
tataatcttcctcctgaata

SEQ ID NO: 46665 - DNA, 20 bp, Artificial Sequence
  chemically synthesized
tgtcttaaaactatattcag

SEQ ID NO: 46666 - DNA, 20 bp, Artificial Sequence
  chemically synthesized
agtgtcttaaaactatattc

SEQ ID NO: 46667 - DNA, 20 bp, Artificial Sequence
  chemically synthesized
cagtgtcttaaaactatatt

SEQ ID NO: 46668 - DNA, 20 bp, Artificial Sequence
  chemically synthesized
ttcctcctgaatatagtttt

SEQ ID NO: 46669 - DNA, 20 bp, Artificial Sequence
  chemically synthesized
tgaatatagttttaagacac

SEQ ID NO: 46670 - DNA, 20 bp, Artificial Sequence
  chemically synthesized
aatatagttttaagacactg

SEQ ID NO: 46671 - DNA, 20 bp, Artificial Sequence
  chemically synthesized
ttttaagacactggagcttt

SEQ ID NO: 46672 - DNA, 20 bp, Artificial Sequence
  chemically synthesized
ttctgtgtttcttaaagctc

SEQ ID NO: 46673 - DNA, 20 bp, Artificial Sequence
  chemically synthesized
ataatattctgtgtttctta

SEQ ID NO: 46674 - DNA, 20 bp, Artificial Sequence
  chemically synthesized
cactggagctttaagaaaca

SEQ ID NO: 46675 - DNA, 20 bp, Artificial Sequence
  chemically synthesized
taagaaacacagaatattat

SEQ ID NO: 46676 - DNA, 20 bp, Artificial Sequence
  chemically synthesized
acacagaatattatcagaaa

SEQ ID NO: 46677 - DNA, 20 bp, Artificial Sequence
  chemically synthesized
attatcagaaacagaaataa

SEQ ID NO: 46678 - DNA, 20 bp, Artificial Sequence
  chemically synthesized
taaagttgctagatattaat

SEQ ID NO: 46679 - DNA, 20 bp, Artificial Sequence
  chemically synthesized
gacgcattcttattaatatc

SEQ ID NO: 46680 - DNA, 20 bp, Artificial Sequence
  chemically synthesized
gtatagacacataaagttgc

SEQ ID NO: 46681 - DNA, 20 bp, Artificial Sequence
  chemically synthesized
ggaaaaagtatagacacata

SEQ ID NO: 46682 - DNA, 20 bp, Artificial Sequence
  chemically synthesized
aaaattcaggggaaaaagta

SEQ ID NO: 46683 - DNA, 20 bp, Artificial Sequence
  chemically synthesized
gaatgaaaattcaggggaaa

SEQ ID NO: 46684 - DNA, 20 bp, Artificial Sequence
  chemically synthesized
ttagcagaatgaaaattcag

SEQ ID NO: 46685 - DNA, 20 bp, Artificial Sequence
  chemically synthesized
attagcagaatgaaaattca

SEQ ID NO: 46686 - DNA, 20 bp, Artificial Sequence
  chemically synthesized
tattagcagaatgaaaattc

SEQ ID NO: 46687 - DNA, 20 bp, Artificial Sequence
  chemically synthesized
ttattagcagaatgaaaatt

SEQ ID NO: 46688 - DNA, 20 bp, Artificial Sequence
  chemically synthesized
gctgtgcttcaaattattag

SEQ ID NO: 46689 - DNA, 20 bp, Artificial Sequence
  chemically synthesized
tcagctgtgcttcaaattat

SEQ ID NO: 46690 - DNA, 20 bp, Artificial Sequence
  chemically synthesized
ttcattctgctaataatttg

SEQ ID NO: 46691 - DNA, 20 bp, Artificial Sequence
  chemically synthesized
tctgctaataatttgaagca

SEQ ID NO: 46692 - DNA, 20 bp, Artificial Sequence
  chemically synthesized
gaggaaataatggtcagcat

SEQ ID NO: 46693 - DNA, 20 bp, Artificial Sequence
  chemically synthesized
tcataggaggaaataatggt

SEQ ID NO: 46694 - DNA, 20 bp, Artificial Sequence
  chemically synthesized
tttttcataggaggaaataa

SEQ ID NO: 46695 - DNA, 20 bp, Artificial Sequence
  chemically synthesized
aaaagggagtttttcatagg

SEQ ID NO: 46696 - DNA, 20 bp, Artificial Sequence
  chemically synthesized
taaaagggagtttttcatag

SEQ ID NO: 46697 - DNA, 20 bp, Artificial Sequence
  chemically synthesized
tttaaaagggagtttttcat

SEQ ID NO: 46698 - DNA, 20 bp, Artificial Sequence
  chemically synthesized
atttaaaagggagtttttca

SEQ ID NO: 46699 - DNA, 20 bp, Artificial Sequence
  chemically synthesized
tgtgagactaatttaaaagg

SEQ ID NO: 46700 - DNA, 20 bp, Artificial Sequence
  chemically synthesized
actgtgagactaatttaaaa

SEQ ID NO: 46701 - DNA, 20 bp, Artificial Sequence
  chemically synthesized
tgaaaaactcccttttaaat

SEQ ID NO: 46702 - DNA, 20 bp, Artificial Sequence
  chemically synthesized
tactgtgagactaatttaaa

SEQ ID NO: 46703 - DNA, 20 bp, Artificial Sequence
  chemically synthesized
ttactgtgagactaatttaa

SEQ ID NO: 46704 - DNA, 20 bp, Artificial Sequence
  chemically synthesized
tcccttttaaattagtctca

SEQ ID NO: 46705 - DNA, 20 bp, Artificial Sequence
  chemically synthesized
ctgcggagtgaatttactgt

SEQ ID NO: 46706 - DNA, 20 bp, Artificial Sequence
  chemically synthesized
ctcacagtaaattcactccg

SEQ ID NO: 46707 - DNA, 20 bp, Artificial Sequence
  chemically synthesized
ttacatctcaatacactgcg

SEQ ID NO: 46708 - DNA, 20 bp, Artificial Sequence
  chemically synthesized
tcttacatctcaatacactg

SEQ ID NO: 46709 - DNA, 20 bp, Artificial Sequence
  chemically synthesized
aattcactccgcagtgtatt

SEQ ID NO: 46710 - DNA, 20 bp, Artificial Sequence
  chemically synthesized
tccgcagtgtattgagatgt

SEQ ID NO: 46711 - DNA, 20 bp, Artificial Sequence
  chemically synthesized
tgagatgtaagaaaacgtca

SEQ ID NO: 46712 - DNA, 20 bp, Artificial Sequence
  chemically synthesized
cagtgtagtcgaggatatat

SEQ ID NO: 46713 - DNA, 20 bp, Artificial Sequence
  chemically synthesized
catattatacagtgtagtcg

SEQ ID NO: 46714 - DNA, 20 bp, Artificial Sequence
  chemically synthesized
tcatattatacagtgtagtc

SEQ ID NO: 46715 - DNA, 20 bp, Artificial Sequence
  chemically synthesized
ttctttcatattatacagtg

SEQ ID NO: 46716 - DNA, 20 bp, Artificial Sequence
  chemically synthesized
agctgttctttcatattata

SEQ ID NO: 46717 - DNA, 20 bp, Artificial Sequence
  chemically synthesized
gactacactgtataatatga

SEQ ID NO: 46718 - DNA, 20 bp, Artificial Sequence
  chemically synthesized
cactgtataatatgaaagaa

SEQ ID NO: 46719 - DNA, 20 bp, Artificial Sequence
  chemically synthesized
gaaagaacagcttctaataa

SEQ ID NO: 46720 - DNA, 20 bp, Artificial Sequence
  chemically synthesized
gtgaagttaacttttattag

SEQ ID NO: 46721 - DNA, 20 bp, Artificial Sequence
  chemically synthesized
tgggtgaagttaacttttat

SEQ ID NO: 46722 - DNA, 20 bp, Artificial Sequence
  chemically synthesized
aaattgtctggcagtgggtg

SEQ ID NO: 46723 - DNA, 20 bp, Artificial Sequence
  chemically synthesized
aagttaacttcacccactgc

SEQ ID NO: 46724 - DNA, 20 bp, Artificial Sequence
  chemically synthesized
cgcttaaattgtctggcagt

SEQ ID NO: 46725 - DNA, 20 bp, Artificial Sequence
  chemically synthesized
acgcttaaattgtctggcag

SEQ ID NO: 46726 - DNA, 20 bp, Artificial Sequence
  chemically synthesized
attacgcttaaattgtctgg

SEQ ID NO: 46727 - DNA, 20 bp, Artificial Sequence
  chemically synthesized
ttcattacgcttaaattgtc

SEQ ID NO: 46728 - DNA, 20 bp, Artificial Sequence
  chemically synthesized
cacccactgccagacaattt

SEQ ID NO: 46729 - DNA, 20 bp, Artificial Sequence
  chemically synthesized
atttaagcgtaatgaaactc

SEQ ID NO: 46730 - DNA, 20 bp, Artificial Sequence
  chemically synthesized
tatataaaacaaagaagctg

SEQ ID NO: 46731 - DNA, 20 bp, Artificial Sequence
  chemically synthesized
tctatataaaacaaagaagc

SEQ ID NO: 46732 - DNA, 20 bp, Artificial Sequence
  chemically synthesized
ttactctatataaaacaaag

SEQ ID NO: 46733 - DNA, 20 bp, Artificial Sequence
  chemically synthesized
ctattactctatataaaaca

SEQ ID NO: 46734 - DNA, 20 bp, Artificial Sequence
  chemically synthesized
tccagcttctttgttttata

SEQ ID NO: 46735 - DNA, 20 bp, Artificial Sequence
  chemically synthesized
cagcttctttgttttatata

SEQ ID NO: 46736 - DNA, 20 bp, Artificial Sequence
  chemically synthesized
ctttgttttatatagagtaa

SEQ ID NO: 46737 - DNA, 20 bp, Artificial Sequence
  chemically synthesized
ttgttttatatagagtaata

SEQ ID NO: 46738 - DNA, 20 bp, Artificial Sequence
  chemically synthesized
tgttttatatagagtaatag

SEQ ID NO: 46739 - DNA, 20 bp, Artificial Sequence
  chemically synthesized
gttttatatagagtaataga

SEQ ID NO: 46740 - DNA, 20 bp, Artificial Sequence
  chemically synthesized
agcatgtctggttaaaggtt

SEQ ID NO: 46741 - DNA, 20 bp, Artificial Sequence
  chemically synthesized
cagcatgtctggttaaaggt

SEQ ID NO: 46742 - DNA, 20 bp, Artificial Sequence
  chemically synthesized
caaatcacccaacctttaac

SEQ ID NO: 46743 - DNA, 20 bp, Artificial Sequence
  chemically synthesized
aaaacagcatgtctggttaa

SEQ ID NO: 46744 - DNA, 20 bp, Artificial Sequence
  chemically synthesized
caaaacagcatgtctggtta

SEQ ID NO: 46745 - DNA, 20 bp, Artificial Sequence
  chemically synthesized
aaggtacaaaacagcatgtc

SEQ ID NO: 46746 - DNA, 20 bp, Artificial Sequence
  chemically synthesized
catatctccaaggtacaaaa

SEQ ID NO: 46747 - DNA, 20 bp, Artificial Sequence
  chemically synthesized
agacatgctgttttgtacct

SEQ ID NO: 46748 - DNA, 20 bp, Artificial Sequence
  chemically synthesized
acatgctgttttgtaccttg

SEQ ID NO: 46749 - DNA, 20 bp, Artificial Sequence
  chemically synthesized
gtttaaatgacatatctcca

SEQ ID NO: 46750 - DNA, 20 bp, Artificial Sequence
  chemically synthesized
cgtttaaatgacatatctcc

SEQ ID NO: 46751 - DNA, 20 bp, Artificial Sequence
  chemically synthesized
gatatgtcatttaaacgata

SEQ ID NO: 46752 - DNA, 20 bp, Artificial Sequence
  chemically synthesized
atatgtcatttaaacgatat

SEQ ID NO: 46753 - DNA, 20 bp, Artificial Sequence
  chemically synthesized
catttaaacgatataggaaa

SEQ ID NO: 46754 - DNA, 20 bp, Artificial Sequence
  chemically synthesized
ataggaaatggatttgtatt

SEQ ID NO: 46755 - DNA, 20 bp, Artificial Sequence
  chemically synthesized
gaaatggatttgtatttggc

SEQ ID NO: 46756 - DNA, 20 bp, Artificial Sequence
  chemically synthesized
aaatgaaaaagcataattac

SEQ ID NO: 46757 - DNA, 20 bp, Artificial Sequence
  chemically synthesized
ttccgtctgccaaaatgaaa

SEQ ID NO: 46758 - DNA, 20 bp, Artificial Sequence
  chemically synthesized
gtaattatgctttttcattt

SEQ ID NO: 46759 - DNA, 20 bp, Artificial Sequence
  chemically synthesized
attatgctttttcattttgg

SEQ ID NO: 46760 - DNA, 20 bp, Artificial Sequence
  chemically synthesized
tgctttttcattttggcaga

SEQ ID NO: 46761 - DNA, 20 bp, Artificial Sequence
  chemically synthesized
gcagacggaaatttttaata

SEQ ID NO: 46762 - DNA, 20 bp, Artificial Sequence
  chemically synthesized
agacggaaatttttaataca

SEQ ID NO: 46763 - DNA, 20 bp, Artificial Sequence
  chemically synthesized
aatttttaatacagagaaaa

SEQ ID NO: 46764 - DNA, 20 bp, Artificial Sequence
  chemically synthesized
atacagagaaaaaagacatt

SEQ ID NO: 46765 - DNA, 20 bp, Artificial Sequence
  chemically synthesized
cagagactacttcaaaacag

SEQ ID NO: 46766 - DNA, 20 bp, Artificial Sequence
  chemically synthesized
gacatttagctgctgttttg

SEQ ID NO: 46767 - DNA, 20 bp, Artificial Sequence
  chemically synthesized
agtcagagactacttcaaaa

SEQ ID NO: 46768 - DNA, 20 bp, Artificial Sequence
  chemically synthesized
atttagctgctgttttgaag

SEQ ID NO: 46769 - DNA, 20 bp, Artificial Sequence
  chemically synthesized
cagaaagaaatggaaagtca

SEQ ID NO: 46770 - DNA, 20 bp, Artificial Sequence
  chemically synthesized
gacagaaagaaatggaaagt

SEQ ID NO: 46771 - DNA, 20 bp, Artificial Sequence
  chemically synthesized
gaaggacagaaagaaatgga

SEQ ID NO: 46772 - DNA, 20 bp, Artificial Sequence
  chemically synthesized
gaaagaaggacagaaagaaa

SEQ ID NO: 46773 - DNA, 20 bp, Artificial Sequence
  chemically synthesized
aatagagaaagaaggacaga

SEQ ID NO: 46774 - DNA, 20 bp, Artificial Sequence
  chemically synthesized
aaggaatagagaaagaagga

SEQ ID NO: 46775 - DNA, 20 bp, Artificial Sequence
  chemically synthesized
aagaaaggaatagagaaaga

SEQ ID NO: 46776 - DNA, 20 bp, Artificial Sequence
  chemically synthesized
aaagaaaggaatagagaaag

SEQ ID NO: 46777 - DNA, 20 bp, Artificial Sequence
  chemically synthesized
ggaaaagaaaggaatagaga

SEQ ID NO: 46778 - DNA, 20 bp, Artificial Sequence
  chemically synthesized
gaagggaaaagaaaggaata

SEQ ID NO: 46779 - DNA, 20 bp, Artificial Sequence
  chemically synthesized
aggaagggaaaagaaaggaa

SEQ ID NO: 46780 - DNA, 20 bp, Artificial Sequence
  chemically synthesized
gcaggaggaagggaaaagaa

SEQ ID NO: 46781 - DNA, 20 bp, Artificial Sequence
  chemically synthesized
ggcaggaggaagggaaaaga

SEQ ID NO: 46782 - DNA, 20 bp, Artificial Sequence
  chemically synthesized
ggaaggcaggaggaagggaa

SEQ ID NO: 46783 - DNA, 20 bp, Artificial Sequence
  chemically synthesized
agcagggaaggcaggaggaa

SEQ ID NO: 46784 - DNA, 20 bp, Artificial Sequence
  chemically synthesized
aagcagggaaggcaggagga

SEQ ID NO: 46785 - DNA, 20 bp, Artificial Sequence
  chemically synthesized
gaagcagggaaggcaggagg

SEQ ID NO: 46786 - DNA, 20 bp, Artificial Sequence
  chemically synthesized
agggaagcagggaaggcagg

SEQ ID NO: 46787 - DNA, 20 bp, Artificial Sequence
  chemically synthesized
aagggaagcagggaaggcag

SEQ ID NO: 46788 - DNA, 20 bp, Artificial Sequence
  chemically synthesized
gaaagggaagcagggaaggc

SEQ ID NO: 46789 - DNA, 20 bp, Artificial Sequence
  chemically synthesized
ggaaagggaagcagggaagg

SEQ ID NO: 46790 - DNA, 20 bp, Artificial Sequence
  chemically synthesized
gatggaaagggaagcaggga

SEQ ID NO: 46791 - DNA, 20 bp, Artificial Sequence
  chemically synthesized
agatggaaagggaagcaggg

SEQ ID NO: 46792 - DNA, 20 bp, Artificial Sequence
  chemically synthesized
caaagatggaaagggaagca

SEQ ID NO: 46793 - DNA, 20 bp, Artificial Sequence
  chemically synthesized
gcaaagatggaaagggaagc

SEQ ID NO: 46794 - DNA, 20 bp, Artificial Sequence
  chemically synthesized
ggcaaagatggaaagggaag

SEQ ID NO: 46795 - DNA, 20 bp, Artificial Sequence
  chemically synthesized
aaaggcaaagatggaaaggg

SEQ ID NO: 46796 - DNA, 20 bp, Artificial Sequence
  chemically synthesized
gagaaaggcaaagatggaaa

SEQ ID NO: 46797 - DNA, 20 bp, Artificial Sequence
  chemically synthesized
tgagaaaggcaaagatggaa

SEQ ID NO: 46798 - DNA, 20 bp, Artificial Sequence
  chemically synthesized
atgagaaaggcaaagatgga

SEQ ID NO: 46799 - DNA, 20 bp, Artificial Sequence
  chemically synthesized
gagaatgagaaaggcaaaga

SEQ ID NO: 46800 - DNA, 20 bp, Artificial Sequence
  chemically synthesized
ggaagagaatgagaaaggca

SEQ ID NO: 46801 - DNA, 20 bp, Artificial Sequence
  chemically synthesized
agttgggaagagaatgagaa

SEQ ID NO: 46802 - DNA, 20 bp, Artificial Sequence
  chemically synthesized
gagttgggaagagaatgaga

SEQ ID NO: 46803 - DNA, 20 bp, Artificial Sequence
  chemically synthesized
agaagagttgggaagagaat

SEQ ID NO: 46804 - DNA, 20 bp, Artificial Sequence
  chemically synthesized
gacaagagaagagttgggaa

SEQ ID NO: 46805 - DNA, 20 bp, Artificial Sequence
  chemically synthesized
aggacaagagaagagttggg

SEQ ID NO: 46806 - DNA, 20 bp, Artificial Sequence
  chemically synthesized
aaaaggacaagagaagagtt

SEQ ID NO: 46807 - DNA, 20 bp, Artificial Sequence
  chemically synthesized
aaaaaggacaagagaagagt

SEQ ID NO: 46808 - DNA, 20 bp, Artificial Sequence
  chemically synthesized
aagaaaaaaggacaagagaa

SEQ ID NO: 46809 - DNA, 20 bp, Artificial Sequence
  chemically synthesized
agaagaaaaaaggacaagag

SEQ ID NO: 46810 - DNA, 20 bp, Artificial Sequence
  chemically synthesized
tacagaagaaaaaaggacaa

SEQ ID NO: 46811 - DNA, 20 bp, Artificial Sequence
  chemically synthesized
cctacagaagaaaaaaggac

SEQ ID NO: 46812 - DNA, 20 bp, Artificial Sequence
  chemically synthesized
tgcatcctacagaagaaaaa

SEQ ID NO: 46813 - DNA, 20 bp, Artificial Sequence
  chemically synthesized
ctgcatcctacagaagaaaa

SEQ ID NO: 46814 - DNA, 20 bp, Artificial Sequence
  chemically synthesized
tcttgtccttttttcttctg

SEQ ID NO: 46815 - DNA, 20 bp, Artificial Sequence
  chemically synthesized
cttgtccttttttcttctgt

SEQ ID NO: 46816 - DNA, 20 bp, Artificial Sequence
  chemically synthesized
aggagagctgcatcctacag

SEQ ID NO: 46817 - DNA, 20 bp, Artificial Sequence
  chemically synthesized
cttttttcttctgtaggatg

SEQ ID NO: 46818 - DNA, 20 bp, Artificial Sequence
  chemically synthesized
gacaggagagctgcatccta

SEQ ID NO: 46819 - DNA, 20 bp, Artificial Sequence
  chemically synthesized
gtgaacttatttggacagga

SEQ ID NO: 46820 - DNA, 20 bp, Artificial Sequence
  chemically synthesized
ctgtgaacttatttggacag

SEQ ID NO: 46821 - DNA, 20 bp, Artificial Sequence
  chemically synthesized
ctctgtgaacttatttggac

SEQ ID NO: 46822 - DNA, 20 bp, Artificial Sequence
  chemically synthesized
tgcagctctcctgtccaaat

SEQ ID NO: 46823 - DNA, 20 bp, Artificial Sequence
  chemically synthesized
actctgtgaacttatttgga

SEQ ID NO: 46824 - DNA, 20 bp, Artificial Sequence
  chemically synthesized
atttactctgtgaacttatt

SEQ ID NO: 46825 - DNA, 20 bp, Artificial Sequence
  chemically synthesized
ctcctgtccaaataagttca

SEQ ID NO: 46826 - DNA, 20 bp, Artificial Sequence
  chemically synthesized
cctgtccaaataagttcaca

SEQ ID NO: 46827 - DNA, 20 bp, Artificial Sequence
  chemically synthesized
aataagttcacagagtaaat

SEQ ID NO: 46828 - DNA, 20 bp, Artificial Sequence
  chemically synthesized
cttagcccatgtttttaaat

SEQ ID NO: 46829 - DNA, 20 bp, Artificial Sequence
  chemically synthesized
taagatctgatttaaaaaca

SEQ ID NO: 46830 - DNA, 20 bp, Artificial Sequence
  chemically synthesized
aagatctgatttaaaaacat

SEQ ID NO: 46831 - DNA, 20 bp, Artificial Sequence
  chemically synthesized
ctgatttaaaaacatgggct

SEQ ID NO: 46832 - DNA, 20 bp, Artificial Sequence
  chemically synthesized
tgatttaaaaacatgggcta

SEQ ID NO: 46833 - DNA, 20 bp, Artificial Sequence
  chemically synthesized
ttaaaaacatgggctaaggc

SEQ ID NO: 46834 - DNA, 20 bp, Artificial Sequence
  chemically synthesized
taaaaacatgggctaaggcc

SEQ ID NO: 46835 - DNA, 20 bp, Artificial Sequence
  chemically synthesized
tgagccaccacgcctggcct

SEQ ID NO: 46836 - DNA, 20 bp, Artificial Sequence
  chemically synthesized
acatgggctaaggccaggcg

SEQ ID NO: 46837 - DNA, 20 bp, Artificial Sequence
  chemically synthesized
tgggctaaggccaggcgtgg

SEQ ID NO: 46838 - DNA, 20 bp, Artificial Sequence
  chemically synthesized
caggcgtgagccaccacgcc

SEQ ID NO: 46839 - DNA, 20 bp, Artificial Sequence
  chemically synthesized
agtgttgggattacaggcgt

SEQ ID NO: 46840 - DNA, 20 bp, Artificial Sequence
  chemically synthesized
tcccaaagtgttgggattac

SEQ ID NO: 46841 - DNA, 20 bp, Artificial Sequence
  chemically synthesized
ctcccaaagtgttgggatta

SEQ ID NO: 46842 - DNA, 20 bp, Artificial Sequence
  chemically synthesized
cgcctgtaatcccaacactt

SEQ ID NO: 46843 - DNA, 20 bp, Artificial Sequence
  chemically synthesized
cctcagcctcccaaagtgtt

SEQ ID NO: 46844 - DNA, 20 bp, Artificial Sequence
  chemically synthesized
gcctgtaatcccaacacttt

SEQ ID NO: 46845 - DNA, 20 bp, Artificial Sequence
  chemically synthesized
gcctcagcctcccaaagtgt

SEQ ID NO: 46846 - DNA, 20 bp, Artificial Sequence
  chemically synthesized
ctgtaatcccaacactttgg

SEQ ID NO: 46847 - DNA, 20 bp, Artificial Sequence
  chemically synthesized
tgtaatcccaacactttggg

SEQ ID NO: 46848 - DNA, 20 bp, Artificial Sequence
  chemically synthesized
ctgcctgcctcagcctccca

SEQ ID NO: 46849 - DNA, 20 bp, Artificial Sequence
  chemically synthesized
tcccaacactttgggaggct

SEQ ID NO: 46850 - DNA, 20 bp, Artificial Sequence
  chemically synthesized
cccaacactttgggaggctg

SEQ ID NO: 46851 - DNA, 20 bp, Artificial Sequence
  chemically synthesized
aacactttgggaggctgagg

SEQ ID NO: 46852 - DNA, 20 bp, Artificial Sequence
  chemically synthesized
acactttgggaggctgaggc

SEQ ID NO: 46853 - DNA, 20 bp, Artificial Sequence
  chemically synthesized
ctttgggaggctgaggcagg

SEQ ID NO: 46854 - DNA, 20 bp, Artificial Sequence
  chemically synthesized
ctcagatgatctgcctgcct

SEQ ID NO: 46855 - DNA, 20 bp, Artificial Sequence
  chemically synthesized
ctgaggcaggcagatcatct

SEQ ID NO: 46856 - DNA, 20 bp, Artificial Sequence
  chemically synthesized
gcaggcagatcatctgagtt

SEQ ID NO: 46857 - DNA, 20 bp, Artificial Sequence
  chemically synthesized
caggcagatcatctgagttc

SEQ ID NO: 46858 - DNA, 20 bp, Artificial Sequence
  chemically synthesized
ggcagatcatctgagttcag

SEQ ID NO: 46859 - DNA, 20 bp, Artificial Sequence
  chemically synthesized
tggtcttgaactcctgaact

SEQ ID NO: 46860 - DNA, 20 bp, Artificial Sequence
  chemically synthesized
tcatctgagttcaggagttc

SEQ ID NO: 46861 - DNA, 20 bp, Artificial Sequence
  chemically synthesized
tgagttcaggagttcaagac

SEQ ID NO: 46862 - DNA, 20 bp, Artificial Sequence
  chemically synthesized
tcaggagttcaagaccagcc

SEQ ID NO: 46863 - DNA, 20 bp, Artificial Sequence
  chemically synthesized
tttcctcatgttggccaggc

SEQ ID NO: 46864 - DNA, 20 bp, Artificial Sequence
  chemically synthesized
agcgtttcctcatgttggcc

SEQ ID NO: 46865 - DNA, 20 bp, Artificial Sequence
  chemically synthesized
tagcgtttcctcatgttggc

SEQ ID NO: 46866 - DNA, 20 bp, Artificial Sequence
  chemically synthesized
aagaccagcctggccaacat

SEQ ID NO: 46867 - DNA, 20 bp, Artificial Sequence
  chemically synthesized
agaccagcctggccaacatg

SEQ ID NO: 46868 - DNA, 20 bp, Artificial Sequence
  chemically synthesized
gagatagcgtttcctcatgt

SEQ ID NO: 46869 - DNA, 20 bp, Artificial Sequence
  chemically synthesized
tttggtatttttagtagaga

SEQ ID NO: 46870 - DNA, 20 bp, Artificial Sequence
  chemically synthesized
tttttttggtatttttagta

SEQ ID NO: 46871 - DNA, 20 bp, Artificial Sequence
  chemically synthesized
tttttttttggtatttttag

SEQ ID NO: 46872 - DNA, 20 bp, Artificial Sequence
  chemically synthesized
ttttttttttttggtatttt

SEQ ID NO: 46873 - DNA, 20 bp, Artificial Sequence
  chemically synthesized
tttttttttttttttttttt

SEQ ID NO: 46874 - DNA, 20 bp, Artificial Sequence
  chemically synthesized
caaaaaaaaaaaaaaaaaaa

SEQ ID NO: 46875 - DNA, 20 bp, Artificial Sequence
  chemically synthesized
aaaaaaaaaaaaaaaaaagc

SEQ ID NO: 46876 - DNA, 20 bp, Artificial Sequence
  chemically synthesized
aaaaaaaaaaaaaaaaagcc

SEQ ID NO: 46877 - DNA, 20 bp, Artificial Sequence
  chemically synthesized
aaaaaaaaaaaagccgggca

SEQ ID NO: 46878 - DNA, 20 bp, Artificial Sequence
  chemically synthesized
aaaaaaaaagccgggcatgg

SEQ ID NO: 46879 - DNA, 20 bp, Artificial Sequence
  chemically synthesized
caggcacctgccaccatgcc

SEQ ID NO: 46880 - DNA, 20 bp, Artificial Sequence
  chemically synthesized
aaaaaagccgggcatggtgg

SEQ ID NO: 46881 - DNA, 20 bp, Artificial Sequence
  chemically synthesized
aaaaagccgggcatggtggc

SEQ ID NO: 46882 - DNA, 20 bp, Artificial Sequence
  chemically synthesized
gtggcaggtgcctgtaatcc

SEQ ID NO: 46883 - DNA, 20 bp, Artificial Sequence
  chemically synthesized
tcccgagtagctgggattac

SEQ ID NO: 46884 - DNA, 20 bp, Artificial Sequence
  chemically synthesized
ctcccgagtagctgggatta

SEQ ID NO: 46885 - DNA, 20 bp, Artificial Sequence
  chemically synthesized
tgcctgtaatcccagctact

SEQ ID NO: 46886 - DNA, 20 bp, Artificial Sequence
  chemically synthesized
cctcagtctcccgagtagct

SEQ ID NO: 46887 - DNA, 20 bp, Artificial Sequence
  chemically synthesized
gcctgtaatcccagctactc

SEQ ID NO: 46888 - DNA, 20 bp, Artificial Sequence
  chemically synthesized
gcctcagtctcccgagtagc

SEQ ID NO: 46889 - DNA, 20 bp, Artificial Sequence
  chemically synthesized
ctgtaatcccagctactcgg

SEQ ID NO: 46890 - DNA, 20 bp, Artificial Sequence
  chemically synthesized
tcctgcctcagtctcccgag

SEQ ID NO: 46891 - DNA, 20 bp, Artificial Sequence
  chemically synthesized
ttttcctgcctcagtctccc

SEQ ID NO: 46892 - DNA, 20 bp, Artificial Sequence
  chemically synthesized
tcccagctactcgggagact

SEQ ID NO: 46893 - DNA, 20 bp, Artificial Sequence
  chemically synthesized
cccagctactcgggagactg

SEQ ID NO: 46894 - DNA, 20 bp, Artificial Sequence
  chemically synthesized
agctactcgggagactgagg

SEQ ID NO: 46895 - DNA, 20 bp, Artificial Sequence
  chemically synthesized
gctactcgggagactgaggc

SEQ ID NO: 46896 - DNA, 20 bp, Artificial Sequence
  chemically synthesized
ttcaagtgattttcctgcct

SEQ ID NO: 46897 - DNA, 20 bp, Artificial Sequence
  chemically synthesized
gcaggaaaatcacttgaacc

SEQ ID NO: 46898 - DNA, 20 bp, Artificial Sequence
  chemically synthesized
caggaaaatcacttgaaccc

SEQ ID NO: 46899 - DNA, 20 bp, Artificial Sequence
  chemically synthesized
atcctttgcctcctgggttc

SEQ ID NO: 46900 - DNA, 20 bp, Artificial Sequence
  chemically synthesized
ggaaaatcacttgaacccag

SEQ ID NO: 46901 - DNA, 20 bp, Artificial Sequence
  chemically synthesized
gaaaatcacttgaacccagg

SEQ ID NO: 46902 - DNA, 20 bp, Artificial Sequence
  chemically synthesized
cactgcatcctttgcctcct

SEQ ID NO: 46903 - DNA, 20 bp, Artificial Sequence
  chemically synthesized
tcacttgaacccaggaggca

SEQ ID NO: 46904 - DNA, 20 bp, Artificial Sequence
  chemically synthesized
tcactgcatcctttgcctcc

SEQ ID NO: 46905 - DNA, 20 bp, Artificial Sequence
  chemically synthesized
cacttgaacccaggaggcaa

SEQ ID NO: 46906 - DNA, 20 bp, Artificial Sequence
  chemically synthesized
aacccaggaggcaaaggatg

SEQ ID NO: 46907 - DNA, 20 bp, Artificial Sequence
  chemically synthesized
caggaggcaaaggatgcagt

SEQ ID NO: 46908 - DNA, 20 bp, Artificial Sequence
  chemically synthesized
ggagtgcagtggtgcgattt

SEQ ID NO: 46909 - DNA, 20 bp, Artificial Sequence
  chemically synthesized
tcgcccaggctggagtgcag

SEQ ID NO: 46910 - DNA, 20 bp, Artificial Sequence
  chemically synthesized
gaaatcgcaccactgcactc

SEQ ID NO: 46911 - DNA, 20 bp, Artificial Sequence
  chemically synthesized
ttgtcgcccaggctggagtg

SEQ ID NO: 46912 - DNA, 20 bp, Artificial Sequence
  chemically synthesized
cgcaccactgcactccagcc

SEQ ID NO: 46913 - DNA, 20 bp, Artificial Sequence
  chemically synthesized
gcaccactgcactccagcct

SEQ ID NO: 46914 - DNA, 20 bp, Artificial Sequence
  chemically synthesized
tgctcttgtcgcccaggctg

SEQ ID NO: 46915 - DNA, 20 bp, Artificial Sequence
  chemically synthesized
tttgctcttgtcgcccaggc

SEQ ID NO: 46916 - DNA, 20 bp, Artificial Sequence
  chemically synthesized
tgcactccagcctgggcgac

SEQ ID NO: 46917 - DNA, 20 bp, Artificial Sequence
  chemically synthesized
gagttttgctcttgtcgccc

SEQ ID NO: 46918 - DNA, 20 bp, Artificial Sequence
  chemically synthesized
ggagttttgctcttgtcgcc

SEQ ID NO: 46919 - DNA, 20 bp, Artificial Sequence
  chemically synthesized
cactccagcctgggcgacaa

SEQ ID NO: 46920 - DNA, 20 bp, Artificial Sequence
  chemically synthesized
gtttgtttgtttttcagttg

SEQ ID NO: 46921 - DNA, 20 bp, Artificial Sequence
  chemically synthesized
ttgtttgtttgtttttcagt

SEQ ID NO: 46922 - DNA, 20 bp, Artificial Sequence
  chemically synthesized
ttgtttgtttgtttgttttt

SEQ ID NO: 46923 - DNA, 20 bp, Artificial Sequence
  chemically synthesized
acaaacaaacaaacaaacca

SEQ ID NO: 46924 - DNA, 20 bp, Artificial Sequence
  chemically synthesized
caaacaaacaaacaaaccat

SEQ ID NO: 46925 - DNA, 20 bp, Artificial Sequence
  chemically synthesized
caaacaaacaaaccatgggc

SEQ ID NO: 46926 - DNA, 20 bp, Artificial Sequence
  chemically synthesized
aggtcaggaagtctagccca

SEQ ID NO: 46927 - DNA, 20 bp, Artificial Sequence
  chemically synthesized
accagataggtcaggaagtc

SEQ ID NO: 46928 - DNA, 20 bp, Artificial Sequence
  chemically synthesized
ctctgaccagataggtcagg

SEQ ID NO: 46929 - DNA, 20 bp, Artificial Sequence
  chemically synthesized
agactctgaccagataggtc

SEQ ID NO: 46930 - DNA, 20 bp, Artificial Sequence
  chemically synthesized
gctagacttcctgacctatc

SEQ ID NO: 46931 - DNA, 20 bp, Artificial Sequence
  chemically synthesized
cagactctgaccagataggt

SEQ ID NO: 46932 - DNA, 20 bp, Artificial Sequence
  chemically synthesized
gacttcctgacctatctggt

SEQ ID NO: 46933 - DNA, 20 bp, Artificial Sequence
  chemically synthesized
acaacagactctgaccagat

SEQ ID NO: 46934 - DNA, 20 bp, Artificial Sequence
  chemically synthesized
aacaacagactctgaccaga

SEQ ID NO: 46935 - DNA, 20 bp, Artificial Sequence
  chemically synthesized
cttcctgacctatctggtca

SEQ ID NO: 46936 - DNA, 20 bp, Artificial Sequence
  chemically synthesized
ccataacaacagactctgac

SEQ ID NO: 46937 - DNA, 20 bp, Artificial Sequence
  chemically synthesized
ctggtcagagtctgttgtta

SEQ ID NO: 46938 - DNA, 20 bp, Artificial Sequence
  chemically synthesized
ttttaatatttccataacaa

SEQ ID NO: 46939 - DNA, 20 bp, Artificial Sequence
  chemically synthesized
gttgttatggaaatattaaa

SEQ ID NO: 46940 - DNA, 20 bp, Artificial Sequence
  chemically synthesized
ttatggaaatattaaaaagc

SEQ ID NO: 46941 - DNA, 20 bp, Artificial Sequence
  chemically synthesized
tgtttcctgctatagagggc

SEQ ID NO: 46942 - DNA, 20 bp, Artificial Sequence
  chemically synthesized
attaaaaagctagccctcta

SEQ ID NO: 46943 - DNA, 20 bp, Artificial Sequence
  chemically synthesized
aaaaagctagccctctatag

SEQ ID NO: 46944 - DNA, 20 bp, Artificial Sequence
  chemically synthesized
accatgtttcctgctataga

SEQ ID NO: 46945 - DNA, 20 bp, Artificial Sequence
  chemically synthesized
aaaagctagccctctatagc

SEQ ID NO: 46946 - DNA, 20 bp, Artificial Sequence
  chemically synthesized
caccatgtttcctgctatag

SEQ ID NO: 46947 - DNA, 20 bp, Artificial Sequence
  chemically synthesized
ccaccatgtttcctgctata

SEQ ID NO: 46948 - DNA, 20 bp, Artificial Sequence
  chemically synthesized
ctccaccatgtttcctgcta

SEQ ID NO: 46949 - DNA, 20 bp, Artificial Sequence
  chemically synthesized
gccctctatagcaggaaaca

SEQ ID NO: 46950 - DNA, 20 bp, Artificial Sequence
  chemically synthesized
ctctatagcaggaaacatgg

SEQ ID NO: 46951 - DNA, 20 bp, Artificial Sequence
  chemically synthesized
ctatagcaggaaacatggtg

SEQ ID NO: 46952 - DNA, 20 bp, Artificial Sequence
  chemically synthesized
atagcaggaaacatggtgga

SEQ ID NO: 46953 - DNA, 20 bp, Artificial Sequence
  chemically synthesized
caggaaacatggtggagagc

SEQ ID NO: 46954 - DNA, 20 bp, Artificial Sequence
  chemically synthesized
tggtggagagccagaaatta

SEQ ID NO: 46955 - DNA, 20 bp, Artificial Sequence
  chemically synthesized
cagccaggagctataatttc

SEQ ID NO: 46956 - DNA, 20 bp, Artificial Sequence
  chemically synthesized
gagccagaaattatagctcc

SEQ ID NO: 46957 - DNA, 20 bp, Artificial Sequence
  chemically synthesized
aaggtacactgagcagccag

SEQ ID NO: 46958 - DNA, 20 bp, Artificial Sequence
  chemically synthesized
aattatagctcctggctgct

SEQ ID NO: 46959 - DNA, 20 bp, Artificial Sequence
  chemically synthesized
agaaggtacactgagcagcc

SEQ ID NO: 46960 - DNA, 20 bp, Artificial Sequence
  chemically synthesized
aagaaggtacactgagcagc

SEQ ID NO: 46961 - DNA, 20 bp, Artificial Sequence
  chemically synthesized
taagaagaaggtacactgag

SEQ ID NO: 46962 - DNA, 20 bp, Artificial Sequence
  chemically synthesized
ttttaagaagaaggtacact

SEQ ID NO: 46963 - DNA, 20 bp, Artificial Sequence
  chemically synthesized
atgctggtattttaagaaga

SEQ ID NO: 46964 - DNA, 20 bp, Artificial Sequence
  chemically synthesized
gatgctggtattttaagaag

SEQ ID NO: 46965 - DNA, 20 bp, Artificial Sequence
  chemically synthesized
tatgatgctggtattttaag

SEQ ID NO: 46966 - DNA, 20 bp, Artificial Sequence
  chemically synthesized
gtaccttcttcttaaaatac

SEQ ID NO: 46967 - DNA, 20 bp, Artificial Sequence
  chemically synthesized
ttttatgatgctggtatttt

SEQ ID NO: 46968 - DNA, 20 bp, Artificial Sequence
  chemically synthesized
tcttcttccttttatgatgc

SEQ ID NO: 46969 - DNA, 20 bp, Artificial Sequence
  chemically synthesized
ttaaaataccagcatcataa

SEQ ID NO: 46970 - DNA, 20 bp, Artificial Sequence
  chemically synthesized
taaaataccagcatcataaa

SEQ ID NO: 46971 - DNA, 20 bp, Artificial Sequence
  chemically synthesized
aataccagcatcataaaagg

SEQ ID NO: 46972 - DNA, 20 bp, Artificial Sequence
  chemically synthesized
accagcatcataaaaggaag

SEQ ID NO: 46973 - DNA, 20 bp, Artificial Sequence
  chemically synthesized
cagcatcataaaaggaagaa

SEQ ID NO: 46974 - DNA, 20 bp, Artificial Sequence
  chemically synthesized
taaaaggaagaagagaactc

SEQ ID NO: 46975 - DNA, 20 bp, Artificial Sequence
  chemically synthesized
aaaggaagaagagaactcca

SEQ ID NO: 46976 - DNA, 20 bp, Artificial Sequence
  chemically synthesized
aggaagaagagaactccaga

SEQ ID NO: 46977 - DNA, 20 bp, Artificial Sequence
  chemically synthesized
gctggaccaagagctctctg

SEQ ID NO: 46978 - DNA, 20 bp, Artificial Sequence
  chemically synthesized
gggctggaccaagagctctc

SEQ ID NO: 46979 - DNA, 20 bp, Artificial Sequence
  chemically synthesized
agagaactccagagagctct

SEQ ID NO: 46980 - DNA, 20 bp, Artificial Sequence
  chemically synthesized
actccagagagctcttggtc

SEQ ID NO: 46981 - DNA, 20 bp, Artificial Sequence
  chemically synthesized
gccagtgagggctggaccaa

SEQ ID NO: 46982 - DNA, 20 bp, Artificial Sequence
  chemically synthesized
cagccagtgagggctggacc

SEQ ID NO: 46983 - DNA, 20 bp, Artificial Sequence
  chemically synthesized
cattcacagccagtgagggc

SEQ ID NO: 46984 - DNA, 20 bp, Artificial Sequence
  chemically synthesized
gctcttggtccagccctcac

SEQ ID NO: 46985 - DNA, 20 bp, Artificial Sequence
  chemically synthesized
ttggcattcacagccagtga

SEQ ID NO: 46986 - DNA, 20 bp, Artificial Sequence
  chemically synthesized
cttggcattcacagccagtg

SEQ ID NO: 46987 - DNA, 20 bp, Artificial Sequence
  chemically synthesized
gcttggcattcacagccagt

SEQ ID NO: 46988 - DNA, 20 bp, Artificial Sequence
  chemically synthesized
acaggcttggcattcacagc

SEQ ID NO: 46989 - DNA, 20 bp, Artificial Sequence
  chemically synthesized
attcacaggcttggcattca

SEQ ID NO: 46990 - DNA, 20 bp, Artificial Sequence
  chemically synthesized
cctcactggctgtgaatgcc

SEQ ID NO: 46991 - DNA, 20 bp, Artificial Sequence
  chemically synthesized
agtttaggtattcacaggct

SEQ ID NO: 46992 - DNA, 20 bp, Artificial Sequence
  chemically synthesized
ttctcagtttaggtattcac

SEQ ID NO: 46993 - DNA, 20 bp, Artificial Sequence
  chemically synthesized
tttctcagtttaggtattca

SEQ ID NO: 46994 - DNA, 20 bp, Artificial Sequence
  chemically synthesized
agcctgtgaatacctaaact

SEQ ID NO: 46995 - DNA, 20 bp, Artificial Sequence
  chemically synthesized
agccattcttttctcagttt

SEQ ID NO: 46996 - DNA, 20 bp, Artificial Sequence
  chemically synthesized
tagccattcttttctcagtt

SEQ ID NO: 46997 - DNA, 20 bp, Artificial Sequence
  chemically synthesized
gtgaatacctaaactgagaa

SEQ ID NO: 46998 - DNA, 20 bp, Artificial Sequence
  chemically synthesized
aagaatagccattcttttct

SEQ ID NO: 46999 - DNA, 20 bp, Artificial Sequence
  chemically synthesized
tacctaaactgagaaaagaa

SEQ ID NO: 47000 - DNA, 20 bp, Artificial Sequence
  chemically synthesized
agatacctttaaggaaagaa

SEQ ID NO: 47001 - DNA, 20 bp, Artificial Sequence
  chemically synthesized
gaatggctattctttcctta

SEQ ID NO: 47002 - DNA, 20 bp, Artificial Sequence
  chemically synthesized
aatggctattctttccttaa

SEQ ID NO: 47003 - DNA, 20 bp, Artificial Sequence
  chemically synthesized
cccatagatacctttaagga

SEQ ID NO: 47004 - DNA, 20 bp, Artificial Sequence
  chemically synthesized
tcagcccatagataccttta

SEQ ID NO: 47005 - DNA, 20 bp, Artificial Sequence
  chemically synthesized
ctcagcccatagataccttt

SEQ ID NO: 47006 - DNA, 20 bp, Artificial Sequence
  chemically synthesized
tctttccttaaaggtatcta

SEQ ID NO: 47007 - DNA, 20 bp, Artificial Sequence
  chemically synthesized
ctttccttaaaggtatctat

SEQ ID NO: 47008 - DNA, 20 bp, Artificial Sequence
  chemically synthesized
cttaaaggtatctatgggct

SEQ ID NO: 47009 - DNA, 20 bp, Artificial Sequence
  chemically synthesized
ttaaaggtatctatgggctg

SEQ ID NO: 47010 - DNA, 20 bp, Artificial Sequence
  chemically synthesized
aattgtgaggcctcagccca

SEQ ID NO: 47011 - DNA, 20 bp, Artificial Sequence
  chemically synthesized
taagagaaattgtgaggcct

SEQ ID NO: 47012 - DNA, 20 bp, Artificial Sequence
  chemically synthesized
gtataataagagaaattgtg

SEQ ID NO: 47013 - DNA, 20 bp, Artificial Sequence
  chemically synthesized
ggtataataagagaaattgt

SEQ ID NO: 47014 - DNA, 20 bp, Artificial Sequence
  chemically synthesized
aaactagaaaggtataataa

SEQ ID NO: 47015 - DNA, 20 bp, Artificial Sequence
  chemically synthesized
aaaaactagaaaggtataat

SEQ ID NO: 47016 - DNA, 20 bp, Artificial Sequence
  chemically synthesized
tttctcttattatacctttc

SEQ ID NO: 47017 - DNA, 20 bp, Artificial Sequence
  chemically synthesized
aaaaaaaaaaaaaactagaa

SEQ ID NO: 47018 - DNA, 20 bp, Artificial Sequence
  chemically synthesized
aaaaaaaaaaaaaaactaga

SEQ ID NO: 47019 - DNA, 20 bp, Artificial Sequence
  chemically synthesized
tgataaaaaaaaaaaaaaac

SEQ ID NO: 47020 - DNA, 20 bp, Artificial Sequence
  chemically synthesized
tttttttttttttatcattc

SEQ ID NO: 47021 - DNA, 20 bp, Artificial Sequence
  chemically synthesized
ttttttttttatcattctag

SEQ ID NO: 47022 - DNA, 20 bp, Artificial Sequence
  chemically synthesized
tttttatcattctagtggtc

SEQ ID NO: 47023 - DNA, 20 bp, Artificial Sequence
  chemically synthesized
agaaagaatttctggaccac

SEQ ID NO: 47024 - DNA, 20 bp, Artificial Sequence
  chemically synthesized
tccaaattagaaagaatttc

SEQ ID NO: 47025 - DNA, 20 bp, Artificial Sequence
  chemically synthesized
tccagaaattctttctaatt

SEQ ID NO: 47026 - DNA, 20 bp, Artificial Sequence
  chemically synthesized
ctagcatcctccaaattaga

SEQ ID NO: 47027 - DNA, 20 bp, Artificial Sequence
  chemically synthesized
cagaaattctttctaatttg

SEQ ID NO: 47028 - DNA, 20 bp, Artificial Sequence
  chemically synthesized
agaaattctttctaatttgg

SEQ ID NO: 47029 - DNA, 20 bp, Artificial Sequence
  chemically synthesized
tggtctagcatcctccaaat

SEQ ID NO: 47030 - DNA, 20 bp, Artificial Sequence
  chemically synthesized
ctttctaatttggaggatgc

SEQ ID NO: 47031 - DNA, 20 bp, Artificial Sequence
  chemically synthesized
tctgctatcagaggatggtc

SEQ ID NO: 47032 - DNA, 20 bp, Artificial Sequence
  chemically synthesized
attcttctgctatcagagga

SEQ ID NO: 47033 - DNA, 20 bp, Artificial Sequence
  chemically synthesized
gatgctagaccatcctctga

SEQ ID NO: 47034 - DNA, 20 bp, Artificial Sequence
  chemically synthesized
gctagaccatcctctgatag

SEQ ID NO: 47035 - DNA, 20 bp, Artificial Sequence
  chemically synthesized
agtgattcttctgctatcag

SEQ ID NO: 47036 - DNA, 20 bp, Artificial Sequence
  chemically synthesized
aagtgattcttctgctatca

SEQ ID NO: 47037 - DNA, 20 bp, Artificial Sequence
  chemically synthesized
agaccatcctctgatagcag

SEQ ID NO: 47038 - DNA, 20 bp, Artificial Sequence
  chemically synthesized
caaagtgattcttctgctat

SEQ ID NO: 47039 - DNA, 20 bp, Artificial Sequence
  chemically synthesized
tgatagcagaagaatcactt

SEQ ID NO: 47040 - DNA, 20 bp, Artificial Sequence
  chemically synthesized
agaatagtgtaggaaatcca

SEQ ID NO: 47041 - DNA, 20 bp, Artificial Sequence
  chemically synthesized
gagacgcctaagaatagtgt

SEQ ID NO: 47042 - DNA, 20 bp, Artificial Sequence
  chemically synthesized
agagacgcctaagaatagtg

SEQ ID NO: 47043 - DNA, 20 bp, Artificial Sequence
  chemically synthesized
tggatttcctacactattct

SEQ ID NO: 47044 - DNA, 20 bp, Artificial Sequence
  chemically synthesized
ggatttcctacactattctt

SEQ ID NO: 47045 - DNA, 20 bp, Artificial Sequence
  chemically synthesized
ttctgagagacgcctaagaa

SEQ ID NO: 47046 - DNA, 20 bp, Artificial Sequence
  chemically synthesized
cttctttctgagagacgcct

SEQ ID NO: 47047 - DNA, 20 bp, Artificial Sequence
  chemically synthesized
cactattcttaggcgtctct

SEQ ID NO: 47048 - DNA, 20 bp, Artificial Sequence
  chemically synthesized
attcttaggcgtctctcaga

SEQ ID NO: 47049 - DNA, 20 bp, Artificial Sequence
  chemically synthesized
tccagcacacttctttctga

SEQ ID NO: 47050 - DNA, 20 bp, Artificial Sequence
  chemically synthesized
cttaggcgtctctcagaaag

SEQ ID NO: 47051 - DNA, 20 bp, Artificial Sequence
  chemically synthesized
tctccagcacacttctttct

SEQ ID NO: 47052 - DNA, 20 bp, Artificial Sequence
  chemically synthesized
tctctcagaaagaagtgtgc

SEQ ID NO: 47053 - DNA, 20 bp, Artificial Sequence
  chemically synthesized
tctcagaaagaagtgtgctg

SEQ ID NO: 47054 - DNA, 20 bp, Artificial Sequence
  chemically synthesized
tcagaaagaagtgtgctgga

SEQ ID NO: 47055 - DNA, 20 bp, Artificial Sequence
  chemically synthesized
cagaaagaagtgtgctggag

SEQ ID NO: 47056 - DNA, 20 bp, Artificial Sequence
  chemically synthesized
agaaagaagtgtgctggaga

SEQ ID NO: 47057 - DNA, 20 bp, Artificial Sequence
  chemically synthesized
aggcagccagcagccctctc

SEQ ID NO: 47058 - DNA, 20 bp, Artificial Sequence
  chemically synthesized
agtgtgctggagagggctgc

SEQ ID NO: 47059 - DNA, 20 bp, Artificial Sequence
  chemically synthesized
aagccaggccaggcagccag

SEQ ID NO: 47060 - DNA, 20 bp, Artificial Sequence
  chemically synthesized
ggagagggctgctggctgcc

SEQ ID NO: 47061 - DNA, 20 bp, Artificial Sequence
  chemically synthesized
cctaagccaggccaggcagc

SEQ ID NO: 47062 - DNA, 20 bp, Artificial Sequence
  chemically synthesized
gggctgctggctgcctggcc

SEQ ID NO: 47063 - DNA, 20 bp, Artificial Sequence
  chemically synthesized
agcccctaagccaggccagg

SEQ ID NO: 47064 - DNA, 20 bp, Artificial Sequence
  chemically synthesized
gaaagcccctaagccaggcc

SEQ ID NO: 47065 - DNA, 20 bp, Artificial Sequence
  chemically synthesized
cgaaagcccctaagccaggc

SEQ ID NO: 47066 - DNA, 20 bp, Artificial Sequence
  chemically synthesized
gctggctgcctggcctggct

SEQ ID NO: 47067 - DNA, 20 bp, Artificial Sequence
  chemically synthesized
ctggctgcctggcctggctt

SEQ ID NO: 47068 - DNA, 20 bp, Artificial Sequence
  chemically synthesized
tggctgcctggcctggctta

SEQ ID NO: 47069 - DNA, 20 bp, Artificial Sequence
  chemically synthesized
ggctgcctggcctggcttag

SEQ ID NO: 47070 - DNA, 20 bp, Artificial Sequence
  chemically synthesized
aggccgaaagcccctaagcc

SEQ ID NO: 47071 - DNA, 20 bp, Artificial Sequence
  chemically synthesized
caggccgaaagcccctaagc

SEQ ID NO: 47072 - DNA, 20 bp, Artificial Sequence
  chemically synthesized
ctttcaggccgaaagcccct

SEQ ID NO: 47073 - DNA, 20 bp, Artificial Sequence
  chemically synthesized
tggcctggcttaggggcttt

SEQ ID NO: 47074 - DNA, 20 bp, Artificial Sequence
  chemically synthesized
ggttgtttctttcaggccga

SEQ ID NO: 47075 - DNA, 20 bp, Artificial Sequence
  chemically synthesized
cttaggggctttcggcctga

SEQ ID NO: 47076 - DNA, 20 bp, Artificial Sequence
  chemically synthesized
gcttagaggttgtttctttc

SEQ ID NO: 47077 - DNA, 20 bp, Artificial Sequence
  chemically synthesized
tgcttagaggttgtttcttt

SEQ ID NO: 47078 - DNA, 20 bp, Artificial Sequence
  chemically synthesized
gcctgaaagaaacaacctct

SEQ ID NO: 47079 - DNA, 20 bp, Artificial Sequence
  chemically synthesized
tgaaagaaacaacctctaag

SEQ ID NO: 47080 - DNA, 20 bp, Artificial Sequence
  chemically synthesized
ctctgtctctcgctgcttag

SEQ ID NO: 47081 - DNA, 20 bp, Artificial Sequence
  chemically synthesized
cctctgtctctcgctgctta

SEQ ID NO: 47082 - DNA, 20 bp, Artificial Sequence
  chemically synthesized
agaaacaacctctaagcagc

SEQ ID NO: 47083 - DNA, 20 bp, Artificial Sequence
  chemically synthesized
ttcctctgtctctcgctgct

SEQ ID NO: 47084 - DNA, 20 bp, Artificial Sequence
  chemically synthesized
aaacaacctctaagcagcga

SEQ ID NO: 47085 - DNA, 20 bp, Artificial Sequence
  chemically synthesized
aacctctaagcagcgagaga

SEQ ID NO: 47086 - DNA, 20 bp, Artificial Sequence
  chemically synthesized
cctctaagcagcgagagaca

SEQ ID NO: 47087 - DNA, 20 bp, Artificial Sequence
  chemically synthesized
ctctaagcagcgagagacag

SEQ ID NO: 47088 - DNA, 20 bp, Artificial Sequence
  chemically synthesized
agcgagagacagaggaaaat

SEQ ID NO: 47089 - DNA, 20 bp, Artificial Sequence
  chemically synthesized
agaggaaaattggcgttgcc

SEQ ID NO: 47090 - DNA, 20 bp, Artificial Sequence
  chemically synthesized
aaaattggcgttgcctggct

SEQ ID NO: 47091 - DNA, 20 bp, Artificial Sequence
  chemically synthesized
gtcttcccattagctcagcc

SEQ ID NO: 47092 - DNA, 20 bp, Artificial Sequence
  chemically synthesized
ggtcttcccattagctcagc

SEQ ID NO: 47093 - DNA, 20 bp, Artificial Sequence
  chemically synthesized
gcgttgcctggctgagctaa

SEQ ID NO: 47094 - DNA, 20 bp, Artificial Sequence
  chemically synthesized
cgttgcctggctgagctaat

SEQ ID NO: 47095 - DNA, 20 bp, Artificial Sequence
  chemically synthesized
cgtaggtcttcccattagct

SEQ ID NO: 47096 - DNA, 20 bp, Artificial Sequence
  chemically synthesized
tgcctggctgagctaatggg

SEQ ID NO: 47097 - DNA, 20 bp, Artificial Sequence
  chemically synthesized
ccctacgtaggtcttcccat

SEQ ID NO: 47098 - DNA, 20 bp, Artificial Sequence
  chemically synthesized
agctaatgggaagacctacg

SEQ ID NO: 47099 - DNA, 20 bp, Artificial Sequence
  chemically synthesized
gctaatgggaagacctacgt

SEQ ID NO: 47100 - DNA, 20 bp, Artificial Sequence
  chemically synthesized
ctaatgggaagacctacgta

SEQ ID NO: 47101 - DNA, 20 bp, Artificial Sequence
  chemically synthesized
caactctagataccctacgt

SEQ ID NO: 47102 - DNA, 20 bp, Artificial Sequence
  chemically synthesized
tcaactctagataccctacg

SEQ ID NO: 47103 - DNA, 20 bp, Artificial Sequence
  chemically synthesized
gaagacctacgtagggtatc

SEQ ID NO: 47104 - DNA, 20 bp, Artificial Sequence
  chemically synthesized
agacctacgtagggtatcta

SEQ ID NO: 47105 - DNA, 20 bp, Artificial Sequence
  chemically synthesized
taaacataaaaagtcaactc

SEQ ID NO: 47106 - DNA, 20 bp, Artificial Sequence
  chemically synthesized
ccttttaatgtaaacataaa

SEQ ID NO: 47107 - DNA, 20 bp, Artificial Sequence
  chemically synthesized
actttttatgtttacattaa

SEQ ID NO: 47108 - DNA, 20 bp, Artificial Sequence
  chemically synthesized
ctttttatgtttacattaaa

SEQ ID NO: 47109 - DNA, 20 bp, Artificial Sequence
  chemically synthesized
tttttatgtttacattaaaa

SEQ ID NO: 47110 - DNA, 20 bp, Artificial Sequence
  chemically synthesized
ttttatgtttacattaaaag

SEQ ID NO: 47111 - DNA, 20 bp, Artificial Sequence
  chemically synthesized
gaaaattttcaattaaatgt

SEQ ID NO: 47112 - DNA, 20 bp, Artificial Sequence
  chemically synthesized
aaattttcaattaaatgtca

SEQ ID NO: 47113 - DNA, 20 bp, Artificial Sequence
  chemically synthesized
ttttcaattaaatgtcagag

SEQ ID NO: 47114 - DNA, 20 bp, Artificial Sequence
  chemically synthesized
ttaaatgtcagagaagttat

SEQ ID NO: 47115 - DNA, 20 bp, Artificial Sequence
  chemically synthesized
tattttcagctatttagttc

SEQ ID NO: 47116 - DNA, 20 bp, Artificial Sequence
  chemically synthesized
cagaatatgcttgaactaaa

SEQ ID NO: 47117 - DNA, 20 bp, Artificial Sequence
  chemically synthesized
taaaaatattttcagctatt

SEQ ID NO: 47118 - DNA, 20 bp, Artificial Sequence
  chemically synthesized
aaattctttaaaaatatttt

SEQ ID NO: 47119 - DNA, 20 bp, Artificial Sequence
  chemically synthesized
aatagctgaaaatattttta

SEQ ID NO: 47120 - DNA, 20 bp, Artificial Sequence
  chemically synthesized
tttaaaaatattataaattc

SEQ ID NO: 47121 - DNA, 20 bp, Artificial Sequence
  chemically synthesized
cttgaaatttcatattgatc

SEQ ID NO: 47122 - DNA, 20 bp, Artificial Sequence
  chemically synthesized
ctagatcaatatgaaatttc

SEQ ID NO: 47123 - DNA, 20 bp, Artificial Sequence
  chemically synthesized
cttaagaactgcaattacaa

SEQ ID NO: 47124 - DNA, 20 bp, Artificial Sequence
  chemically synthesized
atttcaagcttttgtaattg

SEQ ID NO: 47125 - DNA, 20 bp, Artificial Sequence
  chemically synthesized
cttttgtaattgcagttctt

SEQ ID NO: 47126 - DNA, 20 bp, Artificial Sequence
  chemically synthesized
aggaaaataaatgaacactt

SEQ ID NO: 47127 - DNA, 20 bp, Artificial Sequence
  chemically synthesized
ttcatttattttccttaaaa

SEQ ID NO: 47128 - DNA, 20 bp, Artificial Sequence
  chemically synthesized
taagacaaaaagctttttta

SEQ ID NO: 47129 - DNA, 20 bp, Artificial Sequence
  chemically synthesized
ataagacaaaaagctttttt

SEQ ID NO: 47130 - DNA, 20 bp, Artificial Sequence
  chemically synthesized
atggctacacataagacaaa

SEQ ID NO: 47131 - DNA, 20 bp, Artificial Sequence
  chemically synthesized
aaagctttttgtcttatgtg

SEQ ID NO: 47132 - DNA, 20 bp, Artificial Sequence
  chemically synthesized
cctatttgatggctacacat

SEQ ID NO: 47133 - DNA, 20 bp, Artificial Sequence
  chemically synthesized
tcttatgtgtagccatcaaa

SEQ ID NO: 47134 - DNA, 20 bp, Artificial Sequence
  chemically synthesized
cttatgtgtagccatcaaat

SEQ ID NO: 47135 - DNA, 20 bp, Artificial Sequence
  chemically synthesized
tcaccattggacctatttga

SEQ ID NO: 47136 - DNA, 20 bp, Artificial Sequence
  chemically synthesized
tagccatcaaataggtccaa

SEQ ID NO: 47137 - DNA, 20 bp, Artificial Sequence
  chemically synthesized
catcaaataggtccaatggt

SEQ ID NO: 47138 - DNA, 20 bp, Artificial Sequence
  chemically synthesized
aatacactgaatctcaccat

SEQ ID NO: 47139 - DNA, 20 bp, Artificial Sequence
  chemically synthesized
ataggtccaatggtgagatt

SEQ ID NO: 47140 - DNA, 20 bp, Artificial Sequence
  chemically synthesized
tcagtgtattttttttctga

SEQ ID NO: 47141 - DNA, 20 bp, Artificial Sequence
  chemically synthesized
caaaggggaaaaacatcttt

SEQ ID NO: 47142 - DNA, 20 bp, Artificial Sequence
  chemically synthesized
ttataaactgtgaatcaaag

SEQ ID NO: 47143 - DNA, 20 bp, Artificial Sequence
  chemically synthesized
tttataaactgtgaatcaaa

SEQ ID NO: 47144 - DNA, 20 bp, Artificial Sequence
  chemically synthesized
atttataaactgtgaatcaa

SEQ ID NO: 47145 - DNA, 20 bp, Artificial Sequence
  chemically synthesized
tgtttttcccctttgattca

SEQ ID NO: 47146 - DNA, 20 bp, Artificial Sequence
  chemically synthesized
aatttataaactgtgaatca

SEQ ID NO: 47147 - DNA, 20 bp, Artificial Sequence
  chemically synthesized
cacagtttataaattcacct

SEQ ID NO: 47148 - DNA, 20 bp, Artificial Sequence
  chemically synthesized
tgactgcaaagcagttgctt

SEQ ID NO: 47149 - DNA, 20 bp, Artificial Sequence
  chemically synthesized
atgactgcaaagcagttgct

SEQ ID NO: 47150 - DNA, 20 bp, Artificial Sequence
  chemically synthesized
tcacctaagcaactgctttg

SEQ ID NO: 47151 - DNA, 20 bp, Artificial Sequence
  chemically synthesized
ttcaaacaatgactgcaaag

SEQ ID NO: 47152 - DNA, 20 bp, Artificial Sequence
  chemically synthesized
ggtttcaaacaatgactgca

SEQ ID NO: 47153 - DNA, 20 bp, Artificial Sequence
  chemically synthesized
tttttgagcataaaattgta

SEQ ID NO: 47154 - DNA, 20 bp, Artificial Sequence
  chemically synthesized
atttttgagcataaaattgt

SEQ ID NO: 47155 - DNA, 20 bp, Artificial Sequence
  chemically synthesized
attgtgtcaaggacattttt

SEQ ID NO: 47156 - DNA, 20 bp, Artificial Sequence
  chemically synthesized
tttttttttttattgtgtca

SEQ ID NO: 47157 - DNA, 20 bp, Artificial Sequence
  chemically synthesized
ttttttttttttattgtgtc

SEQ ID NO: 47158 - DNA, 20 bp, Artificial Sequence
  chemically synthesized
acaataaaaaaaaaaaaaaa

SEQ ID NO: 47159 - DNA, 20 bp, Artificial Sequence
  chemically synthesized
caataaaaaaaaaaaaaaaa

SEQ ID NO: 47160 - DNA, 20 bp, Artificial Sequence
  chemically synthesized
aaaaaaaaggaaaataacaa

SEQ ID NO: 47161 - DNA, 20 bp, Artificial Sequence
  chemically synthesized
ggcagggaaggaatgagggg

SEQ ID NO: 47162 - DNA, 20 bp, Artificial Sequence
  chemically synthesized
gggcagggaaggaatgaggg

SEQ ID NO: 47163 - DNA, 20 bp, Artificial Sequence
  chemically synthesized
tggggcagggaaggaatgag

SEQ ID NO: 47164 - DNA, 20 bp, Artificial Sequence
  chemically synthesized
atggggcagggaaggaatga

SEQ ID NO: 47165 - DNA, 20 bp, Artificial Sequence
  chemically synthesized
gatggggcagggaaggaatg

SEQ ID NO: 47166 - DNA, 20 bp, Artificial Sequence
  chemically synthesized
tgatggggcagggaaggaat

SEQ ID NO: 47167 - DNA, 20 bp, Artificial Sequence
  chemically synthesized
tgattatgatggggcaggga

SEQ ID NO: 47168 - DNA, 20 bp, Artificial Sequence
  chemically synthesized
gtgattatgatggggcaggg

SEQ ID NO: 47169 - DNA, 20 bp, Artificial Sequence
  chemically synthesized
tatgtgattatgatggggca

SEQ ID NO: 47170 - DNA, 20 bp, Artificial Sequence
  chemically synthesized
gtatgtgattatgatggggc

SEQ ID NO: 47171 - DNA, 20 bp, Artificial Sequence
  chemically synthesized
tgtatgtgattatgatgggg

SEQ ID NO: 47172 - DNA, 20 bp, Artificial Sequence
  chemically synthesized
gtgtgtatgtgattatgatg

SEQ ID NO: 47173 - DNA, 20 bp, Artificial Sequence
  chemically synthesized
tgtgtgtatgtgattatgat

SEQ ID NO: 47174 - DNA, 20 bp, Artificial Sequence
  chemically synthesized
gtgtgtgtatgtgattatga

SEQ ID NO: 47175 - DNA, 20 bp, Artificial Sequence
  chemically synthesized
ataatcacatacacacacac

SEQ ID NO: 47176 - DNA, 20 bp, Artificial Sequence
  chemically synthesized
atttctaaagcaagtagttc

SEQ ID NO: 47177 - DNA, 20 bp, Artificial Sequence
  chemically synthesized
cacactggaactacttgctt

SEQ ID NO: 47178 - DNA, 20 bp, Artificial Sequence
  chemically synthesized
tgtgttatttctaaagcaag

SEQ ID NO: 47179 - DNA, 20 bp, Artificial Sequence
  chemically synthesized
ttgtgtgttatttctaaagc

SEQ ID NO: 47180 - DNA, 20 bp, Artificial Sequence
  chemically synthesized
ccaattgtgtgttatttcta

SEQ ID NO: 47181 - DNA, 20 bp, Artificial Sequence
  chemically synthesized
ctttagaaataacacacaat

SEQ ID NO: 47182 - DNA, 20 bp, Artificial Sequence
  chemically synthesized
aataacacacaattggatga

SEQ ID NO: 47183 - DNA, 20 bp, Artificial Sequence
  chemically synthesized
acaattggatgatagttcta

SEQ ID NO: 47184 - DNA, 20 bp, Artificial Sequence
  chemically synthesized
ggatgatagttctacggaat

SEQ ID NO: 47185 - DNA, 20 bp, Artificial Sequence
  chemically synthesized
gatgatagttctacggaatt

SEQ ID NO: 47186 - DNA, 20 bp, Artificial Sequence
  chemically synthesized
gagcactgaacccaattccg

SEQ ID NO: 47187 - DNA, 20 bp, Artificial Sequence
  chemically synthesized
tagttctacggaattgggtt

SEQ ID NO: 47188 - DNA, 20 bp, Artificial Sequence
  chemically synthesized
tgggttcagtgctccttctc

SEQ ID NO: 47189 - DNA, 20 bp, Artificial Sequence
  chemically synthesized
cttaagaatctcttgagaag

SEQ ID NO: 47190 - DNA, 20 bp, Artificial Sequence
  chemically synthesized
ggttcagtgctccttctcaa

SEQ ID NO: 47191 - DNA, 20 bp, Artificial Sequence
  chemically synthesized
cccttaagaatctcttgaga

SEQ ID NO: 47192 - DNA, 20 bp, Artificial Sequence
  chemically synthesized
acccttaagaatctcttgag

SEQ ID NO: 47193 - DNA, 20 bp, Artificial Sequence
  chemically synthesized
acaacccttaagaatctctt

SEQ ID NO: 47194 - DNA, 20 bp, Artificial Sequence
  chemically synthesized
ctccttctcaagagattctt

SEQ ID NO: 47195 - DNA, 20 bp, Artificial Sequence
  chemically synthesized
tccttctcaagagattctta

SEQ ID NO: 47196 - DNA, 20 bp, Artificial Sequence
  chemically synthesized
ccttctcaagagattcttaa

SEQ ID NO: 47197 - DNA, 20 bp, Artificial Sequence
  chemically synthesized
tgaaattgtcgacaaccctt

SEQ ID NO: 47198 - DNA, 20 bp, Artificial Sequence
  chemically synthesized
gggttgtcgacaatttcatt

SEQ ID NO: 47199 - DNA, 20 bp, Artificial Sequence
  chemically synthesized
ggttgtcgacaatttcattt

SEQ ID NO: 47200 - DNA, 20 bp, Artificial Sequence
  chemically synthesized
gttgtcgacaatttcatttg

SEQ ID NO: 47201 - DNA, 20 bp, Artificial Sequence
  chemically synthesized
acaatttcatttggggctgc

SEQ ID NO: 47202 - DNA, 20 bp, Artificial Sequence
  chemically synthesized
ggaagaccagaatcatctgg

SEQ ID NO: 47203 - DNA, 20 bp, Artificial Sequence
  chemically synthesized
gatggaagaccagaatcatc

SEQ ID NO: 47204 - DNA, 20 bp, Artificial Sequence
  chemically synthesized
ttggggctgccagatgattc

SEQ ID NO: 47205 - DNA, 20 bp, Artificial Sequence
  chemically synthesized
cttttgaatagatggaagac

SEQ ID NO: 47206 - DNA, 20 bp, Artificial Sequence
  chemically synthesized
atcaacttttgaatagatgg

SEQ ID NO: 47207 - DNA, 20 bp, Artificial Sequence
  chemically synthesized
ttgatcaacttttgaataga

SEQ ID NO: 47208 - DNA, 20 bp, Artificial Sequence
  chemically synthesized
ctggtcttccatctattcaa

SEQ ID NO: 47209 - DNA, 20 bp, Artificial Sequence
  chemically synthesized
atatttgatcaacttttgaa

SEQ ID NO: 47210 - DNA, 20 bp, Artificial Sequence
  chemically synthesized
tcaaaagttgatcaaatatg

SEQ ID NO: 47211 - DNA, 20 bp, Artificial Sequence
  chemically synthesized
aaagttgatcaaatatgtgg

SEQ ID NO: 47212 - DNA, 20 bp, Artificial Sequence
  chemically synthesized
aaatatgtggcagtgctcac

SEQ ID NO: 47213 - DNA, 20 bp, Artificial Sequence
  chemically synthesized
aaattctgtggcacacttgt

SEQ ID NO: 47214 - DNA, 20 bp, Artificial Sequence
  chemically synthesized
cagtgctcacaagtgtgcca

SEQ ID NO: 47215 - DNA, 20 bp, Artificial Sequence
  chemically synthesized
caagaaatgaaaaaattctg

SEQ ID NO: 47216 - DNA, 20 bp, Artificial Sequence
  chemically synthesized
cagaattttttcatttcttg

SEQ ID NO: 47217 - DNA, 20 bp, Artificial Sequence
  chemically synthesized
aattttttcatttcttgtag

SEQ ID NO: 47218 - DNA, 20 bp, Artificial Sequence
  chemically synthesized
gttggcatcagtactgctac

SEQ ID NO: 47219 - DNA, 20 bp, Artificial Sequence
  chemically synthesized
gaaacagctgttgttggcat

SEQ ID NO: 47220 - DNA, 20 bp, Artificial Sequence
  chemically synthesized
agcagtactgatgccaacaa

SEQ ID NO: 47221 - DNA, 20 bp, Artificial Sequence
  chemically synthesized
agataagaaacagctgttgt

SEQ ID NO: 47222 - DNA, 20 bp, Artificial Sequence
  chemically synthesized
tggtacactgagataagaaa

SEQ ID NO: 47223 - DNA, 20 bp, Artificial Sequence
  chemically synthesized
acaacagctgtttcttatct

SEQ ID NO: 47224 - DNA, 20 bp, Artificial Sequence
  chemically synthesized
ttccactggtacactgagat

SEQ ID NO: 47225 - DNA, 20 bp, Artificial Sequence
  chemically synthesized
tgtttcttatctcagtgtac

SEQ ID NO: 47226 - DNA, 20 bp, Artificial Sequence
  chemically synthesized
caagcttccactggtacact

SEQ ID NO: 47227 - DNA, 20 bp, Artificial Sequence
  chemically synthesized
ttcttatctcagtgtaccag

SEQ ID NO: 47228 - DNA, 20 bp, Artificial Sequence
  chemically synthesized
ttatctcagtgtaccagtgg

SEQ ID NO: 47229 - DNA, 20 bp, Artificial Sequence
  chemically synthesized
gaagaatgacaagcttccac

SEQ ID NO: 47230 - DNA, 20 bp, Artificial Sequence
  chemically synthesized
ctagctttatgaagaatgac

SEQ ID NO: 47231 - DNA, 20 bp, Artificial Sequence
  chemically synthesized
gaagcttgtcattcttcata

SEQ ID NO: 47232 - DNA, 20 bp, Artificial Sequence
  chemically synthesized
ttacgtaggctagctttatg

SEQ ID NO: 47233 - DNA, 20 bp, Artificial Sequence
  chemically synthesized
cttgtcattcttcataaagc

SEQ ID NO: 47234 - DNA, 20 bp, Artificial Sequence
  chemically synthesized
tgtgtgtctattacgtaggc

SEQ ID NO: 47235 - DNA, 20 bp, Artificial Sequence
  chemically synthesized
cataaagctagcctacgtaa

SEQ ID NO: 47236 - DNA, 20 bp, Artificial Sequence
  chemically synthesized
gatgtgtgtgtctattacgt

SEQ ID NO: 47237 - DNA, 20 bp, Artificial Sequence
  chemically synthesized
agatgtgtgtgtctattacg

SEQ ID NO: 47238 - DNA, 20 bp, Artificial Sequence
  chemically synthesized
aatggacacatcaggcataa

SEQ ID NO: 47239 - DNA, 20 bp, Artificial Sequence
  chemically synthesized
ctactaaaaatggacacatc

SEQ ID NO: 47240 - DNA, 20 bp, Artificial Sequence
  chemically synthesized
gctactaaaaatggacacat

SEQ ID NO: 47241 - DNA, 20 bp, Artificial Sequence
  chemically synthesized
atgcctgatgtgtccatttt

SEQ ID NO: 47242 - DNA, 20 bp, Artificial Sequence
  chemically synthesized
cctgatgtgtccatttttag

SEQ ID NO: 47243 - DNA, 20 bp, Artificial Sequence
  chemically synthesized
ttttgatgggctactaaaaa

SEQ ID NO: 47244 - DNA, 20 bp, Artificial Sequence
  chemically synthesized
catttttagtagcccatcaa

SEQ ID NO: 47245 - DNA, 20 bp, Artificial Sequence
  chemically synthesized
ccgataaatttgcttttgat

SEQ ID NO: 47246 - DNA, 20 bp, Artificial Sequence
  chemically synthesized
gccgataaatttgcttttga

SEQ ID NO: 47247 - DNA, 20 bp, Artificial Sequence
  chemically synthesized
cccatcaaaagcaaatttat

SEQ ID NO: 47248 - DNA, 20 bp, Artificial Sequence
  chemically synthesized
aaagcaaatttatcggcaaa

SEQ ID NO: 47249 - DNA, 20 bp, Artificial Sequence
  chemically synthesized
aaggacaacccggtgtcata

SEQ ID NO: 47250 - DNA, 20 bp, Artificial Sequence
  chemically synthesized
aaatagtttctatatgacac

SEQ ID NO: 47251 - DNA, 20 bp, Artificial Sequence
  chemically synthesized
aatagtttctatatgacacc

SEQ ID NO: 47252 - DNA, 20 bp, Artificial Sequence
  chemically synthesized
gaaaataccaaaggacaacc

SEQ ID NO: 47253 - DNA, 20 bp, Artificial Sequence
  chemically synthesized
tatgacaccgggttgtcctt

SEQ ID NO: 47254 - DNA, 20 bp, Artificial Sequence
  chemically synthesized
tctgtataagaaaataccaa

SEQ ID NO: 47255 - DNA, 20 bp, Artificial Sequence
  chemically synthesized
atctgtataagaaaatacca

SEQ ID NO: 47256 - DNA, 20 bp, Artificial Sequence
  chemically synthesized
tcctttggtattttcttata

SEQ ID NO: 47257 - DNA, 20 bp, Artificial Sequence
  chemically synthesized
ggttataagcacatctgtat

SEQ ID NO: 47258 - DNA, 20 bp, Artificial Sequence
  chemically synthesized
gaattacacgtagtggttat

SEQ ID NO: 47259 - DNA, 20 bp, Artificial Sequence
  chemically synthesized
tgccctggaattacacgtag

SEQ ID NO: 47260 - DNA, 20 bp, Artificial Sequence
  chemically synthesized
agctgccctggaattacacg

SEQ ID NO: 47261 - DNA, 20 bp, Artificial Sequence
  chemically synthesized
ataaccactacgtgtaattc

SEQ ID NO: 47262 - DNA, 20 bp, Artificial Sequence
  chemically synthesized
taaccactacgtgtaattcc

SEQ ID NO: 47263 - DNA, 20 bp, Artificial Sequence
  chemically synthesized
aaccactacgtgtaattcca

SEQ ID NO: 47264 - DNA, 20 bp, Artificial Sequence
  chemically synthesized
cactacgtgtaattccaggg

SEQ ID NO: 47265 - DNA, 20 bp, Artificial Sequence
  chemically synthesized
tctgaatcacaaagctgccc

SEQ ID NO: 47266 - DNA, 20 bp, Artificial Sequence
  chemically synthesized
tccagggcagctttgtgatt

SEQ ID NO: 47267 - DNA, 20 bp, Artificial Sequence
  chemically synthesized
attcaagaatctgaatcaca

SEQ ID NO: 47268 - DNA, 20 bp, Artificial Sequence
  chemically synthesized
aatggttgatttgtacattc

SEQ ID NO: 47269 - DNA, 20 bp, Artificial Sequence
  chemically synthesized
atgctggtgccgtatgataa

SEQ ID NO: 47270 - DNA, 20 bp, Artificial Sequence
  chemically synthesized
acaaatcaaccattatcata

SEQ ID NO: 47271 - DNA, 20 bp, Artificial Sequence
  chemically synthesized
caaccattatcatacggcac

SEQ ID NO: 47272 - DNA, 20 bp, Artificial Sequence
  chemically synthesized
atcatacggcaccagcatca

SEQ ID NO: 47273 - DNA, 20 bp, Artificial Sequence
  chemically synthesized
tcatacggcaccagcatcat

SEQ ID NO: 47274 - DNA, 20 bp, Artificial Sequence
  chemically synthesized
tggacaataccccatgatgc

SEQ ID NO: 47275 - DNA, 20 bp, Artificial Sequence
  chemically synthesized
catacggcaccagcatcatg

SEQ ID NO: 47276 - DNA, 20 bp, Artificial Sequence
  chemically synthesized
ggggtattgtccactgaatt

SEQ ID NO: 47277 - DNA, 20 bp, Artificial Sequence
  chemically synthesized
agtttgctatctaaattcag

SEQ ID NO: 47278 - DNA, 20 bp, Artificial Sequence
  chemically synthesized
tgtagtttgctatctaaatt

SEQ ID NO: 47279 - DNA, 20 bp, Artificial Sequence
  chemically synthesized
tattgtccactgaatttaga

SEQ ID NO: 47280 - DNA, 20 bp, Artificial Sequence
  chemically synthesized
gcaataaataaatgcatgtg

SEQ ID NO: 47281 - DNA, 20 bp, Artificial Sequence
  chemically synthesized
acaaaaggaaattcagaggt

SEQ ID NO: 47282 - DNA, 20 bp, Artificial Sequence
  chemically synthesized
taacacaaaaggaaattcag

SEQ ID NO: 47283 - DNA, 20 bp, Artificial Sequence
  chemically synthesized
gtaacacaaaaggaaattca

SEQ ID NO: 47284 - DNA, 20 bp, Artificial Sequence
  chemically synthesized
ctgtaacacaaaaggaaatt

SEQ ID NO: 47285 - DNA, 20 bp, Artificial Sequence
  chemically synthesized
tactgtgtctgtaacacaaa

SEQ ID NO: 47286 - DNA, 20 bp, Artificial Sequence
  chemically synthesized
atactgtgtctgtaacacaa

SEQ ID NO: 47287 - DNA, 20 bp, Artificial Sequence
  chemically synthesized
ctgaatttccttttgtgtta

SEQ ID NO: 47288 - DNA, 20 bp, Artificial Sequence
  chemically synthesized
ttccttttgtgttacagaca

SEQ ID NO: 47289 - DNA, 20 bp, Artificial Sequence
  chemically synthesized
tacagacacagtatgttatt

SEQ ID NO: 47290 - DNA, 20 bp, Artificial Sequence
  chemically synthesized
cagacacagtatgttattaa

SEQ ID NO: 47291 - DNA, 20 bp, Artificial Sequence
  chemically synthesized
cacagtatgttattaagagc

SEQ ID NO: 47292 - DNA, 20 bp, Artificial Sequence
  chemically synthesized
gtatgttattaagagcaaga

SEQ ID NO: 47293 - DNA, 20 bp, Artificial Sequence
  chemically synthesized
tatgttattaagagcaagaa

SEQ ID NO: 47294 - DNA, 20 bp, Artificial Sequence
  chemically synthesized
atgttattaagagcaagaaa

SEQ ID NO: 47295 - DNA, 20 bp, Artificial Sequence
  chemically synthesized
ttattaagagcaagaaaggg

SEQ ID NO: 47296 - DNA, 20 bp, Artificial Sequence
  chemically synthesized
gaaggaaaagcatttgaaga

SEQ ID NO: 47297 - DNA, 20 bp, Artificial Sequence
  chemically synthesized
caaggaaggaaaagcatttg

SEQ ID NO: 47298 - DNA, 20 bp, Artificial Sequence
  chemically synthesized
ctgtcacctcaaggaaggaa

SEQ ID NO: 47299 - DNA, 20 bp, Artificial Sequence
  chemically synthesized
tcaaatgcttttccttcctt

SEQ ID NO: 47300 - DNA, 20 bp, Artificial Sequence
  chemically synthesized
caaatgcttttccttccttg

SEQ ID NO: 47301 - DNA, 20 bp, Artificial Sequence
  chemically synthesized
gaatcctgtcacctcaagga

SEQ ID NO: 47302 - DNA, 20 bp, Artificial Sequence
  chemically synthesized
tgaatcctgtcacctcaagg

SEQ ID NO: 47303 - DNA, 20 bp, Artificial Sequence
  chemically synthesized
tattgaatcctgtcacctca

SEQ ID NO: 47304 - DNA, 20 bp, Artificial Sequence
  chemically synthesized
cttttccttccttgaggtga

SEQ ID NO: 47305 - DNA, 20 bp, Artificial Sequence
  chemically synthesized
atattgaatcctgtcacctc

SEQ ID NO: 47306 - DNA, 20 bp, Artificial Sequence
  chemically synthesized
ttttccttccttgaggtgac

SEQ ID NO: 47307 - DNA, 20 bp, Artificial Sequence
  chemically synthesized
caggattcaatattgtgccc

SEQ ID NO: 47308 - DNA, 20 bp, Artificial Sequence
  chemically synthesized
aggattcaatattgtgccca

SEQ ID NO: 47309 - DNA, 20 bp, Artificial Sequence
  chemically synthesized
attcaatattgtgcccaagg

SEQ ID NO: 47310 - DNA, 20 bp, Artificial Sequence
  chemically synthesized
gtgattttcaaaactacctt

SEQ ID NO: 47311 - DNA, 20 bp, Artificial Sequence
  chemically synthesized
tgtgattttcaaaactacct

SEQ ID NO: 47312 - DNA, 20 bp, Artificial Sequence
  chemically synthesized
aaggtagttttgaaaatcac

SEQ ID NO: 47313 - DNA, 20 bp, Artificial Sequence
  chemically synthesized
agttttgaaaatcacaagca

SEQ ID NO: 47314 - DNA, 20 bp, Artificial Sequence
  chemically synthesized
gttttgaaaatcacaagcac

SEQ ID NO: 47315 - DNA, 20 bp, Artificial Sequence
  chemically synthesized
caagcacaggccacattatt

SEQ ID NO: 47316 - DNA, 20 bp, Artificial Sequence
  chemically synthesized
acaacttcccctaaataatg

SEQ ID NO: 47317 - DNA, 20 bp, Artificial Sequence
  chemically synthesized
aagcacaggccacattattt

SEQ ID NO: 47318 - DNA, 20 bp, Artificial Sequence
  chemically synthesized
agcacaggccacattattta

SEQ ID NO: 47319 - DNA, 20 bp, Artificial Sequence
  chemically synthesized
gcacaggccacattatttag

SEQ ID NO: 47320 - DNA, 20 bp, Artificial Sequence
  chemically synthesized
caggccacattatttagggg

SEQ ID NO: 47321 - DNA, 20 bp, Artificial Sequence
  chemically synthesized
tttaggggaagttgttattt

SEQ ID NO: 47322 - DNA, 20 bp, Artificial Sequence
  chemically synthesized
gttcatcatgcatttaaaaa

SEQ ID NO: 47323 - DNA, 20 bp, Artificial Sequence
  chemically synthesized
gtttttaaatgcatgatgaa

SEQ ID NO: 47324 - DNA, 20 bp, Artificial Sequence
  chemically synthesized
catgatgaacagaatgttcc

SEQ ID NO: 47325 - DNA, 20 bp, Artificial Sequence
  chemically synthesized
taacaccagggtgcatcact

SEQ ID NO: 47326 - DNA, 20 bp, Artificial Sequence
  chemically synthesized
atgttccaagtgatgcaccc

SEQ ID NO: 47327 - DNA, 20 bp, Artificial Sequence
  chemically synthesized
aagtgatgcaccctggtgtt

SEQ ID NO: 47328 - DNA, 20 bp, Artificial Sequence
  chemically synthesized
taaaatatgacttaacacca

SEQ ID NO: 47329 - DNA, 20 bp, Artificial Sequence
  chemically synthesized
ttaaaatatgacttaacacc

SEQ ID NO: 47330 - DNA, 20 bp, Artificial Sequence
  chemically synthesized
attaaaatatgacttaacac

SEQ ID NO: 47331 - DNA, 20 bp, Artificial Sequence
  chemically synthesized
aagtcatattttaatcaaca

SEQ ID NO: 47332 - DNA, 20 bp, Artificial Sequence
  chemically synthesized
agtcatattttaatcaacat

SEQ ID NO: 47333 - DNA, 20 bp, Artificial Sequence
  chemically synthesized
gtcatattttaatcaacata

SEQ ID NO: 47334 - DNA, 20 bp, Artificial Sequence
  chemically synthesized
tcatattttaatcaacatag

SEQ ID NO: 47335 - DNA, 20 bp, Artificial Sequence
  chemically synthesized
aatcaacataggggcctaac

SEQ ID NO: 47336 - DNA, 20 bp, Artificial Sequence
  chemically synthesized
ttctttttaattttctggtt

SEQ ID NO: 47337 - DNA, 20 bp, Artificial Sequence
  chemically synthesized
attctttttaattttctggt

SEQ ID NO: 47338 - DNA, 20 bp, Artificial Sequence
  chemically synthesized
tagcattctttttaattttc

SEQ ID NO: 47339 - DNA, 20 bp, Artificial Sequence
  chemically synthesized
ggcctaaccagaaaattaaa

SEQ ID NO: 47340 - DNA, 20 bp, Artificial Sequence
  chemically synthesized
ggcatgtcttaaaataacat

SEQ ID NO: 47341 - DNA, 20 bp, Artificial Sequence
  chemically synthesized
aagaatgctaatgttatttt

SEQ ID NO: 47342 - DNA, 20 bp, Artificial Sequence
  chemically synthesized
gttattttaagacatgccaa

SEQ ID NO: 47343 - DNA, 20 bp, Artificial Sequence
  chemically synthesized
tattttaagacatgccaaaa

SEQ ID NO: 47344 - DNA, 20 bp, Artificial Sequence
  chemically synthesized
aattccagaaagtgctcttt

SEQ ID NO: 47345 - DNA, 20 bp, Artificial Sequence
  chemically synthesized
catgccaaaagagcactttc

SEQ ID NO: 47346 - DNA, 20 bp, Artificial Sequence
  chemically synthesized
atttgtgttggaattccaga

SEQ ID NO: 47347 - DNA, 20 bp, Artificial Sequence
  chemically synthesized
aggtatttgtgttggaattc

SEQ ID NO: 47348 - DNA, 20 bp, Artificial Sequence
  chemically synthesized
atgaatgaaggtatttgtgt

SEQ ID NO: 47349 - DNA, 20 bp, Artificial Sequence
  chemically synthesized
aaaagtagagagatgaatga

SEQ ID NO: 47350 - DNA, 20 bp, Artificial Sequence
  chemically synthesized
gaaaagtagagagatgaatg

SEQ ID NO: 47351 - DNA, 20 bp, Artificial Sequence
  chemically synthesized
ccaagtatgagaaaagtaga

SEQ ID NO: 47352 - DNA, 20 bp, Artificial Sequence
  chemically synthesized
caccaagtatgagaaaagta

SEQ ID NO: 47353 - DNA, 20 bp, Artificial Sequence
  chemically synthesized
tccaccaagtatgagaaaag

SEQ ID NO: 47354 - DNA, 20 bp, Artificial Sequence
  chemically synthesized
aaatccaccaagtatgagaa

SEQ ID NO: 47355 - DNA, 20 bp, Artificial Sequence
  chemically synthesized
ctctctacttttctcatact

SEQ ID NO: 47356 - DNA, 20 bp, Artificial Sequence
  chemically synthesized
actccaaatccaccaagtat

SEQ ID NO: 47357 - DNA, 20 bp, Artificial Sequence
  chemically synthesized
tctacttttctcatacttgg

SEQ ID NO: 47358 - DNA, 20 bp, Artificial Sequence
  chemically synthesized
tatcaaactccaaatccacc

SEQ ID NO: 47359 - DNA, 20 bp, Artificial Sequence
  chemically synthesized
tttctcatacttggtggatt

SEQ ID NO: 47360 - DNA, 20 bp, Artificial Sequence
  chemically synthesized
tctcatacttggtggatttg

SEQ ID NO: 47361 - DNA, 20 bp, Artificial Sequence
  chemically synthesized
ggatttggagtttgataaca

SEQ ID NO: 47362 - DNA, 20 bp, Artificial Sequence
  chemically synthesized
gatttggagtttgataacat

SEQ ID NO: 47363 - DNA, 20 bp, Artificial Sequence
  chemically synthesized
ttggagtttgataacatagg

SEQ ID NO: 47364 - DNA, 20 bp, Artificial Sequence
  chemically synthesized
tggagtttgataacataggt

SEQ ID NO: 47365 - DNA, 20 bp, Artificial Sequence
  chemically synthesized
ataacataggtgggtcaaaa

SEQ ID NO: 47366 - DNA, 20 bp, Artificial Sequence
  chemically synthesized
acataggtgggtcaaaaaag

SEQ ID NO: 47367 - DNA, 20 bp, Artificial Sequence
  chemically synthesized
cataggtgggtcaaaaaagt

SEQ ID NO: 47368 - DNA, 20 bp, Artificial Sequence
  chemically synthesized
ataggtgggtcaaaaaagtg

SEQ ID NO: 47369 - DNA, 20 bp, Artificial Sequence
  chemically synthesized
gtgggtcaaaaaagtgggga

SEQ ID NO: 47370 - DNA, 20 bp, Artificial Sequence
  chemically synthesized
tcaaaaaagtggggacagtt

SEQ ID NO: 47371 - DNA, 20 bp, Artificial Sequence
  chemically synthesized
gtttagataaataaccgata

SEQ ID NO: 47372 - DNA, 20 bp, Artificial Sequence
  chemically synthesized
acctccagtgattgctgtat

SEQ ID NO: 47373 - DNA, 20 bp, Artificial Sequence
  chemically synthesized
ataaccgatacagcaatcac

SEQ ID NO: 47374 - DNA, 20 bp, Artificial Sequence
  chemically synthesized
aaccgatacagcaatcactg

SEQ ID NO: 47375 - DNA, 20 bp, Artificial Sequence
  chemically synthesized
accgatacagcaatcactgg

SEQ ID NO: 47376 - DNA, 20 bp, Artificial Sequence
  chemically synthesized
tgagttttctattttacctc

SEQ ID NO: 47377 - DNA, 20 bp, Artificial Sequence
  chemically synthesized
agcaatcactggaggtaaaa

SEQ ID NO: 47378 - DNA, 20 bp, Artificial Sequence
  chemically synthesized
taaaatagaaaactcacctc

SEQ ID NO: 47379 - DNA, 20 bp, Artificial Sequence
  chemically synthesized
aaaatagaaaactcacctct

SEQ ID NO: 47380 - DNA, 20 bp, Artificial Sequence
  chemically synthesized
aaatagaaaactcacctctg

SEQ ID NO: 47381 - DNA, 20 bp, Artificial Sequence
  chemically synthesized
ttttgttcaaccccagaggt

SEQ ID NO: 47382 - DNA, 20 bp, Artificial Sequence
  chemically synthesized
tgccttttgttcaaccccag

SEQ ID NO: 47383 - DNA, 20 bp, Artificial Sequence
  chemically synthesized
atgccttttgttcaacccca

SEQ ID NO: 47384 - DNA, 20 bp, Artificial Sequence
  chemically synthesized
taatgccttttgttcaaccc

SEQ ID NO: 47385 - DNA, 20 bp, Artificial Sequence
  chemically synthesized
tcacctctggggttgaacaa

SEQ ID NO: 47386 - DNA, 20 bp, Artificial Sequence
  chemically synthesized
cacctctggggttgaacaaa

SEQ ID NO: 47387 - DNA, 20 bp, Artificial Sequence
  chemically synthesized
tggggttgaacaaaaggcat

SEQ ID NO: 47388 - DNA, 20 bp, Artificial Sequence
  chemically synthesized
ggggttgaacaaaaggcatt

SEQ ID NO: 47389 - DNA, 20 bp, Artificial Sequence
  chemically synthesized
gggttgaacaaaaggcatta

SEQ ID NO: 47390 - DNA, 20 bp, Artificial Sequence
  chemically synthesized
gttgaacaaaaggcattagg

SEQ ID NO: 47391 - DNA, 20 bp, Artificial Sequence
  chemically synthesized
ttgaacaaaaggcattaggg

SEQ ID NO: 47392 - DNA, 20 bp, Artificial Sequence
  chemically synthesized
aggcattagggaggatctac

SEQ ID NO: 47393 - DNA, 20 bp, Artificial Sequence
  chemically synthesized
aaaagacaaaacaagtctag

SEQ ID NO: 47394 - DNA, 20 bp, Artificial Sequence
  chemically synthesized
tggaaaagacaaaacaagtc

SEQ ID NO: 47395 - DNA, 20 bp, Artificial Sequence
  chemically synthesized
cattctggaaaagacaaaac

SEQ ID NO: 47396 - DNA, 20 bp, Artificial Sequence
  chemically synthesized
tagacttgttttgtcttttc

SEQ ID NO: 47397 - DNA, 20 bp, Artificial Sequence
  chemically synthesized
atttatatgacattctggaa

SEQ ID NO: 47398 - DNA, 20 bp, Artificial Sequence
  chemically synthesized
actgtatttatatgacattc

SEQ ID NO: 47399 - DNA, 20 bp, Artificial Sequence
  chemically synthesized
tccagaatgtcatataaata

SEQ ID NO: 47400 - DNA, 20 bp, Artificial Sequence
  chemically synthesized
tgaaataaaccagtatcaaa

SEQ ID NO: 47401 - DNA, 20 bp, Artificial Sequence
  chemically synthesized
agtatgtaaccttttgatac

SEQ ID NO: 47402 - DNA, 20 bp, Artificial Sequence
  chemically synthesized
gtgaaataaaccagtatcaa

SEQ ID NO: 47403 - DNA, 20 bp, Artificial Sequence
  chemically synthesized
ttatgctgagtgaaataaac

SEQ ID NO: 47404 - DNA, 20 bp, Artificial Sequence
  chemically synthesized
tgatactggtttatttcact

SEQ ID NO: 47405 - DNA, 20 bp, Artificial Sequence
  chemically synthesized
tatggattatgcattatgct

SEQ ID NO: 47406 - DNA, 20 bp, Artificial Sequence
  chemically synthesized
aaatcgttgatacagcaata

SEQ ID NO: 47407 - DNA, 20 bp, Artificial Sequence
  chemically synthesized
aaagaaacaaatcgttgata

SEQ ID NO: 47408 - DNA, 20 bp, Artificial Sequence
  chemically synthesized
gcatactacttagcaatgaa

SEQ ID NO: 47409 - DNA, 20 bp, Artificial Sequence
  chemically synthesized
atttgtttcttttcattgct

SEQ ID NO: 47410 - DNA, 20 bp, Artificial Sequence
  chemically synthesized
tgtttcttttcattgctaag

SEQ ID NO: 47411 - DNA, 20 bp, Artificial Sequence
  chemically synthesized
ccatataatggcatactact

SEQ ID NO: 47412 - DNA, 20 bp, Artificial Sequence
  chemically synthesized
ctaagtagtatgccattata

SEQ ID NO: 47413 - DNA, 20 bp, Artificial Sequence
  chemically synthesized
taagtagtatgccattatat

SEQ ID NO: 47414 - DNA, 20 bp, Artificial Sequence
  chemically synthesized
gctgtagtacacccatataa

SEQ ID NO: 47415 - DNA, 20 bp, Artificial Sequence
  chemically synthesized
gccattatatgggtgtacta

SEQ ID NO: 47416 - DNA, 20 bp, Artificial Sequence
  chemically synthesized
tatatgggtgtactacagct

SEQ ID NO: 47417 - DNA, 20 bp, Artificial Sequence
  chemically synthesized
gtgaatggataactaagctg

SEQ ID NO: 47418 - DNA, 20 bp, Artificial Sequence
  chemically synthesized
gaacaggtgaatggataact

SEQ ID NO: 47419 - DNA, 20 bp, Artificial Sequence
  chemically synthesized
aatgtctttgaacaggtgaa

SEQ ID NO: 47420 - DNA, 20 bp, Artificial Sequence
  chemically synthesized
gttatccattcacctgttca

SEQ ID NO: 47421 - DNA, 20 bp, Artificial Sequence
  chemically synthesized
gcaacctaatgtctttgaac

SEQ ID NO: 47422 - DNA, 20 bp, Artificial Sequence
  chemically synthesized
agcaacctaatgtctttgaa

SEQ ID NO: 47423 - DNA, 20 bp, Artificial Sequence
  chemically synthesized
attcacctgttcaaagacat

SEQ ID NO: 47424 - DNA, 20 bp, Artificial Sequence
  chemically synthesized
ttcacctgttcaaagacatt

SEQ ID NO: 47425 - DNA, 20 bp, Artificial Sequence
  chemically synthesized
caaagacattaggttgcttt

SEQ ID NO: 47426 - DNA, 20 bp, Artificial Sequence
  chemically synthesized
tcatgattgccaaatgctaa

SEQ ID NO: 47427 - DNA, 20 bp, Artificial Sequence
  chemically synthesized
attaggttgcttttagcatt

SEQ ID NO: 47428 - DNA, 20 bp, Artificial Sequence
  chemically synthesized
gcatttggcaatcatgaata

SEQ ID NO: 47429 - DNA, 20 bp, Artificial Sequence
  chemically synthesized
ttggcaatcatgaataaagc

SEQ ID NO: 47430 - DNA, 20 bp, Artificial Sequence
  chemically synthesized
ctgtacacaaatgttgatac

SEQ ID NO: 47431 - DNA, 20 bp, Artificial Sequence
  chemically synthesized
ctggtatcaacatttgtgta

SEQ ID NO: 47432 - DNA, 20 bp, Artificial Sequence
  chemically synthesized
tggtatcaacatttgtgtac

SEQ ID NO: 47433 - DNA, 20 bp, Artificial Sequence
  chemically synthesized
ttgtgtacaggtgtttgcat

SEQ ID NO: 47434 - DNA, 20 bp, Artificial Sequence
  chemically synthesized
acaggtgtttgcataagcat

SEQ ID NO: 47435 - DNA, 20 bp, Artificial Sequence
  chemically synthesized
gcataagttttcatttctct

SEQ ID NO: 47436 - DNA, 20 bp, Artificial Sequence
  chemically synthesized
actcttaagcattcatctta

SEQ ID NO: 47437 - DNA, 20 bp, Artificial Sequence
  chemically synthesized
ccactcttaagcattcatct

SEQ ID NO: 47438 - DNA, 20 bp, Artificial Sequence
  chemically synthesized
tttctctaagatgaatgctt

SEQ ID NO: 47439 - DNA, 20 bp, Artificial Sequence
  chemically synthesized
tctctaagatgaatgcttaa

SEQ ID NO: 47440 - DNA, 20 bp, Artificial Sequence
  chemically synthesized
ctaagatgaatgcttaagag

SEQ ID NO: 47441 - DNA, 20 bp, Artificial Sequence
  chemically synthesized
taagatgaatgcttaagagt

SEQ ID NO: 47442 - DNA, 20 bp, Artificial Sequence
  chemically synthesized
aaccctacaagcccactctt

SEQ ID NO: 47443 - DNA, 20 bp, Artificial Sequence
  chemically synthesized
aatgcttaagagtgggcttg

SEQ ID NO: 47444 - DNA, 20 bp, Artificial Sequence
  chemically synthesized
atgcttaagagtgggcttgt

SEQ ID NO: 47445 - DNA, 20 bp, Artificial Sequence
  chemically synthesized
tgcttaagagtgggcttgta

SEQ ID NO: 47446 - DNA, 20 bp, Artificial Sequence
  chemically synthesized
aaaatctgttgtaaccctac

SEQ ID NO: 47447 - DNA, 20 bp, Artificial Sequence
  chemically synthesized
gtgggcttgtagggttacaa

SEQ ID NO: 47448 - DNA, 20 bp, Artificial Sequence
  chemically synthesized
atccataagtgggaattttt

SEQ ID NO: 47449 - DNA, 20 bp, Artificial Sequence
  chemically synthesized
tgctaaaaaattcccactta

SEQ ID NO: 47450 - DNA, 20 bp, Artificial Sequence
  chemically synthesized
atcatggtacatccataagt

SEQ ID NO: 47451 - DNA, 20 bp, Artificial Sequence
  chemically synthesized
aatcatggtacatccataag

SEQ ID NO: 47452 - DNA, 20 bp, Artificial Sequence
  chemically synthesized
ataaatcatggtacatccat

SEQ ID NO: 47453 - DNA, 20 bp, Artificial Sequence
  chemically synthesized
ggaatttattcaataaatca

SEQ ID NO: 47454 - DNA, 20 bp, Artificial Sequence
  chemically synthesized
tattgaataaattccctctt

SEQ ID NO: 47455 - DNA, 20 bp, Artificial Sequence
  chemically synthesized
attgaataaattccctcttt

SEQ ID NO: 47456 - DNA, 20 bp, Artificial Sequence
  chemically synthesized
aacttatatgttcccaaaga

SEQ ID NO: 47457 - DNA, 20 bp, Artificial Sequence
  chemically synthesized
caacttatatgttcccaaag

SEQ ID NO: 47458 - DNA, 20 bp, Artificial Sequence
  chemically synthesized
acaacttatatgttcccaaa

SEQ ID NO: 47459 - DNA, 20 bp, Artificial Sequence
  chemically synthesized
agacaacttatatgttccca

SEQ ID NO: 47460 - DNA, 20 bp, Artificial Sequence
  chemically synthesized
ttccctctttgggaacatat

SEQ ID NO: 47461 - DNA, 20 bp, Artificial Sequence
  chemically synthesized
gggaacatataagttgtctc

SEQ ID NO: 47462 - DNA, 20 bp, Artificial Sequence
  chemically synthesized
cttagaacagtgaaaaactg

SEQ ID NO: 47463 - DNA, 20 bp, Artificial Sequence
  chemically synthesized
tacttagaacagtgaaaaac

SEQ ID NO: 47464 - DNA, 20 bp, Artificial Sequence
  chemically synthesized
ctccagtttttcactgttct

SEQ ID NO: 47465 - DNA, 20 bp, Artificial Sequence
  chemically synthesized
cactgtggccttacttagaa

SEQ ID NO: 47466 - DNA, 20 bp, Artificial Sequence
  chemically synthesized
agtttttcactgttctaagt

SEQ ID NO: 47467 - DNA, 20 bp, Artificial Sequence
  chemically synthesized
gtttttcactgttctaagta

SEQ ID NO: 47468 - DNA, 20 bp, Artificial Sequence
  chemically synthesized
atgttcactgtggccttact

SEQ ID NO: 47469 - DNA, 20 bp, Artificial Sequence
  chemically synthesized
cactgttctaagtaaggcca

SEQ ID NO: 47470 - DNA, 20 bp, Artificial Sequence
  chemically synthesized
atctacaaagatgttcactg

SEQ ID NO: 47471 - DNA, 20 bp, Artificial Sequence
  chemically synthesized
ggccacagtgaacatctttg

SEQ ID NO: 47472 - DNA, 20 bp, Artificial Sequence
  chemically synthesized
tgtgcaaagatttatctaca

SEQ ID NO: 47473 - DNA, 20 bp, Artificial Sequence
  chemically synthesized
aagtaactaaaatatgtgca

SEQ ID NO: 47474 - DNA, 20 bp, Artificial Sequence
  chemically synthesized
ataaatctttgcacatattt

SEQ ID NO: 47475 - DNA, 20 bp, Artificial Sequence
  chemically synthesized
atattttagttactttttta

SEQ ID NO: 47476 - DNA, 20 bp, Artificial Sequence
  chemically synthesized
ctaggaattttgctttaaaa

SEQ ID NO: 47477 - DNA, 20 bp, Artificial Sequence
  chemically synthesized
cttttttaaagcaaaattcc

SEQ ID NO: 47478 - DNA, 20 bp, Artificial Sequence
  chemically synthesized
ttttaaagcaaaattcctag

SEQ ID NO: 47479 - DNA, 20 bp, Artificial Sequence
  chemically synthesized
aatcaagtaaatatacttct

SEQ ID NO: 47480 - DNA, 20 bp, Artificial Sequence
  chemically synthesized
taatcaagtaaatatacttc

SEQ ID NO: 47481 - DNA, 20 bp, Artificial Sequence
  chemically synthesized
gaagtatatttacttgatta

SEQ ID NO: 47482 - DNA, 20 bp, Artificial Sequence
  chemically synthesized
aagtatatttacttgattaa

SEQ ID NO: 47483 - DNA, 20 bp, Artificial Sequence
  chemically synthesized
aacattcatagcctttaatc

SEQ ID NO: 47484 - DNA, 20 bp, Artificial Sequence
  chemically synthesized
aaatgtttttaaaacattca

SEQ ID NO: 47485 - DNA, 20 bp, Artificial Sequence
  chemically synthesized
ttttacataaattacactta

SEQ ID NO: 47486 - DNA, 20 bp, Artificial Sequence
  chemically synthesized
tacataaattacacttatgg

SEQ ID NO: 47487 - DNA, 20 bp, Artificial Sequence
  chemically synthesized
ataaattacacttatggcag

SEQ ID NO: 47488 - DNA, 20 bp, Artificial Sequence
  chemically synthesized
agagaggcttctgctgccat

SEQ ID NO: 47489 - DNA, 20 bp, Artificial Sequence
  chemically synthesized
aattacacttatggcagcag

SEQ ID NO: 47490 - DNA, 20 bp, Artificial Sequence
  chemically synthesized
acacttatatcaataaagag

SEQ ID NO: 47491 - DNA, 20 bp, Artificial Sequence
  chemically synthesized
tacacttatatcaataaaga

SEQ ID NO: 47492 - DNA, 20 bp, Artificial Sequence
  chemically synthesized
tttacacttatatcaataaa

SEQ ID NO: 47493 - DNA, 20 bp, Artificial Sequence
  chemically synthesized
tctttacacttatatcaata

SEQ ID NO: 47494 - DNA, 20 bp, Artificial Sequence
  chemically synthesized
aagcctctctttattgatat

SEQ ID NO: 47495 - DNA, 20 bp, Artificial Sequence
  chemically synthesized
tctttattgatataagtgta

SEQ ID NO: 47496 - DNA, 20 bp, Artificial Sequence
  chemically synthesized
tttattgatataagtgtaaa

SEQ ID NO: 47497 - DNA, 20 bp, Artificial Sequence
  chemically synthesized
agagaaaaatcaattttctg

SEQ ID NO: 47498 - DNA, 20 bp, Artificial Sequence
  chemically synthesized
gagaaaaatcaattttctgc

SEQ ID NO: 47499 - DNA, 20 bp, Artificial Sequence
  chemically synthesized
aactaaatactattgacctg

SEQ ID NO: 47500 - DNA, 20 bp, Artificial Sequence
  chemically synthesized
atcaattttctgcaggtcaa

SEQ ID NO: 47501 - DNA, 20 bp, Artificial Sequence
  chemically synthesized
ttctgcaggtcaatagtatt

SEQ ID NO: 47502 - DNA, 20 bp, Artificial Sequence
  chemically synthesized
gcaggtcaatagtatttagt

SEQ ID NO: 47503 - DNA, 20 bp, Artificial Sequence
  chemically synthesized
tttagttggcataattctca

SEQ ID NO: 47504 - DNA, 20 bp, Artificial Sequence
  chemically synthesized
gttggcataattctcaaagc

SEQ ID NO: 47505 - DNA, 20 bp, Artificial Sequence
  chemically synthesized
cagtatatctaacttgcttt

SEQ ID NO: 47506 - DNA, 20 bp, Artificial Sequence
  chemically synthesized
gcataattctcaaagcaagt

SEQ ID NO: 47507 - DNA, 20 bp, Artificial Sequence
  chemically synthesized
gttagatatactgcttgata

SEQ ID NO: 47508 - DNA, 20 bp, Artificial Sequence
  chemically synthesized
aaataatctactgtatcaag

SEQ ID NO: 47509 - DNA, 20 bp, Artificial Sequence
  chemically synthesized
agatatactgcttgatacag

SEQ ID NO: 47510 - DNA, 20 bp, Artificial Sequence
  chemically synthesized
cccaaataatctactgtatc

SEQ ID NO: 47511 - DNA, 20 bp, Artificial Sequence
  chemically synthesized
gcttgatacagtagattatt

SEQ ID NO: 47512 - DNA, 20 bp, Artificial Sequence
  chemically synthesized
cttgatacagtagattattt

SEQ ID NO: 47513 - DNA, 20 bp, Artificial Sequence
  chemically synthesized
ggggaagaggagagtgtgag

SEQ ID NO: 47514 - DNA, 20 bp, Artificial Sequence
  chemically synthesized
aggggaagaggagagtgtga

SEQ ID NO: 47515 - DNA, 20 bp, Artificial Sequence
  chemically synthesized
tcaggggaagaggagagtgt

SEQ ID NO: 47516 - DNA, 20 bp, Artificial Sequence
  chemically synthesized
agtctatcaggggaagagga

SEQ ID NO: 47517 - DNA, 20 bp, Artificial Sequence
  chemically synthesized
acagtctatcaggggaagag

SEQ ID NO: 47518 - DNA, 20 bp, Artificial Sequence
  chemically synthesized
ttacagtctatcaggggaag

SEQ ID NO: 47519 - DNA, 20 bp, Artificial Sequence
  chemically synthesized
tttacagtctatcaggggaa

SEQ ID NO: 47520 - DNA, 20 bp, Artificial Sequence
  chemically synthesized
acactctcctcttcccctga

SEQ ID NO: 47521 - DNA, 20 bp, Artificial Sequence
  chemically synthesized
gttttacagtctatcagggg

SEQ ID NO: 47522 - DNA, 20 bp, Artificial Sequence
  chemically synthesized
tgagttttacagtctatcag

SEQ ID NO: 47523 - DNA, 20 bp, Artificial Sequence
  chemically synthesized
ctgagttttacagtctatca

SEQ ID NO: 47524 - DNA, 20 bp, Artificial Sequence
  chemically synthesized
tctgagttttacagtctatc

SEQ ID NO: 47525 - DNA, 20 bp, Artificial Sequence
  chemically synthesized
ctctgagttttacagtctat

SEQ ID NO: 47526 - DNA, 20 bp, Artificial Sequence
  chemically synthesized
ccctgatagactgtaaaact

SEQ ID NO: 47527 - DNA, 20 bp, Artificial Sequence
  chemically synthesized
tttctaaactctgagtttta

SEQ ID NO: 47528 - DNA, 20 bp, Artificial Sequence
  chemically synthesized
ctgatagactgtaaaactca

SEQ ID NO: 47529 - DNA, 20 bp, Artificial Sequence
  chemically synthesized
agactgtaaaactcagagtt

SEQ ID NO: 47530 - DNA, 20 bp, Artificial Sequence
  chemically synthesized
tgagtgcctttctaaactct

SEQ ID NO: 47531 - DNA, 20 bp, Artificial Sequence
  chemically synthesized
tgtaaaactcagagtttaga

SEQ ID NO: 47532 - DNA, 20 bp, Artificial Sequence
  chemically synthesized
gtaaaactcagagtttagaa

SEQ ID NO: 47533 - DNA, 20 bp, Artificial Sequence
  chemically synthesized
tcagagtttagaaaggcact

SEQ ID NO: 47534 - DNA, 20 bp, Artificial Sequence
  chemically synthesized
cagagtttagaaaggcactc

SEQ ID NO: 47535 - DNA, 20 bp, Artificial Sequence
  chemically synthesized
tagaaaggcactcaggatgt

SEQ ID NO: 47536 - DNA, 20 bp, Artificial Sequence
  chemically synthesized
aaatagaaagccaacatcct

SEQ ID NO: 47537 - DNA, 20 bp, Artificial Sequence
  chemically synthesized
ggattgggctttgaaataga

SEQ ID NO: 47538 - DNA, 20 bp, Artificial Sequence
  chemically synthesized
gatgttggctttctatttca

SEQ ID NO: 47539 - DNA, 20 bp, Artificial Sequence
  chemically synthesized
tgctggattgggctttgaaa

SEQ ID NO: 47540 - DNA, 20 bp, Artificial Sequence
  chemically synthesized
ttctatttcaaagcccaatc

SEQ ID NO: 47541 - DNA, 20 bp, Artificial Sequence
  chemically synthesized
ccctctcaagatgctggatt

SEQ ID NO: 47542 - DNA, 20 bp, Artificial Sequence
  chemically synthesized
tccctctcaagatgctggat

SEQ ID NO: 47543 - DNA, 20 bp, Artificial Sequence
  chemically synthesized
aaagcccaatccagcatctt

SEQ ID NO: 47544 - DNA, 20 bp, Artificial Sequence
  chemically synthesized
ccagctccctctcaagatgc

SEQ ID NO: 47545 - DNA, 20 bp, Artificial Sequence
  chemically synthesized
agcccaatccagcatcttga

SEQ ID NO: 47546 - DNA, 20 bp, Artificial Sequence
  chemically synthesized
gcccaatccagcatcttgag

SEQ ID NO: 47547 - DNA, 20 bp, Artificial Sequence
  chemically synthesized
cccaatccagcatcttgaga

SEQ ID NO: 47548 - DNA, 20 bp, Artificial Sequence
  chemically synthesized
caatccagcatcttgagagg

SEQ ID NO: 47549 - DNA, 20 bp, Artificial Sequence
  chemically synthesized
gctatatccagctccctctc

SEQ ID NO: 47550 - DNA, 20 bp, Artificial Sequence
  chemically synthesized
ccagcatcttgagagggagc

SEQ ID NO: 47551 - DNA, 20 bp, Artificial Sequence
  chemically synthesized
tcttgagagggagctggata

SEQ ID NO: 47552 - DNA, 20 bp, Artificial Sequence
  chemically synthesized
tgagagggagctggatatag

SEQ ID NO: 47553 - DNA, 20 bp, Artificial Sequence
  chemically synthesized
tggacattttctgctatatc

SEQ ID NO: 47554 - DNA, 20 bp, Artificial Sequence
  chemically synthesized
tggatatagcagaaaatgtc

SEQ ID NO: 47555 - DNA, 20 bp, Artificial Sequence
  chemically synthesized
gatatagcagaaaatgtcca

SEQ ID NO: 47556 - DNA, 20 bp, Artificial Sequence
  chemically synthesized
agcagaaaatgtccagagta

SEQ ID NO: 47557 - DNA, 20 bp, Artificial Sequence
  chemically synthesized
gttcttctgaatctgtactc

SEQ ID NO: 47558 - DNA, 20 bp, Artificial Sequence
  chemically synthesized
aaatgtccagagtacagatt

SEQ ID NO: 47559 - DNA, 20 bp, Artificial Sequence
  chemically synthesized
tgtccagagtacagattcag

SEQ ID NO: 47560 - DNA, 20 bp, Artificial Sequence
  chemically synthesized
gagtacagattcagaagaac

SEQ ID NO: 47561 - DNA, 20 bp, Artificial Sequence
  chemically synthesized
gattcagaagaactggattt

SEQ ID NO: 47562 - DNA, 20 bp, Artificial Sequence
  chemically synthesized
ggggagtcaggactcaaatc

SEQ ID NO: 47563 - DNA, 20 bp, Artificial Sequence
  chemically synthesized
catgaagtgataggggagtc

SEQ ID NO: 47564 - DNA, 20 bp, Artificial Sequence
  chemically synthesized
tcatgaagtgataggggagt

SEQ ID NO: 47565 - DNA, 20 bp, Artificial Sequence
  chemically synthesized
aagatcatgaagtgataggg

SEQ ID NO: 47566 - DNA, 20 bp, Artificial Sequence
  chemically synthesized
ttaagatcatgaagtgatag

SEQ ID NO: 47567 - DNA, 20 bp, Artificial Sequence
  chemically synthesized
cttaagatcatgaagtgata

SEQ ID NO: 47568 - DNA, 20 bp, Artificial Sequence
  chemically synthesized
gcttaagatcatgaagtgat

SEQ ID NO: 47569 - DNA, 20 bp, Artificial Sequence
  chemically synthesized
agcttaagatcatgaagtga

SEQ ID NO: 47570 - DNA, 20 bp, Artificial Sequence
  chemically synthesized
aagactagcttaagatcatg

SEQ ID NO: 47571 - DNA, 20 bp, Artificial Sequence
  chemically synthesized
ccctatcacttcatgatctt

SEQ ID NO: 47572 - DNA, 20 bp, Artificial Sequence
  chemically synthesized
atcacttcatgatcttaagc

SEQ ID NO: 47573 - DNA, 20 bp, Artificial Sequence
  chemically synthesized
ggcaggaaaaagactagctt

SEQ ID NO: 47574 - DNA, 20 bp, Artificial Sequence
  chemically synthesized
ggcttaggcaggaaaaagac

SEQ ID NO: 47575 - DNA, 20 bp, Artificial Sequence
  chemically synthesized
aataaggcttaggcaggaaa

SEQ ID NO: 47576 - DNA, 20 bp, Artificial Sequence
  chemically synthesized
agctagtctttttcctgcct

SEQ ID NO: 47577 - DNA, 20 bp, Artificial Sequence
  chemically synthesized
aaggaaaataaggcttaggc

SEQ ID NO: 47578 - DNA, 20 bp, Artificial Sequence
  chemically synthesized
taaggaaaataaggcttagg

SEQ ID NO: 47579 - DNA, 20 bp, Artificial Sequence
  chemically synthesized
atataaggaaaataaggctt

SEQ ID NO: 47580 - DNA, 20 bp, Artificial Sequence
  chemically synthesized
aatataaggaaaataaggct

SEQ ID NO: 47581 - DNA, 20 bp, Artificial Sequence
  chemically synthesized
attggaatataaggaaaata

SEQ ID NO: 47582 - DNA, 20 bp, Artificial Sequence
  chemically synthesized
cattggaatataaggaaaat

SEQ ID NO: 47583 - DNA, 20 bp, Artificial Sequence
  chemically synthesized
attattcccattggaatata

SEQ ID NO: 47584 - DNA, 20 bp, Artificial Sequence
  chemically synthesized
cattattcccattggaatat

SEQ ID NO: 47585 - DNA, 20 bp, Artificial Sequence
  chemically synthesized
ttattttccttatattccaa

SEQ ID NO: 47586 - DNA, 20 bp, Artificial Sequence
  chemically synthesized
tattttccttatattccaat

SEQ ID NO: 47587 - DNA, 20 bp, Artificial Sequence
  chemically synthesized
ggagatatcattattcccat

SEQ ID NO: 47588 - DNA, 20 bp, Artificial Sequence
  chemically synthesized
ctgacaacattttggtgagg

SEQ ID NO: 47589 - DNA, 20 bp, Artificial Sequence
  chemically synthesized
tcctgacaacattttggtga

SEQ ID NO: 47590 - DNA, 20 bp, Artificial Sequence
  chemically synthesized
atcctgacaacattttggtg

SEQ ID NO: 47591 - DNA, 20 bp, Artificial Sequence
  chemically synthesized
tatcctgacaacattttggt

SEQ ID NO: 47592 - DNA, 20 bp, Artificial Sequence
  chemically synthesized
attttatcctgacaacattt

SEQ ID NO: 47593 - DNA, 20 bp, Artificial Sequence
  chemically synthesized
ctccctcaccaaaatgttgt

SEQ ID NO: 47594 - DNA, 20 bp, Artificial Sequence
  chemically synthesized
tccctcaccaaaatgttgtc

SEQ ID NO: 47595 - DNA, 20 bp, Artificial Sequence
  chemically synthesized
aaatgttgtcaggataaaat

SEQ ID NO: 47596 - DNA, 20 bp, Artificial Sequence
  chemically synthesized
aatgttgtcaggataaaatg

SEQ ID NO: 47597 - DNA, 20 bp, Artificial Sequence
  chemically synthesized
gtggtgattaacattttaca

SEQ ID NO: 47598 - DNA, 20 bp, Artificial Sequence
  chemically synthesized
gattacaaacattatttgtg

SEQ ID NO: 47599 - DNA, 20 bp, Artificial Sequence
  chemically synthesized
aaataatgtttgtaatcaca

SEQ ID NO: 47600 - DNA, 20 bp, Artificial Sequence
  chemically synthesized
atcattcagacaacacatca

SEQ ID NO: 47601 - DNA, 20 bp, Artificial Sequence
  chemically synthesized
atgatgtgttgtctgaatga

SEQ ID NO: 47602 - DNA, 20 bp, Artificial Sequence
  chemically synthesized
ttccacaattaaccatcatt

SEQ ID NO: 47603 - DNA, 20 bp, Artificial Sequence
  chemically synthesized
gtctgaatgatggttaattg

SEQ ID NO: 47604 - DNA, 20 bp, Artificial Sequence
  chemically synthesized
ccaggtgagagagaaagaat

SEQ ID NO: 47605 - DNA, 20 bp, Artificial Sequence
  chemically synthesized
tgctgcccaggtgagagaga

SEQ ID NO: 47606 - DNA, 20 bp, Artificial Sequence
  chemically synthesized
ccaattctttctctctcacc

SEQ ID NO: 47607 - DNA, 20 bp, Artificial Sequence
  chemically synthesized
taaatgctgcccaggtgaga

SEQ ID NO: 47608 - DNA, 20 bp, Artificial Sequence
  chemically synthesized
caattctttctctctcacct

SEQ ID NO: 47609 - DNA, 20 bp, Artificial Sequence
  chemically synthesized
gataaatgctgcccaggtga

SEQ ID NO: 47610 - DNA, 20 bp, Artificial Sequence
  chemically synthesized
ttctttctctctcacctggg

SEQ ID NO: 47611 - DNA, 20 bp, Artificial Sequence
  chemically synthesized
cagataaatgctgcccaggt

SEQ ID NO: 47612 - DNA, 20 bp, Artificial Sequence
  chemically synthesized
gctgcagataaatgctgccc

SEQ ID NO: 47613 - DNA, 20 bp, Artificial Sequence
  chemically synthesized
ggctgcagataaatgctgcc

SEQ ID NO: 47614 - DNA, 20 bp, Artificial Sequence
  chemically synthesized
acctgggcagcatttatctg

SEQ ID NO: 47615 - DNA, 20 bp, Artificial Sequence
  chemically synthesized
taggagtggattcaaggctg

SEQ ID NO: 47616 - DNA, 20 bp, Artificial Sequence
  chemically synthesized
agtagttaggagtggattca

SEQ ID NO: 47617 - DNA, 20 bp, Artificial Sequence
  chemically synthesized
cagtagttaggagtggattc

SEQ ID NO: 47618 - DNA, 20 bp, Artificial Sequence
  chemically synthesized
acattaacagtagttaggag

SEQ ID NO: 47619 - DNA, 20 bp, Artificial Sequence
  chemically synthesized
ggcacattaacagtagttag

SEQ ID NO: 47620 - DNA, 20 bp, Artificial Sequence
  chemically synthesized
gtggcacattaacagtagtt

SEQ ID NO: 47621 - DNA, 20 bp, Artificial Sequence
  chemically synthesized
tgtggcacattaacagtagt

SEQ ID NO: 47622 - DNA, 20 bp, Artificial Sequence
  chemically synthesized
tacatgtggcacattaacag

SEQ ID NO: 47623 - DNA, 20 bp, Artificial Sequence
  chemically synthesized
tactacatgtggcacattaa

SEQ ID NO: 47624 - DNA, 20 bp, Artificial Sequence
  chemically synthesized
tactgttaatgtgccacatg

SEQ ID NO: 47625 - DNA, 20 bp, Artificial Sequence
  chemically synthesized
gccatactttatactacatg

SEQ ID NO: 47626 - DNA, 20 bp, Artificial Sequence
  chemically synthesized
aatgtgccacatgtagtata

SEQ ID NO: 47627 - DNA, 20 bp, Artificial Sequence
  chemically synthesized
gccacatgtagtataaagta

SEQ ID NO: 47628 - DNA, 20 bp, Artificial Sequence
  chemically synthesized
acatgtagtataaagtatgg

SEQ ID NO: 47629 - DNA, 20 bp, Artificial Sequence
  chemically synthesized
atgtagtataaagtatggca

SEQ ID NO: 47630 - DNA, 20 bp, Artificial Sequence
  chemically synthesized
gtagtataaagtatggcaga

SEQ ID NO: 47631 - DNA, 20 bp, Artificial Sequence
  chemically synthesized
cagagagaaatgcctttgaa

SEQ ID NO: 47632 - DNA, 20 bp, Artificial Sequence
  chemically synthesized
ggcagttagatactattcaa

SEQ ID NO: 47633 - DNA, 20 bp, Artificial Sequence
  chemically synthesized
aggcagttagatactattca

SEQ ID NO: 47634 - DNA, 20 bp, Artificial Sequence
  chemically synthesized
ttgaatagtatctaactgcc

SEQ ID NO: 47635 - DNA, 20 bp, Artificial Sequence
  chemically synthesized
tgaatagtatctaactgcct

SEQ ID NO: 47636 - DNA, 20 bp, Artificial Sequence
  chemically synthesized
gtaccataagcccaggcagt

SEQ ID NO: 47637 - DNA, 20 bp, Artificial Sequence
  chemically synthesized
agaagtaccataagcccagg

SEQ ID NO: 47638 - DNA, 20 bp, Artificial Sequence
  chemically synthesized
tatctaactgcctgggctta

SEQ ID NO: 47639 - DNA, 20 bp, Artificial Sequence
  chemically synthesized
gaaagaagtaccataagccc

SEQ ID NO: 47640 - DNA, 20 bp, Artificial Sequence
  chemically synthesized
agaaagaagtaccataagcc

SEQ ID NO: 47641 - DNA, 20 bp, Artificial Sequence
  chemically synthesized
gatgtagaaagaagtaccat

SEQ ID NO: 47642 - DNA, 20 bp, Artificial Sequence
  chemically synthesized
gaagacagagatgtagaaag

SEQ ID NO: 47643 - DNA, 20 bp, Artificial Sequence
  chemically synthesized
taggaagacagagatgtaga

SEQ ID NO: 47644 - DNA, 20 bp, Artificial Sequence
  chemically synthesized
ggtctaggaagacagagatg

SEQ ID NO: 47645 - DNA, 20 bp, Artificial Sequence
  chemically synthesized
gtcattggtctaggaagaca

SEQ ID NO: 47646 - DNA, 20 bp, Artificial Sequence
  chemically synthesized
tttctacatctctgtcttcc

SEQ ID NO: 47647 - DNA, 20 bp, Artificial Sequence
  chemically synthesized
atgtcattggtctaggaaga

SEQ ID NO: 47648 - DNA, 20 bp, Artificial Sequence
  chemically synthesized
atagatgtcattggtctagg

SEQ ID NO: 47649 - DNA, 20 bp, Artificial Sequence
  chemically synthesized
tgtatagatgtcattggtct

SEQ ID NO: 47650 - DNA, 20 bp, Artificial Sequence
  chemically synthesized
ttgtatagatgtcattggtc

SEQ ID NO: 47651 - DNA, 20 bp, Artificial Sequence
  chemically synthesized
atctgttgtatagatgtcat

SEQ ID NO: 47652 - DNA, 20 bp, Artificial Sequence
  chemically synthesized
gaccaatgacatctatacaa

SEQ ID NO: 47653 - DNA, 20 bp, Artificial Sequence
  chemically synthesized
agaatgaaagatctgttgta

SEQ ID NO: 47654 - DNA, 20 bp, Artificial Sequence
  chemically synthesized
tacaacagatctttcattct

SEQ ID NO: 47655 - DNA, 20 bp, Artificial Sequence
  chemically synthesized
aatggtctagctaagaatga

SEQ ID NO: 47656 - DNA, 20 bp, Artificial Sequence
  chemically synthesized
acagatctttcattcttagc

SEQ ID NO: 47657 - DNA, 20 bp, Artificial Sequence
  chemically synthesized
ggtggataaatggtctagct

SEQ ID NO: 47658 - DNA, 20 bp, Artificial Sequence
  chemically synthesized
tgaatggtggataaatggtc

SEQ ID NO: 47659 - DNA, 20 bp, Artificial Sequence
  chemically synthesized
gctgatgaatggtggataaa

SEQ ID NO: 47660 - DNA, 20 bp, Artificial Sequence
  chemically synthesized
tcattcatgctgatgaatgg

SEQ ID NO: 47661 - DNA, 20 bp, Artificial Sequence
  chemically synthesized
accatttatccaccattcat

SEQ ID NO: 47662 - DNA, 20 bp, Artificial Sequence
  chemically synthesized
ttatcattcatgctgatgaa

SEQ ID NO: 47663 - DNA, 20 bp, Artificial Sequence
  chemically synthesized
tcatcagcatgaatgataaa

SEQ ID NO: 47664 - DNA, 20 bp, Artificial Sequence
  chemically synthesized
agcatgaatgataaacagat

SEQ ID NO: 47665 - DNA, 20 bp, Artificial Sequence
  chemically synthesized
gattttcactgcataaaata

SEQ ID NO: 47666 - DNA, 20 bp, Artificial Sequence
  chemically synthesized
agattagtctatattttatg

SEQ ID NO: 47667 - DNA, 20 bp, Artificial Sequence
  chemically synthesized
atattttatgcagtgaaaat

SEQ ID NO: 47668 - DNA, 20 bp, Artificial Sequence
  chemically synthesized
attttatgcagtgaaaatca

SEQ ID NO: 47669 - DNA, 20 bp, Artificial Sequence
  chemically synthesized
ttttatgcagtgaaaatcag

SEQ ID NO: 47670 - DNA, 20 bp, Artificial Sequence
  chemically synthesized
cagtgaaaatcagaggccca

SEQ ID NO: 47671 - DNA, 20 bp, Artificial Sequence
  chemically synthesized
ccaaatgctaatcagtctat

SEQ ID NO: 47672 - DNA, 20 bp, Artificial Sequence
  chemically synthesized
gccaaatgctaatcagtcta

SEQ ID NO: 47673 - DNA, 20 bp, Artificial Sequence
  chemically synthesized
tcagaggcccatagactgat

SEQ ID NO: 47674 - DNA, 20 bp, Artificial Sequence
  chemically synthesized
catgattgccaaatgctaat

SEQ ID NO: 47675 - DNA, 20 bp, Artificial Sequence
  chemically synthesized
cccatagactgattagcatt

SEQ ID NO: 47676 - DNA, 20 bp, Artificial Sequence
  chemically synthesized
gcatttggcaatcatgaata

SEQ ID NO: 47677 - DNA, 20 bp, Artificial Sequence
  chemically synthesized
ttggcaatcatgaataaagc

SEQ ID NO: 47678 - DNA, 20 bp, Artificial Sequence
  chemically synthesized
ctgtacacaaatgttgatac

SEQ ID NO: 47679 - DNA, 20 bp, Artificial Sequence
  chemically synthesized
ctggtatcaacatttgtgta

SEQ ID NO: 47680 - DNA, 20 bp, Artificial Sequence
  chemically synthesized
tggtatcaacatttgtgtac

SEQ ID NO: 47681 - DNA, 20 bp, Artificial Sequence
  chemically synthesized
ttgtgtacaggtatttgcat

SEQ ID NO: 47682 - DNA, 20 bp, Artificial Sequence
  chemically synthesized
acaggtatttgcatcagcat

SEQ ID NO: 47683 - DNA, 20 bp, Artificial Sequence
  chemically synthesized
tatttgcatcagcataagtt

SEQ ID NO: 47684 - DNA, 20 bp, Artificial Sequence
  chemically synthesized
ttcacttgcatttcagtgaa

SEQ ID NO: 47685 - DNA, 20 bp, Artificial Sequence
  chemically synthesized
ggttcttttcactgaaatgc

SEQ ID NO: 47686 - DNA, 20 bp, Artificial Sequence
  chemically synthesized
ttgtcctttcacttgcattt

SEQ ID NO: 47687 - DNA, 20 bp, Artificial Sequence
  chemically synthesized
tttcactgaaatgcaagtga

SEQ ID NO: 47688 - DNA, 20 bp, Artificial Sequence
  chemically synthesized
ttcactgaaatgcaagtgaa

SEQ ID NO: 47689 - DNA, 20 bp, Artificial Sequence
  chemically synthesized
tgaaatgcaagtgaaaggac

SEQ ID NO: 47690 - DNA, 20 bp, Artificial Sequence
  chemically synthesized
aagtgaaaggacaagaccat

SEQ ID NO: 47691 - DNA, 20 bp, Artificial Sequence
  chemically synthesized
aaggacaagaccataagtac

SEQ ID NO: 47692 - DNA, 20 bp, Artificial Sequence
  chemically synthesized
tgctatgattctagtactta

SEQ ID NO: 47693 - DNA, 20 bp, Artificial Sequence
  chemically synthesized
gaccataagtactagaatca

SEQ ID NO: 47694 - DNA, 20 bp, Artificial Sequence
  chemically synthesized
catagcatctgctatgattc

SEQ ID NO: 47695 - DNA, 20 bp, Artificial Sequence
  chemically synthesized
cataagtactagaatcatag

SEQ ID NO: 47696 - DNA, 20 bp, Artificial Sequence
  chemically synthesized
agaatcatagcagatgctat

SEQ ID NO: 47697 - DNA, 20 bp, Artificial Sequence
  chemically synthesized
catagcagatgctatgagaa

SEQ ID NO: 47698 - DNA, 20 bp, Artificial Sequence
  chemically synthesized
aaagagtccagccattctca

SEQ ID NO: 47699 - DNA, 20 bp, Artificial Sequence
  chemically synthesized
gcagatgctatgagaatggc

SEQ ID NO: 47700 - DNA, 20 bp, Artificial Sequence
  chemically synthesized
tcttccttccttaaagagtc

SEQ ID NO: 47701 - DNA, 20 bp, Artificial Sequence
  chemically synthesized
tgagaatggctggactcttt

SEQ ID NO: 47702 - DNA, 20 bp, Artificial Sequence
  chemically synthesized
gagaatggctggactcttta

SEQ ID NO: 47703 - DNA, 20 bp, Artificial Sequence
  chemically synthesized
aatggctggactctttaagg

SEQ ID NO: 47704 - DNA, 20 bp, Artificial Sequence
  chemically synthesized
tacgatcttccttccttaaa

SEQ ID NO: 47705 - DNA, 20 bp, Artificial Sequence
  chemically synthesized
atggctggactctttaagga

SEQ ID NO: 47706 - DNA, 20 bp, Artificial Sequence
  chemically synthesized
tgtacgatcttccttcctta

SEQ ID NO: 47707 - DNA, 20 bp, Artificial Sequence
  chemically synthesized
gctggactctttaaggaagg

SEQ ID NO: 47708 - DNA, 20 bp, Artificial Sequence
  chemically synthesized
taaggaaggaagatcgtaca

SEQ ID NO: 47709 - DNA, 20 bp, Artificial Sequence
  chemically synthesized
aggaaggaagatcgtacaaa

SEQ ID NO: 47710 - DNA, 20 bp, Artificial Sequence
  chemically synthesized
gaaaatgtggtgtatacatg

SEQ ID NO: 47711 - DNA, 20 bp, Artificial Sequence
  chemically synthesized
tattccattgtatgaaaatg

SEQ ID NO: 47712 - DNA, 20 bp, Artificial Sequence
  chemically synthesized
tacaccacattttcatacaa

SEQ ID NO: 47713 - DNA, 20 bp, Artificial Sequence
  chemically synthesized
tcatacaatggaataccatt

SEQ ID NO: 47714 - DNA, 20 bp, Artificial Sequence
  chemically synthesized
ttcttttttttaatgctgaa

SEQ ID NO: 47715 - DNA, 20 bp, Artificial Sequence
  chemically synthesized
taccattcagcattaaaaaa

SEQ ID NO: 47716 - DNA, 20 bp, Artificial Sequence
  chemically synthesized
cattcagcattaaaaaaaag

SEQ ID NO: 47717 - DNA, 20 bp, Artificial Sequence
  chemically synthesized
attcagcattaaaaaaaaga

SEQ ID NO: 47718 - DNA, 20 bp, Artificial Sequence
  chemically synthesized
aaaaagaaggttcctaccat

SEQ ID NO: 47719 - DNA, 20 bp, Artificial Sequence
  chemically synthesized
tccacattgtcaccaatggt

SEQ ID NO: 47720 - DNA, 20 bp, Artificial Sequence
  chemically synthesized
atccacattgtcaccaatgg

SEQ ID NO: 47721 - DNA, 20 bp, Artificial Sequence
  chemically synthesized
cccatccacattgtcaccaa

SEQ ID NO: 47722 - DNA, 20 bp, Artificial Sequence
  chemically synthesized
tcctaccattggtgacaatg

SEQ ID NO: 47723 - DNA, 20 bp, Artificial Sequence
  chemically synthesized
accattggtgacaatgtgga

SEQ ID NO: 47724 - DNA, 20 bp, Artificial Sequence
  chemically synthesized
ccattggtgacaatgtggat

SEQ ID NO: 47725 - DNA, 20 bp, Artificial Sequence
  chemically synthesized
gacaatgtggatgggccttg

SEQ ID NO: 47726 - DNA, 20 bp, Artificial Sequence
  chemically synthesized
tttcactgagcatgtctgca

SEQ ID NO: 47727 - DNA, 20 bp, Artificial Sequence
  chemically synthesized
atttcactgagcatgtctgc

SEQ ID NO: 47728 - DNA, 20 bp, Artificial Sequence
  chemically synthesized
atgggccttgcagacatgct

SEQ ID NO: 47729 - DNA, 20 bp, Artificial Sequence
  chemically synthesized
tatgactggcttatttcact

SEQ ID NO: 47730 - DNA, 20 bp, Artificial Sequence
  chemically synthesized
gcagacatgctcagtgaaat

SEQ ID NO: 47731 - DNA, 20 bp, Artificial Sequence
  chemically synthesized
acatgctcagtgaaataagc

SEQ ID NO: 47732 - DNA, 20 bp, Artificial Sequence
  chemically synthesized
tcagtgaaataagccagtca

SEQ ID NO: 47733 - DNA, 20 bp, Artificial Sequence
  chemically synthesized
gtgaaataagccagtcatag

SEQ ID NO: 47734 - DNA, 20 bp, Artificial Sequence
  chemically synthesized
agcatttatccttctatgac

SEQ ID NO: 47735 - DNA, 20 bp, Artificial Sequence
  chemically synthesized
tgaaataagccagtcataga

SEQ ID NO: 47736 - DNA, 20 bp, Artificial Sequence
  chemically synthesized
ttcataaaagtggagtcata

SEQ ID NO: 47737 - DNA, 20 bp, Artificial Sequence
  chemically synthesized
tcagacacttcataaaagtg

SEQ ID NO: 47738 - DNA, 20 bp, Artificial Sequence
  chemically synthesized
tttcagacacttcataaaag

SEQ ID NO: 47739 - DNA, 20 bp, Artificial Sequence
  chemically synthesized
tgtatgactccacttttatg

SEQ ID NO: 47740 - DNA, 20 bp, Artificial Sequence
  chemically synthesized
ctatttcagacacttcataa

SEQ ID NO: 47741 - DNA, 20 bp, Artificial Sequence
  chemically synthesized
cttttatgaagtgtctgaaa

SEQ ID NO: 47742 - DNA, 20 bp, Artificial Sequence
  chemically synthesized
ttctatgaggttgactattt

SEQ ID NO: 47743 - DNA, 20 bp, Artificial Sequence
  chemically synthesized
gtctgaaatagtcaacctca

SEQ ID NO: 47744 - DNA, 20 bp, Artificial Sequence
  chemically synthesized
tgaaatagtcaacctcatag

SEQ ID NO: 47745 - DNA, 20 bp, Artificial Sequence
  chemically synthesized
ttctatttactgcttctatg

SEQ ID NO: 47746 - DNA, 20 bp, Artificial Sequence
  chemically synthesized
aatagtcaacctcatagaag

SEQ ID NO: 47747 - DNA, 20 bp, Artificial Sequence
  chemically synthesized
tttctatttactgcttctat

SEQ ID NO: 47748 - DNA, 20 bp, Artificial Sequence
  chemically synthesized
aacctcatagaagcagtaaa

SEQ ID NO: 47749 - DNA, 20 bp, Artificial Sequence
  chemically synthesized
catagaagcagtaaatagaa

SEQ ID NO: 47750 - DNA, 20 bp, Artificial Sequence
  chemically synthesized
agaagcagtaaatagaaaag

SEQ ID NO: 47751 - DNA, 20 bp, Artificial Sequence
  chemically synthesized
gtaaatagaaaagtggttgc

SEQ ID NO: 47752 - DNA, 20 bp, Artificial Sequence
  chemically synthesized
aatagaaaagtggttgccag

SEQ ID NO: 47753 - DNA, 20 bp, Artificial Sequence
  chemically synthesized
gaaaagtggttgccagaaga

SEQ ID NO: 47754 - DNA, 20 bp, Artificial Sequence
  chemically synthesized
aaaagtggttgccagaagac

SEQ ID NO: 47755 - DNA, 20 bp, Artificial Sequence
  chemically synthesized
aaagtggttgccagaagaca

SEQ ID NO: 47756 - DNA, 20 bp, Artificial Sequence
  chemically synthesized
gtttcccctgccctgtcttc

SEQ ID NO: 47757 - DNA, 20 bp, Artificial Sequence
  chemically synthesized
gtggttgccagaagacaggg

SEQ ID NO: 47758 - DNA, 20 bp, Artificial Sequence
  chemically synthesized
tggttgccagaagacagggc

SEQ ID NO: 47759 - DNA, 20 bp, Artificial Sequence
  chemically synthesized
ggttgccagaagacagggca

SEQ ID NO: 47760 - DNA, 20 bp, Artificial Sequence
  chemically synthesized
gttgccagaagacagggcag

SEQ ID NO: 47761 - DNA, 20 bp, Artificial Sequence
  chemically synthesized
gaagacagggcaggggaaac

SEQ ID NO: 47762 - DNA, 20 bp, Artificial Sequence
  chemically synthesized
acgagaaattgttattcaat

SEQ ID NO: 47763 - DNA, 20 bp, Artificial Sequence
  chemically synthesized
attgttattcaatgagtata

SEQ ID NO: 47764 - DNA, 20 bp, Artificial Sequence
  chemically synthesized
gtataaagtttcacttatgc

SEQ ID NO: 47765 - DNA, 20 bp, Artificial Sequence
  chemically synthesized
agaacttactcatcttgcat

SEQ ID NO: 47766 - DNA, 20 bp, Artificial Sequence
  chemically synthesized
aagtttcacttatgcaagat

SEQ ID NO: 47767 - DNA, 20 bp, Artificial Sequence
  chemically synthesized
ttcacttatgcaagatgagt

SEQ ID NO: 47768 - DNA, 20 bp, Artificial Sequence
  chemically synthesized
tatgcaagatgagtaagttc

SEQ ID NO: 47769 - DNA, 20 bp, Artificial Sequence
  chemically synthesized
tgcaagatgagtaagttcta

SEQ ID NO: 47770 - DNA, 20 bp, Artificial Sequence
  chemically synthesized
tatgttgtacagcagatctc

SEQ ID NO: 47771 - DNA, 20 bp, Artificial Sequence
  chemically synthesized
ataggcactatgttgtacag

SEQ ID NO: 47772 - DNA, 20 bp, Artificial Sequence
  chemically synthesized
tagagatctgctgtacaaca

SEQ ID NO: 47773 - DNA, 20 bp, Artificial Sequence
  chemically synthesized
actataggcactatgttgta

SEQ ID NO: 47774 - DNA, 20 bp, Artificial Sequence
  chemically synthesized
gctgtacaacatagtgccta

SEQ ID NO: 47775 - DNA, 20 bp, Artificial Sequence
  chemically synthesized
tacacagtattgttaactat

SEQ ID NO: 47776 - DNA, 20 bp, Artificial Sequence
  chemically synthesized
ctacacagtattgttaacta

SEQ ID NO: 47777 - DNA, 20 bp, Artificial Sequence
  chemically synthesized
ctatagttaacaatactgtg

SEQ ID NO: 47778 - DNA, 20 bp, Artificial Sequence
  chemically synthesized
taagttttaagtgcactaca

SEQ ID NO: 47779 - DNA, 20 bp, Artificial Sequence
  chemically synthesized
gtgtagtgcacttaaaactt

SEQ ID NO: 47780 - DNA, 20 bp, Artificial Sequence
  chemically synthesized
tcttaatccccttaagtttt

SEQ ID NO: 47781 - DNA, 20 bp, Artificial Sequence
  chemically synthesized
tgtagtgcacttaaaactta

SEQ ID NO: 47782 - DNA, 20 bp, Artificial Sequence
  chemically synthesized
gtagtgcacttaaaacttaa

SEQ ID NO: 47783 - DNA, 20 bp, Artificial Sequence
  chemically synthesized
tagtgcacttaaaacttaag

SEQ ID NO: 47784 - DNA, 20 bp, Artificial Sequence
  chemically synthesized
tggaccctcttaatcccctt

SEQ ID NO: 47785 - DNA, 20 bp, Artificial Sequence
  chemically synthesized
acttaaaacttaaggggatt

SEQ ID NO: 47786 - DNA, 20 bp, Artificial Sequence
  chemically synthesized
ttaaaacttaaggggattaa

SEQ ID NO: 47787 - DNA, 20 bp, Artificial Sequence
  chemically synthesized
taaaacttaaggggattaag

SEQ ID NO: 47788 - DNA, 20 bp, Artificial Sequence
  chemically synthesized
aaaacttaaggggattaaga

SEQ ID NO: 47789 - DNA, 20 bp, Artificial Sequence
  chemically synthesized
gggattaagagggtccacct

SEQ ID NO: 47790 - DNA, 20 bp, Artificial Sequence
  chemically synthesized
ttaagagggtccacctcggc

SEQ ID NO: 47791 - DNA, 20 bp, Artificial Sequence
  chemically synthesized
gccaccgcgcccggccgagg

SEQ ID NO: 47792 - DNA, 20 bp, Artificial Sequence
  chemically synthesized
taagagggtccacctcggcc

SEQ ID NO: 47793 - DNA, 20 bp, Artificial Sequence
  chemically synthesized
tgagccaccgcgcccggccg

SEQ ID NO: 47794 - DNA, 20 bp, Artificial Sequence
  chemically synthesized
gtgagccaccgcgcccggcc

SEQ ID NO: 47795 - DNA, 20 bp, Artificial Sequence
  chemically synthesized
gggtccacctcggccgggcg

SEQ ID NO: 47796 - DNA, 20 bp, Artificial Sequence
  chemically synthesized
tccacctcggccgggcgcgg

SEQ ID NO: 47797 - DNA, 20 bp, Artificial Sequence
  chemically synthesized
caggggtgagccaccgcgcc

SEQ ID NO: 47798 - DNA, 20 bp, Artificial Sequence
  chemically synthesized
agtgctgggattacaggggt

SEQ ID NO: 47799 - DNA, 20 bp, Artificial Sequence
  chemically synthesized
ccaaagtgctgggattacag

SEQ ID NO: 47800 - DNA, 20 bp, Artificial Sequence
  chemically synthesized
cccaaagtgctgggattaca

SEQ ID NO: 47801 - DNA, 20 bp, Artificial Sequence
  chemically synthesized
gtggctcacccctgtaatcc

SEQ ID NO: 47802 - DNA, 20 bp, Artificial Sequence
  chemically synthesized
tcccaaagtgctgggattac

SEQ ID NO: 47803 - DNA, 20 bp, Artificial Sequence
  chemically synthesized
ctcccaaagtgctgggatta

SEQ ID NO: 47804 - DNA, 20 bp, Artificial Sequence
  chemically synthesized
cccctgtaatcccagcactt

SEQ ID NO: 47805 - DNA, 20 bp, Artificial Sequence
  chemically synthesized
ccttggcctcccaaagtgct

SEQ ID NO: 47806 - DNA, 20 bp, Artificial Sequence
  chemically synthesized
ccctgtaatcccagcacttt

SEQ ID NO: 47807 - DNA, 20 bp, Artificial Sequence
  chemically synthesized
accttggcctcccaaagtgc

SEQ ID NO: 47808 - DNA, 20 bp, Artificial Sequence
  chemically synthesized
ctgtaatcccagcactttgg

SEQ ID NO: 47809 - DNA, 20 bp, Artificial Sequence
  chemically synthesized
tgtaatcccagcactttggg

SEQ ID NO: 47810 - DNA, 20 bp, Artificial Sequence
  chemically synthesized
ctgctcaccttggcctccca

SEQ ID NO: 47811 - DNA, 20 bp, Artificial Sequence
  chemically synthesized
tcccagcactttgggaggcc

SEQ ID NO: 47812 - DNA, 20 bp, Artificial Sequence
  chemically synthesized
cccagcactttgggaggcca

SEQ ID NO: 47813 - DNA, 20 bp, Artificial Sequence
  chemically synthesized
gcactttgggaggccaaggt

SEQ ID NO: 47814 - DNA, 20 bp, Artificial Sequence
  chemically synthesized
ctttgggaggccaaggtgag

SEQ ID NO: 47815 - DNA, 20 bp, Artificial Sequence
  chemically synthesized
acctcgtgatctgctcacct

SEQ ID NO: 47816 - DNA, 20 bp, Artificial Sequence
  chemically synthesized
ggccaaggtgagcagatcac

SEQ ID NO: 47817 - DNA, 20 bp, Artificial Sequence
  chemically synthesized
gccaaggtgagcagatcacg

SEQ ID NO: 47818 - DNA, 20 bp, Artificial Sequence
  chemically synthesized
ggtgagcagatcacgaggtc

SEQ ID NO: 47819 - DNA, 20 bp, Artificial Sequence
  chemically synthesized
tgagcagatcacgaggtcaa

SEQ ID NO: 47820 - DNA, 20 bp, Artificial Sequence
  chemically synthesized
gatcacgaggtcaagagatc

SEQ ID NO: 47821 - DNA, 20 bp, Artificial Sequence
  chemically synthesized
tcaagagatcgagaccatcc

SEQ ID NO: 47822 - DNA, 20 bp, Artificial Sequence
  chemically synthesized
tttcaccacatcggccagga

SEQ ID NO: 47823 - DNA, 20 bp, Artificial Sequence
  chemically synthesized
ggggtttcaccacatcggcc

SEQ ID NO: 47824 - DNA, 20 bp, Artificial Sequence
  chemically synthesized
cgagaccatcctggccgatg

SEQ ID NO: 47825 - DNA, 20 bp, Artificial Sequence
  chemically synthesized
tggggtttcaccacatcggc

SEQ ID NO: 47826 - DNA, 20 bp, Artificial Sequence
  chemically synthesized
gagatggggtttcaccacat

SEQ ID NO: 47827 - DNA, 20 bp, Artificial Sequence
  chemically synthesized
ttgtatttttagtagagatg

SEQ ID NO: 47828 - DNA, 20 bp, Artificial Sequence
  chemically synthesized
tttgtatttttagtagagat

SEQ ID NO: 47829 - DNA, 20 bp, Artificial Sequence
  chemically synthesized
ttttgtatttttagtagaga

SEQ ID NO: 47830 - DNA, 20 bp, Artificial Sequence
  chemically synthesized
taatttttgtatttttagta

SEQ ID NO: 47831 - DNA, 20 bp, Artificial Sequence
  chemically synthesized
gctaatttttgtatttttag

SEQ ID NO: 47832 - DNA, 20 bp, Artificial Sequence
  chemically synthesized
ccagctaatttttgtatttt

SEQ ID NO: 47833 - DNA, 20 bp, Artificial Sequence
  chemically synthesized
tctactaaaaatacaaaaat

SEQ ID NO: 47834 - DNA, 20 bp, Artificial Sequence
  chemically synthesized
ctaaaaatacaaaaattagc

SEQ ID NO: 47835 - DNA, 20 bp, Artificial Sequence
  chemically synthesized
taaaaatacaaaaattagct

SEQ ID NO: 47836 - DNA, 20 bp, Artificial Sequence
  chemically synthesized
aatacaaaaattagctgggc

SEQ ID NO: 47837 - DNA, 20 bp, Artificial Sequence
  chemically synthesized
atacaaaaattagctgggcg

SEQ ID NO: 47838 - DNA, 20 bp, Artificial Sequence
  chemically synthesized
caaaaattagctgggcgagg

SEQ ID NO: 47839 - DNA, 20 bp, Artificial Sequence
  chemically synthesized
taggtgcgcgccacctcgcc

SEQ ID NO: 47840 - DNA, 20 bp, Artificial Sequence
  chemically synthesized
ggcgaggtggcgcgcaccta

SEQ ID NO: 47841 - DNA, 20 bp, Artificial Sequence
  chemically synthesized
gtggcgcgcacctatagtcc

SEQ ID NO: 47842 - DNA, 20 bp, Artificial Sequence
  chemically synthesized
tcccgagtagctgggactat

SEQ ID NO: 47843 - DNA, 20 bp, Artificial Sequence
  chemically synthesized
ctcccgagtagctgggacta

SEQ ID NO: 47844 - DNA, 20 bp, Artificial Sequence
  chemically synthesized
cacctatagtcccagctact

SEQ ID NO: 47845 - DNA, 20 bp, Artificial Sequence
  chemically synthesized
cctcagcctcccgagtagct

SEQ ID NO: 47846 - DNA, 20 bp, Artificial Sequence
  chemically synthesized
acctatagtcccagctactc

SEQ ID NO: 47847 - DNA, 20 bp, Artificial Sequence
  chemically synthesized
gcctcagcctcccgagtagc

SEQ ID NO: 47848 - DNA, 20 bp, Artificial Sequence
  chemically synthesized
ctatagtcccagctactcgg

SEQ ID NO: 47849 - DNA, 20 bp, Artificial Sequence
  chemically synthesized
tatagtcccagctactcggg

SEQ ID NO: 47850 - DNA, 20 bp, Artificial Sequence
  chemically synthesized
tcctgcctcagcctcccgag

SEQ ID NO: 47851 - DNA, 20 bp, Artificial Sequence
  chemically synthesized
ttctcctgcctcagcctccc

SEQ ID NO: 47852 - DNA, 20 bp, Artificial Sequence
  chemically synthesized
tcccagctactcgggaggct

SEQ ID NO: 47853 - DNA, 20 bp, Artificial Sequence
  chemically synthesized
cccagctactcgggaggctg

SEQ ID NO: 47854 - DNA, 20 bp, Artificial Sequence
  chemically synthesized
agctactcgggaggctgagg

SEQ ID NO: 47855 - DNA, 20 bp, Artificial Sequence
  chemically synthesized
gctactcgggaggctgaggc

SEQ ID NO: 47856 - DNA, 20 bp, Artificial Sequence
  chemically synthesized
tactcgggaggctgaggcag

SEQ ID NO: 47857 - DNA, 20 bp, Artificial Sequence
  chemically synthesized
ttcaagcgattctcctgcct

SEQ ID NO: 47858 - DNA, 20 bp, Artificial Sequence
  chemically synthesized
gcaggagaatcgcttgaacc

SEQ ID NO: 47859 - DNA, 20 bp, Artificial Sequence
  chemically synthesized
caggagaatcgcttgaacct

SEQ ID NO: 47860 - DNA, 20 bp, Artificial Sequence
  chemically synthesized
aacctccacctcccaggttc

SEQ ID NO: 47861 - DNA, 20 bp, Artificial Sequence
  chemically synthesized
ggagaatcgcttgaacctgg

SEQ ID NO: 47862 - DNA, 20 bp, Artificial Sequence
  chemically synthesized
gagaatcgcttgaacctggg

SEQ ID NO: 47863 - DNA, 20 bp, Artificial Sequence
  chemically synthesized
aatcgcttgaacctgggagg

SEQ ID NO: 47864 - DNA, 20 bp, Artificial Sequence
  chemically synthesized
gactgcaacctccacctccc

SEQ ID NO: 47865 - DNA, 20 bp, Artificial Sequence
  chemically synthesized
tcgcttgaacctgggaggtg

SEQ ID NO: 47866 - DNA, 20 bp, Artificial Sequence
  chemically synthesized
tgactgcaacctccacctcc

SEQ ID NO: 47867 - DNA, 20 bp, Artificial Sequence
  chemically synthesized
cgcttgaacctgggaggtgg

SEQ ID NO: 47868 - DNA, 20 bp, Artificial Sequence
  chemically synthesized
aacctgggaggtggaggttg

SEQ ID NO: 47869 - DNA, 20 bp, Artificial Sequence
  chemically synthesized
tgggaggtggaggttgcagt

SEQ ID NO: 47870 - DNA, 20 bp, Artificial Sequence
  chemically synthesized
ggtggaggttgcagtcagct

SEQ ID NO: 47871 - DNA, 20 bp, Artificial Sequence
  chemically synthesized
ggagtgcagtggcacgatct

SEQ ID NO: 47872 - DNA, 20 bp, Artificial Sequence
  chemically synthesized
gtcgccaggctggagtgcag

SEQ ID NO: 47873 - DNA, 20 bp, Artificial Sequence
  chemically synthesized
gagatcgtgccactgcactc

SEQ ID NO: 47874 - DNA, 20 bp, Artificial Sequence
  chemically synthesized
tctgtcgccaggctggagtg

SEQ ID NO: 47875 - DNA, 20 bp, Artificial Sequence
  chemically synthesized
cgtgccactgcactccagcc

SEQ ID NO: 47876 - DNA, 20 bp, Artificial Sequence
  chemically synthesized
cttgctctgtcgccaggctg

SEQ ID NO: 47877 - DNA, 20 bp, Artificial Sequence
  chemically synthesized
atcttgctctgtcgccaggc

SEQ ID NO: 47878 - DNA, 20 bp, Artificial Sequence
  chemically synthesized
actgcactccagcctggcga

SEQ ID NO: 47879 - DNA, 20 bp, Artificial Sequence
  chemically synthesized
tgcactccagcctggcgaca

SEQ ID NO: 47880 - DNA, 20 bp, Artificial Sequence
  chemically synthesized
tggaatcttgctctgtcgcc

SEQ ID NO: 47881 - DNA, 20 bp, Artificial Sequence
  chemically synthesized
atggaatcttgctctgtcgc

SEQ ID NO: 47882 - DNA, 20 bp, Artificial Sequence
  chemically synthesized
ctccagcctggcgacagagc

SEQ ID NO: 47883 - DNA, 20 bp, Artificial Sequence
  chemically synthesized
ttttttttttttttttgaga

SEQ ID NO: 47884 - DNA, 20 bp, Artificial Sequence
  chemically synthesized
tttttttttttttttttttt

SEQ ID NO: 47885 - DNA, 20 bp, Artificial Sequence
  chemically synthesized
aaaaaaaaaaaaaaaaaaaa

SEQ ID NO: 47886 - DNA, 20 bp, Artificial Sequence
  chemically synthesized
aaaaaaaaaaaaaaaaaaaa

SEQ ID NO: 47887 - DNA, 20 bp, Artificial Sequence
  chemically synthesized
aaaaaaaaaaaaaaaaaaag

SEQ ID NO: 47888 - DNA, 20 bp, Artificial Sequence
  chemically synthesized
aaaaaaaaaaaaaaaaaaga

SEQ ID NO: 47889 - DNA, 20 bp, Artificial Sequence
  chemically synthesized
ggcaagaacacaacatgaga

SEQ ID NO: 47890 - DNA, 20 bp, Artificial Sequence
  chemically synthesized
gcatggcaagaacacaacat

SEQ ID NO: 47891 - DNA, 20 bp, Artificial Sequence
  chemically synthesized
tgtgtgtgtctgtgcatggc

SEQ ID NO: 47892 - DNA, 20 bp, Artificial Sequence
  chemically synthesized
tgttgtgttcttgccatgca

SEQ ID NO: 47893 - DNA, 20 bp, Artificial Sequence
  chemically synthesized
cttttgtgtgtgtctgtgca

SEQ ID NO: 47894 - DNA, 20 bp, Artificial Sequence
  chemically synthesized
ccatgcacagacacacacaa

SEQ ID NO: 47895 - DNA, 20 bp, Artificial Sequence
  chemically synthesized
cacagacacacacaaaagca

SEQ ID NO: 47896 - DNA, 20 bp, Artificial Sequence
  chemically synthesized
acagacacacacaaaagcaa

SEQ ID NO: 47897 - DNA, 20 bp, Artificial Sequence
  chemically synthesized
cagacacacacaaaagcaaa

SEQ ID NO: 47898 - DNA, 20 bp, Artificial Sequence
  chemically synthesized
aaagggacacaaaacttttg

SEQ ID NO: 47899 - DNA, 20 bp, Artificial Sequence
  chemically synthesized
aagggacacaaaacttttgt

SEQ ID NO: 47900 - DNA, 20 bp, Artificial Sequence
  chemically synthesized
aacatattcattacctacaa

SEQ ID NO: 47901 - DNA, 20 bp, Artificial Sequence
  chemically synthesized
atgaatatgttcgttatctt

SEQ ID NO: 47902 - DNA, 20 bp, Artificial Sequence
  chemically synthesized
ctattgccacagtcaaacta

SEQ ID NO: 47903 - DNA, 20 bp, Artificial Sequence
  chemically synthesized
cgttatctttagtttgactg

SEQ ID NO: 47904 - DNA, 20 bp, Artificial Sequence
  chemically synthesized
ctttagtttgactgtggcaa

SEQ ID NO: 47905 - DNA, 20 bp, Artificial Sequence
  chemically synthesized
cacccaagatactattgcca

SEQ ID NO: 47906 - DNA, 20 bp, Artificial Sequence
  chemically synthesized
tgactgtggcaatagtatct

SEQ ID NO: 47907 - DNA, 20 bp, Artificial Sequence
  chemically synthesized
gactgtggcaatagtatctt

SEQ ID NO: 47908 - DNA, 20 bp, Artificial Sequence
  chemically synthesized
ttggacatatgtatacaccc

SEQ ID NO: 47909 - DNA, 20 bp, Artificial Sequence
  chemically synthesized
tatatgtaatttggtaagtt

SEQ ID NO: 47910 - DNA, 20 bp, Artificial Sequence
  chemically synthesized
tttaatatatgtaatttggt

SEQ ID NO: 47911 - DNA, 20 bp, Artificial Sequence
  chemically synthesized
catatttaatatatgtaatt

SEQ ID NO: 47912 - DNA, 20 bp, Artificial Sequence
  chemically synthesized
tttgcatataattatacccc

SEQ ID NO: 47913 - DNA, 20 bp, Artificial Sequence
  chemically synthesized
catataattataccccaaga

SEQ ID NO: 47914 - DNA, 20 bp, Artificial Sequence
  chemically synthesized
gtacttttatagctttcttg

SEQ ID NO: 47915 - DNA, 20 bp, Artificial Sequence
  chemically synthesized
tgtacttttatagctttctt

SEQ ID NO: 47916 - DNA, 20 bp, Artificial Sequence
  chemically synthesized
ttgtacttttatagctttct

SEQ ID NO: 47917 - DNA, 20 bp, Artificial Sequence
  chemically synthesized
ataccccaagaaagctataa

SEQ ID NO: 47918 - DNA, 20 bp, Artificial Sequence
  chemically synthesized
tttttttttttgtactttta

SEQ ID NO: 47919 - DNA, 20 bp, Artificial Sequence
  chemically synthesized
taaaagtacaaaaaaaaaaa

SEQ ID NO: 47920 - DNA, 20 bp, Artificial Sequence
  chemically synthesized
gtacaaaaaaaaaaaaagat

SEQ ID NO: 47921 - DNA, 20 bp, Artificial Sequence
  chemically synthesized
aaaaaaaaaaaagatgagta

SEQ ID NO: 47922 - DNA, 20 bp, Artificial Sequence
  chemically synthesized
aaaaaaaaagatgagtacag

SEQ ID NO: 47923 - DNA, 20 bp, Artificial Sequence
  chemically synthesized
aaaaaaagatgagtacagtg

SEQ ID NO: 47924 - DNA, 20 bp, Artificial Sequence
  chemically synthesized
aaaaaagatgagtacagtgg

SEQ ID NO: 47925 - DNA, 20 bp, Artificial Sequence
  chemically synthesized
agtacagtggaggaaaacaa

SEQ ID NO: 47926 - DNA, 20 bp, Artificial Sequence
  chemically synthesized
gtacagtggaggaaaacaaa

SEQ ID NO: 47927 - DNA, 20 bp, Artificial Sequence
  chemically synthesized
tacagtggaggaaaacaaaa

SEQ ID NO: 47928 - DNA, 20 bp, Artificial Sequence
  chemically synthesized
aaacaaaagggaatgtaccc

SEQ ID NO: 47929 - DNA, 20 bp, Artificial Sequence
  chemically synthesized
ccatttgggggcatttgcca

SEQ ID NO: 47930 - DNA, 20 bp, Artificial Sequence
  chemically synthesized
gccatttgggggcatttgcc

SEQ ID NO: 47931 - DNA, 20 bp, Artificial Sequence
  chemically synthesized
cgccatttgggggcatttgc

SEQ ID NO: 47932 - DNA, 20 bp, Artificial Sequence
  chemically synthesized
ccctggcaaatgcccccaaa

SEQ ID NO: 47933 - DNA, 20 bp, Artificial Sequence
  chemically synthesized
ctactgccaccgccatttgg

SEQ ID NO: 47934 - DNA, 20 bp, Artificial Sequence
  chemically synthesized
tggcaaatgcccccaaatgg

SEQ ID NO: 47935 - DNA, 20 bp, Artificial Sequence
  chemically synthesized
tctactgccaccgccatttg

SEQ ID NO: 47936 - DNA, 20 bp, Artificial Sequence
  chemically synthesized
ttctactgccaccgccattt

SEQ ID NO: 47937 - DNA, 20 bp, Artificial Sequence
  chemically synthesized
gttctactgccaccgccatt

SEQ ID NO: 47938 - DNA, 20 bp, Artificial Sequence
  chemically synthesized
caaatgcccccaaatggcgg

SEQ ID NO: 47939 - DNA, 20 bp, Artificial Sequence
  chemically synthesized
atgcccccaaatggcggtgg

SEQ ID NO: 47940 - DNA, 20 bp, Artificial Sequence
  chemically synthesized
cccccaaatggcggtggcag

SEQ ID NO: 47941 - DNA, 20 bp, Artificial Sequence
  chemically synthesized
tggcagtagaactgctgtca

SEQ ID NO: 47942 - DNA, 20 bp, Artificial Sequence
  chemically synthesized
gtattatttttctttgacag

SEQ ID NO: 47943 - DNA, 20 bp, Artificial Sequence
  chemically synthesized
tctgtattatttttctttga

SEQ ID NO: 47944 - DNA, 20 bp, Artificial Sequence
  chemically synthesized
gctgtcaaagaaaaataata

SEQ ID NO: 47945 - DNA, 20 bp, Artificial Sequence
  chemically synthesized
gtcaaagaaaaataatacag

SEQ ID NO: 47946 - DNA, 20 bp, Artificial Sequence
  chemically synthesized
aagaaaaataatacagaagc

SEQ ID NO: 47947 - DNA, 20 bp, Artificial Sequence
  chemically synthesized
ataatacagaagctagaata

SEQ ID NO: 47948 - DNA, 20 bp, Artificial Sequence
  chemically synthesized
tgtttcatcccactttattc

SEQ ID NO: 47949 - DNA, 20 bp, Artificial Sequence
  chemically synthesized
atacagaagctagaataaag

SEQ ID NO: 47950 - DNA, 20 bp, Artificial Sequence
  chemically synthesized
tacagaagctagaataaagt

SEQ ID NO: 47951 - DNA, 20 bp, Artificial Sequence
  chemically synthesized
aataaagtgggatgaaacac

SEQ ID NO: 47952 - DNA, 20 bp, Artificial Sequence
  chemically synthesized
agtgggatgaaacacaagaa

SEQ ID NO: 47953 - DNA, 20 bp, Artificial Sequence
  chemically synthesized
gatgaaacacaagaacagcc

SEQ ID NO: 47954 - DNA, 20 bp, Artificial Sequence
  chemically synthesized
aaacacaagaacagcctagc

SEQ ID NO: 47955 - DNA, 20 bp, Artificial Sequence
  chemically synthesized
ttgcttatacttcaccagct

SEQ ID NO: 47956 - DNA, 20 bp, Artificial Sequence
  chemically synthesized
caagaacagcctagctggtg

SEQ ID NO: 47957 - DNA, 20 bp, Artificial Sequence
  chemically synthesized
attgcttatacttcaccagc

SEQ ID NO: 47958 - DNA, 20 bp, Artificial Sequence
  chemically synthesized
aagaattgcttatacttcac

SEQ ID NO: 47959 - DNA, 20 bp, Artificial Sequence
  chemically synthesized
cagcctagctggtgaagtat

SEQ ID NO: 47960 - DNA, 20 bp, Artificial Sequence
  chemically synthesized
gtgaagtataagcaattctt

SEQ ID NO: 47961 - DNA, 20 bp, Artificial Sequence
  chemically synthesized
acccttagtctgtcaggctc

SEQ ID NO: 47962 - DNA, 20 bp, Artificial Sequence
  chemically synthesized
taagcaattcttgagcctga

SEQ ID NO: 47963 - DNA, 20 bp, Artificial Sequence
  chemically synthesized
ttctacacccttagtctgtc

SEQ ID NO: 47964 - DNA, 20 bp, Artificial Sequence
  chemically synthesized
attcttgagcctgacagact

SEQ ID NO: 47965 - DNA, 20 bp, Artificial Sequence
  chemically synthesized
cttctacacccttagtctgt

SEQ ID NO: 47966 - DNA, 20 bp, Artificial Sequence
  chemically synthesized
ttcttgagcctgacagacta

SEQ ID NO: 47967 - DNA, 20 bp, Artificial Sequence
  chemically synthesized
tcttgagcctgacagactaa

SEQ ID NO: 47968 - DNA, 20 bp, Artificial Sequence
  chemically synthesized
agcctgacagactaagggtg

SEQ ID NO: 47969 - DNA, 20 bp, Artificial Sequence
  chemically synthesized
atcttcttcttctacaccct

SEQ ID NO: 47970 - DNA, 20 bp, Artificial Sequence
  chemically synthesized
ctgacagactaagggtgtag

SEQ ID NO: 47971 - DNA, 20 bp, Artificial Sequence
  chemically synthesized
acagactaagggtgtagaag

SEQ ID NO: 47972 - DNA, 20 bp, Artificial Sequence
  chemically synthesized
gactaagggtgtagaagaag

SEQ ID NO: 47973 - DNA, 20 bp, Artificial Sequence
  chemically synthesized
ttgaggtcaccagtgatcgt

SEQ ID NO: 47974 - DNA, 20 bp, Artificial Sequence
  chemically synthesized
gtatttgatcccacgatcac

SEQ ID NO: 47975 - DNA, 20 bp, Artificial Sequence
  chemically synthesized
tttgaggtcaccagtgatcg

SEQ ID NO: 47976 - DNA, 20 bp, Artificial Sequence
  chemically synthesized
aattgcccttttgaggtcac

SEQ ID NO: 47977 - DNA, 20 bp, Artificial Sequence
  chemically synthesized
acgatcactggtgacctcaa

SEQ ID NO: 47978 - DNA, 20 bp, Artificial Sequence
  chemically synthesized
cgatcactggtgacctcaaa

SEQ ID NO: 47979 - DNA, 20 bp, Artificial Sequence
  chemically synthesized
gatcactggtgacctcaaaa

SEQ ID NO: 47980 - DNA, 20 bp, Artificial Sequence
  chemically synthesized
agtgtgaaattgcccttttg

SEQ ID NO: 47981 - DNA, 20 bp, Artificial Sequence
  chemically synthesized
tagtgtgaaattgccctttt

SEQ ID NO: 47982 - DNA, 20 bp, Artificial Sequence
  chemically synthesized
tcaaaagggcaatttcacac

SEQ ID NO: 47983 - DNA, 20 bp, Artificial Sequence
  chemically synthesized
ggcaatttcacactagtgat

SEQ ID NO: 47984 - DNA, 20 bp, Artificial Sequence
  chemically synthesized
caatttcacactagtgatca

SEQ ID NO: 47985 - DNA, 20 bp, Artificial Sequence
  chemically synthesized
ctccttcagcctctgatcac

SEQ ID NO: 47986 - DNA, 20 bp, Artificial Sequence
  chemically synthesized
aatttcacactagtgatcag

SEQ ID NO: 47987 - DNA, 20 bp, Artificial Sequence
  chemically synthesized
acactagtgatcagaggctg

SEQ ID NO: 47988 - DNA, 20 bp, Artificial Sequence
  chemically synthesized
cactagtgatcagaggctga

SEQ ID NO: 47989 - DNA, 20 bp, Artificial Sequence
  chemically synthesized
ctagtgatcagaggctgaag

SEQ ID NO: 47990 - DNA, 20 bp, Artificial Sequence
  chemically synthesized
tagtgatcagaggctgaagg

SEQ ID NO: 47991 - DNA, 20 bp, Artificial Sequence
  chemically synthesized
agtgatcagaggctgaagga

SEQ ID NO: 47992 - DNA, 20 bp, Artificial Sequence
  chemically synthesized
tgatcagaggctgaaggagg

SEQ ID NO: 47993 - DNA, 20 bp, Artificial Sequence
  chemically synthesized
cctccgtctactccctcctt

SEQ ID NO: 47994 - DNA, 20 bp, Artificial Sequence
  chemically synthesized
tcagaggctgaaggagggag

SEQ ID NO: 47995 - DNA, 20 bp, Artificial Sequence
  chemically synthesized
aggctgaaggagggagtaga

SEQ ID NO: 47996 - DNA, 20 bp, Artificial Sequence
  chemically synthesized
gctgaaggagggagtagacg

SEQ ID NO: 47997 - DNA, 20 bp, Artificial Sequence
  chemically synthesized
ctgaaggagggagtagacgg

SEQ ID NO: 47998 - DNA, 20 bp, Artificial Sequence
  chemically synthesized
tgaaggagggagtagacgga

SEQ ID NO: 47999 - DNA, 20 bp, Artificial Sequence
  chemically synthesized
gaaggagggagtagacggag

SEQ ID NO: 48000 - DNA, 20 bp, Artificial Sequence
  chemically synthesized
ggagggagtagacggagggg

SEQ ID NO: 48001 - DNA, 20 bp, Artificial Sequence
  chemically synthesized
ggagtagacggaggggaagc

SEQ ID NO: 48002 - DNA, 20 bp, Artificial Sequence
  chemically synthesized
cggaggggaagcaagcattt

SEQ ID NO: 48003 - DNA, 20 bp, Artificial Sequence
  chemically synthesized
aggggaagcaagcatttgag

SEQ ID NO: 48004 - DNA, 20 bp, Artificial Sequence
  chemically synthesized
tttgagaagttgtgtataaa

SEQ ID NO: 48005 - DNA, 20 bp, Artificial Sequence
  chemically synthesized
tgagaagttgtgtataaaaa

SEQ ID NO: 48006 - DNA, 20 bp, Artificial Sequence
  chemically synthesized
gagaagttgtgtataaaaag

SEQ ID NO: 48007 - DNA, 20 bp, Artificial Sequence
  chemically synthesized
tgtgtataaaaagaggaaaa

SEQ ID NO: 48008 - DNA, 20 bp, Artificial Sequence
  chemically synthesized
taaaaagaggaaaacagaaa

SEQ ID NO: 48009 - DNA, 20 bp, Artificial Sequence
  chemically synthesized
aagaggaaaacagaaatgga

SEQ ID NO: 48010 - DNA, 20 bp, Artificial Sequence
  chemically synthesized
agaggaaaacagaaatggaa

SEQ ID NO: 48011 - DNA, 20 bp, Artificial Sequence
  chemically synthesized
gaggaaaacagaaatggaaa

SEQ ID NO: 48012 - DNA, 20 bp, Artificial Sequence
  chemically synthesized
aggaaaacagaaatggaaag

SEQ ID NO: 48013 - DNA, 20 bp, Artificial Sequence
  chemically synthesized
aaggggcaacatctgattgt

SEQ ID NO: 48014 - DNA, 20 bp, Artificial Sequence
  chemically synthesized
agagagggatgaccaacaat

SEQ ID NO: 48015 - DNA, 20 bp, Artificial Sequence
  chemically synthesized
gggttacagagcacaagaga

SEQ ID NO: 48016 - DNA, 20 bp, Artificial Sequence
  chemically synthesized
tgggttacagagcacaagag

SEQ ID NO: 48017 - DNA, 20 bp, Artificial Sequence
  chemically synthesized
ctgggttacagagcacaaga

SEQ ID NO: 48018 - DNA, 20 bp, Artificial Sequence
  chemically synthesized
ggctgggttacagagcacaa

SEQ ID NO: 48019 - DNA, 20 bp, Artificial Sequence
  chemically synthesized
taggctgggttacagagcac

SEQ ID NO: 48020 - DNA, 20 bp, Artificial Sequence
  chemically synthesized
ctctcttgtgctctgtaacc

SEQ ID NO: 48021 - DNA, 20 bp, Artificial Sequence
  chemically synthesized
actgaataggctgggttaca

SEQ ID NO: 48022 - DNA, 20 bp, Artificial Sequence
  chemically synthesized
gaactgaataggctgggtta

SEQ ID NO: 48023 - DNA, 20 bp, Artificial Sequence
  chemically synthesized
tgaagtgaactgaataggct

SEQ ID NO: 48024 - DNA, 20 bp, Artificial Sequence
  chemically synthesized
gctctgtaacccagcctatt

SEQ ID NO: 48025 - DNA, 20 bp, Artificial Sequence
  chemically synthesized
atgaagtgaactgaataggc

SEQ ID NO: 48026 - DNA, 20 bp, Artificial Sequence
  chemically synthesized
agtaatgaagtgaactgaat

SEQ ID NO: 48027 - DNA, 20 bp, Artificial Sequence
  chemically synthesized
cagtaatgaagtgaactgaa

SEQ ID NO: 48028 - DNA, 20 bp, Artificial Sequence
  chemically synthesized
cctaagcaaattcagtaatg

SEQ ID NO: 48029 - DNA, 20 bp, Artificial Sequence
  chemically synthesized
aaagaaaccctaagcaaatt

SEQ ID NO: 48030 - DNA, 20 bp, Artificial Sequence
  chemically synthesized
acttcattactgaatttgct

SEQ ID NO: 48031 - DNA, 20 bp, Artificial Sequence
  chemically synthesized
cttcattactgaatttgctt

SEQ ID NO: 48032 - DNA, 20 bp, Artificial Sequence
  chemically synthesized
ttcattactgaatttgctta

SEQ ID NO: 48033 - DNA, 20 bp, Artificial Sequence
  chemically synthesized
taacgttataaagaaaccct

SEQ ID NO: 48034 - DNA, 20 bp, Artificial Sequence
  chemically synthesized
gcatataatttaacgttata

SEQ ID NO: 48035 - DNA, 20 bp, Artificial Sequence
  chemically synthesized
actttaggaaatgaaaacga

SEQ ID NO: 48036 - DNA, 20 bp, Artificial Sequence
  chemically synthesized
tctatcgttttcatttccta

SEQ ID NO: 48037 - DNA, 20 bp, Artificial Sequence
  chemically synthesized
ataatcctgattatgacttt

SEQ ID NO: 48038 - DNA, 20 bp, Artificial Sequence
  chemically synthesized
tataatcctgattatgactt

SEQ ID NO: 48039 - DNA, 20 bp, Artificial Sequence
  chemically synthesized
tcatttcctaaagtcataat

SEQ ID NO: 48040 - DNA, 20 bp, Artificial Sequence
  chemically synthesized
catttcctaaagtcataatc

SEQ ID NO: 48041 - DNA, 20 bp, Artificial Sequence
  chemically synthesized
tcataatcaggattataata

SEQ ID NO: 48042 - DNA, 20 bp, Artificial Sequence
  chemically synthesized
aggattataatacagtattt

SEQ ID NO: 48043 - DNA, 20 bp, Artificial Sequence
  chemically synthesized
acagtatttaagctttcatg

SEQ ID NO: 48044 - DNA, 20 bp, Artificial Sequence
  chemically synthesized
caacactaataactacatga

SEQ ID NO: 48045 - DNA, 20 bp, Artificial Sequence
  chemically synthesized
ttaagctttcatgtagttat

SEQ ID NO: 48046 - DNA, 20 bp, Artificial Sequence
  chemically synthesized
atacagaaaaaaattggaat

SEQ ID NO: 48047 - DNA, 20 bp, Artificial Sequence
  chemically synthesized
catacagaaaaaaattggaa

SEQ ID NO: 48048 - DNA, 20 bp, Artificial Sequence
  chemically synthesized
gaaatcatacagaaaaaaat

SEQ ID NO: 48049 - DNA, 20 bp, Artificial Sequence
  chemically synthesized
aaaagaaaatagaaatcata

SEQ ID NO: 48050 - DNA, 20 bp, Artificial Sequence
  chemically synthesized
tgcgtcacatcaaaagaaaa

SEQ ID NO: 48051 - DNA, 20 bp, Artificial Sequence
  chemically synthesized
aactatatgcgtcacatcaa

SEQ ID NO: 48052 - DNA, 20 bp, Artificial Sequence
  chemically synthesized
ttcttttgatgtgacgcata

SEQ ID NO: 48053 - DNA, 20 bp, Artificial Sequence
  chemically synthesized
tgtgacgcatatagttcctg

SEQ ID NO: 48054 - DNA, 20 bp, Artificial Sequence
  chemically synthesized
acgcatatagttcctgtagc

SEQ ID NO: 48055 - DNA, 20 bp, Artificial Sequence
  chemically synthesized
gcatatagttcctgtagcaa

SEQ ID NO: 48056 - DNA, 20 bp, Artificial Sequence
  chemically synthesized
agaaaacttactcttgctac

SEQ ID NO: 48057 - DNA, 20 bp, Artificial Sequence
  chemically synthesized
cagaaaacttactcttgcta

SEQ ID NO: 48058 - DNA, 20 bp, Artificial Sequence
  chemically synthesized
atagttcctgtagcaagagt

SEQ ID NO: 48059 - DNA, 20 bp, Artificial Sequence
  chemically synthesized
ttggcctttcatttaaatga

SEQ ID NO: 48060 - DNA, 20 bp, Artificial Sequence
  chemically synthesized
gttttctgtcatttaaatga

SEQ ID NO: 48061 - DNA, 20 bp, Artificial Sequence
  chemically synthesized
ttttctgtcatttaaatgaa

SEQ ID NO: 48062 - DNA, 20 bp, Artificial Sequence
  chemically synthesized
tgtcatttaaatgaaaggcc

SEQ ID NO: 48063 - DNA, 20 bp, Artificial Sequence
  chemically synthesized
gaaaagtgttaaatttaact

SEQ ID NO: 48064 - DNA, 20 bp, Artificial Sequence
  chemically synthesized
ttttaatttaacgttttgaa

SEQ ID NO: 48065 - DNA, 20 bp, Artificial Sequence
  chemically synthesized
tcaaaacgttaaattaaaat

SEQ ID NO: 48066 - DNA, 20 bp, Artificial Sequence
  chemically synthesized
caaaacgttaaattaaaata

SEQ ID NO: 48067 - DNA, 20 bp, Artificial Sequence
  chemically synthesized
acgttaaattaaaataagga

SEQ ID NO: 48068 - DNA, 20 bp, Artificial Sequence
  chemically synthesized
atatacgatatagacatata

SEQ ID NO: 48069 - DNA, 20 bp, Artificial Sequence
  chemically synthesized
tttacttttgatatacgata

SEQ ID NO: 48070 - DNA, 20 bp, Artificial Sequence
  chemically synthesized
atgtctatatcgtatatcaa

SEQ ID NO: 48071 - DNA, 20 bp, Artificial Sequence
  chemically synthesized
tatatcgtatatcaaaagta

SEQ ID NO: 48072 - DNA, 20 bp, Artificial Sequence
  chemically synthesized
aaagattcaatgaaaacttt

SEQ ID NO: 48073 - DNA, 20 bp, Artificial Sequence
  chemically synthesized
aagtttagtaagtgatctta

SEQ ID NO: 48074 - DNA, 20 bp, Artificial Sequence
  chemically synthesized
cccatctttgaaagtttagt

SEQ ID NO: 48075 - DNA, 20 bp, Artificial Sequence
  chemically synthesized
tctgcccatctttgaaagtt

SEQ ID NO: 48076 - DNA, 20 bp, Artificial Sequence
  chemically synthesized
gatcacttactaaactttca

SEQ ID NO: 48077 - DNA, 20 bp, Artificial Sequence
  chemically synthesized
acttactaaactttcaaaga

SEQ ID NO: 48078 - DNA, 20 bp, Artificial Sequence
  chemically synthesized
gaaagtctgcccatctttga

SEQ ID NO: 48079 - DNA, 20 bp, Artificial Sequence
  chemically synthesized
cttactaaactttcaaagat

SEQ ID NO: 48080 - DNA, 20 bp, Artificial Sequence
  chemically synthesized
actaaactttcaaagatggg

SEQ ID NO: 48081 - DNA, 20 bp, Artificial Sequence
  chemically synthesized
agatgggcagactttccata

SEQ ID NO: 48082 - DNA, 20 bp, Artificial Sequence
  chemically synthesized
gctgttgaaatctttatgga

SEQ ID NO: 48083 - DNA, 20 bp, Artificial Sequence
  chemically synthesized
ctctgctgttgaaatcttta

SEQ ID NO: 48084 - DNA, 20 bp, Artificial Sequence
  chemically synthesized
actttccataaagatttcaa

SEQ ID NO: 48085 - DNA, 20 bp, Artificial Sequence
  chemically synthesized
ttccataaagatttcaacag

SEQ ID NO: 48086 - DNA, 20 bp, Artificial Sequence
  chemically synthesized
ccataaagatttcaacagca

SEQ ID NO: 48087 - DNA, 20 bp, Artificial Sequence
  chemically synthesized
aaagatttcaacagcagaga

SEQ ID NO: 48088 - DNA, 20 bp, Artificial Sequence
  chemically synthesized
atttcaacagcagagacaga

SEQ ID NO: 48089 - DNA, 20 bp, Artificial Sequence
  chemically synthesized
tttcaacagcagagacagat

SEQ ID NO: 48090 - DNA, 20 bp, Artificial Sequence
  chemically synthesized
gagacagatgggctacattc

SEQ ID NO: 48091 - DNA, 20 bp, Artificial Sequence
  chemically synthesized
gacagatgggctacattcca

SEQ ID NO: 48092 - DNA, 20 bp, Artificial Sequence
  chemically synthesized
tgaccttcctctctggaatg

SEQ ID NO: 48093 - DNA, 20 bp, Artificial Sequence
  chemically synthesized
cagatgggctacattccaga

SEQ ID NO: 48094 - DNA, 20 bp, Artificial Sequence
  chemically synthesized
agatgggctacattccagag

SEQ ID NO: 48095 - DNA, 20 bp, Artificial Sequence
  chemically synthesized
tgggctacattccagagagg

SEQ ID NO: 48096 - DNA, 20 bp, Artificial Sequence
  chemically synthesized
gggctacattccagagagga

SEQ ID NO: 48097 - DNA, 20 bp, Artificial Sequence
  chemically synthesized
actcttgtgaccttcctctc

SEQ ID NO: 48098 - DNA, 20 bp, Artificial Sequence
  chemically synthesized
attccagagaggaaggtcac

SEQ ID NO: 48099 - DNA, 20 bp, Artificial Sequence
  chemically synthesized
tccagagaggaaggtcacaa

SEQ ID NO: 48100 - DNA, 20 bp, Artificial Sequence
  chemically synthesized
aggtcacaagagtgatgaat

SEQ ID NO: 48101 - DNA, 20 bp, Artificial Sequence
  chemically synthesized
acagctatggcagacattag

SEQ ID NO: 48102 - DNA, 20 bp, Artificial Sequence
  chemically synthesized
cacagctatggcagacatta

SEQ ID NO: 48103 - DNA, 20 bp, Artificial Sequence
  chemically synthesized
ttcacagctatggcagacat

SEQ ID NO: 48104 - DNA, 20 bp, Artificial Sequence
  chemically synthesized
gagacctctaatgtctgcca

SEQ ID NO: 48105 - DNA, 20 bp, Artificial Sequence
  chemically synthesized
aaagattttcacagctatgg

SEQ ID NO: 48106 - DNA, 20 bp, Artificial Sequence
  chemically synthesized
cataaagattttcacagcta

SEQ ID NO: 48107 - DNA, 20 bp, Artificial Sequence
  chemically synthesized
gttagccataaagattttca

SEQ ID NO: 48108 - DNA, 20 bp, Artificial Sequence
  chemically synthesized
catagctgtgaaaatcttta

SEQ ID NO: 48109 - DNA, 20 bp, Artificial Sequence
  chemically synthesized
aggaattttagttagccata

SEQ ID NO: 48110 - DNA, 20 bp, Artificial Sequence
  chemically synthesized
tattcgttaggaattttagt

SEQ ID NO: 48111 - DNA, 20 bp, Artificial Sequence
  chemically synthesized
ttgttattcgttaggaattt

SEQ ID NO: 48112 - DNA, 20 bp, Artificial Sequence
  chemically synthesized
tttacaggttgttattcgtt

SEQ ID NO: 48113 - DNA, 20 bp, Artificial Sequence
  chemically synthesized
atttacaggttgttattcgt

SEQ ID NO: 48114 - DNA, 20 bp, Artificial Sequence
  chemically synthesized
acagctcatataatatttac

SEQ ID NO: 48115 - DNA, 20 bp, Artificial Sequence
  chemically synthesized
gacagctcatataatattta

SEQ ID NO: 48116 - DNA, 20 bp, Artificial Sequence
  chemically synthesized
acaacctgtaaatattatat

SEQ ID NO: 48117 - DNA, 20 bp, Artificial Sequence
  chemically synthesized
gtaaatattatatgagctgt

SEQ ID NO: 48118 - DNA, 20 bp, Artificial Sequence
  chemically synthesized
atattatatgagctgtcaga

SEQ ID NO: 48119 - DNA, 20 bp, Artificial Sequence
  chemically synthesized
gctcagcattatctgtctga

SEQ ID NO: 48120 - DNA, 20 bp, Artificial Sequence
  chemically synthesized
gctgtcagacagataatgct

SEQ ID NO: 48121 - DNA, 20 bp, Artificial Sequence
  chemically synthesized
gacagataatgctgagctct

SEQ ID NO: 48122 - DNA, 20 bp, Artificial Sequence
  chemically synthesized
tgtgcaatggtctcagagct

SEQ ID NO: 48123 - DNA, 20 bp, Artificial Sequence
  chemically synthesized
caccatgtgcaatggtctca

SEQ ID NO: 48124 - DNA, 20 bp, Artificial Sequence
  chemically synthesized
ttcaccatgtgcaatggtct

SEQ ID NO: 48125 - DNA, 20 bp, Artificial Sequence
  chemically synthesized
agctctgagaccattgcaca

SEQ ID NO: 48126 - DNA, 20 bp, Artificial Sequence
  chemically synthesized
attctgttcaccatgtgcaa

SEQ ID NO: 48127 - DNA, 20 bp, Artificial Sequence
  chemically synthesized
agaccattgcacatggtgaa

SEQ ID NO: 48128 - DNA, 20 bp, Artificial Sequence
  chemically synthesized
gtgaacagaataccacacca

SEQ ID NO: 48129 - DNA, 20 bp, Artificial Sequence
  chemically synthesized
tgaacagaataccacaccat

SEQ ID NO: 48130 - DNA, 20 bp, Artificial Sequence
  chemically synthesized
tactgacaaatcccatggtg

SEQ ID NO: 48131 - DNA, 20 bp, Artificial Sequence
  chemically synthesized
caatctactgacaaatccca

SEQ ID NO: 48132 - DNA, 20 bp, Artificial Sequence
  chemically synthesized
taccacaccatgggatttgt

SEQ ID NO: 48133 - DNA, 20 bp, Artificial Sequence
  chemically synthesized
cacaccatgggatttgtcag

SEQ ID NO: 48134 - DNA, 20 bp, Artificial Sequence
  chemically synthesized
ggatttgtcagtagattgcc

SEQ ID NO: 48135 - DNA, 20 bp, Artificial Sequence
  chemically synthesized
cagtagattgccaagtcatt

SEQ ID NO: 48136 - DNA, 20 bp, Artificial Sequence
  chemically synthesized
gcctgatactctaaatgact

SEQ ID NO: 48137 - DNA, 20 bp, Artificial Sequence
  chemically synthesized
gtagattgccaagtcattta

SEQ ID NO: 48138 - DNA, 20 bp, Artificial Sequence
  chemically synthesized
tgccaagtcatttagagtat

SEQ ID NO: 48139 - DNA, 20 bp, Artificial Sequence
  chemically synthesized
gccaagtcatttagagtatc

SEQ ID NO: 48140 - DNA, 20 bp, Artificial Sequence
  chemically synthesized
tgacttcccagatcaaatgt

SEQ ID NO: 48141 - DNA, 20 bp, Artificial Sequence
  chemically synthesized
tatcaggctcacatttgatc

SEQ ID NO: 48142 - DNA, 20 bp, Artificial Sequence
  chemically synthesized
atcaggctcacatttgatct

SEQ ID NO: 48143 - DNA, 20 bp, Artificial Sequence
  chemically synthesized
aggctcacatttgatctggg

SEQ ID NO: 48144 - DNA, 20 bp, Artificial Sequence
  chemically synthesized
cacatttgatctgggaagtc

SEQ ID NO: 48145 - DNA, 20 bp, Artificial Sequence
  chemically synthesized
agtatgaactcttgacttcc

SEQ ID NO: 48146 - DNA, 20 bp, Artificial Sequence
  chemically synthesized
catttgatctgggaagtcaa

SEQ ID NO: 48147 - DNA, 20 bp, Artificial Sequence
  chemically synthesized
agagttcatactaaaattct

SEQ ID NO: 48148 - DNA, 20 bp, Artificial Sequence
  chemically synthesized
agtcaccttgccaagaattt

SEQ ID NO: 48149 - DNA, 20 bp, Artificial Sequence
  chemically synthesized
ttcatactaaaattcttggc

SEQ ID NO: 48150 - DNA, 20 bp, Artificial Sequence
  chemically synthesized
tcatactaaaattcttggca

SEQ ID NO: 48151 - DNA, 20 bp, Artificial Sequence
  chemically synthesized
tgcaactcagtcaccttgcc

SEQ ID NO: 48152 - DNA, 20 bp, Artificial Sequence
  chemically synthesized
aaattcttggcaaggtgact

SEQ ID NO: 48153 - DNA, 20 bp, Artificial Sequence
  chemically synthesized
ttggcaaggtgactgagttg

SEQ ID NO: 48154 - DNA, 20 bp, Artificial Sequence
  chemically synthesized
ggcaaggtgactgagttgca

SEQ ID NO: 48155 - DNA, 20 bp, Artificial Sequence
  chemically synthesized
atagttttatctctgcaact

SEQ ID NO: 48156 - DNA, 20 bp, Artificial Sequence
  chemically synthesized
tcagcactggatattagata

SEQ ID NO: 48157 - DNA, 20 bp, Artificial Sequence
  chemically synthesized
ataaaactatatctaatatc

SEQ ID NO: 48158 - DNA, 20 bp, Artificial Sequence
  chemically synthesized
cagccatcagcactggatat

SEQ ID NO: 48159 - DNA, 20 bp, Artificial Sequence
  chemically synthesized
tatctaatatccagtgctga

SEQ ID NO: 48160 - DNA, 20 bp, Artificial Sequence
  chemically synthesized
gactgtgcagccatcagcac

SEQ ID NO: 48161 - DNA, 20 bp, Artificial Sequence
  chemically synthesized
ttgtgtgactgtgcagccat

SEQ ID NO: 48162 - DNA, 20 bp, Artificial Sequence
  chemically synthesized
atccagtgctgatggctgca

SEQ ID NO: 48163 - DNA, 20 bp, Artificial Sequence
  chemically synthesized
ttagactttgtgtgactgtg

SEQ ID NO: 48164 - DNA, 20 bp, Artificial Sequence
  chemically synthesized
gatggctgcacagtcacaca

SEQ ID NO: 48165 - DNA, 20 bp, Artificial Sequence
  chemically synthesized
cacagtcacacaaagtctaa

SEQ ID NO: 48166 - DNA, 20 bp, Artificial Sequence
  chemically synthesized
cacacaaagtctaatagcca

SEQ ID NO: 48167 - DNA, 20 bp, Artificial Sequence
  chemically synthesized
tgccgcccaactttggctat

SEQ ID NO: 48168 - DNA, 20 bp, Artificial Sequence
  chemically synthesized
caaagtctaatagccaaagt

SEQ ID NO: 48169 - DNA, 20 bp, Artificial Sequence
  chemically synthesized
aaagtctaatagccaaagtt

SEQ ID NO: 48170 - DNA, 20 bp, Artificial Sequence
  chemically synthesized
tgagtaatgccgcccaactt

SEQ ID NO: 48171 - DNA, 20 bp, Artificial Sequence
  chemically synthesized
gtctaatagccaaagttggg

SEQ ID NO: 48172 - DNA, 20 bp, Artificial Sequence
  chemically synthesized
tttttctttttttttttcat

SEQ ID NO: 48173 - DNA, 20 bp, Artificial Sequence
  chemically synthesized
cattactcatgaaaaaaaaa

SEQ ID NO: 48174 - DNA, 20 bp, Artificial Sequence
  chemically synthesized
tgaaaaaaaaaaagaaaaaa

SEQ ID NO: 48175 - DNA, 20 bp, Artificial Sequence
  chemically synthesized
ttctataagtcggttagaag

SEQ ID NO: 48176 - DNA, 20 bp, Artificial Sequence
  chemically synthesized
gttttctataagtcggttag

SEQ ID NO: 48177 - DNA, 20 bp, Artificial Sequence
  chemically synthesized
gaagttttctataagtcggt

SEQ ID NO: 48178 - DNA, 20 bp, Artificial Sequence
  chemically synthesized
agctgcttctaaccgactta

SEQ ID NO: 48179 - DNA, 20 bp, Artificial Sequence
  chemically synthesized
ttttgaagttttctataagt

SEQ ID NO: 48180 - DNA, 20 bp, Artificial Sequence
  chemically synthesized
atgtttttgaagttttctat

SEQ ID NO: 48181 - DNA, 20 bp, Artificial Sequence
  chemically synthesized
taatcaccgtgatgtttttg

SEQ ID NO: 48182 - DNA, 20 bp, Artificial Sequence
  chemically synthesized
agaaaacttcaaaaacatca

SEQ ID NO: 48183 - DNA, 20 bp, Artificial Sequence
  chemically synthesized
aaaaacatcacggtgattat

SEQ ID NO: 48184 - DNA, 20 bp, Artificial Sequence
  chemically synthesized
aacatcacggtgattattag

SEQ ID NO: 48185 - DNA, 20 bp, Artificial Sequence
  chemically synthesized
catcacggtgattattagaa

SEQ ID NO: 48186 - DNA, 20 bp, Artificial Sequence
  chemically synthesized
acggtgattattagaagagt

SEQ ID NO: 48187 - DNA, 20 bp, Artificial Sequence
  chemically synthesized
tgattattagaagagtaaga

SEQ ID NO: 48188 - DNA, 20 bp, Artificial Sequence
  chemically synthesized
agaagagtaagaaagcaatc

SEQ ID NO: 48189 - DNA, 20 bp, Artificial Sequence
  chemically synthesized
agaaagcaatcaagcttcct

SEQ ID NO: 48190 - DNA, 20 bp, Artificial Sequence
  chemically synthesized
gaaagcaatcaagcttccta

SEQ ID NO: 48191 - DNA, 20 bp, Artificial Sequence
  chemically synthesized
ttcctatatctgaccttagg

SEQ ID NO: 48192 - DNA, 20 bp, Artificial Sequence
  chemically synthesized
gcaatcaagcttcctaaggt

SEQ ID NO: 48193 - DNA, 20 bp, Artificial Sequence
  chemically synthesized
atcttcctatatctgacctt

SEQ ID NO: 48194 - DNA, 20 bp, Artificial Sequence
  chemically synthesized
tatcttcctatatctgacct

SEQ ID NO: 48195 - DNA, 20 bp, Artificial Sequence
  chemically synthesized
aagcttcctaaggtcagata

SEQ ID NO: 48196 - DNA, 20 bp, Artificial Sequence
  chemically synthesized
agcttcctaaggtcagatat

SEQ ID NO: 48197 - DNA, 20 bp, Artificial Sequence
  chemically synthesized
ttcctaaggtcagatatagg

SEQ ID NO: 48198 - DNA, 20 bp, Artificial Sequence
  chemically synthesized
taaggtcagatataggaaga

SEQ ID NO: 48199 - DNA, 20 bp, Artificial Sequence
  chemically synthesized
aagatagatacctacataaa

SEQ ID NO: 48200 - DNA, 20 bp, Artificial Sequence
  chemically synthesized
attcatggctctatttatgt

SEQ ID NO: 48201 - DNA, 20 bp, Artificial Sequence
  chemically synthesized
tattcatggctctatttatg

SEQ ID NO: 48202 - DNA, 20 bp, Artificial Sequence
  chemically synthesized
gatagatacctacataaata

SEQ ID NO: 48203 - DNA, 20 bp, Artificial Sequence
  chemically synthesized
ccttgagcataaattattca

SEQ ID NO: 48204 - DNA, 20 bp, Artificial Sequence
  chemically synthesized
gccatgaataatttatgctc

SEQ ID NO: 48205 - DNA, 20 bp, Artificial Sequence
  chemically synthesized
ccatgaataatttatgctca

SEQ ID NO: 48206 - DNA, 20 bp, Artificial Sequence
  chemically synthesized
aatttactcgaaaattcctt

SEQ ID NO: 48207 - DNA, 20 bp, Artificial Sequence
  chemically synthesized
tttatgctcaaggaattttc

SEQ ID NO: 48208 - DNA, 20 bp, Artificial Sequence
  chemically synthesized
cgagtaaattcgaacataat

SEQ ID NO: 48209 - DNA, 20 bp, Artificial Sequence
  chemically synthesized
aagttccctggtaatgcagt

SEQ ID NO: 48210 - DNA, 20 bp, Artificial Sequence
  chemically synthesized
taattggctgactgcattac

SEQ ID NO: 48211 - DNA, 20 bp, Artificial Sequence
  chemically synthesized
aattggctgactgcattacc

SEQ ID NO: 48212 - DNA, 20 bp, Artificial Sequence
  chemically synthesized
aggaaagttccctggtaatg

SEQ ID NO: 48213 - DNA, 20 bp, Artificial Sequence
  chemically synthesized
attggctgactgcattacca

SEQ ID NO: 48214 - DNA, 20 bp, Artificial Sequence
  chemically synthesized
ttacctggaggaaagttccc

SEQ ID NO: 48215 - DNA, 20 bp, Artificial Sequence
  chemically synthesized
attaccagggaactttcctc

SEQ ID NO: 48216 - DNA, 20 bp, Artificial Sequence
  chemically synthesized
ttaccagggaactttcctcc

SEQ ID NO: 48217 - DNA, 20 bp, Artificial Sequence
  chemically synthesized
aaccaccattacctggagga

SEQ ID NO: 48218 - DNA, 20 bp, Artificial Sequence
  chemically synthesized
ctgtaaccaccattacctgg

SEQ ID NO: 48219 - DNA, 20 bp, Artificial Sequence
  chemically synthesized
gggaactttcctccaggtaa

SEQ ID NO: 48220 - DNA, 20 bp, Artificial Sequence
  chemically synthesized
actgtaaccaccattacctg

SEQ ID NO: 48221 - DNA, 20 bp, Artificial Sequence
  chemically synthesized
agactgtaaccaccattacc

SEQ ID NO: 48222 - DNA, 20 bp, Artificial Sequence
  chemically synthesized
aactttcctccaggtaatgg

SEQ ID NO: 48223 - DNA, 20 bp, Artificial Sequence
  chemically synthesized
cctccaggtaatggtggtta

SEQ ID NO: 48224 - DNA, 20 bp, Artificial Sequence
  chemically synthesized
gtaatggtggttacagtctt

SEQ ID NO: 48225 - DNA, 20 bp, Artificial Sequence
  chemically synthesized
taatggtggttacagtcttt

SEQ ID NO: 48226 - DNA, 20 bp, Artificial Sequence
  chemically synthesized
gacttaacccagatggccca

SEQ ID NO: 48227 - DNA, 20 bp, Artificial Sequence
  chemically synthesized
gttacagtctttgggccatc

SEQ ID NO: 48228 - DNA, 20 bp, Artificial Sequence
  chemically synthesized
ttacagtctttgggccatct

SEQ ID NO: 48229 - DNA, 20 bp, Artificial Sequence
  chemically synthesized
gtaacctgacttaacccaga

SEQ ID NO: 48230 - DNA, 20 bp, Artificial Sequence
  chemically synthesized
gtctttgggccatctgggtt

SEQ ID NO: 48231 - DNA, 20 bp, Artificial Sequence
  chemically synthesized
gttagtaacctgacttaacc

SEQ ID NO: 48232 - DNA, 20 bp, Artificial Sequence
  chemically synthesized
ttgggccatctgggttaagt

SEQ ID NO: 48233 - DNA, 20 bp, Artificial Sequence
  chemically synthesized
tgggccatctgggttaagtc

SEQ ID NO: 48234 - DNA, 20 bp, Artificial Sequence
  chemically synthesized
ggttaagtcaggttactaac

SEQ ID NO: 48235 - DNA, 20 bp, Artificial Sequence
  chemically synthesized
gcgatattgcattgacttgt

SEQ ID NO: 48236 - DNA, 20 bp, Artificial Sequence
  chemically synthesized
acaagtcaatgcaatatcgc

SEQ ID NO: 48237 - DNA, 20 bp, Artificial Sequence
  chemically synthesized
caagtcaatgcaatatcgcc

SEQ ID NO: 48238 - DNA, 20 bp, Artificial Sequence
  chemically synthesized
gcagagacagtaaaggcacc

SEQ ID NO: 48239 - DNA, 20 bp, Artificial Sequence
  chemically synthesized
tacatctgcagagacagtaa

SEQ ID NO: 48240 - DNA, 20 bp, Artificial Sequence
  chemically synthesized
gtacatctgcagagacagta

SEQ ID NO: 48241 - DNA, 20 bp, Artificial Sequence
  chemically synthesized
aggtgcctttactgtctctg

SEQ ID NO: 48242 - DNA, 20 bp, Artificial Sequence
  chemically synthesized
taaaagtacatctgcagaga

SEQ ID NO: 48243 - DNA, 20 bp, Artificial Sequence
  chemically synthesized
cttttaaaagtacatctgca

SEQ ID NO: 48244 - DNA, 20 bp, Artificial Sequence
  chemically synthesized
gtcttttaaaagtacatctg

SEQ ID NO: 48245 - DNA, 20 bp, Artificial Sequence
  chemically synthesized
ctctgcagatgtacttttaa

SEQ ID NO: 48246 - DNA, 20 bp, Artificial Sequence
  chemically synthesized
gactgcctgtcgtcttttaa

SEQ ID NO: 48247 - DNA, 20 bp, Artificial Sequence
  chemically synthesized
gatgtacttttaaaagacga

SEQ ID NO: 48248 - DNA, 20 bp, Artificial Sequence
  chemically synthesized
atgtacttttaaaagacgac

SEQ ID NO: 48249 - DNA, 20 bp, Artificial Sequence
  chemically synthesized
tacttttaaaagacgacagg

SEQ ID NO: 48250 - DNA, 20 bp, Artificial Sequence
  chemically synthesized
agagcgttcagcaaatggtg

SEQ ID NO: 48251 - DNA, 20 bp, Artificial Sequence
  chemically synthesized
cacagagagcgttcagcaaa

SEQ ID NO: 48252 - DNA, 20 bp, Artificial Sequence
  chemically synthesized
cctttcacacagagagcgtt

SEQ ID NO: 48253 - DNA, 20 bp, Artificial Sequence
  chemically synthesized
tacaatacctttcacacaga

SEQ ID NO: 48254 - DNA, 20 bp, Artificial Sequence
  chemically synthesized
gctgaacgctctctgtgtga

SEQ ID NO: 48255 - DNA, 20 bp, Artificial Sequence
  chemically synthesized
aatacaatacctttcacaca

SEQ ID NO: 48256 - DNA, 20 bp, Artificial Sequence
  chemically synthesized
ctgaacgctctctgtgtgaa

SEQ ID NO: 48257 - DNA, 20 bp, Artificial Sequence
  chemically synthesized
ctaatacaatacctttcaca

SEQ ID NO: 48258 - DNA, 20 bp, Artificial Sequence
  chemically synthesized
ctgtgtgaaaggtattgtat

SEQ ID NO: 48259 - DNA, 20 bp, Artificial Sequence
  chemically synthesized
tgtgtgaaaggtattgtatt

SEQ ID NO: 48260 - DNA, 20 bp, Artificial Sequence
  chemically synthesized
aaaggtattgtattaggcac

SEQ ID NO: 48261 - DNA, 20 bp, Artificial Sequence
  chemically synthesized
aaggtattgtattaggcacc

SEQ ID NO: 48262 - DNA, 20 bp, Artificial Sequence
  chemically synthesized
aggtattgtattaggcacca

SEQ ID NO: 48263 - DNA, 20 bp, Artificial Sequence
  chemically synthesized
tactttccttgaaatttccc

SEQ ID NO: 48264 - DNA, 20 bp, Artificial Sequence
  chemically synthesized
ttaggcaccagggaaatttc

SEQ ID NO: 48265 - DNA, 20 bp, Artificial Sequence
  chemically synthesized
taggcaccagggaaatttca

SEQ ID NO: 48266 - DNA, 20 bp, Artificial Sequence
  chemically synthesized
caccagggaaatttcaagga

SEQ ID NO: 48267 - DNA, 20 bp, Artificial Sequence
  chemically synthesized
gaaagtaaaatttgaaacct

SEQ ID NO: 48268 - DNA, 20 bp, Artificial Sequence
  chemically synthesized
gtaaaatttgaaacctgaga

SEQ ID NO: 48269 - DNA, 20 bp, Artificial Sequence
  chemically synthesized
aaatttgaaacctgagacag

SEQ ID NO: 48270 - DNA, 20 bp, Artificial Sequence
  chemically synthesized
gagttgctccctactgtctc

SEQ ID NO: 48271 - DNA, 20 bp, Artificial Sequence
  chemically synthesized
aatttgaaacctgagacagt

SEQ ID NO: 48272 - DNA, 20 bp, Artificial Sequence
  chemically synthesized
tgagttgctccctactgtct

SEQ ID NO: 48273 - DNA, 20 bp, Artificial Sequence
  chemically synthesized
atttgaaacctgagacagta

SEQ ID NO: 48274 - DNA, 20 bp, Artificial Sequence
  chemically synthesized
ttgaaacctgagacagtagg

SEQ ID NO: 48275 - DNA, 20 bp, Artificial Sequence
  chemically synthesized
tgagacagtagggagcaact

SEQ ID NO: 48276 - DNA, 20 bp, Artificial Sequence
  chemically synthesized
tcatttggtttttaatatct

SEQ ID NO: 48277 - DNA, 20 bp, Artificial Sequence
  chemically synthesized
acatcccatctatgatcatt

SEQ ID NO: 48278 - DNA, 20 bp, Artificial Sequence
  chemically synthesized
tattaaaaaccaaatgatca

SEQ ID NO: 48279 - DNA, 20 bp, Artificial Sequence
  chemically synthesized
aaaaaccaaatgatcataga

SEQ ID NO: 48280 - DNA, 20 bp, Artificial Sequence
  chemically synthesized
aaaaccaaatgatcatagat

SEQ ID NO: 48281 - DNA, 20 bp, Artificial Sequence
  chemically synthesized
tagatgggatgtacatccat

SEQ ID NO: 48282 - DNA, 20 bp, Artificial Sequence
  chemically synthesized
tgggatgtacatccattaga

SEQ ID NO: 48283 - DNA, 20 bp, Artificial Sequence
  chemically synthesized
tcactcttctcgctttctaa

SEQ ID NO: 48284 - DNA, 20 bp, Artificial Sequence
  chemically synthesized
atgtacatccattagaaagc

SEQ ID NO: 48285 - DNA, 20 bp, Artificial Sequence
  chemically synthesized
tacatccattagaaagcgag

SEQ ID NO: 48286 - DNA, 20 bp, Artificial Sequence
  chemically synthesized
catccattagaaagcgagaa

SEQ ID NO: 48287 - DNA, 20 bp, Artificial Sequence
  chemically synthesized
cattagaaagcgagaagagt

SEQ ID NO: 48288 - DNA, 20 bp, Artificial Sequence
  chemically synthesized
agaaagcgagaagagtgaga

SEQ ID NO: 48289 - DNA, 20 bp, Artificial Sequence
  chemically synthesized
cgagaagagtgagaaagaac

SEQ ID NO: 48290 - DNA, 20 bp, Artificial Sequence
  chemically synthesized
actctttttgcgttaattgc

SEQ ID NO: 48291 - DNA, 20 bp, Artificial Sequence
  chemically synthesized
gaactagcaattaacgcaaa

SEQ ID NO: 48292 - DNA, 20 bp, Artificial Sequence
  chemically synthesized
actagcaattaacgcaaaaa

SEQ ID NO: 48293 - DNA, 20 bp, Artificial Sequence
  chemically synthesized
caattaacgcaaaaagagta

SEQ ID NO: 48294 - DNA, 20 bp, Artificial Sequence
  chemically synthesized
aattaacgcaaaaagagtat

SEQ ID NO: 48295 - DNA, 20 bp, Artificial Sequence
  chemically synthesized
ttaacgcaaaaagagtatag

SEQ ID NO: 48296 - DNA, 20 bp, Artificial Sequence
  chemically synthesized
aacgcaaaaagagtatagga

SEQ ID NO: 48297 - DNA, 20 bp, Artificial Sequence
  chemically synthesized
agtataggagagattgaatt

SEQ ID NO: 48298 - DNA, 20 bp, Artificial Sequence
  chemically synthesized
gtataggagagattgaattt

SEQ ID NO: 48299 - DNA, 20 bp, Artificial Sequence
  chemically synthesized
tataggagagattgaatttg

SEQ ID NO: 48300 - DNA, 20 bp, Artificial Sequence
  chemically synthesized
ttcacaactgagtgaaaaat

SEQ ID NO: 48301 - DNA, 20 bp, Artificial Sequence
  chemically synthesized
tttcacaactgagtgaaaaa

SEQ ID NO: 48302 - DNA, 20 bp, Artificial Sequence
  chemically synthesized
tttggggcccatttttcact

SEQ ID NO: 48303 - DNA, 20 bp, Artificial Sequence
  chemically synthesized
tgtttagttctttcacaact

SEQ ID NO: 48304 - DNA, 20 bp, Artificial Sequence
  chemically synthesized
catttttcactcagttgtga

SEQ ID NO: 48305 - DNA, 20 bp, Artificial Sequence
  chemically synthesized
atggctaaggtatacatgtt

SEQ ID NO: 48306 - DNA, 20 bp, Artificial Sequence
  chemically synthesized
agaactaaacatgtatacct

SEQ ID NO: 48307 - DNA, 20 bp, Artificial Sequence
  chemically synthesized
aaacatgtataccttagcca

SEQ ID NO: 48308 - DNA, 20 bp, Artificial Sequence
  chemically synthesized
tcaccatgaggccatggcta

SEQ ID NO: 48309 - DNA, 20 bp, Artificial Sequence
  chemically synthesized
ctcaccatgaggccatggct

SEQ ID NO: 48310 - DNA, 20 bp, Artificial Sequence
  chemically synthesized
ctgcgctcaccatgaggcca

SEQ ID NO: 48311 - DNA, 20 bp, Artificial Sequence
  chemically synthesized
ataccttagccatggcctca

SEQ ID NO: 48312 - DNA, 20 bp, Artificial Sequence
  chemically synthesized
cttagccatggcctcatggt

SEQ ID NO: 48313 - DNA, 20 bp, Artificial Sequence
  chemically synthesized
agcacactgcgctcaccatg

SEQ ID NO: 48314 - DNA, 20 bp, Artificial Sequence
  chemically synthesized
aagcacactgcgctcaccat

SEQ ID NO: 48315 - DNA, 20 bp, Artificial Sequence
  chemically synthesized
ccatggcctcatggtgagcg

SEQ ID NO: 48316 - DNA, 20 bp, Artificial Sequence
  chemically synthesized
ggtgagcgcagtgtgcttcc

SEQ ID NO: 48317 - DNA, 20 bp, Artificial Sequence
  chemically synthesized
gccaaggtcaaggagctagg

SEQ ID NO: 48318 - DNA, 20 bp, Artificial Sequence
  chemically synthesized
caagccaaggtcaaggagct

SEQ ID NO: 48319 - DNA, 20 bp, Artificial Sequence
  chemically synthesized
gcaagccaaggtcaaggagc

SEQ ID NO: 48320 - DNA, 20 bp, Artificial Sequence
  chemically synthesized
tcaagcaagccaaggtcaag

SEQ ID NO: 48321 - DNA, 20 bp, Artificial Sequence
  chemically synthesized
gcttcctagctccttgacct

SEQ ID NO: 48322 - DNA, 20 bp, Artificial Sequence
  chemically synthesized
ggtcaagcaagccaaggtca

SEQ ID NO: 48323 - DNA, 20 bp, Artificial Sequence
  chemically synthesized
tggtcaagcaagccaaggtc

SEQ ID NO: 48324 - DNA, 20 bp, Artificial Sequence
  chemically synthesized
tcacatggtcaagcaagcca

SEQ ID NO: 48325 - DNA, 20 bp, Artificial Sequence
  chemically synthesized
gtcacatggtcaagcaagcc

SEQ ID NO: 48326 - DNA, 20 bp, Artificial Sequence
  chemically synthesized
agcaagtcacatggtcaagc

SEQ ID NO: 48327 - DNA, 20 bp, Artificial Sequence
  chemically synthesized
ctaaagcaagtcacatggtc

SEQ ID NO: 48328 - DNA, 20 bp, Artificial Sequence
  chemically synthesized
atctgctaaagcaagtcaca

SEQ ID NO: 48329 - DNA, 20 bp, Artificial Sequence
  chemically synthesized
cttgaccatgtgacttgctt

SEQ ID NO: 48330 - DNA, 20 bp, Artificial Sequence
  chemically synthesized
gaccatgtgacttgctttag

SEQ ID NO: 48331 - DNA, 20 bp, Artificial Sequence
  chemically synthesized
cacatcatatctgctaaagc

SEQ ID NO: 48332 - DNA, 20 bp, Artificial Sequence
  chemically synthesized
tgttcacatcatatctgcta

SEQ ID NO: 48333 - DNA, 20 bp, Artificial Sequence
  chemically synthesized
tttagcagatatgatgtgaa

SEQ ID NO: 48334 - DNA, 20 bp, Artificial Sequence
  chemically synthesized
tagcagatatgatgtgaaca

SEQ ID NO: 48335 - DNA, 20 bp, Artificial Sequence
  chemically synthesized
agcagatatgatgtgaacag

SEQ ID NO: 48336 - DNA, 20 bp, Artificial Sequence
  chemically synthesized
tgaacagaggcttgtcacac

SEQ ID NO: 48337 - DNA, 20 bp, Artificial Sequence
  chemically synthesized
tggcagattgccagtgtgac

SEQ ID NO: 48338 - DNA, 20 bp, Artificial Sequence
  chemically synthesized
atgttctcatggcagattgc

SEQ ID NO: 48339 - DNA, 20 bp, Artificial Sequence
  chemically synthesized
tcacactggcaatctgccat

SEQ ID NO: 48340 - DNA, 20 bp, Artificial Sequence
  chemically synthesized
cctggggcatgttctcatgg

SEQ ID NO: 48341 - DNA, 20 bp, Artificial Sequence
  chemically synthesized
caacctggggcatgttctca

SEQ ID NO: 48342 - DNA, 20 bp, Artificial Sequence
  chemically synthesized
tctgccatgagaacatgccc

SEQ ID NO: 48343 - DNA, 20 bp, Artificial Sequence
  chemically synthesized
ctgccatgagaacatgcccc

SEQ ID NO: 48344 - DNA, 20 bp, Artificial Sequence
  chemically synthesized
aaaggatcagaagcaacctg

SEQ ID NO: 48345 - DNA, 20 bp, Artificial Sequence
  chemically synthesized
taaaggatcagaagcaacct

SEQ ID NO: 48346 - DNA, 20 bp, Artificial Sequence
  chemically synthesized
ctaaaggatcagaagcaacc

SEQ ID NO: 48347 - DNA, 20 bp, Artificial Sequence
  chemically synthesized
gccccagactaaaggatcag

SEQ ID NO: 48348 - DNA, 20 bp, Artificial Sequence
  chemically synthesized
ccaggttgcttctgatcctt

SEQ ID NO: 48349 - DNA, 20 bp, Artificial Sequence
  chemically synthesized
tgagccccagactaaaggat

SEQ ID NO: 48350 - DNA, 20 bp, Artificial Sequence
  chemically synthesized
ttgcttctgatcctttagtc

SEQ ID NO: 48351 - DNA, 20 bp, Artificial Sequence
  chemically synthesized
tgcttctgatcctttagtct

SEQ ID NO: 48352 - DNA, 20 bp, Artificial Sequence
  chemically synthesized
ggttgtgagccccagactaa

SEQ ID NO: 48353 - DNA, 20 bp, Artificial Sequence
  chemically synthesized
gcttctgatcctttagtctg

SEQ ID NO: 48354 - DNA, 20 bp, Artificial Sequence
  chemically synthesized
gggttgtgagccccagacta

SEQ ID NO: 48355 - DNA, 20 bp, Artificial Sequence
  chemically synthesized
atgtgttgggttgtgagccc

SEQ ID NO: 48356 - DNA, 20 bp, Artificial Sequence
  chemically synthesized
ttctaaatgtgttgggttgt

SEQ ID NO: 48357 - DNA, 20 bp, Artificial Sequence
  chemically synthesized
agatggtttctaaatgtgtt

SEQ ID NO: 48358 - DNA, 20 bp, Artificial Sequence
  chemically synthesized
ggctcacaacccaacacatt

SEQ ID NO: 48359 - DNA, 20 bp, Artificial Sequence
  chemically synthesized
tagatggtttctaaatgtgt

SEQ ID NO: 48360 - DNA, 20 bp, Artificial Sequence
  chemically synthesized
ggctgtgagttcagtttaga

SEQ ID NO: 48361 - DNA, 20 bp, Artificial Sequence
  chemically synthesized
tctaggctgtgagttcagtt

SEQ ID NO: 48362 - DNA, 20 bp, Artificial Sequence
  chemically synthesized
aaccatctaaactgaactca

SEQ ID NO: 48363 - DNA, 20 bp, Artificial Sequence
  chemically synthesized
tcgcctctaggctgtgagtt

SEQ ID NO: 48364 - DNA, 20 bp, Artificial Sequence
  chemically synthesized
tctaaactgaactcacagcc

SEQ ID NO: 48365 - DNA, 20 bp, Artificial Sequence
  chemically synthesized
tgggttcgcctctaggctgt

SEQ ID NO: 48366 - DNA, 20 bp, Artificial Sequence
  chemically synthesized
taaactgaactcacagccta

SEQ ID NO: 48367 - DNA, 20 bp, Artificial Sequence
  chemically synthesized
aaactgaactcacagcctag

SEQ ID NO: 48368 - DNA, 20 bp, Artificial Sequence
  chemically synthesized
gcatgcctgggttcgcctct

SEQ ID NO: 48369 - DNA, 20 bp, Artificial Sequence
  chemically synthesized
agcatgcctgggttcgcctc

SEQ ID NO: 48370 - DNA, 20 bp, Artificial Sequence
  chemically synthesized
tcacagcctagaggcgaacc

SEQ ID NO: 48371 - DNA, 20 bp, Artificial Sequence
  chemically synthesized
cacagcctagaggcgaaccc

SEQ ID NO: 48372 - DNA, 20 bp, Artificial Sequence
  chemically synthesized
cttcatactgaagcatgcct

SEQ ID NO: 48373 - DNA, 20 bp, Artificial Sequence
  chemically synthesized
acttcatactgaagcatgcc

SEQ ID NO: 48374 - DNA, 20 bp, Artificial Sequence
  chemically synthesized
aggcgaacccaggcatgctt

SEQ ID NO: 48375 - DNA, 20 bp, Artificial Sequence
  chemically synthesized
cccaggcatgcttcagtatg

SEQ ID NO: 48376 - DNA, 20 bp, Artificial Sequence
  chemically synthesized
gaaagctctacttcatactg

SEQ ID NO: 48377 - DNA, 20 bp, Artificial Sequence
  chemically synthesized
aggcatgcttcagtatgaag

SEQ ID NO: 48378 - DNA, 20 bp, Artificial Sequence
  chemically synthesized
gcatgcttcagtatgaagta

SEQ ID NO: 48379 - DNA, 20 bp, Artificial Sequence
  chemically synthesized
cagtatgaagtagagctttc

SEQ ID NO: 48380 - DNA, 20 bp, Artificial Sequence
  chemically synthesized
tgaagtagagctttccagtc

SEQ ID NO: 48381 - DNA, 20 bp, Artificial Sequence
  chemically synthesized
ctggataaaacttgactgga

SEQ ID NO: 48382 - DNA, 20 bp, Artificial Sequence
  chemically synthesized
tgatctggataaaacttgac

SEQ ID NO: 48383 - DNA, 20 bp, Artificial Sequence
  chemically synthesized
ctttccagtcaagttttatc

SEQ ID NO: 48384 - DNA, 20 bp, Artificial Sequence
  chemically synthesized
caactgtaattcgggtgatc

SEQ ID NO: 48385 - DNA, 20 bp, Artificial Sequence
  chemically synthesized
tatccagatcacccgaatta

SEQ ID NO: 48386 - DNA, 20 bp, Artificial Sequence
  chemically synthesized
ctacaggtcaactgtaattc

SEQ ID NO: 48387 - DNA, 20 bp, Artificial Sequence
  chemically synthesized
tctacaggtcaactgtaatt

SEQ ID NO: 48388 - DNA, 20 bp, Artificial Sequence
  chemically synthesized
cccgaattacagttgacctg

SEQ ID NO: 48389 - DNA, 20 bp, Artificial Sequence
  chemically synthesized
tctcatgcttatgggtctac

SEQ ID NO: 48390 - DNA, 20 bp, Artificial Sequence
  chemically synthesized
ttctcatgcttatgggtcta

SEQ ID NO: 48391 - DNA, 20 bp, Artificial Sequence
  chemically synthesized
cagttgacctgtagacccat

SEQ ID NO: 48392 - DNA, 20 bp, Artificial Sequence
  chemically synthesized
gcttctgttctcatgcttat

SEQ ID NO: 48393 - DNA, 20 bp, Artificial Sequence
  chemically synthesized
acctgtagacccataagcat

SEQ ID NO: 48394 - DNA, 20 bp, Artificial Sequence
  chemically synthesized
agcttctgttctcatgctta

SEQ ID NO: 48395 - DNA, 20 bp, Artificial Sequence
  chemically synthesized
tagacccataagcatgagaa

SEQ ID NO: 48396 - DNA, 20 bp, Artificial Sequence
  chemically synthesized
acccataagcatgagaacag

SEQ ID NO: 48397 - DNA, 20 bp, Artificial Sequence
  chemically synthesized
aactactatacaagaatata

SEQ ID NO: 48398 - DNA, 20 bp, Artificial Sequence
  chemically synthesized
agaagctttatattcttgta

SEQ ID NO: 48399 - DNA, 20 bp, Artificial Sequence
  chemically synthesized
agctttatattcttgtatag

SEQ ID NO: 48400 - DNA, 20 bp, Artificial Sequence
  chemically synthesized
ccacaatataactactatac

SEQ ID NO: 48401 - DNA, 20 bp, Artificial Sequence
  chemically synthesized
cttgtatagtagttatattg

SEQ ID NO: 48402 - DNA, 20 bp, Artificial Sequence
  chemically synthesized
gttatattgtggcattattg

SEQ ID NO: 48403 - DNA, 20 bp, Artificial Sequence
  chemically synthesized
ttgtggcattattgtggata

SEQ ID NO: 48404 - DNA, 20 bp, Artificial Sequence
  chemically synthesized
attattgtggatacagctga

SEQ ID NO: 48405 - DNA, 20 bp, Artificial Sequence
  chemically synthesized
tattgtggatacagctgaca

SEQ ID NO: 48406 - DNA, 20 bp, Artificial Sequence
  chemically synthesized
ttgtggatacagctgacaga

SEQ ID NO: 48407 - DNA, 20 bp, Artificial Sequence
  chemically synthesized
gtggatacagctgacagaga

SEQ ID NO: 48408 - DNA, 20 bp, Artificial Sequence
  chemically synthesized
ctctctactcctctctctgt

SEQ ID NO: 48409 - DNA, 20 bp, Artificial Sequence
  chemically synthesized
tggatacagctgacagagag

SEQ ID NO: 48410 - DNA, 20 bp, Artificial Sequence
  chemically synthesized
gatacagctgacagagagag

SEQ ID NO: 48411 - DNA, 20 bp, Artificial Sequence
  chemically synthesized
acagctgacagagagaggag

SEQ ID NO: 48412 - DNA, 20 bp, Artificial Sequence
  chemically synthesized
agctgacagagagaggagta

SEQ ID NO: 48413 - DNA, 20 bp, Artificial Sequence
  chemically synthesized
ctgacagagagaggagtaga

SEQ ID NO: 48414 - DNA, 20 bp, Artificial Sequence
  chemically synthesized
gacagagagaggagtagaga

SEQ ID NO: 48415 - DNA, 20 bp, Artificial Sequence
  chemically synthesized
agagagaggagtagagagag

SEQ ID NO: 48416 - DNA, 20 bp, Artificial Sequence
  chemically synthesized
gagagaggagtagagagaga

SEQ ID NO: 48417 - DNA, 20 bp, Artificial Sequence
  chemically synthesized
agagaggagtagagagagaa

SEQ ID NO: 48418 - DNA, 20 bp, Artificial Sequence
  chemically synthesized
gagaggagtagagagagaag

SEQ ID NO: 48419 - DNA, 20 bp, Artificial Sequence
  chemically synthesized
gaggagtagagagagaaggg

SEQ ID NO: 48420 - DNA, 20 bp, Artificial Sequence
  chemically synthesized
ggagtagagagagaagggga

SEQ ID NO: 48421 - DNA, 20 bp, Artificial Sequence
  chemically synthesized
gagtagagagagaaggggag

SEQ ID NO: 48422 - DNA, 20 bp, Artificial Sequence
  chemically synthesized
agtagagagagaaggggaga

SEQ ID NO: 48423 - DNA, 20 bp, Artificial Sequence
  chemically synthesized
gtagagagagaaggggagag

SEQ ID NO: 48424 - DNA, 20 bp, Artificial Sequence
  chemically synthesized
agagaaggggagaggggaaa

SEQ ID NO: 48425 - DNA, 20 bp, Artificial Sequence
  chemically synthesized
agaggggaaacagtatcata

SEQ ID NO: 48426 - DNA, 20 bp, Artificial Sequence
  chemically synthesized
aaacagtatcataaagatta

SEQ ID NO: 48427 - DNA, 20 bp, Artificial Sequence
  chemically synthesized
aaagaataaaaaatatcctc

SEQ ID NO: 48428 - DNA, 20 bp, Artificial Sequence
  chemically synthesized
taaaaaatatcctccagcca

SEQ ID NO: 48429 - DNA, 20 bp, Artificial Sequence
  chemically synthesized
atgggagagactttggctgg

SEQ ID NO: 48430 - DNA, 20 bp, Artificial Sequence
  chemically synthesized
aatgggagagactttggctg

SEQ ID NO: 48431 - DNA, 20 bp, Artificial Sequence
  chemically synthesized
caaatgggagagactttggc

SEQ ID NO: 48432 - DNA, 20 bp, Artificial Sequence
  chemically synthesized
gtaacaaatgggagagactt

SEQ ID NO: 48433 - DNA, 20 bp, Artificial Sequence
  chemically synthesized
gtggctagtaacaaatggga

SEQ ID NO: 48434 - DNA, 20 bp, Artificial Sequence
  chemically synthesized
cagtggctagtaacaaatgg

SEQ ID NO: 48435 - DNA, 20 bp, Artificial Sequence
  chemically synthesized
ggcagtggctagtaacaaat

SEQ ID NO: 48436 - DNA, 20 bp, Artificial Sequence
  chemically synthesized
aggcagtggctagtaacaaa

SEQ ID NO: 48437 - DNA, 20 bp, Artificial Sequence
  chemically synthesized
aagtctctcccatttgttac

SEQ ID NO: 48438 - DNA, 20 bp, Artificial Sequence
  chemically synthesized
atgttagtagaggcagtggc

SEQ ID NO: 48439 - DNA, 20 bp, Artificial Sequence
  chemically synthesized
ttgcatgttagtagaggcag

SEQ ID NO: 48440 - DNA, 20 bp, Artificial Sequence
  chemically synthesized
tctttgcatgttagtagagg

SEQ ID NO: 48441 - DNA, 20 bp, Artificial Sequence
  chemically synthesized
taatctttgcatgttagtag

SEQ ID NO: 48442 - DNA, 20 bp, Artificial Sequence
  chemically synthesized
ttaatctttgcatgttagta

SEQ ID NO: 48443 - DNA, 20 bp, Artificial Sequence
  chemically synthesized
cattaatctttgcatgttag

SEQ ID NO: 48444 - DNA, 20 bp, Artificial Sequence
  chemically synthesized
actgcctctactaacatgca

SEQ ID NO: 48445 - DNA, 20 bp, Artificial Sequence
  chemically synthesized
ccccattaatctttgcatgt

SEQ ID NO: 48446 - DNA, 20 bp, Artificial Sequence
  chemically synthesized
tactaacatgcaaagattaa

SEQ ID NO: 48447 - DNA, 20 bp, Artificial Sequence
  chemically synthesized
actaacatgcaaagattaat

SEQ ID NO: 48448 - DNA, 20 bp, Artificial Sequence
  chemically synthesized
ctaacatgcaaagattaatg

SEQ ID NO: 48449 - DNA, 20 bp, Artificial Sequence
  chemically synthesized
atggggattatcatcctctt

SEQ ID NO: 48450 - DNA, 20 bp, Artificial Sequence
  chemically synthesized
ctcaactgcacagaccaaag

SEQ ID NO: 48451 - DNA, 20 bp, Artificial Sequence
  chemically synthesized
tctcaactgcacagaccaaa

SEQ ID NO: 48452 - DNA, 20 bp, Artificial Sequence
  chemically synthesized
cgtctcaactgcacagacca

SEQ ID NO: 48453 - DNA, 20 bp, Artificial Sequence
  chemically synthesized
atcatcctctttggtctgtg

SEQ ID NO: 48454 - DNA, 20 bp, Artificial Sequence
  chemically synthesized
cctctttggtctgtgcagtt

SEQ ID NO: 48455 - DNA, 20 bp, Artificial Sequence
  chemically synthesized
acccacacgtctcaactgca

SEQ ID NO: 48456 - DNA, 20 bp, Artificial Sequence
  chemically synthesized
gtctgtgcagttgagacgtg

SEQ ID NO: 48457 - DNA, 20 bp, Artificial Sequence
  chemically synthesized
tctgtgcagttgagacgtgt

SEQ ID NO: 48458 - DNA, 20 bp, Artificial Sequence
  chemically synthesized
acgtgtgggttgctattcac

SEQ ID NO: 48459 - DNA, 20 bp, Artificial Sequence
  chemically synthesized
gggttccagacaccagtgaa

SEQ ID NO: 48460 - DNA, 20 bp, Artificial Sequence
  chemically synthesized
ggttgctattcactggtgtc

SEQ ID NO: 48461 - DNA, 20 bp, Artificial Sequence
  chemically synthesized
agaaaaggggttccagacac

SEQ ID NO: 48462 - DNA, 20 bp, Artificial Sequence
  chemically synthesized
cagccttagaaaaggggttc

SEQ ID NO: 48463 - DNA, 20 bp, Artificial Sequence
  chemically synthesized
gtgtctggaaccccttttct

SEQ ID NO: 48464 - DNA, 20 bp, Artificial Sequence
  chemically synthesized
gattatcagccttagaaaag

SEQ ID NO: 48465 - DNA, 20 bp, Artificial Sequence
  chemically synthesized
tgtctggaaccccttttcta

SEQ ID NO: 48466 - DNA, 20 bp, Artificial Sequence
  chemically synthesized
ggattatcagccttagaaaa

SEQ ID NO: 48467 - DNA, 20 bp, Artificial Sequence
  chemically synthesized
tggattatcagccttagaaa

SEQ ID NO: 48468 - DNA, 20 bp, Artificial Sequence
  chemically synthesized
atggattatcagccttagaa

SEQ ID NO: 48469 - DNA, 20 bp, Artificial Sequence
  chemically synthesized
ctattatggattatcagcct

SEQ ID NO: 48470 - DNA, 20 bp, Artificial Sequence
  chemically synthesized
ttgtaactattatggattat

SEQ ID NO: 48471 - DNA, 20 bp, Artificial Sequence
  chemically synthesized
ctaaggctgataatccataa

SEQ ID NO: 48472 - DNA, 20 bp, Artificial Sequence
  chemically synthesized
gttcatacttgtaactatta

SEQ ID NO: 48473 - DNA, 20 bp, Artificial Sequence
  chemically synthesized
tgataatccataatagttac

SEQ ID NO: 48474 - DNA, 20 bp, Artificial Sequence
  chemically synthesized
aacaatttactaacatattc

SEQ ID NO: 48475 - DNA, 20 bp, Artificial Sequence
  chemically synthesized
aagtatgaacttgaatatgt

SEQ ID NO: 48476 - DNA, 20 bp, Artificial Sequence
  chemically synthesized
aatatgttagtaaattgttc

SEQ ID NO: 48477 - DNA, 20 bp, Artificial Sequence
  chemically synthesized
ttagtaaattgttctagtct

SEQ ID NO: 48478 - DNA, 20 bp, Artificial Sequence
  chemically synthesized
acagaagagaaaactgagac

SEQ ID NO: 48479 - DNA, 20 bp, Artificial Sequence
  chemically synthesized
atttcacagaagagaaaact

SEQ ID NO: 48480 - DNA, 20 bp, Artificial Sequence
  chemically synthesized
attgtctccatttcacagaa

SEQ ID NO: 48481 - DNA, 20 bp, Artificial Sequence
  chemically synthesized
ttattgtctccatttcacag

SEQ ID NO: 48482 - DNA, 20 bp, Artificial Sequence
  chemically synthesized
cagttttctcttctgtgaaa

SEQ ID NO: 48483 - DNA, 20 bp, Artificial Sequence
  chemically synthesized
gttttctcttctgtgaaatg

SEQ ID NO: 48484 - DNA, 20 bp, Artificial Sequence
  chemically synthesized
ctgttattgtctccatttca

SEQ ID NO: 48485 - DNA, 20 bp, Artificial Sequence
  chemically synthesized
ctgtgaaatggagacaataa

SEQ ID NO: 48486 - DNA, 20 bp, Artificial Sequence
  chemically synthesized
caataacagtccttatttta

SEQ ID NO: 48487 - DNA, 20 bp, Artificial Sequence
  chemically synthesized
tcacaccaacctttaaaata

SEQ ID NO: 48488 - DNA, 20 bp, Artificial Sequence
  chemically synthesized
aataacagtccttattttaa

SEQ ID NO: 48489 - DNA, 20 bp, Artificial Sequence
  chemically synthesized
ctcacaccaacctttaaaat

SEQ ID NO: 48490 - DNA, 20 bp, Artificial Sequence
  chemically synthesized
acagtccttattttaaaggt

SEQ ID NO: 48491 - DNA, 20 bp, Artificial Sequence
  chemically synthesized
cttattttaaaggttggtgt

SEQ ID NO: 48492 - DNA, 20 bp, Artificial Sequence
  chemically synthesized
ttattttaaaggttggtgtg

SEQ ID NO: 48493 - DNA, 20 bp, Artificial Sequence
  chemically synthesized
aggttggtgtgaggattaaa

SEQ ID NO: 48494 - DNA, 20 bp, Artificial Sequence
  chemically synthesized
ggttggtgtgaggattaaac

SEQ ID NO: 48495 - DNA, 20 bp, Artificial Sequence
  chemically synthesized
cacagaggaagcattttgca

SEQ ID NO: 48496 - DNA, 20 bp, Artificial Sequence
  chemically synthesized
ctgtgctcttaacacagagg

SEQ ID NO: 48497 - DNA, 20 bp, Artificial Sequence
  chemically synthesized
caaaatgcttcctctgtgtt

SEQ ID NO: 48498 - DNA, 20 bp, Artificial Sequence
  chemically synthesized
gctctgtgctcttaacacag

SEQ ID NO: 48499 - DNA, 20 bp, Artificial Sequence
  chemically synthesized
cgctctgtgctcttaacaca

SEQ ID NO: 48500 - DNA, 20 bp, Artificial Sequence
  chemically synthesized
aaatgcttcctctgtgttaa

SEQ ID NO: 48501 - DNA, 20 bp, Artificial Sequence
  chemically synthesized
agcgctctgtgctcttaaca

SEQ ID NO: 48502 - DNA, 20 bp, Artificial Sequence
  chemically synthesized
cttcctctgtgttaagagca

SEQ ID NO: 48503 - DNA, 20 bp, Artificial Sequence
  chemically synthesized
tcctctgtgttaagagcaca

SEQ ID NO: 48504 - DNA, 20 bp, Artificial Sequence
  chemically synthesized
tggaatttttaaaaagtatc

SEQ ID NO: 48505 - DNA, 20 bp, Artificial Sequence
  chemically synthesized
taggagttggaatttttaaa

SEQ ID NO: 48506 - DNA, 20 bp, Artificial Sequence
  chemically synthesized
ataattataaacgtaggagt

SEQ ID NO: 48507 - DNA, 20 bp, Artificial Sequence
  chemically synthesized
gaaaataattataaacgtag

SEQ ID NO: 48508 - DNA, 20 bp, Artificial Sequence
  chemically synthesized
atgaaaataattataaacgt

SEQ ID NO: 48509 - DNA, 20 bp, Artificial Sequence
  chemically synthesized
gatgaaaataattataaacg

SEQ ID NO: 48510 - DNA, 20 bp, Artificial Sequence
  chemically synthesized
aattattttcatcattaatg

SEQ ID NO: 48511 - DNA, 20 bp, Artificial Sequence
  chemically synthesized
attttcatcattaatgtagc

SEQ ID NO: 48512 - DNA, 20 bp, Artificial Sequence
  chemically synthesized
tcattaatgtagctagttat

SEQ ID NO: 48513 - DNA, 20 bp, Artificial Sequence
  chemically synthesized
cattaatgtagctagttatc

SEQ ID NO: 48514 - DNA, 20 bp, Artificial Sequence
  chemically synthesized
gagataaatatcctgataac

SEQ ID NO: 48515 - DNA, 20 bp, Artificial Sequence
  chemically synthesized
ttggcagtaagttcgtgaat

SEQ ID NO: 48516 - DNA, 20 bp, Artificial Sequence
  chemically synthesized
ggattcctcacattggcagt

SEQ ID NO: 48517 - DNA, 20 bp, Artificial Sequence
  chemically synthesized
cacgaacttactgccaatgt

SEQ ID NO: 48518 - DNA, 20 bp, Artificial Sequence
  chemically synthesized
cctgggattcctcacattgg

SEQ ID NO: 48519 - DNA, 20 bp, Artificial Sequence
  chemically synthesized
acgaacttactgccaatgtg

SEQ ID NO: 48520 - DNA, 20 bp, Artificial Sequence
  chemically synthesized
taccctgggattcctcacat

SEQ ID NO: 48521 - DNA, 20 bp, Artificial Sequence
  chemically synthesized
actgccaatgtgaggaatcc

SEQ ID NO: 48522 - DNA, 20 bp, Artificial Sequence
  chemically synthesized
ctgccaatgtgaggaatccc

SEQ ID NO: 48523 - DNA, 20 bp, Artificial Sequence
  chemically synthesized
tgccaatgtgaggaatccca

SEQ ID NO: 48524 - DNA, 20 bp, Artificial Sequence
  chemically synthesized
gtcactttcctggttaccct

SEQ ID NO: 48525 - DNA, 20 bp, Artificial Sequence
  chemically synthesized
gtgaggaatcccagggtaac

SEQ ID NO: 48526 - DNA, 20 bp, Artificial Sequence
  chemically synthesized
tgtcactttcctggttaccc

SEQ ID NO: 48527 - DNA, 20 bp, Artificial Sequence
  chemically synthesized
tgaggaatcccagggtaacc

SEQ ID NO: 48528 - DNA, 20 bp, Artificial Sequence
  chemically synthesized
gaatcccagggtaaccagga

SEQ ID NO: 48529 - DNA, 20 bp, Artificial Sequence
  chemically synthesized
gaaagtctctgtcactttcc

SEQ ID NO: 48530 - DNA, 20 bp, Artificial Sequence
  chemically synthesized
cagggtaaccaggaaagtga

SEQ ID NO: 48531 - DNA, 20 bp, Artificial Sequence
  chemically synthesized
gggtaaccaggaaagtgaca

SEQ ID NO: 48532 - DNA, 20 bp, Artificial Sequence
  chemically synthesized
aaagtgacagagactttcca

SEQ ID NO: 48533 - DNA, 20 bp, Artificial Sequence
  chemically synthesized
tttaactctagaaccatgga

SEQ ID NO: 48534 - DNA, 20 bp, Artificial Sequence
  chemically synthesized
acagagactttccatggttc

SEQ ID NO: 48535 - DNA, 20 bp, Artificial Sequence
  chemically synthesized
tcagtttaactctagaacca

SEQ ID NO: 48536 - DNA, 20 bp, Artificial Sequence
  chemically synthesized
agagactttccatggttcta

SEQ ID NO: 48537 - DNA, 20 bp, Artificial Sequence
  chemically synthesized
gttaacagtcagtttaactc

SEQ ID NO: 48538 - DNA, 20 bp, Artificial Sequence
  chemically synthesized
atgctttggtggttaacagt

SEQ ID NO: 48539 - DNA, 20 bp, Artificial Sequence
  chemically synthesized
tcccatgctttggtggttaa

SEQ ID NO: 48540 - DNA, 20 bp, Artificial Sequence
  chemically synthesized
aaactgactgttaaccacca

SEQ ID NO: 48541 - DNA, 20 bp, Artificial Sequence
  chemically synthesized
tccctggtcccatgctttgg

SEQ ID NO: 48542 - DNA, 20 bp, Artificial Sequence
  chemically synthesized
gactgttaaccaccaaagca

SEQ ID NO: 48543 - DNA, 20 bp, Artificial Sequence
  chemically synthesized
actgttaaccaccaaagcat

SEQ ID NO: 48544 - DNA, 20 bp, Artificial Sequence
  chemically synthesized
agttccctggtcccatgctt

SEQ ID NO: 48545 - DNA, 20 bp, Artificial Sequence
  chemically synthesized
taaccaccaaagcatgggac

SEQ ID NO: 48546 - DNA, 20 bp, Artificial Sequence
  chemically synthesized
aaccaccaaagcatgggacc

SEQ ID NO: 48547 - DNA, 20 bp, Artificial Sequence
  chemically synthesized
accaccaaagcatgggacca

SEQ ID NO: 48548 - DNA, 20 bp, Artificial Sequence
  chemically synthesized
aaagcatgggaccagggaac

SEQ ID NO: 48549 - DNA, 20 bp, Artificial Sequence
  chemically synthesized
tatttccttaactagttccc

SEQ ID NO: 48550 - DNA, 20 bp, Artificial Sequence
  chemically synthesized
atgggaccagggaactagtt

SEQ ID NO: 48551 - DNA, 20 bp, Artificial Sequence
  chemically synthesized
tgggaccagggaactagtta

SEQ ID NO: 48552 - DNA, 20 bp, Artificial Sequence
  chemically synthesized
agaaagattatttccttaac

SEQ ID NO: 48553 - DNA, 20 bp, Artificial Sequence
  chemically synthesized
tggctagaaaaagaggaaga

SEQ ID NO: 48554 - DNA, 20 bp, Artificial Sequence
  chemically synthesized
aaaatggctagaaaaagagg

SEQ ID NO: 48555 - DNA, 20 bp, Artificial Sequence
  chemically synthesized
aatctttcttcctctttttc

SEQ ID NO: 48556 - DNA, 20 bp, Artificial Sequence
  chemically synthesized
cagaaaatggctagaaaaag

SEQ ID NO: 48557 - DNA, 20 bp, Artificial Sequence
  chemically synthesized
tcagaaaatggctagaaaaa

SEQ ID NO: 48558 - DNA, 20 bp, Artificial Sequence
  chemically synthesized
agtcagaaaatggctagaaa

SEQ ID NO: 48559 - DNA, 20 bp, Artificial Sequence
  chemically synthesized
ttaaagagtcagaaaatggc

SEQ ID NO: 48560 - DNA, 20 bp, Artificial Sequence
  chemically synthesized
ttttttaaagagtcagaaaa

SEQ ID NO: 48561 - DNA, 20 bp, Artificial Sequence
  chemically synthesized
cgtaacattttttaaagagt

SEQ ID NO: 48562 - DNA, 20 bp, Artificial Sequence
  chemically synthesized
accgcgtaacattttttaaa

SEQ ID NO: 48563 - DNA, 20 bp, Artificial Sequence
  chemically synthesized
gaaccgcgtaacatttttta

SEQ ID NO: 48564 - DNA, 20 bp, Artificial Sequence
  chemically synthesized
actctttaaaaaatgttacg

SEQ ID NO: 48565 - DNA, 20 bp, Artificial Sequence
  chemically synthesized
aaaaaatgttacgcggttct

SEQ ID NO: 48566 - DNA, 20 bp, Artificial Sequence
  chemically synthesized
aaaatgttacgcggttctca

SEQ ID NO: 48567 - DNA, 20 bp, Artificial Sequence
  chemically synthesized
cgttcatgttttattactct

SEQ ID NO: 48568 - DNA, 20 bp, Artificial Sequence
  chemically synthesized
tcagagtaataaaacatgaa

SEQ ID NO: 48569 - DNA, 20 bp, Artificial Sequence
  chemically synthesized
agagtaataaaacatgaacg

SEQ ID NO: 48570 - DNA, 20 bp, Artificial Sequence
  chemically synthesized
acggagacaaatcttcctct

SEQ ID NO: 48571 - DNA, 20 bp, Artificial Sequence
  chemically synthesized
agcatcagaatgccaagagg

SEQ ID NO: 48572 - DNA, 20 bp, Artificial Sequence
  chemically synthesized
atcagcatcagaatgccaag

SEQ ID NO: 48573 - DNA, 20 bp, Artificial Sequence
  chemically synthesized
catcagcatcagaatgccaa

SEQ ID NO: 48574 - DNA, 20 bp, Artificial Sequence
  chemically synthesized
aacatcagcatcagaatgcc

SEQ ID NO: 48575 - DNA, 20 bp, Artificial Sequence
  chemically synthesized
ttcatagtaaacatcagcat

SEQ ID NO: 48576 - DNA, 20 bp, Artificial Sequence
  chemically synthesized
ttgattttcatagtaaacat

SEQ ID NO: 48577 - DNA, 20 bp, Artificial Sequence
  chemically synthesized
taaaacacagttgattttca

SEQ ID NO: 48578 - DNA, 20 bp, Artificial Sequence
  chemically synthesized
tagtatataatgataaaaca

SEQ ID NO: 48579 - DNA, 20 bp, Artificial Sequence
  chemically synthesized
tttatcattatatactatat

SEQ ID NO: 48580 - DNA, 20 bp, Artificial Sequence
  chemically synthesized
attctgaagcaatactaata

SEQ ID NO: 48581 - DNA, 20 bp, Artificial Sequence
  chemically synthesized
atactatattagtattgctt

SEQ ID NO: 48582 - DNA, 20 bp, Artificial Sequence
  chemically synthesized
gctatttattttgaattctg

SEQ ID NO: 48583 - DNA, 20 bp, Artificial Sequence
  chemically synthesized
gcttcagaattcaaaataaa

SEQ ID NO: 48584 - DNA, 20 bp, Artificial Sequence
  chemically synthesized
tatttatttctaaaaatatt

SEQ ID NO: 48585 - DNA, 20 bp, Artificial Sequence
  chemically synthesized
aataaatagctaaatatttt

SEQ ID NO: 48586 - DNA, 20 bp, Artificial Sequence
  chemically synthesized
accaacaattgaaattaaac

SEQ ID NO: 48587 - DNA, 20 bp, Artificial Sequence
  chemically synthesized
tcttgtttaatttcaattgt

SEQ ID NO: 48588 - DNA, 20 bp, Artificial Sequence
  chemically synthesized
taaaaatttagtttaaaaat

SEQ ID NO: 48589 - DNA, 20 bp, Artificial Sequence
  chemically synthesized
agcttggttatgtaaaaatt

SEQ ID NO: 48590 - DNA, 20 bp, Artificial Sequence
  chemically synthesized
aactaaatttttacataacc

SEQ ID NO: 48591 - DNA, 20 bp, Artificial Sequence
  chemically synthesized
aggaaaaaaaatagtaagct

SEQ ID NO: 48592 - DNA, 20 bp, Artificial Sequence
  chemically synthesized
taaataggaaaaaaaatagt

SEQ ID NO: 48593 - DNA, 20 bp, Artificial Sequence
  chemically synthesized
aatttaaataggaaaaaaaa

SEQ ID NO: 48594 - DNA, 20 bp, Artificial Sequence
  chemically synthesized
tcacccacaccaatttaaat

SEQ ID NO: 48595 - DNA, 20 bp, Artificial Sequence
  chemically synthesized
attttttttcctatttaaat

SEQ ID NO: 48596 - DNA, 20 bp, Artificial Sequence
  chemically synthesized
atcacccacaccaatttaaa

SEQ ID NO: 48597 - DNA, 20 bp, Artificial Sequence
  chemically synthesized
ttttcctatttaaattggtg

SEQ ID NO: 48598 - DNA, 20 bp, Artificial Sequence
  chemically synthesized
tttcctatttaaattggtgt

SEQ ID NO: 48599 - DNA, 20 bp, Artificial Sequence
  chemically synthesized
gtgtgggtgattcatgttaa

SEQ ID NO: 48600 - DNA, 20 bp, Artificial Sequence
  chemically synthesized
taatggaattctctgacctg

SEQ ID NO: 48601 - DNA, 20 bp, Artificial Sequence
  chemically synthesized
cagcacataacttcaggtca

SEQ ID NO: 48602 - DNA, 20 bp, Artificial Sequence
  chemically synthesized
gacagcacataacttcaggt

SEQ ID NO: 48603 - DNA, 20 bp, Artificial Sequence
  chemically synthesized
acaagacagcacataacttc

SEQ ID NO: 48604 - DNA, 20 bp, Artificial Sequence
  chemically synthesized
aacaagacagcacataactt

SEQ ID NO: 48605 - DNA, 20 bp, Artificial Sequence
  chemically synthesized
ggcttatgtcttaaacaaga

SEQ ID NO: 48606 - DNA, 20 bp, Artificial Sequence
  chemically synthesized
agttatgtgctgtcttgttt

SEQ ID NO: 48607 - DNA, 20 bp, Artificial Sequence
  chemically synthesized
gcaaggcttatgtcttaaac

SEQ ID NO: 48608 - DNA, 20 bp, Artificial Sequence
  chemically synthesized
tgctgtcttgtttaagacat

SEQ ID NO: 48609 - DNA, 20 bp, Artificial Sequence
  chemically synthesized
aaaaaaaggcgggggcagca

SEQ ID NO: 48610 - DNA, 20 bp, Artificial Sequence
  chemically synthesized
aaaaaaaaggcgggggcagc

SEQ ID NO: 48611 - DNA, 20 bp, Artificial Sequence
  chemically synthesized
aaaaaaaaaaaaggcggggg

SEQ ID NO: 48612 - DNA, 20 bp, Artificial Sequence
  chemically synthesized
aaaaaaaaaaaaaaaggcgg

SEQ ID NO: 48613 - DNA, 20 bp, Artificial Sequence
  chemically synthesized
aaaaaaaaaaaaaaaaggcg

SEQ ID NO: 48614 - DNA, 20 bp, Artificial Sequence
  chemically synthesized
aaaaaaaaaaaaaaaaaggc

SEQ ID NO: 48615 - DNA, 20 bp, Artificial Sequence
  chemically synthesized
aaaaaaaaaaaaaaaaaagg

SEQ ID NO: 48616 - DNA, 20 bp, Artificial Sequence
  chemically synthesized
aaaaaaaaaaaaaaaaaaaa

SEQ ID NO: 48617 - DNA, 20 bp, Artificial Sequence
  chemically synthesized
aaaaaaaaaaaaaaaaaaaa

SEQ ID NO: 48618 - DNA, 20 bp, Artificial Sequence
  chemically synthesized
tttttttttttttttgcctg

SEQ ID NO: 48619 - DNA, 20 bp, Artificial Sequence
  chemically synthesized
atgacaaccttgttatcttc

SEQ ID NO: 48620 - DNA, 20 bp, Artificial Sequence
  chemically synthesized
catgacaaccttgttatctt

SEQ ID NO: 48621 - DNA, 20 bp, Artificial Sequence
  chemically synthesized
tttttttgcctgaagataac

SEQ ID NO: 48622 - DNA, 20 bp, Artificial Sequence
  chemically synthesized
ttttttgcctgaagataaca

SEQ ID NO: 48623 - DNA, 20 bp, Artificial Sequence
  chemically synthesized
gaagataacaaggttgtcat

SEQ ID NO: 48624 - DNA, 20 bp, Artificial Sequence
  chemically synthesized
gttgtcatgagcttttgtgt

SEQ ID NO: 48625 - DNA, 20 bp, Artificial Sequence
  chemically synthesized
ttgtcatgagcttttgtgtt

SEQ ID NO: 48626 - DNA, 20 bp, Artificial Sequence
  chemically synthesized
attcctggaacccaacacaa

SEQ ID NO: 48627 - DNA, 20 bp, Artificial Sequence
  chemically synthesized
tgagcttttgtgttgggttc

SEQ ID NO: 48628 - DNA, 20 bp, Artificial Sequence
  chemically synthesized
gagcttttgtgttgggttcc

SEQ ID NO: 48629 - DNA, 20 bp, Artificial Sequence
  chemically synthesized
actgcatcttcagttattcc

SEQ ID NO: 48630 - DNA, 20 bp, Artificial Sequence
  chemically synthesized
ttgggttccaggaataactg

SEQ ID NO: 48631 - DNA, 20 bp, Artificial Sequence
  chemically synthesized
tccaggaataactgaagatg

SEQ ID NO: 48632 - DNA, 20 bp, Artificial Sequence
  chemically synthesized
tcagttttgaactgcatctt

SEQ ID NO: 48633 - DNA, 20 bp, Artificial Sequence
  chemically synthesized
acatctattagaggaagatt

SEQ ID NO: 48634 - DNA, 20 bp, Artificial Sequence
  chemically synthesized
aaaactgaatcttcctctaa

SEQ ID NO: 48635 - DNA, 20 bp, Artificial Sequence
  chemically synthesized
gcagatacatctattagagg

SEQ ID NO: 48636 - DNA, 20 bp, Artificial Sequence
  chemically synthesized
ggagcagatacatctattag

SEQ ID NO: 48637 - DNA, 20 bp, Artificial Sequence
  chemically synthesized
tggagcagatacatctatta

SEQ ID NO: 48638 - DNA, 20 bp, Artificial Sequence
  chemically synthesized
tctggagcagatacatctat

SEQ ID NO: 48639 - DNA, 20 bp, Artificial Sequence
  chemically synthesized
tctaatagatgtatctgctc

SEQ ID NO: 48640 - DNA, 20 bp, Artificial Sequence
  chemically synthesized
ttggtccaggagatctggag

SEQ ID NO: 48641 - DNA, 20 bp, Artificial Sequence
  chemically synthesized
gacttggtccaggagatctg

SEQ ID NO: 48642 - DNA, 20 bp, Artificial Sequence
  chemically synthesized
tgtatctgctccagatctcc

SEQ ID NO: 48643 - DNA, 20 bp, Artificial Sequence
  chemically synthesized
aagacttggtccaggagatc

SEQ ID NO: 48644 - DNA, 20 bp, Artificial Sequence
  chemically synthesized
tgctccagatctcctggacc

SEQ ID NO: 48645 - DNA, 20 bp, Artificial Sequence
  chemically synthesized
attcaaaagacttggtccag

SEQ ID NO: 48646 - DNA, 20 bp, Artificial Sequence
  chemically synthesized
taattcaaaagacttggtcc

SEQ ID NO: 48647 - DNA, 20 bp, Artificial Sequence
  chemically synthesized
gtaattcaaaagacttggtc

SEQ ID NO: 48648 - DNA, 20 bp, Artificial Sequence
  chemically synthesized
agaaagtaattcaaaagact

SEQ ID NO: 48649 - DNA, 20 bp, Artificial Sequence
  chemically synthesized
agggaaagaaagtaattcaa

SEQ ID NO: 48650 - DNA, 20 bp, Artificial Sequence
  chemically synthesized
accagctatcaagggaaaga

SEQ ID NO: 48651 - DNA, 20 bp, Artificial Sequence
  chemically synthesized
ctagaccagctatcaaggga

SEQ ID NO: 48652 - DNA, 20 bp, Artificial Sequence
  chemically synthesized
aattactttctttcccttga

SEQ ID NO: 48653 - DNA, 20 bp, Artificial Sequence
  chemically synthesized
cgacctagaccagctatcaa

SEQ ID NO: 48654 - DNA, 20 bp, Artificial Sequence
  chemically synthesized
actttctttcccttgatagc

SEQ ID NO: 48655 - DNA, 20 bp, Artificial Sequence
  chemically synthesized
tcgacctagaccagctatca

SEQ ID NO: 48656 - DNA, 20 bp, Artificial Sequence
  chemically synthesized
ttcgacctagaccagctatc

SEQ ID NO: 48657 - DNA, 20 bp, Artificial Sequence
  chemically synthesized
ctttcccttgatagctggtc

SEQ ID NO: 48658 - DNA, 20 bp, Artificial Sequence
  chemically synthesized
tttcccttgatagctggtct

SEQ ID NO: 48659 - DNA, 20 bp, Artificial Sequence
  chemically synthesized
ttatagaattcgacctagac

SEQ ID NO: 48660 - DNA, 20 bp, Artificial Sequence
  chemically synthesized
tcatgttatagaattcgacc

SEQ ID NO: 48661 - DNA, 20 bp, Artificial Sequence
  chemically synthesized
aagtgaaggagttcatgtta

SEQ ID NO: 48662 - DNA, 20 bp, Artificial Sequence
  chemically synthesized
tcaggaggtgaaaagtgaag

SEQ ID NO: 48663 - DNA, 20 bp, Artificial Sequence
  chemically synthesized
tctcaggaggtgaaaagtga

SEQ ID NO: 48664 - DNA, 20 bp, Artificial Sequence
  chemically synthesized
ttctcaggaggtgaaaagtg

SEQ ID NO: 48665 - DNA, 20 bp, Artificial Sequence
  chemically synthesized
atttattctcaggaggtgaa

SEQ ID NO: 48666 - DNA, 20 bp, Artificial Sequence
  chemically synthesized
tccttcacttttcacctcct

SEQ ID NO: 48667 - DNA, 20 bp, Artificial Sequence
  chemically synthesized
agaagggatttattctcagg

SEQ ID NO: 48668 - DNA, 20 bp, Artificial Sequence
  chemically synthesized
cagaagggatttattctcag

SEQ ID NO: 48669 - DNA, 20 bp, Artificial Sequence
  chemically synthesized
gacagaagggatttattctc

SEQ ID NO: 48670 - DNA, 20 bp, Artificial Sequence
  chemically synthesized
ggacagaagggatttattct

SEQ ID NO: 48671 - DNA, 20 bp, Artificial Sequence
  chemically synthesized
ggtgtgagttagggacagaa

SEQ ID NO: 48672 - DNA, 20 bp, Artificial Sequence
  chemically synthesized
tggtgtgagttagggacaga

SEQ ID NO: 48673 - DNA, 20 bp, Artificial Sequence
  chemically synthesized
atggtgtgagttagggacag

SEQ ID NO: 48674 - DNA, 20 bp, Artificial Sequence
  chemically synthesized
tttatggtgtgagttaggga

SEQ ID NO: 48675 - DNA, 20 bp, Artificial Sequence
  chemically synthesized
ctcatttatggtgtgagtta

SEQ ID NO: 48676 - DNA, 20 bp, Artificial Sequence
  chemically synthesized
gctcatttatggtgtgagtt

SEQ ID NO: 48677 - DNA, 20 bp, Artificial Sequence
  chemically synthesized
agctcatttatggtgtgagt

SEQ ID NO: 48678 - DNA, 20 bp, Artificial Sequence
  chemically synthesized
aatgagctcatttatggtgt

SEQ ID NO: 48679 - DNA, 20 bp, Artificial Sequence
  chemically synthesized
ccctaactcacaccataaat

SEQ ID NO: 48680 - DNA, 20 bp, Artificial Sequence
  chemically synthesized
gaatgaaatgagctcattta

SEQ ID NO: 48681 - DNA, 20 bp, Artificial Sequence
  chemically synthesized
gaagaggaatggaatgaaat

SEQ ID NO: 48682 - DNA, 20 bp, Artificial Sequence
  chemically synthesized
aaaaaaaaatcgaagaggaa

SEQ ID NO: 48683 - DNA, 20 bp, Artificial Sequence
  chemically synthesized
gtggaaaaaaaaaatcgaag

SEQ ID NO: 48684 - DNA, 20 bp, Artificial Sequence
  chemically synthesized
tgtggaaaaaaaaaatcgaa

SEQ ID NO: 48685 - DNA, 20 bp, Artificial Sequence
  chemically synthesized
tctgtggaaaaaaaaaatcg

SEQ ID NO: 48686 - DNA, 20 bp, Artificial Sequence
  chemically synthesized
tcttcgattttttttttcca

SEQ ID NO: 48687 - DNA, 20 bp, Artificial Sequence
  chemically synthesized
gtctgagcaggaaatgtctg

SEQ ID NO: 48688 - DNA, 20 bp, Artificial Sequence
  chemically synthesized
ttccacagacatttcctgct

SEQ ID NO: 48689 - DNA, 20 bp, Artificial Sequence
  chemically synthesized
gggaaagaaaaagtctgagc

SEQ ID NO: 48690 - DNA, 20 bp, Artificial Sequence
  chemically synthesized
agggaaagaaaaagtctgag

SEQ ID NO: 48691 - DNA, 20 bp, Artificial Sequence
  chemically synthesized
gatagggaaagaaaaagtct

SEQ ID NO: 48692 - DNA, 20 bp, Artificial Sequence
  chemically synthesized
caatttgatagggaaagaaa

SEQ ID NO: 48693 - DNA, 20 bp, Artificial Sequence
  chemically synthesized
tgagggcaatttgataggga

SEQ ID NO: 48694 - DNA, 20 bp, Artificial Sequence
  chemically synthesized
aacatgagggcaatttgata

SEQ ID NO: 48695 - DNA, 20 bp, Artificial Sequence
  chemically synthesized
caacatgagggcaatttgat

SEQ ID NO: 48696 - DNA, 20 bp, Artificial Sequence
  chemically synthesized
tcaacatgagggcaatttga

SEQ ID NO: 48697 - DNA, 20 bp, Artificial Sequence
  chemically synthesized
tgaaggattagtcaacatga

SEQ ID NO: 48698 - DNA, 20 bp, Artificial Sequence
  chemically synthesized
ttgaaggattagtcaacatg

SEQ ID NO: 48699 - DNA, 20 bp, Artificial Sequence
  chemically synthesized
attgaaggattagtcaacat

SEQ ID NO: 48700 - DNA, 20 bp, Artificial Sequence
  chemically synthesized
agagagaataattgaaggat

SEQ ID NO: 48701 - DNA, 20 bp, Artificial Sequence
  chemically synthesized
agacgagagagaataattga

SEQ ID NO: 48702 - DNA, 20 bp, Artificial Sequence
  chemically synthesized
cagacgagagagaataattg

SEQ ID NO: 48703 - DNA, 20 bp, Artificial Sequence
  chemically synthesized
atagaaataggcagacgaga

SEQ ID NO: 48704 - DNA, 20 bp, Artificial Sequence
  chemically synthesized
agatagaaataggcagacga

SEQ ID NO: 48705 - DNA, 20 bp, Artificial Sequence
  chemically synthesized
tgagatagaaataggcagac

SEQ ID NO: 48706 - DNA, 20 bp, Artificial Sequence
  chemically synthesized
tttaatgagatagaaatagg

SEQ ID NO: 48707 - DNA, 20 bp, Artificial Sequence
  chemically synthesized
tgttttaatgagatagaaat

SEQ ID NO: 48708 - DNA, 20 bp, Artificial Sequence
  chemically synthesized
atgttttaatgagatagaaa

SEQ ID NO: 48709 - DNA, 20 bp, Artificial Sequence
  chemically synthesized
gcactaatgttttaatgaga

SEQ ID NO: 48710 - DNA, 20 bp, Artificial Sequence
  chemically synthesized
gagagcactaatgttttaat

SEQ ID NO: 48711 - DNA, 20 bp, Artificial Sequence
  chemically synthesized
tttctatctcattaaaacat

SEQ ID NO: 48712 - DNA, 20 bp, Artificial Sequence
  chemically synthesized
atataaatataggttttaga

SEQ ID NO: 48713 - DNA, 20 bp, Artificial Sequence
  chemically synthesized
gaatataaatataggtttta

SEQ ID NO: 48714 - DNA, 20 bp, Artificial Sequence
  chemically synthesized
atgaatataaatataggttt

SEQ ID NO: 48715 - DNA, 20 bp, Artificial Sequence
  chemically synthesized
tgtataatgaatataaatat

SEQ ID NO: 48716 - DNA, 20 bp, Artificial Sequence
  chemically synthesized
atgtataatgaatataaata

SEQ ID NO: 48717 - DNA, 20 bp, Artificial Sequence
  chemically synthesized
tatattcattatacatacgt

SEQ ID NO: 48718 - DNA, 20 bp, Artificial Sequence
  chemically synthesized
ccgcccttctgttcagaaaa

SEQ ID NO: 48719 - DNA, 20 bp, Artificial Sequence
  chemically synthesized
accgcccttctgttcagaaa

SEQ ID NO: 48720 - DNA, 20 bp, Artificial Sequence
  chemically synthesized
taagaaatcccttttctgaa

SEQ ID NO: 48721 - DNA, 20 bp, Artificial Sequence
  chemically synthesized
taccgcccttctgttcagaa

SEQ ID NO: 48722 - DNA, 20 bp, Artificial Sequence
  chemically synthesized
gaaatcccttttctgaacag

SEQ ID NO: 48723 - DNA, 20 bp, Artificial Sequence
  chemically synthesized
aaatcccttttctgaacaga

SEQ ID NO: 48724 - DNA, 20 bp, Artificial Sequence
  chemically synthesized
aatcccttttctgaacagaa

SEQ ID NO: 48725 - DNA, 20 bp, Artificial Sequence
  chemically synthesized
ctccttaccgcccttctgtt

SEQ ID NO: 48726 - DNA, 20 bp, Artificial Sequence
  chemically synthesized
cccttttctgaacagaaggg

SEQ ID NO: 48727 - DNA, 20 bp, Artificial Sequence
  chemically synthesized
tttctgaacagaagggcggt

SEQ ID NO: 48728 - DNA, 20 bp, Artificial Sequence
  chemically synthesized
ttctgaacagaagggcggta

SEQ ID NO: 48729 - DNA, 20 bp, Artificial Sequence
  chemically synthesized
ctgaacagaagggcggtaag

SEQ ID NO: 48730 - DNA, 20 bp, Artificial Sequence
  chemically synthesized
tccctttccagtttcgtgtg

SEQ ID NO: 48731 - DNA, 20 bp, Artificial Sequence
  chemically synthesized
aaggagactacacacgaaac

SEQ ID NO: 48732 - DNA, 20 bp, Artificial Sequence
  chemically synthesized
agactacacacgaaactgga

SEQ ID NO: 48733 - DNA, 20 bp, Artificial Sequence
  chemically synthesized
gactacacacgaaactggaa

SEQ ID NO: 48734 - DNA, 20 bp, Artificial Sequence
  chemically synthesized
actacacacgaaactggaaa

SEQ ID NO: 48735 - DNA, 20 bp, Artificial Sequence
  chemically synthesized
tacacacgaaactggaaagg

SEQ ID NO: 48736 - DNA, 20 bp, Artificial Sequence
  chemically synthesized
aagatgaatatctccctttc

SEQ ID NO: 48737 - DNA, 20 bp, Artificial Sequence
  chemically synthesized
tgtatccaaaaaaaaaaaaa

SEQ ID NO: 48738 - DNA, 20 bp, Artificial Sequence
  chemically synthesized
ttcatctttttttttttttt

SEQ ID NO: 48739 - DNA, 20 bp, Artificial Sequence
  chemically synthesized
tttttttttttttttggata

SEQ ID NO: 48740 - DNA, 20 bp, Artificial Sequence
  chemically synthesized
tttttttttttttggataca

SEQ ID NO: 48741 - DNA, 20 bp, Artificial Sequence
  chemically synthesized
tccagcctgggtgacggagc

SEQ ID NO: 48742 - DNA, 20 bp, Artificial Sequence
  chemically synthesized
cagagtcttgctccgtcacc

SEQ ID NO: 48743 - DNA, 20 bp, Artificial Sequence
  chemically synthesized
gcgctccagcctgggtgacg

SEQ ID NO: 48744 - DNA, 20 bp, Artificial Sequence
  chemically synthesized
agagtcttgctccgtcaccc

SEQ ID NO: 48745 - DNA, 20 bp, Artificial Sequence
  chemically synthesized
ttgcgctccagcctgggtga

SEQ ID NO: 48746 - DNA, 20 bp, Artificial Sequence
  chemically synthesized
tcttgctccgtcacccaggc

SEQ ID NO: 48747 - DNA, 20 bp, Artificial Sequence
  chemically synthesized
ttgctccgtcacccaggctg

SEQ ID NO: 48748 - DNA, 20 bp, Artificial Sequence
  chemically synthesized
gcgccattgcgctccagcct

SEQ ID NO: 48749 - DNA, 20 bp, Artificial Sequence
  chemically synthesized
cgcgccattgcgctccagcc

SEQ ID NO: 48750 - DNA, 20 bp, Artificial Sequence
  chemically synthesized
gagatcgcgccattgcgctc

SEQ ID NO: 48751 - DNA, 20 bp, Artificial Sequence
  chemically synthesized
tcacccaggctggagcgcaa

SEQ ID NO: 48752 - DNA, 20 bp, Artificial Sequence
  chemically synthesized
ggagcgcaatggcgcgatct

SEQ ID NO: 48753 - DNA, 20 bp, Artificial Sequence
  chemically synthesized
ggcggaggttgcagtgagcc

SEQ ID NO: 48754 - DNA, 20 bp, Artificial Sequence
  chemically synthesized
caggaggcggaggttgcagt

SEQ ID NO: 48755 - DNA, 20 bp, Artificial Sequence
  chemically synthesized
aacccaggaggcggaggttg

SEQ ID NO: 48756 - DNA, 20 bp, Artificial Sequence
  chemically synthesized
tgcttgaacccaggaggcgg

SEQ ID NO: 48757 - DNA, 20 bp, Artificial Sequence
  chemically synthesized
tcactgcaacctccgcctcc

SEQ ID NO: 48758 - DNA, 20 bp, Artificial Sequence
  chemically synthesized
ttgcttgaacccaggaggcg

SEQ ID NO: 48759 - DNA, 20 bp, Artificial Sequence
  chemically synthesized
cactgcaacctccgcctcct

SEQ ID NO: 48760 - DNA, 20 bp, Artificial Sequence
  chemically synthesized
aattgcttgaacccaggagg

SEQ ID NO: 48761 - DNA, 20 bp, Artificial Sequence
  chemically synthesized
gagaattgcttgaacccagg

SEQ ID NO: 48762 - DNA, 20 bp, Artificial Sequence
  chemically synthesized
ggagaattgcttgaacccag

SEQ ID NO: 48763 - DNA, 20 bp, Artificial Sequence
  chemically synthesized
aacctccgcctcctgggttc

SEQ ID NO: 48764 - DNA, 20 bp, Artificial Sequence
  chemically synthesized
caggagaattgcttgaaccc

SEQ ID NO: 48765 - DNA, 20 bp, Artificial Sequence
  chemically synthesized
gcaggagaattgcttgaacc

SEQ ID NO: 48766 - DNA, 20 bp, Artificial Sequence
  chemically synthesized
ttcaagcaattctcctgcct

SEQ ID NO: 48767 - DNA, 20 bp, Artificial Sequence
  chemically synthesized
tacttgggaggctgaggcag

SEQ ID NO: 48768 - DNA, 20 bp, Artificial Sequence
  chemically synthesized
gctacttgggaggctgaggc

SEQ ID NO: 48769 - DNA, 20 bp, Artificial Sequence
  chemically synthesized
agctacttgggaggctgagg

SEQ ID NO: 48770 - DNA, 20 bp, Artificial Sequence
  chemically synthesized
cccagctacttgggaggctg

SEQ ID NO: 48771 - DNA, 20 bp, Artificial Sequence
  chemically synthesized
tcccagctacttgggaggct

SEQ ID NO: 48772 - DNA, 20 bp, Artificial Sequence
  chemically synthesized
ttctcctgcctcagcctccc

SEQ ID NO: 48773 - DNA, 20 bp, Artificial Sequence
  chemically synthesized
tcctgcctcagcctcccaag

SEQ ID NO: 48774 - DNA, 20 bp, Artificial Sequence
  chemically synthesized
tgtaatcccagctacttggg

SEQ ID NO: 48775 - DNA, 20 bp, Artificial Sequence
  chemically synthesized
ctgtaatcccagctacttgg

SEQ ID NO: 48776 - DNA, 20 bp, Artificial Sequence
  chemically synthesized
gcctcagcctcccaagtagc

SEQ ID NO: 48777 - DNA, 20 bp, Artificial Sequence
  chemically synthesized
acctgtaatcccagctactt

SEQ ID NO: 48778 - DNA, 20 bp, Artificial Sequence
  chemically synthesized
cctcagcctcccaagtagct

SEQ ID NO: 48779 - DNA, 20 bp, Artificial Sequence
  chemically synthesized
cacctgtaatcccagctact

SEQ ID NO: 48780 - DNA, 20 bp, Artificial Sequence
  chemically synthesized
ctcccaagtagctgggatta

SEQ ID NO: 48781 - DNA, 20 bp, Artificial Sequence
  chemically synthesized
tcccaagtagctgggattac

SEQ ID NO: 48782 - DNA, 20 bp, Artificial Sequence
  chemically synthesized
gtgacaggcacctgtaatcc

SEQ ID NO: 48783 - DNA, 20 bp, Artificial Sequence
  chemically synthesized
agttagctgggcatggtgac

SEQ ID NO: 48784 - DNA, 20 bp, Artificial Sequence
  chemically synthesized
aagttagctgggcatggtga

SEQ ID NO: 48785 - DNA, 20 bp, Artificial Sequence
  chemically synthesized
caggtgcctgtcaccatgcc

SEQ ID NO: 48786 - DNA, 20 bp, Artificial Sequence
  chemically synthesized
atacaaaagttagctgggca

SEQ ID NO: 48787 - DNA, 20 bp, Artificial Sequence
  chemically synthesized
gaaaaatacaaaagttagct

SEQ ID NO: 48788 - DNA, 20 bp, Artificial Sequence
  chemically synthesized
tgaaaaatacaaaagttagc

SEQ ID NO: 48789 - DNA, 20 bp, Artificial Sequence
  chemically synthesized
ctactgaaaaatacaaaagt

SEQ ID NO: 48790 - DNA, 20 bp, Artificial Sequence
  chemically synthesized
gtctctactgaaaaatacaa

SEQ ID NO: 48791 - DNA, 20 bp, Artificial Sequence
  chemically synthesized
cagctaacttttgtattttt

SEQ ID NO: 48792 - DNA, 20 bp, Artificial Sequence
  chemically synthesized
ctaacttttgtatttttcag

SEQ ID NO: 48793 - DNA, 20 bp, Artificial Sequence
  chemically synthesized
aacttttgtatttttcagta

SEQ ID NO: 48794 - DNA, 20 bp, Artificial Sequence
  chemically synthesized
tttgtatttttcagtagaga

SEQ ID NO: 48795 - DNA, 20 bp, Artificial Sequence
  chemically synthesized
ttgtatttttcagtagagac

SEQ ID NO: 48796 - DNA, 20 bp, Artificial Sequence
  chemically synthesized
tgtatttttcagtagagacg

SEQ ID NO: 48797 - DNA, 20 bp, Artificial Sequence
  chemically synthesized
gagacggggtttcaccatgt

SEQ ID NO: 48798 - DNA, 20 bp, Artificial Sequence
  chemically synthesized
cggggtttcaccatgttggt

SEQ ID NO: 48799 - DNA, 20 bp, Artificial Sequence
  chemically synthesized
caagaccagcctgaccaaca

SEQ ID NO: 48800 - DNA, 20 bp, Artificial Sequence
  chemically synthesized
ggggtttcaccatgttggtc

SEQ ID NO: 48801 - DNA, 20 bp, Artificial Sequence
  chemically synthesized
tttcaccatgttggtcaggc

SEQ ID NO: 48802 - DNA, 20 bp, Artificial Sequence
  chemically synthesized
tgaggtcaggagttcaagac

SEQ ID NO: 48803 - DNA, 20 bp, Artificial Sequence
  chemically synthesized
tcacctgaggtcaggagttc

SEQ ID NO: 48804 - DNA, 20 bp, Artificial Sequence
  chemically synthesized
tggtcttgaactcctgacct

SEQ ID NO: 48805 - DNA, 20 bp, Artificial Sequence
  chemically synthesized
ggtggatcacctgaggtcag

SEQ ID NO: 48806 - DNA, 20 bp, Artificial Sequence
  chemically synthesized
ggtcttgaactcctgacctc

SEQ ID NO: 48807 - DNA, 20 bp, Artificial Sequence
  chemically synthesized
tgggtggatcacctgaggtc

SEQ ID NO: 48808 - DNA, 20 bp, Artificial Sequence
  chemically synthesized
gtgggtggatcacctgaggt

SEQ ID NO: 48809 - DNA, 20 bp, Artificial Sequence
  chemically synthesized
caaggtgggtggatcacctg

SEQ ID NO: 48810 - DNA, 20 bp, Artificial Sequence
  chemically synthesized
ccaaggtgggtggatcacct

SEQ ID NO: 48811 - DNA, 20 bp, Artificial Sequence
  chemically synthesized
ctcaggtgatccacccacct

SEQ ID NO: 48812 - DNA, 20 bp, Artificial Sequence
  chemically synthesized
ctttgggaggccaaggtggg

SEQ ID NO: 48813 - DNA, 20 bp, Artificial Sequence
  chemically synthesized
gcactttgggaggccaaggt

SEQ ID NO: 48814 - DNA, 20 bp, Artificial Sequence
  chemically synthesized
agcactttgggaggccaagg

SEQ ID NO: 48815 - DNA, 20 bp, Artificial Sequence
  chemically synthesized
cccagcactttgggaggcca

SEQ ID NO: 48816 - DNA, 20 bp, Artificial Sequence
  chemically synthesized
tcccagcactttgggaggcc

SEQ ID NO: 48817 - DNA, 20 bp, Artificial Sequence
  chemically synthesized
ccacccaccttggcctccca

SEQ ID NO: 48818 - DNA, 20 bp, Artificial Sequence
  chemically synthesized
tgtgatcccagcactttggg

SEQ ID NO: 48819 - DNA, 20 bp, Artificial Sequence
  chemically synthesized
ctgtgatcccagcactttgg

SEQ ID NO: 48820 - DNA, 20 bp, Artificial Sequence
  chemically synthesized
accttggcctcccaaagtgc

SEQ ID NO: 48821 - DNA, 20 bp, Artificial Sequence
  chemically synthesized
gcctgtgatcccagcacttt

SEQ ID NO: 48822 - DNA, 20 bp, Artificial Sequence
  chemically synthesized
ccttggcctcccaaagtgct

SEQ ID NO: 48823 - DNA, 20 bp, Artificial Sequence
  chemically synthesized
cgcctgtgatcccagcactt

SEQ ID NO: 48824 - DNA, 20 bp, Artificial Sequence
  chemically synthesized
ctcccaaagtgctgggatca

SEQ ID NO: 48825 - DNA, 20 bp, Artificial Sequence
  chemically synthesized
tcccaaagtgctgggatcac

SEQ ID NO: 48826 - DNA, 20 bp, Artificial Sequence
  chemically synthesized
gtggctcacgcctgtgatcc

SEQ ID NO: 48827 - DNA, 20 bp, Artificial Sequence
  chemically synthesized
agtgctgggatcacaggcgt

SEQ ID NO: 48828 - DNA, 20 bp, Artificial Sequence
  chemically synthesized
caggcgtgagccaccgcgcc

SEQ ID NO: 48829 - DNA, 20 bp, Artificial Sequence
  chemically synthesized
atatctcgggccgggcgcgg

SEQ ID NO: 48830 - DNA, 20 bp, Artificial Sequence
  chemically synthesized
tgaatatctcgggccgggcg

SEQ ID NO: 48831 - DNA, 20 bp, Artificial Sequence
  chemically synthesized
tgagccaccgcgcccggccc

SEQ ID NO: 48832 - DNA, 20 bp, Artificial Sequence
  chemically synthesized
taagatgaatatctcgggcc

SEQ ID NO: 48833 - DNA, 20 bp, Artificial Sequence
  chemically synthesized
ataagatgaatatctcgggc

SEQ ID NO: 48834 - DNA, 20 bp, Artificial Sequence
  chemically synthesized
tctgataagatgaatatctc

SEQ ID NO: 48835 - DNA, 20 bp, Artificial Sequence
  chemically synthesized
ttctgataagatgaatatct

SEQ ID NO: 48836 - DNA, 20 bp, Artificial Sequence
  chemically synthesized
gcccgagatattcatcttat

SEQ ID NO: 48837 - DNA, 20 bp, Artificial Sequence
  chemically synthesized
agatattcatcttatcagaa

SEQ ID NO: 48838 - DNA, 20 bp, Artificial Sequence
  chemically synthesized
ttctacttagccattctgat

SEQ ID NO: 48839 - DNA, 20 bp, Artificial Sequence
  chemically synthesized
ttcatcttatcagaatggct

SEQ ID NO: 48840 - DNA, 20 bp, Artificial Sequence
  chemically synthesized
atcttatcagaatggctaag

SEQ ID NO: 48841 - DNA, 20 bp, Artificial Sequence
  chemically synthesized
ttatcagaatggctaagtag

SEQ ID NO: 48842 - DNA, 20 bp, Artificial Sequence
  chemically synthesized
tatcagaatggctaagtaga

SEQ ID NO: 48843 - DNA, 20 bp, Artificial Sequence
  chemically synthesized
atcagaatggctaagtagaa

SEQ ID NO: 48844 - DNA, 20 bp, Artificial Sequence
  chemically synthesized
atcagtttctcccttctact

SEQ ID NO: 48845 - DNA, 20 bp, Artificial Sequence
  chemically synthesized
cagaatggctaagtagaagg

SEQ ID NO: 48846 - DNA, 20 bp, Artificial Sequence
  chemically synthesized
tgcattcagtgatgaaaaat

SEQ ID NO: 48847 - DNA, 20 bp, Artificial Sequence
  chemically synthesized
caagagtcacaagatgcatt

SEQ ID NO: 48848 - DNA, 20 bp, Artificial Sequence
  chemically synthesized
tctcacctagcaagagtcac

SEQ ID NO: 48849 - DNA, 20 bp, Artificial Sequence
  chemically synthesized
atgcatcttgtgactcttgc

SEQ ID NO: 48850 - DNA, 20 bp, Artificial Sequence
  chemically synthesized
tgcatcttgtgactcttgct

SEQ ID NO: 48851 - DNA, 20 bp, Artificial Sequence
  chemically synthesized
tccctgatctcacctagcaa

SEQ ID NO: 48852 - DNA, 20 bp, Artificial Sequence
  chemically synthesized
tcttgtgactcttgctaggt

SEQ ID NO: 48853 - DNA, 20 bp, Artificial Sequence
  chemically synthesized
ggtccctgatctcacctagc

SEQ ID NO: 48854 - DNA, 20 bp, Artificial Sequence
  chemically synthesized
gcttggtccctgatctcacc

SEQ ID NO: 48855 - DNA, 20 bp, Artificial Sequence
  chemically synthesized
tgactcttgctaggtgagat

SEQ ID NO: 48856 - DNA, 20 bp, Artificial Sequence
  chemically synthesized
gactcttgctaggtgagatc

SEQ ID NO: 48857 - DNA, 20 bp, Artificial Sequence
  chemically synthesized
actcttgctaggtgagatca

SEQ ID NO: 48858 - DNA, 20 bp, Artificial Sequence
  chemically synthesized
gctaggtgagatcagggacc

SEQ ID NO: 48859 - DNA, 20 bp, Artificial Sequence
  chemically synthesized
aaagaatgtttataattgct

SEQ ID NO: 48860 - DNA, 20 bp, Artificial Sequence
  chemically synthesized
aattataaacattctttgct

SEQ ID NO: 48861 - DNA, 20 bp, Artificial Sequence
  chemically synthesized
cttttgataggaacttagca

SEQ ID NO: 48862 - DNA, 20 bp, Artificial Sequence
  chemically synthesized
tattccttttgataggaact

SEQ ID NO: 48863 - DNA, 20 bp, Artificial Sequence
  chemically synthesized
ctttgctaagttcctatcaa

SEQ ID NO: 48864 - DNA, 20 bp, Artificial Sequence
  chemically synthesized
tttgctaagttcctatcaaa

SEQ ID NO: 48865 - DNA, 20 bp, Artificial Sequence
  chemically synthesized
tagagggtattccttttgat

SEQ ID NO: 48866 - DNA, 20 bp, Artificial Sequence
  chemically synthesized
gtagagggtattccttttga

SEQ ID NO: 48867 - DNA, 20 bp, Artificial Sequence
  chemically synthesized
aaaaggaataccctctactt

SEQ ID NO: 48868 - DNA, 20 bp, Artificial Sequence
  chemically synthesized
acatgcaaatccaaagtaga

SEQ ID NO: 48869 - DNA, 20 bp, Artificial Sequence
  chemically synthesized
tacatgcaaatccaaagtag

SEQ ID NO: 48870 - DNA, 20 bp, Artificial Sequence
  chemically synthesized
ctacatgcaaatccaaagta

SEQ ID NO: 48871 - DNA, 20 bp, Artificial Sequence
  chemically synthesized
ggctacatgcaaatccaaag

SEQ ID NO: 48872 - DNA, 20 bp, Artificial Sequence
  chemically synthesized
tgaggctacatgcaaatcca

SEQ ID NO: 48873 - DNA, 20 bp, Artificial Sequence
  chemically synthesized
ctctactttggatttgcatg

SEQ ID NO: 48874 - DNA, 20 bp, Artificial Sequence
  chemically synthesized
tttggatttgcatgtagcct

SEQ ID NO: 48875 - DNA, 20 bp, Artificial Sequence
  chemically synthesized
ttggatttgcatgtagcctc

SEQ ID NO: 48876 - DNA, 20 bp, Artificial Sequence
  chemically synthesized
tggatttgcatgtagcctca

SEQ ID NO: 48877 - DNA, 20 bp, Artificial Sequence
  chemically synthesized
attaacgcatattgtccctg

SEQ ID NO: 48878 - DNA, 20 bp, Artificial Sequence
  chemically synthesized
tattaacgcatattgtccct

SEQ ID NO: 48879 - DNA, 20 bp, Artificial Sequence
  chemically synthesized
aatatgcgttaatactcaac

SEQ ID NO: 48880 - DNA, 20 bp, Artificial Sequence
  chemically synthesized
tgcgttaatactcaactaga

SEQ ID NO: 48881 - DNA, 20 bp, Artificial Sequence
  chemically synthesized
aggagatgttctatctagtt

SEQ ID NO: 48882 - DNA, 20 bp, Artificial Sequence
  chemically synthesized
gagaaaggagatgttctatc

SEQ ID NO: 48883 - DNA, 20 bp, Artificial Sequence
  chemically synthesized
cattccacagtgagagaaag

SEQ ID NO: 48884 - DNA, 20 bp, Artificial Sequence
  chemically synthesized
tccattccacagtgagagaa

SEQ ID NO: 48885 - DNA, 20 bp, Artificial Sequence
  chemically synthesized
atccattccacagtgagaga

SEQ ID NO: 48886 - DNA, 20 bp, Artificial Sequence
  chemically synthesized
acatctcctttctctcactg

SEQ ID NO: 48887 - DNA, 20 bp, Artificial Sequence
  chemically synthesized
aggaatccattccacagtga

SEQ ID NO: 48888 - DNA, 20 bp, Artificial Sequence
  chemically synthesized
ggaggaatccattccacagt

SEQ ID NO: 48889 - DNA, 20 bp, Artificial Sequence
  chemically synthesized
tcctttctctcactgtggaa

SEQ ID NO: 48890 - DNA, 20 bp, Artificial Sequence
  chemically synthesized
gaagggaggaatccattcca

SEQ ID NO: 48891 - DNA, 20 bp, Artificial Sequence
  chemically synthesized
atgggagtagaatggaaggg

SEQ ID NO: 48892 - DNA, 20 bp, Artificial Sequence
  chemically synthesized
aatgggagtagaatggaagg

SEQ ID NO: 48893 - DNA, 20 bp, Artificial Sequence
  chemically synthesized
gcaatgggagtagaatggaa

SEQ ID NO: 48894 - DNA, 20 bp, Artificial Sequence
  chemically synthesized
tgcaatgggagtagaatgga

SEQ ID NO: 48895 - DNA, 20 bp, Artificial Sequence
  chemically synthesized
gtgcaatgggagtagaatgg

SEQ ID NO: 48896 - DNA, 20 bp, Artificial Sequence
  chemically synthesized
tgggtgcaatgggagtagaa

SEQ ID NO: 48897 - DNA, 20 bp, Artificial Sequence
  chemically synthesized
aatagtgggtgcaatgggag

SEQ ID NO: 48898 - DNA, 20 bp, Artificial Sequence
  chemically synthesized
gtaaatagtgggtgcaatgg

SEQ ID NO: 48899 - DNA, 20 bp, Artificial Sequence
  chemically synthesized
tagtaaatagtgggtgcaat

SEQ ID NO: 48900 - DNA, 20 bp, Artificial Sequence
  chemically synthesized
gtagtaaatagtgggtgcaa

SEQ ID NO: 48901 - DNA, 20 bp, Artificial Sequence
  chemically synthesized
ctacagtggtagtaaatagt

SEQ ID NO: 48902 - DNA, 20 bp, Artificial Sequence
  chemically synthesized
cctacagtggtagtaaatag

SEQ ID NO: 48903 - DNA, 20 bp, Artificial Sequence
  chemically synthesized
cctcctacagtggtagtaaa

SEQ ID NO: 48904 - DNA, 20 bp, Artificial Sequence
  chemically synthesized
cccactatttactaccactg

SEQ ID NO: 48905 - DNA, 20 bp, Artificial Sequence
  chemically synthesized
ccactatttactaccactgt

SEQ ID NO: 48906 - DNA, 20 bp, Artificial Sequence
  chemically synthesized
aaaatgacctcctacagtgg

SEQ ID NO: 48907 - DNA, 20 bp, Artificial Sequence
  chemically synthesized
actatttactaccactgtag

SEQ ID NO: 48908 - DNA, 20 bp, Artificial Sequence
  chemically synthesized
ctatttactaccactgtagg

SEQ ID NO: 48909 - DNA, 20 bp, Artificial Sequence
  chemically synthesized
taaaaaatgacctcctacag

SEQ ID NO: 48910 - DNA, 20 bp, Artificial Sequence
  chemically synthesized
ctataaaaaatgacctccta

SEQ ID NO: 48911 - DNA, 20 bp, Artificial Sequence
  chemically synthesized
ctgtaggaggtcatttttta

SEQ ID NO: 48912 - DNA, 20 bp, Artificial Sequence
  chemically synthesized
tgtaggaggtcattttttat

SEQ ID NO: 48913 - DNA, 20 bp, Artificial Sequence
  chemically synthesized
taaataccaatcacaaaaga

SEQ ID NO: 48914 - DNA, 20 bp, Artificial Sequence
  chemically synthesized
ataggtctgtcttttgtgat

SEQ ID NO: 48915 - DNA, 20 bp, Artificial Sequence
  chemically synthesized
catttaaataccaatcacaa

SEQ ID NO: 48916 - DNA, 20 bp, Artificial Sequence
  chemically synthesized
gattggtatttaaatgtccc

SEQ ID NO: 48917 - DNA, 20 bp, Artificial Sequence
  chemically synthesized
attggtatttaaatgtccca

SEQ ID NO: 48918 - DNA, 20 bp, Artificial Sequence
  chemically synthesized
aaaaagagaattattgcctt

SEQ ID NO: 48919 - DNA, 20 bp, Artificial Sequence
  chemically synthesized
taaaaagagaattattgcct

SEQ ID NO: 48920 - DNA, 20 bp, Artificial Sequence
  chemically synthesized
ctgaaatatgaagataaaaa

SEQ ID NO: 48921 - DNA, 20 bp, Artificial Sequence
  chemically synthesized
acctgaaatatgaagataaa

SEQ ID NO: 48922 - DNA, 20 bp, Artificial Sequence
  chemically synthesized
ctctttttatcttcatattt

SEQ ID NO: 48923 - DNA, 20 bp, Artificial Sequence
  chemically synthesized
aacgagtcacctgaaatatg

SEQ ID NO: 48924 - DNA, 20 bp, Artificial Sequence
  chemically synthesized
tctttttatcttcatatttc

SEQ ID NO: 48925 - DNA, 20 bp, Artificial Sequence
  chemically synthesized
ctatatttattaacaaaaac

SEQ ID NO: 48926 - DNA, 20 bp, Artificial Sequence
  chemically synthesized
ctcgtttttgttaataaata

SEQ ID NO: 48927 - DNA, 20 bp, Artificial Sequence
  chemically synthesized
tcgtttttgttaataaatat

SEQ ID NO: 48928 - DNA, 20 bp, Artificial Sequence
  chemically synthesized
gaatgaatgaatgaatacta

SEQ ID NO: 48929 - DNA, 20 bp, Artificial Sequence
  chemically synthesized
aatgaatgaatgaatactac

SEQ ID NO: 48930 - DNA, 20 bp, Artificial Sequence
  chemically synthesized
atgaatgaatactacaggca

SEQ ID NO: 48931 - DNA, 20 bp, Artificial Sequence
  chemically synthesized
attgttacttactgtgcctg

SEQ ID NO: 48932 - DNA, 20 bp, Artificial Sequence
  chemically synthesized
atgaatactacaggcacagt

SEQ ID NO: 48933 - DNA, 20 bp, Artificial Sequence
  chemically synthesized
cacagtaagtaacaatgcta

SEQ ID NO: 48934 - DNA, 20 bp, Artificial Sequence
  chemically synthesized
acagtaagtaacaatgctac

SEQ ID NO: 48935 - DNA, 20 bp, Artificial Sequence
  chemically synthesized
aagaagtgacatggtgcctg

SEQ ID NO: 48936 - DNA, 20 bp, Artificial Sequence
  chemically synthesized
ttctgagctaagaagtgaca

SEQ ID NO: 48937 - DNA, 20 bp, Artificial Sequence
  chemically synthesized
acaggcaccatgtcacttct

SEQ ID NO: 48938 - DNA, 20 bp, Artificial Sequence
  chemically synthesized
caccatgtcacttcttagct

SEQ ID NO: 48939 - DNA, 20 bp, Artificial Sequence
  chemically synthesized
tcatagaattctgagctaag

SEQ ID NO: 48940 - DNA, 20 bp, Artificial Sequence
  chemically synthesized
aagtcatagaattctgagct

SEQ ID NO: 48941 - DNA, 20 bp, Artificial Sequence
  chemically synthesized
aagggaagtcatagaattct

SEQ ID NO: 48942 - DNA, 20 bp, Artificial Sequence
  chemically synthesized
ctttgtgagaagggaagtca

SEQ ID NO: 48943 - DNA, 20 bp, Artificial Sequence
  chemically synthesized
tatatgctttgtgagaaggg

SEQ ID NO: 48944 - DNA, 20 bp, Artificial Sequence
  chemically synthesized
gcatatatgctttgtgagaa

SEQ ID NO: 48945 - DNA, 20 bp, Artificial Sequence
  chemically synthesized
ctatgacttcccttctcaca

SEQ ID NO: 48946 - DNA, 20 bp, Artificial Sequence
  chemically synthesized
ggcatatatgctttgtgaga

SEQ ID NO: 48947 - DNA, 20 bp, Artificial Sequence
  chemically synthesized
tggcatatatgctttgtgag

SEQ ID NO: 48948 - DNA, 20 bp, Artificial Sequence
  chemically synthesized
ctttggcatatatgctttgt

SEQ ID NO: 48949 - DNA, 20 bp, Artificial Sequence
  chemically synthesized
ctcacaaagcatatatgcca

SEQ ID NO: 48950 - DNA, 20 bp, Artificial Sequence
  chemically synthesized
tcacaaagcatatatgccaa

SEQ ID NO: 48951 - DNA, 20 bp, Artificial Sequence
  chemically synthesized
tggctatcgttaaaagcctt

SEQ ID NO: 48952 - DNA, 20 bp, Artificial Sequence
  chemically synthesized
atgccaaaggcttttaacga

SEQ ID NO: 48953 - DNA, 20 bp, Artificial Sequence
  chemically synthesized
ctatggttggctatcgttaa

SEQ ID NO: 48954 - DNA, 20 bp, Artificial Sequence
  chemically synthesized
cttttaacgatagccaacca

SEQ ID NO: 48955 - DNA, 20 bp, Artificial Sequence
  chemically synthesized
agggtcttatcaactatggt

SEQ ID NO: 48956 - DNA, 20 bp, Artificial Sequence
  chemically synthesized
aggaagggtcttatcaacta

SEQ ID NO: 48957 - DNA, 20 bp, Artificial Sequence
  chemically synthesized
gatagccaaccatagttgat

SEQ ID NO: 48958 - DNA, 20 bp, Artificial Sequence
  chemically synthesized
accaagggccagacgaggaa

SEQ ID NO: 48959 - DNA, 20 bp, Artificial Sequence
  chemically synthesized
gaccaagggccagacgagga

SEQ ID NO: 48960 - DNA, 20 bp, Artificial Sequence
  chemically synthesized
tgataagacccttcctcgtc

SEQ ID NO: 48961 - DNA, 20 bp, Artificial Sequence
  chemically synthesized
tgaccaagggccagacgagg

SEQ ID NO: 48962 - DNA, 20 bp, Artificial Sequence
  chemically synthesized
gagtgaccaagggccagacg

SEQ ID NO: 48963 - DNA, 20 bp, Artificial Sequence
  chemically synthesized
tgagtgaccaagggccagac

SEQ ID NO: 48964 - DNA, 20 bp, Artificial Sequence
  chemically synthesized
acccttcctcgtctggccct

SEQ ID NO: 48965 - DNA, 20 bp, Artificial Sequence
  chemically synthesized
gtcagtgagtgaccaagggc

SEQ ID NO: 48966 - DNA, 20 bp, Artificial Sequence
  chemically synthesized
ggaggtcagtgagtgaccaa

SEQ ID NO: 48967 - DNA, 20 bp, Artificial Sequence
  chemically synthesized
aggaggtcagtgagtgacca

SEQ ID NO: 48968 - DNA, 20 bp, Artificial Sequence
  chemically synthesized
taggaggtcagtgagtgacc

SEQ ID NO: 48969 - DNA, 20 bp, Artificial Sequence
  chemically synthesized
gtgaatgataggaggtcagt

SEQ ID NO: 48970 - DNA, 20 bp, Artificial Sequence
  chemically synthesized
gatggtgaatgataggaggt

SEQ ID NO: 48971 - DNA, 20 bp, Artificial Sequence
  chemically synthesized
gaaagatggtgaatgatagg

SEQ ID NO: 48972 - DNA, 20 bp, Artificial Sequence
  chemically synthesized
agaaagatggtgaatgatag

SEQ ID NO: 48973 - DNA, 20 bp, Artificial Sequence
  chemically synthesized
gaagaaagatggtgaatgat

SEQ ID NO: 48974 - DNA, 20 bp, Artificial Sequence
  chemically synthesized
ggaagaaagatggtgaatga

SEQ ID NO: 48975 - DNA, 20 bp, Artificial Sequence
  chemically synthesized
ctgaagccaaggaagaaaga

SEQ ID NO: 48976 - DNA, 20 bp, Artificial Sequence
  chemically synthesized
cattcaccatctttcttcct

SEQ ID NO: 48977 - DNA, 20 bp, Artificial Sequence
  chemically synthesized
atgactgaagccaaggaaga

SEQ ID NO: 48978 - DNA, 20 bp, Artificial Sequence
  chemically synthesized
cagtatgactgaagccaagg

SEQ ID NO: 48979 - DNA, 20 bp, Artificial Sequence
  chemically synthesized
ccatctttcttccttggctt

SEQ ID NO: 48980 - DNA, 20 bp, Artificial Sequence
  chemically synthesized
agccagtatgactgaagcca

SEQ ID NO: 48981 - DNA, 20 bp, Artificial Sequence
  chemically synthesized
aagccagtatgactgaagcc

SEQ ID NO: 48982 - DNA, 20 bp, Artificial Sequence
  chemically synthesized
caaggaagccagtatgactg

SEQ ID NO: 48983 - DNA, 20 bp, Artificial Sequence
  chemically synthesized
ttccttggcttcagtcatac

SEQ ID NO: 48984 - DNA, 20 bp, Artificial Sequence
  chemically synthesized
aatattaatagcaaggaagc

SEQ ID NO: 48985 - DNA, 20 bp, Artificial Sequence
  chemically synthesized
gagaaatattaatagcaagg

SEQ ID NO: 48986 - DNA, 20 bp, Artificial Sequence
  chemically synthesized
tttgagaaatattaatagca

SEQ ID NO: 48987 - DNA, 20 bp, Artificial Sequence
  chemically synthesized
gtttgagaaatattaatagc

SEQ ID NO: 48988 - DNA, 20 bp, Artificial Sequence
  chemically synthesized
gagggtttgagaaatattaa

SEQ ID NO: 48989 - DNA, 20 bp, Artificial Sequence
  chemically synthesized
ggagcatgcttagagggttt

SEQ ID NO: 48990 - DNA, 20 bp, Artificial Sequence
  chemically synthesized
taatatttctcaaaccctct

SEQ ID NO: 48991 - DNA, 20 bp, Artificial Sequence
  chemically synthesized
caagatggagcatgcttaga

SEQ ID NO: 48992 - DNA, 20 bp, Artificial Sequence
  chemically synthesized
ccaagatggagcatgcttag

SEQ ID NO: 48993 - DNA, 20 bp, Artificial Sequence
  chemically synthesized
tccaagatggagcatgctta

SEQ ID NO: 48994 - DNA, 20 bp, Artificial Sequence
  chemically synthesized
gatccaagatggagcatgct

SEQ ID NO: 48995 - DNA, 20 bp, Artificial Sequence
  chemically synthesized
cctctaagcatgctccatct

SEQ ID NO: 48996 - DNA, 20 bp, Artificial Sequence
  chemically synthesized
aaagtaaaggatccaagatg

SEQ ID NO: 48997 - DNA, 20 bp, Artificial Sequence
  chemically synthesized
taaaagtaaaggatccaaga

SEQ ID NO: 48998 - DNA, 20 bp, Artificial Sequence
  chemically synthesized
acagtaaaagtaaaggatcc

SEQ ID NO: 48999 - DNA, 20 bp, Artificial Sequence
  chemically synthesized
ggaggaaacagtaaaagtaa

SEQ ID NO: 49000 - DNA, 20 bp, Artificial Sequence
  chemically synthesized
tggaggaaacagtaaaagta

SEQ ID NO: 49001 - DNA, 20 bp, Artificial Sequence
  chemically synthesized
ccaggtggaggaaacagtaa

SEQ ID NO: 49002 - DNA, 20 bp, Artificial Sequence
  chemically synthesized
agtgttccaggtggaggaaa

SEQ ID NO: 49003 - DNA, 20 bp, Artificial Sequence
  chemically synthesized
cttttactgtttcctccacc

SEQ ID NO: 49004 - DNA, 20 bp, Artificial Sequence
  chemically synthesized
ggacaaagtgttccaggtgg

SEQ ID NO: 49005 - DNA, 20 bp, Artificial Sequence
  chemically synthesized
gggacaaagtgttccaggtg

SEQ ID NO: 49006 - DNA, 20 bp, Artificial Sequence
  chemically synthesized
gggggacaaagtgttccagg

SEQ ID NO: 49007 - DNA, 20 bp, Artificial Sequence
  chemically synthesized
attgggggacaaagtgttcc

SEQ ID NO: 49008 - DNA, 20 bp, Artificial Sequence
  chemically synthesized
tattgggggacaaagtgttc

SEQ ID NO: 49009 - DNA, 20 bp, Artificial Sequence
  chemically synthesized
cagtcagatattgggggaca

SEQ ID NO: 49010 - DNA, 20 bp, Artificial Sequence
  chemically synthesized
gtacaccagtcagatattgg

SEQ ID NO: 49011 - DNA, 20 bp, Artificial Sequence
  chemically synthesized
agtacaccagtcagatattg

SEQ ID NO: 49012 - DNA, 20 bp, Artificial Sequence
  chemically synthesized
aagtacaccagtcagatatt

SEQ ID NO: 49013 - DNA, 20 bp, Artificial Sequence
  chemically synthesized
gaagtacaccagtcagatat

SEQ ID NO: 49014 - DNA, 20 bp, Artificial Sequence
  chemically synthesized
tttgtcccccaatatctgac

SEQ ID NO: 49015 - DNA, 20 bp, Artificial Sequence
  chemically synthesized
atgtgaggaagtacaccagt

SEQ ID NO: 49016 - DNA, 20 bp, Artificial Sequence
  chemically synthesized
agagatgtgaggaagtacac

SEQ ID NO: 49017 - DNA, 20 bp, Artificial Sequence
  chemically synthesized
atttcagtagagatgtgagg

SEQ ID NO: 49018 - DNA, 20 bp, Artificial Sequence
  chemically synthesized
gacatttcagtagagatgtg

SEQ ID NO: 49019 - DNA, 20 bp, Artificial Sequence
  chemically synthesized
tgacatttcagtagagatgt

SEQ ID NO: 49020 - DNA, 20 bp, Artificial Sequence
  chemically synthesized
ggaatggtgacatttcagta

SEQ ID NO: 49021 - DNA, 20 bp, Artificial Sequence
  chemically synthesized
caggaatggtgacatttcag

SEQ ID NO: 49022 - DNA, 20 bp, Artificial Sequence
  chemically synthesized
ggtcaggaatggtgacattt

SEQ ID NO: 49023 - DNA, 20 bp, Artificial Sequence
  chemically synthesized
tttagtggagtggtcaggaa

SEQ ID NO: 49024 - DNA, 20 bp, Artificial Sequence
  chemically synthesized
acccttttagtggagtggtc

SEQ ID NO: 49025 - DNA, 20 bp, Artificial Sequence
  chemically synthesized
gacccttttagtggagtggt

SEQ ID NO: 49026 - DNA, 20 bp, Artificial Sequence
  chemically synthesized
aggggacccttttagtggag

SEQ ID NO: 49027 - DNA, 20 bp, Artificial Sequence
  chemically synthesized
attcctgaccactccactaa

SEQ ID NO: 49028 - DNA, 20 bp, Artificial Sequence
  chemically synthesized
ttcctgaccactccactaaa

SEQ ID NO: 49029 - DNA, 20 bp, Artificial Sequence
  chemically synthesized
agaaggggacccttttagtg

SEQ ID NO: 49030 - DNA, 20 bp, Artificial Sequence
  chemically synthesized
tcctgaccactccactaaaa

SEQ ID NO: 49031 - DNA, 20 bp, Artificial Sequence
  chemically synthesized
ggagaaggggacccttttag

SEQ ID NO: 49032 - DNA, 20 bp, Artificial Sequence
  chemically synthesized
atgggagaaggggacccttt

SEQ ID NO: 49033 - DNA, 20 bp, Artificial Sequence
  chemically synthesized
gggctagaggatgggagaag

SEQ ID NO: 49034 - DNA, 20 bp, Artificial Sequence
  chemically synthesized
ggggctagaggatgggagaa

SEQ ID NO: 49035 - DNA, 20 bp, Artificial Sequence
  chemically synthesized
aggggctagaggatgggaga

SEQ ID NO: 49036 - DNA, 20 bp, Artificial Sequence
  chemically synthesized
aaggggctagaggatgggag

SEQ ID NO: 49037 - DNA, 20 bp, Artificial Sequence
  chemically synthesized
ctaaaggggctagaggatgg

SEQ ID NO: 49038 - DNA, 20 bp, Artificial Sequence
  chemically synthesized
ggtccccttctcccatcctc

SEQ ID NO: 49039 - DNA, 20 bp, Artificial Sequence
  chemically synthesized
ggctaaaggggctagaggat

SEQ ID NO: 49040 - DNA, 20 bp, Artificial Sequence
  chemically synthesized
aggctaaaggggctagagga

SEQ ID NO: 49041 - DNA, 20 bp, Artificial Sequence
  chemically synthesized
aagcaggctaaaggggctag

SEQ ID NO: 49042 - DNA, 20 bp, Artificial Sequence
  chemically synthesized
aaagcaggctaaaggggcta

SEQ ID NO: 49043 - DNA, 20 bp, Artificial Sequence
  chemically synthesized
ctcccatcctctagcccctt

SEQ ID NO: 49044 - DNA, 20 bp, Artificial Sequence
  chemically synthesized
ataaagcaggctaaaggggc

SEQ ID NO: 49045 - DNA, 20 bp, Artificial Sequence
  chemically synthesized
aagaataaagcaggctaaag

SEQ ID NO: 49046 - DNA, 20 bp, Artificial Sequence
  chemically synthesized
aaagaataaagcaggctaaa

SEQ ID NO: 49047 - DNA, 20 bp, Artificial Sequence
  chemically synthesized
caaagaataaagcaggctaa

SEQ ID NO: 49048 - DNA, 20 bp, Artificial Sequence
  chemically synthesized
acaaagaataaagcaggcta

SEQ ID NO: 49049 - DNA, 20 bp, Artificial Sequence
  chemically synthesized
ttaaaaacaaagaataaagc

SEQ ID NO: 49050 - DNA, 20 bp, Artificial Sequence
  chemically synthesized
tttaaaaacaaagaataaag

SEQ ID NO: 49051 - DNA, 20 bp, Artificial Sequence
  chemically synthesized
tgatttaaaaacaaagaata

SEQ ID NO: 49052 - DNA, 20 bp, Artificial Sequence
  chemically synthesized
ataagtttgatttaaaaaca

SEQ ID NO: 49053 - DNA, 20 bp, Artificial Sequence
  chemically synthesized
atggacaatcaggtcatgat

SEQ ID NO: 49054 - DNA, 20 bp, Artificial Sequence
  chemically synthesized
acaagagaagatggacaatc

SEQ ID NO: 49055 - DNA, 20 bp, Artificial Sequence
  chemically synthesized
aacaagagaagatggacaat

SEQ ID NO: 49056 - DNA, 20 bp, Artificial Sequence
  chemically synthesized
tacattttaacaagagaaga

SEQ ID NO: 49057 - DNA, 20 bp, Artificial Sequence
  chemically synthesized
agcttacattttaacaagag

SEQ ID NO: 49058 - DNA, 20 bp, Artificial Sequence
  chemically synthesized
tggagcttacattttaacaa

SEQ ID NO: 49059 - DNA, 20 bp, Artificial Sequence
  chemically synthesized
tgtggagcttacattttaac

SEQ ID NO: 49060 - DNA, 20 bp, Artificial Sequence
  chemically synthesized
atcttctcttgttaaaatgt

SEQ ID NO: 49061 - DNA, 20 bp, Artificial Sequence
  chemically synthesized
aacaaagtttatttattgtg

SEQ ID NO: 49062 - DNA, 20 bp, Artificial Sequence
  chemically synthesized
aaaacaaagtttatttattg

SEQ ID NO: 49063 - DNA, 20 bp, Artificial Sequence
  chemically synthesized
aaacggcagtaaataaaaca

SEQ ID NO: 49064 - DNA, 20 bp, Artificial Sequence
  chemically synthesized
tctaggaactggggaaacgg

SEQ ID NO: 49065 - DNA, 20 bp, Artificial Sequence
  chemically synthesized
tttatttactgccgtttccc

SEQ ID NO: 49066 - DNA, 20 bp, Artificial Sequence
  chemically synthesized
tgatctaggaactggggaaa

SEQ ID NO: 49067 - DNA, 20 bp, Artificial Sequence
  chemically synthesized
actgccgtttccccagttcc

SEQ ID NO: 49068 - DNA, 20 bp, Artificial Sequence
  chemically synthesized
aaactctgatctaggaactg

SEQ ID NO: 49069 - DNA, 20 bp, Artificial Sequence
  chemically synthesized
caaactctgatctaggaact

SEQ ID NO: 49070 - DNA, 20 bp, Artificial Sequence
  chemically synthesized
tcaaactctgatctaggaac

SEQ ID NO: 49071 - DNA, 20 bp, Artificial Sequence
  chemically synthesized
cgtttccccagttcctagat

SEQ ID NO: 49072 - DNA, 20 bp, Artificial Sequence
  chemically synthesized
tttccccagttcctagatca

SEQ ID NO: 49073 - DNA, 20 bp, Artificial Sequence
  chemically synthesized
tgtaaatcaaactctgatct

SEQ ID NO: 49074 - DNA, 20 bp, Artificial Sequence
  chemically synthesized
atgtaaatcaaactctgatc

SEQ ID NO: 49075 - DNA, 20 bp, Artificial Sequence
  chemically synthesized
gatcagagtttgatttacat

SEQ ID NO: 49076 - DNA, 20 bp, Artificial Sequence
  chemically synthesized
gatttacattggtcattcaa

SEQ ID NO: 49077 - DNA, 20 bp, Artificial Sequence
  chemically synthesized
tcattcaacagacatttgtt

SEQ ID NO: 49078 - DNA, 20 bp, Artificial Sequence
  chemically synthesized
cagacatttgttgagtaaca

SEQ ID NO: 49079 - DNA, 20 bp, Artificial Sequence
  chemically synthesized
cactttatcttcagtcagtt

SEQ ID NO: 49080 - DNA, 20 bp, Artificial Sequence
  chemically synthesized
aatcaattcttaactgactg

SEQ ID NO: 49081 - DNA, 20 bp, Artificial Sequence
  chemically synthesized
aacttcactttatcttcagt

SEQ ID NO: 49082 - DNA, 20 bp, Artificial Sequence
  chemically synthesized
ttcttaactgactgaagata

SEQ ID NO: 49083 - DNA, 20 bp, Artificial Sequence
  chemically synthesized
aatgaacttcactttatctt

SEQ ID NO: 49084 - DNA, 20 bp, Artificial Sequence
  chemically synthesized
aactgactgaagataaagtg

SEQ ID NO: 49085 - DNA, 20 bp, Artificial Sequence
  chemically synthesized
tgaagttcattaactctttc

SEQ ID NO: 49086 - DNA, 20 bp, Artificial Sequence
  chemically synthesized
cttagtctaatgtccagaaa

SEQ ID NO: 49087 - DNA, 20 bp, Artificial Sequence
  chemically synthesized
tgcttagtctaatgtccaga

SEQ ID NO: 49088 - DNA, 20 bp, Artificial Sequence
  chemically synthesized
cattaactctttctggacat

SEQ ID NO: 49089 - DNA, 20 bp, Artificial Sequence
  chemically synthesized
ctggtgcttagtctaatgtc

SEQ ID NO: 49090 - DNA, 20 bp, Artificial Sequence
  chemically synthesized
ctctttctggacattagact

SEQ ID NO: 49091 - DNA, 20 bp, Artificial Sequence
  chemically synthesized
ctggacattagactaagcac

SEQ ID NO: 49092 - DNA, 20 bp, Artificial Sequence
  chemically synthesized
tggacattagactaagcacc

SEQ ID NO: 49093 - DNA, 20 bp, Artificial Sequence
  chemically synthesized
aaagaacttagcctggtgct

SEQ ID NO: 49094 - DNA, 20 bp, Artificial Sequence
  chemically synthesized
attagactaagcaccaggct

SEQ ID NO: 49095 - DNA, 20 bp, Artificial Sequence
  chemically synthesized
taaaatgaaagaacttagcc

SEQ ID NO: 49096 - DNA, 20 bp, Artificial Sequence
  chemically synthesized
tctaataaaatgaaagaact

SEQ ID NO: 49097 - DNA, 20 bp, Artificial Sequence
  chemically synthesized
ttcccagtctaataaaatga

SEQ ID NO: 49098 - DNA, 20 bp, Artificial Sequence
  chemically synthesized
gctaagttctttcattttat

SEQ ID NO: 49099 - DNA, 20 bp, Artificial Sequence
  chemically synthesized
gttctttcattttattagac

SEQ ID NO: 49100 - DNA, 20 bp, Artificial Sequence
  chemically synthesized
ttctttcattttattagact

SEQ ID NO: 49101 - DNA, 20 bp, Artificial Sequence
  chemically synthesized
ggcacttaaaagattgttcc

SEQ ID NO: 49102 - DNA, 20 bp, Artificial Sequence
  chemically synthesized
tagactgggaacaatctttt

SEQ ID NO: 49103 - DNA, 20 bp, Artificial Sequence
  chemically synthesized
atgaataactgggcacttaa

SEQ ID NO: 49104 - DNA, 20 bp, Artificial Sequence
  chemically synthesized
ggaacaatcttttaagtgcc

SEQ ID NO: 49105 - DNA, 20 bp, Artificial Sequence
  chemically synthesized
ccttgattgaatgaataact

SEQ ID NO: 49106 - DNA, 20 bp, Artificial Sequence
  chemically synthesized
gccttgattgaatgaataac

SEQ ID NO: 49107 - DNA, 20 bp, Artificial Sequence
  chemically synthesized
gcccagttattcattcaatc

SEQ ID NO: 49108 - DNA, 20 bp, Artificial Sequence
  chemically synthesized
cccagttattcattcaatca

SEQ ID NO: 49109 - DNA, 20 bp, Artificial Sequence
  chemically synthesized
acatcttgcatattagatgc

SEQ ID NO: 49110 - DNA, 20 bp, Artificial Sequence
  chemically synthesized
aacatcttgcatattagatg

SEQ ID NO: 49111 - DNA, 20 bp, Artificial Sequence
  chemically synthesized
atatcctgcatctaatatgc

SEQ ID NO: 49112 - DNA, 20 bp, Artificial Sequence
  chemically synthesized
taacacaacatcttgcatat

SEQ ID NO: 49113 - DNA, 20 bp, Artificial Sequence
  chemically synthesized
taatatgcaagatgttgtgt

SEQ ID NO: 49114 - DNA, 20 bp, Artificial Sequence
  chemically synthesized
caaaattatttttaataaaa

SEQ ID NO: 49115 - DNA, 20 bp, Artificial Sequence
  chemically synthesized
tttttaataaaaaagtaatg

SEQ ID NO: 49116 - DNA, 20 bp, Artificial Sequence
  chemically synthesized
ttttaataaaaaagtaatgc

SEQ ID NO: 49117 - DNA, 20 bp, Artificial Sequence
  chemically synthesized
gtgagcactttaagggcata

SEQ ID NO: 49118 - DNA, 20 bp, Artificial Sequence
  chemically synthesized
tgtgagcactttaagggcat

SEQ ID NO: 49119 - DNA, 20 bp, Artificial Sequence
  chemically synthesized
gtgtgagcactttaagggca

SEQ ID NO: 49120 - DNA, 20 bp, Artificial Sequence
  chemically synthesized
atgcaggccctatgccctta

SEQ ID NO: 49121 - DNA, 20 bp, Artificial Sequence
  chemically synthesized
ttggagtgtgagcactttaa

SEQ ID NO: 49122 - DNA, 20 bp, Artificial Sequence
  chemically synthesized
gttggagtgtgagcacttta

SEQ ID NO: 49123 - DNA, 20 bp, Artificial Sequence
  chemically synthesized
tgttggagtgtgagcacttt

SEQ ID NO: 49124 - DNA, 20 bp, Artificial Sequence
  chemically synthesized
aaggaaatatgttggagtgt

SEQ ID NO: 49125 - DNA, 20 bp, Artificial Sequence
  chemically synthesized
tcttgaaaggaaatatgttg

SEQ ID NO: 49126 - DNA, 20 bp, Artificial Sequence
  chemically synthesized
gatcttgaaaggaaatatgt

SEQ ID NO: 49127 - DNA, 20 bp, Artificial Sequence
  chemically synthesized
actccaacatatttcctttc

SEQ ID NO: 49128 - DNA, 20 bp, Artificial Sequence
  chemically synthesized
tcagtaacatagatcttgaa

SEQ ID NO: 49129 - DNA, 20 bp, Artificial Sequence
  chemically synthesized
gtcagtaacatagatcttga

SEQ ID NO: 49130 - DNA, 20 bp, Artificial Sequence
  chemically synthesized
acgtaagatggtcagtaaca

SEQ ID NO: 49131 - DNA, 20 bp, Artificial Sequence
  chemically synthesized
gagttagaacgtaagatggt

SEQ ID NO: 49132 - DNA, 20 bp, Artificial Sequence
  chemically synthesized
gcaagagttagaacgtaaga

SEQ ID NO: 49133 - DNA, 20 bp, Artificial Sequence
  chemically synthesized
acaggcaagagttagaacgt

SEQ ID NO: 49134 - DNA, 20 bp, Artificial Sequence
  chemically synthesized
tgcccatgacaggcaagagt

SEQ ID NO: 49135 - DNA, 20 bp, Artificial Sequence
  chemically synthesized
tacatgcccatgacaggcaa

SEQ ID NO: 49136 - DNA, 20 bp, Artificial Sequence
  chemically synthesized
catacatgcccatgacaggc

SEQ ID NO: 49137 - DNA, 20 bp, Artificial Sequence
  chemically synthesized
gttctaactcttgcctgtca

SEQ ID NO: 49138 - DNA, 20 bp, Artificial Sequence
  chemically synthesized
ttctaactcttgcctgtcat

SEQ ID NO: 49139 - DNA, 20 bp, Artificial Sequence
  chemically synthesized
gcagcatacatgcccatgac

SEQ ID NO: 49140 - DNA, 20 bp, Artificial Sequence
  chemically synthesized
agcagcatacatgcccatga

SEQ ID NO: 49141 - DNA, 20 bp, Artificial Sequence
  chemically synthesized
tcatgggcatgtatgctgct

SEQ ID NO: 49142 - DNA, 20 bp, Artificial Sequence
  chemically synthesized
accttaaaccttaagctcag

SEQ ID NO: 49143 - DNA, 20 bp, Artificial Sequence
  chemically synthesized
gcatgtatgctgctgagctt

SEQ ID NO: 49144 - DNA, 20 bp, Artificial Sequence
  chemically synthesized
catgtatgctgctgagctta

SEQ ID NO: 49145 - DNA, 20 bp, Artificial Sequence
  chemically synthesized
cttaccttaaaccttaagct

SEQ ID NO: 49146 - DNA, 20 bp, Artificial Sequence
  chemically synthesized
tgctgctgagcttaaggttt

SEQ ID NO: 49147 - DNA, 20 bp, Artificial Sequence
  chemically synthesized
aatctcttaccttaaacctt

SEQ ID NO: 49148 - DNA, 20 bp, Artificial Sequence
  chemically synthesized
gctgctgagcttaaggttta

SEQ ID NO: 49149 - DNA, 20 bp, Artificial Sequence
  chemically synthesized
ctgagcttaaggtttaaggt

SEQ ID NO: 49150 - DNA, 20 bp, Artificial Sequence
  chemically synthesized
gagcttaaggtttaaggtaa

SEQ ID NO: 49151 - DNA, 20 bp, Artificial Sequence
  chemically synthesized
gtaattttatgctgtcccca

SEQ ID NO: 49152 - DNA, 20 bp, Artificial Sequence
  chemically synthesized
ataggtaaggactttgggga

SEQ ID NO: 49153 - DNA, 20 bp, Artificial Sequence
  chemically synthesized
attaataggtaaggactttg

SEQ ID NO: 49154 - DNA, 20 bp, Artificial Sequence
  chemically synthesized
cattaataggtaaggacttt

SEQ ID NO: 49155 - DNA, 20 bp, Artificial Sequence
  chemically synthesized
ccattaataggtaaggactt

SEQ ID NO: 49156 - DNA, 20 bp, Artificial Sequence
  chemically synthesized
atgatctccattaataggta

SEQ ID NO: 49157 - DNA, 20 bp, Artificial Sequence
  chemically synthesized
catgatctccattaataggt

SEQ ID NO: 49158 - DNA, 20 bp, Artificial Sequence
  chemically synthesized
ccaaagtccttacctattaa

SEQ ID NO: 49159 - DNA, 20 bp, Artificial Sequence
  chemically synthesized
aaagtccttacctattaatg

SEQ ID NO: 49160 - DNA, 20 bp, Artificial Sequence
  chemically synthesized
acctcatgatctccattaat

SEQ ID NO: 49161 - DNA, 20 bp, Artificial Sequence
  chemically synthesized
aacctcatgatctccattaa

SEQ ID NO: 49162 - DNA, 20 bp, Artificial Sequence
  chemically synthesized
tacctattaatggagatcat

SEQ ID NO: 49163 - DNA, 20 bp, Artificial Sequence
  chemically synthesized
acctattaatggagatcatg

SEQ ID NO: 49164 - DNA, 20 bp, Artificial Sequence
  chemically synthesized
attaatggagatcatgaggt

SEQ ID NO: 49165 - DNA, 20 bp, Artificial Sequence
  chemically synthesized
gtagtgattattattattta

SEQ ID NO: 49166 - DNA, 20 bp, Artificial Sequence
  chemically synthesized
agtagtgattattattattt

SEQ ID NO: 49167 - DNA, 20 bp, Artificial Sequence
  chemically synthesized
attattttgttcaggataag

SEQ ID NO: 49168 - DNA, 20 bp, Artificial Sequence
  chemically synthesized
ttgattattttgttcaggat

SEQ ID NO: 49169 - DNA, 20 bp, Artificial Sequence
  chemically synthesized
tgaggttgattattttgttc

SEQ ID NO: 49170 - DNA, 20 bp, Artificial Sequence
  chemically synthesized
atgaggttgattattttgtt

SEQ ID NO: 49171 - DNA, 20 bp, Artificial Sequence
  chemically synthesized
ttactcttgctttcataatg

SEQ ID NO: 49172 - DNA, 20 bp, Artificial Sequence
  chemically synthesized
aataatcaacctcattatga

SEQ ID NO: 49173 - DNA, 20 bp, Artificial Sequence
  chemically synthesized
tttactcttgctttcataat

SEQ ID NO: 49174 - DNA, 20 bp, Artificial Sequence
  chemically synthesized
atcaacctcattatgaaagc

SEQ ID NO: 49175 - DNA, 20 bp, Artificial Sequence
  chemically synthesized
caacctcattatgaaagcaa

SEQ ID NO: 49176 - DNA, 20 bp, Artificial Sequence
  chemically synthesized
caagagtaaatcaaattacc

SEQ ID NO: 49177 - DNA, 20 bp, Artificial Sequence
  chemically synthesized
ataggcccattacagtcact

SEQ ID NO: 49178 - DNA, 20 bp, Artificial Sequence
  chemically synthesized
aataggcccattacagtcac

SEQ ID NO: 49179 - DNA, 20 bp, Artificial Sequence
  chemically synthesized
aaattacccagtgactgtaa

SEQ ID NO: 49180 - DNA, 20 bp, Artificial Sequence
  chemically synthesized
aattacccagtgactgtaat

SEQ ID NO: 49181 - DNA, 20 bp, Artificial Sequence
  chemically synthesized
gtattataataggcccatta

SEQ ID NO: 49182 - DNA, 20 bp, Artificial Sequence
  chemically synthesized
taagaaaaaggtattataat

SEQ ID NO: 49183 - DNA, 20 bp, Artificial Sequence
  chemically synthesized
ctaagaaaaaggtattataa

SEQ ID NO: 49184 - DNA, 20 bp, Artificial Sequence
  chemically synthesized
ctattataatacctttttct

SEQ ID NO: 49185 - DNA, 20 bp, Artificial Sequence
  chemically synthesized
tttagaagcatctaagaaaa

SEQ ID NO: 49186 - DNA, 20 bp, Artificial Sequence
  chemically synthesized
atttagaagcatctaagaaa

SEQ ID NO: 49187 - DNA, 20 bp, Artificial Sequence
  chemically synthesized
acaggcatttagaagcatct

SEQ ID NO: 49188 - DNA, 20 bp, Artificial Sequence
  chemically synthesized
tgaaattgacaggcatttag

SEQ ID NO: 49189 - DNA, 20 bp, Artificial Sequence
  chemically synthesized
caatgaaattgacaggcatt

SEQ ID NO: 49190 - DNA, 20 bp, Artificial Sequence
  chemically synthesized
gagggggcaatgaaattgac

SEQ ID NO: 49191 - DNA, 20 bp, Artificial Sequence
  chemically synthesized
tgagggggcaatgaaattga

SEQ ID NO: 49192 - DNA, 20 bp, Artificial Sequence
  chemically synthesized
tcaatttcattgccccctca

SEQ ID NO: 49193 - DNA, 20 bp, Artificial Sequence
  chemically synthesized
gaggaagccaatctgtgagg

SEQ ID NO: 49194 - DNA, 20 bp, Artificial Sequence
  chemically synthesized
ggaggaagccaatctgtgag

SEQ ID NO: 49195 - DNA, 20 bp, Artificial Sequence
  chemically synthesized
tggaggaagccaatctgtga

SEQ ID NO: 49196 - DNA, 20 bp, Artificial Sequence
  chemically synthesized
ttcattgccccctcacagat

SEQ ID NO: 49197 - DNA, 20 bp, Artificial Sequence
  chemically synthesized
ctggaggaagccaatctgtg

SEQ ID NO: 49198 - DNA, 20 bp, Artificial Sequence
  chemically synthesized
cctggaggaagccaatctgt

SEQ ID NO: 49199 - DNA, 20 bp, Artificial Sequence
  chemically synthesized
cctcacagattggcttcctc

SEQ ID NO: 49200 - DNA, 20 bp, Artificial Sequence
  chemically synthesized
ctcacagattggcttcctcc

SEQ ID NO: 49201 - DNA, 20 bp, Artificial Sequence
  chemically synthesized
tagagttggcttcctggagg

SEQ ID NO: 49202 - DNA, 20 bp, Artificial Sequence
  chemically synthesized
acagattggcttcctccagg

SEQ ID NO: 49203 - DNA, 20 bp, Artificial Sequence
  chemically synthesized
ccttagagttggcttcctgg

SEQ ID NO: 49204 - DNA, 20 bp, Artificial Sequence
  chemically synthesized
gccttagagttggcttcctg

SEQ ID NO: 49205 - DNA, 20 bp, Artificial Sequence
  chemically synthesized
ttgccttagagttggcttcc

SEQ ID NO: 49206 - DNA, 20 bp, Artificial Sequence
  chemically synthesized
tcctccaggaagccaactct

SEQ ID NO: 49207 - DNA, 20 bp, Artificial Sequence
  chemically synthesized
cctccaggaagccaactcta

SEQ ID NO: 49208 - DNA, 20 bp, Artificial Sequence
  chemically synthesized
tctaatcattgccttagagt

SEQ ID NO: 49209 - DNA, 20 bp, Artificial Sequence
  chemically synthesized
gctctctaatcattgcctta

SEQ ID NO: 49210 - DNA, 20 bp, Artificial Sequence
  chemically synthesized
ctgctctctaatcattgcct

SEQ ID NO: 49211 - DNA, 20 bp, Artificial Sequence
  chemically synthesized
gccaactctaaggcaatgat

SEQ ID NO: 49212 - DNA, 20 bp, Artificial Sequence
  chemically synthesized
caactctaaggcaatgatta

SEQ ID NO: 49213 - DNA, 20 bp, Artificial Sequence
  chemically synthesized
actctaaggcaatgattaga

SEQ ID NO: 49214 - DNA, 20 bp, Artificial Sequence
  chemically synthesized
ctaaggcaatgattagagag

SEQ ID NO: 49215 - DNA, 20 bp, Artificial Sequence
  chemically synthesized
taaggcaatgattagagagc

SEQ ID NO: 49216 - DNA, 20 bp, Artificial Sequence
  chemically synthesized
gcaatgattagagagcagga

SEQ ID NO: 49217 - DNA, 20 bp, Artificial Sequence
  chemically synthesized
gagagcaggatagacaactg

SEQ ID NO: 49218 - DNA, 20 bp, Artificial Sequence
  chemically synthesized
agcaggatagacaactgtgg

SEQ ID NO: 49219 - DNA, 20 bp, Artificial Sequence
  chemically synthesized
gcaggatagacaactgtgga

SEQ ID NO: 49220 - DNA, 20 bp, Artificial Sequence
  chemically synthesized
caggatagacaactgtggaa

SEQ ID NO: 49221 - DNA, 20 bp, Artificial Sequence
  chemically synthesized
tttctttcacttcccttcca

SEQ ID NO: 49222 - DNA, 20 bp, Artificial Sequence
  chemically synthesized
gatagacaactgtggaaggg

SEQ ID NO: 49223 - DNA, 20 bp, Artificial Sequence
  chemically synthesized
caactgtggaagggaagtga

SEQ ID NO: 49224 - DNA, 20 bp, Artificial Sequence
  chemically synthesized
tggaagggaagtgaaagaaa

SEQ ID NO: 49225 - DNA, 20 bp, Artificial Sequence
  chemically synthesized
ggaagggaagtgaaagaaac

SEQ ID NO: 49226 - DNA, 20 bp, Artificial Sequence
  chemically synthesized
ggaagtgaaagaaacaggaa

SEQ ID NO: 49227 - DNA, 20 bp, Artificial Sequence
  chemically synthesized
gaaagaaacaggaatagaaa

SEQ ID NO: 49228 - DNA, 20 bp, Artificial Sequence
  chemically synthesized
aaagaaacaggaatagaaat

SEQ ID NO: 49229 - DNA, 20 bp, Artificial Sequence
  chemically synthesized
aagaaacaggaatagaaata

SEQ ID NO: 49230 - DNA, 20 bp, Artificial Sequence
  chemically synthesized
gaaacaggaatagaaatagg

SEQ ID NO: 49231 - DNA, 20 bp, Artificial Sequence
  chemically synthesized
acaggaatagaaatagggag

SEQ ID NO: 49232 - DNA, 20 bp, Artificial Sequence
  chemically synthesized
aatagaaatagggagaagtc

SEQ ID NO: 49233 - DNA, 20 bp, Artificial Sequence
  chemically synthesized
atagaaatagggagaagtca

SEQ ID NO: 49234 - DNA, 20 bp, Artificial Sequence
  chemically synthesized
gggagaagtcaaggtgaatg

SEQ ID NO: 49235 - DNA, 20 bp, Artificial Sequence
  chemically synthesized
agtcaaggtgaatgcagacc

SEQ ID NO: 49236 - DNA, 20 bp, Artificial Sequence
  chemically synthesized
ggtgaatgcagacccagtga

SEQ ID NO: 49237 - DNA, 20 bp, Artificial Sequence
  chemically synthesized
ggttgaatgagactgtcact

SEQ ID NO: 49238 - DNA, 20 bp, Artificial Sequence
  chemically synthesized
gggttgaatgagactgtcac

SEQ ID NO: 49239 - DNA, 20 bp, Artificial Sequence
  chemically synthesized
gagctcccatggggttgaat

SEQ ID NO: 49240 - DNA, 20 bp, Artificial Sequence
  chemically synthesized
gacagtctcattcaacccca

SEQ ID NO: 49241 - DNA, 20 bp, Artificial Sequence
  chemically synthesized
acagtctcattcaaccccat

SEQ ID NO: 49242 - DNA, 20 bp, Artificial Sequence
  chemically synthesized
agtctcattcaaccccatgg

SEQ ID NO: 49243 - DNA, 20 bp, Artificial Sequence
  chemically synthesized
ctagctcaagagctcccatg

SEQ ID NO: 49244 - DNA, 20 bp, Artificial Sequence
  chemically synthesized
tctagctcaagagctcccat

SEQ ID NO: 49245 - DNA, 20 bp, Artificial Sequence
  chemically synthesized
ttctagctcaagagctccca

SEQ ID NO: 49246 - DNA, 20 bp, Artificial Sequence
  chemically synthesized
tcaaccccatgggagctctt

SEQ ID NO: 49247 - DNA, 20 bp, Artificial Sequence
  chemically synthesized
ccccatgggagctcttgagc

SEQ ID NO: 49248 - DNA, 20 bp, Artificial Sequence
  chemically synthesized
acattaacattctagctcaa

SEQ ID NO: 49249 - DNA, 20 bp, Artificial Sequence
  chemically synthesized
gaacattaacattctagctc

SEQ ID NO: 49250 - DNA, 20 bp, Artificial Sequence
  chemically synthesized
tcaggagaacattaacattc

SEQ ID NO: 49251 - DNA, 20 bp, Artificial Sequence
  chemically synthesized
tagaatgttaatgttctcct

SEQ ID NO: 49252 - DNA, 20 bp, Artificial Sequence
  chemically synthesized
atgttaatgttctcctgagt

SEQ ID NO: 49253 - DNA, 20 bp, Artificial Sequence
  chemically synthesized
tgttaatgttctcctgagtt

SEQ ID NO: 49254 - DNA, 20 bp, Artificial Sequence
  chemically synthesized
gccattttggcccaactcag

SEQ ID NO: 49255 - DNA, 20 bp, Artificial Sequence
  chemically synthesized
tggccattttggcccaactc

SEQ ID NO: 49256 - DNA, 20 bp, Artificial Sequence
  chemically synthesized
ctggccattttggcccaact

SEQ ID NO: 49257 - DNA, 20 bp, Artificial Sequence
  chemically synthesized
tctcctgagttgggccaaaa

SEQ ID NO: 49258 - DNA, 20 bp, Artificial Sequence
  chemically synthesized
ctgagttgggccaaaatggc

SEQ ID NO: 49259 - DNA, 20 bp, Artificial Sequence
  chemically synthesized
gaataatgacctggccattt

SEQ ID NO: 49260 - DNA, 20 bp, Artificial Sequence
  chemically synthesized
tgagttgggccaaaatggcc

SEQ ID NO: 49261 - DNA, 20 bp, Artificial Sequence
  chemically synthesized
agtgtaggggaataatgacc

SEQ ID NO: 49262 - DNA, 20 bp, Artificial Sequence
  chemically synthesized
gctcttcctgatcagtgtag

SEQ ID NO: 49263 - DNA, 20 bp, Artificial Sequence
  chemically synthesized
agctcttcctgatcagtgta

SEQ ID NO: 49264 - DNA, 20 bp, Artificial Sequence
  chemically synthesized
cagctcttcctgatcagtgt

SEQ ID NO: 49265 - DNA, 20 bp, Artificial Sequence
  chemically synthesized
cattattcccctacactgat

SEQ ID NO: 49266 - DNA, 20 bp, Artificial Sequence
  chemically synthesized
gcagctcttcctgatcagtg

SEQ ID NO: 49267 - DNA, 20 bp, Artificial Sequence
  chemically synthesized
attattcccctacactgatc

SEQ ID NO: 49268 - DNA, 20 bp, Artificial Sequence
  chemically synthesized
attcccctacactgatcagg

SEQ ID NO: 49269 - DNA, 20 bp, Artificial Sequence
  chemically synthesized
caggggcagctcttcctgat

SEQ ID NO: 49270 - DNA, 20 bp, Artificial Sequence
  chemically synthesized
tcccctacactgatcaggaa

SEQ ID NO: 49271 - DNA, 20 bp, Artificial Sequence
  chemically synthesized
tcaggaagagctgcccctgt

SEQ ID NO: 49272 - DNA, 20 bp, Artificial Sequence
  chemically synthesized
gatcataccccttacagggg

SEQ ID NO: 49273 - DNA, 20 bp, Artificial Sequence
  chemically synthesized
caggaagagctgcccctgta

SEQ ID NO: 49274 - DNA, 20 bp, Artificial Sequence
  chemically synthesized
aggaagagctgcccctgtaa

SEQ ID NO: 49275 - DNA, 20 bp, Artificial Sequence
  chemically synthesized
ggaagagctgcccctgtaag

SEQ ID NO: 49276 - DNA, 20 bp, Artificial Sequence
  chemically synthesized
caagatcataccccttacag

SEQ ID NO: 49277 - DNA, 20 bp, Artificial Sequence
  chemically synthesized
ccaagatcataccccttaca

SEQ ID NO: 49278 - DNA, 20 bp, Artificial Sequence
  chemically synthesized
cccaagatcataccccttac

SEQ ID NO: 49279 - DNA, 20 bp, Artificial Sequence
  chemically synthesized
acccaagatcatacccctta

SEQ ID NO: 49280 - DNA, 20 bp, Artificial Sequence
  chemically synthesized
ccctgtaaggggtatgatct

SEQ ID NO: 49281 - DNA, 20 bp, Artificial Sequence
  chemically synthesized
cctgtaaggggtatgatctt

SEQ ID NO: 49282 - DNA, 20 bp, Artificial Sequence
  chemically synthesized
taaggggtatgatcttgggt

SEQ ID NO: 49283 - DNA, 20 bp, Artificial Sequence
  chemically synthesized
aaggggtatgatcttgggtg

SEQ ID NO: 49284 - DNA, 20 bp, Artificial Sequence
  chemically synthesized
ttgcatcagctgcctcaccc

SEQ ID NO: 49285 - DNA, 20 bp, Artificial Sequence
  chemically synthesized
gggtatgatcttgggtgagg

SEQ ID NO: 49286 - DNA, 20 bp, Artificial Sequence
  chemically synthesized
acaatcttcaggaattgcat

SEQ ID NO: 49287 - DNA, 20 bp, Artificial Sequence
  chemically synthesized
ggcagctgatgcaattcctg

SEQ ID NO: 49288 - DNA, 20 bp, Artificial Sequence
  chemically synthesized
gtcctcagcagacaatcttc

SEQ ID NO: 49289 - DNA, 20 bp, Artificial Sequence
  chemically synthesized
tgtcctcagcagacaatctt

SEQ ID NO: 49290 - DNA, 20 bp, Artificial Sequence
  chemically synthesized
attcctgaagattgtctgct

SEQ ID NO: 49291 - DNA, 20 bp, Artificial Sequence
  chemically synthesized
ttcctgaagattgtctgctg

SEQ ID NO: 49292 - DNA, 20 bp, Artificial Sequence
  chemically synthesized
atgaaagggagtgtcctcag

SEQ ID NO: 49293 - DNA, 20 bp, Artificial Sequence
  chemically synthesized
tcgatgaaagggagtgtcct

SEQ ID NO: 49294 - DNA, 20 bp, Artificial Sequence
  chemically synthesized
tttagtctctcgatgaaagg

SEQ ID NO: 49295 - DNA, 20 bp, Artificial Sequence
  chemically synthesized
tgaggacactccctttcatc

SEQ ID NO: 49296 - DNA, 20 bp, Artificial Sequence
  chemically synthesized
cctttagtctctcgatgaaa

SEQ ID NO: 49297 - DNA, 20 bp, Artificial Sequence
  chemically synthesized
ccctttagtctctcgatgaa

SEQ ID NO: 49298 - DNA, 20 bp, Artificial Sequence
  chemically synthesized
aggacactccctttcatcga

SEQ ID NO: 49299 - DNA, 20 bp, Artificial Sequence
  chemically synthesized
accctttagtctctcgatga

SEQ ID NO: 49300 - DNA, 20 bp, Artificial Sequence
  chemically synthesized
tccctttcatcgagagacta

SEQ ID NO: 49301 - DNA, 20 bp, Artificial Sequence
  chemically synthesized
ccctttcatcgagagactaa

SEQ ID NO: 49302 - DNA, 20 bp, Artificial Sequence
  chemically synthesized
cctttcatcgagagactaaa

SEQ ID NO: 49303 - DNA, 20 bp, Artificial Sequence
  chemically synthesized
ctgcatccttagggaccctt

SEQ ID NO: 49304 - DNA, 20 bp, Artificial Sequence
  chemically synthesized
cgagagactaaagggtccct

SEQ ID NO: 49305 - DNA, 20 bp, Artificial Sequence
  chemically synthesized
gagagactaaagggtcccta

SEQ ID NO: 49306 - DNA, 20 bp, Artificial Sequence
  chemically synthesized
gttgcttttctgcatcctta

SEQ ID NO: 49307 - DNA, 20 bp, Artificial Sequence
  chemically synthesized
ctaaagggtccctaaggatg

SEQ ID NO: 49308 - DNA, 20 bp, Artificial Sequence
  chemically synthesized
agttgcttttctgcatcctt

SEQ ID NO: 49309 - DNA, 20 bp, Artificial Sequence
  chemically synthesized
aagttgcttttctgcatcct

SEQ ID NO: 49310 - DNA, 20 bp, Artificial Sequence
  chemically synthesized
gggtccctaaggatgcagaa

SEQ ID NO: 49311 - DNA, 20 bp, Artificial Sequence
  chemically synthesized
tatgcctgaggaattatttg

SEQ ID NO: 49312 - DNA, 20 bp, Artificial Sequence
  chemically synthesized
agcaacttcaaataattcct

SEQ ID NO: 49313 - DNA, 20 bp, Artificial Sequence
  chemically synthesized
gcaacttcaaataattcctc

SEQ ID NO: 49314 - DNA, 20 bp, Artificial Sequence
  chemically synthesized
ttcaaataattcctcaggca

SEQ ID NO: 49315 - DNA, 20 bp, Artificial Sequence
  chemically synthesized
tcaaataattcctcaggcat

SEQ ID NO: 49316 - DNA, 20 bp, Artificial Sequence
  chemically synthesized
aatacagtgacctatgcctg

SEQ ID NO: 49317 - DNA, 20 bp, Artificial Sequence
  chemically synthesized
aaatacagtgacctatgcct

SEQ ID NO: 49318 - DNA, 20 bp, Artificial Sequence
  chemically synthesized
caggcataggtcactgtatt

SEQ ID NO: 49319 - DNA, 20 bp, Artificial Sequence
  chemically synthesized
gtcatgtggaacactaaata

SEQ ID NO: 49320 - DNA, 20 bp, Artificial Sequence
  chemically synthesized
ttgtggtaatgaaagtcatg

SEQ ID NO: 49321 - DNA, 20 bp, Artificial Sequence
  chemically synthesized
tgcacaatttgtggtaatga

SEQ ID NO: 49322 - DNA, 20 bp, Artificial Sequence
  chemically synthesized
accaatgcctgcacaatttg

SEQ ID NO: 49323 - DNA, 20 bp, Artificial Sequence
  chemically synthesized
tttcattaccacaaattgtg

SEQ ID NO: 49324 - DNA, 20 bp, Artificial Sequence
  chemically synthesized
ttcattaccacaaattgtgc

SEQ ID NO: 49325 - DNA, 20 bp, Artificial Sequence
  chemically synthesized
accacaaattgtgcaggcat

SEQ ID NO: 49326 - DNA, 20 bp, Artificial Sequence
  chemically synthesized
attgtgcaggcattggtata

SEQ ID NO: 49327 - DNA, 20 bp, Artificial Sequence
  chemically synthesized
ttgtgcaggcattggtataa

SEQ ID NO: 49328 - DNA, 20 bp, Artificial Sequence
  chemically synthesized
gtgcaggcattggtataaag

SEQ ID NO: 49329 - DNA, 20 bp, Artificial Sequence
  chemically synthesized
ataaaggagtgattctcaac

SEQ ID NO: 49330 - DNA, 20 bp, Artificial Sequence
  chemically synthesized
taaaggagtgattctcaact

SEQ ID NO: 49331 - DNA, 20 bp, Artificial Sequence
  chemically synthesized
aaaggagtgattctcaacta

SEQ ID NO: 49332 - DNA, 20 bp, Artificial Sequence
  chemically synthesized
aaggagtgattctcaactag

SEQ ID NO: 49333 - DNA, 20 bp, Artificial Sequence
  chemically synthesized
gggtgaaattgcccctagtt

SEQ ID NO: 49334 - DNA, 20 bp, Artificial Sequence
  chemically synthesized
ctgttgggtgaaattgcccc

SEQ ID NO: 49335 - DNA, 20 bp, Artificial Sequence
  chemically synthesized
ctaggggcaatttcacccaa

SEQ ID NO: 49336 - DNA, 20 bp, Artificial Sequence
  chemically synthesized
taggggcaatttcacccaac

SEQ ID NO: 49337 - DNA, 20 bp, Artificial Sequence
  chemically synthesized
aggggcaatttcacccaaca

SEQ ID NO: 49338 - DNA, 20 bp, Artificial Sequence
  chemically synthesized
ggggcaatttcacccaacag

SEQ ID NO: 49339 - DNA, 20 bp, Artificial Sequence
  chemically synthesized
tctgtctgatgtcccctgtt

SEQ ID NO: 49340 - DNA, 20 bp, Artificial Sequence
  chemically synthesized
gtctgtctgatgtcccctgt

SEQ ID NO: 49341 - DNA, 20 bp, Artificial Sequence
  chemically synthesized
tttcacccaacaggggacat

SEQ ID NO: 49342 - DNA, 20 bp, Artificial Sequence
  chemically synthesized
acccaacaggggacatcaga

SEQ ID NO: 49343 - DNA, 20 bp, Artificial Sequence
  chemically synthesized
gacatcagacagacaatgtc

SEQ ID NO: 49344 - DNA, 20 bp, Artificial Sequence
  chemically synthesized
catcagacagacaatgtctg

SEQ ID NO: 49345 - DNA, 20 bp, Artificial Sequence
  chemically synthesized
gtgacaaccaaaaatgtctc

SEQ ID NO: 49346 - DNA, 20 bp, Artificial Sequence
  chemically synthesized
acaatgtctggagacatttt

SEQ ID NO: 49347 - DNA, 20 bp, Artificial Sequence
  chemically synthesized
ggagacatttttggttgtca

SEQ ID NO: 49348 - DNA, 20 bp, Artificial Sequence
  chemically synthesized
catttttggttgtcacagct

SEQ ID NO: 49349 - DNA, 20 bp, Artificial Sequence
  chemically synthesized
atttttggttgtcacagcta

SEQ ID NO: 49350 - DNA, 20 bp, Artificial Sequence
  chemically synthesized
tttttggttgtcacagctaa

SEQ ID NO: 49351 - DNA, 20 bp, Artificial Sequence
  chemically synthesized
tttggttgtcacagctaagg

SEQ ID NO: 49352 - DNA, 20 bp, Artificial Sequence
  chemically synthesized
ttggttgtcacagctaaggg

SEQ ID NO: 49353 - DNA, 20 bp, Artificial Sequence
  chemically synthesized
tggttgtcacagctaaggga

SEQ ID NO: 49354 - DNA, 20 bp, Artificial Sequence
  chemically synthesized
ggttgtcacagctaagggag

SEQ ID NO: 49355 - DNA, 20 bp, Artificial Sequence
  chemically synthesized
ccagtagcactcccctccct

SEQ ID NO: 49356 - DNA, 20 bp, Artificial Sequence
  chemically synthesized
ttgtcacagctaagggaggg

SEQ ID NO: 49357 - DNA, 20 bp, Artificial Sequence
  chemically synthesized
ctaagggaggggagtgctac

SEQ ID NO: 49358 - DNA, 20 bp, Artificial Sequence
  chemically synthesized
ctctactcactacatgccag

SEQ ID NO: 49359 - DNA, 20 bp, Artificial Sequence
  chemically synthesized
aggggagtgctactggcatg

SEQ ID NO: 49360 - DNA, 20 bp, Artificial Sequence
  chemically synthesized
ggcctctactcactacatgc

SEQ ID NO: 49361 - DNA, 20 bp, Artificial Sequence
  chemically synthesized
gagtgctactggcatgtagt

SEQ ID NO: 49362 - DNA, 20 bp, Artificial Sequence
  chemically synthesized
tgctactggcatgtagtgag

SEQ ID NO: 49363 - DNA, 20 bp, Artificial Sequence
  chemically synthesized
ctactggcatgtagtgagta

SEQ ID NO: 49364 - DNA, 20 bp, Artificial Sequence
  chemically synthesized
tactggcatgtagtgagtag

SEQ ID NO: 49365 - DNA, 20 bp, Artificial Sequence
  chemically synthesized
ggcatgtagtgagtagaggc

SEQ ID NO: 49366 - DNA, 20 bp, Artificial Sequence
  chemically synthesized
catgtagtgagtagaggcca

SEQ ID NO: 49367 - DNA, 20 bp, Artificial Sequence
  chemically synthesized
gctgtcctgtgcattatctc

SEQ ID NO: 49368 - DNA, 20 bp, Artificial Sequence
  chemically synthesized
tagaggccagagataatgca

SEQ ID NO: 49369 - DNA, 20 bp, Artificial Sequence
  chemically synthesized
agaggccagagataatgcac

SEQ ID NO: 49370 - DNA, 20 bp, Artificial Sequence
  chemically synthesized
gccagagataatgcacagga

SEQ ID NO: 49371 - DNA, 20 bp, Artificial Sequence
  chemically synthesized
ctgtgggcaaaaattattgg

SEQ ID NO: 49372 - DNA, 20 bp, Artificial Sequence
  chemically synthesized
tctgtgggcaaaaattattg

SEQ ID NO: 49373 - DNA, 20 bp, Artificial Sequence
  chemically synthesized
ctctgtgggcaaaaattatt

SEQ ID NO: 49374 - DNA, 20 bp, Artificial Sequence
  chemically synthesized
cctctgtgggcaaaaattat

SEQ ID NO: 49375 - DNA, 20 bp, Artificial Sequence
  chemically synthesized
cccccaataatttttgccca

SEQ ID NO: 49376 - DNA, 20 bp, Artificial Sequence
  chemically synthesized
cccaataatttttgcccaca

SEQ ID NO: 49377 - DNA, 20 bp, Artificial Sequence
  chemically synthesized
ccaataatttttgcccacag

SEQ ID NO: 49378 - DNA, 20 bp, Artificial Sequence
  chemically synthesized
tggtgggatcacacctctgt

SEQ ID NO: 49379 - DNA, 20 bp, Artificial Sequence
  chemically synthesized
atggtgggatcacacctctg

SEQ ID NO: 49380 - DNA, 20 bp, Artificial Sequence
  chemically synthesized
ctttgcgcaacagaaatggt

SEQ ID NO: 49381 - DNA, 20 bp, Artificial Sequence
  chemically synthesized
gctttgcgcaacagaaatgg

SEQ ID NO: 49382 - DNA, 20 bp, Artificial Sequence
  chemically synthesized
aaagctttgcgcaacagaaa

SEQ ID NO: 49383 - DNA, 20 bp, Artificial Sequence
  chemically synthesized
cccaccatttctgttgcgca

SEQ ID NO: 49384 - DNA, 20 bp, Artificial Sequence
  chemically synthesized
gaatacaaagctttgcgcaa

SEQ ID NO: 49385 - DNA, 20 bp, Artificial Sequence
  chemically synthesized
ttgcgcaaagctttgtattc

SEQ ID NO: 49386 - DNA, 20 bp, Artificial Sequence
  chemically synthesized
gtcatctgtcctagaataca

SEQ ID NO: 49387 - DNA, 20 bp, Artificial Sequence
  chemically synthesized
tgcgcaaagctttgtattct

SEQ ID NO: 49388 - DNA, 20 bp, Artificial Sequence
  chemically synthesized
caaagctttgtattctagga

SEQ ID NO: 49389 - DNA, 20 bp, Artificial Sequence
  chemically synthesized
tagcattttgtcatctgtcc

SEQ ID NO: 49390 - DNA, 20 bp, Artificial Sequence
  chemically synthesized
cagatgacaaaatgctaccc

SEQ ID NO: 49391 - DNA, 20 bp, Artificial Sequence
  chemically synthesized
agatgacaaaatgctacccc

SEQ ID NO: 49392 - DNA, 20 bp, Artificial Sequence
  chemically synthesized
tttgtgagtttggcctgggg

SEQ ID NO: 49393 - DNA, 20 bp, Artificial Sequence
  chemically synthesized
gcatttgtgagtttggcctg

SEQ ID NO: 49394 - DNA, 20 bp, Artificial Sequence
  chemically synthesized
ggcatttgtgagtttggcct

SEQ ID NO: 49395 - DNA, 20 bp, Artificial Sequence
  chemically synthesized
aggcatttgtgagtttggcc

SEQ ID NO: 49396 - DNA, 20 bp, Artificial Sequence
  chemically synthesized
aatgaaggcatttgtgagtt

SEQ ID NO: 49397 - DNA, 20 bp, Artificial Sequence
  chemically synthesized
cagaaaatgaaggcatttgt

SEQ ID NO: 49398 - DNA, 20 bp, Artificial Sequence
  chemically synthesized
ttacactactcagaaaatga

SEQ ID NO: 49399 - DNA, 20 bp, Artificial Sequence
  chemically synthesized
tttacactactcagaaaatg

SEQ ID NO: 49400 - DNA, 20 bp, Artificial Sequence
  chemically synthesized
cacaaatgccttcattttct

SEQ ID NO: 49401 - DNA, 20 bp, Artificial Sequence
  chemically synthesized
aaatgccttcattttctgag

SEQ ID NO: 49402 - DNA, 20 bp, Artificial Sequence
  chemically synthesized
aagtgtatttttacactact

SEQ ID NO: 49403 - DNA, 20 bp, Artificial Sequence
  chemically synthesized
tagtgtaaaaatacactttt

SEQ ID NO: 49404 - DNA, 20 bp, Artificial Sequence
  chemically synthesized
gtgtaaaaatacacttttca

SEQ ID NO: 49405 - DNA, 20 bp, Artificial Sequence
  chemically synthesized
agtggaatgctggctctgaa

SEQ ID NO: 49406 - DNA, 20 bp, Artificial Sequence
  chemically synthesized
aaaaatacacttttcagagc

SEQ ID NO: 49407 - DNA, 20 bp, Artificial Sequence
  chemically synthesized
ccagataattagtggaatgc

SEQ ID NO: 49408 - DNA, 20 bp, Artificial Sequence
  chemically synthesized
atttggggccagataattag

SEQ ID NO: 49409 - DNA, 20 bp, Artificial Sequence
  chemically synthesized
ccagcattccactaattatc

SEQ ID NO: 49410 - DNA, 20 bp, Artificial Sequence
  chemically synthesized
ggcatttggggccagataat

SEQ ID NO: 49411 - DNA, 20 bp, Artificial Sequence
  chemically synthesized
gcactattggcatttggggc

SEQ ID NO: 49412 - DNA, 20 bp, Artificial Sequence
  chemically synthesized
ctgggcactattggcatttg

SEQ ID NO: 49413 - DNA, 20 bp, Artificial Sequence
  chemically synthesized
cctgggcactattggcattt

SEQ ID NO: 49414 - DNA, 20 bp, Artificial Sequence
  chemically synthesized
acctgggcactattggcatt

SEQ ID NO: 49415 - DNA, 20 bp, Artificial Sequence
  chemically synthesized
tatctggccccaaatgccaa

SEQ ID NO: 49416 - DNA, 20 bp, Artificial Sequence
  chemically synthesized
tttcttgacctgggcactat

SEQ ID NO: 49417 - DNA, 20 bp, Artificial Sequence
  chemically synthesized
ccccaaatgccaatagtgcc

SEQ ID NO: 49418 - DNA, 20 bp, Artificial Sequence
  chemically synthesized
cccaaatgccaatagtgccc

SEQ ID NO: 49419 - DNA, 20 bp, Artificial Sequence
  chemically synthesized
atgccaatagtgcccaggtc

SEQ ID NO: 49420 - DNA, 20 bp, Artificial Sequence
  chemically synthesized
aaactaggctttcttgacct

SEQ ID NO: 49421 - DNA, 20 bp, Artificial Sequence
  chemically synthesized
taaactaggctttcttgacc

SEQ ID NO: 49422 - DNA, 20 bp, Artificial Sequence
  chemically synthesized
caatagtgcccaggtcaaga

SEQ ID NO: 49423 - DNA, 20 bp, Artificial Sequence
  chemically synthesized
gtgcccaggtcaagaaagcc

SEQ ID NO: 49424 - DNA, 20 bp, Artificial Sequence
  chemically synthesized
ggtcaagaaagcctagttta

SEQ ID NO: 49425 - DNA, 20 bp, Artificial Sequence
  chemically synthesized
cacaggccagactgtaaact

SEQ ID NO: 49426 - DNA, 20 bp, Artificial Sequence
  chemically synthesized
ccacaggccagactgtaaac

SEQ ID NO: 49427 - DNA, 20 bp, Artificial Sequence
  chemically synthesized
agaaagcctagtttacagtc

SEQ ID NO: 49428 - DNA, 20 bp, Artificial Sequence
  chemically synthesized
ctagtttacagtctggcctg

SEQ ID NO: 49429 - DNA, 20 bp, Artificial Sequence
  chemically synthesized
ccatctcacaggccacaggc

SEQ ID NO: 49430 - DNA, 20 bp, Artificial Sequence
  chemically synthesized
aatgccatctcacaggccac

SEQ ID NO: 49431 - DNA, 20 bp, Artificial Sequence
  chemically synthesized
taatgccatctcacaggcca

SEQ ID NO: 49432 - DNA, 20 bp, Artificial Sequence
  chemically synthesized
cagtctggcctgtggcctgt

SEQ ID NO: 49433 - DNA, 20 bp, Artificial Sequence
  chemically synthesized
ctggcctgtggcctgtgaga

SEQ ID NO: 49434 - DNA, 20 bp, Artificial Sequence
  chemically synthesized
taagggtaatgccatctcac

SEQ ID NO: 49435 - DNA, 20 bp, Artificial Sequence
  chemically synthesized
ctaagggtaatgccatctca

SEQ ID NO: 49436 - DNA, 20 bp, Artificial Sequence
  chemically synthesized
ctgtgagatggcattaccct

SEQ ID NO: 49437 - DNA, 20 bp, Artificial Sequence
  chemically synthesized
gagatggcattacccttaga

SEQ ID NO: 49438 - DNA, 20 bp, Artificial Sequence
  chemically synthesized
gttatttattatccatctaa

SEQ ID NO: 49439 - DNA, 20 bp, Artificial Sequence
  chemically synthesized
agttatttattatccatcta

SEQ ID NO: 49440 - DNA, 20 bp, Artificial Sequence
  chemically synthesized
tagttatttattatccatct

SEQ ID NO: 49441 - DNA, 20 bp, Artificial Sequence
  chemically synthesized
taataaataactaatccaat

SEQ ID NO: 49442 - DNA, 20 bp, Artificial Sequence
  chemically synthesized
gacaaagcatctgattggat

SEQ ID NO: 49443 - DNA, 20 bp, Artificial Sequence
  chemically synthesized
tccaagacaaagcatctgat

SEQ ID NO: 49444 - DNA, 20 bp, Artificial Sequence
  chemically synthesized
tccaatcagatgctttgtct

SEQ ID NO: 49445 - DNA, 20 bp, Artificial Sequence
  chemically synthesized
caatcagatgctttgtcttg

SEQ ID NO: 49446 - DNA, 20 bp, Artificial Sequence
  chemically synthesized
cattcaagctctccaagaca

SEQ ID NO: 49447 - DNA, 20 bp, Artificial Sequence
  chemically synthesized
atcagatgctttgtcttgga

SEQ ID NO: 49448 - DNA, 20 bp, Artificial Sequence
  chemically synthesized
gtattacattcaagctctcc

SEQ ID NO: 49449 - DNA, 20 bp, Artificial Sequence
  chemically synthesized
tatctctgtgtattacattc

SEQ ID NO: 49450 - DNA, 20 bp, Artificial Sequence
  chemically synthesized
gagagcttgaatgtaataca

SEQ ID NO: 49451 - DNA, 20 bp, Artificial Sequence
  chemically synthesized
gagcttgaatgtaatacaca

SEQ ID NO: 49452 - DNA, 20 bp, Artificial Sequence
  chemically synthesized
atgtaatacacagagataaa

SEQ ID NO: 49453 - DNA, 20 bp, Artificial Sequence
  chemically synthesized
gtaatacacagagataaaca

SEQ ID NO: 49454 - DNA, 20 bp, Artificial Sequence
  chemically synthesized
acagagataaacagagatga

SEQ ID NO: 49455 - DNA, 20 bp, Artificial Sequence
  chemically synthesized
agataaacagagatgacaga

SEQ ID NO: 49456 - DNA, 20 bp, Artificial Sequence
  chemically synthesized
gataaacagagatgacagat

SEQ ID NO: 49457 - DNA, 20 bp, Artificial Sequence
  chemically synthesized
aaacagagatgacagatggg

SEQ ID NO: 49458 - DNA, 20 bp, Artificial Sequence
  chemically synthesized
aacagagatgacagatgggt

SEQ ID NO: 49459 - DNA, 20 bp, Artificial Sequence
  chemically synthesized
acagagatgacagatgggtg

SEQ ID NO: 49460 - DNA, 20 bp, Artificial Sequence
  chemically synthesized
gagatgacagatgggtgggg

SEQ ID NO: 49461 - DNA, 20 bp, Artificial Sequence
  chemically synthesized
gatgggtggggaagtttaaa

SEQ ID NO: 49462 - DNA, 20 bp, Artificial Sequence
  chemically synthesized
ggtggggaagtttaaaaagt

SEQ ID NO: 49463 - DNA, 20 bp, Artificial Sequence
  chemically synthesized
gtttaaaaagtcggataaca

SEQ ID NO: 49464 - DNA, 20 bp, Artificial Sequence
  chemically synthesized
tttaaaaagtcggataacaa

SEQ ID NO: 49465 - DNA, 20 bp, Artificial Sequence
  chemically synthesized
aaaaagtcggataacaaagg

SEQ ID NO: 49466 - DNA, 20 bp, Artificial Sequence
  chemically synthesized
cggataacaaaggaagaaaa

SEQ ID NO: 49467 - DNA, 20 bp, Artificial Sequence
  chemically synthesized
ataacaaaggaagaaaatgg

SEQ ID NO: 49468 - DNA, 20 bp, Artificial Sequence
  chemically synthesized
aggaagaaaatggaagtcat

SEQ ID NO: 49469 - DNA, 20 bp, Artificial Sequence
  chemically synthesized
agaaaatggaagtcataaga

SEQ ID NO: 49470 - DNA, 20 bp, Artificial Sequence
  chemically synthesized
aaatggaagtcataagaaag

SEQ ID NO: 49471 - DNA, 20 bp, Artificial Sequence
  chemically synthesized
cataagaaagtagaaactat

SEQ ID NO: 49472 - DNA, 20 bp, Artificial Sequence
  chemically synthesized
aagaaagtagaaactataag

SEQ ID NO: 49473 - DNA, 20 bp, Artificial Sequence
  chemically synthesized
aaagtagaaactataagtag

SEQ ID NO: 49474 - DNA, 20 bp, Artificial Sequence
  chemically synthesized
cacctaacaccttctactta

SEQ ID NO: 49475 - DNA, 20 bp, Artificial Sequence
  chemically synthesized
aagtagaaactataagtaga

SEQ ID NO: 49476 - DNA, 20 bp, Artificial Sequence
  chemically synthesized
aaactataagtagaaggtgt

SEQ ID NO: 49477 - DNA, 20 bp, Artificial Sequence
  chemically synthesized
aactataagtagaaggtgtt

SEQ ID NO: 49478 - DNA, 20 bp, Artificial Sequence
  chemically synthesized
tataagtagaaggtgttagg

SEQ ID NO: 49479 - DNA, 20 bp, Artificial Sequence
  chemically synthesized
taagtagaaggtgttaggtg

SEQ ID NO: 49480 - DNA, 20 bp, Artificial Sequence
  chemically synthesized
agtagaaggtgttaggtgga

SEQ ID NO: 49481 - DNA, 20 bp, Artificial Sequence
  chemically synthesized
agaaggtgttaggtggagag

SEQ ID NO: 49482 - DNA, 20 bp, Artificial Sequence
  chemically synthesized
aaggtgttaggtggagagaa

SEQ ID NO: 49483 - DNA, 20 bp, Artificial Sequence
  chemically synthesized
ggtgttaggtggagagaaga

SEQ ID NO: 49484 - DNA, 20 bp, Artificial Sequence
  chemically synthesized
gttaggtggagagaagagag

SEQ ID NO: 49485 - DNA, 20 bp, Artificial Sequence
  chemically synthesized
gagaagatatgatactgtaa

SEQ ID NO: 49486 - DNA, 20 bp, Artificial Sequence
  chemically synthesized
ccatagacttcagactatta

SEQ ID NO: 49487 - DNA, 20 bp, Artificial Sequence
  chemically synthesized
tatgatactgtaatagtctg

SEQ ID NO: 49488 - DNA, 20 bp, Artificial Sequence
  chemically synthesized
ctgtaatagtctgaagtcta

SEQ ID NO: 49489 - DNA, 20 bp, Artificial Sequence
  chemically synthesized
gcatttgctgccatagactt

SEQ ID NO: 49490 - DNA, 20 bp, Artificial Sequence
  chemically synthesized
taatagtctgaagtctatgg

SEQ ID NO: 49491 - DNA, 20 bp, Artificial Sequence
  chemically synthesized
tgtatatgcatttgctgcca

SEQ ID NO: 49492 - DNA, 20 bp, Artificial Sequence
  chemically synthesized
tatggcagcaaatgcatata

SEQ ID NO: 49493 - DNA, 20 bp, Artificial Sequence
  chemically synthesized
gcagcaaatgcatatacaga

SEQ ID NO: 49494 - DNA, 20 bp, Artificial Sequence
  chemically synthesized
gcaaatgcatatacagaaag

SEQ ID NO: 49495 - DNA, 20 bp, Artificial Sequence
  chemically synthesized
aaagaagcaaacatgtttcg

SEQ ID NO: 49496 - DNA, 20 bp, Artificial Sequence
  chemically synthesized
aaaagaataacatggaacaa

SEQ ID NO: 49497 - DNA, 20 bp, Artificial Sequence
  chemically synthesized
aaagaaagaaaagaataaca

SEQ ID NO: 49498 - DNA, 20 bp, Artificial Sequence
  chemically synthesized
aaaaaaaaagaaagaaagaa

SEQ ID NO: 49499 - DNA, 20 bp, Artificial Sequence
  chemically synthesized
aaaaaaaaaaaaaagaaaga

SEQ ID NO: 49500 - DNA, 20 bp, Artificial Sequence
  chemically synthesized
ctcaaaaaaaaaaaaaaaga

SEQ ID NO: 49501 - DNA, 20 bp, Artificial Sequence
  chemically synthesized
ccatctcaaaaaaaaaaaaa

SEQ ID NO: 49502 - DNA, 20 bp, Artificial Sequence
  chemically synthesized
ctttcttttttttttttttt

SEQ ID NO: 49503 - DNA, 20 bp, Artificial Sequence
  chemically synthesized
ctttttttttttttttgaga

SEQ ID NO: 49504 - DNA, 20 bp, Artificial Sequence
  chemically synthesized
ttttttttttttttgagatg

SEQ ID NO: 49505 - DNA, 20 bp, Artificial Sequence
  chemically synthesized
accagcctaggcaacagggc

SEQ ID NO: 49506 - DNA, 20 bp, Artificial Sequence
  chemically synthesized
tggagtctcgccctgttgcc

SEQ ID NO: 49507 - DNA, 20 bp, Artificial Sequence
  chemically synthesized
gcacaccagcctaggcaaca

SEQ ID NO: 49508 - DNA, 20 bp, Artificial Sequence
  chemically synthesized
ggagtctcgccctgttgcct

SEQ ID NO: 49509 - DNA, 20 bp, Artificial Sequence
  chemically synthesized
tgcacaccagcctaggcaac

SEQ ID NO: 49510 - DNA, 20 bp, Artificial Sequence
  chemically synthesized
ttgcacaccagcctaggcaa

SEQ ID NO: 49511 - DNA, 20 bp, Artificial Sequence
  chemically synthesized
tctcgccctgttgcctaggc

SEQ ID NO: 49512 - DNA, 20 bp, Artificial Sequence
  chemically synthesized
acaccattgcacaccagcct

SEQ ID NO: 49513 - DNA, 20 bp, Artificial Sequence
  chemically synthesized
cacaccattgcacaccagcc

SEQ ID NO: 49514 - DNA, 20 bp, Artificial Sequence
  chemically synthesized
aagatcacaccattgcacac

SEQ ID NO: 49515 - DNA, 20 bp, Artificial Sequence
  chemically synthesized
ttgcctaggctggtgtgcaa

SEQ ID NO: 49516 - DNA, 20 bp, Artificial Sequence
  chemically synthesized
ggtgtgcaatggtgtgatct

SEQ ID NO: 49517 - DNA, 20 bp, Artificial Sequence
  chemically synthesized
gacggaggttgcagtgagcc

SEQ ID NO: 49518 - DNA, 20 bp, Artificial Sequence
  chemically synthesized
caggagacggaggttgcagt

SEQ ID NO: 49519 - DNA, 20 bp, Artificial Sequence
  chemically synthesized
aacccaggagacggaggttg

SEQ ID NO: 49520 - DNA, 20 bp, Artificial Sequence
  chemically synthesized
cgcttgaacccaggagacgg

SEQ ID NO: 49521 - DNA, 20 bp, Artificial Sequence
  chemically synthesized
tcactgcaacctccgtctcc

SEQ ID NO: 49522 - DNA, 20 bp, Artificial Sequence
  chemically synthesized
tcgcttgaacccaggagacg

SEQ ID NO: 49523 - DNA, 20 bp, Artificial Sequence
  chemically synthesized
cactgcaacctccgtctcct

SEQ ID NO: 49524 - DNA, 20 bp, Artificial Sequence
  chemically synthesized
aatcgcttgaacccaggaga

SEQ ID NO: 49525 - DNA, 20 bp, Artificial Sequence
  chemically synthesized
ggagaatcgcttgaacccag

SEQ ID NO: 49526 - DNA, 20 bp, Artificial Sequence
  chemically synthesized
aacctccgtctcctgggttc

SEQ ID NO: 49527 - DNA, 20 bp, Artificial Sequence
  chemically synthesized
caggagaatcgcttgaaccc

SEQ ID NO: 49528 - DNA, 20 bp, Artificial Sequence
  chemically synthesized
gcaggagaatcgcttgaacc

SEQ ID NO: 49529 - DNA, 20 bp, Artificial Sequence
  chemically synthesized
ttcaagcgattctcctgcct

SEQ ID NO: 49530 - DNA, 20 bp, Artificial Sequence
  chemically synthesized
tactcaggaggctgaggcag

SEQ ID NO: 49531 - DNA, 20 bp, Artificial Sequence
  chemically synthesized
gctactcaggaggctgaggc

SEQ ID NO: 49532 - DNA, 20 bp, Artificial Sequence
  chemically synthesized
agctactcaggaggctgagg

SEQ ID NO: 49533 - DNA, 20 bp, Artificial Sequence
  chemically synthesized
cccagctactcaggaggctg

SEQ ID NO: 49534 - DNA, 20 bp, Artificial Sequence
  chemically synthesized
tcccagctactcaggaggct

SEQ ID NO: 49535 - DNA, 20 bp, Artificial Sequence
  chemically synthesized
ttctcctgcctcagcctcct

SEQ ID NO: 49536 - DNA, 20 bp, Artificial Sequence
  chemically synthesized
tcctgcctcagcctcctgag

SEQ ID NO: 49537 - DNA, 20 bp, Artificial Sequence
  chemically synthesized
tgtaatcccagctactcagg

SEQ ID NO: 49538 - DNA, 20 bp, Artificial Sequence
  chemically synthesized
ctgtaatcccagctactcag

SEQ ID NO: 49539 - DNA, 20 bp, Artificial Sequence
  chemically synthesized
gcctcagcctcctgagtagc

SEQ ID NO: 49540 - DNA, 20 bp, Artificial Sequence
  chemically synthesized
acctgtaatcccagctactc

SEQ ID NO: 49541 - DNA, 20 bp, Artificial Sequence
  chemically synthesized
cctcagcctcctgagtagct

SEQ ID NO: 49542 - DNA, 20 bp, Artificial Sequence
  chemically synthesized
cacctgtaatcccagctact

SEQ ID NO: 49543 - DNA, 20 bp, Artificial Sequence
  chemically synthesized
ctcctgagtagctgggatta

SEQ ID NO: 49544 - DNA, 20 bp, Artificial Sequence
  chemically synthesized
tcctgagtagctgggattac

SEQ ID NO: 49545 - DNA, 20 bp, Artificial Sequence
  chemically synthesized
gtggcgcacacctgtaatcc

SEQ ID NO: 49546 - DNA, 20 bp, Artificial Sequence
  chemically synthesized
caggtgtgcgccaccatgcc

SEQ ID NO: 49547 - DNA, 20 bp, Artificial Sequence
  chemically synthesized
aaaaaattagccaggcatgg

SEQ ID NO: 49548 - DNA, 20 bp, Artificial Sequence
  chemically synthesized
cacaaaaaattagccaggca

SEQ ID NO: 49549 - DNA, 20 bp, Artificial Sequence
  chemically synthesized
aaagacacaaaaaattagcc

SEQ ID NO: 49550 - DNA, 20 bp, Artificial Sequence
  chemically synthesized
taaagacacaaaaaattagc

SEQ ID NO: 49551 - DNA, 20 bp, Artificial Sequence
  chemically synthesized
ctactaaagacacaaaaaat

SEQ ID NO: 49552 - DNA, 20 bp, Artificial Sequence
  chemically synthesized
tggctaattttttgtgtctt

SEQ ID NO: 49553 - DNA, 20 bp, Artificial Sequence
  chemically synthesized
ctaattttttgtgtctttag

SEQ ID NO: 49554 - DNA, 20 bp, Artificial Sequence
  chemically synthesized
aattttttgtgtctttagta

SEQ ID NO: 49555 - DNA, 20 bp, Artificial Sequence
  chemically synthesized
gtgaaaccctgtctctacta

SEQ ID NO: 49556 - DNA, 20 bp, Artificial Sequence
  chemically synthesized
ttttgtgtctttagtagaga

SEQ ID NO: 49557 - DNA, 20 bp, Artificial Sequence
  chemically synthesized
tttgtgtctttagtagagac

SEQ ID NO: 49558 - DNA, 20 bp, Artificial Sequence
  chemically synthesized
ttgtgtctttagtagagaca

SEQ ID NO: 49559 - DNA, 20 bp, Artificial Sequence
  chemically synthesized
gagacagggtttcaccatgt

SEQ ID NO: 49560 - DNA, 20 bp, Artificial Sequence
  chemically synthesized
cagggtttcaccatgttggc

SEQ ID NO: 49561 - DNA, 20 bp, Artificial Sequence
  chemically synthesized
ggagaccaacctggccaaca

SEQ ID NO: 49562 - DNA, 20 bp, Artificial Sequence
  chemically synthesized
agggtttcaccatgttggcc

SEQ ID NO: 49563 - DNA, 20 bp, Artificial Sequence
  chemically synthesized
tttcaccatgttggccaggt

SEQ ID NO: 49564 - DNA, 20 bp, Artificial Sequence
  chemically synthesized
tcaggagttggagaccaacc

SEQ ID NO: 49565 - DNA, 20 bp, Artificial Sequence
  chemically synthesized
gatcacgaggtcaggagttg

SEQ ID NO: 49566 - DNA, 20 bp, Artificial Sequence
  chemically synthesized
cggatcacgaggtcaggagt

SEQ ID NO: 49567 - DNA, 20 bp, Artificial Sequence
  chemically synthesized
cgggcggatcacgaggtcag

SEQ ID NO: 49568 - DNA, 20 bp, Artificial Sequence
  chemically synthesized
ggcgggcggatcacgaggtc

SEQ ID NO: 49569 - DNA, 20 bp, Artificial Sequence
  chemically synthesized
aggcgggcggatcacgaggt

SEQ ID NO: 49570 - DNA, 20 bp, Artificial Sequence
  chemically synthesized
gctgaggcgggcggatcacg

SEQ ID NO: 49571 - DNA, 20 bp, Artificial Sequence
  chemically synthesized
ggctgaggcgggcggatcac

SEQ ID NO: 49572 - DNA, 20 bp, Artificial Sequence
  chemically synthesized
acctcgtgatccgcccgcct

SEQ ID NO: 49573 - DNA, 20 bp, Artificial Sequence
  chemically synthesized
ctttgggaggctgaggcggg

SEQ ID NO: 49574 - DNA, 20 bp, Artificial Sequence
  chemically synthesized
gcactttgggaggctgaggc

SEQ ID NO: 49575 - DNA, 20 bp, Artificial Sequence
  chemically synthesized
agcactttgggaggctgagg

SEQ ID NO: 49576 - DNA, 20 bp, Artificial Sequence
  chemically synthesized
cccagcactttgggaggctg

SEQ ID NO: 49577 - DNA, 20 bp, Artificial Sequence
  chemically synthesized
tcccagcactttgggaggct

SEQ ID NO: 49578 - DNA, 20 bp, Artificial Sequence
  chemically synthesized
ccgcccgcctcagcctccca

SEQ ID NO: 49579 - DNA, 20 bp, Artificial Sequence
  chemically synthesized
tataatcccagcactttggg

SEQ ID NO: 49580 - DNA, 20 bp, Artificial Sequence
  chemically synthesized
ctataatcccagcactttgg

SEQ ID NO: 49581 - DNA, 20 bp, Artificial Sequence
  chemically synthesized
gcctcagcctcccaaagtgc

SEQ ID NO: 49582 - DNA, 20 bp, Artificial Sequence
  chemically synthesized
acctataatcccagcacttt

SEQ ID NO: 49583 - DNA, 20 bp, Artificial Sequence
  chemically synthesized
cctcagcctcccaaagtgct

SEQ ID NO: 49584 - DNA, 20 bp, Artificial Sequence
  chemically synthesized
cacctataatcccagcactt

SEQ ID NO: 49585 - DNA, 20 bp, Artificial Sequence
  chemically synthesized
ctcccaaagtgctgggatta

SEQ ID NO: 49586 - DNA, 20 bp, Artificial Sequence
  chemically synthesized
tcccaaagtgctgggattat

SEQ ID NO: 49587 - DNA, 20 bp, Artificial Sequence
  chemically synthesized
gtggctcacacctataatcc

SEQ ID NO: 49588 - DNA, 20 bp, Artificial Sequence
  chemically synthesized
agtgctgggattataggtgt

SEQ ID NO: 49589 - DNA, 20 bp, Artificial Sequence
  chemically synthesized
taggtgtgagccaccgcgcc

SEQ ID NO: 49590 - DNA, 20 bp, Artificial Sequence
  chemically synthesized
ataacatgggccgggcgcgg

SEQ ID NO: 49591 - DNA, 20 bp, Artificial Sequence
  chemically synthesized
agaataacatgggccgggcg

SEQ ID NO: 49592 - DNA, 20 bp, Artificial Sequence
  chemically synthesized
catgaagaataacatgggcc

SEQ ID NO: 49593 - DNA, 20 bp, Artificial Sequence
  chemically synthesized
gcatgaagaataacatgggc

SEQ ID NO: 49594 - DNA, 20 bp, Artificial Sequence
  chemically synthesized
agaggcatgaagaataacat

SEQ ID NO: 49595 - DNA, 20 bp, Artificial Sequence
  chemically synthesized
gagaggcatgaagaataaca

SEQ ID NO: 49596 - DNA, 20 bp, Artificial Sequence
  chemically synthesized
tcaggatacagagaggcatg

SEQ ID NO: 49597 - DNA, 20 bp, Artificial Sequence
  chemically synthesized
aacattttcaggatacagag

SEQ ID NO: 49598 - DNA, 20 bp, Artificial Sequence
  chemically synthesized
gaacattttcaggatacaga

SEQ ID NO: 49599 - DNA, 20 bp, Artificial Sequence
  chemically synthesized
aggaacattttcaggataca

SEQ ID NO: 49600 - DNA, 20 bp, Artificial Sequence
  chemically synthesized
taaggaacattttcaggata

SEQ ID NO: 49601 - DNA, 20 bp, Artificial Sequence
  chemically synthesized
aggtgataaggaacattttc

SEQ ID NO: 49602 - DNA, 20 bp, Artificial Sequence
  chemically synthesized
taggtgataaggaacatttt

SEQ ID NO: 49603 - DNA, 20 bp, Artificial Sequence
  chemically synthesized
agggataggcttaggtgata

SEQ ID NO: 49604 - DNA, 20 bp, Artificial Sequence
  chemically synthesized
gaaaatgttccttatcacct

SEQ ID NO: 49605 - DNA, 20 bp, Artificial Sequence
  chemically synthesized
cagggataggcttaggtgat

SEQ ID NO: 49606 - DNA, 20 bp, Artificial Sequence
  chemically synthesized
taagggacagggataggctt

SEQ ID NO: 49607 - DNA, 20 bp, Artificial Sequence
  chemically synthesized
gtaagggacagggataggct

SEQ ID NO: 49608 - DNA, 20 bp, Artificial Sequence
  chemically synthesized
aggctgtaagggacagggat

SEQ ID NO: 49609 - DNA, 20 bp, Artificial Sequence
  chemically synthesized
aaggctgtaagggacaggga

SEQ ID NO: 49610 - DNA, 20 bp, Artificial Sequence
  chemically synthesized
ccttaaggctgtaagggaca

SEQ ID NO: 49611 - DNA, 20 bp, Artificial Sequence
  chemically synthesized
tccttaaggctgtaagggac

SEQ ID NO: 49612 - DNA, 20 bp, Artificial Sequence
  chemically synthesized
aagcctatccctgtccctta

SEQ ID NO: 49613 - DNA, 20 bp, Artificial Sequence
  chemically synthesized
ctccttaaggctgtaaggga

SEQ ID NO: 49614 - DNA, 20 bp, Artificial Sequence
  chemically synthesized
atgtctccttaaggctgtaa

SEQ ID NO: 49615 - DNA, 20 bp, Artificial Sequence
  chemically synthesized
tatgtctccttaaggctgta

SEQ ID NO: 49616 - DNA, 20 bp, Artificial Sequence
  chemically synthesized
ctatgtctccttaaggctgt

SEQ ID NO: 49617 - DNA, 20 bp, Artificial Sequence
  chemically synthesized
tccctgtcccttacagcctt

SEQ ID NO: 49618 - DNA, 20 bp, Artificial Sequence
  chemically synthesized
ccctgtcccttacagcctta

SEQ ID NO: 49619 - DNA, 20 bp, Artificial Sequence
  chemically synthesized
ctgtcccttacagccttaag

SEQ ID NO: 49620 - DNA, 20 bp, Artificial Sequence
  chemically synthesized
ttatgtgctatgtctcctta

SEQ ID NO: 49621 - DNA, 20 bp, Artificial Sequence
  chemically synthesized
gttatgtgctatgtctcctt

SEQ ID NO: 49622 - DNA, 20 bp, Artificial Sequence
  chemically synthesized
cttacagccttaaggagaca

SEQ ID NO: 49623 - DNA, 20 bp, Artificial Sequence
  chemically synthesized
taaggagacatagcacataa

SEQ ID NO: 49624 - DNA, 20 bp, Artificial Sequence
  chemically synthesized
aggagacatagcacataaca

SEQ ID NO: 49625 - DNA, 20 bp, Artificial Sequence
  chemically synthesized
agacatagcacataacagag

SEQ ID NO: 49626 - DNA, 20 bp, Artificial Sequence
  chemically synthesized
acataacagagcagtacctg

SEQ ID NO: 49627 - DNA, 20 bp, Artificial Sequence
  chemically synthesized
tcttgatttcaggcgactgc

SEQ ID NO: 49628 - DNA, 20 bp, Artificial Sequence
  chemically synthesized
atcttgatttcaggcgactg

SEQ ID NO: 49629 - DNA, 20 bp, Artificial Sequence
  chemically synthesized
acctgcagtcgcctgaaatc

SEQ ID NO: 49630 - DNA, 20 bp, Artificial Sequence
  chemically synthesized
gtaaaaatcatcttgatttc

SEQ ID NO: 49631 - DNA, 20 bp, Artificial Sequence
  chemically synthesized
agtaaaaatcatcttgattt

SEQ ID NO: 49632 - DNA, 20 bp, Artificial Sequence
  chemically synthesized
aatcaagatgatttttactg

SEQ ID NO: 49633 - DNA, 20 bp, Artificial Sequence
  chemically synthesized
aatagactttcagatatctg

SEQ ID NO: 49634 - DNA, 20 bp, Artificial Sequence
  chemically synthesized
tttttactgcagatatctga

SEQ ID NO: 49635 - DNA, 20 bp, Artificial Sequence
  chemically synthesized
tagatttttaaatagacttt

SEQ ID NO: 49636 - DNA, 20 bp, Artificial Sequence
  chemically synthesized
aaccattctagatttttaaa

SEQ ID NO: 49637 - DNA, 20 bp, Artificial Sequence
  chemically synthesized
tgaaagtctatttaaaaatc

SEQ ID NO: 49638 - DNA, 20 bp, Artificial Sequence
  chemically synthesized
gtctatttaaaaatctagaa

SEQ ID NO: 49639 - DNA, 20 bp, Artificial Sequence
  chemically synthesized
tcctggtttaaaaaccattc

SEQ ID NO: 49640 - DNA, 20 bp, Artificial Sequence
  chemically synthesized
atctagaatggtttttaaac

SEQ ID NO: 49641 - DNA, 20 bp, Artificial Sequence
  chemically synthesized
tctagaatggtttttaaacc

SEQ ID NO: 49642 - DNA, 20 bp, Artificial Sequence
  chemically synthesized
aatggtttttaaaccaggaa

SEQ ID NO: 49643 - DNA, 20 bp, Artificial Sequence
  chemically synthesized
agacttacataaactgttcc

SEQ ID NO: 49644 - DNA, 20 bp, Artificial Sequence
  chemically synthesized
aaaccaggaacagtttatgt

SEQ ID NO: 49645 - DNA, 20 bp, Artificial Sequence
  chemically synthesized
cagtttatgtaagtctacta

SEQ ID NO: 49646 - DNA, 20 bp, Artificial Sequence
  chemically synthesized
aaaggcattttgttctttag

SEQ ID NO: 49647 - DNA, 20 bp, Artificial Sequence
  chemically synthesized
acaaaaggcattttgttctt

SEQ ID NO: 49648 - DNA, 20 bp, Artificial Sequence
  chemically synthesized
aactttgaagtgaggacaaa

SEQ ID NO: 49649 - DNA, 20 bp, Artificial Sequence
  chemically synthesized
gaactttgaagtgaggacaa

SEQ ID NO: 49650 - DNA, 20 bp, Artificial Sequence
  chemically synthesized
tgccttttgtcctcacttca

SEQ ID NO: 49651 - DNA, 20 bp, Artificial Sequence
  chemically synthesized
ctggtgagaactttgaagtg

SEQ ID NO: 49652 - DNA, 20 bp, Artificial Sequence
  chemically synthesized
tctggtgagaactttgaagt

SEQ ID NO: 49653 - DNA, 20 bp, Artificial Sequence
  chemically synthesized
actttctggtgagaactttg

SEQ ID NO: 49654 - DNA, 20 bp, Artificial Sequence
  chemically synthesized
cctcacttcaaagttctcac

SEQ ID NO: 49655 - DNA, 20 bp, Artificial Sequence
  chemically synthesized
acttcaaagttctcaccaga

SEQ ID NO: 49656 - DNA, 20 bp, Artificial Sequence
  chemically synthesized
attacaaagtactttctggt

SEQ ID NO: 49657 - DNA, 20 bp, Artificial Sequence
  chemically synthesized
tgggattacaaagtactttc

SEQ ID NO: 49658 - DNA, 20 bp, Artificial Sequence
  chemically synthesized
acaaccagtttgggattaca

SEQ ID NO: 49659 - DNA, 20 bp, Artificial Sequence
  chemically synthesized
agtactttgtaatcccaaac

SEQ ID NO: 49660 - DNA, 20 bp, Artificial Sequence
  chemically synthesized
tttcagaacacaaccagttt

SEQ ID NO: 49661 - DNA, 20 bp, Artificial Sequence
  chemically synthesized
ttttcagaacacaaccagtt

SEQ ID NO: 49662 - DNA, 20 bp, Artificial Sequence
  chemically synthesized
ttccattttcagaacacaac

SEQ ID NO: 49663 - DNA, 20 bp, Artificial Sequence
  chemically synthesized
aactggttgtgttctgaaaa

SEQ ID NO: 49664 - DNA, 20 bp, Artificial Sequence
  chemically synthesized
atttggatgttttccatttt

SEQ ID NO: 49665 - DNA, 20 bp, Artificial Sequence
  chemically synthesized
gaaaatggaaaacatccaaa

SEQ ID NO: 49666 - DNA, 20 bp, Artificial Sequence
  chemically synthesized
attactttcgtttttccatt

SEQ ID NO: 49667 - DNA, 20 bp, Artificial Sequence
  chemically synthesized
acatccaaatggaaaaacga

SEQ ID NO: 49668 - DNA, 20 bp, Artificial Sequence
  chemically synthesized
aaagtaatgattcttgccca

SEQ ID NO: 49669 - DNA, 20 bp, Artificial Sequence
  chemically synthesized
aagtaatgattcttgcccac

SEQ ID NO: 49670 - DNA, 20 bp, Artificial Sequence
  chemically synthesized
agtaatgattcttgcccaca

SEQ ID NO: 49671 - DNA, 20 bp, Artificial Sequence
  chemically synthesized
gggatcacatccctgtgggc

SEQ ID NO: 49672 - DNA, 20 bp, Artificial Sequence
  chemically synthesized
tagtgggatcacatccctgt

SEQ ID NO: 49673 - DNA, 20 bp, Artificial Sequence
  chemically synthesized
atagtgggatcacatccctg

SEQ ID NO: 49674 - DNA, 20 bp, Artificial Sequence
  chemically synthesized
ctttgcacaacagaaatagt

SEQ ID NO: 49675 - DNA, 20 bp, Artificial Sequence
  chemically synthesized
gctttgcacaacagaaatag

SEQ ID NO: 49676 - DNA, 20 bp, Artificial Sequence
  chemically synthesized
aaagctttgcacaacagaaa

SEQ ID NO: 49677 - DNA, 20 bp, Artificial Sequence
  chemically synthesized
cccactatttctgttgtgca

SEQ ID NO: 49678 - DNA, 20 bp, Artificial Sequence
  chemically synthesized
aaatacaaagctttgcacaa

SEQ ID NO: 49679 - DNA, 20 bp, Artificial Sequence
  chemically synthesized
ttgtgcaaagctttgtattt

SEQ ID NO: 49680 - DNA, 20 bp, Artificial Sequence
  chemically synthesized
tgtcatctgtccaaaataca

SEQ ID NO: 49681 - DNA, 20 bp, Artificial Sequence
  chemically synthesized
gcaaagctttgtattttgga

SEQ ID NO: 49682 - DNA, 20 bp, Artificial Sequence
  chemically synthesized
cagatgacaaaatgctaccc

SEQ ID NO: 49683 - DNA, 20 bp, Artificial Sequence
  chemically synthesized
agatgacaaaatgctacccc

SEQ ID NO: 49684 - DNA, 20 bp, Artificial Sequence
  chemically synthesized
tttgtgaatttggcctgggg

SEQ ID NO: 49685 - DNA, 20 bp, Artificial Sequence
  chemically synthesized
gcatttgtgaatttggcctg

SEQ ID NO: 49686 - DNA, 20 bp, Artificial Sequence
  chemically synthesized
ggcatttgtgaatttggcct

SEQ ID NO: 49687 - DNA, 20 bp, Artificial Sequence
  chemically synthesized
aggcatttgtgaatttggcc

SEQ ID NO: 49688 - DNA, 20 bp, Artificial Sequence
  chemically synthesized
aatgaaggcatttgtgaatt

SEQ ID NO: 49689 - DNA, 20 bp, Artificial Sequence
  chemically synthesized
ttacactacccagaaaatga

SEQ ID NO: 49690 - DNA, 20 bp, Artificial Sequence
  chemically synthesized
tcacaaatgccttcattttc

SEQ ID NO: 49691 - DNA, 20 bp, Artificial Sequence
  chemically synthesized
tttacactacccagaaaatg

SEQ ID NO: 49692 - DNA, 20 bp, Artificial Sequence
  chemically synthesized
cacaaatgccttcattttct

SEQ ID NO: 49693 - DNA, 20 bp, Artificial Sequence
  chemically synthesized
aaatgccttcattttctggg

SEQ ID NO: 49694 - DNA, 20 bp, Artificial Sequence
  chemically synthesized
gggtgtatttttacactacc

SEQ ID NO: 49695 - DNA, 20 bp, Artificial Sequence
  chemically synthesized
tagtgtaaaaatacaccctt

SEQ ID NO: 49696 - DNA, 20 bp, Artificial Sequence
  chemically synthesized
gtgtaaaaatacacccttca

SEQ ID NO: 49697 - DNA, 20 bp, Artificial Sequence
  chemically synthesized
ggtggaatgctggctctgaa

SEQ ID NO: 49698 - DNA, 20 bp, Artificial Sequence
  chemically synthesized
aaaaatacacccttcagagc

SEQ ID NO: 49699 - DNA, 20 bp, Artificial Sequence
  chemically synthesized
tggtggaatgctggctctga

SEQ ID NO: 49700 - DNA, 20 bp, Artificial Sequence
  chemically synthesized
ttggtggaatgctggctctg

SEQ ID NO: 49701 - DNA, 20 bp, Artificial Sequence
  chemically synthesized
gcactattttggtggaatgc

SEQ ID NO: 49702 - DNA, 20 bp, Artificial Sequence
  chemically synthesized
gagccagcattccaccaaaa

SEQ ID NO: 49703 - DNA, 20 bp, Artificial Sequence
  chemically synthesized
taacatgggcactattttgg

SEQ ID NO: 49704 - DNA, 20 bp, Artificial Sequence
  chemically synthesized
ttataacatgggcactattt

SEQ ID NO: 49705 - DNA, 20 bp, Artificial Sequence
  chemically synthesized
ctgaatcagttttataacat

SEQ ID NO: 49706 - DNA, 20 bp, Artificial Sequence
  chemically synthesized
tctgaatcagttttataaca

SEQ ID NO: 49707 - DNA, 20 bp, Artificial Sequence
  chemically synthesized
cccatgttataaaactgatt

SEQ ID NO: 49708 - DNA, 20 bp, Artificial Sequence
  chemically synthesized
ccagcaccagagttctgaat

SEQ ID NO: 49709 - DNA, 20 bp, Artificial Sequence
  chemically synthesized
ataaaactgattcagaactc

SEQ ID NO: 49710 - DNA, 20 bp, Artificial Sequence
  chemically synthesized
ctgattcagaactctggtgc

SEQ ID NO: 49711 - DNA, 20 bp, Artificial Sequence
  chemically synthesized
gggccaagagaccagcacca

SEQ ID NO: 49712 - DNA, 20 bp, Artificial Sequence
  chemically synthesized
tagggccaagagaccagcac

SEQ ID NO: 49713 - DNA, 20 bp, Artificial Sequence
  chemically synthesized
gaactctggtgctggtctct

SEQ ID NO: 49714 - DNA, 20 bp, Artificial Sequence
  chemically synthesized
aggagctagggccaagagac

SEQ ID NO: 49715 - DNA, 20 bp, Artificial Sequence
  chemically synthesized
tggtgctggtctcttggccc

SEQ ID NO: 49716 - DNA, 20 bp, Artificial Sequence
  chemically synthesized
tcatgaggagctagggccaa

SEQ ID NO: 49717 - DNA, 20 bp, Artificial Sequence
  chemically synthesized
cctcatgaggagctagggcc

SEQ ID NO: 49718 - DNA, 20 bp, Artificial Sequence
  chemically synthesized
ctgggcctcatgaggagcta

SEQ ID NO: 49719 - DNA, 20 bp, Artificial Sequence
  chemically synthesized
tctgggcctcatgaggagct

SEQ ID NO: 49720 - DNA, 20 bp, Artificial Sequence
  chemically synthesized
ttctgggcctcatgaggagc

SEQ ID NO: 49721 - DNA, 20 bp, Artificial Sequence
  chemically synthesized
tcttggccctagctcctcat

SEQ ID NO: 49722 - DNA, 20 bp, Artificial Sequence
  chemically synthesized
cttggccctagctcctcatg

SEQ ID NO: 49723 - DNA, 20 bp, Artificial Sequence
  chemically synthesized
attcttctgggcctcatgag

SEQ ID NO: 49724 - DNA, 20 bp, Artificial Sequence
  chemically synthesized
agattcttctgggcctcatg

SEQ ID NO: 49725 - DNA, 20 bp, Artificial Sequence
  chemically synthesized
cagattcttctgggcctcat

SEQ ID NO: 49726 - DNA, 20 bp, Artificial Sequence
  chemically synthesized
ccctagctcctcatgaggcc

SEQ ID NO: 49727 - DNA, 20 bp, Artificial Sequence
  chemically synthesized
tagctcctcatgaggcccag

SEQ ID NO: 49728 - DNA, 20 bp, Artificial Sequence
  chemically synthesized
tcattgtgacagattcttct

SEQ ID NO: 49729 - DNA, 20 bp, Artificial Sequence
  chemically synthesized
ctcattgtgacagattcttc

SEQ ID NO: 49730 - DNA, 20 bp, Artificial Sequence
  chemically synthesized
ccagaagaatctgtcacaat

SEQ ID NO: 49731 - DNA, 20 bp, Artificial Sequence
  chemically synthesized
tttcatcttcctcattgtga

SEQ ID NO: 49732 - DNA, 20 bp, Artificial Sequence
  chemically synthesized
cagaagaatctgtcacaatg

SEQ ID NO: 49733 - DNA, 20 bp, Artificial Sequence
  chemically synthesized
aagaatctgtcacaatgagg

SEQ ID NO: 49734 - DNA, 20 bp, Artificial Sequence
  chemically synthesized
cacaatgaggaagatgaaat

SEQ ID NO: 49735 - DNA, 20 bp, Artificial Sequence
  chemically synthesized
atgaggaagatgaaataaga

SEQ ID NO: 49736 - DNA, 20 bp, Artificial Sequence
  chemically synthesized
aagatgaaataagaaagaaa

SEQ ID NO: 49737 - DNA, 20 bp, Artificial Sequence
  chemically synthesized
cccggtggcatggaagagat

SEQ ID NO: 49738 - DNA, 20 bp, Artificial Sequence
  chemically synthesized
attagcccggtggcatggaa

SEQ ID NO: 49739 - DNA, 20 bp, Artificial Sequence
  chemically synthesized
aaattagcccggtggcatgg

SEQ ID NO: 49740 - DNA, 20 bp, Artificial Sequence
  chemically synthesized
tctcatctcttccatgccac

SEQ ID NO: 49741 - DNA, 20 bp, Artificial Sequence
  chemically synthesized
ctcatctcttccatgccacc

SEQ ID NO: 49742 - DNA, 20 bp, Artificial Sequence
  chemically synthesized
tggaaattagcccggtggca

SEQ ID NO: 49743 - DNA, 20 bp, Artificial Sequence
  chemically synthesized
ttacatggaaattagcccgg

SEQ ID NO: 49744 - DNA, 20 bp, Artificial Sequence
  chemically synthesized
gacttacatggaaattagcc

SEQ ID NO: 49745 - DNA, 20 bp, Artificial Sequence
  chemically synthesized
tcacggacttacatggaaat

SEQ ID NO: 49746 - DNA, 20 bp, Artificial Sequence
  chemically synthesized
caccgggctaatttccatgt

SEQ ID NO: 49747 - DNA, 20 bp, Artificial Sequence
  chemically synthesized
tccttcgtcacggacttaca

SEQ ID NO: 49748 - DNA, 20 bp, Artificial Sequence
  chemically synthesized
ttccatgtaagtccgtgacg

SEQ ID NO: 49749 - DNA, 20 bp, Artificial Sequence
  chemically synthesized
tccatgtaagtccgtgacga

SEQ ID NO: 49750 - DNA, 20 bp, Artificial Sequence
  chemically synthesized
taaccaccactccttcgtca

SEQ ID NO: 49751 - DNA, 20 bp, Artificial Sequence
  chemically synthesized
catgtaagtccgtgacgaag

SEQ ID NO: 49752 - DNA, 20 bp, Artificial Sequence
  chemically synthesized
gtaagtccgtgacgaaggag

SEQ ID NO: 49753 - DNA, 20 bp, Artificial Sequence
  chemically synthesized
agtccgtgacgaaggagtgg

SEQ ID NO: 49754 - DNA, 20 bp, Artificial Sequence
  chemically synthesized
cgtgacgaaggagtggtggt

SEQ ID NO: 49755 - DNA, 20 bp, Artificial Sequence
  chemically synthesized
aggagtggtggttagtgatc

SEQ ID NO: 49756 - DNA, 20 bp, Artificial Sequence
  chemically synthesized
gctgaatgggcgcatttagc

SEQ ID NO: 49757 - DNA, 20 bp, Artificial Sequence
  chemically synthesized
tagagctgaatgggcgcatt

SEQ ID NO: 49758 - DNA, 20 bp, Artificial Sequence
  chemically synthesized
tccagctaaatgcgcccatt

SEQ ID NO: 49759 - DNA, 20 bp, Artificial Sequence
  chemically synthesized
atctggctttagagctgaat

SEQ ID NO: 49760 - DNA, 20 bp, Artificial Sequence
  chemically synthesized
aatctggctttagagctgaa

SEQ ID NO: 49761 - DNA, 20 bp, Artificial Sequence
  chemically synthesized
aatgcgcccattcagctcta

SEQ ID NO: 49762 - DNA, 20 bp, Artificial Sequence
  chemically synthesized
cgcccattcagctctaaagc

SEQ ID NO: 49763 - DNA, 20 bp, Artificial Sequence
  chemically synthesized
ccatgcataatctggcttta

SEQ ID NO: 49764 - DNA, 20 bp, Artificial Sequence
  chemically synthesized
ccccatgcataatctggctt

SEQ ID NO: 49765 - DNA, 20 bp, Artificial Sequence
  chemically synthesized
atcataccccatgcataatc

SEQ ID NO: 49766 - DNA, 20 bp, Artificial Sequence
  chemically synthesized
ctctaaagccagattatgca

SEQ ID NO: 49767 - DNA, 20 bp, Artificial Sequence
  chemically synthesized
tctaaagccagattatgcat

SEQ ID NO: 49768 - DNA, 20 bp, Artificial Sequence
  chemically synthesized
ctaaagccagattatgcatg

SEQ ID NO: 49769 - DNA, 20 bp, Artificial Sequence
  chemically synthesized
agattatgcatggggtatga

SEQ ID NO: 49770 - DNA, 20 bp, Artificial Sequence
  chemically synthesized
ttatgcatggggtatgatag

SEQ ID NO: 49771 - DNA, 20 bp, Artificial Sequence
  chemically synthesized
ggtatgatagcagcttcata

SEQ ID NO: 49772 - DNA, 20 bp, Artificial Sequence
  chemically synthesized
aacctctcctagactttatg

SEQ ID NO: 49773 - DNA, 20 bp, Artificial Sequence
  chemically synthesized
gatagcagcttcataaagtc

SEQ ID NO: 49774 - DNA, 20 bp, Artificial Sequence
  chemically synthesized
atagcagcttcataaagtct

SEQ ID NO: 49775 - DNA, 20 bp, Artificial Sequence
  chemically synthesized
agcagcttcataaagtctag

SEQ ID NO: 49776 - DNA, 20 bp, Artificial Sequence
  chemically synthesized
cagcttcataaagtctagga

SEQ ID NO: 49777 - DNA, 20 bp, Artificial Sequence
  chemically synthesized
agcttcataaagtctaggag

SEQ ID NO: 49778 - DNA, 20 bp, Artificial Sequence
  chemically synthesized
acaatagtattaacctctcc

SEQ ID NO: 49779 - DNA, 20 bp, Artificial Sequence
  chemically synthesized
ggatctgagtggaacaacaa

SEQ ID NO: 49780 - DNA, 20 bp, Artificial Sequence
  chemically synthesized
aatactattgttgttccact

SEQ ID NO: 49781 - DNA, 20 bp, Artificial Sequence
  chemically synthesized
ctcagtaaaagggatctgag

SEQ ID NO: 49782 - DNA, 20 bp, Artificial Sequence
  chemically synthesized
cagctcagtaaaagggatct

SEQ ID NO: 49783 - DNA, 20 bp, Artificial Sequence
  chemically synthesized
ccactcagatcccttttact

SEQ ID NO: 49784 - DNA, 20 bp, Artificial Sequence
  chemically synthesized
ggtgaaccagctcagtaaaa

SEQ ID NO: 49785 - DNA, 20 bp, Artificial Sequence
  chemically synthesized
gggtgaaccagctcagtaaa

SEQ ID NO: 49786 - DNA, 20 bp, Artificial Sequence
  chemically synthesized
tgggtgaaccagctcagtaa

SEQ ID NO: 49787 - DNA, 20 bp, Artificial Sequence
  chemically synthesized
tcagatcccttttactgagc

SEQ ID NO: 49788 - DNA, 20 bp, Artificial Sequence
  chemically synthesized
tgcggctgggtgaaccagct

SEQ ID NO: 49789 - DNA, 20 bp, Artificial Sequence
  chemically synthesized
ttttactgagctggttcacc

SEQ ID NO: 49790 - DNA, 20 bp, Artificial Sequence
  chemically synthesized
acaactgcggctgggtgaac

SEQ ID NO: 49791 - DNA, 20 bp, Artificial Sequence
  chemically synthesized
tgagctggttcacccagccg

SEQ ID NO: 49792 - DNA, 20 bp, Artificial Sequence
  chemically synthesized
cactcacaacaactgcggct

SEQ ID NO: 49793 - DNA, 20 bp, Artificial Sequence
  chemically synthesized
acactcacaacaactgcggc

SEQ ID NO: 49794 - DNA, 20 bp, Artificial Sequence
  chemically synthesized
accaacactcacaacaactg

SEQ ID NO: 49795 - DNA, 20 bp, Artificial Sequence
  chemically synthesized
cacccagccgcagttgttgt

SEQ ID NO: 49796 - DNA, 20 bp, Artificial Sequence
  chemically synthesized
gccgcagttgttgtgagtgt

SEQ ID NO: 49797 - DNA, 20 bp, Artificial Sequence
  chemically synthesized
tgttgtgagtgttggttgct

SEQ ID NO: 49798 - DNA, 20 bp, Artificial Sequence
  chemically synthesized
gttgtgagtgttggttgcta

SEQ ID NO: 49799 - DNA, 20 bp, Artificial Sequence
  chemically synthesized
tgaaaggaccaatgaggcct

SEQ ID NO: 49800 - DNA, 20 bp, Artificial Sequence
  chemically synthesized
gttggttgctaaggcctcat

SEQ ID NO: 49801 - DNA, 20 bp, Artificial Sequence
  chemically synthesized
ttctggtgaaaggaccaatg

SEQ ID NO: 49802 - DNA, 20 bp, Artificial Sequence
  chemically synthesized
tttctggtgaaaggaccaat

SEQ ID NO: 49803 - DNA, 20 bp, Artificial Sequence
  chemically synthesized
ggcctcattggtcctttcac

SEQ ID NO: 49804 - DNA, 20 bp, Artificial Sequence
  chemically synthesized
aagggaggatttctggtgaa

SEQ ID NO: 49805 - DNA, 20 bp, Artificial Sequence
  chemically synthesized
caagggaggatttctggtga

SEQ ID NO: 49806 - DNA, 20 bp, Artificial Sequence
  chemically synthesized
tttggccaagggaggatttc

SEQ ID NO: 49807 - DNA, 20 bp, Artificial Sequence
  chemically synthesized
tttcaccagaaatcctccct

SEQ ID NO: 49808 - DNA, 20 bp, Artificial Sequence
  chemically synthesized
agttcccatttggccaaggg

SEQ ID NO: 49809 - DNA, 20 bp, Artificial Sequence
  chemically synthesized
cagttcccatttggccaagg

SEQ ID NO: 49810 - DNA, 20 bp, Artificial Sequence
  chemically synthesized
agcagttcccatttggccaa

SEQ ID NO: 49811 - DNA, 20 bp, Artificial Sequence
  chemically synthesized
aagcagttcccatttggcca

SEQ ID NO: 49812 - DNA, 20 bp, Artificial Sequence
  chemically synthesized
gaaatcctcccttggccaaa

SEQ ID NO: 49813 - DNA, 20 bp, Artificial Sequence
  chemically synthesized
aaagcagttcccatttggcc

SEQ ID NO: 49814 - DNA, 20 bp, Artificial Sequence
  chemically synthesized
aaatcctcccttggccaaat

SEQ ID NO: 49815 - DNA, 20 bp, Artificial Sequence
  chemically synthesized
atagcaaagcagttcccatt

SEQ ID NO: 49816 - DNA, 20 bp, Artificial Sequence
  chemically synthesized
gggagtaggagatagcaaag

SEQ ID NO: 49817 - DNA, 20 bp, Artificial Sequence
  chemically synthesized
ctggggagtaggagatagca

SEQ ID NO: 49818 - DNA, 20 bp, Artificial Sequence
  chemically synthesized
gatttctggggagtaggaga

SEQ ID NO: 49819 - DNA, 20 bp, Artificial Sequence
  chemically synthesized
tgtggatttctggggagtag

SEQ ID NO: 49820 - DNA, 20 bp, Artificial Sequence
  chemically synthesized
ctttgctatctcctactccc

SEQ ID NO: 49821 - DNA, 20 bp, Artificial Sequence
  chemically synthesized
gctgtggatttctggggagt

SEQ ID NO: 49822 - DNA, 20 bp, Artificial Sequence
  chemically synthesized
ggctgtggatttctggggag

SEQ ID NO: 49823 - DNA, 20 bp, Artificial Sequence
  chemically synthesized
attggctgtggatttctggg

SEQ ID NO: 49824 - DNA, 20 bp, Artificial Sequence
  chemically synthesized
tcattggctgtggatttctg

SEQ ID NO: 49825 - DNA, 20 bp, Artificial Sequence
  chemically synthesized
gtcattggctgtggatttct

SEQ ID NO: 49826 - DNA, 20 bp, Artificial Sequence
  chemically synthesized
agtcattggctgtggatttc

SEQ ID NO: 49827 - DNA, 20 bp, Artificial Sequence
  chemically synthesized
tcctactccccagaaatcca

SEQ ID NO: 49828 - DNA, 20 bp, Artificial Sequence
  chemically synthesized
tgtgaattagtcattggctg

SEQ ID NO: 49829 - DNA, 20 bp, Artificial Sequence
  chemically synthesized
ttcccgtgtgaattagtcat

SEQ ID NO: 49830 - DNA, 20 bp, Artificial Sequence
  chemically synthesized
cagccaatgactaattcaca

SEQ ID NO: 49831 - DNA, 20 bp, Artificial Sequence
  chemically synthesized
ttttattttcccgtgtgaat

SEQ ID NO: 49832 - DNA, 20 bp, Artificial Sequence
  chemically synthesized
agccaatgactaattcacac

SEQ ID NO: 49833 - DNA, 20 bp, Artificial Sequence
  chemically synthesized
taattcacacgggaaaataa

SEQ ID NO: 49834 - DNA, 20 bp, Artificial Sequence
  chemically synthesized
cacacgggaaaataaaagcc

SEQ ID NO: 49835 - DNA, 20 bp, Artificial Sequence
  chemically synthesized
ggaaaataaaagcccagccc

SEQ ID NO: 49836 - DNA, 20 bp, Artificial Sequence
  chemically synthesized
caccgcgcccagccagggct

SEQ ID NO: 49837 - DNA, 20 bp, Artificial Sequence
  chemically synthesized
ccaccgcgcccagccagggc

SEQ ID NO: 49838 - DNA, 20 bp, Artificial Sequence
  chemically synthesized
aataaaagcccagccctggc

SEQ ID NO: 49839 - DNA, 20 bp, Artificial Sequence
  chemically synthesized
ataaaagcccagccctggct

SEQ ID NO: 49840 - DNA, 20 bp, Artificial Sequence
  chemically synthesized
tgagccaccgcgcccagcca

SEQ ID NO: 49841 - DNA, 20 bp, Artificial Sequence
  chemically synthesized
gtgagccaccgcgcccagcc

SEQ ID NO: 49842 - DNA, 20 bp, Artificial Sequence
  chemically synthesized
cgtgagccaccgcgcccagc

SEQ ID NO: 49843 - DNA, 20 bp, Artificial Sequence
  chemically synthesized
agcccagccctggctgggcg

SEQ ID NO: 49844 - DNA, 20 bp, Artificial Sequence
  chemically synthesized
ccagccctggctgggcgcgg

SEQ ID NO: 49845 - DNA, 20 bp, Artificial Sequence
  chemically synthesized
caggcgtgagccaccgcgcc

SEQ ID NO: 49846 - DNA, 20 bp, Artificial Sequence
  chemically synthesized
agtgctgggattacaggcgt

SEQ ID NO: 49847 - DNA, 20 bp, Artificial Sequence
  chemically synthesized
gtggctcacgcctgtaatcc

SEQ ID NO: 49848 - DNA, 20 bp, Artificial Sequence
  chemically synthesized
tccaaaagtgctgggattac

SEQ ID NO: 49849 - DNA, 20 bp, Artificial Sequence
  chemically synthesized
ctccaaaagtgctgggatta

SEQ ID NO: 49850 - DNA, 20 bp, Artificial Sequence
  chemically synthesized
cctcggtctccaaaagtgct

SEQ ID NO: 49851 - DNA, 20 bp, Artificial Sequence
  chemically synthesized
gcctgtaatcccagcacttt

SEQ ID NO: 49852 - DNA, 20 bp, Artificial Sequence
  chemically synthesized
gcctcggtctccaaaagtgc

SEQ ID NO: 49853 - DNA, 20 bp, Artificial Sequence
  chemically synthesized
ctgtaatcccagcacttttg

SEQ ID NO: 49854 - DNA, 20 bp, Artificial Sequence
  chemically synthesized
ccgcctgcctcggtctccaa

SEQ ID NO: 49855 - DNA, 20 bp, Artificial Sequence
  chemically synthesized
tcccagcacttttggagacc

SEQ ID NO: 49856 - DNA, 20 bp, Artificial Sequence
  chemically synthesized
cccagcacttttggagaccg

SEQ ID NO: 49857 - DNA, 20 bp, Artificial Sequence
  chemically synthesized
agcacttttggagaccgagg

SEQ ID NO: 49858 - DNA, 20 bp, Artificial Sequence
  chemically synthesized
gcacttttggagaccgaggc

SEQ ID NO: 49859 - DNA, 20 bp, Artificial Sequence
  chemically synthesized
cttttggagaccgaggcagg

SEQ ID NO: 49860 - DNA, 20 bp, Artificial Sequence
  chemically synthesized
atctcctgatccgcctgcct

SEQ ID NO: 49861 - DNA, 20 bp, Artificial Sequence
  chemically synthesized
ggagaccgaggcaggcggat

SEQ ID NO: 49862 - DNA, 20 bp, Artificial Sequence
  chemically synthesized
gagaccgaggcaggcggatc

SEQ ID NO: 49863 - DNA, 20 bp, Artificial Sequence
  chemically synthesized
gaccgaggcaggcggatcag

SEQ ID NO: 49864 - DNA, 20 bp, Artificial Sequence
  chemically synthesized
aggcaggcggatcaggagat

SEQ ID NO: 49865 - DNA, 20 bp, Artificial Sequence
  chemically synthesized
ggcaggcggatcaggagatc

SEQ ID NO: 49866 - DNA, 20 bp, Artificial Sequence
  chemically synthesized
caggcggatcaggagatcag

SEQ ID NO: 49867 - DNA, 20 bp, Artificial Sequence
  chemically synthesized
gatcaggagatcaggagttc

SEQ ID NO: 49868 - DNA, 20 bp, Artificial Sequence
  chemically synthesized
ggagatcaggagttcgagac

SEQ ID NO: 49869 - DNA, 20 bp, Artificial Sequence
  chemically synthesized
tcaggagttcgagaccagcc

SEQ ID NO: 49870 - DNA, 20 bp, Artificial Sequence
  chemically synthesized
tttcactaggttggccaggc

SEQ ID NO: 49871 - DNA, 20 bp, Artificial Sequence
  chemically synthesized
ggggtttcactaggttggcc

SEQ ID NO: 49872 - DNA, 20 bp, Artificial Sequence
  chemically synthesized
cgagaccagcctggccaacc

SEQ ID NO: 49873 - DNA, 20 bp, Artificial Sequence
  chemically synthesized
cggggtttcactaggttggc

SEQ ID NO: 49874 - DNA, 20 bp, Artificial Sequence
  chemically synthesized
gagacggggtttcactaggt

SEQ ID NO: 49875 - DNA, 20 bp, Artificial Sequence
  chemically synthesized
actagagacggggtttcact

SEQ ID NO: 49876 - DNA, 20 bp, Artificial Sequence
  chemically synthesized
tactagagacggggtttcac

SEQ ID NO: 49877 - DNA, 20 bp, Artificial Sequence
  chemically synthesized
acctagtgaaaccccgtctc

SEQ ID NO: 49878 - DNA, 20 bp, Artificial Sequence
  chemically synthesized
ttgtatttttactagagacg

SEQ ID NO: 49879 - DNA, 20 bp, Artificial Sequence
  chemically synthesized
tttgtatttttactagagac

SEQ ID NO: 49880 - DNA, 20 bp, Artificial Sequence
  chemically synthesized
ttttgtatttttactagaga

SEQ ID NO: 49881 - DNA, 20 bp, Artificial Sequence
  chemically synthesized
ttttttttgtatttttacta

SEQ ID NO: 49882 - DNA, 20 bp, Artificial Sequence
  chemically synthesized
ttttttttttgtatttttac

SEQ ID NO: 49883 - DNA, 20 bp, Artificial Sequence
  chemically synthesized
aaaaaaaaaaaaaaaaaatc

SEQ ID NO: 49884 - DNA, 20 bp, Artificial Sequence
  chemically synthesized
aaaaaaaaaaaaaaaaatcc

SEQ ID NO: 49885 - DNA, 20 bp, Artificial Sequence
  chemically synthesized
aaaaaaaaaaaatccaggcg

SEQ ID NO: 49886 - DNA, 20 bp, Artificial Sequence
  chemically synthesized
aaaaaaaaatccaggcgcgg

SEQ ID NO: 49887 - DNA, 20 bp, Artificial Sequence
  chemically synthesized
gtagctgggactaccgcgcc

SEQ ID NO: 49888 - DNA, 20 bp, Artificial Sequence
  chemically synthesized
aaatccaggcgcggtagtcc

SEQ ID NO: 49889 - DNA, 20 bp, Artificial Sequence
  chemically synthesized
gcgcggtagtcccagctact

SEQ ID NO: 49890 - DNA, 20 bp, Artificial Sequence
  chemically synthesized
cctcagcctcccgagtagct

SEQ ID NO: 49891 - DNA, 20 bp, Artificial Sequence
  chemically synthesized
cgcggtagtcccagctactc

SEQ ID NO: 49892 - DNA, 20 bp, Artificial Sequence
  chemically synthesized
gcctcagcctcccgagtagc

SEQ ID NO: 49893 - DNA, 20 bp, Artificial Sequence
  chemically synthesized
cggtagtcccagctactcgg

SEQ ID NO: 49894 - DNA, 20 bp, Artificial Sequence
  chemically synthesized
ggtagtcccagctactcggg

SEQ ID NO: 49895 - DNA, 20 bp, Artificial Sequence
  chemically synthesized
tcctgcctcagcctcccgag

SEQ ID NO: 49896 - DNA, 20 bp, Artificial Sequence
  chemically synthesized
ttctcctgcctcagcctccc

SEQ ID NO: 49897 - DNA, 20 bp, Artificial Sequence
  chemically synthesized
tcccagctactcgggaggct

SEQ ID NO: 49898 - DNA, 20 bp, Artificial Sequence
  chemically synthesized
cccagctactcgggaggctg

SEQ ID NO: 49899 - DNA, 20 bp, Artificial Sequence
  chemically synthesized
agctactcgggaggctgagg

SEQ ID NO: 49900 - DNA, 20 bp, Artificial Sequence
  chemically synthesized
gctactcgggaggctgaggc

SEQ ID NO: 49901 - DNA, 20 bp, Artificial Sequence
  chemically synthesized
tactcgggaggctgaggcag

SEQ ID NO: 49902 - DNA, 20 bp, Artificial Sequence
  chemically synthesized
ttcaagctattctcctgcct

SEQ ID NO: 49903 - DNA, 20 bp, Artificial Sequence
  chemically synthesized
gggaggctgaggcaggagaa

SEQ ID NO: 49904 - DNA, 20 bp, Artificial Sequence
  chemically synthesized
gcaggagaatagcttgaacc

SEQ ID NO: 49905 - DNA, 20 bp, Artificial Sequence
  chemically synthesized
caggagaatagcttgaacct

SEQ ID NO: 49906 - DNA, 20 bp, Artificial Sequence
  chemically synthesized
aacctccgcctcccaggttc

SEQ ID NO: 49907 - DNA, 20 bp, Artificial Sequence
  chemically synthesized
ggagaatagcttgaacctgg

SEQ ID NO: 49908 - DNA, 20 bp, Artificial Sequence
  chemically synthesized
gagaatagcttgaacctggg

SEQ ID NO: 49909 - DNA, 20 bp, Artificial Sequence
  chemically synthesized
aatagcttgaacctgggagg

SEQ ID NO: 49910 - DNA, 20 bp, Artificial Sequence
  chemically synthesized
cactgcaacctccgcctccc

SEQ ID NO: 49911 - DNA, 20 bp, Artificial Sequence
  chemically synthesized
tagcttgaacctgggaggcg

SEQ ID NO: 49912 - DNA, 20 bp, Artificial Sequence
  chemically synthesized
tcactgcaacctccgcctcc

SEQ ID NO: 49913 - DNA, 20 bp, Artificial Sequence
  chemically synthesized
agcttgaacctgggaggcgg

SEQ ID NO: 49914 - DNA, 20 bp, Artificial Sequence
  chemically synthesized
aacctgggaggcggaggttg

SEQ ID NO: 49915 - DNA, 20 bp, Artificial Sequence
  chemically synthesized
tgggaggcggaggttgcagt

SEQ ID NO: 49916 - DNA, 20 bp, Artificial Sequence
  chemically synthesized
ggcggaggttgcagtgagcc

SEQ ID NO: 49917 - DNA, 20 bp, Artificial Sequence
  chemically synthesized
ggagtgcaatggcgtgatct

SEQ ID NO: 49918 - DNA, 20 bp, Artificial Sequence
  chemically synthesized
tcacccaaactggagtgcaa

SEQ ID NO: 49919 - DNA, 20 bp, Artificial Sequence
  chemically synthesized
aagatcacgccattgcactc

SEQ ID NO: 49920 - DNA, 20 bp, Artificial Sequence
  chemically synthesized
cacgccattgcactccagtt

SEQ ID NO: 49921 - DNA, 20 bp, Artificial Sequence
  chemically synthesized
acgccattgcactccagttt

SEQ ID NO: 49922 - DNA, 20 bp, Artificial Sequence
  chemically synthesized
ttgttctgtcacccaaactg

SEQ ID NO: 49923 - DNA, 20 bp, Artificial Sequence
  chemically synthesized
tcttgttctgtcacccaaac

SEQ ID NO: 49924 - DNA, 20 bp, Artificial Sequence
  chemically synthesized
ttgcactccagtttgggtga

SEQ ID NO: 49925 - DNA, 20 bp, Artificial Sequence
  chemically synthesized
tccagtttgggtgacagaac

SEQ ID NO: 49926 - DNA, 20 bp, Artificial Sequence
  chemically synthesized
tgtttgtttgttttgagatg

SEQ ID NO: 49927 - DNA, 20 bp, Artificial Sequence
  chemically synthesized
tttgtttgtttgttttgaga

SEQ ID NO: 49928 - DNA, 20 bp, Artificial Sequence
  chemically synthesized
gctttttgtttgtttgtttt

SEQ ID NO: 49929 - DNA, 20 bp, Artificial Sequence
  chemically synthesized
tctcaaaacaaacaaacaaa

SEQ ID NO: 49930 - DNA, 20 bp, Artificial Sequence
  chemically synthesized
aaacaaacaaacaaaaagcc

SEQ ID NO: 49931 - DNA, 20 bp, Artificial Sequence
  chemically synthesized
aacaaacaaacaaaaagccc

SEQ ID NO: 49932 - DNA, 20 bp, Artificial Sequence
  chemically synthesized
tactttgagataaggggcct

SEQ ID NO: 49933 - DNA, 20 bp, Artificial Sequence
  chemically synthesized
ctactttgagataaggggcc

SEQ ID NO: 49934 - DNA, 20 bp, Artificial Sequence
  chemically synthesized
tgtccctactttgagataag

SEQ ID NO: 49935 - DNA, 20 bp, Artificial Sequence
  chemically synthesized
ttgtccctactttgagataa

SEQ ID NO: 49936 - DNA, 20 bp, Artificial Sequence
  chemically synthesized
agcccaggccccttatctca

SEQ ID NO: 49937 - DNA, 20 bp, Artificial Sequence
  chemically synthesized
attgtccctactttgagata

SEQ ID NO: 49938 - DNA, 20 bp, Artificial Sequence
  chemically synthesized
aattgtccctactttgagat

SEQ ID NO: 49939 - DNA, 20 bp, Artificial Sequence
  chemically synthesized
ccaggccccttatctcaaag

SEQ ID NO: 49940 - DNA, 20 bp, Artificial Sequence
  chemically synthesized
caggccccttatctcaaagt

SEQ ID NO: 49941 - DNA, 20 bp, Artificial Sequence
  chemically synthesized
aggccccttatctcaaagta

SEQ ID NO: 49942 - DNA, 20 bp, Artificial Sequence
  chemically synthesized
gaacaaattgtccctacttt

SEQ ID NO: 49943 - DNA, 20 bp, Artificial Sequence
  chemically synthesized
agtagggacaatttgttctc

SEQ ID NO: 49944 - DNA, 20 bp, Artificial Sequence
  chemically synthesized
tagggacaatttgttctcca

SEQ ID NO: 49945 - DNA, 20 bp, Artificial Sequence
  chemically synthesized
tgatcccacagggagctctg

SEQ ID NO: 49946 - DNA, 20 bp, Artificial Sequence
  chemically synthesized
cttgatcccacagggagctc

SEQ ID NO: 49947 - DNA, 20 bp, Artificial Sequence
  chemically synthesized
ttgttctccagagctccctg

SEQ ID NO: 49948 - DNA, 20 bp, Artificial Sequence
  chemically synthesized
tgttctccagagctccctgt

SEQ ID NO: 49949 - DNA, 20 bp, Artificial Sequence
  chemically synthesized
cttcagcttgatcccacagg

SEQ ID NO: 49950 - DNA, 20 bp, Artificial Sequence
  chemically synthesized
cacttcagcttgatcccaca

SEQ ID NO: 49951 - DNA, 20 bp, Artificial Sequence
  chemically synthesized
tcacttcagcttgatcccac

SEQ ID NO: 49952 - DNA, 20 bp, Artificial Sequence
  chemically synthesized
ccagagctccctgtgggatc

SEQ ID NO: 49953 - DNA, 20 bp, Artificial Sequence
  chemically synthesized
ctcacttcagcttgatccca

SEQ ID NO: 49954 - DNA, 20 bp, Artificial Sequence
  chemically synthesized
ctccctgtgggatcaagctg

SEQ ID NO: 49955 - DNA, 20 bp, Artificial Sequence
  chemically synthesized
ctgtgggatcaagctgaagt

SEQ ID NO: 49956 - DNA, 20 bp, Artificial Sequence
  chemically synthesized
gggaaggaagagactcactt

SEQ ID NO: 49957 - DNA, 20 bp, Artificial Sequence
  chemically synthesized
aggagttaagtgggaaggaa

SEQ ID NO: 49958 - DNA, 20 bp, Artificial Sequence
  chemically synthesized
caaggagttaagtgggaagg

SEQ ID NO: 49959 - DNA, 20 bp, Artificial Sequence
  chemically synthesized
ggtcaaggagttaagtggga

SEQ ID NO: 49960 - DNA, 20 bp, Artificial Sequence
  chemically synthesized
tggtcaaggagttaagtggg

SEQ ID NO: 49961 - DNA, 20 bp, Artificial Sequence
  chemically synthesized
tgctggtcaaggagttaagt

SEQ ID NO: 49962 - DNA, 20 bp, Artificial Sequence
  chemically synthesized
atgctggtcaaggagttaag

SEQ ID NO: 49963 - DNA, 20 bp, Artificial Sequence
  chemically synthesized
aggatgctggtcaaggagtt

SEQ ID NO: 49964 - DNA, 20 bp, Artificial Sequence
  chemically synthesized
ttcccacttaactccttgac

SEQ ID NO: 49965 - DNA, 20 bp, Artificial Sequence
  chemically synthesized
taagaaggatgctggtcaag

SEQ ID NO: 49966 - DNA, 20 bp, Artificial Sequence
  chemically synthesized
agtaagaaggatgctggtca

SEQ ID NO: 49967 - DNA, 20 bp, Artificial Sequence
  chemically synthesized
aagtaagaaggatgctggtc

SEQ ID NO: 49968 - DNA, 20 bp, Artificial Sequence
  chemically synthesized
ggataaagtaagaaggatgc

SEQ ID NO: 49969 - DNA, 20 bp, Artificial Sequence
  chemically synthesized
ggaagcaggataaagtaaga

SEQ ID NO: 49970 - DNA, 20 bp, Artificial Sequence
  chemically synthesized
gggaagcaggataaagtaag

SEQ ID NO: 49971 - DNA, 20 bp, Artificial Sequence
  chemically synthesized
tgagggaagcaggataaagt

SEQ ID NO: 49972 - DNA, 20 bp, Artificial Sequence
  chemically synthesized
ggagtgagggaagcaggata

SEQ ID NO: 49973 - DNA, 20 bp, Artificial Sequence
  chemically synthesized
tgaaagggagtgagggaagc

SEQ ID NO: 49974 - DNA, 20 bp, Artificial Sequence
  chemically synthesized
gtgaaagggagtgagggaag

SEQ ID NO: 49975 - DNA, 20 bp, Artificial Sequence
  chemically synthesized
caggtgaaagggagtgaggg

SEQ ID NO: 49976 - DNA, 20 bp, Artificial Sequence
  chemically synthesized
gttcaggtgaaagggagtga

SEQ ID NO: 49977 - DNA, 20 bp, Artificial Sequence
  chemically synthesized
tgttcaggtgaaagggagtg

SEQ ID NO: 49978 - DNA, 20 bp, Artificial Sequence
  chemically synthesized
ttgttcaggtgaaagggagt

SEQ ID NO: 49979 - DNA, 20 bp, Artificial Sequence
  chemically synthesized
taatttgttcaggtgaaagg

SEQ ID NO: 49980 - DNA, 20 bp, Artificial Sequence
  chemically synthesized
agtaatttgttcaggtgaaa

SEQ ID NO: 49981 - DNA, 20 bp, Artificial Sequence
  chemically synthesized
aagtaatttgttcaggtgaa

SEQ ID NO: 49982 - DNA, 20 bp, Artificial Sequence
  chemically synthesized
gaagtaatttgttcaggtga

SEQ ID NO: 49983 - DNA, 20 bp, Artificial Sequence
  chemically synthesized
cttgtagaagtaatttgttc

SEQ ID NO: 49984 - DNA, 20 bp, Artificial Sequence
  chemically synthesized
tcttgtagaagtaatttgtt

SEQ ID NO: 49985 - DNA, 20 bp, Artificial Sequence
  chemically synthesized
cctgaacaaattacttctac

SEQ ID NO: 49986 - DNA, 20 bp, Artificial Sequence
  chemically synthesized
gaacaaattacttctacaag

SEQ ID NO: 49987 - DNA, 20 bp, Artificial Sequence
  chemically synthesized
atagatggggcttcttgtag

SEQ ID NO: 49988 - DNA, 20 bp, Artificial Sequence
  chemically synthesized
tagatagatggggcttcttg

SEQ ID NO: 49989 - DNA, 20 bp, Artificial Sequence
  chemically synthesized
gagccctatttagatagatg

SEQ ID NO: 49990 - DNA, 20 bp, Artificial Sequence
  chemically synthesized
agagccctatttagatagat

SEQ ID NO: 49991 - DNA, 20 bp, Artificial Sequence
  chemically synthesized
tagagccctatttagataga

SEQ ID NO: 49992 - DNA, 20 bp, Artificial Sequence
  chemically synthesized
agaagccccatctatctaaa

SEQ ID NO: 49993 - DNA, 20 bp, Artificial Sequence
  chemically synthesized
gaagccccatctatctaaat

SEQ ID NO: 49994 - DNA, 20 bp, Artificial Sequence
  chemically synthesized
gaagtagagccctatttaga

SEQ ID NO: 49995 - DNA, 20 bp, Artificial Sequence
  chemically synthesized
aagccccatctatctaaata

SEQ ID NO: 49996 - DNA, 20 bp, Artificial Sequence
  chemically synthesized
cctagaagtagagccctatt

SEQ ID NO: 49997 - DNA, 20 bp, Artificial Sequence
  chemically synthesized
tctaaatagggctctacttc

SEQ ID NO: 49998 - DNA, 20 bp, Artificial Sequence
  chemically synthesized
ctaaatagggctctacttct

SEQ ID NO: 49999 - DNA, 20 bp, Artificial Sequence
  chemically synthesized
aggtaaaatccctagaagta

SEQ ID NO: 50000 - DNA, 20 bp, Artificial Sequence
  chemically synthesized
taaatagggctctacttcta

SEQ ID NO: 50001 - DNA, 20 bp, Artificial Sequence
  chemically synthesized
ttaggtaaaatccctagaag

SEQ ID NO: 50002 - DNA, 20 bp, Artificial Sequence
  chemically synthesized
gccttaggtaaaatccctag

SEQ ID NO: 50003 - DNA, 20 bp, Artificial Sequence
  chemically synthesized
ctagccttaggtaaaatccc

SEQ ID NO: 50004 - DNA, 20 bp, Artificial Sequence
  chemically synthesized
tacttctagggattttacct

SEQ ID NO: 50005 - DNA, 20 bp, Artificial Sequence
  chemically synthesized
acttctagggattttaccta

SEQ ID NO: 50006 - DNA, 20 bp, Artificial Sequence
  chemically synthesized
ctagggattttacctaaggc

SEQ ID NO: 50007 - DNA, 20 bp, Artificial Sequence
  chemically synthesized
tagggattttacctaaggct

SEQ ID NO: 50008 - DNA, 20 bp, Artificial Sequence
  chemically synthesized
agggattttacctaaggcta

SEQ ID NO: 50009 - DNA, 20 bp, Artificial Sequence
  chemically synthesized
tagttgctcaccctagcctt

SEQ ID NO: 50010 - DNA, 20 bp, Artificial Sequence
  chemically synthesized
atagttgctcaccctagcct

SEQ ID NO: 50011 - DNA, 20 bp, Artificial Sequence
  chemically synthesized
attttacctaaggctagggt

SEQ ID NO: 50012 - DNA, 20 bp, Artificial Sequence
  chemically synthesized
accaagatagttgctcaccc

SEQ ID NO: 50013 - DNA, 20 bp, Artificial Sequence
  chemically synthesized
gctagggtgagcaactatct

SEQ ID NO: 50014 - DNA, 20 bp, Artificial Sequence
  chemically synthesized
tagtcccaggcaaaccaaga

SEQ ID NO: 50015 - DNA, 20 bp, Artificial Sequence
  chemically synthesized
tctgtagtcccaggcaaacc

SEQ ID NO: 50016 - DNA, 20 bp, Artificial Sequence
  chemically synthesized
agcaactatcttggtttgcc

SEQ ID NO: 50017 - DNA, 20 bp, Artificial Sequence
  chemically synthesized
gcaactatcttggtttgcct

SEQ ID NO: 50018 - DNA, 20 bp, Artificial Sequence
  chemically synthesized
tcttggtttgcctgggacta

SEQ ID NO: 50019 - DNA, 20 bp, Artificial Sequence
  chemically synthesized
caggaaatctctgtagtccc

SEQ ID NO: 50020 - DNA, 20 bp, Artificial Sequence
  chemically synthesized
ccaggaaatctctgtagtcc

SEQ ID NO: 50021 - DNA, 20 bp, Artificial Sequence
  chemically synthesized
ttggtttgcctgggactaca

SEQ ID NO: 50022 - DNA, 20 bp, Artificial Sequence
  chemically synthesized
cattttccaggaaatctctg

SEQ ID NO: 50023 - DNA, 20 bp, Artificial Sequence
  chemically synthesized
ctgggactacagagatttcc

SEQ ID NO: 50024 - DNA, 20 bp, Artificial Sequence
  chemically synthesized
tacagagatttcctggaaaa

SEQ ID NO: 50025 - DNA, 20 bp, Artificial Sequence
  chemically synthesized
acagagatttcctggaaaat

SEQ ID NO: 50026 - DNA, 20 bp, Artificial Sequence
  chemically synthesized
cactggaattcccattttcc

SEQ ID NO: 50027 - DNA, 20 bp, Artificial Sequence
  chemically synthesized
gcactggaattcccattttc

SEQ ID NO: 50028 - DNA, 20 bp, Artificial Sequence
  chemically synthesized
ttcctggaaaatgggaattc

SEQ ID NO: 50029 - DNA, 20 bp, Artificial Sequence
  chemically synthesized
gactttcccggatttagcac

SEQ ID NO: 50030 - DNA, 20 bp, Artificial Sequence
  chemically synthesized
gggaattccagtgctaaatc

SEQ ID NO: 50031 - DNA, 20 bp, Artificial Sequence
  chemically synthesized
ggaattccagtgctaaatcc

SEQ ID NO: 50032 - DNA, 20 bp, Artificial Sequence
  chemically synthesized
gtctgggactttcccggatt

SEQ ID NO: 50033 - DNA, 20 bp, Artificial Sequence
  chemically synthesized
ttccagtgctaaatccggga

SEQ ID NO: 50034 - DNA, 20 bp, Artificial Sequence
  chemically synthesized
tggtttgtctgggactttcc

SEQ ID NO: 50035 - DNA, 20 bp, Artificial Sequence
  chemically synthesized
tgctaaatccgggaaagtcc

SEQ ID NO: 50036 - DNA, 20 bp, Artificial Sequence
  chemically synthesized
ccactcatcctggtttgtct

SEQ ID NO: 50037 - DNA, 20 bp, Artificial Sequence
  chemically synthesized
cgggaaagtcccagacaaac

SEQ ID NO: 50038 - DNA, 20 bp, Artificial Sequence
  chemically synthesized
accactcatcctggtttgtc

SEQ ID NO: 50039 - DNA, 20 bp, Artificial Sequence
  chemically synthesized
gggaaagtcccagacaaacc

SEQ ID NO: 50040 - DNA, 20 bp, Artificial Sequence
  chemically synthesized
agtcccagacaaaccaggat

SEQ ID NO: 50041 - DNA, 20 bp, Artificial Sequence
  chemically synthesized
cccagacaaaccaggatgag

SEQ ID NO: 50042 - DNA, 20 bp, Artificial Sequence
  chemically synthesized
tgcagagtgaccactcatcc

SEQ ID NO: 50043 - DNA, 20 bp, Artificial Sequence
  chemically synthesized
aaatatttatgtgcgttgca

SEQ ID NO: 50044 - DNA, 20 bp, Artificial Sequence
  chemically synthesized
ccaaatatttatgtgcgttg

SEQ ID NO: 50045 - DNA, 20 bp, Artificial Sequence
  chemically synthesized
ctgcaacgcacataaatatt

SEQ ID NO: 50046 - DNA, 20 bp, Artificial Sequence
  chemically synthesized
cacataaatatttggatcct

SEQ ID NO: 50047 - DNA, 20 bp, Artificial Sequence
  chemically synthesized
acttagcaggaaggatgctc

SEQ ID NO: 50048 - DNA, 20 bp, Artificial Sequence
  chemically synthesized
aacttagcaggaaggatgct

SEQ ID NO: 50049 - DNA, 20 bp, Artificial Sequence
  chemically synthesized
tcctgagcatccttcctgct

SEQ ID NO: 50050 - DNA, 20 bp, Artificial Sequence
  chemically synthesized
tcttcataaacttagcagga

SEQ ID NO: 50051 - DNA, 20 bp, Artificial Sequence
  chemically synthesized
atcttcataaacttagcagg

SEQ ID NO: 50052 - DNA, 20 bp, Artificial Sequence
  chemically synthesized
agaatcttcataaacttagc

SEQ ID NO: 50053 - DNA, 20 bp, Artificial Sequence
  chemically synthesized
aagaatcttcataaacttag

SEQ ID NO: 50054 - DNA, 20 bp, Artificial Sequence
  chemically synthesized
gcaaagaatcttcataaact

SEQ ID NO: 50055 - DNA, 20 bp, Artificial Sequence
  chemically synthesized
tccttcctgctaagtttatg

SEQ ID NO: 50056 - DNA, 20 bp, Artificial Sequence
  chemically synthesized
ttatgaagattctttgccta

SEQ ID NO: 50057 - DNA, 20 bp, Artificial Sequence
  chemically synthesized
tatgaagattctttgcctac

SEQ ID NO: 50058 - DNA, 20 bp, Artificial Sequence
  chemically synthesized
cactcaagtccctgtaggca

SEQ ID NO: 50059 - DNA, 20 bp, Artificial Sequence
  chemically synthesized
atgaagattctttgcctaca

SEQ ID NO: 50060 - DNA, 20 bp, Artificial Sequence
  chemically synthesized
tggatcactcaagtccctgt

SEQ ID NO: 50061 - DNA, 20 bp, Artificial Sequence
  chemically synthesized
ttggatcactcaagtccctg

SEQ ID NO: 50062 - DNA, 20 bp, Artificial Sequence
  chemically synthesized
ttctttgcctacagggactt

SEQ ID NO: 50063 - DNA, 20 bp, Artificial Sequence
  chemically synthesized
ctatgttatttggatcactc

SEQ ID NO: 50064 - DNA, 20 bp, Artificial Sequence
  chemically synthesized
cttgagtgatccaaataaca

SEQ ID NO: 50065 - DNA, 20 bp, Artificial Sequence
  chemically synthesized
actaatttatctatgttatt

SEQ ID NO: 50066 - DNA, 20 bp, Artificial Sequence
  chemically synthesized
tccaaataacatagataaat

SEQ ID NO: 50067 - DNA, 20 bp, Artificial Sequence
  chemically synthesized
atagataaattagtcatttc

SEQ ID NO: 50068 - DNA, 20 bp, Artificial Sequence
  chemically synthesized
tagataaattagtcatttct

SEQ ID NO: 50069 - DNA, 20 bp, Artificial Sequence
  chemically synthesized
tttgtgcatagatggtttcc

SEQ ID NO: 50070 - DNA, 20 bp, Artificial Sequence
  chemically synthesized
tttttttttttgtgcataga

SEQ ID NO: 50071 - DNA, 20 bp, Artificial Sequence
  chemically synthesized
tttttttttttttttgtgca

SEQ ID NO: 50072 - DNA, 20 bp, Artificial Sequence
  chemically synthesized
aaaaaaaaaaaaaaaaaaca

SEQ ID NO: 50073 - DNA, 20 bp, Artificial Sequence
  chemically synthesized
aaacaaagtgccccaatttg

SEQ ID NO: 50074 - DNA, 20 bp, Artificial Sequence
  chemically synthesized
ttggcaaatactacaaattg

SEQ ID NO: 50075 - DNA, 20 bp, Artificial Sequence
  chemically synthesized
attggcaaatactacaaatt

SEQ ID NO: 50076 - DNA, 20 bp, Artificial Sequence
  chemically synthesized
aattggcaaatactacaaat

SEQ ID NO: 50077 - DNA, 20 bp, Artificial Sequence
  chemically synthesized
gtagtatttgccaatttcca

SEQ ID NO: 50078 - DNA, 20 bp, Artificial Sequence
  chemically synthesized
aagatttactccatggaaat

SEQ ID NO: 50079 - DNA, 20 bp, Artificial Sequence
  chemically synthesized
agtatttgccaatttccatg

SEQ ID NO: 50080 - DNA, 20 bp, Artificial Sequence
  chemically synthesized
tagtgggaagatttactcca

SEQ ID NO: 50081 - DNA, 20 bp, Artificial Sequence
  chemically synthesized
ttgaaatcaggcatagtggg

SEQ ID NO: 50082 - DNA, 20 bp, Artificial Sequence
  chemically synthesized
agcttgaaatcaggcatagt

SEQ ID NO: 50083 - DNA, 20 bp, Artificial Sequence
  chemically synthesized
tagcttgaaatcaggcatag

SEQ ID NO: 50084 - DNA, 20 bp, Artificial Sequence
  chemically synthesized
tggtagcttgaaatcaggca

SEQ ID NO: 50085 - DNA, 20 bp, Artificial Sequence
  chemically synthesized
ttcccactatgcctgatttc

SEQ ID NO: 50086 - DNA, 20 bp, Artificial Sequence
  chemically synthesized
acctttggtagcttgaaatc

SEQ ID NO: 50087 - DNA, 20 bp, Artificial Sequence
  chemically synthesized
tacctttggtagcttgaaat

SEQ ID NO: 50088 - DNA, 20 bp, Artificial Sequence
  chemically synthesized
tgcctgatttcaagctacca

SEQ ID NO: 50089 - DNA, 20 bp, Artificial Sequence
  chemically synthesized
gcctgatttcaagctaccaa

SEQ ID NO: 50090 - DNA, 20 bp, Artificial Sequence
  chemically synthesized
tgatttcaagctaccaaagg

SEQ ID NO: 50091 - DNA, 20 bp, Artificial Sequence
  chemically synthesized
gttattaagcctacctttgg

SEQ ID NO: 50092 - DNA, 20 bp, Artificial Sequence
  chemically synthesized
gatttcaagctaccaaaggt

SEQ ID NO: 50093 - DNA, 20 bp, Artificial Sequence
  chemically synthesized
ctagttattaagcctacctt

SEQ ID NO: 50094 - DNA, 20 bp, Artificial Sequence
  chemically synthesized
ccaaaggtaggcttaataac

SEQ ID NO: 50095 - DNA, 20 bp, Artificial Sequence
  chemically synthesized
ggaattgtgagctagttatt

SEQ ID NO: 50096 - DNA, 20 bp, Artificial Sequence
  chemically synthesized
aatatacaggaattgtgagc

SEQ ID NO: 50097 - DNA, 20 bp, Artificial Sequence
  chemically synthesized
gtaaaatatacaggaattgt

SEQ ID NO: 50098 - DNA, 20 bp, Artificial Sequence
  chemically synthesized
gagccaattgtaaaatatac

SEQ ID NO: 50099 - DNA, 20 bp, Artificial Sequence
  chemically synthesized
agagccaattgtaaaatata

SEQ ID NO: 50100 - DNA, 20 bp, Artificial Sequence
  chemically synthesized
attcctgtatattttacaat

SEQ ID NO: 50101 - DNA, 20 bp, Artificial Sequence
  chemically synthesized
attttacaattggctctctt

SEQ ID NO: 50102 - DNA, 20 bp, Artificial Sequence
  chemically synthesized
tggcttacaatggctcaaga

SEQ ID NO: 50103 - DNA, 20 bp, Artificial Sequence
  chemically synthesized
gctggcttacaatggctcaa

SEQ ID NO: 50104 - DNA, 20 bp, Artificial Sequence
  chemically synthesized
gggctggcttacaatggctc

SEQ ID NO: 50105 - DNA, 20 bp, Artificial Sequence
  chemically synthesized
tggctctcttgagccattgt

SEQ ID NO: 50106 - DNA, 20 bp, Artificial Sequence
  chemically synthesized
gtgctggggctggcttacaa

SEQ ID NO: 50107 - DNA, 20 bp, Artificial Sequence
  chemically synthesized
tctcttgagccattgtaagc

SEQ ID NO: 50108 - DNA, 20 bp, Artificial Sequence
  chemically synthesized
gagccattgtaagccagccc

SEQ ID NO: 50109 - DNA, 20 bp, Artificial Sequence
  chemically synthesized
gggaatttctgtgctggggc

SEQ ID NO: 50110 - DNA, 20 bp, Artificial Sequence
  chemically synthesized
attgtaagccagccccagca

SEQ ID NO: 50111 - DNA, 20 bp, Artificial Sequence
  chemically synthesized
ctatgggaatttctgtgctg

SEQ ID NO: 50112 - DNA, 20 bp, Artificial Sequence
  chemically synthesized
gctatgggaatttctgtgct

SEQ ID NO: 50113 - DNA, 20 bp, Artificial Sequence
  chemically synthesized
tgctatgggaatttctgtgc

SEQ ID NO: 50114 - DNA, 20 bp, Artificial Sequence
  chemically synthesized
ccccagcacagaaattccca

SEQ ID NO: 50115 - DNA, 20 bp, Artificial Sequence
  chemically synthesized
cagcacagaaattcccatag

SEQ ID NO: 50116 - DNA, 20 bp, Artificial Sequence
  chemically synthesized
aacgtttttgtttctgctat

SEQ ID NO: 50117 - DNA, 20 bp, Artificial Sequence
  chemically synthesized
gaacgtttttgtttctgcta

SEQ ID NO: 50118 - DNA, 20 bp, Artificial Sequence
  chemically synthesized
aatttgaacacatgaggaaa

SEQ ID NO: 50119 - DNA, 20 bp, Artificial Sequence
  chemically synthesized
cccatcaatttgaacacatg

SEQ ID NO: 50120 - DNA, 20 bp, Artificial Sequence
  chemically synthesized
tcccatcaatttgaacacat

SEQ ID NO: 50121 - DNA, 20 bp, Artificial Sequence
  chemically synthesized
tcctcatgtgttcaaattga

SEQ ID NO: 50122 - DNA, 20 bp, Artificial Sequence
  chemically synthesized
cctcatgtgttcaaattgat

SEQ ID NO: 50123 - DNA, 20 bp, Artificial Sequence
  chemically synthesized
gttcaaattgatgggatata

SEQ ID NO: 50124 - DNA, 20 bp, Artificial Sequence
  chemically synthesized
ttcaaattgatgggatatat

SEQ ID NO: 50125 - DNA, 20 bp, Artificial Sequence
  chemically synthesized
tcaaattgatgggatatata

SEQ ID NO: 50126 - DNA, 20 bp, Artificial Sequence
  chemically synthesized
gcaaccagattttgcatcgt

SEQ ID NO: 50127 - DNA, 20 bp, Artificial Sequence
  chemically synthesized
agggccaacgatgcaaaatc

SEQ ID NO: 50128 - DNA, 20 bp, Artificial Sequence
  chemically synthesized
tttacagtatcattagcaac

SEQ ID NO: 50129 - DNA, 20 bp, Artificial Sequence
  chemically synthesized
tatttgctttacagtatcat

SEQ ID NO: 50130 - DNA, 20 bp, Artificial Sequence
  chemically synthesized
tggttgctaatgatactgta

SEQ ID NO: 50131 - DNA, 20 bp, Artificial Sequence
  chemically synthesized
tctcagatttatttgcttta

SEQ ID NO: 50132 - DNA, 20 bp, Artificial Sequence
  chemically synthesized
actgtaaagcaaataaatct

SEQ ID NO: 50133 - DNA, 20 bp, Artificial Sequence
  chemically synthesized
tgtaaagcaaataaatctga

SEQ ID NO: 50134 - DNA, 20 bp, Artificial Sequence
  chemically synthesized
tatactccccaataagctct

SEQ ID NO: 50135 - DNA, 20 bp, Artificial Sequence
  chemically synthesized
aaataaatctgagagcttat

SEQ ID NO: 50136 - DNA, 20 bp, Artificial Sequence
  chemically synthesized
aataaatctgagagcttatt

SEQ ID NO: 50137 - DNA, 20 bp, Artificial Sequence
  chemically synthesized
ataaatctgagagcttattg

SEQ ID NO: 50138 - DNA, 20 bp, Artificial Sequence
  chemically synthesized
aaatctgagagcttattggg

SEQ ID NO: 50139 - DNA, 20 bp, Artificial Sequence
  chemically synthesized
tcaaatgtatactccccaat

SEQ ID NO: 50140 - DNA, 20 bp, Artificial Sequence
  chemically synthesized
ttattggggagtatacattt

SEQ ID NO: 50141 - DNA, 20 bp, Artificial Sequence
  chemically synthesized
gggagtatacatttgagcta

SEQ ID NO: 50142 - DNA, 20 bp, Artificial Sequence
  chemically synthesized
ggagtatacatttgagctaa

SEQ ID NO: 50143 - DNA, 20 bp, Artificial Sequence
  chemically synthesized
agtatacatttgagctaaag

SEQ ID NO: 50144 - DNA, 20 bp, Artificial Sequence
  chemically synthesized
gtcatggcccttttctcctt

SEQ ID NO: 50145 - DNA, 20 bp, Artificial Sequence
  chemically synthesized
acatttgagctaaaggagaa

SEQ ID NO: 50146 - DNA, 20 bp, Artificial Sequence
  chemically synthesized
catttgagctaaaggagaaa

SEQ ID NO: 50147 - DNA, 20 bp, Artificial Sequence
  chemically synthesized
atttgagctaaaggagaaaa

SEQ ID NO: 50148 - DNA, 20 bp, Artificial Sequence
  chemically synthesized
cttcttaaaatgtgttgtca

SEQ ID NO: 50149 - DNA, 20 bp, Artificial Sequence
  chemically synthesized
gggccatgacaacacatttt

SEQ ID NO: 50150 - DNA, 20 bp, Artificial Sequence
  chemically synthesized
ccatgacaacacattttaag

SEQ ID NO: 50151 - DNA, 20 bp, Artificial Sequence
  chemically synthesized
atgacaacacattttaagaa

SEQ ID NO: 50152 - DNA, 20 bp, Artificial Sequence
  chemically synthesized
gaatataattattactgctg

SEQ ID NO: 50153 - DNA, 20 bp, Artificial Sequence
  chemically synthesized
cccataaaaagcagctacag

SEQ ID NO: 50154 - DNA, 20 bp, Artificial Sequence
  chemically synthesized
atgcccataaaaagcagcta

SEQ ID NO: 50155 - DNA, 20 bp, Artificial Sequence
  chemically synthesized
actgctgtagctgcttttta

SEQ ID NO: 50156 - DNA, 20 bp, Artificial Sequence
  chemically synthesized
tttccaatgcccataaaaag

SEQ ID NO: 50157 - DNA, 20 bp, Artificial Sequence
  chemically synthesized
ctgctgtagctgctttttat

SEQ ID NO: 50158 - DNA, 20 bp, Artificial Sequence
  chemically synthesized
gcctttccaatgcccataaa

SEQ ID NO: 50159 - DNA, 20 bp, Artificial Sequence
  chemically synthesized
tagctgctttttatgggcat

SEQ ID NO: 50160 - DNA, 20 bp, Artificial Sequence
  chemically synthesized
tgctttttatgggcattgga

SEQ ID NO: 50161 - DNA, 20 bp, Artificial Sequence
  chemically synthesized
gctttttatgggcattggaa

SEQ ID NO: 50162 - DNA, 20 bp, Artificial Sequence
  chemically synthesized
tgcccctataaattcaaaga

SEQ ID NO: 50163 - DNA, 20 bp, Artificial Sequence
  chemically synthesized
ataatgcccctataaattca

SEQ ID NO: 50164 - DNA, 20 bp, Artificial Sequence
  chemically synthesized
aaaggctgtctttgaattta

SEQ ID NO: 50165 - DNA, 20 bp, Artificial Sequence
  chemically synthesized
aaggctgtctttgaatttat

SEQ ID NO: 50166 - DNA, 20 bp, Artificial Sequence
  chemically synthesized
aggctgtctttgaatttata

SEQ ID NO: 50167 - DNA, 20 bp, Artificial Sequence
  chemically synthesized
ggctgtctttgaatttatag

SEQ ID NO: 50168 - DNA, 20 bp, Artificial Sequence
  chemically synthesized
tgaatttataggggcattat

SEQ ID NO: 50169 - DNA, 20 bp, Artificial Sequence
  chemically synthesized
aggggcattatcagcatcac

SEQ ID NO: 50170 - DNA, 20 bp, Artificial Sequence
  chemically synthesized
ggcattatcagcatcactgg

SEQ ID NO: 50171 - DNA, 20 bp, Artificial Sequence
  chemically synthesized
gcattatcagcatcactggt

SEQ ID NO: 50172 - DNA, 20 bp, Artificial Sequence
  chemically synthesized
acaaatgccatgtgacctac

SEQ ID NO: 50173 - DNA, 20 bp, Artificial Sequence
  chemically synthesized
agcatcactggtaggtcaca

SEQ ID NO: 50174 - DNA, 20 bp, Artificial Sequence
  chemically synthesized
gtcccaagtgttaggaattt

SEQ ID NO: 50175 - DNA, 20 bp, Artificial Sequence
  chemically synthesized
tgtcccaagtgttaggaatt

SEQ ID NO: 50176 - DNA, 20 bp, Artificial Sequence
  chemically synthesized
tgtcccaaattcctaacact

SEQ ID NO: 50177 - DNA, 20 bp, Artificial Sequence
  chemically synthesized
gtcccaaattcctaacactt

SEQ ID NO: 50178 - DNA, 20 bp, Artificial Sequence
  chemically synthesized
cacatgttgtcccaagtgtt

SEQ ID NO: 50179 - DNA, 20 bp, Artificial Sequence
  chemically synthesized
tcacatgttgtcccaagtgt

SEQ ID NO: 50180 - DNA, 20 bp, Artificial Sequence
  chemically synthesized
cagcagtcacatgttgtccc

SEQ ID NO: 50181 - DNA, 20 bp, Artificial Sequence
  chemically synthesized
gggacaacatgtgactgctg

SEQ ID NO: 50182 - DNA, 20 bp, Artificial Sequence
  chemically synthesized
atttgagccagtttcttcag

SEQ ID NO: 50183 - DNA, 20 bp, Artificial Sequence
  chemically synthesized
catgtgactgctgaagaaac

SEQ ID NO: 50184 - DNA, 20 bp, Artificial Sequence
  chemically synthesized
atgatttgagccagtttctt

SEQ ID NO: 50185 - DNA, 20 bp, Artificial Sequence
  chemically synthesized
cagggtgaaatgatttgagc

SEQ ID NO: 50186 - DNA, 20 bp, Artificial Sequence
  chemically synthesized
atctcagggtgaaatgattt

SEQ ID NO: 50187 - DNA, 20 bp, Artificial Sequence
  chemically synthesized
ggctcaaatcatttcaccct

SEQ ID NO: 50188 - DNA, 20 bp, Artificial Sequence
  chemically synthesized
ctctttcaagtaaaatctca

SEQ ID NO: 50189 - DNA, 20 bp, Artificial Sequence
  chemically synthesized
tctctttcaagtaaaatctc

SEQ ID NO: 50190 - DNA, 20 bp, Artificial Sequence
  chemically synthesized
ttctctttcaagtaaaatct

SEQ ID NO: 50191 - DNA, 20 bp, Artificial Sequence
  chemically synthesized
caccctgagattttacttga

SEQ ID NO: 50192 - DNA, 20 bp, Artificial Sequence
  chemically synthesized
ccctgagattttacttgaaa

SEQ ID NO: 50193 - DNA, 20 bp, Artificial Sequence
  chemically synthesized
gcaggctaaaattctctttc

SEQ ID NO: 50194 - DNA, 20 bp, Artificial Sequence
  chemically synthesized
ttttacttgaaagagaattt

SEQ ID NO: 50195 - DNA, 20 bp, Artificial Sequence
  chemically synthesized
tccaatgtgagatgatttgc

SEQ ID NO: 50196 - DNA, 20 bp, Artificial Sequence
  chemically synthesized
gtccaatgtgagatgatttg

SEQ ID NO: 50197 - DNA, 20 bp, Artificial Sequence
  chemically synthesized
gcctgcaaatcatctcacat

SEQ ID NO: 50198 - DNA, 20 bp, Artificial Sequence
  chemically synthesized
gaattttgcaggtccaatgt

SEQ ID NO: 50199 - DNA, 20 bp, Artificial Sequence
  chemically synthesized
aaagtcagaaagaattttgc

SEQ ID NO: 50200 - DNA, 20 bp, Artificial Sequence
  chemically synthesized
aaaagtcagaaagaattttg

SEQ ID NO: 50201 - DNA, 20 bp, Artificial Sequence
  chemically synthesized
ccatcatgataaaagtcaga

SEQ ID NO: 50202 - DNA, 20 bp, Artificial Sequence
  chemically synthesized
taagccatcatgataaaagt

SEQ ID NO: 50203 - DNA, 20 bp, Artificial Sequence
  chemically synthesized
aaaataagccatcatgataa

SEQ ID NO: 50204 - DNA, 20 bp, Artificial Sequence
  chemically synthesized
ctttctgacttttatcatga

SEQ ID NO: 50205 - DNA, 20 bp, Artificial Sequence
  chemically synthesized
aaaaataaaaacatcaaaat

SEQ ID NO: 50206 - DNA, 20 bp, Artificial Sequence
  chemically synthesized
tttgatgtttttattttttt

SEQ ID NO: 50207 - DNA, 20 bp, Artificial Sequence
  chemically synthesized
gtttttatttttttgagatg

SEQ ID NO: 50208 - DNA, 20 bp, Artificial Sequence
  chemically synthesized
cactccagcctgggcaacaa

SEQ ID NO: 50209 - DNA, 20 bp, Artificial Sequence
  chemically synthesized
gcagtttcactcttgttgcc

SEQ ID NO: 50210 - DNA, 20 bp, Artificial Sequence
  chemically synthesized
cagtttcactcttgttgccc

SEQ ID NO: 50211 - DNA, 20 bp, Artificial Sequence
  chemically synthesized
tgcactccagcctgggcaac

SEQ ID NO: 50212 - DNA, 20 bp, Artificial Sequence
  chemically synthesized
ttcactcttgttgcccaggc

SEQ ID NO: 50213 - DNA, 20 bp, Artificial Sequence
  chemically synthesized
cactcttgttgcccaggctg

SEQ ID NO: 50214 - DNA, 20 bp, Artificial Sequence
  chemically synthesized
gcgccattgcactccagcct

SEQ ID NO: 50215 - DNA, 20 bp, Artificial Sequence
  chemically synthesized
tgcgccattgcactccagcc

SEQ ID NO: 50216 - DNA, 20 bp, Artificial Sequence
  chemically synthesized
gagattgcgccattgcactc

SEQ ID NO: 50217 - DNA, 20 bp, Artificial Sequence
  chemically synthesized
ttgcccaggctggagtgcaa

SEQ ID NO: 50218 - DNA, 20 bp, Artificial Sequence
  chemically synthesized
ggagtgcaatggcgcaatct

SEQ ID NO: 50219 - DNA, 20 bp, Artificial Sequence
  chemically synthesized
ggcagaggttgcagtgagcc

SEQ ID NO: 50220 - DNA, 20 bp, Artificial Sequence
  chemically synthesized
caggaggcagaggttgcagt

SEQ ID NO: 50221 - DNA, 20 bp, Artificial Sequence
  chemically synthesized
aacccaggaggcagaggttg

SEQ ID NO: 50222 - DNA, 20 bp, Artificial Sequence
  chemically synthesized
cacttgaacccaggaggcag

SEQ ID NO: 50223 - DNA, 20 bp, Artificial Sequence
  chemically synthesized
tcactgcaacctctgcctcc

SEQ ID NO: 50224 - DNA, 20 bp, Artificial Sequence
  chemically synthesized
tcacttgaacccaggaggca

SEQ ID NO: 50225 - DNA, 20 bp, Artificial Sequence
  chemically synthesized
cactgcaacctctgcctcct

SEQ ID NO: 50226 - DNA, 20 bp, Artificial Sequence
  chemically synthesized
aatcacttgaacccaggagg

SEQ ID NO: 50227 - DNA, 20 bp, Artificial Sequence
  chemically synthesized
gagaatcacttgaacccagg

SEQ ID NO: 50228 - DNA, 20 bp, Artificial Sequence
  chemically synthesized
ggagaatcacttgaacccag

SEQ ID NO: 50229 - DNA, 20 bp, Artificial Sequence
  chemically synthesized
aacctctgcctcctgggttc

SEQ ID NO: 50230 - DNA, 20 bp, Artificial Sequence
  chemically synthesized
caggagaatcacttgaaccc

SEQ ID NO: 50231 - DNA, 20 bp, Artificial Sequence
  chemically synthesized
gcaggagaatcacttgaacc

SEQ ID NO: 50232 - DNA, 20 bp, Artificial Sequence
  chemically synthesized
ttcaagtgattctcctgcct

SEQ ID NO: 50233 - DNA, 20 bp, Artificial Sequence
  chemically synthesized
tactcgagaggctgaggcag

SEQ ID NO: 50234 - DNA, 20 bp, Artificial Sequence
  chemically synthesized
gctactcgagaggctgaggc

SEQ ID NO: 50235 - DNA, 20 bp, Artificial Sequence
  chemically synthesized
agctactcgagaggctgagg

SEQ ID NO: 50236 - DNA, 20 bp, Artificial Sequence
  chemically synthesized
cccagctactcgagaggctg

SEQ ID NO: 50237 - DNA, 20 bp, Artificial Sequence
  chemically synthesized
tcccagctactcgagaggct

SEQ ID NO: 50238 - DNA, 20 bp, Artificial Sequence
  chemically synthesized
ttctcctgcctcagcctctc

SEQ ID NO: 50239 - DNA, 20 bp, Artificial Sequence
  chemically synthesized
tcctgcctcagcctctcgag

SEQ ID NO: 50240 - DNA, 20 bp, Artificial Sequence
  chemically synthesized
tgtaatcccagctactcgag

SEQ ID NO: 50241 - DNA, 20 bp, Artificial Sequence
  chemically synthesized
ctgtaatcccagctactcga

SEQ ID NO: 50242 - DNA, 20 bp, Artificial Sequence
  chemically synthesized
gcctcagcctctcgagtagc

SEQ ID NO: 50243 - DNA, 20 bp, Artificial Sequence
  chemically synthesized
atctgtaatcccagctactc

SEQ ID NO: 50244 - DNA, 20 bp, Artificial Sequence
  chemically synthesized
cctcagcctctcgagtagct

SEQ ID NO: 50245 - DNA, 20 bp, Artificial Sequence
  chemically synthesized
ctctcgagtagctgggatta

SEQ ID NO: 50246 - DNA, 20 bp, Artificial Sequence
  chemically synthesized
gtggcatgcatctgtaatcc

SEQ ID NO: 50247 - DNA, 20 bp, Artificial Sequence
  chemically synthesized
cagatgcatgccaccacgcc

SEQ ID NO: 50248 - DNA, 20 bp, Artificial Sequence
  chemically synthesized
acaaaattagctgggcgtgg

SEQ ID NO: 50249 - DNA, 20 bp, Artificial Sequence
  chemically synthesized
aatacaaaattagctgggcg

SEQ ID NO: 50250 - DNA, 20 bp, Artificial Sequence
  chemically synthesized
ctaaaaatacaaaattagct

SEQ ID NO: 50251 - DNA, 20 bp, Artificial Sequence
  chemically synthesized
actaaaaatacaaaattagc

SEQ ID NO: 50252 - DNA, 20 bp, Artificial Sequence
  chemically synthesized
ctctactaaaaatacaaaat

SEQ ID NO: 50253 - DNA, 20 bp, Artificial Sequence
  chemically synthesized
cccagctaattttgtatttt

SEQ ID NO: 50254 - DNA, 20 bp, Artificial Sequence
  chemically synthesized
agctaattttgtatttttag

SEQ ID NO: 50255 - DNA, 20 bp, Artificial Sequence
  chemically synthesized
ctaattttgtatttttagta

SEQ ID NO: 50256 - DNA, 20 bp, Artificial Sequence
  chemically synthesized
ttttgtatttttagtagaga

SEQ ID NO: 50257 - DNA, 20 bp, Artificial Sequence
  chemically synthesized
tttgtatttttagtagagac

SEQ ID NO: 50258 - DNA, 20 bp, Artificial Sequence
  chemically synthesized
ttgtatttttagtagagaca

SEQ ID NO: 50259 - DNA, 20 bp, Artificial Sequence
  chemically synthesized
gagacagggtttctccatgt

SEQ ID NO: 50260 - DNA, 20 bp, Artificial Sequence
  chemically synthesized
agaccagcctgaccaacatg

SEQ ID NO: 50261 - DNA, 20 bp, Artificial Sequence
  chemically synthesized
cagggtttctccatgttggt

SEQ ID NO: 50262 - DNA, 20 bp, Artificial Sequence
  chemically synthesized
caagaccagcctgaccaaca

SEQ ID NO: 50263 - DNA, 20 bp, Artificial Sequence
  chemically synthesized
agggtttctccatgttggtc

SEQ ID NO: 50264 - DNA, 20 bp, Artificial Sequence
  chemically synthesized
tttctccatgttggtcaggc

SEQ ID NO: 50265 - DNA, 20 bp, Artificial Sequence
  chemically synthesized
tgaggtcaggagttcaagac

SEQ ID NO: 50266 - DNA, 20 bp, Artificial Sequence
  chemically synthesized
tcacctgaggtcaggagttc

SEQ ID NO: 50267 - DNA, 20 bp, Artificial Sequence
  chemically synthesized
tggtcttgaactcctgacct

SEQ ID NO: 50268 - DNA, 20 bp, Artificial Sequence
  chemically synthesized
ggcagatcacctgaggtcag

SEQ ID NO: 50269 - DNA, 20 bp, Artificial Sequence
  chemically synthesized
ggtcttgaactcctgacctc

SEQ ID NO: 50270 - DNA, 20 bp, Artificial Sequence
  chemically synthesized
cgggcagatcacctgaggtc

SEQ ID NO: 50271 - DNA, 20 bp, Artificial Sequence
  chemically synthesized
gcgggcagatcacctgaggt

SEQ ID NO: 50272 - DNA, 20 bp, Artificial Sequence
  chemically synthesized
cgaggcgggcagatcacctg

SEQ ID NO: 50273 - DNA, 20 bp, Artificial Sequence
  chemically synthesized
ccgaggcgggcagatcacct

SEQ ID NO: 50274 - DNA, 20 bp, Artificial Sequence
  chemically synthesized
ctcaggtgatctgcccgcct

SEQ ID NO: 50275 - DNA, 20 bp, Artificial Sequence
  chemically synthesized
ctttgggaggccgaggcggg

SEQ ID NO: 50276 - DNA, 20 bp, Artificial Sequence
  chemically synthesized
gcactttgggaggccgaggc

SEQ ID NO: 50277 - DNA, 20 bp, Artificial Sequence
  chemically synthesized
agcactttgggaggccgagg

SEQ ID NO: 50278 - DNA, 20 bp, Artificial Sequence
  chemically synthesized
cccagcactttgggaggccg

SEQ ID NO: 50279 - DNA, 20 bp, Artificial Sequence
  chemically synthesized
tcccagcactttgggaggcc

SEQ ID NO: 50280 - DNA, 20 bp, Artificial Sequence
  chemically synthesized
ctgcccgcctcggcctccca

SEQ ID NO: 50281 - DNA, 20 bp, Artificial Sequence
  chemically synthesized
agtaatcccagcactttggg

SEQ ID NO: 50282 - DNA, 20 bp, Artificial Sequence
  chemically synthesized
cagtaatcccagcactttgg

SEQ ID NO: 50283 - DNA, 20 bp, Artificial Sequence
  chemically synthesized
gcctcggcctcccaaagtgc

SEQ ID NO: 50284 - DNA, 20 bp, Artificial Sequence
  chemically synthesized
gccagtaatcccagcacttt

SEQ ID NO: 50285 - DNA, 20 bp, Artificial Sequence
  chemically synthesized
cctcggcctcccaaagtgct

SEQ ID NO: 50286 - DNA, 20 bp, Artificial Sequence
  chemically synthesized
cgccagtaatcccagcactt

SEQ ID NO: 50287 - DNA, 20 bp, Artificial Sequence
  chemically synthesized
tcccaaagtgctgggattac

SEQ ID NO: 50288 - DNA, 20 bp, Artificial Sequence
  chemically synthesized
gtggctcacgccagtaatcc

SEQ ID NO: 50289 - DNA, 20 bp, Artificial Sequence
  chemically synthesized
agtgctgggattactggcgt

SEQ ID NO: 50290 - DNA, 20 bp, Artificial Sequence
  chemically synthesized
ccgggtgcggtggctcacgc

SEQ ID NO: 50291 - DNA, 20 bp, Artificial Sequence
  chemically synthesized
ctggcgtgagccaccgcacc

SEQ ID NO: 50292 - DNA, 20 bp, Artificial Sequence
  chemically synthesized
catcatgaggccgggtgcgg

SEQ ID NO: 50293 - DNA, 20 bp, Artificial Sequence
  chemically synthesized
agccatcatgaggccgggtg

SEQ ID NO: 50294 - DNA, 20 bp, Artificial Sequence
  chemically synthesized
aaataagccatcatgaggcc

SEQ ID NO: 50295 - DNA, 20 bp, Artificial Sequence
  chemically synthesized
taaataagccatcatgaggc

SEQ ID NO: 50296 - DNA, 20 bp, Artificial Sequence
  chemically synthesized
caccgcacccggcctcatga

SEQ ID NO: 50297 - DNA, 20 bp, Artificial Sequence
  chemically synthesized
ggcttaaataagccatcatg

SEQ ID NO: 50298 - DNA, 20 bp, Artificial Sequence
  chemically synthesized
tggcttaaataagccatcat

SEQ ID NO: 50299 - DNA, 20 bp, Artificial Sequence
  chemically synthesized
ggcctcatgatggcttattt

SEQ ID NO: 50300 - DNA, 20 bp, Artificial Sequence
  chemically synthesized
agcttcagattggcttaaat

SEQ ID NO: 50301 - DNA, 20 bp, Artificial Sequence
  chemically synthesized
ggcttatttaagccaatctg

SEQ ID NO: 50302 - DNA, 20 bp, Artificial Sequence
  chemically synthesized
aataatttaaagcttcagat

SEQ ID NO: 50303 - DNA, 20 bp, Artificial Sequence
  chemically synthesized
ggggcaataatttaaagctt

SEQ ID NO: 50304 - DNA, 20 bp, Artificial Sequence
  chemically synthesized
atgagtggggcaataattta

SEQ ID NO: 50305 - DNA, 20 bp, Artificial Sequence
  chemically synthesized
gacaatttgaaatatgagtg

SEQ ID NO: 50306 - DNA, 20 bp, Artificial Sequence
  chemically synthesized
agacaatttgaaatatgagt

SEQ ID NO: 50307 - DNA, 20 bp, Artificial Sequence
  chemically synthesized
cagacaatttgaaatatgag

SEQ ID NO: 50308 - DNA, 20 bp, Artificial Sequence
  chemically synthesized
ggacagacaatttgaaatat

SEQ ID NO: 50309 - DNA, 20 bp, Artificial Sequence
  chemically synthesized
tttcaaattgtctgtcccct

SEQ ID NO: 50310 - DNA, 20 bp, Artificial Sequence
  chemically synthesized
ttcaaattgtctgtcccctg

SEQ ID NO: 50311 - DNA, 20 bp, Artificial Sequence
  chemically synthesized
ctaccagtgtcctcagggga

SEQ ID NO: 50312 - DNA, 20 bp, Artificial Sequence
  chemically synthesized
tatgctaccagtgtcctcag

SEQ ID NO: 50313 - DNA, 20 bp, Artificial Sequence
  chemically synthesized
ctatgctaccagtgtcctca

SEQ ID NO: 50314 - DNA, 20 bp, Artificial Sequence
  chemically synthesized
cctatgctaccagtgtcctc

SEQ ID NO: 50315 - DNA, 20 bp, Artificial Sequence
  chemically synthesized
tgtctgtcccctgaggacac

SEQ ID NO: 50316 - DNA, 20 bp, Artificial Sequence
  chemically synthesized
acctatgctaccagtgtcct

SEQ ID NO: 50317 - DNA, 20 bp, Artificial Sequence
  chemically synthesized
ctgtcccctgaggacactgg

SEQ ID NO: 50318 - DNA, 20 bp, Artificial Sequence
  chemically synthesized
ccctgaggacactggtagca

SEQ ID NO: 50319 - DNA, 20 bp, Artificial Sequence
  chemically synthesized
cctgaggacactggtagcat

SEQ ID NO: 50320 - DNA, 20 bp, Artificial Sequence
  chemically synthesized
agtgctccaacctatgctac

SEQ ID NO: 50321 - DNA, 20 bp, Artificial Sequence
  chemically synthesized
aggacactggtagcataggt

SEQ ID NO: 50322 - DNA, 20 bp, Artificial Sequence
  chemically synthesized
gacactggtagcataggttg

SEQ ID NO: 50323 - DNA, 20 bp, Artificial Sequence
  chemically synthesized
gcataggttggagcactgtt

SEQ ID NO: 50324 - DNA, 20 bp, Artificial Sequence
  chemically synthesized
attgctgacatttcacttaa

SEQ ID NO: 50325 - DNA, 20 bp, Artificial Sequence
  chemically synthesized
agcactgttaagtgaaatgt

SEQ ID NO: 50326 - DNA, 20 bp, Artificial Sequence
  chemically synthesized
agtgaaatgtcagcaattat

SEQ ID NO: 50327 - DNA, 20 bp, Artificial Sequence
  chemically synthesized
gcaattattagatgtgctta

SEQ ID NO: 50328 - DNA, 20 bp, Artificial Sequence
  chemically synthesized
caattattagatgtgcttaa

SEQ ID NO: 50329 - DNA, 20 bp, Artificial Sequence
  chemically synthesized
aaaaaataggggaaaccttt

SEQ ID NO: 50330 - DNA, 20 bp, Artificial Sequence
  chemically synthesized
cacttaattttaaaaaatag

SEQ ID NO: 50331 - DNA, 20 bp, Artificial Sequence
  chemically synthesized
acacttaattttaaaaaata

SEQ ID NO: 50332 - DNA, 20 bp, Artificial Sequence
  chemically synthesized
cacacttaattttaaaaaat

SEQ ID NO: 50333 - DNA, 20 bp, Artificial Sequence
  chemically synthesized
acacacttaattttaaaaaa

SEQ ID NO: 50334 - DNA, 20 bp, Artificial Sequence
  chemically synthesized
ttcccctattttttaaaatt

SEQ ID NO: 50335 - DNA, 20 bp, Artificial Sequence
  chemically synthesized
taaaattaagtgtgtatgtg

SEQ ID NO: 50336 - DNA, 20 bp, Artificial Sequence
  chemically synthesized
aattaagtgtgtatgtgtag

SEQ ID NO: 50337 - DNA, 20 bp, Artificial Sequence
  chemically synthesized
attaagtgtgtatgtgtagt

SEQ ID NO: 50338 - DNA, 20 bp, Artificial Sequence
  chemically synthesized
ttaagtgtgtatgtgtagtg

SEQ ID NO: 50339 - DNA, 20 bp, Artificial Sequence
  chemically synthesized
tatgtgtagtggggaatgtc

SEQ ID NO: 50340 - DNA, 20 bp, Artificial Sequence
  chemically synthesized
atgtgtagtggggaatgtcc

SEQ ID NO: 50341 - DNA, 20 bp, Artificial Sequence
  chemically synthesized
gtggggaatgtccaggatga

SEQ ID NO: 50342 - DNA, 20 bp, Artificial Sequence
  chemically synthesized
gagttgccaagctttcatcc

SEQ ID NO: 50343 - DNA, 20 bp, Artificial Sequence
  chemically synthesized
gaatgtccaggatgaaagct

SEQ ID NO: 50344 - DNA, 20 bp, Artificial Sequence
  chemically synthesized
tttctatcttgagagttgcc

SEQ ID NO: 50345 - DNA, 20 bp, Artificial Sequence
  chemically synthesized
atgaaagcttggcaactctc

SEQ ID NO: 50346 - DNA, 20 bp, Artificial Sequence
  chemically synthesized
aagcttggcaactctcaaga

SEQ ID NO: 50347 - DNA, 20 bp, Artificial Sequence
  chemically synthesized
gcagtttgtttctatcttga

SEQ ID NO: 50348 - DNA, 20 bp, Artificial Sequence
  chemically synthesized
tagcagtttgtttctatctt

SEQ ID NO: 50349 - DNA, 20 bp, Artificial Sequence
  chemically synthesized
tcaagatagaaacaaactgc

SEQ ID NO: 50350 - DNA, 20 bp, Artificial Sequence
  chemically synthesized
caagatagaaacaaactgct

SEQ ID NO: 50351 - DNA, 20 bp, Artificial Sequence
  chemically synthesized
ccttgatacatagggcctag

SEQ ID NO: 50352 - DNA, 20 bp, Artificial Sequence
  chemically synthesized
tctccttgatacatagggcc

SEQ ID NO: 50353 - DNA, 20 bp, Artificial Sequence
  chemically synthesized
cagtttctccttgatacata

SEQ ID NO: 50354 - DNA, 20 bp, Artificial Sequence
  chemically synthesized
actgctaggccctatgtatc

SEQ ID NO: 50355 - DNA, 20 bp, Artificial Sequence
  chemically synthesized
acagtttctccttgatacat

SEQ ID NO: 50356 - DNA, 20 bp, Artificial Sequence
  chemically synthesized
ctgctaggccctatgtatca

SEQ ID NO: 50357 - DNA, 20 bp, Artificial Sequence
  chemically synthesized
tacagtttctccttgataca

SEQ ID NO: 50358 - DNA, 20 bp, Artificial Sequence
  chemically synthesized
gctaggccctatgtatcaag

SEQ ID NO: 50359 - DNA, 20 bp, Artificial Sequence
  chemically synthesized
gtatcaaggagaaactgtaa

SEQ ID NO: 50360 - DNA, 20 bp, Artificial Sequence
  chemically synthesized
caaagtgactcaagctttta

SEQ ID NO: 50361 - DNA, 20 bp, Artificial Sequence
  chemically synthesized
aggagaaactgtaaaagctt

SEQ ID NO: 50362 - DNA, 20 bp, Artificial Sequence
  chemically synthesized
ctctcttgtcaaagtgactc

SEQ ID NO: 50363 - DNA, 20 bp, Artificial Sequence
  chemically synthesized
aaagcttgagtcactttgac

SEQ ID NO: 50364 - DNA, 20 bp, Artificial Sequence
  chemically synthesized
agcttgagtcactttgacaa

SEQ ID NO: 50365 - DNA, 20 bp, Artificial Sequence
  chemically synthesized
agtctttttctctcttgtca

SEQ ID NO: 50366 - DNA, 20 bp, Artificial Sequence
  chemically synthesized
cttgagtcactttgacaaga

SEQ ID NO: 50367 - DNA, 20 bp, Artificial Sequence
  chemically synthesized
tcactttgacaagagagaaa

SEQ ID NO: 50368 - DNA, 20 bp, Artificial Sequence
  chemically synthesized
aagagagaaaaagacttaac

SEQ ID NO: 50369 - DNA, 20 bp, Artificial Sequence
  chemically synthesized
agagagaaaaagacttaacc

SEQ ID NO: 50370 - DNA, 20 bp, Artificial Sequence
  chemically synthesized
gagagaaaaagacttaacca

SEQ ID NO: 50371 - DNA, 20 bp, Artificial Sequence
  chemically synthesized
ccttaatcatatccctggtt

SEQ ID NO: 50372 - DNA, 20 bp, Artificial Sequence
  chemically synthesized
aactgccttaatcatatccc

SEQ ID NO: 50373 - DNA, 20 bp, Artificial Sequence
  chemically synthesized
acttaaccagggatatgatt

SEQ ID NO: 50374 - DNA, 20 bp, Artificial Sequence
  chemically synthesized
cttaaccagggatatgatta

SEQ ID NO: 50375 - DNA, 20 bp, Artificial Sequence
  chemically synthesized
aaccagggatatgattaagg

SEQ ID NO: 50376 - DNA, 20 bp, Artificial Sequence
  chemically synthesized
gggatatgattaaggcagtt

SEQ ID NO: 50377 - DNA, 20 bp, Artificial Sequence
  chemically synthesized
ttaaggcagttaagattgta

SEQ ID NO: 50378 - DNA, 20 bp, Artificial Sequence
  chemically synthesized
gttaagattgtaaagcctgc

SEQ ID NO: 50379 - DNA, 20 bp, Artificial Sequence
  chemically synthesized
actgatccattatttcttgc

SEQ ID NO: 50380 - DNA, 20 bp, Artificial Sequence
  chemically synthesized
aactgatccattatttcttg

SEQ ID NO: 50381 - DNA, 20 bp, Artificial Sequence
  chemically synthesized
gtaaagcctgcaagaaataa

SEQ ID NO: 50382 - DNA, 20 bp, Artificial Sequence
  chemically synthesized
gcctgcaagaaataatggat

SEQ ID NO: 50383 - DNA, 20 bp, Artificial Sequence
  chemically synthesized
ggatcagttatttcttttta

SEQ ID NO: 50384 - DNA, 20 bp, Artificial Sequence
  chemically synthesized
agattatgagacactgtaaa

SEQ ID NO: 50385 - DNA, 20 bp, Artificial Sequence
  chemically synthesized
tttacagtgtctcataatct

SEQ ID NO: 50386 - DNA, 20 bp, Artificial Sequence
  chemically synthesized
gagtgaccttctcagattat

SEQ ID NO: 50387 - DNA, 20 bp, Artificial Sequence
  chemically synthesized
acagtgtctcataatctgag

SEQ ID NO: 50388 - DNA, 20 bp, Artificial Sequence
  chemically synthesized
cagtgtctcataatctgaga

SEQ ID NO: 50389 - DNA, 20 bp, Artificial Sequence
  chemically synthesized
gtttcattgagtgaccttct

SEQ ID NO: 50390 - DNA, 20 bp, Artificial Sequence
  chemically synthesized
gagaaggtcactcaatgaaa

SEQ ID NO: 50391 - DNA, 20 bp, Artificial Sequence
  chemically synthesized
aatttaaaagctgtttcatt

SEQ ID NO: 50392 - DNA, 20 bp, Artificial Sequence
  chemically synthesized
aatgaaacagcttttaaatt

SEQ ID NO: 50393 - DNA, 20 bp, Artificial Sequence
  chemically synthesized
actatttattctgaatttaa

SEQ ID NO: 50394 - DNA, 20 bp, Artificial Sequence
  chemically synthesized
gcttttaaattcagaataaa

SEQ ID NO: 50395 - DNA, 20 bp, Artificial Sequence
  chemically synthesized
aattcagaataaatagtaaa

SEQ ID NO: 50396 - DNA, 20 bp, Artificial Sequence
  chemically synthesized
attcagaataaatagtaaaa

SEQ ID NO: 50397 - DNA, 20 bp, Artificial Sequence
  chemically synthesized
taaaaaggaaatttgtcttt

SEQ ID NO: 50398 - DNA, 20 bp, Artificial Sequence
  chemically synthesized
aaaaggaaatttgtctttca

SEQ ID NO: 50399 - DNA, 20 bp, Artificial Sequence
  chemically synthesized
cagtggcaatgggactctga

SEQ ID NO: 50400 - DNA, 20 bp, Artificial Sequence
  chemically synthesized
tgacctcttgcagtggcaat

SEQ ID NO: 50401 - DNA, 20 bp, Artificial Sequence
  chemically synthesized
gtgacctcttgcagtggcaa

SEQ ID NO: 50402 - DNA, 20 bp, Artificial Sequence
  chemically synthesized
cagagtcccattgccactgc

SEQ ID NO: 50403 - DNA, 20 bp, Artificial Sequence
  chemically synthesized
gagtcccattgccactgcaa

SEQ ID NO: 50404 - DNA, 20 bp, Artificial Sequence
  chemically synthesized
agtcccattgccactgcaag

SEQ ID NO: 50405 - DNA, 20 bp, Artificial Sequence
  chemically synthesized
taaccagtgacctcttgcag

SEQ ID NO: 50406 - DNA, 20 bp, Artificial Sequence
  chemically synthesized
ttttaaccagtgacctcttg

SEQ ID NO: 50407 - DNA, 20 bp, Artificial Sequence
  chemically synthesized
ttgccactgcaagaggtcac

SEQ ID NO: 50408 - DNA, 20 bp, Artificial Sequence
  chemically synthesized
tgcaagaggtcactggttaa

SEQ ID NO: 50409 - DNA, 20 bp, Artificial Sequence
  chemically synthesized
tttatactccagcttttaac

SEQ ID NO: 50410 - DNA, 20 bp, Artificial Sequence
  chemically synthesized
agaggtcactggttaaaagc

SEQ ID NO: 50411 - DNA, 20 bp, Artificial Sequence
  chemically synthesized
aggtcactggttaaaagctg

SEQ ID NO: 50412 - DNA, 20 bp, Artificial Sequence
  chemically synthesized
aaaggtaacattttatactc

SEQ ID NO: 50413 - DNA, 20 bp, Artificial Sequence
  chemically synthesized
taatggaaaaaaaacaataa

SEQ ID NO: 50414 - DNA, 20 bp, Artificial Sequence
  chemically synthesized
gtaatggaaaaaaaacaata

SEQ ID NO: 50415 - DNA, 20 bp, Artificial Sequence
  chemically synthesized
attgttttttttccattaca

SEQ ID NO: 50416 - DNA, 20 bp, Artificial Sequence
  chemically synthesized
ttgttttttttccattacaa

SEQ ID NO: 50417 - DNA, 20 bp, Artificial Sequence
  chemically synthesized
agcatgtactacctttgtaa

SEQ ID NO: 50418 - DNA, 20 bp, Artificial Sequence
  chemically synthesized
ttttttttccattacaaagg

SEQ ID NO: 50419 - DNA, 20 bp, Artificial Sequence
  chemically synthesized
aaggtagtacatgctattac

SEQ ID NO: 50420 - DNA, 20 bp, Artificial Sequence
  chemically synthesized
ttttacaaattttctggtaa

SEQ ID NO: 50421 - DNA, 20 bp, Artificial Sequence
  chemically synthesized
ttttacttttacaaattttc

SEQ ID NO: 50422 - DNA, 20 bp, Artificial Sequence
  chemically synthesized
tattaccagaaaatttgtaa

SEQ ID NO: 50423 - DNA, 20 bp, Artificial Sequence
  chemically synthesized
agaaaatttgtaaaagtaaa

SEQ ID NO: 50424 - DNA, 20 bp, Artificial Sequence
  chemically synthesized
aatttgtaaaagtaaaaaga

SEQ ID NO: 50425 - DNA, 20 bp, Artificial Sequence
  chemically synthesized
aaaagataccaaaagacaaa

SEQ ID NO: 50426 - DNA, 20 bp, Artificial Sequence
  chemically synthesized
tgcaataactgtttgtcttt

SEQ ID NO: 50427 - DNA, 20 bp, Artificial Sequence
  chemically synthesized
ggaaaataaaaagataccaa

SEQ ID NO: 50428 - DNA, 20 bp, Artificial Sequence
  chemically synthesized
aaggaaaaatggaaaataaa

SEQ ID NO: 50429 - DNA, 20 bp, Artificial Sequence
  chemically synthesized
atgtacacataaaggaaaaa

SEQ ID NO: 50430 - DNA, 20 bp, Artificial Sequence
  chemically synthesized
taacagaaatgtacacataa

SEQ ID NO: 50431 - DNA, 20 bp, Artificial Sequence
  chemically synthesized
ataacagaaatgtacacata

SEQ ID NO: 50432 - DNA, 20 bp, Artificial Sequence
  chemically synthesized
acaaaataaaataaaaataa

SEQ ID NO: 50433 - DNA, 20 bp, Artificial Sequence
  chemically synthesized
ttttattttattttgtaata

SEQ ID NO: 50434 - DNA, 20 bp, Artificial Sequence
  chemically synthesized
aaaggctgacttcaaaatta

SEQ ID NO: 50435 - DNA, 20 bp, Artificial Sequence
  chemically synthesized
gtgatcatgctgtaattttg

SEQ ID NO: 50436 - DNA, 20 bp, Artificial Sequence
  chemically synthesized
tcatgctgtaattttgaagt

SEQ ID NO: 50437 - DNA, 20 bp, Artificial Sequence
  chemically synthesized
atgtaatacattaagggaaa

SEQ ID NO: 50438 - DNA, 20 bp, Artificial Sequence
  chemically synthesized
catgtaatacattaagggaa

SEQ ID NO: 50439 - DNA, 20 bp, Artificial Sequence
  chemically synthesized
tgtaccatgtaatacattaa

SEQ ID NO: 50440 - DNA, 20 bp, Artificial Sequence
  chemically synthesized
ctgtaccatgtaatacatta

SEQ ID NO: 50441 - DNA, 20 bp, Artificial Sequence
  chemically synthesized
actgtaccatgtaatacatt

SEQ ID NO: 50442 - DNA, 20 bp, Artificial Sequence
  chemically synthesized
ttttcccttaatgtattaca

SEQ ID NO: 50443 - DNA, 20 bp, Artificial Sequence
  chemically synthesized
ccttaatgtattacatggta

SEQ ID NO: 50444 - DNA, 20 bp, Artificial Sequence
  chemically synthesized
ttatatggtcgtttttatca

SEQ ID NO: 50445 - DNA, 20 bp, Artificial Sequence
  chemically synthesized
ttgataaaaacgaccatata

SEQ ID NO: 50446 - DNA, 20 bp, Artificial Sequence
  chemically synthesized
atagcattcataactttata

SEQ ID NO: 50447 - DNA, 20 bp, Artificial Sequence
  chemically synthesized
tataaagttatgaatgctat

SEQ ID NO: 50448 - DNA, 20 bp, Artificial Sequence
  chemically synthesized
tgcttctcagcaaagactaa

SEQ ID NO: 50449 - DNA, 20 bp, Artificial Sequence
  chemically synthesized
gaatgctattagtctttgct

SEQ ID NO: 50450 - DNA, 20 bp, Artificial Sequence
  chemically synthesized
tgctattagtctttgctgag

SEQ ID NO: 50451 - DNA, 20 bp, Artificial Sequence
  chemically synthesized
ttttctgttgcttctcagca

SEQ ID NO: 50452 - DNA, 20 bp, Artificial Sequence
  chemically synthesized
tgaccttttctgttgcttct

SEQ ID NO: 50453 - DNA, 20 bp, Artificial Sequence
  chemically synthesized
tagtctttgctgagaagcaa

SEQ ID NO: 50454 - DNA, 20 bp, Artificial Sequence
  chemically synthesized
tttgctgagaagcaacagaa

SEQ ID NO: 50455 - DNA, 20 bp, Artificial Sequence
  chemically synthesized
ttgctgagaagcaacagaaa

SEQ ID NO: 50456 - DNA, 20 bp, Artificial Sequence
  chemically synthesized
aaaaggtcacattatttatt

SEQ ID NO: 50457 - DNA, 20 bp, Artificial Sequence
  chemically synthesized
gcatagtggctatcacatag

SEQ ID NO: 50458 - DNA, 20 bp, Artificial Sequence
  chemically synthesized
attgagtgtctactatgtga

SEQ ID NO: 50459 - DNA, 20 bp, Artificial Sequence
  chemically synthesized
ttagcatagtggctatcaca

SEQ ID NO: 50460 - DNA, 20 bp, Artificial Sequence
  chemically synthesized
aggcatgagatttagcatag

SEQ ID NO: 50461 - DNA, 20 bp, Artificial Sequence
  chemically synthesized
cagaggcatgagatttagca

SEQ ID NO: 50462 - DNA, 20 bp, Artificial Sequence
  chemically synthesized
atacacagaggcatgagatt

SEQ ID NO: 50463 - DNA, 20 bp, Artificial Sequence
  chemically synthesized
ttgataatacacagaggcat

SEQ ID NO: 50464 - DNA, 20 bp, Artificial Sequence
  chemically synthesized
ttgacattgataatacacag

SEQ ID NO: 50465 - DNA, 20 bp, Artificial Sequence
  chemically synthesized
cttgacattgataatacaca

SEQ ID NO: 50466 - DNA, 20 bp, Artificial Sequence
  chemically synthesized
ctcttgacattgataataca

SEQ ID NO: 50467 - DNA, 20 bp, Artificial Sequence
  chemically synthesized
ctctgtgtattatcaatgtc

SEQ ID NO: 50468 - DNA, 20 bp, Artificial Sequence
  chemically synthesized
ctgtgtattatcaatgtcaa

SEQ ID NO: 50469 - DNA, 20 bp, Artificial Sequence
  chemically synthesized
cttatacccaaaagaagaag

SEQ ID NO: 50470 - DNA, 20 bp, Artificial Sequence
  chemically synthesized
tcttatacccaaaagaagaa

SEQ ID NO: 50471 - DNA, 20 bp, Artificial Sequence
  chemically synthesized
gaatttacctcttcttcttt

SEQ ID NO: 50472 - DNA, 20 bp, Artificial Sequence
  chemically synthesized
tgtcttatacccaaaagaag

SEQ ID NO: 50473 - DNA, 20 bp, Artificial Sequence
  chemically synthesized
aatttacctcttcttctttt

SEQ ID NO: 50474 - DNA, 20 bp, Artificial Sequence
  chemically synthesized
ttatgtcttatacccaaaag

SEQ ID NO: 50475 - DNA, 20 bp, Artificial Sequence
  chemically synthesized
gaattatgtcttatacccaa

SEQ ID NO: 50476 - DNA, 20 bp, Artificial Sequence
  chemically synthesized
cctcttcttcttttgggtat

SEQ ID NO: 50477 - DNA, 20 bp, Artificial Sequence
  chemically synthesized
agatgttcagtaaatattta

SEQ ID NO: 50478 - DNA, 20 bp, Artificial Sequence
  chemically synthesized
tgtggtacttggtagatgtt

SEQ ID NO: 50479 - DNA, 20 bp, Artificial Sequence
  chemically synthesized
atatttactgaacatctacc

SEQ ID NO: 50480 - DNA, 20 bp, Artificial Sequence
  chemically synthesized
atgtggtatgtggtacttgg

SEQ ID NO: 50481 - DNA, 20 bp, Artificial Sequence
  chemically synthesized
ctaatgtggtatgtggtact

SEQ ID NO: 50482 - DNA, 20 bp, Artificial Sequence
  chemically synthesized
acagtacctaatgtggtatg

SEQ ID NO: 50483 - DNA, 20 bp, Artificial Sequence
  chemically synthesized
ccaagtaccacataccacat

SEQ ID NO: 50484 - DNA, 20 bp, Artificial Sequence
  chemically synthesized
caagtaccacataccacatt

SEQ ID NO: 50485 - DNA, 20 bp, Artificial Sequence
  chemically synthesized
atattctacagtacctaatg

SEQ ID NO: 50486 - DNA, 20 bp, Artificial Sequence
  chemically synthesized
acataccacattaggtactg

SEQ ID NO: 50487 - DNA, 20 bp, Artificial Sequence
  chemically synthesized
ttgttgacagttatattcta

SEQ ID NO: 50488 - DNA, 20 bp, Artificial Sequence
  chemically synthesized
tgtagaatataactgtcaac

SEQ ID NO: 50489 - DNA, 20 bp, Artificial Sequence
  chemically synthesized
gatagtattagtcttgttga

SEQ ID NO: 50490 - DNA, 20 bp, Artificial Sequence
  chemically synthesized
ctaaaatgtcaggatagtat

SEQ ID NO: 50491 - DNA, 20 bp, Artificial Sequence
  chemically synthesized
taatctctaaaatgtcagga

SEQ ID NO: 50492 - DNA, 20 bp, Artificial Sequence
  chemically synthesized
ctaatactatcctgacattt

SEQ ID NO: 50493 - DNA, 20 bp, Artificial Sequence
  chemically synthesized
accttaatctctaaaatgtc

SEQ ID NO: 50494 - DNA, 20 bp, Artificial Sequence
  chemically synthesized
gaccttaatctctaaaatgt

SEQ ID NO: 50495 - DNA, 20 bp, Artificial Sequence
  chemically synthesized
aatactatcctgacatttta

SEQ ID NO: 50496 - DNA, 20 bp, Artificial Sequence
  chemically synthesized
atcctgacattttagagatt

SEQ ID NO: 50497 - DNA, 20 bp, Artificial Sequence
  chemically synthesized
tcctgacattttagagatta

SEQ ID NO: 50498 - DNA, 20 bp, Artificial Sequence
  chemically synthesized
gtgataaataatcaaaaaga

SEQ ID NO: 50499 - DNA, 20 bp, Artificial Sequence
  chemically synthesized
acgagtgataaataatcaaa

SEQ ID NO: 50500 - DNA, 20 bp, Artificial Sequence
  chemically synthesized
tttgattatttatcactcgt

SEQ ID NO: 50501 - DNA, 20 bp, Artificial Sequence
  chemically synthesized
tagttgtttgtataactaac

SEQ ID NO: 50502 - DNA, 20 bp, Artificial Sequence
  chemically synthesized
tagttatacaaacaactatt

SEQ ID NO: 50503 - DNA, 20 bp, Artificial Sequence
  chemically synthesized
tgcacattagaacggctcaa

SEQ ID NO: 50504 - DNA, 20 bp, Artificial Sequence
  chemically synthesized
cagtgttttgcacattagaa

SEQ ID NO: 50505 - DNA, 20 bp, Artificial Sequence
  chemically synthesized
aagtccagtgttttgcacat

SEQ ID NO: 50506 - DNA, 20 bp, Artificial Sequence
  chemically synthesized
cgttctaatgtgcaaaacac

SEQ ID NO: 50507 - DNA, 20 bp, Artificial Sequence
  chemically synthesized
tgtgcaaaacactggacttt

SEQ ID NO: 50508 - DNA, 20 bp, Artificial Sequence
  chemically synthesized
aaggatctaatctgaaagtc

SEQ ID NO: 50509 - DNA, 20 bp, Artificial Sequence
  chemically synthesized
aaaacactggactttcagat

SEQ ID NO: 50510 - DNA, 20 bp, Artificial Sequence
  chemically synthesized
tttccaaggatctaatctga

SEQ ID NO: 50511 - DNA, 20 bp, Artificial Sequence
  chemically synthesized
ggactttcagattagatcct

SEQ ID NO: 50512 - DNA, 20 bp, Artificial Sequence
  chemically synthesized
ctttctgaagatgatttcca

SEQ ID NO: 50513 - DNA, 20 bp, Artificial Sequence
  chemically synthesized
cctttctgaagatgatttcc

SEQ ID NO: 50514 - DNA, 20 bp, Artificial Sequence
  chemically synthesized
agatccttggaaatcatctt

SEQ ID NO: 50515 - DNA, 20 bp, Artificial Sequence
  chemically synthesized
ccttggaaatcatcttcaga

SEQ ID NO: 50516 - DNA, 20 bp, Artificial Sequence
  chemically synthesized
cttggaaatcatcttcagaa

SEQ ID NO: 50517 - DNA, 20 bp, Artificial Sequence
  chemically synthesized
tggaaatcatcttcagaaag

SEQ ID NO: 50518 - DNA, 20 bp, Artificial Sequence
  chemically synthesized
agtagttcctctcctttctg

SEQ ID NO: 50519 - DNA, 20 bp, Artificial Sequence
  chemically synthesized
gaaatcatcttcagaaagga

SEQ ID NO: 50520 - DNA, 20 bp, Artificial Sequence
  chemically synthesized
aaatcatcttcagaaaggag

SEQ ID NO: 50521 - DNA, 20 bp, Artificial Sequence
  chemically synthesized
catttaatggtcagtataag

SEQ ID NO: 50522 - DNA, 20 bp, Artificial Sequence
  chemically synthesized
ttgcatttaatggtcagtat

SEQ ID NO: 50523 - DNA, 20 bp, Artificial Sequence
  chemically synthesized
attctcttgcatttaatggt

SEQ ID NO: 50524 - DNA, 20 bp, Artificial Sequence
  chemically synthesized
attcattctcttgcatttaa

SEQ ID NO: 50525 - DNA, 20 bp, Artificial Sequence
  chemically synthesized
ttatactgaccattaaatgc

SEQ ID NO: 50526 - DNA, 20 bp, Artificial Sequence
  chemically synthesized
atactgaccattaaatgcaa

SEQ ID NO: 50527 - DNA, 20 bp, Artificial Sequence
  chemically synthesized
atgaatgaaactttcatgac

SEQ ID NO: 50528 - DNA, 20 bp, Artificial Sequence
  chemically synthesized
tagagtcaaactagtcatga

SEQ ID NO: 50529 - DNA, 20 bp, Artificial Sequence
  chemically synthesized
catgcctgttagagtcaaac

SEQ ID NO: 50530 - DNA, 20 bp, Artificial Sequence
  chemically synthesized
catgactagtttgactctaa

SEQ ID NO: 50531 - DNA, 20 bp, Artificial Sequence
  chemically synthesized
atgactagtttgactctaac

SEQ ID NO: 50532 - DNA, 20 bp, Artificial Sequence
  chemically synthesized
aacttaatgcatgcctgtta

SEQ ID NO: 50533 - DNA, 20 bp, Artificial Sequence
  chemically synthesized
ataacttaatgcatgcctgt

SEQ ID NO: 50534 - DNA, 20 bp, Artificial Sequence
  chemically synthesized
gactctaacaggcatgcatt

SEQ ID NO: 50535 - DNA, 20 bp, Artificial Sequence
  chemically synthesized
atgcattaagttatactatc

SEQ ID NO: 50536 - DNA, 20 bp, Artificial Sequence
  chemically synthesized
cattattactatcagcttga

SEQ ID NO: 50537 - DNA, 20 bp, Artificial Sequence
  chemically synthesized
aagttatactatcaagctga

SEQ ID NO: 50538 - DNA, 20 bp, Artificial Sequence
  chemically synthesized
attagtatcattattactat

SEQ ID NO: 50539 - DNA, 20 bp, Artificial Sequence
  chemically synthesized
taataatgatactaatgcta

SEQ ID NO: 50540 - DNA, 20 bp, Artificial Sequence
  chemically synthesized
tttgctattagctttagcat

SEQ ID NO: 50541 - DNA, 20 bp, Artificial Sequence
  chemically synthesized
gatactaatgctaaagctaa

SEQ ID NO: 50542 - DNA, 20 bp, Artificial Sequence
  chemically synthesized
caagtgtttgctattagctt

SEQ ID NO: 50543 - DNA, 20 bp, Artificial Sequence
  chemically synthesized
gctattcaagtgtttgctat

SEQ ID NO: 50544 - DNA, 20 bp, Artificial Sequence
  chemically synthesized
gctaatagcaaacacttgaa

SEQ ID NO: 50545 - DNA, 20 bp, Artificial Sequence
  chemically synthesized
gaacatagtaagtgctattc

SEQ ID NO: 50546 - DNA, 20 bp, Artificial Sequence
  chemically synthesized
agtagtgcctggaacatagt

SEQ ID NO: 50547 - DNA, 20 bp, Artificial Sequence
  chemically synthesized
gaatagcacttactatgttc

SEQ ID NO: 50548 - DNA, 20 bp, Artificial Sequence
  chemically synthesized
aatagcacttactatgttcc

SEQ ID NO: 50549 - DNA, 20 bp, Artificial Sequence
  chemically synthesized
ttagagtagtgcctggaaca

SEQ ID NO: 50550 - DNA, 20 bp, Artificial Sequence
  chemically synthesized
aaaacccttagagtagtgcc

SEQ ID NO: 50551 - DNA, 20 bp, Artificial Sequence
  chemically synthesized
tatgttccaggcactactct

SEQ ID NO: 50552 - DNA, 20 bp, Artificial Sequence
  chemically synthesized
atgttccaggcactactcta

SEQ ID NO: 50553 - DNA, 20 bp, Artificial Sequence
  chemically synthesized
tgttccaggcactactctaa

SEQ ID NO: 50554 - DNA, 20 bp, Artificial Sequence
  chemically synthesized
tatttgtaaaacccttagag

SEQ ID NO: 50555 - DNA, 20 bp, Artificial Sequence
  chemically synthesized
taatatttgtaaaaccctta

SEQ ID NO: 50556 - DNA, 20 bp, Artificial Sequence
  chemically synthesized
gttaatatttgtaaaaccct

SEQ ID NO: 50557 - DNA, 20 bp, Artificial Sequence
  chemically synthesized
gggttacagtgaagatcaaa

SEQ ID NO: 50558 - DNA, 20 bp, Artificial Sequence
  chemically synthesized
tatttcatagggttacagtg

SEQ ID NO: 50559 - DNA, 20 bp, Artificial Sequence
  chemically synthesized
tgtattatttcatagggtta

SEQ ID NO: 50560 - DNA, 20 bp, Artificial Sequence
  chemically synthesized
tatggctgtattatttcata

SEQ ID NO: 50561 - DNA, 20 bp, Artificial Sequence
  chemically synthesized
atatggctgtattatttcat

SEQ ID NO: 50562 - DNA, 20 bp, Artificial Sequence
  chemically synthesized
aatatggctgtattatttca

SEQ ID NO: 50563 - DNA, 20 bp, Artificial Sequence
  chemically synthesized
tgtaaccctatgaaataata

SEQ ID NO: 50564 - DNA, 20 bp, Artificial Sequence
  chemically synthesized
atattgaattcggtgaaata

SEQ ID NO: 50565 - DNA, 20 bp, Artificial Sequence
  chemically synthesized
gaccaatgggatattgaatt

SEQ ID NO: 50566 - DNA, 20 bp, Artificial Sequence
  chemically synthesized
caccgaattcaatatcccat

SEQ ID NO: 50567 - DNA, 20 bp, Artificial Sequence
  chemically synthesized
gaatgcaccatacgaccaat

SEQ ID NO: 50568 - DNA, 20 bp, Artificial Sequence
  chemically synthesized
agaatgcaccatacgaccaa

SEQ ID NO: 50569 - DNA, 20 bp, Artificial Sequence
  chemically synthesized
tcaatatcccattggtcgta

SEQ ID NO: 50570 - DNA, 20 bp, Artificial Sequence
  chemically synthesized
cgtatggtgcattctgattt

SEQ ID NO: 50571 - DNA, 20 bp, Artificial Sequence
  chemically synthesized
cgtttcaacagttctgaaat

SEQ ID NO: 50572 - DNA, 20 bp, Artificial Sequence
  chemically synthesized
cttttccacccacgtttcaa

SEQ ID NO: 50573 - DNA, 20 bp, Artificial Sequence
  chemically synthesized
atttcagaactgttgaaacg

SEQ ID NO: 50574 - DNA, 20 bp, Artificial Sequence
  chemically synthesized
tttcagaactgttgaaacgt

SEQ ID NO: 50575 - DNA, 20 bp, Artificial Sequence
  chemically synthesized
cagaactgttgaaacgtggg

SEQ ID NO: 50576 - DNA, 20 bp, Artificial Sequence
  chemically synthesized
ctgttgaaacgtgggtggaa

SEQ ID NO: 50577 - DNA, 20 bp, Artificial Sequence
  chemically synthesized
taacatatttggtcaattgt

SEQ ID NO: 50578 - DNA, 20 bp, Artificial Sequence
  chemically synthesized
agggataatagtaacatatt

SEQ ID NO: 50579 - DNA, 20 bp, Artificial Sequence
  chemically synthesized
catctttaaaatagggataa

SEQ ID NO: 50580 - DNA, 20 bp, Artificial Sequence
  chemically synthesized
ttactattatccctatttta

SEQ ID NO: 50581 - DNA, 20 bp, Artificial Sequence
  chemically synthesized
tattcttcatctttaaaata

SEQ ID NO: 50582 - DNA, 20 bp, Artificial Sequence
  chemically synthesized
ttattcttcatctttaaaat

SEQ ID NO: 50583 - DNA, 20 bp, Artificial Sequence
  chemically synthesized
tttattcttcatctttaaaa

SEQ ID NO: 50584 - DNA, 20 bp, Artificial Sequence
  chemically synthesized
ttatccctattttaaagatg

SEQ ID NO: 50585 - DNA, 20 bp, Artificial Sequence
  chemically synthesized
tattttaaagatgaagaata

SEQ ID NO: 50586 - DNA, 20 bp, Artificial Sequence
  chemically synthesized
ttttaaagatgaagaataaa

SEQ ID NO: 50587 - DNA, 20 bp, Artificial Sequence
  chemically synthesized
aaagatgaagaataaagaga

SEQ ID NO: 50588 - DNA, 20 bp, Artificial Sequence
  chemically synthesized
aagaataaagagaaagaaaa

SEQ ID NO: 50589 - DNA, 20 bp, Artificial Sequence
  chemically synthesized
aagagaaagaaaaaagcata

SEQ ID NO: 50590 - DNA, 20 bp, Artificial Sequence
  chemically synthesized
gaaaaaagcataaagtgtct

SEQ ID NO: 50591 - DNA, 20 bp, Artificial Sequence
  chemically synthesized
actgggttcaaatattgact

SEQ ID NO: 50592 - DNA, 20 bp, Artificial Sequence
  chemically synthesized
tctgagtcaatatttgaacc

SEQ ID NO: 50593 - DNA, 20 bp, Artificial Sequence
  chemically synthesized
agtcaatatttgaacccagt

SEQ ID NO: 50594 - DNA, 20 bp, Artificial Sequence
  chemically synthesized
gctgtaaaatgaaactgact

SEQ ID NO: 50595 - DNA, 20 bp, Artificial Sequence
  chemically synthesized
agctgtaaaatgaaactgac

SEQ ID NO: 50596 - DNA, 20 bp, Artificial Sequence
  chemically synthesized
acccagtcagtttcatttta

SEQ ID NO: 50597 - DNA, 20 bp, Artificial Sequence
  chemically synthesized
tcgatagcggttaagagtaa

SEQ ID NO: 50598 - DNA, 20 bp, Artificial Sequence
  chemically synthesized
atggtatcgatagcggttaa

SEQ ID NO: 50599 - DNA, 20 bp, Artificial Sequence
  chemically synthesized
aaatggtatcgatagcggtt

SEQ ID NO: 50600 - DNA, 20 bp, Artificial Sequence
  chemically synthesized
tatcaaaatggtatcgatag

SEQ ID NO: 50601 - DNA, 20 bp, Artificial Sequence
  chemically synthesized
ccttatcaaaatggtatcga

SEQ ID NO: 50602 - DNA, 20 bp, Artificial Sequence
  chemically synthesized
gctatcgataccattttgat

SEQ ID NO: 50603 - DNA, 20 bp, Artificial Sequence
  chemically synthesized
taaaaactgccttatcaaaa

SEQ ID NO: 50604 - DNA, 20 bp, Artificial Sequence
  chemically synthesized
ctatcgataccattttgata

SEQ ID NO: 50605 - DNA, 20 bp, Artificial Sequence
  chemically synthesized
tcgataccattttgataagg

SEQ ID NO: 50606 - DNA, 20 bp, Artificial Sequence
  chemically synthesized
cattttgataaggcagtttt

SEQ ID NO: 50607 - DNA, 20 bp, Artificial Sequence
  chemically synthesized
tgataaggcagtttttagcc

SEQ ID NO: 50608 - DNA, 20 bp, Artificial Sequence
  chemically synthesized
ataaggcagtttttagccca

SEQ ID NO: 50609 - DNA, 20 bp, Artificial Sequence
  chemically synthesized
taaggcagtttttagcccag

SEQ ID NO: 50610 - DNA, 20 bp, Artificial Sequence
  chemically synthesized
atttttctctcaacacctct

SEQ ID NO: 50611 - DNA, 20 bp, Artificial Sequence
  chemically synthesized
aatttttctctcaacacctc

SEQ ID NO: 50612 - DNA, 20 bp, Artificial Sequence
  chemically synthesized
gtttttagcccagaggtgtt

SEQ ID NO: 50613 - DNA, 20 bp, Artificial Sequence
  chemically synthesized
ttttagcccagaggtgttga

SEQ ID NO: 50614 - DNA, 20 bp, Artificial Sequence
  chemically synthesized
gaggtgttgagagaaaaatt

SEQ ID NO: 50615 - DNA, 20 bp, Artificial Sequence
  chemically synthesized
aggtgttgagagaaaaattt

SEQ ID NO: 50616 - DNA, 20 bp, Artificial Sequence
  chemically synthesized
ttaggttatgtaaatcaact

SEQ ID NO: 50617 - DNA, 20 bp, Artificial Sequence
  chemically synthesized
taggttatgtaaatcaactt

SEQ ID NO: 50618 - DNA, 20 bp, Artificial Sequence
  chemically synthesized
ttatgtaaatcaacttagga

SEQ ID NO: 50619 - DNA, 20 bp, Artificial Sequence
  chemically synthesized
cctcttcgtttggccatcct

SEQ ID NO: 50620 - DNA, 20 bp, Artificial Sequence
  chemically synthesized
caacttaggatggccaaacg

SEQ ID NO: 50621 - DNA, 20 bp, Artificial Sequence
  chemically synthesized
acttaggatggccaaacgaa

SEQ ID NO: 50622 - DNA, 20 bp, Artificial Sequence
  chemically synthesized
cttaggatggccaaacgaag

SEQ ID NO: 50623 - DNA, 20 bp, Artificial Sequence
  chemically synthesized
ctcgtatattcctcttcgtt

SEQ ID NO: 50624 - DNA, 20 bp, Artificial Sequence
  chemically synthesized
ccaaacgaagaggaatatac

SEQ ID NO: 50625 - DNA, 20 bp, Artificial Sequence
  chemically synthesized
aaacgaagaggaatatacga

SEQ ID NO: 50626 - DNA, 20 bp, Artificial Sequence
  chemically synthesized
atatacgagagaataatcgt

SEQ ID NO: 50627 - DNA, 20 bp, Artificial Sequence
  chemically synthesized
gagagaataatcgttggcaa

SEQ ID NO: 50628 - DNA, 20 bp, Artificial Sequence
  chemically synthesized
agaataatcgttggcaatag

SEQ ID NO: 50629 - DNA, 20 bp, Artificial Sequence
  chemically synthesized
taatcgttggcaatagcaga

SEQ ID NO: 50630 - DNA, 20 bp, Artificial Sequence
  chemically synthesized
gttggcaatagcagatagac

SEQ ID NO: 50631 - DNA, 20 bp, Artificial Sequence
  chemically synthesized
gcaatagcagatagactaga

SEQ ID NO: 50632 - DNA, 20 bp, Artificial Sequence
  chemically synthesized
tgcccaggccaataactgtc

SEQ ID NO: 50633 - DNA, 20 bp, Artificial Sequence
  chemically synthesized
cagatagactagacagttat

SEQ ID NO: 50634 - DNA, 20 bp, Artificial Sequence
  chemically synthesized
agactagacagttattggcc

SEQ ID NO: 50635 - DNA, 20 bp, Artificial Sequence
  chemically synthesized
gactagacagttattggcct

SEQ ID NO: 50636 - DNA, 20 bp, Artificial Sequence
  chemically synthesized
cccgttaagaagaaatgccc

SEQ ID NO: 50637 - DNA, 20 bp, Artificial Sequence
  chemically synthesized
acccgttaagaagaaatgcc

SEQ ID NO: 50638 - DNA, 20 bp, Artificial Sequence
  chemically synthesized
gcctgggcatttcttcttaa

SEQ ID NO: 50639 - DNA, 20 bp, Artificial Sequence
  chemically synthesized
cctgggcatttcttcttaac

SEQ ID NO: 50640 - DNA, 20 bp, Artificial Sequence
  chemically synthesized
acactgccttacccgttaag

SEQ ID NO: 50641 - DNA, 20 bp, Artificial Sequence
  chemically synthesized
ggcatttcttcttaacgggt

SEQ ID NO: 50642 - DNA, 20 bp, Artificial Sequence
  chemically synthesized
atcacactgccttacccgtt

SEQ ID NO: 50643 - DNA, 20 bp, Artificial Sequence
  chemically synthesized
gcatttcttcttaacgggta

SEQ ID NO: 50644 - DNA, 20 bp, Artificial Sequence
  chemically synthesized
tttcttcttaacgggtaagg

SEQ ID NO: 50645 - DNA, 20 bp, Artificial Sequence
  chemically synthesized
gggtaaggcagtgtgatgtg

SEQ ID NO: 50646 - DNA, 20 bp, Artificial Sequence
  chemically synthesized
aggcagtgtgatgtgtggct

SEQ ID NO: 50647 - DNA, 20 bp, Artificial Sequence
  chemically synthesized
tgatgtgtggcttggatgtc

SEQ ID NO: 50648 - DNA, 20 bp, Artificial Sequence
  chemically synthesized
aacccagtttctggacatcc

SEQ ID NO: 50649 - DNA, 20 bp, Artificial Sequence
  chemically synthesized
tggcttggatgtccagaaac

SEQ ID NO: 50650 - DNA, 20 bp, Artificial Sequence
  chemically synthesized
ggcttggatgtccagaaact

SEQ ID NO: 50651 - DNA, 20 bp, Artificial Sequence
  chemically synthesized
tgggactggaacccagtttc

SEQ ID NO: 50652 - DNA, 20 bp, Artificial Sequence
  chemically synthesized
gatgtccagaaactgggttc

SEQ ID NO: 50653 - DNA, 20 bp, Artificial Sequence
  chemically synthesized
ataatactgggactggaacc

SEQ ID NO: 50654 - DNA, 20 bp, Artificial Sequence
  chemically synthesized
cagaaactgggttccagtcc

SEQ ID NO: 50655 - DNA, 20 bp, Artificial Sequence
  chemically synthesized
gatagttataatactgggac

SEQ ID NO: 50656 - DNA, 20 bp, Artificial Sequence
  chemically synthesized
acaaagatagttataatact

SEQ ID NO: 50657 - DNA, 20 bp, Artificial Sequence
  chemically synthesized
cacaaagatagttataatac

SEQ ID NO: 50658 - DNA, 20 bp, Artificial Sequence
  chemically synthesized
cataaccaaggtcacaaaga

SEQ ID NO: 50659 - DNA, 20 bp, Artificial Sequence
  chemically synthesized
atgacataaccaaggtcaca

SEQ ID NO: 50660 - DNA, 20 bp, Artificial Sequence
  chemically synthesized
tataactatctttgtgacct

SEQ ID NO: 50661 - DNA, 20 bp, Artificial Sequence
  chemically synthesized
acgatcaaatgacataacca

SEQ ID NO: 50662 - DNA, 20 bp, Artificial Sequence
  chemically synthesized
aacgatcaaatgacataacc

SEQ ID NO: 50663 - DNA, 20 bp, Artificial Sequence
  chemically synthesized
tacagataatgaaataggtg

SEQ ID NO: 50664 - DNA, 20 bp, Artificial Sequence
  chemically synthesized
tattttacagataatgaaat

SEQ ID NO: 50665 - DNA, 20 bp, Artificial Sequence
  chemically synthesized
ttattttacagataatgaaa

SEQ ID NO: 50666 - DNA, 20 bp, Artificial Sequence
  chemically synthesized
tatttcattatctgtaaaat

SEQ ID NO: 50667 - DNA, 20 bp, Artificial Sequence
  chemically synthesized
atttcattatctgtaaaata

SEQ ID NO: 50668 - DNA, 20 bp, Artificial Sequence
  chemically synthesized
cgagccctttccttatttta

SEQ ID NO: 50669 - DNA, 20 bp, Artificial Sequence
  chemically synthesized
cattatctgtaaaataagga

SEQ ID NO: 50670 - DNA, 20 bp, Artificial Sequence
  chemically synthesized
attatctgtaaaataaggaa

SEQ ID NO: 50671 - DNA, 20 bp, Artificial Sequence
  chemically synthesized
ttatctgtaaaataaggaaa

SEQ ID NO: 50672 - DNA, 20 bp, Artificial Sequence
  chemically synthesized
tgagaaacattgaatcattc

SEQ ID NO: 50673 - DNA, 20 bp, Artificial Sequence
  chemically synthesized
ggttgcagtcgaaatagttt

SEQ ID NO: 50674 - DNA, 20 bp, Artificial Sequence
  chemically synthesized
tctgtgggttgcagtcgaaa

SEQ ID NO: 50675 - DNA, 20 bp, Artificial Sequence
  chemically synthesized
actatttcgactgcaaccca

SEQ ID NO: 50676 - DNA, 20 bp, Artificial Sequence
  chemically synthesized
cgtttttcttctgtgggttg

SEQ ID NO: 50677 - DNA, 20 bp, Artificial Sequence
  chemically synthesized
atttcgactgcaacccacag

SEQ ID NO: 50678 - DNA, 20 bp, Artificial Sequence
  chemically synthesized
gtaaaacgtttttcttctgt

SEQ ID NO: 50679 - DNA, 20 bp, Artificial Sequence
  chemically synthesized
tgtaaaacgtttttcttctg

SEQ ID NO: 50680 - DNA, 20 bp, Artificial Sequence
  chemically synthesized
aaacgttttacactgtgatc

SEQ ID NO: 50681 - DNA, 20 bp, Artificial Sequence
  chemically synthesized
cacgcgcgcacgccagatca

SEQ ID NO: 50682 - DNA, 20 bp, Artificial Sequence
  chemically synthesized
gcgcacgcacgcgcgcacgc

SEQ ID NO: 50683 - DNA, 20 bp, Artificial Sequence
  chemically synthesized
tttggcggtggttaatttgt

SEQ ID NO: 50684 - DNA, 20 bp, Artificial Sequence
  chemically synthesized
gttaagtgttgttttggcgg

SEQ ID NO: 50685 - DNA, 20 bp, Artificial Sequence
  chemically synthesized
aaggttaagtgttgttttgg

SEQ ID NO: 50686 - DNA, 20 bp, Artificial Sequence
  chemically synthesized
agcaaggttaagtgttgttt

SEQ ID NO: 50687 - DNA, 20 bp, Artificial Sequence
  chemically synthesized
tgcattacctaagcaaggtt

SEQ ID NO: 50688 - DNA, 20 bp, Artificial Sequence
  chemically synthesized
aaacaacacttaaccttgct

SEQ ID NO: 50689 - DNA, 20 bp, Artificial Sequence
  chemically synthesized
aacaacacttaaccttgctt

SEQ ID NO: 50690 - DNA, 20 bp, Artificial Sequence
  chemically synthesized
cagagtgcattacctaagca

SEQ ID NO: 50691 - DNA, 20 bp, Artificial Sequence
  chemically synthesized
tcagagtgcattacctaagc

SEQ ID NO: 50692 - DNA, 20 bp, Artificial Sequence
  chemically synthesized
aatatcagagtgcattacct

SEQ ID NO: 50693 - DNA, 20 bp, Artificial Sequence
  chemically synthesized
gaacagattagaaaatatca

SEQ ID NO: 50694 - DNA, 20 bp, Artificial Sequence
  chemically synthesized
tggaacagattagaaaatat

SEQ ID NO: 50695 - DNA, 20 bp, Artificial Sequence
  chemically synthesized
tggaatggaatggaacagat

SEQ ID NO: 50696 - DNA, 20 bp, Artificial Sequence
  chemically synthesized
tggaatggaatggaatggaa

SEQ ID NO: 50697 - DNA, 20 bp, Artificial Sequence
  chemically synthesized
tggtatggaatggaatggaa

SEQ ID NO: 50698 - DNA, 20 bp, Artificial Sequence
  chemically synthesized
ttgactggtatggaatggaa

SEQ ID NO: 50699 - DNA, 20 bp, Artificial Sequence
  chemically synthesized
aatttttgactggtatggaa

SEQ ID NO: 50700 - DNA, 20 bp, Artificial Sequence
  chemically synthesized
cattccattccattccatac

SEQ ID NO: 50701 - DNA, 20 bp, Artificial Sequence
  chemically synthesized
ccaacaatttttgactggta

SEQ ID NO: 50702 - DNA, 20 bp, Artificial Sequence
  chemically synthesized
tacaaccaacaatttttgac

SEQ ID NO: 50703 - DNA, 20 bp, Artificial Sequence
  chemically synthesized
ccataccagtcaaaaattgt

SEQ ID NO: 50704 - DNA, 20 bp, Artificial Sequence
  chemically synthesized
agtcaaaaattgttggttgt

SEQ ID NO: 50705 - DNA, 20 bp, Artificial Sequence
  chemically synthesized
gtaagtcattaaactgattt

SEQ ID NO: 50706 - DNA, 20 bp, Artificial Sequence
  chemically synthesized
taagtcattaaactgatttt

SEQ ID NO: 50707 - DNA, 20 bp, Artificial Sequence
  chemically synthesized
tcattagcaaatcctaaaat

SEQ ID NO: 50708 - DNA, 20 bp, Artificial Sequence
  chemically synthesized
tgattttaggatttgctaat

SEQ ID NO: 50709 - DNA, 20 bp, Artificial Sequence
  chemically synthesized
aactctgaggtgtggctcat

SEQ ID NO: 50710 - DNA, 20 bp, Artificial Sequence
  chemically synthesized
tttgctaatgagccacacct

SEQ ID NO: 50711 - DNA, 20 bp, Artificial Sequence
  chemically synthesized
tgctaatgagccacacctca

SEQ ID NO: 50712 - DNA, 20 bp, Artificial Sequence
  chemically synthesized
agtttccaaactctgaggtg

SEQ ID NO: 50713 - DNA, 20 bp, Artificial Sequence
  chemically synthesized
atgagccacacctcagagtt

SEQ ID NO: 50714 - DNA, 20 bp, Artificial Sequence
  chemically synthesized
ccagtagtttccaaactctg

SEQ ID NO: 50715 - DNA, 20 bp, Artificial Sequence
  chemically synthesized
accagtagtttccaaactct

SEQ ID NO: 50716 - DNA, 20 bp, Artificial Sequence
  chemically synthesized
cctcagagtttggaaactac

SEQ ID NO: 50717 - DNA, 20 bp, Artificial Sequence
  chemically synthesized
gagtttggaaactactggta

SEQ ID NO: 50718 - DNA, 20 bp, Artificial Sequence
  chemically synthesized
ttagaaagtatctataccag

SEQ ID NO: 50719 - DNA, 20 bp, Artificial Sequence
  chemically synthesized
agcttagaaagtatctatac

SEQ ID NO: 50720 - DNA, 20 bp, Artificial Sequence
  chemically synthesized
tactggtatagatactttct

SEQ ID NO: 50721 - DNA, 20 bp, Artificial Sequence
  chemically synthesized
taactggagataagcttaga

SEQ ID NO: 50722 - DNA, 20 bp, Artificial Sequence
  chemically synthesized
ttcctaactggagataagct

SEQ ID NO: 50723 - DNA, 20 bp, Artificial Sequence
  chemically synthesized
atactttctaagcttatctc

SEQ ID NO: 50724 - DNA, 20 bp, Artificial Sequence
  chemically synthesized
ggagtttcctaactggagat

SEQ ID NO: 50725 - DNA, 20 bp, Artificial Sequence
  chemically synthesized
tttctaagcttatctccagt

SEQ ID NO: 50726 - DNA, 20 bp, Artificial Sequence
  chemically synthesized
ttctaagcttatctccagtt

SEQ ID NO: 50727 - DNA, 20 bp, Artificial Sequence
  chemically synthesized
gctgtggagtttcctaactg

SEQ ID NO: 50728 - DNA, 20 bp, Artificial Sequence
  chemically synthesized
gtgctgtggagtttcctaac

SEQ ID NO: 50729 - DNA, 20 bp, Artificial Sequence
  chemically synthesized
tctccagttaggaaactcca

SEQ ID NO: 50730 - DNA, 20 bp, Artificial Sequence
  chemically synthesized
aggagccctcttgtgctgtg

SEQ ID NO: 50731 - DNA, 20 bp, Artificial Sequence
  chemically synthesized
gttaggaaactccacagcac

SEQ ID NO: 50732 - DNA, 20 bp, Artificial Sequence
  chemically synthesized
ccaggagccctcttgtgctg

SEQ ID NO: 50733 - DNA, 20 bp, Artificial Sequence
  chemically synthesized
taggaaactccacagcacaa

SEQ ID NO: 50734 - DNA, 20 bp, Artificial Sequence
  chemically synthesized
aggaaactccacagcacaag

SEQ ID NO: 50735 - DNA, 20 bp, Artificial Sequence
  chemically synthesized
ggaaactccacagcacaaga

SEQ ID NO: 50736 - DNA, 20 bp, Artificial Sequence
  chemically synthesized
ccacagcacaagagggctcc

SEQ ID NO: 50737 - DNA, 20 bp, Artificial Sequence
  chemically synthesized
cacagcacaagagggctcct

SEQ ID NO: 50738 - DNA, 20 bp, Artificial Sequence
  chemically synthesized
agcacaagagggctcctggg

SEQ ID NO: 50739 - DNA, 20 bp, Artificial Sequence
  chemically synthesized
gcacaagagggctcctgggt

SEQ ID NO: 50740 - DNA, 20 bp, Artificial Sequence
  chemically synthesized
ccagccccactcccacccag

SEQ ID NO: 50741 - DNA, 20 bp, Artificial Sequence
  chemically synthesized
acaagagggctcctgggtgg

SEQ ID NO: 50742 - DNA, 20 bp, Artificial Sequence
  chemically synthesized
tcccagccccactcccaccc

SEQ ID NO: 50743 - DNA, 20 bp, Artificial Sequence
  chemically synthesized
ttcccagccccactcccacc

SEQ ID NO: 50744 - DNA, 20 bp, Artificial Sequence
  chemically synthesized
agagggctcctgggtgggag

SEQ ID NO: 50745 - DNA, 20 bp, Artificial Sequence
  chemically synthesized
gagggctcctgggtgggagt

SEQ ID NO: 50746 - DNA, 20 bp, Artificial Sequence
  chemically synthesized
agggctcctgggtgggagtg

SEQ ID NO: 50747 - DNA, 20 bp, Artificial Sequence
  chemically synthesized
ctcctgggtgggagtggggc

SEQ ID NO: 50748 - DNA, 20 bp, Artificial Sequence
  chemically synthesized
tcctgggtgggagtggggct

SEQ ID NO: 50749 - DNA, 20 bp, Artificial Sequence
  chemically synthesized
gggagtggggctgggaactt

SEQ ID NO: 50750 - DNA, 20 bp, Artificial Sequence
  chemically synthesized
cctctctttactgaagttcc

SEQ ID NO: 50751 - DNA, 20 bp, Artificial Sequence
  chemically synthesized
tggggctgggaacttcagta

SEQ ID NO: 50752 - DNA, 20 bp, Artificial Sequence
  chemically synthesized
gggctgggaacttcagtaaa

SEQ ID NO: 50753 - DNA, 20 bp, Artificial Sequence
  chemically synthesized
tcaagtccctctctttactg

SEQ ID NO: 50754 - DNA, 20 bp, Artificial Sequence
  chemically synthesized
gctgggaacttcagtaaaga

SEQ ID NO: 50755 - DNA, 20 bp, Artificial Sequence
  chemically synthesized
ctgggaacttcagtaaagag

SEQ ID NO: 50756 - DNA, 20 bp, Artificial Sequence
  chemically synthesized
tgggaacttcagtaaagaga

SEQ ID NO: 50757 - DNA, 20 bp, Artificial Sequence
  chemically synthesized
atttatgaggcaaaagggtc

SEQ ID NO: 50758 - DNA, 20 bp, Artificial Sequence
  chemically synthesized
tgagtatttatgaggcaaaa

SEQ ID NO: 50759 - DNA, 20 bp, Artificial Sequence
  chemically synthesized
atgagtatttatgaggcaaa

SEQ ID NO: 50760 - DNA, 20 bp, Artificial Sequence
  chemically synthesized
aatgagtatttatgaggcaa

SEQ ID NO: 50761 - DNA, 20 bp, Artificial Sequence
  chemically synthesized
aaagaaaatgagtatttatg

SEQ ID NO: 50762 - DNA, 20 bp, Artificial Sequence
  chemically synthesized
aaaagaaaatgagtatttat

SEQ ID NO: 50763 - DNA, 20 bp, Artificial Sequence
  chemically synthesized
gatccaattaaaaagaaaat

SEQ ID NO: 50764 - DNA, 20 bp, Artificial Sequence
  chemically synthesized
atactcattttctttttaat

SEQ ID NO: 50765 - DNA, 20 bp, Artificial Sequence
  chemically synthesized
agaaacgtgatccaattaaa

SEQ ID NO: 50766 - DNA, 20 bp, Artificial Sequence
  chemically synthesized
gatcacgtttctacaacctt

SEQ ID NO: 50767 - DNA, 20 bp, Artificial Sequence
  chemically synthesized
aaaatttctgctaaaggttg

SEQ ID NO: 50768 - DNA, 20 bp, Artificial Sequence
  chemically synthesized
cacgtttctacaacctttag

SEQ ID NO: 50769 - DNA, 20 bp, Artificial Sequence
  chemically synthesized
tgacaaaaaatttctgctaa

SEQ ID NO: 50770 - DNA, 20 bp, Artificial Sequence
  chemically synthesized
atgacaaaaaatttctgcta

SEQ ID NO: 50771 - DNA, 20 bp, Artificial Sequence
  chemically synthesized
gcagaaattttttgtcatta

SEQ ID NO: 50772 - DNA, 20 bp, Artificial Sequence
  chemically synthesized
ttttttgtcattaaagcatc

SEQ ID NO: 50773 - DNA, 20 bp, Artificial Sequence
  chemically synthesized
tgccttaatgtggtatttgc

SEQ ID NO: 50774 - DNA, 20 bp, Artificial Sequence
  chemically synthesized
catctggcaaataccacatt

SEQ ID NO: 50775 - DNA, 20 bp, Artificial Sequence
  chemically synthesized
atctggcaaataccacatta

SEQ ID NO: 50776 - DNA, 20 bp, Artificial Sequence
  chemically synthesized
agtgaatctttgccttaatg

SEQ ID NO: 50777 - DNA, 20 bp, Artificial Sequence
  chemically synthesized
gcaaataccacattaaggca

SEQ ID NO: 50778 - DNA, 20 bp, Artificial Sequence
  chemically synthesized
caaagattcactgtgatcca

SEQ ID NO: 50779 - DNA, 20 bp, Artificial Sequence
  chemically synthesized
aaactttatgccatggatca

SEQ ID NO: 50780 - DNA, 20 bp, Artificial Sequence
  chemically synthesized
tcactgtgatccatggcata

SEQ ID NO: 50781 - DNA, 20 bp, Artificial Sequence
  chemically synthesized
tcacactaaactttatgcca

SEQ ID NO: 50782 - DNA, 20 bp, Artificial Sequence
  chemically synthesized
gtgatccatggcataaagtt

SEQ ID NO: 50783 - DNA, 20 bp, Artificial Sequence
  chemically synthesized
aagtttagtgtgaaattaac

SEQ ID NO: 50784 - DNA, 20 bp, Artificial Sequence
  chemically synthesized
gaagcctttttcaggcacac

SEQ ID NO: 50785 - DNA, 20 bp, Artificial Sequence
  chemically synthesized
attaactggtgtgcctgaaa

SEQ ID NO: 50786 - DNA, 20 bp, Artificial Sequence
  chemically synthesized
ttaactggtgtgcctgaaaa

SEQ ID NO: 50787 - DNA, 20 bp, Artificial Sequence
  chemically synthesized
tgactgtggaagcctttttc

SEQ ID NO: 50788 - DNA, 20 bp, Artificial Sequence
  chemically synthesized
gtgactgtggaagccttttt

SEQ ID NO: 50789 - DNA, 20 bp, Artificial Sequence
  chemically synthesized
gtgcctgaaaaaggcttcca

SEQ ID NO: 50790 - DNA, 20 bp, Artificial Sequence
  chemically synthesized
ccagttttaggtgactgtgg

SEQ ID NO: 50791 - DNA, 20 bp, Artificial Sequence
  chemically synthesized
tctccagttttaggtgactg

SEQ ID NO: 50792 - DNA, 20 bp, Artificial Sequence
  chemically synthesized
cttccacagtcacctaaaac

SEQ ID NO: 50793 - DNA, 20 bp, Artificial Sequence
  chemically synthesized
tccacagtcacctaaaactg

SEQ ID NO: 50794 - DNA, 20 bp, Artificial Sequence
  chemically synthesized
gtctatagttctccagtttt

SEQ ID NO: 50795 - DNA, 20 bp, Artificial Sequence
  chemically synthesized
agtctatagttctccagttt

SEQ ID NO: 50796 - DNA, 20 bp, Artificial Sequence
  chemically synthesized
ataaggagtctatagttctc

SEQ ID NO: 50797 - DNA, 20 bp, Artificial Sequence
  chemically synthesized
cacctaaaactggagaacta

SEQ ID NO: 50798 - DNA, 20 bp, Artificial Sequence
  chemically synthesized
ctaagaggataaggagtcta

SEQ ID NO: 50799 - DNA, 20 bp, Artificial Sequence
  chemically synthesized
tgagactctaagaggataag

SEQ ID NO: 50800 - DNA, 20 bp, Artificial Sequence
  chemically synthesized
actgagactctaagaggata

SEQ ID NO: 50801 - DNA, 20 bp, Artificial Sequence
  chemically synthesized
ctatagactccttatcctct

SEQ ID NO: 50802 - DNA, 20 bp, Artificial Sequence
  chemically synthesized
cactgagactctaagaggat

SEQ ID NO: 50803 - DNA, 20 bp, Artificial Sequence
  chemically synthesized
atagactccttatcctctta

SEQ ID NO: 50804 - DNA, 20 bp, Artificial Sequence
  chemically synthesized
ttatacactgagactctaag

SEQ ID NO: 50805 - DNA, 20 bp, Artificial Sequence
  chemically synthesized
attatacactgagactctaa

SEQ ID NO: 50806 - DNA, 20 bp, Artificial Sequence
  chemically synthesized
tccttatcctcttagagtct

SEQ ID NO: 50807 - DNA, 20 bp, Artificial Sequence
  chemically synthesized
ttattatacactgagactct

SEQ ID NO: 50808 - DNA, 20 bp, Artificial Sequence
  chemically synthesized
tggaatttttattatacact

SEQ ID NO: 50809 - DNA, 20 bp, Artificial Sequence
  chemically synthesized
cagtgtataataaaaattcc

SEQ ID NO: 50810 - DNA, 20 bp, Artificial Sequence
  chemically synthesized
ttatttcttgttagaattct

SEQ ID NO: 50811 - DNA, 20 bp, Artificial Sequence
  chemically synthesized
aaaattccaagaattctaac

SEQ ID NO: 50812 - DNA, 20 bp, Artificial Sequence
  chemically synthesized
taagcaagtttatttcttgt

SEQ ID NO: 50813 - DNA, 20 bp, Artificial Sequence
  chemically synthesized
actaggtttcaaagataagc

SEQ ID NO: 50814 - DNA, 20 bp, Artificial Sequence
  chemically synthesized
aaacactaggtttcaaagat

SEQ ID NO: 50815 - DNA, 20 bp, Artificial Sequence
  chemically synthesized
acttgcttatctttgaaacc

SEQ ID NO: 50816 - DNA, 20 bp, Artificial Sequence
  chemically synthesized
tggaaaaacactaggtttca

SEQ ID NO: 50817 - DNA, 20 bp, Artificial Sequence
  chemically synthesized
aataagattggaaaaacact

SEQ ID NO: 50818 - DNA, 20 bp, Artificial Sequence
  chemically synthesized
taataagattggaaaaacac

SEQ ID NO: 50819 - DNA, 20 bp, Artificial Sequence
  chemically synthesized
atagtactgattaataagat

SEQ ID NO: 50820 - DNA, 20 bp, Artificial Sequence
  chemically synthesized
gtttttccaatcttattaat

SEQ ID NO: 50821 - DNA, 20 bp, Artificial Sequence
  chemically synthesized
aaaaaatagtactgattaat

SEQ ID NO: 50822 - DNA, 20 bp, Artificial Sequence
  chemically synthesized
taactgtcccttgaaaaaaa

SEQ ID NO: 50823 - DNA, 20 bp, Artificial Sequence
  chemically synthesized
taatcagtactatttttttc

SEQ ID NO: 50824 - DNA, 20 bp, Artificial Sequence
  chemically synthesized
aatcagtactatttttttca

SEQ ID NO: 50825 - DNA, 20 bp, Artificial Sequence
  chemically synthesized
atcagtactatttttttcaa

SEQ ID NO: 50826 - DNA, 20 bp, Artificial Sequence
  chemically synthesized
gtactatttttttcaaggga

SEQ ID NO: 50827 - DNA, 20 bp, Artificial Sequence
  chemically synthesized
taaaacattaatgttatatt

SEQ ID NO: 50828 - DNA, 20 bp, Artificial Sequence
  chemically synthesized
ttaaaacattaatgttatat

SEQ ID NO: 50829 - DNA, 20 bp, Artificial Sequence
  chemically synthesized
aatataacattaatgtttta

SEQ ID NO: 50830 - DNA, 20 bp, Artificial Sequence
  chemically synthesized
cattaatgttttaaagaacc

SEQ ID NO: 50831 - DNA, 20 bp, Artificial Sequence
  chemically synthesized
atgttttaaagaacctggct

SEQ ID NO: 50832 - DNA, 20 bp, Artificial Sequence
  chemically synthesized
aaaagaatattttccaagcc

SEQ ID NO: 50833 - DNA, 20 bp, Artificial Sequence
  chemically synthesized
taaaagaatattttccaagc

SEQ ID NO: 50834 - DNA, 20 bp, Artificial Sequence
  chemically synthesized
cccttaaaagaatattttcc

SEQ ID NO: 50835 - DNA, 20 bp, Artificial Sequence
  chemically synthesized
ggcttggaaaatattctttt

SEQ ID NO: 50836 - DNA, 20 bp, Artificial Sequence
  chemically synthesized
gcttggaaaatattctttta

SEQ ID NO: 50837 - DNA, 20 bp, Artificial Sequence
  chemically synthesized
cttggaaaatattcttttaa

SEQ ID NO: 50838 - DNA, 20 bp, Artificial Sequence
  chemically synthesized
aagttccagaggtcccttaa

SEQ ID NO: 50839 - DNA, 20 bp, Artificial Sequence
  chemically synthesized
atattcttttaagggacctc

SEQ ID NO: 50840 - DNA, 20 bp, Artificial Sequence
  chemically synthesized
taatattttacaagttccag

SEQ ID NO: 50841 - DNA, 20 bp, Artificial Sequence
  chemically synthesized
ttaatattttacaagttcca

SEQ ID NO: 50842 - DNA, 20 bp, Artificial Sequence
  chemically synthesized
tcttaatattttacaagttc

SEQ ID NO: 50843 - DNA, 20 bp, Artificial Sequence
  chemically synthesized
tggttttcttaatattttac

SEQ ID NO: 50844 - DNA, 20 bp, Artificial Sequence
  chemically synthesized
tctggaacttgtaaaatatt

SEQ ID NO: 50845 - DNA, 20 bp, Artificial Sequence
  chemically synthesized
gtaaaatattaagaaaacca

SEQ ID NO: 50846 - DNA, 20 bp, Artificial Sequence
  chemically synthesized
ataacagtaaaaagaatcca

SEQ ID NO: 50847 - DNA, 20 bp, Artificial Sequence
  chemically synthesized
aatcattctataacagtaaa

SEQ ID NO: 50848 - DNA, 20 bp, Artificial Sequence
  chemically synthesized
atggattctttttactgtta

SEQ ID NO: 50849 - DNA, 20 bp, Artificial Sequence
  chemically synthesized
agggagaaatcattctataa

SEQ ID NO: 50850 - DNA, 20 bp, Artificial Sequence
  chemically synthesized
actatatatttgggtaaagg

SEQ ID NO: 50851 - DNA, 20 bp, Artificial Sequence
  chemically synthesized
tcactatatatttgggtaaa

SEQ ID NO: 50852 - DNA, 20 bp, Artificial Sequence
  chemically synthesized
atcactatatatttgggtaa

SEQ ID NO: 50853 - DNA, 20 bp, Artificial Sequence
  chemically synthesized
gatcactatatatttgggta

SEQ ID NO: 50854 - DNA, 20 bp, Artificial Sequence
  chemically synthesized
tctccctttacccaaatata

SEQ ID NO: 50855 - DNA, 20 bp, Artificial Sequence
  chemically synthesized
agaaagatcactatatattt

SEQ ID NO: 50856 - DNA, 20 bp, Artificial Sequence
  chemically synthesized
aagaaagatcactatatatt

SEQ ID NO: 50857 - DNA, 20 bp, Artificial Sequence
  chemically synthesized
aaatatatagtgatctttct

SEQ ID NO: 50858 - DNA, 20 bp, Artificial Sequence
  chemically synthesized
atatagtgatctttcttggt

SEQ ID NO: 50859 - DNA, 20 bp, Artificial Sequence
  chemically synthesized
ttctacttttctcaccaaga

SEQ ID NO: 50860 - DNA, 20 bp, Artificial Sequence
  chemically synthesized
taaattctacttttctcacc

SEQ ID NO: 50861 - DNA, 20 bp, Artificial Sequence
  chemically synthesized
gtgatctttcttggtgagaa

SEQ ID NO: 50862 - DNA, 20 bp, Artificial Sequence
  chemically synthesized
atctttcttggtgagaaaag

SEQ ID NO: 50863 - DNA, 20 bp, Artificial Sequence
  chemically synthesized
ttggtgagaaaagtagaatt

SEQ ID NO: 50864 - DNA, 20 bp, Artificial Sequence
  chemically synthesized
gagaaaagtagaatttagaa

SEQ ID NO: 50865 - DNA, 20 bp, Artificial Sequence
  chemically synthesized
aaaagtagaatttagaacag

SEQ ID NO: 50866 - DNA, 20 bp, Artificial Sequence
  chemically synthesized
tagaatttagaacagaagac

SEQ ID NO: 50867 - DNA, 20 bp, Artificial Sequence
  chemically synthesized
gaatttagaacagaagacca

SEQ ID NO: 50868 - DNA, 20 bp, Artificial Sequence
  chemically synthesized
tgaccattatttcaattctc

SEQ ID NO: 50869 - DNA, 20 bp, Artificial Sequence
  chemically synthesized
agaccagagaattgaaataa

SEQ ID NO: 50870 - DNA, 20 bp, Artificial Sequence
  chemically synthesized
cagagaattgaaataatggt

SEQ ID NO: 50871 - DNA, 20 bp, Artificial Sequence
  chemically synthesized
agagaattgaaataatggtc

SEQ ID NO: 50872 - DNA, 20 bp, Artificial Sequence
  chemically synthesized
tgtctcaaaaaaagaattta

SEQ ID NO: 50873 - DNA, 20 bp, Artificial Sequence
  chemically synthesized
aatctttaaattcttttttt

SEQ ID NO: 50874 - DNA, 20 bp, Artificial Sequence
  chemically synthesized
gagagactctgtctcaaaaa

SEQ ID NO: 50875 - DNA, 20 bp, Artificial Sequence
  chemically synthesized
tttaaattctttttttgaga

SEQ ID NO: 50876 - DNA, 20 bp, Artificial Sequence
  chemically synthesized
taaattctttttttgagaca

SEQ ID NO: 50877 - DNA, 20 bp, Artificial Sequence
  chemically synthesized
tccagcctgggtgatagaga

SEQ ID NO: 50878 - DNA, 20 bp, Artificial Sequence
  chemically synthesized
agtccagcctgggtgataga

SEQ ID NO: 50879 - DNA, 20 bp, Artificial Sequence
  chemically synthesized
cagagtctctctctatcacc

SEQ ID NO: 50880 - DNA, 20 bp, Artificial Sequence
  chemically synthesized
gcagtccagcctgggtgata

SEQ ID NO: 50881 - DNA, 20 bp, Artificial Sequence
  chemically synthesized
agagtctctctctatcaccc

SEQ ID NO: 50882 - DNA, 20 bp, Artificial Sequence
  chemically synthesized
ctgcagtccagcctgggtga

SEQ ID NO: 50883 - DNA, 20 bp, Artificial Sequence
  chemically synthesized
tctctctctatcacccaggc

SEQ ID NO: 50884 - DNA, 20 bp, Artificial Sequence
  chemically synthesized
atgccactgcagtccagcct

SEQ ID NO: 50885 - DNA, 20 bp, Artificial Sequence
  chemically synthesized
catgccactgcagtccagcc

SEQ ID NO: 50886 - DNA, 20 bp, Artificial Sequence
  chemically synthesized
ctatcacccaggctggactg

SEQ ID NO: 50887 - DNA, 20 bp, Artificial Sequence
  chemically synthesized
gagatcatgccactgcagtc

SEQ ID NO: 50888 - DNA, 20 bp, Artificial Sequence
  chemically synthesized
tcacccaggctggactgcag

SEQ ID NO: 50889 - DNA, 20 bp, Artificial Sequence
  chemically synthesized
gagctgagatcatgccactg

SEQ ID NO: 50890 - DNA, 20 bp, Artificial Sequence
  chemically synthesized
ggactgcagtggcatgatct

SEQ ID NO: 50891 - DNA, 20 bp, Artificial Sequence
  chemically synthesized
ggtggaggttgcagtgagct

SEQ ID NO: 50892 - DNA, 20 bp, Artificial Sequence
  chemically synthesized
ctggaggtggaggttgcagt

SEQ ID NO: 50893 - DNA, 20 bp, Artificial Sequence
  chemically synthesized
aaccctggaggtggaggttg

SEQ ID NO: 50894 - DNA, 20 bp, Artificial Sequence
  chemically synthesized
ctcactgcaacctccacctc

SEQ ID NO: 50895 - DNA, 20 bp, Artificial Sequence
  chemically synthesized
ggcttgaaccctggaggtgg

SEQ ID NO: 50896 - DNA, 20 bp, Artificial Sequence
  chemically synthesized
tcactgcaacctccacctcc

SEQ ID NO: 50897 - DNA, 20 bp, Artificial Sequence
  chemically synthesized
tggcttgaaccctggaggtg

SEQ ID NO: 50898 - DNA, 20 bp, Artificial Sequence
  chemically synthesized
cactgcaacctccacctcca

SEQ ID NO: 50899 - DNA, 20 bp, Artificial Sequence
  chemically synthesized
aatggcttgaaccctggagg

SEQ ID NO: 50900 - DNA, 20 bp, Artificial Sequence
  chemically synthesized
gagaatggcttgaaccctgg

SEQ ID NO: 50901 - DNA, 20 bp, Artificial Sequence
  chemically synthesized
ggagaatggcttgaaccctg

SEQ ID NO: 50902 - DNA, 20 bp, Artificial Sequence
  chemically synthesized
aacctccacctccagggttc

SEQ ID NO: 50903 - DNA, 20 bp, Artificial Sequence
  chemically synthesized
caggagaatggcttgaaccc

SEQ ID NO: 50904 - DNA, 20 bp, Artificial Sequence
  chemically synthesized
aggaggctgaggcaggagaa

SEQ ID NO: 50905 - DNA, 20 bp, Artificial Sequence
  chemically synthesized
ttcaagccattctcctgcct

SEQ ID NO: 50906 - DNA, 20 bp, Artificial Sequence
  chemically synthesized
tgcttaggaggctgaggcag

SEQ ID NO: 50907 - DNA, 20 bp, Artificial Sequence
  chemically synthesized
gctgcttaggaggctgaggc

SEQ ID NO: 50908 - DNA, 20 bp, Artificial Sequence
  chemically synthesized
agctgcttaggaggctgagg

SEQ ID NO: 50909 - DNA, 20 bp, Artificial Sequence
  chemically synthesized
cccagctgcttaggaggctg

SEQ ID NO: 50910 - DNA, 20 bp, Artificial Sequence
  chemically synthesized
tcccagctgcttaggaggct

SEQ ID NO: 50911 - DNA, 20 bp, Artificial Sequence
  chemically synthesized
ttctcctgcctcagcctcct

SEQ ID NO: 50912 - DNA, 20 bp, Artificial Sequence
  chemically synthesized
tcctgcctcagcctcctaag

SEQ ID NO: 50913 - DNA, 20 bp, Artificial Sequence
  chemically synthesized
tgtaatcccagctgcttagg

SEQ ID NO: 50914 - DNA, 20 bp, Artificial Sequence
  chemically synthesized
ctgtaatcccagctgcttag

SEQ ID NO: 50915 - DNA, 20 bp, Artificial Sequence
  chemically synthesized
gcctcagcctcctaagcagc

SEQ ID NO: 50916 - DNA, 20 bp, Artificial Sequence
  chemically synthesized
gcctgtaatcccagctgctt

SEQ ID NO: 50917 - DNA, 20 bp, Artificial Sequence
  chemically synthesized
cctcagcctcctaagcagct

SEQ ID NO: 50918 - DNA, 20 bp, Artificial Sequence
  chemically synthesized
cgcctgtaatcccagctgct

SEQ ID NO: 50919 - DNA, 20 bp, Artificial Sequence
  chemically synthesized
ctcctaagcagctgggatta

SEQ ID NO: 50920 - DNA, 20 bp, Artificial Sequence
  chemically synthesized
tcctaagcagctgggattac

SEQ ID NO: 50921 - DNA, 20 bp, Artificial Sequence
  chemically synthesized
gtggcactcgcctgtaatcc

SEQ ID NO: 50922 - DNA, 20 bp, Artificial Sequence
  chemically synthesized
aagcagctgggattacaggc

SEQ ID NO: 50923 - DNA, 20 bp, Artificial Sequence
  chemically synthesized
caggcgagtgccaccacgcc

SEQ ID NO: 50924 - DNA, 20 bp, Artificial Sequence
  chemically synthesized
caaaaattagctgggcgtgg

SEQ ID NO: 50925 - DNA, 20 bp, Artificial Sequence
  chemically synthesized
atacaaaaattagctgggcg

SEQ ID NO: 50926 - DNA, 20 bp, Artificial Sequence
  chemically synthesized
taaaaatacaaaaattagct

SEQ ID NO: 50927 - DNA, 20 bp, Artificial Sequence
  chemically synthesized
ctaaaaatacaaaaattagc

SEQ ID NO: 50928 - DNA, 20 bp, Artificial Sequence
  chemically synthesized
tgtactaaaaatacaaaaat

SEQ ID NO: 50929 - DNA, 20 bp, Artificial Sequence
  chemically synthesized
ccagctaatttttgtatttt

SEQ ID NO: 50930 - DNA, 20 bp, Artificial Sequence
  chemically synthesized
taatttttgtatttttagta

SEQ ID NO: 50931 - DNA, 20 bp, Artificial Sequence
  chemically synthesized
ttttgtatttttagtacaga

SEQ ID NO: 50932 - DNA, 20 bp, Artificial Sequence
  chemically synthesized
tttgtatttttagtacagat

SEQ ID NO: 50933 - DNA, 20 bp, Artificial Sequence
  chemically synthesized
ttgtatttttagtacagatg

SEQ ID NO: 50934 - DNA, 20 bp, Artificial Sequence
  chemically synthesized
tgtatttttagtacagatgg

SEQ ID NO: 50935 - DNA, 20 bp, Artificial Sequence
  chemically synthesized
agtacagatgggggtttcac

SEQ ID NO: 50936 - DNA, 20 bp, Artificial Sequence
  chemically synthesized
gtacagatgggggtttcacc

SEQ ID NO: 50937 - DNA, 20 bp, Artificial Sequence
  chemically synthesized
agatgggggtttcaccaggt

SEQ ID NO: 50938 - DNA, 20 bp, Artificial Sequence
  chemically synthesized
gggggtttcaccaggttggc

SEQ ID NO: 50939 - DNA, 20 bp, Artificial Sequence
  chemically synthesized
caagaccagcctggccaacc

SEQ ID NO: 50940 - DNA, 20 bp, Artificial Sequence
  chemically synthesized
ggggtttcaccaggttggcc

SEQ ID NO: 50941 - DNA, 20 bp, Artificial Sequence
  chemically synthesized
tttcaccaggttggccaggc

SEQ ID NO: 50942 - DNA, 20 bp, Artificial Sequence
  chemically synthesized
tcaggagttcaagaccagcc

SEQ ID NO: 50943 - DNA, 20 bp, Artificial Sequence
  chemically synthesized
tgaggtcaggagttcaagac

SEQ ID NO: 50944 - DNA, 20 bp, Artificial Sequence
  chemically synthesized
tcacttgaggtcaggagttc

SEQ ID NO: 50945 - DNA, 20 bp, Artificial Sequence
  chemically synthesized
ggcagatcacttgaggtcag

SEQ ID NO: 50946 - DNA, 20 bp, Artificial Sequence
  chemically synthesized
ggtcttgaactcctgacctc

SEQ ID NO: 50947 - DNA, 20 bp, Artificial Sequence
  chemically synthesized
tgggcagatcacttgaggtc

SEQ ID NO: 50948 - DNA, 20 bp, Artificial Sequence
  chemically synthesized
gtgggcagatcacttgaggt

SEQ ID NO: 50949 - DNA, 20 bp, Artificial Sequence
  chemically synthesized
tgaggtgggcagatcacttg

SEQ ID NO: 50950 - DNA, 20 bp, Artificial Sequence
  chemically synthesized
ctgaggtgggcagatcactt

SEQ ID NO: 50951 - DNA, 20 bp, Artificial Sequence
  chemically synthesized
ctcaagtgatctgcccacct

SEQ ID NO: 50952 - DNA, 20 bp, Artificial Sequence
  chemically synthesized
ctttgggaggctgaggtggg

SEQ ID NO: 50953 - DNA, 20 bp, Artificial Sequence
  chemically synthesized
tcactttgggaggctgaggt

SEQ ID NO: 50954 - DNA, 20 bp, Artificial Sequence
  chemically synthesized
atcactttgggaggctgagg

SEQ ID NO: 50955 - DNA, 20 bp, Artificial Sequence
  chemically synthesized
cccatcactttgggaggctg

SEQ ID NO: 50956 - DNA, 20 bp, Artificial Sequence
  chemically synthesized
tcccatcactttgggaggct

SEQ ID NO: 50957 - DNA, 20 bp, Artificial Sequence
  chemically synthesized
ctgcccacctcagcctccca

SEQ ID NO: 50958 - DNA, 20 bp, Artificial Sequence
  chemically synthesized
tgtaatcccatcactttggg

SEQ ID NO: 50959 - DNA, 20 bp, Artificial Sequence
  chemically synthesized
ctgtaatcccatcactttgg

SEQ ID NO: 50960 - DNA, 20 bp, Artificial Sequence
  chemically synthesized
acctcagcctcccaaagtga

SEQ ID NO: 50961 - DNA, 20 bp, Artificial Sequence
  chemically synthesized
acctgtaatcccatcacttt

SEQ ID NO: 50962 - DNA, 20 bp, Artificial Sequence
  chemically synthesized
cctcagcctcccaaagtgat

SEQ ID NO: 50963 - DNA, 20 bp, Artificial Sequence
  chemically synthesized
cacctgtaatcccatcactt

SEQ ID NO: 50964 - DNA, 20 bp, Artificial Sequence
  chemically synthesized
ctcccaaagtgatgggatta

SEQ ID NO: 50965 - DNA, 20 bp, Artificial Sequence
  chemically synthesized
tcccaaagtgatgggattac

SEQ ID NO: 50966 - DNA, 20 bp, Artificial Sequence
  chemically synthesized
agtgatgggattacaggtgt

SEQ ID NO: 50967 - DNA, 20 bp, Artificial Sequence
  chemically synthesized
taaagatttgttgggcgtgg

SEQ ID NO: 50968 - DNA, 20 bp, Artificial Sequence
  chemically synthesized
gtttaaagatttgttgggcg

SEQ ID NO: 50969 - DNA, 20 bp, Artificial Sequence
  chemically synthesized
gaagagtttaaagatttgtt

SEQ ID NO: 50970 - DNA, 20 bp, Artificial Sequence
  chemically synthesized
tgaagagtttaaagatttgt

SEQ ID NO: 50971 - DNA, 20 bp, Artificial Sequence
  chemically synthesized
cttttcttttgaagagttta

SEQ ID NO: 50972 - DNA, 20 bp, Artificial Sequence
  chemically synthesized
caaatctttaaactcttcaa

SEQ ID NO: 50973 - DNA, 20 bp, Artificial Sequence
  chemically synthesized
aattgtccttttcttttgaa

SEQ ID NO: 50974 - DNA, 20 bp, Artificial Sequence
  chemically synthesized
aaaattgtccttttcttttg

SEQ ID NO: 50975 - DNA, 20 bp, Artificial Sequence
  chemically synthesized
ctttaaactcttcaaaagaa

SEQ ID NO: 50976 - DNA, 20 bp, Artificial Sequence
  chemically synthesized
tttaaactcttcaaaagaaa

SEQ ID NO: 50977 - DNA, 20 bp, Artificial Sequence
  chemically synthesized
caaaagaaaaggacaatttt

SEQ ID NO: 50978 - DNA, 20 bp, Artificial Sequence
  chemically synthesized
gtattcattggttggcatag

SEQ ID NO: 50979 - DNA, 20 bp, Artificial Sequence
  chemically synthesized
aaagtattcattggttggca

SEQ ID NO: 50980 - DNA, 20 bp, Artificial Sequence
  chemically synthesized
gtactaaagtattcattggt

SEQ ID NO: 50981 - DNA, 20 bp, Artificial Sequence
  chemically synthesized
gaaagtactaaagtattcat

SEQ ID NO: 50982 - DNA, 20 bp, Artificial Sequence
  chemically synthesized
atgccaaccaatgaatactt

SEQ ID NO: 50983 - DNA, 20 bp, Artificial Sequence
  chemically synthesized
ctgtgattaagaaagtacta

SEQ ID NO: 50984 - DNA, 20 bp, Artificial Sequence
  chemically synthesized
tcatatgtctgtgattaaga

SEQ ID NO: 50985 - DNA, 20 bp, Artificial Sequence
  chemically synthesized
ctttagtactttcttaatca

SEQ ID NO: 50986 - DNA, 20 bp, Artificial Sequence
  chemically synthesized
ctcttcatatgtctgtgatt

SEQ ID NO: 50987 - DNA, 20 bp, Artificial Sequence
  chemically synthesized
ttcttaatcacagacatatg

SEQ ID NO: 50988 - DNA, 20 bp, Artificial Sequence
  chemically synthesized
cttaatcacagacatatgaa

SEQ ID NO: 50989 - DNA, 20 bp, Artificial Sequence
  chemically synthesized
ataattggtaggtatattgt

SEQ ID NO: 50990 - DNA, 20 bp, Artificial Sequence
  chemically synthesized
gttatatatgtataattggt

SEQ ID NO: 50991 - DNA, 20 bp, Artificial Sequence
  chemically synthesized
agttatatatgtataattgg

SEQ ID NO: 50992 - DNA, 20 bp, Artificial Sequence
  chemically synthesized
tatagttatatatgtataat

SEQ ID NO: 50993 - DNA, 20 bp, Artificial Sequence
  chemically synthesized
atacatatataactataaat

SEQ ID NO: 50994 - DNA, 20 bp, Artificial Sequence
  chemically synthesized
ttaaattatatactaattta

SEQ ID NO: 50995 - DNA, 20 bp, Artificial Sequence
  chemically synthesized
gtaaattatatacatatttg

SEQ ID NO: 50996 - DNA, 20 bp, Artificial Sequence
  chemically synthesized
catatttgaagtcacactat

SEQ ID NO: 50997 - DNA, 20 bp, Artificial Sequence
  chemically synthesized
agaaaaaggagaaattctaa

SEQ ID NO: 50998 - DNA, 20 bp, Artificial Sequence
  chemically synthesized
caacttaaaccaagaaaaag

SEQ ID NO: 50999 - DNA, 20 bp, Artificial Sequence
  chemically synthesized
ttagaatttctcctttttct

SEQ ID NO: 51000 - DNA, 20 bp, Artificial Sequence
  chemically synthesized
tacaacttaaaccaagaaaa

SEQ ID NO: 51001 - DNA, 20 bp, Artificial Sequence
  chemically synthesized
ctacaacttaaaccaagaaa

SEQ ID NO: 51002 - DNA, 20 bp, Artificial Sequence
  chemically synthesized
tttctcctttttcttggttt

SEQ ID NO: 51003 - DNA, 20 bp, Artificial Sequence
  chemically synthesized
tgacttctacaacttaaacc

SEQ ID NO: 51004 - DNA, 20 bp, Artificial Sequence
  chemically synthesized
ctttttcttggtttaagttg

SEQ ID NO: 51005 - DNA, 20 bp, Artificial Sequence
  chemically synthesized
tttcttggtttaagttgtag

SEQ ID NO: 51006 - DNA, 20 bp, Artificial Sequence
  chemically synthesized
tttaagttgtagaagtcaat

SEQ ID NO: 51007 - DNA, 20 bp, Artificial Sequence
  chemically synthesized
ttaagttgtagaagtcaatt

SEQ ID NO: 51008 - DNA, 20 bp, Artificial Sequence
  chemically synthesized
aagttgtagaagtcaattag

SEQ ID NO: 51009 - DNA, 20 bp, Artificial Sequence
  chemically synthesized
ttgtagaagtcaattaggag

SEQ ID NO: 51010 - DNA, 20 bp, Artificial Sequence
  chemically synthesized
tagaagtcaattaggagtag

SEQ ID NO: 51011 - DNA, 20 bp, Artificial Sequence
  chemically synthesized
gagtagcagtgtattaaaac

SEQ ID NO: 51012 - DNA, 20 bp, Artificial Sequence
  chemically synthesized
tagcagtgtattaaaactag

SEQ ID NO: 51013 - DNA, 20 bp, Artificial Sequence
  chemically synthesized
agtgtattaaaactagaagt

SEQ ID NO: 51014 - DNA, 20 bp, Artificial Sequence
  chemically synthesized
gtgtattaaaactagaagta

SEQ ID NO: 51015 - DNA, 20 bp, Artificial Sequence
  chemically synthesized
cactaacttgtccttacttc

SEQ ID NO: 51016 - DNA, 20 bp, Artificial Sequence
  chemically synthesized
ttaaaactagaagtaaggac

SEQ ID NO: 51017 - DNA, 20 bp, Artificial Sequence
  chemically synthesized
aactagaagtaaggacaagt

SEQ ID NO: 51018 - DNA, 20 bp, Artificial Sequence
  chemically synthesized
aaggacaagttagtgtctat

SEQ ID NO: 51019 - DNA, 20 bp, Artificial Sequence
  chemically synthesized
gacaagttagtgtctatcag

SEQ ID NO: 51020 - DNA, 20 bp, Artificial Sequence
  chemically synthesized
caagttagtgtctatcagcg

SEQ ID NO: 51021 - DNA, 20 bp, Artificial Sequence
  chemically synthesized
atatgacccttctccgctga

SEQ ID NO: 51022 - DNA, 20 bp, Artificial Sequence
  chemically synthesized
gttagtgtctatcagcggag

SEQ ID NO: 51023 - DNA, 20 bp, Artificial Sequence
  chemically synthesized
ttagtgtctatcagcggaga

SEQ ID NO: 51024 - DNA, 20 bp, Artificial Sequence
  chemically synthesized
tagtgtctatcagcggagaa

SEQ ID NO: 51025 - DNA, 20 bp, Artificial Sequence
  chemically synthesized
aagagaaaatgagaagagaa

SEQ ID NO: 51026 - DNA, 20 bp, Artificial Sequence
  chemically synthesized
gatctaagagaaaatgagaa

SEQ ID NO: 51027 - DNA, 20 bp, Artificial Sequence
  chemically synthesized
tagatctaagagaaaatgag

SEQ ID NO: 51028 - DNA, 20 bp, Artificial Sequence
  chemically synthesized
tcttagatctaagagaaaat

SEQ ID NO: 51029 - DNA, 20 bp, Artificial Sequence
  chemically synthesized
tttctcttctcattttctct

SEQ ID NO: 51030 - DNA, 20 bp, Artificial Sequence
  chemically synthesized
ttcttttatcttagatctaa

SEQ ID NO: 51031 - DNA, 20 bp, Artificial Sequence
  chemically synthesized
tctcattttctcttagatct

SEQ ID NO: 51032 - DNA, 20 bp, Artificial Sequence
  chemically synthesized
ttttcttttatcttagatct

SEQ ID NO: 51033 - DNA, 20 bp, Artificial Sequence
  chemically synthesized
ttctcttagatctaagataa

SEQ ID NO: 51034 - DNA, 20 bp, Artificial Sequence
  chemically synthesized
agaaattttttcttttatct

SEQ ID NO: 51035 - DNA, 20 bp, Artificial Sequence
  chemically synthesized
gaaaaaatttctttaacatg

SEQ ID NO: 51036 - DNA, 20 bp, Artificial Sequence
  chemically synthesized
ggcccaatctctacatgtta

SEQ ID NO: 51037 - DNA, 20 bp, Artificial Sequence
  chemically synthesized
aaaaatttctttaacatgta

SEQ ID NO: 51038 - DNA, 20 bp, Artificial Sequence
  chemically synthesized
tttctttaacatgtagagat

SEQ ID NO: 51039 - DNA, 20 bp, Artificial Sequence
  chemically synthesized
ttctttaacatgtagagatt

SEQ ID NO: 51040 - DNA, 20 bp, Artificial Sequence
  chemically synthesized
acatgtagagattgggccac

SEQ ID NO: 51041 - DNA, 20 bp, Artificial Sequence
  chemically synthesized
catgtagagattgggccacc

SEQ ID NO: 51042 - DNA, 20 bp, Artificial Sequence
  chemically synthesized
gtagagattgggccaccagg

SEQ ID NO: 51043 - DNA, 20 bp, Artificial Sequence
  chemically synthesized
aattcactgtttcttcctgg

SEQ ID NO: 51044 - DNA, 20 bp, Artificial Sequence
  chemically synthesized
aagaattcactgtttcttcc

SEQ ID NO: 51045 - DNA, 20 bp, Artificial Sequence
  chemically synthesized
attgggccaccaggaagaaa

SEQ ID NO: 51046 - DNA, 20 bp, Artificial Sequence
  chemically synthesized
aaacagtgaattcttttttt

SEQ ID NO: 51047 - DNA, 20 bp, Artificial Sequence
  chemically synthesized
ggcagccttttactaaaaaa

SEQ ID NO: 51048 - DNA, 20 bp, Artificial Sequence
  chemically synthesized
tgaattcttttttttagtaa

SEQ ID NO: 51049 - DNA, 20 bp, Artificial Sequence
  chemically synthesized
gaattcttttttttagtaaa

SEQ ID NO: 51050 - DNA, 20 bp, Artificial Sequence
  chemically synthesized
tgtttatcagaagacagagg

SEQ ID NO: 51051 - DNA, 20 bp, Artificial Sequence
  chemically synthesized
tgttgtttatcagaagacag

SEQ ID NO: 51052 - DNA, 20 bp, Artificial Sequence
  chemically synthesized
ctgttgtttatcagaagaca

SEQ ID NO: 51053 - DNA, 20 bp, Artificial Sequence
  chemically synthesized
gtctgttgtttatcagaaga

SEQ ID NO: 51054 - DNA, 20 bp, Artificial Sequence
  chemically synthesized
agctgtctgttgtttatcag

SEQ ID NO: 51055 - DNA, 20 bp, Artificial Sequence
  chemically synthesized
accagctgtctgttgtttat

SEQ ID NO: 51056 - DNA, 20 bp, Artificial Sequence
  chemically synthesized
ctctgtcttctgataaacaa

SEQ ID NO: 51057 - DNA, 20 bp, Artificial Sequence
  chemically synthesized
gtcttctgataaacaacaga

SEQ ID NO: 51058 - DNA, 20 bp, Artificial Sequence
  chemically synthesized
tctgataaacaacagacagc

SEQ ID NO: 51059 - DNA, 20 bp, Artificial Sequence
  chemically synthesized
ttatttggaaattacattac

SEQ ID NO: 51060 - DNA, 20 bp, Artificial Sequence
  chemically synthesized
actcccctttggaaattatt

SEQ ID NO: 51061 - DNA, 20 bp, Artificial Sequence
  chemically synthesized
taatttccaaataatttcca

SEQ ID NO: 51062 - DNA, 20 bp, Artificial Sequence
  chemically synthesized
aatttccaaataatttccaa

SEQ ID NO: 51063 - DNA, 20 bp, Artificial Sequence
  chemically synthesized
atttccaaataatttccaaa

SEQ ID NO: 51064 - DNA, 20 bp, Artificial Sequence
  chemically synthesized
tttccaaataatttccaaag

SEQ ID NO: 51065 - DNA, 20 bp, Artificial Sequence
  chemically synthesized
tccaaataatttccaaaggg

SEQ ID NO: 51066 - DNA, 20 bp, Artificial Sequence
  chemically synthesized
cacacacacacactcccctt

SEQ ID NO: 51067 - DNA, 20 bp, Artificial Sequence
  chemically synthesized
gtgtgtgtgtgtgtgtgtgt

SEQ ID NO: 51068 - DNA, 20 bp, Artificial Sequence
  chemically synthesized
gtgtgtgtgtgtgtgtgtga

SEQ ID NO: 51069 - DNA, 20 bp, Artificial Sequence
  chemically synthesized
gtgtgtgtgtgtgtgtgaga

SEQ ID NO: 51070 - DNA, 20 bp, Artificial Sequence
  chemically synthesized
gtgtgtgtgtgtgtgagaga

SEQ ID NO: 51071 - DNA, 20 bp, Artificial Sequence
  chemically synthesized
gtgtgtgtgtgtgagagaga

SEQ ID NO: 51072 - DNA, 20 bp, Artificial Sequence
  chemically synthesized
gtgtgtgtgtgagagagaga

SEQ ID NO: 51073 - DNA, 20 bp, Artificial Sequence
  chemically synthesized
gtgtgtgtgagagagagaga

SEQ ID NO: 51074 - DNA, 20 bp, Artificial Sequence
  chemically synthesized
gtgtgtgagagagagagaga

SEQ ID NO: 51075 - DNA, 20 bp, Artificial Sequence
  chemically synthesized
gtgtgagagagagagagaga

SEQ ID NO: 51076 - DNA, 20 bp, Artificial Sequence
  chemically synthesized
gtgagagagagagagagaga

SEQ ID NO: 51077 - DNA, 20 bp, Artificial Sequence
  chemically synthesized
gagagagtgcacacacgtgc

SEQ ID NO: 51078 - DNA, 20 bp, Artificial Sequence
  chemically synthesized
gagtgcacacacgtgcgaga

SEQ ID NO: 51079 - DNA, 20 bp, Artificial Sequence
  chemically synthesized
gtgcacacacgtgcgagaca

SEQ ID NO: 51080 - DNA, 20 bp, Artificial Sequence
  chemically synthesized
gcacacacgtgcgagacaga

SEQ ID NO: 51081 - DNA, 20 bp, Artificial Sequence
  chemically synthesized
acacacgtgcgagacagaga

SEQ ID NO: 51082 - DNA, 20 bp, Artificial Sequence
  chemically synthesized
acacgtgcgagacagagaga

SEQ ID NO: 51083 - DNA, 20 bp, Artificial Sequence
  chemically synthesized
acgtgcgagacagagagaga

SEQ ID NO: 51084 - DNA, 20 bp, Artificial Sequence
  chemically synthesized
gtgcgagacagagagagaga

SEQ ID NO: 51085 - DNA, 20 bp, Artificial Sequence
  chemically synthesized
gacagagagagagagagaat

SEQ ID NO: 51086 - DNA, 20 bp, Artificial Sequence
  chemically synthesized
gagagagagaataagataaa

SEQ ID NO: 51087 - DNA, 20 bp, Artificial Sequence
  chemically synthesized
gagagagaataagataaaca

SEQ ID NO: 51088 - DNA, 20 bp, Artificial Sequence
  chemically synthesized
gagaataagataaacagaga

SEQ ID NO: 51089 - DNA, 20 bp, Artificial Sequence
  chemically synthesized
ataagataaacagagacagt

SEQ ID NO: 51090 - DNA, 20 bp, Artificial Sequence
  chemically synthesized
gacagtaagcatgtttacgc

SEQ ID NO: 51091 - DNA, 20 bp, Artificial Sequence
  chemically synthesized
agtaagcatgtttacgctgg

SEQ ID NO: 51092 - DNA, 20 bp, Artificial Sequence
  chemically synthesized
gtaagcatgtttacgctggc

SEQ ID NO: 51093 - DNA, 20 bp, Artificial Sequence
  chemically synthesized
gaactactaattgcacccgc

SEQ ID NO: 51094 - DNA, 20 bp, Artificial Sequence
  chemically synthesized
tttacgctggcgggtgcaat

SEQ ID NO: 51095 - DNA, 20 bp, Artificial Sequence
  chemically synthesized
acgctggcgggtgcaattag

SEQ ID NO: 51096 - DNA, 20 bp, Artificial Sequence
  chemically synthesized
caaagaaaagaaaaataagg

SEQ ID NO: 51097 - DNA, 20 bp, Artificial Sequence
  chemically synthesized
acaaagaaaagaaaaataag

SEQ ID NO: 51098 - DNA, 20 bp, Artificial Sequence
  chemically synthesized
ttacaaagaaaagaaaaata

SEQ ID NO: 51099 - DNA, 20 bp, Artificial Sequence
  chemically synthesized
attacaaagaaaagaaaaat

SEQ ID NO: 51100 - DNA, 20 bp, Artificial Sequence
  chemically synthesized
agcttagaaattacaaagaa

SEQ ID NO: 51101 - DNA, 20 bp, Artificial Sequence
  chemically synthesized
cctaaagcttagaaattaca

SEQ ID NO: 51102 - DNA, 20 bp, Artificial Sequence
  chemically synthesized
ttcttttctttgtaatttct

SEQ ID NO: 51103 - DNA, 20 bp, Artificial Sequence
  chemically synthesized
tctttgtaatttctaagctt

SEQ ID NO: 51104 - DNA, 20 bp, Artificial Sequence
  chemically synthesized
ctttgtaatttctaagcttt

SEQ ID NO: 51105 - DNA, 20 bp, Artificial Sequence
  chemically synthesized
atagggtggctcctaaagct

SEQ ID NO: 51106 - DNA, 20 bp, Artificial Sequence
  chemically synthesized
ttgtaatttctaagctttag

SEQ ID NO: 51107 - DNA, 20 bp, Artificial Sequence
  chemically synthesized
taataatagggtggctccta

SEQ ID NO: 51108 - DNA, 20 bp, Artificial Sequence
  chemically synthesized
tactataaataataataggg

SEQ ID NO: 51109 - DNA, 20 bp, Artificial Sequence
  chemically synthesized
ggttactataaataataata

SEQ ID NO: 51110 - DNA, 20 bp, Artificial Sequence
  chemically synthesized
aggttactataaataataat

SEQ ID NO: 51111 - DNA, 20 bp, Artificial Sequence
  chemically synthesized
caggttactataaataataa

SEQ ID NO: 51112 - DNA, 20 bp, Artificial Sequence
  chemically synthesized
agccaccctattattattta

SEQ ID NO: 51113 - DNA, 20 bp, Artificial Sequence
  chemically synthesized
tattatttatagtaacctga

SEQ ID NO: 51114 - DNA, 20 bp, Artificial Sequence
  chemically synthesized
atgtttagtaatgtgctttc

SEQ ID NO: 51115 - DNA, 20 bp, Artificial Sequence
  chemically synthesized
catgtttagtaatgtgcttt

SEQ ID NO: 51116 - DNA, 20 bp, Artificial Sequence
  chemically synthesized
ggcctgagttgatacatgtt

SEQ ID NO: 51117 - DNA, 20 bp, Artificial Sequence
  chemically synthesized
ttactaaacatgtatcaact

SEQ ID NO: 51118 - DNA, 20 bp, Artificial Sequence
  chemically synthesized
tactaaacatgtatcaactc

SEQ ID NO: 51119 - DNA, 20 bp, Artificial Sequence
  chemically synthesized
acttttttttagacaggcct

SEQ ID NO: 51120 - DNA, 20 bp, Artificial Sequence
  chemically synthesized
attgatacttttttttagac

SEQ ID NO: 51121 - DNA, 20 bp, Artificial Sequence
  chemically synthesized
aattgatacttttttttaga

SEQ ID NO: 51122 - DNA, 20 bp, Artificial Sequence
  chemically synthesized
actcaggcctgtctaaaaaa

SEQ ID NO: 51123 - DNA, 20 bp, Artificial Sequence
  chemically synthesized
tttgaattgatacttttttt

SEQ ID NO: 51124 - DNA, 20 bp, Artificial Sequence
  chemically synthesized
aaattcatttaatatgacct

SEQ ID NO: 51125 - DNA, 20 bp, Artificial Sequence
  chemically synthesized
attcatttaatatgacctta

SEQ ID NO: 51126 - DNA, 20 bp, Artificial Sequence
  chemically synthesized
ttcatttaatatgaccttag

SEQ ID NO: 51127 - DNA, 20 bp, Artificial Sequence
  chemically synthesized
atgttttaaatattcctcta

SEQ ID NO: 51128 - DNA, 20 bp, Artificial Sequence
  chemically synthesized
tatgttttaaatattcctct

SEQ ID NO: 51129 - DNA, 20 bp, Artificial Sequence
  chemically synthesized
taaaacatatttttattcat

SEQ ID NO: 51130 - DNA, 20 bp, Artificial Sequence
  chemically synthesized
aacatatttttattcattgg

SEQ ID NO: 51131 - DNA, 20 bp, Artificial Sequence
  chemically synthesized
acatatttttattcattggt

SEQ ID NO: 51132 - DNA, 20 bp, Artificial Sequence
  chemically synthesized
catatttttattcattggtg

SEQ ID NO: 51133 - DNA, 20 bp, Artificial Sequence
  chemically synthesized
atatttttattcattggtgg

SEQ ID NO: 51134 - DNA, 20 bp, Artificial Sequence
  chemically synthesized
tatttttattcattggtggg

SEQ ID NO: 51135 - DNA, 20 bp, Artificial Sequence
  chemically synthesized
ttttattcattggtgggggg

SEQ ID NO: 51136 - DNA, 20 bp, Artificial Sequence
  chemically synthesized
gtggggggaagctgctttta

SEQ ID NO: 51137 - DNA, 20 bp, Artificial Sequence
  chemically synthesized
cgtatttgctactataaaag

SEQ ID NO: 51138 - DNA, 20 bp, Artificial Sequence
  chemically synthesized
gggggaagctgcttttatag

SEQ ID NO: 51139 - DNA, 20 bp, Artificial Sequence
  chemically synthesized
tcacgtatttgctactataa

SEQ ID NO: 51140 - DNA, 20 bp, Artificial Sequence
  chemically synthesized
tagtagcaaatacgtgactt

SEQ ID NO: 51141 - DNA, 20 bp, Artificial Sequence
  chemically synthesized
gtagcaaatacgtgacttca

SEQ ID NO: 51142 - DNA, 20 bp, Artificial Sequence
  chemically synthesized
tttgaagcaggacatctctg

SEQ ID NO: 51143 - DNA, 20 bp, Artificial Sequence
  chemically synthesized
aaaatcaccatatttgaagc

SEQ ID NO: 51144 - DNA, 20 bp, Artificial Sequence
  chemically synthesized
aaaaatcaccatatttgaag

SEQ ID NO: 51145 - DNA, 20 bp, Artificial Sequence
  chemically synthesized
gagatgtcctgcttcaaata

SEQ ID NO: 51146 - DNA, 20 bp, Artificial Sequence
  chemically synthesized
aaaaaaaatcaccatatttg

SEQ ID NO: 51147 - DNA, 20 bp, Artificial Sequence
  chemically synthesized
tttttttttttttttaaatt

SEQ ID NO: 51148 - DNA, 20 bp, Artificial Sequence
  chemically synthesized
ttttttttttttttaaattt

SEQ ID NO: 51149 - DNA, 20 bp, Artificial Sequence
  chemically synthesized
tttttttttttttaaattta

SEQ ID NO: 51150 - DNA, 20 bp, Artificial Sequence
  chemically synthesized
tttttttttaaatttagggt

SEQ ID NO: 51151 - DNA, 20 bp, Artificial Sequence
  chemically synthesized
ttttttttaaatttagggtc

SEQ ID NO: 51152 - DNA, 20 bp, Artificial Sequence
  chemically synthesized
tttttttaaatttagggtca

SEQ ID NO: 51153 - DNA, 20 bp, Artificial Sequence
  chemically synthesized
tccaatctgtgtgacagagc

SEQ ID NO: 51154 - DNA, 20 bp, Artificial Sequence
  chemically synthesized
cagggtcttgctctgtcaca

SEQ ID NO: 51155 - DNA, 20 bp, Artificial Sequence
  chemically synthesized
gcactccaatctgtgtgaca

SEQ ID NO: 51156 - DNA, 20 bp, Artificial Sequence
  chemically synthesized
ccgcactccaatctgtgtga

SEQ ID NO: 51157 - DNA, 20 bp, Artificial Sequence
  chemically synthesized
tcttgctctgtcacacagat

SEQ ID NO: 51158 - DNA, 20 bp, Artificial Sequence
  chemically synthesized
ttgctctgtcacacagattg

SEQ ID NO: 51159 - DNA, 20 bp, Artificial Sequence
  chemically synthesized
ctgtcacacagattggagtg

SEQ ID NO: 51160 - DNA, 20 bp, Artificial Sequence
  chemically synthesized
tgtcacacagattggagtgc

SEQ ID NO: 51161 - DNA, 20 bp, Artificial Sequence
  chemically synthesized
gtcacacagattggagtgcg

SEQ ID NO: 51162 - DNA, 20 bp, Artificial Sequence
  chemically synthesized
tcacacagattggagtgcgg

SEQ ID NO: 51163 - DNA, 20 bp, Artificial Sequence
  chemically synthesized
cacacagattggagtgcggg

SEQ ID NO: 51164 - DNA, 20 bp, Artificial Sequence
  chemically synthesized
acacagattggagtgcgggg

SEQ ID NO: 51165 - DNA, 20 bp, Artificial Sequence
  chemically synthesized
cacagattggagtgcggggg

SEQ ID NO: 51166 - DNA, 20 bp, Artificial Sequence
  chemically synthesized
acagattggagtgcgggggg

SEQ ID NO: 51167 - DNA, 20 bp, Artificial Sequence
  chemically synthesized
gattggagtgcggggggggg

SEQ ID NO: 51168 - DNA, 20 bp, Artificial Sequence
  chemically synthesized
gtgcgggggggggtggatta

SEQ ID NO: 51169 - DNA, 20 bp, Artificial Sequence
  chemically synthesized
gggtggattatggatcactg

SEQ ID NO: 51170 - DNA, 20 bp, Artificial Sequence
  chemically synthesized
agcccaagaggtcaaggctg

SEQ ID NO: 51171 - DNA, 20 bp, Artificial Sequence
  chemically synthesized
cacttgagcccaagaggtca

SEQ ID NO: 51172 - DNA, 20 bp, Artificial Sequence
  chemically synthesized
tcactgcagccttgacctct

SEQ ID NO: 51173 - DNA, 20 bp, Artificial Sequence
  chemically synthesized
tcacttgagcccaagaggtc

SEQ ID NO: 51174 - DNA, 20 bp, Artificial Sequence
  chemically synthesized
cactgcagccttgacctctt

SEQ ID NO: 51175 - DNA, 20 bp, Artificial Sequence
  chemically synthesized
gaggatcacttgagcccaag

SEQ ID NO: 51176 - DNA, 20 bp, Artificial Sequence
  chemically synthesized
ggaggatcacttgagcccaa

SEQ ID NO: 51177 - DNA, 20 bp, Artificial Sequence
  chemically synthesized
agccttgacctcttgggctc

SEQ ID NO: 51178 - DNA, 20 bp, Artificial Sequence
  chemically synthesized
caggaggatcacttgagccc

SEQ ID NO: 51179 - DNA, 20 bp, Artificial Sequence
  chemically synthesized
ctgaggcaggaggatcactt

SEQ ID NO: 51180 - DNA, 20 bp, Artificial Sequence
  chemically synthesized
ctcaagtgatcctcctgcct

SEQ ID NO: 51181 - DNA, 20 bp, Artificial Sequence
  chemically synthesized
ctttgggaaactgaggcagg

SEQ ID NO: 51182 - DNA, 20 bp, Artificial Sequence
  chemically synthesized
tctttgggaaactgaggcag

SEQ ID NO: 51183 - DNA, 20 bp, Artificial Sequence
  chemically synthesized
attctttgggaaactgaggc

SEQ ID NO: 51184 - DNA, 20 bp, Artificial Sequence
  chemically synthesized
aattctttgggaaactgagg

SEQ ID NO: 51185 - DNA, 20 bp, Artificial Sequence
  chemically synthesized
cccaattctttgggaaactg

SEQ ID NO: 51186 - DNA, 20 bp, Artificial Sequence
  chemically synthesized
tcccaattctttgggaaact

SEQ ID NO: 51187 - DNA, 20 bp, Artificial Sequence
  chemically synthesized
cctcctgcctcagtttccca

SEQ ID NO: 51188 - DNA, 20 bp, Artificial Sequence
  chemically synthesized
gcctcagtttcccaaagaat

SEQ ID NO: 51189 - DNA, 20 bp, Artificial Sequence
  chemically synthesized
gcctataatcccaattcttt

SEQ ID NO: 51190 - DNA, 20 bp, Artificial Sequence
  chemically synthesized
cctcagtttcccaaagaatt

SEQ ID NO: 51191 - DNA, 20 bp, Artificial Sequence
  chemically synthesized
tgcctataatcccaattctt

SEQ ID NO: 51192 - DNA, 20 bp, Artificial Sequence
  chemically synthesized
ttcccaaagaattgggatta

SEQ ID NO: 51193 - DNA, 20 bp, Artificial Sequence
  chemically synthesized
tcccaaagaattgggattat

SEQ ID NO: 51194 - DNA, 20 bp, Artificial Sequence
  chemically synthesized
agaattgggattataggcat

SEQ ID NO: 51195 - DNA, 20 bp, Artificial Sequence
  chemically synthesized
tatttgagctaggcatggtg

SEQ ID NO: 51196 - DNA, 20 bp, Artificial Sequence
  chemically synthesized
ggcatgagccacaccatgcc

SEQ ID NO: 51197 - DNA, 20 bp, Artificial Sequence
  chemically synthesized
aaccgtatttgagctaggca

SEQ ID NO: 51198 - DNA, 20 bp, Artificial Sequence
  chemically synthesized
atccaaaccgtatttgagct

SEQ ID NO: 51199 - DNA, 20 bp, Artificial Sequence
  chemically synthesized
catccaaaccgtatttgagc

SEQ ID NO: 51200 - DNA, 20 bp, Artificial Sequence
  chemically synthesized
caccatgcctagctcaaata

SEQ ID NO: 51201 - DNA, 20 bp, Artificial Sequence
  chemically synthesized
gtgccatccaaaccgtattt

SEQ ID NO: 51202 - DNA, 20 bp, Artificial Sequence
  chemically synthesized
tgcctagctcaaatacggtt

SEQ ID NO: 51203 - DNA, 20 bp, Artificial Sequence
  chemically synthesized
tagctcaaatacggtttgga

SEQ ID NO: 51204 - DNA, 20 bp, Artificial Sequence
  chemically synthesized
tggatggcacacccaatttc

SEQ ID NO: 51205 - DNA, 20 bp, Artificial Sequence
  chemically synthesized
agaaaattgcaccagaaatt

SEQ ID NO: 51206 - DNA, 20 bp, Artificial Sequence
  chemically synthesized
tagaaaattgcaccagaaat

SEQ ID NO: 51207 - DNA, 20 bp, Artificial Sequence
  chemically synthesized
ttacctctagaaaattgcac

SEQ ID NO: 51208 - DNA, 20 bp, Artificial Sequence
  chemically synthesized
caatttctggtgcaattttc

SEQ ID NO: 51209 - DNA, 20 bp, Artificial Sequence
  chemically synthesized
atttctggtgcaattttcta

SEQ ID NO: 51210 - DNA, 20 bp, Artificial Sequence
  chemically synthesized
tttctggtgcaattttctag

SEQ ID NO: 51211 - DNA, 20 bp, Artificial Sequence
  chemically synthesized
tggtgcaattttctagaggt

SEQ ID NO: 51212 - DNA, 20 bp, Artificial Sequence
  chemically synthesized
tgtattgccaaacttacctc

SEQ ID NO: 51213 - DNA, 20 bp, Artificial Sequence
  chemically synthesized
caattttctagaggtaagtt

SEQ ID NO: 51214 - DNA, 20 bp, Artificial Sequence
  chemically synthesized
agtttggcaatacacttgaa

SEQ ID NO: 51215 - DNA, 20 bp, Artificial Sequence
  chemically synthesized
gtttggcaatacacttgaaa

SEQ ID NO: 51216 - DNA, 20 bp, Artificial Sequence
  chemically synthesized
ttacattcgtaagccttttc

SEQ ID NO: 51217 - DNA, 20 bp, Artificial Sequence
  chemically synthesized
taaagaatgtttacattcgt

SEQ ID NO: 51218 - DNA, 20 bp, Artificial Sequence
  chemically synthesized
aaggtggaattgtcatgtta

SEQ ID NO: 51219 - DNA, 20 bp, Artificial Sequence
  chemically synthesized
taacatgacaattccacctt

SEQ ID NO: 51220 - DNA, 20 bp, Artificial Sequence
  chemically synthesized
aacatgacaattccaccttt

SEQ ID NO: 51221 - DNA, 20 bp, Artificial Sequence
  chemically synthesized
acaggataaatgcctaaagg

SEQ ID NO: 51222 - DNA, 20 bp, Artificial Sequence
  chemically synthesized
tctacaggataaatgcctaa

SEQ ID NO: 51223 - DNA, 20 bp, Artificial Sequence
  chemically synthesized
ttctacaggataaatgccta

SEQ ID NO: 51224 - DNA, 20 bp, Artificial Sequence
  chemically synthesized
acctttaggcatttatcctg

SEQ ID NO: 51225 - DNA, 20 bp, Artificial Sequence
  chemically synthesized
ttaggcatttatcctgtaga

SEQ ID NO: 51226 - DNA, 20 bp, Artificial Sequence
  chemically synthesized
atatctcagattctttctac

SEQ ID NO: 51227 - DNA, 20 bp, Artificial Sequence
  chemically synthesized
aatatctcagattctttcta

SEQ ID NO: 51228 - DNA, 20 bp, Artificial Sequence
  chemically synthesized
ttatcctgtagaaagaatct

SEQ ID NO: 51229 - DNA, 20 bp, Artificial Sequence
  chemically synthesized
ttatacctttacaaatatct

SEQ ID NO: 51230 - DNA, 20 bp, Artificial Sequence
  chemically synthesized
aagaatctgagatatttgta

SEQ ID NO: 51231 - DNA, 20 bp, Artificial Sequence
  chemically synthesized
agaatctgagatatttgtaa

SEQ ID NO: 51232 - DNA, 20 bp, Artificial Sequence
  chemically synthesized
gatatttgtaaaggtataaa

SEQ ID NO: 51233 - DNA, 20 bp, Artificial Sequence
  chemically synthesized
atatttgtaaaggtataaaa

SEQ ID NO: 51234 - DNA, 20 bp, Artificial Sequence
  chemically synthesized
taaaggtataaaaaggatat

SEQ ID NO: 51235 - DNA, 20 bp, Artificial Sequence
  chemically synthesized
ctttattatatcgagcatta

SEQ ID NO: 51236 - DNA, 20 bp, Artificial Sequence
  chemically synthesized
ttcacaatctttattatatc

SEQ ID NO: 51237 - DNA, 20 bp, Artificial Sequence
  chemically synthesized
ccataatgctcgatataata

SEQ ID NO: 51238 - DNA, 20 bp, Artificial Sequence
  chemically synthesized
tgtgaaataatctttatatt

SEQ ID NO: 51239 - DNA, 20 bp, Artificial Sequence
  chemically synthesized
attctaaattgctcaatata

SEQ ID NO: 51240 - DNA, 20 bp, Artificial Sequence
  chemically synthesized
aatctttatattgagcaatt

SEQ ID NO: 51241 - DNA, 20 bp, Artificial Sequence
  chemically synthesized
tgagcaatttagaattgtgt

SEQ ID NO: 51242 - DNA, 20 bp, Artificial Sequence
  chemically synthesized
tagaattgtgttggtaaatt

SEQ ID NO: 51243 - DNA, 20 bp, Artificial Sequence
  chemically synthesized
ttgtgttggtaaatttggta

SEQ ID NO: 51244 - DNA, 20 bp, Artificial Sequence
  chemically synthesized
tggtaaatttggtacagcca

SEQ ID NO: 51245 - DNA, 20 bp, Artificial Sequence
  chemically synthesized
taaatttggtacagccacag

SEQ ID NO: 51246 - DNA, 20 bp, Artificial Sequence
  chemically synthesized
aatttggtacagccacagaa

SEQ ID NO: 51247 - DNA, 20 bp, Artificial Sequence
  chemically synthesized
tttggtacagccacagaaga

SEQ ID NO: 51248 - DNA, 20 bp, Artificial Sequence
  chemically synthesized
ctggctaatactctcttctg

SEQ ID NO: 51249 - DNA, 20 bp, Artificial Sequence
  chemically synthesized
acagccacagaagagagtat

SEQ ID NO: 51250 - DNA, 20 bp, Artificial Sequence
  chemically synthesized
ccacagaagagagtattagc

SEQ ID NO: 51251 - DNA, 20 bp, Artificial Sequence
  chemically synthesized
agagagtattagccagtcat

SEQ ID NO: 51252 - DNA, 20 bp, Artificial Sequence
  chemically synthesized
agagtaatttttctaatgac

SEQ ID NO: 51253 - DNA, 20 bp, Artificial Sequence
  chemically synthesized
tcattagaaaaattactctg

SEQ ID NO: 51254 - DNA, 20 bp, Artificial Sequence
  chemically synthesized
ttagaaaaattactctgaag

SEQ ID NO: 51255 - DNA, 20 bp, Artificial Sequence
  chemically synthesized
tgtttaaatattcttcttca

SEQ ID NO: 51256 - DNA, 20 bp, Artificial Sequence
  chemically synthesized
tgtgtttaaatattcttctt

SEQ ID NO: 51257 - DNA, 20 bp, Artificial Sequence
  chemically synthesized
atttaaacacacgaaaatat

SEQ ID NO: 51258 - DNA, 20 bp, Artificial Sequence
  chemically synthesized
aaacacacgaaaatattgga

SEQ ID NO: 51259 - DNA, 20 bp, Artificial Sequence
  chemically synthesized
acacgaaaatattggaaaga

SEQ ID NO: 51260 - DNA, 20 bp, Artificial Sequence
  chemically synthesized
aatattggaaagatagtttt

SEQ ID NO: 51261 - DNA, 20 bp, Artificial Sequence
  chemically synthesized
atattggaaagatagtttta

SEQ ID NO: 51262 - DNA, 20 bp, Artificial Sequence
  chemically synthesized
tattggaaagatagttttaa

SEQ ID NO: 51263 - DNA, 20 bp, Artificial Sequence
  chemically synthesized
aagatagttttaagggaaaa

SEQ ID NO: 51264 - DNA, 20 bp, Artificial Sequence
  chemically synthesized
atagttttaagggaaaaaag

SEQ ID NO: 51265 - DNA, 20 bp, Artificial Sequence
  chemically synthesized
aaaacatgctacagttttat

SEQ ID NO: 51266 - DNA, 20 bp, Artificial Sequence
  chemically synthesized
aaaagcagctcataaaactg

SEQ ID NO: 51267 - DNA, 20 bp, Artificial Sequence
  chemically synthesized
gcgcagataaaaacatgcta

SEQ ID NO: 51268 - DNA, 20 bp, Artificial Sequence
  chemically synthesized
agcatgtttttatctgcgca

SEQ ID NO: 51269 - DNA, 20 bp, Artificial Sequence
  chemically synthesized
cttttcttttaaaccatgcg

SEQ ID NO: 51270 - DNA, 20 bp, Artificial Sequence
  chemically synthesized
tttatctgcgcatggtttaa

SEQ ID NO: 51271 - DNA, 20 bp, Artificial Sequence
  chemically synthesized
ctgcgcatggtttaaaagaa

SEQ ID NO: 51272 - DNA, 20 bp, Artificial Sequence
  chemically synthesized
gcgcatggtttaaaagaaaa

SEQ ID NO: 51273 - DNA, 20 bp, Artificial Sequence
  chemically synthesized
gcatggtttaaaagaaaaga

SEQ ID NO: 51274 - DNA, 20 bp, Artificial Sequence
  chemically synthesized
atggtttaaaagaaaagaga

SEQ ID NO: 51275 - DNA, 20 bp, Artificial Sequence
  chemically synthesized
tggtttaaaagaaaagagag

SEQ ID NO: 51276 - DNA, 20 bp, Artificial Sequence
  chemically synthesized
ttaaaagaaaagagagaggc

SEQ ID NO: 51277 - DNA, 20 bp, Artificial Sequence
  chemically synthesized
taaaagaaaagagagaggcc

SEQ ID NO: 51278 - DNA, 20 bp, Artificial Sequence
  chemically synthesized
gaaaagagagaggccgggcg

SEQ ID NO: 51279 - DNA, 20 bp, Artificial Sequence
  chemically synthesized
aagagagaggccgggcgtgg

SEQ ID NO: 51280 - DNA, 20 bp, Artificial Sequence
  chemically synthesized
caggcatgagccaccacgcc

SEQ ID NO: 51281 - DNA, 20 bp, Artificial Sequence
  chemically synthesized
agtgttgagattacaggcat

SEQ ID NO: 51282 - DNA, 20 bp, Artificial Sequence
  chemically synthesized
tcccaaagtgttgagattac

SEQ ID NO: 51283 - DNA, 20 bp, Artificial Sequence
  chemically synthesized
ctcccaaagtgttgagatta

SEQ ID NO: 51284 - DNA, 20 bp, Artificial Sequence
  chemically synthesized
tgcctgtaatctcaacactt

SEQ ID NO: 51285 - DNA, 20 bp, Artificial Sequence
  chemically synthesized
ctgaggcctcccaaagtgtt

SEQ ID NO: 51286 - DNA, 20 bp, Artificial Sequence
  chemically synthesized
gcctgtaatctcaacacttt

SEQ ID NO: 51287 - DNA, 20 bp, Artificial Sequence
  chemically synthesized
ctgtaatctcaacactttgg

SEQ ID NO: 51288 - DNA, 20 bp, Artificial Sequence
  chemically synthesized
tgtaatctcaacactttggg

SEQ ID NO: 51289 - DNA, 20 bp, Artificial Sequence
  chemically synthesized
ccacccactgaggcctccca

SEQ ID NO: 51290 - DNA, 20 bp, Artificial Sequence
  chemically synthesized
ctcaacactttgggaggcct

SEQ ID NO: 51291 - DNA, 20 bp, Artificial Sequence
  chemically synthesized
aacactttgggaggcctcag

SEQ ID NO: 51292 - DNA, 20 bp, Artificial Sequence
  chemically synthesized
acactttgggaggcctcagt

SEQ ID NO: 51293 - DNA, 20 bp, Artificial Sequence
  chemically synthesized
ctttgggaggcctcagtggg

SEQ ID NO: 51294 - DNA, 20 bp, Artificial Sequence
  chemically synthesized
ctcaagtaatccacccactg

SEQ ID NO: 51295 - DNA, 20 bp, Artificial Sequence
  chemically synthesized
cctcaagtaatccacccact

SEQ ID NO: 51296 - DNA, 20 bp, Artificial Sequence
  chemically synthesized
cctcagtgggtggattactt

SEQ ID NO: 51297 - DNA, 20 bp, Artificial Sequence
  chemically synthesized
ctcagtgggtggattacttg

SEQ ID NO: 51298 - DNA, 20 bp, Artificial Sequence
  chemically synthesized
ggtctcgaacttgtggcctc

SEQ ID NO: 51299 - DNA, 20 bp, Artificial Sequence
  chemically synthesized
ggtggattacttgaggccac

SEQ ID NO: 51300 - DNA, 20 bp, Artificial Sequence
  chemically synthesized
ttacttgaggccacaagttc

SEQ ID NO: 51301 - DNA, 20 bp, Artificial Sequence
  chemically synthesized
ccaggctggtctcgaacttg

SEQ ID NO: 51302 - DNA, 20 bp, Artificial Sequence
  chemically synthesized
tgaggccacaagttcgagac

SEQ ID NO: 51303 - DNA, 20 bp, Artificial Sequence
  chemically synthesized
ccacaagttcgagaccagcc

SEQ ID NO: 51304 - DNA, 20 bp, Artificial Sequence
  chemically synthesized
tttcactatgttggccaggc

SEQ ID NO: 51305 - DNA, 20 bp, Artificial Sequence
  chemically synthesized
ggggtttcactatgttggcc

SEQ ID NO: 51306 - DNA, 20 bp, Artificial Sequence
  chemically synthesized
cgagaccagcctggccaaca

SEQ ID NO: 51307 - DNA, 20 bp, Artificial Sequence
  chemically synthesized
cggggtttcactatgttggc

SEQ ID NO: 51308 - DNA, 20 bp, Artificial Sequence
  chemically synthesized
gagacggggtttcactatgt

SEQ ID NO: 51309 - DNA, 20 bp, Artificial Sequence
  chemically synthesized
ttgtatttttagtagagacg

SEQ ID NO: 51310 - DNA, 20 bp, Artificial Sequence
  chemically synthesized
tttgtatttttagtagagac

SEQ ID NO: 51311 - DNA, 20 bp, Artificial Sequence
  chemically synthesized
ttttgtatttttagtagaga

SEQ ID NO: 51312 - DNA, 20 bp, Artificial Sequence
  chemically synthesized
aattttttgtatttttagta

SEQ ID NO: 51313 - DNA, 20 bp, Artificial Sequence
  chemically synthesized
ctaattttttgtatttttag

SEQ ID NO: 51314 - DNA, 20 bp, Artificial Sequence
  chemically synthesized
tggctaattttttgtatttt

SEQ ID NO: 51315 - DNA, 20 bp, Artificial Sequence
  chemically synthesized
ctactaaaaatacaaaaaat

SEQ ID NO: 51316 - DNA, 20 bp, Artificial Sequence
  chemically synthesized
aaaaatacaaaaaattagcc

SEQ ID NO: 51317 - DNA, 20 bp, Artificial Sequence
  chemically synthesized
tacaaaaaattagccaagcg

SEQ ID NO: 51318 - DNA, 20 bp, Artificial Sequence
  chemically synthesized
aaaaaattagccaagcgtgg

SEQ ID NO: 51319 - DNA, 20 bp, Artificial Sequence
  chemically synthesized
caggaatacgccaccacgct

SEQ ID NO: 51320 - DNA, 20 bp, Artificial Sequence
  chemically synthesized
gtggcgtattcctgtaatcc

SEQ ID NO: 51321 - DNA, 20 bp, Artificial Sequence
  chemically synthesized
tcccgagtagctgggattac

SEQ ID NO: 51322 - DNA, 20 bp, Artificial Sequence
  chemically synthesized
ctcccgagtagctgggatta

SEQ ID NO: 51323 - DNA, 20 bp, Artificial Sequence
  chemically synthesized
ttcctgtaatcccagctact

SEQ ID NO: 51324 - DNA, 20 bp, Artificial Sequence
  chemically synthesized
actcagcctcccgagtagct

SEQ ID NO: 51325 - DNA, 20 bp, Artificial Sequence
  chemically synthesized
tcctgtaatcccagctactc

SEQ ID NO: 51326 - DNA, 20 bp, Artificial Sequence
  chemically synthesized
gactcagcctcccgagtagc

SEQ ID NO: 51327 - DNA, 20 bp, Artificial Sequence
  chemically synthesized
ctgtaatcccagctactcgg

SEQ ID NO: 51328 - DNA, 20 bp, Artificial Sequence
  chemically synthesized
tgtaatcccagctactcggg

SEQ ID NO: 51329 - DNA, 20 bp, Artificial Sequence
  chemically synthesized
tcatgactcagcctcccgag

SEQ ID NO: 51330 - DNA, 20 bp, Artificial Sequence
  chemically synthesized
ttctcatgactcagcctccc

SEQ ID NO: 51331 - DNA, 20 bp, Artificial Sequence
  chemically synthesized
tcccagctactcgggaggct

SEQ ID NO: 51332 - DNA, 20 bp, Artificial Sequence
  chemically synthesized
tactcgggaggctgagtcat

SEQ ID NO: 51333 - DNA, 20 bp, Artificial Sequence
  chemically synthesized
ttctagcgattctcatgact

SEQ ID NO: 51334 - DNA, 20 bp, Artificial Sequence
  chemically synthesized
ggctgagtcatgagaatcgc

SEQ ID NO: 51335 - DNA, 20 bp, Artificial Sequence
  chemically synthesized
tcatgagaatcgctagaacc

SEQ ID NO: 51336 - DNA, 20 bp, Artificial Sequence
  chemically synthesized
catgagaatcgctagaaccc

SEQ ID NO: 51337 - DNA, 20 bp, Artificial Sequence
  chemically synthesized
acctcccccgtcctgggttc

SEQ ID NO: 51338 - DNA, 20 bp, Artificial Sequence
  chemically synthesized
agaatcgctagaacccagga

SEQ ID NO: 51339 - DNA, 20 bp, Artificial Sequence
  chemically synthesized
gaatcgctagaacccaggac

SEQ ID NO: 51340 - DNA, 20 bp, Artificial Sequence
  chemically synthesized
aatcgctagaacccaggacg

SEQ ID NO: 51341 - DNA, 20 bp, Artificial Sequence
  chemically synthesized
atcgctagaacccaggacgg

SEQ ID NO: 51342 - DNA, 20 bp, Artificial Sequence
  chemically synthesized
actgcaacctcccccgtcct

SEQ ID NO: 51343 - DNA, 20 bp, Artificial Sequence
  chemically synthesized
cactgcaacctcccccgtcc

SEQ ID NO: 51344 - DNA, 20 bp, Artificial Sequence
  chemically synthesized
cgctagaacccaggacgggg

SEQ ID NO: 51345 - DNA, 20 bp, Artificial Sequence
  chemically synthesized
gctagaacccaggacggggg

SEQ ID NO: 51346 - DNA, 20 bp, Artificial Sequence
  chemically synthesized
acccaggacgggggaggttg

SEQ ID NO: 51347 - DNA, 20 bp, Artificial Sequence
  chemically synthesized
aggacgggggaggttgcagt

SEQ ID NO: 51348 - DNA, 20 bp, Artificial Sequence
  chemically synthesized
gggggaggttgcagtgagct

SEQ ID NO: 51349 - DNA, 20 bp, Artificial Sequence
  chemically synthesized
tttgagacagagtgcaatct

SEQ ID NO: 51350 - DNA, 20 bp, Artificial Sequence
  chemically synthesized
tttttttgttttttgagaca

SEQ ID NO: 51351 - DNA, 20 bp, Artificial Sequence
  chemically synthesized
tatttttttgttttttgaga

SEQ ID NO: 51352 - DNA, 20 bp, Artificial Sequence
  chemically synthesized
tttttatttttttgtttttt

SEQ ID NO: 51353 - DNA, 20 bp, Artificial Sequence
  chemically synthesized
acaaaaaaataaaaaaataa

SEQ ID NO: 51354 - DNA, 20 bp, Artificial Sequence
  chemically synthesized
aaaaataaaaaaataaaaga

SEQ ID NO: 51355 - DNA, 20 bp, Artificial Sequence
  chemically synthesized
gtgtgtgtgtgtgtgtatca

SEQ ID NO: 51356 - DNA, 20 bp, Artificial Sequence
  chemically synthesized
tgtgtgtgtgtgtgtgtatc

SEQ ID NO: 51357 - DNA, 20 bp, Artificial Sequence
  chemically synthesized
acacacacacacgcaaccac

SEQ ID NO: 51358 - DNA, 20 bp, Artificial Sequence
  chemically synthesized
acacacacacgcaaccacaa

SEQ ID NO: 51359 - DNA, 20 bp, Artificial Sequence
  chemically synthesized
tactttctgtatttctcttg

SEQ ID NO: 51360 - DNA, 20 bp, Artificial Sequence
  chemically synthesized
acgcaaccacaagagaaata

SEQ ID NO: 51361 - DNA, 20 bp, Artificial Sequence
  chemically synthesized
aaccacaagagaaatacaga

SEQ ID NO: 51362 - DNA, 20 bp, Artificial Sequence
  chemically synthesized
gataatcactatcagaaatt

SEQ ID NO: 51363 - DNA, 20 bp, Artificial Sequence
  chemically synthesized
tatataaaccaaatttctga

SEQ ID NO: 51364 - DNA, 20 bp, Artificial Sequence
  chemically synthesized
gactcagagataatcactat

SEQ ID NO: 51365 - DNA, 20 bp, Artificial Sequence
  chemically synthesized
ttctgatagtgattatctct

SEQ ID NO: 51366 - DNA, 20 bp, Artificial Sequence
  chemically synthesized
tagtgattatctctgagtca

SEQ ID NO: 51367 - DNA, 20 bp, Artificial Sequence
  chemically synthesized
atccataatcctatgactca

SEQ ID NO: 51368 - DNA, 20 bp, Artificial Sequence
  chemically synthesized
agtgattatctctgagtcat

SEQ ID NO: 51369 - DNA, 20 bp, Artificial Sequence
  chemically synthesized
gtatccataatcctatgact

SEQ ID NO: 51370 - DNA, 20 bp, Artificial Sequence
  chemically synthesized
atctctgagtcataggatta

SEQ ID NO: 51371 - DNA, 20 bp, Artificial Sequence
  chemically synthesized
agtacaaacaagaaaagaaa

SEQ ID NO: 51372 - DNA, 20 bp, Artificial Sequence
  chemically synthesized
gcccacagtacaaacaagaa

SEQ ID NO: 51373 - DNA, 20 bp, Artificial Sequence
  chemically synthesized
ggaaagcccacagtacaaac

SEQ ID NO: 51374 - DNA, 20 bp, Artificial Sequence
  chemically synthesized
ttcttttcttgtttgtactg

SEQ ID NO: 51375 - DNA, 20 bp, Artificial Sequence
  chemically synthesized
tcttttcttgtttgtactgt

SEQ ID NO: 51376 - DNA, 20 bp, Artificial Sequence
  chemically synthesized
agaaaaatttggaaagccca

SEQ ID NO: 51377 - DNA, 20 bp, Artificial Sequence
  chemically synthesized
cacatcaagaaaaatttgga

SEQ ID NO: 51378 - DNA, 20 bp, Artificial Sequence
  chemically synthesized
tatacacatcaagaaaaatt

SEQ ID NO: 51379 - DNA, 20 bp, Artificial Sequence
  chemically synthesized
aaaggtactctatacacatc

SEQ ID NO: 51380 - DNA, 20 bp, Artificial Sequence
  chemically synthesized
caaatttttcttgatgtgta

SEQ ID NO: 51381 - DNA, 20 bp, Artificial Sequence
  chemically synthesized
aatttttcttgatgtgtata

SEQ ID NO: 51382 - DNA, 20 bp, Artificial Sequence
  chemically synthesized
tgtactttttaaaattacaa

SEQ ID NO: 51383 - DNA, 20 bp, Artificial Sequence
  chemically synthesized
ttgtactttttaaaattaca

SEQ ID NO: 51384 - DNA, 20 bp, Artificial Sequence
  chemically synthesized
agtacctttgtaattttaaa

SEQ ID NO: 51385 - DNA, 20 bp, Artificial Sequence
  chemically synthesized
attttaaaaagtacaatgta

SEQ ID NO: 51386 - DNA, 20 bp, Artificial Sequence
  chemically synthesized
gtaaagaaacaatccatcct

SEQ ID NO: 51387 - DNA, 20 bp, Artificial Sequence
  chemically synthesized
taggacggtgagactaagga

SEQ ID NO: 51388 - DNA, 20 bp, Artificial Sequence
  chemically synthesized
gaaataggacggtgagacta

SEQ ID NO: 51389 - DNA, 20 bp, Artificial Sequence
  chemically synthesized
agaaataggacggtgagact

SEQ ID NO: 51390 - DNA, 20 bp, Artificial Sequence
  chemically synthesized
tatttaagaaataggacggt

SEQ ID NO: 51391 - DNA, 20 bp, Artificial Sequence
  chemically synthesized
gggatatttaagaaatagga

SEQ ID NO: 51392 - DNA, 20 bp, Artificial Sequence
  chemically synthesized
ttaagggatatttaagaaat

SEQ ID NO: 51393 - DNA, 20 bp, Artificial Sequence
  chemically synthesized
tttaagggatatttaagaaa

SEQ ID NO: 51394 - DNA, 20 bp, Artificial Sequence
  chemically synthesized
acttggtttaagggatattt

SEQ ID NO: 51395 - DNA, 20 bp, Artificial Sequence
  chemically synthesized
tcttaaatatcccttaaacc

SEQ ID NO: 51396 - DNA, 20 bp, Artificial Sequence
  chemically synthesized
aaaataccaacttggtttaa

SEQ ID NO: 51397 - DNA, 20 bp, Artificial Sequence
  chemically synthesized
gaaaataccaacttggttta

SEQ ID NO: 51398 - DNA, 20 bp, Artificial Sequence
  chemically synthesized
agaaaataccaacttggttt

SEQ ID NO: 51399 - DNA, 20 bp, Artificial Sequence
  chemically synthesized
aaatatcccttaaaccaagt

SEQ ID NO: 51400 - DNA, 20 bp, Artificial Sequence
  chemically synthesized
gtataaagaaaataccaact

SEQ ID NO: 51401 - DNA, 20 bp, Artificial Sequence
  chemically synthesized
aagctttgcttgcaggtata

SEQ ID NO: 51402 - DNA, 20 bp, Artificial Sequence
  chemically synthesized
ggtattttctttatacctgc

SEQ ID NO: 51403 - DNA, 20 bp, Artificial Sequence
  chemically synthesized
tttctttatacctgcaagca

SEQ ID NO: 51404 - DNA, 20 bp, Artificial Sequence
  chemically synthesized
cgcttaaaagctttgcttgc

SEQ ID NO: 51405 - DNA, 20 bp, Artificial Sequence
  chemically synthesized
acgcttaaaagctttgcttg

SEQ ID NO: 51406 - DNA, 20 bp, Artificial Sequence
  chemically synthesized
tacctgcaagcaaagctttt

SEQ ID NO: 51407 - DNA, 20 bp, Artificial Sequence
  chemically synthesized
gaatatcaatatacgcttaa

SEQ ID NO: 51408 - DNA, 20 bp, Artificial Sequence
  chemically synthesized
gcgtatattgatattccaca

SEQ ID NO: 51409 - DNA, 20 bp, Artificial Sequence
  chemically synthesized
cgtatattgatattccacat

SEQ ID NO: 51410 - DNA, 20 bp, Artificial Sequence
  chemically synthesized
cagtctcttggatgcccatg

SEQ ID NO: 51411 - DNA, 20 bp, Artificial Sequence
  chemically synthesized
gatattccacatgggcatcc

SEQ ID NO: 51412 - DNA, 20 bp, Artificial Sequence
  chemically synthesized
tattccacatgggcatccaa

SEQ ID NO: 51413 - DNA, 20 bp, Artificial Sequence
  chemically synthesized
cccggaagtcatcagtctct

SEQ ID NO: 51414 - DNA, 20 bp, Artificial Sequence
  chemically synthesized
gagccagccccggaagtcat

SEQ ID NO: 51415 - DNA, 20 bp, Artificial Sequence
  chemically synthesized
tccaagagactgatgacttc

SEQ ID NO: 51416 - DNA, 20 bp, Artificial Sequence
  chemically synthesized
ccaagagactgatgacttcc

SEQ ID NO: 51417 - DNA, 20 bp, Artificial Sequence
  chemically synthesized
caagagactgatgacttccg

SEQ ID NO: 51418 - DNA, 20 bp, Artificial Sequence
  chemically synthesized
agactgatgacttccggggc

SEQ ID NO: 51419 - DNA, 20 bp, Artificial Sequence
  chemically synthesized
ctgaatggagccagccccgg

SEQ ID NO: 51420 - DNA, 20 bp, Artificial Sequence
  chemically synthesized
tgcctgaatggagccagccc

SEQ ID NO: 51421 - DNA, 20 bp, Artificial Sequence
  chemically synthesized
tctacctgcctgaatggagc

SEQ ID NO: 51422 - DNA, 20 bp, Artificial Sequence
  chemically synthesized
cttccggggctggctccatt

SEQ ID NO: 51423 - DNA, 20 bp, Artificial Sequence
  chemically synthesized
ttccggggctggctccattc

SEQ ID NO: 51424 - DNA, 20 bp, Artificial Sequence
  chemically synthesized
ctgatctacctgcctgaatg

SEQ ID NO: 51425 - DNA, 20 bp, Artificial Sequence
  chemically synthesized
cggggctggctccattcagg

SEQ ID NO: 51426 - DNA, 20 bp, Artificial Sequence
  chemically synthesized
ggggctggctccattcaggc

SEQ ID NO: 51427 - DNA, 20 bp, Artificial Sequence
  chemically synthesized
gactgatctacctgcctgaa

SEQ ID NO: 51428 - DNA, 20 bp, Artificial Sequence
  chemically synthesized
gctggctccattcaggcagg

SEQ ID NO: 51429 - DNA, 20 bp, Artificial Sequence
  chemically synthesized
ctccattcaggcaggtagat

SEQ ID NO: 51430 - DNA, 20 bp, Artificial Sequence
  chemically synthesized
tagacacaggtattcataaa

SEQ ID NO: 51431 - DNA, 20 bp, Artificial Sequence
  chemically synthesized
gttagacacaggtattcata

SEQ ID NO: 51432 - DNA, 20 bp, Artificial Sequence
  chemically synthesized
aggtcaggcctgttagacac

SEQ ID NO: 51433 - DNA, 20 bp, Artificial Sequence
  chemically synthesized
ttatgaatacctgtgtctaa

SEQ ID NO: 51434 - DNA, 20 bp, Artificial Sequence
  chemically synthesized
aaggtcaggcctgttagaca

SEQ ID NO: 51435 - DNA, 20 bp, Artificial Sequence
  chemically synthesized
tatgaatacctgtgtctaac

SEQ ID NO: 51436 - DNA, 20 bp, Artificial Sequence
  chemically synthesized
tccagaaaggtcaggcctgt

SEQ ID NO: 51437 - DNA, 20 bp, Artificial Sequence
  chemically synthesized
tgcccacttccagaaaggtc

SEQ ID NO: 51438 - DNA, 20 bp, Artificial Sequence
  chemically synthesized
tctaacaggcctgacctttc

SEQ ID NO: 51439 - DNA, 20 bp, Artificial Sequence
  chemically synthesized
gtgcccacttccagaaaggt

SEQ ID NO: 51440 - DNA, 20 bp, Artificial Sequence
  chemically synthesized
aacaggcctgacctttctgg

SEQ ID NO: 51441 - DNA, 20 bp, Artificial Sequence
  chemically synthesized
atcagtgcccacttccagaa

SEQ ID NO: 51442 - DNA, 20 bp, Artificial Sequence
  chemically synthesized
catcagtgcccacttccaga

SEQ ID NO: 51443 - DNA, 20 bp, Artificial Sequence
  chemically synthesized
aggcctgacctttctggaag

SEQ ID NO: 51444 - DNA, 20 bp, Artificial Sequence
  chemically synthesized
ggcctgacctttctggaagt

SEQ ID NO: 51445 - DNA, 20 bp, Artificial Sequence
  chemically synthesized
atcacatcagtgcccacttc

SEQ ID NO: 51446 - DNA, 20 bp, Artificial Sequence
  chemically synthesized
cctttcaaaccatatcacat

SEQ ID NO: 51447 - DNA, 20 bp, Artificial Sequence
  chemically synthesized
aagtgggcactgatgtgata

SEQ ID NO: 51448 - DNA, 20 bp, Artificial Sequence
  chemically synthesized
actgatgtgatatggtttga

SEQ ID NO: 51449 - DNA, 20 bp, Artificial Sequence
  chemically synthesized
ctgatgtgatatggtttgaa

SEQ ID NO: 51450 - DNA, 20 bp, Artificial Sequence
  chemically synthesized
tgatatggtttgaaaggtgt

SEQ ID NO: 51451 - DNA, 20 bp, Artificial Sequence
  chemically synthesized
aggtgtgagaatgctcccct

SEQ ID NO: 51452 - DNA, 20 bp, Artificial Sequence
  chemically synthesized
gaactttgaggggccaaggg

SEQ ID NO: 51453 - DNA, 20 bp, Artificial Sequence
  chemically synthesized
aggaactttgaggggccaag

SEQ ID NO: 51454 - DNA, 20 bp, Artificial Sequence
  chemically synthesized
aaggaactttgaggggccaa

SEQ ID NO: 51455 - DNA, 20 bp, Artificial Sequence
  chemically synthesized
gaaggaactttgaggggcca

SEQ ID NO: 51456 - DNA, 20 bp, Artificial Sequence
  chemically synthesized
ggaaggaactttgaggggcc

SEQ ID NO: 51457 - DNA, 20 bp, Artificial Sequence
  chemically synthesized
atgctccccttggcccctca

SEQ ID NO: 51458 - DNA, 20 bp, Artificial Sequence
  chemically synthesized
tgtgaggaaggaactttgag

SEQ ID NO: 51459 - DNA, 20 bp, Artificial Sequence
  chemically synthesized
ctgtgaggaaggaactttga

SEQ ID NO: 51460 - DNA, 20 bp, Artificial Sequence
  chemically synthesized
gctgtgaggaaggaactttg

SEQ ID NO: 51461 - DNA, 20 bp, Artificial Sequence
  chemically synthesized
agctgtgaggaaggaacttt

SEQ ID NO: 51462 - DNA, 20 bp, Artificial Sequence
  chemically synthesized
ccctcaaagttccttcctca

SEQ ID NO: 51463 - DNA, 20 bp, Artificial Sequence
  chemically synthesized
taagctctgagctgtgagga

SEQ ID NO: 51464 - DNA, 20 bp, Artificial Sequence
  chemically synthesized
ataagctctgagctgtgagg

SEQ ID NO: 51465 - DNA, 20 bp, Artificial Sequence
  chemically synthesized
aaagttccttcctcacagct

SEQ ID NO: 51466 - DNA, 20 bp, Artificial Sequence
  chemically synthesized
gccataagctctgagctgtg

SEQ ID NO: 51467 - DNA, 20 bp, Artificial Sequence
  chemically synthesized
ggccataagctctgagctgt

SEQ ID NO: 51468 - DNA, 20 bp, Artificial Sequence
  chemically synthesized
agttccttcctcacagctca

SEQ ID NO: 51469 - DNA, 20 bp, Artificial Sequence
  chemically synthesized
gaacatcggccataagctct

SEQ ID NO: 51470 - DNA, 20 bp, Artificial Sequence
  chemically synthesized
tcctcacagctcagagctta

SEQ ID NO: 51471 - DNA, 20 bp, Artificial Sequence
  chemically synthesized
ggtggtagaacatcggccat

SEQ ID NO: 51472 - DNA, 20 bp, Artificial Sequence
  chemically synthesized
agcctgaggtggtagaacat

SEQ ID NO: 51473 - DNA, 20 bp, Artificial Sequence
  chemically synthesized
tggccgatgttctaccacct

SEQ ID NO: 51474 - DNA, 20 bp, Artificial Sequence
  chemically synthesized
ggccgatgttctaccacctc

SEQ ID NO: 51475 - DNA, 20 bp, Artificial Sequence
  chemically synthesized
aatccataagcctgaggtgg

SEQ ID NO: 51476 - DNA, 20 bp, Artificial Sequence
  chemically synthesized
gaaaatccataagcctgagg

SEQ ID NO: 51477 - DNA, 20 bp, Artificial Sequence
  chemically synthesized
tgtgaaaatccataagcctg

SEQ ID NO: 51478 - DNA, 20 bp, Artificial Sequence
  chemically synthesized
gttctaccacctcaggctta

SEQ ID NO: 51479 - DNA, 20 bp, Artificial Sequence
  chemically synthesized
gtgtgaaaatccataagcct

SEQ ID NO: 51480 - DNA, 20 bp, Artificial Sequence
  chemically synthesized
ttattagtgtgaaaatccat

SEQ ID NO: 51481 - DNA, 20 bp, Artificial Sequence
  chemically synthesized
ctgggttatttgcattttat

SEQ ID NO: 51482 - DNA, 20 bp, Artificial Sequence
  chemically synthesized
ctaataaaatgcaaataacc

SEQ ID NO: 51483 - DNA, 20 bp, Artificial Sequence
  chemically synthesized
taataaaatgcaaataaccc

SEQ ID NO: 51484 - DNA, 20 bp, Artificial Sequence
  chemically synthesized
ataaaatgcaaataacccag

SEQ ID NO: 51485 - DNA, 20 bp, Artificial Sequence
  chemically synthesized
aaatgcaaataacccaggag

SEQ ID NO: 51486 - DNA, 20 bp, Artificial Sequence
  chemically synthesized
gtttaatgtgtacttctcct

SEQ ID NO: 51487 - DNA, 20 bp, Artificial Sequence
  chemically synthesized
agtttaatgtgtacttctcc

SEQ ID NO: 51488 - DNA, 20 bp, Artificial Sequence
  chemically synthesized
tttaacccaagtgataggta

SEQ ID NO: 51489 - DNA, 20 bp, Artificial Sequence
  chemically synthesized
attaaactttacctatcact

SEQ ID NO: 51490 - DNA, 20 bp, Artificial Sequence
  chemically synthesized
ttaaactttacctatcactt

SEQ ID NO: 51491 - DNA, 20 bp, Artificial Sequence
  chemically synthesized
actcatttaacccaagtgat

SEQ ID NO: 51492 - DNA, 20 bp, Artificial Sequence
  chemically synthesized
tactcatttaacccaagtga

SEQ ID NO: 51493 - DNA, 20 bp, Artificial Sequence
  chemically synthesized
atgatatactcatttaaccc

SEQ ID NO: 51494 - DNA, 20 bp, Artificial Sequence
  chemically synthesized
acctatcacttgggttaaat

SEQ ID NO: 51495 - DNA, 20 bp, Artificial Sequence
  chemically synthesized
agtatatcattttctgaaaa

SEQ ID NO: 51496 - DNA, 20 bp, Artificial Sequence
  chemically synthesized
gtatatcattttctgaaaat

SEQ ID NO: 51497 - DNA, 20 bp, Artificial Sequence
  chemically synthesized
tacccattaaaacctatttt

SEQ ID NO: 51498 - DNA, 20 bp, Artificial Sequence
  chemically synthesized
tttctgaaaataggttttaa

SEQ ID NO: 51499 - DNA, 20 bp, Artificial Sequence
  chemically synthesized
ttctgaaaataggttttaat

SEQ ID NO: 51500 - DNA, 20 bp, Artificial Sequence
  chemically synthesized
gaaaataggttttaatgggt

SEQ ID NO: 51501 - DNA, 20 bp, Artificial Sequence
  chemically synthesized
aggttttaatgggtaagaca

SEQ ID NO: 51502 - DNA, 20 bp, Artificial Sequence
  chemically synthesized
ggttttaatgggtaagacat

SEQ ID NO: 51503 - DNA, 20 bp, Artificial Sequence
  chemically synthesized
atgggtaagacatgggaatt

SEQ ID NO: 51504 - DNA, 20 bp, Artificial Sequence
  chemically synthesized
gggtaagacatgggaattca

SEQ ID NO: 51505 - DNA, 20 bp, Artificial Sequence
  chemically synthesized
ggtaagacatgggaattcag

SEQ ID NO: 51506 - DNA, 20 bp, Artificial Sequence
  chemically synthesized
gtaagacatgggaattcaga

SEQ ID NO: 51507 - DNA, 20 bp, Artificial Sequence
  chemically synthesized
taagacatgggaattcagag

SEQ ID NO: 51508 - DNA, 20 bp, Artificial Sequence
  chemically synthesized
aagacatgggaattcagagg

SEQ ID NO: 51509 - DNA, 20 bp, Artificial Sequence
  chemically synthesized
gacatgggaattcagagggg

SEQ ID NO: 51510 - DNA, 20 bp, Artificial Sequence
  chemically synthesized
tgggaattcagagggggagt

SEQ ID NO: 51511 - DNA, 20 bp, Artificial Sequence
  chemically synthesized
gggaattcagagggggagtc

SEQ ID NO: 51512 - DNA, 20 bp, Artificial Sequence
  chemically synthesized
ggaattcagagggggagtca

SEQ ID NO: 51513 - DNA, 20 bp, Artificial Sequence
  chemically synthesized
aattcagagggggagtcagg

SEQ ID NO: 51514 - DNA, 20 bp, Artificial Sequence
  chemically synthesized
tcagagggggagtcagggag

SEQ ID NO: 51515 - DNA, 20 bp, Artificial Sequence
  chemically synthesized
aaaatatgaatgaatatacc

SEQ ID NO: 51516 - DNA, 20 bp, Artificial Sequence
  chemically synthesized
aatgaatatacctggtgtct

SEQ ID NO: 51517 - DNA, 20 bp, Artificial Sequence
  chemically synthesized
ttaattactcctcagacacc

SEQ ID NO: 51518 - DNA, 20 bp, Artificial Sequence
  chemically synthesized
atgaatatacctggtgtctg

SEQ ID NO: 51519 - DNA, 20 bp, Artificial Sequence
  chemically synthesized
attaattactcctcagacac

SEQ ID NO: 51520 - DNA, 20 bp, Artificial Sequence
  chemically synthesized
gaatatacctggtgtctgag

SEQ ID NO: 51521 - DNA, 20 bp, Artificial Sequence
  chemically synthesized
tatgaatattaattactcct

SEQ ID NO: 51522 - DNA, 20 bp, Artificial Sequence
  chemically synthesized
ggagtaattaatattcataa

SEQ ID NO: 51523 - DNA, 20 bp, Artificial Sequence
  chemically synthesized
cataaaccataaataaaaaa

SEQ ID NO: 51524 - DNA, 20 bp, Artificial Sequence
  chemically synthesized
atagtactattttttattta

SEQ ID NO: 51525 - DNA, 20 bp, Artificial Sequence
  chemically synthesized
attttttatttatggtttat

SEQ ID NO: 51526 - DNA, 20 bp, Artificial Sequence
  chemically synthesized
tttatggtttatgagtcgct

SEQ ID NO: 51527 - DNA, 20 bp, Artificial Sequence
  chemically synthesized
ttatggtttatgagtcgctt

SEQ ID NO: 51528 - DNA, 20 bp, Artificial Sequence
  chemically synthesized
atggtttatgagtcgcttag

SEQ ID NO: 51529 - DNA, 20 bp, Artificial Sequence
  chemically synthesized
aaatgtgataacatactcct

SEQ ID NO: 51530 - DNA, 20 bp, Artificial Sequence
  chemically synthesized
ccattctattcgatttaatt

SEQ ID NO: 51531 - DNA, 20 bp, Artificial Sequence
  chemically synthesized
ttaatctcaattaaatcgaa

SEQ ID NO: 51532 - DNA, 20 bp, Artificial Sequence
  chemically synthesized
ctcaattaaatcgaatagaa

SEQ ID NO: 51533 - DNA, 20 bp, Artificial Sequence
  chemically synthesized
cgaatagaatggctgtcacc

SEQ ID NO: 51534 - DNA, 20 bp, Artificial Sequence
  chemically synthesized
gaatagaatggctgtcacca

SEQ ID NO: 51535 - DNA, 20 bp, Artificial Sequence
  chemically synthesized
tacttaacttgccttggtga

SEQ ID NO: 51536 - DNA, 20 bp, Artificial Sequence
  chemically synthesized
agaatggctgtcaccaaggc

SEQ ID NO: 51537 - DNA, 20 bp, Artificial Sequence
  chemically synthesized
ctggtctacttaacttgcct

SEQ ID NO: 51538 - DNA, 20 bp, Artificial Sequence
  chemically synthesized
ggctgtcaccaaggcaagtt

SEQ ID NO: 51539 - DNA, 20 bp, Artificial Sequence
  chemically synthesized
tgtcaccaaggcaagttaag

SEQ ID NO: 51540 - DNA, 20 bp, Artificial Sequence
  chemically synthesized
ccaaggcaagttaagtagac

SEQ ID NO: 51541 - DNA, 20 bp, Artificial Sequence
  chemically synthesized
aaggcaagttaagtagacca

SEQ ID NO: 51542 - DNA, 20 bp, Artificial Sequence
  chemically synthesized
agttaagtagaccagagatt

SEQ ID NO: 51543 - DNA, 20 bp, Artificial Sequence
  chemically synthesized
tctgcatctttccaaatctc

SEQ ID NO: 51544 - DNA, 20 bp, Artificial Sequence
  chemically synthesized
aagtagaccagagatttgga

SEQ ID NO: 51545 - DNA, 20 bp, Artificial Sequence
  chemically synthesized
accagagatttggaaagatg

SEQ ID NO: 51546 - DNA, 20 bp, Artificial Sequence
  chemically synthesized
agagatttggaaagatgcag

SEQ ID NO: 51547 - DNA, 20 bp, Artificial Sequence
  chemically synthesized
gatgcagaagacgaaatctg

SEQ ID NO: 51548 - DNA, 20 bp, Artificial Sequence
  chemically synthesized
tagaaaaatgataaaggcta

SEQ ID NO: 51549 - DNA, 20 bp, Artificial Sequence
  chemically synthesized
cggctctagaaaaatgataa

SEQ ID NO: 51550 - DNA, 20 bp, Artificial Sequence
  chemically synthesized
acggctctagaaaaatgata

SEQ ID NO: 51551 - DNA, 20 bp, Artificial Sequence
  chemically synthesized
tgtagcctttatcatttttc

SEQ ID NO: 51552 - DNA, 20 bp, Artificial Sequence
  chemically synthesized
tagcctttatcatttttcta

SEQ ID NO: 51553 - DNA, 20 bp, Artificial Sequence
  chemically synthesized
gtggcttttaggaacggctc

SEQ ID NO: 51554 - DNA, 20 bp, Artificial Sequence
  chemically synthesized
ttttctagagccgttcctaa

SEQ ID NO: 51555 - DNA, 20 bp, Artificial Sequence
  chemically synthesized
gggatcgtggcttttaggaa

SEQ ID NO: 51556 - DNA, 20 bp, Artificial Sequence
  chemically synthesized
tgagtgggatcgtggctttt

SEQ ID NO: 51557 - DNA, 20 bp, Artificial Sequence
  chemically synthesized
atgagtgggatcgtggcttt

SEQ ID NO: 51558 - DNA, 20 bp, Artificial Sequence
  chemically synthesized
tatctaaatgagtgggatcg

SEQ ID NO: 51559 - DNA, 20 bp, Artificial Sequence
  chemically synthesized
aagccacgatcccactcatt

SEQ ID NO: 51560 - DNA, 20 bp, Artificial Sequence
  chemically synthesized
agcagtttatctaaatgagt

SEQ ID NO: 51561 - DNA, 20 bp, Artificial Sequence
  chemically synthesized
aagcagtttatctaaatgag

SEQ ID NO: 51562 - DNA, 20 bp, Artificial Sequence
  chemically synthesized
ttaaagcagtttatctaaat

SEQ ID NO: 51563 - DNA, 20 bp, Artificial Sequence
  chemically synthesized
gaaaaagggataagttaaag

SEQ ID NO: 51564 - DNA, 20 bp, Artificial Sequence
  chemically synthesized
caagaaaaagggataagtta

SEQ ID NO: 51565 - DNA, 20 bp, Artificial Sequence
  chemically synthesized
agttgccaagaaaaagggat

SEQ ID NO: 51566 - DNA, 20 bp, Artificial Sequence
  chemically synthesized
tttaacttatccctttttct

SEQ ID NO: 51567 - DNA, 20 bp, Artificial Sequence
  chemically synthesized
tttggagttgccaagaaaaa

SEQ ID NO: 51568 - DNA, 20 bp, Artificial Sequence
  chemically synthesized
ctttggagttgccaagaaaa

SEQ ID NO: 51569 - DNA, 20 bp, Artificial Sequence
  chemically synthesized
gctttggagttgccaagaaa

SEQ ID NO: 51570 - DNA, 20 bp, Artificial Sequence
  chemically synthesized
cacaatgctttggagttgcc

SEQ ID NO: 51571 - DNA, 20 bp, Artificial Sequence
  chemically synthesized
cctttttcttggcaactcca

SEQ ID NO: 51572 - DNA, 20 bp, Artificial Sequence
  chemically synthesized
cacagtttcacaatgctttg

SEQ ID NO: 51573 - DNA, 20 bp, Artificial Sequence
  chemically synthesized
gacacagtttcacaatgctt

SEQ ID NO: 51574 - DNA, 20 bp, Artificial Sequence
  chemically synthesized
gtggtctagttatttggaca

SEQ ID NO: 51575 - DNA, 20 bp, Artificial Sequence
  chemically synthesized
tgaaactgtgtccaaataac

SEQ ID NO: 51576 - DNA, 20 bp, Artificial Sequence
  chemically synthesized
ccgcatgtggtctagttatt

SEQ ID NO: 51577 - DNA, 20 bp, Artificial Sequence
  chemically synthesized
tttattatccgcatgtggtc

SEQ ID NO: 51578 - DNA, 20 bp, Artificial Sequence
  chemically synthesized
ccaaataactagaccacatg

SEQ ID NO: 51579 - DNA, 20 bp, Artificial Sequence
  chemically synthesized
ctaactttattatccgcatg

SEQ ID NO: 51580 - DNA, 20 bp, Artificial Sequence
  chemically synthesized
tagaccacatgcggataata

SEQ ID NO: 51581 - DNA, 20 bp, Artificial Sequence
  chemically synthesized
ccacatgcggataataaagt

SEQ ID NO: 51582 - DNA, 20 bp, Artificial Sequence
  chemically synthesized
acatgcggataataaagtta

SEQ ID NO: 51583 - DNA, 20 bp, Artificial Sequence
  chemically synthesized
gcggataataaagttagagc

SEQ ID NO: 51584 - DNA, 20 bp, Artificial Sequence
  chemically synthesized
taataaagttagagccagtc

SEQ ID NO: 51585 - DNA, 20 bp, Artificial Sequence
  chemically synthesized
aagtatcttattttctggac

SEQ ID NO: 51586 - DNA, 20 bp, Artificial Sequence
  chemically synthesized
ttagagccagtccagaaaat

SEQ ID NO: 51587 - DNA, 20 bp, Artificial Sequence
  chemically synthesized
agaagaagtatcttattttc

SEQ ID NO: 51588 - DNA, 20 bp, Artificial Sequence
  chemically synthesized
atcgataatagattaagaag

SEQ ID NO: 51589 - DNA, 20 bp, Artificial Sequence
  chemically synthesized
tacatcgataatagattaag

SEQ ID NO: 51590 - DNA, 20 bp, Artificial Sequence
  chemically synthesized
tcatacatcgataatagatt

SEQ ID NO: 51591 - DNA, 20 bp, Artificial Sequence
  chemically synthesized
tttttgtcatacatcgataa

SEQ ID NO: 51592 - DNA, 20 bp, Artificial Sequence
  chemically synthesized
atcgatgtatgacaaaaaca

SEQ ID NO: 51593 - DNA, 20 bp, Artificial Sequence
  chemically synthesized
tcgatgtatgacaaaaacac

SEQ ID NO: 51594 - DNA, 20 bp, Artificial Sequence
  chemically synthesized
caaaatttcctggaaggtgt

SEQ ID NO: 51595 - DNA, 20 bp, Artificial Sequence
  chemically synthesized
aacacaggaccaacaccttc

SEQ ID NO: 51596 - DNA, 20 bp, Artificial Sequence
  chemically synthesized
acacaggaccaacaccttcc

SEQ ID NO: 51597 - DNA, 20 bp, Artificial Sequence
  chemically synthesized
tttgaacaaaatttcctgga

SEQ ID NO: 51598 - DNA, 20 bp, Artificial Sequence
  chemically synthesized
ttttgaacaaaatttcctgg

SEQ ID NO: 51599 - DNA, 20 bp, Artificial Sequence
  chemically synthesized
tctttttgaacaaaatttcc

SEQ ID NO: 51600 - DNA, 20 bp, Artificial Sequence
  chemically synthesized
tccaggaaattttgttcaaa

SEQ ID NO: 51601 - DNA, 20 bp, Artificial Sequence
  chemically synthesized
aattttgttcaaaaagacaa

SEQ ID NO: 51602 - DNA, 20 bp, Artificial Sequence
  chemically synthesized
tcaaaaagacaacagccaac

SEQ ID NO: 51603 - DNA, 20 bp, Artificial Sequence
  chemically synthesized
aaaaagacaacagccaactg

SEQ ID NO: 51604 - DNA, 20 bp, Artificial Sequence
  chemically synthesized
ttgtcatgtgtgtctccagt

SEQ ID NO: 51605 - DNA, 20 bp, Artificial Sequence
  chemically synthesized
gatgttgtcatgtgtgtctc

SEQ ID NO: 51606 - DNA, 20 bp, Artificial Sequence
  chemically synthesized
aatactttaaagtatttgag

SEQ ID NO: 51607 - DNA, 20 bp, Artificial Sequence
  chemically synthesized
acaaatactttaaagtattt

SEQ ID NO: 51608 - DNA, 20 bp, Artificial Sequence
  chemically synthesized
acatctactcaaatacttta

SEQ ID NO: 51609 - DNA, 20 bp, Artificial Sequence
  chemically synthesized
ccacgctcacaaatacttta

SEQ ID NO: 51610 - DNA, 20 bp, Artificial Sequence
  chemically synthesized
aaatactttaaagtatttgt

SEQ ID NO: 51611 - DNA, 20 bp, Artificial Sequence
  chemically synthesized
ctttaaagtatttgtgagcg

SEQ ID NO: 51612 - DNA, 20 bp, Artificial Sequence
  chemically synthesized
attctccacgggttaataaa

SEQ ID NO: 51613 - DNA, 20 bp, Artificial Sequence
  chemically synthesized
tggatctttttattaacccg

SEQ ID NO: 51614 - DNA, 20 bp, Artificial Sequence
  chemically synthesized
gatctttttattaacccgtg

SEQ ID NO: 51615 - DNA, 20 bp, Artificial Sequence
  chemically synthesized
ctttcttttccattctccac

SEQ ID NO: 51616 - DNA, 20 bp, Artificial Sequence
  chemically synthesized
ttttattaacccgtggagaa

SEQ ID NO: 51617 - DNA, 20 bp, Artificial Sequence
  chemically synthesized
cctttcttttccattctcca

SEQ ID NO: 51618 - DNA, 20 bp, Artificial Sequence
  chemically synthesized
ttaacccgtggagaatggaa

SEQ ID NO: 51619 - DNA, 20 bp, Artificial Sequence
  chemically synthesized
cccgtggagaatggaaaaga

SEQ ID NO: 51620 - DNA, 20 bp, Artificial Sequence
  chemically synthesized
ccgtggagaatggaaaagaa

SEQ ID NO: 51621 - DNA, 20 bp, Artificial Sequence
  chemically synthesized
tggaaaagaaaggaaatgat

SEQ ID NO: 51622 - DNA, 20 bp, Artificial Sequence
  chemically synthesized
gaaaggaaatgatcagaaaa

SEQ ID NO: 51623 - DNA, 20 bp, Artificial Sequence
  chemically synthesized
tgatcagaaaatggcaatga

SEQ ID NO: 51624 - DNA, 20 bp, Artificial Sequence
  chemically synthesized
aaaatggcaatgaaagaata

SEQ ID NO: 51625 - DNA, 20 bp, Artificial Sequence
  chemically synthesized
atggcaatgaaagaatatgg

SEQ ID NO: 51626 - DNA, 20 bp, Artificial Sequence
  chemically synthesized
gcaatgaaagaatatggcag

SEQ ID NO: 51627 - DNA, 20 bp, Artificial Sequence
  chemically synthesized
gaaagaatatggcagaagaa

SEQ ID NO: 51628 - DNA, 20 bp, Artificial Sequence
  chemically synthesized
aagaatatggcagaagaatg

SEQ ID NO: 51629 - DNA, 20 bp, Artificial Sequence
  chemically synthesized
gcagaagaatggagatcata

SEQ ID NO: 51630 - DNA, 20 bp, Artificial Sequence
  chemically synthesized
ttatatattttatagagagg

SEQ ID NO: 51631 - DNA, 20 bp, Artificial Sequence
  chemically synthesized
aatttatatattttatagag

SEQ ID NO: 51632 - DNA, 20 bp, Artificial Sequence
  chemically synthesized
taatttatatattttataga

SEQ ID NO: 51633 - DNA, 20 bp, Artificial Sequence
  chemically synthesized
cttaatttatatattttata

SEQ ID NO: 51634 - DNA, 20 bp, Artificial Sequence
  chemically synthesized
tacttaatttatatatttta

SEQ ID NO: 51635 - DNA, 20 bp, Artificial Sequence
  chemically synthesized
ctctataaaatatataaatt

SEQ ID NO: 51636 - DNA, 20 bp, Artificial Sequence
  chemically synthesized
atataaattaagtaaaatta

SEQ ID NO: 51637 - DNA, 20 bp, Artificial Sequence
  chemically synthesized
cagtgcgatgcttaaaaaca

SEQ ID NO: 51638 - DNA, 20 bp, Artificial Sequence
  chemically synthesized
gctccagagtctgtgttttt

SEQ ID NO: 51639 - DNA, 20 bp, Artificial Sequence
  chemically synthesized
atgcttaaaaacacagactc

SEQ ID NO: 51640 - DNA, 20 bp, Artificial Sequence
  chemically synthesized
gcttaaaaacacagactctg

SEQ ID NO: 51641 - DNA, 20 bp, Artificial Sequence
  chemically synthesized
aactcaagaagttggctcca

SEQ ID NO: 51642 - DNA, 20 bp, Artificial Sequence
  chemically synthesized
gaaactcaagaagttggctc

SEQ ID NO: 51643 - DNA, 20 bp, Artificial Sequence
  chemically synthesized
gactctggagccaacttctt

SEQ ID NO: 51644 - DNA, 20 bp, Artificial Sequence
  chemically synthesized
aggattgaaactcaagaagt

SEQ ID NO: 51645 - DNA, 20 bp, Artificial Sequence
  chemically synthesized
agccaggattgaaactcaag

SEQ ID NO: 51646 - DNA, 20 bp, Artificial Sequence
  chemically synthesized
gggagccaggattgaaactc

SEQ ID NO: 51647 - DNA, 20 bp, Artificial Sequence
  chemically synthesized
aacttcttgagtttcaatcc

SEQ ID NO: 51648 - DNA, 20 bp, Artificial Sequence
  chemically synthesized
agctagtagatgagggagcc

SEQ ID NO: 51649 - DNA, 20 bp, Artificial Sequence
  chemically synthesized
cagctagtagatgagggagc

SEQ ID NO: 51650 - DNA, 20 bp, Artificial Sequence
  chemically synthesized
catacagctagtagatgagg

SEQ ID NO: 51651 - DNA, 20 bp, Artificial Sequence
  chemically synthesized
ttcatacagctagtagatga

SEQ ID NO: 51652 - DNA, 20 bp, Artificial Sequence
  chemically synthesized
atcctggctccctcatctac

SEQ ID NO: 51653 - DNA, 20 bp, Artificial Sequence
  chemically synthesized
attcatacagctagtagatg

SEQ ID NO: 51654 - DNA, 20 bp, Artificial Sequence
  chemically synthesized
cattcatacagctagtagat

SEQ ID NO: 51655 - DNA, 20 bp, Artificial Sequence
  chemically synthesized
gcacacattcatacagctag

SEQ ID NO: 51656 - DNA, 20 bp, Artificial Sequence
  chemically synthesized
gaggcacacattcatacagc

SEQ ID NO: 51657 - DNA, 20 bp, Artificial Sequence
  chemically synthesized
aactgaggcacacattcata

SEQ ID NO: 51658 - DNA, 20 bp, Artificial Sequence
  chemically synthesized
agctgtatgaatgtgtgcct

SEQ ID NO: 51659 - DNA, 20 bp, Artificial Sequence
  chemically synthesized
tttcaatgatgaagaaactg

SEQ ID NO: 51660 - DNA, 20 bp, Artificial Sequence
  chemically synthesized
atttcaatgatgaagaaact

SEQ ID NO: 51661 - DNA, 20 bp, Artificial Sequence
  chemically synthesized
ttatacccatttcaatgatg

SEQ ID NO: 51662 - DNA, 20 bp, Artificial Sequence
  chemically synthesized
cagtttcttcatcattgaaa

SEQ ID NO: 51663 - DNA, 20 bp, Artificial Sequence
  chemically synthesized
agtttcttcatcattgaaat

SEQ ID NO: 51664 - DNA, 20 bp, Artificial Sequence
  chemically synthesized
cattgaaatgggtataataa

SEQ ID NO: 51665 - DNA, 20 bp, Artificial Sequence
  chemically synthesized
ataataatggtacctacctt

SEQ ID NO: 51666 - DNA, 20 bp, Artificial Sequence
  chemically synthesized
taataatggtacctacctta

SEQ ID NO: 51667 - DNA, 20 bp, Artificial Sequence
  chemically synthesized
aataatggtacctaccttaa

SEQ ID NO: 51668 - DNA, 20 bp, Artificial Sequence
  chemically synthesized
tcccttcaatcccttaaggt

SEQ ID NO: 51669 - DNA, 20 bp, Artificial Sequence
  chemically synthesized
atcccttcaatcccttaagg

SEQ ID NO: 51670 - DNA, 20 bp, Artificial Sequence
  chemically synthesized
gcaatcccttcaatccctta

SEQ ID NO: 51671 - DNA, 20 bp, Artificial Sequence
  chemically synthesized
agcaatcccttcaatccctt

SEQ ID NO: 51672 - DNA, 20 bp, Artificial Sequence
  chemically synthesized
gtacctaccttaagggattg

SEQ ID NO: 51673 - DNA, 20 bp, Artificial Sequence
  chemically synthesized
tacctaccttaagggattga

SEQ ID NO: 51674 - DNA, 20 bp, Artificial Sequence
  chemically synthesized
acctaccttaagggattgaa

SEQ ID NO: 51675 - DNA, 20 bp, Artificial Sequence
  chemically synthesized
gggattgaagggattgctat

SEQ ID NO: 51676 - DNA, 20 bp, Artificial Sequence
  chemically synthesized
ggattgaagggattgctata

SEQ ID NO: 51677 - DNA, 20 bp, Artificial Sequence
  chemically synthesized
tttaactagtttaatcctta

SEQ ID NO: 51678 - DNA, 20 bp, Artificial Sequence
  chemically synthesized
gattgctataaggattaaac

SEQ ID NO: 51679 - DNA, 20 bp, Artificial Sequence
  chemically synthesized
gaaatgttacagattttaac

SEQ ID NO: 51680 - DNA, 20 bp, Artificial Sequence
  chemically synthesized
ctttgtgcctagaaatgtta

SEQ ID NO: 51681 - DNA, 20 bp, Artificial Sequence
  chemically synthesized
gttaaaatctgtaacatttc

SEQ ID NO: 51682 - DNA, 20 bp, Artificial Sequence
  chemically synthesized
ttaaaatctgtaacatttct

SEQ ID NO: 51683 - DNA, 20 bp, Artificial Sequence
  chemically synthesized
ctgtaacatttctaggcaca

SEQ ID NO: 51684 - DNA, 20 bp, Artificial Sequence
  chemically synthesized
taacgcaattactttgtgcc

SEQ ID NO: 51685 - DNA, 20 bp, Artificial Sequence
  chemically synthesized
aagtaattgcgttaaaatga

SEQ ID NO: 51686 - DNA, 20 bp, Artificial Sequence
  chemically synthesized
tcatatatgagtatatatga

SEQ ID NO: 51687 - DNA, 20 bp, Artificial Sequence
  chemically synthesized
gtcatatatgagtatatatg

SEQ ID NO: 51688 - DNA, 20 bp, Artificial Sequence
  chemically synthesized
ggtcatatatgagtatatat

SEQ ID NO: 51689 - DNA, 20 bp, Artificial Sequence
  chemically synthesized
atttccttgtggtcatatat

SEQ ID NO: 51690 - DNA, 20 bp, Artificial Sequence
  chemically synthesized
atatactcatatatgaccac

SEQ ID NO: 51691 - DNA, 20 bp, Artificial Sequence
  chemically synthesized
tatactcatatatgaccaca

SEQ ID NO: 51692 - DNA, 20 bp, Artificial Sequence
  chemically synthesized
cattctgatgtatttccttg

SEQ ID NO: 51693 - DNA, 20 bp, Artificial Sequence
  chemically synthesized
atgaccacaaggaaatacat

SEQ ID NO: 51694 - DNA, 20 bp, Artificial Sequence
  chemically synthesized
gaaatacatcagaatgctaa

SEQ ID NO: 51695 - DNA, 20 bp, Artificial Sequence
  chemically synthesized
cacatggagttaacatctgt

SEQ ID NO: 51696 - DNA, 20 bp, Artificial Sequence
  chemically synthesized
taacagatgttaactccatg

SEQ ID NO: 51697 - DNA, 20 bp, Artificial Sequence
  chemically synthesized
aagccatactttaccacatg

SEQ ID NO: 51698 - DNA, 20 bp, Artificial Sequence
  chemically synthesized
gatgttaactccatgtggta

SEQ ID NO: 51699 - DNA, 20 bp, Artificial Sequence
  chemically synthesized
aaaagccatactttaccaca

SEQ ID NO: 51700 - DNA, 20 bp, Artificial Sequence
  chemically synthesized
taactccatgtggtaaagta

SEQ ID NO: 51701 - DNA, 20 bp, Artificial Sequence
  chemically synthesized
tgagttttttggtatttaaa

SEQ ID NO: 51702 - DNA, 20 bp, Artificial Sequence
  chemically synthesized
agtatatgtgttgagttttt

SEQ ID NO: 51703 - DNA, 20 bp, Artificial Sequence
  chemically synthesized
attataaaagtatatgtgtt

SEQ ID NO: 51704 - DNA, 20 bp, Artificial Sequence
  chemically synthesized
cactttttatttgattataa

SEQ ID NO: 51705 - DNA, 20 bp, Artificial Sequence
  chemically synthesized
tacttttataatcaaataaa

SEQ ID NO: 51706 - DNA, 20 bp, Artificial Sequence
  chemically synthesized
ttttataatcaaataaaaag

SEQ ID NO: 51707 - DNA, 20 bp, Artificial Sequence
  chemically synthesized
tggtataaattaacattaat

SEQ ID NO: 51708 - DNA, 20 bp, Artificial Sequence
  chemically synthesized
gtataaattaacattaatca

SEQ ID NO: 51709 - DNA, 20 bp, Artificial Sequence
  chemically synthesized
tataaattaacattaatcag

SEQ ID NO: 51710 - DNA, 20 bp, Artificial Sequence
  chemically synthesized
taacattaatcagaggaaaa

SEQ ID NO: 51711 - DNA, 20 bp, Artificial Sequence
  chemically synthesized
aacattaatcagaggaaaac

SEQ ID NO: 51712 - DNA, 20 bp, Artificial Sequence
  chemically synthesized
atattgcatattaaattggc

SEQ ID NO: 51713 - DNA, 20 bp, Artificial Sequence
  chemically synthesized
tacaatattgcatattaaat

SEQ ID NO: 51714 - DNA, 20 bp, Artificial Sequence
  chemically synthesized
aatatgcaatattgtataaa

SEQ ID NO: 51715 - DNA, 20 bp, Artificial Sequence
  chemically synthesized
atatgcaatattgtataaat

SEQ ID NO: 51716 - DNA, 20 bp, Artificial Sequence
  chemically synthesized
ttaactgaaagtttaagtat

SEQ ID NO: 51717 - DNA, 20 bp, Artificial Sequence
  chemically synthesized
ttttctaatacttaaacttt

SEQ ID NO: 51718 - DNA, 20 bp, Artificial Sequence
  chemically synthesized
ccttggttaactgaaagttt

SEQ ID NO: 51719 - DNA, 20 bp, Artificial Sequence
  chemically synthesized
aaataaccttggttaactga

SEQ ID NO: 51720 - DNA, 20 bp, Artificial Sequence
  chemically synthesized
acttaaactttcagttaacc

SEQ ID NO: 51721 - DNA, 20 bp, Artificial Sequence
  chemically synthesized
cttaaactttcagttaacca

SEQ ID NO: 51722 - DNA, 20 bp, Artificial Sequence
  chemically synthesized
aatactaagagaaataacct

SEQ ID NO: 51723 - DNA, 20 bp, Artificial Sequence
  chemically synthesized
ttaaccaaggttatttctct

SEQ ID NO: 51724 - DNA, 20 bp, Artificial Sequence
  chemically synthesized
gtttttataattaatactaa

SEQ ID NO: 51725 - DNA, 20 bp, Artificial Sequence
  chemically synthesized
atgtttttataattaatact

SEQ ID NO: 51726 - DNA, 20 bp, Artificial Sequence
  chemically synthesized
taaaaacataattaataaaa

SEQ ID NO: 51727 - DNA, 20 bp, Artificial Sequence
  chemically synthesized
aattaataaaatagcaaaac

SEQ ID NO: 51728 - DNA, 20 bp, Artificial Sequence
  chemically synthesized
tagccattctttttatttac

SEQ ID NO: 51729 - DNA, 20 bp, Artificial Sequence
  chemically synthesized
tagcaaaaccagtaaataaa

SEQ ID NO: 51730 - DNA, 20 bp, Artificial Sequence
  chemically synthesized
aaaccagtaaataaaaagaa

SEQ ID NO: 51731 - DNA, 20 bp, Artificial Sequence
  chemically synthesized
cagtaaataaaaagaatggc

SEQ ID NO: 51732 - DNA, 20 bp, Artificial Sequence
  chemically synthesized
gtaaataaaaagaatggcta

SEQ ID NO: 51733 - DNA, 20 bp, Artificial Sequence
  chemically synthesized
taaataaaaagaatggctag

SEQ ID NO: 51734 - DNA, 20 bp, Artificial Sequence
  chemically synthesized
aaaaagaatggctagaggtc

SEQ ID NO: 51735 - DNA, 20 bp, Artificial Sequence
  chemically synthesized
ctccttttgttcttgacctc

SEQ ID NO: 51736 - DNA, 20 bp, Artificial Sequence
  chemically synthesized
tggctagaggtcaagaacaa

SEQ ID NO: 51737 - DNA, 20 bp, Artificial Sequence
  chemically synthesized
ggctagaggtcaagaacaaa

SEQ ID NO: 51738 - DNA, 20 bp, Artificial Sequence
  chemically synthesized
ctagaggtcaagaacaaaag

SEQ ID NO: 51739 - DNA, 20 bp, Artificial Sequence
  chemically synthesized
caagaacaaaaggagaatac

SEQ ID NO: 51740 - DNA, 20 bp, Artificial Sequence
  chemically synthesized
aagaacaaaaggagaataca

SEQ ID NO: 51741 - DNA, 20 bp, Artificial Sequence
  chemically synthesized
agtgctaggattacattcgt

SEQ ID NO: 51742 - DNA, 20 bp, Artificial Sequence
  chemically synthesized
aaggctcacgaatgtaatcc

SEQ ID NO: 51743 - DNA, 20 bp, Artificial Sequence
  chemically synthesized
cgaatgtaatcctagcactt

SEQ ID NO: 51744 - DNA, 20 bp, Artificial Sequence
  chemically synthesized
ccttggcctcccaaagtgct

SEQ ID NO: 51745 - DNA, 20 bp, Artificial Sequence
  chemically synthesized
gaatgtaatcctagcacttt

SEQ ID NO: 51746 - DNA, 20 bp, Artificial Sequence
  chemically synthesized
gccttggcctcccaaagtgc

SEQ ID NO: 51747 - DNA, 20 bp, Artificial Sequence
  chemically synthesized
atgtaatcctagcactttgg

SEQ ID NO: 51748 - DNA, 20 bp, Artificial Sequence
  chemically synthesized
tgtaatcctagcactttggg

SEQ ID NO: 51749 - DNA, 20 bp, Artificial Sequence
  chemically synthesized
ccactcgccttggcctccca

SEQ ID NO: 51750 - DNA, 20 bp, Artificial Sequence
  chemically synthesized
tcctagcactttgggaggcc

SEQ ID NO: 51751 - DNA, 20 bp, Artificial Sequence
  chemically synthesized
cctagcactttgggaggcca

SEQ ID NO: 51752 - DNA, 20 bp, Artificial Sequence
  chemically synthesized
gcactttgggaggccaaggc

SEQ ID NO: 51753 - DNA, 20 bp, Artificial Sequence
  chemically synthesized
ctttgggaggccaaggcgag

SEQ ID NO: 51754 - DNA, 20 bp, Artificial Sequence
  chemically synthesized
ctcaagtgatccactcgcct

SEQ ID NO: 51755 - DNA, 20 bp, Artificial Sequence
  chemically synthesized
ccaaggcgagtggatcactt

SEQ ID NO: 51756 - DNA, 20 bp, Artificial Sequence
  chemically synthesized
caaggcgagtggatcacttg

SEQ ID NO: 51757 - DNA, 20 bp, Artificial Sequence
  chemically synthesized
gcgagtggatcacttgaggt

SEQ ID NO: 51758 - DNA, 20 bp, Artificial Sequence
  chemically synthesized
cgagtggatcacttgaggtc

SEQ ID NO: 51759 - DNA, 20 bp, Artificial Sequence
  chemically synthesized
ggtctcgagctcctgacctc

SEQ ID NO: 51760 - DNA, 20 bp, Artificial Sequence
  chemically synthesized
agtggatcacttgaggtcag

SEQ ID NO: 51761 - DNA, 20 bp, Artificial Sequence
  chemically synthesized
tcacttgaggtcaggagctc

SEQ ID NO: 51762 - DNA, 20 bp, Artificial Sequence
  chemically synthesized
tgaggtcaggagctcgagac

SEQ ID NO: 51763 - DNA, 20 bp, Artificial Sequence
  chemically synthesized
acattggtcaggctggtctc

SEQ ID NO: 51764 - DNA, 20 bp, Artificial Sequence
  chemically synthesized
cttcaccacattggtcaggc

SEQ ID NO: 51765 - DNA, 20 bp, Artificial Sequence
  chemically synthesized
gaggcttcaccacattggtc

SEQ ID NO: 51766 - DNA, 20 bp, Artificial Sequence
  chemically synthesized
cgagaccagcctgaccaatg

SEQ ID NO: 51767 - DNA, 20 bp, Artificial Sequence
  chemically synthesized
cgaggcttcaccacattggt

SEQ ID NO: 51768 - DNA, 20 bp, Artificial Sequence
  chemically synthesized
gagacgaggcttcaccacat

SEQ ID NO: 51769 - DNA, 20 bp, Artificial Sequence
  chemically synthesized
ccagcctgaccaatgtggtg

SEQ ID NO: 51770 - DNA, 20 bp, Artificial Sequence
  chemically synthesized
gtatttttttagtagagacg

SEQ ID NO: 51771 - DNA, 20 bp, Artificial Sequence
  chemically synthesized
tgtatttttttagtagagac

SEQ ID NO: 51772 - DNA, 20 bp, Artificial Sequence
  chemically synthesized
atttttgtatttttttagta

SEQ ID NO: 51773 - DNA, 20 bp, Artificial Sequence
  chemically synthesized
taatttttgtatttttttag

SEQ ID NO: 51774 - DNA, 20 bp, Artificial Sequence
  chemically synthesized
agataatttttgtatttttt

SEQ ID NO: 51775 - DNA, 20 bp, Artificial Sequence
  chemically synthesized
aaaaaaatacaaaaattatc

SEQ ID NO: 51776 - DNA, 20 bp, Artificial Sequence
  chemically synthesized
aaaaaatacaaaaattatct

SEQ ID NO: 51777 - DNA, 20 bp, Artificial Sequence
  chemically synthesized
atacaaaaattatctgggcc

SEQ ID NO: 51778 - DNA, 20 bp, Artificial Sequence
  chemically synthesized
caaaaattatctgggcctgg

SEQ ID NO: 51779 - DNA, 20 bp, Artificial Sequence
  chemically synthesized
caggtgtacaccaccaggcc

SEQ ID NO: 51780 - DNA, 20 bp, Artificial Sequence
  chemically synthesized
gactacaggtgtacaccacc

SEQ ID NO: 51781 - DNA, 20 bp, Artificial Sequence
  chemically synthesized
ggactacaggtgtacaccac

SEQ ID NO: 51782 - DNA, 20 bp, Artificial Sequence
  chemically synthesized
ggcctggtggtgtacacctg

SEQ ID NO: 51783 - DNA, 20 bp, Artificial Sequence
  chemically synthesized
gtggtgtacacctgtagtcc

SEQ ID NO: 51784 - DNA, 20 bp, Artificial Sequence
  chemically synthesized
tcccgagtagctgggactac

SEQ ID NO: 51785 - DNA, 20 bp, Artificial Sequence
  chemically synthesized
ctcccgagtagctgggacta

SEQ ID NO: 51786 - DNA, 20 bp, Artificial Sequence
  chemically synthesized
cacctgtagtcccagctact

SEQ ID NO: 51787 - DNA, 20 bp, Artificial Sequence
  chemically synthesized
cctcagcctcccgagtagct

SEQ ID NO: 51788 - DNA, 20 bp, Artificial Sequence
  chemically synthesized
acctgtagtcccagctactc

SEQ ID NO: 51789 - DNA, 20 bp, Artificial Sequence
  chemically synthesized
gcctcagcctcccgagtagc

SEQ ID NO: 51790 - DNA, 20 bp, Artificial Sequence
  chemically synthesized
ctgtagtcccagctactcgg

SEQ ID NO: 51791 - DNA, 20 bp, Artificial Sequence
  chemically synthesized
tgtagtcccagctactcggg

SEQ ID NO: 51792 - DNA, 20 bp, Artificial Sequence
  chemically synthesized
tcctgcctcagcctcccgag

SEQ ID NO: 51793 - DNA, 20 bp, Artificial Sequence
  chemically synthesized
ttctcctgcctcagcctccc

SEQ ID NO: 51794 - DNA, 20 bp, Artificial Sequence
  chemically synthesized
tcccagctactcgggaggct

SEQ ID NO: 51795 - DNA, 20 bp, Artificial Sequence
  chemically synthesized
cccagctactcgggaggctg

SEQ ID NO: 51796 - DNA, 20 bp, Artificial Sequence
  chemically synthesized
agctactcgggaggctgagg

SEQ ID NO: 51797 - DNA, 20 bp, Artificial Sequence
  chemically synthesized
gctactcgggaggctgaggc

SEQ ID NO: 51798 - DNA, 20 bp, Artificial Sequence
  chemically synthesized
tactcgggaggctgaggcag

SEQ ID NO: 51799 - DNA, 20 bp, Artificial Sequence
  chemically synthesized
ttcaaactattctcctgcct

SEQ ID NO: 51800 - DNA, 20 bp, Artificial Sequence
  chemically synthesized
gggaggctgaggcaggagaa

SEQ ID NO: 51801 - DNA, 20 bp, Artificial Sequence
  chemically synthesized
gcaggagaatagtttgaacc

SEQ ID NO: 51802 - DNA, 20 bp, Artificial Sequence
  chemically synthesized
caggagaatagtttgaaccc

SEQ ID NO: 51803 - DNA, 20 bp, Artificial Sequence
  chemically synthesized
ggagaatagtttgaacccgg

SEQ ID NO: 51804 - DNA, 20 bp, Artificial Sequence
  chemically synthesized
gagaatagtttgaacccggg

SEQ ID NO: 51805 - DNA, 20 bp, Artificial Sequence
  chemically synthesized
aatagtttgaacccgggagg

SEQ ID NO: 51806 - DNA, 20 bp, Artificial Sequence
  chemically synthesized
cactgcaacctccgcctccc

SEQ ID NO: 51807 - DNA, 20 bp, Artificial Sequence
  chemically synthesized
tagtttgaacccgggaggcg

SEQ ID NO: 51808 - DNA, 20 bp, Artificial Sequence
  chemically synthesized
tcactgcaacctccgcctcc

SEQ ID NO: 51809 - DNA, 20 bp, Artificial Sequence
  chemically synthesized
agtttgaacccgggaggcgg

SEQ ID NO: 51810 - DNA, 20 bp, Artificial Sequence
  chemically synthesized
aacccgggaggcggaggttg

SEQ ID NO: 51811 - DNA, 20 bp, Artificial Sequence
  chemically synthesized
cgggaggcggaggttgcagt

SEQ ID NO: 51812 - DNA, 20 bp, Artificial Sequence
  chemically synthesized
ggcggaggttgcagtgagcc

SEQ ID NO: 51813 - DNA, 20 bp, Artificial Sequence
  chemically synthesized
tgagtgcagtggcgtgatct

SEQ ID NO: 51814 - DNA, 20 bp, Artificial Sequence
  chemically synthesized
cacccaggctgtgagtgcag

SEQ ID NO: 51815 - DNA, 20 bp, Artificial Sequence
  chemically synthesized
agatcacgccactgcactca

SEQ ID NO: 51816 - DNA, 20 bp, Artificial Sequence
  chemically synthesized
tgtcacccaggctgtgagtg

SEQ ID NO: 51817 - DNA, 20 bp, Artificial Sequence
  chemically synthesized
acgccactgcactcacagcc

SEQ ID NO: 51818 - DNA, 20 bp, Artificial Sequence
  chemically synthesized
cgccactgcactcacagcct

SEQ ID NO: 51819 - DNA, 20 bp, Artificial Sequence
  chemically synthesized
cattctgtcacccaggctgt

SEQ ID NO: 51820 - DNA, 20 bp, Artificial Sequence
  chemically synthesized
tgcactcacagcctgggtga

SEQ ID NO: 51821 - DNA, 20 bp, Artificial Sequence
  chemically synthesized
ggagcctcattctgtcaccc

SEQ ID NO: 51822 - DNA, 20 bp, Artificial Sequence
  chemically synthesized
gggagcctcattctgtcacc

SEQ ID NO: 51823 - DNA, 20 bp, Artificial Sequence
  chemically synthesized
cacagcctgggtgacagaat

SEQ ID NO: 51824 - DNA, 20 bp, Artificial Sequence
  chemically synthesized
acagcctgggtgacagaatg

SEQ ID NO: 51825 - DNA, 20 bp, Artificial Sequence
  chemically synthesized
ttttttttttttttgagagg

SEQ ID NO: 51826 - DNA, 20 bp, Artificial Sequence
  chemically synthesized
ttttttttttttttttgaga

SEQ ID NO: 51827 - DNA, 20 bp, Artificial Sequence
  chemically synthesized
tttttttttttttttttgag

SEQ ID NO: 51828 - DNA, 20 bp, Artificial Sequence
  chemically synthesized
ttttttttttttttttttga

SEQ ID NO: 51829 - DNA, 20 bp, Artificial Sequence
  chemically synthesized
tttttttttttttttttttt

SEQ ID NO: 51830 - DNA, 20 bp, Artificial Sequence
  chemically synthesized
aaaaaaaaaaaaaaaaaaaa

SEQ ID NO: 51831 - DNA, 20 bp, Artificial Sequence
  chemically synthesized
aaaaaaaaaaaaaaaaaaaa

SEQ ID NO: 51832 - DNA, 20 bp, Artificial Sequence
  chemically synthesized
aaaaaaaaaaaaaaaaaagg

SEQ ID NO: 51833 - DNA, 20 bp, Artificial Sequence
  chemically synthesized
aaaaaaaaaaaaaaaaagga

SEQ ID NO: 51834 - DNA, 20 bp, Artificial Sequence
  chemically synthesized
aaaaaaaggaaggatgcaaa

SEQ ID NO: 51835 - DNA, 20 bp, Artificial Sequence
  chemically synthesized
aaaggaaggatgcaaacagt

SEQ ID NO: 51836 - DNA, 20 bp, Artificial Sequence
  chemically synthesized
aaggaaggatgcaaacagtt

SEQ ID NO: 51837 - DNA, 20 bp, Artificial Sequence
  chemically synthesized
aggaaggatgcaaacagtta

SEQ ID NO: 51838 - DNA, 20 bp, Artificial Sequence
  chemically synthesized
aggatgcaaacagttaggga

SEQ ID NO: 51839 - DNA, 20 bp, Artificial Sequence
  chemically synthesized
ggatgcaaacagttagggaa

SEQ ID NO: 51840 - DNA, 20 bp, Artificial Sequence
  chemically synthesized
ttagggaaaggaaatgccca

SEQ ID NO: 51841 - DNA, 20 bp, Artificial Sequence
  chemically synthesized
tagggaaaggaaatgcccat

SEQ ID NO: 51842 - DNA, 20 bp, Artificial Sequence
  chemically synthesized
aaaggaaatgcccataggct

SEQ ID NO: 51843 - DNA, 20 bp, Artificial Sequence
  chemically synthesized
aagttgaaacctcagcctat

SEQ ID NO: 51844 - DNA, 20 bp, Artificial Sequence
  chemically synthesized
aaggaaatgcccataggctg

SEQ ID NO: 51845 - DNA, 20 bp, Artificial Sequence
  chemically synthesized
caagttgaaacctcagccta

SEQ ID NO: 51846 - DNA, 20 bp, Artificial Sequence
  chemically synthesized
atgcctccaagttgaaacct

SEQ ID NO: 51847 - DNA, 20 bp, Artificial Sequence
  chemically synthesized
cataggctgaggtttcaact

SEQ ID NO: 51848 - DNA, 20 bp, Artificial Sequence
  chemically synthesized
taggctgaggtttcaacttg

SEQ ID NO: 51849 - DNA, 20 bp, Artificial Sequence
  chemically synthesized
aggctgaggtttcaacttgg

SEQ ID NO: 51850 - DNA, 20 bp, Artificial Sequence
  chemically synthesized
gaggtttcaacttggaggca

SEQ ID NO: 51851 - DNA, 20 bp, Artificial Sequence
  chemically synthesized
taaataaatactatgcctcc

SEQ ID NO: 51852 - DNA, 20 bp, Artificial Sequence
  chemically synthesized
ataatattttacatatttat

SEQ ID NO: 51853 - DNA, 20 bp, Artificial Sequence
  chemically synthesized
taatattttacatatttatg

SEQ ID NO: 51854 - DNA, 20 bp, Artificial Sequence
  chemically synthesized
gaggtaatgtgatattttac

SEQ ID NO: 51855 - DNA, 20 bp, Artificial Sequence
  chemically synthesized
aatgtgatattttactggca

SEQ ID NO: 51856 - DNA, 20 bp, Artificial Sequence
  chemically synthesized
gatcattatgcattctatgc

SEQ ID NO: 51857 - DNA, 20 bp, Artificial Sequence
  chemically synthesized
gcatagaatgcataatgatc

SEQ ID NO: 51858 - DNA, 20 bp, Artificial Sequence
  chemically synthesized
agaatgcataatgatcaagt

SEQ ID NO: 51859 - DNA, 20 bp, Artificial Sequence
  chemically synthesized
gaatgcataatgatcaagtc

SEQ ID NO: 51860 - DNA, 20 bp, Artificial Sequence
  chemically synthesized
aatgcataatgatcaagtca

SEQ ID NO: 51861 - DNA, 20 bp, Artificial Sequence
  chemically synthesized
atgatcaagtcagggtattt

SEQ ID NO: 51862 - DNA, 20 bp, Artificial Sequence
  chemically synthesized
tgatcaagtcagggtatttg

SEQ ID NO: 51863 - DNA, 20 bp, Artificial Sequence
  chemically synthesized
tttgaggcatccattacttt

SEQ ID NO: 51864 - DNA, 20 bp, Artificial Sequence
  chemically synthesized
atgacaaatactcaaagtaa

SEQ ID NO: 51865 - DNA, 20 bp, Artificial Sequence
  chemically synthesized
agacaaatgacaaatactca

SEQ ID NO: 51866 - DNA, 20 bp, Artificial Sequence
  chemically synthesized
tttgtcatttgtctatgtat

SEQ ID NO: 51867 - DNA, 20 bp, Artificial Sequence
  chemically synthesized
ttgtcatttgtctatgtatt

SEQ ID NO: 51868 - DNA, 20 bp, Artificial Sequence
  chemically synthesized
cttgaattgttcccaataca

SEQ ID NO: 51869 - DNA, 20 bp, Artificial Sequence
  chemically synthesized
ctatgtattgggaacaattc

SEQ ID NO: 51870 - DNA, 20 bp, Artificial Sequence
  chemically synthesized
ttcaaagtaccaagaagaaa

SEQ ID NO: 51871 - DNA, 20 bp, Artificial Sequence
  chemically synthesized
caattcaagccctttcttct

SEQ ID NO: 51872 - DNA, 20 bp, Artificial Sequence
  chemically synthesized
tttcaaagtaccaagaagaa

SEQ ID NO: 51873 - DNA, 20 bp, Artificial Sequence
  chemically synthesized
atttcaaagtaccaagaaga

SEQ ID NO: 51874 - DNA, 20 bp, Artificial Sequence
  chemically synthesized
gtatatttcaaagtaccaag

SEQ ID NO: 51875 - DNA, 20 bp, Artificial Sequence
  chemically synthesized
gttgtatatttcaaagtacc

SEQ ID NO: 51876 - DNA, 20 bp, Artificial Sequence
  chemically synthesized
acgatgtgttgtatatttca

SEQ ID NO: 51877 - DNA, 20 bp, Artificial Sequence
  chemically synthesized
caacacatcgttgttaacta

SEQ ID NO: 51878 - DNA, 20 bp, Artificial Sequence
  chemically synthesized
acagcagaatagagtgactg

SEQ ID NO: 51879 - DNA, 20 bp, Artificial Sequence
  chemically synthesized
tatcatttgacagcagaata

SEQ ID NO: 51880 - DNA, 20 bp, Artificial Sequence
  chemically synthesized
tatatcatttgacagcagaa

SEQ ID NO: 51881 - DNA, 20 bp, Artificial Sequence
  chemically synthesized
tacgttatatcatttgacag

SEQ ID NO: 51882 - DNA, 20 bp, Artificial Sequence
  chemically synthesized
gactacgttatatcatttga

SEQ ID NO: 51883 - DNA, 20 bp, Artificial Sequence
  chemically synthesized
tgctgtcaaatgatataacg

SEQ ID NO: 51884 - DNA, 20 bp, Artificial Sequence
  chemically synthesized
caaacatccagttagataga

SEQ ID NO: 51885 - DNA, 20 bp, Artificial Sequence
  chemically synthesized
acaaacatccagttagatag

SEQ ID NO: 51886 - DNA, 20 bp, Artificial Sequence
  chemically synthesized
acgtagtccttctatctaac

SEQ ID NO: 51887 - DNA, 20 bp, Artificial Sequence
  chemically synthesized
ggtacaaacatccagttaga

SEQ ID NO: 51888 - DNA, 20 bp, Artificial Sequence
  chemically synthesized
aatgggtacaaacatccagt

SEQ ID NO: 51889 - DNA, 20 bp, Artificial Sequence
  chemically synthesized
ggttaatgggtacaaacatc

SEQ ID NO: 51890 - DNA, 20 bp, Artificial Sequence
  chemically synthesized
ataaagagagggtggttaat

SEQ ID NO: 51891 - DNA, 20 bp, Artificial Sequence
  chemically synthesized
gataaagagagggtggttaa

SEQ ID NO: 51892 - DNA, 20 bp, Artificial Sequence
  chemically synthesized
agggggagataaagagaggg

SEQ ID NO: 51893 - DNA, 20 bp, Artificial Sequence
  chemically synthesized
tagagggggagataaagaga

SEQ ID NO: 51894 - DNA, 20 bp, Artificial Sequence
  chemically synthesized
gtagagggggagataaagag

SEQ ID NO: 51895 - DNA, 20 bp, Artificial Sequence
  chemically synthesized
ggtagagggggagataaaga

SEQ ID NO: 51896 - DNA, 20 bp, Artificial Sequence
  chemically synthesized
tgggtagagggggagataaa

SEQ ID NO: 51897 - DNA, 20 bp, Artificial Sequence
  chemically synthesized
tgtgggtagagggggagata

SEQ ID NO: 51898 - DNA, 20 bp, Artificial Sequence
  chemically synthesized
aaggtgtgtgggtagagggg

SEQ ID NO: 51899 - DNA, 20 bp, Artificial Sequence
  chemically synthesized
gaaaggtgtgtgggtagagg

SEQ ID NO: 51900 - DNA, 20 bp, Artificial Sequence
  chemically synthesized
ggaaaggtgtgtgggtagag

SEQ ID NO: 51901 - DNA, 20 bp, Artificial Sequence
  chemically synthesized
gggaaaggtgtgtgggtaga

SEQ ID NO: 51902 - DNA, 20 bp, Artificial Sequence
  chemically synthesized
tgggaaaggtgtgtgggtag

SEQ ID NO: 51903 - DNA, 20 bp, Artificial Sequence
  chemically synthesized
ctgggaaaggtgtgtgggta

SEQ ID NO: 51904 - DNA, 20 bp, Artificial Sequence
  chemically synthesized
ggctgggaaaggtgtgtggg

SEQ ID NO: 51905 - DNA, 20 bp, Artificial Sequence
  chemically synthesized
agtggctgggaaaggtgtgt

SEQ ID NO: 51906 - DNA, 20 bp, Artificial Sequence
  chemically synthesized
tagtggctgggaaaggtgtg

SEQ ID NO: 51907 - DNA, 20 bp, Artificial Sequence
  chemically synthesized
ctctacccacacacctttcc

SEQ ID NO: 51908 - DNA, 20 bp, Artificial Sequence
  chemically synthesized
tagatactagtggctgggaa

SEQ ID NO: 51909 - DNA, 20 bp, Artificial Sequence
  chemically synthesized
atagatactagtggctggga

SEQ ID NO: 51910 - DNA, 20 bp, Artificial Sequence
  chemically synthesized
cacacacctttcccagccac

SEQ ID NO: 51911 - DNA, 20 bp, Artificial Sequence
  chemically synthesized
aatgatagatactagtggct

SEQ ID NO: 51912 - DNA, 20 bp, Artificial Sequence
  chemically synthesized
gaatgatagatactagtggc

SEQ ID NO: 51913 - DNA, 20 bp, Artificial Sequence
  chemically synthesized
aatagaatgatagatactag

SEQ ID NO: 51914 - DNA, 20 bp, Artificial Sequence
  chemically synthesized
tagaatagaatgatagatac

SEQ ID NO: 51915 - DNA, 20 bp, Artificial Sequence
  chemically synthesized
ataaacatagaatagaatga

SEQ ID NO: 51916 - DNA, 20 bp, Artificial Sequence
  chemically synthesized
aattgataataaacatagaa

SEQ ID NO: 51917 - DNA, 20 bp, Artificial Sequence
  chemically synthesized
aaaaaaattgataataaaca

SEQ ID NO: 51918 - DNA, 20 bp, Artificial Sequence
  chemically synthesized
atgtttattatcaatttttt

SEQ ID NO: 51919 - DNA, 20 bp, Artificial Sequence
  chemically synthesized
tcaatttttttagctcccac

SEQ ID NO: 51920 - DNA, 20 bp, Artificial Sequence
  chemically synthesized
aatttttttagctcccacaa

SEQ ID NO: 51921 - DNA, 20 bp, Artificial Sequence
  chemically synthesized
gcatgttcttactcttgtgg

SEQ ID NO: 51922 - DNA, 20 bp, Artificial Sequence
  chemically synthesized
tcgcatgttcttactcttgt

SEQ ID NO: 51923 - DNA, 20 bp, Artificial Sequence
  chemically synthesized
tttttagctcccacaagagt

SEQ ID NO: 51924 - DNA, 20 bp, Artificial Sequence
  chemically synthesized
atcgcatgttcttactcttg

SEQ ID NO: 51925 - DNA, 20 bp, Artificial Sequence
  chemically synthesized
cgatttttgtctttctgtgc

SEQ ID NO: 51926 - DNA, 20 bp, Artificial Sequence
  chemically synthesized
tgaaataaccctggcacaga

SEQ ID NO: 51927 - DNA, 20 bp, Artificial Sequence
  chemically synthesized
gatttttgtctttctgtgcc

SEQ ID NO: 51928 - DNA, 20 bp, Artificial Sequence
  chemically synthesized
atttttgtctttctgtgcca

SEQ ID NO: 51929 - DNA, 20 bp, Artificial Sequence
  chemically synthesized
taagtgaaataaccctggca

SEQ ID NO: 51930 - DNA, 20 bp, Artificial Sequence
  chemically synthesized
tatgttaagtgaaataaccc

SEQ ID NO: 51931 - DNA, 20 bp, Artificial Sequence
  chemically synthesized
gaactggaggtcattatgtt

SEQ ID NO: 51932 - DNA, 20 bp, Artificial Sequence
  chemically synthesized
tcacttaacataatgacctc

SEQ ID NO: 51933 - DNA, 20 bp, Artificial Sequence
  chemically synthesized
agcaacatggatggaactgg

SEQ ID NO: 51934 - DNA, 20 bp, Artificial Sequence
  chemically synthesized
cagcaacatggatggaactg

SEQ ID NO: 51935 - DNA, 20 bp, Artificial Sequence
  chemically synthesized
cacagcaacatggatggaac

SEQ ID NO: 51936 - DNA, 20 bp, Artificial Sequence
  chemically synthesized
gtcattcacagcaacatgga

SEQ ID NO: 51937 - DNA, 20 bp, Artificial Sequence
  chemically synthesized
ccatgtcattcacagcaaca

SEQ ID NO: 51938 - DNA, 20 bp, Artificial Sequence
  chemically synthesized
gaatgaaaccatgtcattca

SEQ ID NO: 51939 - DNA, 20 bp, Artificial Sequence
  chemically synthesized
ccatgttgctgtgaatgaca

SEQ ID NO: 51940 - DNA, 20 bp, Artificial Sequence
  chemically synthesized
atgacatggtttcattcttg

SEQ ID NO: 51941 - DNA, 20 bp, Artificial Sequence
  chemically synthesized
tgtacacaatgaaacactgc

SEQ ID NO: 51942 - DNA, 20 bp, Artificial Sequence
  chemically synthesized
ttgcagtgtttcattgtgta

SEQ ID NO: 51943 - DNA, 20 bp, Artificial Sequence
  chemically synthesized
atgaatggataaagaatatg

SEQ ID NO: 51944 - DNA, 20 bp, Artificial Sequence
  chemically synthesized
tatcaacagatgaatggata

SEQ ID NO: 51945 - DNA, 20 bp, Artificial Sequence
  chemically synthesized
agtgtatatcaacagatgaa

SEQ ID NO: 51946 - DNA, 20 bp, Artificial Sequence
  chemically synthesized
tcaacctaagtgtatatcaa

SEQ ID NO: 51947 - DNA, 20 bp, Artificial Sequence
  chemically synthesized
ttcatctgttgatatacact

SEQ ID NO: 51948 - DNA, 20 bp, Artificial Sequence
  chemically synthesized
tcatctgttgatatacactt

SEQ ID NO: 51949 - DNA, 20 bp, Artificial Sequence
  chemically synthesized
caaagatgtgaaatcaacct

SEQ ID NO: 51950 - DNA, 20 bp, Artificial Sequence
  chemically synthesized
cagcactgtttaaaacagca

SEQ ID NO: 51951 - DNA, 20 bp, Artificial Sequence
  chemically synthesized
cacatctttgctgttttaaa

SEQ ID NO: 51952 - DNA, 20 bp, Artificial Sequence
  chemically synthesized
tatcacagcactgtttaaaa

SEQ ID NO: 51953 - DNA, 20 bp, Artificial Sequence
  chemically synthesized
gttttaaacagtgctgtgat

SEQ ID NO: 51954 - DNA, 20 bp, Artificial Sequence
  chemically synthesized
ctgcacttgcatgcttatca

SEQ ID NO: 51955 - DNA, 20 bp, Artificial Sequence
  chemically synthesized
cagtgctgtgataagcatgc

SEQ ID NO: 51956 - DNA, 20 bp, Artificial Sequence
  chemically synthesized
ctgtgataagcatgcaagtg

SEQ ID NO: 51957 - DNA, 20 bp, Artificial Sequence
  chemically synthesized
tgtgataagcatgcaagtgc

SEQ ID NO: 51958 - DNA, 20 bp, Artificial Sequence
  chemically synthesized
aagaaatcagtatatcaaaa

SEQ ID NO: 51959 - DNA, 20 bp, Artificial Sequence
  chemically synthesized
taagaaatcagtatatcaaa

SEQ ID NO: 51960 - DNA, 20 bp, Artificial Sequence
  chemically synthesized
ctaagaaatcagtatatcaa

SEQ ID NO: 51961 - DNA, 20 bp, Artificial Sequence
  chemically synthesized
cttttgatatactgatttct

SEQ ID NO: 51962 - DNA, 20 bp, Artificial Sequence
  chemically synthesized
ccatcccaaagctaagaaat

SEQ ID NO: 51963 - DNA, 20 bp, Artificial Sequence
  chemically synthesized
atatactgatttcttagctt

SEQ ID NO: 51964 - DNA, 20 bp, Artificial Sequence
  chemically synthesized
tatactgatttcttagcttt

SEQ ID NO: 51965 - DNA, 20 bp, Artificial Sequence
  chemically synthesized
tggttatccatcccaaagct

SEQ ID NO: 51966 - DNA, 20 bp, Artificial Sequence
  chemically synthesized
ctgatttcttagctttggga

SEQ ID NO: 51967 - DNA, 20 bp, Artificial Sequence
  chemically synthesized
actactggttatccatccca

SEQ ID NO: 51968 - DNA, 20 bp, Artificial Sequence
  chemically synthesized
ttagctttgggatggataac

SEQ ID NO: 51969 - DNA, 20 bp, Artificial Sequence
  chemically synthesized
gctttgggatggataaccag

SEQ ID NO: 51970 - DNA, 20 bp, Artificial Sequence
  chemically synthesized
ttgggatggataaccagtag

SEQ ID NO: 51971 - DNA, 20 bp, Artificial Sequence
  chemically synthesized
tgggatggataaccagtagt

SEQ ID NO: 51972 - DNA, 20 bp, Artificial Sequence
  chemically synthesized
ccatctggcaatcccactac

SEQ ID NO: 51973 - DNA, 20 bp, Artificial Sequence
  chemically synthesized
ataaccagtagtgggattgc

SEQ ID NO: 51974 - DNA, 20 bp, Artificial Sequence
  chemically synthesized
ccagtagtgggattgccaga

SEQ ID NO: 51975 - DNA, 20 bp, Artificial Sequence
  chemically synthesized
tagtgggattgccagatggt

SEQ ID NO: 51976 - DNA, 20 bp, Artificial Sequence
  chemically synthesized
agtgggattgccagatggta

SEQ ID NO: 51977 - DNA, 20 bp, Artificial Sequence
  chemically synthesized
aatagaactaccttaccatc

SEQ ID NO: 51978 - DNA, 20 bp, Artificial Sequence
  chemically synthesized
gggattgccagatggtaagg

SEQ ID NO: 51979 - DNA, 20 bp, Artificial Sequence
  chemically synthesized
tggtaaggtagttctattta

SEQ ID NO: 51980 - DNA, 20 bp, Artificial Sequence
  chemically synthesized
gattctcaacaaactgtaaa

SEQ ID NO: 51981 - DNA, 20 bp, Artificial Sequence
  chemically synthesized
agttctatttacagtttgtt

SEQ ID NO: 51982 - DNA, 20 bp, Artificial Sequence
  chemically synthesized
agtaaattagtaacagtatg

SEQ ID NO: 51983 - DNA, 20 bp, Artificial Sequence
  chemically synthesized
atgtaacagtaaattagtaa

SEQ ID NO: 51984 - DNA, 20 bp, Artificial Sequence
  chemically synthesized
atgaaaatgtaacagtaaat

SEQ ID NO: 51985 - DNA, 20 bp, Artificial Sequence
  chemically synthesized
cagtgttgatgaaaatgtaa

SEQ ID NO: 51986 - DNA, 20 bp, Artificial Sequence
  chemically synthesized
cattttcatcaacactgtaa

SEQ ID NO: 51987 - DNA, 20 bp, Artificial Sequence
  chemically synthesized
ttttcatcaacactgtaaaa

SEQ ID NO: 51988 - DNA, 20 bp, Artificial Sequence
  chemically synthesized
gaagaaagggaactctttta

SEQ ID NO: 51989 - DNA, 20 bp, Artificial Sequence
  chemically synthesized
ctggtgagaatgtgaagaaa

SEQ ID NO: 51990 - DNA, 20 bp, Artificial Sequence
  chemically synthesized
tctggtgagaatgtgaagaa

SEQ ID NO: 51991 - DNA, 20 bp, Artificial Sequence
  chemically synthesized
ttctggtgagaatgtgaaga

SEQ ID NO: 51992 - DNA, 20 bp, Artificial Sequence
  chemically synthesized
cagattctggtgagaatgtg

SEQ ID NO: 51993 - DNA, 20 bp, Artificial Sequence
  chemically synthesized
ccctttcttcacattctcac

SEQ ID NO: 51994 - DNA, 20 bp, Artificial Sequence
  chemically synthesized
aaaaaataacagattctggt

SEQ ID NO: 51995 - DNA, 20 bp, Artificial Sequence
  chemically synthesized
agacaaaaaataacagattc

SEQ ID NO: 51996 - DNA, 20 bp, Artificial Sequence
  chemically synthesized
attcaaaagacaaaaaataa

SEQ ID NO: 51997 - DNA, 20 bp, Artificial Sequence
  chemically synthesized
ttagaatggctattattcaa

SEQ ID NO: 51998 - DNA, 20 bp, Artificial Sequence
  chemically synthesized
attttttgtcttttgaataa

SEQ ID NO: 51999 - DNA, 20 bp, Artificial Sequence
  chemically synthesized
tgaataatagccattctaat

SEQ ID NO: 52000 - DNA, 20 bp, Artificial Sequence
  chemically synthesized
tcgtcttaccccaattagaa

SEQ ID NO: 52001 - DNA, 20 bp, Artificial Sequence
  chemically synthesized
gaataatagccattctaatt

SEQ ID NO: 52002 - DNA, 20 bp, Artificial Sequence
  chemically synthesized
aataatagccattctaattg

SEQ ID NO: 52003 - DNA, 20 bp, Artificial Sequence
  chemically synthesized
atatatcgtcttaccccaat

SEQ ID NO: 52004 - DNA, 20 bp, Artificial Sequence
  chemically synthesized
atagccattctaattggggt

SEQ ID NO: 52005 - DNA, 20 bp, Artificial Sequence
  chemically synthesized
gggtaagacgatatatcatg

SEQ ID NO: 52006 - DNA, 20 bp, Artificial Sequence
  chemically synthesized
tcaccagggaaatgcaaatc

SEQ ID NO: 52007 - DNA, 20 bp, Artificial Sequence
  chemically synthesized
ggtcttgatttgcatttccc

SEQ ID NO: 52008 - DNA, 20 bp, Artificial Sequence
  chemically synthesized
atttgcatttccctggtgat

SEQ ID NO: 52009 - DNA, 20 bp, Artificial Sequence
  chemically synthesized
ctcaacatcactaatcacca

SEQ ID NO: 52010 - DNA, 20 bp, Artificial Sequence
  chemically synthesized
gctcaacatcactaatcacc

SEQ ID NO: 52011 - DNA, 20 bp, Artificial Sequence
  chemically synthesized
tgctcaacatcactaatcac

SEQ ID NO: 52012 - DNA, 20 bp, Artificial Sequence
  chemically synthesized
ccctggtgattagtgatgtt

SEQ ID NO: 52013 - DNA, 20 bp, Artificial Sequence
  chemically synthesized
gcattttttcatatacctgt

SEQ ID NO: 52014 - DNA, 20 bp, Artificial Sequence
  chemically synthesized
aaggcatacaaatggccaac

SEQ ID NO: 52015 - DNA, 20 bp, Artificial Sequence
  chemically synthesized
gaaggcatacaaatggccaa

SEQ ID NO: 52016 - DNA, 20 bp, Artificial Sequence
  chemically synthesized
ctcaaaagaaggcatacaaa

SEQ ID NO: 52017 - DNA, 20 bp, Artificial Sequence
  chemically synthesized
ccatttgtatgccttctttt

SEQ ID NO: 52018 - DNA, 20 bp, Artificial Sequence
  chemically synthesized
gagtgacaattctcaaaaga

SEQ ID NO: 52019 - DNA, 20 bp, Artificial Sequence
  chemically synthesized
tgagtgacaattctcaaaag

SEQ ID NO: 52020 - DNA, 20 bp, Artificial Sequence
  chemically synthesized
aaatgagtgacaattctcaa

SEQ ID NO: 52021 - DNA, 20 bp, Artificial Sequence
  chemically synthesized
agaattgtcactcatttcat

SEQ ID NO: 52022 - DNA, 20 bp, Artificial Sequence
  chemically synthesized
tgatccctgccttatgaaat

SEQ ID NO: 52023 - DNA, 20 bp, Artificial Sequence
  chemically synthesized
gaattgtcactcatttcata

SEQ ID NO: 52024 - DNA, 20 bp, Artificial Sequence
  chemically synthesized
ttgtcactcatttcataagg

SEQ ID NO: 52025 - DNA, 20 bp, Artificial Sequence
  chemically synthesized
tgtcactcatttcataaggc

SEQ ID NO: 52026 - DNA, 20 bp, Artificial Sequence
  chemically synthesized
gtcactcatttcataaggca

SEQ ID NO: 52027 - DNA, 20 bp, Artificial Sequence
  chemically synthesized
atcatttaatgaattattta

SEQ ID NO: 52028 - DNA, 20 bp, Artificial Sequence
  chemically synthesized
atgaattatttaaagaatta

SEQ ID NO: 52029 - DNA, 20 bp, Artificial Sequence
  chemically synthesized
gaattatttaaagaattata

SEQ ID NO: 52030 - DNA, 20 bp, Artificial Sequence
  chemically synthesized
tttaaagaattatagagtca

SEQ ID NO: 52031 - DNA, 20 bp, Artificial Sequence
  chemically synthesized
agagtcacagtaacatatat

SEQ ID NO: 52032 - DNA, 20 bp, Artificial Sequence
  chemically synthesized
ttacatgatatcataattat

SEQ ID NO: 52033 - DNA, 20 bp, Artificial Sequence
  chemically synthesized
gcctatcagttcagttcata

SEQ ID NO: 52034 - DNA, 20 bp, Artificial Sequence
  chemically synthesized
agctttatgaactgaactga

SEQ ID NO: 52035 - DNA, 20 bp, Artificial Sequence
  chemically synthesized
gctttatgaactgaactgat

SEQ ID NO: 52036 - DNA, 20 bp, Artificial Sequence
  chemically synthesized
ttaatttctgcctatcagtt

SEQ ID NO: 52037 - DNA, 20 bp, Artificial Sequence
  chemically synthesized
ttatgaactgaactgatagg

SEQ ID NO: 52038 - DNA, 20 bp, Artificial Sequence
  chemically synthesized
agtttttaatttctgcctat

SEQ ID NO: 52039 - DNA, 20 bp, Artificial Sequence
  chemically synthesized
ggcagaaattaaaaactcaa

SEQ ID NO: 52040 - DNA, 20 bp, Artificial Sequence
  chemically synthesized
tgaagcaaaaacatactttt

SEQ ID NO: 52041 - DNA, 20 bp, Artificial Sequence
  chemically synthesized
tcaaaagtatgtttttgctt

SEQ ID NO: 52042 - DNA, 20 bp, Artificial Sequence
  chemically synthesized
aaagtatgtttttgcttcag

SEQ ID NO: 52043 - DNA, 20 bp, Artificial Sequence
  chemically synthesized
tgttagtatatgggctgctg

SEQ ID NO: 52044 - DNA, 20 bp, Artificial Sequence
  chemically synthesized
ttattccaatgttagtatat

SEQ ID NO: 52045 - DNA, 20 bp, Artificial Sequence
  chemically synthesized
attattccaatgttagtata

SEQ ID NO: 52046 - DNA, 20 bp, Artificial Sequence
  chemically synthesized
agcagcccatatactaacat

SEQ ID NO: 52047 - DNA, 20 bp, Artificial Sequence
  chemically synthesized
ctgtatcattattccaatgt

SEQ ID NO: 52048 - DNA, 20 bp, Artificial Sequence
  chemically synthesized
ctaacattggaataatgata

SEQ ID NO: 52049 - DNA, 20 bp, Artificial Sequence
  chemically synthesized
aacattggaataatgataca

SEQ ID NO: 52050 - DNA, 20 bp, Artificial Sequence
  chemically synthesized
aataatgatacagagaatac

SEQ ID NO: 52051 - DNA, 20 bp, Artificial Sequence
  chemically synthesized
tgatacagagaatactagca

SEQ ID NO: 52052 - DNA, 20 bp, Artificial Sequence
  chemically synthesized
actttgctcaggagccatgc

SEQ ID NO: 52053 - DNA, 20 bp, Artificial Sequence
  chemically synthesized
agaatactagcatggctcct

SEQ ID NO: 52054 - DNA, 20 bp, Artificial Sequence
  chemically synthesized
actagcatggctcctgagca

SEQ ID NO: 52055 - DNA, 20 bp, Artificial Sequence
  chemically synthesized
atgtggaacactttgctcag

SEQ ID NO: 52056 - DNA, 20 bp, Artificial Sequence
  chemically synthesized
aaatgtggaacactttgctc

SEQ ID NO: 52057 - DNA, 20 bp, Artificial Sequence
  chemically synthesized
aaaatgtggaacactttgct

SEQ ID NO: 52058 - DNA, 20 bp, Artificial Sequence
  chemically synthesized
ttgagtctttttgaaaaatg

SEQ ID NO: 52059 - DNA, 20 bp, Artificial Sequence
  chemically synthesized
agtgttccacatttttcaaa

SEQ ID NO: 52060 - DNA, 20 bp, Artificial Sequence
  chemically synthesized
ttaaccatattaatattttt

SEQ ID NO: 52061 - DNA, 20 bp, Artificial Sequence
  chemically synthesized
aagactcaaaaatattaata

SEQ ID NO: 52062 - DNA, 20 bp, Artificial Sequence
  chemically synthesized
tattaatatggttaacattt

SEQ ID NO: 52063 - DNA, 20 bp, Artificial Sequence
  chemically synthesized
atggttaacatttgagaata

SEQ ID NO: 52064 - DNA, 20 bp, Artificial Sequence
  chemically synthesized
taacatttgagaatatagtg

SEQ ID NO: 52065 - DNA, 20 bp, Artificial Sequence
  chemically synthesized
aacatttgagaatatagtgc

SEQ ID NO: 52066 - DNA, 20 bp, Artificial Sequence
  chemically synthesized
tgcaggaaacaattatgcat

SEQ ID NO: 52067 - DNA, 20 bp, Artificial Sequence
  chemically synthesized
aaacaattatgcattagctg

SEQ ID NO: 52068 - DNA, 20 bp, Artificial Sequence
  chemically synthesized
attatgcattagctgaagac

SEQ ID NO: 52069 - DNA, 20 bp, Artificial Sequence
  chemically synthesized
ggatcattttgtccagtctt

SEQ ID NO: 52070 - DNA, 20 bp, Artificial Sequence
  chemically synthesized
gccaattggatcattttgtc

SEQ ID NO: 52071 - DNA, 20 bp, Artificial Sequence
  chemically synthesized
actggacaaaatgatccaat

SEQ ID NO: 52072 - DNA, 20 bp, Artificial Sequence
  chemically synthesized
ttaggaagaggaaggccaat

SEQ ID NO: 52073 - DNA, 20 bp, Artificial Sequence
  chemically synthesized
tgagaaggttaggaagagga

SEQ ID NO: 52074 - DNA, 20 bp, Artificial Sequence
  chemically synthesized
ttgagaaggttaggaagagg

SEQ ID NO: 52075 - DNA, 20 bp, Artificial Sequence
  chemically synthesized
aagttgagaaggttaggaag

SEQ ID NO: 52076 - DNA, 20 bp, Artificial Sequence
  chemically synthesized
taagttgagaaggttaggaa

SEQ ID NO: 52077 - DNA, 20 bp, Artificial Sequence
  chemically synthesized
gataagttgagaaggttagg

SEQ ID NO: 52078 - DNA, 20 bp, Artificial Sequence
  chemically synthesized
gttgataagttgagaaggtt

SEQ ID NO: 52079 - DNA, 20 bp, Artificial Sequence
  chemically synthesized
ggttgataagttgagaaggt

SEQ ID NO: 52080 - DNA, 20 bp, Artificial Sequence
  chemically synthesized
acttggttgataagttgaga

SEQ ID NO: 52081 - DNA, 20 bp, Artificial Sequence
  chemically synthesized
aacttggttgataagttgag

SEQ ID NO: 52082 - DNA, 20 bp, Artificial Sequence
  chemically synthesized
tataacttggttgataagtt

SEQ ID NO: 52083 - DNA, 20 bp, Artificial Sequence
  chemically synthesized
accttctcaacttatcaacc

SEQ ID NO: 52084 - DNA, 20 bp, Artificial Sequence
  chemically synthesized
tgaaatataacttggttgat

SEQ ID NO: 52085 - DNA, 20 bp, Artificial Sequence
  chemically synthesized
aatcatcctgaaatataact

SEQ ID NO: 52086 - DNA, 20 bp, Artificial Sequence
  chemically synthesized
ttatcaaccaagttatattt

SEQ ID NO: 52087 - DNA, 20 bp, Artificial Sequence
  chemically synthesized
tatcaaccaagttatatttc

SEQ ID NO: 52088 - DNA, 20 bp, Artificial Sequence
  chemically synthesized
tcttttatcagatgcagtag

SEQ ID NO: 52089 - DNA, 20 bp, Artificial Sequence
  chemically synthesized
taatcttttatcagatgcag

SEQ ID NO: 52090 - DNA, 20 bp, Artificial Sequence
  chemically synthesized
tagtaatcttttatcagatg

SEQ ID NO: 52091 - DNA, 20 bp, Artificial Sequence
  chemically synthesized
gcttctactgcatctgataa

SEQ ID NO: 52092 - DNA, 20 bp, Artificial Sequence
  chemically synthesized
gaattatagtaatcttttat

SEQ ID NO: 52093 - DNA, 20 bp, Artificial Sequence
  chemically synthesized
aagaattaagagttgaatta

SEQ ID NO: 52094 - DNA, 20 bp, Artificial Sequence
  chemically synthesized
tgaaaaaacaaaagaattaa

SEQ ID NO: 52095 - DNA, 20 bp, Artificial Sequence
  chemically synthesized
gttgaaaaaacaaaagaatt

SEQ ID NO: 52096 - DNA, 20 bp, Artificial Sequence
  chemically synthesized
aataacagttgaaaaaacaa

SEQ ID NO: 52097 - DNA, 20 bp, Artificial Sequence
  chemically synthesized
atcttgattaataagaataa

SEQ ID NO: 52098 - DNA, 20 bp, Artificial Sequence
  chemically synthesized
aactgttattcttattaatc

SEQ ID NO: 52099 - DNA, 20 bp, Artificial Sequence
  chemically synthesized
tttattgcatcttgattaat

SEQ ID NO: 52100 - DNA, 20 bp, Artificial Sequence
  chemically synthesized
ttattaatcaagatgcaata

SEQ ID NO: 52101 - DNA, 20 bp, Artificial Sequence
  chemically synthesized
aatcaagatgcaataaagtt

SEQ ID NO: 52102 - DNA, 20 bp, Artificial Sequence
  chemically synthesized
gcaataaagttaagtgataa

SEQ ID NO: 52103 - DNA, 20 bp, Artificial Sequence
  chemically synthesized
tctttccagtaagtcatttt

SEQ ID NO: 52104 - DNA, 20 bp, Artificial Sequence
  chemically synthesized
aaaagctgaaaatgacttac

SEQ ID NO: 52105 - DNA, 20 bp, Artificial Sequence
  chemically synthesized
gctgaaaatgacttactgga

SEQ ID NO: 52106 - DNA, 20 bp, Artificial Sequence
  chemically synthesized
ctcagcactttctttccagt

SEQ ID NO: 52107 - DNA, 20 bp, Artificial Sequence
  chemically synthesized
aaaatgacttactggaaaga

SEQ ID NO: 52108 - DNA, 20 bp, Artificial Sequence
  chemically synthesized
gcatctcagcactttctttc

SEQ ID NO: 52109 - DNA, 20 bp, Artificial Sequence
  chemically synthesized
cttactggaaagaaagtgct

SEQ ID NO: 52110 - DNA, 20 bp, Artificial Sequence
  chemically synthesized
gaaagaaagtgctgagatgc

SEQ ID NO: 52111 - DNA, 20 bp, Artificial Sequence
  chemically synthesized
gggactttggtccagcatct

SEQ ID NO: 52112 - DNA, 20 bp, Artificial Sequence
  chemically synthesized
agtgctgagatgctggacca

SEQ ID NO: 52113 - DNA, 20 bp, Artificial Sequence
  chemically synthesized
agcccacagggactttggtc

SEQ ID NO: 52114 - DNA, 20 bp, Artificial Sequence
  chemically synthesized
catgaagcccacagggactt

SEQ ID NO: 52115 - DNA, 20 bp, Artificial Sequence
  chemically synthesized
atgctggaccaaagtccctg

SEQ ID NO: 52116 - DNA, 20 bp, Artificial Sequence
  chemically synthesized
tgctggaccaaagtccctgt

SEQ ID NO: 52117 - DNA, 20 bp, Artificial Sequence
  chemically synthesized
gcagctgcatgaagcccaca

SEQ ID NO: 52118 - DNA, 20 bp, Artificial Sequence
  chemically synthesized
ggcagctgcatgaagcccac

SEQ ID NO: 52119 - DNA, 20 bp, Artificial Sequence
  chemically synthesized
aggcagctgcatgaagccca

SEQ ID NO: 52120 - DNA, 20 bp, Artificial Sequence
  chemically synthesized
aagtccctgtgggcttcatg

SEQ ID NO: 52121 - DNA, 20 bp, Artificial Sequence
  chemically synthesized
ccgagtcaggcagctgcatg

SEQ ID NO: 52122 - DNA, 20 bp, Artificial Sequence
  chemically synthesized
cttcatgcagctgcctgact

SEQ ID NO: 52123 - DNA, 20 bp, Artificial Sequence
  chemically synthesized
ccgtcgaggaccgagtcagg

SEQ ID NO: 52124 - DNA, 20 bp, Artificial Sequence
  chemically synthesized
tggccgtcgaggaccgagtc

SEQ ID NO: 52125 - DNA, 20 bp, Artificial Sequence
  chemically synthesized
gtggccgtcgaggaccgagt

SEQ ID NO: 52126 - DNA, 20 bp, Artificial Sequence
  chemically synthesized
ccaggtggccgtcgaggacc

SEQ ID NO: 52127 - DNA, 20 bp, Artificial Sequence
  chemically synthesized
ctgcctgactcggtcctcga

SEQ ID NO: 52128 - DNA, 20 bp, Artificial Sequence
  chemically synthesized
ttcctcccaggtggccgtcg

SEQ ID NO: 52129 - DNA, 20 bp, Artificial Sequence
  chemically synthesized
tttcctcccaggtggccgtc

SEQ ID NO: 52130 - DNA, 20 bp, Artificial Sequence
  chemically synthesized
ctcggtcctcgacggccacc

SEQ ID NO: 52131 - DNA, 20 bp, Artificial Sequence
  chemically synthesized
tcggtcctcgacggccacct

SEQ ID NO: 52132 - DNA, 20 bp, Artificial Sequence
  chemically synthesized
ggtcctcgacggccacctgg

SEQ ID NO: 52133 - DNA, 20 bp, Artificial Sequence
  chemically synthesized
gtcctcgacggccacctggg

SEQ ID NO: 52134 - DNA, 20 bp, Artificial Sequence
  chemically synthesized
tctctccttttcctcccagg

SEQ ID NO: 52135 - DNA, 20 bp, Artificial Sequence
  chemically synthesized
atttctctccttttcctccc

SEQ ID NO: 52136 - DNA, 20 bp, Artificial Sequence
  chemically synthesized
cgacggccacctgggaggaa

SEQ ID NO: 52137 - DNA, 20 bp, Artificial Sequence
  chemically synthesized
catttctctccttttcctcc

SEQ ID NO: 52138 - DNA, 20 bp, Artificial Sequence
  chemically synthesized
gacggccacctgggaggaaa

SEQ ID NO: 52139 - DNA, 20 bp, Artificial Sequence
  chemically synthesized
cggccacctgggaggaaaag

SEQ ID NO: 52140 - DNA, 20 bp, Artificial Sequence
  chemically synthesized
gccacctgggaggaaaagga

SEQ ID NO: 52141 - DNA, 20 bp, Artificial Sequence
  chemically synthesized
ttcctcattatatagaatga

SEQ ID NO: 52142 - DNA, 20 bp, Artificial Sequence
  chemically synthesized
tgttcctcattatatagaat

SEQ ID NO: 52143 - DNA, 20 bp, Artificial Sequence
  chemically synthesized
gttctctcattctatataat

SEQ ID NO: 52144 - DNA, 20 bp, Artificial Sequence
  chemically synthesized
ttctctcattctatataatg

SEQ ID NO: 52145 - DNA, 20 bp, Artificial Sequence
  chemically synthesized
tttaattgttcctcattata

SEQ ID NO: 52146 - DNA, 20 bp, Artificial Sequence
  chemically synthesized
aacaatgtatcctttctgat

SEQ ID NO: 52147 - DNA, 20 bp, Artificial Sequence
  chemically synthesized
ctcaaagtatcttatcagaa

SEQ ID NO: 52148 - DNA, 20 bp, Artificial Sequence
  chemically synthesized
actcaaagtatcttatcaga

SEQ ID NO: 52149 - DNA, 20 bp, Artificial Sequence
  chemically synthesized
ggagactcaaagtatcttat

SEQ ID NO: 52150 - DNA, 20 bp, Artificial Sequence
  chemically synthesized
cctttctgataagatacttt

SEQ ID NO: 52151 - DNA, 20 bp, Artificial Sequence
  chemically synthesized
ttctcagtcttggagactca

SEQ ID NO: 52152 - DNA, 20 bp, Artificial Sequence
  chemically synthesized
ataagatactttgagtctcc

SEQ ID NO: 52153 - DNA, 20 bp, Artificial Sequence
  chemically synthesized
tactttgagtctccaagact

SEQ ID NO: 52154 - DNA, 20 bp, Artificial Sequence
  chemically synthesized
ctttagtgttctcagtcttg

SEQ ID NO: 52155 - DNA, 20 bp, Artificial Sequence
  chemically synthesized
tgctttagtgttctcagtct

SEQ ID NO: 52156 - DNA, 20 bp, Artificial Sequence
  chemically synthesized
aaatgttgctttagtgttct

SEQ ID NO: 52157 - DNA, 20 bp, Artificial Sequence
  chemically synthesized
ctccaagactgagaacacta

SEQ ID NO: 52158 - DNA, 20 bp, Artificial Sequence
  chemically synthesized
agagttatgaaatgttgctt

SEQ ID NO: 52159 - DNA, 20 bp, Artificial Sequence
  chemically synthesized
aaagcaacatttcataactc

SEQ ID NO: 52160 - DNA, 20 bp, Artificial Sequence
  chemically synthesized
gtaagtgaatattaaaacta

SEQ ID NO: 52161 - DNA, 20 bp, Artificial Sequence
  chemically synthesized
cggtaagtgaatattaaaac

SEQ ID NO: 52162 - DNA, 20 bp, Artificial Sequence
  chemically synthesized
tctggaatactatatacggt

SEQ ID NO: 52163 - DNA, 20 bp, Artificial Sequence
  chemically synthesized
taatattcacttaccgtata

SEQ ID NO: 52164 - DNA, 20 bp, Artificial Sequence
  chemically synthesized
cgagtctggaatactatata

SEQ ID NO: 52165 - DNA, 20 bp, Artificial Sequence
  chemically synthesized
acttaccgtatatagtattc

SEQ ID NO: 52166 - DNA, 20 bp, Artificial Sequence
  chemically synthesized
tggattgataaaaacgagtc

SEQ ID NO: 52167 - DNA, 20 bp, Artificial Sequence
  chemically synthesized
ggccttggattgataaaaac

SEQ ID NO: 52168 - DNA, 20 bp, Artificial Sequence
  chemically synthesized
agactcgtttttatcaatcc

SEQ ID NO: 52169 - DNA, 20 bp, Artificial Sequence
  chemically synthesized
gactcgtttttatcaatcca

SEQ ID NO: 52170 - DNA, 20 bp, Artificial Sequence
  chemically synthesized
aaatcctttgtgtttggcct

SEQ ID NO: 52171 - DNA, 20 bp, Artificial Sequence
  chemically synthesized
tcaatccaaggccaaacaca

SEQ ID NO: 52172 - DNA, 20 bp, Artificial Sequence
  chemically synthesized
caatccaaggccaaacacaa

SEQ ID NO: 52173 - DNA, 20 bp, Artificial Sequence
  chemically synthesized
gagaggaaatcctttgtgtt

SEQ ID NO: 52174 - DNA, 20 bp, Artificial Sequence
  chemically synthesized
cattttaacattgtcgagag

SEQ ID NO: 52175 - DNA, 20 bp, Artificial Sequence
  chemically synthesized
tcattttaacattgtcgaga

SEQ ID NO: 52176 - DNA, 20 bp, Artificial Sequence
  chemically synthesized
tctcattttaacattgtcga

SEQ ID NO: 52177 - DNA, 20 bp, Artificial Sequence
  chemically synthesized
aatctcattttaacattgtc

SEQ ID NO: 52178 - DNA, 20 bp, Artificial Sequence
  chemically synthesized
tctctcgacaatgttaaaat

SEQ ID NO: 52179 - DNA, 20 bp, Artificial Sequence
  chemically synthesized
acaatgttaaaatgagattt

SEQ ID NO: 52180 - DNA, 20 bp, Artificial Sequence
  chemically synthesized
gagattttggttttttttta

SEQ ID NO: 52181 - DNA, 20 bp, Artificial Sequence
  chemically synthesized
tttttttacagtcaactcat

SEQ ID NO: 52182 - DNA, 20 bp, Artificial Sequence
  chemically synthesized
ttttacagtcaactcattgg

SEQ ID NO: 52183 - DNA, 20 bp, Artificial Sequence
  chemically synthesized
gttcatttgtggctgccaat

SEQ ID NO: 52184 - DNA, 20 bp, Artificial Sequence
  chemically synthesized
ttgaagcagtagttcatttg

SEQ ID NO: 52185 - DNA, 20 bp, Artificial Sequence
  chemically synthesized
tatggtactaattgaagcag

SEQ ID NO: 52186 - DNA, 20 bp, Artificial Sequence
  chemically synthesized
aaatgaactactgcttcaat

SEQ ID NO: 52187 - DNA, 20 bp, Artificial Sequence
  chemically synthesized
ttttatggtactaattgaag

SEQ ID NO: 52188 - DNA, 20 bp, Artificial Sequence
  chemically synthesized
tttttttatggtactaattg

SEQ ID NO: 52189 - DNA, 20 bp, Artificial Sequence
  chemically synthesized
taaagatttgtattttttta

SEQ ID NO: 52190 - DNA, 20 bp, Artificial Sequence
  chemically synthesized
ctaatgtttttgtgaaagta

SEQ ID NO: 52191 - DNA, 20 bp, Artificial Sequence
  chemically synthesized
cctccctaatgtttttgtga

SEQ ID NO: 52192 - DNA, 20 bp, Artificial Sequence
  chemically synthesized
ctttactttcacaaaaacat

SEQ ID NO: 52193 - DNA, 20 bp, Artificial Sequence
  chemically synthesized
tttactttcacaaaaacatt

SEQ ID NO: 52194 - DNA, 20 bp, Artificial Sequence
  chemically synthesized
ttactttcacaaaaacatta

SEQ ID NO: 52195 - DNA, 20 bp, Artificial Sequence
  chemically synthesized
actttcacaaaaacattagg

SEQ ID NO: 52196 - DNA, 20 bp, Artificial Sequence
  chemically synthesized
ctttcacaaaaacattaggg

SEQ ID NO: 52197 - DNA, 20 bp, Artificial Sequence
  chemically synthesized
tttcacaaaaacattaggga

SEQ ID NO: 52198 - DNA, 20 bp, Artificial Sequence
  chemically synthesized
acattagggagggtgacatt

SEQ ID NO: 52199 - DNA, 20 bp, Artificial Sequence
  chemically synthesized
agggagggtgacatttggta

SEQ ID NO: 52200 - DNA, 20 bp, Artificial Sequence
  chemically synthesized
gggagggtgacatttggtat

SEQ ID NO: 52201 - DNA, 20 bp, Artificial Sequence
  chemically synthesized
acatttggtataggtgacta

SEQ ID NO: 52202 - DNA, 20 bp, Artificial Sequence
  chemically synthesized
atgtcatttctgagattctg

SEQ ID NO: 52203 - DNA, 20 bp, Artificial Sequence
  chemically synthesized
tataggtgactacagaatct

SEQ ID NO: 52204 - DNA, 20 bp, Artificial Sequence
  chemically synthesized
agacaagacatgtcatttct

SEQ ID NO: 52205 - DNA, 20 bp, Artificial Sequence
  chemically synthesized
aaatgacatgtcttgtcttt

SEQ ID NO: 52206 - DNA, 20 bp, Artificial Sequence
  chemically synthesized
atagcctaagacttaaagac

SEQ ID NO: 52207 - DNA, 20 bp, Artificial Sequence
  chemically synthesized
catgtcttgtctttaagtct

SEQ ID NO: 52208 - DNA, 20 bp, Artificial Sequence
  chemically synthesized
aaacaatagcctaagactta

SEQ ID NO: 52209 - DNA, 20 bp, Artificial Sequence
  chemically synthesized
atgtcttgtctttaagtctt

SEQ ID NO: 52210 - DNA, 20 bp, Artificial Sequence
  chemically synthesized
tttgtcaaaaacaatagcct

SEQ ID NO: 52211 - DNA, 20 bp, Artificial Sequence
  chemically synthesized
taaaaatttgtcaaaaacaa

SEQ ID NO: 52212 - DNA, 20 bp, Artificial Sequence
  chemically synthesized
ttgtttttgacaaattttta

SEQ ID NO: 52213 - DNA, 20 bp, Artificial Sequence
  chemically synthesized
tttttgacaaatttttaaag

SEQ ID NO: 52214 - DNA, 20 bp, Artificial Sequence
  chemically synthesized
aaagaagcaatattgattaa

SEQ ID NO: 52215 - DNA, 20 bp, Artificial Sequence
  chemically synthesized
ttaatagataataaatcatt

SEQ ID NO: 52216 - DNA, 20 bp, Artificial Sequence
  chemically synthesized
attgataattattaattaac

SEQ ID NO: 52217 - DNA, 20 bp, Artificial Sequence
  chemically synthesized
gataattattaattaaccag

SEQ ID NO: 52218 - DNA, 20 bp, Artificial Sequence
  chemically synthesized
attaaatattaatcaaccac

SEQ ID NO: 52219 - DNA, 20 bp, Artificial Sequence
  chemically synthesized
ggttgattaatatttaatta

SEQ ID NO: 52220 - DNA, 20 bp, Artificial Sequence
  chemically synthesized
gttgattaatatttaattat

SEQ ID NO: 52221 - DNA, 20 bp, Artificial Sequence
  chemically synthesized
attaatatttaattatgggc

SEQ ID NO: 52222 - DNA, 20 bp, Artificial Sequence
  chemically synthesized
ttaatatttaattatgggct

SEQ ID NO: 52223 - DNA, 20 bp, Artificial Sequence
  chemically synthesized
atttaattatgggctgggca

SEQ ID NO: 52224 - DNA, 20 bp, Artificial Sequence
  chemically synthesized
caggcatgagtcactgtgcc

SEQ ID NO: 52225 - DNA, 20 bp, Artificial Sequence
  chemically synthesized
agtgctgggattacaggcat

SEQ ID NO: 52226 - DNA, 20 bp, Artificial Sequence
  chemically synthesized
gtgactcatgcctgtaatcc

SEQ ID NO: 52227 - DNA, 20 bp, Artificial Sequence
  chemically synthesized
tcccaaagtgctgggattac

SEQ ID NO: 52228 - DNA, 20 bp, Artificial Sequence
  chemically synthesized
ctcccaaagtgctgggatta

SEQ ID NO: 52229 - DNA, 20 bp, Artificial Sequence
  chemically synthesized
tgcctgtaatcccagcactt

SEQ ID NO: 52230 - DNA, 20 bp, Artificial Sequence
  chemically synthesized
acttggcctcccaaagtgct

SEQ ID NO: 52231 - DNA, 20 bp, Artificial Sequence
  chemically synthesized
gcctgtaatcccagcacttt

SEQ ID NO: 52232 - DNA, 20 bp, Artificial Sequence
  chemically synthesized
aacttggcctcccaaagtgc

SEQ ID NO: 52233 - DNA, 20 bp, Artificial Sequence
  chemically synthesized
ctgtaatcccagcactttgg

SEQ ID NO: 52234 - DNA, 20 bp, Artificial Sequence
  chemically synthesized
tgtaatcccagcactttggg

SEQ ID NO: 52235 - DNA, 20 bp, Artificial Sequence
  chemically synthesized
ccagccaacttggcctccca

SEQ ID NO: 52236 - DNA, 20 bp, Artificial Sequence
  chemically synthesized
tcccagcactttgggaggcc

SEQ ID NO: 52237 - DNA, 20 bp, Artificial Sequence
  chemically synthesized
agcactttgggaggccaagt

SEQ ID NO: 52238 - DNA, 20 bp, Artificial Sequence
  chemically synthesized
ctttgggaggccaagttggc

SEQ ID NO: 52239 - DNA, 20 bp, Artificial Sequence
  chemically synthesized
ctcaagtgatccagccaact

SEQ ID NO: 52240 - DNA, 20 bp, Artificial Sequence
  chemically synthesized
acttatgacctcaagtgatc

SEQ ID NO: 52241 - DNA, 20 bp, Artificial Sequence
  chemically synthesized
ccaagttggctggatcactt

SEQ ID NO: 52242 - DNA, 20 bp, Artificial Sequence
  chemically synthesized
caagttggctggatcacttg

SEQ ID NO: 52243 - DNA, 20 bp, Artificial Sequence
  chemically synthesized
ggcctcgaacttatgacctc

SEQ ID NO: 52244 - DNA, 20 bp, Artificial Sequence
  chemically synthesized
gctggatcacttgaggtcat

SEQ ID NO: 52245 - DNA, 20 bp, Artificial Sequence
  chemically synthesized
tcacttgaggtcataagttc

SEQ ID NO: 52246 - DNA, 20 bp, Artificial Sequence
  chemically synthesized
cacttgaggtcataagttcg

SEQ ID NO: 52247 - DNA, 20 bp, Artificial Sequence
  chemically synthesized
tgaggtcataagttcgaggc

SEQ ID NO: 52248 - DNA, 20 bp, Artificial Sequence
  chemically synthesized
tcataagttcgaggccagcc

SEQ ID NO: 52249 - DNA, 20 bp, Artificial Sequence
  chemically synthesized
tttcaccatgttggccaggc

SEQ ID NO: 52250 - DNA, 20 bp, Artificial Sequence
  chemically synthesized
gggttttcaccatgttggcc

SEQ ID NO: 52251 - DNA, 20 bp, Artificial Sequence
  chemically synthesized
cgaggccagcctggccaaca

SEQ ID NO: 52252 - DNA, 20 bp, Artificial Sequence
  chemically synthesized
cgggttttcaccatgttggc

SEQ ID NO: 52253 - DNA, 20 bp, Artificial Sequence
  chemically synthesized
gagacgggttttcaccatgt

SEQ ID NO: 52254 - DNA, 20 bp, Artificial Sequence
  chemically synthesized
tttgtatttctagtagagac

SEQ ID NO: 52255 - DNA, 20 bp, Artificial Sequence
  chemically synthesized
tggtgaaaacccgtctctac

SEQ ID NO: 52256 - DNA, 20 bp, Artificial Sequence
  chemically synthesized
ttttgtatttctagtagaga

SEQ ID NO: 52257 - DNA, 20 bp, Artificial Sequence
  chemically synthesized
taatttttgtatttctagta

SEQ ID NO: 52258 - DNA, 20 bp, Artificial Sequence
  chemically synthesized
actaatttttgtatttctag

SEQ ID NO: 52259 - DNA, 20 bp, Artificial Sequence
  chemically synthesized
ctgactaatttttgtatttc

SEQ ID NO: 52260 - DNA, 20 bp, Artificial Sequence
  chemically synthesized
tctactagaaatacaaaaat

SEQ ID NO: 52261 - DNA, 20 bp, Artificial Sequence
  chemically synthesized
ctagaaatacaaaaattagt

SEQ ID NO: 52262 - DNA, 20 bp, Artificial Sequence
  chemically synthesized
tagaaatacaaaaattagtc

SEQ ID NO: 52263 - DNA, 20 bp, Artificial Sequence
  chemically synthesized
atacaaaaattagtcaggtg

SEQ ID NO: 52264 - DNA, 20 bp, Artificial Sequence
  chemically synthesized
caaaaattagtcaggtgtgg

SEQ ID NO: 52265 - DNA, 20 bp, Artificial Sequence
  chemically synthesized
ggtgtggtggcgcatgcctg

SEQ ID NO: 52266 - DNA, 20 bp, Artificial Sequence
  chemically synthesized
gtggcgcatgcctgtagtcc

SEQ ID NO: 52267 - DNA, 20 bp, Artificial Sequence
  chemically synthesized
tccctaggagctgggactac

SEQ ID NO: 52268 - DNA, 20 bp, Artificial Sequence
  chemically synthesized
ctccctaggagctgggacta

SEQ ID NO: 52269 - DNA, 20 bp, Artificial Sequence
  chemically synthesized
atgcctgtagtcccagctcc

SEQ ID NO: 52270 - DNA, 20 bp, Artificial Sequence
  chemically synthesized
tgcctgtagtcccagctcct

SEQ ID NO: 52271 - DNA, 20 bp, Artificial Sequence
  chemically synthesized
cctcagcctccctaggagct

SEQ ID NO: 52272 - DNA, 20 bp, Artificial Sequence
  chemically synthesized
gcctgtagtcccagctccta

SEQ ID NO: 52273 - DNA, 20 bp, Artificial Sequence
  chemically synthesized
gcctcagcctccctaggagc

SEQ ID NO: 52274 - DNA, 20 bp, Artificial Sequence
  chemically synthesized
ctgtagtcccagctcctagg

SEQ ID NO: 52275 - DNA, 20 bp, Artificial Sequence
  chemically synthesized
tgtagtcccagctcctaggg

SEQ ID NO: 52276 - DNA, 20 bp, Artificial Sequence
  chemically synthesized
tcctgcctcagcctccctag

SEQ ID NO: 52277 - DNA, 20 bp, Artificial Sequence
  chemically synthesized
cctcctgcctcagcctccct

SEQ ID NO: 52278 - DNA, 20 bp, Artificial Sequence
  chemically synthesized
ccctcctgcctcagcctccc

SEQ ID NO: 52279 - DNA, 20 bp, Artificial Sequence
  chemically synthesized
tcccagctcctagggaggct

SEQ ID NO: 52280 - DNA, 20 bp, Artificial Sequence
  chemically synthesized
cccagctcctagggaggctg

SEQ ID NO: 52281 - DNA, 20 bp, Artificial Sequence
  chemically synthesized
agctcctagggaggctgagg

SEQ ID NO: 52282 - DNA, 20 bp, Artificial Sequence
  chemically synthesized
gctcctagggaggctgaggc

SEQ ID NO: 52283 - DNA, 20 bp, Artificial Sequence
  chemically synthesized
tcctagggaggctgaggcag

SEQ ID NO: 52284 - DNA, 20 bp, Artificial Sequence
  chemically synthesized
cctagggaggctgaggcagg

SEQ ID NO: 52285 - DNA, 20 bp, Artificial Sequence
  chemically synthesized
ctgcagcctccctcctgcct

SEQ ID NO: 52286 - DNA, 20 bp, Artificial Sequence
  chemically synthesized
ctagggaggctgaggcagga

SEQ ID NO: 52287 - DNA, 20 bp, Artificial Sequence
  chemically synthesized
agggaggctgaggcaggagg

SEQ ID NO: 52288 - DNA, 20 bp, Artificial Sequence
  chemically synthesized
gggaggctgaggcaggaggg

SEQ ID NO: 52289 - DNA, 20 bp, Artificial Sequence
  chemically synthesized
ctgaggcaggagggaggctg

SEQ ID NO: 52290 - DNA, 20 bp, Artificial Sequence
  chemically synthesized
ggcaggagggaggctgcagt

SEQ ID NO: 52291 - DNA, 20 bp, Artificial Sequence
  chemically synthesized
aggagggaggctgcagtgag

SEQ ID NO: 52292 - DNA, 20 bp, Artificial Sequence
  chemically synthesized
ggcgtgatctctgctcactg

SEQ ID NO: 52293 - DNA, 20 bp, Artificial Sequence
  chemically synthesized
gagggaggctgcagtgagca

SEQ ID NO: 52294 - DNA, 20 bp, Artificial Sequence
  chemically synthesized
tcacccaggctggagtacag

SEQ ID NO: 52295 - DNA, 20 bp, Artificial Sequence
  chemically synthesized
gagatcacgccactgtactc

SEQ ID NO: 52296 - DNA, 20 bp, Artificial Sequence
  chemically synthesized
ctgtcacccaggctggagta

SEQ ID NO: 52297 - DNA, 20 bp, Artificial Sequence
  chemically synthesized
cacgccactgtactccagcc

SEQ ID NO: 52298 - DNA, 20 bp, Artificial Sequence
  chemically synthesized
acgccactgtactccagcct

SEQ ID NO: 52299 - DNA, 20 bp, Artificial Sequence
  chemically synthesized
tcactctgtcacccaggctg

SEQ ID NO: 52300 - DNA, 20 bp, Artificial Sequence
  chemically synthesized
tttcactctgtcacccaggc

SEQ ID NO: 52301 - DNA, 20 bp, Artificial Sequence
  chemically synthesized
ctgtactccagcctgggtga

SEQ ID NO: 52302 - DNA, 20 bp, Artificial Sequence
  chemically synthesized
ggagtttcactctgtcaccc

SEQ ID NO: 52303 - DNA, 20 bp, Artificial Sequence
  chemically synthesized
gtactccagcctgggtgaca

SEQ ID NO: 52304 - DNA, 20 bp, Artificial Sequence
  chemically synthesized
tggagtttcactctgtcacc

SEQ ID NO: 52305 - DNA, 20 bp, Artificial Sequence
  chemically synthesized
cagagtgaaactccacctca

SEQ ID NO: 52306 - DNA, 20 bp, Artificial Sequence
  chemically synthesized
atatttttttctttgaggtg

SEQ ID NO: 52307 - DNA, 20 bp, Artificial Sequence
  chemically synthesized
taatatttttttctttgagg

SEQ ID NO: 52308 - DNA, 20 bp, Artificial Sequence
  chemically synthesized
acttaatatttttttctttg

SEQ ID NO: 52309 - DNA, 20 bp, Artificial Sequence
  chemically synthesized
tacttaatatttttttcttt

SEQ ID NO: 52310 - DNA, 20 bp, Artificial Sequence
  chemically synthesized
acctcaaagaaaaaaatatt

SEQ ID NO: 52311 - DNA, 20 bp, Artificial Sequence
  chemically synthesized
gaaaaaaatattaagtatca

SEQ ID NO: 52312 - DNA, 20 bp, Artificial Sequence
  chemically synthesized
aaaaatattaagtatcaaag

SEQ ID NO: 52313 - DNA, 20 bp, Artificial Sequence
  chemically synthesized
tattaagtatcaaagaagta

SEQ ID NO: 52314 - DNA, 20 bp, Artificial Sequence
  chemically synthesized
attaagtatcaaagaagtac

SEQ ID NO: 52315 - DNA, 20 bp, Artificial Sequence
  chemically synthesized
agtatcaaagaagtacaggc

SEQ ID NO: 52316 - DNA, 20 bp, Artificial Sequence
  chemically synthesized
gtatcaaagaagtacaggca

SEQ ID NO: 52317 - DNA, 20 bp, Artificial Sequence
  chemically synthesized
gtacaggcaaggcttaaatt

SEQ ID NO: 52318 - DNA, 20 bp, Artificial Sequence
  chemically synthesized
tacaggcaaggcttaaattt

SEQ ID NO: 52319 - DNA, 20 bp, Artificial Sequence
  chemically synthesized
ccctattttatcccaaattt

SEQ ID NO: 52320 - DNA, 20 bp, Artificial Sequence
  chemically synthesized
ggcttaaatttgggataaaa

SEQ ID NO: 52321 - DNA, 20 bp, Artificial Sequence
  chemically synthesized
gcttaaatttgggataaaat

SEQ ID NO: 52322 - DNA, 20 bp, Artificial Sequence
  chemically synthesized
cttaaatttgggataaaata

SEQ ID NO: 52323 - DNA, 20 bp, Artificial Sequence
  chemically synthesized
aaatttgggataaaataggg

SEQ ID NO: 52324 - DNA, 20 bp, Artificial Sequence
  chemically synthesized
aatttgggataaaatagggt

SEQ ID NO: 52325 - DNA, 20 bp, Artificial Sequence
  chemically synthesized
ttgggataaaatagggtggg

SEQ ID NO: 52326 - DNA, 20 bp, Artificial Sequence
  chemically synthesized
gataaaatagggtgggtagt

SEQ ID NO: 52327 - DNA, 20 bp, Artificial Sequence
  chemically synthesized
agtaagataaaactaatttt

SEQ ID NO: 52328 - DNA, 20 bp, Artificial Sequence
  chemically synthesized
gaaaactgaattccgaaaat

SEQ ID NO: 52329 - DNA, 20 bp, Artificial Sequence
  chemically synthesized
taaaactaattttcggaatt

SEQ ID NO: 52330 - DNA, 20 bp, Artificial Sequence
  chemically synthesized
aattttcggaattcagtttt

SEQ ID NO: 52331 - DNA, 20 bp, Artificial Sequence
  chemically synthesized
tttcggaattcagttttcag

SEQ ID NO: 52332 - DNA, 20 bp, Artificial Sequence
  chemically synthesized
aattcagttttcagtggact

SEQ ID NO: 52333 - DNA, 20 bp, Artificial Sequence
  chemically synthesized
tatatttcttaataatttcc

SEQ ID NO: 52334 - DNA, 20 bp, Artificial Sequence
  chemically synthesized
cagtggacttggaaattatt

SEQ ID NO: 52335 - DNA, 20 bp, Artificial Sequence
  chemically synthesized
attattaagaaatatacctt

SEQ ID NO: 52336 - DNA, 20 bp, Artificial Sequence
  chemically synthesized
ttattaagaaatataccttt

SEQ ID NO: 52337 - DNA, 20 bp, Artificial Sequence
  chemically synthesized
tattaagaaatataccttta

SEQ ID NO: 52338 - DNA, 20 bp, Artificial Sequence
  chemically synthesized
attaagaaatatacctttag

SEQ ID NO: 52339 - DNA, 20 bp, Artificial Sequence
  chemically synthesized
ttaagaaatatacctttagg

SEQ ID NO: 52340 - DNA, 20 bp, Artificial Sequence
  chemically synthesized
tttcactgcatgccccctaa

SEQ ID NO: 52341 - DNA, 20 bp, Artificial Sequence
  chemically synthesized
ttttcactgcatgcccccta

SEQ ID NO: 52342 - DNA, 20 bp, Artificial Sequence
  chemically synthesized
atatacctttagggggcatg

SEQ ID NO: 52343 - DNA, 20 bp, Artificial Sequence
  chemically synthesized
taataggaagaaaagaatgg

SEQ ID NO: 52344 - DNA, 20 bp, Artificial Sequence
  chemically synthesized
acctaataggaagaaaagaa

SEQ ID NO: 52345 - DNA, 20 bp, Artificial Sequence
  chemically synthesized
gaaaaacctaataggaagaa

SEQ ID NO: 52346 - DNA, 20 bp, Artificial Sequence
  chemically synthesized
tgccattcttttcttcctat

SEQ ID NO: 52347 - DNA, 20 bp, Artificial Sequence
  chemically synthesized
gccattcttttcttcctatt

SEQ ID NO: 52348 - DNA, 20 bp, Artificial Sequence
  chemically synthesized
ttatagaaaaacctaatagg

SEQ ID NO: 52349 - DNA, 20 bp, Artificial Sequence
  chemically synthesized
atattatagaaaaacctaat

SEQ ID NO: 52350 - DNA, 20 bp, Artificial Sequence
  chemically synthesized
tatattatagaaaaacctaa

SEQ ID NO: 52351 - DNA, 20 bp, Artificial Sequence
  chemically synthesized
cacactgtgtcaatatatta

SEQ ID NO: 52352 - DNA, 20 bp, Artificial Sequence
  chemically synthesized
ttttctataatatattgaca

SEQ ID NO: 52353 - DNA, 20 bp, Artificial Sequence
  chemically synthesized
gacacagtgtgctgtcaact

SEQ ID NO: 52354 - DNA, 20 bp, Artificial Sequence
  chemically synthesized
aatagaactcactaagttga

SEQ ID NO: 52355 - DNA, 20 bp, Artificial Sequence
  chemically synthesized
cagtgtgctgtcaacttagt

SEQ ID NO: 52356 - DNA, 20 bp, Artificial Sequence
  chemically synthesized
caccaagaatagaactcact

SEQ ID NO: 52357 - DNA, 20 bp, Artificial Sequence
  chemically synthesized
aacttagtgagttctattct

SEQ ID NO: 52358 - DNA, 20 bp, Artificial Sequence
  chemically synthesized
ttagtgagttctattcttgg

SEQ ID NO: 52359 - DNA, 20 bp, Artificial Sequence
  chemically synthesized
cctttcttccccaccaagaa

SEQ ID NO: 52360 - DNA, 20 bp, Artificial Sequence
  chemically synthesized
tagtgagttctattcttggt

SEQ ID NO: 52361 - DNA, 20 bp, Artificial Sequence
  chemically synthesized
agtgagttctattcttggtg

SEQ ID NO: 52362 - DNA, 20 bp, Artificial Sequence
  chemically synthesized
gagttctattcttggtgggg

SEQ ID NO: 52363 - DNA, 20 bp, Artificial Sequence
  chemically synthesized
ttattcctttcttccccacc

SEQ ID NO: 52364 - DNA, 20 bp, Artificial Sequence
  chemically synthesized
tctattcttggtggggaaga

SEQ ID NO: 52365 - DNA, 20 bp, Artificial Sequence
  chemically synthesized
ctattcttggtggggaagaa

SEQ ID NO: 52366 - DNA, 20 bp, Artificial Sequence
  chemically synthesized
ggaagaaaggaataatttta

SEQ ID NO: 52367 - DNA, 20 bp, Artificial Sequence
  chemically synthesized
gaagaaaggaataattttac

SEQ ID NO: 52368 - DNA, 20 bp, Artificial Sequence
  chemically synthesized
aaatgccaaataagtaagta

SEQ ID NO: 52369 - DNA, 20 bp, Artificial Sequence
  chemically synthesized
acatgctatacttacttatt

SEQ ID NO: 52370 - DNA, 20 bp, Artificial Sequence
  chemically synthesized
tggcaaaatgccaaataagt

SEQ ID NO: 52371 - DNA, 20 bp, Artificial Sequence
  chemically synthesized
ggattggcaaaatgccaaat

SEQ ID NO: 52372 - DNA, 20 bp, Artificial Sequence
  chemically synthesized
agccaccacttatattggat

SEQ ID NO: 52373 - DNA, 20 bp, Artificial Sequence
  chemically synthesized
gcattttgccaatccaatat

SEQ ID NO: 52374 - DNA, 20 bp, Artificial Sequence
  chemically synthesized
ttttgccaatccaatataag

SEQ ID NO: 52375 - DNA, 20 bp, Artificial Sequence
  chemically synthesized
cctggagccaccacttatat

SEQ ID NO: 52376 - DNA, 20 bp, Artificial Sequence
  chemically synthesized
tgccaatccaatataagtgg

SEQ ID NO: 52377 - DNA, 20 bp, Artificial Sequence
  chemically synthesized
tccaatataagtggtggctc

SEQ ID NO: 52378 - DNA, 20 bp, Artificial Sequence
  chemically synthesized
ccaatataagtggtggctcc

SEQ ID NO: 52379 - DNA, 20 bp, Artificial Sequence
  chemically synthesized
ttagagagctaggatgcctg

SEQ ID NO: 52380 - DNA, 20 bp, Artificial Sequence
  chemically synthesized
agtggtggctccaggcatcc

SEQ ID NO: 52381 - DNA, 20 bp, Artificial Sequence
  chemically synthesized
agttagagagctaggatgcc

SEQ ID NO: 52382 - DNA, 20 bp, Artificial Sequence
  chemically synthesized
aaatccagagttagagagct

SEQ ID NO: 52383 - DNA, 20 bp, Artificial Sequence
  chemically synthesized
aaaatccagagttagagagc

SEQ ID NO: 52384 - DNA, 20 bp, Artificial Sequence
  chemically synthesized
aatcaaaatccagagttaga

SEQ ID NO: 52385 - DNA, 20 bp, Artificial Sequence
  chemically synthesized
gcatcctagctctctaactc

SEQ ID NO: 52386 - DNA, 20 bp, Artificial Sequence
  chemically synthesized
taaatcaaaatccagagtta

SEQ ID NO: 52387 - DNA, 20 bp, Artificial Sequence
  chemically synthesized
actaaatcaaaatccagagt

SEQ ID NO: 52388 - DNA, 20 bp, Artificial Sequence
  chemically synthesized
cacaactaaatcaaaatcca

SEQ ID NO: 52389 - DNA, 20 bp, Artificial Sequence
  chemically synthesized
ttcacaactaaatcaaaatc

SEQ ID NO: 52390 - DNA, 20 bp, Artificial Sequence
  chemically synthesized
tctaactctggattttgatt

SEQ ID NO: 52391 - DNA, 20 bp, Artificial Sequence
  chemically synthesized
gattttgatttagttgtgaa

SEQ ID NO: 52392 - DNA, 20 bp, Artificial Sequence
  chemically synthesized
gatcaacccctagtttagca

SEQ ID NO: 52393 - DNA, 20 bp, Artificial Sequence
  chemically synthesized
gtgaacagtccatgctaaac

SEQ ID NO: 52394 - DNA, 20 bp, Artificial Sequence
  chemically synthesized
tgaacagtccatgctaaact

SEQ ID NO: 52395 - DNA, 20 bp, Artificial Sequence
  chemically synthesized
gaacagtccatgctaaacta

SEQ ID NO: 52396 - DNA, 20 bp, Artificial Sequence
  chemically synthesized
aacagtccatgctaaactag

SEQ ID NO: 52397 - DNA, 20 bp, Artificial Sequence
  chemically synthesized
gctctgatcaacccctagtt

SEQ ID NO: 52398 - DNA, 20 bp, Artificial Sequence
  chemically synthesized
tgcaagctctgatcaacccc

SEQ ID NO: 52399 - DNA, 20 bp, Artificial Sequence
  chemically synthesized
atgctaaactaggggttgat

SEQ ID NO: 52400 - DNA, 20 bp, Artificial Sequence
  chemically synthesized
gctaaactaggggttgatca

SEQ ID NO: 52401 - DNA, 20 bp, Artificial Sequence
  chemically synthesized
ggggttgatcagagcttgca

SEQ ID NO: 52402 - DNA, 20 bp, Artificial Sequence
  chemically synthesized
ggttgatcagagcttgcaca

SEQ ID NO: 52403 - DNA, 20 bp, Artificial Sequence
  chemically synthesized
gagttctgattgctctgtgc

SEQ ID NO: 52404 - DNA, 20 bp, Artificial Sequence
  chemically synthesized
cagagcttgcacagagcaat

SEQ ID NO: 52405 - DNA, 20 bp, Artificial Sequence
  chemically synthesized
tgcacagagcaatcagaact

SEQ ID NO: 52406 - DNA, 20 bp, Artificial Sequence
  chemically synthesized
gcacagagcaatcagaactc

SEQ ID NO: 52407 - DNA, 20 bp, Artificial Sequence
  chemically synthesized
cacagagcaatcagaactca

SEQ ID NO: 52408 - DNA, 20 bp, Artificial Sequence
  chemically synthesized
acagagcaatcagaactcag

SEQ ID NO: 52409 - DNA, 20 bp, Artificial Sequence
  chemically synthesized
cagagcaatcagaactcagg

SEQ ID NO: 52410 - DNA, 20 bp, Artificial Sequence
  chemically synthesized
agcaatcagaactcaggggg

SEQ ID NO: 52411 - DNA, 20 bp, Artificial Sequence
  chemically synthesized
caccacgggaactaccccct

SEQ ID NO: 52412 - DNA, 20 bp, Artificial Sequence
  chemically synthesized
aactcagggggtagttcccg

SEQ ID NO: 52413 - DNA, 20 bp, Artificial Sequence
  chemically synthesized
tcgggaattctgcacaccac

SEQ ID NO: 52414 - DNA, 20 bp, Artificial Sequence
  chemically synthesized
ggggtagttcccgtggtgtg

SEQ ID NO: 52415 - DNA, 20 bp, Artificial Sequence
  chemically synthesized
ctcgggaattctgcacacca

SEQ ID NO: 52416 - DNA, 20 bp, Artificial Sequence
  chemically synthesized
ccgtggtgtgcagaattccc

SEQ ID NO: 52417 - DNA, 20 bp, Artificial Sequence
  chemically synthesized
gtggtgtgcagaattcccga

SEQ ID NO: 52418 - DNA, 20 bp, Artificial Sequence
  chemically synthesized
tggtgtgcagaattcccgag

SEQ ID NO: 52419 - DNA, 20 bp, Artificial Sequence
  chemically synthesized
aacatcgatttttacctctc

SEQ ID NO: 52420 - DNA, 20 bp, Artificial Sequence
  chemically synthesized
taacatcgatttttacctct

SEQ ID NO: 52421 - DNA, 20 bp, Artificial Sequence
  chemically synthesized
aaaatcgatgttaatctcat

SEQ ID NO: 52422 - DNA, 20 bp, Artificial Sequence
  chemically synthesized
cgatgttaatctcatcagaa

SEQ ID NO: 52423 - DNA, 20 bp, Artificial Sequence
  chemically synthesized
acctgagccacttttctgat

SEQ ID NO: 52424 - DNA, 20 bp, Artificial Sequence
  chemically synthesized
tgttaatctcatcagaaaag

SEQ ID NO: 52425 - DNA, 20 bp, Artificial Sequence
  chemically synthesized
atctcatcagaaaagtggct

SEQ ID NO: 52426 - DNA, 20 bp, Artificial Sequence
  chemically synthesized
tctcatcagaaaagtggctc

SEQ ID NO: 52427 - DNA, 20 bp, Artificial Sequence
  chemically synthesized
catcagaaaagtggctcagg

SEQ ID NO: 52428 - DNA, 20 bp, Artificial Sequence
  chemically synthesized
ggtttgagaccaggctacct

SEQ ID NO: 52429 - DNA, 20 bp, Artificial Sequence
  chemically synthesized
gaaaagtggctcaggtagcc

SEQ ID NO: 52430 - DNA, 20 bp, Artificial Sequence
  chemically synthesized
gccagagttggtttgagacc

SEQ ID NO: 52431 - DNA, 20 bp, Artificial Sequence
  chemically synthesized
ggccagagttggtttgagac

SEQ ID NO: 52432 - DNA, 20 bp, Artificial Sequence
  chemically synthesized
tggaaggccagagttggttt

SEQ ID NO: 52433 - DNA, 20 bp, Artificial Sequence
  chemically synthesized
gcctggtctcaaaccaactc

SEQ ID NO: 52434 - DNA, 20 bp, Artificial Sequence
  chemically synthesized
tgatattggaaggccagagt

SEQ ID NO: 52435 - DNA, 20 bp, Artificial Sequence
  chemically synthesized
taattgatattggaaggcca

SEQ ID NO: 52436 - DNA, 20 bp, Artificial Sequence
  chemically synthesized
cttaattgatattggaaggc

SEQ ID NO: 52437 - DNA, 20 bp, Artificial Sequence
  chemically synthesized
ggcacttaattgatattgga

SEQ ID NO: 52438 - DNA, 20 bp, Artificial Sequence
  chemically synthesized
aggcacttaattgatattgg

SEQ ID NO: 52439 - DNA, 20 bp, Artificial Sequence
  chemically synthesized
actaggcacttaattgatat

SEQ ID NO: 52440 - DNA, 20 bp, Artificial Sequence
  chemically synthesized
ctggccttccaatatcaatt

SEQ ID NO: 52441 - DNA, 20 bp, Artificial Sequence
  chemically synthesized
tccaatatcaattaagtgcc

SEQ ID NO: 52442 - DNA, 20 bp, Artificial Sequence
  chemically synthesized
gattgttctggatatacact

SEQ ID NO: 52443 - DNA, 20 bp, Artificial Sequence
  chemically synthesized
agattgttctggatatacac

SEQ ID NO: 52444 - DNA, 20 bp, Artificial Sequence
  chemically synthesized
ttaagtgcctagtgtatatc

SEQ ID NO: 52445 - DNA, 20 bp, Artificial Sequence
  chemically synthesized
gtgaaaaaatgagattgttc

SEQ ID NO: 52446 - DNA, 20 bp, Artificial Sequence
  chemically synthesized
tagggagagagtgaaaaaat

SEQ ID NO: 52447 - DNA, 20 bp, Artificial Sequence
  chemically synthesized
tcattttttcactctctccc

SEQ ID NO: 52448 - DNA, 20 bp, Artificial Sequence
  chemically synthesized
aatgggcaagtctagggaga

SEQ ID NO: 52449 - DNA, 20 bp, Artificial Sequence
  chemically synthesized
aaaatgggcaagtctaggga

SEQ ID NO: 52450 - DNA, 20 bp, Artificial Sequence
  chemically synthesized
caaaaatgggcaagtctagg

SEQ ID NO: 52451 - DNA, 20 bp, Artificial Sequence
  chemically synthesized
agcaaaaatgggcaagtcta

SEQ ID NO: 52452 - DNA, 20 bp, Artificial Sequence
  chemically synthesized
aagcaaaaatgggcaagtct

SEQ ID NO: 52453 - DNA, 20 bp, Artificial Sequence
  chemically synthesized
caagcaaaaatgggcaagtc

SEQ ID NO: 52454 - DNA, 20 bp, Artificial Sequence
  chemically synthesized
tgggccaagcaaaaatgggc

SEQ ID NO: 52455 - DNA, 20 bp, Artificial Sequence
  chemically synthesized
tatttgggccaagcaaaaat

SEQ ID NO: 52456 - DNA, 20 bp, Artificial Sequence
  chemically synthesized
gtatttgggccaagcaaaaa

SEQ ID NO: 52457 - DNA, 20 bp, Artificial Sequence
  chemically synthesized
tagacttgcccatttttgct

SEQ ID NO: 52458 - DNA, 20 bp, Artificial Sequence
  chemically synthesized
gttatccacgtatttgggcc

SEQ ID NO: 52459 - DNA, 20 bp, Artificial Sequence
  chemically synthesized
ttttgcttggcccaaatacg

SEQ ID NO: 52460 - DNA, 20 bp, Artificial Sequence
  chemically synthesized
acttggttatccacgtattt

SEQ ID NO: 52461 - DNA, 20 bp, Artificial Sequence
  chemically synthesized
cacttggttatccacgtatt

SEQ ID NO: 52462 - DNA, 20 bp, Artificial Sequence
  chemically synthesized
gcccaaatacgtggataacc

SEQ ID NO: 52463 - DNA, 20 bp, Artificial Sequence
  chemically synthesized
caaatacgtggataaccaag

SEQ ID NO: 52464 - DNA, 20 bp, Artificial Sequence
  chemically synthesized
aaatacgtggataaccaagt

SEQ ID NO: 52465 - DNA, 20 bp, Artificial Sequence
  chemically synthesized
aatacgtggataaccaagtg

SEQ ID NO: 52466 - DNA, 20 bp, Artificial Sequence
  chemically synthesized
cattgtaggggaaccccact

SEQ ID NO: 52467 - DNA, 20 bp, Artificial Sequence
  chemically synthesized
aagtaaatcctgcattgtag

SEQ ID NO: 52468 - DNA, 20 bp, Artificial Sequence
  chemically synthesized
agtggggttcccctacaatg

SEQ ID NO: 52469 - DNA, 20 bp, Artificial Sequence
  chemically synthesized
aaagtaaatcctgcattgta

SEQ ID NO: 52470 - DNA, 20 bp, Artificial Sequence
  chemically synthesized
gtggggttcccctacaatgc

SEQ ID NO: 52471 - DNA, 20 bp, Artificial Sequence
  chemically synthesized
taaagtaaatcctgcattgt

SEQ ID NO: 52472 - DNA, 20 bp, Artificial Sequence
  chemically synthesized
ataaagtaaatcctgcattg

SEQ ID NO: 52473 - DNA, 20 bp, Artificial Sequence
  chemically synthesized
gcttttgtgtatataaaata

SEQ ID NO: 52474 - DNA, 20 bp, Artificial Sequence
  chemically synthesized
actttattttatatacacaa

SEQ ID NO: 52475 - DNA, 20 bp, Artificial Sequence
  chemically synthesized
ttttatatacacaaaagcat

SEQ ID NO: 52476 - DNA, 20 bp, Artificial Sequence
  chemically synthesized
tttatatacacaaaagcatg

SEQ ID NO: 52477 - DNA, 20 bp, Artificial Sequence
  chemically synthesized
ttatatacacaaaagcatga

SEQ ID NO: 52478 - DNA, 20 bp, Artificial Sequence
  chemically synthesized
ggtcataaggttgggaaggt

SEQ ID NO: 52479 - DNA, 20 bp, Artificial Sequence
  chemically synthesized
gggtcataaggttgggaagg

SEQ ID NO: 52480 - DNA, 20 bp, Artificial Sequence
  chemically synthesized
gcagggtcataaggttggga

SEQ ID NO: 52481 - DNA, 20 bp, Artificial Sequence
  chemically synthesized
tgcagggtcataaggttggg

SEQ ID NO: 52482 - DNA, 20 bp, Artificial Sequence
  chemically synthesized
gagtgcagggtcataaggtt

SEQ ID NO: 52483 - DNA, 20 bp, Artificial Sequence
  chemically synthesized
ggagtgcagggtcataaggt

SEQ ID NO: 52484 - DNA, 20 bp, Artificial Sequence
  chemically synthesized
tttgggagtgcagggtcata

SEQ ID NO: 52485 - DNA, 20 bp, Artificial Sequence
  chemically synthesized
gtttgggagtgcagggtcat

SEQ ID NO: 52486 - DNA, 20 bp, Artificial Sequence
  chemically synthesized
aggtagagtttgggagtgca

SEQ ID NO: 52487 - DNA, 20 bp, Artificial Sequence
  chemically synthesized
caggtagagtttgggagtgc

SEQ ID NO: 52488 - DNA, 20 bp, Artificial Sequence
  chemically synthesized
gcaggtagagtttgggagtg

SEQ ID NO: 52489 - DNA, 20 bp, Artificial Sequence
  chemically synthesized
gcttagcaggtagagtttgg

SEQ ID NO: 52490 - DNA, 20 bp, Artificial Sequence
  chemically synthesized
gggcttagcaggtagagttt

SEQ ID NO: 52491 - DNA, 20 bp, Artificial Sequence
  chemically synthesized
tgggcttagcaggtagagtt

SEQ ID NO: 52492 - DNA, 20 bp, Artificial Sequence
  chemically synthesized
tttggtgggcttagcaggta

SEQ ID NO: 52493 - DNA, 20 bp, Artificial Sequence
  chemically synthesized
actcccaaactctacctgct

SEQ ID NO: 52494 - DNA, 20 bp, Artificial Sequence
  chemically synthesized
gttttggtgggcttagcagg

SEQ ID NO: 52495 - DNA, 20 bp, Artificial Sequence
  chemically synthesized
gtagttttggtgggcttagc

SEQ ID NO: 52496 - DNA, 20 bp, Artificial Sequence
  chemically synthesized
ggtagttttggtgggcttag

SEQ ID NO: 52497 - DNA, 20 bp, Artificial Sequence
  chemically synthesized
gcaggtagttttggtgggct

SEQ ID NO: 52498 - DNA, 20 bp, Artificial Sequence
  chemically synthesized
gacaggcaggtagttttggt

SEQ ID NO: 52499 - DNA, 20 bp, Artificial Sequence
  chemically synthesized
ggacaggcaggtagttttgg

SEQ ID NO: 52500 - DNA, 20 bp, Artificial Sequence
  chemically synthesized
gcaggacaggcaggtagttt

SEQ ID NO: 52501 - DNA, 20 bp, Artificial Sequence
  chemically synthesized
aatagtgcaggacaggcagg

SEQ ID NO: 52502 - DNA, 20 bp, Artificial Sequence
  chemically synthesized
tggaatagtgcaggacaggc

SEQ ID NO: 52503 - DNA, 20 bp, Artificial Sequence
  chemically synthesized
atggaatagtgcaggacagg

SEQ ID NO: 52504 - DNA, 20 bp, Artificial Sequence
  chemically synthesized
tggatggaatagtgcaggac

SEQ ID NO: 52505 - DNA, 20 bp, Artificial Sequence
  chemically synthesized
ttggatggaatagtgcagga

SEQ ID NO: 52506 - DNA, 20 bp, Artificial Sequence
  chemically synthesized
tatattggatggaatagtgc

SEQ ID NO: 52507 - DNA, 20 bp, Artificial Sequence
  chemically synthesized
ttatattggatggaatagtg

SEQ ID NO: 52508 - DNA, 20 bp, Artificial Sequence
  chemically synthesized
aagagttatattggatggaa

SEQ ID NO: 52509 - DNA, 20 bp, Artificial Sequence
  chemically synthesized
cgcacaagagttatattgga

SEQ ID NO: 52510 - DNA, 20 bp, Artificial Sequence
  chemically synthesized
gccacgcacaagagttatat

SEQ ID NO: 52511 - DNA, 20 bp, Artificial Sequence
  chemically synthesized
tccaatataactcttgtgcg

SEQ ID NO: 52512 - DNA, 20 bp, Artificial Sequence
  chemically synthesized
catgaagaagccacgcacaa

SEQ ID NO: 52513 - DNA, 20 bp, Artificial Sequence
  chemically synthesized
agcatgaagaagccacgcac

SEQ ID NO: 52514 - DNA, 20 bp, Artificial Sequence
  chemically synthesized
agagaaggagcagcatgaag

SEQ ID NO: 52515 - DNA, 20 bp, Artificial Sequence
  chemically synthesized
ccgagagaaggagcagcatg

SEQ ID NO: 52516 - DNA, 20 bp, Artificial Sequence
  chemically synthesized
agcattgccgagagaaggag

SEQ ID NO: 52517 - DNA, 20 bp, Artificial Sequence
  chemically synthesized
cttcatgctgctccttctct

SEQ ID NO: 52518 - DNA, 20 bp, Artificial Sequence
  chemically synthesized
aagagcattgccgagagaag

SEQ ID NO: 52519 - DNA, 20 bp, Artificial Sequence
  chemically synthesized
gtaagagcattgccgagaga

SEQ ID NO: 52520 - DNA, 20 bp, Artificial Sequence
  chemically synthesized
ggtaagagcattgccgagag

SEQ ID NO: 52521 - DNA, 20 bp, Artificial Sequence
  chemically synthesized
tggggtaagagcattgccga

SEQ ID NO: 52522 - DNA, 20 bp, Artificial Sequence
  chemically synthesized
agtggggtaagagcattgcc

SEQ ID NO: 52523 - DNA, 20 bp, Artificial Sequence
  chemically synthesized
ctgggagagaagtggggtaa

SEQ ID NO: 52524 - DNA, 20 bp, Artificial Sequence
  chemically synthesized
atctgggagagaagtggggt

SEQ ID NO: 52525 - DNA, 20 bp, Artificial Sequence
  chemically synthesized
attgatctgggagagaagtg

SEQ ID NO: 52526 - DNA, 20 bp, Artificial Sequence
  chemically synthesized
cattgatctgggagagaagt

SEQ ID NO: 52527 - DNA, 20 bp, Artificial Sequence
  chemically synthesized
gcattgatctgggagagaag

SEQ ID NO: 52528 - DNA, 20 bp, Artificial Sequence
  chemically synthesized
ctcttaccccacttctctcc

SEQ ID NO: 52529 - DNA, 20 bp, Artificial Sequence
  chemically synthesized
acagcattgatctgggagag

SEQ ID NO: 52530 - DNA, 20 bp, Artificial Sequence
  chemically synthesized
ctaacagcattgatctggga

SEQ ID NO: 52531 - DNA, 20 bp, Artificial Sequence
  chemically synthesized
cactaacagcattgatctgg

SEQ ID NO: 52532 - DNA, 20 bp, Artificial Sequence
  chemically synthesized
aacactaacagcattgatct

SEQ ID NO: 52533 - DNA, 20 bp, Artificial Sequence
  chemically synthesized
aaacactaacagcattgatc

SEQ ID NO: 52534 - DNA, 20 bp, Artificial Sequence
  chemically synthesized
ctctcccagatcaatgctgt

SEQ ID NO: 52535 - DNA, 20 bp, Artificial Sequence
  chemically synthesized
agtaaacatataaacactaa

SEQ ID NO: 52536 - DNA, 20 bp, Artificial Sequence
  chemically synthesized
ttctaacctgggagatgagg

SEQ ID NO: 52537 - DNA, 20 bp, Artificial Sequence
  chemically synthesized
atgtttacttcctcatctcc

SEQ ID NO: 52538 - DNA, 20 bp, Artificial Sequence
  chemically synthesized
taattctaacctgggagatg

SEQ ID NO: 52539 - DNA, 20 bp, Artificial Sequence
  chemically synthesized
tgtttacttcctcatctccc

SEQ ID NO: 52540 - DNA, 20 bp, Artificial Sequence
  chemically synthesized
ttaattctaacctgggagat

SEQ ID NO: 52541 - DNA, 20 bp, Artificial Sequence
  chemically synthesized
tacttcctcatctcccaggt

SEQ ID NO: 52542 - DNA, 20 bp, Artificial Sequence
  chemically synthesized
agccattaattctaacctgg

SEQ ID NO: 52543 - DNA, 20 bp, Artificial Sequence
  chemically synthesized
gaagccattaattctaacct

SEQ ID NO: 52544 - DNA, 20 bp, Artificial Sequence
  chemically synthesized
ggaagccattaattctaacc

SEQ ID NO: 52545 - DNA, 20 bp, Artificial Sequence
  chemically synthesized
atctcccaggttagaattaa

SEQ ID NO: 52546 - DNA, 20 bp, Artificial Sequence
  chemically synthesized
gttagaattaatggcttcct

SEQ ID NO: 52547 - DNA, 20 bp, Artificial Sequence
  chemically synthesized
atactgttagaatgctgagg

SEQ ID NO: 52548 - DNA, 20 bp, Artificial Sequence
  chemically synthesized
catatactgttagaatgctg

SEQ ID NO: 52549 - DNA, 20 bp, Artificial Sequence
  chemically synthesized
ccatatactgttagaatgct

SEQ ID NO: 52550 - DNA, 20 bp, Artificial Sequence
  chemically synthesized
tggcttcctcagcattctaa

SEQ ID NO: 52551 - DNA, 20 bp, Artificial Sequence
  chemically synthesized
aggtataaaccatatactgt

SEQ ID NO: 52552 - DNA, 20 bp, Artificial Sequence
  chemically synthesized
ctcagcattctaacagtata

SEQ ID NO: 52553 - DNA, 20 bp, Artificial Sequence
  chemically synthesized
cagtatatggtttatacctg

SEQ ID NO: 52554 - DNA, 20 bp, Artificial Sequence
  chemically synthesized
ttatatgatagaagtgcttc

SEQ ID NO: 52555 - DNA, 20 bp, Artificial Sequence
  chemically synthesized
attatatgatagaagtgctt

SEQ ID NO: 52556 - DNA, 20 bp, Artificial Sequence
  chemically synthesized
taaaatgaattatatgatag

SEQ ID NO: 52557 - DNA, 20 bp, Artificial Sequence
  chemically synthesized
aactaaaatgaattatatga

SEQ ID NO: 52558 - DNA, 20 bp, Artificial Sequence
  chemically synthesized
ttctatcatataattcattt

SEQ ID NO: 52559 - DNA, 20 bp, Artificial Sequence
  chemically synthesized
tataattcattttagttata

SEQ ID NO: 52560 - DNA, 20 bp, Artificial Sequence
  chemically synthesized
cattttagttatatggacat

SEQ ID NO: 52561 - DNA, 20 bp, Artificial Sequence
  chemically synthesized
gacatgagtgtgtcttgcaa

SEQ ID NO: 52562 - DNA, 20 bp, Artificial Sequence
  chemically synthesized
agaagtttccaatctattgc

SEQ ID NO: 52563 - DNA, 20 bp, Artificial Sequence
  chemically synthesized
gagtgtgtcttgcaatagat

SEQ ID NO: 52564 - DNA, 20 bp, Artificial Sequence
  chemically synthesized
atagattggaaacttcttga

SEQ ID NO: 52565 - DNA, 20 bp, Artificial Sequence
  chemically synthesized
aaatggtccctgctatcaag

SEQ ID NO: 52566 - DNA, 20 bp, Artificial Sequence
  chemically synthesized
gattggaaacttcttgatag

SEQ ID NO: 52567 - DNA, 20 bp, Artificial Sequence
  chemically synthesized
attggaaacttcttgatagc

SEQ ID NO: 52568 - DNA, 20 bp, Artificial Sequence
  chemically synthesized
ttggaaacttcttgatagca

SEQ ID NO: 52569 - DNA, 20 bp, Artificial Sequence
  chemically synthesized
aaaaaatggtccctgctatc

SEQ ID NO: 52570 - DNA, 20 bp, Artificial Sequence
  chemically synthesized
agagaaaggtaaacaaaaaa

SEQ ID NO: 52571 - DNA, 20 bp, Artificial Sequence
  chemically synthesized
ttggagacattcgaagagaa

SEQ ID NO: 52572 - DNA, 20 bp, Artificial Sequence
  chemically synthesized
gttggagacattcgaagaga

SEQ ID NO: 52573 - DNA, 20 bp, Artificial Sequence
  chemically synthesized
aagggttggagacattcgaa

SEQ ID NO: 52574 - DNA, 20 bp, Artificial Sequence
  chemically synthesized
gaaagggttggagacattcg

SEQ ID NO: 52575 - DNA, 20 bp, Artificial Sequence
  chemically synthesized
gcctcctgcagaaagggttg

SEQ ID NO: 52576 - DNA, 20 bp, Artificial Sequence
  chemically synthesized
gtgcctcctgcagaaagggt

SEQ ID NO: 52577 - DNA, 20 bp, Artificial Sequence
  chemically synthesized
aatgtctccaaccctttctg

SEQ ID NO: 52578 - DNA, 20 bp, Artificial Sequence
  chemically synthesized
atgtctccaaccctttctgc

SEQ ID NO: 52579 - DNA, 20 bp, Artificial Sequence
  chemically synthesized
ctatgtgcctcctgcagaaa

SEQ ID NO: 52580 - DNA, 20 bp, Artificial Sequence
  chemically synthesized
actatgtgcctcctgcagaa

SEQ ID NO: 52581 - DNA, 20 bp, Artificial Sequence
  chemically synthesized
gtctccaaccctttctgcag

SEQ ID NO: 52582 - DNA, 20 bp, Artificial Sequence
  chemically synthesized
tactatgtgcctcctgcaga

SEQ ID NO: 52583 - DNA, 20 bp, Artificial Sequence
  chemically synthesized
tctccaaccctttctgcagg

SEQ ID NO: 52584 - DNA, 20 bp, Artificial Sequence
  chemically synthesized
catatactatgtgcctcctg

SEQ ID NO: 52585 - DNA, 20 bp, Artificial Sequence
  chemically synthesized
ccctttctgcaggaggcaca

SEQ ID NO: 52586 - DNA, 20 bp, Artificial Sequence
  chemically synthesized
tgcaggaggcacatagtata

SEQ ID NO: 52587 - DNA, 20 bp, Artificial Sequence
  chemically synthesized
aggaggcacatagtatatgg

SEQ ID NO: 52588 - DNA, 20 bp, Artificial Sequence
  chemically synthesized
gcaaatatttgtttaatgac

SEQ ID NO: 52589 - DNA, 20 bp, Artificial Sequence
  chemically synthesized
catccatttgtttggtcaac

SEQ ID NO: 52590 - DNA, 20 bp, Artificial Sequence
  chemically synthesized
tgactagttgaccaaacaaa

SEQ ID NO: 52591 - DNA, 20 bp, Artificial Sequence
  chemically synthesized
catttactcatccatttgtt

SEQ ID NO: 52592 - DNA, 20 bp, Artificial Sequence
  chemically synthesized
agttgaccaaacaaatggat

SEQ ID NO: 52593 - DNA, 20 bp, Artificial Sequence
  chemically synthesized
aaacaaatggatgagtaaat

SEQ ID NO: 52594 - DNA, 20 bp, Artificial Sequence
  chemically synthesized
gatgagtaaatgagtaaatg

SEQ ID NO: 52595 - DNA, 20 bp, Artificial Sequence
  chemically synthesized
gtgtgtgtgtgtgtgtgtgt

SEQ ID NO: 52596 - DNA, 20 bp, Artificial Sequence
  chemically synthesized
gtgtgtgtgtgtgtgtgtga

SEQ ID NO: 52597 - DNA, 20 bp, Artificial Sequence
  chemically synthesized
gtgtgtgtgtgtgtgtgaga

SEQ ID NO: 52598 - DNA, 20 bp, Artificial Sequence
  chemically synthesized
gtgtgtgtgtgtgtgagaga

SEQ ID NO: 52599 - DNA, 20 bp, Artificial Sequence
  chemically synthesized
gtgtgtgtgtgtgagagaga

SEQ ID NO: 52600 - DNA, 20 bp, Artificial Sequence
  chemically synthesized
gtgtgtgtgtgagagagaga

SEQ ID NO: 52601 - DNA, 20 bp, Artificial Sequence
  chemically synthesized
gtgtgtgtgagagagagaga

SEQ ID NO: 52602 - DNA, 20 bp, Artificial Sequence
  chemically synthesized
gtgtgtgagagagagagaga

SEQ ID NO: 52603 - DNA, 20 bp, Artificial Sequence
  chemically synthesized
gtgtgagagagagagagaga

SEQ ID NO: 52604 - DNA, 20 bp, Artificial Sequence
  chemically synthesized
gtgagagagagagagagaga

SEQ ID NO: 52605 - DNA, 20 bp, Artificial Sequence
  chemically synthesized
gagagagagagagagagaga

SEQ ID NO: 52606 - DNA, 20 bp, Artificial Sequence
  chemically synthesized
gagagagagagagagagaga

SEQ ID NO: 52607 - DNA, 20 bp, Artificial Sequence
  chemically synthesized
gagagagagagagagagaga

SEQ ID NO: 52608 - DNA, 20 bp, Artificial Sequence
  chemically synthesized
agagagagagagagagagag

SEQ ID NO: 52609 - DNA, 20 bp, Artificial Sequence
  chemically synthesized
agagagagagagagagagaa

SEQ ID NO: 52610 - DNA, 20 bp, Artificial Sequence
  chemically synthesized
gagagagagagagagaagag

SEQ ID NO: 52611 - DNA, 20 bp, Artificial Sequence
  chemically synthesized
gagagagagagagaagagaa

SEQ ID NO: 52612 - DNA, 20 bp, Artificial Sequence
  chemically synthesized
agagagagagaagagaagag

SEQ ID NO: 52613 - DNA, 20 bp, Artificial Sequence
  chemically synthesized
agaagagaagagaagcgatg

SEQ ID NO: 52614 - DNA, 20 bp, Artificial Sequence
  chemically synthesized
agaagcgatgcggaacaaac

SEQ ID NO: 52615 - DNA, 20 bp, Artificial Sequence
  chemically synthesized
tcagtgcactcagtgtcagt

SEQ ID NO: 52616 - DNA, 20 bp, Artificial Sequence
  chemically synthesized
gtcagtgcactcagtgtcag

SEQ ID NO: 52617 - DNA, 20 bp, Artificial Sequence
  chemically synthesized
caagtatgcctactgacact

SEQ ID NO: 52618 - DNA, 20 bp, Artificial Sequence
  chemically synthesized
gcagtcagtgcactcagtgt

SEQ ID NO: 52619 - DNA, 20 bp, Artificial Sequence
  chemically synthesized
agacctgcagtcagtgcact

SEQ ID NO: 52620 - DNA, 20 bp, Artificial Sequence
  chemically synthesized
gacactgagtgcactgactg

SEQ ID NO: 52621 - DNA, 20 bp, Artificial Sequence
  chemically synthesized
acactgagtgcactgactgc

SEQ ID NO: 52622 - DNA, 20 bp, Artificial Sequence
  chemically synthesized
aaccattacagacctgcagt

SEQ ID NO: 52623 - DNA, 20 bp, Artificial Sequence
  chemically synthesized
aattaaccattacagacctg

SEQ ID NO: 52624 - DNA, 20 bp, Artificial Sequence
  chemically synthesized
cactgactgcaggtctgtaa

SEQ ID NO: 52625 - DNA, 20 bp, Artificial Sequence
  chemically synthesized
acacatagaattaaccatta

SEQ ID NO: 52626 - DNA, 20 bp, Artificial Sequence
  chemically synthesized
aatggttaattctatgtgtc

SEQ ID NO: 52627 - DNA, 20 bp, Artificial Sequence
  chemically synthesized
agtccagtcaacttgacaca

SEQ ID NO: 52628 - DNA, 20 bp, Artificial Sequence
  chemically synthesized
attctatgtgtcaagttgac

SEQ ID NO: 52629 - DNA, 20 bp, Artificial Sequence
  chemically synthesized
gtgtcaagttgactggacta

SEQ ID NO: 52630 - DNA, 20 bp, Artificial Sequence
  chemically synthesized
tgtcaagttgactggactat

SEQ ID NO: 52631 - DNA, 20 bp, Artificial Sequence
  chemically synthesized
gtcaagttgactggactatg

SEQ ID NO: 52632 - DNA, 20 bp, Artificial Sequence
  chemically synthesized
tacctgggcaccccatagtc

SEQ ID NO: 52633 - DNA, 20 bp, Artificial Sequence
  chemically synthesized
tggtttacctgggcacccca

SEQ ID NO: 52634 - DNA, 20 bp, Artificial Sequence
  chemically synthesized
tgactggactatggggtgcc

SEQ ID NO: 52635 - DNA, 20 bp, Artificial Sequence
  chemically synthesized
gactggactatggggtgccc

SEQ ID NO: 52636 - DNA, 20 bp, Artificial Sequence
  chemically synthesized
ccagaaatagtggtttacct

SEQ ID NO: 52637 - DNA, 20 bp, Artificial Sequence
  chemically synthesized
cccagaaatagtggtttacc

SEQ ID NO: 52638 - DNA, 20 bp, Artificial Sequence
  chemically synthesized
cccaggtaaaccactatttc

SEQ ID NO: 52639 - DNA, 20 bp, Artificial Sequence
  chemically synthesized
acagacacacccagaaatag

SEQ ID NO: 52640 - DNA, 20 bp, Artificial Sequence
  chemically synthesized
ccaggtaaaccactatttct

SEQ ID NO: 52641 - DNA, 20 bp, Artificial Sequence
  chemically synthesized
ctcacagacacacccagaaa

SEQ ID NO: 52642 - DNA, 20 bp, Artificial Sequence
  chemically synthesized
aacaccctcacagacacacc

SEQ ID NO: 52643 - DNA, 20 bp, Artificial Sequence
  chemically synthesized
ctatttctgggtgtgtctgt

SEQ ID NO: 52644 - DNA, 20 bp, Artificial Sequence
  chemically synthesized
tatttctgggtgtgtctgtg

SEQ ID NO: 52645 - DNA, 20 bp, Artificial Sequence
  chemically synthesized
atttctgggtgtgtctgtga

SEQ ID NO: 52646 - DNA, 20 bp, Artificial Sequence
  chemically synthesized
ttgtctgcaaaacaccctca

SEQ ID NO: 52647 - DNA, 20 bp, Artificial Sequence
  chemically synthesized
gtgtctgtgagggtgttttg

SEQ ID NO: 52648 - DNA, 20 bp, Artificial Sequence
  chemically synthesized
tgtgagggtgttttgcagac

SEQ ID NO: 52649 - DNA, 20 bp, Artificial Sequence
  chemically synthesized
gggtgttttgcagacaagat

SEQ ID NO: 52650 - DNA, 20 bp, Artificial Sequence
  chemically synthesized
ttgcagacaagattagcatt

SEQ ID NO: 52651 - DNA, 20 bp, Artificial Sequence
  chemically synthesized
gacaagattagcatttggtt

SEQ ID NO: 52652 - DNA, 20 bp, Artificial Sequence
  chemically synthesized
aagattagcatttggttcag

SEQ ID NO: 52653 - DNA, 20 bp, Artificial Sequence
  chemically synthesized
agcatttggttcagtggatt

SEQ ID NO: 52654 - DNA, 20 bp, Artificial Sequence
  chemically synthesized
atttggttcagtggattcag

SEQ ID NO: 52655 - DNA, 20 bp, Artificial Sequence
  chemically synthesized
atgcccgcccacattgggga

SEQ ID NO: 52656 - DNA, 20 bp, Artificial Sequence
  chemically synthesized
gatgcccgcccacattgggg

SEQ ID NO: 52657 - DNA, 20 bp, Artificial Sequence
  chemically synthesized
gtagattgccctccccaatg

SEQ ID NO: 52658 - DNA, 20 bp, Artificial Sequence
  chemically synthesized
tgatgcccgcccacattggg

SEQ ID NO: 52659 - DNA, 20 bp, Artificial Sequence
  chemically synthesized
tagattgccctccccaatgt

SEQ ID NO: 52660 - DNA, 20 bp, Artificial Sequence
  chemically synthesized
gatgatgcccgcccacattg

SEQ ID NO: 52661 - DNA, 20 bp, Artificial Sequence
  chemically synthesized
ggatgatgcccgcccacatt

SEQ ID NO: 52662 - DNA, 20 bp, Artificial Sequence
  chemically synthesized
attgccctccccaatgtggg

SEQ ID NO: 52663 - DNA, 20 bp, Artificial Sequence
  chemically synthesized
aggatgatgcccgcccacat

SEQ ID NO: 52664 - DNA, 20 bp, Artificial Sequence
  chemically synthesized
ttgccctccccaatgtgggc

SEQ ID NO: 52665 - DNA, 20 bp, Artificial Sequence
  chemically synthesized
gtgggcgggcatcatcctgt

SEQ ID NO: 52666 - DNA, 20 bp, Artificial Sequence
  chemically synthesized
cgggcatcatcctgtcagtt

SEQ ID NO: 52667 - DNA, 20 bp, Artificial Sequence
  chemically synthesized
tgtttaggacctcaactgac

SEQ ID NO: 52668 - DNA, 20 bp, Artificial Sequence
  chemically synthesized
gggcatcatcctgtcagttg

SEQ ID NO: 52669 - DNA, 20 bp, Artificial Sequence
  chemically synthesized
ctgtttaggacctcaactga

SEQ ID NO: 52670 - DNA, 20 bp, Artificial Sequence
  chemically synthesized
ctgtcagttgaggtcctaaa

SEQ ID NO: 52671 - DNA, 20 bp, Artificial Sequence
  chemically synthesized
catgcctttttgttctgttt

SEQ ID NO: 52672 - DNA, 20 bp, Artificial Sequence
  chemically synthesized
acatgcctttttgttctgtt

SEQ ID NO: 52673 - DNA, 20 bp, Artificial Sequence
  chemically synthesized
gaggtcctaaacagaacaaa

SEQ ID NO: 52674 - DNA, 20 bp, Artificial Sequence
  chemically synthesized
aggtcctaaacagaacaaaa

SEQ ID NO: 52675 - DNA, 20 bp, Artificial Sequence
  chemically synthesized
agcaggcctgcagggaaaaa

SEQ ID NO: 52676 - DNA, 20 bp, Artificial Sequence
  chemically synthesized
aagcaggcctgcagggaaaa

SEQ ID NO: 52677 - DNA, 20 bp, Artificial Sequence
  chemically synthesized
gcatgttccttttttccctg

SEQ ID NO: 52678 - DNA, 20 bp, Artificial Sequence
  chemically synthesized
catgttccttttttccctgc

SEQ ID NO: 52679 - DNA, 20 bp, Artificial Sequence
  chemically synthesized
ccagctcaagcaggcctgca

SEQ ID NO: 52680 - DNA, 20 bp, Artificial Sequence
  chemically synthesized
cccagctcaagcaggcctgc

SEQ ID NO: 52681 - DNA, 20 bp, Artificial Sequence
  chemically synthesized
tcccagctcaagcaggcctg

SEQ ID NO: 52682 - DNA, 20 bp, Artificial Sequence
  chemically synthesized
ttttccctgcaggcctgctt

SEQ ID NO: 52683 - DNA, 20 bp, Artificial Sequence
  chemically synthesized
actgacatcccagctcaagc

SEQ ID NO: 52684 - DNA, 20 bp, Artificial Sequence
  chemically synthesized
ccctgcaggcctgcttgagc

SEQ ID NO: 52685 - DNA, 20 bp, Artificial Sequence
  chemically synthesized
gactgacatcccagctcaag

SEQ ID NO: 52686 - DNA, 20 bp, Artificial Sequence
  chemically synthesized
cctgcaggcctgcttgagct

SEQ ID NO: 52687 - DNA, 20 bp, Artificial Sequence
  chemically synthesized
gaagactgacatcccagctc

SEQ ID NO: 52688 - DNA, 20 bp, Artificial Sequence
  chemically synthesized
gcctgcttgagctgggatgt

SEQ ID NO: 52689 - DNA, 20 bp, Artificial Sequence
  chemically synthesized
gcaggagaagactgacatcc

SEQ ID NO: 52690 - DNA, 20 bp, Artificial Sequence
  chemically synthesized
tcccagtgcaagtgcaggag

SEQ ID NO: 52691 - DNA, 20 bp, Artificial Sequence
  chemically synthesized
aaatcccagtgcaagtgcag

SEQ ID NO: 52692 - DNA, 20 bp, Artificial Sequence
  chemically synthesized
gtaaatcccagtgcaagtgc

SEQ ID NO: 52693 - DNA, 20 bp, Artificial Sequence
  chemically synthesized
tgtaaatcccagtgcaagtg

SEQ ID NO: 52694 - DNA, 20 bp, Artificial Sequence
  chemically synthesized
gtcttctcctgcacttgcac

SEQ ID NO: 52695 - DNA, 20 bp, Artificial Sequence
  chemically synthesized
tcttctcctgcacttgcact

SEQ ID NO: 52696 - DNA, 20 bp, Artificial Sequence
  chemically synthesized
gatgatgtaaatcccagtgc

SEQ ID NO: 52697 - DNA, 20 bp, Artificial Sequence
  chemically synthesized
ggagttgatgatgtaaatcc

SEQ ID NO: 52698 - DNA, 20 bp, Artificial Sequence
  chemically synthesized
atttacatcatcaactcccc

SEQ ID NO: 52699 - DNA, 20 bp, Artificial Sequence
  chemically synthesized
tgaaggcctgagaaccaggg

SEQ ID NO: 52700 - DNA, 20 bp, Artificial Sequence
  chemically synthesized
tctgaaggcctgagaaccag

SEQ ID NO: 52701 - DNA, 20 bp, Artificial Sequence
  chemically synthesized
tcatcaactcccctggttct

SEQ ID NO: 52702 - DNA, 20 bp, Artificial Sequence
  chemically synthesized
gtctgaaggcctgagaacca

SEQ ID NO: 52703 - DNA, 20 bp, Artificial Sequence
  chemically synthesized
catcaactcccctggttctc

SEQ ID NO: 52704 - DNA, 20 bp, Artificial Sequence
  chemically synthesized
agtctgaaggcctgagaacc

SEQ ID NO: 52705 - DNA, 20 bp, Artificial Sequence
  chemically synthesized
cagtctgaaggcctgagaac

SEQ ID NO: 52706 - DNA, 20 bp, Artificial Sequence
  chemically synthesized
tcccctggttctcaggcctt

SEQ ID NO: 52707 - DNA, 20 bp, Artificial Sequence
  chemically synthesized
cagtcccagtctgaaggcct

SEQ ID NO: 52708 - DNA, 20 bp, Artificial Sequence
  chemically synthesized
tggttctcaggccttcagac

SEQ ID NO: 52709 - DNA, 20 bp, Artificial Sequence
  chemically synthesized
ggttctcaggccttcagact

SEQ ID NO: 52710 - DNA, 20 bp, Artificial Sequence
  chemically synthesized
tgatttcagtcccagtctga

SEQ ID NO: 52711 - DNA, 20 bp, Artificial Sequence
  chemically synthesized
gtgatttcagtcccagtctg

SEQ ID NO: 52712 - DNA, 20 bp, Artificial Sequence
  chemically synthesized
tggtagtgtgatttcagtcc

SEQ ID NO: 52713 - DNA, 20 bp, Artificial Sequence
  chemically synthesized
gaaaattggtagtgtgattt

SEQ ID NO: 52714 - DNA, 20 bp, Artificial Sequence
  chemically synthesized
tagagagccaggaaaattgg

SEQ ID NO: 52715 - DNA, 20 bp, Artificial Sequence
  chemically synthesized
aatcacactaccaattttcc

SEQ ID NO: 52716 - DNA, 20 bp, Artificial Sequence
  chemically synthesized
agctagagagccaggaaaat

SEQ ID NO: 52717 - DNA, 20 bp, Artificial Sequence
  chemically synthesized
taccaattttcctggctctc

SEQ ID NO: 52718 - DNA, 20 bp, Artificial Sequence
  chemically synthesized
tatctgcaagctagagagcc

SEQ ID NO: 52719 - DNA, 20 bp, Artificial Sequence
  chemically synthesized
ctatctgcaagctagagagc

SEQ ID NO: 52720 - DNA, 20 bp, Artificial Sequence
  chemically synthesized
cctgctatctgcaagctaga

SEQ ID NO: 52721 - DNA, 20 bp, Artificial Sequence
  chemically synthesized
tttcctggctctctagcttg

SEQ ID NO: 52722 - DNA, 20 bp, Artificial Sequence
  chemically synthesized
gacctgctatctgcaagcta

SEQ ID NO: 52723 - DNA, 20 bp, Artificial Sequence
  chemically synthesized
atgacctgctatctgcaagc

SEQ ID NO: 52724 - DNA, 20 bp, Artificial Sequence
  chemically synthesized
ctggctctctagcttgcaga

SEQ ID NO: 52725 - DNA, 20 bp, Artificial Sequence
  chemically synthesized
tcccatgacctgctatctgc

SEQ ID NO: 52726 - DNA, 20 bp, Artificial Sequence
  chemically synthesized
gctctctagcttgcagatag

SEQ ID NO: 52727 - DNA, 20 bp, Artificial Sequence
  chemically synthesized
ctctctagcttgcagatagc

SEQ ID NO: 52728 - DNA, 20 bp, Artificial Sequence
  chemically synthesized
agcttgcagatagcaggtca

SEQ ID NO: 52729 - DNA, 20 bp, Artificial Sequence
  chemically synthesized
gcttgcagatagcaggtcat

SEQ ID NO: 52730 - DNA, 20 bp, Artificial Sequence
  chemically synthesized
tagcaggtcatgggacttct

SEQ ID NO: 52731 - DNA, 20 bp, Artificial Sequence
  chemically synthesized
tcatgcagttggagactaag

SEQ ID NO: 52732 - DNA, 20 bp, Artificial Sequence
  chemically synthesized
atctcatgcagttggagact

SEQ ID NO: 52733 - DNA, 20 bp, Artificial Sequence
  chemically synthesized
agtattatctcatgcagttg

SEQ ID NO: 52734 - DNA, 20 bp, Artificial Sequence
  chemically synthesized
ttcttagtctccaactgcat

SEQ ID NO: 52735 - DNA, 20 bp, Artificial Sequence
  chemically synthesized
taagtattatctcatgcagt

SEQ ID NO: 52736 - DNA, 20 bp, Artificial Sequence
  chemically synthesized
aaattaagtattatctcatg

SEQ ID NO: 52737 - DNA, 20 bp, Artificial Sequence
  chemically synthesized
gtgtgtgaatatataaaatt

SEQ ID NO: 52738 - DNA, 20 bp, Artificial Sequence
  chemically synthesized
tttatatattcacacacaca

SEQ ID NO: 52739 - DNA, 20 bp, Artificial Sequence
  chemically synthesized
aaggttctccagagaaatag

SEQ ID NO: 52740 - DNA, 20 bp, Artificial Sequence
  chemically synthesized
tattgttgcttctatttctc

SEQ ID NO: 52741 - DNA, 20 bp, Artificial Sequence
  chemically synthesized
gtcaaggttctccagagaaa

SEQ ID NO: 52742 - DNA, 20 bp, Artificial Sequence
  chemically synthesized
ttgttgcttctatttctctg

SEQ ID NO: 52743 - DNA, 20 bp, Artificial Sequence
  chemically synthesized
tgattagtcaaggttctcca

SEQ ID NO: 52744 - DNA, 20 bp, Artificial Sequence
  chemically synthesized
attgattagtcaaggttctc

SEQ ID NO: 52745 - DNA, 20 bp, Artificial Sequence
  chemically synthesized
ccagggacattgattagtca

SEQ ID NO: 52746 - DNA, 20 bp, Artificial Sequence
  chemically synthesized
cccagggacattgattagtc

SEQ ID NO: 52747 - DNA, 20 bp, Artificial Sequence
  chemically synthesized
atttacccagggacattgat

SEQ ID NO: 52748 - DNA, 20 bp, Artificial Sequence
  chemically synthesized
ccttgactaatcaatgtccc

SEQ ID NO: 52749 - DNA, 20 bp, Artificial Sequence
  chemically synthesized
cttgactaatcaatgtccct

SEQ ID NO: 52750 - DNA, 20 bp, Artificial Sequence
  chemically synthesized
agttaagaataatttaccca

SEQ ID NO: 52751 - DNA, 20 bp, Artificial Sequence
  chemically synthesized
aagttaagaataatttaccc

SEQ ID NO: 52752 - DNA, 20 bp, Artificial Sequence
  chemically synthesized
aaagttaagaataatttacc

SEQ ID NO: 52753 - DNA, 20 bp, Artificial Sequence
  chemically synthesized
ttttactgataaggaaagtt

SEQ ID NO: 52754 - DNA, 20 bp, Artificial Sequence
  chemically synthesized
ttattcttaactttccttat

SEQ ID NO: 52755 - DNA, 20 bp, Artificial Sequence
  chemically synthesized
ccacattttactgataagga

SEQ ID NO: 52756 - DNA, 20 bp, Artificial Sequence
  chemically synthesized
ttttccacattttactgata

SEQ ID NO: 52757 - DNA, 20 bp, Artificial Sequence
  chemically synthesized
attttccacattttactgat

SEQ ID NO: 52758 - DNA, 20 bp, Artificial Sequence
  chemically synthesized
ctttccttatcagtaaaatg

SEQ ID NO: 52759 - DNA, 20 bp, Artificial Sequence
  chemically synthesized
gtggaaaataatataactta

SEQ ID NO: 52760 - DNA, 20 bp, Artificial Sequence
  chemically synthesized
tggaaaataatataacttat

SEQ ID NO: 52761 - DNA, 20 bp, Artificial Sequence
  chemically synthesized
ggaaaataatataacttata

SEQ ID NO: 52762 - DNA, 20 bp, Artificial Sequence
  chemically synthesized
taattcccacaaaaccctat

SEQ ID NO: 52763 - DNA, 20 bp, Artificial Sequence
  chemically synthesized
atataacttatagggttttg

SEQ ID NO: 52764 - DNA, 20 bp, Artificial Sequence
  chemically synthesized
tataacttatagggttttgt

SEQ ID NO: 52765 - DNA, 20 bp, Artificial Sequence
  chemically synthesized
gggttttgtgggaattaaat

SEQ ID NO: 52766 - DNA, 20 bp, Artificial Sequence
  chemically synthesized
aaataagatgatacaatgta

SEQ ID NO: 52767 - DNA, 20 bp, Artificial Sequence
  chemically synthesized
atgatacaatgtaaagcatt

SEQ ID NO: 52768 - DNA, 20 bp, Artificial Sequence
  chemically synthesized
acaatgtaaagcatttagcc

SEQ ID NO: 52769 - DNA, 20 bp, Artificial Sequence
  chemically synthesized
attaccacgtgacagaaact

SEQ ID NO: 52770 - DNA, 20 bp, Artificial Sequence
  chemically synthesized
aattaccacgtgacagaaac

SEQ ID NO: 52771 - DNA, 20 bp, Artificial Sequence
  chemically synthesized
ttagcctagtttctgtcacg

SEQ ID NO: 52772 - DNA, 20 bp, Artificial Sequence
  chemically synthesized
attgagcaattaccacgtga

SEQ ID NO: 52773 - DNA, 20 bp, Artificial Sequence
  chemically synthesized
agtagctggtaacatttatt

SEQ ID NO: 52774 - DNA, 20 bp, Artificial Sequence
  chemically synthesized
aattgctcaataaatgttac

SEQ ID NO: 52775 - DNA, 20 bp, Artificial Sequence
  chemically synthesized
atagtagcaagaacagtagc

SEQ ID NO: 52776 - DNA, 20 bp, Artificial Sequence
  chemically synthesized
cataatagtagcaagaacag

SEQ ID NO: 52777 - DNA, 20 bp, Artificial Sequence
  chemically synthesized
aaccataatagtagcaagaa

SEQ ID NO: 52778 - DNA, 20 bp, Artificial Sequence
  chemically synthesized
ttattaaccataatagtagc

SEQ ID NO: 52779 - DNA, 20 bp, Artificial Sequence
  chemically synthesized
tactgttcttgctactatta

SEQ ID NO: 52780 - DNA, 20 bp, Artificial Sequence
  chemically synthesized
ccttttattaaccataatag

SEQ ID NO: 52781 - DNA, 20 bp, Artificial Sequence
  chemically synthesized
tctccttttattaaccataa

SEQ ID NO: 52782 - DNA, 20 bp, Artificial Sequence
  chemically synthesized
gctactattatggttaataa

SEQ ID NO: 52783 - DNA, 20 bp, Artificial Sequence
  chemically synthesized
ctactattatggttaataaa

SEQ ID NO: 52784 - DNA, 20 bp, Artificial Sequence
  chemically synthesized
actattatggttaataaaag

SEQ ID NO: 52785 - DNA, 20 bp, Artificial Sequence
  chemically synthesized
tattatggttaataaaagga

SEQ ID NO: 52786 - DNA, 20 bp, Artificial Sequence
  chemically synthesized
attatggttaataaaaggag

SEQ ID NO: 52787 - DNA, 20 bp, Artificial Sequence
  chemically synthesized
ggttaataaaaggagaggaa

SEQ ID NO: 52788 - DNA, 20 bp, Artificial Sequence
  chemically synthesized
gttaataaaaggagaggaat

SEQ ID NO: 52789 - DNA, 20 bp, Artificial Sequence
  chemically synthesized
ataaaaggagaggaataggc

SEQ ID NO: 52790 - DNA, 20 bp, Artificial Sequence
  chemically synthesized
taaaaggagaggaataggcc

SEQ ID NO: 52791 - DNA, 20 bp, Artificial Sequence
  chemically synthesized
ggagaggaataggccaggca

SEQ ID NO: 52792 - DNA, 20 bp, Artificial Sequence
  chemically synthesized
caggtgtgagtcaccatgcc

SEQ ID NO: 52793 - DNA, 20 bp, Artificial Sequence
  chemically synthesized
agtgctgggattacaggtgt

SEQ ID NO: 52794 - DNA, 20 bp, Artificial Sequence
  chemically synthesized
gtgactcacacctgtaatcc

SEQ ID NO: 52795 - DNA, 20 bp, Artificial Sequence
  chemically synthesized
tcccaaagtgctgggattac

SEQ ID NO: 52796 - DNA, 20 bp, Artificial Sequence
  chemically synthesized
ctcccaaagtgctgggatta

SEQ ID NO: 52797 - DNA, 20 bp, Artificial Sequence
  chemically synthesized
cacctgtaatcccagcactt

SEQ ID NO: 52798 - DNA, 20 bp, Artificial Sequence
  chemically synthesized
cctcggcctcccaaagtgct

SEQ ID NO: 52799 - DNA, 20 bp, Artificial Sequence
  chemically synthesized
acctgtaatcccagcacttt

SEQ ID NO: 52800 - DNA, 20 bp, Artificial Sequence
  chemically synthesized
gcctcggcctcccaaagtgc

SEQ ID NO: 52801 - DNA, 20 bp, Artificial Sequence
  chemically synthesized
ctgtaatcccagcactttgg

SEQ ID NO: 52802 - DNA, 20 bp, Artificial Sequence
  chemically synthesized
tgtaatcccagcactttggg

SEQ ID NO: 52803 - DNA, 20 bp, Artificial Sequence
  chemically synthesized
ccgcctgcctcggcctccca

SEQ ID NO: 52804 - DNA, 20 bp, Artificial Sequence
  chemically synthesized
tcccagcactttgggaggcc

SEQ ID NO: 52805 - DNA, 20 bp, Artificial Sequence
  chemically synthesized
cccagcactttgggaggccg

SEQ ID NO: 52806 - DNA, 20 bp, Artificial Sequence
  chemically synthesized
agcactttgggaggccgagg

SEQ ID NO: 52807 - DNA, 20 bp, Artificial Sequence
  chemically synthesized
gcactttgggaggccgaggc

SEQ ID NO: 52808 - DNA, 20 bp, Artificial Sequence
  chemically synthesized
ctttgggaggccgaggcagg

SEQ ID NO: 52809 - DNA, 20 bp, Artificial Sequence
  chemically synthesized
ctcaagtgatccgcctgcct

SEQ ID NO: 52810 - DNA, 20 bp, Artificial Sequence
  chemically synthesized
ccgaggcaggcggatcactt

SEQ ID NO: 52811 - DNA, 20 bp, Artificial Sequence
  chemically synthesized
cgaggcaggcggatcacttg

SEQ ID NO: 52812 - DNA, 20 bp, Artificial Sequence
  chemically synthesized
gcaggcggatcacttgaggt

SEQ ID NO: 52813 - DNA, 20 bp, Artificial Sequence
  chemically synthesized
caggcggatcacttgaggtc

SEQ ID NO: 52814 - DNA, 20 bp, Artificial Sequence
  chemically synthesized
ggtctcgaactcctgacctc

SEQ ID NO: 52815 - DNA, 20 bp, Artificial Sequence
  chemically synthesized
ggcggatcacttgaggtcag

SEQ ID NO: 52816 - DNA, 20 bp, Artificial Sequence
  chemically synthesized
tcacttgaggtcaggagttc

SEQ ID NO: 52817 - DNA, 20 bp, Artificial Sequence
  chemically synthesized
tgaggtcaggagttcgagac

SEQ ID NO: 52818 - DNA, 20 bp, Artificial Sequence
  chemically synthesized
tcaggagttcgagaccggtc

SEQ ID NO: 52819 - DNA, 20 bp, Artificial Sequence
  chemically synthesized
tttcatcatgttggccagac

SEQ ID NO: 52820 - DNA, 20 bp, Artificial Sequence
  chemically synthesized
ctgcgtttcatcatgttggc

SEQ ID NO: 52821 - DNA, 20 bp, Artificial Sequence
  chemically synthesized
gagactgcgtttcatcatgt

SEQ ID NO: 52822 - DNA, 20 bp, Artificial Sequence
  chemically synthesized
ctggccaacatgatgaaacg

SEQ ID NO: 52823 - DNA, 20 bp, Artificial Sequence
  chemically synthesized
taatttttgtatttttagta

SEQ ID NO: 52824 - DNA, 20 bp, Artificial Sequence
  chemically synthesized
gctaatttttgtatttttag

SEQ ID NO: 52825 - DNA, 20 bp, Artificial Sequence
  chemically synthesized
caagctaatttttgtatttt

SEQ ID NO: 52826 - DNA, 20 bp, Artificial Sequence
  chemically synthesized
tctactaaaaatacaaaaat

SEQ ID NO: 52827 - DNA, 20 bp, Artificial Sequence
  chemically synthesized
taaaaatacaaaaattagct

SEQ ID NO: 52828 - DNA, 20 bp, Artificial Sequence
  chemically synthesized
atacaaaaattagcttggtg

SEQ ID NO: 52829 - DNA, 20 bp, Artificial Sequence
  chemically synthesized
caaaaattagcttggtgtgg

SEQ ID NO: 52830 - DNA, 20 bp, Artificial Sequence
  chemically synthesized
cagatgcccaccaccacacc

SEQ ID NO: 52831 - DNA, 20 bp, Artificial Sequence
  chemically synthesized
aaattagcttggtgtggtgg

SEQ ID NO: 52832 - DNA, 20 bp, Artificial Sequence
  chemically synthesized
aattagcttggtgtggtggt

SEQ ID NO: 52833 - DNA, 20 bp, Artificial Sequence
  chemically synthesized
gtggtgggcatctgtaatcc

SEQ ID NO: 52834 - DNA, 20 bp, Artificial Sequence
  chemically synthesized
ttcccgagtagctgggatta

SEQ ID NO: 52835 - DNA, 20 bp, Artificial Sequence
  chemically synthesized
catctgtaatcccagctact

SEQ ID NO: 52836 - DNA, 20 bp, Artificial Sequence
  chemically synthesized
tctcagcttcccgagtagct

SEQ ID NO: 52837 - DNA, 20 bp, Artificial Sequence
  chemically synthesized
atctgtaatcccagctactc

SEQ ID NO: 52838 - DNA, 20 bp, Artificial Sequence
  chemically synthesized
gtctcagcttcccgagtagc

SEQ ID NO: 52839 - DNA, 20 bp, Artificial Sequence
  chemically synthesized
tgtaatcccagctactcggg

SEQ ID NO: 52840 - DNA, 20 bp, Artificial Sequence
  chemically synthesized
tcctgtctcagcttcccgag

SEQ ID NO: 52841 - DNA, 20 bp, Artificial Sequence
  chemically synthesized
ttctcctgtctcagcttccc

SEQ ID NO: 52842 - DNA, 20 bp, Artificial Sequence
  chemically synthesized
tcccagctactcgggaagct

SEQ ID NO: 52843 - DNA, 20 bp, Artificial Sequence
  chemically synthesized
agctactcgggaagctgaga

SEQ ID NO: 52844 - DNA, 20 bp, Artificial Sequence
  chemically synthesized
gctactcgggaagctgagac

SEQ ID NO: 52845 - DNA, 20 bp, Artificial Sequence
  chemically synthesized
tactcgggaagctgagacag

SEQ ID NO: 52846 - DNA, 20 bp, Artificial Sequence
  chemically synthesized
ttcaagtgattctcctgtct

SEQ ID NO: 52847 - DNA, 20 bp, Artificial Sequence
  chemically synthesized
caggagaatcacttgaatct

SEQ ID NO: 52848 - DNA, 20 bp, Artificial Sequence
  chemically synthesized
aacctccacctctcagattc

SEQ ID NO: 52849 - DNA, 20 bp, Artificial Sequence
  chemically synthesized
ggagaatcacttgaatctga

SEQ ID NO: 52850 - DNA, 20 bp, Artificial Sequence
  chemically synthesized
gagaatcacttgaatctgag

SEQ ID NO: 52851 - DNA, 20 bp, Artificial Sequence
  chemically synthesized
aatcacttgaatctgagagg

SEQ ID NO: 52852 - DNA, 20 bp, Artificial Sequence
  chemically synthesized
tcacttgaatctgagaggtg

SEQ ID NO: 52853 - DNA, 20 bp, Artificial Sequence
  chemically synthesized
gcactgcaacctccacctct

SEQ ID NO: 52854 - DNA, 20 bp, Artificial Sequence
  chemically synthesized
cacttgaatctgagaggtgg

SEQ ID NO: 52855 - DNA, 20 bp, Artificial Sequence
  chemically synthesized
aatctgagaggtggaggttg

SEQ ID NO: 52856 - DNA, 20 bp, Artificial Sequence
  chemically synthesized
ggtggaggttgcagtgcgcc

SEQ ID NO: 52857 - DNA, 20 bp, Artificial Sequence
  chemically synthesized
ggagtgtagtgacacgatct

SEQ ID NO: 52858 - DNA, 20 bp, Artificial Sequence
  chemically synthesized
gagatcgtgtcactacactc

SEQ ID NO: 52859 - DNA, 20 bp, Artificial Sequence
  chemically synthesized
ctgttacctaggctggagtg

SEQ ID NO: 52860 - DNA, 20 bp, Artificial Sequence
  chemically synthesized
cgtgtcactacactccagcc

SEQ ID NO: 52861 - DNA, 20 bp, Artificial Sequence
  chemically synthesized
gtgtcactacactccagcct

SEQ ID NO: 52862 - DNA, 20 bp, Artificial Sequence
  chemically synthesized
ttgttctgttacctaggctg

SEQ ID NO: 52863 - DNA, 20 bp, Artificial Sequence
  chemically synthesized
tcttgttctgttacctaggc

SEQ ID NO: 52864 - DNA, 20 bp, Artificial Sequence
  chemically synthesized
ctacactccagcctaggtaa

SEQ ID NO: 52865 - DNA, 20 bp, Artificial Sequence
  chemically synthesized
ggagtcttgttctgttacct

SEQ ID NO: 52866 - DNA, 20 bp, Artificial Sequence
  chemically synthesized
tggagtcttgttctgttacc

SEQ ID NO: 52867 - DNA, 20 bp, Artificial Sequence
  chemically synthesized
tccagcctaggtaacagaac

SEQ ID NO: 52868 - DNA, 20 bp, Artificial Sequence
  chemically synthesized
ttttttttttttttgagatg

SEQ ID NO: 52869 - DNA, 20 bp, Artificial Sequence
  chemically synthesized
ttttttttttttttttgaga

SEQ ID NO: 52870 - DNA, 20 bp, Artificial Sequence
  chemically synthesized
cttttttttttttttttttt

SEQ ID NO: 52871 - DNA, 20 bp, Artificial Sequence
  chemically synthesized
ctcaaaaaaaaaaaaaaaaa

SEQ ID NO: 52872 - DNA, 20 bp, Artificial Sequence
  chemically synthesized
aaaaaaaaaaaaaagcaaaa

SEQ ID NO: 52873 - DNA, 20 bp, Artificial Sequence
  chemically synthesized
aaaaaaaaaaaaagcaaaaa

SEQ ID NO: 52874 - DNA, 20 bp, Artificial Sequence
  chemically synthesized
aaaaaaaaaaagcaaaaaag

SEQ ID NO: 52875 - DNA, 20 bp, Artificial Sequence
  chemically synthesized
aaaaaaaaagcaaaaaagga

SEQ ID NO: 52876 - DNA, 20 bp, Artificial Sequence
  chemically synthesized
aaagcaaaaaaggagagcaa

SEQ ID NO: 52877 - DNA, 20 bp, Artificial Sequence
  chemically synthesized
gagcaatagactataatgtg

SEQ ID NO: 52878 - DNA, 20 bp, Artificial Sequence
  chemically synthesized
atgtggtgccctgcacatta

SEQ ID NO: 52879 - DNA, 20 bp, Artificial Sequence
  chemically synthesized
agcaatagactataatgtgc

SEQ ID NO: 52880 - DNA, 20 bp, Artificial Sequence
  chemically synthesized
gcaatagactataatgtgca

SEQ ID NO: 52881 - DNA, 20 bp, Artificial Sequence
  chemically synthesized
agccatttttgtattgtatg

SEQ ID NO: 52882 - DNA, 20 bp, Artificial Sequence
  chemically synthesized
caccacatacaatacaaaaa

SEQ ID NO: 52883 - DNA, 20 bp, Artificial Sequence
  chemically synthesized
acatattgcttaataaacat

SEQ ID NO: 52884 - DNA, 20 bp, Artificial Sequence
  chemically synthesized
aaaaatggctaatgtttatt

SEQ ID NO: 52885 - DNA, 20 bp, Artificial Sequence
  chemically synthesized
aatgtttattaagcaatatg

SEQ ID NO: 52886 - DNA, 20 bp, Artificial Sequence
  chemically synthesized
attatgttatttcatcttca

SEQ ID NO: 52887 - DNA, 20 bp, Artificial Sequence
  chemically synthesized
cctattgcagagttactgtg

SEQ ID NO: 52888 - DNA, 20 bp, Artificial Sequence
  chemically synthesized
tcttcacagtaactctgcaa

SEQ ID NO: 52889 - DNA, 20 bp, Artificial Sequence
  chemically synthesized
cttcacagtaactctgcaat

SEQ ID NO: 52890 - DNA, 20 bp, Artificial Sequence
  chemically synthesized
taatattaactcctattgca

SEQ ID NO: 52891 - DNA, 20 bp, Artificial Sequence
  chemically synthesized
tcacagtaactctgcaatag

SEQ ID NO: 52892 - DNA, 20 bp, Artificial Sequence
  chemically synthesized
aataatattaactcctattg

SEQ ID NO: 52893 - DNA, 20 bp, Artificial Sequence
  chemically synthesized
tttatgtcaatgaagtcggg

SEQ ID NO: 52894 - DNA, 20 bp, Artificial Sequence
  chemically synthesized
ttttatgtcaatgaagtcgg

SEQ ID NO: 52895 - DNA, 20 bp, Artificial Sequence
  chemically synthesized
tttttatgtcaatgaagtcg

SEQ ID NO: 52896 - DNA, 20 bp, Artificial Sequence
  chemically synthesized
gtttttatgtcaatgaagtc

SEQ ID NO: 52897 - DNA, 20 bp, Artificial Sequence
  chemically synthesized
agtttttatgtcaatgaagt

SEQ ID NO: 52898 - DNA, 20 bp, Artificial Sequence
  chemically synthesized
cctcagtttttatgtcaatg

SEQ ID NO: 52899 - DNA, 20 bp, Artificial Sequence
  chemically synthesized
acttcattgacataaaaact

SEQ ID NO: 52900 - DNA, 20 bp, Artificial Sequence
  chemically synthesized
cttcattgacataaaaactg

SEQ ID NO: 52901 - DNA, 20 bp, Artificial Sequence
  chemically synthesized
tgacataaaaactgaggcat

SEQ ID NO: 52902 - DNA, 20 bp, Artificial Sequence
  chemically synthesized
ttttttaacctctcatgcct

SEQ ID NO: 52903 - DNA, 20 bp, Artificial Sequence
  chemically synthesized
acataaaaactgaggcatga

SEQ ID NO: 52904 - DNA, 20 bp, Artificial Sequence
  chemically synthesized
cataaaaactgaggcatgag

SEQ ID NO: 52905 - DNA, 20 bp, Artificial Sequence
  chemically synthesized
taaaaaaaaaaaacttgcct

SEQ ID NO: 52906 - DNA, 20 bp, Artificial Sequence
  chemically synthesized
ctaactactgaagcttaggc

SEQ ID NO: 52907 - DNA, 20 bp, Artificial Sequence
  chemically synthesized
aaaaaaacttgcctaagctt

SEQ ID NO: 52908 - DNA, 20 bp, Artificial Sequence
  chemically synthesized
tttactaactactgaagctt

SEQ ID NO: 52909 - DNA, 20 bp, Artificial Sequence
  chemically synthesized
atttactaactactgaagct

SEQ ID NO: 52910 - DNA, 20 bp, Artificial Sequence
  chemically synthesized
aaaacttgcctaagcttcag

SEQ ID NO: 52911 - DNA, 20 bp, Artificial Sequence
  chemically synthesized
cttgcctaagcttcagtagt

SEQ ID NO: 52912 - DNA, 20 bp, Artificial Sequence
  chemically synthesized
tgccaatttactaactactg

SEQ ID NO: 52913 - DNA, 20 bp, Artificial Sequence
  chemically synthesized
agcttcagtagttagtaaat

SEQ ID NO: 52914 - DNA, 20 bp, Artificial Sequence
  chemically synthesized
ttcagtagttagtaaattgg

SEQ ID NO: 52915 - DNA, 20 bp, Artificial Sequence
  chemically synthesized
cagtagttagtaaattggca

SEQ ID NO: 52916 - DNA, 20 bp, Artificial Sequence
  chemically synthesized
agttagtaaattggcagagc

SEQ ID NO: 52917 - DNA, 20 bp, Artificial Sequence
  chemically synthesized
gttagtaaattggcagagct

SEQ ID NO: 52918 - DNA, 20 bp, Artificial Sequence
  chemically synthesized
gactgaatgagtttgaatcc

SEQ ID NO: 52919 - DNA, 20 bp, Artificial Sequence
  chemically synthesized
agctaggattcaaactcatt

SEQ ID NO: 52920 - DNA, 20 bp, Artificial Sequence
  chemically synthesized
gagcaagacccagactgaat

SEQ ID NO: 52921 - DNA, 20 bp, Artificial Sequence
  chemically synthesized
ggattcaaactcattcagtc

SEQ ID NO: 52922 - DNA, 20 bp, Artificial Sequence
  chemically synthesized
gattcaaactcattcagtct

SEQ ID NO: 52923 - DNA, 20 bp, Artificial Sequence
  chemically synthesized
tagcagttaagagcaagacc

SEQ ID NO: 52924 - DNA, 20 bp, Artificial Sequence
  chemically synthesized
tcaggatagcagttaagagc

SEQ ID NO: 52925 - DNA, 20 bp, Artificial Sequence
  chemically synthesized
atcttcaggatagcagttaa

SEQ ID NO: 52926 - DNA, 20 bp, Artificial Sequence
  chemically synthesized
taatcttcaggatagcagtt

SEQ ID NO: 52927 - DNA, 20 bp, Artificial Sequence
  chemically synthesized
aactttaatcttcaggatag

SEQ ID NO: 52928 - DNA, 20 bp, Artificial Sequence
  chemically synthesized
tgctcttaactgctatcctg

SEQ ID NO: 52929 - DNA, 20 bp, Artificial Sequence
  chemically synthesized
ttcaactttaatcttcagga

SEQ ID NO: 52930 - DNA, 20 bp, Artificial Sequence
  chemically synthesized
ttttttcaactttaatcttc

SEQ ID NO: 52931 - DNA, 20 bp, Artificial Sequence
  chemically synthesized
aactgctatcctgaagatta

SEQ ID NO: 52932 - DNA, 20 bp, Artificial Sequence
  chemically synthesized
tttttttcaactttaatctt

SEQ ID NO: 52933 - DNA, 20 bp, Artificial Sequence
  chemically synthesized
tgaagattaaagttgaaaaa

SEQ ID NO: 52934 - DNA, 20 bp, Artificial Sequence
  chemically synthesized
gtattttataaatatttaat

SEQ ID NO: 52935 - DNA, 20 bp, Artificial Sequence
  chemically synthesized
ataaatatttaataagtaat

SEQ ID NO: 52936 - DNA, 20 bp, Artificial Sequence
  chemically synthesized
aactgattaaagaaattaaa

SEQ ID NO: 52937 - DNA, 20 bp, Artificial Sequence
  chemically synthesized
ggctttttaatttctttaat

SEQ ID NO: 52938 - DNA, 20 bp, Artificial Sequence
  chemically synthesized
tgcattcaataaactgatta

SEQ ID NO: 52939 - DNA, 20 bp, Artificial Sequence
  chemically synthesized
tttaatcagtttattgaatg

SEQ ID NO: 52940 - DNA, 20 bp, Artificial Sequence
  chemically synthesized
tattgaatgcagaccaattc

SEQ ID NO: 52941 - DNA, 20 bp, Artificial Sequence
  chemically synthesized
atcgatatgcacactagaat

SEQ ID NO: 52942 - DNA, 20 bp, Artificial Sequence
  chemically synthesized
agtttcatcgatatgcacac

SEQ ID NO: 52943 - DNA, 20 bp, Artificial Sequence
  chemically synthesized
tgtgcatatcgatgaaactg

SEQ ID NO: 52944 - DNA, 20 bp, Artificial Sequence
  chemically synthesized
taaaatacgttgaacaactg

SEQ ID NO: 52945 - DNA, 20 bp, Artificial Sequence
  chemically synthesized
cagttgttcaacgtatttta

SEQ ID NO: 52946 - DNA, 20 bp, Artificial Sequence
  chemically synthesized
cgtattttatggcccaatgc

SEQ ID NO: 52947 - DNA, 20 bp, Artificial Sequence
  chemically synthesized
gtattttatggcccaatgca

SEQ ID NO: 52948 - DNA, 20 bp, Artificial Sequence
  chemically synthesized
ccaggaattgaccttgcatt

SEQ ID NO: 52949 - DNA, 20 bp, Artificial Sequence
  chemically synthesized
accaggaattgaccttgcat

SEQ ID NO: 52950 - DNA, 20 bp, Artificial Sequence
  chemically synthesized
cccaatgcaaggtcaattcc

SEQ ID NO: 52951 - DNA, 20 bp, Artificial Sequence
  chemically synthesized
aaggtcaattcctggtcttg

SEQ ID NO: 52952 - DNA, 20 bp, Artificial Sequence
  chemically synthesized
gtatcacattcttcaagacc

SEQ ID NO: 52953 - DNA, 20 bp, Artificial Sequence
  chemically synthesized
ggtatcacattcttcaagac

SEQ ID NO: 52954 - DNA, 20 bp, Artificial Sequence
  chemically synthesized
cttatggtatcacattcttc

SEQ ID NO: 52955 - DNA, 20 bp, Artificial Sequence
  chemically synthesized
cttgaagaatgtgataccat

SEQ ID NO: 52956 - DNA, 20 bp, Artificial Sequence
  chemically synthesized
aacctttctctataatctta

SEQ ID NO: 52957 - DNA, 20 bp, Artificial Sequence
  chemically synthesized
aatgtgataccataagatta

SEQ ID NO: 52958 - DNA, 20 bp, Artificial Sequence
  chemically synthesized
tgtgataccataagattata

SEQ ID NO: 52959 - DNA, 20 bp, Artificial Sequence
  chemically synthesized
ataccataagattatagaga

SEQ ID NO: 52960 - DNA, 20 bp, Artificial Sequence
  chemically synthesized
taccataagattatagagaa

SEQ ID NO: 52961 - DNA, 20 bp, Artificial Sequence
  chemically synthesized
aagattatagagaaaggttg

SEQ ID NO: 52962 - DNA, 20 bp, Artificial Sequence
  chemically synthesized
agattatagagaaaggttgt

SEQ ID NO: 52963 - DNA, 20 bp, Artificial Sequence
  chemically synthesized
aaacgcgtgcaaataaatgt

SEQ ID NO: 52964 - DNA, 20 bp, Artificial Sequence
  chemically synthesized
aacgcgtgcaaataaatgtt

SEQ ID NO: 52965 - DNA, 20 bp, Artificial Sequence
  chemically synthesized
tatgtcattatttctaaatt

SEQ ID NO: 52966 - DNA, 20 bp, Artificial Sequence
  chemically synthesized
gaaatgacccattctaaatt

SEQ ID NO: 52967 - DNA, 20 bp, Artificial Sequence
  chemically synthesized
cattatttctaaatttagaa

SEQ ID NO: 52968 - DNA, 20 bp, Artificial Sequence
  chemically synthesized
attatttctaaatttagaat

SEQ ID NO: 52969 - DNA, 20 bp, Artificial Sequence
  chemically synthesized
atttcatgaataaatcaatc

SEQ ID NO: 52970 - DNA, 20 bp, Artificial Sequence
  chemically synthesized
ttcatgaataaatcaatcta

SEQ ID NO: 52971 - DNA, 20 bp, Artificial Sequence
  chemically synthesized
caaacactcacatttatctc

SEQ ID NO: 52972 - DNA, 20 bp, Artificial Sequence
  chemically synthesized
atcaatctagagataaatgt

SEQ ID NO: 52973 - DNA, 20 bp, Artificial Sequence
  chemically synthesized
tagagataaatgtgagtgtt

SEQ ID NO: 52974 - DNA, 20 bp, Artificial Sequence
  chemically synthesized
agagataaatgtgagtgttt

SEQ ID NO: 52975 - DNA, 20 bp, Artificial Sequence
  chemically synthesized
gagataaatgtgagtgtttg

SEQ ID NO: 52976 - DNA, 20 bp, Artificial Sequence
  chemically synthesized
agataaatgtgagtgtttgg

SEQ ID NO: 52977 - DNA, 20 bp, Artificial Sequence
  chemically synthesized
taaatgtgagtgtttggggg

SEQ ID NO: 52978 - DNA, 20 bp, Artificial Sequence
  chemically synthesized
aatgtgagtgtttgggggta

SEQ ID NO: 52979 - DNA, 20 bp, Artificial Sequence
  chemically synthesized
tgtgagtgtttgggggtaga

SEQ ID NO: 52980 - DNA, 20 bp, Artificial Sequence
  chemically synthesized
gtgagtgtttgggggtagag

SEQ ID NO: 52981 - DNA, 20 bp, Artificial Sequence
  chemically synthesized
gagtgtttgggggtagagag

SEQ ID NO: 52982 - DNA, 20 bp, Artificial Sequence
  chemically synthesized
tgtttgggggtagagaggag

SEQ ID NO: 52983 - DNA, 20 bp, Artificial Sequence
  chemically synthesized
ggggtagagaggagaagatg

SEQ ID NO: 52984 - DNA, 20 bp, Artificial Sequence
  chemically synthesized
gagaagatgaagatgccata

SEQ ID NO: 52985 - DNA, 20 bp, Artificial Sequence
  chemically synthesized
agaagatgaagatgccatat

SEQ ID NO: 52986 - DNA, 20 bp, Artificial Sequence
  chemically synthesized
aagatgaagatgccatatgg

SEQ ID NO: 52987 - DNA, 20 bp, Artificial Sequence
  chemically synthesized
gatcagtgtccactcccata

SEQ ID NO: 52988 - DNA, 20 bp, Artificial Sequence
  chemically synthesized
atgaagatgccatatgggag

SEQ ID NO: 52989 - DNA, 20 bp, Artificial Sequence
  chemically synthesized
atatgggagtggacactgat

SEQ ID NO: 52990 - DNA, 20 bp, Artificial Sequence
  chemically synthesized
tatgtgcaaagatttctgat

SEQ ID NO: 52991 - DNA, 20 bp, Artificial Sequence
  chemically synthesized
tttctttctcagtatgtgca

SEQ ID NO: 52992 - DNA, 20 bp, Artificial Sequence
  chemically synthesized
cagaaatctttgcacatact

SEQ ID NO: 52993 - DNA, 20 bp, Artificial Sequence
  chemically synthesized
aatctttgcacatactgaga

SEQ ID NO: 52994 - DNA, 20 bp, Artificial Sequence
  chemically synthesized
tccccttgggatttctttct

SEQ ID NO: 52995 - DNA, 20 bp, Artificial Sequence
  chemically synthesized
catactgagaaagaaatccc

SEQ ID NO: 52996 - DNA, 20 bp, Artificial Sequence
  chemically synthesized
atactgagaaagaaatccca

SEQ ID NO: 52997 - DNA, 20 bp, Artificial Sequence
  chemically synthesized
tactgagaaagaaatcccaa

SEQ ID NO: 52998 - DNA, 20 bp, Artificial Sequence
  chemically synthesized
actgagaaagaaatcccaag

SEQ ID NO: 52999 - DNA, 20 bp, Artificial Sequence
  chemically synthesized
gagaaagaaatcccaagggg

SEQ ID NO: 53000 - DNA, 20 bp, Artificial Sequence
  chemically synthesized
accatctacatcttcccctt

SEQ ID NO: 53001 - DNA, 20 bp, Artificial Sequence
  chemically synthesized
taccatctacatcttcccct

SEQ ID NO: 53002 - DNA, 20 bp, Artificial Sequence
  chemically synthesized
gaaatcccaaggggaagatg

SEQ ID NO: 53003 - DNA, 20 bp, Artificial Sequence
  chemically synthesized
tcccaaggggaagatgtaga

SEQ ID NO: 53004 - DNA, 20 bp, Artificial Sequence
  chemically synthesized
aggggaagatgtagatggta

SEQ ID NO: 53005 - DNA, 20 bp, Artificial Sequence
  chemically synthesized
ggggaagatgtagatggtaa

SEQ ID NO: 53006 - DNA, 20 bp, Artificial Sequence
  chemically synthesized
aaaggattatgactgtgcca

SEQ ID NO: 53007 - DNA, 20 bp, Artificial Sequence
  chemically synthesized
aaggattatgactgtgccat

SEQ ID NO: 53008 - DNA, 20 bp, Artificial Sequence
  chemically synthesized
agagaaagtggcctatggca

SEQ ID NO: 53009 - DNA, 20 bp, Artificial Sequence
  chemically synthesized
ttactagagaaagtggccta

SEQ ID NO: 53010 - DNA, 20 bp, Artificial Sequence
  chemically synthesized
gtgccataggccactttctc

SEQ ID NO: 53011 - DNA, 20 bp, Artificial Sequence
  chemically synthesized
aacattcttactagagaaag

SEQ ID NO: 53012 - DNA, 20 bp, Artificial Sequence
  chemically synthesized
actaacattcttactagaga

SEQ ID NO: 53013 - DNA, 20 bp, Artificial Sequence
  chemically synthesized
cataggccactttctctagt

SEQ ID NO: 53014 - DNA, 20 bp, Artificial Sequence
  chemically synthesized
tgaaactaacattcttacta

SEQ ID NO: 53015 - DNA, 20 bp, Artificial Sequence
  chemically synthesized
tatgaaactaacattcttac

SEQ ID NO: 53016 - DNA, 20 bp, Artificial Sequence
  chemically synthesized
actttctctagtaagaatgt

SEQ ID NO: 53017 - DNA, 20 bp, Artificial Sequence
  chemically synthesized
tagtaagaatgttagtttca

SEQ ID NO: 53018 - DNA, 20 bp, Artificial Sequence
  chemically synthesized
agtaagaatgttagtttcat

SEQ ID NO: 53019 - DNA, 20 bp, Artificial Sequence
  chemically synthesized
gtaagaatgttagtttcata

SEQ ID NO: 53020 - DNA, 20 bp, Artificial Sequence
  chemically synthesized
atgttagtttcatagggact

SEQ ID NO: 53021 - DNA, 20 bp, Artificial Sequence
  chemically synthesized
actttgatgctgcatcggct

SEQ ID NO: 53022 - DNA, 20 bp, Artificial Sequence
  chemically synthesized
tcatagggactgagccgatg

SEQ ID NO: 53023 - DNA, 20 bp, Artificial Sequence
  chemically synthesized
aatgaactttgatgctgcat

SEQ ID NO: 53024 - DNA, 20 bp, Artificial Sequence
  chemically synthesized
actgagccgatgcagcatca

SEQ ID NO: 53025 - DNA, 20 bp, Artificial Sequence
  chemically synthesized
tgcagcatcaaagttcattc

SEQ ID NO: 53026 - DNA, 20 bp, Artificial Sequence
  chemically synthesized
cagagagaagattgggagtc

SEQ ID NO: 53027 - DNA, 20 bp, Artificial Sequence
  chemically synthesized
ttcttcagagagaagattgg

SEQ ID NO: 53028 - DNA, 20 bp, Artificial Sequence
  chemically synthesized
aattcttcagagagaagatt

SEQ ID NO: 53029 - DNA, 20 bp, Artificial Sequence
  chemically synthesized
aaattcttcagagagaagat

SEQ ID NO: 53030 - DNA, 20 bp, Artificial Sequence
  chemically synthesized
gactcccaatcttctctctg

SEQ ID NO: 53031 - DNA, 20 bp, Artificial Sequence
  chemically synthesized
aggcaaaattcttcagagag

SEQ ID NO: 53032 - DNA, 20 bp, Artificial Sequence
  chemically synthesized
agaaggcaaaattcttcaga

SEQ ID NO: 53033 - DNA, 20 bp, Artificial Sequence
  chemically synthesized
taagaaggcaaaattcttca

SEQ ID NO: 53034 - DNA, 20 bp, Artificial Sequence
  chemically synthesized
tataagaaggcaaaattctt

SEQ ID NO: 53035 - DNA, 20 bp, Artificial Sequence
  chemically synthesized
ggagcgctccttgtataaga

SEQ ID NO: 53036 - DNA, 20 bp, Artificial Sequence
  chemically synthesized
agaattttgccttcttatac

SEQ ID NO: 53037 - DNA, 20 bp, Artificial Sequence
  chemically synthesized
tggagcgctccttgtataag

SEQ ID NO: 53038 - DNA, 20 bp, Artificial Sequence
  chemically synthesized
gaattttgccttcttataca

SEQ ID NO: 53039 - DNA, 20 bp, Artificial Sequence
  chemically synthesized
attttgccttcttatacaag

SEQ ID NO: 53040 - DNA, 20 bp, Artificial Sequence
  chemically synthesized
cactggagcgctccttgtat

SEQ ID NO: 53041 - DNA, 20 bp, Artificial Sequence
  chemically synthesized
ttcttatacaaggagcgctc

SEQ ID NO: 53042 - DNA, 20 bp, Artificial Sequence
  chemically synthesized
ttatacaaggagcgctccag

SEQ ID NO: 53043 - DNA, 20 bp, Artificial Sequence
  chemically synthesized
tacaaggagcgctccagtgg

SEQ ID NO: 53044 - DNA, 20 bp, Artificial Sequence
  chemically synthesized
tacactggaaactaccactg

SEQ ID NO: 53045 - DNA, 20 bp, Artificial Sequence
  chemically synthesized
tgtacactggaaactaccac

SEQ ID NO: 53046 - DNA, 20 bp, Artificial Sequence
  chemically synthesized
agcgctccagtggtagtttc

SEQ ID NO: 53047 - DNA, 20 bp, Artificial Sequence
  chemically synthesized
tgacaatattgaatgtacac

SEQ ID NO: 53048 - DNA, 20 bp, Artificial Sequence
  chemically synthesized
agtgtacattcaatattgtc

SEQ ID NO: 53049 - DNA, 20 bp, Artificial Sequence
  chemically synthesized
tattgtcaagattttaaaat

SEQ ID NO: 53050 - DNA, 20 bp, Artificial Sequence
  chemically synthesized
aagattttaaaatgagatca

SEQ ID NO: 53051 - DNA, 20 bp, Artificial Sequence
  chemically synthesized
ttaagtttgagttatgaaga

SEQ ID NO: 53052 - DNA, 20 bp, Artificial Sequence
  chemically synthesized
tctcttaagtttgagttatg

SEQ ID NO: 53053 - DNA, 20 bp, Artificial Sequence
  chemically synthesized
catcttcataactcaaactt

SEQ ID NO: 53054 - DNA, 20 bp, Artificial Sequence
  chemically synthesized
tcataccttctcttaagttt

SEQ ID NO: 53055 - DNA, 20 bp, Artificial Sequence
  chemically synthesized
tcttcataactcaaacttaa

SEQ ID NO: 53056 - DNA, 20 bp, Artificial Sequence
  chemically synthesized
tcataactcaaacttaagag

SEQ ID NO: 53057 - DNA, 20 bp, Artificial Sequence
  chemically synthesized
cataactcaaacttaagaga

SEQ ID NO: 53058 - DNA, 20 bp, Artificial Sequence
  chemically synthesized
tcgctgtcataccttctctt

SEQ ID NO: 53059 - DNA, 20 bp, Artificial Sequence
  chemically synthesized
aaacttaagagaaggtatga

SEQ ID NO: 53060 - DNA, 20 bp, Artificial Sequence
  chemically synthesized
ttaagagaaggtatgacagc

SEQ ID NO: 53061 - DNA, 20 bp, Artificial Sequence
  chemically synthesized
agagaaggtatgacagcgag

SEQ ID NO: 53062 - DNA, 20 bp, Artificial Sequence
  chemically synthesized
gtatgacagcgagaagaatt

SEQ ID NO: 53063 - DNA, 20 bp, Artificial Sequence
  chemically synthesized
ctccagtgataatttgtgga

SEQ ID NO: 53064 - DNA, 20 bp, Artificial Sequence
  chemically synthesized
ctttctccagtgataatttg

SEQ ID NO: 53065 - DNA, 20 bp, Artificial Sequence
  chemically synthesized
ttctttccacaaattatcac

SEQ ID NO: 53066 - DNA, 20 bp, Artificial Sequence
  chemically synthesized
ctttccacaaattatcactg

SEQ ID NO: 53067 - DNA, 20 bp, Artificial Sequence
  chemically synthesized
ccacaaattatcactggaga

SEQ ID NO: 53068 - DNA, 20 bp, Artificial Sequence
  chemically synthesized
cacaaattatcactggagaa

SEQ ID NO: 53069 - DNA, 20 bp, Artificial Sequence
  chemically synthesized
atccacacaaaacctttctc

SEQ ID NO: 53070 - DNA, 20 bp, Artificial Sequence
  chemically synthesized
cactggagaaaggttttgtg

SEQ ID NO: 53071 - DNA, 20 bp, Artificial Sequence
  chemically synthesized
gtgtggattgaatgcacaac

SEQ ID NO: 53072 - DNA, 20 bp, Artificial Sequence
  chemically synthesized
aatttgtttctttatttagc

SEQ ID NO: 53073 - DNA, 20 bp, Artificial Sequence
  chemically synthesized
aatgcacaactggctaaata

SEQ ID NO: 53074 - DNA, 20 bp, Artificial Sequence
  chemically synthesized
cataaatttgtttctttatt

SEQ ID NO: 53075 - DNA, 20 bp, Artificial Sequence
  chemically synthesized
aaagaaacaaatttatgaat

SEQ ID NO: 53076 - DNA, 20 bp, Artificial Sequence
  chemically synthesized
tatgaatgagaaaaacttga

SEQ ID NO: 53077 - DNA, 20 bp, Artificial Sequence
  chemically synthesized
cgaggactttggttgctttc

SEQ ID NO: 53078 - DNA, 20 bp, Artificial Sequence
  chemically synthesized
gaaaaacttgaaagcaacca

SEQ ID NO: 53079 - DNA, 20 bp, Artificial Sequence
  chemically synthesized
gctaaagctttcgaggactt

SEQ ID NO: 53080 - DNA, 20 bp, Artificial Sequence
  chemically synthesized
aaagcaaccaaagtcctcga

SEQ ID NO: 53081 - DNA, 20 bp, Artificial Sequence
  chemically synthesized
gtcccaagctaaagctttcg

SEQ ID NO: 53082 - DNA, 20 bp, Artificial Sequence
  chemically synthesized
agtcccaagctaaagctttc

SEQ ID NO: 53083 - DNA, 20 bp, Artificial Sequence
  chemically synthesized
accaaagtcctcgaaagctt

SEQ ID NO: 53084 - DNA, 20 bp, Artificial Sequence
  chemically synthesized
agtcctcgaaagctttagct

SEQ ID NO: 53085 - DNA, 20 bp, Artificial Sequence
  chemically synthesized
gtcctcgaaagctttagctt

SEQ ID NO: 53086 - DNA, 20 bp, Artificial Sequence
  chemically synthesized
tgttcctaagtcccaagcta

SEQ ID NO: 53087 - DNA, 20 bp, Artificial Sequence
  chemically synthesized
gaaagctttagcttgggact

SEQ ID NO: 53088 - DNA, 20 bp, Artificial Sequence
  chemically synthesized
aaagctttagcttgggactt

SEQ ID NO: 53089 - DNA, 20 bp, Artificial Sequence
  chemically synthesized
gtgctttgttcctaagtccc

SEQ ID NO: 53090 - DNA, 20 bp, Artificial Sequence
  chemically synthesized
tagcttgggacttaggaaca

SEQ ID NO: 53091 - DNA, 20 bp, Artificial Sequence
  chemically synthesized
gaataaagtgctttgttcct

SEQ ID NO: 53092 - DNA, 20 bp, Artificial Sequence
  chemically synthesized
gcataattgctcaaagaata

SEQ ID NO: 53093 - DNA, 20 bp, Artificial Sequence
  chemically synthesized
aacaaagcactttattcttt

SEQ ID NO: 53094 - DNA, 20 bp, Artificial Sequence
  chemically synthesized
tttccttgcataattgctca

SEQ ID NO: 53095 - DNA, 20 bp, Artificial Sequence
  chemically synthesized
tattctttgagcaattatgc

SEQ ID NO: 53096 - DNA, 20 bp, Artificial Sequence
  chemically synthesized
attctttgagcaattatgca

SEQ ID NO: 53097 - DNA, 20 bp, Artificial Sequence
  chemically synthesized
aatttgataatctattaaac

SEQ ID NO: 53098 - DNA, 20 bp, Artificial Sequence
  chemically synthesized
gcatggaggctctcgtttaa

SEQ ID NO: 53099 - DNA, 20 bp, Artificial Sequence
  chemically synthesized
tttgataatctattaaacga

SEQ ID NO: 53100 - DNA, 20 bp, Artificial Sequence
  chemically synthesized
tagaaagatctaatgcatgg

SEQ ID NO: 53101 - DNA, 20 bp, Artificial Sequence
  chemically synthesized
aaacgagagcctccatgcat

SEQ ID NO: 53102 - DNA, 20 bp, Artificial Sequence
  chemically synthesized
ttagaaagatctaatgcatg

SEQ ID NO: 53103 - DNA, 20 bp, Artificial Sequence
  chemically synthesized
agttagaaagatctaatgca

SEQ ID NO: 53104 - DNA, 20 bp, Artificial Sequence
  chemically synthesized
atgcattagatctttctaac

SEQ ID NO: 53105 - DNA, 20 bp, Artificial Sequence
  chemically synthesized
ttaacatacagccagttaga

SEQ ID NO: 53106 - DNA, 20 bp, Artificial Sequence
  chemically synthesized
tgatttaacatacagccagt

SEQ ID NO: 53107 - DNA, 20 bp, Artificial Sequence
  chemically synthesized
atattgatttaacatacagc

SEQ ID NO: 53108 - DNA, 20 bp, Artificial Sequence
  chemically synthesized
cggtatattgatttaacata

SEQ ID NO: 53109 - DNA, 20 bp, Artificial Sequence
  chemically synthesized
tatgttaaatcaatataccg

SEQ ID NO: 53110 - DNA, 20 bp, Artificial Sequence
  chemically synthesized
ttcctgttttgtatatacca

SEQ ID NO: 53111 - DNA, 20 bp, Artificial Sequence
  chemically synthesized
ataccgtggtatatacaaaa

SEQ ID NO: 53112 - DNA, 20 bp, Artificial Sequence
  chemically synthesized
taccgtggtatatacaaaac

SEQ ID NO: 53113 - DNA, 20 bp, Artificial Sequence
  chemically synthesized
cgtggtatatacaaaacagg

SEQ ID NO: 53114 - DNA, 20 bp, Artificial Sequence
  chemically synthesized
atatacaaaacaggaagcaa

SEQ ID NO: 53115 - DNA, 20 bp, Artificial Sequence
  chemically synthesized
acaaaacaggaagcaaaagc

SEQ ID NO: 53116 - DNA, 20 bp, Artificial Sequence
  chemically synthesized
agacacaggtatatcatttc

SEQ ID NO: 53117 - DNA, 20 bp, Artificial Sequence
  chemically synthesized
tgtgccagaacataagacac

SEQ ID NO: 53118 - DNA, 20 bp, Artificial Sequence
  chemically synthesized
ttgtgccagaacataagaca

SEQ ID NO: 53119 - DNA, 20 bp, Artificial Sequence
  chemically synthesized
tatacctgtgtcttatgttc

SEQ ID NO: 53120 - DNA, 20 bp, Artificial Sequence
  chemically synthesized
aactgattgtgccagaacat

SEQ ID NO: 53121 - DNA, 20 bp, Artificial Sequence
  chemically synthesized
gtcttatgttctggcacaat

SEQ ID NO: 53122 - DNA, 20 bp, Artificial Sequence
  chemically synthesized
aaggaaagaactgattgtgc

SEQ ID NO: 53123 - DNA, 20 bp, Artificial Sequence
  chemically synthesized
ggcacaatcagttctttcct

SEQ ID NO: 53124 - DNA, 20 bp, Artificial Sequence
  chemically synthesized
acaatcagttctttccttgg

SEQ ID NO: 53125 - DNA, 20 bp, Artificial Sequence
  chemically synthesized
aatgaataaaccaccaagga

SEQ ID NO: 53126 - DNA, 20 bp, Artificial Sequence
  chemically synthesized
ataaaatgaataaaccacca

SEQ ID NO: 53127 - DNA, 20 bp, Artificial Sequence
  chemically synthesized
tataaaatgaataaaccacc

SEQ ID NO: 53128 - DNA, 20 bp, Artificial Sequence
  chemically synthesized
tggtggtttattcattttat

SEQ ID NO: 53129 - DNA, 20 bp, Artificial Sequence
  chemically synthesized
taagtatttgttaatattga

SEQ ID NO: 53130 - DNA, 20 bp, Artificial Sequence
  chemically synthesized
agtatttgttaatattgaaa

SEQ ID NO: 53131 - DNA, 20 bp, Artificial Sequence
  chemically synthesized
tttgttaatattgaaagaga

SEQ ID NO: 53132 - DNA, 20 bp, Artificial Sequence
  chemically synthesized
ttgttaatattgaaagagat

SEQ ID NO: 53133 - DNA, 20 bp, Artificial Sequence
  chemically synthesized
taggcaaaaaacaaatgcta

SEQ ID NO: 53134 - DNA, 20 bp, Artificial Sequence
  chemically synthesized
cttgcagagatcagggacta

SEQ ID NO: 53135 - DNA, 20 bp, Artificial Sequence
  chemically synthesized
ctttacacttgcagagatca

SEQ ID NO: 53136 - DNA, 20 bp, Artificial Sequence
  chemically synthesized
cctttacacttgcagagatc

SEQ ID NO: 53137 - DNA, 20 bp, Artificial Sequence
  chemically synthesized
acctttacacttgcagagat

SEQ ID NO: 53138 - DNA, 20 bp, Artificial Sequence
  chemically synthesized
ctatagtccctgatctctgc

SEQ ID NO: 53139 - DNA, 20 bp, Artificial Sequence
  chemically synthesized
tccaaacctttacacttgca

SEQ ID NO: 53140 - DNA, 20 bp, Artificial Sequence
  chemically synthesized
cctccaaacctttacacttg

SEQ ID NO: 53141 - DNA, 20 bp, Artificial Sequence
  chemically synthesized
ccctgatctctgcaagtgta

SEQ ID NO: 53142 - DNA, 20 bp, Artificial Sequence
  chemically synthesized
cctgatctctgcaagtgtaa

SEQ ID NO: 53143 - DNA, 20 bp, Artificial Sequence
  chemically synthesized
tctctgcaagtgtaaaggtt

SEQ ID NO: 53144 - DNA, 20 bp, Artificial Sequence
  chemically synthesized
tctgcaagtgtaaaggtttg

SEQ ID NO: 53145 - DNA, 20 bp, Artificial Sequence
  chemically synthesized
ctgcaagtgtaaaggtttgg

SEQ ID NO: 53146 - DNA, 20 bp, Artificial Sequence
  chemically synthesized
aagtgtaaaggtttggaggt

SEQ ID NO: 53147 - DNA, 20 bp, Artificial Sequence
  chemically synthesized
tgtaaaggtttggaggtaag

SEQ ID NO: 53148 - DNA, 20 bp, Artificial Sequence
  chemically synthesized
aaaggtttggaggtaagaag

SEQ ID NO: 53149 - DNA, 20 bp, Artificial Sequence
  chemically synthesized
tggaggtaagaagtagtgac

SEQ ID NO: 53150 - DNA, 20 bp, Artificial Sequence
  chemically synthesized
taagaagtagtgacaagctg

SEQ ID NO: 53151 - DNA, 20 bp, Artificial Sequence
  chemically synthesized
aagtagtgacaagctgaaga

SEQ ID NO: 53152 - DNA, 20 bp, Artificial Sequence
  chemically synthesized
agtagtgacaagctgaagaa

SEQ ID NO: 53153 - DNA, 20 bp, Artificial Sequence
  chemically synthesized
tgcagccccaagcctttctt

SEQ ID NO: 53154 - DNA, 20 bp, Artificial Sequence
  chemically synthesized
tgacaagctgaagaaaggct

SEQ ID NO: 53155 - DNA, 20 bp, Artificial Sequence
  chemically synthesized
gacaagctgaagaaaggctt

SEQ ID NO: 53156 - DNA, 20 bp, Artificial Sequence
  chemically synthesized
acaagctgaagaaaggcttg

SEQ ID NO: 53157 - DNA, 20 bp, Artificial Sequence
  chemically synthesized
tgaagaaaggcttggggctg

SEQ ID NO: 53158 - DNA, 20 bp, Artificial Sequence
  chemically synthesized
caccactgttctgcagcccc

SEQ ID NO: 53159 - DNA, 20 bp, Artificial Sequence
  chemically synthesized
aaaggcttggggctgcagaa

SEQ ID NO: 53160 - DNA, 20 bp, Artificial Sequence
  chemically synthesized
tcctcaacaccactgttctg

SEQ ID NO: 53161 - DNA, 20 bp, Artificial Sequence
  chemically synthesized
ggcttggggctgcagaacag

SEQ ID NO: 53162 - DNA, 20 bp, Artificial Sequence
  chemically synthesized
ggctgcagaacagtggtgtt

SEQ ID NO: 53163 - DNA, 20 bp, Artificial Sequence
  chemically synthesized
gctgcagaacagtggtgttg

SEQ ID NO: 53164 - DNA, 20 bp, Artificial Sequence
  chemically synthesized
aacagtggtgttgaggacga

SEQ ID NO: 53165 - DNA, 20 bp, Artificial Sequence
  chemically synthesized
gtggtgttgaggacgacagt

SEQ ID NO: 53166 - DNA, 20 bp, Artificial Sequence
  chemically synthesized
ggacgacagtgagatacaat

SEQ ID NO: 53167 - DNA, 20 bp, Artificial Sequence
  chemically synthesized
gacagtgagatacaattagt

SEQ ID NO: 53168 - DNA, 20 bp, Artificial Sequence
  chemically synthesized
caattagttagtcatgttga

SEQ ID NO: 53169 - DNA, 20 bp, Artificial Sequence
  chemically synthesized
gacgccttgctttgcatcat

SEQ ID NO: 53170 - DNA, 20 bp, Artificial Sequence
  chemically synthesized
tgttgaaagccgatgatgca

SEQ ID NO: 53171 - DNA, 20 bp, Artificial Sequence
  chemically synthesized
gaaagccgatgatgcaaagc

SEQ ID NO: 53172 - DNA, 20 bp, Artificial Sequence
  chemically synthesized
aaagccgatgatgcaaagca

SEQ ID NO: 53173 - DNA, 20 bp, Artificial Sequence
  chemically synthesized
tgatgcaaagcaaggcgtcc

SEQ ID NO: 53174 - DNA, 20 bp, Artificial Sequence
  chemically synthesized
agcaaggcgtcccagactct

SEQ ID NO: 53175 - DNA, 20 bp, Artificial Sequence
  chemically synthesized
aatcttgagcctcagagtct

SEQ ID NO: 53176 - DNA, 20 bp, Artificial Sequence
  chemically synthesized
gcaaggcgtcccagactctg

SEQ ID NO: 53177 - DNA, 20 bp, Artificial Sequence
  chemically synthesized
aaatcttgagcctcagagtc

SEQ ID NO: 53178 - DNA, 20 bp, Artificial Sequence
  chemically synthesized
agggtaaatcttgagcctca

SEQ ID NO: 53179 - DNA, 20 bp, Artificial Sequence
  chemically synthesized
cgtcccagactctgaggctc

SEQ ID NO: 53180 - DNA, 20 bp, Artificial Sequence
  chemically synthesized
gcagggtaaatcttgagcct

SEQ ID NO: 53181 - DNA, 20 bp, Artificial Sequence
  chemically synthesized
ttgcctgcagggtaaatctt

SEQ ID NO: 53182 - DNA, 20 bp, Artificial Sequence
  chemically synthesized
gaggctcaagatttaccctg

SEQ ID NO: 53183 - DNA, 20 bp, Artificial Sequence
  chemically synthesized
aggctcaagatttaccctgc

SEQ ID NO: 53184 - DNA, 20 bp, Artificial Sequence
  chemically synthesized
agtggttctctttgcctgca

SEQ ID NO: 53185 - DNA, 20 bp, Artificial Sequence
  chemically synthesized
caagatttaccctgcaggca

SEQ ID NO: 53186 - DNA, 20 bp, Artificial Sequence
  chemically synthesized
cagtggttctctttgcctgc

SEQ ID NO: 53187 - DNA, 20 bp, Artificial Sequence
  chemically synthesized
tcagtggttctctttgcctg

SEQ ID NO: 53188 - DNA, 20 bp, Artificial Sequence
  chemically synthesized
agatttaccctgcaggcaaa

SEQ ID NO: 53189 - DNA, 20 bp, Artificial Sequence
  chemically synthesized
catgtcacagaaattttcag

SEQ ID NO: 53190 - DNA, 20 bp, Artificial Sequence
  chemically synthesized
agtcatgtcacagaaatttt

SEQ ID NO: 53191 - DNA, 20 bp, Artificial Sequence
  chemically synthesized
taaaatagtgagtcatgtca

SEQ ID NO: 53192 - DNA, 20 bp, Artificial Sequence
  chemically synthesized
tgtgacatgactcactattt

SEQ ID NO: 53193 - DNA, 20 bp, Artificial Sequence
  chemically synthesized
taactttcctctaaaatagt

SEQ ID NO: 53194 - DNA, 20 bp, Artificial Sequence
  chemically synthesized
tgacatgactcactatttta

SEQ ID NO: 53195 - DNA, 20 bp, Artificial Sequence
  chemically synthesized
gacatgactcactattttag

SEQ ID NO: 53196 - DNA, 20 bp, Artificial Sequence
  chemically synthesized
accctaactttcctctaaaa

SEQ ID NO: 53197 - DNA, 20 bp, Artificial Sequence
  chemically synthesized
tgactcactattttagagga

SEQ ID NO: 53198 - DNA, 20 bp, Artificial Sequence
  chemically synthesized
tcactattttagaggaaagt

SEQ ID NO: 53199 - DNA, 20 bp, Artificial Sequence
  chemically synthesized
cactattttagaggaaagtt

SEQ ID NO: 53200 - DNA, 20 bp, Artificial Sequence
  chemically synthesized
actattttagaggaaagtta

SEQ ID NO: 53201 - DNA, 20 bp, Artificial Sequence
  chemically synthesized
tttagaggaaagttagggtt

SEQ ID NO: 53202 - DNA, 20 bp, Artificial Sequence
  chemically synthesized
ttagaggaaagttagggttt

SEQ ID NO: 53203 - DNA, 20 bp, Artificial Sequence
  chemically synthesized
gaggaaagttagggtttggg

SEQ ID NO: 53204 - DNA, 20 bp, Artificial Sequence
  chemically synthesized
aagttagggtttgggaagat

SEQ ID NO: 53205 - DNA, 20 bp, Artificial Sequence
  chemically synthesized
agggtttgggaagatcagta

SEQ ID NO: 53206 - DNA, 20 bp, Artificial Sequence
  chemically synthesized
aagatcagtatagtgtaaaa

SEQ ID NO: 53207 - DNA, 20 bp, Artificial Sequence
  chemically synthesized
atagtgtaaaacagattcga

SEQ ID NO: 53208 - DNA, 20 bp, Artificial Sequence
  chemically synthesized
tagtgtaaaacagattcgaa

SEQ ID NO: 53209 - DNA, 20 bp, Artificial Sequence
  chemically synthesized
agtgtaaaacagattcgaaa

SEQ ID NO: 53210 - DNA, 20 bp, Artificial Sequence
  chemically synthesized
acagattcgaaagggcacct

SEQ ID NO: 53211 - DNA, 20 bp, Artificial Sequence
  chemically synthesized
tcgaaagggcacctgagact

SEQ ID NO: 53212 - DNA, 20 bp, Artificial Sequence
  chemically synthesized
ctctttctgatctcagtctc

SEQ ID NO: 53213 - DNA, 20 bp, Artificial Sequence
  chemically synthesized
cctctttctgatctcagtct

SEQ ID NO: 53214 - DNA, 20 bp, Artificial Sequence
  chemically synthesized
agggcacctgagactgagat

SEQ ID NO: 53215 - DNA, 20 bp, Artificial Sequence
  chemically synthesized
caacagcctctttctgatct

SEQ ID NO: 53216 - DNA, 20 bp, Artificial Sequence
  chemically synthesized
cacctgagactgagatcaga

SEQ ID NO: 53217 - DNA, 20 bp, Artificial Sequence
  chemically synthesized
cctgagactgagatcagaaa

SEQ ID NO: 53218 - DNA, 20 bp, Artificial Sequence
  chemically synthesized
ctgagactgagatcagaaag

SEQ ID NO: 53219 - DNA, 20 bp, Artificial Sequence
  chemically synthesized
ccaagtctagtaagttacaa

SEQ ID NO: 53220 - DNA, 20 bp, Artificial Sequence
  chemically synthesized
aagaggctgttgtaacttac

SEQ ID NO: 53221 - DNA, 20 bp, Artificial Sequence
  chemically synthesized
catatcaacccaagtctagt

SEQ ID NO: 53222 - DNA, 20 bp, Artificial Sequence
  chemically synthesized
ctgttgtaacttactagact

SEQ ID NO: 53223 - DNA, 20 bp, Artificial Sequence
  chemically synthesized
tgttgtaacttactagactt

SEQ ID NO: 53224 - DNA, 20 bp, Artificial Sequence
  chemically synthesized
aatgcatatcaacccaagtc

SEQ ID NO: 53225 - DNA, 20 bp, Artificial Sequence
  chemically synthesized
attctaatgcatatcaaccc

SEQ ID NO: 53226 - DNA, 20 bp, Artificial Sequence
  chemically synthesized
agacttgggttgatatgcat

SEQ ID NO: 53227 - DNA, 20 bp, Artificial Sequence
  chemically synthesized
ggttgatatgcattagaatt

SEQ ID NO: 53228 - DNA, 20 bp, Artificial Sequence
  chemically synthesized
gttgatatgcattagaatta

SEQ ID NO: 53229 - DNA, 20 bp, Artificial Sequence
  chemically synthesized
cttttacattgaatacaata

SEQ ID NO: 53230 - DNA, 20 bp, Artificial Sequence
  chemically synthesized
ctgtattgtattcaatgtaa

SEQ ID NO: 53231 - DNA, 20 bp, Artificial Sequence
  chemically synthesized
tattgtattcaatgtaaaag

SEQ ID NO: 53232 - DNA, 20 bp, Artificial Sequence
  chemically synthesized
attgtattcaatgtaaaaga

SEQ ID NO: 53233 - DNA, 20 bp, Artificial Sequence
  chemically synthesized
atgtaaaagaaggtacatat

SEQ ID NO: 53234 - DNA, 20 bp, Artificial Sequence
  chemically synthesized
taaaagaaggtacatatgag

SEQ ID NO: 53235 - DNA, 20 bp, Artificial Sequence
  chemically synthesized
aaaagaaggtacatatgaga

SEQ ID NO: 53236 - DNA, 20 bp, Artificial Sequence
  chemically synthesized
catatgagaaggtattttga

SEQ ID NO: 53237 - DNA, 20 bp, Artificial Sequence
  chemically synthesized
atatgagaaggtattttgaa

SEQ ID NO: 53238 - DNA, 20 bp, Artificial Sequence
  chemically synthesized
atgagaaggtattttgaaag

SEQ ID NO: 53239 - DNA, 20 bp, Artificial Sequence
  chemically synthesized
tgagaaggtattttgaaagg

SEQ ID NO: 53240 - DNA, 20 bp, Artificial Sequence
  chemically synthesized
gaaggtattttgaaaggagg

SEQ ID NO: 53241 - DNA, 20 bp, Artificial Sequence
  chemically synthesized
ggaggaagaactatccaatt

SEQ ID NO: 53242 - DNA, 20 bp, Artificial Sequence
  chemically synthesized
atctccaacaccaaattgga

SEQ ID NO: 53243 - DNA, 20 bp, Artificial Sequence
  chemically synthesized
attaatctccaacaccaaat

SEQ ID NO: 53244 - DNA, 20 bp, Artificial Sequence
  chemically synthesized
agaactatccaatttggtgt

SEQ ID NO: 53245 - DNA, 20 bp, Artificial Sequence
  chemically synthesized
aactatccaatttggtgttg

SEQ ID NO: 53246 - DNA, 20 bp, Artificial Sequence
  chemically synthesized
gtgttggagattaatatctg

SEQ ID NO: 53247 - DNA, 20 bp, Artificial Sequence
  chemically synthesized
ttggagattaatatctgaag

SEQ ID NO: 53248 - DNA, 20 bp, Artificial Sequence
  chemically synthesized
caagagtttatttgcttctt

SEQ ID NO: 53249 - DNA, 20 bp, Artificial Sequence
  chemically synthesized
tgaagaagcaaataaactct

SEQ ID NO: 53250 - DNA, 20 bp, Artificial Sequence
  chemically synthesized
cttccttactcgaaatccaa

SEQ ID NO: 53251 - DNA, 20 bp, Artificial Sequence
  chemically synthesized
caaataaactcttggatttc

SEQ ID NO: 53252 - DNA, 20 bp, Artificial Sequence
  chemically synthesized
gtcttccttactcgaaatcc

SEQ ID NO: 53253 - DNA, 20 bp, Artificial Sequence
  chemically synthesized
taaactcttggatttcgagt

SEQ ID NO: 53254 - DNA, 20 bp, Artificial Sequence
  chemically synthesized
aaactcttggatttcgagta

SEQ ID NO: 53255 - DNA, 20 bp, Artificial Sequence
  chemically synthesized
ctcttggatttcgagtaagg

SEQ ID NO: 53256 - DNA, 20 bp, Artificial Sequence
  chemically synthesized
ggatttcgagtaaggaagac

SEQ ID NO: 53257 - DNA, 20 bp, Artificial Sequence
  chemically synthesized
gatttcgagtaaggaagact

SEQ ID NO: 53258 - DNA, 20 bp, Artificial Sequence
  chemically synthesized
tttcgagtaaggaagactgg

SEQ ID NO: 53259 - DNA, 20 bp, Artificial Sequence
  chemically synthesized
cagcaatatcttcattctcc

SEQ ID NO: 53260 - DNA, 20 bp, Artificial Sequence
  chemically synthesized
taaggaagactgggagaatg

SEQ ID NO: 53261 - DNA, 20 bp, Artificial Sequence
  chemically synthesized
tgggagaatgaagatattgc

SEQ ID NO: 53262 - DNA, 20 bp, Artificial Sequence
  chemically synthesized
gagaatgaagatattgctgg

SEQ ID NO: 53263 - DNA, 20 bp, Artificial Sequence
  chemically synthesized
tctgattttcatattgccac

SEQ ID NO: 53264 - DNA, 20 bp, Artificial Sequence
  chemically synthesized
gctggtggcaatatgaaaat

SEQ ID NO: 53265 - DNA, 20 bp, Artificial Sequence
  chemically synthesized
tggcaatatgaaaatcagaa

SEQ ID NO: 53266 - DNA, 20 bp, Artificial Sequence
  chemically synthesized
ggcaatatgaaaatcagaaa

SEQ ID NO: 53267 - DNA, 20 bp, Artificial Sequence
  chemically synthesized
aatatgaaaatcagaaaagg

SEQ ID NO: 53268 - DNA, 20 bp, Artificial Sequence
  chemically synthesized
aaaatcagaaaaggaagaaa

SEQ ID NO: 53269 - DNA, 20 bp, Artificial Sequence
  chemically synthesized
tatgtatgtatgaattcatt

SEQ ID NO: 53270 - DNA, 20 bp, Artificial Sequence
  chemically synthesized
acataatgaatttgtcctaa

SEQ ID NO: 53271 - DNA, 20 bp, Artificial Sequence
  chemically synthesized
cagttaaatgtttcactgtt

SEQ ID NO: 53272 - DNA, 20 bp, Artificial Sequence
  chemically synthesized
ccagttaaatgtttcactgt

SEQ ID NO: 53273 - DNA, 20 bp, Artificial Sequence
  chemically synthesized
ctaacagtgaaacatttaac

SEQ ID NO: 53274 - DNA, 20 bp, Artificial Sequence
  chemically synthesized
aacagtgaaacatttaactg

SEQ ID NO: 53275 - DNA, 20 bp, Artificial Sequence
  chemically synthesized
ctggctatacatgacatctc

SEQ ID NO: 53276 - DNA, 20 bp, Artificial Sequence
  chemically synthesized
ttaactggagatgtcatgta

SEQ ID NO: 53277 - DNA, 20 bp, Artificial Sequence
  chemically synthesized
ctggagatgtcatgtatagc

SEQ ID NO: 53278 - DNA, 20 bp, Artificial Sequence
  chemically synthesized
agatgtcatgtatagccagt

SEQ ID NO: 53279 - DNA, 20 bp, Artificial Sequence
  chemically synthesized
atgtcatgtatagccagtta

SEQ ID NO: 53280 - DNA, 20 bp, Artificial Sequence
  chemically synthesized
acaaattgttcatctctaac

SEQ ID NO: 53281 - DNA, 20 bp, Artificial Sequence
  chemically synthesized
tagagatgaacaatttgtct

SEQ ID NO: 53282 - DNA, 20 bp, Artificial Sequence
  chemically synthesized
ctttcctttctttaattgct

SEQ ID NO: 53283 - DNA, 20 bp, Artificial Sequence
  chemically synthesized
acaatttgtctcagcaatta

SEQ ID NO: 53284 - DNA, 20 bp, Artificial Sequence
  chemically synthesized
tttgtctcagcaattaaaga

SEQ ID NO: 53285 - DNA, 20 bp, Artificial Sequence
  chemically synthesized
ttgtctcagcaattaaagaa

SEQ ID NO: 53286 - DNA, 20 bp, Artificial Sequence
  chemically synthesized
ctcagcaattaaagaaagga

SEQ ID NO: 53287 - DNA, 20 bp, Artificial Sequence
  chemically synthesized
tcagcaattaaagaaaggaa

SEQ ID NO: 53288 - DNA, 20 bp, Artificial Sequence
  chemically synthesized
cagcaattaaagaaaggaaa

SEQ ID NO: 53289 - DNA, 20 bp, Artificial Sequence
  chemically synthesized
caattaaagaaaggaaaggg

SEQ ID NO: 53290 - DNA, 20 bp, Artificial Sequence
  chemically synthesized
taaagaaaggaaagggaagt

SEQ ID NO: 53291 - DNA, 20 bp, Artificial Sequence
  chemically synthesized
ggaaagggaagtgagactaa

SEQ ID NO: 53292 - DNA, 20 bp, Artificial Sequence
  chemically synthesized
gaaagggaagtgagactaaa

SEQ ID NO: 53293 - DNA, 20 bp, Artificial Sequence
  chemically synthesized
aaagggaagtgagactaaaa

SEQ ID NO: 53294 - DNA, 20 bp, Artificial Sequence
  chemically synthesized
aagggaagtgagactaaaag

SEQ ID NO: 53295 - DNA, 20 bp, Artificial Sequence
  chemically synthesized
aagctcactcttaccccttt

SEQ ID NO: 53296 - DNA, 20 bp, Artificial Sequence
  chemically synthesized
gaagtgagactaaaaggggt

SEQ ID NO: 53297 - DNA, 20 bp, Artificial Sequence
  chemically synthesized
agtgagactaaaaggggtaa

SEQ ID NO: 53298 - DNA, 20 bp, Artificial Sequence
  chemically synthesized
agactaaaaggggtaagagt

SEQ ID NO: 53299 - DNA, 20 bp, Artificial Sequence
  chemically synthesized
aaaggggtaagagtgagctt

SEQ ID NO: 53300 - DNA, 20 bp, Artificial Sequence
  chemically synthesized
ggggtaagagtgagctttgg

SEQ ID NO: 53301 - DNA, 20 bp, Artificial Sequence
  chemically synthesized
gggtaagagtgagctttgga

SEQ ID NO: 53302 - DNA, 20 bp, Artificial Sequence
  chemically synthesized
ctttcttggctcaccttcca

SEQ ID NO: 53303 - DNA, 20 bp, Artificial Sequence
  chemically synthesized
aagagtgagctttggaaggt

SEQ ID NO: 53304 - DNA, 20 bp, Artificial Sequence
  chemically synthesized
tgagctttggaaggtgagcc

SEQ ID NO: 53305 - DNA, 20 bp, Artificial Sequence
  chemically synthesized
ctttggaaggtgagccaaga

SEQ ID NO: 53306 - DNA, 20 bp, Artificial Sequence
  chemically synthesized
tggaaggtgagccaagaaag

SEQ ID NO: 53307 - DNA, 20 bp, Artificial Sequence
  chemically synthesized
ctcctttatctcttctttct

SEQ ID NO: 53308 - DNA, 20 bp, Artificial Sequence
  chemically synthesized
gaaggtgagccaagaaagaa

SEQ ID NO: 53309 - DNA, 20 bp, Artificial Sequence
  chemically synthesized
gagccaagaaagaagagata

SEQ ID NO: 53310 - DNA, 20 bp, Artificial Sequence
  chemically synthesized
agccaagaaagaagagataa

SEQ ID NO: 53311 - DNA, 20 bp, Artificial Sequence
  chemically synthesized
ccaagaaagaagagataaag

SEQ ID NO: 53312 - DNA, 20 bp, Artificial Sequence
  chemically synthesized
aagagataaaggagtttaaa

SEQ ID NO: 53313 - DNA, 20 bp, Artificial Sequence
  chemically synthesized
tttaaatagaatgatttaaa

SEQ ID NO: 53314 - DNA, 20 bp, Artificial Sequence
  chemically synthesized
aatagaatgatttaaacagc

SEQ ID NO: 53315 - DNA, 20 bp, Artificial Sequence
  chemically synthesized
atagaatgatttaaacagcc

SEQ ID NO: 53316 - DNA, 20 bp, Artificial Sequence
  chemically synthesized
agaatgatttaaacagccag

SEQ ID NO: 53317 - DNA, 20 bp, Artificial Sequence
  chemically synthesized
gaatgatttaaacagccagg

SEQ ID NO: 53318 - DNA, 20 bp, Artificial Sequence
  chemically synthesized
agaagagattgggttcctcc

SEQ ID NO: 53319 - DNA, 20 bp, Artificial Sequence
  chemically synthesized
ctattaattcagaagagatt

SEQ ID NO: 53320 - DNA, 20 bp, Artificial Sequence
  chemically synthesized
cctattaattcagaagagat

SEQ ID NO: 53321 - DNA, 20 bp, Artificial Sequence
  chemically synthesized
catgccctattaattcagaa

SEQ ID NO: 53322 - DNA, 20 bp, Artificial Sequence
  chemically synthesized
gacatgccctattaattcag

SEQ ID NO: 53323 - DNA, 20 bp, Artificial Sequence
  chemically synthesized
cccaatctcttctgaattaa

SEQ ID NO: 53324 - DNA, 20 bp, Artificial Sequence
  chemically synthesized
ccaatctcttctgaattaat

SEQ ID NO: 53325 - DNA, 20 bp, Artificial Sequence
  chemically synthesized
agagacatgccctattaatt

SEQ ID NO: 53326 - DNA, 20 bp, Artificial Sequence
  chemically synthesized
caatctcttctgaattaata

SEQ ID NO: 53327 - DNA, 20 bp, Artificial Sequence
  chemically synthesized
tacttttataaaaggaaaca

SEQ ID NO: 53328 - DNA, 20 bp, Artificial Sequence
  chemically synthesized
attacttttataaaaggaaa

SEQ ID NO: 53329 - DNA, 20 bp, Artificial Sequence
  chemically synthesized
gtctctgtttccttttataa

SEQ ID NO: 53330 - DNA, 20 bp, Artificial Sequence
  chemically synthesized
atttgtattacttttataaa

SEQ ID NO: 53331 - DNA, 20 bp, Artificial Sequence
  chemically synthesized
tatttgtattacttttataa

SEQ ID NO: 53332 - DNA, 20 bp, Artificial Sequence
  chemically synthesized
atacaaatataacatctttt

SEQ ID NO: 53333 - DNA, 20 bp, Artificial Sequence
  chemically synthesized
caaatataacatctttttgg

SEQ ID NO: 53334 - DNA, 20 bp, Artificial Sequence
  chemically synthesized
acaggatgtatgcttccaaa

SEQ ID NO: 53335 - DNA, 20 bp, Artificial Sequence
  chemically synthesized
tatgatctaatagttgaaac

SEQ ID NO: 53336 - DNA, 20 bp, Artificial Sequence
  chemically synthesized
ctatgatctaatagttgaaa

SEQ ID NO: 53337 - DNA, 20 bp, Artificial Sequence
  chemically synthesized
atacatcctgtttcaactat

SEQ ID NO: 53338 - DNA, 20 bp, Artificial Sequence
  chemically synthesized
tttcgtgatctatgatctaa

SEQ ID NO: 53339 - DNA, 20 bp, Artificial Sequence
  chemically synthesized
ctgtttcaactattagatca

SEQ ID NO: 53340 - DNA, 20 bp, Artificial Sequence
  chemically synthesized
tattagatcatagatcacga

SEQ ID NO: 53341 - DNA, 20 bp, Artificial Sequence
  chemically synthesized
gatcatagatcacgaaagct

SEQ ID NO: 53342 - DNA, 20 bp, Artificial Sequence
  chemically synthesized
agatcacgaaagcttagaac

SEQ ID NO: 53343 - DNA, 20 bp, Artificial Sequence
  chemically synthesized
tcaaggtttcttccagttct

SEQ ID NO: 53344 - DNA, 20 bp, Artificial Sequence
  chemically synthesized
tcacgaaagcttagaactgg

SEQ ID NO: 53345 - DNA, 20 bp, Artificial Sequence
  chemically synthesized
gtatcaatcaaggtttcttc

SEQ ID NO: 53346 - DNA, 20 bp, Artificial Sequence
  chemically synthesized
agaccctcgtgtatcaatca

SEQ ID NO: 53347 - DNA, 20 bp, Artificial Sequence
  chemically synthesized
tagaccctcgtgtatcaatc

SEQ ID NO: 53348 - DNA, 20 bp, Artificial Sequence
  chemically synthesized
agaaaccttgattgatacac

SEQ ID NO: 53349 - DNA, 20 bp, Artificial Sequence
  chemically synthesized
gaaaccttgattgatacacg

SEQ ID NO: 53350 - DNA, 20 bp, Artificial Sequence
  chemically synthesized
aaaccttgattgatacacga

SEQ ID NO: 53351 - DNA, 20 bp, Artificial Sequence
  chemically synthesized
atacacgagggtctattctt

SEQ ID NO: 53352 - DNA, 20 bp, Artificial Sequence
  chemically synthesized
tctgggatagttctgaagaa

SEQ ID NO: 53353 - DNA, 20 bp, Artificial Sequence
  chemically synthesized
gcccatctgggatagttctg

SEQ ID NO: 53354 - DNA, 20 bp, Artificial Sequence
  chemically synthesized
tctattcttcagaactatcc

SEQ ID NO: 53355 - DNA, 20 bp, Artificial Sequence
  chemically synthesized
ttcttcagaactatcccaga

SEQ ID NO: 53356 - DNA, 20 bp, Artificial Sequence
  chemically synthesized
agttttctgcccatctggga

SEQ ID NO: 53357 - DNA, 20 bp, Artificial Sequence
  chemically synthesized
tcttcagaactatcccagat

SEQ ID NO: 53358 - DNA, 20 bp, Artificial Sequence
  chemically synthesized
tcagaactatcccagatggg

SEQ ID NO: 53359 - DNA, 20 bp, Artificial Sequence
  chemically synthesized
tggcagttttctgcccatct

SEQ ID NO: 53360 - DNA, 20 bp, Artificial Sequence
  chemically synthesized
atggcagttttctgcccatc

SEQ ID NO: 53361 - DNA, 20 bp, Artificial Sequence
  chemically synthesized
atgggcagaaaactgccatc

SEQ ID NO: 53362 - DNA, 20 bp, Artificial Sequence
  chemically synthesized
agttctcatggaccagatgg

SEQ ID NO: 53363 - DNA, 20 bp, Artificial Sequence
  chemically synthesized
atgagttctcatggaccaga

SEQ ID NO: 53364 - DNA, 20 bp, Artificial Sequence
  chemically synthesized
aaaactgccatctggtccat

SEQ ID NO: 53365 - DNA, 20 bp, Artificial Sequence
  chemically synthesized
gattatgagttctcatggac

SEQ ID NO: 53366 - DNA, 20 bp, Artificial Sequence
  chemically synthesized
acctagattatgagttctca

SEQ ID NO: 53367 - DNA, 20 bp, Artificial Sequence
  chemically synthesized
gtccatgagaactcataatc

SEQ ID NO: 53368 - DNA, 20 bp, Artificial Sequence
  chemically synthesized
tccatgagaactcataatct

SEQ ID NO: 53369 - DNA, 20 bp, Artificial Sequence
  chemically synthesized
attgctgcaacctagattat

SEQ ID NO: 53370 - DNA, 20 bp, Artificial Sequence
  chemically synthesized
agaactcataatctaggttg

SEQ ID NO: 53371 - DNA, 20 bp, Artificial Sequence
  chemically synthesized
actgaagaattgctgcaacc

SEQ ID NO: 53372 - DNA, 20 bp, Artificial Sequence
  chemically synthesized
tctaggttgcagcaattctt

SEQ ID NO: 53373 - DNA, 20 bp, Artificial Sequence
  chemically synthesized
ttgcagcaattcttcagtaa

SEQ ID NO: 53374 - DNA, 20 bp, Artificial Sequence
  chemically synthesized
ttcctgagatgcttttactg

SEQ ID NO: 53375 - DNA, 20 bp, Artificial Sequence
  chemically synthesized
attcttcagtaaaagcatct

SEQ ID NO: 53376 - DNA, 20 bp, Artificial Sequence
  chemically synthesized
ttcttcagtaaaagcatctc

SEQ ID NO: 53377 - DNA, 20 bp, Artificial Sequence
  chemically synthesized
aaaaaggacctttttttcct

SEQ ID NO: 53378 - DNA, 20 bp, Artificial Sequence
  chemically synthesized
taaaagcatctcaggaaaaa

SEQ ID NO: 53379 - DNA, 20 bp, Artificial Sequence
  chemically synthesized
aaaagcatctcaggaaaaaa

SEQ ID NO: 53380 - DNA, 20 bp, Artificial Sequence
  chemically synthesized
cctcatggaacatataaaaa

SEQ ID NO: 53381 - DNA, 20 bp, Artificial Sequence
  chemically synthesized
tcctcatggaacatataaaa

SEQ ID NO: 53382 - DNA, 20 bp, Artificial Sequence
  chemically synthesized
tccttttttatatgttccat

SEQ ID NO: 53383 - DNA, 20 bp, Artificial Sequence
  chemically synthesized
ccttttttatatgttccatg

SEQ ID NO: 53384 - DNA, 20 bp, Artificial Sequence
  chemically synthesized
ttttatatgttccatgagga

SEQ ID NO: 53385 - DNA, 20 bp, Artificial Sequence
  chemically synthesized
tttatatgttccatgaggac

SEQ ID NO: 53386 - DNA, 20 bp, Artificial Sequence
  chemically synthesized
aagatgtgtccctgtcctca

SEQ ID NO: 53387 - DNA, 20 bp, Artificial Sequence
  chemically synthesized
ttatatgttccatgaggaca

SEQ ID NO: 53388 - DNA, 20 bp, Artificial Sequence
  chemically synthesized
cactgaggatttagcaggga

SEQ ID NO: 53389 - DNA, 20 bp, Artificial Sequence
  chemically synthesized
tactcactgaggatttagca

SEQ ID NO: 53390 - DNA, 20 bp, Artificial Sequence
  chemically synthesized
ctactcactgaggatttagc

SEQ ID NO: 53391 - DNA, 20 bp, Artificial Sequence
  chemically synthesized
gctactcactgaggatttag

SEQ ID NO: 53392 - DNA, 20 bp, Artificial Sequence
  chemically synthesized
atctttccctgctaaatcct

SEQ ID NO: 53393 - DNA, 20 bp, Artificial Sequence
  chemically synthesized
tgtgctactcactgaggatt

SEQ ID NO: 53394 - DNA, 20 bp, Artificial Sequence
  chemically synthesized
ttccctgctaaatcctcagt

SEQ ID NO: 53395 - DNA, 20 bp, Artificial Sequence
  chemically synthesized
cctgctaaatcctcagtgag

SEQ ID NO: 53396 - DNA, 20 bp, Artificial Sequence
  chemically synthesized
aggtactgtgctactcactg

SEQ ID NO: 53397 - DNA, 20 bp, Artificial Sequence
  chemically synthesized
caggtactgtgctactcact

SEQ ID NO: 53398 - DNA, 20 bp, Artificial Sequence
  chemically synthesized
taaatcctcagtgagtagca

SEQ ID NO: 53399 - DNA, 20 bp, Artificial Sequence
  chemically synthesized
tcagtgagtagcacagtacc

SEQ ID NO: 53400 - DNA, 20 bp, Artificial Sequence
  chemically synthesized
tttagcacctattatatgcc

SEQ ID NO: 53401 - DNA, 20 bp, Artificial Sequence
  chemically synthesized
atttagcacctattatatgc

SEQ ID NO: 53402 - DNA, 20 bp, Artificial Sequence
  chemically synthesized
gcacagtacctggcatataa

SEQ ID NO: 53403 - DNA, 20 bp, Artificial Sequence
  chemically synthesized
cacagtacctggcatataat

SEQ ID NO: 53404 - DNA, 20 bp, Artificial Sequence
  chemically synthesized
tcattcaactaatattaatt

SEQ ID NO: 53405 - DNA, 20 bp, Artificial Sequence
  chemically synthesized
aataggtgctaaattaatat

SEQ ID NO: 53406 - DNA, 20 bp, Artificial Sequence
  chemically synthesized
agtaaagatccgtgaataaa

SEQ ID NO: 53407 - DNA, 20 bp, Artificial Sequence
  chemically synthesized
attaatgtactgtttattca

SEQ ID NO: 53408 - DNA, 20 bp, Artificial Sequence
  chemically synthesized
aaatatagttgttaatagta

SEQ ID NO: 53409 - DNA, 20 bp, Artificial Sequence
  chemically synthesized
attcaaaatatagttgttaa

SEQ ID NO: 53410 - DNA, 20 bp, Artificial Sequence
  chemically synthesized
gaaatgattcattcaaaata

SEQ ID NO: 53411 - DNA, 20 bp, Artificial Sequence
  chemically synthesized
gaatgaatcatttctttttc

SEQ ID NO: 53412 - DNA, 20 bp, Artificial Sequence
  chemically synthesized
ttgtgtcagggatcttgaaa

SEQ ID NO: 53413 - DNA, 20 bp, Artificial Sequence
  chemically synthesized
tttttcaagatccctgacac

SEQ ID NO: 53414 - DNA, 20 bp, Artificial Sequence
  chemically synthesized
tttttcaaaagcttgtgtca

SEQ ID NO: 53415 - DNA, 20 bp, Artificial Sequence
  chemically synthesized
gtttttcaaaagcttgtgtc

SEQ ID NO: 53416 - DNA, 20 bp, Artificial Sequence
  chemically synthesized
agtttttcaaaagcttgtgt

SEQ ID NO: 53417 - DNA, 20 bp, Artificial Sequence
  chemically synthesized
gagggagggaagtttttcaa

SEQ ID NO: 53418 - DNA, 20 bp, Artificial Sequence
  chemically synthesized
aaggaagaagggagggaggg

SEQ ID NO: 53419 - DNA, 20 bp, Artificial Sequence
  chemically synthesized
ggaaaggaagaagggaggga

SEQ ID NO: 53420 - DNA, 20 bp, Artificial Sequence
  chemically synthesized
aggaaaggaagaagggaggg

SEQ ID NO: 53421 - DNA, 20 bp, Artificial Sequence
  chemically synthesized
aaggaaaggaagaagggagg

SEQ ID NO: 53422 - DNA, 20 bp, Artificial Sequence
  chemically synthesized
agaaggaaaggaagaaggga

SEQ ID NO: 53423 - DNA, 20 bp, Artificial Sequence
  chemically synthesized
aagaaggaaaggaagaaggg

SEQ ID NO: 53424 - DNA, 20 bp, Artificial Sequence
  chemically synthesized
aaagaaggaaaggaagaagg

SEQ ID NO: 53425 - DNA, 20 bp, Artificial Sequence
  chemically synthesized
gaaaagaaggaaaggaagaa

SEQ ID NO: 53426 - DNA, 20 bp, Artificial Sequence
  chemically synthesized
agaaaagaaggaaaggaaga

SEQ ID NO: 53427 - DNA, 20 bp, Artificial Sequence
  chemically synthesized
aagaaaagaaggaaaggaag

SEQ ID NO: 53428 - DNA, 20 bp, Artificial Sequence
  chemically synthesized
aggaagaaaagaaggaaagg

SEQ ID NO: 53429 - DNA, 20 bp, Artificial Sequence
  chemically synthesized
ggaaggaagaaaagaaggaa

SEQ ID NO: 53430 - DNA, 20 bp, Artificial Sequence
  chemically synthesized
aggaaggaagaaaagaagga

SEQ ID NO: 53431 - DNA, 20 bp, Artificial Sequence
  chemically synthesized
aaggaggaaggaagaaaaga

SEQ ID NO: 53432 - DNA, 20 bp, Artificial Sequence
  chemically synthesized
aaaggaggaaggaagaaaag

SEQ ID NO: 53433 - DNA, 20 bp, Artificial Sequence
  chemically synthesized
agaaaaggaggaaggaagaa

SEQ ID NO: 53434 - DNA, 20 bp, Artificial Sequence
  chemically synthesized
aaggaagaaaaggaggaagg

SEQ ID NO: 53435 - DNA, 20 bp, Artificial Sequence
  chemically synthesized
agaaaggaagaaaaggagga

SEQ ID NO: 53436 - DNA, 20 bp, Artificial Sequence
  chemically synthesized
aagaaaggaagaaaaggagg

SEQ ID NO: 53437 - DNA, 20 bp, Artificial Sequence
  chemically synthesized
tggaagaaaggaagaaaagg

SEQ ID NO: 53438 - DNA, 20 bp, Artificial Sequence
  chemically synthesized
atggaagaaaggaagaaaag

SEQ ID NO: 53439 - DNA, 20 bp, Artificial Sequence
  chemically synthesized
aaatggaagaaaggaagaaa

SEQ ID NO: 53440 - DNA, 20 bp, Artificial Sequence
  chemically synthesized
aaaatggaagaaaggaagaa

SEQ ID NO: 53441 - DNA, 20 bp, Artificial Sequence
  chemically synthesized
catcaaaaatggaagaaagg

SEQ ID NO: 53442 - DNA, 20 bp, Artificial Sequence
  chemically synthesized
catcatcaaaaatggaagaa

SEQ ID NO: 53443 - DNA, 20 bp, Artificial Sequence
  chemically synthesized
tcatcatcaaaaatggaaga

SEQ ID NO: 53444 - DNA, 20 bp, Artificial Sequence
  chemically synthesized
actttcatcatcaaaaatgg

SEQ ID NO: 53445 - DNA, 20 bp, Artificial Sequence
  chemically synthesized
tttactttcatcatcaaaaa

SEQ ID NO: 53446 - DNA, 20 bp, Artificial Sequence
  chemically synthesized
tcttccatttttgatgatga

SEQ ID NO: 53447 - DNA, 20 bp, Artificial Sequence
  chemically synthesized
ttgatgatgaaagtaaaaaa

SEQ ID NO: 53448 - DNA, 20 bp, Artificial Sequence
  chemically synthesized
gatgaaagtaaaaaaaagaa

SEQ ID NO: 53449 - DNA, 20 bp, Artificial Sequence
  chemically synthesized
gaaagtaaaaaaaagaaaag

SEQ ID NO: 53450 - DNA, 20 bp, Artificial Sequence
  chemically synthesized
aagaaaagaagaaaaccatt

SEQ ID NO: 53451 - DNA, 20 bp, Artificial Sequence
  chemically synthesized
taggcaaaattgaatctaaa

SEQ ID NO: 53452 - DNA, 20 bp, Artificial Sequence
  chemically synthesized
ttcaattttgcctataatac

SEQ ID NO: 53453 - DNA, 20 bp, Artificial Sequence
  chemically synthesized
atttttaaatctagtattat

SEQ ID NO: 53454 - DNA, 20 bp, Artificial Sequence
  chemically synthesized
catttttaaatctagtatta

SEQ ID NO: 53455 - DNA, 20 bp, Artificial Sequence
  chemically synthesized
ccgttttacatttttaaatc

SEQ ID NO: 53456 - DNA, 20 bp, Artificial Sequence
  chemically synthesized
ctagatttaaaaatgtaaaa

SEQ ID NO: 53457 - DNA, 20 bp, Artificial Sequence
  chemically synthesized
caatttataaaacaaccctg

SEQ ID NO: 53458 - DNA, 20 bp, Artificial Sequence
  chemically synthesized
tggaggagatttggacttca

SEQ ID NO: 53459 - DNA, 20 bp, Artificial Sequence
  chemically synthesized
gtggaggagatttggacttc

SEQ ID NO: 53460 - DNA, 20 bp, Artificial Sequence
  chemically synthesized
tgtggaggagatttggactt

SEQ ID NO: 53461 - DNA, 20 bp, Artificial Sequence
  chemically synthesized
aaacaaatgtggaggagatt

SEQ ID NO: 53462 - DNA, 20 bp, Artificial Sequence
  chemically synthesized
agagtaaaacaaatgtggag

SEQ ID NO: 53463 - DNA, 20 bp, Artificial Sequence
  chemically synthesized
ctagagtaaaacaaatgtgg

SEQ ID NO: 53464 - DNA, 20 bp, Artificial Sequence
  chemically synthesized
actagagtaaaacaaatgtg

SEQ ID NO: 53465 - DNA, 20 bp, Artificial Sequence
  chemically synthesized
aaactagagtaaaacaaatg

SEQ ID NO: 53466 - DNA, 20 bp, Artificial Sequence
  chemically synthesized
cctccacatttgttttactc

SEQ ID NO: 53467 - DNA, 20 bp, Artificial Sequence
  chemically synthesized
atatgattatttaaaaacta

SEQ ID NO: 53468 - DNA, 20 bp, Artificial Sequence
  chemically synthesized
aaatatgattatttaaaaac

SEQ ID NO: 53469 - DNA, 20 bp, Artificial Sequence
  chemically synthesized
gtttttaaataatcatattt

SEQ ID NO: 53470 - DNA, 20 bp, Artificial Sequence
  chemically synthesized
aataatcatatttaagattt

SEQ ID NO: 53471 - DNA, 20 bp, Artificial Sequence
  chemically synthesized
taatcatatttaagatttga

SEQ ID NO: 53472 - DNA, 20 bp, Artificial Sequence
  chemically synthesized
atttaagatttgagagttat

SEQ ID NO: 53473 - DNA, 20 bp, Artificial Sequence
  chemically synthesized
tttaagatttgagagttatg

SEQ ID NO: 53474 - DNA, 20 bp, Artificial Sequence
  chemically synthesized
ttaagatttgagagttatga

SEQ ID NO: 53475 - DNA, 20 bp, Artificial Sequence
  chemically synthesized
agaccaaggagaataatata

SEQ ID NO: 53476 - DNA, 20 bp, Artificial Sequence
  chemically synthesized
gggctatatattattctcct

SEQ ID NO: 53477 - DNA, 20 bp, Artificial Sequence
  chemically synthesized
tctgaaatgagaagaccaag

SEQ ID NO: 53478 - DNA, 20 bp, Artificial Sequence
  chemically synthesized
catctgaaatgagaagacca

SEQ ID NO: 53479 - DNA, 20 bp, Artificial Sequence
  chemically synthesized
tcatctgaaatgagaagacc

SEQ ID NO: 53480 - DNA, 20 bp, Artificial Sequence
  chemically synthesized
tctccttggtcttctcattt

SEQ ID NO: 53481 - DNA, 20 bp, Artificial Sequence
  chemically synthesized
cagaactcatctgaaatgag

SEQ ID NO: 53482 - DNA, 20 bp, Artificial Sequence
  chemically synthesized
ctacagaactcatctgaaat

SEQ ID NO: 53483 - DNA, 20 bp, Artificial Sequence
  chemically synthesized
ttggtcttctcatttcagat

SEQ ID NO: 53484 - DNA, 20 bp, Artificial Sequence
  chemically synthesized
ctcatttcagatgagttctg

SEQ ID NO: 53485 - DNA, 20 bp, Artificial Sequence
  chemically synthesized
tttcagatgagttctgtaga

SEQ ID NO: 53486 - DNA, 20 bp, Artificial Sequence
  chemically synthesized
tgcaaacagtatactgtcta

SEQ ID NO: 53487 - DNA, 20 bp, Artificial Sequence
  chemically synthesized
tgtagacagtatactgtttg

SEQ ID NO: 53488 - DNA, 20 bp, Artificial Sequence
  chemically synthesized
tagacagtatactgtttgca

SEQ ID NO: 53489 - DNA, 20 bp, Artificial Sequence
  chemically synthesized
gaaaggaaggtctctgcaaa

SEQ ID NO: 53490 - DNA, 20 bp, Artificial Sequence
  chemically synthesized
ttactgaagctaagaaagga

SEQ ID NO: 53491 - DNA, 20 bp, Artificial Sequence
  chemically synthesized
ttgcagagaccttcctttct

SEQ ID NO: 53492 - DNA, 20 bp, Artificial Sequence
  chemically synthesized
cttactgaagctaagaaagg

SEQ ID NO: 53493 - DNA, 20 bp, Artificial Sequence
  chemically synthesized
tttcttactgaagctaagaa

SEQ ID NO: 53494 - DNA, 20 bp, Artificial Sequence
  chemically synthesized
atttcttactgaagctaaga

SEQ ID NO: 53495 - DNA, 20 bp, Artificial Sequence
  chemically synthesized
agaccttcctttcttagctt

SEQ ID NO: 53496 - DNA, 20 bp, Artificial Sequence
  chemically synthesized
tgatatttcttactgaagct

SEQ ID NO: 53497 - DNA, 20 bp, Artificial Sequence
  chemically synthesized
cttcctttcttagcttcagt

SEQ ID NO: 53498 - DNA, 20 bp, Artificial Sequence
  chemically synthesized
tgtagtgatatttcttactg

SEQ ID NO: 53499 - DNA, 20 bp, Artificial Sequence
  chemically synthesized
caatatcttttgaatgaatg

SEQ ID NO: 53500 - DNA, 20 bp, Artificial Sequence
  chemically synthesized
atatcactacattcattcaa

SEQ ID NO: 53501 - DNA, 20 bp, Artificial Sequence
  chemically synthesized
ttcattcaaaagatattgac

SEQ ID NO: 53502 - DNA, 20 bp, Artificial Sequence
  chemically synthesized
aaagatattgactagaatgt

SEQ ID NO: 53503 - DNA, 20 bp, Artificial Sequence
  chemically synthesized
tggacaataaacttacattc

SEQ ID NO: 53504 - DNA, 20 bp, Artificial Sequence
  chemically synthesized
atgtaagtttattgtccaca

SEQ ID NO: 53505 - DNA, 20 bp, Artificial Sequence
  chemically synthesized
aagtttattgtccacaaaga

SEQ ID NO: 53506 - DNA, 20 bp, Artificial Sequence
  chemically synthesized
agataagatctctgtctttg

SEQ ID NO: 53507 - DNA, 20 bp, Artificial Sequence
  chemically synthesized
gtttattgtccacaaagaca

SEQ ID NO: 53508 - DNA, 20 bp, Artificial Sequence
  chemically synthesized
aaattcttaacaagacagat

SEQ ID NO: 53509 - DNA, 20 bp, Artificial Sequence
  chemically synthesized
gagatcttatctgtcttgtt

SEQ ID NO: 53510 - DNA, 20 bp, Artificial Sequence
  chemically synthesized
gtgataaattcttaacaaga

SEQ ID NO: 53511 - DNA, 20 bp, Artificial Sequence
  chemically synthesized
cattgtgataaattcttaac

SEQ ID NO: 53512 - DNA, 20 bp, Artificial Sequence
  chemically synthesized
taagaatttatcacaatgcc

SEQ ID NO: 53513 - DNA, 20 bp, Artificial Sequence
  chemically synthesized
ttatcacaatgcctagtaca

SEQ ID NO: 53514 - DNA, 20 bp, Artificial Sequence
  chemically synthesized
ttgatcatcttctatgtact

SEQ ID NO: 53515 - DNA, 20 bp, Artificial Sequence
  chemically synthesized
cttgatcatcttctatgtac

SEQ ID NO: 53516 - DNA, 20 bp, Artificial Sequence
  chemically synthesized
tcacaatgcctagtacatag

SEQ ID NO: 53517 - DNA, 20 bp, Artificial Sequence
  chemically synthesized
ctagtacatagaagatgatc

SEQ ID NO: 53518 - DNA, 20 bp, Artificial Sequence
  chemically synthesized
gatgatcaagaaatactgaa

SEQ ID NO: 53519 - DNA, 20 bp, Artificial Sequence
  chemically synthesized
ctttcattcattcatccatt

SEQ ID NO: 53520 - DNA, 20 bp, Artificial Sequence
  chemically synthesized
ctgaatggatgaatgaatga

SEQ ID NO: 53521 - DNA, 20 bp, Artificial Sequence
  chemically synthesized
tgaatggatgaatgaatgaa

SEQ ID NO: 53522 - DNA, 20 bp, Artificial Sequence
  chemically synthesized
gaatgaatgaaaggcttttt

SEQ ID NO: 53523 - DNA, 20 bp, Artificial Sequence
  chemically synthesized
acaaataagaggaactcaaa

SEQ ID NO: 53524 - DNA, 20 bp, Artificial Sequence
  chemically synthesized
ctcagtgcctgacaaataag

SEQ ID NO: 53525 - DNA, 20 bp, Artificial Sequence
  chemically synthesized
tctcagtgcctgacaaataa

SEQ ID NO: 53526 - DNA, 20 bp, Artificial Sequence
  chemically synthesized
tttgagttcctcttatttgt

SEQ ID NO: 53527 - DNA, 20 bp, Artificial Sequence
  chemically synthesized
ttgagttcctcttatttgtc

SEQ ID NO: 53528 - DNA, 20 bp, Artificial Sequence
  chemically synthesized
tatctcagtgcctgacaaat

SEQ ID NO: 53529 - DNA, 20 bp, Artificial Sequence
  chemically synthesized
cctcttatttgtcaggcact

SEQ ID NO: 53530 - DNA, 20 bp, Artificial Sequence
  chemically synthesized
tatttgtcaggcactgagat

SEQ ID NO: 53531 - DNA, 20 bp, Artificial Sequence
  chemically synthesized
taccgtattcatacttatct

SEQ ID NO: 53532 - DNA, 20 bp, Artificial Sequence
  chemically synthesized
cactgagataagtatgaata

SEQ ID NO: 53533 - DNA, 20 bp, Artificial Sequence
  chemically synthesized
tgagataagtatgaatacgg

SEQ ID NO: 53534 - DNA, 20 bp, Artificial Sequence
  chemically synthesized
tatgaatacggtagacttga

SEQ ID NO: 53535 - DNA, 20 bp, Artificial Sequence
  chemically synthesized
atacccagaattacgctttc

SEQ ID NO: 53536 - DNA, 20 bp, Artificial Sequence
  chemically synthesized
tagacttgaaagcgtaattc

SEQ ID NO: 53537 - DNA, 20 bp, Artificial Sequence
  chemically synthesized
agacttgaaagcgtaattct

SEQ ID NO: 53538 - DNA, 20 bp, Artificial Sequence
  chemically synthesized
tggtgctcattcattatacc

SEQ ID NO: 53539 - DNA, 20 bp, Artificial Sequence
  chemically synthesized
taattctgggtataatgaat

SEQ ID NO: 53540 - DNA, 20 bp, Artificial Sequence
  chemically synthesized
cgtaatttagttggatgatt

SEQ ID NO: 53541 - DNA, 20 bp, Artificial Sequence
  chemically synthesized
gtgtcgtatcgtaatttagt

SEQ ID NO: 53542 - DNA, 20 bp, Artificial Sequence
  chemically synthesized
gtgtgtgtcgtatcgtaatt

SEQ ID NO: 53543 - DNA, 20 bp, Artificial Sequence
  chemically synthesized
cagtcacagcttggaattaa

SEQ ID NO: 53544 - DNA, 20 bp, Artificial Sequence
  chemically synthesized
cgacacacactcttaattcc

SEQ ID NO: 53545 - DNA, 20 bp, Artificial Sequence
  chemically synthesized
aacagtcacagcttggaatt

SEQ ID NO: 53546 - DNA, 20 bp, Artificial Sequence
  chemically synthesized
tttgggaaacagtcacagct

SEQ ID NO: 53547 - DNA, 20 bp, Artificial Sequence
  chemically synthesized
tgagctttgggaaacagtca

SEQ ID NO: 53548 - DNA, 20 bp, Artificial Sequence
  chemically synthesized
caagctgtgactgtttccca

SEQ ID NO: 53549 - DNA, 20 bp, Artificial Sequence
  chemically synthesized
atggactgagctttgggaaa

SEQ ID NO: 53550 - DNA, 20 bp, Artificial Sequence
  chemically synthesized
tgtgactgtttcccaaagct

SEQ ID NO: 53551 - DNA, 20 bp, Artificial Sequence
  chemically synthesized
agaggaatggactgagcttt

SEQ ID NO: 53552 - DNA, 20 bp, Artificial Sequence
  chemically synthesized
cagaggaatggactgagctt

SEQ ID NO: 53553 - DNA, 20 bp, Artificial Sequence
  chemically synthesized
aatacacagaggaatggact

SEQ ID NO: 53554 - DNA, 20 bp, Artificial Sequence
  chemically synthesized
tttcacaatacacagaggaa

SEQ ID NO: 53555 - DNA, 20 bp, Artificial Sequence
  chemically synthesized
ttatctttcacaatacacag

SEQ ID NO: 53556 - DNA, 20 bp, Artificial Sequence
  chemically synthesized
cttatctttcacaatacaca

SEQ ID NO: 53557 - DNA, 20 bp, Artificial Sequence
  chemically synthesized
agcttatctttcacaataca

SEQ ID NO: 53558 - DNA, 20 bp, Artificial Sequence
  chemically synthesized
cattcctctgtgtattgtga

SEQ ID NO: 53559 - DNA, 20 bp, Artificial Sequence
  chemically synthesized
ctctgtgtattgtgaaagat

SEQ ID NO: 53560 - DNA, 20 bp, Artificial Sequence
  chemically synthesized
gttgaagaaaaaatgaaata

SEQ ID NO: 53561 - DNA, 20 bp, Artificial Sequence
  chemically synthesized
cttatttaaaagcaatgttg

SEQ ID NO: 53562 - DNA, 20 bp, Artificial Sequence
  chemically synthesized
cttcaacattgcttttaaat

SEQ ID NO: 53563 - DNA, 20 bp, Artificial Sequence
  chemically synthesized
tattcttttggcttatttaa

SEQ ID NO: 53564 - DNA, 20 bp, Artificial Sequence
  chemically synthesized
attgcttttaaataagccaa

SEQ ID NO: 53565 - DNA, 20 bp, Artificial Sequence
  chemically synthesized
ctttctttcttttattcttt

SEQ ID NO: 53566 - DNA, 20 bp, Artificial Sequence
  chemically synthesized
taaataagccaaaagaataa

SEQ ID NO: 53567 - DNA, 20 bp, Artificial Sequence
  chemically synthesized
taagccaaaagaataaaaga

SEQ ID NO: 53568 - DNA, 20 bp, Artificial Sequence
  chemically synthesized
ccaaaagaataaaagaaaga

SEQ ID NO: 53569 - DNA, 20 bp, Artificial Sequence
  chemically synthesized
gaataaaagaaagaaagaaa

SEQ ID NO: 53570 - DNA, 20 bp, Artificial Sequence
  chemically synthesized
aataaaagaaagaaagaaaa

SEQ ID NO: 53571 - DNA, 20 bp, Artificial Sequence
  chemically synthesized
aagagccatgatgttgttat

SEQ ID NO: 53572 - DNA, 20 bp, Artificial Sequence
  chemically synthesized
aaggaccgataacaacatca

SEQ ID NO: 53573 - DNA, 20 bp, Artificial Sequence
  chemically synthesized
gataacaacatcatggctct

SEQ ID NO: 53574 - DNA, 20 bp, Artificial Sequence
  chemically synthesized
ttatttgaaataatttctaa

SEQ ID NO: 53575 - DNA, 20 bp, Artificial Sequence
  chemically synthesized
atttatttgaaataatttct

SEQ ID NO: 53576 - DNA, 20 bp, Artificial Sequence
  chemically synthesized
aaagaaccaacatttacatt

SEQ ID NO: 53577 - DNA, 20 bp, Artificial Sequence
  chemically synthesized
atttatctaaatgtaaatgt

SEQ ID NO: 53578 - DNA, 20 bp, Artificial Sequence
  chemically synthesized
gagaatctaaaacaaagtta

SEQ ID NO: 53579 - DNA, 20 bp, Artificial Sequence
  chemically synthesized
ttggttctttaactttgttt

SEQ ID NO: 53580 - DNA, 20 bp, Artificial Sequence
  chemically synthesized
gcccttgagaatctaaaaca

SEQ ID NO: 53581 - DNA, 20 bp, Artificial Sequence
  chemically synthesized
taactttgttttagattctc

SEQ ID NO: 53582 - DNA, 20 bp, Artificial Sequence
  chemically synthesized
aactttgttttagattctca

SEQ ID NO: 53583 - DNA, 20 bp, Artificial Sequence
  chemically synthesized
actttgttttagattctcaa

SEQ ID NO: 53584 - DNA, 20 bp, Artificial Sequence
  chemically synthesized
aagacaaagtggaagccctt

SEQ ID NO: 53585 - DNA, 20 bp, Artificial Sequence
  chemically synthesized
aaggtcaaaagacaaagtgg

SEQ ID NO: 53586 - DNA, 20 bp, Artificial Sequence
  chemically synthesized
agaaaggtcaaaagacaaag

SEQ ID NO: 53587 - DNA, 20 bp, Artificial Sequence
  chemically synthesized
aacagaaaggtcaaaagaca

SEQ ID NO: 53588 - DNA, 20 bp, Artificial Sequence
  chemically synthesized
gtaattaacagaaaggtcaa

SEQ ID NO: 53589 - DNA, 20 bp, Artificial Sequence
  chemically synthesized
aagtagagtaattaacagaa

SEQ ID NO: 53590 - DNA, 20 bp, Artificial Sequence
  chemically synthesized
aaagtagagtaattaacaga

SEQ ID NO: 53591 - DNA, 20 bp, Artificial Sequence
  chemically synthesized
actcaaagtagagtaattaa

SEQ ID NO: 53592 - DNA, 20 bp, Artificial Sequence
  chemically synthesized
tctgttaattactctacttt

SEQ ID NO: 53593 - DNA, 20 bp, Artificial Sequence
  chemically synthesized
tgaagataaaactcaaagta

SEQ ID NO: 53594 - DNA, 20 bp, Artificial Sequence
  chemically synthesized
agtgaagataaaactcaaag

SEQ ID NO: 53595 - DNA, 20 bp, Artificial Sequence
  chemically synthesized
tctagtgaagataaaactca

SEQ ID NO: 53596 - DNA, 20 bp, Artificial Sequence
  chemically synthesized
actttgagttttatcttcac

SEQ ID NO: 53597 - DNA, 20 bp, Artificial Sequence
  chemically synthesized
ttgagttttatcttcactag

SEQ ID NO: 53598 - DNA, 20 bp, Artificial Sequence
  chemically synthesized
tctctcctaaacttctagtg

SEQ ID NO: 53599 - DNA, 20 bp, Artificial Sequence
  chemically synthesized
ttttatcttcactagaagtt

SEQ ID NO: 53600 - DNA, 20 bp, Artificial Sequence
  chemically synthesized
tttatcttcactagaagttt

SEQ ID NO: 53601 - DNA, 20 bp, Artificial Sequence
  chemically synthesized
gcctgtctctcctaaacttc

SEQ ID NO: 53602 - DNA, 20 bp, Artificial Sequence
  chemically synthesized
tatcttcactagaagtttag

SEQ ID NO: 53603 - DNA, 20 bp, Artificial Sequence
  chemically synthesized
tcttcactagaagtttagga

SEQ ID NO: 53604 - DNA, 20 bp, Artificial Sequence
  chemically synthesized
cactagaagtttaggagaga

SEQ ID NO: 53605 - DNA, 20 bp, Artificial Sequence
  chemically synthesized
actagaagtttaggagagac

SEQ ID NO: 53606 - DNA, 20 bp, Artificial Sequence
  chemically synthesized
acaggcattacctccccatg

SEQ ID NO: 53607 - DNA, 20 bp, Artificial Sequence
  chemically synthesized
cagtgtatttccacatgggg

SEQ ID NO: 53608 - DNA, 20 bp, Artificial Sequence
  chemically synthesized
gcagtgtatttccacatggg

SEQ ID NO: 53609 - DNA, 20 bp, Artificial Sequence
  chemically synthesized
tagcagtgtatttccacatg

SEQ ID NO: 53610 - DNA, 20 bp, Artificial Sequence
  chemically synthesized
ctagcagtgtatttccacat

SEQ ID NO: 53611 - DNA, 20 bp, Artificial Sequence
  chemically synthesized
cctagcagtgtatttccaca

SEQ ID NO: 53612 - DNA, 20 bp, Artificial Sequence
  chemically synthesized
cccatgtggaaatacactgc

SEQ ID NO: 53613 - DNA, 20 bp, Artificial Sequence
  chemically synthesized
ccatgtggaaatacactgct

SEQ ID NO: 53614 - DNA, 20 bp, Artificial Sequence
  chemically synthesized
gaagaaaccacattgcctag

SEQ ID NO: 53615 - DNA, 20 bp, Artificial Sequence
  chemically synthesized
aaatacactgctaggcaatg

SEQ ID NO: 53616 - DNA, 20 bp, Artificial Sequence
  chemically synthesized
taggaagaaaccacattgcc

SEQ ID NO: 53617 - DNA, 20 bp, Artificial Sequence
  chemically synthesized
taggcaatgtggtttcttcc

SEQ ID NO: 53618 - DNA, 20 bp, Artificial Sequence
  chemically synthesized
gatgtagcttggacactagg

SEQ ID NO: 53619 - DNA, 20 bp, Artificial Sequence
  chemically synthesized
gtggtttcttcctagtgtcc

SEQ ID NO: 53620 - DNA, 20 bp, Artificial Sequence
  chemically synthesized
taagatgtagcttggacact

SEQ ID NO: 53621 - DNA, 20 bp, Artificial Sequence
  chemically synthesized
gtaagatgtagcttggacac

SEQ ID NO: 53622 - DNA, 20 bp, Artificial Sequence
  chemically synthesized
gtaatcagtaagatgtagct

SEQ ID NO: 53623 - DNA, 20 bp, Artificial Sequence
  chemically synthesized
atgtagtaatcagtaagatg

SEQ ID NO: 53624 - DNA, 20 bp, Artificial Sequence
  chemically synthesized
ttatgtatgtagtaatcagt

SEQ ID NO: 53625 - DNA, 20 bp, Artificial Sequence
  chemically synthesized
tgatttatgtatgtagtaat

SEQ ID NO: 53626 - DNA, 20 bp, Artificial Sequence
  chemically synthesized
gtaaacatgatttatgtatg

SEQ ID NO: 53627 - DNA, 20 bp, Artificial Sequence
  chemically synthesized
tacataaatcatgtttactc

SEQ ID NO: 53628 - DNA, 20 bp, Artificial Sequence
  chemically synthesized
aaatcatgtttactccagtc

SEQ ID NO: 53629 - DNA, 20 bp, Artificial Sequence
  chemically synthesized
atcatgtttactccagtcta

SEQ ID NO: 53630 - DNA, 20 bp, Artificial Sequence
  chemically synthesized
tacatattttctctagactg

SEQ ID NO: 53631 - DNA, 20 bp, Artificial Sequence
  chemically synthesized
gttacatattttctctagac

SEQ ID NO: 53632 - DNA, 20 bp, Artificial Sequence
  chemically synthesized
tcctagttacatattttctc

SEQ ID NO: 53633 - DNA, 20 bp, Artificial Sequence
  chemically synthesized
gtctagagaaaatatgtaac

SEQ ID NO: 53634 - DNA, 20 bp, Artificial Sequence
  chemically synthesized
tctagagaaaatatgtaact

SEQ ID NO: 53635 - DNA, 20 bp, Artificial Sequence
  chemically synthesized
aaaatcaaaacatacgttcc

SEQ ID NO: 53636 - DNA, 20 bp, Artificial Sequence
  chemically synthesized
gaacgtatgttttgattttc

SEQ ID NO: 53637 - DNA, 20 bp, Artificial Sequence
  chemically synthesized
tgttttgattttctggttct

SEQ ID NO: 53638 - DNA, 20 bp, Artificial Sequence
  chemically synthesized
ggtctagacaaactgagaac

SEQ ID NO: 53639 - DNA, 20 bp, Artificial Sequence
  chemically synthesized
atctagggtctagacaaact

SEQ ID NO: 53640 - DNA, 20 bp, Artificial Sequence
  chemically synthesized
tttctggttctcagtttgtc

SEQ ID NO: 53641 - DNA, 20 bp, Artificial Sequence
  chemically synthesized
ttctcagtttgtctagaccc

SEQ ID NO: 53642 - DNA, 20 bp, Artificial Sequence
  chemically synthesized
atggatatttatctagggtc

SEQ ID NO: 53643 - DNA, 20 bp, Artificial Sequence
  chemically synthesized
ttcccatggatatttatcta

SEQ ID NO: 53644 - DNA, 20 bp, Artificial Sequence
  chemically synthesized
attcccatggatatttatct

SEQ ID NO: 53645 - DNA, 20 bp, Artificial Sequence
  chemically synthesized
cattcccatggatatttatc

SEQ ID NO: 53646 - DNA, 20 bp, Artificial Sequence
  chemically synthesized
agaccctagataaatatcca

SEQ ID NO: 53647 - DNA, 20 bp, Artificial Sequence
  chemically synthesized
gaccctagataaatatccat

SEQ ID NO: 53648 - DNA, 20 bp, Artificial Sequence
  chemically synthesized
gtctgtttcttgcattccca

SEQ ID NO: 53649 - DNA, 20 bp, Artificial Sequence
  chemically synthesized
ataaatatccatgggaatgc

SEQ ID NO: 53650 - DNA, 20 bp, Artificial Sequence
  chemically synthesized
atccatgggaatgcaagaaa

SEQ ID NO: 53651 - DNA, 20 bp, Artificial Sequence
  chemically synthesized
tttaataggctcatttgtgt

SEQ ID NO: 53652 - DNA, 20 bp, Artificial Sequence
  chemically synthesized
gacatgacacttacacaaat

SEQ ID NO: 53653 - DNA, 20 bp, Artificial Sequence
  chemically synthesized
gcttttgtttttgttttaat

SEQ ID NO: 53654 - DNA, 20 bp, Artificial Sequence
  chemically synthesized
tgcttttgtttttgttttaa

SEQ ID NO: 53655 - DNA, 20 bp, Artificial Sequence
  chemically synthesized
gcctattaaaacaaaaacaa

SEQ ID NO: 53656 - DNA, 20 bp, Artificial Sequence
  chemically synthesized
taaaacaaaaacaaaagcaa

SEQ ID NO: 53657 - DNA, 20 bp, Artificial Sequence
  chemically synthesized
acaaaaacaaaagcaaaaga

SEQ ID NO: 53658 - DNA, 20 bp, Artificial Sequence
  chemically synthesized
ttactagcatcacagcacaa

SEQ ID NO: 53659 - DNA, 20 bp, Artificial Sequence
  chemically synthesized
atttactagcatcacagcac

SEQ ID NO: 53660 - DNA, 20 bp, Artificial Sequence
  chemically synthesized
aaactcttgtgctgtgatgc

SEQ ID NO: 53661 - DNA, 20 bp, Artificial Sequence
  chemically synthesized
tggtttatttactagcatca

SEQ ID NO: 53662 - DNA, 20 bp, Artificial Sequence
  chemically synthesized
catatgtgtggtttatttac

SEQ ID NO: 53663 - DNA, 20 bp, Artificial Sequence
  chemically synthesized
gtcatttgtgtgcatatgtg

SEQ ID NO: 53664 - DNA, 20 bp, Artificial Sequence
  chemically synthesized
tatgcacacaaatgactctc

SEQ ID NO: 53665 - DNA, 20 bp, Artificial Sequence
  chemically synthesized
aaactcgtgaatagactgga

SEQ ID NO: 53666 - DNA, 20 bp, Artificial Sequence
  chemically synthesized
aaaaactcgtgaatagactg

SEQ ID NO: 53667 - DNA, 20 bp, Artificial Sequence
  chemically synthesized
acaaaaactcgtgaatagac

SEQ ID NO: 53668 - DNA, 20 bp, Artificial Sequence
  chemically synthesized
tgactctccagtctattcac

SEQ ID NO: 53669 - DNA, 20 bp, Artificial Sequence
  chemically synthesized
tcaggacaaaaactcgtgaa

SEQ ID NO: 53670 - DNA, 20 bp, Artificial Sequence
  chemically synthesized
attcacgagtttttgtcctg

SEQ ID NO: 53671 - DNA, 20 bp, Artificial Sequence
  chemically synthesized
tgtacaaactgaaaaacttc

SEQ ID NO: 53672 - DNA, 20 bp, Artificial Sequence
  chemically synthesized
ctgtacaaactgaaaaactt

SEQ ID NO: 53673 - DNA, 20 bp, Artificial Sequence
  chemically synthesized
gtttttgtcctgaagttttt

SEQ ID NO: 53674 - DNA, 20 bp, Artificial Sequence
  chemically synthesized
ctgaagtttttcagtttgta

SEQ ID NO: 53675 - DNA, 20 bp, Artificial Sequence
  chemically synthesized
ccaacacagacacatgcaca

SEQ ID NO: 53676 - DNA, 20 bp, Artificial Sequence
  chemically synthesized
ctgtgtgcatgtgtctgtgt

SEQ ID NO: 53677 - DNA, 20 bp, Artificial Sequence
  chemically synthesized
tgtgtgcatgtgtctgtgtt

SEQ ID NO: 53678 - DNA, 20 bp, Artificial Sequence
  chemically synthesized
gtgtgcatgtgtctgtgttg

SEQ ID NO: 53679 - DNA, 20 bp, Artificial Sequence
  chemically synthesized
tgtgcatgtgtctgtgttgg

SEQ ID NO: 53680 - DNA, 20 bp, Artificial Sequence
  chemically synthesized
aggaagttcctcccccaaca

SEQ ID NO: 53681 - DNA, 20 bp, Artificial Sequence
  chemically synthesized
tgcatgtgtctgtgttgggg

SEQ ID NO: 53682 - DNA, 20 bp, Artificial Sequence
  chemically synthesized
gcatgtgtctgtgttggggg

SEQ ID NO: 53683 - DNA, 20 bp, Artificial Sequence
  chemically synthesized
gggagtaagaatgaacgagg

SEQ ID NO: 53684 - DNA, 20 bp, Artificial Sequence
  chemically synthesized
tttgggagtaagaatgaacg

SEQ ID NO: 53685 - DNA, 20 bp, Artificial Sequence
  chemically synthesized
atttgggagtaagaatgaac

SEQ ID NO: 53686 - DNA, 20 bp, Artificial Sequence
  chemically synthesized
acttgtgaggatttgggagt

SEQ ID NO: 53687 - DNA, 20 bp, Artificial Sequence
  chemically synthesized
tgttacttgtgaggatttgg

SEQ ID NO: 53688 - DNA, 20 bp, Artificial Sequence
  chemically synthesized
agtgttacttgtgaggattt

SEQ ID NO: 53689 - DNA, 20 bp, Artificial Sequence
  chemically synthesized
gagtgttacttgtgaggatt

SEQ ID NO: 53690 - DNA, 20 bp, Artificial Sequence
  chemically synthesized
tcttactcccaaatcctcac

SEQ ID NO: 53691 - DNA, 20 bp, Artificial Sequence
  chemically synthesized
atttatgagtgttacttgtg

SEQ ID NO: 53692 - DNA, 20 bp, Artificial Sequence
  chemically synthesized
tatttatgagtgttacttgt

SEQ ID NO: 53693 - DNA, 20 bp, Artificial Sequence
  chemically synthesized
atgtttgggcacgtatttat

SEQ ID NO: 53694 - DNA, 20 bp, Artificial Sequence
  chemically synthesized
gcgtttcccggataatgttt

SEQ ID NO: 53695 - DNA, 20 bp, Artificial Sequence
  chemically synthesized
agcgtttcccggataatgtt

SEQ ID NO: 53696 - DNA, 20 bp, Artificial Sequence
  chemically synthesized
atacgtgcccaaacattatc

SEQ ID NO: 53697 - DNA, 20 bp, Artificial Sequence
  chemically synthesized
tacgtgcccaaacattatcc

SEQ ID NO: 53698 - DNA, 20 bp, Artificial Sequence
  chemically synthesized
tcagtctcaggagcgtttcc

SEQ ID NO: 53699 - DNA, 20 bp, Artificial Sequence
  chemically synthesized
attatccgggaaacgctcct

SEQ ID NO: 53700 - DNA, 20 bp, Artificial Sequence
  chemically synthesized
gaaactgtaatcagtctcag

SEQ ID NO: 53701 - DNA, 20 bp, Artificial Sequence
  chemically synthesized
ctgaaactgtaatcagtctc

SEQ ID NO: 53702 - DNA, 20 bp, Artificial Sequence
  chemically synthesized
actgaaactgtaatcagtct

SEQ ID NO: 53703 - DNA, 20 bp, Artificial Sequence
  chemically synthesized
aacgctcctgagactgatta

SEQ ID NO: 53704 - DNA, 20 bp, Artificial Sequence
  chemically synthesized
attttaactgaaactgtaat

SEQ ID NO: 53705 - DNA, 20 bp, Artificial Sequence
  chemically synthesized
cctgagactgattacagttt

SEQ ID NO: 53706 - DNA, 20 bp, Artificial Sequence
  chemically synthesized
agggattaccattagttaaa

SEQ ID NO: 53707 - DNA, 20 bp, Artificial Sequence
  chemically synthesized
aagggattaccattagttaa

SEQ ID NO: 53708 - DNA, 20 bp, Artificial Sequence
  chemically synthesized
gttaaaatccttttaactaa

SEQ ID NO: 53709 - DNA, 20 bp, Artificial Sequence
  chemically synthesized
taactgaaagggattaccat

SEQ ID NO: 53710 - DNA, 20 bp, Artificial Sequence
  chemically synthesized
taactaatggtaatcccttt

SEQ ID NO: 53711 - DNA, 20 bp, Artificial Sequence
  chemically synthesized
ataatggattttaactgaaa

SEQ ID NO: 53712 - DNA, 20 bp, Artificial Sequence
  chemically synthesized
aataatggattttaactgaa

SEQ ID NO: 53713 - DNA, 20 bp, Artificial Sequence
  chemically synthesized
taataatggattttaactga

SEQ ID NO: 53714 - DNA, 20 bp, Artificial Sequence
  chemically synthesized
aatcagaattagaataataa

SEQ ID NO: 53715 - DNA, 20 bp, Artificial Sequence
  chemically synthesized
caactcaaaagaatcagaat

SEQ ID NO: 53716 - DNA, 20 bp, Artificial Sequence
  chemically synthesized
cagttacaactcaaaagaat

SEQ ID NO: 53717 - DNA, 20 bp, Artificial Sequence
  chemically synthesized
attctaattctgattctttt

SEQ ID NO: 53718 - DNA, 20 bp, Artificial Sequence
  chemically synthesized
ttttttcagttacaactcaa

SEQ ID NO: 53719 - DNA, 20 bp, Artificial Sequence
  chemically synthesized
ttttttttttattatttttt

SEQ ID NO: 53720 - DNA, 20 bp, Artificial Sequence
  chemically synthesized
aaaaataataaaaaaaaaaa

SEQ ID NO: 53721 - DNA, 20 bp, Artificial Sequence
  chemically synthesized
aataaaaaaaaaaaaagtct

SEQ ID NO: 53722 - DNA, 20 bp, Artificial Sequence
  chemically synthesized
aaaaaaaaaaagtctgagat

SEQ ID NO: 53723 - DNA, 20 bp, Artificial Sequence
  chemically synthesized
atcaagaccagaacttatct

SEQ ID NO: 53724 - DNA, 20 bp, Artificial Sequence
  chemically synthesized
aaaaagtctgagataagttc

SEQ ID NO: 53725 - DNA, 20 bp, Artificial Sequence
  chemically synthesized
ggagagtttgaaatcaagac

SEQ ID NO: 53726 - DNA, 20 bp, Artificial Sequence
  chemically synthesized
gcccaggagagtttgaaatc

SEQ ID NO: 53727 - DNA, 20 bp, Artificial Sequence
  chemically synthesized
gtcttgatttcaaactctcc

SEQ ID NO: 53728 - DNA, 20 bp, Artificial Sequence
  chemically synthesized
tcttgatttcaaactctcct

SEQ ID NO: 53729 - DNA, 20 bp, Artificial Sequence
  chemically synthesized
gcactctgggaggcccagga

SEQ ID NO: 53730 - DNA, 20 bp, Artificial Sequence
  chemically synthesized
cagcactctgggaggcccag

SEQ ID NO: 53731 - DNA, 20 bp, Artificial Sequence
  chemically synthesized
cccagcactctgggaggccc

SEQ ID NO: 53732 - DNA, 20 bp, Artificial Sequence
  chemically synthesized
tcaaactctcctgggcctcc

SEQ ID NO: 53733 - DNA, 20 bp, Artificial Sequence
  chemically synthesized
tcccagcactctgggaggcc

SEQ ID NO: 53734 - DNA, 20 bp, Artificial Sequence
  chemically synthesized
aaactctcctgggcctccca

SEQ ID NO: 53735 - DNA, 20 bp, Artificial Sequence
  chemically synthesized
tgtaatcccagcactctggg

SEQ ID NO: 53736 - DNA, 20 bp, Artificial Sequence
  chemically synthesized
ctgtaatcccagcactctgg

SEQ ID NO: 53737 - DNA, 20 bp, Artificial Sequence
  chemically synthesized
tcctgggcctcccagagtgc

SEQ ID NO: 53738 - DNA, 20 bp, Artificial Sequence
  chemically synthesized
gcctgtaatcccagcactct

SEQ ID NO: 53739 - DNA, 20 bp, Artificial Sequence
  chemically synthesized
cctgggcctcccagagtgct

SEQ ID NO: 53740 - DNA, 20 bp, Artificial Sequence
  chemically synthesized
tgcctgtaatcccagcactc

SEQ ID NO: 53741 - DNA, 20 bp, Artificial Sequence
  chemically synthesized
ctcccagagtgctgggatta

SEQ ID NO: 53742 - DNA, 20 bp, Artificial Sequence
  chemically synthesized
tcccagagtgctgggattac

SEQ ID NO: 53743 - DNA, 20 bp, Artificial Sequence
  chemically synthesized
gtggctcatgcctgtaatcc

SEQ ID NO: 53744 - DNA, 20 bp, Artificial Sequence
  chemically synthesized
agtgctgggattacaggcat

SEQ ID NO: 53745 - DNA, 20 bp, Artificial Sequence
  chemically synthesized
caggcatgagccacctctac

SEQ ID NO: 53746 - DNA, 20 bp, Artificial Sequence
  chemically synthesized
cagaagatggccggtagagg

SEQ ID NO: 53747 - DNA, 20 bp, Artificial Sequence
  chemically synthesized
ttccagaagatggccggtag

SEQ ID NO: 53748 - DNA, 20 bp, Artificial Sequence
  chemically synthesized
attccagaagatggccggta

SEQ ID NO: 53749 - DNA, 20 bp, Artificial Sequence
  chemically synthesized
tcattccagaagatggccgg

SEQ ID NO: 53750 - DNA, 20 bp, Artificial Sequence
  chemically synthesized
acttcattccagaagatggc

SEQ ID NO: 53751 - DNA, 20 bp, Artificial Sequence
  chemically synthesized
cacctctaccggccatcttc

SEQ ID NO: 53752 - DNA, 20 bp, Artificial Sequence
  chemically synthesized
caaaacttcattccagaaga

SEQ ID NO: 53753 - DNA, 20 bp, Artificial Sequence
  chemically synthesized
atcacaaaacttcattccag

SEQ ID NO: 53754 - DNA, 20 bp, Artificial Sequence
  chemically synthesized
accggccatcttctggaatg

SEQ ID NO: 53755 - DNA, 20 bp, Artificial Sequence
  chemically synthesized
cctatcacaaaacttcattc

SEQ ID NO: 53756 - DNA, 20 bp, Artificial Sequence
  chemically synthesized
tctggaatgaagttttgtga

SEQ ID NO: 53757 - DNA, 20 bp, Artificial Sequence
  chemically synthesized
ctggaatgaagttttgtgat

SEQ ID NO: 53758 - DNA, 20 bp, Artificial Sequence
  chemically synthesized
atgaagttttgtgataggta

SEQ ID NO: 53759 - DNA, 20 bp, Artificial Sequence
  chemically synthesized
ttgtgataggtatagctctg

SEQ ID NO: 53760 - DNA, 20 bp, Artificial Sequence
  chemically synthesized
gcccaggttgttttgccgca

SEQ ID NO: 53761 - DNA, 20 bp, Artificial Sequence
  chemically synthesized
aagcccaggttgttttgccg

SEQ ID NO: 53762 - DNA, 20 bp, Artificial Sequence
  chemically synthesized
agctctgcggcaaaacaacc

SEQ ID NO: 53763 - DNA, 20 bp, Artificial Sequence
  chemically synthesized
gctctgcggcaaaacaacct

SEQ ID NO: 53764 - DNA, 20 bp, Artificial Sequence
  chemically synthesized
tctttgcattcaacaagccc

SEQ ID NO: 53765 - DNA, 20 bp, Artificial Sequence
  chemically synthesized
atctttgcattcaacaagcc

SEQ ID NO: 53766 - DNA, 20 bp, Artificial Sequence
  chemically synthesized
agttaatctttgcattcaac

SEQ ID NO: 53767 - DNA, 20 bp, Artificial Sequence
  chemically synthesized
acctgggcttgttgaatgca

SEQ ID NO: 53768 - DNA, 20 bp, Artificial Sequence
  chemically synthesized
aactcaaaggaaagacaatt

SEQ ID NO: 53769 - DNA, 20 bp, Artificial Sequence
  chemically synthesized
aactgaattgtctttccttt

SEQ ID NO: 53770 - DNA, 20 bp, Artificial Sequence
  chemically synthesized
acagaaataaactcaaagga

SEQ ID NO: 53771 - DNA, 20 bp, Artificial Sequence
  chemically synthesized
aaacacagaaataaactcaa

SEQ ID NO: 53772 - DNA, 20 bp, Artificial Sequence
  chemically synthesized
aaaacacagaaataaactca

SEQ ID NO: 53773 - DNA, 20 bp, Artificial Sequence
  chemically synthesized
gccctaatgtcaggaaaaca

SEQ ID NO: 53774 - DNA, 20 bp, Artificial Sequence
  chemically synthesized
tttctgtgttttcctgacat

SEQ ID NO: 53775 - DNA, 20 bp, Artificial Sequence
  chemically synthesized
ttctgtgttttcctgacatt

SEQ ID NO: 53776 - DNA, 20 bp, Artificial Sequence
  chemically synthesized
tctgtgttttcctgacatta

SEQ ID NO: 53777 - DNA, 20 bp, Artificial Sequence
  chemically synthesized
ctcctaagtgccctaatgtc

SEQ ID NO: 53778 - DNA, 20 bp, Artificial Sequence
  chemically synthesized
actcctaagtgccctaatgt

SEQ ID NO: 53779 - DNA, 20 bp, Artificial Sequence
  chemically synthesized
tttcctgacattagggcact

SEQ ID NO: 53780 - DNA, 20 bp, Artificial Sequence
  chemically synthesized
ttcctgacattagggcactt

SEQ ID NO: 53781 - DNA, 20 bp, Artificial Sequence
  chemically synthesized
cctgacattagggcacttag

SEQ ID NO: 53782 - DNA, 20 bp, Artificial Sequence
  chemically synthesized
agaaacactgtttaactcct

SEQ ID NO: 53783 - DNA, 20 bp, Artificial Sequence
  chemically synthesized
tagggcacttaggagttaaa

SEQ ID NO: 53784 - DNA, 20 bp, Artificial Sequence
  chemically synthesized
tctatcctgaagtcaaacgc

SEQ ID NO: 53785 - DNA, 20 bp, Artificial Sequence
  chemically synthesized
gtgtttcttgcgtttgactt

SEQ ID NO: 53786 - DNA, 20 bp, Artificial Sequence
  chemically synthesized
tgtttcttgcgtttgacttc

SEQ ID NO: 53787 - DNA, 20 bp, Artificial Sequence
  chemically synthesized
tcttgcgtttgacttcagga

SEQ ID NO: 53788 - DNA, 20 bp, Artificial Sequence
  chemically synthesized
gtttcccgtgatctatcctg

SEQ ID NO: 53789 - DNA, 20 bp, Artificial Sequence
  chemically synthesized
tttgacttcaggatagatca

SEQ ID NO: 53790 - DNA, 20 bp, Artificial Sequence
  chemically synthesized
ttgacttcaggatagatcac

SEQ ID NO: 53791 - DNA, 20 bp, Artificial Sequence
  chemically synthesized
gatagatcacgggaaacaac

SEQ ID NO: 53792 - DNA, 20 bp, Artificial Sequence
  chemically synthesized
agtgagtgccatgttagcac

SEQ ID NO: 53793 - DNA, 20 bp, Artificial Sequence
  chemically synthesized
ggaaacaactagtgctaaca

SEQ ID NO: 53794 - DNA, 20 bp, Artificial Sequence
  chemically synthesized
actcagagtgagtgccatgt

SEQ ID NO: 53795 - DNA, 20 bp, Artificial Sequence
  chemically synthesized
gctaacatggcactcactct

SEQ ID NO: 53796 - DNA, 20 bp, Artificial Sequence
  chemically synthesized
attatgctcctactcagagt

SEQ ID NO: 53797 - DNA, 20 bp, Artificial Sequence
  chemically synthesized
aacatggcactcactctgag

SEQ ID NO: 53798 - DNA, 20 bp, Artificial Sequence
  chemically synthesized
acatggcactcactctgagt

SEQ ID NO: 53799 - DNA, 20 bp, Artificial Sequence
  chemically synthesized
atggcactcactctgagtag

SEQ ID NO: 53800 - DNA, 20 bp, Artificial Sequence
  chemically synthesized
aagaattatgctcctactca

SEQ ID NO: 53801 - DNA, 20 bp, Artificial Sequence
  chemically synthesized
ttaagaattatgctcctact

SEQ ID NO: 53802 - DNA, 20 bp, Artificial Sequence
  chemically synthesized
agtaggagcataattcttaa

SEQ ID NO: 53803 - DNA, 20 bp, Artificial Sequence
  chemically synthesized
taagtcacacaaaatctatt

SEQ ID NO: 53804 - DNA, 20 bp, Artificial Sequence
  chemically synthesized
aatagattttgtgtgactta

SEQ ID NO: 53805 - DNA, 20 bp, Artificial Sequence
  chemically synthesized
ggcattagtatcaatgccat

SEQ ID NO: 53806 - DNA, 20 bp, Artificial Sequence
  chemically synthesized
ggtctcagatggcacggcat

SEQ ID NO: 53807 - DNA, 20 bp, Artificial Sequence
  chemically synthesized
aaggatggtctcagatggca

SEQ ID NO: 53808 - DNA, 20 bp, Artificial Sequence
  chemically synthesized
atactaatgccgtgccatct

SEQ ID NO: 53809 - DNA, 20 bp, Artificial Sequence
  chemically synthesized
agattaaggatggtctcaga

SEQ ID NO: 53810 - DNA, 20 bp, Artificial Sequence
  chemically synthesized
aggtagattaaggatggtct

SEQ ID NO: 53811 - DNA, 20 bp, Artificial Sequence
  chemically synthesized
cttaaaaggtagattaagga

SEQ ID NO: 53812 - DNA, 20 bp, Artificial Sequence
  chemically synthesized
gaaccttaaaaggtagatta

SEQ ID NO: 53813 - DNA, 20 bp, Artificial Sequence
  chemically synthesized
ggaaccttaaaaggtagatt

SEQ ID NO: 53814 - DNA, 20 bp, Artificial Sequence
  chemically synthesized
ccatccttaatctacctttt

SEQ ID NO: 53815 - DNA, 20 bp, Artificial Sequence
  chemically synthesized
catccttaatctacctttta

SEQ ID NO: 53816 - DNA, 20 bp, Artificial Sequence
  chemically synthesized
gatgcaggaaccttaaaagg

SEQ ID NO: 53817 - DNA, 20 bp, Artificial Sequence
  chemically synthesized
tgtgatgcaggaaccttaaa

SEQ ID NO: 53818 - DNA, 20 bp, Artificial Sequence
  chemically synthesized
ctgtgatgcaggaaccttaa

SEQ ID NO: 53819 - DNA, 20 bp, Artificial Sequence
  chemically synthesized
cttttaaggttcctgcatca

SEQ ID NO: 53820 - DNA, 20 bp, Artificial Sequence
  chemically synthesized
aggaaaaaaagctgtgatgc

SEQ ID NO: 53821 - DNA, 20 bp, Artificial Sequence
  chemically synthesized
aaggaaaaaaagctgtgatg

SEQ ID NO: 53822 - DNA, 20 bp, Artificial Sequence
  chemically synthesized
atataaaatggaaggaaaaa

SEQ ID NO: 53823 - DNA, 20 bp, Artificial Sequence
  chemically synthesized
gcacagaaatataaaatgga

SEQ ID NO: 53824 - DNA, 20 bp, Artificial Sequence
  chemically synthesized
agcacagaaatataaaatgg

SEQ ID NO: 53825 - DNA, 20 bp, Artificial Sequence
  chemically synthesized
gtcagcacagaaatataaaa

SEQ ID NO: 53826 - DNA, 20 bp, Artificial Sequence
  chemically synthesized
gattaagaaagaagtcagca

SEQ ID NO: 53827 - DNA, 20 bp, Artificial Sequence
  chemically synthesized
agtcagattaagaaagaagt

SEQ ID NO: 53828 - DNA, 20 bp, Artificial Sequence
  chemically synthesized
aaggagtcagattaagaaag

SEQ ID NO: 53829 - DNA, 20 bp, Artificial Sequence
  chemically synthesized
aaaaaggagtcagattaaga

SEQ ID NO: 53830 - DNA, 20 bp, Artificial Sequence
  chemically synthesized
ataaaaaaaggagtcagatt

SEQ ID NO: 53831 - DNA, 20 bp, Artificial Sequence
  chemically synthesized
gagggaataaaaaaaggagt

SEQ ID NO: 53832 - DNA, 20 bp, Artificial Sequence
  chemically synthesized
aaaggagggaataaaaaaag

SEQ ID NO: 53833 - DNA, 20 bp, Artificial Sequence
  chemically synthesized
aaaaaggagggaataaaaaa

SEQ ID NO: 53834 - DNA, 20 bp, Artificial Sequence
  chemically synthesized
gaaaaaggagggaataaaaa

SEQ ID NO: 53835 - DNA, 20 bp, Artificial Sequence
  chemically synthesized
gagaaaggacagaaaaagga

SEQ ID NO: 53836 - DNA, 20 bp, Artificial Sequence
  chemically synthesized
ggagaaaggacagaaaaagg

SEQ ID NO: 53837 - DNA, 20 bp, Artificial Sequence
  chemically synthesized
aggagaaaggacagaaaaag

SEQ ID NO: 53838 - DNA, 20 bp, Artificial Sequence
  chemically synthesized
ggaggagaaaggacagaaaa

SEQ ID NO: 53839 - DNA, 20 bp, Artificial Sequence
  chemically synthesized
tggaggagaaaggacagaaa

SEQ ID NO: 53840 - DNA, 20 bp, Artificial Sequence
  chemically synthesized
gagggctggaggagaaagga

SEQ ID NO: 53841 - DNA, 20 bp, Artificial Sequence
  chemically synthesized
gggggagggctggaggagaa

SEQ ID NO: 53842 - DNA, 20 bp, Artificial Sequence
  chemically synthesized
tttttctgtcctttctcctc

SEQ ID NO: 53843 - DNA, 20 bp, Artificial Sequence
  chemically synthesized
agggggagggctggaggaga

SEQ ID NO: 53844 - DNA, 20 bp, Artificial Sequence
  chemically synthesized
ataaagggggagggctggag

SEQ ID NO: 53845 - DNA, 20 bp, Artificial Sequence
  chemically synthesized
taataaagggggagggctgg

SEQ ID NO: 53846 - DNA, 20 bp, Artificial Sequence
  chemically synthesized
ataataaagggggagggctg

SEQ ID NO: 53847 - DNA, 20 bp, Artificial Sequence
  chemically synthesized
acataataaagggggagggc

SEQ ID NO: 53848 - DNA, 20 bp, Artificial Sequence
  chemically synthesized
tagaacataataaaggggga

SEQ ID NO: 53849 - DNA, 20 bp, Artificial Sequence
  chemically synthesized
atagaacataataaaggggg

SEQ ID NO: 53850 - DNA, 20 bp, Artificial Sequence
  chemically synthesized
tatagaacataataaagggg

SEQ ID NO: 53851 - DNA, 20 bp, Artificial Sequence
  chemically synthesized
tgtatagaacataataaagg

SEQ ID NO: 53852 - DNA, 20 bp, Artificial Sequence
  chemically synthesized
ttgtatagaacataataaag

SEQ ID NO: 53853 - DNA, 20 bp, Artificial Sequence
  chemically synthesized
gttgtatagaacataataaa

SEQ ID NO: 53854 - DNA, 20 bp, Artificial Sequence
  chemically synthesized
ggttgtatagaacataataa

SEQ ID NO: 53855 - DNA, 20 bp, Artificial Sequence
  chemically synthesized
aggttgtatagaacataata

SEQ ID NO: 53856 - DNA, 20 bp, Artificial Sequence
  chemically synthesized
tactcttctggtaggttgta

SEQ ID NO: 53857 - DNA, 20 bp, Artificial Sequence
  chemically synthesized
ttatgttctatacaacctac

SEQ ID NO: 53858 - DNA, 20 bp, Artificial Sequence
  chemically synthesized
tgttctatacaacctaccag

SEQ ID NO: 53859 - DNA, 20 bp, Artificial Sequence
  chemically synthesized
ttctatacaacctaccagaa

SEQ ID NO: 53860 - DNA, 20 bp, Artificial Sequence
  chemically synthesized
agtctgtgtactcttctggt

SEQ ID NO: 53861 - DNA, 20 bp, Artificial Sequence
  chemically synthesized
gagtctgtgtactcttctgg

SEQ ID NO: 53862 - DNA, 20 bp, Artificial Sequence
  chemically synthesized
gcagagtctgtgtactcttc

SEQ ID NO: 53863 - DNA, 20 bp, Artificial Sequence
  chemically synthesized
caacctaccagaagagtaca

SEQ ID NO: 53864 - DNA, 20 bp, Artificial Sequence
  chemically synthesized
aagagtacacagactctgct

SEQ ID NO: 53865 - DNA, 20 bp, Artificial Sequence
  chemically synthesized
agagtacacagactctgctg

SEQ ID NO: 53866 - DNA, 20 bp, Artificial Sequence
  chemically synthesized
aggcactgtttgcctcagca

SEQ ID NO: 53867 - DNA, 20 bp, Artificial Sequence
  chemically synthesized
tgaggcactgtttgcctcag

SEQ ID NO: 53868 - DNA, 20 bp, Artificial Sequence
  chemically synthesized
acagactctgctgaggcaaa

SEQ ID NO: 53869 - DNA, 20 bp, Artificial Sequence
  chemically synthesized
atttgaggcactgtttgcct

SEQ ID NO: 53870 - DNA, 20 bp, Artificial Sequence
  chemically synthesized
ggcaaacagtgcctcaaatg

SEQ ID NO: 53871 - DNA, 20 bp, Artificial Sequence
  chemically synthesized
gcaaacagtgcctcaaatga

SEQ ID NO: 53872 - DNA, 20 bp, Artificial Sequence
  chemically synthesized
atgcacagccccttcatttg

SEQ ID NO: 53873 - DNA, 20 bp, Artificial Sequence
  chemically synthesized
caaacagtgcctcaaatgaa

SEQ ID NO: 53874 - DNA, 20 bp, Artificial Sequence
  chemically synthesized
catgcacagccccttcattt

SEQ ID NO: 53875 - DNA, 20 bp, Artificial Sequence
  chemically synthesized
aaacagtgcctcaaatgaag

SEQ ID NO: 53876 - DNA, 20 bp, Artificial Sequence
  chemically synthesized
gcttgtcttgcaagcatgca

SEQ ID NO: 53877 - DNA, 20 bp, Artificial Sequence
  chemically synthesized
aaggggctgtgcatgcttgc

SEQ ID NO: 53878 - DNA, 20 bp, Artificial Sequence
  chemically synthesized
gctgtgcatgcttgcaagac

SEQ ID NO: 53879 - DNA, 20 bp, Artificial Sequence
  chemically synthesized
tcctgcctcgcttgtcttgc

SEQ ID NO: 53880 - DNA, 20 bp, Artificial Sequence
  chemically synthesized
tgcatgcttgcaagacaagc

SEQ ID NO: 53881 - DNA, 20 bp, Artificial Sequence
  chemically synthesized
gcatgcttgcaagacaagcg

SEQ ID NO: 53882 - DNA, 20 bp, Artificial Sequence
  chemically synthesized
tgcttgcaagacaagcgagg

SEQ ID NO: 53883 - DNA, 20 bp, Artificial Sequence
  chemically synthesized
gcttgcaagacaagcgaggc

SEQ ID NO: 53884 - DNA, 20 bp, Artificial Sequence
  chemically synthesized
caagcgaggcaggatatgaa

SEQ ID NO: 53885 - DNA, 20 bp, Artificial Sequence
  chemically synthesized
aagcgaggcaggatatgaat

SEQ ID NO: 53886 - DNA, 20 bp, Artificial Sequence
  chemically synthesized
caggatatgaataggactcc

SEQ ID NO: 53887 - DNA, 20 bp, Artificial Sequence
  chemically synthesized
tatgaataggactcctagcc

SEQ ID NO: 53888 - DNA, 20 bp, Artificial Sequence
  chemically synthesized
ttgggctggcactaggctag

SEQ ID NO: 53889 - DNA, 20 bp, Artificial Sequence
  chemically synthesized
cgttgggctggcactaggct

SEQ ID NO: 53890 - DNA, 20 bp, Artificial Sequence
  chemically synthesized
gcgttgggctggcactaggc

SEQ ID NO: 53891 - DNA, 20 bp, Artificial Sequence
  chemically synthesized
taggactcctagcctagtgc

SEQ ID NO: 53892 - DNA, 20 bp, Artificial Sequence
  chemically synthesized
agaagcgttgggctggcact

SEQ ID NO: 53893 - DNA, 20 bp, Artificial Sequence
  chemically synthesized
gagaagcgttgggctggcac

SEQ ID NO: 53894 - DNA, 20 bp, Artificial Sequence
  chemically synthesized
ttcttggagaagcgttgggc

SEQ ID NO: 53895 - DNA, 20 bp, Artificial Sequence
  chemically synthesized
aatgttcttggagaagcgtt

SEQ ID NO: 53896 - DNA, 20 bp, Artificial Sequence
  chemically synthesized
gaatgttcttggagaagcgt

SEQ ID NO: 53897 - DNA, 20 bp, Artificial Sequence
  chemically synthesized
tgccagcccaacgcttctcc

SEQ ID NO: 53898 - DNA, 20 bp, Artificial Sequence
  chemically synthesized
gaggaagaatgttcttggag

SEQ ID NO: 53899 - DNA, 20 bp, Artificial Sequence
  chemically synthesized
ttagaggaagaatgttcttg

SEQ ID NO: 53900 - DNA, 20 bp, Artificial Sequence
  chemically synthesized
aattagaggaagaatgttct

SEQ ID NO: 53901 - DNA, 20 bp, Artificial Sequence
  chemically synthesized
gagttcatcagaattagagg

SEQ ID NO: 53902 - DNA, 20 bp, Artificial Sequence
  chemically synthesized
gcagagttcatcagaattag

SEQ ID NO: 53903 - DNA, 20 bp, Artificial Sequence
  chemically synthesized
ggcagagttcatcagaatta

SEQ ID NO: 53904 - DNA, 20 bp, Artificial Sequence
  chemically synthesized
atggcagagttcatcagaat

SEQ ID NO: 53905 - DNA, 20 bp, Artificial Sequence
  chemically synthesized
agtttgatggcagagttcat

SEQ ID NO: 53906 - DNA, 20 bp, Artificial Sequence
  chemically synthesized
tgccttccagtttgatggca

SEQ ID NO: 53907 - DNA, 20 bp, Artificial Sequence
  chemically synthesized
cttgccttccagtttgatgg

SEQ ID NO: 53908 - DNA, 20 bp, Artificial Sequence
  chemically synthesized
gatgaactctgccatcaaac

SEQ ID NO: 53909 - DNA, 20 bp, Artificial Sequence
  chemically synthesized
tctcttgccttccagtttga

SEQ ID NO: 53910 - DNA, 20 bp, Artificial Sequence
  chemically synthesized
gaactctgccatcaaactgg

SEQ ID NO: 53911 - DNA, 20 bp, Artificial Sequence
  chemically synthesized
aactctgccatcaaactgga

SEQ ID NO: 53912 - DNA, 20 bp, Artificial Sequence
  chemically synthesized
ctgccatcaaactggaaggc

SEQ ID NO: 53913 - DNA, 20 bp, Artificial Sequence
  chemically synthesized
ttttgttctctcttgccttc

SEQ ID NO: 53914 - DNA, 20 bp, Artificial Sequence
  chemically synthesized
gccatcaaactggaaggcaa

SEQ ID NO: 53915 - DNA, 20 bp, Artificial Sequence
  chemically synthesized
catcaaactggaaggcaaga

SEQ ID NO: 53916 - DNA, 20 bp, Artificial Sequence
  chemically synthesized
gaaggcaagagagaacaaaa

SEQ ID NO: 53917 - DNA, 20 bp, Artificial Sequence
  chemically synthesized
gcaagagagaacaaaacagc

SEQ ID NO: 53918 - DNA, 20 bp, Artificial Sequence
  chemically synthesized
aaggcttaacaacggacaaa

SEQ ID NO: 53919 - DNA, 20 bp, Artificial Sequence
  chemically synthesized
taaaggcttaacaacggaca

SEQ ID NO: 53920 - DNA, 20 bp, Artificial Sequence
  chemically synthesized
caagctctttgtccgttgtt

SEQ ID NO: 53921 - DNA, 20 bp, Artificial Sequence
  chemically synthesized
aaagattaaaggcttaacaa

SEQ ID NO: 53922 - DNA, 20 bp, Artificial Sequence
  chemically synthesized
tcggtgaggtgaaagattaa

SEQ ID NO: 53923 - DNA, 20 bp, Artificial Sequence
  chemically synthesized
atcggtgaggtgaaagatta

SEQ ID NO: 53924 - DNA, 20 bp, Artificial Sequence
  chemically synthesized
tttagaaatcggtgaggtga

SEQ ID NO: 53925 - DNA, 20 bp, Artificial Sequence
  chemically synthesized
gtgcattttagaaatcggtg

SEQ ID NO: 53926 - DNA, 20 bp, Artificial Sequence
  chemically synthesized
agtgcattttagaaatcggt

SEQ ID NO: 53927 - DNA, 20 bp, Artificial Sequence
  chemically synthesized
ccaaagtgcattttagaaat

SEQ ID NO: 53928 - DNA, 20 bp, Artificial Sequence
  chemically synthesized
caaacatccaaagtgcattt

SEQ ID NO: 53929 - DNA, 20 bp, Artificial Sequence
  chemically synthesized
ccgatttctaaaatgcactt

SEQ ID NO: 53930 - DNA, 20 bp, Artificial Sequence
  chemically synthesized
aaccaataaacaaacatcca

SEQ ID NO: 53931 - DNA, 20 bp, Artificial Sequence
  chemically synthesized
cactttggatgtttgtttat

SEQ ID NO: 53932 - DNA, 20 bp, Artificial Sequence
  chemically synthesized
aatgaggcagttgcataagc

SEQ ID NO: 53933 - DNA, 20 bp, Artificial Sequence
  chemically synthesized
acagaatgaggcagttgcat

SEQ ID NO: 53934 - DNA, 20 bp, Artificial Sequence
  chemically synthesized
tccattatcacagaatgagg

SEQ ID NO: 53935 - DNA, 20 bp, Artificial Sequence
  chemically synthesized
gactccattatcacagaatg

SEQ ID NO: 53936 - DNA, 20 bp, Artificial Sequence
  chemically synthesized
tgactccattatcacagaat

SEQ ID NO: 53937 - DNA, 20 bp, Artificial Sequence
  chemically synthesized
actgcctcattctgtgataa

SEQ ID NO: 53938 - DNA, 20 bp, Artificial Sequence
  chemically synthesized
ataacctgactccattatca

SEQ ID NO: 53939 - DNA, 20 bp, Artificial Sequence
  chemically synthesized
tgcctcattctgtgataatg

SEQ ID NO: 53940 - DNA, 20 bp, Artificial Sequence
  chemically synthesized
tcattctgtgataatggagt

SEQ ID NO: 53941 - DNA, 20 bp, Artificial Sequence
  chemically synthesized
cattctgtgataatggagtc

SEQ ID NO: 53942 - DNA, 20 bp, Artificial Sequence
  chemically synthesized
tcaacattaaattgacttca

SEQ ID NO: 53943 - DNA, 20 bp, Artificial Sequence
  chemically synthesized
ttaaggtacttgggtctatg

SEQ ID NO: 53944 - DNA, 20 bp, Artificial Sequence
  chemically synthesized
taaattgacttcatagaccc

SEQ ID NO: 53945 - DNA, 20 bp, Artificial Sequence
  chemically synthesized
atgatacccttaaggtactt

SEQ ID NO: 53946 - DNA, 20 bp, Artificial Sequence
  chemically synthesized
aatgatacccttaaggtact

SEQ ID NO: 53947 - DNA, 20 bp, Artificial Sequence
  chemically synthesized
ttcatagacccaagtacctt

SEQ ID NO: 53948 - DNA, 20 bp, Artificial Sequence
  chemically synthesized
tcatagacccaagtacctta

SEQ ID NO: 53949 - DNA, 20 bp, Artificial Sequence
  chemically synthesized
catagacccaagtaccttaa

SEQ ID NO: 53950 - DNA, 20 bp, Artificial Sequence
  chemically synthesized
taaaatgaatgataccctta

SEQ ID NO: 53951 - DNA, 20 bp, Artificial Sequence
  chemically synthesized
ttaaaatgaatgataccctt

SEQ ID NO: 53952 - DNA, 20 bp, Artificial Sequence
  chemically synthesized
gggtatcattcattttaatt

SEQ ID NO: 53953 - DNA, 20 bp, Artificial Sequence
  chemically synthesized
tcattcattttaatttagaa

SEQ ID NO: 53954 - DNA, 20 bp, Artificial Sequence
  chemically synthesized
ttcattttaatttagaaaag

SEQ ID NO: 53955 - DNA, 20 bp, Artificial Sequence
  chemically synthesized
gacaaatgaaacaggatagg

SEQ ID NO: 53956 - DNA, 20 bp, Artificial Sequence
  chemically synthesized
tgacaaatgaaacaggatag

SEQ ID NO: 53957 - DNA, 20 bp, Artificial Sequence
  chemically synthesized
tttgacaaatgaaacaggat

SEQ ID NO: 53958 - DNA, 20 bp, Artificial Sequence
  chemically synthesized
ttttgacaaatgaaacagga

SEQ ID NO: 53959 - DNA, 20 bp, Artificial Sequence
  chemically synthesized
aagattttgacaaatgaaac

SEQ ID NO: 53960 - DNA, 20 bp, Artificial Sequence
  chemically synthesized
aaagattttgacaaatgaaa

SEQ ID NO: 53961 - DNA, 20 bp, Artificial Sequence
  chemically synthesized
gtttcatttgtcaaaatctt

SEQ ID NO: 53962 - DNA, 20 bp, Artificial Sequence
  chemically synthesized
tgtagatgtaattaaaacta

SEQ ID NO: 53963 - DNA, 20 bp, Artificial Sequence
  chemically synthesized
tttagttttaattacatcta

SEQ ID NO: 53964 - DNA, 20 bp, Artificial Sequence
  chemically synthesized
tcacaattttcataagtctg

SEQ ID NO: 53965 - DNA, 20 bp, Artificial Sequence
  chemically synthesized
cttcctgtcacaattttcat

SEQ ID NO: 53966 - DNA, 20 bp, Artificial Sequence
  chemically synthesized
cagacttatgaaaattgtga

SEQ ID NO: 53967 - DNA, 20 bp, Artificial Sequence
  chemically synthesized
agacttatgaaaattgtgac

SEQ ID NO: 53968 - DNA, 20 bp, Artificial Sequence
  chemically synthesized
cttatgaaaattgtgacagg

SEQ ID NO: 53969 - DNA, 20 bp, Artificial Sequence
  chemically synthesized
tatgaaaattgtgacaggaa

SEQ ID NO: 53970 - DNA, 20 bp, Artificial Sequence
  chemically synthesized
gaaaattgtgacaggaagag

SEQ ID NO: 53971 - DNA, 20 bp, Artificial Sequence
  chemically synthesized
aaattgtgacaggaagagaa

SEQ ID NO: 53972 - DNA, 20 bp, Artificial Sequence
  chemically synthesized
gacaggaagagaagagatca

SEQ ID NO: 53973 - DNA, 20 bp, Artificial Sequence
  chemically synthesized
acaggaagagaagagatcat

SEQ ID NO: 53974 - DNA, 20 bp, Artificial Sequence
  chemically synthesized
ggaagagaagagatcatagg

SEQ ID NO: 53975 - DNA, 20 bp, Artificial Sequence
  chemically synthesized
aaaaaaaaaaaaaaaggcag

SEQ ID NO: 53976 - DNA, 20 bp, Artificial Sequence
  chemically synthesized
aaaaaaaaaaaaaaaaaagg

SEQ ID NO: 53977 - DNA, 20 bp, Artificial Sequence
  chemically synthesized
aaaaaaaaaaaaaaaaaaaa

SEQ ID NO: 53978 - DNA, 20 bp, Artificial Sequence
  chemically synthesized
caaaaaaaaaaaaaaaaaaa

SEQ ID NO: 53979 - DNA, 20 bp, Artificial Sequence
  chemically synthesized
tttttttttttttttttttt

SEQ ID NO: 53980 - DNA, 20 bp, Artificial Sequence
  chemically synthesized
tttttttttttttttggtct

SEQ ID NO: 53981 - DNA, 20 bp, Artificial Sequence
  chemically synthesized
tttttttttttttggtctca

SEQ ID NO: 53982 - DNA, 20 bp, Artificial Sequence
  chemically synthesized
tttttttttttggtctcaga

SEQ ID NO: 53983 - DNA, 20 bp, Artificial Sequence
  chemically synthesized
aactttcctcttttctctct

SEQ ID NO: 53984 - DNA, 20 bp, Artificial Sequence
  chemically synthesized
ttttttggtctcagagagaa

SEQ ID NO: 53985 - DNA, 20 bp, Artificial Sequence
  chemically synthesized
ttttggtctcagagagaaaa

SEQ ID NO: 53986 - DNA, 20 bp, Artificial Sequence
  chemically synthesized
tttggtctcagagagaaaag

SEQ ID NO: 53987 - DNA, 20 bp, Artificial Sequence
  chemically synthesized
gtctcagagagaaaagagga

SEQ ID NO: 53988 - DNA, 20 bp, Artificial Sequence
  chemically synthesized
gaaagttgaattactttgcc

SEQ ID NO: 53989 - DNA, 20 bp, Artificial Sequence
  chemically synthesized
agttgaattactttgcctgg

SEQ ID NO: 53990 - DNA, 20 bp, Artificial Sequence
  chemically synthesized
gttacatcaccttccaggca

SEQ ID NO: 53991 - DNA, 20 bp, Artificial Sequence
  chemically synthesized
gttgaattactttgcctgga

SEQ ID NO: 53992 - DNA, 20 bp, Artificial Sequence
  chemically synthesized
atcaagttacatcaccttcc

SEQ ID NO: 53993 - DNA, 20 bp, Artificial Sequence
  chemically synthesized
tatcaagttacatcaccttc

SEQ ID NO: 53994 - DNA, 20 bp, Artificial Sequence
  chemically synthesized
gaaggtgatgtaacttgata

SEQ ID NO: 53995 - DNA, 20 bp, Artificial Sequence
  chemically synthesized
tttaagataaaatctgtatc

SEQ ID NO: 53996 - DNA, 20 bp, Artificial Sequence
  chemically synthesized
acagattttatcttaaaaaa

SEQ ID NO: 53997 - DNA, 20 bp, Artificial Sequence
  chemically synthesized
cagattttatcttaaaaaat

SEQ ID NO: 53998 - DNA, 20 bp, Artificial Sequence
  chemically synthesized
taaaagggaacctatttttt

SEQ ID NO: 53999 - DNA, 20 bp, Artificial Sequence
  chemically synthesized
aaaaataggttcccttttaa

SEQ ID NO: 54000 - DNA, 20 bp, Artificial Sequence
  chemically synthesized
cattaggaaaacttttaaaa

SEQ ID NO: 54001 - DNA, 20 bp, Artificial Sequence
  chemically synthesized
acattaggaaaacttttaaa

SEQ ID NO: 54002 - DNA, 20 bp, Artificial Sequence
  chemically synthesized
tacattaggaaaacttttaa

SEQ ID NO: 54003 - DNA, 20 bp, Artificial Sequence
  chemically synthesized
tgcaaatcatgagatacatt

SEQ ID NO: 54004 - DNA, 20 bp, Artificial Sequence
  chemically synthesized
ttgcaaatcatgagatacat

SEQ ID NO: 54005 - DNA, 20 bp, Artificial Sequence
  chemically synthesized
tagttcctgttgcaaatcat

SEQ ID NO: 54006 - DNA, 20 bp, Artificial Sequence
  chemically synthesized
atgtatctcatgatttgcaa

SEQ ID NO: 54007 - DNA, 20 bp, Artificial Sequence
  chemically synthesized
tgtatctcatgatttgcaac

SEQ ID NO: 54008 - DNA, 20 bp, Artificial Sequence
  chemically synthesized
atgatttgcaacaggaacta

SEQ ID NO: 54009 - DNA, 20 bp, Artificial Sequence
  chemically synthesized
ttgcaacaggaactaaagtc

SEQ ID NO: 54010 - DNA, 20 bp, Artificial Sequence
  chemically synthesized
aggtgagagccacttgactt

SEQ ID NO: 54011 - DNA, 20 bp, Artificial Sequence
  chemically synthesized
caacaggaactaaagtcaag

SEQ ID NO: 54012 - DNA, 20 bp, Artificial Sequence
  chemically synthesized
gtaatgatgttgtaaggtga

SEQ ID NO: 54013 - DNA, 20 bp, Artificial Sequence
  chemically synthesized
atgtaatgatgttgtaaggt

SEQ ID NO: 54014 - DNA, 20 bp, Artificial Sequence
  chemically synthesized
tttaatgtaatgatgttgta

SEQ ID NO: 54015 - DNA, 20 bp, Artificial Sequence
  chemically synthesized
atttaatgtaatgatgttgt

SEQ ID NO: 54016 - DNA, 20 bp, Artificial Sequence
  chemically synthesized
acattaaatcatttacattc

SEQ ID NO: 54017 - DNA, 20 bp, Artificial Sequence
  chemically synthesized
aatcatttacattccagcct

SEQ ID NO: 54018 - DNA, 20 bp, Artificial Sequence
  chemically synthesized
caagaataaatagctaaggc

SEQ ID NO: 54019 - DNA, 20 bp, Artificial Sequence
  chemically synthesized
agctcaagaataaatagcta

SEQ ID NO: 54020 - DNA, 20 bp, Artificial Sequence
  chemically synthesized
aagctcaagaataaatagct

SEQ ID NO: 54021 - DNA, 20 bp, Artificial Sequence
  chemically synthesized
aaataaagctcaagaataaa

SEQ ID NO: 54022 - DNA, 20 bp, Artificial Sequence
  chemically synthesized
agccttagctatttattctt

SEQ ID NO: 54023 - DNA, 20 bp, Artificial Sequence
  chemically synthesized
atgtggtataaataaagctc

SEQ ID NO: 54024 - DNA, 20 bp, Artificial Sequence
  chemically synthesized
ttccaaatgtggtataaata

SEQ ID NO: 54025 - DNA, 20 bp, Artificial Sequence
  chemically synthesized
agctttatttataccacatt

SEQ ID NO: 54026 - DNA, 20 bp, Artificial Sequence
  chemically synthesized
tttatttataccacatttgg

SEQ ID NO: 54027 - DNA, 20 bp, Artificial Sequence
  chemically synthesized
agaacgatatcttccaaatg

SEQ ID NO: 54028 - DNA, 20 bp, Artificial Sequence
  chemically synthesized
tttggaagatatcgttctca

SEQ ID NO: 54029 - DNA, 20 bp, Artificial Sequence
  chemically synthesized
tggcctcagaaaatttctgt

SEQ ID NO: 54030 - DNA, 20 bp, Artificial Sequence
  chemically synthesized
cgttctcacagaaattttct

SEQ ID NO: 54031 - DNA, 20 bp, Artificial Sequence
  chemically synthesized
gttctcacagaaattttctg

SEQ ID NO: 54032 - DNA, 20 bp, Artificial Sequence
  chemically synthesized
cagaaattttctgaggccat

SEQ ID NO: 54033 - DNA, 20 bp, Artificial Sequence
  chemically synthesized
aaggaatgctccaatggcct

SEQ ID NO: 54034 - DNA, 20 bp, Artificial Sequence
  chemically synthesized
gaaattttctgaggccattg

SEQ ID NO: 54035 - DNA, 20 bp, Artificial Sequence
  chemically synthesized
cctagaaaggaatgctccaa

SEQ ID NO: 54036 - DNA, 20 bp, Artificial Sequence
  chemically synthesized
gccattggagcattcctttc

SEQ ID NO: 54037 - DNA, 20 bp, Artificial Sequence
  chemically synthesized
ccattggagcattcctttct

SEQ ID NO: 54038 - DNA, 20 bp, Artificial Sequence
  chemically synthesized
cattggagcattcctttcta

SEQ ID NO: 54039 - DNA, 20 bp, Artificial Sequence
  chemically synthesized
attggagcattcctttctag

SEQ ID NO: 54040 - DNA, 20 bp, Artificial Sequence
  chemically synthesized
gggccaaaatgcccctagaa

SEQ ID NO: 54041 - DNA, 20 bp, Artificial Sequence
  chemically synthesized
tgggccaaaatgcccctaga

SEQ ID NO: 54042 - DNA, 20 bp, Artificial Sequence
  chemically synthesized
cttatgggccaaaatgcccc

SEQ ID NO: 54043 - DNA, 20 bp, Artificial Sequence
  chemically synthesized
attcctttctaggggcattt

SEQ ID NO: 54044 - DNA, 20 bp, Artificial Sequence
  chemically synthesized
ctaggggcattttggcccat

SEQ ID NO: 54045 - DNA, 20 bp, Artificial Sequence
  chemically synthesized
ggggcattttggcccataag

SEQ ID NO: 54046 - DNA, 20 bp, Artificial Sequence
  chemically synthesized
gtgaacattatgctacttat

SEQ ID NO: 54047 - DNA, 20 bp, Artificial Sequence
  chemically synthesized
tgtgaacattatgctactta

SEQ ID NO: 54048 - DNA, 20 bp, Artificial Sequence
  chemically synthesized
taagtagcataatgttcaca

SEQ ID NO: 54049 - DNA, 20 bp, Artificial Sequence
  chemically synthesized
aattacataattatgcctcc

SEQ ID NO: 54050 - DNA, 20 bp, Artificial Sequence
  chemically synthesized
tcctgtgttcaaataccagg

SEQ ID NO: 54051 - DNA, 20 bp, Artificial Sequence
  chemically synthesized
ctcctgtgttcaaataccag

SEQ ID NO: 54052 - DNA, 20 bp, Artificial Sequence
  chemically synthesized
tactcctgtgttcaaatacc

SEQ ID NO: 54053 - DNA, 20 bp, Artificial Sequence
  chemically synthesized
atactcctgtgttcaaatac

SEQ ID NO: 54054 - DNA, 20 bp, Artificial Sequence
  chemically synthesized
tgcctcctggtatttgaaca

SEQ ID NO: 54055 - DNA, 20 bp, Artificial Sequence
  chemically synthesized
gcctcctggtatttgaacac

SEQ ID NO: 54056 - DNA, 20 bp, Artificial Sequence
  chemically synthesized
ctcctggtatttgaacacag

SEQ ID NO: 54057 - DNA, 20 bp, Artificial Sequence
  chemically synthesized
ttgaacacaggagtatttcc

SEQ ID NO: 54058 - DNA, 20 bp, Artificial Sequence
  chemically synthesized
tgaacacaggagtatttcca

SEQ ID NO: 54059 - DNA, 20 bp, Artificial Sequence
  chemically synthesized
aaattgccacttttgttcct

SEQ ID NO: 54060 - DNA, 20 bp, Artificial Sequence
  chemically synthesized
ggagtatttccaaggaacaa

SEQ ID NO: 54061 - DNA, 20 bp, Artificial Sequence
  chemically synthesized
gtatttccaaggaacaaaag

SEQ ID NO: 54062 - DNA, 20 bp, Artificial Sequence
  chemically synthesized
tggcaatttgaaataatcat

SEQ ID NO: 54063 - DNA, 20 bp, Artificial Sequence
  chemically synthesized
aatttgaaataatcatcagt

SEQ ID NO: 54064 - DNA, 20 bp, Artificial Sequence
  chemically synthesized
taatcatcagtgagatacca

SEQ ID NO: 54065 - DNA, 20 bp, Artificial Sequence
  chemically synthesized
tcagtgagataccatagaac

SEQ ID NO: 54066 - DNA, 20 bp, Artificial Sequence
  chemically synthesized
ttcggacaataccagttcta

SEQ ID NO: 54067 - DNA, 20 bp, Artificial Sequence
  chemically synthesized
ttttttttttcggacaatac

SEQ ID NO: 54068 - DNA, 20 bp, Artificial Sequence
  chemically synthesized
gccgtctttttttttttttt

SEQ ID NO: 54069 - DNA, 20 bp, Artificial Sequence
  chemically synthesized
attgtccgaaaaaaaaaaaa

SEQ ID NO: 54070 - DNA, 20 bp, Artificial Sequence
  chemically synthesized
tccgaaaaaaaaaaaaaaga

SEQ ID NO: 54071 - DNA, 20 bp, Artificial Sequence
  chemically synthesized
aaaaaaaagacggcatatat

SEQ ID NO: 54072 - DNA, 20 bp, Artificial Sequence
  chemically synthesized
aaaaaaagacggcatatatt

SEQ ID NO: 54073 - DNA, 20 bp, Artificial Sequence
  chemically synthesized
atattaacgaatgactgaaa

SEQ ID NO: 54074 - DNA, 20 bp, Artificial Sequence
  chemically synthesized
tattaacgaatgactgaaac

SEQ ID NO: 54075 - DNA, 20 bp, Artificial Sequence
  chemically synthesized
taacgaatgactgaaacagg

SEQ ID NO: 54076 - DNA, 20 bp, Artificial Sequence
  chemically synthesized
ttgcatttatctacctgttt

SEQ ID NO: 54077 - DNA, 20 bp, Artificial Sequence
  chemically synthesized
aacaggtagataaatgcaaa

SEQ ID NO: 54078 - DNA, 20 bp, Artificial Sequence
  chemically synthesized
tagataaatgcaaaaagata

SEQ ID NO: 54079 - DNA, 20 bp, Artificial Sequence
  chemically synthesized
aatgcaaaaagataaagcac

SEQ ID NO: 54080 - DNA, 20 bp, Artificial Sequence
  chemically synthesized
agatgaaaatgtttgatttc

SEQ ID NO: 54081 - DNA, 20 bp, Artificial Sequence
  chemically synthesized
gaaatcaaacattttcatct

SEQ ID NO: 54082 - DNA, 20 bp, Artificial Sequence
  chemically synthesized
atcaaacattttcatctcag

SEQ ID NO: 54083 - DNA, 20 bp, Artificial Sequence
  chemically synthesized
aaacattttcatctcagtgg

SEQ ID NO: 54084 - DNA, 20 bp, Artificial Sequence
  chemically synthesized
atataaaagcttctgccact

SEQ ID NO: 54085 - DNA, 20 bp, Artificial Sequence
  chemically synthesized
cattttcatctcagtggcag

SEQ ID NO: 54086 - DNA, 20 bp, Artificial Sequence
  chemically synthesized
tattgttacccaaaatataa

SEQ ID NO: 54087 - DNA, 20 bp, Artificial Sequence
  chemically synthesized
tggcagaagcttttatattt

SEQ ID NO: 54088 - DNA, 20 bp, Artificial Sequence
  chemically synthesized
ggcagaagcttttatatttt

SEQ ID NO: 54089 - DNA, 20 bp, Artificial Sequence
  chemically synthesized
tttgggtaacaatatacttg

SEQ ID NO: 54090 - DNA, 20 bp, Artificial Sequence
  chemically synthesized
agaacaaactgaaaatctac

SEQ ID NO: 54091 - DNA, 20 bp, Artificial Sequence
  chemically synthesized
acaatatacttgtagatttt

SEQ ID NO: 54092 - DNA, 20 bp, Artificial Sequence
  chemically synthesized
tttattaaagaagtgtttag

SEQ ID NO: 54093 - DNA, 20 bp, Artificial Sequence
  chemically synthesized
gcctttattaaagaagtgtt

SEQ ID NO: 54094 - DNA, 20 bp, Artificial Sequence
  chemically synthesized
ccttccagcctttattaaag

SEQ ID NO: 54095 - DNA, 20 bp, Artificial Sequence
  chemically synthesized
tactaaacacttctttaata

SEQ ID NO: 54096 - DNA, 20 bp, Artificial Sequence
  chemically synthesized
actaaacacttctttaataa

SEQ ID NO: 54097 - DNA, 20 bp, Artificial Sequence
  chemically synthesized
cccccttccagcctttatta

SEQ ID NO: 54098 - DNA, 20 bp, Artificial Sequence
  chemically synthesized
aacacttctttaataaaggc

SEQ ID NO: 54099 - DNA, 20 bp, Artificial Sequence
  chemically synthesized
acttctttaataaaggctgg

SEQ ID NO: 54100 - DNA, 20 bp, Artificial Sequence
  chemically synthesized
cttctttaataaaggctgga

SEQ ID NO: 54101 - DNA, 20 bp, Artificial Sequence
  chemically synthesized
ttctttaataaaggctggaa

SEQ ID NO: 54102 - DNA, 20 bp, Artificial Sequence
  chemically synthesized
tctttaataaaggctggaag

SEQ ID NO: 54103 - DNA, 20 bp, Artificial Sequence
  chemically synthesized
ctttaataaaggctggaagg

SEQ ID NO: 54104 - DNA, 20 bp, Artificial Sequence
  chemically synthesized
cttcagcaaattcccccttc

SEQ ID NO: 54105 - DNA, 20 bp, Artificial Sequence
  chemically synthesized
ctggaagggggaatttgctg

SEQ ID NO: 54106 - DNA, 20 bp, Artificial Sequence
  chemically synthesized
ttaagggttgttgcagactt

SEQ ID NO: 54107 - DNA, 20 bp, Artificial Sequence
  chemically synthesized
tcctcggttaagggttgttg

SEQ ID NO: 54108 - DNA, 20 bp, Artificial Sequence
  chemically synthesized
gtctgcaacaacccttaacc

SEQ ID NO: 54109 - DNA, 20 bp, Artificial Sequence
  chemically synthesized
tctgcaacaacccttaaccg

SEQ ID NO: 54110 - DNA, 20 bp, Artificial Sequence
  chemically synthesized
gggttgatttcctcggttaa

SEQ ID NO: 54111 - DNA, 20 bp, Artificial Sequence
  chemically synthesized
agggttgatttcctcggtta

SEQ ID NO: 54112 - DNA, 20 bp, Artificial Sequence
  chemically synthesized
gagggttgatttcctcggtt

SEQ ID NO: 54113 - DNA, 20 bp, Artificial Sequence
  chemically synthesized
ttaaggagggttgatttcct

SEQ ID NO: 54114 - DNA, 20 bp, Artificial Sequence
  chemically synthesized
gatggtacgggatttaagga

SEQ ID NO: 54115 - DNA, 20 bp, Artificial Sequence
  chemically synthesized
ggatggtacgggatttaagg

SEQ ID NO: 54116 - DNA, 20 bp, Artificial Sequence
  chemically synthesized
aggatggtacgggatttaag

SEQ ID NO: 54117 - DNA, 20 bp, Artificial Sequence
  chemically synthesized
caaggatggtacgggattta

SEQ ID NO: 54118 - DNA, 20 bp, Artificial Sequence
  chemically synthesized
gcaaggatggtacgggattt

SEQ ID NO: 54119 - DNA, 20 bp, Artificial Sequence
  chemically synthesized
aaatgctgcaaggatggtac

SEQ ID NO: 54120 - DNA, 20 bp, Artificial Sequence
  chemically synthesized
gaaatgctgcaaggatggta

SEQ ID NO: 54121 - DNA, 20 bp, Artificial Sequence
  chemically synthesized
taaatcccgtaccatccttg

SEQ ID NO: 54122 - DNA, 20 bp, Artificial Sequence
  chemically synthesized
ctttggaaatgctgcaagga

SEQ ID NO: 54123 - DNA, 20 bp, Artificial Sequence
  chemically synthesized
gaagctttggaaatgctgca

SEQ ID NO: 54124 - DNA, 20 bp, Artificial Sequence
  chemically synthesized
ggaagctttggaaatgctgc

SEQ ID NO: 54125 - DNA, 20 bp, Artificial Sequence
  chemically synthesized
ccatccttgcagcatttcca

SEQ ID NO: 54126 - DNA, 20 bp, Artificial Sequence
  chemically synthesized
gagtcaaggtcaggaagctt

SEQ ID NO: 54127 - DNA, 20 bp, Artificial Sequence
  chemically synthesized
tgaagggagtcaaggtcagg

SEQ ID NO: 54128 - DNA, 20 bp, Artificial Sequence
  chemically synthesized
ctgtgaagggagtcaaggtc

SEQ ID NO: 54129 - DNA, 20 bp, Artificial Sequence
  chemically synthesized
actgtgaagggagtcaaggt

SEQ ID NO: 54130 - DNA, 20 bp, Artificial Sequence
  chemically synthesized
attgactgtgaagggagtca

SEQ ID NO: 54131 - DNA, 20 bp, Artificial Sequence
  chemically synthesized
aattgactgtgaagggagtc

SEQ ID NO: 54132 - DNA, 20 bp, Artificial Sequence
  chemically synthesized
cctgaccttgactcccttca

SEQ ID NO: 54133 - DNA, 20 bp, Artificial Sequence
  chemically synthesized
ggtcaaattgactgtgaagg

SEQ ID NO: 54134 - DNA, 20 bp, Artificial Sequence
  chemically synthesized
gtggtcaaattgactgtgaa

SEQ ID NO: 54135 - DNA, 20 bp, Artificial Sequence
  chemically synthesized
ggtggtcaaattgactgtga

SEQ ID NO: 54136 - DNA, 20 bp, Artificial Sequence
  chemically synthesized
tggtggtcaaattgactgtg

SEQ ID NO: 54137 - DNA, 20 bp, Artificial Sequence
  chemically synthesized
agtcaatttgaccaccactc

SEQ ID NO: 54138 - DNA, 20 bp, Artificial Sequence
  chemically synthesized
gtcaatttgaccaccactca

SEQ ID NO: 54139 - DNA, 20 bp, Artificial Sequence
  chemically synthesized
ggacaagcttccttgagtgg

SEQ ID NO: 54140 - DNA, 20 bp, Artificial Sequence
  chemically synthesized
aatttgaccaccactcaagg

SEQ ID NO: 54141 - DNA, 20 bp, Artificial Sequence
  chemically synthesized
ggcggacaagcttccttgag

SEQ ID NO: 54142 - DNA, 20 bp, Artificial Sequence
  chemically synthesized
tctggcggacaagcttcctt

SEQ ID NO: 54143 - DNA, 20 bp, Artificial Sequence
  chemically synthesized
actcaaggaagcttgtccgc

SEQ ID NO: 54144 - DNA, 20 bp, Artificial Sequence
  chemically synthesized
aacagggtcttctggcggac

SEQ ID NO: 54145 - DNA, 20 bp, Artificial Sequence
  chemically synthesized
caaggaagcttgtccgccag

SEQ ID NO: 54146 - DNA, 20 bp, Artificial Sequence
  chemically synthesized
gtggaaacagggtcttctgg

SEQ ID NO: 54147 - DNA, 20 bp, Artificial Sequence
  chemically synthesized
gaagtggaaacagggtcttc

SEQ ID NO: 54148 - DNA, 20 bp, Artificial Sequence
  chemically synthesized
agagccgggaagtggaaaca

SEQ ID NO: 54149 - DNA, 20 bp, Artificial Sequence
  chemically synthesized
gagagccgggaagtggaaac

SEQ ID NO: 54150 - DNA, 20 bp, Artificial Sequence
  chemically synthesized
ggagagccgggaagtggaaa

SEQ ID NO: 54151 - DNA, 20 bp, Artificial Sequence
  chemically synthesized
aagaccctgtttccacttcc

SEQ ID NO: 54152 - DNA, 20 bp, Artificial Sequence
  chemically synthesized
agaggaggagagccgggaag

SEQ ID NO: 54153 - DNA, 20 bp, Artificial Sequence
  chemically synthesized
gccagaggaggagagccggg

SEQ ID NO: 54154 - DNA, 20 bp, Artificial Sequence
  chemically synthesized
cttgccagaggaggagagcc

SEQ ID NO: 54155 - DNA, 20 bp, Artificial Sequence
  chemically synthesized
acttgccagaggaggagagc

SEQ ID NO: 54156 - DNA, 20 bp, Artificial Sequence
  chemically synthesized
agtcacttgccagaggagga

SEQ ID NO: 54157 - DNA, 20 bp, Artificial Sequence
  chemically synthesized
acttcccggctctcctcctc

SEQ ID NO: 54158 - DNA, 20 bp, Artificial Sequence
  chemically synthesized
tcagtcacttgccagaggag

SEQ ID NO: 54159 - DNA, 20 bp, Artificial Sequence
  chemically synthesized
tttcagtcacttgccagagg

SEQ ID NO: 54160 - DNA, 20 bp, Artificial Sequence
  chemically synthesized
cccggctctcctcctctggc

SEQ ID NO: 54161 - DNA, 20 bp, Artificial Sequence
  chemically synthesized
ttttcagtcacttgccagag

SEQ ID NO: 54162 - DNA, 20 bp, Artificial Sequence
  chemically synthesized
gcttttcagtcacttgccag

SEQ ID NO: 54163 - DNA, 20 bp, Artificial Sequence
  chemically synthesized
cgcttttcagtcacttgcca

SEQ ID NO: 54164 - DNA, 20 bp, Artificial Sequence
  chemically synthesized
ggcgcttttcagtcacttgc

SEQ ID NO: 54165 - DNA, 20 bp, Artificial Sequence
  chemically synthesized
tcctctggcaagtgactgaa

SEQ ID NO: 54166 - DNA, 20 bp, Artificial Sequence
  chemically synthesized
gagaaaagaaaggcgctttt

SEQ ID NO: 54167 - DNA, 20 bp, Artificial Sequence
  chemically synthesized
gcatcagtgagagaaaagaa

SEQ ID NO: 54168 - DNA, 20 bp, Artificial Sequence
  chemically synthesized
tgcatcagtgagagaaaaga

SEQ ID NO: 54169 - DNA, 20 bp, Artificial Sequence
  chemically synthesized
gttctgcatcagtgagagaa

SEQ ID NO: 54170 - DNA, 20 bp, Artificial Sequence
  chemically synthesized
tgtcagttctgcatcagtga

SEQ ID NO: 54171 - DNA, 20 bp, Artificial Sequence
  chemically synthesized
tttcttttctctcactgatg

SEQ ID NO: 54172 - DNA, 20 bp, Artificial Sequence
  chemically synthesized
tttgtcagttctgcatcagt

SEQ ID NO: 54173 - DNA, 20 bp, Artificial Sequence
  chemically synthesized
ctggtttgtcagttctgcat

SEQ ID NO: 54174 - DNA, 20 bp, Artificial Sequence
  chemically synthesized
ctgatgcagaactgacaaac

SEQ ID NO: 54175 - DNA, 20 bp, Artificial Sequence
  chemically synthesized
acggcttgatactggtttgt

SEQ ID NO: 54176 - DNA, 20 bp, Artificial Sequence
  chemically synthesized
agaactgacaaaccagtatc

SEQ ID NO: 54177 - DNA, 20 bp, Artificial Sequence
  chemically synthesized
tgtaaagaacggcttgatac

SEQ ID NO: 54178 - DNA, 20 bp, Artificial Sequence
  chemically synthesized
gtttattgatttgtaaagaa

SEQ ID NO: 54179 - DNA, 20 bp, Artificial Sequence
  chemically synthesized
ttccggtttattgatttgta

SEQ ID NO: 54180 - DNA, 20 bp, Artificial Sequence
  chemically synthesized
ttctttacaaatcaataaac

SEQ ID NO: 54181 - DNA, 20 bp, Artificial Sequence
  chemically synthesized
tttacaaatcaataaaccgg

SEQ ID NO: 54182 - DNA, 20 bp, Artificial Sequence
  chemically synthesized
gtacagtagatgagatcttc

SEQ ID NO: 54183 - DNA, 20 bp, Artificial Sequence
  chemically synthesized
gatttggaagtacagtagat

SEQ ID NO: 54184 - DNA, 20 bp, Artificial Sequence
  chemically synthesized
tgtaggatttggaagtacag

SEQ ID NO: 54185 - DNA, 20 bp, Artificial Sequence
  chemically synthesized
tgttgtaggatttggaagta

SEQ ID NO: 54186 - DNA, 20 bp, Artificial Sequence
  chemically synthesized
cagaatgttgtaggatttgg

SEQ ID NO: 54187 - DNA, 20 bp, Artificial Sequence
  chemically synthesized
agacagaatgttgtaggatt

SEQ ID NO: 54188 - DNA, 20 bp, Artificial Sequence
  chemically synthesized
gagagaagacagaatgttgt

SEQ ID NO: 54189 - DNA, 20 bp, Artificial Sequence
  chemically synthesized
agagagaagacagaatgttg

SEQ ID NO: 54190 - DNA, 20 bp, Artificial Sequence
  chemically synthesized
tatgcgaagaagagagaaga

SEQ ID NO: 54191 - DNA, 20 bp, Artificial Sequence
  chemically synthesized
atgatatgcgaagaagagag

SEQ ID NO: 54192 - DNA, 20 bp, Artificial Sequence
  chemically synthesized
cttatgatatgcgaagaaga

SEQ ID NO: 54193 - DNA, 20 bp, Artificial Sequence
  chemically synthesized
ggcttatgatatgcgaagaa

SEQ ID NO: 54194 - DNA, 20 bp, Artificial Sequence
  chemically synthesized
gtggcttatgatatgcgaag

SEQ ID NO: 54195 - DNA, 20 bp, Artificial Sequence
  chemically synthesized
cttgtggcttatgatatgcg

SEQ ID NO: 54196 - DNA, 20 bp, Artificial Sequence
  chemically synthesized
ctctcttcttcgcatatcat

SEQ ID NO: 54197 - DNA, 20 bp, Artificial Sequence
  chemically synthesized
cttcgcatatcataagccac

SEQ ID NO: 54198 - DNA, 20 bp, Artificial Sequence
  chemically synthesized
agcgtgaagtaaataacttg

SEQ ID NO: 54199 - DNA, 20 bp, Artificial Sequence
  chemically synthesized
gtcctttactaagaagcgtg

SEQ ID NO: 54200 - DNA, 20 bp, Artificial Sequence
  chemically synthesized
gttatttacttcacgcttct

SEQ ID NO: 54201 - DNA, 20 bp, Artificial Sequence
  chemically synthesized
ttacttcacgcttcttagta

SEQ ID NO: 54202 - DNA, 20 bp, Artificial Sequence
  chemically synthesized
atcccctgtcctttactaag

SEQ ID NO: 54203 - DNA, 20 bp, Artificial Sequence
  chemically synthesized
tacttcacgcttcttagtaa

SEQ ID NO: 54204 - DNA, 20 bp, Artificial Sequence
  chemically synthesized
tccatcccctgtcctttact

SEQ ID NO: 54205 - DNA, 20 bp, Artificial Sequence
  chemically synthesized
tcacgcttcttagtaaagga

SEQ ID NO: 54206 - DNA, 20 bp, Artificial Sequence
  chemically synthesized
cacgcttcttagtaaaggac

SEQ ID NO: 54207 - DNA, 20 bp, Artificial Sequence
  chemically synthesized
acgcttcttagtaaaggaca

SEQ ID NO: 54208 - DNA, 20 bp, Artificial Sequence
  chemically synthesized
cgcttcttagtaaaggacag

SEQ ID NO: 54209 - DNA, 20 bp, Artificial Sequence
  chemically synthesized
tcttagtaaaggacagggga

SEQ ID NO: 54210 - DNA, 20 bp, Artificial Sequence
  chemically synthesized
ttagtaaaggacaggggatg

SEQ ID NO: 54211 - DNA, 20 bp, Artificial Sequence
  chemically synthesized
tctacacagagaaacaatgg

SEQ ID NO: 54212 - DNA, 20 bp, Artificial Sequence
  chemically synthesized
acatctacacagagaaacaa

SEQ ID NO: 54213 - DNA, 20 bp, Artificial Sequence
  chemically synthesized
gcttccattgtttctctgtg

SEQ ID NO: 54214 - DNA, 20 bp, Artificial Sequence
  chemically synthesized
ggttctcacacatctacaca

SEQ ID NO: 54215 - DNA, 20 bp, Artificial Sequence
  chemically synthesized
ctggttctcacacatctaca

SEQ ID NO: 54216 - DNA, 20 bp, Artificial Sequence
  chemically synthesized
gtttctctgtgtagatgtgt

SEQ ID NO: 54217 - DNA, 20 bp, Artificial Sequence
  chemically synthesized
ctgtgtagatgtgtgagaac

SEQ ID NO: 54218 - DNA, 20 bp, Artificial Sequence
  chemically synthesized
ccatggcagagttttaattc

SEQ ID NO: 54219 - DNA, 20 bp, Artificial Sequence
  chemically synthesized
ccagaattaaaactctgcca

SEQ ID NO: 54220 - DNA, 20 bp, Artificial Sequence
  chemically synthesized
gagactgtgagtccatggca

SEQ ID NO: 54221 - DNA, 20 bp, Artificial Sequence
  chemically synthesized
tagagactgtgagtccatgg

SEQ ID NO: 54222 - DNA, 20 bp, Artificial Sequence
  chemically synthesized
ccgtagagactgtgagtcca

SEQ ID NO: 54223 - DNA, 20 bp, Artificial Sequence
  chemically synthesized
aaaactctgccatggactca

SEQ ID NO: 54224 - DNA, 20 bp, Artificial Sequence
  chemically synthesized
agagagaccgtagagactgt

SEQ ID NO: 54225 - DNA, 20 bp, Artificial Sequence
  chemically synthesized
ccatggactcacagtctcta

SEQ ID NO: 54226 - DNA, 20 bp, Artificial Sequence
  chemically synthesized
acagagggagagagaccgta

SEQ ID NO: 54227 - DNA, 20 bp, Artificial Sequence
  chemically synthesized
agacagagggagagagaccg

SEQ ID NO: 54228 - DNA, 20 bp, Artificial Sequence
  chemically synthesized
gcaaagaagacagagggaga

SEQ ID NO: 54229 - DNA, 20 bp, Artificial Sequence
  chemically synthesized
gtgcaaagaagacagaggga

SEQ ID NO: 54230 - DNA, 20 bp, Artificial Sequence
  chemically synthesized
gtgtgcaaagaagacagagg

SEQ ID NO: 54231 - DNA, 20 bp, Artificial Sequence
  chemically synthesized
aagtgtgcaaagaagacaga

SEQ ID NO: 54232 - DNA, 20 bp, Artificial Sequence
  chemically synthesized
gaagtgtgcaaagaagacag

SEQ ID NO: 54233 - DNA, 20 bp, Artificial Sequence
  chemically synthesized
agaagtgtgcaaagaagaca

SEQ ID NO: 54234 - DNA, 20 bp, Artificial Sequence
  chemically synthesized
tcagaagtgtgcaaagaaga

SEQ ID NO: 54235 - DNA, 20 bp, Artificial Sequence
  chemically synthesized
taggtcagaagtgtgcaaag

SEQ ID NO: 54236 - DNA, 20 bp, Artificial Sequence
  chemically synthesized
ggctaggtcagaagtgtgca

SEQ ID NO: 54237 - DNA, 20 bp, Artificial Sequence
  chemically synthesized
ttctttgcacacttctgacc

SEQ ID NO: 54238 - DNA, 20 bp, Artificial Sequence
  chemically synthesized
gaagaggagggctaggtcag

SEQ ID NO: 54239 - DNA, 20 bp, Artificial Sequence
  chemically synthesized
agagaagaggagggctaggt

SEQ ID NO: 54240 - DNA, 20 bp, Artificial Sequence
  chemically synthesized
ggggagagaagaggagggct

SEQ ID NO: 54241 - DNA, 20 bp, Artificial Sequence
  chemically synthesized
gggggagagaagaggagggc

SEQ ID NO: 54242 - DNA, 20 bp, Artificial Sequence
  chemically synthesized
ggcagggggagagaagagga

SEQ ID NO: 54243 - DNA, 20 bp, Artificial Sequence
  chemically synthesized
aggcagggggagagaagagg

SEQ ID NO: 54244 - DNA, 20 bp, Artificial Sequence
  chemically synthesized
gaggcagggggagagaagag

SEQ ID NO: 54245 - DNA, 20 bp, Artificial Sequence
  chemically synthesized
gggaggcagggggagagaag

SEQ ID NO: 54246 - DNA, 20 bp, Artificial Sequence
  chemically synthesized
agggaggcagggggagagaa

SEQ ID NO: 54247 - DNA, 20 bp, Artificial Sequence
  chemically synthesized
agagggaggcagggggagag

SEQ ID NO: 54248 - DNA, 20 bp, Artificial Sequence
  chemically synthesized
ggaagagggaggcaggggga

SEQ ID NO: 54249 - DNA, 20 bp, Artificial Sequence
  chemically synthesized
agggaagagggaggcagggg

SEQ ID NO: 54250 - DNA, 20 bp, Artificial Sequence
  chemically synthesized
tgagggaagagggaggcagg

SEQ ID NO: 54251 - DNA, 20 bp, Artificial Sequence
  chemically synthesized
atgagggaagagggaggcag

SEQ ID NO: 54252 - DNA, 20 bp, Artificial Sequence
  chemically synthesized
aatgagggaagagggaggca

SEQ ID NO: 54253 - DNA, 20 bp, Artificial Sequence
  chemically synthesized
gaatgagggaagagggaggc

SEQ ID NO: 54254 - DNA, 20 bp, Artificial Sequence
  chemically synthesized
ggaatgagggaagagggagg

SEQ ID NO: 54255 - DNA, 20 bp, Artificial Sequence
  chemically synthesized
gggggaatgagggaagaggg

SEQ ID NO: 54256 - DNA, 20 bp, Artificial Sequence
  chemically synthesized
agggggaatgagggaagagg

SEQ ID NO: 54257 - DNA, 20 bp, Artificial Sequence
  chemically synthesized
tgagggggaatgagggaaga

SEQ ID NO: 54258 - DNA, 20 bp, Artificial Sequence
  chemically synthesized
gtgagggggaatgagggaag

SEQ ID NO: 54259 - DNA, 20 bp, Artificial Sequence
  chemically synthesized
ggtgagggggaatgagggaa

SEQ ID NO: 54260 - DNA, 20 bp, Artificial Sequence
  chemically synthesized
ggggtgagggggaatgaggg

SEQ ID NO: 54261 - DNA, 20 bp, Artificial Sequence
  chemically synthesized
ggtggggtgagggggaatga

SEQ ID NO: 54262 - DNA, 20 bp, Artificial Sequence
  chemically synthesized
gggtggggtgagggggaatg

SEQ ID NO: 54263 - DNA, 20 bp, Artificial Sequence
  chemically synthesized
ggggtggggtgagggggaat

SEQ ID NO: 54264 - DNA, 20 bp, Artificial Sequence
  chemically synthesized
gccttgggggtggggtgagg

SEQ ID NO: 54265 - DNA, 20 bp, Artificial Sequence
  chemically synthesized
agccttgggggtggggtgag

SEQ ID NO: 54266 - DNA, 20 bp, Artificial Sequence
  chemically synthesized
cagccttgggggtggggtga

SEQ ID NO: 54267 - DNA, 20 bp, Artificial Sequence
  chemically synthesized
acagccttgggggtggggtg

SEQ ID NO: 54268 - DNA, 20 bp, Artificial Sequence
  chemically synthesized
aacagccttgggggtggggt

SEQ ID NO: 54269 - DNA, 20 bp, Artificial Sequence
  chemically synthesized
ttccccctcaccccaccccc

SEQ ID NO: 54270 - DNA, 20 bp, Artificial Sequence
  chemically synthesized
tacaaacagccttgggggtg

SEQ ID NO: 54271 - DNA, 20 bp, Artificial Sequence
  chemically synthesized
tccccctcaccccaccccca

SEQ ID NO: 54272 - DNA, 20 bp, Artificial Sequence
  chemically synthesized
ttacaaacagccttgggggt

SEQ ID NO: 54273 - DNA, 20 bp, Artificial Sequence
  chemically synthesized
cttacaaacagccttggggg

SEQ ID NO: 54274 - DNA, 20 bp, Artificial Sequence
  chemically synthesized
gagcttacaaacagccttgg

SEQ ID NO: 54275 - DNA, 20 bp, Artificial Sequence
  chemically synthesized
ggagcttacaaacagccttg

SEQ ID NO: 54276 - DNA, 20 bp, Artificial Sequence
  chemically synthesized
gggagcttacaaacagcctt

SEQ ID NO: 54277 - DNA, 20 bp, Artificial Sequence
  chemically synthesized
ggggagcttacaaacagcct

SEQ ID NO: 54278 - DNA, 20 bp, Artificial Sequence
  chemically synthesized
ccacccccaaggctgtttgt

SEQ ID NO: 54279 - DNA, 20 bp, Artificial Sequence
  chemically synthesized
gcatttggggagcttacaaa

SEQ ID NO: 54280 - DNA, 20 bp, Artificial Sequence
  chemically synthesized
aagtcttatgagcatttggg

SEQ ID NO: 54281 - DNA, 20 bp, Artificial Sequence
  chemically synthesized
gaaagtcttatgagcatttg

SEQ ID NO: 54282 - DNA, 20 bp, Artificial Sequence
  chemically synthesized
ggaaagtcttatgagcattt

SEQ ID NO: 54283 - DNA, 20 bp, Artificial Sequence
  chemically synthesized
aggaaagtcttatgagcatt

SEQ ID NO: 54284 - DNA, 20 bp, Artificial Sequence
  chemically synthesized
taagctccccaaatgctcat

SEQ ID NO: 54285 - DNA, 20 bp, Artificial Sequence
  chemically synthesized
atagttcaggaaagtcttat

SEQ ID NO: 54286 - DNA, 20 bp, Artificial Sequence
  chemically synthesized
atatctgaaatagttcagga

SEQ ID NO: 54287 - DNA, 20 bp, Artificial Sequence
  chemically synthesized
gaaaatatctgaaatagttc

SEQ ID NO: 54288 - DNA, 20 bp, Artificial Sequence
  chemically synthesized
tgaaaatatctgaaatagtt

SEQ ID NO: 54289 - DNA, 20 bp, Artificial Sequence
  chemically synthesized
aagactttcctgaactattt

SEQ ID NO: 54290 - DNA, 20 bp, Artificial Sequence
  chemically synthesized
tgaagtgaaaatatctgaaa

SEQ ID NO: 54291 - DNA, 20 bp, Artificial Sequence
  chemically synthesized
atagttttagtttagagttg

SEQ ID NO: 54292 - DNA, 20 bp, Artificial Sequence
  chemically synthesized
aacaaaatagttttagttta

SEQ ID NO: 54293 - DNA, 20 bp, Artificial Sequence
  chemically synthesized
aaaacaaaatagttttagtt

SEQ ID NO: 54294 - DNA, 20 bp, Artificial Sequence
  chemically synthesized
ttggaaaaacaaaatagttt

SEQ ID NO: 54295 - DNA, 20 bp, Artificial Sequence
  chemically synthesized
ccacatttggaaaaacaaaa

SEQ ID NO: 54296 - DNA, 20 bp, Artificial Sequence
  chemically synthesized
ctattttgtttttccaaatg

SEQ ID NO: 54297 - DNA, 20 bp, Artificial Sequence
  chemically synthesized
gcactatgtaaagccacatt

SEQ ID NO: 54298 - DNA, 20 bp, Artificial Sequence
  chemically synthesized
tttccaaatgtggctttaca

SEQ ID NO: 54299 - DNA, 20 bp, Artificial Sequence
  chemically synthesized
gtagttttctgcactatgta

SEQ ID NO: 54300 - DNA, 20 bp, Artificial Sequence
  chemically synthesized
aaatgtggctttacatagtg

SEQ ID NO: 54301 - DNA, 20 bp, Artificial Sequence
  chemically synthesized
ttacatagtgcagaaaacta

SEQ ID NO: 54302 - DNA, 20 bp, Artificial Sequence
  chemically synthesized
tacatagtgcagaaaactac

SEQ ID NO: 54303 - DNA, 20 bp, Artificial Sequence
  chemically synthesized
acatagtgcagaaaactaca

SEQ ID NO: 54304 - DNA, 20 bp, Artificial Sequence
  chemically synthesized
tactttggatgttttccctg

SEQ ID NO: 54305 - DNA, 20 bp, Artificial Sequence
  chemically synthesized
aactacagggaaaacatcca

SEQ ID NO: 54306 - DNA, 20 bp, Artificial Sequence
  chemically synthesized
taaaagatcacattgtactt

SEQ ID NO: 54307 - DNA, 20 bp, Artificial Sequence
  chemically synthesized
aagtacaatgtgatctttta

SEQ ID NO: 54308 - DNA, 20 bp, Artificial Sequence
  chemically synthesized
agtacaatgtgatcttttat

SEQ ID NO: 54309 - DNA, 20 bp, Artificial Sequence
  chemically synthesized
tacaatgtgatcttttatag

SEQ ID NO: 54310 - DNA, 20 bp, Artificial Sequence
  chemically synthesized
atcttttgtttctcctataa

SEQ ID NO: 54311 - DNA, 20 bp, Artificial Sequence
  chemically synthesized
atcttttataggagaaacaa

SEQ ID NO: 54312 - DNA, 20 bp, Artificial Sequence
  chemically synthesized
gaaacaaaagattgaatttc

SEQ ID NO: 54313 - DNA, 20 bp, Artificial Sequence
  chemically synthesized
aaacaaaagattgaatttct

SEQ ID NO: 54314 - DNA, 20 bp, Artificial Sequence
  chemically synthesized
tacctacttccatgatgacc

SEQ ID NO: 54315 - DNA, 20 bp, Artificial Sequence
  chemically synthesized
attgaatttctaggtcatca

SEQ ID NO: 54316 - DNA, 20 bp, Artificial Sequence
  chemically synthesized
gaatttctaggtcatcatgg

SEQ ID NO: 54317 - DNA, 20 bp, Artificial Sequence
  chemically synthesized
tttctaggtcatcatggaag

SEQ ID NO: 54318 - DNA, 20 bp, Artificial Sequence
  chemically synthesized
ttctaggtcatcatggaagt

SEQ ID NO: 54319 - DNA, 20 bp, Artificial Sequence
  chemically synthesized
tggaagtaggtacacttccc

SEQ ID NO: 54320 - DNA, 20 bp, Artificial Sequence
  chemically synthesized
ggaagtaggtacacttccct

SEQ ID NO: 54321 - DNA, 20 bp, Artificial Sequence
  chemically synthesized
cctcagattatcgcccaggg

SEQ ID NO: 54322 - DNA, 20 bp, Artificial Sequence
  chemically synthesized
gtacctcagattatcgccca

SEQ ID NO: 54323 - DNA, 20 bp, Artificial Sequence
  chemically synthesized
agtacctcagattatcgccc

SEQ ID NO: 54324 - DNA, 20 bp, Artificial Sequence
  chemically synthesized
aagtacctcagattatcgcc

SEQ ID NO: 54325 - DNA, 20 bp, Artificial Sequence
  chemically synthesized
acttccctgggcgataatct

SEQ ID NO: 54326 - DNA, 20 bp, Artificial Sequence
  chemically synthesized
cttccctgggcgataatctg

SEQ ID NO: 54327 - DNA, 20 bp, Artificial Sequence
  chemically synthesized
aagaagcttataaagtacct

SEQ ID NO: 54328 - DNA, 20 bp, Artificial Sequence
  chemically synthesized
gataatctgaggtactttat

SEQ ID NO: 54329 - DNA, 20 bp, Artificial Sequence
  chemically synthesized
gtgaaagaaagaagcttata

SEQ ID NO: 54330 - DNA, 20 bp, Artificial Sequence
  chemically synthesized
cttgctttcgtgaaagaaag

SEQ ID NO: 54331 - DNA, 20 bp, Artificial Sequence
  chemically synthesized
tttcttgctttcgtgaaaga

SEQ ID NO: 54332 - DNA, 20 bp, Artificial Sequence
  chemically synthesized
taagcttctttctttcacga

SEQ ID NO: 54333 - DNA, 20 bp, Artificial Sequence
  chemically synthesized
aggatttcttgctttcgtga

SEQ ID NO: 54334 - DNA, 20 bp, Artificial Sequence
  chemically synthesized
cttctttctttcacgaaagc

SEQ ID NO: 54335 - DNA, 20 bp, Artificial Sequence
  chemically synthesized
cacgtatcttgatggatttt

SEQ ID NO: 54336 - DNA, 20 bp, Artificial Sequence
  chemically synthesized
gcacgtatcttgatggattt

SEQ ID NO: 54337 - DNA, 20 bp, Artificial Sequence
  chemically synthesized
aagaaatcctaaaatccatc

SEQ ID NO: 54338 - DNA, 20 bp, Artificial Sequence
  chemically synthesized
gcacagtgcacgtatcttga

SEQ ID NO: 54339 - DNA, 20 bp, Artificial Sequence
  chemically synthesized
ttaaaaagagagttgaggca

SEQ ID NO: 54340 - DNA, 20 bp, Artificial Sequence
  chemically synthesized
gaggattaaaaagagagttg

SEQ ID NO: 54341 - DNA, 20 bp, Artificial Sequence
  chemically synthesized
tgaggattaaaaagagagtt

SEQ ID NO: 54342 - DNA, 20 bp, Artificial Sequence
  chemically synthesized
tcacttgaggattaaaaaga

SEQ ID NO: 54343 - DNA, 20 bp, Artificial Sequence
  chemically synthesized
tttcacttgaggattaaaaa

SEQ ID NO: 54344 - DNA, 20 bp, Artificial Sequence
  chemically synthesized
gatttcacttgaggattaaa

SEQ ID NO: 54345 - DNA, 20 bp, Artificial Sequence
  chemically synthesized
caactctctttttaatcctc

SEQ ID NO: 54346 - DNA, 20 bp, Artificial Sequence
  chemically synthesized
tactgtgttgatttcacttg

SEQ ID NO: 54347 - DNA, 20 bp, Artificial Sequence
  chemically synthesized
gtactgtgttgatttcactt

SEQ ID NO: 54348 - DNA, 20 bp, Artificial Sequence
  chemically synthesized
atcctcaagtgaaatcaaca

SEQ ID NO: 54349 - DNA, 20 bp, Artificial Sequence
  chemically synthesized
caagtgaaatcaacacagta

SEQ ID NO: 54350 - DNA, 20 bp, Artificial Sequence
  chemically synthesized
cagtgtaataaaaatgcata

SEQ ID NO: 54351 - DNA, 20 bp, Artificial Sequence
  chemically synthesized
aataaaaatgcatatagccc

SEQ ID NO: 54352 - DNA, 20 bp, Artificial Sequence
  chemically synthesized
ataaaaatgcatatagcccc

SEQ ID NO: 54353 - DNA, 20 bp, Artificial Sequence
  chemically synthesized
ttgctaaggcacaaagcctg

SEQ ID NO: 54354 - DNA, 20 bp, Artificial Sequence
  chemically synthesized
tttgctaaggcacaaagcct

SEQ ID NO: 54355 - DNA, 20 bp, Artificial Sequence
  chemically synthesized
ctttgctaaggcacaaagcc

SEQ ID NO: 54356 - DNA, 20 bp, Artificial Sequence
  chemically synthesized
tagccccaggctttgtgcct

SEQ ID NO: 54357 - DNA, 20 bp, Artificial Sequence
  chemically synthesized
tctctctttgctaaggcaca

SEQ ID NO: 54358 - DNA, 20 bp, Artificial Sequence
  chemically synthesized
ccaggctttgtgccttagca

SEQ ID NO: 54359 - DNA, 20 bp, Artificial Sequence
  chemically synthesized
aggctttgtgccttagcaaa

SEQ ID NO: 54360 - DNA, 20 bp, Artificial Sequence
  chemically synthesized
tattttttctctctttgcta

SEQ ID NO: 54361 - DNA, 20 bp, Artificial Sequence
  chemically synthesized
ttattttttctctctttgct

SEQ ID NO: 54362 - DNA, 20 bp, Artificial Sequence
  chemically synthesized
gctttgtgccttagcaaaga

SEQ ID NO: 54363 - DNA, 20 bp, Artificial Sequence
  chemically synthesized
ttagcaaagagagaaaaaat

SEQ ID NO: 54364 - DNA, 20 bp, Artificial Sequence
  chemically synthesized
agtagacatatgaagtcagg

SEQ ID NO: 54365 - DNA, 20 bp, Artificial Sequence
  chemically synthesized
cacagtagacatatgaagtc

SEQ ID NO: 54366 - DNA, 20 bp, Artificial Sequence
  chemically synthesized
tcacagtagacatatgaagt

SEQ ID NO: 54367 - DNA, 20 bp, Artificial Sequence
  chemically synthesized
ttattcacagtagacatatg

SEQ ID NO: 54368 - DNA, 20 bp, Artificial Sequence
  chemically synthesized
cagtgactgattattcacag

SEQ ID NO: 54369 - DNA, 20 bp, Artificial Sequence
  chemically synthesized
acgcagtgactgattattca

SEQ ID NO: 54370 - DNA, 20 bp, Artificial Sequence
  chemically synthesized
atatgtctactgtgaataat

SEQ ID NO: 54371 - DNA, 20 bp, Artificial Sequence
  chemically synthesized
ataatcagtcactgcgtttt

SEQ ID NO: 54372 - DNA, 20 bp, Artificial Sequence
  chemically synthesized
taatcagtcactgcgttttt

SEQ ID NO: 54373 - DNA, 20 bp, Artificial Sequence
  chemically synthesized
aaagcaaaatcccaaaaacg

SEQ ID NO: 54374 - DNA, 20 bp, Artificial Sequence
  chemically synthesized
tgctatacgttaagattata

SEQ ID NO: 54375 - DNA, 20 bp, Artificial Sequence
  chemically synthesized
tgctttataatcttaacgta

SEQ ID NO: 54376 - DNA, 20 bp, Artificial Sequence
  chemically synthesized
ggagttcactgctatacgtt

SEQ ID NO: 54377 - DNA, 20 bp, Artificial Sequence
  chemically synthesized
tttataatcttaacgtatag

SEQ ID NO: 54378 - DNA, 20 bp, Artificial Sequence
  chemically synthesized
cttgtcacaccacaaacatg

SEQ ID NO: 54379 - DNA, 20 bp, Artificial Sequence
  chemically synthesized
agcagtgaactccatgtttg

SEQ ID NO: 54380 - DNA, 20 bp, Artificial Sequence
  chemically synthesized
ttcttgtcacaccacaaaca

SEQ ID NO: 54381 - DNA, 20 bp, Artificial Sequence
  chemically synthesized
ctccatgtttgtggtgtgac

SEQ ID NO: 54382 - DNA, 20 bp, Artificial Sequence
  chemically synthesized
tttgtggtgtgacaagaata

SEQ ID NO: 54383 - DNA, 20 bp, Artificial Sequence
  chemically synthesized
ttgtggtgtgacaagaataa

SEQ ID NO: 54384 - DNA, 20 bp, Artificial Sequence
  chemically synthesized
acctgttttaaagaaagaaa

SEQ ID NO: 54385 - DNA, 20 bp, Artificial Sequence
  chemically synthesized
ggaacaacctgttttaaaga

SEQ ID NO: 54386 - DNA, 20 bp, Artificial Sequence
  chemically synthesized
ttctttttctttctttaaaa

SEQ ID NO: 54387 - DNA, 20 bp, Artificial Sequence
  chemically synthesized
tctttttctttctttaaaac

SEQ ID NO: 54388 - DNA, 20 bp, Artificial Sequence
  chemically synthesized
tatgggaacaacctgtttta

SEQ ID NO: 54389 - DNA, 20 bp, Artificial Sequence
  chemically synthesized
gtctctcttatggaaaatat

SEQ ID NO: 54390 - DNA, 20 bp, Artificial Sequence
  chemically synthesized
tgtctctcttatggaaaata

SEQ ID NO: 54391 - DNA, 20 bp, Artificial Sequence
  chemically synthesized
gttgttcccatattttccat

SEQ ID NO: 54392 - DNA, 20 bp, Artificial Sequence
  chemically synthesized
tgttcccatattttccataa

SEQ ID NO: 54393 - DNA, 20 bp, Artificial Sequence
  chemically synthesized
ttcccatattttccataaga

SEQ ID NO: 54394 - DNA, 20 bp, Artificial Sequence
  chemically synthesized
gccgacacatgtctctctta

SEQ ID NO: 54395 - DNA, 20 bp, Artificial Sequence
  chemically synthesized
tccataagagagacatgtgt

SEQ ID NO: 54396 - DNA, 20 bp, Artificial Sequence
  chemically synthesized
agagacatgtgtcggcttaa

SEQ ID NO: 54397 - DNA, 20 bp, Artificial Sequence
  chemically synthesized
attgtagtttcatttctttt

SEQ ID NO: 54398 - DNA, 20 bp, Artificial Sequence
  chemically synthesized
taaaagaaatgaaactacaa

SEQ ID NO: 54399 - DNA, 20 bp, Artificial Sequence
  chemically synthesized
attcctccctcacaccattg

SEQ ID NO: 54400 - DNA, 20 bp, Artificial Sequence
  chemically synthesized
aaatgaaactacaatggtgt

SEQ ID NO: 54401 - DNA, 20 bp, Artificial Sequence
  chemically synthesized
aatgaaactacaatggtgtg

SEQ ID NO: 54402 - DNA, 20 bp, Artificial Sequence
  chemically synthesized
atgaaactacaatggtgtga

SEQ ID NO: 54403 - DNA, 20 bp, Artificial Sequence
  chemically synthesized
gaaactacaatggtgtgagg

SEQ ID NO: 54404 - DNA, 20 bp, Artificial Sequence
  chemically synthesized
aaactacaatggtgtgaggg

SEQ ID NO: 54405 - DNA, 20 bp, Artificial Sequence
  chemically synthesized
aaatatacgctaacaatcag

SEQ ID NO: 54406 - DNA, 20 bp, Artificial Sequence
  chemically synthesized
gggaggaatctcctgattgt

SEQ ID NO: 54407 - DNA, 20 bp, Artificial Sequence
  chemically synthesized
gaaaatatacgctaacaatc

SEQ ID NO: 54408 - DNA, 20 bp, Artificial Sequence
  chemically synthesized
agaaaatatacgctaacaat

SEQ ID NO: 54409 - DNA, 20 bp, Artificial Sequence
  chemically synthesized
tgacaatttcaggtaaaatg

SEQ ID NO: 54410 - DNA, 20 bp, Artificial Sequence
  chemically synthesized
tacacttcgttgacaatttc

SEQ ID NO: 54411 - DNA, 20 bp, Artificial Sequence
  chemically synthesized
ctacacttcgttgacaattt

SEQ ID NO: 54412 - DNA, 20 bp, Artificial Sequence
  chemically synthesized
tttacctgaaattgtcaacg

SEQ ID NO: 54413 - DNA, 20 bp, Artificial Sequence
  chemically synthesized
ctgaaattgtcaacgaagtg

SEQ ID NO: 54414 - DNA, 20 bp, Artificial Sequence
  chemically synthesized
tgaaattgtcaacgaagtgt

SEQ ID NO: 54415 - DNA, 20 bp, Artificial Sequence
  chemically synthesized
ttgtcaacgaagtgtaggta

SEQ ID NO: 54416 - DNA, 20 bp, Artificial Sequence
  chemically synthesized
aacgaagtgtaggtaaagtt

SEQ ID NO: 54417 - DNA, 20 bp, Artificial Sequence
  chemically synthesized
acgaagtgtaggtaaagtta

SEQ ID NO: 54418 - DNA, 20 bp, Artificial Sequence
  chemically synthesized
aagtgtaggtaaagttaagg

SEQ ID NO: 54419 - DNA, 20 bp, Artificial Sequence
  chemically synthesized
agtgtaggtaaagttaaggc

SEQ ID NO: 54420 - DNA, 20 bp, Artificial Sequence
  chemically synthesized
gtgtaggtaaagttaaggcg

SEQ ID NO: 54421 - DNA, 20 bp, Artificial Sequence
  chemically synthesized
gtaaagttaaggcggggccc

SEQ ID NO: 54422 - DNA, 20 bp, Artificial Sequence
  chemically synthesized
taaagttaaggcggggccct

SEQ ID NO: 54423 - DNA, 20 bp, Artificial Sequence
  chemically synthesized
ccacgttattgaacagccta

SEQ ID NO: 54424 - DNA, 20 bp, Artificial Sequence
  chemically synthesized
gccacgttattgaacagcct

SEQ ID NO: 54425 - DNA, 20 bp, Artificial Sequence
  chemically synthesized
agccacgttattgaacagcc

SEQ ID NO: 54426 - DNA, 20 bp, Artificial Sequence
  chemically synthesized
atgttagccacgttattgaa

SEQ ID NO: 54427 - DNA, 20 bp, Artificial Sequence
  chemically synthesized
ccctaggctgttcaataacg

SEQ ID NO: 54428 - DNA, 20 bp, Artificial Sequence
  chemically synthesized
tcaataacgtggctaacatt

SEQ ID NO: 54429 - DNA, 20 bp, Artificial Sequence
  chemically synthesized
aaggccctcaaaccaaatgt

SEQ ID NO: 54430 - DNA, 20 bp, Artificial Sequence
  chemically synthesized
acgtggctaacatttggttt

SEQ ID NO: 54431 - DNA, 20 bp, Artificial Sequence
  chemically synthesized
cgtggctaacatttggtttg

SEQ ID NO: 54432 - DNA, 20 bp, Artificial Sequence
  chemically synthesized
gtggctaacatttggtttga

SEQ ID NO: 54433 - DNA, 20 bp, Artificial Sequence
  chemically synthesized
atttggtttgagggccttct

SEQ ID NO: 54434 - DNA, 20 bp, Artificial Sequence
  chemically synthesized
atttgggaacagaactgaga

SEQ ID NO: 54435 - DNA, 20 bp, Artificial Sequence
  chemically synthesized
tatttgggaacagaactgag

SEQ ID NO: 54436 - DNA, 20 bp, Artificial Sequence
  chemically synthesized
gactatttgggaacagaact

SEQ ID NO: 54437 - DNA, 20 bp, Artificial Sequence
  chemically synthesized
aaaggctgactatttgggaa

SEQ ID NO: 54438 - DNA, 20 bp, Artificial Sequence
  chemically synthesized
ttctcagttctgttcccaaa

SEQ ID NO: 54439 - DNA, 20 bp, Artificial Sequence
  chemically synthesized
cagttctgttcccaaatagt

SEQ ID NO: 54440 - DNA, 20 bp, Artificial Sequence
  chemically synthesized
gaaagaaaggctgactattt

SEQ ID NO: 54441 - DNA, 20 bp, Artificial Sequence
  chemically synthesized
ggaaagaaaggctgactatt

SEQ ID NO: 54442 - DNA, 20 bp, Artificial Sequence
  chemically synthesized
gacaagcagttgggaaagaa

SEQ ID NO: 54443 - DNA, 20 bp, Artificial Sequence
  chemically synthesized
ggacaagcagttgggaaaga

SEQ ID NO: 54444 - DNA, 20 bp, Artificial Sequence
  chemically synthesized
ctaaggacaagcagttggga

SEQ ID NO: 54445 - DNA, 20 bp, Artificial Sequence
  chemically synthesized
tcagctaaggacaagcagtt

SEQ ID NO: 54446 - DNA, 20 bp, Artificial Sequence
  chemically synthesized
atcagctaaggacaagcagt

SEQ ID NO: 54447 - DNA, 20 bp, Artificial Sequence
  chemically synthesized
actaatcagctaaggacaag

SEQ ID NO: 54448 - DNA, 20 bp, Artificial Sequence
  chemically synthesized
ctttcccaactgcttgtcct

SEQ ID NO: 54449 - DNA, 20 bp, Artificial Sequence
  chemically synthesized
tttactaatcagctaaggac

SEQ ID NO: 54450 - DNA, 20 bp, Artificial Sequence
  chemically synthesized
ggttatttactaatcagcta

SEQ ID NO: 54451 - DNA, 20 bp, Artificial Sequence
  chemically synthesized
actgcttgtccttagctgat

SEQ ID NO: 54452 - DNA, 20 bp, Artificial Sequence
  chemically synthesized
gggttatttactaatcagct

SEQ ID NO: 54453 - DNA, 20 bp, Artificial Sequence
  chemically synthesized
tcctagggttatttactaat

SEQ ID NO: 54454 - DNA, 20 bp, Artificial Sequence
  chemically synthesized
agctgattagtaaataaccc

SEQ ID NO: 54455 - DNA, 20 bp, Artificial Sequence
  chemically synthesized
gctgattagtaaataaccct

SEQ ID NO: 54456 - DNA, 20 bp, Artificial Sequence
  chemically synthesized
gattagtaaataaccctagg

SEQ ID NO: 54457 - DNA, 20 bp, Artificial Sequence
  chemically synthesized
aacaatcatttatcttccta

SEQ ID NO: 54458 - DNA, 20 bp, Artificial Sequence
  chemically synthesized
gaacaatcatttatcttcct

SEQ ID NO: 54459 - DNA, 20 bp, Artificial Sequence
  chemically synthesized
tgaacaatcatttatcttcc

SEQ ID NO: 54460 - DNA, 20 bp, Artificial Sequence
  chemically synthesized
agataaatgattgttcataa

SEQ ID NO: 54461 - DNA, 20 bp, Artificial Sequence
  chemically synthesized
gataaatgattgttcataac

SEQ ID NO: 54462 - DNA, 20 bp, Artificial Sequence
  chemically synthesized
gattgttcataacaggcttc

SEQ ID NO: 54463 - DNA, 20 bp, Artificial Sequence
  chemically synthesized
actcacagctgtggtactgg

SEQ ID NO: 54464 - DNA, 20 bp, Artificial Sequence
  chemically synthesized
ataacaggcttccagtacca

SEQ ID NO: 54465 - DNA, 20 bp, Artificial Sequence
  chemically synthesized
aatactcacagctgtggtac

SEQ ID NO: 54466 - DNA, 20 bp, Artificial Sequence
  chemically synthesized
gcttccagtaccacagctgt

SEQ ID NO: 54467 - DNA, 20 bp, Artificial Sequence
  chemically synthesized
aatgcaaatactcacagctg

SEQ ID NO: 54468 - DNA, 20 bp, Artificial Sequence
  chemically synthesized
acttaaaatgcaaatactca

SEQ ID NO: 54469 - DNA, 20 bp, Artificial Sequence
  chemically synthesized
gctgtgagtatttgcatttt

SEQ ID NO: 54470 - DNA, 20 bp, Artificial Sequence
  chemically synthesized
attaatggcttaattattta

SEQ ID NO: 54471 - DNA, 20 bp, Artificial Sequence
  chemically synthesized
aagtgcaactttaaataatt

SEQ ID NO: 54472 - DNA, 20 bp, Artificial Sequence
  chemically synthesized
ataagtatttgagtaattaa

SEQ ID NO: 54473 - DNA, 20 bp, Artificial Sequence
  chemically synthesized
taaacactcaataagtattt

SEQ ID NO: 54474 - DNA, 20 bp, Artificial Sequence
  chemically synthesized
taattactcaaatacttatt

SEQ ID NO: 54475 - DNA, 20 bp, Artificial Sequence
  chemically synthesized
gtgccttataaacactcaat

SEQ ID NO: 54476 - DNA, 20 bp, Artificial Sequence
  chemically synthesized
aatacttattgagtgtttat

SEQ ID NO: 54477 - DNA, 20 bp, Artificial Sequence
  chemically synthesized
atacttattgagtgtttata

SEQ ID NO: 54478 - DNA, 20 bp, Artificial Sequence
  chemically synthesized
gtgtttataaggcactttgc

SEQ ID NO: 54479 - DNA, 20 bp, Artificial Sequence
  chemically synthesized
tgtttataaggcactttgct

SEQ ID NO: 54480 - DNA, 20 bp, Artificial Sequence
  chemically synthesized
tttataaggcactttgctag

SEQ ID NO: 54481 - DNA, 20 bp, Artificial Sequence
  chemically synthesized
ttctgcttcctctcctagca

SEQ ID NO: 54482 - DNA, 20 bp, Artificial Sequence
  chemically synthesized
tataaggcactttgctagga

SEQ ID NO: 54483 - DNA, 20 bp, Artificial Sequence
  chemically synthesized
ataaggcactttgctaggag

SEQ ID NO: 54484 - DNA, 20 bp, Artificial Sequence
  chemically synthesized
aggcactttgctaggagagg

SEQ ID NO: 54485 - DNA, 20 bp, Artificial Sequence
  chemically synthesized
attttttctgcttcctctcc

SEQ ID NO: 54486 - DNA, 20 bp, Artificial Sequence
  chemically synthesized
cactttgctaggagaggaag

SEQ ID NO: 54487 - DNA, 20 bp, Artificial Sequence
  chemically synthesized
cagaaaaaataaaaataaat

SEQ ID NO: 54488 - DNA, 20 bp, Artificial Sequence
  chemically synthesized
ataaaaataaataagaaaac

SEQ ID NO: 54489 - DNA, 20 bp, Artificial Sequence
  chemically synthesized
taaaaataaataagaaaaca

SEQ ID NO: 54490 - DNA, 20 bp, Artificial Sequence
  chemically synthesized
aaaaataaataagaaaacaa

SEQ ID NO: 54491 - DNA, 20 bp, Artificial Sequence
  chemically synthesized
aaaataaataagaaaacaag

SEQ ID NO: 54492 - DNA, 20 bp, Artificial Sequence
  chemically synthesized
taaataagaaaacaagggga

SEQ ID NO: 54493 - DNA, 20 bp, Artificial Sequence
  chemically synthesized
gaaaacaaggggatggtctt

SEQ ID NO: 54494 - DNA, 20 bp, Artificial Sequence
  chemically synthesized
tcaaatctacaaattcacta

SEQ ID NO: 54495 - DNA, 20 bp, Artificial Sequence
  chemically synthesized
gatggtctttagtgaatttg

SEQ ID NO: 54496 - DNA, 20 bp, Artificial Sequence
  chemically synthesized
tagatttgatatttacaaat

SEQ ID NO: 54497 - DNA, 20 bp, Artificial Sequence
  chemically synthesized
atttacaaataagcataata

SEQ ID NO: 54498 - DNA, 20 bp, Artificial Sequence
  chemically synthesized
ataagcataataaagtatta

SEQ ID NO: 54499 - DNA, 20 bp, Artificial Sequence
  chemically synthesized
taagcataataaagtattat

SEQ ID NO: 54500 - DNA, 20 bp, Artificial Sequence
  chemically synthesized
cataataaagtattatggga

SEQ ID NO: 54501 - DNA, 20 bp, Artificial Sequence
  chemically synthesized
ttatgggaaagattttaatg

SEQ ID NO: 54502 - DNA, 20 bp, Artificial Sequence
  chemically synthesized
ggaaagattttaatgtagtg

SEQ ID NO: 54503 - DNA, 20 bp, Artificial Sequence
  chemically synthesized
tgtgatacactgtcaaattg

SEQ ID NO: 54504 - DNA, 20 bp, Artificial Sequence
  chemically synthesized
gcagtcattccccaatttga

SEQ ID NO: 54505 - DNA, 20 bp, Artificial Sequence
  chemically synthesized
ttgtgatacactgtcaaatt

SEQ ID NO: 54506 - DNA, 20 bp, Artificial Sequence
  chemically synthesized
gttgtgatacactgtcaaat

SEQ ID NO: 54507 - DNA, 20 bp, Artificial Sequence
  chemically synthesized
acagtgtatcacaactattt

SEQ ID NO: 54508 - DNA, 20 bp, Artificial Sequence
  chemically synthesized
ttttttgaaaagttctcaaa

SEQ ID NO: 54509 - DNA, 20 bp, Artificial Sequence
  chemically synthesized
agaatctgtatttttttgaa

SEQ ID NO: 54510 - DNA, 20 bp, Artificial Sequence
  chemically synthesized
gagaacttttcaaaaaaata

SEQ ID NO: 54511 - DNA, 20 bp, Artificial Sequence
  chemically synthesized
ttcaaaaaaatacagattct

SEQ ID NO: 54512 - DNA, 20 bp, Artificial Sequence
  chemically synthesized
agaaattatttagacgagct

SEQ ID NO: 54513 - DNA, 20 bp, Artificial Sequence
  chemically synthesized
aaatcagaaattatttagac

SEQ ID NO: 54514 - DNA, 20 bp, Artificial Sequence
  chemically synthesized
taactaaatcagaaattatt

SEQ ID NO: 54515 - DNA, 20 bp, Artificial Sequence
  chemically synthesized
cgtctaaataatttctgatt

SEQ ID NO: 54516 - DNA, 20 bp, Artificial Sequence
  chemically synthesized
cagcctcaaattaactaaat

SEQ ID NO: 54517 - DNA, 20 bp, Artificial Sequence
  chemically synthesized
atttctgatttagttaattt

SEQ ID NO: 54518 - DNA, 20 bp, Artificial Sequence
  chemically synthesized
tttctgatttagttaatttg

SEQ ID NO: 54519 - DNA, 20 bp, Artificial Sequence
  chemically synthesized
gatttagttaatttgaggct

SEQ ID NO: 54520 - DNA, 20 bp, Artificial Sequence
  chemically synthesized
atttagttaatttgaggctg

SEQ ID NO: 54521 - DNA, 20 bp, Artificial Sequence
  chemically synthesized
ttaatttgaggctgaggctt

SEQ ID NO: 54522 - DNA, 20 bp, Artificial Sequence
  chemically synthesized
aagtaaagattctcaagcct

SEQ ID NO: 54523 - DNA, 20 bp, Artificial Sequence
  chemically synthesized
taaagaaagtaaagattctc

SEQ ID NO: 54524 - DNA, 20 bp, Artificial Sequence
  chemically synthesized
gtggagacttaaagaaagta

SEQ ID NO: 54525 - DNA, 20 bp, Artificial Sequence
  chemically synthesized
tgagaatctttactttcttt

SEQ ID NO: 54526 - DNA, 20 bp, Artificial Sequence
  chemically synthesized
tatctgtggagacttaaaga

SEQ ID NO: 54527 - DNA, 20 bp, Artificial Sequence
  chemically synthesized
gaactatctgtggagactta

SEQ ID NO: 54528 - DNA, 20 bp, Artificial Sequence
  chemically synthesized
ttactttctttaagtctcca

SEQ ID NO: 54529 - DNA, 20 bp, Artificial Sequence
  chemically synthesized
tttctttaagtctccacaga

SEQ ID NO: 54530 - DNA, 20 bp, Artificial Sequence
  chemically synthesized
gtacatcagaactatctgtg

SEQ ID NO: 54531 - DNA, 20 bp, Artificial Sequence
  chemically synthesized
ctgtacatcagaactatctg

SEQ ID NO: 54532 - DNA, 20 bp, Artificial Sequence
  chemically synthesized
ccacagatagttctgatgta

SEQ ID NO: 54533 - DNA, 20 bp, Artificial Sequence
  chemically synthesized
atgtataccaggctgtacat

SEQ ID NO: 54534 - DNA, 20 bp, Artificial Sequence
  chemically synthesized
gatagttctgatgtacagcc

SEQ ID NO: 54535 - DNA, 20 bp, Artificial Sequence
  chemically synthesized
tacactgatggatgtatacc

SEQ ID NO: 54536 - DNA, 20 bp, Artificial Sequence
  chemically synthesized
ctacactgatggatgtatac

SEQ ID NO: 54537 - DNA, 20 bp, Artificial Sequence
  chemically synthesized
acagcctggtatacatccat

SEQ ID NO: 54538 - DNA, 20 bp, Artificial Sequence
  chemically synthesized
ctggtatacatccatcagtg

SEQ ID NO: 54539 - DNA, 20 bp, Artificial Sequence
  chemically synthesized
tggcatttccactacactga

SEQ ID NO: 54540 - DNA, 20 bp, Artificial Sequence
  chemically synthesized
gtatacatccatcagtgtag

SEQ ID NO: 54541 - DNA, 20 bp, Artificial Sequence
  chemically synthesized
ttcctgagtcataaaattcg

SEQ ID NO: 54542 - DNA, 20 bp, Artificial Sequence
  chemically synthesized
atgccacgaattttatgact

SEQ ID NO: 54543 - DNA, 20 bp, Artificial Sequence
  chemically synthesized
tgccacgaattttatgactc

SEQ ID NO: 54544 - DNA, 20 bp, Artificial Sequence
  chemically synthesized
cacgaattttatgactcagg

SEQ ID NO: 54545 - DNA, 20 bp, Artificial Sequence
  chemically synthesized
actccaactcaggtcttcct

SEQ ID NO: 54546 - DNA, 20 bp, Artificial Sequence
  chemically synthesized
tttatgactcaggaagacct

SEQ ID NO: 54547 - DNA, 20 bp, Artificial Sequence
  chemically synthesized
tgactcaggaagacctgagt

SEQ ID NO: 54548 - DNA, 20 bp, Artificial Sequence
  chemically synthesized
actcaggaagacctgagttg

SEQ ID NO: 54549 - DNA, 20 bp, Artificial Sequence
  chemically synthesized
ctagtaagggactccaactc

SEQ ID NO: 54550 - DNA, 20 bp, Artificial Sequence
  chemically synthesized
gctagtaagggactccaact

SEQ ID NO: 54551 - DNA, 20 bp, Artificial Sequence
  chemically synthesized
cctgagttggagtcccttac

SEQ ID NO: 54552 - DNA, 20 bp, Artificial Sequence
  chemically synthesized
gctggttaaatagctagtaa

SEQ ID NO: 54553 - DNA, 20 bp, Artificial Sequence
  chemically synthesized
tgctggttaaatagctagta

SEQ ID NO: 54554 - DNA, 20 bp, Artificial Sequence
  chemically synthesized
atgctggttaaatagctagt

SEQ ID NO: 54555 - DNA, 20 bp, Artificial Sequence
  chemically synthesized
taagatgctggttaaatagc

SEQ ID NO: 54556 - DNA, 20 bp, Artificial Sequence
  chemically synthesized
tcccttactagctatttaac

SEQ ID NO: 54557 - DNA, 20 bp, Artificial Sequence
  chemically synthesized
tagataagatgctggttaaa

SEQ ID NO: 54558 - DNA, 20 bp, Artificial Sequence
  chemically synthesized
caggctgttagataagatgc

SEQ ID NO: 54559 - DNA, 20 bp, Artificial Sequence
  chemically synthesized
ttaaccagcatcttatctaa

SEQ ID NO: 54560 - DNA, 20 bp, Artificial Sequence
  chemically synthesized
aggttcacaggctgttagat

SEQ ID NO: 54561 - DNA, 20 bp, Artificial Sequence
  chemically synthesized
aactaaggttcacaggctgt

SEQ ID NO: 54562 - DNA, 20 bp, Artificial Sequence
  chemically synthesized
ataaagaaactaaggttcac

SEQ ID NO: 54563 - DNA, 20 bp, Artificial Sequence
  chemically synthesized
atctaacagcctgtgaacct

SEQ ID NO: 54564 - DNA, 20 bp, Artificial Sequence
  chemically synthesized
cataaagaaactaaggttca

SEQ ID NO: 54565 - DNA, 20 bp, Artificial Sequence
  chemically synthesized
attaacacataaagaaacta

SEQ ID NO: 54566 - DNA, 20 bp, Artificial Sequence
  chemically synthesized
tattaacacataaagaaact

SEQ ID NO: 54567 - DNA, 20 bp, Artificial Sequence
  chemically synthesized
ggtatttctattaacacata

SEQ ID NO: 54568 - DNA, 20 bp, Artificial Sequence
  chemically synthesized
ttagtttctttatgtgttaa

SEQ ID NO: 54569 - DNA, 20 bp, Artificial Sequence
  chemically synthesized
ttgttggtagtgttgttatg

SEQ ID NO: 54570 - DNA, 20 bp, Artificial Sequence
  chemically synthesized
attattactgtcattgttgg

SEQ ID NO: 54571 - DNA, 20 bp, Artificial Sequence
  chemically synthesized
aacaacactaccaacaatga

SEQ ID NO: 54572 - DNA, 20 bp, Artificial Sequence
  chemically synthesized
gctattattactgtcattgt

SEQ ID NO: 54573 - DNA, 20 bp, Artificial Sequence
  chemically synthesized
accaacaatgacagtaataa

SEQ ID NO: 54574 - DNA, 20 bp, Artificial Sequence
  chemically synthesized
gtaataatagcaaacattta

SEQ ID NO: 54575 - DNA, 20 bp, Artificial Sequence
  chemically synthesized
aataatagcaaacatttata

SEQ ID NO: 54576 - DNA, 20 bp, Artificial Sequence
  chemically synthesized
tagagcatttactatatccc

SEQ ID NO: 54577 - DNA, 20 bp, Artificial Sequence
  chemically synthesized
ttgaaatagcacttgggata

SEQ ID NO: 54578 - DNA, 20 bp, Artificial Sequence
  chemically synthesized
atgctcttgaaatagcactt

SEQ ID NO: 54579 - DNA, 20 bp, Artificial Sequence
  chemically synthesized
aatgctcttgaaatagcact

SEQ ID NO: 54580 - DNA, 20 bp, Artificial Sequence
  chemically synthesized
tatatcccaagtgctatttc

SEQ ID NO: 54581 - DNA, 20 bp, Artificial Sequence
  chemically synthesized
tatcccaagtgctatttcaa

SEQ ID NO: 54582 - DNA, 20 bp, Artificial Sequence
  chemically synthesized
tacctataatgctcttgaaa

SEQ ID NO: 54583 - DNA, 20 bp, Artificial Sequence
  chemically synthesized
gtgctatttcaagagcatta

SEQ ID NO: 54584 - DNA, 20 bp, Artificial Sequence
  chemically synthesized
tgctatttcaagagcattat

SEQ ID NO: 54585 - DNA, 20 bp, Artificial Sequence
  chemically synthesized
ttcatttatgtctttcttat

SEQ ID NO: 54586 - DNA, 20 bp, Artificial Sequence
  chemically synthesized
aaatttaccttctgataaga

SEQ ID NO: 54587 - DNA, 20 bp, Artificial Sequence
  chemically synthesized
atttatgtctttcttatcag

SEQ ID NO: 54588 - DNA, 20 bp, Artificial Sequence
  chemically synthesized
tttatgtctttcttatcaga

SEQ ID NO: 54589 - DNA, 20 bp, Artificial Sequence
  chemically synthesized
catcaaatttaccttctgat

SEQ ID NO: 54590 - DNA, 20 bp, Artificial Sequence
  chemically synthesized
tatcagaaggtaaatttgat

SEQ ID NO: 54591 - DNA, 20 bp, Artificial Sequence
  chemically synthesized
atcagaaggtaaatttgatg

SEQ ID NO: 54592 - DNA, 20 bp, Artificial Sequence
  chemically synthesized
tcagaaggtaaatttgatga

SEQ ID NO: 54593 - DNA, 20 bp, Artificial Sequence
  chemically synthesized
gaaggtaaatttgatgaggg

SEQ ID NO: 54594 - DNA, 20 bp, Artificial Sequence
  chemically synthesized
aaggtaaatttgatgagggc

SEQ ID NO: 54595 - DNA, 20 bp, Artificial Sequence
  chemically synthesized
agtaatgaataaaatagatt

SEQ ID NO: 54596 - DNA, 20 bp, Artificial Sequence
  chemically synthesized
gggtacagtaatgaataaaa

SEQ ID NO: 54597 - DNA, 20 bp, Artificial Sequence
  chemically synthesized
tttattcattactgtacccc

SEQ ID NO: 54598 - DNA, 20 bp, Artificial Sequence
  chemically synthesized
ttattcattactgtaccccc

SEQ ID NO: 54599 - DNA, 20 bp, Artificial Sequence
  chemically synthesized
tgacctgggtcctgggggta

SEQ ID NO: 54600 - DNA, 20 bp, Artificial Sequence
  chemically synthesized
ggcactgacctgggtcctgg

SEQ ID NO: 54601 - DNA, 20 bp, Artificial Sequence
  chemically synthesized
attactgtacccccaggacc

SEQ ID NO: 54602 - DNA, 20 bp, Artificial Sequence
  chemically synthesized
aggcactgacctgggtcctg

SEQ ID NO: 54603 - DNA, 20 bp, Artificial Sequence
  chemically synthesized
ttactgtacccccaggaccc

SEQ ID NO: 54604 - DNA, 20 bp, Artificial Sequence
  chemically synthesized
caggcactgacctgggtcct

SEQ ID NO: 54605 - DNA, 20 bp, Artificial Sequence
  chemically synthesized
acaggcactgacctgggtcc

SEQ ID NO: 54606 - DNA, 20 bp, Artificial Sequence
  chemically synthesized
tgtacccccaggacccaggt

SEQ ID NO: 54607 - DNA, 20 bp, Artificial Sequence
  chemically synthesized
tatgagacaggcactgacct

SEQ ID NO: 54608 - DNA, 20 bp, Artificial Sequence
  chemically synthesized
ctatgagacaggcactgacc

SEQ ID NO: 54609 - DNA, 20 bp, Artificial Sequence
  chemically synthesized
ccaggtcagtgcctgtctca

SEQ ID NO: 54610 - DNA, 20 bp, Artificial Sequence
  chemically synthesized
ttaggtacctactatgagac

SEQ ID NO: 54611 - DNA, 20 bp, Artificial Sequence
  chemically synthesized
gttaggtacctactatgaga

SEQ ID NO: 54612 - DNA, 20 bp, Artificial Sequence
  chemically synthesized
ggtcagtgcctgtctcatag

SEQ ID NO: 54613 - DNA, 20 bp, Artificial Sequence
  chemically synthesized
gtcagtgcctgtctcatagt

SEQ ID NO: 54614 - DNA, 20 bp, Artificial Sequence
  chemically synthesized
gttagttaggtacctactat

SEQ ID NO: 54615 - DNA, 20 bp, Artificial Sequence
  chemically synthesized
attctttcaagtagttagtt

SEQ ID NO: 54616 - DNA, 20 bp, Artificial Sequence
  chemically synthesized
cattctttcaagtagttagt

SEQ ID NO: 54617 - DNA, 20 bp, Artificial Sequence
  chemically synthesized
tgttcattctttcaagtagt

SEQ ID NO: 54618 - DNA, 20 bp, Artificial Sequence
  chemically synthesized
gtacctaactaactacttga

SEQ ID NO: 54619 - DNA, 20 bp, Artificial Sequence
  chemically synthesized
gtgatgttcattctttcaag

SEQ ID NO: 54620 - DNA, 20 bp, Artificial Sequence
  chemically synthesized
atagtgatgttcattctttc

SEQ ID NO: 54621 - DNA, 20 bp, Artificial Sequence
  chemically synthesized
gaaagaatgaacatcactat

SEQ ID NO: 54622 - DNA, 20 bp, Artificial Sequence
  chemically synthesized
aaagaatgaacatcactatg

SEQ ID NO: 54623 - DNA, 20 bp, Artificial Sequence
  chemically synthesized
aatgaacatcactatgagga

SEQ ID NO: 54624 - DNA, 20 bp, Artificial Sequence
  chemically synthesized
actatggtgtactttcctca

SEQ ID NO: 54625 - DNA, 20 bp, Artificial Sequence
  chemically synthesized
actatgaggaaagtacacca

SEQ ID NO: 54626 - DNA, 20 bp, Artificial Sequence
  chemically synthesized
catctgtaaaatggtcacta

SEQ ID NO: 54627 - DNA, 20 bp, Artificial Sequence
  chemically synthesized
acaccatagtgaccatttta

SEQ ID NO: 54628 - DNA, 20 bp, Artificial Sequence
  chemically synthesized
ccatttcctcatctgtaaaa

SEQ ID NO: 54629 - DNA, 20 bp, Artificial Sequence
  chemically synthesized
atagtgaccattttacagat

SEQ ID NO: 54630 - DNA, 20 bp, Artificial Sequence
  chemically synthesized
tagtgaccattttacagatg

SEQ ID NO: 54631 - DNA, 20 bp, Artificial Sequence
  chemically synthesized
ccattttacagatgaggaaa

SEQ ID NO: 54632 - DNA, 20 bp, Artificial Sequence
  chemically synthesized
attttacagatgaggaaatg

SEQ ID NO: 54633 - DNA, 20 bp, Artificial Sequence
  chemically synthesized
ttttacagatgaggaaatgg

SEQ ID NO: 54634 - DNA, 20 bp, Artificial Sequence
  chemically synthesized
cagatgaggaaatggaggca

SEQ ID NO: 54635 - DNA, 20 bp, Artificial Sequence
  chemically synthesized
gatgaggaaatggaggcaca

SEQ ID NO: 54636 - DNA, 20 bp, Artificial Sequence
  chemically synthesized
gaaatggaggcacagagaat

SEQ ID NO: 54637 - DNA, 20 bp, Artificial Sequence
  chemically synthesized
atgagatgttgtaatgtgca

SEQ ID NO: 54638 - DNA, 20 bp, Artificial Sequence
  chemically synthesized
gatgttgtaatgtgcacagt

SEQ ID NO: 54639 - DNA, 20 bp, Artificial Sequence
  chemically synthesized
tgttgtaatgtgcacagttg

SEQ ID NO: 54640 - DNA, 20 bp, Artificial Sequence
  chemically synthesized
ttgtaatgtgcacagttgga

SEQ ID NO: 54641 - DNA, 20 bp, Artificial Sequence
  chemically synthesized
cagttggagagaccactttc

SEQ ID NO: 54642 - DNA, 20 bp, Artificial Sequence
  chemically synthesized
acataccgagtgccagaaag

SEQ ID NO: 54643 - DNA, 20 bp, Artificial Sequence
  chemically synthesized
agtacataccgagtgccaga

SEQ ID NO: 54644 - DNA, 20 bp, Artificial Sequence
  chemically synthesized
agagaccactttctggcact

SEQ ID NO: 54645 - DNA, 20 bp, Artificial Sequence
  chemically synthesized
aatgagtacataccgagtgc

SEQ ID NO: 54646 - DNA, 20 bp, Artificial Sequence
  chemically synthesized
cagaaaaatgagtacatacc

SEQ ID NO: 54647 - DNA, 20 bp, Artificial Sequence
  chemically synthesized
tttgcagttatcagaaaaat

SEQ ID NO: 54648 - DNA, 20 bp, Artificial Sequence
  chemically synthesized
ttctagcaatttgcagttat

SEQ ID NO: 54649 - DNA, 20 bp, Artificial Sequence
  chemically synthesized
aggcttgttctagcaatttg

SEQ ID NO: 54650 - DNA, 20 bp, Artificial Sequence
  chemically synthesized
ttctgataactgcaaattgc

SEQ ID NO: 54651 - DNA, 20 bp, Artificial Sequence
  chemically synthesized
taactgcaaattgctagaac

SEQ ID NO: 54652 - DNA, 20 bp, Artificial Sequence
  chemically synthesized
atagctgtttaggcttgttc

SEQ ID NO: 54653 - DNA, 20 bp, Artificial Sequence
  chemically synthesized
attgctagaacaagcctaaa

SEQ ID NO: 54654 - DNA, 20 bp, Artificial Sequence
  chemically synthesized
tgtaacccccatagctgttt

SEQ ID NO: 54655 - DNA, 20 bp, Artificial Sequence
  chemically synthesized
ctgtaacccccatagctgtt

SEQ ID NO: 54656 - DNA, 20 bp, Artificial Sequence
  chemically synthesized
agaacaagcctaaacagcta

SEQ ID NO: 54657 - DNA, 20 bp, Artificial Sequence
  chemically synthesized
gaacaagcctaaacagctat

SEQ ID NO: 54658 - DNA, 20 bp, Artificial Sequence
  chemically synthesized
aacaagcctaaacagctatg

SEQ ID NO: 54659 - DNA, 20 bp, Artificial Sequence
  chemically synthesized
acaagcctaaacagctatgg

SEQ ID NO: 54660 - DNA, 20 bp, Artificial Sequence
  chemically synthesized
cagatactctgtaaccccca

SEQ ID NO: 54661 - DNA, 20 bp, Artificial Sequence
  chemically synthesized
ctaaacagctatgggggtta

SEQ ID NO: 54662 - DNA, 20 bp, Artificial Sequence
  chemically synthesized
aaacagctatgggggttaca

SEQ ID NO: 54663 - DNA, 20 bp, Artificial Sequence
  chemically synthesized
tatgggggttacagagtatc

SEQ ID NO: 54664 - DNA, 20 bp, Artificial Sequence
  chemically synthesized
cctccttcattaatttcatc

SEQ ID NO: 54665 - DNA, 20 bp, Artificial Sequence
  chemically synthesized
gtatctggatgaaattaatg

SEQ ID NO: 54666 - DNA, 20 bp, Artificial Sequence
  chemically synthesized
tatctggatgaaattaatga

SEQ ID NO: 54667 - DNA, 20 bp, Artificial Sequence
  chemically synthesized
tctggatgaaattaatgaag

SEQ ID NO: 54668 - DNA, 20 bp, Artificial Sequence
  chemically synthesized
ctggatgaaattaatgaagg

SEQ ID NO: 54669 - DNA, 20 bp, Artificial Sequence
  chemically synthesized
gaaggaggttgctttgaaac

SEQ ID NO: 54670 - DNA, 20 bp, Artificial Sequence
  chemically synthesized
aaggaggttgctttgaaact

SEQ ID NO: 54671 - DNA, 20 bp, Artificial Sequence
  chemically synthesized
attgtgaaggcccagtttca

SEQ ID NO: 54672 - DNA, 20 bp, Artificial Sequence
  chemically synthesized
cttacccaattgtgaaggcc

SEQ ID NO: 54673 - DNA, 20 bp, Artificial Sequence
  chemically synthesized
tgaaactgggccttcacaat

SEQ ID NO: 54674 - DNA, 20 bp, Artificial Sequence
  chemically synthesized
aaaagcttacccaattgtga

SEQ ID NO: 54675 - DNA, 20 bp, Artificial Sequence
  chemically synthesized
gaaactgggccttcacaatt

SEQ ID NO: 54676 - DNA, 20 bp, Artificial Sequence
  chemically synthesized
caaaagcttacccaattgtg

SEQ ID NO: 54677 - DNA, 20 bp, Artificial Sequence
  chemically synthesized
ctgggccttcacaattgggt

SEQ ID NO: 54678 - DNA, 20 bp, Artificial Sequence
  chemically synthesized
acaattgggtaagcttttga

SEQ ID NO: 54679 - DNA, 20 bp, Artificial Sequence
  chemically synthesized
caattgggtaagcttttgat

SEQ ID NO: 54680 - DNA, 20 bp, Artificial Sequence
  chemically synthesized
cttctgtttttgcccatcaa

SEQ ID NO: 54681 - DNA, 20 bp, Artificial Sequence
  chemically synthesized
aagcttttgatgggcaaaaa

SEQ ID NO: 54682 - DNA, 20 bp, Artificial Sequence
  chemically synthesized
cttttgatgggcaaaaacag

SEQ ID NO: 54683 - DNA, 20 bp, Artificial Sequence
  chemically synthesized
caaaaacagaagaaacactc

SEQ ID NO: 54684 - DNA, 20 bp, Artificial Sequence
  chemically synthesized
aaaaacagaagaaacactct

SEQ ID NO: 54685 - DNA, 20 bp, Artificial Sequence
  chemically synthesized
cattctactcttgtcaccca

SEQ ID NO: 54686 - DNA, 20 bp, Artificial Sequence
  chemically synthesized
gaagaaacactctgggtgac

SEQ ID NO: 54687 - DNA, 20 bp, Artificial Sequence
  chemically synthesized
ctcattctactcttgtcacc

SEQ ID NO: 54688 - DNA, 20 bp, Artificial Sequence
  chemically synthesized
agaaacactctgggtgacaa

SEQ ID NO: 54689 - DNA, 20 bp, Artificial Sequence
  chemically synthesized
aacactctgggtgacaagag

SEQ ID NO: 54690 - DNA, 20 bp, Artificial Sequence
  chemically synthesized
ctgggtgacaagagtagaat

SEQ ID NO: 54691 - DNA, 20 bp, Artificial Sequence
  chemically synthesized
atgagcaatttttttttttt

SEQ ID NO: 54692 - DNA, 20 bp, Artificial Sequence
  chemically synthesized
aatttttttttttttggcac

SEQ ID NO: 54693 - DNA, 20 bp, Artificial Sequence
  chemically synthesized
ttttttttttggcactagta

SEQ ID NO: 54694 - DNA, 20 bp, Artificial Sequence
  chemically synthesized
tttttttttggcactagtaa

SEQ ID NO: 54695 - DNA, 20 bp, Artificial Sequence
  chemically synthesized
cttcatatccgggcctttac

SEQ ID NO: 54696 - DNA, 20 bp, Artificial Sequence
  chemically synthesized
ttttggcactagtaaaggcc

SEQ ID NO: 54697 - DNA, 20 bp, Artificial Sequence
  chemically synthesized
ctagtaaaggcccggatatg

SEQ ID NO: 54698 - DNA, 20 bp, Artificial Sequence
  chemically synthesized
tctgtttatccttcatatcc

SEQ ID NO: 54699 - DNA, 20 bp, Artificial Sequence
  chemically synthesized
tagtaaaggcccggatatga

SEQ ID NO: 54700 - DNA, 20 bp, Artificial Sequence
  chemically synthesized
ttctgtttatccttcatatc

SEQ ID NO: 54701 - DNA, 20 bp, Artificial Sequence
  chemically synthesized
gcccggatatgaaggataaa

SEQ ID NO: 54702 - DNA, 20 bp, Artificial Sequence
  chemically synthesized
atatgaaggataaacagaaa

SEQ ID NO: 54703 - DNA, 20 bp, Artificial Sequence
  chemically synthesized
atgaaggataaacagaaaaa

SEQ ID NO: 54704 - DNA, 20 bp, Artificial Sequence
  chemically synthesized
gaaaaagagttgaataatac

SEQ ID NO: 54705 - DNA, 20 bp, Artificial Sequence
  chemically synthesized
aaaaagagttgaataataca

SEQ ID NO: 54706 - DNA, 20 bp, Artificial Sequence
  chemically synthesized
agagttgaataatacaaggc

SEQ ID NO: 54707 - DNA, 20 bp, Artificial Sequence
  chemically synthesized
ataatacaaggctagaaatg

SEQ ID NO: 54708 - DNA, 20 bp, Artificial Sequence
  chemically synthesized
ttgactccaagctacatttc

SEQ ID NO: 54709 - DNA, 20 bp, Artificial Sequence
  chemically synthesized
acaaggctagaaatgtagct

SEQ ID NO: 54710 - DNA, 20 bp, Artificial Sequence
  chemically synthesized
aaggctagaaatgtagcttg

SEQ ID NO: 54711 - DNA, 20 bp, Artificial Sequence
  chemically synthesized
tacagctctggtttgactcc

SEQ ID NO: 54712 - DNA, 20 bp, Artificial Sequence
  chemically synthesized
aatgtagcttggagtcaaac

SEQ ID NO: 54713 - DNA, 20 bp, Artificial Sequence
  chemically synthesized
tgtagcttggagtcaaacca

SEQ ID NO: 54714 - DNA, 20 bp, Artificial Sequence
  chemically synthesized
ctgacagtcaagtacagctc

SEQ ID NO: 54715 - DNA, 20 bp, Artificial Sequence
  chemically synthesized
ttaaacctgacagtcaagta

SEQ ID NO: 54716 - DNA, 20 bp, Artificial Sequence
  chemically synthesized
ccagagctgtacttgactgt

SEQ ID NO: 54717 - DNA, 20 bp, Artificial Sequence
  chemically synthesized
cagagctgtacttgactgtc

SEQ ID NO: 54718 - DNA, 20 bp, Artificial Sequence
  chemically synthesized
tattcttaaacctgacagtc

SEQ ID NO: 54719 - DNA, 20 bp, Artificial Sequence
  chemically synthesized
gtctctattcttaaacctga

SEQ ID NO: 54720 - DNA, 20 bp, Artificial Sequence
  chemically synthesized
tgtacttgactgtcaggttt

SEQ ID NO: 54721 - DNA, 20 bp, Artificial Sequence
  chemically synthesized
ttgactgtcaggtttaagaa

SEQ ID NO: 54722 - DNA, 20 bp, Artificial Sequence
  chemically synthesized
gactgtcaggtttaagaata

SEQ ID NO: 54723 - DNA, 20 bp, Artificial Sequence
  chemically synthesized
ttaagaatagagacttcatt

SEQ ID NO: 54724 - DNA, 20 bp, Artificial Sequence
  chemically synthesized
ttcccatgaacaactaaatg

SEQ ID NO: 54725 - DNA, 20 bp, Artificial Sequence
  chemically synthesized
agacttcatttagttgttca

SEQ ID NO: 54726 - DNA, 20 bp, Artificial Sequence
  chemically synthesized
gacttcatttagttgttcat

SEQ ID NO: 54727 - DNA, 20 bp, Artificial Sequence
  chemically synthesized
ttcatttagttgttcatggg

SEQ ID NO: 54728 - DNA, 20 bp, Artificial Sequence
  chemically synthesized
tcatttagttgttcatggga

SEQ ID NO: 54729 - DNA, 20 bp, Artificial Sequence
  chemically synthesized
tatcatgtgaatgcatttga

SEQ ID NO: 54730 - DNA, 20 bp, Artificial Sequence
  chemically synthesized
ttcacatgataataaaattc

SEQ ID NO: 54731 - DNA, 20 bp, Artificial Sequence
  chemically synthesized
aaattcaagaaaaacaaaaa

SEQ ID NO: 54732 - DNA, 20 bp, Artificial Sequence
  chemically synthesized
aaaaaagttatttaaaaatc

SEQ ID NO: 54733 - DNA, 20 bp, Artificial Sequence
  chemically synthesized
tagagagacatggtgaaaga

SEQ ID NO: 54734 - DNA, 20 bp, Artificial Sequence
  chemically synthesized
gctagagagacatggtgaaa

SEQ ID NO: 54735 - DNA, 20 bp, Artificial Sequence
  chemically synthesized
tggctagagagacatggtga

SEQ ID NO: 54736 - DNA, 20 bp, Artificial Sequence
  chemically synthesized
agaaaatggctagagagaca

SEQ ID NO: 54737 - DNA, 20 bp, Artificial Sequence
  chemically synthesized
tctctttcaccatgtctctc

SEQ ID NO: 54738 - DNA, 20 bp, Artificial Sequence
  chemically synthesized
tggggaagaaaatggctaga

SEQ ID NO: 54739 - DNA, 20 bp, Artificial Sequence
  chemically synthesized
aatggggaagaaaatggcta

SEQ ID NO: 54740 - DNA, 20 bp, Artificial Sequence
  chemically synthesized
ggaatggggaagaaaatggc

SEQ ID NO: 54741 - DNA, 20 bp, Artificial Sequence
  chemically synthesized
tcagggaatggggaagaaaa

SEQ ID NO: 54742 - DNA, 20 bp, Artificial Sequence
  chemically synthesized
cttgccatcagggaatgggg

SEQ ID NO: 54743 - DNA, 20 bp, Artificial Sequence
  chemically synthesized
atacttgccatcagggaatg

SEQ ID NO: 54744 - DNA, 20 bp, Artificial Sequence
  chemically synthesized
aatacttgccatcagggaat

SEQ ID NO: 54745 - DNA, 20 bp, Artificial Sequence
  chemically synthesized
aaatacttgccatcagggaa

SEQ ID NO: 54746 - DNA, 20 bp, Artificial Sequence
  chemically synthesized
ttttcttccccattccctga

SEQ ID NO: 54747 - DNA, 20 bp, Artificial Sequence
  chemically synthesized
cttccccattccctgatggc

SEQ ID NO: 54748 - DNA, 20 bp, Artificial Sequence
  chemically synthesized
tatggaaatacttgccatca

SEQ ID NO: 54749 - DNA, 20 bp, Artificial Sequence
  chemically synthesized
gtatggaaatacttgccatc

SEQ ID NO: 54750 - DNA, 20 bp, Artificial Sequence
  chemically synthesized
agtatggaaatacttgccat

SEQ ID NO: 54751 - DNA, 20 bp, Artificial Sequence
  chemically synthesized
taaaaaattaatgtagagta

SEQ ID NO: 54752 - DNA, 20 bp, Artificial Sequence
  chemically synthesized
ttacttaaaaaattaatgta

SEQ ID NO: 54753 - DNA, 20 bp, Artificial Sequence
  chemically synthesized
tcttacttaaaaaattaatg

SEQ ID NO: 54754 - DNA, 20 bp, Artificial Sequence
  chemically synthesized
atactctacattaatttttt

SEQ ID NO: 54755 - DNA, 20 bp, Artificial Sequence
  chemically synthesized
tctacattaattttttaagt

SEQ ID NO: 54756 - DNA, 20 bp, Artificial Sequence
  chemically synthesized
aagtaagaaaaatattacgt

SEQ ID NO: 54757 - DNA, 20 bp, Artificial Sequence
  chemically synthesized
cgttggtgcaaatgtgatcg

SEQ ID NO: 54758 - DNA, 20 bp, Artificial Sequence
  chemically synthesized
gatcgcagtttttgccattg

SEQ ID NO: 54759 - DNA, 20 bp, Artificial Sequence
  chemically synthesized
atcgcagtttttgccattga

SEQ ID NO: 54760 - DNA, 20 bp, Artificial Sequence
  chemically synthesized
ggttttaccattaccttcaa

SEQ ID NO: 54761 - DNA, 20 bp, Artificial Sequence
  chemically synthesized
gtttttgccattgaaggtaa

SEQ ID NO: 54762 - DNA, 20 bp, Artificial Sequence
  chemically synthesized
ggttggtacataagtaattg

SEQ ID NO: 54763 - DNA, 20 bp, Artificial Sequence
  chemically synthesized
tgatatttaggttggtacat

SEQ ID NO: 54764 - DNA, 20 bp, Artificial Sequence
  chemically synthesized
tctgacaatgatatttaggt

SEQ ID NO: 54765 - DNA, 20 bp, Artificial Sequence
  chemically synthesized
ccattctgacaatgatattt

SEQ ID NO: 54766 - DNA, 20 bp, Artificial Sequence
  chemically synthesized
accattctgacaatgatatt

SEQ ID NO: 54767 - DNA, 20 bp, Artificial Sequence
  chemically synthesized
accaacctaaatatcattgt

SEQ ID NO: 54768 - DNA, 20 bp, Artificial Sequence
  chemically synthesized
cctaaatatcattgtcagaa

SEQ ID NO: 54769 - DNA, 20 bp, Artificial Sequence
  chemically synthesized
tcattgtcagaatggtgttt

SEQ ID NO: 54770 - DNA, 20 bp, Artificial Sequence
  chemically synthesized
cattgtcagaatggtgtttt

SEQ ID NO: 54771 - DNA, 20 bp, Artificial Sequence
  chemically synthesized
tggtgttttaggatgaatga

SEQ ID NO: 54772 - DNA, 20 bp, Artificial Sequence
  chemically synthesized
ttttaggatgaatgaaagca

SEQ ID NO: 54773 - DNA, 20 bp, Artificial Sequence
  chemically synthesized
ttaggatgaatgaaagcatg

SEQ ID NO: 54774 - DNA, 20 bp, Artificial Sequence
  chemically synthesized
gatgaatgaaagcatggaga

SEQ ID NO: 54775 - DNA, 20 bp, Artificial Sequence
  chemically synthesized
atgaaagcatggagaaagcg

SEQ ID NO: 54776 - DNA, 20 bp, Artificial Sequence
  chemically synthesized
gaaagcatggagaaagcgaa

SEQ ID NO: 54777 - DNA, 20 bp, Artificial Sequence
  chemically synthesized
aagcatggagaaagcgaaga

SEQ ID NO: 54778 - DNA, 20 bp, Artificial Sequence
  chemically synthesized
agcatggagaaagcgaagag

SEQ ID NO: 54779 - DNA, 20 bp, Artificial Sequence
  chemically synthesized
ggagaaagcgaagagaggat

SEQ ID NO: 54780 - DNA, 20 bp, Artificial Sequence
  chemically synthesized
gcgaagagaggataagctgc

SEQ ID NO: 54781 - DNA, 20 bp, Artificial Sequence
  chemically synthesized
tctcttgttttcgtttctgg

SEQ ID NO: 54782 - DNA, 20 bp, Artificial Sequence
  chemically synthesized
acatctcttgttttcgtttc

SEQ ID NO: 54783 - DNA, 20 bp, Artificial Sequence
  chemically synthesized
aagctgccagaaacgaaaac

SEQ ID NO: 54784 - DNA, 20 bp, Artificial Sequence
  chemically synthesized
gctgccagaaacgaaaacaa

SEQ ID NO: 54785 - DNA, 20 bp, Artificial Sequence
  chemically synthesized
tgatattgttacatttaaca

SEQ ID NO: 54786 - DNA, 20 bp, Artificial Sequence
  chemically synthesized
tgtgttaaatgtaacaatat

SEQ ID NO: 54787 - DNA, 20 bp, Artificial Sequence
  chemically synthesized
ttaaatgtaacaatatcaga

SEQ ID NO: 54788 - DNA, 20 bp, Artificial Sequence
  chemically synthesized
aatgtaacaatatcagaaag

SEQ ID NO: 54789 - DNA, 20 bp, Artificial Sequence
  chemically synthesized
caatatcagaaagtagactc

SEQ ID NO: 54790 - DNA, 20 bp, Artificial Sequence
  chemically synthesized
aatatcagaaagtagactca

SEQ ID NO: 54791 - DNA, 20 bp, Artificial Sequence
  chemically synthesized
atcagaaagtagactcaagg

SEQ ID NO: 54792 - DNA, 20 bp, Artificial Sequence
  chemically synthesized
tgagagtctgaggcttcctt

SEQ ID NO: 54793 - DNA, 20 bp, Artificial Sequence
  chemically synthesized
aagtagactcaaggaagcct

SEQ ID NO: 54794 - DNA, 20 bp, Artificial Sequence
  chemically synthesized
tcacctagggtgagagtctg

SEQ ID NO: 54795 - DNA, 20 bp, Artificial Sequence
  chemically synthesized
ctcacctagggtgagagtct

SEQ ID NO: 54796 - DNA, 20 bp, Artificial Sequence
  chemically synthesized
gaagcctcagactctcaccc

SEQ ID NO: 54797 - DNA, 20 bp, Artificial Sequence
  chemically synthesized
aagcctcagactctcaccct

SEQ ID NO: 54798 - DNA, 20 bp, Artificial Sequence
  chemically synthesized
ctcctcctcacctagggtga

SEQ ID NO: 54799 - DNA, 20 bp, Artificial Sequence
  chemically synthesized
atctcctcctcacctagggt

SEQ ID NO: 54800 - DNA, 20 bp, Artificial Sequence
  chemically synthesized
ctcagactctcaccctaggt

SEQ ID NO: 54801 - DNA, 20 bp, Artificial Sequence
  chemically synthesized
tcagactctcaccctaggtg

SEQ ID NO: 54802 - DNA, 20 bp, Artificial Sequence
  chemically synthesized
atccatctcctcctcaccta

SEQ ID NO: 54803 - DNA, 20 bp, Artificial Sequence
  chemically synthesized
agactctcaccctaggtgag

SEQ ID NO: 54804 - DNA, 20 bp, Artificial Sequence
  chemically synthesized
tatccatctcctcctcacct

SEQ ID NO: 54805 - DNA, 20 bp, Artificial Sequence
  chemically synthesized
gactctcaccctaggtgagg

SEQ ID NO: 54806 - DNA, 20 bp, Artificial Sequence
  chemically synthesized
ttatccatctcctcctcacc

SEQ ID NO: 54807 - DNA, 20 bp, Artificial Sequence
  chemically synthesized
ctctcaccctaggtgaggag

SEQ ID NO: 54808 - DNA, 20 bp, Artificial Sequence
  chemically synthesized
caccctaggtgaggaggaga

SEQ ID NO: 54809 - DNA, 20 bp, Artificial Sequence
  chemically synthesized
aggaggagatggataaaaat

SEQ ID NO: 54810 - DNA, 20 bp, Artificial Sequence
  chemically synthesized
aggagatggataaaaatcag

SEQ ID NO: 54811 - DNA, 20 bp, Artificial Sequence
  chemically synthesized
ggagatggataaaaatcaga

SEQ ID NO: 54812 - DNA, 20 bp, Artificial Sequence
  chemically synthesized
taaaaatcagaaggaaccac

SEQ ID NO: 54813 - DNA, 20 bp, Artificial Sequence
  chemically synthesized
actatgctgcaacaaaccag

SEQ ID NO: 54814 - DNA, 20 bp, Artificial Sequence
  chemically synthesized
caaactatgctgcaacaaac

SEQ ID NO: 54815 - DNA, 20 bp, Artificial Sequence
  chemically synthesized
aaggaaccactggtttgttg

SEQ ID NO: 54816 - DNA, 20 bp, Artificial Sequence
  chemically synthesized
accactggtttgttgcagca

SEQ ID NO: 54817 - DNA, 20 bp, Artificial Sequence
  chemically synthesized
tgcagcatagtttgatgtaa

SEQ ID NO: 54818 - DNA, 20 bp, Artificial Sequence
  chemically synthesized
agtttgatgtaatagcaaat

SEQ ID NO: 54819 - DNA, 20 bp, Artificial Sequence
  chemically synthesized
aatagcaaatcagtaaatca

SEQ ID NO: 54820 - DNA, 20 bp, Artificial Sequence
  chemically synthesized
gcaaatcagtaaatcatgga

SEQ ID NO: 54821 - DNA, 20 bp, Artificial Sequence
  chemically synthesized
aaatcatggacggttgaaca

SEQ ID NO: 54822 - DNA, 20 bp, Artificial Sequence
  chemically synthesized
atggacggttgaacaaagac

SEQ ID NO: 54823 - DNA, 20 bp, Artificial Sequence
  chemically synthesized
ggacggttgaacaaagactg

SEQ ID NO: 54824 - DNA, 20 bp, Artificial Sequence
  chemically synthesized
gacggttgaacaaagactgg

SEQ ID NO: 54825 - DNA, 20 bp, Artificial Sequence
  chemically synthesized
taattttcccatcattcctc

SEQ ID NO: 54826 - DNA, 20 bp, Artificial Sequence
  chemically synthesized
aacaaagactggaggaatga

SEQ ID NO: 54827 - DNA, 20 bp, Artificial Sequence
  chemically synthesized
acaaagactggaggaatgat

SEQ ID NO: 54828 - DNA, 20 bp, Artificial Sequence
  chemically synthesized
gaatgatgggaaaattatga

SEQ ID NO: 54829 - DNA, 20 bp, Artificial Sequence
  chemically synthesized
aatgatgggaaaattatgaa

SEQ ID NO: 54830 - DNA, 20 bp, Artificial Sequence
  chemically synthesized
tgggaaaattatgaaaggtg

SEQ ID NO: 54831 - DNA, 20 bp, Artificial Sequence
  chemically synthesized
gaaaattatgaaaggtgtgg

SEQ ID NO: 54832 - DNA, 20 bp, Artificial Sequence
  chemically synthesized
gtggcagtgaattctcctta

SEQ ID NO: 54833 - DNA, 20 bp, Artificial Sequence
  chemically synthesized
atgataagaggggctttaag

SEQ ID NO: 54834 - DNA, 20 bp, Artificial Sequence
  chemically synthesized
gaatgataagaggggcttta

SEQ ID NO: 54835 - DNA, 20 bp, Artificial Sequence
  chemically synthesized
tgaatgataagaggggcttt

SEQ ID NO: 54836 - DNA, 20 bp, Artificial Sequence
  chemically synthesized
atgagaatgaatgataagag

SEQ ID NO: 54837 - DNA, 20 bp, Artificial Sequence
  chemically synthesized
aatgagaatgaatgataaga

SEQ ID NO: 54838 - DNA, 20 bp, Artificial Sequence
  chemically synthesized
caatgagaatgaatgataag

SEQ ID NO: 54839 - DNA, 20 bp, Artificial Sequence
  chemically synthesized
acaatgagaatgaatgataa

SEQ ID NO: 54840 - DNA, 20 bp, Artificial Sequence
  chemically synthesized
taacaatgagaatgaatgat

SEQ ID NO: 54841 - DNA, 20 bp, Artificial Sequence
  chemically synthesized
ttatcattcattctcattgt

SEQ ID NO: 54842 - DNA, 20 bp, Artificial Sequence
  chemically synthesized
gtagggatcttgctaacaat

SEQ ID NO: 54843 - DNA, 20 bp, Artificial Sequence
  chemically synthesized
cattcattctcattgttagc

SEQ ID NO: 54844 - DNA, 20 bp, Artificial Sequence
  chemically synthesized
tgttagcaagatccctacca

SEQ ID NO: 54845 - DNA, 20 bp, Artificial Sequence
  chemically synthesized
tttttgccccagctatggta

SEQ ID NO: 54846 - DNA, 20 bp, Artificial Sequence
  chemically synthesized
gtttttgccccagctatggt

SEQ ID NO: 54847 - DNA, 20 bp, Artificial Sequence
  chemically synthesized
agcaagatccctaccatagc

SEQ ID NO: 54848 - DNA, 20 bp, Artificial Sequence
  chemically synthesized
tgtttttgccccagctatgg

SEQ ID NO: 54849 - DNA, 20 bp, Artificial Sequence
  chemically synthesized
gcaagatccctaccatagct

SEQ ID NO: 54850 - DNA, 20 bp, Artificial Sequence
  chemically synthesized
caagatccctaccatagctg

SEQ ID NO: 54851 - DNA, 20 bp, Artificial Sequence
  chemically synthesized
cattgtttttgccccagcta

SEQ ID NO: 54852 - DNA, 20 bp, Artificial Sequence
  chemically synthesized
taaatacattgtttttgccc

SEQ ID NO: 54853 - DNA, 20 bp, Artificial Sequence
  chemically synthesized
caatgtatttaactaaaaat

SEQ ID NO: 54854 - DNA, 20 bp, Artificial Sequence
  chemically synthesized
tacacgccttagctcatttt

SEQ ID NO: 54855 - DNA, 20 bp, Artificial Sequence
  chemically synthesized
tatttaactaaaaatgagct

SEQ ID NO: 54856 - DNA, 20 bp, Artificial Sequence
  chemically synthesized
atttaactaaaaatgagcta

SEQ ID NO: 54857 - DNA, 20 bp, Artificial Sequence
  chemically synthesized
gttaaacgctttacacgcct

SEQ ID NO: 54858 - DNA, 20 bp, Artificial Sequence
  chemically synthesized
aaaatgagctaaggcgtgta

SEQ ID NO: 54859 - DNA, 20 bp, Artificial Sequence
  chemically synthesized
aaggcgtgtaaagcgtttaa

SEQ ID NO: 54860 - DNA, 20 bp, Artificial Sequence
  chemically synthesized
cgtttaacagcatctgttat

SEQ ID NO: 54861 - DNA, 20 bp, Artificial Sequence
  chemically synthesized
gtttaacagcatctgttata

SEQ ID NO: 54862 - DNA, 20 bp, Artificial Sequence
  chemically synthesized
actcagtgctcaccttataa

SEQ ID NO: 54863 - DNA, 20 bp, Artificial Sequence
  chemically synthesized
aacagcatctgttataaggt

SEQ ID NO: 54864 - DNA, 20 bp, Artificial Sequence
  chemically synthesized
tctgttataaggtgagcact

SEQ ID NO: 54865 - DNA, 20 bp, Artificial Sequence
  chemically synthesized
taaggtgagcactgagtaaa

SEQ ID NO: 54866 - DNA, 20 bp, Artificial Sequence
  chemically synthesized
agtaacagttaccatttact

SEQ ID NO: 54867 - DNA, 20 bp, Artificial Sequence
  chemically synthesized
cttttaatacaaataagtaa

SEQ ID NO: 54868 - DNA, 20 bp, Artificial Sequence
  chemically synthesized
ccccaccttttaatacaaat

SEQ ID NO: 54869 - DNA, 20 bp, Artificial Sequence
  chemically synthesized
ctgttacttatttgtattaa

SEQ ID NO: 54870 - DNA, 20 bp, Artificial Sequence
  chemically synthesized
tgttacttatttgtattaaa

SEQ ID NO: 54871 - DNA, 20 bp, Artificial Sequence
  chemically synthesized
tacttatttgtattaaaagg

SEQ ID NO: 54872 - DNA, 20 bp, Artificial Sequence
  chemically synthesized
acttatttgtattaaaaggt

SEQ ID NO: 54873 - DNA, 20 bp, Artificial Sequence
  chemically synthesized
cttatttgtattaaaaggtg

SEQ ID NO: 54874 - DNA, 20 bp, Artificial Sequence
  chemically synthesized
tttgtattaaaaggtggggc

SEQ ID NO: 54875 - DNA, 20 bp, Artificial Sequence
  chemically synthesized
ttgtattaaaaggtggggct

SEQ ID NO: 54876 - DNA, 20 bp, Artificial Sequence
  chemically synthesized
ttaaaaggtggggctgggca

SEQ ID NO: 54877 - DNA, 20 bp, Artificial Sequence
  chemically synthesized
aaaggtggggctgggcatgg

SEQ ID NO: 54878 - DNA, 20 bp, Artificial Sequence
  chemically synthesized
caggcttgcaccaccatgcc

SEQ ID NO: 54879 - DNA, 20 bp, Artificial Sequence
  chemically synthesized
ggggctgggcatggtggtgc

SEQ ID NO: 54880 - DNA, 20 bp, Artificial Sequence
  chemically synthesized
aggtcactgtgagagattac

SEQ ID NO: 54881 - DNA, 20 bp, Artificial Sequence
  chemically synthesized
caggtcactgtgagagatta

SEQ ID NO: 54882 - DNA, 20 bp, Artificial Sequence
  chemically synthesized
tgcaagcctgtaatctctca

SEQ ID NO: 54883 - DNA, 20 bp, Artificial Sequence
  chemically synthesized
agcctcccaggtcactgtga

SEQ ID NO: 54884 - DNA, 20 bp, Artificial Sequence
  chemically synthesized
tcagcctcccaggtcactgt

SEQ ID NO: 54885 - DNA, 20 bp, Artificial Sequence
  chemically synthesized
tgtaatctctcacagtgacc

SEQ ID NO: 54886 - DNA, 20 bp, Artificial Sequence
  chemically synthesized
gtaatctctcacagtgacct

SEQ ID NO: 54887 - DNA, 20 bp, Artificial Sequence
  chemically synthesized
aatctctcacagtgacctgg

SEQ ID NO: 54888 - DNA, 20 bp, Artificial Sequence
  chemically synthesized
atctctcacagtgacctggg

SEQ ID NO: 54889 - DNA, 20 bp, Artificial Sequence
  chemically synthesized
tcctcccacttcagcctccc

SEQ ID NO: 54890 - DNA, 20 bp, Artificial Sequence
  chemically synthesized
atcctcccacttcagcctcc

SEQ ID NO: 54891 - DNA, 20 bp, Artificial Sequence
  chemically synthesized
cacagtgacctgggaggctg

SEQ ID NO: 54892 - DNA, 20 bp, Artificial Sequence
  chemically synthesized
agtgacctgggaggctgaag

SEQ ID NO: 54893 - DNA, 20 bp, Artificial Sequence
  chemically synthesized
gtgacctgggaggctgaagt

SEQ ID NO: 54894 - DNA, 20 bp, Artificial Sequence
  chemically synthesized
gacctgggaggctgaagtgg

SEQ ID NO: 54895 - DNA, 20 bp, Artificial Sequence
  chemically synthesized
acctgggaggctgaagtggg

SEQ ID NO: 54896 - DNA, 20 bp, Artificial Sequence
  chemically synthesized
ttcaagtgatcctcccactt

SEQ ID NO: 54897 - DNA, 20 bp, Artificial Sequence
  chemically synthesized
gtgggaggatcacttgaacc

SEQ ID NO: 54898 - DNA, 20 bp, Artificial Sequence
  chemically synthesized
tgggaggatcacttgaaccc

SEQ ID NO: 54899 - DNA, 20 bp, Artificial Sequence
  chemically synthesized
ggtcttgaactcctgggttc

SEQ ID NO: 54900 - DNA, 20 bp, Artificial Sequence
  chemically synthesized
ggaggatcacttgaacccag

SEQ ID NO: 54901 - DNA, 20 bp, Artificial Sequence
  chemically synthesized
caggctggtcttgaactcct

SEQ ID NO: 54902 - DNA, 20 bp, Artificial Sequence
  chemically synthesized
tcacttgaacccaggagttc

SEQ ID NO: 54903 - DNA, 20 bp, Artificial Sequence
  chemically synthesized
ccaggctggtcttgaactcc

SEQ ID NO: 54904 - DNA, 20 bp, Artificial Sequence
  chemically synthesized
tgaacccaggagttcaagac

SEQ ID NO: 54905 - DNA, 20 bp, Artificial Sequence
  chemically synthesized
ccaggagttcaagaccagcc

SEQ ID NO: 54906 - DNA, 20 bp, Artificial Sequence
  chemically synthesized
caggagttcaagaccagcct

SEQ ID NO: 54907 - DNA, 20 bp, Artificial Sequence
  chemically synthesized
tctcactatgttgcccaggc

SEQ ID NO: 54908 - DNA, 20 bp, Artificial Sequence
  chemically synthesized
agggtctcactatgttgccc

SEQ ID NO: 54909 - DNA, 20 bp, Artificial Sequence
  chemically synthesized
caagaccagcctgggcaaca

SEQ ID NO: 54910 - DNA, 20 bp, Artificial Sequence
  chemically synthesized
cagggtctcactatgttgcc

SEQ ID NO: 54911 - DNA, 20 bp, Artificial Sequence
  chemically synthesized
accagcctgggcaacatagt

SEQ ID NO: 54912 - DNA, 20 bp, Artificial Sequence
  chemically synthesized
ttatttttttttaagagaca

SEQ ID NO: 54913 - DNA, 20 bp, Artificial Sequence
  chemically synthesized
gttatttttttttaagagac

SEQ ID NO: 54914 - DNA, 20 bp, Artificial Sequence
  chemically synthesized
tgttatttttttttaagaga

SEQ ID NO: 54915 - DNA, 20 bp, Artificial Sequence
  chemically synthesized
tttgtgttatttttttttaa

SEQ ID NO: 54916 - DNA, 20 bp, Artificial Sequence
  chemically synthesized
tgtttgtgttattttttttt

SEQ ID NO: 54917 - DNA, 20 bp, Artificial Sequence
  chemically synthesized
aataacacaaacaaaaaaca

SEQ ID NO: 54918 - DNA, 20 bp, Artificial Sequence
  chemically synthesized
acaaacaaaaaacatggtgt

SEQ ID NO: 54919 - DNA, 20 bp, Artificial Sequence
  chemically synthesized
aaacaaaaaacatggtgtca

SEQ ID NO: 54920 - DNA, 20 bp, Artificial Sequence
  chemically synthesized
caaaaaacatggtgtcagag

SEQ ID NO: 54921 - DNA, 20 bp, Artificial Sequence
  chemically synthesized
ggtgtcagagcagaatacaa

SEQ ID NO: 54922 - DNA, 20 bp, Artificial Sequence
  chemically synthesized
gtgtcagagcagaatacaat

SEQ ID NO: 54923 - DNA, 20 bp, Artificial Sequence
  chemically synthesized
tgtcagagcagaatacaatg

SEQ ID NO: 54924 - DNA, 20 bp, Artificial Sequence
  chemically synthesized
agagcagaatacaatggggt

SEQ ID NO: 54925 - DNA, 20 bp, Artificial Sequence
  chemically synthesized
atacaatggggtgagtttga

SEQ ID NO: 54926 - DNA, 20 bp, Artificial Sequence
  chemically synthesized
gagtttgacagacccatctt

SEQ ID NO: 54927 - DNA, 20 bp, Artificial Sequence
  chemically synthesized
agtttgacagacccatcttt

SEQ ID NO: 54928 - DNA, 20 bp, Artificial Sequence
  chemically synthesized
gtttgacagacccatcttta

SEQ ID NO: 54929 - DNA, 20 bp, Artificial Sequence
  chemically synthesized
atggaacttcccctaaagat

SEQ ID NO: 54930 - DNA, 20 bp, Artificial Sequence
  chemically synthesized
tttgacagacccatctttag

SEQ ID NO: 54931 - DNA, 20 bp, Artificial Sequence
  chemically synthesized
tatggaacttcccctaaaga

SEQ ID NO: 54932 - DNA, 20 bp, Artificial Sequence
  chemically synthesized
gacagacccatctttagggg

SEQ ID NO: 54933 - DNA, 20 bp, Artificial Sequence
  chemically synthesized
tagatatggaacttccccta

SEQ ID NO: 54934 - DNA, 20 bp, Artificial Sequence
  chemically synthesized
tttaggggaagttccatatc

SEQ ID NO: 54935 - DNA, 20 bp, Artificial Sequence
  chemically synthesized
taaaaaagggaagctagata

SEQ ID NO: 54936 - DNA, 20 bp, Artificial Sequence
  chemically synthesized
ttactataaaaaagggaagc

SEQ ID NO: 54937 - DNA, 20 bp, Artificial Sequence
  chemically synthesized
gtatttactataaaaaaggg

SEQ ID NO: 54938 - DNA, 20 bp, Artificial Sequence
  chemically synthesized
tatctagcttccctttttta

SEQ ID NO: 54939 - DNA, 20 bp, Artificial Sequence
  chemically synthesized
caagtatttactataaaaaa

SEQ ID NO: 54940 - DNA, 20 bp, Artificial Sequence
  chemically synthesized
tcaagtatttactataaaaa

SEQ ID NO: 54941 - DNA, 20 bp, Artificial Sequence
  chemically synthesized
ctcaagtatttactataaaa

SEQ ID NO: 54942 - DNA, 20 bp, Artificial Sequence
  chemically synthesized
cttttttatagtaaatactt

SEQ ID NO: 54943 - DNA, 20 bp, Artificial Sequence
  chemically synthesized
tttatagtaaatacttgagc

SEQ ID NO: 54944 - DNA, 20 bp, Artificial Sequence
  chemically synthesized
taccctcaacaaaccagctc

SEQ ID NO: 54945 - DNA, 20 bp, Artificial Sequence
  chemically synthesized
aatacttgagctggtttgtt

SEQ ID NO: 54946 - DNA, 20 bp, Artificial Sequence
  chemically synthesized
atgggttaccctcaacaaac

SEQ ID NO: 54947 - DNA, 20 bp, Artificial Sequence
  chemically synthesized
atacttgagctggtttgttg

SEQ ID NO: 54948 - DNA, 20 bp, Artificial Sequence
  chemically synthesized
tacttgagctggtttgttga

SEQ ID NO: 54949 - DNA, 20 bp, Artificial Sequence
  chemically synthesized
gtaaatgattaaaatcgtat

SEQ ID NO: 54950 - DNA, 20 bp, Artificial Sequence
  chemically synthesized
ggtaaatgattaaaatcgta

SEQ ID NO: 54951 - DNA, 20 bp, Artificial Sequence
  chemically synthesized
atacgattttaatcatttac

SEQ ID NO: 54952 - DNA, 20 bp, Artificial Sequence
  chemically synthesized
tacgattttaatcatttacc

SEQ ID NO: 54953 - DNA, 20 bp, Artificial Sequence
  chemically synthesized
tactttccagatttaagtcc

SEQ ID NO: 54954 - DNA, 20 bp, Artificial Sequence
  chemically synthesized
catttaccaggacttaaatc

SEQ ID NO: 54955 - DNA, 20 bp, Artificial Sequence
  chemically synthesized
ctgtcatactttccagattt

SEQ ID NO: 54956 - DNA, 20 bp, Artificial Sequence
  chemically synthesized
taccaggacttaaatctgga

SEQ ID NO: 54957 - DNA, 20 bp, Artificial Sequence
  chemically synthesized
aacccaactgtcatactttc

SEQ ID NO: 54958 - DNA, 20 bp, Artificial Sequence
  chemically synthesized
cttaaatctggaaagtatga

SEQ ID NO: 54959 - DNA, 20 bp, Artificial Sequence
  chemically synthesized
aatctggaaagtatgacagt

SEQ ID NO: 54960 - DNA, 20 bp, Artificial Sequence
  chemically synthesized
atctggaaagtatgacagtt

SEQ ID NO: 54961 - DNA, 20 bp, Artificial Sequence
  chemically synthesized
aaagtatgacagttgggttc

SEQ ID NO: 54962 - DNA, 20 bp, Artificial Sequence
  chemically synthesized
tcaagaatcaatgattccac

SEQ ID NO: 54963 - DNA, 20 bp, Artificial Sequence
  chemically synthesized
gcagcccttgaaaatgctgg

SEQ ID NO: 54964 - DNA, 20 bp, Artificial Sequence
  chemically synthesized
atagcagcccttgaaaatgc

SEQ ID NO: 54965 - DNA, 20 bp, Artificial Sequence
  chemically synthesized
atgattccaccagcattttc

SEQ ID NO: 54966 - DNA, 20 bp, Artificial Sequence
  chemically synthesized
tgattccaccagcattttca

SEQ ID NO: 54967 - DNA, 20 bp, Artificial Sequence
  chemically synthesized
gattccaccagcattttcaa

SEQ ID NO: 54968 - DNA, 20 bp, Artificial Sequence
  chemically synthesized
atacagtacagtgtacatag

SEQ ID NO: 54969 - DNA, 20 bp, Artificial Sequence
  chemically synthesized
aacatacagtacagtgtaca

SEQ ID NO: 54970 - DNA, 20 bp, Artificial Sequence
  chemically synthesized
cacacgatgaacatacagta

SEQ ID NO: 54971 - DNA, 20 bp, Artificial Sequence
  chemically synthesized
tccaccacacgatgaacata

SEQ ID NO: 54972 - DNA, 20 bp, Artificial Sequence
  chemically synthesized
tgtactgtatgttcatcgtg

SEQ ID NO: 54973 - DNA, 20 bp, Artificial Sequence
  chemically synthesized
actgtatgttcatcgtgtgg

SEQ ID NO: 54974 - DNA, 20 bp, Artificial Sequence
  chemically synthesized
tatgttcatcgtgtggtgga

SEQ ID NO: 54975 - DNA, 20 bp, Artificial Sequence
  chemically synthesized
tcatcgtgtggtggatggca

SEQ ID NO: 54976 - DNA, 20 bp, Artificial Sequence
  chemically synthesized
cgtgtggtggatggcaaaga

SEQ ID NO: 54977 - DNA, 20 bp, Artificial Sequence
  chemically synthesized
gtgtggtggatggcaaagat

SEQ ID NO: 54978 - DNA, 20 bp, Artificial Sequence
  chemically synthesized
catgaaaaatttcttttctc

SEQ ID NO: 54979 - DNA, 20 bp, Artificial Sequence
  chemically synthesized
agacacaaggttcttgagaa

SEQ ID NO: 54980 - DNA, 20 bp, Artificial Sequence
  chemically synthesized
cagcaagacacaaggttctt

SEQ ID NO: 54981 - DNA, 20 bp, Artificial Sequence
  chemically synthesized
tcatctcccagcaagacaca

SEQ ID NO: 54982 - DNA, 20 bp, Artificial Sequence
  chemically synthesized
gtcatctcccagcaagacac

SEQ ID NO: 54983 - DNA, 20 bp, Artificial Sequence
  chemically synthesized
tcaagaaccttgtgtcttgc

SEQ ID NO: 54984 - DNA, 20 bp, Artificial Sequence
  chemically synthesized
caagaaccttgtgtcttgct

SEQ ID NO: 54985 - DNA, 20 bp, Artificial Sequence
  chemically synthesized
agaaccttgtgtcttgctgg

SEQ ID NO: 54986 - DNA, 20 bp, Artificial Sequence
  chemically synthesized
agctgcagtcatctcccagc

SEQ ID NO: 54987 - DNA, 20 bp, Artificial Sequence
  chemically synthesized
tctcagctgcagtcatctcc

SEQ ID NO: 54988 - DNA, 20 bp, Artificial Sequence
  chemically synthesized
gtcttgctgggagatgactg

SEQ ID NO: 54989 - DNA, 20 bp, Artificial Sequence
  chemically synthesized
gctgggagatgactgcagct

SEQ ID NO: 54990 - DNA, 20 bp, Artificial Sequence
  chemically synthesized
tctctaattcgtctcagctg

SEQ ID NO: 54991 - DNA, 20 bp, Artificial Sequence
  chemically synthesized
caaaagtctctaattcgtct

SEQ ID NO: 54992 - DNA, 20 bp, Artificial Sequence
  chemically synthesized
tgactgcagctgagacgaat

SEQ ID NO: 54993 - DNA, 20 bp, Artificial Sequence
  chemically synthesized
actgcagctgagacgaatta

SEQ ID NO: 54994 - DNA, 20 bp, Artificial Sequence
  chemically synthesized
cacagagactatcagttcaa

SEQ ID NO: 54995 - DNA, 20 bp, Artificial Sequence
  chemically synthesized
attagagacttttgaactga

SEQ ID NO: 54996 - DNA, 20 bp, Artificial Sequence
  chemically synthesized
ggtcataacacagagactat

SEQ ID NO: 54997 - DNA, 20 bp, Artificial Sequence
  chemically synthesized
cccttattggtcataacaca

SEQ ID NO: 54998 - DNA, 20 bp, Artificial Sequence
  chemically synthesized
tgcccttattggtcataaca

SEQ ID NO: 54999 - DNA, 20 bp, Artificial Sequence
  chemically synthesized
gtctctgtgttatgaccaat

SEQ ID NO: 55000 - DNA, 20 bp, Artificial Sequence
  chemically synthesized
tctctgtgttatgaccaata

SEQ ID NO: 55001 - DNA, 20 bp, Artificial Sequence
  chemically synthesized
ctctgtgttatgaccaataa

SEQ ID NO: 55002 - DNA, 20 bp, Artificial Sequence
  chemically synthesized
aaaatacatattgcccttat

SEQ ID NO: 55003 - DNA, 20 bp, Artificial Sequence
  chemically synthesized
ataagggcaatatgtatttt

SEQ ID NO: 55004 - DNA, 20 bp, Artificial Sequence
  chemically synthesized
agggcaatatgtatttttgg

SEQ ID NO: 55005 - DNA, 20 bp, Artificial Sequence
  chemically synthesized
caatatgtatttttggaagt

SEQ ID NO: 55006 - DNA, 20 bp, Artificial Sequence
  chemically synthesized
atgtatttttggaagtgaga

SEQ ID NO: 55007 - DNA, 20 bp, Artificial Sequence
  chemically synthesized
tatttttggaagtgagacag

SEQ ID NO: 55008 - DNA, 20 bp, Artificial Sequence
  chemically synthesized
tttggaagtgagacagcagt

SEQ ID NO: 55009 - DNA, 20 bp, Artificial Sequence
  chemically synthesized
ttggaagtgagacagcagtg

SEQ ID NO: 55010 - DNA, 20 bp, Artificial Sequence
  chemically synthesized
aagtgagacagcagtgaggc

SEQ ID NO: 55011 - DNA, 20 bp, Artificial Sequence
  chemically synthesized
agtgagacagcagtgaggcc

SEQ ID NO: 55012 - DNA, 20 bp, Artificial Sequence
  chemically synthesized
tgagacagcagtgaggccag

SEQ ID NO: 55013 - DNA, 20 bp, Artificial Sequence
  chemically synthesized
gatgcctcccagattgctcc

SEQ ID NO: 55014 - DNA, 20 bp, Artificial Sequence
  chemically synthesized
cagtgaggccaggagcaatc

SEQ ID NO: 55015 - DNA, 20 bp, Artificial Sequence
  chemically synthesized
agtgaggccaggagcaatct

SEQ ID NO: 55016 - DNA, 20 bp, Artificial Sequence
  chemically synthesized
tgaggccaggagcaatctgg

SEQ ID NO: 55017 - DNA, 20 bp, Artificial Sequence
  chemically synthesized
gaggccaggagcaatctggg

SEQ ID NO: 55018 - DNA, 20 bp, Artificial Sequence
  chemically synthesized
acctcttttctgatgcctcc

SEQ ID NO: 55019 - DNA, 20 bp, Artificial Sequence
  chemically synthesized
aggagcaatctgggaggcat

SEQ ID NO: 55020 - DNA, 20 bp, Artificial Sequence
  chemically synthesized
caatctgggaggcatcagaa

SEQ ID NO: 55021 - DNA, 20 bp, Artificial Sequence
  chemically synthesized
atctgggaggcatcagaaaa

SEQ ID NO: 55022 - DNA, 20 bp, Artificial Sequence
  chemically synthesized
tctgggaggcatcagaaaag

SEQ ID NO: 55023 - DNA, 20 bp, Artificial Sequence
  chemically synthesized
gcatcagaaaagaggtgaca

SEQ ID NO: 55024 - DNA, 20 bp, Artificial Sequence
  chemically synthesized
gacacagaacatcattgtcc

SEQ ID NO: 55025 - DNA, 20 bp, Artificial Sequence
  chemically synthesized
acacagaacatcattgtcct

SEQ ID NO: 55026 - DNA, 20 bp, Artificial Sequence
  chemically synthesized
agaacatcattgtcctaggt

SEQ ID NO: 55027 - DNA, 20 bp, Artificial Sequence
  chemically synthesized
gctgatactgagtctgacct

SEQ ID NO: 55028 - DNA, 20 bp, Artificial Sequence
  chemically synthesized
tgctgatactgagtctgacc

SEQ ID NO: 55029 - DNA, 20 bp, Artificial Sequence
  chemically synthesized
tcattgtcctaggtcagact

SEQ ID NO: 55030 - DNA, 20 bp, Artificial Sequence
  chemically synthesized
tcctaggtcagactcagtat

SEQ ID NO: 55031 - DNA, 20 bp, Artificial Sequence
  chemically synthesized
gatgctaagctgctgatact

SEQ ID NO: 55032 - DNA, 20 bp, Artificial Sequence
  chemically synthesized
taggtcagactcagtatcag

SEQ ID NO: 55033 - DNA, 20 bp, Artificial Sequence
  chemically synthesized
cagactcagtatcagcagct

SEQ ID NO: 55034 - DNA, 20 bp, Artificial Sequence
  chemically synthesized
cctcatggacatgagatgct

SEQ ID NO: 55035 - DNA, 20 bp, Artificial Sequence
  chemically synthesized
aaaatactcctcatggacat

SEQ ID NO: 55036 - DNA, 20 bp, Artificial Sequence
  chemically synthesized
gcttagcatctcatgtccat

SEQ ID NO: 55037 - DNA, 20 bp, Artificial Sequence
  chemically synthesized
cttagcatctcatgtccatg

SEQ ID NO: 55038 - DNA, 20 bp, Artificial Sequence
  chemically synthesized
tagcatctcatgtccatgag

SEQ ID NO: 55039 - DNA, 20 bp, Artificial Sequence
  chemically synthesized
tgttcaaaaaatactcctca

SEQ ID NO: 55040 - DNA, 20 bp, Artificial Sequence
  chemically synthesized
catgaggagtattttttgaa

SEQ ID NO: 55041 - DNA, 20 bp, Artificial Sequence
  chemically synthesized
atgaggagtattttttgaac

SEQ ID NO: 55042 - DNA, 20 bp, Artificial Sequence
  chemically synthesized
cattaagattatatcacaaa

SEQ ID NO: 55043 - DNA, 20 bp, Artificial Sequence
  chemically synthesized
gtgatataatcttaatgatt

SEQ ID NO: 55044 - DNA, 20 bp, Artificial Sequence
  chemically synthesized
tcaggaatctctgaatcatt

SEQ ID NO: 55045 - DNA, 20 bp, Artificial Sequence
  chemically synthesized
gatataatcttaatgattca

SEQ ID NO: 55046 - DNA, 20 bp, Artificial Sequence
  chemically synthesized
ttaatgattcagagattcct

SEQ ID NO: 55047 - DNA, 20 bp, Artificial Sequence
  chemically synthesized
gtgatactgtttgaaatctc

SEQ ID NO: 55048 - DNA, 20 bp, Artificial Sequence
  chemically synthesized
agtgatactgtttgaaatct

SEQ ID NO: 55049 - DNA, 20 bp, Artificial Sequence
  chemically synthesized
gagattcctgagatttcaaa

SEQ ID NO: 55050 - DNA, 20 bp, Artificial Sequence
  chemically synthesized
atttcaaacagtatcactta

SEQ ID NO: 55051 - DNA, 20 bp, Artificial Sequence
  chemically synthesized
aaaggaaagattgacactat

SEQ ID NO: 55052 - DNA, 20 bp, Artificial Sequence
  chemically synthesized
ttgcttactaaaataaagga

SEQ ID NO: 55053 - DNA, 20 bp, Artificial Sequence
  chemically synthesized
tgtcaatctttcctttattt

SEQ ID NO: 55054 - DNA, 20 bp, Artificial Sequence
  chemically synthesized
cttgttgcttactaaaataa

SEQ ID NO: 55055 - DNA, 20 bp, Artificial Sequence
  chemically synthesized
acttgttgcttactaaaata

SEQ ID NO: 55056 - DNA, 20 bp, Artificial Sequence
  chemically synthesized
aatctttcctttattttagt

SEQ ID NO: 55057 - DNA, 20 bp, Artificial Sequence
  chemically synthesized
cctttattttagtaagcaac

SEQ ID NO: 55058 - DNA, 20 bp, Artificial Sequence
  chemically synthesized
aaaaaaaaaaaagatggtaa

SEQ ID NO: 55059 - DNA, 20 bp, Artificial Sequence
  chemically synthesized
aaaaaaaaaaaaaagatggt

SEQ ID NO: 55060 - DNA, 20 bp, Artificial Sequence
  chemically synthesized
aaaaaaaaaaaaaaaaaaga

SEQ ID NO: 55061 - DNA, 20 bp, Artificial Sequence
  chemically synthesized
tcaaaaaaaaaaaaaaaaaa

SEQ ID NO: 55062 - DNA, 20 bp, Artificial Sequence
  chemically synthesized
tttttttttttttttttttt

SEQ ID NO: 55063 - DNA, 20 bp, Artificial Sequence
  chemically synthesized
tccagactgggcaacagagc

SEQ ID NO: 55064 - DNA, 20 bp, Artificial Sequence
  chemically synthesized
ctccagactgggcaacagag

SEQ ID NO: 55065 - DNA, 20 bp, Artificial Sequence
  chemically synthesized
agacgtcctgctctgttgcc

SEQ ID NO: 55066 - DNA, 20 bp, Artificial Sequence
  chemically synthesized
gcactccagactgggcaaca

SEQ ID NO: 55067 - DNA, 20 bp, Artificial Sequence
  chemically synthesized
ctgcactccagactgggcaa

SEQ ID NO: 55068 - DNA, 20 bp, Artificial Sequence
  chemically synthesized
tcctgctctgttgcccagtc

SEQ ID NO: 55069 - DNA, 20 bp, Artificial Sequence
  chemically synthesized
ctgctctgttgcccagtctg

SEQ ID NO: 55070 - DNA, 20 bp, Artificial Sequence
  chemically synthesized
atgccactgcactccagact

SEQ ID NO: 55071 - DNA, 20 bp, Artificial Sequence
  chemically synthesized
catgccactgcactccagac

SEQ ID NO: 55072 - DNA, 20 bp, Artificial Sequence
  chemically synthesized
ctgttgcccagtctggagtg

SEQ ID NO: 55073 - DNA, 20 bp, Artificial Sequence
  chemically synthesized
gagatcatgccactgcactc

SEQ ID NO: 55074 - DNA, 20 bp, Artificial Sequence
  chemically synthesized
ttgcccagtctggagtgcag

SEQ ID NO: 55075 - DNA, 20 bp, Artificial Sequence
  chemically synthesized
ggagtgcagtggcatgatct

SEQ ID NO: 55076 - DNA, 20 bp, Artificial Sequence
  chemically synthesized
ggcaggggttgcaatgagct

SEQ ID NO: 55077 - DNA, 20 bp, Artificial Sequence
  chemically synthesized
tgggaggcaggggttgcaat

SEQ ID NO: 55078 - DNA, 20 bp, Artificial Sequence
  chemically synthesized
tgcttgaacctgggaggcag

SEQ ID NO: 55079 - DNA, 20 bp, Artificial Sequence
  chemically synthesized
tcattgcaacccctgcctcc

SEQ ID NO: 55080 - DNA, 20 bp, Artificial Sequence
  chemically synthesized
ttgcttgaacctgggaggca

SEQ ID NO: 55081 - DNA, 20 bp, Artificial Sequence
  chemically synthesized
cattgcaacccctgcctccc

SEQ ID NO: 55082 - DNA, 20 bp, Artificial Sequence
  chemically synthesized
attgcttgaacctgggaggc

SEQ ID NO: 55083 - DNA, 20 bp, Artificial Sequence
  chemically synthesized
aattgcttgaacctgggagg

SEQ ID NO: 55084 - DNA, 20 bp, Artificial Sequence
  chemically synthesized
gagaattgcttgaacctggg

SEQ ID NO: 55085 - DNA, 20 bp, Artificial Sequence
  chemically synthesized
ggagaattgcttgaacctgg

SEQ ID NO: 55086 - DNA, 20 bp, Artificial Sequence
  chemically synthesized
aacccctgcctcccaggttc

SEQ ID NO: 55087 - DNA, 20 bp, Artificial Sequence
  chemically synthesized
caggagaattgcttgaacct

SEQ ID NO: 55088 - DNA, 20 bp, Artificial Sequence
  chemically synthesized
gcaggagaattgcttgaacc

SEQ ID NO: 55089 - DNA, 20 bp, Artificial Sequence
  chemically synthesized
ttcaagcaattctcctgcct

SEQ ID NO: 55090 - DNA, 20 bp, Artificial Sequence
  chemically synthesized
tactcgggaggctgaggcag

SEQ ID NO: 55091 - DNA, 20 bp, Artificial Sequence
  chemically synthesized
ggtactcgggaggctgaggc

SEQ ID NO: 55092 - DNA, 20 bp, Artificial Sequence
  chemically synthesized
gggtactcgggaggctgagg

SEQ ID NO: 55093 - DNA, 20 bp, Artificial Sequence
  chemically synthesized
cccgggtactcgggaggctg

SEQ ID NO: 55094 - DNA, 20 bp, Artificial Sequence
  chemically synthesized
tcccgggtactcgggaggct

SEQ ID NO: 55095 - DNA, 20 bp, Artificial Sequence
  chemically synthesized
ttctcctgcctcagcctccc

SEQ ID NO: 55096 - DNA, 20 bp, Artificial Sequence
  chemically synthesized
tgtaatcccgggtactcggg

SEQ ID NO: 55097 - DNA, 20 bp, Artificial Sequence
  chemically synthesized
ctgtaatcccgggtactcgg

SEQ ID NO: 55098 - DNA, 20 bp, Artificial Sequence
  chemically synthesized
gcctcagcctcccgagtacc

SEQ ID NO: 55099 - DNA, 20 bp, Artificial Sequence
  chemically synthesized
gcctgtaatcccgggtactc

SEQ ID NO: 55100 - DNA, 20 bp, Artificial Sequence
  chemically synthesized
cctcagcctcccgagtaccc

SEQ ID NO: 55101 - DNA, 20 bp, Artificial Sequence
  chemically synthesized
tgcctgtaatcccgggtact

SEQ ID NO: 55102 - DNA, 20 bp, Artificial Sequence
  chemically synthesized
ctcccgagtacccgggatta

SEQ ID NO: 55103 - DNA, 20 bp, Artificial Sequence
  chemically synthesized
tggcgcatgcctgtaatccc

SEQ ID NO: 55104 - DNA, 20 bp, Artificial Sequence
  chemically synthesized
tcccgagtacccgggattac

SEQ ID NO: 55105 - DNA, 20 bp, Artificial Sequence
  chemically synthesized
ttggcgcatgcctgtaatcc

SEQ ID NO: 55106 - DNA, 20 bp, Artificial Sequence
  chemically synthesized
caggcatgcgccaacccacc

SEQ ID NO: 55107 - DNA, 20 bp, Artificial Sequence
  chemically synthesized
caaaaattagccgggtgggt

SEQ ID NO: 55108 - DNA, 20 bp, Artificial Sequence
  chemically synthesized
aatacaaaaattagccgggt

SEQ ID NO: 55109 - DNA, 20 bp, Artificial Sequence
  chemically synthesized
aaatacaaaaattagccggg

SEQ ID NO: 55110 - DNA, 20 bp, Artificial Sequence
  chemically synthesized
aaaaaatacaaaaattagcc

SEQ ID NO: 55111 - DNA, 20 bp, Artificial Sequence
  chemically synthesized
taaaaaatacaaaaattagc

SEQ ID NO: 55112 - DNA, 20 bp, Artificial Sequence
  chemically synthesized
cttctaaaaaatacaaaaat

SEQ ID NO: 55113 - DNA, 20 bp, Artificial Sequence
  chemically synthesized
cggctaatttttgtattttt

SEQ ID NO: 55114 - DNA, 20 bp, Artificial Sequence
  chemically synthesized
ctaatttttgtattttttag

SEQ ID NO: 55115 - DNA, 20 bp, Artificial Sequence
  chemically synthesized
aatttttgtattttttagaa

SEQ ID NO: 55116 - DNA, 20 bp, Artificial Sequence
  chemically synthesized
tttgtattttttagaagaga

SEQ ID NO: 55117 - DNA, 20 bp, Artificial Sequence
  chemically synthesized
ttgtattttttagaagagat

SEQ ID NO: 55118 - DNA, 20 bp, Artificial Sequence
  chemically synthesized
tgtattttttagaagagatg

SEQ ID NO: 55119 - DNA, 20 bp, Artificial Sequence
  chemically synthesized
gagatggggtttcaccctgt

SEQ ID NO: 55120 - DNA, 20 bp, Artificial Sequence
  chemically synthesized
tggggtttcaccctgttggc

SEQ ID NO: 55121 - DNA, 20 bp, Artificial Sequence
  chemically synthesized
ggagaccagcctggccaaca

SEQ ID NO: 55122 - DNA, 20 bp, Artificial Sequence
  chemically synthesized
ggggtttcaccctgttggcc

SEQ ID NO: 55123 - DNA, 20 bp, Artificial Sequence
  chemically synthesized
tggagaccagcctggccaac

SEQ ID NO: 55124 - DNA, 20 bp, Artificial Sequence
  chemically synthesized
atggagaccagcctggccaa

SEQ ID NO: 55125 - DNA, 20 bp, Artificial Sequence
  chemically synthesized
tttcaccctgttggccaggc

SEQ ID NO: 55126 - DNA, 20 bp, Artificial Sequence
  chemically synthesized
taggaggatggagaccagcc

SEQ ID NO: 55127 - DNA, 20 bp, Artificial Sequence
  chemically synthesized
aaagataggaggatggagac

SEQ ID NO: 55128 - DNA, 20 bp, Artificial Sequence
  chemically synthesized
ggttaaaagataggaggatg

SEQ ID NO: 55129 - DNA, 20 bp, Artificial Sequence
  chemically synthesized
atggttaaaagataggagga

SEQ ID NO: 55130 - DNA, 20 bp, Artificial Sequence
  chemically synthesized
tgaaatggttaaaagatagg

SEQ ID NO: 55131 - DNA, 20 bp, Artificial Sequence
  chemically synthesized
gtgaaatggttaaaagatag

SEQ ID NO: 55132 - DNA, 20 bp, Artificial Sequence
  chemically synthesized
ccgtgaaatggttaaaagat

SEQ ID NO: 55133 - DNA, 20 bp, Artificial Sequence
  chemically synthesized
accgtgaaatggttaaaaga

SEQ ID NO: 55134 - DNA, 20 bp, Artificial Sequence
  chemically synthesized
aacaaccgtgaaatggttaa

SEQ ID NO: 55135 - DNA, 20 bp, Artificial Sequence
  chemically synthesized
cctatcttttaaccatttca

SEQ ID NO: 55136 - DNA, 20 bp, Artificial Sequence
  chemically synthesized
ctttgcaaacaaccgtgaaa

SEQ ID NO: 55137 - DNA, 20 bp, Artificial Sequence
  chemically synthesized
ccatttcacggttgtttgca

SEQ ID NO: 55138 - DNA, 20 bp, Artificial Sequence
  chemically synthesized
ttctaatcactgtattttga

SEQ ID NO: 55139 - DNA, 20 bp, Artificial Sequence
  chemically synthesized
tgcaaagaactttcaaaata

SEQ ID NO: 55140 - DNA, 20 bp, Artificial Sequence
  chemically synthesized
aactttcaaaatacagtgat

SEQ ID NO: 55141 - DNA, 20 bp, Artificial Sequence
  chemically synthesized
caatacagtaaggaaaagac

SEQ ID NO: 55142 - DNA, 20 bp, Artificial Sequence
  chemically synthesized
aatttcaatacagtaaggaa

SEQ ID NO: 55143 - DNA, 20 bp, Artificial Sequence
  chemically synthesized
aaatcaatttcaatacagta

SEQ ID NO: 55144 - DNA, 20 bp, Artificial Sequence
  chemically synthesized
aaaatcaatttcaatacagt

SEQ ID NO: 55145 - DNA, 20 bp, Artificial Sequence
  chemically synthesized
ataaaaaatcaatttcaata

SEQ ID NO: 55146 - DNA, 20 bp, Artificial Sequence
  chemically synthesized
gtattgaaattgatttttta

SEQ ID NO: 55147 - DNA, 20 bp, Artificial Sequence
  chemically synthesized
tgaaattgattttttatggt

SEQ ID NO: 55148 - DNA, 20 bp, Artificial Sequence
  chemically synthesized
gaaattgattttttatggtt

SEQ ID NO: 55149 - DNA, 20 bp, Artificial Sequence
  chemically synthesized
tttttatggttaggtgaata

SEQ ID NO: 55150 - DNA, 20 bp, Artificial Sequence
  chemically synthesized
atatagatgattaaatataa

SEQ ID NO: 55151 - DNA, 20 bp, Artificial Sequence
  chemically synthesized
ttgaatgattttgtgttgtt

SEQ ID NO: 55152 - DNA, 20 bp, Artificial Sequence
  chemically synthesized
ctttactcatgcaaaattca

SEQ ID NO: 55153 - DNA, 20 bp, Artificial Sequence
  chemically synthesized
aaaaactgtgaattttgcat

SEQ ID NO: 55154 - DNA, 20 bp, Artificial Sequence
  chemically synthesized
ctgtgaattttgcatgagta

SEQ ID NO: 55155 - DNA, 20 bp, Artificial Sequence
  chemically synthesized
tgtgaattttgcatgagtaa

SEQ ID NO: 55156 - DNA, 20 bp, Artificial Sequence
  chemically synthesized
gtgaattttgcatgagtaaa

SEQ ID NO: 55157 - DNA, 20 bp, Artificial Sequence
  chemically synthesized
attttgcatgagtaaagggc

SEQ ID NO: 55158 - DNA, 20 bp, Artificial Sequence
  chemically synthesized
agtaggaacaatagcgatac

SEQ ID NO: 55159 - DNA, 20 bp, Artificial Sequence
  chemically synthesized
tcattttcaagtaggaacaa

SEQ ID NO: 55160 - DNA, 20 bp, Artificial Sequence
  chemically synthesized
cactgaaatcattttcaagt

SEQ ID NO: 55161 - DNA, 20 bp, Artificial Sequence
  chemically synthesized
gcactgaaatcattttcaag

SEQ ID NO: 55162 - DNA, 20 bp, Artificial Sequence
  chemically synthesized
agtgcactgaaatcattttc

SEQ ID NO: 55163 - DNA, 20 bp, Artificial Sequence
  chemically synthesized
ttcctacttgaaaatgattt

SEQ ID NO: 55164 - DNA, 20 bp, Artificial Sequence
  chemically synthesized
gtctagaaaaagtttgatat

SEQ ID NO: 55165 - DNA, 20 bp, Artificial Sequence
  chemically synthesized
cactgatatcaaactttttc

SEQ ID NO: 55166 - DNA, 20 bp, Artificial Sequence
  chemically synthesized
actttggaaaagtctagaaa

SEQ ID NO: 55167 - DNA, 20 bp, Artificial Sequence
  chemically synthesized
ccgattactttggaaaagtc

SEQ ID NO: 55168 - DNA, 20 bp, Artificial Sequence
  chemically synthesized
actttttctagacttttcca

SEQ ID NO: 55169 - DNA, 20 bp, Artificial Sequence
  chemically synthesized
catttccgattactttggaa

SEQ ID NO: 55170 - DNA, 20 bp, Artificial Sequence
  chemically synthesized
ctagacttttccaaagtaat

SEQ ID NO: 55171 - DNA, 20 bp, Artificial Sequence
  chemically synthesized
tggagcatttccgattactt

SEQ ID NO: 55172 - DNA, 20 bp, Artificial Sequence
  chemically synthesized
tcaaaaagtttcaaaatttg

SEQ ID NO: 55173 - DNA, 20 bp, Artificial Sequence
  chemically synthesized
actcaaaaagtttcaaaatt

SEQ ID NO: 55174 - DNA, 20 bp, Artificial Sequence
  chemically synthesized
tccaaattttgaaacttttt

SEQ ID NO: 55175 - DNA, 20 bp, Artificial Sequence
  chemically synthesized
acgtcatgtcagtactcaaa

SEQ ID NO: 55176 - DNA, 20 bp, Artificial Sequence
  chemically synthesized
ttccacttgtgacgtcatgt

SEQ ID NO: 55177 - DNA, 20 bp, Artificial Sequence
  chemically synthesized
gagtactgacatgacgtcac

SEQ ID NO: 55178 - DNA, 20 bp, Artificial Sequence
  chemically synthesized
tactgacatgacgtcacaag

SEQ ID NO: 55179 - DNA, 20 bp, Artificial Sequence
  chemically synthesized
gtgacctgtcacatgaggtc

SEQ ID NO: 55180 - DNA, 20 bp, Artificial Sequence
  chemically synthesized
tgtgacctgtcacatgaggt

SEQ ID NO: 55181 - DNA, 20 bp, Artificial Sequence
  chemically synthesized
tcacacctgacctcatgtga

SEQ ID NO: 55182 - DNA, 20 bp, Artificial Sequence
  chemically synthesized
tgactgtgacctgtcacatg

SEQ ID NO: 55183 - DNA, 20 bp, Artificial Sequence
  chemically synthesized
cacacctgacctcatgtgac

SEQ ID NO: 55184 - DNA, 20 bp, Artificial Sequence
  chemically synthesized
ttgactgtgacctgtcacat

SEQ ID NO: 55185 - DNA, 20 bp, Artificial Sequence
  chemically synthesized
tgacctcatgtgacaggtca

SEQ ID NO: 55186 - DNA, 20 bp, Artificial Sequence
  chemically synthesized
cttttgtgcgtgaaacacaa

SEQ ID NO: 55187 - DNA, 20 bp, Artificial Sequence
  chemically synthesized
cttttgtgtttcacgcacaa

SEQ ID NO: 55188 - DNA, 20 bp, Artificial Sequence
  chemically synthesized
atattgtataaaatttcctt

SEQ ID NO: 55189 - DNA, 20 bp, Artificial Sequence
  chemically synthesized
tattgtataaaatttccttc

SEQ ID NO: 55190 - DNA, 20 bp, Artificial Sequence
  chemically synthesized
attgtataaaatttccttca

SEQ ID NO: 55191 - DNA, 20 bp, Artificial Sequence
  chemically synthesized
accttatacacataccctga

SEQ ID NO: 55192 - DNA, 20 bp, Artificial Sequence
  chemically synthesized
taccttatacacataccctg

SEQ ID NO: 55193 - DNA, 20 bp, Artificial Sequence
  chemically synthesized
ttccttcagggtatgtgtat

SEQ ID NO: 55194 - DNA, 20 bp, Artificial Sequence
  chemically synthesized
tccttcagggtatgtgtata

SEQ ID NO: 55195 - DNA, 20 bp, Artificial Sequence
  chemically synthesized
atataaatgaatttcatgtt

SEQ ID NO: 55196 - DNA, 20 bp, Artificial Sequence
  chemically synthesized
tataaatgaatttcatgttt

SEQ ID NO: 55197 - DNA, 20 bp, Artificial Sequence
  chemically synthesized
atgaatttcatgtttaggct

SEQ ID NO: 55198 - DNA, 20 bp, Artificial Sequence
  chemically synthesized
tgaatttcatgtttaggctt

SEQ ID NO: 55199 - DNA, 20 bp, Artificial Sequence
  chemically synthesized
gatatcttgggatgggaccc

SEQ ID NO: 55200 - DNA, 20 bp, Artificial Sequence
  chemically synthesized
ttaggcttgggtcccatccc

SEQ ID NO: 55201 - DNA, 20 bp, Artificial Sequence
  chemically synthesized
ctcatgagatatcttgggat

SEQ ID NO: 55202 - DNA, 20 bp, Artificial Sequence
  chemically synthesized
cctcatgagatatcttggga

SEQ ID NO: 55203 - DNA, 20 bp, Artificial Sequence
  chemically synthesized
tattcctcatgagatatctt

SEQ ID NO: 55204 - DNA, 20 bp, Artificial Sequence
  chemically synthesized
atattcctcatgagatatct

SEQ ID NO: 55205 - DNA, 20 bp, Artificial Sequence
  chemically synthesized
cccatcccaagatatctcat

SEQ ID NO: 55206 - DNA, 20 bp, Artificial Sequence
  chemically synthesized
ccatcccaagatatctcatg

SEQ ID NO: 55207 - DNA, 20 bp, Artificial Sequence
  chemically synthesized
aatatttgcatattcctcat

SEQ ID NO: 55208 - DNA, 20 bp, Artificial Sequence
  chemically synthesized
ttttttatttttgtggattt

SEQ ID NO: 55209 - DNA, 20 bp, Artificial Sequence
  chemically synthesized
ttttggattttttatttttg

SEQ ID NO: 55210 - DNA, 20 bp, Artificial Sequence
  chemically synthesized
gcttgggaccagaagtgttt

SEQ ID NO: 55211 - DNA, 20 bp, Artificial Sequence
  chemically synthesized
taaaaaatccaaaacacttc

SEQ ID NO: 55212 - DNA, 20 bp, Artificial Sequence
  chemically synthesized
tccaaaatgcttgggaccag

SEQ ID NO: 55213 - DNA, 20 bp, Artificial Sequence
  chemically synthesized
tccaaaacacttctggtccc

SEQ ID NO: 55214 - DNA, 20 bp, Artificial Sequence
  chemically synthesized
ttatccaaaatgcttgggac

SEQ ID NO: 55215 - DNA, 20 bp, Artificial Sequence
  chemically synthesized
attccttatccaaaatgctt

SEQ ID NO: 55216 - DNA, 20 bp, Artificial Sequence
  chemically synthesized
acttctggtcccaagcattt

SEQ ID NO: 55217 - DNA, 20 bp, Artificial Sequence
  chemically synthesized
tattccttatccaaaatgct

SEQ ID NO: 55218 - DNA, 20 bp, Artificial Sequence
  chemically synthesized
tggtcccaagcattttggat

SEQ ID NO: 55219 - DNA, 20 bp, Artificial Sequence
  chemically synthesized
ggtcccaagcattttggata

SEQ ID NO: 55220 - DNA, 20 bp, Artificial Sequence
  chemically synthesized
gttagatcggaaaacaagtt

SEQ ID NO: 55221 - DNA, 20 bp, Artificial Sequence
  chemically synthesized
gccaggttagatcggaaaac

SEQ ID NO: 55222 - DNA, 20 bp, Artificial Sequence
  chemically synthesized
atgttagggccaggttagat

SEQ ID NO: 55223 - DNA, 20 bp, Artificial Sequence
  chemically synthesized
acttgttttccgatctaacc

SEQ ID NO: 55224 - DNA, 20 bp, Artificial Sequence
  chemically synthesized
gttgaatgttagggccaggt

SEQ ID NO: 55225 - DNA, 20 bp, Artificial Sequence
  chemically synthesized
caaagttgaatgttagggcc

SEQ ID NO: 55226 - DNA, 20 bp, Artificial Sequence
  chemically synthesized
acaaagttgaatgttagggc

SEQ ID NO: 55227 - DNA, 20 bp, Artificial Sequence
  chemically synthesized
tattacaaagttgaatgtta

SEQ ID NO: 55228 - DNA, 20 bp, Artificial Sequence
  chemically synthesized
atattacaaagttgaatgtt

SEQ ID NO: 55229 - DNA, 20 bp, Artificial Sequence
  chemically synthesized
tatattacaaagttgaatgt

SEQ ID NO: 55230 - DNA, 20 bp, Artificial Sequence
  chemically synthesized
tttcttcattatatattaca

SEQ ID NO: 55231 - DNA, 20 bp, Artificial Sequence
  chemically synthesized
caactttgtaatatataatg

SEQ ID NO: 55232 - DNA, 20 bp, Artificial Sequence
  chemically synthesized
ataatgaagaaataaaacaa

SEQ ID NO: 55233 - DNA, 20 bp, Artificial Sequence
  chemically synthesized
aatgaagaaataaaacaaca

SEQ ID NO: 55234 - DNA, 20 bp, Artificial Sequence
  chemically synthesized
aagaaataaaacaacagagt

SEQ ID NO: 55235 - DNA, 20 bp, Artificial Sequence
  chemically synthesized
agaaataaaacaacagagta

SEQ ID NO: 55236 - DNA, 20 bp, Artificial Sequence
  chemically synthesized
ataaaacaacagagtaaggc

SEQ ID NO: 55237 - DNA, 20 bp, Artificial Sequence
  chemically synthesized
taaaacaacagagtaaggcc

SEQ ID NO: 55238 - DNA, 20 bp, Artificial Sequence
  chemically synthesized
caacagagtaaggccgggtg

SEQ ID NO: 55239 - DNA, 20 bp, Artificial Sequence
  chemically synthesized
cagagtaaggccgggtgcgg

SEQ ID NO: 55240 - DNA, 20 bp, Artificial Sequence
  chemically synthesized
caggcctgagccaccgcacc

SEQ ID NO: 55241 - DNA, 20 bp, Artificial Sequence
  chemically synthesized
taaggccgggtgcggtggct

SEQ ID NO: 55242 - DNA, 20 bp, Artificial Sequence
  chemically synthesized
aaggccgggtgcggtggctc

SEQ ID NO: 55243 - DNA, 20 bp, Artificial Sequence
  chemically synthesized
agtgctgggattacaggcct

SEQ ID NO: 55244 - DNA, 20 bp, Artificial Sequence
  chemically synthesized
gtggctcaggcctgtaatcc

SEQ ID NO: 55245 - DNA, 20 bp, Artificial Sequence
  chemically synthesized
tcccgaagtgctgggattac

SEQ ID NO: 55246 - DNA, 20 bp, Artificial Sequence
  chemically synthesized
ctcccgaagtgctgggatta

SEQ ID NO: 55247 - DNA, 20 bp, Artificial Sequence
  chemically synthesized
ggcctgtaatcccagcactt

SEQ ID NO: 55248 - DNA, 20 bp, Artificial Sequence
  chemically synthesized
cctcggcctcccgaagtgct

SEQ ID NO: 55249 - DNA, 20 bp, Artificial Sequence
  chemically synthesized
gcctgtaatcccagcacttc

SEQ ID NO: 55250 - DNA, 20 bp, Artificial Sequence
  chemically synthesized
gcctcggcctcccgaagtgc

SEQ ID NO: 55251 - DNA, 20 bp, Artificial Sequence
  chemically synthesized
ctgtaatcccagcacttcgg

SEQ ID NO: 55252 - DNA, 20 bp, Artificial Sequence
  chemically synthesized
tgtaatcccagcacttcggg

SEQ ID NO: 55253 - DNA, 20 bp, Artificial Sequence
  chemically synthesized
ccaccagcctcggcctcccg

SEQ ID NO: 55254 - DNA, 20 bp, Artificial Sequence
  chemically synthesized
tcccagcacttcgggaggcc

SEQ ID NO: 55255 - DNA, 20 bp, Artificial Sequence
  chemically synthesized
cccagcacttcgggaggccg

SEQ ID NO: 55256 - DNA, 20 bp, Artificial Sequence
  chemically synthesized
gcacttcgggaggccgaggc

SEQ ID NO: 55257 - DNA, 20 bp, Artificial Sequence
  chemically synthesized
cttcgggaggccgaggctgg

SEQ ID NO: 55258 - DNA, 20 bp, Artificial Sequence
  chemically synthesized
acctcgtgatccaccagcct

SEQ ID NO: 55259 - DNA, 20 bp, Artificial Sequence
  chemically synthesized
ctcctgacctcgtgatccac

SEQ ID NO: 55260 - DNA, 20 bp, Artificial Sequence
  chemically synthesized
ggccgaggctggtggatcac

SEQ ID NO: 55261 - DNA, 20 bp, Artificial Sequence
  chemically synthesized
gccgaggctggtggatcacg

SEQ ID NO: 55262 - DNA, 20 bp, Artificial Sequence
  chemically synthesized
aggctggtggatcacgaggt

SEQ ID NO: 55263 - DNA, 20 bp, Artificial Sequence
  chemically synthesized
ggctggtggatcacgaggtc

SEQ ID NO: 55264 - DNA, 20 bp, Artificial Sequence
  chemically synthesized
ctggtggatcacgaggtcag

SEQ ID NO: 55265 - DNA, 20 bp, Artificial Sequence
  chemically synthesized
gatcacgaggtcaggagatc

SEQ ID NO: 55266 - DNA, 20 bp, Artificial Sequence
  chemically synthesized
tcaggagatcgagaccatcc

SEQ ID NO: 55267 - DNA, 20 bp, Artificial Sequence
  chemically synthesized
tttcaccgtgttagccagga

SEQ ID NO: 55268 - DNA, 20 bp, Artificial Sequence
  chemically synthesized
ggggtttcaccgtgttagcc

SEQ ID NO: 55269 - DNA, 20 bp, Artificial Sequence
  chemically synthesized
cgagaccatcctggctaaca

SEQ ID NO: 55270 - DNA, 20 bp, Artificial Sequence
  chemically synthesized
cggggtttcaccgtgttagc

SEQ ID NO: 55271 - DNA, 20 bp, Artificial Sequence
  chemically synthesized
gagacggggtttcaccgtgt

SEQ ID NO: 55272 - DNA, 20 bp, Artificial Sequence
  chemically synthesized
acacggtgaaaccccgtctc

SEQ ID NO: 55273 - DNA, 20 bp, Artificial Sequence
  chemically synthesized
ttgtgtttttactagagacg

SEQ ID NO: 55274 - DNA, 20 bp, Artificial Sequence
  chemically synthesized
tttgtgtttttactagagac

SEQ ID NO: 55275 - DNA, 20 bp, Artificial Sequence
  chemically synthesized
ttttgtgtttttactagaga

SEQ ID NO: 55276 - DNA, 20 bp, Artificial Sequence
  chemically synthesized
atttttttgtgtttttacta

SEQ ID NO: 55277 - DNA, 20 bp, Artificial Sequence
  chemically synthesized
taatttttttgtgtttttac

SEQ ID NO: 55278 - DNA, 20 bp, Artificial Sequence
  chemically synthesized
aaaacacaaaaaaattaaat

SEQ ID NO: 55279 - DNA, 20 bp, Artificial Sequence
  chemically synthesized
cacaaaaaaattaaattagc

SEQ ID NO: 55280 - DNA, 20 bp, Artificial Sequence
  chemically synthesized
acaaaaaaattaaattagcc

SEQ ID NO: 55281 - DNA, 20 bp, Artificial Sequence
  chemically synthesized
aaaattaaattagccgggca

SEQ ID NO: 55282 - DNA, 20 bp, Artificial Sequence
  chemically synthesized
attaaattagccgggcatgg

SEQ ID NO: 55283 - DNA, 20 bp, Artificial Sequence
  chemically synthesized
caggtgcccgccaccatgcc

SEQ ID NO: 55284 - DNA, 20 bp, Artificial Sequence
  chemically synthesized
aaattagccgggcatggtgg

SEQ ID NO: 55285 - DNA, 20 bp, Artificial Sequence
  chemically synthesized
aattagccgggcatggtggc

SEQ ID NO: 55286 - DNA, 20 bp, Artificial Sequence
  chemically synthesized
ggcatggtggcgggcacctg

SEQ ID NO: 55287 - DNA, 20 bp, Artificial Sequence
  chemically synthesized
gtggcgggcacctgtagtcc

SEQ ID NO: 55288 - DNA, 20 bp, Artificial Sequence
  chemically synthesized
tcccgagcagctgggactac

SEQ ID NO: 55289 - DNA, 20 bp, Artificial Sequence
  chemically synthesized
ctcccgagcagctgggacta

SEQ ID NO: 55290 - DNA, 20 bp, Artificial Sequence
  chemically synthesized
cacctgtagtcccagctgct

SEQ ID NO: 55291 - DNA, 20 bp, Artificial Sequence
  chemically synthesized
cctcaacctcccgagcagct

SEQ ID NO: 55292 - DNA, 20 bp, Artificial Sequence
  chemically synthesized
acctgtagtcccagctgctc

SEQ ID NO: 55293 - DNA, 20 bp, Artificial Sequence
  chemically synthesized
gcctcaacctcccgagcagc

SEQ ID NO: 55294 - DNA, 20 bp, Artificial Sequence
  chemically synthesized
ctgtagtcccagctgctcgg

SEQ ID NO: 55295 - DNA, 20 bp, Artificial Sequence
  chemically synthesized
tgtagtcccagctgctcggg

SEQ ID NO: 55296 - DNA, 20 bp, Artificial Sequence
  chemically synthesized
tcctgcctcaacctcccgag

SEQ ID NO: 55297 - DNA, 20 bp, Artificial Sequence
  chemically synthesized
ttctcctgcctcaacctccc

SEQ ID NO: 55298 - DNA, 20 bp, Artificial Sequence
  chemically synthesized
tcccagctgctcgggaggtt

SEQ ID NO: 55299 - DNA, 20 bp, Artificial Sequence
  chemically synthesized
cccagctgctcgggaggttg

SEQ ID NO: 55300 - DNA, 20 bp, Artificial Sequence
  chemically synthesized
agctgctcgggaggttgagg

SEQ ID NO: 55301 - DNA, 20 bp, Artificial Sequence
  chemically synthesized
gctgctcgggaggttgaggc

SEQ ID NO: 55302 - DNA, 20 bp, Artificial Sequence
  chemically synthesized
tgctcgggaggttgaggcag

SEQ ID NO: 55303 - DNA, 20 bp, Artificial Sequence
  chemically synthesized
gggaggttgaggcaggagaa

SEQ ID NO: 55304 - DNA, 20 bp, Artificial Sequence
  chemically synthesized
caggagaatggcgtgaaccc

SEQ ID NO: 55305 - DNA, 20 bp, Artificial Sequence
  chemically synthesized
ggagaatggcgtgaaccccg

SEQ ID NO: 55306 - DNA, 20 bp, Artificial Sequence
  chemically synthesized
gagaatggcgtgaaccccgg

SEQ ID NO: 55307 - DNA, 20 bp, Artificial Sequence
  chemically synthesized
aatggcgtgaaccccggagg

SEQ ID NO: 55308 - DNA, 20 bp, Artificial Sequence
  chemically synthesized
cactgcaagctccgcctccg

SEQ ID NO: 55309 - DNA, 20 bp, Artificial Sequence
  chemically synthesized
tggcgtgaaccccggaggcg

SEQ ID NO: 55310 - DNA, 20 bp, Artificial Sequence
  chemically synthesized
tcactgcaagctccgcctcc

SEQ ID NO: 55311 - DNA, 20 bp, Artificial Sequence
  chemically synthesized
ctcactgcaagctccgcctc

SEQ ID NO: 55312 - DNA, 20 bp, Artificial Sequence
  chemically synthesized
aaccccggaggcggagcttg

SEQ ID NO: 55313 - DNA, 20 bp, Artificial Sequence
  chemically synthesized
ccggaggcggagcttgcagt

SEQ ID NO: 55314 - DNA, 20 bp, Artificial Sequence
  chemically synthesized
gcacgatctcggctcactgc

SEQ ID NO: 55315 - DNA, 20 bp, Artificial Sequence
  chemically synthesized
ggcggagcttgcagtgagcc

SEQ ID NO: 55316 - DNA, 20 bp, Artificial Sequence
  chemically synthesized
ggagtgcagtggcacgatct

SEQ ID NO: 55317 - DNA, 20 bp, Artificial Sequence
  chemically synthesized
tcacccaggctggagtgcag

SEQ ID NO: 55318 - DNA, 20 bp, Artificial Sequence
  chemically synthesized
gagatcgtgccactgcactc

SEQ ID NO: 55319 - DNA, 20 bp, Artificial Sequence
  chemically synthesized
ctgtcacccaggctggagtg

SEQ ID NO: 55320 - DNA, 20 bp, Artificial Sequence
  chemically synthesized
cgtgccactgcactccagcc

SEQ ID NO: 55321 - DNA, 20 bp, Artificial Sequence
  chemically synthesized
gtgccactgcactccagcct

SEQ ID NO: 55322 - DNA, 20 bp, Artificial Sequence
  chemically synthesized
tcactctgtcacccaggctg

SEQ ID NO: 55323 - DNA, 20 bp, Artificial Sequence
  chemically synthesized
tctcactctgtcacccaggc

SEQ ID NO: 55324 - DNA, 20 bp, Artificial Sequence
  chemically synthesized
ctgcactccagcctgggtga

SEQ ID NO: 55325 - DNA, 20 bp, Artificial Sequence
  chemically synthesized
ggtgtctcactctgtcaccc

SEQ ID NO: 55326 - DNA, 20 bp, Artificial Sequence
  chemically synthesized
gcactccagcctgggtgaca

SEQ ID NO: 55327 - DNA, 20 bp, Artificial Sequence
  chemically synthesized
cggtgtctcactctgtcacc

SEQ ID NO: 55328 - DNA, 20 bp, Artificial Sequence
  chemically synthesized
tccagcctgggtgacagagt

SEQ ID NO: 55329 - DNA, 20 bp, Artificial Sequence
  chemically synthesized
tttgtttttgttttttgaga

SEQ ID NO: 55330 - DNA, 20 bp, Artificial Sequence
  chemically synthesized
tgtttttgtttttgtttttt

SEQ ID NO: 55331 - DNA, 20 bp, Artificial Sequence
  chemically synthesized
aaaaacaaacaaacaaacaa

SEQ ID NO: 55332 - DNA, 20 bp, Artificial Sequence
  chemically synthesized
aaacaaacaaacaaacaaca

SEQ ID NO: 55333 - DNA, 20 bp, Artificial Sequence
  chemically synthesized
caaacaacagagtaaacttc

SEQ ID NO: 55334 - DNA, 20 bp, Artificial Sequence
  chemically synthesized
aacaacagagtaaacttcca

SEQ ID NO: 55335 - DNA, 20 bp, Artificial Sequence
  chemically synthesized
tatagatttgtttactctgg

SEQ ID NO: 55336 - DNA, 20 bp, Artificial Sequence
  chemically synthesized
aggtatagatttgtttactc

SEQ ID NO: 55337 - DNA, 20 bp, Artificial Sequence
  chemically synthesized
gagtaaacaaatctatacct

SEQ ID NO: 55338 - DNA, 20 bp, Artificial Sequence
  chemically synthesized
agtaaacaaatctatacctc

SEQ ID NO: 55339 - DNA, 20 bp, Artificial Sequence
  chemically synthesized
gtaaacaaatctatacctca

SEQ ID NO: 55340 - DNA, 20 bp, Artificial Sequence
  chemically synthesized
atttaaatatccctgaggta

SEQ ID NO: 55341 - DNA, 20 bp, Artificial Sequence
  chemically synthesized
ctgatatttaaatatccctg

SEQ ID NO: 55342 - DNA, 20 bp, Artificial Sequence
  chemically synthesized
tctgatatttaaatatccct

SEQ ID NO: 55343 - DNA, 20 bp, Artificial Sequence
  chemically synthesized
cctcagggatatttaaatat

SEQ ID NO: 55344 - DNA, 20 bp, Artificial Sequence
  chemically synthesized
agatggtaagtcaaaagtat

SEQ ID NO: 55345 - DNA, 20 bp, Artificial Sequence
  chemically synthesized
ttatgaagatggtaagtcaa

SEQ ID NO: 55346 - DNA, 20 bp, Artificial Sequence
  chemically synthesized
cattgccttatgaagatggt

SEQ ID NO: 55347 - DNA, 20 bp, Artificial Sequence
  chemically synthesized
ttttgacttaccatcttcat

SEQ ID NO: 55348 - DNA, 20 bp, Artificial Sequence
  chemically synthesized
tatgcattgccttatgaaga

SEQ ID NO: 55349 - DNA, 20 bp, Artificial Sequence
  chemically synthesized
tttgacttaccatcttcata

SEQ ID NO: 55350 - DNA, 20 bp, Artificial Sequence
  chemically synthesized
agcatatgcattgccttatg

SEQ ID NO: 55351 - DNA, 20 bp, Artificial Sequence
  chemically synthesized
ggcaatgcatatgctgaaca

SEQ ID NO: 55352 - DNA, 20 bp, Artificial Sequence
  chemically synthesized
agataagaatcatctgtgtt

SEQ ID NO: 55353 - DNA, 20 bp, Artificial Sequence
  chemically synthesized
ccttagtttggtgaacagat

SEQ ID NO: 55354 - DNA, 20 bp, Artificial Sequence
  chemically synthesized
aaagaccttagtttggtgaa

SEQ ID NO: 55355 - DNA, 20 bp, Artificial Sequence
  chemically synthesized
tcttatctgttcaccaaact

SEQ ID NO: 55356 - DNA, 20 bp, Artificial Sequence
  chemically synthesized
cttatctgttcaccaaacta

SEQ ID NO: 55357 - DNA, 20 bp, Artificial Sequence
  chemically synthesized
agtccttaaagaccttagtt

SEQ ID NO: 55358 - DNA, 20 bp, Artificial Sequence
  chemically synthesized
gttaaagtccttaaagacct

SEQ ID NO: 55359 - DNA, 20 bp, Artificial Sequence
  chemically synthesized
ttcaccaaactaaggtcttt

SEQ ID NO: 55360 - DNA, 20 bp, Artificial Sequence
  chemically synthesized
tcaccaaactaaggtcttta

SEQ ID NO: 55361 - DNA, 20 bp, Artificial Sequence
  chemically synthesized
cttagtagttaaagtcctta

SEQ ID NO: 55362 - DNA, 20 bp, Artificial Sequence
  chemically synthesized
gtaaatattcttagtagtta

SEQ ID NO: 55363 - DNA, 20 bp, Artificial Sequence
  chemically synthesized
ctttaaggactttaactact

SEQ ID NO: 55364 - DNA, 20 bp, Artificial Sequence
  chemically synthesized
attaacgtaaatattcttag

SEQ ID NO: 55365 - DNA, 20 bp, Artificial Sequence
  chemically synthesized
tgaattaacgtaaatattct

SEQ ID NO: 55366 - DNA, 20 bp, Artificial Sequence
  chemically synthesized
aagaatatttacgttaattc

SEQ ID NO: 55367 - DNA, 20 bp, Artificial Sequence
  chemically synthesized
ttaatatttgttttaaaaaa

SEQ ID NO: 55368 - DNA, 20 bp, Artificial Sequence
  chemically synthesized
tctatatcctgaatatttaa

SEQ ID NO: 55369 - DNA, 20 bp, Artificial Sequence
  chemically synthesized
aacagaatcttttaaatatt

SEQ ID NO: 55370 - DNA, 20 bp, Artificial Sequence
  chemically synthesized
acagaatcttttaaatattc

SEQ ID NO: 55371 - DNA, 20 bp, Artificial Sequence
  chemically synthesized
tcttttaaatattcaggata

SEQ ID NO: 55372 - DNA, 20 bp, Artificial Sequence
  chemically synthesized
ccagaaagggtagattgaat

SEQ ID NO: 55373 - DNA, 20 bp, Artificial Sequence
  chemically synthesized
ccaattcaatctaccctttc

SEQ ID NO: 55374 - DNA, 20 bp, Artificial Sequence
  chemically synthesized
taacttttgaccagaaaggg

SEQ ID NO: 55375 - DNA, 20 bp, Artificial Sequence
  chemically synthesized
atttaacttttgaccagaaa

SEQ ID NO: 55376 - DNA, 20 bp, Artificial Sequence
  chemically synthesized
tatttaacttttgaccagaa

SEQ ID NO: 55377 - DNA, 20 bp, Artificial Sequence
  chemically synthesized
ttatttaacttttgaccaga

SEQ ID NO: 55378 - DNA, 20 bp, Artificial Sequence
  chemically synthesized
aatctaccctttctggtcaa

SEQ ID NO: 55379 - DNA, 20 bp, Artificial Sequence
  chemically synthesized
caatttatttaacttttgac

SEQ ID NO: 55380 - DNA, 20 bp, Artificial Sequence
  chemically synthesized
tggtcaaaagttaaataaat

SEQ ID NO: 55381 - DNA, 20 bp, Artificial Sequence
  chemically synthesized
caaaagttaaataaattgga

SEQ ID NO: 55382 - DNA, 20 bp, Artificial Sequence
  chemically synthesized
aataaattggatggaatctc

SEQ ID NO: 55383 - DNA, 20 bp, Artificial Sequence
  chemically synthesized
atatgtagttatgaatactt

SEQ ID NO: 55384 - DNA, 20 bp, Artificial Sequence
  chemically synthesized
aagtattcataactacatat

SEQ ID NO: 55385 - DNA, 20 bp, Artificial Sequence
  chemically synthesized
atagtttttgttcttatatg

SEQ ID NO: 55386 - DNA, 20 bp, Artificial Sequence
  chemically synthesized
atataagaacaaaaactatc

SEQ ID NO: 55387 - DNA, 20 bp, Artificial Sequence
  chemically synthesized
ttttgttgatacattcttga

SEQ ID NO: 55388 - DNA, 20 bp, Artificial Sequence
  chemically synthesized
tatcaagaatgtatcaacaa

SEQ ID NO: 55389 - DNA, 20 bp, Artificial Sequence
  chemically synthesized
atcaagaatgtatcaacaaa

SEQ ID NO: 55390 - DNA, 20 bp, Artificial Sequence
  chemically synthesized
gtatcaacaaaaggtttccg

SEQ ID NO: 55391 - DNA, 20 bp, Artificial Sequence
  chemically synthesized
atgtgtactgaaagaggcca

SEQ ID NO: 55392 - DNA, 20 bp, Artificial Sequence
  chemically synthesized
aaggtttccgtggcctcttt

SEQ ID NO: 55393 - DNA, 20 bp, Artificial Sequence
  chemically synthesized
tgtcttatgtgtactgaaag

SEQ ID NO: 55394 - DNA, 20 bp, Artificial Sequence
  chemically synthesized
atgtcttatgtgtactgaaa

SEQ ID NO: 55395 - DNA, 20 bp, Artificial Sequence
  chemically synthesized
acatgtcttatgtgtactga

SEQ ID NO: 55396 - DNA, 20 bp, Artificial Sequence
  chemically synthesized
tggcctctttcagtacacat

SEQ ID NO: 55397 - DNA, 20 bp, Artificial Sequence
  chemically synthesized
aaaaaaaaaaaaaaaaaaaa

SEQ ID NO: 55398 - DNA, 20 bp, Artificial Sequence
  chemically synthesized
tttttttttttttttttttt

SEQ ID NO: 55399 - DNA, 20 bp, Artificial Sequence
  chemically synthesized
ttttttttttttttttgaga

SEQ ID NO: 55400 - DNA, 20 bp, Artificial Sequence
  chemically synthesized
ttttttttttttttgagaca

SEQ ID NO: 55401 - DNA, 20 bp, Artificial Sequence
  chemically synthesized
ctccagcctggtgacagagc

SEQ ID NO: 55402 - DNA, 20 bp, Artificial Sequence
  chemically synthesized
acagagtcttgctctgtcac

SEQ ID NO: 55403 - DNA, 20 bp, Artificial Sequence
  chemically synthesized
cagagtcttgctctgtcacc

SEQ ID NO: 55404 - DNA, 20 bp, Artificial Sequence
  chemically synthesized
tgcactccagcctggtgaca

SEQ ID NO: 55405 - DNA, 20 bp, Artificial Sequence
  chemically synthesized
actgcactccagcctggtga

SEQ ID NO: 55406 - DNA, 20 bp, Artificial Sequence
  chemically synthesized
gtcttgctctgtcaccaggc

SEQ ID NO: 55407 - DNA, 20 bp, Artificial Sequence
  chemically synthesized
cttgctctgtcaccaggctg

SEQ ID NO: 55408 - DNA, 20 bp, Artificial Sequence
  chemically synthesized
ggcgccactgcactccagcc

SEQ ID NO: 55409 - DNA, 20 bp, Artificial Sequence
  chemically synthesized
tctgtcaccaggctggagtg

SEQ ID NO: 55410 - DNA, 20 bp, Artificial Sequence
  chemically synthesized
gagatggcgccactgcactc

SEQ ID NO: 55411 - DNA, 20 bp, Artificial Sequence
  chemically synthesized
gtcaccaggctggagtgcag

SEQ ID NO: 55412 - DNA, 20 bp, Artificial Sequence
  chemically synthesized
ggagtgcagtggcgccatct

SEQ ID NO: 55413 - DNA, 20 bp, Artificial Sequence
  chemically synthesized
gaagttgcagtgagccgaga

SEQ ID NO: 55414 - DNA, 20 bp, Artificial Sequence
  chemically synthesized
agcggaagttgcagtgagcc

SEQ ID NO: 55415 - DNA, 20 bp, Artificial Sequence
  chemically synthesized
cgggaagcggaagttgcagt

SEQ ID NO: 55416 - DNA, 20 bp, Artificial Sequence
  chemically synthesized
aacccgggaagcggaagttg

SEQ ID NO: 55417 - DNA, 20 bp, Artificial Sequence
  chemically synthesized
cgcttgaacccgggaagcgg

SEQ ID NO: 55418 - DNA, 20 bp, Artificial Sequence
  chemically synthesized
tcactgcaacttccgcttcc

SEQ ID NO: 55419 - DNA, 20 bp, Artificial Sequence
  chemically synthesized
cactgcaacttccgcttccc

SEQ ID NO: 55420 - DNA, 20 bp, Artificial Sequence
  chemically synthesized
aatcgcttgaacccgggaag

SEQ ID NO: 55421 - DNA, 20 bp, Artificial Sequence
  chemically synthesized
gagaatcgcttgaacccggg

SEQ ID NO: 55422 - DNA, 20 bp, Artificial Sequence
  chemically synthesized
aacttccgcttcccgggttc

SEQ ID NO: 55423 - DNA, 20 bp, Artificial Sequence
  chemically synthesized
caggagaatcgcttgaaccc

SEQ ID NO: 55424 - DNA, 20 bp, Artificial Sequence
  chemically synthesized
gcaggagaatcgcttgaacc

SEQ ID NO: 55425 - DNA, 20 bp, Artificial Sequence
  chemically synthesized
ttcaagcgattctcctgcct

SEQ ID NO: 55426 - DNA, 20 bp, Artificial Sequence
  chemically synthesized
tactggggaggccgaggcag

SEQ ID NO: 55427 - DNA, 20 bp, Artificial Sequence
  chemically synthesized
gctactggggaggccgaggc

SEQ ID NO: 55428 - DNA, 20 bp, Artificial Sequence
  chemically synthesized
agctactggggaggccgagg

SEQ ID NO: 55429 - DNA, 20 bp, Artificial Sequence
  chemically synthesized
cccagctactggggaggccg

SEQ ID NO: 55430 - DNA, 20 bp, Artificial Sequence
  chemically synthesized
tcccagctactggggaggcc

SEQ ID NO: 55431 - DNA, 20 bp, Artificial Sequence
  chemically synthesized
ttctcctgcctcggcctccc

SEQ ID NO: 55432 - DNA, 20 bp, Artificial Sequence
  chemically synthesized
tcctgcctcggcctccccag

SEQ ID NO: 55433 - DNA, 20 bp, Artificial Sequence
  chemically synthesized
tgtagtcccagctactgggg

SEQ ID NO: 55434 - DNA, 20 bp, Artificial Sequence
  chemically synthesized
ctgtagtcccagctactggg

SEQ ID NO: 55435 - DNA, 20 bp, Artificial Sequence
  chemically synthesized
gcctcggcctccccagtagc

SEQ ID NO: 55436 - DNA, 20 bp, Artificial Sequence
  chemically synthesized
gcctgtagtcccagctactg

SEQ ID NO: 55437 - DNA, 20 bp, Artificial Sequence
  chemically synthesized
cctcggcctccccagtagct

SEQ ID NO: 55438 - DNA, 20 bp, Artificial Sequence
  chemically synthesized
tgcctgtagtcccagctact

SEQ ID NO: 55439 - DNA, 20 bp, Artificial Sequence
  chemically synthesized
atgcctgtagtcccagctac

SEQ ID NO: 55440 - DNA, 20 bp, Artificial Sequence
  chemically synthesized
ctccccagtagctgggacta

SEQ ID NO: 55441 - DNA, 20 bp, Artificial Sequence
  chemically synthesized
tccccagtagctgggactac

SEQ ID NO: 55442 - DNA, 20 bp, Artificial Sequence
  chemically synthesized
gtggtgcatgcctgtagtcc

SEQ ID NO: 55443 - DNA, 20 bp, Artificial Sequence
  chemically synthesized
ggcgtggtggtgcatgcctg

SEQ ID NO: 55444 - DNA, 20 bp, Artificial Sequence
  chemically synthesized
caggcatgcaccaccacgcc

SEQ ID NO: 55445 - DNA, 20 bp, Artificial Sequence
  chemically synthesized
caaaaattagccaggcgtgg

SEQ ID NO: 55446 - DNA, 20 bp, Artificial Sequence
  chemically synthesized
atacaaaaattagccaggcg

SEQ ID NO: 55447 - DNA, 20 bp, Artificial Sequence
  chemically synthesized
taaaaatacaaaaattagcc

SEQ ID NO: 55448 - DNA, 20 bp, Artificial Sequence
  chemically synthesized
ctaaaaatacaaaaattagc

SEQ ID NO: 55449 - DNA, 20 bp, Artificial Sequence
  chemically synthesized
tctactaaaaatacaaaaat

SEQ ID NO: 55450 - DNA, 20 bp, Artificial Sequence
  chemically synthesized
ctggctaatttttgtatttt

SEQ ID NO: 55451 - DNA, 20 bp, Artificial Sequence
  chemically synthesized
gctaatttttgtatttttag

SEQ ID NO: 55452 - DNA, 20 bp, Artificial Sequence
  chemically synthesized
taatttttgtatttttagta

SEQ ID NO: 55453 - DNA, 20 bp, Artificial Sequence
  chemically synthesized
tttgtatttttagtagagat

SEQ ID NO: 55454 - DNA, 20 bp, Artificial Sequence
  chemically synthesized
atgagtttcaccatgttgcc

SEQ ID NO: 55455 - DNA, 20 bp, Artificial Sequence
  chemically synthesized
caagaccatcctgggcaaca

SEQ ID NO: 55456 - DNA, 20 bp, Artificial Sequence
  chemically synthesized
tgagtttcaccatgttgccc

SEQ ID NO: 55457 - DNA, 20 bp, Artificial Sequence
  chemically synthesized
tttcaccatgttgcccagga

SEQ ID NO: 55458 - DNA, 20 bp, Artificial Sequence
  chemically synthesized
caggagatcaagaccatcct

SEQ ID NO: 55459 - DNA, 20 bp, Artificial Sequence
  chemically synthesized
tcaggagatcaagaccatcc

SEQ ID NO: 55460 - DNA, 20 bp, Artificial Sequence
  chemically synthesized
gatcacgagatcaggagatc

SEQ ID NO: 55461 - DNA, 20 bp, Artificial Sequence
  chemically synthesized
tgggcggatcacgagatcag

SEQ ID NO: 55462 - DNA, 20 bp, Artificial Sequence
  chemically synthesized
ggtgggcggatcacgagatc

SEQ ID NO: 55463 - DNA, 20 bp, Artificial Sequence
  chemically synthesized
aggtgggcggatcacgagat

SEQ ID NO: 55464 - DNA, 20 bp, Artificial Sequence
  chemically synthesized
ggccgaggtgggcggatcac

SEQ ID NO: 55465 - DNA, 20 bp, Artificial Sequence
  chemically synthesized
atctcgtgatccgcccacct

SEQ ID NO: 55466 - DNA, 20 bp, Artificial Sequence
  chemically synthesized
ctttgggaggccgaggtggg

SEQ ID NO: 55467 - DNA, 20 bp, Artificial Sequence
  chemically synthesized
gtactttgggaggccgaggt

SEQ ID NO: 55468 - DNA, 20 bp, Artificial Sequence
  chemically synthesized
agtactttgggaggccgagg

SEQ ID NO: 55469 - DNA, 20 bp, Artificial Sequence
  chemically synthesized
cccagtactttgggaggccg

SEQ ID NO: 55470 - DNA, 20 bp, Artificial Sequence
  chemically synthesized
tcccagtactttgggaggcc

SEQ ID NO: 55471 - DNA, 20 bp, Artificial Sequence
  chemically synthesized
ccgcccacctcggcctccca

SEQ ID NO: 55472 - DNA, 20 bp, Artificial Sequence
  chemically synthesized
tgtaatcccagtactttggg

SEQ ID NO: 55473 - DNA, 20 bp, Artificial Sequence
  chemically synthesized
ctgtaatcccagtactttgg

SEQ ID NO: 55474 - DNA, 20 bp, Artificial Sequence
  chemically synthesized
acctcggcctcccaaagtac

SEQ ID NO: 55475 - DNA, 20 bp, Artificial Sequence
  chemically synthesized
gcctgtaatcccagtacttt

SEQ ID NO: 55476 - DNA, 20 bp, Artificial Sequence
  chemically synthesized
cctcggcctcccaaagtact

SEQ ID NO: 55477 - DNA, 20 bp, Artificial Sequence
  chemically synthesized
cgcctgtaatcccagtactt

SEQ ID NO: 55478 - DNA, 20 bp, Artificial Sequence
  chemically synthesized
ctcccaaagtactgggatta

SEQ ID NO: 55479 - DNA, 20 bp, Artificial Sequence
  chemically synthesized
tcccaaagtactgggattac

SEQ ID NO: 55480 - DNA, 20 bp, Artificial Sequence
  chemically synthesized
gtggctcacgcctgtaatcc

SEQ ID NO: 55481 - DNA, 20 bp, Artificial Sequence
  chemically synthesized
agtactgggattacaggcgt

SEQ ID NO: 55482 - DNA, 20 bp, Artificial Sequence
  chemically synthesized
caggcgtgagccaccgtgcc

SEQ ID NO: 55483 - DNA, 20 bp, Artificial Sequence
  chemically synthesized
catgtcttggccgggcacgg

SEQ ID NO: 55484 - DNA, 20 bp, Artificial Sequence
  chemically synthesized
atacatgtcttggccgggca

SEQ ID NO: 55485 - DNA, 20 bp, Artificial Sequence
  chemically synthesized
gtgagccaccgtgcccggcc

SEQ ID NO: 55486 - DNA, 20 bp, Artificial Sequence
  chemically synthesized
taaagatacatgtcttggcc

SEQ ID NO: 55487 - DNA, 20 bp, Artificial Sequence
  chemically synthesized
ataaagatacatgtcttggc

SEQ ID NO: 55488 - DNA, 20 bp, Artificial Sequence
  chemically synthesized
ctctataaagatacatgtct

SEQ ID NO: 55489 - DNA, 20 bp, Artificial Sequence
  chemically synthesized
ggccaagacatgtatcttta

SEQ ID NO: 55490 - DNA, 20 bp, Artificial Sequence
  chemically synthesized
ccaagacatgtatctttata

SEQ ID NO: 55491 - DNA, 20 bp, Artificial Sequence
  chemically synthesized
ttgagaaaccttgctctata

SEQ ID NO: 55492 - DNA, 20 bp, Artificial Sequence
  chemically synthesized
gacatgtatctttatagagc

SEQ ID NO: 55493 - DNA, 20 bp, Artificial Sequence
  chemically synthesized
acatgtatctttatagagca

SEQ ID NO: 55494 - DNA, 20 bp, Artificial Sequence
  chemically synthesized
agagcaaggtttctcaactt

SEQ ID NO: 55495 - DNA, 20 bp, Artificial Sequence
  chemically synthesized
atgtcaataatgctgaagtt

SEQ ID NO: 55496 - DNA, 20 bp, Artificial Sequence
  chemically synthesized
ccaaaatgtcaataatgctg

SEQ ID NO: 55497 - DNA, 20 bp, Artificial Sequence
  chemically synthesized
cttcagcattattgacattt

SEQ ID NO: 55498 - DNA, 20 bp, Artificial Sequence
  chemically synthesized
gcattattgacattttggcc

SEQ ID NO: 55499 - DNA, 20 bp, Artificial Sequence
  chemically synthesized
cattattgacattttggcct

SEQ ID NO: 55500 - DNA, 20 bp, Artificial Sequence
  chemically synthesized
agcacaacaaaaaattgccc

SEQ ID NO: 55501 - DNA, 20 bp, Artificial Sequence
  chemically synthesized
tagcacaacaaaaaattgcc

SEQ ID NO: 55502 - DNA, 20 bp, Artificial Sequence
  chemically synthesized
tctataattcgtgggataga

SEQ ID NO: 55503 - DNA, 20 bp, Artificial Sequence
  chemically synthesized
attctctataattcgtggga

SEQ ID NO: 55504 - DNA, 20 bp, Artificial Sequence
  chemically synthesized
aggcattctctataattcgt

SEQ ID NO: 55505 - DNA, 20 bp, Artificial Sequence
  chemically synthesized
gctatctatcccacgaatta

SEQ ID NO: 55506 - DNA, 20 bp, Artificial Sequence
  chemically synthesized
taggcattctctataattcg

SEQ ID NO: 55507 - DNA, 20 bp, Artificial Sequence
  chemically synthesized
tatctatcccacgaattata

SEQ ID NO: 55508 - DNA, 20 bp, Artificial Sequence
  chemically synthesized
cacgaattatagagaatgcc

SEQ ID NO: 55509 - DNA, 20 bp, Artificial Sequence
  chemically synthesized
gaattatagagaatgcctag

SEQ ID NO: 55510 - DNA, 20 bp, Artificial Sequence
  chemically synthesized
tagaagttgtggatgctgct

SEQ ID NO: 55511 - DNA, 20 bp, Artificial Sequence
  chemically synthesized
gtagaagttgtggatgctgc

SEQ ID NO: 55512 - DNA, 20 bp, Artificial Sequence
  chemically synthesized
catctagtgggtagaagttg

SEQ ID NO: 55513 - DNA, 20 bp, Artificial Sequence
  chemically synthesized
tactggcatctagtgggtag

SEQ ID NO: 55514 - DNA, 20 bp, Artificial Sequence
  chemically synthesized
catccacaacttctacccac

SEQ ID NO: 55515 - DNA, 20 bp, Artificial Sequence
  chemically synthesized
tgctactggcatctagtggg

SEQ ID NO: 55516 - DNA, 20 bp, Artificial Sequence
  chemically synthesized
aggtgctactggcatctagt

SEQ ID NO: 55517 - DNA, 20 bp, Artificial Sequence
  chemically synthesized
gaggtgctactggcatctag

SEQ ID NO: 55518 - DNA, 20 bp, Artificial Sequence
  chemically synthesized
aacttctacccactagatgc

SEQ ID NO: 55519 - DNA, 20 bp, Artificial Sequence
  chemically synthesized
gaggaggtgctactggcatc

SEQ ID NO: 55520 - DNA, 20 bp, Artificial Sequence
  chemically synthesized
ttctacccactagatgccag

SEQ ID NO: 55521 - DNA, 20 bp, Artificial Sequence
  chemically synthesized
aactggtgaggaggtgctac

SEQ ID NO: 55522 - DNA, 20 bp, Artificial Sequence
  chemically synthesized
tgccagtagcacctcctcac

SEQ ID NO: 55523 - DNA, 20 bp, Artificial Sequence
  chemically synthesized
agttgtcccaactggtgagg

SEQ ID NO: 55524 - DNA, 20 bp, Artificial Sequence
  chemically synthesized
cagttgtcccaactggtgag

SEQ ID NO: 55525 - DNA, 20 bp, Artificial Sequence
  chemically synthesized
agtagcacctcctcaccagt

SEQ ID NO: 55526 - DNA, 20 bp, Artificial Sequence
  chemically synthesized
ttcagttgtcccaactggtg

SEQ ID NO: 55527 - DNA, 20 bp, Artificial Sequence
  chemically synthesized
gtagcacctcctcaccagtt

SEQ ID NO: 55528 - DNA, 20 bp, Artificial Sequence
  chemically synthesized
tttcagttgtcccaactggt

SEQ ID NO: 55529 - DNA, 20 bp, Artificial Sequence
  chemically synthesized
acattttcagttgtcccaac

SEQ ID NO: 55530 - DNA, 20 bp, Artificial Sequence
  chemically synthesized
gcaatttctggagacatttt

SEQ ID NO: 55531 - DNA, 20 bp, Artificial Sequence
  chemically synthesized
gggacaactgaaaatgtctc

SEQ ID NO: 55532 - DNA, 20 bp, Artificial Sequence
  chemically synthesized
aggggacatggcaatttctg

SEQ ID NO: 55533 - DNA, 20 bp, Artificial Sequence
  chemically synthesized
ccaggggacatggcaatttc

SEQ ID NO: 55534 - DNA, 20 bp, Artificial Sequence
  chemically synthesized
ccagaaattgccatgtcccc

SEQ ID NO: 55535 - DNA, 20 bp, Artificial Sequence
  chemically synthesized
agtctgtcccccaggggaca

SEQ ID NO: 55536 - DNA, 20 bp, Artificial Sequence
  chemically synthesized
cagaaattgccatgtcccct

SEQ ID NO: 55537 - DNA, 20 bp, Artificial Sequence
  chemically synthesized
agaaattgccatgtcccctg

SEQ ID NO: 55538 - DNA, 20 bp, Artificial Sequence
  chemically synthesized
gaaattgccatgtcccctgg

SEQ ID NO: 55539 - DNA, 20 bp, Artificial Sequence
  chemically synthesized
agagcaagtctgtcccccag

SEQ ID NO: 55540 - DNA, 20 bp, Artificial Sequence
  chemically synthesized
ttgccatgtcccctggggga

SEQ ID NO: 55541 - DNA, 20 bp, Artificial Sequence
  chemically synthesized
aagagcaagtctgtccccca

SEQ ID NO: 55542 - DNA, 20 bp, Artificial Sequence
  chemically synthesized
caagagcaagtctgtccccc

SEQ ID NO: 55543 - DNA, 20 bp, Artificial Sequence
  chemically synthesized
ccaagagcaagtctgtcccc

SEQ ID NO: 55544 - DNA, 20 bp, Artificial Sequence
  chemically synthesized
ctgggggacagacttgctct

SEQ ID NO: 55545 - DNA, 20 bp, Artificial Sequence
  chemically synthesized
agtggttctcaaccaagagc

SEQ ID NO: 55546 - DNA, 20 bp, Artificial Sequence
  chemically synthesized
ggacagacttgctcttggtt

SEQ ID NO: 55547 - DNA, 20 bp, Artificial Sequence
  chemically synthesized
cactagtggttctcaaccaa

SEQ ID NO: 55548 - DNA, 20 bp, Artificial Sequence
  chemically synthesized
tacactagtggttctcaacc

SEQ ID NO: 55549 - DNA, 20 bp, Artificial Sequence
  chemically synthesized
tgctcttggttgagaaccac

SEQ ID NO: 55550 - DNA, 20 bp, Artificial Sequence
  chemically synthesized
gaaagtttactgtacactag

SEQ ID NO: 55551 - DNA, 20 bp, Artificial Sequence
  chemically synthesized
ggttgagaaccactagtgta

SEQ ID NO: 55552 - DNA, 20 bp, Artificial Sequence
  chemically synthesized
ggtgaaagtttactgtacac

SEQ ID NO: 55553 - DNA, 20 bp, Artificial Sequence
  chemically synthesized
gtatatgaagtagagggtga

SEQ ID NO: 55554 - DNA, 20 bp, Artificial Sequence
  chemically synthesized
atctgtgtatatgaagtaga

SEQ ID NO: 55555 - DNA, 20 bp, Artificial Sequence
  chemically synthesized
tatctgtgtatatgaagtag

SEQ ID NO: 55556 - DNA, 20 bp, Artificial Sequence
  chemically synthesized
atatctgtgtatatgaagta

SEQ ID NO: 55557 - DNA, 20 bp, Artificial Sequence
  chemically synthesized
caatatctgtgtatatgaag

SEQ ID NO: 55558 - DNA, 20 bp, Artificial Sequence
  chemically synthesized
catcaatatctgtgtatatg

SEQ ID NO: 55559 - DNA, 20 bp, Artificial Sequence
  chemically synthesized
caccctctacttcatataca

SEQ ID NO: 55560 - DNA, 20 bp, Artificial Sequence
  chemically synthesized
atacacagatattgatgttt

SEQ ID NO: 55561 - DNA, 20 bp, Artificial Sequence
  chemically synthesized
cagatattgatgtttgagat

SEQ ID NO: 55562 - DNA, 20 bp, Artificial Sequence
  chemically synthesized
gatattgatgtttgagataa

SEQ ID NO: 55563 - DNA, 20 bp, Artificial Sequence
  chemically synthesized
tattgatgtttgagataaga

SEQ ID NO: 55564 - DNA, 20 bp, Artificial Sequence
  chemically synthesized
accagttatagacatagaat

SEQ ID NO: 55565 - DNA, 20 bp, Artificial Sequence
  chemically synthesized
aaccagttatagacatagaa

SEQ ID NO: 55566 - DNA, 20 bp, Artificial Sequence
  chemically synthesized
tcctcaaccagttatagaca

SEQ ID NO: 55567 - DNA, 20 bp, Artificial Sequence
  chemically synthesized
tcctattctatgtctataac

SEQ ID NO: 55568 - DNA, 20 bp, Artificial Sequence
  chemically synthesized
tctccttcctcaaccagtta

SEQ ID NO: 55569 - DNA, 20 bp, Artificial Sequence
  chemically synthesized
ttctatgtctataactggtt

SEQ ID NO: 55570 - DNA, 20 bp, Artificial Sequence
  chemically synthesized
tctatgtctataactggttg

SEQ ID NO: 55571 - DNA, 20 bp, Artificial Sequence
  chemically synthesized
atgtctataactggttgagg

SEQ ID NO: 55572 - DNA, 20 bp, Artificial Sequence
  chemically synthesized
ttaacttctccttcctcaac

SEQ ID NO: 55573 - DNA, 20 bp, Artificial Sequence
  chemically synthesized
tgtctataactggttgagga

SEQ ID NO: 55574 - DNA, 20 bp, Artificial Sequence
  chemically synthesized
tctataactggttgaggaag

SEQ ID NO: 55575 - DNA, 20 bp, Artificial Sequence
  chemically synthesized
ataactggttgaggaaggag

SEQ ID NO: 55576 - DNA, 20 bp, Artificial Sequence
  chemically synthesized
gttgaggaaggagaagttaa

SEQ ID NO: 55577 - DNA, 20 bp, Artificial Sequence
  chemically synthesized
aaggagaagttaacagtccc

SEQ ID NO: 55578 - DNA, 20 bp, Artificial Sequence
  chemically synthesized
caatagtctgtatataactc

SEQ ID NO: 55579 - DNA, 20 bp, Artificial Sequence
  chemically synthesized
acaatagtctgtatataact

SEQ ID NO: 55580 - DNA, 20 bp, Artificial Sequence
  chemically synthesized
taacagtcccgagttatata

SEQ ID NO: 55581 - DNA, 20 bp, Artificial Sequence
  chemically synthesized
agttatatacagactattgt

SEQ ID NO: 55582 - DNA, 20 bp, Artificial Sequence
  chemically synthesized
gaattgggcagatctgacaa

SEQ ID NO: 55583 - DNA, 20 bp, Artificial Sequence
  chemically synthesized
attgtcagatctgcccaatt

SEQ ID NO: 55584 - DNA, 20 bp, Artificial Sequence
  chemically synthesized
tagaggaatactgaattggg

SEQ ID NO: 55585 - DNA, 20 bp, Artificial Sequence
  chemically synthesized
aattagaggaatactgaatt

SEQ ID NO: 55586 - DNA, 20 bp, Artificial Sequence
  chemically synthesized
caattagaggaatactgaat

SEQ ID NO: 55587 - DNA, 20 bp, Artificial Sequence
  chemically synthesized
caattcagtattcctctaat

SEQ ID NO: 55588 - DNA, 20 bp, Artificial Sequence
  chemically synthesized
gagcaaagactgccaattag

SEQ ID NO: 55589 - DNA, 20 bp, Artificial Sequence
  chemically synthesized
ttcagtattcctctaattgg

SEQ ID NO: 55590 - DNA, 20 bp, Artificial Sequence
  chemically synthesized
agagcaaagactgccaatta

SEQ ID NO: 55591 - DNA, 20 bp, Artificial Sequence
  chemically synthesized
ccagagcaaagactgccaat

SEQ ID NO: 55592 - DNA, 20 bp, Artificial Sequence
  chemically synthesized
ctaattggcagtctttgctc

SEQ ID NO: 55593 - DNA, 20 bp, Artificial Sequence
  chemically synthesized
caacaaggaatgccagagca

SEQ ID NO: 55594 - DNA, 20 bp, Artificial Sequence
  chemically synthesized
cagcacaacaaggaatgcca

SEQ ID NO: 55595 - DNA, 20 bp, Artificial Sequence
  chemically synthesized
gtcagcacaacaaggaatgc

SEQ ID NO: 55596 - DNA, 20 bp, Artificial Sequence
  chemically synthesized
gactctgtgtcagcacaaca

SEQ ID NO: 55597 - DNA, 20 bp, Artificial Sequence
  chemically synthesized
agactctgtgtcagcacaac

SEQ ID NO: 55598 - DNA, 20 bp, Artificial Sequence
  chemically synthesized
cattccttgttgtgctgaca

SEQ ID NO: 55599 - DNA, 20 bp, Artificial Sequence
  chemically synthesized
ttccttgttgtgctgacaca

SEQ ID NO: 55600 - DNA, 20 bp, Artificial Sequence
  chemically synthesized
agatcttctagactctgtgt

SEQ ID NO: 55601 - DNA, 20 bp, Artificial Sequence
  chemically synthesized
tgttgtgctgacacagagtc

SEQ ID NO: 55602 - DNA, 20 bp, Artificial Sequence
  chemically synthesized
tgtgctgacacagagtctag

SEQ ID NO: 55603 - DNA, 20 bp, Artificial Sequence
  chemically synthesized
agatcacaatgcagatcttc

SEQ ID NO: 55604 - DNA, 20 bp, Artificial Sequence
  chemically synthesized
gaagccatcagatcacaatg

SEQ ID NO: 55605 - DNA, 20 bp, Artificial Sequence
  chemically synthesized
agatctgcattgtgatctga

SEQ ID NO: 55606 - DNA, 20 bp, Artificial Sequence
  chemically synthesized
aattgaacaagggaagccat

SEQ ID NO: 55607 - DNA, 20 bp, Artificial Sequence
  chemically synthesized
gaagcagaattgaacaaggg

SEQ ID NO: 55608 - DNA, 20 bp, Artificial Sequence
  chemically synthesized
gtggaagcagaattgaacaa

SEQ ID NO: 55609 - DNA, 20 bp, Artificial Sequence
  chemically synthesized
ggtggaagcagaattgaaca

SEQ ID NO: 55610 - DNA, 20 bp, Artificial Sequence
  chemically synthesized
gggtggaagcagaattgaac

SEQ ID NO: 55611 - DNA, 20 bp, Artificial Sequence
  chemically synthesized
tgaagaaataggggtggaag

SEQ ID NO: 55612 - DNA, 20 bp, Artificial Sequence
  chemically synthesized
ctgtgaagaaataggggtgg

SEQ ID NO: 55613 - DNA, 20 bp, Artificial Sequence
  chemically synthesized
cacctgtgaagaaatagggg

SEQ ID NO: 55614 - DNA, 20 bp, Artificial Sequence
  chemically synthesized
taacacctgtgaagaaatag

SEQ ID NO: 55615 - DNA, 20 bp, Artificial Sequence
  chemically synthesized
ataacacctgtgaagaaata

SEQ ID NO: 55616 - DNA, 20 bp, Artificial Sequence
  chemically synthesized
aataacacctgtgaagaaat

SEQ ID NO: 55617 - DNA, 20 bp, Artificial Sequence
  chemically synthesized
gaataacacctgtgaagaaa

SEQ ID NO: 55618 - DNA, 20 bp, Artificial Sequence
  chemically synthesized
cttccacccctatttcttca

SEQ ID NO: 55619 - DNA, 20 bp, Artificial Sequence
  chemically synthesized
ttccacccctatttcttcac

SEQ ID NO: 55620 - DNA, 20 bp, Artificial Sequence
  chemically synthesized
attgcagaataacacctgtg

SEQ ID NO: 55621 - DNA, 20 bp, Artificial Sequence
  chemically synthesized
atgccagggcagatttattg

SEQ ID NO: 55622 - DNA, 20 bp, Artificial Sequence
  chemically synthesized
attctgcaataaatctgccc

SEQ ID NO: 55623 - DNA, 20 bp, Artificial Sequence
  chemically synthesized
ccaagaagcagatgccaggg

SEQ ID NO: 55624 - DNA, 20 bp, Artificial Sequence
  chemically synthesized
cctccaagaagcagatgcca

SEQ ID NO: 55625 - DNA, 20 bp, Artificial Sequence
  chemically synthesized
tcctccaagaagcagatgcc

SEQ ID NO: 55626 - DNA, 20 bp, Artificial Sequence
  chemically synthesized
gtcctccaagaagcagatgc

SEQ ID NO: 55627 - DNA, 20 bp, Artificial Sequence
  chemically synthesized
ctgccctggcatctgcttct

SEQ ID NO: 55628 - DNA, 20 bp, Artificial Sequence
  chemically synthesized
gccctggcatctgcttcttg

SEQ ID NO: 55629 - DNA, 20 bp, Artificial Sequence
  chemically synthesized
aggttgagtcctccaagaag

SEQ ID NO: 55630 - DNA, 20 bp, Artificial Sequence
  chemically synthesized
ccctggcatctgcttcttgg

SEQ ID NO: 55631 - DNA, 20 bp, Artificial Sequence
  chemically synthesized
tgcaggttgagtcctccaag

SEQ ID NO: 55632 - DNA, 20 bp, Artificial Sequence
  chemically synthesized
tgttgcaggttgagtcctcc

SEQ ID NO: 55633 - DNA, 20 bp, Artificial Sequence
  chemically synthesized
attgattattgttgcaggtt

SEQ ID NO: 55634 - DNA, 20 bp, Artificial Sequence
  chemically synthesized
gattgattgattattgttgc

SEQ ID NO: 55635 - DNA, 20 bp, Artificial Sequence
  chemically synthesized
tgattgattgattattgttg

SEQ ID NO: 55636 - DNA, 20 bp, Artificial Sequence
  chemically synthesized
aggctaggggaatggaatcg

SEQ ID NO: 55637 - DNA, 20 bp, Artificial Sequence
  chemically synthesized
attccacgattccattcccc

SEQ ID NO: 55638 - DNA, 20 bp, Artificial Sequence
  chemically synthesized
gcccacctaggctaggggaa

SEQ ID NO: 55639 - DNA, 20 bp, Artificial Sequence
  chemically synthesized
acgattccattcccctagcc

SEQ ID NO: 55640 - DNA, 20 bp, Artificial Sequence
  chemically synthesized
cgattccattcccctagcct

SEQ ID NO: 55641 - DNA, 20 bp, Artificial Sequence
  chemically synthesized
cacatgcccacctaggctag

SEQ ID NO: 55642 - DNA, 20 bp, Artificial Sequence
  chemically synthesized
tcacatgcccacctaggcta

SEQ ID NO: 55643 - DNA, 20 bp, Artificial Sequence
  chemically synthesized
gtcacatgcccacctaggct

SEQ ID NO: 55644 - DNA, 20 bp, Artificial Sequence
  chemically synthesized
ttccattcccctagcctagg

SEQ ID NO: 55645 - DNA, 20 bp, Artificial Sequence
  chemically synthesized
ggtcacatgcccacctaggc

SEQ ID NO: 55646 - DNA, 20 bp, Artificial Sequence
  chemically synthesized
tccattcccctagcctaggt

SEQ ID NO: 55647 - DNA, 20 bp, Artificial Sequence
  chemically synthesized
attgggtcacatgcccacct

SEQ ID NO: 55648 - DNA, 20 bp, Artificial Sequence
  chemically synthesized
aattgggtcacatgcccacc

SEQ ID NO: 55649 - DNA, 20 bp, Artificial Sequence
  chemically synthesized
ggtgggcatgtgacccaatt

SEQ ID NO: 55650 - DNA, 20 bp, Artificial Sequence
  chemically synthesized
gtgggcatgtgacccaattt

SEQ ID NO: 55651 - DNA, 20 bp, Artificial Sequence
  chemically synthesized
gactctttatggcccaaatt

SEQ ID NO: 55652 - DNA, 20 bp, Artificial Sequence
  chemically synthesized
tgactctttatggcccaaat

SEQ ID NO: 55653 - DNA, 20 bp, Artificial Sequence
  chemically synthesized
gtgacccaatttgggccata

SEQ ID NO: 55654 - DNA, 20 bp, Artificial Sequence
  chemically synthesized
gacccaatttgggccataaa

SEQ ID NO: 55655 - DNA, 20 bp, Artificial Sequence
  chemically synthesized
agtatgggcttgactcttta

SEQ ID NO: 55656 - DNA, 20 bp, Artificial Sequence
  chemically synthesized
aatttgggccataaagagtc

SEQ ID NO: 55657 - DNA, 20 bp, Artificial Sequence
  chemically synthesized
cttaaagactggtcaagtat

SEQ ID NO: 55658 - DNA, 20 bp, Artificial Sequence
  chemically synthesized
gcttaaagactggtcaagta

SEQ ID NO: 55659 - DNA, 20 bp, Artificial Sequence
  chemically synthesized
gagtcaagcccatacttgac

SEQ ID NO: 55660 - DNA, 20 bp, Artificial Sequence
  chemically synthesized
cgagagcttaaagactggtc

SEQ ID NO: 55661 - DNA, 20 bp, Artificial Sequence
  chemically synthesized
cccatacttgaccagtcttt

SEQ ID NO: 55662 - DNA, 20 bp, Artificial Sequence
  chemically synthesized
tgacccgagagcttaaagac

SEQ ID NO: 55663 - DNA, 20 bp, Artificial Sequence
  chemically synthesized
tactctgacccgagagctta

SEQ ID NO: 55664 - DNA, 20 bp, Artificial Sequence
  chemically synthesized
ttgaccagtctttaagctct

SEQ ID NO: 55665 - DNA, 20 bp, Artificial Sequence
  chemically synthesized
tgaccagtctttaagctctc

SEQ ID NO: 55666 - DNA, 20 bp, Artificial Sequence
  chemically synthesized
cagtctttaagctctcgggt

SEQ ID NO: 55667 - DNA, 20 bp, Artificial Sequence
  chemically synthesized
agagagctactctgacccga

SEQ ID NO: 55668 - DNA, 20 bp, Artificial Sequence
  chemically synthesized
gtctttaagctctcgggtca

SEQ ID NO: 55669 - DNA, 20 bp, Artificial Sequence
  chemically synthesized
agagagagctactctgaccc

SEQ ID NO: 55670 - DNA, 20 bp, Artificial Sequence
  chemically synthesized
tttaagctctcgggtcagag

SEQ ID NO: 55671 - DNA, 20 bp, Artificial Sequence
  chemically synthesized
cataccctgcagaaaagaga

SEQ ID NO: 55672 - DNA, 20 bp, Artificial Sequence
  chemically synthesized
aacataccctgcagaaaaga

SEQ ID NO: 55673 - DNA, 20 bp, Artificial Sequence
  chemically synthesized
gagtagctctctcttttctg

SEQ ID NO: 55674 - DNA, 20 bp, Artificial Sequence
  chemically synthesized
tcaacataccctgcagaaaa

SEQ ID NO: 55675 - DNA, 20 bp, Artificial Sequence
  chemically synthesized
agtagctctctcttttctgc

SEQ ID NO: 55676 - DNA, 20 bp, Artificial Sequence
  chemically synthesized
gtagctctctcttttctgca

SEQ ID NO: 55677 - DNA, 20 bp, Artificial Sequence
  chemically synthesized
cctcaacataccctgcagaa

SEQ ID NO: 55678 - DNA, 20 bp, Artificial Sequence
  chemically synthesized
aacaccctcaacataccctg

SEQ ID NO: 55679 - DNA, 20 bp, Artificial Sequence
  chemically synthesized
tcttttctgcagggtatgtt

SEQ ID NO: 55680 - DNA, 20 bp, Artificial Sequence
  chemically synthesized
cttttctgcagggtatgttg

SEQ ID NO: 55681 - DNA, 20 bp, Artificial Sequence
  chemically synthesized
ttttctgcagggtatgttga

SEQ ID NO: 55682 - DNA, 20 bp, Artificial Sequence
  chemically synthesized
cagggtatgttgagggtgtt

SEQ ID NO: 55683 - DNA, 20 bp, Artificial Sequence
  chemically synthesized
gggtatgttgagggtgttaa

SEQ ID NO: 55684 - DNA, 20 bp, Artificial Sequence
  chemically synthesized
ggtatgttgagggtgttaag

SEQ ID NO: 55685 - DNA, 20 bp, Artificial Sequence
  chemically synthesized
tgttgagggtgttaagagga

SEQ ID NO: 55686 - DNA, 20 bp, Artificial Sequence
  chemically synthesized
tgagggtgttaagaggatgg

SEQ ID NO: 55687 - DNA, 20 bp, Artificial Sequence
  chemically synthesized
gagggtgttaagaggatggc

SEQ ID NO: 55688 - DNA, 20 bp, Artificial Sequence
  chemically synthesized
ggtgttaagaggatggcagg

SEQ ID NO: 55689 - DNA, 20 bp, Artificial Sequence
  chemically synthesized
gtgttaagaggatggcaggt

SEQ ID NO: 55690 - DNA, 20 bp, Artificial Sequence
  chemically synthesized
gaggatggcaggtgggcctg

SEQ ID NO: 55691 - DNA, 20 bp, Artificial Sequence
  chemically synthesized
ggcaggtgggcctgcagcaa

SEQ ID NO: 55692 - DNA, 20 bp, Artificial Sequence
  chemically synthesized
ggctttcagactattgctgc

SEQ ID NO: 55693 - DNA, 20 bp, Artificial Sequence
  chemically synthesized
tggctttcagactattgctg

SEQ ID NO: 55694 - DNA, 20 bp, Artificial Sequence
  chemically synthesized
ggcctgcagcaatagtctga

SEQ ID NO: 55695 - DNA, 20 bp, Artificial Sequence
  chemically synthesized
ttggtgacagtggtggcttt

SEQ ID NO: 55696 - DNA, 20 bp, Artificial Sequence
  chemically synthesized
aagggtgttggtgacagtgg

SEQ ID NO: 55697 - DNA, 20 bp, Artificial Sequence
  chemically synthesized
caaaagggtgttggtgacag

SEQ ID NO: 55698 - DNA, 20 bp, Artificial Sequence
  chemically synthesized
aaacaaaagggtgttggtga

SEQ ID NO: 55699 - DNA, 20 bp, Artificial Sequence
  chemically synthesized
gttaagaaacaaaagggtgt

SEQ ID NO: 55700 - DNA, 20 bp, Artificial Sequence
  chemically synthesized
agattagttaagaaacaaaa

SEQ ID NO: 55701 - DNA, 20 bp, Artificial Sequence
  chemically synthesized
cagattagttaagaaacaaa

SEQ ID NO: 55702 - DNA, 20 bp, Artificial Sequence
  chemically synthesized
tcagattagttaagaaacaa

SEQ ID NO: 55703 - DNA, 20 bp, Artificial Sequence
  chemically synthesized
aaactcaactcagattagtt

SEQ ID NO: 55704 - DNA, 20 bp, Artificial Sequence
  chemically synthesized
ttttgtttcttaactaatct

SEQ ID NO: 55705 - DNA, 20 bp, Artificial Sequence
  chemically synthesized
acagaaaactcaactcagat

SEQ ID NO: 55706 - DNA, 20 bp, Artificial Sequence
  chemically synthesized
tttcttaactaatctgagtt

SEQ ID NO: 55707 - DNA, 20 bp, Artificial Sequence
  chemically synthesized
aagtgacagaaaactcaact

SEQ ID NO: 55708 - DNA, 20 bp, Artificial Sequence
  chemically synthesized
gttgagttttctgtcactta

SEQ ID NO: 55709 - DNA, 20 bp, Artificial Sequence
  chemically synthesized
ggactcttggctgtaagtga

SEQ ID NO: 55710 - DNA, 20 bp, Artificial Sequence
  chemically synthesized
gttttctgtcacttacagcc

SEQ ID NO: 55711 - DNA, 20 bp, Artificial Sequence
  chemically synthesized
taggctggactcttggctgt

SEQ ID NO: 55712 - DNA, 20 bp, Artificial Sequence
  chemically synthesized
tttctgtcacttacagccaa

SEQ ID NO: 55713 - DNA, 20 bp, Artificial Sequence
  chemically synthesized
gtcacttacagccaagagtc

SEQ ID NO: 55714 - DNA, 20 bp, Artificial Sequence
  chemically synthesized
agtatattaggctggactct

SEQ ID NO: 55715 - DNA, 20 bp, Artificial Sequence
  chemically synthesized
tattataaagtatattaggc

SEQ ID NO: 55716 - DNA, 20 bp, Artificial Sequence
  chemically synthesized
cctttattataaagtatatt

SEQ ID NO: 55717 - DNA, 20 bp, Artificial Sequence
  chemically synthesized
ccctttattataaagtatat

SEQ ID NO: 55718 - DNA, 20 bp, Artificial Sequence
  chemically synthesized
gcctaatatactttataata

SEQ ID NO: 55719 - DNA, 20 bp, Artificial Sequence
  chemically synthesized
gtagtttcccctttattata

SEQ ID NO: 55720 - DNA, 20 bp, Artificial Sequence
  chemically synthesized
cctaatatactttataataa

SEQ ID NO: 55721 - DNA, 20 bp, Artificial Sequence
  chemically synthesized
ctaatatactttataataaa

SEQ ID NO: 55722 - DNA, 20 bp, Artificial Sequence
  chemically synthesized
taatatactttataataaag

SEQ ID NO: 55723 - DNA, 20 bp, Artificial Sequence
  chemically synthesized
ttataataaaggggaaacta

SEQ ID NO: 55724 - DNA, 20 bp, Artificial Sequence
  chemically synthesized
aattttcttaaatgtttctg

SEQ ID NO: 55725 - DNA, 20 bp, Artificial Sequence
  chemically synthesized
gggaaactacagaaacattt

SEQ ID NO: 55726 - DNA, 20 bp, Artificial Sequence
  chemically synthesized
acagaaacatttaagaaaat

SEQ ID NO: 55727 - DNA, 20 bp, Artificial Sequence
  chemically synthesized
aaaattagcattgatcctaa

SEQ ID NO: 55728 - DNA, 20 bp, Artificial Sequence
  chemically synthesized
ggtaatttgtaacaactttt

SEQ ID NO: 55729 - DNA, 20 bp, Artificial Sequence
  chemically synthesized
aggtaatttgtaacaacttt

SEQ ID NO: 55730 - DNA, 20 bp, Artificial Sequence
  chemically synthesized
tctgaatagttattgtgatg

SEQ ID NO: 55731 - DNA, 20 bp, Artificial Sequence
  chemically synthesized
ctctgaatagttattgtgat

SEQ ID NO: 55732 - DNA, 20 bp, Artificial Sequence
  chemically synthesized
acctcatcacaataactatt

SEQ ID NO: 55733 - DNA, 20 bp, Artificial Sequence
  chemically synthesized
ctcatcacaataactattca

SEQ ID NO: 55734 - DNA, 20 bp, Artificial Sequence
  chemically synthesized
cttaaatacgttgctctgaa

SEQ ID NO: 55735 - DNA, 20 bp, Artificial Sequence
  chemically synthesized
ctattcagagcaacgtattt

SEQ ID NO: 55736 - DNA, 20 bp, Artificial Sequence
  chemically synthesized
gcaacgtatttaagttgctc

SEQ ID NO: 55737 - DNA, 20 bp, Artificial Sequence
  chemically synthesized
caatgtgctttgtggttctt

SEQ ID NO: 55738 - DNA, 20 bp, Artificial Sequence
  chemically synthesized
taagttgctcaagaaccaca

SEQ ID NO: 55739 - DNA, 20 bp, Artificial Sequence
  chemically synthesized
taaaaaggcaatgtgctttg

SEQ ID NO: 55740 - DNA, 20 bp, Artificial Sequence
  chemically synthesized
aagtctctttaaatttaaaa

SEQ ID NO: 55741 - DNA, 20 bp, Artificial Sequence
  chemically synthesized
gaagtctctttaaatttaaa

SEQ ID NO: 55742 - DNA, 20 bp, Artificial Sequence
  chemically synthesized
acattgcctttttaaattta

SEQ ID NO: 55743 - DNA, 20 bp, Artificial Sequence
  chemically synthesized
attgcctttttaaatttaaa

SEQ ID NO: 55744 - DNA, 20 bp, Artificial Sequence
  chemically synthesized
ctctgtcccacatttttatg

SEQ ID NO: 55745 - DNA, 20 bp, Artificial Sequence
  chemically synthesized
aaagagacttcataaaaatg

SEQ ID NO: 55746 - DNA, 20 bp, Artificial Sequence
  chemically synthesized
aagagacttcataaaaatgt

SEQ ID NO: 55747 - DNA, 20 bp, Artificial Sequence
  chemically synthesized
gacttcataaaaatgtggga

SEQ ID NO: 55748 - DNA, 20 bp, Artificial Sequence
  chemically synthesized
cttcataaaaatgtgggaca

SEQ ID NO: 55749 - DNA, 20 bp, Artificial Sequence
  chemically synthesized
cataaaaatgtgggacagag

SEQ ID NO: 55750 - DNA, 20 bp, Artificial Sequence
  chemically synthesized
aaatgtgggacagagcagaa

SEQ ID NO: 55751 - DNA, 20 bp, Artificial Sequence
  chemically synthesized
cagaatggtacccattatta

SEQ ID NO: 55752 - DNA, 20 bp, Artificial Sequence
  chemically synthesized
taaaatcattctataataat

SEQ ID NO: 55753 - DNA, 20 bp, Artificial Sequence
  chemically synthesized
gtaaaatcattctataataa

SEQ ID NO: 55754 - DNA, 20 bp, Artificial Sequence
  chemically synthesized
tagaatgattttaccaactg

SEQ ID NO: 55755 - DNA, 20 bp, Artificial Sequence
  chemically synthesized
tggagaattaatgccgcagt

SEQ ID NO: 55756 - DNA, 20 bp, Artificial Sequence
  chemically synthesized
tctttggagaattaatgccg

SEQ ID NO: 55757 - DNA, 20 bp, Artificial Sequence
  chemically synthesized
actgcggcattaattctcca

SEQ ID NO: 55758 - DNA, 20 bp, Artificial Sequence
  chemically synthesized
gagactgggggaaatctttg

SEQ ID NO: 55759 - DNA, 20 bp, Artificial Sequence
  chemically synthesized
atgagactgggggaaatctt

SEQ ID NO: 55760 - DNA, 20 bp, Artificial Sequence
  chemically synthesized
aattctccaaagatttcccc

SEQ ID NO: 55761 - DNA, 20 bp, Artificial Sequence
  chemically synthesized
tttcttcataatgagactgg

SEQ ID NO: 55762 - DNA, 20 bp, Artificial Sequence
  chemically synthesized
atttcttcataatgagactg

SEQ ID NO: 55763 - DNA, 20 bp, Artificial Sequence
  chemically synthesized
tatttcttcataatgagact

SEQ ID NO: 55764 - DNA, 20 bp, Artificial Sequence
  chemically synthesized
ttatttcttcataatgagac

SEQ ID NO: 55765 - DNA, 20 bp, Artificial Sequence
  chemically synthesized
tttcccccagtctcattatg

SEQ ID NO: 55766 - DNA, 20 bp, Artificial Sequence
  chemically synthesized
gtctattatttcttcataat

SEQ ID NO: 55767 - DNA, 20 bp, Artificial Sequence
  chemically synthesized
gtctcattatgaagaaataa

SEQ ID NO: 55768 - DNA, 20 bp, Artificial Sequence
  chemically synthesized
ttatgaagaaataatagaca

SEQ ID NO: 55769 - DNA, 20 bp, Artificial Sequence
  chemically synthesized
aaataatagacatagaatac

SEQ ID NO: 55770 - DNA, 20 bp, Artificial Sequence
  chemically synthesized
aataatagacatagaatact

SEQ ID NO: 55771 - DNA, 20 bp, Artificial Sequence
  chemically synthesized
atagacatagaatactaggc

SEQ ID NO: 55772 - DNA, 20 bp, Artificial Sequence
  chemically synthesized
tagacatagaatactaggct

SEQ ID NO: 55773 - DNA, 20 bp, Artificial Sequence
  chemically synthesized
gtgagccaccgcacccagcc

SEQ ID NO: 55774 - DNA, 20 bp, Artificial Sequence
  chemically synthesized
atagaatactaggctgggtg

SEQ ID NO: 55775 - DNA, 20 bp, Artificial Sequence
  chemically synthesized
gaatactaggctgggtgcgg

SEQ ID NO: 55776 - DNA, 20 bp, Artificial Sequence
  chemically synthesized
catgcgtgagccaccgcacc

SEQ ID NO: 55777 - DNA, 20 bp, Artificial Sequence
  chemically synthesized
agtgctgggattacatgcgt

SEQ ID NO: 55778 - DNA, 20 bp, Artificial Sequence
  chemically synthesized
gtggctcacgcatgtaatcc

SEQ ID NO: 55779 - DNA, 20 bp, Artificial Sequence
  chemically synthesized
cgcatgtaatcccagcactt

SEQ ID NO: 55780 - DNA, 20 bp, Artificial Sequence
  chemically synthesized
cctcggcctcccaaagtgct

SEQ ID NO: 55781 - DNA, 20 bp, Artificial Sequence
  chemically synthesized
gcatgtaatcccagcacttt

SEQ ID NO: 55782 - DNA, 20 bp, Artificial Sequence
  chemically synthesized
gcctcggcctcccaaagtgc

SEQ ID NO: 55783 - DNA, 20 bp, Artificial Sequence
  chemically synthesized
atgtaatcccagcactttgg

SEQ ID NO: 55784 - DNA, 20 bp, Artificial Sequence
  chemically synthesized
tgtaatcccagcactttggg

SEQ ID NO: 55785 - DNA, 20 bp, Artificial Sequence
  chemically synthesized
ctgcccgcctcggcctccca

SEQ ID NO: 55786 - DNA, 20 bp, Artificial Sequence
  chemically synthesized
tcccagcactttgggaggcc

SEQ ID NO: 55787 - DNA, 20 bp, Artificial Sequence
  chemically synthesized
cccagcactttgggaggccg

SEQ ID NO: 55788 - DNA, 20 bp, Artificial Sequence
  chemically synthesized
agcactttgggaggccgagg

SEQ ID NO: 55789 - DNA, 20 bp, Artificial Sequence
  chemically synthesized
gcactttgggaggccgaggc

SEQ ID NO: 55790 - DNA, 20 bp, Artificial Sequence
  chemically synthesized
ctttgggaggccgaggcggg

SEQ ID NO: 55791 - DNA, 20 bp, Artificial Sequence
  chemically synthesized
atctcgtgatctgcccgcct

SEQ ID NO: 55792 - DNA, 20 bp, Artificial Sequence
  chemically synthesized
ggccgaggcgggcagatcac

SEQ ID NO: 55793 - DNA, 20 bp, Artificial Sequence
  chemically synthesized
aggcgggcagatcacgagat

SEQ ID NO: 55794 - DNA, 20 bp, Artificial Sequence
  chemically synthesized
ggcgggcagatcacgagatt

SEQ ID NO: 55795 - DNA, 20 bp, Artificial Sequence
  chemically synthesized
cgggcagatcacgagattag

SEQ ID NO: 55796 - DNA, 20 bp, Artificial Sequence
  chemically synthesized
gatcacgagattaggagatc

SEQ ID NO: 55797 - DNA, 20 bp, Artificial Sequence
  chemically synthesized
atcacgagattaggagatcg

SEQ ID NO: 55798 - DNA, 20 bp, Artificial Sequence
  chemically synthesized
ttaggagatcgaggccatcc

SEQ ID NO: 55799 - DNA, 20 bp, Artificial Sequence
  chemically synthesized
ggtttcaccgttagccagga

SEQ ID NO: 55800 - DNA, 20 bp, Artificial Sequence
  chemically synthesized
atcgaggccatcctggctaa

SEQ ID NO: 55801 - DNA, 20 bp, Artificial Sequence
  chemically synthesized
acggggtttcaccgttagcc

SEQ ID NO: 55802 - DNA, 20 bp, Artificial Sequence
  chemically synthesized
gacggggtttcaccgttagc

SEQ ID NO: 55803 - DNA, 20 bp, Artificial Sequence
  chemically synthesized
tacagacggggtttcaccgt

SEQ ID NO: 55804 - DNA, 20 bp, Artificial Sequence
  chemically synthesized
ttgtatttttagtacagacg

SEQ ID NO: 55805 - DNA, 20 bp, Artificial Sequence
  chemically synthesized
tttgtatttttagtacagac

SEQ ID NO: 55806 - DNA, 20 bp, Artificial Sequence
  chemically synthesized
ttttgtatttttagtacaga

SEQ ID NO: 55807 - DNA, 20 bp, Artificial Sequence
  chemically synthesized
aattttttgtatttttagta

SEQ ID NO: 55808 - DNA, 20 bp, Artificial Sequence
  chemically synthesized
tggctaattttttgtatttt

SEQ ID NO: 55809 - DNA, 20 bp, Artificial Sequence
  chemically synthesized
gtactaaaaatacaaaaaat

SEQ ID NO: 55810 - DNA, 20 bp, Artificial Sequence
  chemically synthesized
taaaaatacaaaaaattagc

SEQ ID NO: 55811 - DNA, 20 bp, Artificial Sequence
  chemically synthesized
aaaaatacaaaaaattagcc

SEQ ID NO: 55812 - DNA, 20 bp, Artificial Sequence
  chemically synthesized
tacaaaaaattagccaggcg

SEQ ID NO: 55813 - DNA, 20 bp, Artificial Sequence
  chemically synthesized
aaaaaattagccaggcgtgg

SEQ ID NO: 55814 - DNA, 20 bp, Artificial Sequence
  chemically synthesized
caggcgcccgccaccacgcc

SEQ ID NO: 55815 - DNA, 20 bp, Artificial Sequence
  chemically synthesized
aaattagccaggcgtggtgg

SEQ ID NO: 55816 - DNA, 20 bp, Artificial Sequence
  chemically synthesized
aattagccaggcgtggtggc

SEQ ID NO: 55817 - DNA, 20 bp, Artificial Sequence
  chemically synthesized
gtggcgggcgcctgtaatcc

SEQ ID NO: 55818 - DNA, 20 bp, Artificial Sequence
  chemically synthesized
tcctgagtagctgggattac

SEQ ID NO: 55819 - DNA, 20 bp, Artificial Sequence
  chemically synthesized
ctcctgagtagctgggatta

SEQ ID NO: 55820 - DNA, 20 bp, Artificial Sequence
  chemically synthesized
cgcctgtaatcccagctact

SEQ ID NO: 55821 - DNA, 20 bp, Artificial Sequence
  chemically synthesized
cctcagcctcctgagtagct

SEQ ID NO: 55822 - DNA, 20 bp, Artificial Sequence
  chemically synthesized
gcctgtaatcccagctactc

SEQ ID NO: 55823 - DNA, 20 bp, Artificial Sequence
  chemically synthesized
gcctcagcctcctgagtagc

SEQ ID NO: 55824 - DNA, 20 bp, Artificial Sequence
  chemically synthesized
ctgtaatcccagctactcag

SEQ ID NO: 55825 - DNA, 20 bp, Artificial Sequence
  chemically synthesized
tgtaatcccagctactcagg

SEQ ID NO: 55826 - DNA, 20 bp, Artificial Sequence
  chemically synthesized
tcctgcctcagcctcctgag

SEQ ID NO: 55827 - DNA, 20 bp, Artificial Sequence
  chemically synthesized
ttctcctgcctcagcctcct

SEQ ID NO: 55828 - DNA, 20 bp, Artificial Sequence
  chemically synthesized
tcccagctactcaggaggct

SEQ ID NO: 55829 - DNA, 20 bp, Artificial Sequence
  chemically synthesized
cccagctactcaggaggctg

SEQ ID NO: 55830 - DNA, 20 bp, Artificial Sequence
  chemically synthesized
agctactcaggaggctgagg

SEQ ID NO: 55831 - DNA, 20 bp, Artificial Sequence
  chemically synthesized
gctactcaggaggctgaggc

SEQ ID NO: 55832 - DNA, 20 bp, Artificial Sequence
  chemically synthesized
tactcaggaggctgaggcag

SEQ ID NO: 55833 - DNA, 20 bp, Artificial Sequence
  chemically synthesized
ttcaagtgattctcctgcct

SEQ ID NO: 55834 - DNA, 20 bp, Artificial Sequence
  chemically synthesized
gcaggagaatcacttgaacc

SEQ ID NO: 55835 - DNA, 20 bp, Artificial Sequence
  chemically synthesized
caggagaatcacttgaaccc

SEQ ID NO: 55836 - DNA, 20 bp, Artificial Sequence
  chemically synthesized
aacctccacctcccgggttc

SEQ ID NO: 55837 - DNA, 20 bp, Artificial Sequence
  chemically synthesized
ggagaatcacttgaacccgg

SEQ ID NO: 55838 - DNA, 20 bp, Artificial Sequence
  chemically synthesized
gagaatcacttgaacccggg

SEQ ID NO: 55839 - DNA, 20 bp, Artificial Sequence
  chemically synthesized
aatcacttgaacccgggagg

SEQ ID NO: 55840 - DNA, 20 bp, Artificial Sequence
  chemically synthesized
cactgcaacctccacctccc

SEQ ID NO: 55841 - DNA, 20 bp, Artificial Sequence
  chemically synthesized
tcacttgaacccgggaggtg

SEQ ID NO: 55842 - DNA, 20 bp, Artificial Sequence
  chemically synthesized
tcactgcaacctccacctcc

SEQ ID NO: 55843 - DNA, 20 bp, Artificial Sequence
  chemically synthesized
cacttgaacccgggaggtgg

SEQ ID NO: 55844 - DNA, 20 bp, Artificial Sequence
  chemically synthesized
aacccgggaggtggaggttg

SEQ ID NO: 55845 - DNA, 20 bp, Artificial Sequence
  chemically synthesized
cgggaggtggaggttgcagt

SEQ ID NO: 55846 - DNA, 20 bp, Artificial Sequence
  chemically synthesized
ggtggaggttgcagtgagcc

SEQ ID NO: 55847 - DNA, 20 bp, Artificial Sequence
  chemically synthesized
ggagtgcagtggtgtgatct

SEQ ID NO: 55848 - DNA, 20 bp, Artificial Sequence
  chemically synthesized
tcgcccaggctggagtgcag

SEQ ID NO: 55849 - DNA, 20 bp, Artificial Sequence
  chemically synthesized
gagatcacaccactgcactc

SEQ ID NO: 55850 - DNA, 20 bp, Artificial Sequence
  chemically synthesized
ctgtcgcccaggctggagtg

SEQ ID NO: 55851 - DNA, 20 bp, Artificial Sequence
  chemically synthesized
cacaccactgcactccagcc

SEQ ID NO: 55852 - DNA, 20 bp, Artificial Sequence
  chemically synthesized
acaccactgcactccagcct

SEQ ID NO: 55853 - DNA, 20 bp, Artificial Sequence
  chemically synthesized
tcgctctgtcgcccaggctg

SEQ ID NO: 55854 - DNA, 20 bp, Artificial Sequence
  chemically synthesized
tctcgctctgtcgcccaggc

SEQ ID NO: 55855 - DNA, 20 bp, Artificial Sequence
  chemically synthesized
ctgcactccagcctgggcga

SEQ ID NO: 55856 - DNA, 20 bp, Artificial Sequence
  chemically synthesized
ggggtctcgctctgtcgccc

SEQ ID NO: 55857 - DNA, 20 bp, Artificial Sequence
  chemically synthesized
gcactccagcctgggcgaca

SEQ ID NO: 55858 - DNA, 20 bp, Artificial Sequence
  chemically synthesized
tggggtctcgctctgtcgcc

SEQ ID NO: 55859 - DNA, 20 bp, Artificial Sequence
  chemically synthesized
tccagcctgggcgacagagc

SEQ ID NO: 55860 - DNA, 20 bp, Artificial Sequence
  chemically synthesized
ttttttttttttttgagatg

SEQ ID NO: 55861 - DNA, 20 bp, Artificial Sequence
  chemically synthesized
tttttttttttttttgagat

SEQ ID NO: 55862 - DNA, 20 bp, Artificial Sequence
  chemically synthesized
ttttttttttttttttgaga

SEQ ID NO: 55863 - DNA, 20 bp, Artificial Sequence
  chemically synthesized
cttttttttttttttttttt

SEQ ID NO: 55864 - DNA, 20 bp, Artificial Sequence
  chemically synthesized
ctcaaaaaaaaaaaaaaaaa

SEQ ID NO: 55865 - DNA, 20 bp, Artificial Sequence
  chemically synthesized
aaaaaaaaaaaaaagaatac

SEQ ID NO: 55866 - DNA, 20 bp, Artificial Sequence
  chemically synthesized
aaaaaaagaatactagatat

SEQ ID NO: 55867 - DNA, 20 bp, Artificial Sequence
  chemically synthesized
accttgtggcatctaatatc

SEQ ID NO: 55868 - DNA, 20 bp, Artificial Sequence
  chemically synthesized
tactagatattagatgccac

SEQ ID NO: 55869 - DNA, 20 bp, Artificial Sequence
  chemically synthesized
actagatattagatgccaca

SEQ ID NO: 55870 - DNA, 20 bp, Artificial Sequence
  chemically synthesized
agtgtatattgataaccttg

SEQ ID NO: 55871 - DNA, 20 bp, Artificial Sequence
  chemically synthesized
acaaggttatcaatatacac

SEQ ID NO: 55872 - DNA, 20 bp, Artificial Sequence
  chemically synthesized
tatcaatatacactagtttc

SEQ ID NO: 55873 - DNA, 20 bp, Artificial Sequence
  chemically synthesized
atcaatatacactagtttcg

SEQ ID NO: 55874 - DNA, 20 bp, Artificial Sequence
  chemically synthesized
ttttcaaaaagcctcgaaac

SEQ ID NO: 55875 - DNA, 20 bp, Artificial Sequence
  chemically synthesized
ggtgcaccaaaattttcaaa

SEQ ID NO: 55876 - DNA, 20 bp, Artificial Sequence
  chemically synthesized
tcgaggctttttgaaaattt

SEQ ID NO: 55877 - DNA, 20 bp, Artificial Sequence
  chemically synthesized
aattttggtgcacccctatc

SEQ ID NO: 55878 - DNA, 20 bp, Artificial Sequence
  chemically synthesized
gggcgggatatgctggatag

SEQ ID NO: 55879 - DNA, 20 bp, Artificial Sequence
  chemically synthesized
ggggcgggatatgctggata

SEQ ID NO: 55880 - DNA, 20 bp, Artificial Sequence
  chemically synthesized
aggggcgggatatgctggat

SEQ ID NO: 55881 - DNA, 20 bp, Artificial Sequence
  chemically synthesized
gaggggcgggatatgctgga

SEQ ID NO: 55882 - DNA, 20 bp, Artificial Sequence
  chemically synthesized
tagagaggggcgggatatgc

SEQ ID NO: 55883 - DNA, 20 bp, Artificial Sequence
  chemically synthesized
aatgtgaaatagagaggggc

SEQ ID NO: 55884 - DNA, 20 bp, Artificial Sequence
  chemically synthesized
gaatgtgaaatagagagggg

SEQ ID NO: 55885 - DNA, 20 bp, Artificial Sequence
  chemically synthesized
agggaatgtgaaatagagag

SEQ ID NO: 55886 - DNA, 20 bp, Artificial Sequence
  chemically synthesized
cagggaatgtgaaatagaga

SEQ ID NO: 55887 - DNA, 20 bp, Artificial Sequence
  chemically synthesized
acagggaatgtgaaatagag

SEQ ID NO: 55888 - DNA, 20 bp, Artificial Sequence
  chemically synthesized
aacagggaatgtgaaataga

SEQ ID NO: 55889 - DNA, 20 bp, Artificial Sequence
  chemically synthesized
gcaacagggaatgtgaaata

SEQ ID NO: 55890 - DNA, 20 bp, Artificial Sequence
  chemically synthesized
tagcaacagggaatgtgaaa

SEQ ID NO: 55891 - DNA, 20 bp, Artificial Sequence
  chemically synthesized
ttttcctaatattagcaaca

SEQ ID NO: 55892 - DNA, 20 bp, Artificial Sequence
  chemically synthesized
cttttcctaatattagcaac

SEQ ID NO: 55893 - DNA, 20 bp, Artificial Sequence
  chemically synthesized
tcttttcctaatattagcaa

SEQ ID NO: 55894 - DNA, 20 bp, Artificial Sequence
  chemically synthesized
acattccctgttgctaatat

SEQ ID NO: 55895 - DNA, 20 bp, Artificial Sequence
  chemically synthesized
cattccctgttgctaatatt

SEQ ID NO: 55896 - DNA, 20 bp, Artificial Sequence
  chemically synthesized
acgttctcttttcctaatat

SEQ ID NO: 55897 - DNA, 20 bp, Artificial Sequence
  chemically synthesized
cctgttgctaatattaggaa

SEQ ID NO: 55898 - DNA, 20 bp, Artificial Sequence
  chemically synthesized
tgttgctaatattaggaaaa

SEQ ID NO: 55899 - DNA, 20 bp, Artificial Sequence
  chemically synthesized
ggaaaagagaacgtttacgt

SEQ ID NO: 55900 - DNA, 20 bp, Artificial Sequence
  chemically synthesized
agaggttggttcaaatcaaa

SEQ ID NO: 55901 - DNA, 20 bp, Artificial Sequence
  chemically synthesized
tttgatttgaaccaacctct

SEQ ID NO: 55902 - DNA, 20 bp, Artificial Sequence
  chemically synthesized
ttgatttgaaccaacctctc

SEQ ID NO: 55903 - DNA, 20 bp, Artificial Sequence
  chemically synthesized
tattattgaccctgagaggt

SEQ ID NO: 55904 - DNA, 20 bp, Artificial Sequence
  chemically synthesized
tgatttgaaccaacctctca

SEQ ID NO: 55905 - DNA, 20 bp, Artificial Sequence
  chemically synthesized
gaaatattattgaccctgag

SEQ ID NO: 55906 - DNA, 20 bp, Artificial Sequence
  chemically synthesized
tgaaatattattgaccctga

SEQ ID NO: 55907 - DNA, 20 bp, Artificial Sequence
  chemically synthesized
actgaaatattattgaccct

SEQ ID NO: 55908 - DNA, 20 bp, Artificial Sequence
  chemically synthesized
tctcagggtcaataatattt

SEQ ID NO: 55909 - DNA, 20 bp, Artificial Sequence
  chemically synthesized
atatttcagtattttgtgtg

SEQ ID NO: 55910 - DNA, 20 bp, Artificial Sequence
  chemically synthesized
gtattttgtgtgcagcattt

SEQ ID NO: 55911 - DNA, 20 bp, Artificial Sequence
  chemically synthesized
gtgcagcatttaagattata

SEQ ID NO: 55912 - DNA, 20 bp, Artificial Sequence
  chemically synthesized
attataaagtatgcccattt

SEQ ID NO: 55913 - DNA, 20 bp, Artificial Sequence
  chemically synthesized
tttaaaaggagtgctgaaat

SEQ ID NO: 55914 - DNA, 20 bp, Artificial Sequence
  chemically synthesized
gtttaaaaggagtgctgaaa

SEQ ID NO: 55915 - DNA, 20 bp, Artificial Sequence
  chemically synthesized
taaatctttctgtttaaaag

SEQ ID NO: 55916 - DNA, 20 bp, Artificial Sequence
  chemically synthesized
atttcagcactccttttaaa

SEQ ID NO: 55917 - DNA, 20 bp, Artificial Sequence
  chemically synthesized
actaaatctttctgtttaaa

SEQ ID NO: 55918 - DNA, 20 bp, Artificial Sequence
  chemically synthesized
aactaaatctttctgtttaa

SEQ ID NO: 55919 - DNA, 20 bp, Artificial Sequence
  chemically synthesized
cagcactccttttaaacaga

SEQ ID NO: 55920 - DNA, 20 bp, Artificial Sequence
  chemically synthesized
tccttttaaacagaaagatt

SEQ ID NO: 55921 - DNA, 20 bp, Artificial Sequence
  chemically synthesized
aagatttagttgaaaactca

SEQ ID NO: 55922 - DNA, 20 bp, Artificial Sequence
  chemically synthesized
cagtggacaaatgtggcttt

SEQ ID NO: 55923 - DNA, 20 bp, Artificial Sequence
  chemically synthesized
aagctttcagtggacaaatg

SEQ ID NO: 55924 - DNA, 20 bp, Artificial Sequence
  chemically synthesized
aagccacatttgtccactga

SEQ ID NO: 55925 - DNA, 20 bp, Artificial Sequence
  chemically synthesized
agctttttaaaagctttcag

SEQ ID NO: 55926 - DNA, 20 bp, Artificial Sequence
  chemically synthesized
tgaagctttttaaaagcttt

SEQ ID NO: 55927 - DNA, 20 bp, Artificial Sequence
  chemically synthesized
gtccactgaaagcttttaaa

SEQ ID NO: 55928 - DNA, 20 bp, Artificial Sequence
  chemically synthesized
tcacaaatgaagctttttaa

SEQ ID NO: 55929 - DNA, 20 bp, Artificial Sequence
  chemically synthesized
aatgtgtcttttcacaaatg

SEQ ID NO: 55930 - DNA, 20 bp, Artificial Sequence
  chemically synthesized
taaaaagcttcatttgtgaa

SEQ ID NO: 55931 - DNA, 20 bp, Artificial Sequence
  chemically synthesized
ttgtgaaaagacacattgac

SEQ ID NO: 55932 - DNA, 20 bp, Artificial Sequence
  chemically synthesized
gtgaaaagacacattgacca

SEQ ID NO: 55933 - DNA, 20 bp, Artificial Sequence
  chemically synthesized
gacacattgaccagagctgc

SEQ ID NO: 55934 - DNA, 20 bp, Artificial Sequence
  chemically synthesized
ttaatgatccccagcagctc

SEQ ID NO: 55935 - DNA, 20 bp, Artificial Sequence
  chemically synthesized
acacattgaccagagctgct

SEQ ID NO: 55936 - DNA, 20 bp, Artificial Sequence
  chemically synthesized
cacattgaccagagctgctg

SEQ ID NO: 55937 - DNA, 20 bp, Artificial Sequence
  chemically synthesized
ctttcattaatgatccccag

SEQ ID NO: 55938 - DNA, 20 bp, Artificial Sequence
  chemically synthesized
cagctttcattaatgatccc

SEQ ID NO: 55939 - DNA, 20 bp, Artificial Sequence
  chemically synthesized
ctgctggggatcattaatga

SEQ ID NO: 55940 - DNA, 20 bp, Artificial Sequence
  chemically synthesized
tggggatcattaatgaaagc

SEQ ID NO: 55941 - DNA, 20 bp, Artificial Sequence
  chemically synthesized
cagaatctcctttgaagatc

SEQ ID NO: 55942 - DNA, 20 bp, Artificial Sequence
  chemically synthesized
taatgaaagctggatcttca

SEQ ID NO: 55943 - DNA, 20 bp, Artificial Sequence
  chemically synthesized
aatgaaagctggatcttcaa

SEQ ID NO: 55944 - DNA, 20 bp, Artificial Sequence
  chemically synthesized
tgaaagctggatcttcaaag

SEQ ID NO: 55945 - DNA, 20 bp, Artificial Sequence
  chemically synthesized
gtaacacagaatctcctttg

SEQ ID NO: 55946 - DNA, 20 bp, Artificial Sequence
  chemically synthesized
ccaagtacctttttgtaaca

SEQ ID NO: 55947 - DNA, 20 bp, Artificial Sequence
  chemically synthesized
aggagattctgtgttacaaa

SEQ ID NO: 55948 - DNA, 20 bp, Artificial Sequence
  chemically synthesized
ggagattctgtgttacaaaa

SEQ ID NO: 55949 - DNA, 20 bp, Artificial Sequence
  chemically synthesized
ctgtgttacaaaaaggtact

SEQ ID NO: 55950 - DNA, 20 bp, Artificial Sequence
  chemically synthesized
gcagcttagccaaaatgtcc

SEQ ID NO: 55951 - DNA, 20 bp, Artificial Sequence
  chemically synthesized
aaaaaggtacttggacattt

SEQ ID NO: 55952 - DNA, 20 bp, Artificial Sequence
  chemically synthesized
ggtacttggacattttggct

SEQ ID NO: 55953 - DNA, 20 bp, Artificial Sequence
  chemically synthesized
tggacattttggctaagctg

SEQ ID NO: 55954 - DNA, 20 bp, Artificial Sequence
  chemically synthesized
atcacaggtggtctgcagct

SEQ ID NO: 55955 - DNA, 20 bp, Artificial Sequence
  chemically synthesized
gccaaatcacaggtggtctg

SEQ ID NO: 55956 - DNA, 20 bp, Artificial Sequence
  chemically synthesized
tcaaatggccaaatcacagg

SEQ ID NO: 55957 - DNA, 20 bp, Artificial Sequence
  chemically synthesized
gctgcagaccacctgtgatt

SEQ ID NO: 55958 - DNA, 20 bp, Artificial Sequence
  chemically synthesized
ctatcaaatggccaaatcac

SEQ ID NO: 55959 - DNA, 20 bp, Artificial Sequence
  chemically synthesized
tctatcaaatggccaaatca

SEQ ID NO: 55960 - DNA, 20 bp, Artificial Sequence
  chemically synthesized
cctgtgatttggccatttga

SEQ ID NO: 55961 - DNA, 20 bp, Artificial Sequence
  chemically synthesized
tgtgatttggccatttgata

SEQ ID NO: 55962 - DNA, 20 bp, Artificial Sequence
  chemically synthesized
acaaccaaccctctatcaaa

SEQ ID NO: 55963 - DNA, 20 bp, Artificial Sequence
  chemically synthesized
gtgatttggccatttgatag

SEQ ID NO: 55964 - DNA, 20 bp, Artificial Sequence
  chemically synthesized
tgatttggccatttgataga

SEQ ID NO: 55965 - DNA, 20 bp, Artificial Sequence
  chemically synthesized
ttggccatttgatagagggt

SEQ ID NO: 55966 - DNA, 20 bp, Artificial Sequence
  chemically synthesized
gatagagggttggttgttga

SEQ ID NO: 55967 - DNA, 20 bp, Artificial Sequence
  chemically synthesized
atagagggttggttgttgac

SEQ ID NO: 55968 - DNA, 20 bp, Artificial Sequence
  chemically synthesized
gttggttgttgacaggtcct

SEQ ID NO: 55969 - DNA, 20 bp, Artificial Sequence
  chemically synthesized
tggttgttgacaggtcctaa

SEQ ID NO: 55970 - DNA, 20 bp, Artificial Sequence
  chemically synthesized
agacatagggggtatctctt

SEQ ID NO: 55971 - DNA, 20 bp, Artificial Sequence
  chemically synthesized
gagacatagggggtatctct

SEQ ID NO: 55972 - DNA, 20 bp, Artificial Sequence
  chemically synthesized
ttaaaaagaagagacatagg

SEQ ID NO: 55973 - DNA, 20 bp, Artificial Sequence
  chemically synthesized
tttaaaaagaagagacatag

SEQ ID NO: 55974 - DNA, 20 bp, Artificial Sequence
  chemically synthesized
ttttaaaaagaagagacata

SEQ ID NO: 55975 - DNA, 20 bp, Artificial Sequence
  chemically synthesized
attttaaaaagaagagacat

SEQ ID NO: 55976 - DNA, 20 bp, Artificial Sequence
  chemically synthesized
aattttaaaaagaagagaca

SEQ ID NO: 55977 - DNA, 20 bp, Artificial Sequence
  chemically synthesized
taatacaattttaaaaagaa

SEQ ID NO: 55978 - DNA, 20 bp, Artificial Sequence
  chemically synthesized
tttaatacaattttaaaaag

SEQ ID NO: 55979 - DNA, 20 bp, Artificial Sequence
  chemically synthesized
tcttttaatacaattttaaa

SEQ ID NO: 55980 - DNA, 20 bp, Artificial Sequence
  chemically synthesized
tctttttaaaattgtattaa

SEQ ID NO: 55981 - DNA, 20 bp, Artificial Sequence
  chemically synthesized
gtattaaaagatttgtatca

SEQ ID NO: 55982 - DNA, 20 bp, Artificial Sequence
  chemically synthesized
tattaaaagatttgtatcat

SEQ ID NO: 55983 - DNA, 20 bp, Artificial Sequence
  chemically synthesized
agactttcattttaaatagg

SEQ ID NO: 55984 - DNA, 20 bp, Artificial Sequence
  chemically synthesized
ccagactttcattttaaata

SEQ ID NO: 55985 - DNA, 20 bp, Artificial Sequence
  chemically synthesized
cccagactttcattttaaat

SEQ ID NO: 55986 - DNA, 20 bp, Artificial Sequence
  chemically synthesized
gcccagactttcattttaaa

SEQ ID NO: 55987 - DNA, 20 bp, Artificial Sequence
  chemically synthesized
gggctccctatttaaaatga

SEQ ID NO: 55988 - DNA, 20 bp, Artificial Sequence
  chemically synthesized
ccctatttaaaatgaaagtc

SEQ ID NO: 55989 - DNA, 20 bp, Artificial Sequence
  chemically synthesized
cctatttaaaatgaaagtct

SEQ ID NO: 55990 - DNA, 20 bp, Artificial Sequence
  chemically synthesized
atttaaaatgaaagtctggg

SEQ ID NO: 55991 - DNA, 20 bp, Artificial Sequence
  chemically synthesized
gagtaaaaggggcagctgcc

SEQ ID NO: 55992 - DNA, 20 bp, Artificial Sequence
  chemically synthesized
tctagacggagtaaaagggg

SEQ ID NO: 55993 - DNA, 20 bp, Artificial Sequence
  chemically synthesized
tcttctagacggagtaaaag

SEQ ID NO: 55994 - DNA, 20 bp, Artificial Sequence
  chemically synthesized
ttcttctagacggagtaaaa

SEQ ID NO: 55995 - DNA, 20 bp, Artificial Sequence
  chemically synthesized
cttcttctagacggagtaaa

SEQ ID NO: 55996 - DNA, 20 bp, Artificial Sequence
  chemically synthesized
ccttcttctagacggagtaa

SEQ ID NO: 55997 - DNA, 20 bp, Artificial Sequence
  chemically synthesized
gctgccccttttactccgtc

SEQ ID NO: 55998 - DNA, 20 bp, Artificial Sequence
  chemically synthesized
gccccttttactccgtctag

SEQ ID NO: 55999 - DNA, 20 bp, Artificial Sequence
  chemically synthesized
aaggtaccttcttctagacg

SEQ ID NO: 56000 - DNA, 20 bp, Artificial Sequence
  chemically synthesized
gtaaggtaccttcttctaga

SEQ ID NO: 56001 - DNA, 20 bp, Artificial Sequence
  chemically synthesized
ccttttactccgtctagaag

SEQ ID NO: 56002 - DNA, 20 bp, Artificial Sequence
  chemically synthesized
cttttactccgtctagaaga

SEQ ID NO: 56003 - DNA, 20 bp, Artificial Sequence
  chemically synthesized
aaatgtaaggtaccttcttc

SEQ ID NO: 56004 - DNA, 20 bp, Artificial Sequence
  chemically synthesized
aactcatgttagaaaatgta

SEQ ID NO: 56005 - DNA, 20 bp, Artificial Sequence
  chemically synthesized
aaactcatgttagaaaatgt

SEQ ID NO: 56006 - DNA, 20 bp, Artificial Sequence
  chemically synthesized
taccttacattttctaacat

SEQ ID NO: 56007 - DNA, 20 bp, Artificial Sequence
  chemically synthesized
tattgatggaaaactcatgt

SEQ ID NO: 56008 - DNA, 20 bp, Artificial Sequence
  chemically synthesized
tcatagcagacaattattga

SEQ ID NO: 56009 - DNA, 20 bp, Artificial Sequence
  chemically synthesized
ggaatactttggtgtcatag

SEQ ID NO: 56010 - DNA, 20 bp, Artificial Sequence
  chemically synthesized
tggggaatactttggtgtca

SEQ ID NO: 56011 - DNA, 20 bp, Artificial Sequence
  chemically synthesized
aattgtctgctatgacacca

SEQ ID NO: 56012 - DNA, 20 bp, Artificial Sequence
  chemically synthesized
ccaggaggtggggaatactt

SEQ ID NO: 56013 - DNA, 20 bp, Artificial Sequence
  chemically synthesized
ccaaagtattccccacctcc

SEQ ID NO: 56014 - DNA, 20 bp, Artificial Sequence
  chemically synthesized
tgctctccagccaggaggtg

SEQ ID NO: 56015 - DNA, 20 bp, Artificial Sequence
  chemically synthesized
atgctctccagccaggaggt

SEQ ID NO: 56016 - DNA, 20 bp, Artificial Sequence
  chemically synthesized
catgctctccagccaggagg

SEQ ID NO: 56017 - DNA, 20 bp, Artificial Sequence
  chemically synthesized
agtattccccacctcctggc

SEQ ID NO: 56018 - DNA, 20 bp, Artificial Sequence
  chemically synthesized
caacatgctctccagccagg

SEQ ID NO: 56019 - DNA, 20 bp, Artificial Sequence
  chemically synthesized
tattccccacctcctggctg

SEQ ID NO: 56020 - DNA, 20 bp, Artificial Sequence
  chemically synthesized
acaacatgctctccagccag

SEQ ID NO: 56021 - DNA, 20 bp, Artificial Sequence
  chemically synthesized
ttccccacctcctggctgga

SEQ ID NO: 56022 - DNA, 20 bp, Artificial Sequence
  chemically synthesized
agacaacatgctctccagcc

SEQ ID NO: 56023 - DNA, 20 bp, Artificial Sequence
  chemically synthesized
aagacaacatgctctccagc

SEQ ID NO: 56024 - DNA, 20 bp, Artificial Sequence
  chemically synthesized
gaccaagacaacatgctctc

SEQ ID NO: 56025 - DNA, 20 bp, Artificial Sequence
  chemically synthesized
ggctggagagcatgttgtct

SEQ ID NO: 56026 - DNA, 20 bp, Artificial Sequence
  chemically synthesized
acataacagaggagatgacc

SEQ ID NO: 56027 - DNA, 20 bp, Artificial Sequence
  chemically synthesized
ctgtctccaacataacagag

SEQ ID NO: 56028 - DNA, 20 bp, Artificial Sequence
  chemically synthesized
ctctgtctccaacataacag

SEQ ID NO: 56029 - DNA, 20 bp, Artificial Sequence
  chemically synthesized
actctgtctccaacataaca

SEQ ID NO: 56030 - DNA, 20 bp, Artificial Sequence
  chemically synthesized
ggtcatctcctctgttatgt

SEQ ID NO: 56031 - DNA, 20 bp, Artificial Sequence
  chemically synthesized
tcactctgtctccaacataa

SEQ ID NO: 56032 - DNA, 20 bp, Artificial Sequence
  chemically synthesized
tcatctcctctgttatgttg

SEQ ID NO: 56033 - DNA, 20 bp, Artificial Sequence
  chemically synthesized
ctcctctgttatgttggaga

SEQ ID NO: 56034 - DNA, 20 bp, Artificial Sequence
  chemically synthesized
cctctgttatgttggagaca

SEQ ID NO: 56035 - DNA, 20 bp, Artificial Sequence
  chemically synthesized
tggagacagagtgacacacg

SEQ ID NO: 56036 - DNA, 20 bp, Artificial Sequence
  chemically synthesized
ggagacagagtgacacacgt

SEQ ID NO: 56037 - DNA, 20 bp, Artificial Sequence
  chemically synthesized
gagtgacacacgtaggtgaa

SEQ ID NO: 56038 - DNA, 20 bp, Artificial Sequence
  chemically synthesized
agtgacacacgtaggtgaat

SEQ ID NO: 56039 - DNA, 20 bp, Artificial Sequence
  chemically synthesized
gtgacacacgtaggtgaatg

SEQ ID NO: 56040 - DNA, 20 bp, Artificial Sequence
  chemically synthesized
agacaaggatttaattggtt

SEQ ID NO: 56041 - DNA, 20 bp, Artificial Sequence
  chemically synthesized
gacccagacaaggatttaat

SEQ ID NO: 56042 - DNA, 20 bp, Artificial Sequence
  chemically synthesized
aaaccaattaaatccttgtc

SEQ ID NO: 56043 - DNA, 20 bp, Artificial Sequence
  chemically synthesized
aaccaattaaatccttgtct

SEQ ID NO: 56044 - DNA, 20 bp, Artificial Sequence
  chemically synthesized
aatcggtttagacccagaca

SEQ ID NO: 56045 - DNA, 20 bp, Artificial Sequence
  chemically synthesized
taatcggtttagacccagac

SEQ ID NO: 56046 - DNA, 20 bp, Artificial Sequence
  chemically synthesized
ctttttaatcggtttagacc

SEQ ID NO: 56047 - DNA, 20 bp, Artificial Sequence
  chemically synthesized
gagttcctttttaatcggtt

SEQ ID NO: 56048 - DNA, 20 bp, Artificial Sequence
  chemically synthesized
ctgggtctaaaccgattaaa

SEQ ID NO: 56049 - DNA, 20 bp, Artificial Sequence
  chemically synthesized
tgggtctaaaccgattaaaa

SEQ ID NO: 56050 - DNA, 20 bp, Artificial Sequence
  chemically synthesized
gatttgagttcctttttaat

SEQ ID NO: 56051 - DNA, 20 bp, Artificial Sequence
  chemically synthesized
atctgagagaaaatagattt

SEQ ID NO: 56052 - DNA, 20 bp, Artificial Sequence
  chemically synthesized
tctcccaatctgagagaaaa

SEQ ID NO: 56053 - DNA, 20 bp, Artificial Sequence
  chemically synthesized
aactcaaatctattttctct

SEQ ID NO: 56054 - DNA, 20 bp, Artificial Sequence
  chemically synthesized
aaatctattttctctcagat

SEQ ID NO: 56055 - DNA, 20 bp, Artificial Sequence
  chemically synthesized
aatctattttctctcagatt

SEQ ID NO: 56056 - DNA, 20 bp, Artificial Sequence
  chemically synthesized
cgtggactctcccaatctga

SEQ ID NO: 56057 - DNA, 20 bp, Artificial Sequence
  chemically synthesized
tctattttctctcagattgg

SEQ ID NO: 56058 - DNA, 20 bp, Artificial Sequence
  chemically synthesized
ttcgtggactctcccaatct

SEQ ID NO: 56059 - DNA, 20 bp, Artificial Sequence
  chemically synthesized
tattttctctcagattggga

SEQ ID NO: 56060 - DNA, 20 bp, Artificial Sequence
  chemically synthesized
gtttggcttttttattttcg

SEQ ID NO: 56061 - DNA, 20 bp, Artificial Sequence
  chemically synthesized
gagagtccacgaaaataaaa

SEQ ID NO: 56062 - DNA, 20 bp, Artificial Sequence
  chemically synthesized
aaaataaaaaagccaaacaa

SEQ ID NO: 56063 - DNA, 20 bp, Artificial Sequence
  chemically synthesized
tgggcagcatttctgttgtt

SEQ ID NO: 56064 - DNA, 20 bp, Artificial Sequence
  chemically synthesized
caaacaacagaaatgctgcc

SEQ ID NO: 56065 - DNA, 20 bp, Artificial Sequence
  chemically synthesized
caacatcctgtgcaactggg

SEQ ID NO: 56066 - DNA, 20 bp, Artificial Sequence
  chemically synthesized
agaaatgctgcccagttgca

SEQ ID NO: 56067 - DNA, 20 bp, Artificial Sequence
  chemically synthesized
tagcaacatcctgtgcaact

SEQ ID NO: 56068 - DNA, 20 bp, Artificial Sequence
  chemically synthesized
gaaatgctgcccagttgcac

SEQ ID NO: 56069 - DNA, 20 bp, Artificial Sequence
  chemically synthesized
atagcaacatcctgtgcaac

SEQ ID NO: 56070 - DNA, 20 bp, Artificial Sequence
  chemically synthesized
cacaggatgttgctattatc

SEQ ID NO: 56071 - DNA, 20 bp, Artificial Sequence
  chemically synthesized
gatgtgcaaatgctagataa

SEQ ID NO: 56072 - DNA, 20 bp, Artificial Sequence
  chemically synthesized
ataaattgatgtgcaaatgc

SEQ ID NO: 56073 - DNA, 20 bp, Artificial Sequence
  chemically synthesized
tatgttttcaaactcattga

SEQ ID NO: 56074 - DNA, 20 bp, Artificial Sequence
  chemically synthesized
ggtaactagtgactgtcaat

SEQ ID NO: 56075 - DNA, 20 bp, Artificial Sequence
  chemically synthesized
tcaaactcattgacagtcac

SEQ ID NO: 56076 - DNA, 20 bp, Artificial Sequence
  chemically synthesized
cattgacagtcactagttac

SEQ ID NO: 56077 - DNA, 20 bp, Artificial Sequence
  chemically synthesized
acagagtgcctgccggtaac

SEQ ID NO: 56078 - DNA, 20 bp, Artificial Sequence
  chemically synthesized
tgacagtcactagttaccgg

SEQ ID NO: 56079 - DNA, 20 bp, Artificial Sequence
  chemically synthesized
gacagtcactagttaccggc

SEQ ID NO: 56080 - DNA, 20 bp, Artificial Sequence
  chemically synthesized
cttcttaacagagtgcctgc

SEQ ID NO: 56081 - DNA, 20 bp, Artificial Sequence
  chemically synthesized
ttaccggcaggcactctgtt

SEQ ID NO: 56082 - DNA, 20 bp, Artificial Sequence
  chemically synthesized
ccggcaggcactctgttaag

SEQ ID NO: 56083 - DNA, 20 bp, Artificial Sequence
  chemically synthesized
gagttctctacttcttaaca

SEQ ID NO: 56084 - DNA, 20 bp, Artificial Sequence
  chemically synthesized
tagagttctctacttcttaa

SEQ ID NO: 56085 - DNA, 20 bp, Artificial Sequence
  chemically synthesized
gcaggcactctgttaagaag

SEQ ID NO: 56086 - DNA, 20 bp, Artificial Sequence
  chemically synthesized
aggcactctgttaagaagta

SEQ ID NO: 56087 - DNA, 20 bp, Artificial Sequence
  chemically synthesized
gttaagaagtagagaactct

SEQ ID NO: 56088 - DNA, 20 bp, Artificial Sequence
  chemically synthesized
gaagtagagaactctaagct

SEQ ID NO: 56089 - DNA, 20 bp, Artificial Sequence
  chemically synthesized
tatggtcaaaactcagctta

SEQ ID NO: 56090 - DNA, 20 bp, Artificial Sequence
  chemically synthesized
tctatggtcaaaactcagct

SEQ ID NO: 56091 - DNA, 20 bp, Artificial Sequence
  chemically synthesized
gggaatctatggtcaaaact

SEQ ID NO: 56092 - DNA, 20 bp, Artificial Sequence
  chemically synthesized
tctaagctgagttttgacca

SEQ ID NO: 56093 - DNA, 20 bp, Artificial Sequence
  chemically synthesized
aaatcacttccgggaatcta

SEQ ID NO: 56094 - DNA, 20 bp, Artificial Sequence
  chemically synthesized
gagttttgaccatagattcc

SEQ ID NO: 56095 - DNA, 20 bp, Artificial Sequence
  chemically synthesized
ttttgaccatagattcccgg

SEQ ID NO: 56096 - DNA, 20 bp, Artificial Sequence
  chemically synthesized
tgatcttgtaaatcacttcc

SEQ ID NO: 56097 - DNA, 20 bp, Artificial Sequence
  chemically synthesized
atgatcttgtaaatcacttc

SEQ ID NO: 56098 - DNA, 20 bp, Artificial Sequence
  chemically synthesized
gattcccggaagtgatttac

SEQ ID NO: 56099 - DNA, 20 bp, Artificial Sequence
  chemically synthesized
tttcaaatttgtatgaccaa

SEQ ID NO: 56100 - DNA, 20 bp, Artificial Sequence
  chemically synthesized
ttcaaatttgtatgaccaaa

SEQ ID NO: 56101 - DNA, 20 bp, Artificial Sequence
  chemically synthesized
atcatatttaaaatgccttt

SEQ ID NO: 56102 - DNA, 20 bp, Artificial Sequence
  chemically synthesized
aaatatgattttaaattgca

SEQ ID NO: 56103 - DNA, 20 bp, Artificial Sequence
  chemically synthesized
aatatgattttaaattgcaa

SEQ ID NO: 56104 - DNA, 20 bp, Artificial Sequence
  chemically synthesized
atatgattttaaattgcaaa

SEQ ID NO: 56105 - DNA, 20 bp, Artificial Sequence
  chemically synthesized
attgcaaagggacgaaatca

SEQ ID NO: 56106 - DNA, 20 bp, Artificial Sequence
  chemically synthesized
ttgcaaagggacgaaatcat

SEQ ID NO: 56107 - DNA, 20 bp, Artificial Sequence
  chemically synthesized
ggcatccaaagaaacacaag

SEQ ID NO: 56108 - DNA, 20 bp, Artificial Sequence
  chemically synthesized
attggcatccaaagaaacac

SEQ ID NO: 56109 - DNA, 20 bp, Artificial Sequence
  chemically synthesized
atgggcttcttgtgtttctt

SEQ ID NO: 56110 - DNA, 20 bp, Artificial Sequence
  chemically synthesized
agtaatgtgattggcatcca

SEQ ID NO: 56111 - DNA, 20 bp, Artificial Sequence
  chemically synthesized
agctctcgaagtaatgtgat

SEQ ID NO: 56112 - DNA, 20 bp, Artificial Sequence
  chemically synthesized
gatgccaatcacattacttc

SEQ ID NO: 56113 - DNA, 20 bp, Artificial Sequence
  chemically synthesized
tgccaatcacattacttcga

SEQ ID NO: 56114 - DNA, 20 bp, Artificial Sequence
  chemically synthesized
aatcacattacttcgagagc

SEQ ID NO: 56115 - DNA, 20 bp, Artificial Sequence
  chemically synthesized
acgacctatgccagctctcg

SEQ ID NO: 56116 - DNA, 20 bp, Artificial Sequence
  chemically synthesized
cattacttcgagagctggca

SEQ ID NO: 56117 - DNA, 20 bp, Artificial Sequence
  chemically synthesized
attacttcgagagctggcat

SEQ ID NO: 56118 - DNA, 20 bp, Artificial Sequence
  chemically synthesized
gagacatccacgacctatgc

SEQ ID NO: 56119 - DNA, 20 bp, Artificial Sequence
  chemically synthesized
tcgagagctggcataggtcg

SEQ ID NO: 56120 - DNA, 20 bp, Artificial Sequence
  chemically synthesized
ggcataggtcgtggatgtct

SEQ ID NO: 56121 - DNA, 20 bp, Artificial Sequence
  chemically synthesized
gcataggtcgtggatgtctc

SEQ ID NO: 56122 - DNA, 20 bp, Artificial Sequence
  chemically synthesized
ttatcagtggtgcgtagcct

SEQ ID NO: 56123 - DNA, 20 bp, Artificial Sequence
  chemically synthesized
tttgtgttatcagtggtgcg

SEQ ID NO: 56124 - DNA, 20 bp, Artificial Sequence
  chemically synthesized
cgcatagtttgtgttatcag

SEQ ID NO: 56125 - DNA, 20 bp, Artificial Sequence
  chemically synthesized
gcccgcatagtttgtgttat

SEQ ID NO: 56126 - DNA, 20 bp, Artificial Sequence
  chemically synthesized
cactgataacacaaactatg

SEQ ID NO: 56127 - DNA, 20 bp, Artificial Sequence
  chemically synthesized
actgataacacaaactatgc

SEQ ID NO: 56128 - DNA, 20 bp, Artificial Sequence
  chemically synthesized
tttctgctccagtgcccgca

SEQ ID NO: 56129 - DNA, 20 bp, Artificial Sequence
  chemically synthesized
aacacaaactatgcgggcac

SEQ ID NO: 56130 - DNA, 20 bp, Artificial Sequence
  chemically synthesized
cacaaactatgcgggcactg

SEQ ID NO: 56131 - DNA, 20 bp, Artificial Sequence
  chemically synthesized
aaactatgcgggcactggag

SEQ ID NO: 56132 - DNA, 20 bp, Artificial Sequence
  chemically synthesized
tatgcgggcactggagcaga

SEQ ID NO: 56133 - DNA, 20 bp, Artificial Sequence
  chemically synthesized
ctgctcatatctttctgctc

SEQ ID NO: 56134 - DNA, 20 bp, Artificial Sequence
  chemically synthesized
gcactggagcagaaagatat

SEQ ID NO: 56135 - DNA, 20 bp, Artificial Sequence
  chemically synthesized
ctggagcagaaagatatgag

SEQ ID NO: 56136 - DNA, 20 bp, Artificial Sequence
  chemically synthesized
ggagcagaaagatatgagca

SEQ ID NO: 56137 - DNA, 20 bp, Artificial Sequence
  chemically synthesized
gagcagaaagatatgagcag

SEQ ID NO: 56138 - DNA, 20 bp, Artificial Sequence
  chemically synthesized
cagaaagatatgagcagagg

SEQ ID NO: 56139 - DNA, 20 bp, Artificial Sequence
  chemically synthesized
gaaagatatgagcagaggaa

SEQ ID NO: 56140 - DNA, 20 bp, Artificial Sequence
  chemically synthesized
aagatatgagcagaggaaga

SEQ ID NO: 56141 - DNA, 20 bp, Artificial Sequence
  chemically synthesized
atgagcagaggaagagagat

SEQ ID NO: 56142 - DNA, 20 bp, Artificial Sequence
  chemically synthesized
agcagaggaagagagataag

SEQ ID NO: 56143 - DNA, 20 bp, Artificial Sequence
  chemically synthesized
gagagataagtggtgcctct

SEQ ID NO: 56144 - DNA, 20 bp, Artificial Sequence
  chemically synthesized
accactttctggggtcttag

SEQ ID NO: 56145 - DNA, 20 bp, Artificial Sequence
  chemically synthesized
aaccactttctggggtctta

SEQ ID NO: 56146 - DNA, 20 bp, Artificial Sequence
  chemically synthesized
aagtggtgcctctaagaccc

SEQ ID NO: 56147 - DNA, 20 bp, Artificial Sequence
  chemically synthesized
aaaaccactttctggggtct

SEQ ID NO: 56148 - DNA, 20 bp, Artificial Sequence
  chemically synthesized
ggtgcctctaagaccccaga

SEQ ID NO: 56149 - DNA, 20 bp, Artificial Sequence
  chemically synthesized
gcctctaagaccccagaaag

SEQ ID NO: 56150 - DNA, 20 bp, Artificial Sequence
  chemically synthesized
gggttcaaaaccactttctg

SEQ ID NO: 56151 - DNA, 20 bp, Artificial Sequence
  chemically synthesized
agggttcaaaaccactttct

SEQ ID NO: 56152 - DNA, 20 bp, Artificial Sequence
  chemically synthesized
aagggttcaaaaccactttc

SEQ ID NO: 56153 - DNA, 20 bp, Artificial Sequence
  chemically synthesized
aaagtggttttgaacccttg

SEQ ID NO: 56154 - DNA, 20 bp, Artificial Sequence
  chemically synthesized
ctttccagtgagatccacaa

SEQ ID NO: 56155 - DNA, 20 bp, Artificial Sequence
  chemically synthesized
cctttccagtgagatccaca

SEQ ID NO: 56156 - DNA, 20 bp, Artificial Sequence
  chemically synthesized
ccctttccagtgagatccac

SEQ ID NO: 56157 - DNA, 20 bp, Artificial Sequence
  chemically synthesized
tgaacccttgtggatctcac

SEQ ID NO: 56158 - DNA, 20 bp, Artificial Sequence
  chemically synthesized
cccttgtggatctcactgga

SEQ ID NO: 56159 - DNA, 20 bp, Artificial Sequence
  chemically synthesized
ccttgtggatctcactggaa

SEQ ID NO: 56160 - DNA, 20 bp, Artificial Sequence
  chemically synthesized
tctcctaatccctttccagt

SEQ ID NO: 56161 - DNA, 20 bp, Artificial Sequence
  chemically synthesized
cttgtggatctcactggaaa

SEQ ID NO: 56162 - DNA, 20 bp, Artificial Sequence
  chemically synthesized
gtattctcctaatccctttc

SEQ ID NO: 56163 - DNA, 20 bp, Artificial Sequence
  chemically synthesized
ggatctcactggaaagggat

SEQ ID NO: 56164 - DNA, 20 bp, Artificial Sequence
  chemically synthesized
gatctcactggaaagggatt

SEQ ID NO: 56165 - DNA, 20 bp, Artificial Sequence
  chemically synthesized
tctcactggaaagggattag

SEQ ID NO: 56166 - DNA, 20 bp, Artificial Sequence
  chemically synthesized
gggattaggagaataccacc

SEQ ID NO: 56167 - DNA, 20 bp, Artificial Sequence
  chemically synthesized
attaggagaataccacctgg

SEQ ID NO: 56168 - DNA, 20 bp, Artificial Sequence
  chemically synthesized
gagaatggtcttctgccagg

SEQ ID NO: 56169 - DNA, 20 bp, Artificial Sequence
  chemically synthesized
aggagaataccacctggcag

SEQ ID NO: 56170 - DNA, 20 bp, Artificial Sequence
  chemically synthesized
taagagaatggtcttctgcc

SEQ ID NO: 56171 - DNA, 20 bp, Artificial Sequence
  chemically synthesized
ataagagaatggtcttctgc

SEQ ID NO: 56172 - DNA, 20 bp, Artificial Sequence
  chemically synthesized
gatcagccttaataagagaa

SEQ ID NO: 56173 - DNA, 20 bp, Artificial Sequence
  chemically synthesized
cagaagaccattctcttatt

SEQ ID NO: 56174 - DNA, 20 bp, Artificial Sequence
  chemically synthesized
agaagaccattctcttatta

SEQ ID NO: 56175 - DNA, 20 bp, Artificial Sequence
  chemically synthesized
gagtggatcagccttaataa

SEQ ID NO: 56176 - DNA, 20 bp, Artificial Sequence
  chemically synthesized
gagagtggatcagccttaat

SEQ ID NO: 56177 - DNA, 20 bp, Artificial Sequence
  chemically synthesized
gagagagagagagagtggat

SEQ ID NO: 56178 - DNA, 20 bp, Artificial Sequence
  chemically synthesized
tttttgagagagagagagag

SEQ ID NO: 56179 - DNA, 20 bp, Artificial Sequence
  chemically synthesized
ttttttttgagagagagaga

SEQ ID NO: 56180 - DNA, 20 bp, Artificial Sequence
  chemically synthesized
ttttttttttgagagagaga

SEQ ID NO: 56181 - DNA, 20 bp, Artificial Sequence
  chemically synthesized
ttttttttttttgagagaga

SEQ ID NO: 56182 - DNA, 20 bp, Artificial Sequence
  chemically synthesized
ttttttttttttttgagaga

SEQ ID NO: 56183 - DNA, 20 bp, Artificial Sequence
  chemically synthesized
ttttttttttttttttgaga

SEQ ID NO: 56184 - DNA, 20 bp, Artificial Sequence
  chemically synthesized
ttttttttttttttttttga

SEQ ID NO: 56185 - DNA, 20 bp, Artificial Sequence
  chemically synthesized
tttttttttttttttttttt

SEQ ID NO: 56186 - DNA, 20 bp, Artificial Sequence
  chemically synthesized
aaaaaaataaataaataaaa

SEQ ID NO: 56187 - DNA, 20 bp, Artificial Sequence
  chemically synthesized
taaataaataaaaaagataa

SEQ ID NO: 56188 - DNA, 20 bp, Artificial Sequence
  chemically synthesized
aaaaaagataaaagaaaaaa

SEQ ID NO: 56189 - DNA, 20 bp, Artificial Sequence
  chemically synthesized
aaaaaaaagaaaaaaaactt

SEQ ID NO: 56190 - DNA, 20 bp, Artificial Sequence
  chemically synthesized
aaaaagaaaaaaaacttaag

SEQ ID NO: 56191 - DNA, 20 bp, Artificial Sequence
  chemically synthesized
aaaagaaaaaaaacttaagt

SEQ ID NO: 56192 - DNA, 20 bp, Artificial Sequence
  chemically synthesized
aagaaaaaaaacttaagtag

SEQ ID NO: 56193 - DNA, 20 bp, Artificial Sequence
  chemically synthesized
agaaaaaaaacttaagtagg

SEQ ID NO: 56194 - DNA, 20 bp, Artificial Sequence
  chemically synthesized
ctagactttccctcctactt

SEQ ID NO: 56195 - DNA, 20 bp, Artificial Sequence
  chemically synthesized
gaaaaaaaacttaagtagga

SEQ ID NO: 56196 - DNA, 20 bp, Artificial Sequence
  chemically synthesized
aaaaacttaagtaggaggga

SEQ ID NO: 56197 - DNA, 20 bp, Artificial Sequence
  chemically synthesized
cttaagtaggagggaaagtc

SEQ ID NO: 56198 - DNA, 20 bp, Artificial Sequence
  chemically synthesized
taagtaggagggaaagtcta

SEQ ID NO: 56199 - DNA, 20 bp, Artificial Sequence
  chemically synthesized
gagggaaagtctagagttga

SEQ ID NO: 56200 - DNA, 20 bp, Artificial Sequence
  chemically synthesized
cctttcagctctgtcaactc

SEQ ID NO: 56201 - DNA, 20 bp, Artificial Sequence
  chemically synthesized
gggaaagtctagagttgaca

SEQ ID NO: 56202 - DNA, 20 bp, Artificial Sequence
  chemically synthesized
tctagagttgacagagctga

SEQ ID NO: 56203 - DNA, 20 bp, Artificial Sequence
  chemically synthesized
ctagagttgacagagctgaa

SEQ ID NO: 56204 - DNA, 20 bp, Artificial Sequence
  chemically synthesized
ttaaaattttgagagccttt

SEQ ID NO: 56205 - DNA, 20 bp, Artificial Sequence
  chemically synthesized
aaaaagtcttaaaattttga

SEQ ID NO: 56206 - DNA, 20 bp, Artificial Sequence
  chemically synthesized
aaaaaaagtcttaaaatttt

SEQ ID NO: 56207 - DNA, 20 bp, Artificial Sequence
  chemically synthesized
tgaaaggctctcaaaatttt

SEQ ID NO: 56208 - DNA, 20 bp, Artificial Sequence
  chemically synthesized
tttaagacacttaaaaaaaa

SEQ ID NO: 56209 - DNA, 20 bp, Artificial Sequence
  chemically synthesized
attttaagactttttttttt

SEQ ID NO: 56210 - DNA, 20 bp, Artificial Sequence
  chemically synthesized
taaagtccctaaaatatttt

SEQ ID NO: 56211 - DNA, 20 bp, Artificial Sequence
  chemically synthesized
ttaagtgtcttaaaatattt

SEQ ID NO: 56212 - DNA, 20 bp, Artificial Sequence
  chemically synthesized
taagtgtcttaaaatatttt

SEQ ID NO: 56213 - DNA, 20 bp, Artificial Sequence
  chemically synthesized
aagtgtcttaaaatatttta

SEQ ID NO: 56214 - DNA, 20 bp, Artificial Sequence
  chemically synthesized
tctttactaagacaaagtta

SEQ ID NO: 56215 - DNA, 20 bp, Artificial Sequence
  chemically synthesized
tagggactttaactttgtct

SEQ ID NO: 56216 - DNA, 20 bp, Artificial Sequence
  chemically synthesized
ttatcatctttactaagaca

SEQ ID NO: 56217 - DNA, 20 bp, Artificial Sequence
  chemically synthesized
actttaactttgtcttagta

SEQ ID NO: 56218 - DNA, 20 bp, Artificial Sequence
  chemically synthesized
ttaattttatcatctttact

SEQ ID NO: 56219 - DNA, 20 bp, Artificial Sequence
  chemically synthesized
ttagtaaagatgataaaatt

SEQ ID NO: 56220 - DNA, 20 bp, Artificial Sequence
  chemically synthesized
ttctaaaaagaatgagtgtg

SEQ ID NO: 56221 - DNA, 20 bp, Artificial Sequence
  chemically synthesized
gaaaagcttctaaaaagaat

SEQ ID NO: 56222 - DNA, 20 bp, Artificial Sequence
  chemically synthesized
cactacacactcattctttt

SEQ ID NO: 56223 - DNA, 20 bp, Artificial Sequence
  chemically synthesized
tacacactcattctttttag

SEQ ID NO: 56224 - DNA, 20 bp, Artificial Sequence
  chemically synthesized
ggaggtgaaaagcttctaaa

SEQ ID NO: 56225 - DNA, 20 bp, Artificial Sequence
  chemically synthesized
acagttaaaagggaggtgaa

SEQ ID NO: 56226 - DNA, 20 bp, Artificial Sequence
  chemically synthesized
aatgcacacagttaaaaggg

SEQ ID NO: 56227 - DNA, 20 bp, Artificial Sequence
  chemically synthesized
aaatgcacacagttaaaagg

SEQ ID NO: 56228 - DNA, 20 bp, Artificial Sequence
  chemically synthesized
ttaaatgcacacagttaaaa

SEQ ID NO: 56229 - DNA, 20 bp, Artificial Sequence
  chemically synthesized
attaaatgcacacagttaaa

SEQ ID NO: 56230 - DNA, 20 bp, Artificial Sequence
  chemically synthesized
aattaaatgcacacagttaa

SEQ ID NO: 56231 - DNA, 20 bp, Artificial Sequence
  chemically synthesized
ttacacaaattaaatgcaca

SEQ ID NO: 56232 - DNA, 20 bp, Artificial Sequence
  chemically synthesized
aggacattgaaggggacata

SEQ ID NO: 56233 - DNA, 20 bp, Artificial Sequence
  chemically synthesized
gatacaaaaggacattgaag

SEQ ID NO: 56234 - DNA, 20 bp, Artificial Sequence
  chemically synthesized
agatacaaaaggacattgaa

SEQ ID NO: 56235 - DNA, 20 bp, Artificial Sequence
  chemically synthesized
aagatacaaaaggacattga

SEQ ID NO: 56236 - DNA, 20 bp, Artificial Sequence
  chemically synthesized
aaagatacaaaaggacattg

SEQ ID NO: 56237 - DNA, 20 bp, Artificial Sequence
  chemically synthesized
gctaaaaaaaaagatacaaa

SEQ ID NO: 56238 - DNA, 20 bp, Artificial Sequence
  chemically synthesized
tgctaaaaaaaaagatacaa

SEQ ID NO: 56239 - DNA, 20 bp, Artificial Sequence
  chemically synthesized
tccttttgtatctttttttt

SEQ ID NO: 56240 - DNA, 20 bp, Artificial Sequence
  chemically synthesized
agactaaaatgctaaaaaaa

SEQ ID NO: 56241 - DNA, 20 bp, Artificial Sequence
  chemically synthesized
tatctttttttttagcattt

SEQ ID NO: 56242 - DNA, 20 bp, Artificial Sequence
  chemically synthesized
aaaaatcagacagacagaaa

SEQ ID NO: 56243 - DNA, 20 bp, Artificial Sequence
  chemically synthesized
gaagaaaaaaatcagacaga

SEQ ID NO: 56244 - DNA, 20 bp, Artificial Sequence
  chemically synthesized
aatagaagaaaaaaatcaga

SEQ ID NO: 56245 - DNA, 20 bp, Artificial Sequence
  chemically synthesized
tttgaatagaagaaaaaaat

SEQ ID NO: 56246 - DNA, 20 bp, Artificial Sequence
  chemically synthesized
tgatttttttcttctattca

SEQ ID NO: 56247 - DNA, 20 bp, Artificial Sequence
  chemically synthesized
gagaaaatgtctttgaatag

SEQ ID NO: 56248 - DNA, 20 bp, Artificial Sequence
  chemically synthesized
gaggagaaaatgtctttgaa

SEQ ID NO: 56249 - DNA, 20 bp, Artificial Sequence
  chemically synthesized
taaataaagctataatagag

SEQ ID NO: 56250 - DNA, 20 bp, Artificial Sequence
  chemically synthesized
agacattttctcctctatta

SEQ ID NO: 56251 - DNA, 20 bp, Artificial Sequence
  chemically synthesized
attaaataaagctataatag

SEQ ID NO: 56252 - DNA, 20 bp, Artificial Sequence
  chemically synthesized
cattaaataaagctataata

SEQ ID NO: 56253 - DNA, 20 bp, Artificial Sequence
  chemically synthesized
aacattaaataaagctataa

SEQ ID NO: 56254 - DNA, 20 bp, Artificial Sequence
  chemically synthesized
cataagggaaacattaaata

SEQ ID NO: 56255 - DNA, 20 bp, Artificial Sequence
  chemically synthesized
gcacttatgctgtagcataa

SEQ ID NO: 56256 - DNA, 20 bp, Artificial Sequence
  chemically synthesized
ttaatgtttcccttatgcta

SEQ ID NO: 56257 - DNA, 20 bp, Artificial Sequence
  chemically synthesized
ggcacttatgctgtagcata

SEQ ID NO: 56258 - DNA, 20 bp, Artificial Sequence
  chemically synthesized
aggcacttatgctgtagcat

SEQ ID NO: 56259 - DNA, 20 bp, Artificial Sequence
  chemically synthesized
tttcccttatgctacagcat

SEQ ID NO: 56260 - DNA, 20 bp, Artificial Sequence
  chemically synthesized
aaaaaaaggcacttatgctg

SEQ ID NO: 56261 - DNA, 20 bp, Artificial Sequence
  chemically synthesized
agatatggatggagaaaaaa

SEQ ID NO: 56262 - DNA, 20 bp, Artificial Sequence
  chemically synthesized
gagatatggatggagaaaaa

SEQ ID NO: 56263 - DNA, 20 bp, Artificial Sequence
  chemically synthesized
ctaatttagagatatggatg

SEQ ID NO: 56264 - DNA, 20 bp, Artificial Sequence
  chemically synthesized
ccctaatttagagatatgga

SEQ ID NO: 56265 - DNA, 20 bp, Artificial Sequence
  chemically synthesized
gaccccctaatttagagata

SEQ ID NO: 56266 - DNA, 20 bp, Artificial Sequence
  chemically synthesized
ctccatccatatctctaaat

SEQ ID NO: 56267 - DNA, 20 bp, Artificial Sequence
  chemically synthesized
tccatccatatctctaaatt

SEQ ID NO: 56268 - DNA, 20 bp, Artificial Sequence
  chemically synthesized
ccatccatatctctaaatta

SEQ ID NO: 56269 - DNA, 20 bp, Artificial Sequence
  chemically synthesized
aagagggaccccctaattta

SEQ ID NO: 56270 - DNA, 20 bp, Artificial Sequence
  chemically synthesized
catccatatctctaaattag

SEQ ID NO: 56271 - DNA, 20 bp, Artificial Sequence
  chemically synthesized
atccatatctctaaattagg

SEQ ID NO: 56272 - DNA, 20 bp, Artificial Sequence
  chemically synthesized
ggaagagggaccccctaatt

SEQ ID NO: 56273 - DNA, 20 bp, Artificial Sequence
  chemically synthesized
tgctgcatagaaaaggaaga

SEQ ID NO: 56274 - DNA, 20 bp, Artificial Sequence
  chemically synthesized
ctgctgcatagaaaaggaag

SEQ ID NO: 56275 - DNA, 20 bp, Artificial Sequence
  chemically synthesized
actgctgcatagaaaaggaa

SEQ ID NO: 56276 - DNA, 20 bp, Artificial Sequence
  chemically synthesized
agactgctgcatagaaaagg

SEQ ID NO: 56277 - DNA, 20 bp, Artificial Sequence
  chemically synthesized
gacagactgctgcatagaaa

SEQ ID NO: 56278 - DNA, 20 bp, Artificial Sequence
  chemically synthesized
gtccctcttccttttctatg

SEQ ID NO: 56279 - DNA, 20 bp, Artificial Sequence
  chemically synthesized
agacagactgctgcatagaa

SEQ ID NO: 56280 - DNA, 20 bp, Artificial Sequence
  chemically synthesized
cctcttccttttctatgcag

SEQ ID NO: 56281 - DNA, 20 bp, Artificial Sequence
  chemically synthesized
gctgaagacagactgctgca

SEQ ID NO: 56282 - DNA, 20 bp, Artificial Sequence
  chemically synthesized
tctatgcagcagtctgtctt

SEQ ID NO: 56283 - DNA, 20 bp, Artificial Sequence
  chemically synthesized
tgaagacatcatgctgaaga

SEQ ID NO: 56284 - DNA, 20 bp, Artificial Sequence
  chemically synthesized
aaagtgaagacatcatgctg

SEQ ID NO: 56285 - DNA, 20 bp, Artificial Sequence
  chemically synthesized
gactacaatagagaaaagtg

SEQ ID NO: 56286 - DNA, 20 bp, Artificial Sequence
  chemically synthesized
aaagagactacaatagagaa

SEQ ID NO: 56287 - DNA, 20 bp, Artificial Sequence
  chemically synthesized
gtcttcacttttctctattg

SEQ ID NO: 56288 - DNA, 20 bp, Artificial Sequence
  chemically synthesized
tcacaaaagagactacaata

SEQ ID NO: 56289 - DNA, 20 bp, Artificial Sequence
  chemically synthesized
aatcacaaaagagactacaa

SEQ ID NO: 56290 - DNA, 20 bp, Artificial Sequence
  chemically synthesized
gctattggccaatcacaaaa

SEQ ID NO: 56291 - DNA, 20 bp, Artificial Sequence
  chemically synthesized
attgtagtctcttttgtgat

SEQ ID NO: 56292 - DNA, 20 bp, Artificial Sequence
  chemically synthesized
ttgctattggccaatcacaa

SEQ ID NO: 56293 - DNA, 20 bp, Artificial Sequence
  chemically synthesized
tctcttttgtgattggccaa

SEQ ID NO: 56294 - DNA, 20 bp, Artificial Sequence
  chemically synthesized
agtaagtttcattttgctat

SEQ ID NO: 56295 - DNA, 20 bp, Artificial Sequence
  chemically synthesized
aatagcaaaatgaaacttac

SEQ ID NO: 56296 - DNA, 20 bp, Artificial Sequence
  chemically synthesized
ttttgggattggattctagt

SEQ ID NO: 56297 - DNA, 20 bp, Artificial Sequence
  chemically synthesized
gtgcttttgggattggattc

SEQ ID NO: 56298 - DNA, 20 bp, Artificial Sequence
  chemically synthesized
ttactagaatccaatcccaa

SEQ ID NO: 56299 - DNA, 20 bp, Artificial Sequence
  chemically synthesized
ttctaaagtgcttttgggat

SEQ ID NO: 56300 - DNA, 20 bp, Artificial Sequence
  chemically synthesized
catccttctaaagtgctttt

SEQ ID NO: 56301 - DNA, 20 bp, Artificial Sequence
  chemically synthesized
ccatccttctaaagtgcttt

SEQ ID NO: 56302 - DNA, 20 bp, Artificial Sequence
  chemically synthesized
atccaatcccaaaagcactt

SEQ ID NO: 56303 - DNA, 20 bp, Artificial Sequence
  chemically synthesized
caatcccaaaagcactttag

SEQ ID NO: 56304 - DNA, 20 bp, Artificial Sequence
  chemically synthesized
aatcccaaaagcactttaga

SEQ ID NO: 56305 - DNA, 20 bp, Artificial Sequence
  chemically synthesized
gataagattccatccttcta

SEQ ID NO: 56306 - DNA, 20 bp, Artificial Sequence
  chemically synthesized
ccaaaagcactttagaagga

SEQ ID NO: 56307 - DNA, 20 bp, Artificial Sequence
  chemically synthesized
tgattcagggagtaaatgat

SEQ ID NO: 56308 - DNA, 20 bp, Artificial Sequence
  chemically synthesized
actgatgatagtgattcagg

SEQ ID NO: 56309 - DNA, 20 bp, Artificial Sequence
  chemically synthesized
gtactgatgatagtgattca

SEQ ID NO: 56310 - DNA, 20 bp, Artificial Sequence
  chemically synthesized
tgtactgatgatagtgattc

SEQ ID NO: 56311 - DNA, 20 bp, Artificial Sequence
  chemically synthesized
ctgtactgatgatagtgatt

SEQ ID NO: 56312 - DNA, 20 bp, Artificial Sequence
  chemically synthesized
actccctgaatcactatcat

SEQ ID NO: 56313 - DNA, 20 bp, Artificial Sequence
  chemically synthesized
tacaccaactgtactgatga

SEQ ID NO: 56314 - DNA, 20 bp, Artificial Sequence
  chemically synthesized
ctgaatcactatcatcagta

SEQ ID NO: 56315 - DNA, 20 bp, Artificial Sequence
  chemically synthesized
atcactatcatcagtacagt

SEQ ID NO: 56316 - DNA, 20 bp, Artificial Sequence
  chemically synthesized
tatcatcagtacagttggtg

SEQ ID NO: 56317 - DNA, 20 bp, Artificial Sequence
  chemically synthesized
tcagtacagttggtgtagaa

SEQ ID NO: 56318 - DNA, 20 bp, Artificial Sequence
  chemically synthesized
tgtagaacggtattccattc

SEQ ID NO: 56319 - DNA, 20 bp, Artificial Sequence
  chemically synthesized
gtagaacggtattccattct

SEQ ID NO: 56320 - DNA, 20 bp, Artificial Sequence
  chemically synthesized
tagaacggtattccattctg

SEQ ID NO: 56321 - DNA, 20 bp, Artificial Sequence
  chemically synthesized
ttatccaatgagccccagaa

SEQ ID NO: 56322 - DNA, 20 bp, Artificial Sequence
  chemically synthesized
catacttatccaatgagccc

SEQ ID NO: 56323 - DNA, 20 bp, Artificial Sequence
  chemically synthesized
tattccattctggggctcat

SEQ ID NO: 56324 - DNA, 20 bp, Artificial Sequence
  chemically synthesized
cattctggggctcattggat

SEQ ID NO: 56325 - DNA, 20 bp, Artificial Sequence
  chemically synthesized
tgaactcatacttatccaat

SEQ ID NO: 56326 - DNA, 20 bp, Artificial Sequence
  chemically synthesized
ggggctcattggataagtat

SEQ ID NO: 56327 - DNA, 20 bp, Artificial Sequence
  chemically synthesized
ggataagtatgagttcaacc

SEQ ID NO: 56328 - DNA, 20 bp, Artificial Sequence
  chemically synthesized
taagtatgagttcaacctgg

SEQ ID NO: 56329 - DNA, 20 bp, Artificial Sequence
  chemically synthesized
ccggttattttatagctgcc

SEQ ID NO: 56330 - DNA, 20 bp, Artificial Sequence
  chemically synthesized
cccggttattttatagctgc

SEQ ID NO: 56331 - DNA, 20 bp, Artificial Sequence
  chemically synthesized
attttcccccggttatttta

SEQ ID NO: 56332 - DNA, 20 bp, Artificial Sequence
  chemically synthesized
cctggcagctataaaataac

SEQ ID NO: 56333 - DNA, 20 bp, Artificial Sequence
  chemically synthesized
ctggcagctataaaataacc

SEQ ID NO: 56334 - DNA, 20 bp, Artificial Sequence
  chemically synthesized
tggcagctataaaataaccg

SEQ ID NO: 56335 - DNA, 20 bp, Artificial Sequence
  chemically synthesized
ggcagctataaaataaccgg

SEQ ID NO: 56336 - DNA, 20 bp, Artificial Sequence
  chemically synthesized
aaaggaacaagattttcccc

SEQ ID NO: 56337 - DNA, 20 bp, Artificial Sequence
  chemically synthesized
ctataaaggaggaaaggaac

SEQ ID NO: 56338 - DNA, 20 bp, Artificial Sequence
  chemically synthesized
tccgagctataaaggaggaa

SEQ ID NO: 56339 - DNA, 20 bp, Artificial Sequence
  chemically synthesized
ttccgagctataaaggagga

SEQ ID NO: 56340 - DNA, 20 bp, Artificial Sequence
  chemically synthesized
cttgttcctttcctccttta

SEQ ID NO: 56341 - DNA, 20 bp, Artificial Sequence
  chemically synthesized
aaatttccgagctataaagg

SEQ ID NO: 56342 - DNA, 20 bp, Artificial Sequence
  chemically synthesized
caaatttccgagctataaag

SEQ ID NO: 56343 - DNA, 20 bp, Artificial Sequence
  chemically synthesized
cacaaatttccgagctataa

SEQ ID NO: 56344 - DNA, 20 bp, Artificial Sequence
  chemically synthesized
tcctttcctcctttatagct

SEQ ID NO: 56345 - DNA, 20 bp, Artificial Sequence
  chemically synthesized
tcacaaatttccgagctata

SEQ ID NO: 56346 - DNA, 20 bp, Artificial Sequence
  chemically synthesized
aaggtcactcacaaatttcc

SEQ ID NO: 56347 - DNA, 20 bp, Artificial Sequence
  chemically synthesized
tttatagctcggaaatttgt

SEQ ID NO: 56348 - DNA, 20 bp, Artificial Sequence
  chemically synthesized
taattagaaataaagaagca

SEQ ID NO: 56349 - DNA, 20 bp, Artificial Sequence
  chemically synthesized
ataattagaaataaagaagc

SEQ ID NO: 56350 - DNA, 20 bp, Artificial Sequence
  chemically synthesized
gggcataattagaaataaag

SEQ ID NO: 56351 - DNA, 20 bp, Artificial Sequence
  chemically synthesized
atagggcataattagaaata

SEQ ID NO: 56352 - DNA, 20 bp, Artificial Sequence
  chemically synthesized
atttttccatagggcataat

SEQ ID NO: 56353 - DNA, 20 bp, Artificial Sequence
  chemically synthesized
ttatttctaattatgcccta

SEQ ID NO: 56354 - DNA, 20 bp, Artificial Sequence
  chemically synthesized
aaaggcgttatttttccata

SEQ ID NO: 56355 - DNA, 20 bp, Artificial Sequence
  chemically synthesized
aaaaggcgttatttttccat

SEQ ID NO: 56356 - DNA, 20 bp, Artificial Sequence
  chemically synthesized
aaaaaggcgttatttttcca

SEQ ID NO: 56357 - DNA, 20 bp, Artificial Sequence
  chemically synthesized
tacaatataaatgaaaaaaa

SEQ ID NO: 56358 - DNA, 20 bp, Artificial Sequence
  chemically synthesized
atacaatataaatgaaaaaa

SEQ ID NO: 56359 - DNA, 20 bp, Artificial Sequence
  chemically synthesized
tttttttcatttatattgta

SEQ ID NO: 56360 - DNA, 20 bp, Artificial Sequence
  chemically synthesized
atttatattgtatagtgcct

SEQ ID NO: 56361 - DNA, 20 bp, Artificial Sequence
  chemically synthesized
taaaggcccccaaaaatctt

SEQ ID NO: 56362 - DNA, 20 bp, Artificial Sequence
  chemically synthesized
tgtatagtgcctaagatttt

SEQ ID NO: 56363 - DNA, 20 bp, Artificial Sequence
  chemically synthesized
ttaaaggcccccaaaaatct

SEQ ID NO: 56364 - DNA, 20 bp, Artificial Sequence
  chemically synthesized
gtatagtgcctaagattttt

SEQ ID NO: 56365 - DNA, 20 bp, Artificial Sequence
  chemically synthesized
tatagtgcctaagatttttg

SEQ ID NO: 56366 - DNA, 20 bp, Artificial Sequence
  chemically synthesized
atagtgcctaagatttttgg

SEQ ID NO: 56367 - DNA, 20 bp, Artificial Sequence
  chemically synthesized
attgtactgctgttcattaa

SEQ ID NO: 56368 - DNA, 20 bp, Artificial Sequence
  chemically synthesized
ttttgggggcctttaatgaa

SEQ ID NO: 56369 - DNA, 20 bp, Artificial Sequence
  chemically synthesized
aattgtactgctgttcatta

SEQ ID NO: 56370 - DNA, 20 bp, Artificial Sequence
  chemically synthesized
tgggggcctttaatgaacag

SEQ ID NO: 56371 - DNA, 20 bp, Artificial Sequence
  chemically synthesized
acaatttcattttcatttta

SEQ ID NO: 56372 - DNA, 20 bp, Artificial Sequence
  chemically synthesized
caatttcattttcattttac

SEQ ID NO: 56373 - DNA, 20 bp, Artificial Sequence
  chemically synthesized
aaaaattaaactacatgctc

SEQ ID NO: 56374 - DNA, 20 bp, Artificial Sequence
  chemically synthesized
tgaatccttcctcgagcatg

SEQ ID NO: 56375 - DNA, 20 bp, Artificial Sequence
  chemically synthesized
aaaattaaactacatgctcg

SEQ ID NO: 56376 - DNA, 20 bp, Artificial Sequence
  chemically synthesized
attaaactacatgctcgagg

SEQ ID NO: 56377 - DNA, 20 bp, Artificial Sequence
  chemically synthesized
ttaaactacatgctcgagga

SEQ ID NO: 56378 - DNA, 20 bp, Artificial Sequence
  chemically synthesized
gaaatgttgaatccttcctc

SEQ ID NO: 56379 - DNA, 20 bp, Artificial Sequence
  chemically synthesized
gaggaaggattcaacatttc

SEQ ID NO: 56380 - DNA, 20 bp, Artificial Sequence
  chemically synthesized
ggaaggattcaacatttccg

SEQ ID NO: 56381 - DNA, 20 bp, Artificial Sequence
  chemically synthesized
ttcaacatttccggagaacc

SEQ ID NO: 56382 - DNA, 20 bp, Artificial Sequence
  chemically synthesized
agggaaaatgctaggttctc

SEQ ID NO: 56383 - DNA, 20 bp, Artificial Sequence
  chemically synthesized
gtcttctgagggaaaatgct

SEQ ID NO: 56384 - DNA, 20 bp, Artificial Sequence
  chemically synthesized
agtcttctgagggaaaatgc

SEQ ID NO: 56385 - DNA, 20 bp, Artificial Sequence
  chemically synthesized
gagaacctagcattttccct

SEQ ID NO: 56386 - DNA, 20 bp, Artificial Sequence
  chemically synthesized
aacctagcattttccctcag

SEQ ID NO: 56387 - DNA, 20 bp, Artificial Sequence
  chemically synthesized
atctaattttagtcttctga

SEQ ID NO: 56388 - DNA, 20 bp, Artificial Sequence
  chemically synthesized
gatctaattttagtcttctg

SEQ ID NO: 56389 - DNA, 20 bp, Artificial Sequence
  chemically synthesized
ggatctaattttagtcttct

SEQ ID NO: 56390 - DNA, 20 bp, Artificial Sequence
  chemically synthesized
ttccctcagaagactaaaat

SEQ ID NO: 56391 - DNA, 20 bp, Artificial Sequence
  chemically synthesized
attaaaacaggatctaattt

SEQ ID NO: 56392 - DNA, 20 bp, Artificial Sequence
  chemically synthesized
gcagggacagtcattaaaac

SEQ ID NO: 56393 - DNA, 20 bp, Artificial Sequence
  chemically synthesized
tgcagggacagtcattaaaa

SEQ ID NO: 56394 - DNA, 20 bp, Artificial Sequence
  chemically synthesized
agaagtcagtgttgcaggga

SEQ ID NO: 56395 - DNA, 20 bp, Artificial Sequence
  chemically synthesized
acatagaagtcagtgttgca

SEQ ID NO: 56396 - DNA, 20 bp, Artificial Sequence
  chemically synthesized
tacatagaagtcagtgttgc

SEQ ID NO: 56397 - DNA, 20 bp, Artificial Sequence
  chemically synthesized
ttacatagaagtcagtgttg

SEQ ID NO: 56398 - DNA, 20 bp, Artificial Sequence
  chemically synthesized
cattctcattacatagaagt

SEQ ID NO: 56399 - DNA, 20 bp, Artificial Sequence
  chemically synthesized
gaaacattctcattacatag

SEQ ID NO: 56400 - DNA, 20 bp, Artificial Sequence
  chemically synthesized
aacactgacttctatgtaat

SEQ ID NO: 56401 - DNA, 20 bp, Artificial Sequence
  chemically synthesized
atggaaacattctcattaca

SEQ ID NO: 56402 - DNA, 20 bp, Artificial Sequence
  chemically synthesized
gtggtctgtcagcaggaaca

SEQ ID NO: 56403 - DNA, 20 bp, Artificial Sequence
  chemically synthesized
tgtttccatgttcctgctga

SEQ ID NO: 56404 - DNA, 20 bp, Artificial Sequence
  chemically synthesized
atagtaggtggtctgtcagc

SEQ ID NO: 56405 - DNA, 20 bp, Artificial Sequence
  chemically synthesized
aatagtaggtggtctgtcag

SEQ ID NO: 56406 - DNA, 20 bp, Artificial Sequence
  chemically synthesized
aagaatagtaggtggtctgt

SEQ ID NO: 56407 - DNA, 20 bp, Artificial Sequence
  chemically synthesized
catcagcaaagaatagtagg

SEQ ID NO: 56408 - DNA, 20 bp, Artificial Sequence
  chemically synthesized
ccacatcagcaaagaatagt

SEQ ID NO: 56409 - DNA, 20 bp, Artificial Sequence
  chemically synthesized
cccacatcagcaaagaatag

SEQ ID NO: 56410 - DNA, 20 bp, Artificial Sequence
  chemically synthesized
agccccacatcagcaaagaa

SEQ ID NO: 56411 - DNA, 20 bp, Artificial Sequence
  chemically synthesized
ttatcagccccacatcagca

SEQ ID NO: 56412 - DNA, 20 bp, Artificial Sequence
  chemically synthesized
cctactattctttgctgatg

SEQ ID NO: 56413 - DNA, 20 bp, Artificial Sequence
  chemically synthesized
ctactattctttgctgatgt

SEQ ID NO: 56414 - DNA, 20 bp, Artificial Sequence
  chemically synthesized
tactattctttgctgatgtg

SEQ ID NO: 56415 - DNA, 20 bp, Artificial Sequence
  chemically synthesized
cagaattatcagccccacat

SEQ ID NO: 56416 - DNA, 20 bp, Artificial Sequence
  chemically synthesized
ttattgattgtcagaattat

SEQ ID NO: 56417 - DNA, 20 bp, Artificial Sequence
  chemically synthesized
caattattattattgattgt

SEQ ID NO: 56418 - DNA, 20 bp, Artificial Sequence
  chemically synthesized
tataaacattaacatgtatt

SEQ ID NO: 56419 - DNA, 20 bp, Artificial Sequence
  chemically synthesized
attgagtgcgtgctttgtgc

SEQ ID NO: 56420 - DNA, 20 bp, Artificial Sequence
  chemically synthesized
ttgagtgcgtgctttgtgcc

SEQ ID NO: 56421 - DNA, 20 bp, Artificial Sequence
  chemically synthesized
tttgtgcagtgcctggcaca

SEQ ID NO: 56422 - DNA, 20 bp, Artificial Sequence
  chemically synthesized
aaagcactttgtgcagtgcc

SEQ ID NO: 56423 - DNA, 20 bp, Artificial Sequence
  chemically synthesized
tttgtgccaggcactgcaca

SEQ ID NO: 56424 - DNA, 20 bp, Artificial Sequence
  chemically synthesized
tcattataaagcactttgtg

SEQ ID NO: 56425 - DNA, 20 bp, Artificial Sequence
  chemically synthesized
caaatgaaataatcattata

SEQ ID NO: 56426 - DNA, 20 bp, Artificial Sequence
  chemically synthesized
taactcatggggttattaca

SEQ ID NO: 56427 - DNA, 20 bp, Artificial Sequence
  chemically synthesized
gatctttgtaataaccccat

SEQ ID NO: 56428 - DNA, 20 bp, Artificial Sequence
  chemically synthesized
atttgtattcttaactcatg

SEQ ID NO: 56429 - DNA, 20 bp, Artificial Sequence
  chemically synthesized
ttgtaataaccccatgagtt

SEQ ID NO: 56430 - DNA, 20 bp, Artificial Sequence
  chemically synthesized
catttgtattcttaactcat

SEQ ID NO: 56431 - DNA, 20 bp, Artificial Sequence
  chemically synthesized
gcatttgtattcttaactca

SEQ ID NO: 56432 - DNA, 20 bp, Artificial Sequence
  chemically synthesized
agttaagaatacaaatgctc

SEQ ID NO: 56433 - DNA, 20 bp, Artificial Sequence
  chemically synthesized
tgaacaattctgatatgcca

SEQ ID NO: 56434 - DNA, 20 bp, Artificial Sequence
  chemically synthesized
atacaaatgctctggcatat

SEQ ID NO: 56435 - DNA, 20 bp, Artificial Sequence
  chemically synthesized
tgtgaacaattctgatatgc

SEQ ID NO: 56436 - DNA, 20 bp, Artificial Sequence
  chemically synthesized
tcagaattgttcacatttga

SEQ ID NO: 56437 - DNA, 20 bp, Artificial Sequence
  chemically synthesized
agtttttaaaagtcgatatt

SEQ ID NO: 56438 - DNA, 20 bp, Artificial Sequence
  chemically synthesized
ggtttctagacagtttttaa

SEQ ID NO: 56439 - DNA, 20 bp, Artificial Sequence
  chemically synthesized
atcgacttttaaaaactgtc

SEQ ID NO: 56440 - DNA, 20 bp, Artificial Sequence
  chemically synthesized
tgtcgtgggaggtttctaga

SEQ ID NO: 56441 - DNA, 20 bp, Artificial Sequence
  chemically synthesized
taagtgtcgtgggaggtttc

SEQ ID NO: 56442 - DNA, 20 bp, Artificial Sequence
  chemically synthesized
agtgcagtaagtgtcgtggg

SEQ ID NO: 56443 - DNA, 20 bp, Artificial Sequence
  chemically synthesized
cagtgcagtaagtgtcgtgg

SEQ ID NO: 56444 - DNA, 20 bp, Artificial Sequence
  chemically synthesized
atcagtgcagtaagtgtcgt

SEQ ID NO: 56445 - DNA, 20 bp, Artificial Sequence
  chemically synthesized
catcagtgcagtaagtgtcg

SEQ ID NO: 56446 - DNA, 20 bp, Artificial Sequence
  chemically synthesized
tggagaaccatcagtgcagt

SEQ ID NO: 56447 - DNA, 20 bp, Artificial Sequence
  chemically synthesized
cacgacacttactgcactga

SEQ ID NO: 56448 - DNA, 20 bp, Artificial Sequence
  chemically synthesized
agtatggagaaccatcagtg

SEQ ID NO: 56449 - DNA, 20 bp, Artificial Sequence
  chemically synthesized
ggaggagtatggagaaccat

SEQ ID NO: 56450 - DNA, 20 bp, Artificial Sequence
  chemically synthesized
tgtgtcattggaggagtatg

SEQ ID NO: 56451 - DNA, 20 bp, Artificial Sequence
  chemically synthesized
tttgtgtcattggaggagta

SEQ ID NO: 56452 - DNA, 20 bp, Artificial Sequence
  chemically synthesized
taggctttgtgtcattggag

SEQ ID NO: 56453 - DNA, 20 bp, Artificial Sequence
  chemically synthesized
gataggctttgtgtcattgg

SEQ ID NO: 56454 - DNA, 20 bp, Artificial Sequence
  chemically synthesized
ggataggctttgtgtcattg

SEQ ID NO: 56455 - DNA, 20 bp, Artificial Sequence
  chemically synthesized
caggataggctttgtgtcat

SEQ ID NO: 56456 - DNA, 20 bp, Artificial Sequence
  chemically synthesized
catactcctccaatgacaca

SEQ ID NO: 56457 - DNA, 20 bp, Artificial Sequence
  chemically synthesized
acaagaattcaaagcaggat

SEQ ID NO: 56458 - DNA, 20 bp, Artificial Sequence
  chemically synthesized
tacaagaattcaaagcagga

SEQ ID NO: 56459 - DNA, 20 bp, Artificial Sequence
  chemically synthesized
ataatacaagaattcaaagc

SEQ ID NO: 56460 - DNA, 20 bp, Artificial Sequence
  chemically synthesized
aataatacaagaattcaaag

SEQ ID NO: 56461 - DNA, 20 bp, Artificial Sequence
  chemically synthesized
aataataatacaagaattca

SEQ ID NO: 56462 - DNA, 20 bp, Artificial Sequence
  chemically synthesized
tatatgaataataataatac

SEQ ID NO: 56463 - DNA, 20 bp, Artificial Sequence
  chemically synthesized
ttgtattattattattcata

SEQ ID NO: 56464 - DNA, 20 bp, Artificial Sequence
  chemically synthesized
tgtattattattattcatat

SEQ ID NO: 56465 - DNA, 20 bp, Artificial Sequence
  chemically synthesized
gtattattattattcatata

SEQ ID NO: 56466 - DNA, 20 bp, Artificial Sequence
  chemically synthesized
attattattattcatatagg

SEQ ID NO: 56467 - DNA, 20 bp, Artificial Sequence
  chemically synthesized
gggagaattcaacaaataaa

SEQ ID NO: 56468 - DNA, 20 bp, Artificial Sequence
  chemically synthesized
ggagaattcaacaaataaac

SEQ ID NO: 56469 - DNA, 20 bp, Artificial Sequence
  chemically synthesized
gtcagtcttcttggtgtcaa

SEQ ID NO: 56470 - DNA, 20 bp, Artificial Sequence
  chemically synthesized
acaggtattctattgacacc

SEQ ID NO: 56471 - DNA, 20 bp, Artificial Sequence
  chemically synthesized
ggtattctattgacaccaag

SEQ ID NO: 56472 - DNA, 20 bp, Artificial Sequence
  chemically synthesized
agcggcagtgtcagtcttct

SEQ ID NO: 56473 - DNA, 20 bp, Artificial Sequence
  chemically synthesized
gagcagagcagcggcagtgt

SEQ ID NO: 56474 - DNA, 20 bp, Artificial Sequence
  chemically synthesized
aaagtggagcagagcagcgg

SEQ ID NO: 56475 - DNA, 20 bp, Artificial Sequence
  chemically synthesized
ctcaaagtggagcagagcag

SEQ ID NO: 56476 - DNA, 20 bp, Artificial Sequence
  chemically synthesized
aacctcaaagtggagcagag

SEQ ID NO: 56477 - DNA, 20 bp, Artificial Sequence
  chemically synthesized
acaaacctcaaagtggagca

SEQ ID NO: 56478 - DNA, 20 bp, Artificial Sequence
  chemically synthesized
ctacaaacctcaaagtggag

SEQ ID NO: 56479 - DNA, 20 bp, Artificial Sequence
  chemically synthesized
ccgctgctctgctccacttt

SEQ ID NO: 56480 - DNA, 20 bp, Artificial Sequence
  chemically synthesized
cgctgctctgctccactttg

SEQ ID NO: 56481 - DNA, 20 bp, Artificial Sequence
  chemically synthesized
ttgctacaaacctcaaagtg

SEQ ID NO: 56482 - DNA, 20 bp, Artificial Sequence
  chemically synthesized
atttgctacaaacctcaaag

SEQ ID NO: 56483 - DNA, 20 bp, Artificial Sequence
  chemically synthesized
catatttgctacaaacctca

SEQ ID NO: 56484 - DNA, 20 bp, Artificial Sequence
  chemically synthesized
ctgctccactttgaggtttg

SEQ ID NO: 56485 - DNA, 20 bp, Artificial Sequence
  chemically synthesized
aggtttgtagcaaatatgtc

SEQ ID NO: 56486 - DNA, 20 bp, Artificial Sequence
  chemically synthesized
acaagatgtgatgcaagcac

SEQ ID NO: 56487 - DNA, 20 bp, Artificial Sequence
  chemically synthesized
gggctgacaagatgtgatgc

SEQ ID NO: 56488 - DNA, 20 bp, Artificial Sequence
  chemically synthesized
gtgcttgcatcacatcttgt

SEQ ID NO: 56489 - DNA, 20 bp, Artificial Sequence
  chemically synthesized
ggaatcacaggtgggctgac

SEQ ID NO: 56490 - DNA, 20 bp, Artificial Sequence
  chemically synthesized
ctgacactggaatcacaggt

SEQ ID NO: 56491 - DNA, 20 bp, Artificial Sequence
  chemically synthesized
gctgacactggaatcacagg

SEQ ID NO: 56492 - DNA, 20 bp, Artificial Sequence
  chemically synthesized
tgtcagcccacctgtgattc

SEQ ID NO: 56493 - DNA, 20 bp, Artificial Sequence
  chemically synthesized
actgctgacactggaatcac

SEQ ID NO: 56494 - DNA, 20 bp, Artificial Sequence
  chemically synthesized
tactgctgacactggaatca

SEQ ID NO: 56495 - DNA, 20 bp, Artificial Sequence
  chemically synthesized
cccacctgtgattccagtgt

SEQ ID NO: 56496 - DNA, 20 bp, Artificial Sequence
  chemically synthesized
acctgtgattccagtgtcag

SEQ ID NO: 56497 - DNA, 20 bp, Artificial Sequence
  chemically synthesized
ccgtccactactgctgacac

SEQ ID NO: 56498 - DNA, 20 bp, Artificial Sequence
  chemically synthesized
tgtgattccagtgtcagcag

SEQ ID NO: 56499 - DNA, 20 bp, Artificial Sequence
  chemically synthesized
gattccagtgtcagcagtag

SEQ ID NO: 56500 - DNA, 20 bp, Artificial Sequence
  chemically synthesized
ccagtgtcagcagtagtgga

SEQ ID NO: 56501 - DNA, 20 bp, Artificial Sequence
  chemically synthesized
agtagtggacggttctgtgc

SEQ ID NO: 56502 - DNA, 20 bp, Artificial Sequence
  chemically synthesized
agcacgagttagaacttgca

SEQ ID NO: 56503 - DNA, 20 bp, Artificial Sequence
  chemically synthesized
gctggctatacagcacgagt

SEQ ID NO: 56504 - DNA, 20 bp, Artificial Sequence
  chemically synthesized
ggatgctggctatacagcac

SEQ ID NO: 56505 - DNA, 20 bp, Artificial Sequence
  chemically synthesized
aagttctaactcgtgctgta

SEQ ID NO: 56506 - DNA, 20 bp, Artificial Sequence
  chemically synthesized
tctaactcgtgctgtatagc

SEQ ID NO: 56507 - DNA, 20 bp, Artificial Sequence
  chemically synthesized
gagaagggatgctggctata

SEQ ID NO: 56508 - DNA, 20 bp, Artificial Sequence
  chemically synthesized
tcccttttgagaagggatgc

SEQ ID NO: 56509 - DNA, 20 bp, Artificial Sequence
  chemically synthesized
tagccagcatcccttctcaa

SEQ ID NO: 56510 - DNA, 20 bp, Artificial Sequence
  chemically synthesized
tcagggatcccttttgagaa

SEQ ID NO: 56511 - DNA, 20 bp, Artificial Sequence
  chemically synthesized
agccagcatcccttctcaaa

SEQ ID NO: 56512 - DNA, 20 bp, Artificial Sequence
  chemically synthesized
ctcagggatcccttttgaga

SEQ ID NO: 56513 - DNA, 20 bp, Artificial Sequence
  chemically synthesized
gccagcatcccttctcaaaa

SEQ ID NO: 56514 - DNA, 20 bp, Artificial Sequence
  chemically synthesized
gctcagggatcccttttgag

SEQ ID NO: 56515 - DNA, 20 bp, Artificial Sequence
  chemically synthesized
aaggctcagggatccctttt

SEQ ID NO: 56516 - DNA, 20 bp, Artificial Sequence
  chemically synthesized
ccttctcaaaagggatccct

SEQ ID NO: 56517 - DNA, 20 bp, Artificial Sequence
  chemically synthesized
acagaaagctgaaaggctca

SEQ ID NO: 56518 - DNA, 20 bp, Artificial Sequence
  chemically synthesized
aacagaaagctgaaaggctc

SEQ ID NO: 56519 - DNA, 20 bp, Artificial Sequence
  chemically synthesized
aaagggatccctgagccttt

SEQ ID NO: 56520 - DNA, 20 bp, Artificial Sequence
  chemically synthesized
gaacagaaagctgaaaggct

SEQ ID NO: 56521 - DNA, 20 bp, Artificial Sequence
  chemically synthesized
acctagaacagaaagctgaa

SEQ ID NO: 56522 - DNA, 20 bp, Artificial Sequence
  chemically synthesized
aacctagaacagaaagctga

SEQ ID NO: 56523 - DNA, 20 bp, Artificial Sequence
  chemically synthesized
agcctttcagctttctgttc

SEQ ID NO: 56524 - DNA, 20 bp, Artificial Sequence
  chemically synthesized
tcaggggaacctagaacaga

SEQ ID NO: 56525 - DNA, 20 bp, Artificial Sequence
  chemically synthesized
gcctttcagctttctgttct

SEQ ID NO: 56526 - DNA, 20 bp, Artificial Sequence
  chemically synthesized
ggggtcaggggaacctagaa

SEQ ID NO: 56527 - DNA, 20 bp, Artificial Sequence
  chemically synthesized
tcatgggggtcaggggaacc

SEQ ID NO: 56528 - DNA, 20 bp, Artificial Sequence
  chemically synthesized
tcccatgtcatgggggtcag

SEQ ID NO: 56529 - DNA, 20 bp, Artificial Sequence
  chemically synthesized
ctcccatgtcatgggggtca

SEQ ID NO: 56530 - DNA, 20 bp, Artificial Sequence
  chemically synthesized
gctcccatgtcatgggggtc

SEQ ID NO: 56531 - DNA, 20 bp, Artificial Sequence
  chemically synthesized
agctcccatgtcatgggggt

SEQ ID NO: 56532 - DNA, 20 bp, Artificial Sequence
  chemically synthesized
aggaagctcccatgtcatgg

SEQ ID NO: 56533 - DNA, 20 bp, Artificial Sequence
  chemically synthesized
ttcccctgacccccatgaca

SEQ ID NO: 56534 - DNA, 20 bp, Artificial Sequence
  chemically synthesized
caggaagctcccatgtcatg

SEQ ID NO: 56535 - DNA, 20 bp, Artificial Sequence
  chemically synthesized
tcccctgacccccatgacat

SEQ ID NO: 56536 - DNA, 20 bp, Artificial Sequence
  chemically synthesized
ccaggaagctcccatgtcat

SEQ ID NO: 56537 - DNA, 20 bp, Artificial Sequence
  chemically synthesized
cccaggaagctcccatgtca

SEQ ID NO: 56538 - DNA, 20 bp, Artificial Sequence
  chemically synthesized
ccctgacccccatgacatgg

SEQ ID NO: 56539 - DNA, 20 bp, Artificial Sequence
  chemically synthesized
cccatgacatgggagcttcc

SEQ ID NO: 56540 - DNA, 20 bp, Artificial Sequence
  chemically synthesized
ccatgacatgggagcttcct

SEQ ID NO: 56541 - DNA, 20 bp, Artificial Sequence
  chemically synthesized
tgacatgggagcttcctggg

SEQ ID NO: 56542 - DNA, 20 bp, Artificial Sequence
  chemically synthesized
gacatgggagcttcctgggt

SEQ ID NO: 56543 - DNA, 20 bp, Artificial Sequence
  chemically synthesized
gctatgcttgcccacccagg

SEQ ID NO: 56544 - DNA, 20 bp, Artificial Sequence
  chemically synthesized
ctggctatgcttgcccaccc

SEQ ID NO: 56545 - DNA, 20 bp, Artificial Sequence
  chemically synthesized
tgggagcttcctgggtgggc

SEQ ID NO: 56546 - DNA, 20 bp, Artificial Sequence
  chemically synthesized
gctggctatgcttgcccacc

SEQ ID NO: 56547 - DNA, 20 bp, Artificial Sequence
  chemically synthesized
gcttcctgggtgggcaagca

SEQ ID NO: 56548 - DNA, 20 bp, Artificial Sequence
  chemically synthesized
cctgggtgggcaagcatagc

SEQ ID NO: 56549 - DNA, 20 bp, Artificial Sequence
  chemically synthesized
tgggcaagcatagccagcca

SEQ ID NO: 56550 - DNA, 20 bp, Artificial Sequence
  chemically synthesized
gggcaagcatagccagccac

SEQ ID NO: 56551 - DNA, 20 bp, Artificial Sequence
  chemically synthesized
ggcaagcatagccagccaca

SEQ ID NO: 56552 - DNA, 20 bp, Artificial Sequence
  chemically synthesized
gcaagcatagccagccacag

SEQ ID NO: 56553 - DNA, 20 bp, Artificial Sequence
  chemically synthesized
aaagcactaacccctgtggc

SEQ ID NO: 56554 - DNA, 20 bp, Artificial Sequence
  chemically synthesized
gcatagccagccacaggggt

SEQ ID NO: 56555 - DNA, 20 bp, Artificial Sequence
  chemically synthesized
tgccaaagcactaacccctg

SEQ ID NO: 56556 - DNA, 20 bp, Artificial Sequence
  chemically synthesized
agccacaggggttagtgctt

SEQ ID NO: 56557 - DNA, 20 bp, Artificial Sequence
  chemically synthesized
cacaggggttagtgctttgg

SEQ ID NO: 56558 - DNA, 20 bp, Artificial Sequence
  chemically synthesized
gaaaaagagaattgctgcca

SEQ ID NO: 56559 - DNA, 20 bp, Artificial Sequence
  chemically synthesized
agaagttgggaggggaaaaa

SEQ ID NO: 56560 - DNA, 20 bp, Artificial Sequence
  chemically synthesized
gcagaagttgggaggggaaa

SEQ ID NO: 56561 - DNA, 20 bp, Artificial Sequence
  chemically synthesized
cactgtgcagaagttgggag

SEQ ID NO: 56562 - DNA, 20 bp, Artificial Sequence
  chemically synthesized
acactgtgcagaagttggga

SEQ ID NO: 56563 - DNA, 20 bp, Artificial Sequence
  chemically synthesized
aacactgtgcagaagttggg

SEQ ID NO: 56564 - DNA, 20 bp, Artificial Sequence
  chemically synthesized
aaacactgtgcagaagttgg

SEQ ID NO: 56565 - DNA, 20 bp, Artificial Sequence
  chemically synthesized
ataaacactgtgcagaagtt

SEQ ID NO: 56566 - DNA, 20 bp, Artificial Sequence
  chemically synthesized
aataaacactgtgcagaagt

SEQ ID NO: 56567 - DNA, 20 bp, Artificial Sequence
  chemically synthesized
ttcccctcccaacttctgca

SEQ ID NO: 56568 - DNA, 20 bp, Artificial Sequence
  chemically synthesized
gctcaataaacactgtgcag

SEQ ID NO: 56569 - DNA, 20 bp, Artificial Sequence
  chemically synthesized
taagctcaataaacactgtg

SEQ ID NO: 56570 - DNA, 20 bp, Artificial Sequence
  chemically synthesized
acttctgcacagtgtttatt

SEQ ID NO: 56571 - DNA, 20 bp, Artificial Sequence
  chemically synthesized
gtgaactatatgatatgagt

SEQ ID NO: 56572 - DNA, 20 bp, Artificial Sequence
  chemically synthesized
agctgtgaactatatgatat

SEQ ID NO: 56573 - DNA, 20 bp, Artificial Sequence
  chemically synthesized
ttgagcttactcatatcata

SEQ ID NO: 56574 - DNA, 20 bp, Artificial Sequence
  chemically synthesized
tactcatatcatatagttca

SEQ ID NO: 56575 - DNA, 20 bp, Artificial Sequence
  chemically synthesized
catatagttcacagctttga

SEQ ID NO: 56576 - DNA, 20 bp, Artificial Sequence
  chemically synthesized
aacaagaagtttttctatca

SEQ ID NO: 56577 - DNA, 20 bp, Artificial Sequence
  chemically synthesized
aaatacaaaaaggaaacaag

SEQ ID NO: 56578 - DNA, 20 bp, Artificial Sequence
  chemically synthesized
tataaatacaaaaaggaaac

SEQ ID NO: 56579 - DNA, 20 bp, Artificial Sequence
  chemically synthesized
atctaagtataaatacaaaa

SEQ ID NO: 56580 - DNA, 20 bp, Artificial Sequence
  chemically synthesized
aatctaagtataaatacaaa

SEQ ID NO: 56581 - DNA, 20 bp, Artificial Sequence
  chemically synthesized
ttcctttttgtatttatact

SEQ ID NO: 56582 - DNA, 20 bp, Artificial Sequence
  chemically synthesized
caaaacaatgtagaaaatct

SEQ ID NO: 56583 - DNA, 20 bp, Artificial Sequence
  chemically synthesized
cggaaagattcaaaacaatg

SEQ ID NO: 56584 - DNA, 20 bp, Artificial Sequence
  chemically synthesized
gaacttcacacaacgtcgga

SEQ ID NO: 56585 - DNA, 20 bp, Artificial Sequence
  chemically synthesized
ctctgaacttcacacaacgt

SEQ ID NO: 56586 - DNA, 20 bp, Artificial Sequence
  chemically synthesized
aatctttccgacgttgtgtg

SEQ ID NO: 56587 - DNA, 20 bp, Artificial Sequence
  chemically synthesized
ttccgacgttgtgtgaagtt

SEQ ID NO: 56588 - DNA, 20 bp, Artificial Sequence
  chemically synthesized
ccgacgttgtgtgaagttca

SEQ ID NO: 56589 - DNA, 20 bp, Artificial Sequence
  chemically synthesized
acgttgtgtgaagttcagag

SEQ ID NO: 56590 - DNA, 20 bp, Artificial Sequence
  chemically synthesized
ttgtgtgaagttcagagcag

SEQ ID NO: 56591 - DNA, 20 bp, Artificial Sequence
  chemically synthesized
tgaagttcagagcagcggaa

SEQ ID NO: 56592 - DNA, 20 bp, Artificial Sequence
  chemically synthesized
gaagttcagagcagcggaaa

SEQ ID NO: 56593 - DNA, 20 bp, Artificial Sequence
  chemically synthesized
gttcagagcagcggaaaagg

SEQ ID NO: 56594 - DNA, 20 bp, Artificial Sequence
  chemically synthesized
ttcagagcagcggaaaaggc

SEQ ID NO: 56595 - DNA, 20 bp, Artificial Sequence
  chemically synthesized
tcagagcagcggaaaaggca

SEQ ID NO: 56596 - DNA, 20 bp, Artificial Sequence
  chemically synthesized
cagagcagcggaaaaggcag

SEQ ID NO: 56597 - DNA, 20 bp, Artificial Sequence
  chemically synthesized
cggaaaaggcaggggtgcac

SEQ ID NO: 56598 - DNA, 20 bp, Artificial Sequence
  chemically synthesized
gaaaaggcaggggtgcactg

SEQ ID NO: 56599 - DNA, 20 bp, Artificial Sequence
  chemically synthesized
aaaggcaggggtgcactgga

SEQ ID NO: 56600 - DNA, 20 bp, Artificial Sequence
  chemically synthesized
aaggcaggggtgcactggag

SEQ ID NO: 56601 - DNA, 20 bp, Artificial Sequence
  chemically synthesized
tgagtgggacacatcctctc

SEQ ID NO: 56602 - DNA, 20 bp, Artificial Sequence
  chemically synthesized
tggagaggatgtgtcccact

SEQ ID NO: 56603 - DNA, 20 bp, Artificial Sequence
  chemically synthesized
ggcaagcattggatctgagt

SEQ ID NO: 56604 - DNA, 20 bp, Artificial Sequence
  chemically synthesized
gggcaagcattggatctgag

SEQ ID NO: 56605 - DNA, 20 bp, Artificial Sequence
  chemically synthesized
tatgggcaagcattggatct

SEQ ID NO: 56606 - DNA, 20 bp, Artificial Sequence
  chemically synthesized
catctgatatgggcaagcat

SEQ ID NO: 56607 - DNA, 20 bp, Artificial Sequence
  chemically synthesized
ctttttcatctgatatgggc

SEQ ID NO: 56608 - DNA, 20 bp, Artificial Sequence
  chemically synthesized
gatccaatgcttgcccatat

SEQ ID NO: 56609 - DNA, 20 bp, Artificial Sequence
  chemically synthesized
attcctttttcatctgatat

SEQ ID NO: 56610 - DNA, 20 bp, Artificial Sequence
  chemically synthesized
gattcctttttcatctgata

SEQ ID NO: 56611 - DNA, 20 bp, Artificial Sequence
  chemically synthesized
cttgcccatatcagatgaaa

SEQ ID NO: 56612 - DNA, 20 bp, Artificial Sequence
  chemically synthesized
ttgcccatatcagatgaaaa

SEQ ID NO: 56613 - DNA, 20 bp, Artificial Sequence
  chemically synthesized
aaaaggaatcaattctcaac

SEQ ID NO: 56614 - DNA, 20 bp, Artificial Sequence
  chemically synthesized
aggaatcaattctcaaccag

SEQ ID NO: 56615 - DNA, 20 bp, Artificial Sequence
  chemically synthesized
ggaatcaattctcaaccagt

SEQ ID NO: 56616 - DNA, 20 bp, Artificial Sequence
  chemically synthesized
tgctcctgctcccactggtt

SEQ ID NO: 56617 - DNA, 20 bp, Artificial Sequence
  chemically synthesized
aatcaattctcaaccagtgg

SEQ ID NO: 56618 - DNA, 20 bp, Artificial Sequence
  chemically synthesized
caattctcaaccagtgggag

SEQ ID NO: 56619 - DNA, 20 bp, Artificial Sequence
  chemically synthesized
atacctgctcctgctcccac

SEQ ID NO: 56620 - DNA, 20 bp, Artificial Sequence
  chemically synthesized
aattctcaaccagtgggagc

SEQ ID NO: 56621 - DNA, 20 bp, Artificial Sequence
  chemically synthesized
ttctcaaccagtgggagcag

SEQ ID NO: 56622 - DNA, 20 bp, Artificial Sequence
  chemically synthesized
tcaaccagtgggagcaggag

SEQ ID NO: 56623 - DNA, 20 bp, Artificial Sequence
  chemically synthesized
caaccagtgggagcaggagc

SEQ ID NO: 56624 - DNA, 20 bp, Artificial Sequence
  chemically synthesized
gagcaggtatacacatgctc

SEQ ID NO: 56625 - DNA, 20 bp, Artificial Sequence
  chemically synthesized
gcctgaaatatggaaagcca

SEQ ID NO: 56626 - DNA, 20 bp, Artificial Sequence
  chemically synthesized
cagcctgaaatatggaaagc

SEQ ID NO: 56627 - DNA, 20 bp, Artificial Sequence
  chemically synthesized
gctacagcctgaaatatgga

SEQ ID NO: 56628 - DNA, 20 bp, Artificial Sequence
  chemically synthesized
tgctctggctttccatattt

SEQ ID NO: 56629 - DNA, 20 bp, Artificial Sequence
  chemically synthesized
gctctggctttccatatttc

SEQ ID NO: 56630 - DNA, 20 bp, Artificial Sequence
  chemically synthesized
ggtagctacagcctgaaata

SEQ ID NO: 56631 - DNA, 20 bp, Artificial Sequence
  chemically synthesized
gctttccatatttcaggctg

SEQ ID NO: 56632 - DNA, 20 bp, Artificial Sequence
  chemically synthesized
aatctggatataggtagcta

SEQ ID NO: 56633 - DNA, 20 bp, Artificial Sequence
  chemically synthesized
aaaacaaatctggatatagg

SEQ ID NO: 56634 - DNA, 20 bp, Artificial Sequence
  chemically synthesized
aggctgtagctacctatatc

SEQ ID NO: 56635 - DNA, 20 bp, Artificial Sequence
  chemically synthesized
aagaaaacaaatctggatat

SEQ ID NO: 56636 - DNA, 20 bp, Artificial Sequence
  chemically synthesized
gaagaaaacaaatctggata

SEQ ID NO: 56637 - DNA, 20 bp, Artificial Sequence
  chemically synthesized
tgtacagaagaaaacaaatc

SEQ ID NO: 56638 - DNA, 20 bp, Artificial Sequence
  chemically synthesized
aactgttgagaagtgtacag

SEQ ID NO: 56639 - DNA, 20 bp, Artificial Sequence
  chemically synthesized
tggaactgttgagaagtgta

SEQ ID NO: 56640 - DNA, 20 bp, Artificial Sequence
  chemically synthesized
ttcttctgtacacttctcaa

SEQ ID NO: 56641 - DNA, 20 bp, Artificial Sequence
  chemically synthesized
aattctctggaactgttgag

SEQ ID NO: 56642 - DNA, 20 bp, Artificial Sequence
  chemically synthesized
agcaattctctggaactgtt

SEQ ID NO: 56643 - DNA, 20 bp, Artificial Sequence
  chemically synthesized
tgtacacttctcaacagttc

SEQ ID NO: 56644 - DNA, 20 bp, Artificial Sequence
  chemically synthesized
tacacttctcaacagttcca

SEQ ID NO: 56645 - DNA, 20 bp, Artificial Sequence
  chemically synthesized
aagaaagatgagcaattctc

SEQ ID NO: 56646 - DNA, 20 bp, Artificial Sequence
  chemically synthesized
atgaagcgacaaagaaagat

SEQ ID NO: 56647 - DNA, 20 bp, Artificial Sequence
  chemically synthesized
gaagaatgaagcgacaaaga

SEQ ID NO: 56648 - DNA, 20 bp, Artificial Sequence
  chemically synthesized
acaagaagaatgaagcgaca

SEQ ID NO: 56649 - DNA, 20 bp, Artificial Sequence
  chemically synthesized
ataagagaacaagaagaatg

SEQ ID NO: 56650 - DNA, 20 bp, Artificial Sequence
  chemically synthesized
agcaggaataagagaacaag

SEQ ID NO: 56651 - DNA, 20 bp, Artificial Sequence
  chemically synthesized
agaagcaggaataagagaac

SEQ ID NO: 56652 - DNA, 20 bp, Artificial Sequence
  chemically synthesized
attctaagaagcaggaataa

SEQ ID NO: 56653 - DNA, 20 bp, Artificial Sequence
  chemically synthesized
taattctaagaagcaggaat

SEQ ID NO: 56654 - DNA, 20 bp, Artificial Sequence
  chemically synthesized
gttctcttattcctgcttct

SEQ ID NO: 56655 - DNA, 20 bp, Artificial Sequence
  chemically synthesized
tgcaagtaattctaagaagc

SEQ ID NO: 56656 - DNA, 20 bp, Artificial Sequence
  chemically synthesized
gtgcaagtaattctaagaag

SEQ ID NO: 56657 - DNA, 20 bp, Artificial Sequence
  chemically synthesized
tgggtgcaagtaattctaag

SEQ ID NO: 56658 - DNA, 20 bp, Artificial Sequence
  chemically synthesized
acctgggtgcaagtaattct

SEQ ID NO: 56659 - DNA, 20 bp, Artificial Sequence
  chemically synthesized
ttcttagaattacttgcacc

SEQ ID NO: 56660 - DNA, 20 bp, Artificial Sequence
  chemically synthesized
tcttagaattacttgcaccc

SEQ ID NO: 56661 - DNA, 20 bp, Artificial Sequence
  chemically synthesized
gggcggggggacctgggtgc

SEQ ID NO: 56662 - DNA, 20 bp, Artificial Sequence
  chemically synthesized
aaaaaagggcggggggacct

SEQ ID NO: 56663 - DNA, 20 bp, Artificial Sequence
  chemically synthesized
aaaaaaagggcggggggacc

SEQ ID NO: 56664 - DNA, 20 bp, Artificial Sequence
  chemically synthesized
ctcaaaaaaaaaagggcggg

SEQ ID NO: 56665 - DNA, 20 bp, Artificial Sequence
  chemically synthesized
tctcaaaaaaaaaagggcgg

SEQ ID NO: 56666 - DNA, 20 bp, Artificial Sequence
  chemically synthesized
gtctcaaaaaaaaaagggcg

SEQ ID NO: 56667 - DNA, 20 bp, Artificial Sequence
  chemically synthesized
tgtctcaaaaaaaaaagggc

SEQ ID NO: 56668 - DNA, 20 bp, Artificial Sequence
  chemically synthesized
ctgtctcaaaaaaaaaaggg

SEQ ID NO: 56669 - DNA, 20 bp, Artificial Sequence
  chemically synthesized
actctgtctcaaaaaaaaaa

SEQ ID NO: 56670 - DNA, 20 bp, Artificial Sequence
  chemically synthesized
gactctgtctcaaaaaaaaa

SEQ ID NO: 56671 - DNA, 20 bp, Artificial Sequence
  chemically synthesized
agactctgtctcaaaaaaaa

SEQ ID NO: 56672 - DNA, 20 bp, Artificial Sequence
  chemically synthesized
ccccccgccctttttttttt

SEQ ID NO: 56673 - DNA, 20 bp, Artificial Sequence
  chemically synthesized
ccgcccttttttttttgaga

SEQ ID NO: 56674 - DNA, 20 bp, Artificial Sequence
  chemically synthesized
gcccttttttttttgagaca

SEQ ID NO: 56675 - DNA, 20 bp, Artificial Sequence
  chemically synthesized
tccagcctgggcgacagagc

SEQ ID NO: 56676 - DNA, 20 bp, Artificial Sequence
  chemically synthesized
cagagtcttgctctgtcgcc

SEQ ID NO: 56677 - DNA, 20 bp, Artificial Sequence
  chemically synthesized
gcactccagcctgggcgaca

SEQ ID NO: 56678 - DNA, 20 bp, Artificial Sequence
  chemically synthesized
agagtcttgctctgtcgccc

SEQ ID NO: 56679 - DNA, 20 bp, Artificial Sequence
  chemically synthesized
ctgcactccagcctgggcga

SEQ ID NO: 56680 - DNA, 20 bp, Artificial Sequence
  chemically synthesized
tcttgctctgtcgcccaggc

SEQ ID NO: 56681 - DNA, 20 bp, Artificial Sequence
  chemically synthesized
ttgctctgtcgcccaggctg

SEQ ID NO: 56682 - DNA, 20 bp, Artificial Sequence
  chemically synthesized
gcaccactgcactccagcct

SEQ ID NO: 56683 - DNA, 20 bp, Artificial Sequence
  chemically synthesized
tgcaccactgcactccagcc

SEQ ID NO: 56684 - DNA, 20 bp, Artificial Sequence
  chemically synthesized
ctgtcgcccaggctggagtg

SEQ ID NO: 56685 - DNA, 20 bp, Artificial Sequence
  chemically synthesized
gagattgcaccactgcactc

SEQ ID NO: 56686 - DNA, 20 bp, Artificial Sequence
  chemically synthesized
tcgcccaggctggagtgcag

SEQ ID NO: 56687 - DNA, 20 bp, Artificial Sequence
  chemically synthesized
ggagtgcagtggtgcaatct

SEQ ID NO: 56688 - DNA, 20 bp, Artificial Sequence
  chemically synthesized
gcagtggtgcaatctcggct

SEQ ID NO: 56689 - DNA, 20 bp, Artificial Sequence
  chemically synthesized
ggcagaggctgcactgagcc

SEQ ID NO: 56690 - DNA, 20 bp, Artificial Sequence
  chemically synthesized
ggtgcaatctcggctcagtg

SEQ ID NO: 56691 - DNA, 20 bp, Artificial Sequence
  chemically synthesized
cgggaggcagaggctgcact

SEQ ID NO: 56692 - DNA, 20 bp, Artificial Sequence
  chemically synthesized
ctcttgaacccgggaggcag

SEQ ID NO: 56693 - DNA, 20 bp, Artificial Sequence
  chemically synthesized
tcagtgcagcctctgcctcc

SEQ ID NO: 56694 - DNA, 20 bp, Artificial Sequence
  chemically synthesized
tctcttgaacccgggaggca

SEQ ID NO: 56695 - DNA, 20 bp, Artificial Sequence
  chemically synthesized
cagtgcagcctctgcctccc

SEQ ID NO: 56696 - DNA, 20 bp, Artificial Sequence
  chemically synthesized
aatctcttgaacccgggagg

SEQ ID NO: 56697 - DNA, 20 bp, Artificial Sequence
  chemically synthesized
gagaatctcttgaacccggg

SEQ ID NO: 56698 - DNA, 20 bp, Artificial Sequence
  chemically synthesized
ggagaatctcttgaacccgg

SEQ ID NO: 56699 - DNA, 20 bp, Artificial Sequence
  chemically synthesized
agcctctgcctcccgggttc

SEQ ID NO: 56700 - DNA, 20 bp, Artificial Sequence
  chemically synthesized
caggagaatctcttgaaccc

SEQ ID NO: 56701 - DNA, 20 bp, Artificial Sequence
  chemically synthesized
cctctgcctcccgggttcaa

SEQ ID NO: 56702 - DNA, 20 bp, Artificial Sequence
  chemically synthesized
acaggagaatctcttgaacc

SEQ ID NO: 56703 - DNA, 20 bp, Artificial Sequence
  chemically synthesized
ttcaagagattctcctgtct

SEQ ID NO: 56704 - DNA, 20 bp, Artificial Sequence
  chemically synthesized
tacttgggaggctgagacag

SEQ ID NO: 56705 - DNA, 20 bp, Artificial Sequence
  chemically synthesized
gctacttgggaggctgagac

SEQ ID NO: 56706 - DNA, 20 bp, Artificial Sequence
  chemically synthesized
agctacttgggaggctgaga

SEQ ID NO: 56707 - DNA, 20 bp, Artificial Sequence
  chemically synthesized
tcccagctacttgggaggct

SEQ ID NO: 56708 - DNA, 20 bp, Artificial Sequence
  chemically synthesized
ttctcctgtctcagcctccc

SEQ ID NO: 56709 - DNA, 20 bp, Artificial Sequence
  chemically synthesized
tcctgtctcagcctcccaag

SEQ ID NO: 56710 - DNA, 20 bp, Artificial Sequence
  chemically synthesized
tgtaatcccagctacttggg

SEQ ID NO: 56711 - DNA, 20 bp, Artificial Sequence
  chemically synthesized
ctgtaatcccagctacttgg

SEQ ID NO: 56712 - DNA, 20 bp, Artificial Sequence
  chemically synthesized
gtctcagcctcccaagtagc

SEQ ID NO: 56713 - DNA, 20 bp, Artificial Sequence
  chemically synthesized
acctgtaatcccagctactt

SEQ ID NO: 56714 - DNA, 20 bp, Artificial Sequence
  chemically synthesized
tctcagcctcccaagtagct

SEQ ID NO: 56715 - DNA, 20 bp, Artificial Sequence
  chemically synthesized
cacctgtaatcccagctact

SEQ ID NO: 56716 - DNA, 20 bp, Artificial Sequence
  chemically synthesized
ctcccaagtagctgggatta

SEQ ID NO: 56717 - DNA, 20 bp, Artificial Sequence
  chemically synthesized
tcccaagtagctgggattac

SEQ ID NO: 56718 - DNA, 20 bp, Artificial Sequence
  chemically synthesized
gtggcacacacctgtaatcc

SEQ ID NO: 56719 - DNA, 20 bp, Artificial Sequence
  chemically synthesized
gattacaggtgtgtgccacc

SEQ ID NO: 56720 - DNA, 20 bp, Artificial Sequence
  chemically synthesized
caggtgtgtgccaccaagcc

SEQ ID NO: 56721 - DNA, 20 bp, Artificial Sequence
  chemically synthesized
caaaaattagctgggcttgg

SEQ ID NO: 56722 - DNA, 20 bp, Artificial Sequence
  chemically synthesized
atacaaaaattagctgggct

SEQ ID NO: 56723 - DNA, 20 bp, Artificial Sequence
  chemically synthesized
taaaaatacaaaaattagct

SEQ ID NO: 56724 - DNA, 20 bp, Artificial Sequence
  chemically synthesized
ctaaaaatacaaaaattagc

SEQ ID NO: 56725 - DNA, 20 bp, Artificial Sequence
  chemically synthesized
tctactaaaaatacaaaaat

SEQ ID NO: 56726 - DNA, 20 bp, Artificial Sequence
  chemically synthesized
ccagctaatttttgtatttt

SEQ ID NO: 56727 - DNA, 20 bp, Artificial Sequence
  chemically synthesized
gctaatttttgtatttttag

SEQ ID NO: 56728 - DNA, 20 bp, Artificial Sequence
  chemically synthesized
taatttttgtatttttagta

SEQ ID NO: 56729 - DNA, 20 bp, Artificial Sequence
  chemically synthesized
ttttgtatttttagtagaga

SEQ ID NO: 56730 - DNA, 20 bp, Artificial Sequence
  chemically synthesized
tttgtatttttagtagagac

SEQ ID NO: 56731 - DNA, 20 bp, Artificial Sequence
  chemically synthesized
ttgtatttttagtagagaca

SEQ ID NO: 56732 - DNA, 20 bp, Artificial Sequence
  chemically synthesized
gagacagggtttcaccatgt

SEQ ID NO: 56733 - DNA, 20 bp, Artificial Sequence
  chemically synthesized
cagggtttcaccatgttggc

SEQ ID NO: 56734 - DNA, 20 bp, Artificial Sequence
  chemically synthesized
ccagaccagcctggccaaca

SEQ ID NO: 56735 - DNA, 20 bp, Artificial Sequence
  chemically synthesized
agggtttcaccatgttggcc

SEQ ID NO: 56736 - DNA, 20 bp, Artificial Sequence
  chemically synthesized
tttcaccatgttggccaggc

SEQ ID NO: 56737 - DNA, 20 bp, Artificial Sequence
  chemically synthesized
tcaggagttccagaccagcc

SEQ ID NO: 56738 - DNA, 20 bp, Artificial Sequence
  chemically synthesized
ccatgttggccaggctggtc

SEQ ID NO: 56739 - DNA, 20 bp, Artificial Sequence
  chemically synthesized
tgaggtcaggagttccagac

SEQ ID NO: 56740 - DNA, 20 bp, Artificial Sequence
  chemically synthesized
tcacctgaggtcaggagttc

SEQ ID NO: 56741 - DNA, 20 bp, Artificial Sequence
  chemically synthesized
tggtctggaactcctgacct

SEQ ID NO: 56742 - DNA, 20 bp, Artificial Sequence
  chemically synthesized
ggcagatcacctgaggtcag

SEQ ID NO: 56743 - DNA, 20 bp, Artificial Sequence
  chemically synthesized
ggtctggaactcctgacctc

SEQ ID NO: 56744 - DNA, 20 bp, Artificial Sequence
  chemically synthesized
tgggcagatcacctgaggtc

SEQ ID NO: 56745 - DNA, 20 bp, Artificial Sequence
  chemically synthesized
gtgggcagatcacctgaggt

SEQ ID NO: 56746 - DNA, 20 bp, Artificial Sequence
  chemically synthesized
tgaggtgggcagatcacctg

SEQ ID NO: 56747 - DNA, 20 bp, Artificial Sequence
  chemically synthesized
ttgaggtgggcagatcacct

SEQ ID NO: 56748 - DNA, 20 bp, Artificial Sequence
  chemically synthesized
ctttgggaggttgaggtggg

SEQ ID NO: 56749 - DNA, 20 bp, Artificial Sequence
  chemically synthesized
gtactttgggaggttgaggt

SEQ ID NO: 56750 - DNA, 20 bp, Artificial Sequence
  chemically synthesized
agtactttgggaggttgagg

SEQ ID NO: 56751 - DNA, 20 bp, Artificial Sequence
  chemically synthesized
accagtactttgggaggttg

SEQ ID NO: 56752 - DNA, 20 bp, Artificial Sequence
  chemically synthesized
taccagtactttgggaggtt

SEQ ID NO: 56753 - DNA, 20 bp, Artificial Sequence
  chemically synthesized
ctgcccacctcaacctccca

SEQ ID NO: 56754 - DNA, 20 bp, Artificial Sequence
  chemically synthesized
tgtaataccagtactttggg

SEQ ID NO: 56755 - DNA, 20 bp, Artificial Sequence
  chemically synthesized
ctgtaataccagtactttgg

SEQ ID NO: 56756 - DNA, 20 bp, Artificial Sequence
  chemically synthesized
acctcaacctcccaaagtac

SEQ ID NO: 56757 - DNA, 20 bp, Artificial Sequence
  chemically synthesized
gcctgtaataccagtacttt

SEQ ID NO: 56758 - DNA, 20 bp, Artificial Sequence
  chemically synthesized
tgcctgtaataccagtactt

SEQ ID NO: 56759 - DNA, 20 bp, Artificial Sequence
  chemically synthesized
ctcccaaagtactggtatta

SEQ ID NO: 56760 - DNA, 20 bp, Artificial Sequence
  chemically synthesized
tcccaaagtactggtattac

SEQ ID NO: 56761 - DNA, 20 bp, Artificial Sequence
  chemically synthesized
gtggctcatgcctgtaatac

SEQ ID NO: 56762 - DNA, 20 bp, Artificial Sequence
  chemically synthesized
agtactggtattacaggcat

SEQ ID NO: 56763 - DNA, 20 bp, Artificial Sequence
  chemically synthesized
caggcatgagccaccatgcc

SEQ ID NO: 56764 - DNA, 20 bp, Artificial Sequence
  chemically synthesized
ggacctcgggccgggcatgg

SEQ ID NO: 56765 - DNA, 20 bp, Artificial Sequence
  chemically synthesized
aagggacctcgggccgggca

SEQ ID NO: 56766 - DNA, 20 bp, Artificial Sequence
  chemically synthesized
tgagccaccatgcccggccc

SEQ ID NO: 56767 - DNA, 20 bp, Artificial Sequence
  chemically synthesized
gagccaccatgcccggcccg

SEQ ID NO: 56768 - DNA, 20 bp, Artificial Sequence
  chemically synthesized
tcaagaagggacctcgggcc

SEQ ID NO: 56769 - DNA, 20 bp, Artificial Sequence
  chemically synthesized
atcaagaagggacctcgggc

SEQ ID NO: 56770 - DNA, 20 bp, Artificial Sequence
  chemically synthesized
cagaatcaagaagggacctc

SEQ ID NO: 56771 - DNA, 20 bp, Artificial Sequence
  chemically synthesized
acagaatcaagaagggacct

SEQ ID NO: 56772 - DNA, 20 bp, Artificial Sequence
  chemically synthesized
cctcatcacagaatcaagaa

SEQ ID NO: 56773 - DNA, 20 bp, Artificial Sequence
  chemically synthesized
acctcatcacagaatcaaga

SEQ ID NO: 56774 - DNA, 20 bp, Artificial Sequence
  chemically synthesized
tacctcatcacagaatcaag

SEQ ID NO: 56775 - DNA, 20 bp, Artificial Sequence
  chemically synthesized
ggttacctcatcacagaatc

SEQ ID NO: 56776 - DNA, 20 bp, Artificial Sequence
  chemically synthesized
tcccttcttgattctgtgat

SEQ ID NO: 56777 - DNA, 20 bp, Artificial Sequence
  chemically synthesized
cccttcttgattctgtgatg

SEQ ID NO: 56778 - DNA, 20 bp, Artificial Sequence
  chemically synthesized
agtgaggggttacctcatca

SEQ ID NO: 56779 - DNA, 20 bp, Artificial Sequence
  chemically synthesized
agacctggctttgtagtgag

SEQ ID NO: 56780 - DNA, 20 bp, Artificial Sequence
  chemically synthesized
aagacctggctttgtagtga

SEQ ID NO: 56781 - DNA, 20 bp, Artificial Sequence
  chemically synthesized
tgaggtaacccctcactaca

SEQ ID NO: 56782 - DNA, 20 bp, Artificial Sequence
  chemically synthesized
taagacctggctttgtagtg

SEQ ID NO: 56783 - DNA, 20 bp, Artificial Sequence
  chemically synthesized
ctaagacctggctttgtagt

SEQ ID NO: 56784 - DNA, 20 bp, Artificial Sequence
  chemically synthesized
gtaacccctcactacaaagc

SEQ ID NO: 56785 - DNA, 20 bp, Artificial Sequence
  chemically synthesized
taacccctcactacaaagcc

SEQ ID NO: 56786 - DNA, 20 bp, Artificial Sequence
  chemically synthesized
tatcctaagacctggctttg

SEQ ID NO: 56787 - DNA, 20 bp, Artificial Sequence
  chemically synthesized
ctcactacaaagccaggtct

SEQ ID NO: 56788 - DNA, 20 bp, Artificial Sequence
  chemically synthesized
tcactacaaagccaggtctt

SEQ ID NO: 56789 - DNA, 20 bp, Artificial Sequence
  chemically synthesized
gtgagacctatcctaagacc

SEQ ID NO: 56790 - DNA, 20 bp, Artificial Sequence
  chemically synthesized
tacaaagccaggtcttagga

SEQ ID NO: 56791 - DNA, 20 bp, Artificial Sequence
  chemically synthesized
acaaagccaggtcttaggat

SEQ ID NO: 56792 - DNA, 20 bp, Artificial Sequence
  chemically synthesized
atgatggtgagacctatcct

SEQ ID NO: 56793 - DNA, 20 bp, Artificial Sequence
  chemically synthesized
agtccaggtttaatgatggt

SEQ ID NO: 56794 - DNA, 20 bp, Artificial Sequence
  chemically synthesized
caagagtccaggtttaatga

SEQ ID NO: 56795 - DNA, 20 bp, Artificial Sequence
  chemically synthesized
ggtctcaccatcattaaacc

SEQ ID NO: 56796 - DNA, 20 bp, Artificial Sequence
  chemically synthesized
catcattaaacctggactct

SEQ ID NO: 56797 - DNA, 20 bp, Artificial Sequence
  chemically synthesized
tttgccttctccaagagtcc

SEQ ID NO: 56798 - DNA, 20 bp, Artificial Sequence
  chemically synthesized
atttgccttctccaagagtc

SEQ ID NO: 56799 - DNA, 20 bp, Artificial Sequence
  chemically synthesized
tcattaaacctggactcttg

SEQ ID NO: 56800 - DNA, 20 bp, Artificial Sequence
  chemically synthesized
ttaaacctggactcttggag

SEQ ID NO: 56801 - DNA, 20 bp, Artificial Sequence
  chemically synthesized
taaacctggactcttggaga

SEQ ID NO: 56802 - DNA, 20 bp, Artificial Sequence
  chemically synthesized
ttcacatttgccttctccaa

SEQ ID NO: 56803 - DNA, 20 bp, Artificial Sequence
  chemically synthesized
tattcacatttgccttctcc

SEQ ID NO: 56804 - DNA, 20 bp, Artificial Sequence
  chemically synthesized
tcacagattctggtttttaa

SEQ ID NO: 56805 - DNA, 20 bp, Artificial Sequence
  chemically synthesized
atgtgaataccattaaaaac

SEQ ID NO: 56806 - DNA, 20 bp, Artificial Sequence
  chemically synthesized
actgtcaacatcacagattc

SEQ ID NO: 56807 - DNA, 20 bp, Artificial Sequence
  chemically synthesized
actttccactgtcaacatca

SEQ ID NO: 56808 - DNA, 20 bp, Artificial Sequence
  chemically synthesized
accagaatctgtgatgttga

SEQ ID NO: 56809 - DNA, 20 bp, Artificial Sequence
  chemically synthesized
agaatctgtgatgttgacag

SEQ ID NO: 56810 - DNA, 20 bp, Artificial Sequence
  chemically synthesized
tctgtgatgttgacagtgga

SEQ ID NO: 56811 - DNA, 20 bp, Artificial Sequence
  chemically synthesized
gtcttaaataatgagtgatg

SEQ ID NO: 56812 - DNA, 20 bp, Artificial Sequence
  chemically synthesized
gtctacatcactcattattt

SEQ ID NO: 56813 - DNA, 20 bp, Artificial Sequence
  chemically synthesized
caaagagggtcttaaataat

SEQ ID NO: 56814 - DNA, 20 bp, Artificial Sequence
  chemically synthesized
acatttattgatgacaaaga

SEQ ID NO: 56815 - DNA, 20 bp, Artificial Sequence
  chemically synthesized
aacatttattgatgacaaag

SEQ ID NO: 56816 - DNA, 20 bp, Artificial Sequence
  chemically synthesized
gaacatttattgatgacaaa

SEQ ID NO: 56817 - DNA, 20 bp, Artificial Sequence
  chemically synthesized
atgaacatttattgatgaca

SEQ ID NO: 56818 - DNA, 20 bp, Artificial Sequence
  chemically synthesized
ttgtcatcaataaatgttca

SEQ ID NO: 56819 - DNA, 20 bp, Artificial Sequence
  chemically synthesized
aataaatgttcatggaaatt

SEQ ID NO: 56820 - DNA, 20 bp, Artificial Sequence
  chemically synthesized
ataaatgttcatggaaattc

SEQ ID NO: 56821 - DNA, 20 bp, Artificial Sequence
  chemically synthesized
tggaaattcaggcactatct

SEQ ID NO: 56822 - DNA, 20 bp, Artificial Sequence
  chemically synthesized
ggaaattcaggcactatctt

SEQ ID NO: 56823 - DNA, 20 bp, Artificial Sequence
  chemically synthesized
ctcagcagtgggacctaaga

SEQ ID NO: 56824 - DNA, 20 bp, Artificial Sequence
  chemically synthesized
cggcctcagcagtgggacct

SEQ ID NO: 56825 - DNA, 20 bp, Artificial Sequence
  chemically synthesized
ctatcttaggtcccactgct

SEQ ID NO: 56826 - DNA, 20 bp, Artificial Sequence
  chemically synthesized
tatcttaggtcccactgctg

SEQ ID NO: 56827 - DNA, 20 bp, Artificial Sequence
  chemically synthesized
taaatcccggcctcagcagt

SEQ ID NO: 56828 - DNA, 20 bp, Artificial Sequence
  chemically synthesized
ttaaatcccggcctcagcag

SEQ ID NO: 56829 - DNA, 20 bp, Artificial Sequence
  chemically synthesized
ttaggtcccactgctgaggc

SEQ ID NO: 56830 - DNA, 20 bp, Artificial Sequence
  chemically synthesized
ggattaaatcccggcctcag

SEQ ID NO: 56831 - DNA, 20 bp, Artificial Sequence
  chemically synthesized
taggtcccactgctgaggcc

SEQ ID NO: 56832 - DNA, 20 bp, Artificial Sequence
  chemically synthesized
tctggattaaatcccggcct

SEQ ID NO: 56833 - DNA, 20 bp, Artificial Sequence
  chemically synthesized
tcagattctggattaaatcc

SEQ ID NO: 56834 - DNA, 20 bp, Artificial Sequence
  chemically synthesized
gctgaggccgggatttaatc

SEQ ID NO: 56835 - DNA, 20 bp, Artificial Sequence
  chemically synthesized
caaatcttgttatcagattc

SEQ ID NO: 56836 - DNA, 20 bp, Artificial Sequence
  chemically synthesized
ttaatccagaatctgataac

SEQ ID NO: 56837 - DNA, 20 bp, Artificial Sequence
  chemically synthesized
gttccaacaaatcttgttat

SEQ ID NO: 56838 - DNA, 20 bp, Artificial Sequence
  chemically synthesized
aatctgataacaagatttgt

SEQ ID NO: 56839 - DNA, 20 bp, Artificial Sequence
  chemically synthesized
atttgttggaacttctgcct

SEQ ID NO: 56840 - DNA, 20 bp, Artificial Sequence
  chemically synthesized
tttgttggaacttctgcctt

SEQ ID NO: 56841 - DNA, 20 bp, Artificial Sequence
  chemically synthesized
tttctcctgccctaaggcag

SEQ ID NO: 56842 - DNA, 20 bp, Artificial Sequence
  chemically synthesized
ttgttggaacttctgcctta

SEQ ID NO: 56843 - DNA, 20 bp, Artificial Sequence
  chemically synthesized
tgttttctcctgccctaagg

SEQ ID NO: 56844 - DNA, 20 bp, Artificial Sequence
  chemically synthesized
ttggaacttctgccttaggg

SEQ ID NO: 56845 - DNA, 20 bp, Artificial Sequence
  chemically synthesized
tggaacttctgccttagggc

SEQ ID NO: 56846 - DNA, 20 bp, Artificial Sequence
  chemically synthesized
tattgttttctcctgcccta

SEQ ID NO: 56847 - DNA, 20 bp, Artificial Sequence
  chemically synthesized
gaacttctgccttagggcag

SEQ ID NO: 56848 - DNA, 20 bp, Artificial Sequence
  chemically synthesized
ttattgttttctcctgccct

SEQ ID NO: 56849 - DNA, 20 bp, Artificial Sequence
  chemically synthesized
ttagggcaggagaaaacaat

SEQ ID NO: 56850 - DNA, 20 bp, Artificial Sequence
  chemically synthesized
ggcaggagaaaacaataaga

SEQ ID NO: 56851 - DNA, 20 bp, Artificial Sequence
  chemically synthesized
aataagaaagactttaaaat

SEQ ID NO: 56852 - DNA, 20 bp, Artificial Sequence
  chemically synthesized
ataagaaagactttaaaata

SEQ ID NO: 56853 - DNA, 20 bp, Artificial Sequence
  chemically synthesized
aggtgactctccttatttta

SEQ ID NO: 56854 - DNA, 20 bp, Artificial Sequence
  chemically synthesized
aagaaagactttaaaataag

SEQ ID NO: 56855 - DNA, 20 bp, Artificial Sequence
  chemically synthesized
gaaagactttaaaataagga

SEQ ID NO: 56856 - DNA, 20 bp, Artificial Sequence
  chemically synthesized
aataaggagagtcacctaat

SEQ ID NO: 56857 - DNA, 20 bp, Artificial Sequence
  chemically synthesized
cctaaaatgcagatctgatt

SEQ ID NO: 56858 - DNA, 20 bp, Artificial Sequence
  chemically synthesized
tcctaaaatgcagatctgat

SEQ ID NO: 56859 - DNA, 20 bp, Artificial Sequence
  chemically synthesized
acctaatcagatctgcattt

SEQ ID NO: 56860 - DNA, 20 bp, Artificial Sequence
  chemically synthesized
cctaatcagatctgcatttt

SEQ ID NO: 56861 - DNA, 20 bp, Artificial Sequence
  chemically synthesized
atagtaatcctcctaaaatg

SEQ ID NO: 56862 - DNA, 20 bp, Artificial Sequence
  chemically synthesized
taatcagatctgcattttag

SEQ ID NO: 56863 - DNA, 20 bp, Artificial Sequence
  chemically synthesized
aatcagatctgcattttagg

SEQ ID NO: 56864 - DNA, 20 bp, Artificial Sequence
  chemically synthesized
gcattttaggaggattacta

SEQ ID NO: 56865 - DNA, 20 bp, Artificial Sequence
  chemically synthesized
cattttaggaggattactat

SEQ ID NO: 56866 - DNA, 20 bp, Artificial Sequence
  chemically synthesized
ccttttccacaatgcgccta

SEQ ID NO: 56867 - DNA, 20 bp, Artificial Sequence
  chemically synthesized
ggattactataggcgcattg

SEQ ID NO: 56868 - DNA, 20 bp, Artificial Sequence
  chemically synthesized
actataggcgcattgtggaa

SEQ ID NO: 56869 - DNA, 20 bp, Artificial Sequence
  chemically synthesized
ctataggcgcattgtggaaa

SEQ ID NO: 56870 - DNA, 20 bp, Artificial Sequence
  chemically synthesized
tataggcgcattgtggaaaa

SEQ ID NO: 56871 - DNA, 20 bp, Artificial Sequence
  chemically synthesized
cgcattgtggaaaagggatt

SEQ ID NO: 56872 - DNA, 20 bp, Artificial Sequence
  chemically synthesized
attgtggaaaagggattcgg

SEQ ID NO: 56873 - DNA, 20 bp, Artificial Sequence
  chemically synthesized
tggaaaagggattcggaagc

SEQ ID NO: 56874 - DNA, 20 bp, Artificial Sequence
  chemically synthesized
ttcggaagcaagaacaatat

SEQ ID NO: 56875 - DNA, 20 bp, Artificial Sequence
  chemically synthesized
tcggaagcaagaacaatatc

SEQ ID NO: 56876 - DNA, 20 bp, Artificial Sequence
  chemically synthesized
cggaagcaagaacaatatca

SEQ ID NO: 56877 - DNA, 20 bp, Artificial Sequence
  chemically synthesized
gaagcaagaacaatatcagg

SEQ ID NO: 56878 - DNA, 20 bp, Artificial Sequence
  chemically synthesized
acaatatcagggagataaat

SEQ ID NO: 56879 - DNA, 20 bp, Artificial Sequence
  chemically synthesized
aatatcagggagataaatta

SEQ ID NO: 56880 - DNA, 20 bp, Artificial Sequence
  chemically synthesized
atatcagggagataaattag

SEQ ID NO: 56881 - DNA, 20 bp, Artificial Sequence
  chemically synthesized
gagataaattagaggctatg

SEQ ID NO: 56882 - DNA, 20 bp, Artificial Sequence
  chemically synthesized
cttttgactcaaatgctaca

SEQ ID NO: 56883 - DNA, 20 bp, Artificial Sequence
  chemically synthesized
ttagaggctatgtagcattt

SEQ ID NO: 56884 - DNA, 20 bp, Artificial Sequence
  chemically synthesized
ctatgtagcatttgagtcaa

SEQ ID NO: 56885 - DNA, 20 bp, Artificial Sequence
  chemically synthesized
gcatttgagtcaaaagatat

SEQ ID NO: 56886 - DNA, 20 bp, Artificial Sequence
  chemically synthesized
atttgagtcaaaagatattg

SEQ ID NO: 56887 - DNA, 20 bp, Artificial Sequence
  chemically synthesized
agtcaaaagatattggagtc

SEQ ID NO: 56888 - DNA, 20 bp, Artificial Sequence
  chemically synthesized
gtcaaaagatattggagtca

SEQ ID NO: 56889 - DNA, 20 bp, Artificial Sequence
  chemically synthesized
tcaaaagatattggagtcaa

SEQ ID NO: 56890 - DNA, 20 bp, Artificial Sequence
  chemically synthesized
aaaagatattggagtcaagg

SEQ ID NO: 56891 - DNA, 20 bp, Artificial Sequence
  chemically synthesized
aaagatattggagtcaaggg

SEQ ID NO: 56892 - DNA, 20 bp, Artificial Sequence
  chemically synthesized
gagtcaagggaggtgtaaat

SEQ ID NO: 56893 - DNA, 20 bp, Artificial Sequence
  chemically synthesized
agtcaagggaggtgtaaata

SEQ ID NO: 56894 - DNA, 20 bp, Artificial Sequence
  chemically synthesized
gtcaagggaggtgtaaataa

SEQ ID NO: 56895 - DNA, 20 bp, Artificial Sequence
  chemically synthesized
tgtaaataagggaatgaatt

SEQ ID NO: 56896 - DNA, 20 bp, Artificial Sequence
  chemically synthesized
taaataagggaatgaattaa

SEQ ID NO: 56897 - DNA, 20 bp, Artificial Sequence
  chemically synthesized
taagggaatgaattaagaga

SEQ ID NO: 56898 - DNA, 20 bp, Artificial Sequence
  chemically synthesized
gaatgaattaagagatggct

SEQ ID NO: 56899 - DNA, 20 bp, Artificial Sequence
  chemically synthesized
aatgaattaagagatggctt

SEQ ID NO: 56900 - DNA, 20 bp, Artificial Sequence
  chemically synthesized
atgaattaagagatggcttg

SEQ ID NO: 56901 - DNA, 20 bp, Artificial Sequence
  chemically synthesized
attaagagatggcttgggga

SEQ ID NO: 56902 - DNA, 20 bp, Artificial Sequence
  chemically synthesized
taagagatggcttggggata

SEQ ID NO: 56903 - DNA, 20 bp, Artificial Sequence
  chemically synthesized
attctgtcagctctatcccc

SEQ ID NO: 56904 - DNA, 20 bp, Artificial Sequence
  chemically synthesized
tggcttggggatagagctga

SEQ ID NO: 56905 - DNA, 20 bp, Artificial Sequence
  chemically synthesized
gatgcattgccaaattctgt

SEQ ID NO: 56906 - DNA, 20 bp, Artificial Sequence
  chemically synthesized
gggatagagctgacagaatt

SEQ ID NO: 56907 - DNA, 20 bp, Artificial Sequence
  chemically synthesized
aatttggcaatgcatcatgt

SEQ ID NO: 56908 - DNA, 20 bp, Artificial Sequence
  chemically synthesized
aatgcatcatgttagattta

SEQ ID NO: 56909 - DNA, 20 bp, Artificial Sequence
  chemically synthesized
catgttagatttaaagataa

SEQ ID NO: 56910 - DNA, 20 bp, Artificial Sequence
  chemically synthesized
gttagatttaaagataaaag

SEQ ID NO: 56911 - DNA, 20 bp, Artificial Sequence
  chemically synthesized
tttaaagataaaagtagatt

SEQ ID NO: 56912 - DNA, 20 bp, Artificial Sequence
  chemically synthesized
attgcccaagtcaaaaatta

SEQ ID NO: 56913 - DNA, 20 bp, Artificial Sequence
  chemically synthesized
aattgcccaagtcaaaaatt

SEQ ID NO: 56914 - DNA, 20 bp, Artificial Sequence
  chemically synthesized
caattgcccaagtcaaaaat

SEQ ID NO: 56915 - DNA, 20 bp, Artificial Sequence
  chemically synthesized
taataccctaatttttgact

SEQ ID NO: 56916 - DNA, 20 bp, Artificial Sequence
  chemically synthesized
aataccctaatttttgactt

SEQ ID NO: 56917 - DNA, 20 bp, Artificial Sequence
  chemically synthesized
taatttttgacttgggcaat

SEQ ID NO: 56918 - DNA, 20 bp, Artificial Sequence
  chemically synthesized
tacgcttcacccaattgccc

SEQ ID NO: 56919 - DNA, 20 bp, Artificial Sequence
  chemically synthesized
aatttttgacttgggcaatt

SEQ ID NO: 56920 - DNA, 20 bp, Artificial Sequence
  chemically synthesized
ttgacttgggcaattgggtg

SEQ ID NO: 56921 - DNA, 20 bp, Artificial Sequence
  chemically synthesized
ttgggcaattgggtgaagcg

SEQ ID NO: 56922 - DNA, 20 bp, Artificial Sequence
  chemically synthesized
gggtgaagcgtagcgttcat

SEQ ID NO: 56923 - DNA, 20 bp, Artificial Sequence
  chemically synthesized
aagcgtagcgttcataagaa

SEQ ID NO: 56924 - DNA, 20 bp, Artificial Sequence
  chemically synthesized
gttcataagaacagcacaat

SEQ ID NO: 56925 - DNA, 20 bp, Artificial Sequence
  chemically synthesized
ttcataagaacagcacaatt

SEQ ID NO: 56926 - DNA, 20 bp, Artificial Sequence
  chemically synthesized
tcataagaacagcacaatta

SEQ ID NO: 56927 - DNA, 20 bp, Artificial Sequence
  chemically synthesized
ataagaacagcacaattagg

SEQ ID NO: 56928 - DNA, 20 bp, Artificial Sequence
  chemically synthesized
taagaacagcacaattaggg

SEQ ID NO: 56929 - DNA, 20 bp, Artificial Sequence
  chemically synthesized
aagaacagcacaattaggga

SEQ ID NO: 56930 - DNA, 20 bp, Artificial Sequence
  chemically synthesized
attagggagggaaaaatgtt

SEQ ID NO: 56931 - DNA, 20 bp, Artificial Sequence
  chemically synthesized
ttagggagggaaaaatgttg

SEQ ID NO: 56932 - DNA, 20 bp, Artificial Sequence
  chemically synthesized
tagggagggaaaaatgttga

SEQ ID NO: 56933 - DNA, 20 bp, Artificial Sequence
  chemically synthesized
ggagggaaaaatgttgaggg

SEQ ID NO: 56934 - DNA, 20 bp, Artificial Sequence
  chemically synthesized
gaaaaatgttgagggtggat

SEQ ID NO: 56935 - DNA, 20 bp, Artificial Sequence
  chemically synthesized
aaaaatgttgagggtggatt

SEQ ID NO: 56936 - DNA, 20 bp, Artificial Sequence
  chemically synthesized
ttgagggtggattgggacaa

SEQ ID NO: 56937 - DNA, 20 bp, Artificial Sequence
  chemically synthesized
tgagggtggattgggacaaa

SEQ ID NO: 56938 - DNA, 20 bp, Artificial Sequence
  chemically synthesized
agggtggattgggacaaaag

SEQ ID NO: 56939 - DNA, 20 bp, Artificial Sequence
  chemically synthesized
gggtggattgggacaaaagg

SEQ ID NO: 56940 - DNA, 20 bp, Artificial Sequence
  chemically synthesized
gacaaaaggaggataataat

SEQ ID NO: 56941 - DNA, 20 bp, Artificial Sequence
  chemically synthesized
ggaggataataatgagctgc

SEQ ID NO: 56942 - DNA, 20 bp, Artificial Sequence
  chemically synthesized
gaggataataatgagctgct

SEQ ID NO: 56943 - DNA, 20 bp, Artificial Sequence
  chemically synthesized
aggataataatgagctgctg

SEQ ID NO: 56944 - DNA, 20 bp, Artificial Sequence
  chemically synthesized
cagacttaacatgtccccag

SEQ ID NO: 56945 - DNA, 20 bp, Artificial Sequence
  chemically synthesized
cctcagacttaacatgtccc

SEQ ID NO: 56946 - DNA, 20 bp, Artificial Sequence
  chemically synthesized
tgagctgctggggacatgtt

SEQ ID NO: 56947 - DNA, 20 bp, Artificial Sequence
  chemically synthesized
gctggggacatgttaagtct

SEQ ID NO: 56948 - DNA, 20 bp, Artificial Sequence
  chemically synthesized
ctggggacatgttaagtctg

SEQ ID NO: 56949 - DNA, 20 bp, Artificial Sequence
  chemically synthesized
tgaatgtcccacagacacct

SEQ ID NO: 56950 - DNA, 20 bp, Artificial Sequence
  chemically synthesized
tgttaagtctgaggtgtctg

SEQ ID NO: 56951 - DNA, 20 bp, Artificial Sequence
  chemically synthesized
gttaagtctgaggtgtctgt

SEQ ID NO: 56952 - DNA, 20 bp, Artificial Sequence
  chemically synthesized
accacaacctgaatgtccca

SEQ ID NO: 56953 - DNA, 20 bp, Artificial Sequence
  chemically synthesized
tgaggtgtctgtgggacatt

SEQ ID NO: 56954 - DNA, 20 bp, Artificial Sequence
  chemically synthesized
gaggtgtctgtgggacattc

SEQ ID NO: 56955 - DNA, 20 bp, Artificial Sequence
  chemically synthesized
tctgtgggacattcaggttg

SEQ ID NO: 56956 - DNA, 20 bp, Artificial Sequence
  chemically synthesized
gtgggacattcaggttgtgg

SEQ ID NO: 56957 - DNA, 20 bp, Artificial Sequence
  chemically synthesized
acattcaggttgtggtggac

SEQ ID NO: 56958 - DNA, 20 bp, Artificial Sequence
  chemically synthesized
gttgtggtggacaagaaaca

SEQ ID NO: 56959 - DNA, 20 bp, Artificial Sequence
  chemically synthesized
gtggtggacaagaaacatag

SEQ ID NO: 56960 - DNA, 20 bp, Artificial Sequence
  chemically synthesized
tggtggacaagaaacataga

SEQ ID NO: 56961 - DNA, 20 bp, Artificial Sequence
  chemically synthesized
tggacaagaaacatagaagg

SEQ ID NO: 56962 - DNA, 20 bp, Artificial Sequence
  chemically synthesized
caagaaacatagaaggtggc

SEQ ID NO: 56963 - DNA, 20 bp, Artificial Sequence
  chemically synthesized
aagaaacatagaaggtggct

SEQ ID NO: 56964 - DNA, 20 bp, Artificial Sequence
  chemically synthesized
atagaaggtggctgggtctg

SEQ ID NO: 56965 - DNA, 20 bp, Artificial Sequence
  chemically synthesized
tctctcctgggcttcagacc

SEQ ID NO: 56966 - DNA, 20 bp, Artificial Sequence
  chemically synthesized
aggtggctgggtctgaagcc

SEQ ID NO: 56967 - DNA, 20 bp, Artificial Sequence
  chemically synthesized
ggtggctgggtctgaagccc

SEQ ID NO: 56968 - DNA, 20 bp, Artificial Sequence
  chemically synthesized
cttatttctctcctgggctt

SEQ ID NO: 56969 - DNA, 20 bp, Artificial Sequence
  chemically synthesized
tggctgggtctgaagcccag

SEQ ID NO: 56970 - DNA, 20 bp, Artificial Sequence
  chemically synthesized
gctgggtctgaagcccagga

SEQ ID NO: 56971 - DNA, 20 bp, Artificial Sequence
  chemically synthesized
gtcagacttatttctctcct

SEQ ID NO: 56972 - DNA, 20 bp, Artificial Sequence
  chemically synthesized
ggtcagacttatttctctcc

SEQ ID NO: 56973 - DNA, 20 bp, Artificial Sequence
  chemically synthesized
ctgaagcccaggagagaaat

SEQ ID NO: 56974 - DNA, 20 bp, Artificial Sequence
  chemically synthesized
cttgattattgaagtaaggt

SEQ ID NO: 56975 - DNA, 20 bp, Artificial Sequence
  chemically synthesized
ctggcttgattattgaagta

SEQ ID NO: 56976 - DNA, 20 bp, Artificial Sequence
  chemically synthesized
gctggcttgattattgaagt

SEQ ID NO: 56977 - DNA, 20 bp, Artificial Sequence
  chemically synthesized
aatggctggcttgattattg

SEQ ID NO: 56978 - DNA, 20 bp, Artificial Sequence
  chemically synthesized
ctgaccttacttcaataatc

SEQ ID NO: 56979 - DNA, 20 bp, Artificial Sequence
  chemically synthesized
ccttacttcaataatcaagc

SEQ ID NO: 56980 - DNA, 20 bp, Artificial Sequence
  chemically synthesized
gcataattatttgaaatggc

SEQ ID NO: 56981 - DNA, 20 bp, Artificial Sequence
  chemically synthesized
tctagcataattatttgaaa

SEQ ID NO: 56982 - DNA, 20 bp, Artificial Sequence
  chemically synthesized
gccatttcaaataattatgc

SEQ ID NO: 56983 - DNA, 20 bp, Artificial Sequence
  chemically synthesized
catttcaaataattatgcta

SEQ ID NO: 56984 - DNA, 20 bp, Artificial Sequence
  chemically synthesized
atatggatgttcaattgctc

SEQ ID NO: 56985 - DNA, 20 bp, Artificial Sequence
  chemically synthesized
tgaggtttattttttgcata

SEQ ID NO: 56986 - DNA, 20 bp, Artificial Sequence
  chemically synthesized
aaagtatgaggtttaagttg

SEQ ID NO: 56987 - DNA, 20 bp, Artificial Sequence
  chemically synthesized
taaagtatgaggtttaagtt

SEQ ID NO: 56988 - DNA, 20 bp, Artificial Sequence
  chemically synthesized
ttatataaagtatgaggttt

SEQ ID NO: 56989 - DNA, 20 bp, Artificial Sequence
  chemically synthesized
tgatttttatataaagtatg

SEQ ID NO: 56990 - DNA, 20 bp, Artificial Sequence
  chemically synthesized
ttgatttttatataaagtat

SEQ ID NO: 56991 - DNA, 20 bp, Artificial Sequence
  chemically synthesized
atccatttgatttttatata

SEQ ID NO: 56992 - DNA, 20 bp, Artificial Sequence
  chemically synthesized
tactttatataaaaatcaaa

SEQ ID NO: 56993 - DNA, 20 bp, Artificial Sequence
  chemically synthesized
tataaaaatcaaatggatca

SEQ ID NO: 56994 - DNA, 20 bp, Artificial Sequence
  chemically synthesized
tagttttacattttatgttt

SEQ ID NO: 56995 - DNA, 20 bp, Artificial Sequence
  chemically synthesized
aacataaaatgtaaaactat

SEQ ID NO: 56996 - DNA, 20 bp, Artificial Sequence
  chemically synthesized
ctcctgttttatatgtctta

SEQ ID NO: 56997 - DNA, 20 bp, Artificial Sequence
  chemically synthesized
aaactataagacatataaaa

SEQ ID NO: 56998 - DNA, 20 bp, Artificial Sequence
  chemically synthesized
aactataagacatataaaac

SEQ ID NO: 56999 - DNA, 20 bp, Artificial Sequence
  chemically synthesized
ctataagacatataaaacag

SEQ ID NO: 57000 - DNA, 20 bp, Artificial Sequence
  chemically synthesized
ataagacatataaaacagga

SEQ ID NO: 57001 - DNA, 20 bp, Artificial Sequence
  chemically synthesized
ataaaacaggagagccaaaa

SEQ ID NO: 57002 - DNA, 20 bp, Artificial Sequence
  chemically synthesized
gagacggggtttcaccattt

SEQ ID NO: 57003 - DNA, 20 bp, Artificial Sequence
  chemically synthesized
ttgtatttttagtagagacg

SEQ ID NO: 57004 - DNA, 20 bp, Artificial Sequence
  chemically synthesized
tttgtatttttagtagagac

SEQ ID NO: 57005 - DNA, 20 bp, Artificial Sequence
  chemically synthesized
ttttgtatttttagtagaga

SEQ ID NO: 57006 - DNA, 20 bp, Artificial Sequence
  chemically synthesized
aattttttgtatttttagta

SEQ ID NO: 57007 - DNA, 20 bp, Artificial Sequence
  chemically synthesized
ctaattttttgtatttttag

SEQ ID NO: 57008 - DNA, 20 bp, Artificial Sequence
  chemically synthesized
cagctaattttttgtatttt

SEQ ID NO: 57009 - DNA, 20 bp, Artificial Sequence
  chemically synthesized
ctactaaaaatacaaaaaat

SEQ ID NO: 57010 - DNA, 20 bp, Artificial Sequence
  chemically synthesized
taaaaatacaaaaaattagc

SEQ ID NO: 57011 - DNA, 20 bp, Artificial Sequence
  chemically synthesized
aaaaatacaaaaaattagct

SEQ ID NO: 57012 - DNA, 20 bp, Artificial Sequence
  chemically synthesized
tacaaaaaattagctgggtg

SEQ ID NO: 57013 - DNA, 20 bp, Artificial Sequence
  chemically synthesized
aaaaaattagctgggtgtgg

SEQ ID NO: 57014 - DNA, 20 bp, Artificial Sequence
  chemically synthesized
caggcctccaccaccacacc

SEQ ID NO: 57015 - DNA, 20 bp, Artificial Sequence
  chemically synthesized
aaattagctgggtgtggtgg

SEQ ID NO: 57016 - DNA, 20 bp, Artificial Sequence
  chemically synthesized
attagctgggtgtggtggtg

SEQ ID NO: 57017 - DNA, 20 bp, Artificial Sequence
  chemically synthesized
ttagctgggtgtggtggtgg

SEQ ID NO: 57018 - DNA, 20 bp, Artificial Sequence
  chemically synthesized
ggtgtggtggtggaggcctg

SEQ ID NO: 57019 - DNA, 20 bp, Artificial Sequence
  chemically synthesized
gtggtggaggcctgtagtcc

SEQ ID NO: 57020 - DNA, 20 bp, Artificial Sequence
  chemically synthesized
tcccgagtagctgggactac

SEQ ID NO: 57021 - DNA, 20 bp, Artificial Sequence
  chemically synthesized
ctcccgagtagctgggacta

SEQ ID NO: 57022 - DNA, 20 bp, Artificial Sequence
  chemically synthesized
ggcctgtagtcccagctact

SEQ ID NO: 57023 - DNA, 20 bp, Artificial Sequence
  chemically synthesized
cctcagcctcccgagtagct

SEQ ID NO: 57024 - DNA, 20 bp, Artificial Sequence
  chemically synthesized
gcctgtagtcccagctactc

SEQ ID NO: 57025 - DNA, 20 bp, Artificial Sequence
  chemically synthesized
gcctcagcctcccgagtagc

SEQ ID NO: 57026 - DNA, 20 bp, Artificial Sequence
  chemically synthesized
ctgtagtcccagctactcgg

SEQ ID NO: 57027 - DNA, 20 bp, Artificial Sequence
  chemically synthesized
tgtagtcccagctactcggg

SEQ ID NO: 57028 - DNA, 20 bp, Artificial Sequence
  chemically synthesized
tcctgcctcagcctcccgag

SEQ ID NO: 57029 - DNA, 20 bp, Artificial Sequence
  chemically synthesized
ttctcctgcctcagcctccc

SEQ ID NO: 57030 - DNA, 20 bp, Artificial Sequence
  chemically synthesized
tcccagctactcgggaggct

SEQ ID NO: 57031 - DNA, 20 bp, Artificial Sequence
  chemically synthesized
cccagctactcgggaggctg

SEQ ID NO: 57032 - DNA, 20 bp, Artificial Sequence
  chemically synthesized
agctactcgggaggctgagg

SEQ ID NO: 57033 - DNA, 20 bp, Artificial Sequence
  chemically synthesized
gctactcgggaggctgaggc

SEQ ID NO: 57034 - DNA, 20 bp, Artificial Sequence
  chemically synthesized
tactcgggaggctgaggcag

SEQ ID NO: 57035 - DNA, 20 bp, Artificial Sequence
  chemically synthesized
ttcacgccattctcctgcct

SEQ ID NO: 57036 - DNA, 20 bp, Artificial Sequence
  chemically synthesized
gggaggctgaggcaggagaa

SEQ ID NO: 57037 - DNA, 20 bp, Artificial Sequence
  chemically synthesized
gcaggagaatggcgtgaacc

SEQ ID NO: 57038 - DNA, 20 bp, Artificial Sequence
  chemically synthesized
caggagaatggcgtgaaccc

SEQ ID NO: 57039 - DNA, 20 bp, Artificial Sequence
  chemically synthesized
ggagaatggcgtgaacccgg

SEQ ID NO: 57040 - DNA, 20 bp, Artificial Sequence
  chemically synthesized
gagaatggcgtgaacccggg

SEQ ID NO: 57041 - DNA, 20 bp, Artificial Sequence
  chemically synthesized
aatggcgtgaacccgggagg

SEQ ID NO: 57042 - DNA, 20 bp, Artificial Sequence
  chemically synthesized
cactgcaagttccgcctccc

SEQ ID NO: 57043 - DNA, 20 bp, Artificial Sequence
  chemically synthesized
tcactgcaagttccgcctcc

SEQ ID NO: 57044 - DNA, 20 bp, Artificial Sequence
  chemically synthesized
aacccgggaggcggaacttg

SEQ ID NO: 57045 - DNA, 20 bp, Artificial Sequence
  chemically synthesized
cgggaggcggaacttgcagt

SEQ ID NO: 57046 - DNA, 20 bp, Artificial Sequence
  chemically synthesized
gcccgatcttggctcactgc

SEQ ID NO: 57047 - DNA, 20 bp, Artificial Sequence
  chemically synthesized
ggcggaacttgcagtgagcc

SEQ ID NO: 57048 - DNA, 20 bp, Artificial Sequence
  chemically synthesized
aacttgcagtgagccaagat

SEQ ID NO: 57049 - DNA, 20 bp, Artificial Sequence
  chemically synthesized
acttgcagtgagccaagatc

SEQ ID NO: 57050 - DNA, 20 bp, Artificial Sequence
  chemically synthesized
ggagtgcagtggcccgatct

SEQ ID NO: 57051 - DNA, 20 bp, Artificial Sequence
  chemically synthesized
tcgcccagcttggagtgcag

SEQ ID NO: 57052 - DNA, 20 bp, Artificial Sequence
  chemically synthesized
agatcgggccactgcactcc

SEQ ID NO: 57053 - DNA, 20 bp, Artificial Sequence
  chemically synthesized
ctgtcgcccagcttggagtg

SEQ ID NO: 57054 - DNA, 20 bp, Artificial Sequence
  chemically synthesized
cgggccactgcactccaagc

SEQ ID NO: 57055 - DNA, 20 bp, Artificial Sequence
  chemically synthesized
gggccactgcactccaagct

SEQ ID NO: 57056 - DNA, 20 bp, Artificial Sequence
  chemically synthesized
tcgctctgtcgcccagcttg

SEQ ID NO: 57057 - DNA, 20 bp, Artificial Sequence
  chemically synthesized
cctcgctctgtcgcccagct

SEQ ID NO: 57058 - DNA, 20 bp, Artificial Sequence
  chemically synthesized
ctgcactccaagctgggcga

SEQ ID NO: 57059 - DNA, 20 bp, Artificial Sequence
  chemically synthesized
gcactccaagctgggcgaca

SEQ ID NO: 57060 - DNA, 20 bp, Artificial Sequence
  chemically synthesized
cggagcctcgctctgtcgcc

SEQ ID NO: 57061 - DNA, 20 bp, Artificial Sequence
  chemically synthesized
tccaagctgggcgacagagc

SEQ ID NO: 57062 - DNA, 20 bp, Artificial Sequence
  chemically synthesized
ccaagctgggcgacagagcg

SEQ ID NO: 57063 - DNA, 20 bp, Artificial Sequence
  chemically synthesized
ttttttttttttttgagacg

SEQ ID NO: 57064 - DNA, 20 bp, Artificial Sequence
  chemically synthesized
ttttttttttttttttgaga

SEQ ID NO: 57065 - DNA, 20 bp, Artificial Sequence
  chemically synthesized
tctttttttttttttttttt

SEQ ID NO: 57066 - DNA, 20 bp, Artificial Sequence
  chemically synthesized
tctcaaaaaaaaaaaaaaaa

SEQ ID NO: 57067 - DNA, 20 bp, Artificial Sequence
  chemically synthesized
aaaaaaaaaaaaaaaaagaa

SEQ ID NO: 57068 - DNA, 20 bp, Artificial Sequence
  chemically synthesized
aaaaaaaaaaaaaaaagaac

SEQ ID NO: 57069 - DNA, 20 bp, Artificial Sequence
  chemically synthesized
aaaaaaaaaaaaaagaacag

SEQ ID NO: 57070 - DNA, 20 bp, Artificial Sequence
  chemically synthesized
aaagaacaggagaaaatctt

SEQ ID NO: 57071 - DNA, 20 bp, Artificial Sequence
  chemically synthesized
aagaacaggagaaaatcttt

SEQ ID NO: 57072 - DNA, 20 bp, Artificial Sequence
  chemically synthesized
aggagaaaatctttgggatc

SEQ ID NO: 57073 - DNA, 20 bp, Artificial Sequence
  chemically synthesized
ttgcctagccctggatccca

SEQ ID NO: 57074 - DNA, 20 bp, Artificial Sequence
  chemically synthesized
ggagaaaatctttgggatcc

SEQ ID NO: 57075 - DNA, 20 bp, Artificial Sequence
  chemically synthesized
gagaaaatctttgggatcca

SEQ ID NO: 57076 - DNA, 20 bp, Artificial Sequence
  chemically synthesized
aaatctttgggatccagggc

SEQ ID NO: 57077 - DNA, 20 bp, Artificial Sequence
  chemically synthesized
aatctttgggatccagggct

SEQ ID NO: 57078 - DNA, 20 bp, Artificial Sequence
  chemically synthesized
aagaatactttgcctagccc

SEQ ID NO: 57079 - DNA, 20 bp, Artificial Sequence
  chemically synthesized
ttgggatccagggctaggca

SEQ ID NO: 57080 - DNA, 20 bp, Artificial Sequence
  chemically synthesized
gagtctaagaatactttgcc

SEQ ID NO: 57081 - DNA, 20 bp, Artificial Sequence
  chemically synthesized
agggctaggcaaagtattct

SEQ ID NO: 57082 - DNA, 20 bp, Artificial Sequence
  chemically synthesized
catgcttttgtgttgagtct

SEQ ID NO: 57083 - DNA, 20 bp, Artificial Sequence
  chemically synthesized
tattcttagactcaacacaa

SEQ ID NO: 57084 - DNA, 20 bp, Artificial Sequence
  chemically synthesized
atggatcatgcttttgtgtt

SEQ ID NO: 57085 - DNA, 20 bp, Artificial Sequence
  chemically synthesized
cacaaaagcatgatccataa

SEQ ID NO: 57086 - DNA, 20 bp, Artificial Sequence
  chemically synthesized
acaaaagcatgatccataaa

SEQ ID NO: 57087 - DNA, 20 bp, Artificial Sequence
  chemically synthesized
tttatcgctttttcctttta

SEQ ID NO: 57088 - DNA, 20 bp, Artificial Sequence
  chemically synthesized
gcatgatccataaaaggaaa

SEQ ID NO: 57089 - DNA, 20 bp, Artificial Sequence
  chemically synthesized
aaagaattttaattttggcg

SEQ ID NO: 57090 - DNA, 20 bp, Artificial Sequence
  chemically synthesized
aaaagaattttaattttggc

SEQ ID NO: 57091 - DNA, 20 bp, Artificial Sequence
  chemically synthesized
atgaaaaagaattttaattt

SEQ ID NO: 57092 - DNA, 20 bp, Artificial Sequence
  chemically synthesized
cttcttaacaggggatgaaa

SEQ ID NO: 57093 - DNA, 20 bp, Artificial Sequence
  chemically synthesized
attctttttcatcccctgtt

SEQ ID NO: 57094 - DNA, 20 bp, Artificial Sequence
  chemically synthesized
tcttttcatcttcttaacag

SEQ ID NO: 57095 - DNA, 20 bp, Artificial Sequence
  chemically synthesized
ctttttcatcccctgttaag

SEQ ID NO: 57096 - DNA, 20 bp, Artificial Sequence
  chemically synthesized
atcttttcatcttcttaaca

SEQ ID NO: 57097 - DNA, 20 bp, Artificial Sequence
  chemically synthesized
catcttttcatcttcttaac

SEQ ID NO: 57098 - DNA, 20 bp, Artificial Sequence
  chemically synthesized
tcatcttttcatcttcttaa

SEQ ID NO: 57099 - DNA, 20 bp, Artificial Sequence
  chemically synthesized
tcccctgttaagaagatgaa

SEQ ID NO: 57100 - DNA, 20 bp, Artificial Sequence
  chemically synthesized
tgttaagaagatgaaaagat

SEQ ID NO: 57101 - DNA, 20 bp, Artificial Sequence
  chemically synthesized
ttaagaagatgaaaagatga

SEQ ID NO: 57102 - DNA, 20 bp, Artificial Sequence
  chemically synthesized
aagaagatgaaaagatgaga

SEQ ID NO: 57103 - DNA, 20 bp, Artificial Sequence
  chemically synthesized
catttgaaaaccctatacac

SEQ ID NO: 57104 - DNA, 20 bp, Artificial Sequence
  chemically synthesized
ctagtcctttcttgtgtata

SEQ ID NO: 57105 - DNA, 20 bp, Artificial Sequence
  chemically synthesized
actagtcctttcttgtgtat

SEQ ID NO: 57106 - DNA, 20 bp, Artificial Sequence
  chemically synthesized
tactagtcctttcttgtgta

SEQ ID NO: 57107 - DNA, 20 bp, Artificial Sequence
  chemically synthesized
tgaaaaccctatacacaaga

SEQ ID NO: 57108 - DNA, 20 bp, Artificial Sequence
  chemically synthesized
gaaaaccctatacacaagaa

SEQ ID NO: 57109 - DNA, 20 bp, Artificial Sequence
  chemically synthesized
ccctatacacaagaaaggac

SEQ ID NO: 57110 - DNA, 20 bp, Artificial Sequence
  chemically synthesized
gttctttctgtatcagatac

SEQ ID NO: 57111 - DNA, 20 bp, Artificial Sequence
  chemically synthesized
gaaaggactagtatctgata

SEQ ID NO: 57112 - DNA, 20 bp, Artificial Sequence
  chemically synthesized
ggactagtatctgatacaga

SEQ ID NO: 57113 - DNA, 20 bp, Artificial Sequence
  chemically synthesized
tttgagagttctttctgtat

SEQ ID NO: 57114 - DNA, 20 bp, Artificial Sequence
  chemically synthesized
tttttatagttcggttttga

SEQ ID NO: 57115 - DNA, 20 bp, Artificial Sequence
  chemically synthesized
tttttttatagttcggtttt

SEQ ID NO: 57116 - DNA, 20 bp, Artificial Sequence
  chemically synthesized
tcaaaagtttttttatagtt

SEQ ID NO: 57117 - DNA, 20 bp, Artificial Sequence
  chemically synthesized
ctaattcaaaagttttttta

SEQ ID NO: 57118 - DNA, 20 bp, Artificial Sequence
  chemically synthesized
ctataaaaaaacttttgaat

SEQ ID NO: 57119 - DNA, 20 bp, Artificial Sequence
  chemically synthesized
ttgtctattttctaattcaa

SEQ ID NO: 57120 - DNA, 20 bp, Artificial Sequence
  chemically synthesized
aaaacttttgaattagaaaa

SEQ ID NO: 57121 - DNA, 20 bp, Artificial Sequence
  chemically synthesized
ttgaattagaaaatagacaa

SEQ ID NO: 57122 - DNA, 20 bp, Artificial Sequence
  chemically synthesized
aaatagacaaaagacatgaa

SEQ ID NO: 57123 - DNA, 20 bp, Artificial Sequence
  chemically synthesized
acatgaacagacatttcaat

SEQ ID NO: 57124 - DNA, 20 bp, Artificial Sequence
  chemically synthesized
catgaacagacatttcaatg

SEQ ID NO: 57125 - DNA, 20 bp, Artificial Sequence
  chemically synthesized
tgaacagacatttcaatgag

SEQ ID NO: 57126 - DNA, 20 bp, Artificial Sequence
  chemically synthesized
gaacagacatttcaatgagg

SEQ ID NO: 57127 - DNA, 20 bp, Artificial Sequence
  chemically synthesized
caatgaggaggatatacata

SEQ ID NO: 57128 - DNA, 20 bp, Artificial Sequence
  chemically synthesized
aggatatacatatggcaaac

SEQ ID NO: 57129 - DNA, 20 bp, Artificial Sequence
  chemically synthesized
atacatatggcaaacaagta

SEQ ID NO: 57130 - DNA, 20 bp, Artificial Sequence
  chemically synthesized
tacatatggcaaacaagtac

SEQ ID NO: 57131 - DNA, 20 bp, Artificial Sequence
  chemically synthesized
atggcaaacaagtacaggaa

SEQ ID NO: 57132 - DNA, 20 bp, Artificial Sequence
  chemically synthesized
gtacaggaaaagttgttcaa

SEQ ID NO: 57133 - DNA, 20 bp, Artificial Sequence
  chemically synthesized
tgttcaacagcatttgccac

SEQ ID NO: 57134 - DNA, 20 bp, Artificial Sequence
  chemically synthesized
gttcaacagcatttgccacg

SEQ ID NO: 57135 - DNA, 20 bp, Artificial Sequence
  chemically synthesized
ttcaacagcatttgccacga

SEQ ID NO: 57136 - DNA, 20 bp, Artificial Sequence
  chemically synthesized
tttaatttacgtttccctcg

SEQ ID NO: 57137 - DNA, 20 bp, Artificial Sequence
  chemically synthesized
acgagggaaacgtaaattaa

SEQ ID NO: 57138 - DNA, 20 bp, Artificial Sequence
  chemically synthesized
acgtaaattaaaagcacaat

SEQ ID NO: 57139 - DNA, 20 bp, Artificial Sequence
  chemically synthesized
agccattctgatatgtgtgt

SEQ ID NO: 57140 - DNA, 20 bp, Artificial Sequence
  chemically synthesized
tagccattctgatatgtgtg

SEQ ID NO: 57141 - DNA, 20 bp, Artificial Sequence
  chemically synthesized
agatattcctacacacatat

SEQ ID NO: 57142 - DNA, 20 bp, Artificial Sequence
  chemically synthesized
ttcctacacacatatcagaa

SEQ ID NO: 57143 - DNA, 20 bp, Artificial Sequence
  chemically synthesized
ttgtcattattttttatttt

SEQ ID NO: 57144 - DNA, 20 bp, Artificial Sequence
  chemically synthesized
ataatgacaacaccaaatgt

SEQ ID NO: 57145 - DNA, 20 bp, Artificial Sequence
  chemically synthesized
tctgcatcttcaccaacatt

SEQ ID NO: 57146 - DNA, 20 bp, Artificial Sequence
  chemically synthesized
gacaacaccaaatgttggtg

SEQ ID NO: 57147 - DNA, 20 bp, Artificial Sequence
  chemically synthesized
accaaatgttggtgaagatg

SEQ ID NO: 57148 - DNA, 20 bp, Artificial Sequence
  chemically synthesized
caaatgttggtgaagatgca

SEQ ID NO: 57149 - DNA, 20 bp, Artificial Sequence
  chemically synthesized
tggtgaagatgcagagaaac

SEQ ID NO: 57150 - DNA, 20 bp, Artificial Sequence
  chemically synthesized
ccagcaatgtatgagtgatc

SEQ ID NO: 57151 - DNA, 20 bp, Artificial Sequence
  chemically synthesized
atattccaccagcaatgtat

SEQ ID NO: 57152 - DNA, 20 bp, Artificial Sequence
  chemically synthesized
ctggatcactcatacattgc

SEQ ID NO: 57153 - DNA, 20 bp, Artificial Sequence
  chemically synthesized
gatcactcatacattgctgg

SEQ ID NO: 57154 - DNA, 20 bp, Artificial Sequence
  chemically synthesized
tgtactattttatattccac

SEQ ID NO: 57155 - DNA, 20 bp, Artificial Sequence
  chemically synthesized
attgctggtggaatataaaa

SEQ ID NO: 57156 - DNA, 20 bp, Artificial Sequence
  chemically synthesized
tggtggaatataaaatagta

SEQ ID NO: 57157 - DNA, 20 bp, Artificial Sequence
  chemically synthesized
ataaaatagtacagacgctt

SEQ ID NO: 57158 - DNA, 20 bp, Artificial Sequence
  chemically synthesized
atagtacagacgcttcggaa

SEQ ID NO: 57159 - DNA, 20 bp, Artificial Sequence
  chemically synthesized
aaaactgccaaacttttccg

SEQ ID NO: 57160 - DNA, 20 bp, Artificial Sequence
  chemically synthesized
acagacgcttcggaaaagtt

SEQ ID NO: 57161 - DNA, 20 bp, Artificial Sequence
  chemically synthesized
gacgcttcggaaaagtttgg

SEQ ID NO: 57162 - DNA, 20 bp, Artificial Sequence
  chemically synthesized
tcatatggtagttgaatgtt

SEQ ID NO: 57163 - DNA, 20 bp, Artificial Sequence
  chemically synthesized
gcaattgttaggtcatatgg

SEQ ID NO: 57164 - DNA, 20 bp, Artificial Sequence
  chemically synthesized
agtgcaattgttaggtcata

SEQ ID NO: 57165 - DNA, 20 bp, Artificial Sequence
  chemically synthesized
tgctgaagagtgcaattgtt

SEQ ID NO: 57166 - DNA, 20 bp, Artificial Sequence
  chemically synthesized
atgctgaagagtgcaattgt

SEQ ID NO: 57167 - DNA, 20 bp, Artificial Sequence
  chemically synthesized
gacctaacaattgcactctt

SEQ ID NO: 57168 - DNA, 20 bp, Artificial Sequence
  chemically synthesized
tccctgagataaatgctgaa

SEQ ID NO: 57169 - DNA, 20 bp, Artificial Sequence
  chemically synthesized
tttccctgagataaatgctg

SEQ ID NO: 57170 - DNA, 20 bp, Artificial Sequence
  chemically synthesized
gcactcttcagcatttatct

SEQ ID NO: 57171 - DNA, 20 bp, Artificial Sequence
  chemically synthesized
cactcttcagcatttatctc

SEQ ID NO: 57172 - DNA, 20 bp, Artificial Sequence
  chemically synthesized
actcttcagcatttatctca

SEQ ID NO: 57173 - DNA, 20 bp, Artificial Sequence
  chemically synthesized
acataagtttttatttccct

SEQ ID NO: 57174 - DNA, 20 bp, Artificial Sequence
  chemically synthesized
acaggtttttgtgtgaacat

SEQ ID NO: 57175 - DNA, 20 bp, Artificial Sequence
  chemically synthesized
agctaccaacattaatgtac

SEQ ID NO: 57176 - DNA, 20 bp, Artificial Sequence
  chemically synthesized
aagctaccaacattaatgta

SEQ ID NO: 57177 - DNA, 20 bp, Artificial Sequence
  chemically synthesized
aaaaacctgtacattaatgt

SEQ ID NO: 57178 - DNA, 20 bp, Artificial Sequence
  chemically synthesized
aacctgtacattaatgttgg

SEQ ID NO: 57179 - DNA, 20 bp, Artificial Sequence
  chemically synthesized
gttttggactattgtgaata

SEQ ID NO: 57180 - DNA, 20 bp, Artificial Sequence
  chemically synthesized
gttggtagctttattcacaa

SEQ ID NO: 57181 - DNA, 20 bp, Artificial Sequence
  chemically synthesized
ttcacaatagtccaaaacta

SEQ ID NO: 57182 - DNA, 20 bp, Artificial Sequence
  chemically synthesized
atctgagttatctgtagttt

SEQ ID NO: 57183 - DNA, 20 bp, Artificial Sequence
  chemically synthesized
gaagacatctgagttatctg

SEQ ID NO: 57184 - DNA, 20 bp, Artificial Sequence
  chemically synthesized
gtccaaaactacagataact

SEQ ID NO: 57185 - DNA, 20 bp, Artificial Sequence
  chemically synthesized
ctcaccccttgaagacatct

SEQ ID NO: 57186 - DNA, 20 bp, Artificial Sequence
  chemically synthesized
cagataactcagatgtcttc

SEQ ID NO: 57187 - DNA, 20 bp, Artificial Sequence
  chemically synthesized
agataactcagatgtcttca

SEQ ID NO: 57188 - DNA, 20 bp, Artificial Sequence
  chemically synthesized
gataactcagatgtcttcaa

SEQ ID NO: 57189 - DNA, 20 bp, Artificial Sequence
  chemically synthesized
ataactcagatgtcttcaag

SEQ ID NO: 57190 - DNA, 20 bp, Artificial Sequence
  chemically synthesized
atttaatcactcaccccttg

SEQ ID NO: 57191 - DNA, 20 bp, Artificial Sequence
  chemically synthesized
ctcagatgtcttcaaggggt

SEQ ID NO: 57192 - DNA, 20 bp, Artificial Sequence
  chemically synthesized
gggtgagtgattaaataaac

SEQ ID NO: 57193 - DNA, 20 bp, Artificial Sequence
  chemically synthesized
ggtgagtgattaaataaact

SEQ ID NO: 57194 - DNA, 20 bp, Artificial Sequence
  chemically synthesized
gtgagtgattaaataaacta

SEQ ID NO: 57195 - DNA, 20 bp, Artificial Sequence
  chemically synthesized
gctatggtttggatataccc

SEQ ID NO: 57196 - DNA, 20 bp, Artificial Sequence
  chemically synthesized
actagggtatatccaaacca

SEQ ID NO: 57197 - DNA, 20 bp, Artificial Sequence
  chemically synthesized
gtgagttgtatgctatggtt

SEQ ID NO: 57198 - DNA, 20 bp, Artificial Sequence
  chemically synthesized
ttatcgtgagttgtatgcta

SEQ ID NO: 57199 - DNA, 20 bp, Artificial Sequence
  chemically synthesized
acttgtttcctttttatcgt

SEQ ID NO: 57200 - DNA, 20 bp, Artificial Sequence
  chemically synthesized
agcatacaactcacgataaa

SEQ ID NO: 57201 - DNA, 20 bp, Artificial Sequence
  chemically synthesized
gcatacaactcacgataaaa

SEQ ID NO: 57202 - DNA, 20 bp, Artificial Sequence
  chemically synthesized
actcacgataaaaaggaaac

SEQ ID NO: 57203 - DNA, 20 bp, Artificial Sequence
  chemically synthesized
tttctctttttatatgcagc

SEQ ID NO: 57204 - DNA, 20 bp, Artificial Sequence
  chemically synthesized
gagatttctctttttatatg

SEQ ID NO: 57205 - DNA, 20 bp, Artificial Sequence
  chemically synthesized
caagtcttgctgcatataaa

SEQ ID NO: 57206 - DNA, 20 bp, Artificial Sequence
  chemically synthesized
agtcttgctgcatataaaaa

SEQ ID NO: 57207 - DNA, 20 bp, Artificial Sequence
  chemically synthesized
catataaaaagagaaatctc

SEQ ID NO: 57208 - DNA, 20 bp, Artificial Sequence
  chemically synthesized
atataaaaagagaaatctct

SEQ ID NO: 57209 - DNA, 20 bp, Artificial Sequence
  chemically synthesized
tataaaaagagaaatctcta

SEQ ID NO: 57210 - DNA, 20 bp, Artificial Sequence
  chemically synthesized
tcactcaacataattcccta

SEQ ID NO: 57211 - DNA, 20 bp, Artificial Sequence
  chemically synthesized
actcactcaacataattccc

SEQ ID NO: 57212 - DNA, 20 bp, Artificial Sequence
  chemically synthesized
aatctctagggaattatgtt

SEQ ID NO: 57213 - DNA, 20 bp, Artificial Sequence
  chemically synthesized
tctagggaattatgttgagt

SEQ ID NO: 57214 - DNA, 20 bp, Artificial Sequence
  chemically synthesized
ggaattatgttgagtgagtc

SEQ ID NO: 57215 - DNA, 20 bp, Artificial Sequence
  chemically synthesized
cagtatgtaatattttggga

SEQ ID NO: 57216 - DNA, 20 bp, Artificial Sequence
  chemically synthesized
catacagtatgtaatatttt

SEQ ID NO: 57217 - DNA, 20 bp, Artificial Sequence
  chemically synthesized
ccatacagtatgtaatattt

SEQ ID NO: 57218 - DNA, 20 bp, Artificial Sequence
  chemically synthesized
ccaaaatattacatactgta

SEQ ID NO: 57219 - DNA, 20 bp, Artificial Sequence
  chemically synthesized
gttatatgaatggaaccata

SEQ ID NO: 57220 - DNA, 20 bp, Artificial Sequence
  chemically synthesized
tttcaataatgttatatgaa

SEQ ID NO: 57221 - DNA, 20 bp, Artificial Sequence
  chemically synthesized
ttattgaaataacaaaatta

SEQ ID NO: 57222 - DNA, 20 bp, Artificial Sequence
  chemically synthesized
aaataacaaaattaaagaaa

SEQ ID NO: 57223 - DNA, 20 bp, Artificial Sequence
  chemically synthesized
aaaattaaagaaatggaaaa

SEQ ID NO: 57224 - DNA, 20 bp, Artificial Sequence
  chemically synthesized
taaagaaatggaaaacagac

SEQ ID NO: 57225 - DNA, 20 bp, Artificial Sequence
  chemically synthesized
agaaatggaaaacagactag

SEQ ID NO: 57226 - DNA, 20 bp, Artificial Sequence
  chemically synthesized
ctcctacttccagcaactac

SEQ ID NO: 57227 - DNA, 20 bp, Artificial Sequence
  chemically synthesized
gaaaacagactagtagttgc

SEQ ID NO: 57228 - DNA, 20 bp, Artificial Sequence
  chemically synthesized
aacagactagtagttgctgg

SEQ ID NO: 57229 - DNA, 20 bp, Artificial Sequence
  chemically synthesized
agactagtagttgctggaag

SEQ ID NO: 57230 - DNA, 20 bp, Artificial Sequence
  chemically synthesized
gactagtagttgctggaagt

SEQ ID NO: 57231 - DNA, 20 bp, Artificial Sequence
  chemically synthesized
ctagtagttgctggaagtag

SEQ ID NO: 57232 - DNA, 20 bp, Artificial Sequence
  chemically synthesized
ccccccctacctcctacttc

SEQ ID NO: 57233 - DNA, 20 bp, Artificial Sequence
  chemically synthesized
tagtagttgctggaagtagg

SEQ ID NO: 57234 - DNA, 20 bp, Artificial Sequence
  chemically synthesized
tagttgctggaagtaggagg

SEQ ID NO: 57235 - DNA, 20 bp, Artificial Sequence
  chemically synthesized
agttgctggaagtaggaggt

SEQ ID NO: 57236 - DNA, 20 bp, Artificial Sequence
  chemically synthesized
gttgctggaagtaggaggta

SEQ ID NO: 57237 - DNA, 20 bp, Artificial Sequence
  chemically synthesized
ttgctggaagtaggaggtag

SEQ ID NO: 57238 - DNA, 20 bp, Artificial Sequence
  chemically synthesized
tgctggaagtaggaggtagg

SEQ ID NO: 57239 - DNA, 20 bp, Artificial Sequence
  chemically synthesized
gctggaagtaggaggtaggg

SEQ ID NO: 57240 - DNA, 20 bp, Artificial Sequence
  chemically synthesized
ctggaagtaggaggtagggg

SEQ ID NO: 57241 - DNA, 20 bp, Artificial Sequence
  chemically synthesized
gaagtaggaggtaggggggg

SEQ ID NO: 57242 - DNA, 20 bp, Artificial Sequence
  chemically synthesized
aagtaggaggtagggggggc

SEQ ID NO: 57243 - DNA, 20 bp, Artificial Sequence
  chemically synthesized
agtaggaggtagggggggca

SEQ ID NO: 57244 - DNA, 20 bp, Artificial Sequence
  chemically synthesized
aggaggtagggggggcaggg

SEQ ID NO: 57245 - DNA, 20 bp, Artificial Sequence
  chemically synthesized
aggtagggggggcagggaag

SEQ ID NO: 57246 - DNA, 20 bp, Artificial Sequence
  chemically synthesized
ggtagggggggcagggaagt

SEQ ID NO: 57247 - DNA, 20 bp, Artificial Sequence
  chemically synthesized
ggggggcagggaagtgggtg

SEQ ID NO: 57248 - DNA, 20 bp, Artificial Sequence
  chemically synthesized
ggaagtgggtgtggctataa

SEQ ID NO: 57249 - DNA, 20 bp, Artificial Sequence
  chemically synthesized
gaagtgggtgtggctataaa

SEQ ID NO: 57250 - DNA, 20 bp, Artificial Sequence
  chemically synthesized
tccctcctattggcctttta

SEQ ID NO: 57251 - DNA, 20 bp, Artificial Sequence
  chemically synthesized
gtgtggctataaaaggccaa

SEQ ID NO: 57252 - DNA, 20 bp, Artificial Sequence
  chemically synthesized
tgtggctataaaaggccaat

SEQ ID NO: 57253 - DNA, 20 bp, Artificial Sequence
  chemically synthesized
tggctataaaaggccaatag

SEQ ID NO: 57254 - DNA, 20 bp, Artificial Sequence
  chemically synthesized
ggctataaaaggccaatagg

SEQ ID NO: 57255 - DNA, 20 bp, Artificial Sequence
  chemically synthesized
gctataaaaggccaatagga

SEQ ID NO: 57256 - DNA, 20 bp, Artificial Sequence
  chemically synthesized
actacaaagatccctcctat

SEQ ID NO: 57257 - DNA, 20 bp, Artificial Sequence
  chemically synthesized
gccaataggagggatctttg

SEQ ID NO: 57258 - DNA, 20 bp, Artificial Sequence
  chemically synthesized
agaacattttcatcactaca

SEQ ID NO: 57259 - DNA, 20 bp, Artificial Sequence
  chemically synthesized
acgtcaatattgtcagtata

SEQ ID NO: 57260 - DNA, 20 bp, Artificial Sequence
  chemically synthesized
gattttgacgtcaatattgt

SEQ ID NO: 57261 - DNA, 20 bp, Artificial Sequence
  chemically synthesized
caatattgacgtcaaaatcc

SEQ ID NO: 57262 - DNA, 20 bp, Artificial Sequence
  chemically synthesized
tctagttcaatgtcacaacc

SEQ ID NO: 57263 - DNA, 20 bp, Artificial Sequence
  chemically synthesized
ctctagttcaatgtcacaac

SEQ ID NO: 57264 - DNA, 20 bp, Artificial Sequence
  chemically synthesized
tcctggttgtgacattgaac

SEQ ID NO: 57265 - DNA, 20 bp, Artificial Sequence
  chemically synthesized
ctggttgtgacattgaacta

SEQ ID NO: 57266 - DNA, 20 bp, Artificial Sequence
  chemically synthesized
atggtacacctgcaaaactc

SEQ ID NO: 57267 - DNA, 20 bp, Artificial Sequence
  chemically synthesized
gacattgaactagagttttg

SEQ ID NO: 57268 - DNA, 20 bp, Artificial Sequence
  chemically synthesized
acattgaactagagttttgc

SEQ ID NO: 57269 - DNA, 20 bp, Artificial Sequence
  chemically synthesized
gagttttgcaggtgtaccat

SEQ ID NO: 57270 - DNA, 20 bp, Artificial Sequence
  chemically synthesized
gttttgcaggtgtaccatta

SEQ ID NO: 57271 - DNA, 20 bp, Artificial Sequence
  chemically synthesized
ttttgcaggtgtaccattag

SEQ ID NO: 57272 - DNA, 20 bp, Artificial Sequence
  chemically synthesized
ttttaccgagtttcctctaa

SEQ ID NO: 57273 - DNA, 20 bp, Artificial Sequence
  chemically synthesized
gtgtaccattagaggaaact

SEQ ID NO: 57274 - DNA, 20 bp, Artificial Sequence
  chemically synthesized
attagaggaaactcggtaaa

SEQ ID NO: 57275 - DNA, 20 bp, Artificial Sequence
  chemically synthesized
ttagaggaaactcggtaaaa

SEQ ID NO: 57276 - DNA, 20 bp, Artificial Sequence
  chemically synthesized
actccacatacctttttacc

SEQ ID NO: 57277 - DNA, 20 bp, Artificial Sequence
  chemically synthesized
aaactcggtaaaaaggtatg

SEQ ID NO: 57278 - DNA, 20 bp, Artificial Sequence
  chemically synthesized
actcggtaaaaaggtatgtg

SEQ ID NO: 57279 - DNA, 20 bp, Artificial Sequence
  chemically synthesized
gagttgtaagaaattataca

SEQ ID NO: 57280 - DNA, 20 bp, Artificial Sequence
  chemically synthesized
gtagattcacatggagttgt

SEQ ID NO: 57281 - DNA, 20 bp, Artificial Sequence
  chemically synthesized
tttaattgtagattcacatg

SEQ ID NO: 57282 - DNA, 20 bp, Artificial Sequence
  chemically synthesized
tttttaattgtagattcaca

SEQ ID NO: 57283 - DNA, 20 bp, Artificial Sequence
  chemically synthesized
gatctcagcatttttaattg

SEQ ID NO: 57284 - DNA, 20 bp, Artificial Sequence
  chemically synthesized
aatctacaattaaaaatgct

SEQ ID NO: 57285 - DNA, 20 bp, Artificial Sequence
  chemically synthesized
caattaaaaatgctgagatc

SEQ ID NO: 57286 - DNA, 20 bp, Artificial Sequence
  chemically synthesized
tactgagaactactagatct

SEQ ID NO: 57287 - DNA, 20 bp, Artificial Sequence
  chemically synthesized
ttaaaaatgctgagatctag

SEQ ID NO: 57288 - DNA, 20 bp, Artificial Sequence
  chemically synthesized
gatacattactgagaactac

SEQ ID NO: 57289 - DNA, 20 bp, Artificial Sequence
  chemically synthesized
tgctgagatctagtagttct

SEQ ID NO: 57290 - DNA, 20 bp, Artificial Sequence
  chemically synthesized
tcagtcattgatacattact

SEQ ID NO: 57291 - DNA, 20 bp, Artificial Sequence
  chemically synthesized
taactaatctgatgaaaatt

SEQ ID NO: 57292 - DNA, 20 bp, Artificial Sequence
  chemically synthesized
atcaatgactgaattttcat

SEQ ID NO: 57293 - DNA, 20 bp, Artificial Sequence
  chemically synthesized
tgactgaattttcatcagat

SEQ ID NO: 57294 - DNA, 20 bp, Artificial Sequence
  chemically synthesized
ttatattgaatattaattct

SEQ ID NO: 57295 - DNA, 20 bp, Artificial Sequence
  chemically synthesized
tatattgaatattaattcta

SEQ ID NO: 57296 - DNA, 20 bp, Artificial Sequence
  chemically synthesized
aagggatagtgacagaacct

SEQ ID NO: 57297 - DNA, 20 bp, Artificial Sequence
  chemically synthesized
ttcttgaaaagggatagtga

SEQ ID NO: 57298 - DNA, 20 bp, Artificial Sequence
  chemically synthesized
tctagattcttgaaaaggga

SEQ ID NO: 57299 - DNA, 20 bp, Artificial Sequence
  chemically synthesized
ttctgtcactatcccttttc

SEQ ID NO: 57300 - DNA, 20 bp, Artificial Sequence
  chemically synthesized
agcttctagattcttgaaaa

SEQ ID NO: 57301 - DNA, 20 bp, Artificial Sequence
  chemically synthesized
aagcttctagattcttgaaa

SEQ ID NO: 57302 - DNA, 20 bp, Artificial Sequence
  chemically synthesized
taagcttctagattcttgaa

SEQ ID NO: 57303 - DNA, 20 bp, Artificial Sequence
  chemically synthesized
actatcccttttcaagaatc

SEQ ID NO: 57304 - DNA, 20 bp, Artificial Sequence
  chemically synthesized
atcccttttcaagaatctag

SEQ ID NO: 57305 - DNA, 20 bp, Artificial Sequence
  chemically synthesized
ttttcaagaatctagaagct

SEQ ID NO: 57306 - DNA, 20 bp, Artificial Sequence
  chemically synthesized
caaaaagaaatctaagcttc

SEQ ID NO: 57307 - DNA, 20 bp, Artificial Sequence
  chemically synthesized
attgcttcaaaaagaaatct

SEQ ID NO: 57308 - DNA, 20 bp, Artificial Sequence
  chemically synthesized
gaagcttagatttctttttg

SEQ ID NO: 57309 - DNA, 20 bp, Artificial Sequence
  chemically synthesized
tattggtatattgcttcaaa

SEQ ID NO: 57310 - DNA, 20 bp, Artificial Sequence
  chemically synthesized
tttttgaagcaatataccaa

SEQ ID NO: 57311 - DNA, 20 bp, Artificial Sequence
  chemically synthesized
atttttaataagaaaactat

SEQ ID NO: 57312 - DNA, 20 bp, Artificial Sequence
  chemically synthesized
aagccttctgaatttttaat

SEQ ID NO: 57313 - DNA, 20 bp, Artificial Sequence
  chemically synthesized
tagttttcttattaaaaatt

SEQ ID NO: 57314 - DNA, 20 bp, Artificial Sequence
  chemically synthesized
ttttcttattaaaaattcag

SEQ ID NO: 57315 - DNA, 20 bp, Artificial Sequence
  chemically synthesized
tttcttattaaaaattcaga

SEQ ID NO: 57316 - DNA, 20 bp, Artificial Sequence
  chemically synthesized
aaaaattcagaaggcttcaa

SEQ ID NO: 57317 - DNA, 20 bp, Artificial Sequence
  chemically synthesized
caaaaaattattcgccattg

SEQ ID NO: 57318 - DNA, 20 bp, Artificial Sequence
  chemically synthesized
ttcaatggcgaataattttt

SEQ ID NO: 57319 - DNA, 20 bp, Artificial Sequence
  chemically synthesized
gcgaataattttttggtaat

SEQ ID NO: 57320 - DNA, 20 bp, Artificial Sequence
  chemically synthesized
tggtaataagaaaaaaaact

SEQ ID NO: 57321 - DNA, 20 bp, Artificial Sequence
  chemically synthesized
ttttaataaaaaataattct

SEQ ID NO: 57322 - DNA, 20 bp, Artificial Sequence
  chemically synthesized
ttattaaaaaacaacaaaat

SEQ ID NO: 57323 - DNA, 20 bp, Artificial Sequence
  chemically synthesized
aaacaacaaaatcagctctt

SEQ ID NO: 57324 - DNA, 20 bp, Artificial Sequence
  chemically synthesized
ctgaactgtaagtgtcttaa

SEQ ID NO: 57325 - DNA, 20 bp, Artificial Sequence
  chemically synthesized
atctgaactgtaagtgtctt

SEQ ID NO: 57326 - DNA, 20 bp, Artificial Sequence
  chemically synthesized
atcagctcttaagacactta

SEQ ID NO: 57327 - DNA, 20 bp, Artificial Sequence
  chemically synthesized
ctcttaagacacttacagtt

SEQ ID NO: 57328 - DNA, 20 bp, Artificial Sequence
  chemically synthesized
tatttccccatctgaactgt

SEQ ID NO: 57329 - DNA, 20 bp, Artificial Sequence
  chemically synthesized
taagacacttacagttcaga

SEQ ID NO: 57330 - DNA, 20 bp, Artificial Sequence
  chemically synthesized
aagacacttacagttcagat

SEQ ID NO: 57331 - DNA, 20 bp, Artificial Sequence
  chemically synthesized
agacacttacagttcagatg

SEQ ID NO: 57332 - DNA, 20 bp, Artificial Sequence
  chemically synthesized
tacagttcagatggggaaat

SEQ ID NO: 57333 - DNA, 20 bp, Artificial Sequence
  chemically synthesized
tcagatggggaaataagatc

SEQ ID NO: 57334 - DNA, 20 bp, Artificial Sequence
  chemically synthesized
actactcattttcacatatc

SEQ ID NO: 57335 - DNA, 20 bp, Artificial Sequence
  chemically synthesized
agatctagatatgtgaaaat

SEQ ID NO: 57336 - DNA, 20 bp, Artificial Sequence
  chemically synthesized
tctagatatgtgaaaatgag

SEQ ID NO: 57337 - DNA, 20 bp, Artificial Sequence
  chemically synthesized
atgtgaaaatgagtagtgtc

SEQ ID NO: 57338 - DNA, 20 bp, Artificial Sequence
  chemically synthesized
aaatgagtagtgtccggtga

SEQ ID NO: 57339 - DNA, 20 bp, Artificial Sequence
  chemically synthesized
aatgagtagtgtccggtgaa

SEQ ID NO: 57340 - DNA, 20 bp, Artificial Sequence
  chemically synthesized
cccagaaacgagcctttcac

SEQ ID NO: 57341 - DNA, 20 bp, Artificial Sequence
  chemically synthesized
tccggtgaaaggctcgtttc

SEQ ID NO: 57342 - DNA, 20 bp, Artificial Sequence
  chemically synthesized
ccggtgaaaggctcgtttct

SEQ ID NO: 57343 - DNA, 20 bp, Artificial Sequence
  chemically synthesized
tgaactaaccacccagaaac

SEQ ID NO: 57344 - DNA, 20 bp, Artificial Sequence
  chemically synthesized
gtgaaaggctcgtttctggg

SEQ ID NO: 57345 - DNA, 20 bp, Artificial Sequence
  chemically synthesized
aaggctcgtttctgggtggt

SEQ ID NO: 57346 - DNA, 20 bp, Artificial Sequence
  chemically synthesized
gaacctttgaactaaccacc

SEQ ID NO: 57347 - DNA, 20 bp, Artificial Sequence
  chemically synthesized
gtttctgggtggttagttca

SEQ ID NO: 57348 - DNA, 20 bp, Artificial Sequence
  chemically synthesized
tttctgggtggttagttcaa

SEQ ID NO: 57349 - DNA, 20 bp, Artificial Sequence
  chemically synthesized
tggttagttcaaaggttccc

SEQ ID NO: 57350 - DNA, 20 bp, Artificial Sequence
  chemically synthesized
gttagttcaaaggttccctg

SEQ ID NO: 57351 - DNA, 20 bp, Artificial Sequence
  chemically synthesized
ttagttcaaaggttccctgg

SEQ ID NO: 57352 - DNA, 20 bp, Artificial Sequence
  chemically synthesized
ctcaagctcagcgtcctcca

SEQ ID NO: 57353 - DNA, 20 bp, Artificial Sequence
  chemically synthesized
gctcaagctcagcgtcctcc

SEQ ID NO: 57354 - DNA, 20 bp, Artificial Sequence
  chemically synthesized
agctcaagctcagcgtcctc

SEQ ID NO: 57355 - DNA, 20 bp, Artificial Sequence
  chemically synthesized
aaggttccctggaggacgct

SEQ ID NO: 57356 - DNA, 20 bp, Artificial Sequence
  chemically synthesized
ccctggaggacgctgagctt

SEQ ID NO: 57357 - DNA, 20 bp, Artificial Sequence
  chemically synthesized
ttgcagatccagctcaagct

SEQ ID NO: 57358 - DNA, 20 bp, Artificial Sequence
  chemically synthesized
ggaggacgctgagcttgagc

SEQ ID NO: 57359 - DNA, 20 bp, Artificial Sequence
  chemically synthesized
tgtgattgcagatccagctc

SEQ ID NO: 57360 - DNA, 20 bp, Artificial Sequence
  chemically synthesized
tccagatgtgattgcagatc

SEQ ID NO: 57361 - DNA, 20 bp, Artificial Sequence
  chemically synthesized
cctcaatccagatgtgattg

SEQ ID NO: 57362 - DNA, 20 bp, Artificial Sequence
  chemically synthesized
gctggatctgcaatcacatc

SEQ ID NO: 57363 - DNA, 20 bp, Artificial Sequence
  chemically synthesized
tctgcaatcacatctggatt

SEQ ID NO: 57364 - DNA, 20 bp, Artificial Sequence
  chemically synthesized
ctgcaatcacatctggattg

SEQ ID NO: 57365 - DNA, 20 bp, Artificial Sequence
  chemically synthesized
tgcaatcacatctggattga

SEQ ID NO: 57366 - DNA, 20 bp, Artificial Sequence
  chemically synthesized
ctggaaggattccctcaatc

SEQ ID NO: 57367 - DNA, 20 bp, Artificial Sequence
  chemically synthesized
ctggattgagggaatccttc

SEQ ID NO: 57368 - DNA, 20 bp, Artificial Sequence
  chemically synthesized
gctatttgctgagtgctgga

SEQ ID NO: 57369 - DNA, 20 bp, Artificial Sequence
  chemically synthesized
tgctatttgctgagtgctgg

SEQ ID NO: 57370 - DNA, 20 bp, Artificial Sequence
  chemically synthesized
gagggaatccttccagcact

SEQ ID NO: 57371 - DNA, 20 bp, Artificial Sequence
  chemically synthesized
tcctgctatttgctgagtgc

SEQ ID NO: 57372 - DNA, 20 bp, Artificial Sequence
  chemically synthesized
tccttccagcactcagcaaa

SEQ ID NO: 57373 - DNA, 20 bp, Artificial Sequence
  chemically synthesized
agtttttcctgctatttgct

SEQ ID NO: 57374 - DNA, 20 bp, Artificial Sequence
  chemically synthesized
ttccagcactcagcaaatag

SEQ ID NO: 57375 - DNA, 20 bp, Artificial Sequence
  chemically synthesized
tccagcactcagcaaatagc

SEQ ID NO: 57376 - DNA, 20 bp, Artificial Sequence
  chemically synthesized
aaatagcaggaaaaactgtc

SEQ ID NO: 57377 - DNA, 20 bp, Artificial Sequence
  chemically synthesized
tgatacctgctgtgtctgga

SEQ ID NO: 57378 - DNA, 20 bp, Artificial Sequence
  chemically synthesized
caggaaaaactgtccagaca

SEQ ID NO: 57379 - DNA, 20 bp, Artificial Sequence
  chemically synthesized
gaaaaactgtccagacacag

SEQ ID NO: 57380 - DNA, 20 bp, Artificial Sequence
  chemically synthesized
atcttgatacctgctgtgtc

SEQ ID NO: 57381 - DNA, 20 bp, Artificial Sequence
  chemically synthesized
aaaaactgtccagacacagc

SEQ ID NO: 57382 - DNA, 20 bp, Artificial Sequence
  chemically synthesized
gtccagacacagcaggtatc

SEQ ID NO: 57383 - DNA, 20 bp, Artificial Sequence
  chemically synthesized
acacagcaggtatcaagatt

SEQ ID NO: 57384 - DNA, 20 bp, Artificial Sequence
  chemically synthesized
acagcaggtatcaagatttg

SEQ ID NO: 57385 - DNA, 20 bp, Artificial Sequence
  chemically synthesized
gatttggagactttcctcat

SEQ ID NO: 57386 - DNA, 20 bp, Artificial Sequence
  chemically synthesized
tgcttccctcctgatgagga

SEQ ID NO: 57387 - DNA, 20 bp, Artificial Sequence
  chemically synthesized
atttggagactttcctcatc

SEQ ID NO: 57388 - DNA, 20 bp, Artificial Sequence
  chemically synthesized
ttggagactttcctcatcag

SEQ ID NO: 57389 - DNA, 20 bp, Artificial Sequence
  chemically synthesized
tggagactttcctcatcagg

SEQ ID NO: 57390 - DNA, 20 bp, Artificial Sequence
  chemically synthesized
caaatgcttccctcctgatg

SEQ ID NO: 57391 - DNA, 20 bp, Artificial Sequence
  chemically synthesized
ggagactttcctcatcagga

SEQ ID NO: 57392 - DNA, 20 bp, Artificial Sequence
  chemically synthesized
acaaatgcttccctcctgat

SEQ ID NO: 57393 - DNA, 20 bp, Artificial Sequence
  chemically synthesized
gactttcctcatcaggaggg

SEQ ID NO: 57394 - DNA, 20 bp, Artificial Sequence
  chemically synthesized
aagcatttgttttgtttgtt

SEQ ID NO: 57395 - DNA, 20 bp, Artificial Sequence
  chemically synthesized
ttttgtttgtttggacatac

SEQ ID NO: 57396 - DNA, 20 bp, Artificial Sequence
  chemically synthesized
tttgtttgtttggacataca

SEQ ID NO: 57397 - DNA, 20 bp, Artificial Sequence
  chemically synthesized
tgtttgtttggacatacaag

SEQ ID NO: 57398 - DNA, 20 bp, Artificial Sequence
  chemically synthesized
tgtttggacatacaaggaga

SEQ ID NO: 57399 - DNA, 20 bp, Artificial Sequence
  chemically synthesized
tggacatacaaggagacaga

SEQ ID NO: 57400 - DNA, 20 bp, Artificial Sequence
  chemically synthesized
gacagaaagaatattgataa

SEQ ID NO: 57401 - DNA, 20 bp, Artificial Sequence
  chemically synthesized
gatgtatttgaacccgatct

SEQ ID NO: 57402 - DNA, 20 bp, Artificial Sequence
  chemically synthesized
tcaacattgtcaccaagatc

SEQ ID NO: 57403 - DNA, 20 bp, Artificial Sequence
  chemically synthesized
ctcaacattgtcaccaagat

SEQ ID NO: 57404 - DNA, 20 bp, Artificial Sequence
  chemically synthesized
tttggctcaacattgtcacc

SEQ ID NO: 57405 - DNA, 20 bp, Artificial Sequence
  chemically synthesized
ccgatcttggtgacaatgtt

SEQ ID NO: 57406 - DNA, 20 bp, Artificial Sequence
  chemically synthesized
ttggtgacaatgttgagcca

SEQ ID NO: 57407 - DNA, 20 bp, Artificial Sequence
  chemically synthesized
aatcatcatgtttacaactt

SEQ ID NO: 57408 - DNA, 20 bp, Artificial Sequence
  chemically synthesized
aagttgtaaacatgatgatt

SEQ ID NO: 57409 - DNA, 20 bp, Artificial Sequence
  chemically synthesized
aaacatgatgattaagaact

SEQ ID NO: 57410 - DNA, 20 bp, Artificial Sequence
  chemically synthesized
aacatgatgattaagaactc

SEQ ID NO: 57411 - DNA, 20 bp, Artificial Sequence
  chemically synthesized
gcagtccaacttcagtacct

SEQ ID NO: 57412 - DNA, 20 bp, Artificial Sequence
  chemically synthesized
gattaagaactcaggtactg

SEQ ID NO: 57413 - DNA, 20 bp, Artificial Sequence
  chemically synthesized
aagaactcaggtactgaagt

SEQ ID NO: 57414 - DNA, 20 bp, Artificial Sequence
  chemically synthesized
cacaccaggcagtccaactt

SEQ ID NO: 57415 - DNA, 20 bp, Artificial Sequence
  chemically synthesized
ggtactgaagttggactgcc

SEQ ID NO: 57416 - DNA, 20 bp, Artificial Sequence
  chemically synthesized
aacgaggtagtcacaccagg

SEQ ID NO: 57417 - DNA, 20 bp, Artificial Sequence
  chemically synthesized
agaaacgaggtagtcacacc

SEQ ID NO: 57418 - DNA, 20 bp, Artificial Sequence
  chemically synthesized
gagaaacgaggtagtcacac

SEQ ID NO: 57419 - DNA, 20 bp, Artificial Sequence
  chemically synthesized
ctctcagttgagaaacgagg

SEQ ID NO: 57420 - DNA, 20 bp, Artificial Sequence
  chemically synthesized
tggctctcagttgagaaacg

SEQ ID NO: 57421 - DNA, 20 bp, Artificial Sequence
  chemically synthesized
gtggctctcagttgagaaac

SEQ ID NO: 57422 - DNA, 20 bp, Artificial Sequence
  chemically synthesized
gactacctcgtttctcaact

SEQ ID NO: 57423 - DNA, 20 bp, Artificial Sequence
  chemically synthesized
ctacctcgtttctcaactga

SEQ ID NO: 57424 - DNA, 20 bp, Artificial Sequence
  chemically synthesized
ttgcccagtggctctcagtt

SEQ ID NO: 57425 - DNA, 20 bp, Artificial Sequence
  chemically synthesized
gtgctttgcccagtggctct

SEQ ID NO: 57426 - DNA, 20 bp, Artificial Sequence
  chemically synthesized
gtttctcaactgagagccac

SEQ ID NO: 57427 - DNA, 20 bp, Artificial Sequence
  chemically synthesized
tttctcaactgagagccact

SEQ ID NO: 57428 - DNA, 20 bp, Artificial Sequence
  chemically synthesized
caactgagagccactgggca

SEQ ID NO: 57429 - DNA, 20 bp, Artificial Sequence
  chemically synthesized
gagttaagtgctttgcccag

SEQ ID NO: 57430 - DNA, 20 bp, Artificial Sequence
  chemically synthesized
agcgagttaagtgctttgcc

SEQ ID NO: 57431 - DNA, 20 bp, Artificial Sequence
  chemically synthesized
aagcagaaacttagcgagtt

SEQ ID NO: 57432 - DNA, 20 bp, Artificial Sequence
  chemically synthesized
ggcaaagcacttaactcgct

SEQ ID NO: 57433 - DNA, 20 bp, Artificial Sequence
  chemically synthesized
tacaaaagcagaaacttagc

SEQ ID NO: 57434 - DNA, 20 bp, Artificial Sequence
  chemically synthesized
tagatacaaaagcagaaact

SEQ ID NO: 57435 - DNA, 20 bp, Artificial Sequence
  chemically synthesized
atcatttttagatacaaaag

SEQ ID NO: 57436 - DNA, 20 bp, Artificial Sequence
  chemically synthesized
agtatcatttttagatacaa

SEQ ID NO: 57437 - DNA, 20 bp, Artificial Sequence
  chemically synthesized
ctgatgagtagtatcatttt

SEQ ID NO: 57438 - DNA, 20 bp, Artificial Sequence
  chemically synthesized
ctaaaaatgatactactcat

SEQ ID NO: 57439 - DNA, 20 bp, Artificial Sequence
  chemically synthesized
aaaaatgatactactcatca

SEQ ID NO: 57440 - DNA, 20 bp, Artificial Sequence
  chemically synthesized
tctgaggtacctctgatgag

SEQ ID NO: 57441 - DNA, 20 bp, Artificial Sequence
  chemically synthesized
aaaatgatactactcatcag

SEQ ID NO: 57442 - DNA, 20 bp, Artificial Sequence
  chemically synthesized
ctttctgaggtacctctgat

SEQ ID NO: 57443 - DNA, 20 bp, Artificial Sequence
  chemically synthesized
actactcatcagaggtacct

SEQ ID NO: 57444 - DNA, 20 bp, Artificial Sequence
  chemically synthesized
ctcatcagaggtacctcaga

SEQ ID NO: 57445 - DNA, 20 bp, Artificial Sequence
  chemically synthesized
atcagaggtacctcagaaag

SEQ ID NO: 57446 - DNA, 20 bp, Artificial Sequence
  chemically synthesized
attctaacaactactttctg

SEQ ID NO: 57447 - DNA, 20 bp, Artificial Sequence
  chemically synthesized
aattctaacaactactttct

SEQ ID NO: 57448 - DNA, 20 bp, Artificial Sequence
  chemically synthesized
gtacctcagaaagtagttgt

SEQ ID NO: 57449 - DNA, 20 bp, Artificial Sequence
  chemically synthesized
agaaagtagttgttagaatt

SEQ ID NO: 57450 - DNA, 20 bp, Artificial Sequence
  chemically synthesized
gaaagtagttgttagaatta

SEQ ID NO: 57451 - DNA, 20 bp, Artificial Sequence
  chemically synthesized
aaagtagttgttagaattaa

SEQ ID NO: 57452 - DNA, 20 bp, Artificial Sequence
  chemically synthesized
agtagttgttagaattaagg

SEQ ID NO: 57453 - DNA, 20 bp, Artificial Sequence
  chemically synthesized
taagggagataacgtatgtc

SEQ ID NO: 57454 - DNA, 20 bp, Artificial Sequence
  chemically synthesized
gataacgtatgtcaagtcct

SEQ ID NO: 57455 - DNA, 20 bp, Artificial Sequence
  chemically synthesized
cgtatgtcaagtccttagca

SEQ ID NO: 57456 - DNA, 20 bp, Artificial Sequence
  chemically synthesized
ctctgccagtcactgtgcta

SEQ ID NO: 57457 - DNA, 20 bp, Artificial Sequence
  chemically synthesized
actctgccagtcactgtgct

SEQ ID NO: 57458 - DNA, 20 bp, Artificial Sequence
  chemically synthesized
caagtccttagcacagtgac

SEQ ID NO: 57459 - DNA, 20 bp, Artificial Sequence
  chemically synthesized
gtccttagcacagtgactgg

SEQ ID NO: 57460 - DNA, 20 bp, Artificial Sequence
  chemically synthesized
ccttagcacagtgactggca

SEQ ID NO: 57461 - DNA, 20 bp, Artificial Sequence
  chemically synthesized
tatgccagatgagactctgc

SEQ ID NO: 57462 - DNA, 20 bp, Artificial Sequence
  chemically synthesized
gtgactggcagagtctcatc

SEQ ID NO: 57463 - DNA, 20 bp, Artificial Sequence
  chemically synthesized
agagctaatatatgccagat

SEQ ID NO: 57464 - DNA, 20 bp, Artificial Sequence
  chemically synthesized
agctcagagctaatatatgc

SEQ ID NO: 57465 - DNA, 20 bp, Artificial Sequence
  chemically synthesized
gagtctcatctggcatatat

SEQ ID NO: 57466 - DNA, 20 bp, Artificial Sequence
  chemically synthesized
atctggcatatattagctct

SEQ ID NO: 57467 - DNA, 20 bp, Artificial Sequence
  chemically synthesized
cagcacccccattaagctca

SEQ ID NO: 57468 - DNA, 20 bp, Artificial Sequence
  chemically synthesized
tatattagctctgagcttaa

SEQ ID NO: 57469 - DNA, 20 bp, Artificial Sequence
  chemically synthesized
accagcacccccattaagct

SEQ ID NO: 57470 - DNA, 20 bp, Artificial Sequence
  chemically synthesized
atattagctctgagcttaat

SEQ ID NO: 57471 - DNA, 20 bp, Artificial Sequence
  chemically synthesized
tattagctctgagcttaatg

SEQ ID NO: 57472 - DNA, 20 bp, Artificial Sequence
  chemically synthesized
attagctctgagcttaatgg

SEQ ID NO: 57473 - DNA, 20 bp, Artificial Sequence
  chemically synthesized
tcaccaccagcacccccatt

SEQ ID NO: 57474 - DNA, 20 bp, Artificial Sequence
  chemically synthesized
tctgagcttaatgggggtgc

SEQ ID NO: 57475 - DNA, 20 bp, Artificial Sequence
  chemically synthesized
gagcttaatgggggtgctgg

SEQ ID NO: 57476 - DNA, 20 bp, Artificial Sequence
  chemically synthesized
gacaacgtcattatcaccac

SEQ ID NO: 57477 - DNA, 20 bp, Artificial Sequence
  chemically synthesized
ataatgacgttgtctctcca

SEQ ID NO: 57478 - DNA, 20 bp, Artificial Sequence
  chemically synthesized
taatgacgttgtctctccaa

SEQ ID NO: 57479 - DNA, 20 bp, Artificial Sequence
  chemically synthesized
agccgtttgcaacctttgga

SEQ ID NO: 57480 - DNA, 20 bp, Artificial Sequence
  chemically synthesized
taagccgtttgcaacctttg

SEQ ID NO: 57481 - DNA, 20 bp, Artificial Sequence
  chemically synthesized
cctaagccgtttgcaacctt

SEQ ID NO: 57482 - DNA, 20 bp, Artificial Sequence
  chemically synthesized
gtctctccaaaggttgcaaa

SEQ ID NO: 57483 - DNA, 20 bp, Artificial Sequence
  chemically synthesized
tccaaaggttgcaaacggct

SEQ ID NO: 57484 - DNA, 20 bp, Artificial Sequence
  chemically synthesized
ccaaaggttgcaaacggctt

SEQ ID NO: 57485 - DNA, 20 bp, Artificial Sequence
  chemically synthesized
caaaggttgcaaacggctta

SEQ ID NO: 57486 - DNA, 20 bp, Artificial Sequence
  chemically synthesized
aaaggttgcaaacggcttag

SEQ ID NO: 57487 - DNA, 20 bp, Artificial Sequence
  chemically synthesized
ggttgcaaacggcttagggg

SEQ ID NO: 57488 - DNA, 20 bp, Artificial Sequence
  chemically synthesized
ttgcaaacggcttaggggca

SEQ ID NO: 57489 - DNA, 20 bp, Artificial Sequence
  chemically synthesized
aagcgatagtctctgcccct

SEQ ID NO: 57490 - DNA, 20 bp, Artificial Sequence
  chemically synthesized
aggtagtctaagataagcga

SEQ ID NO: 57491 - DNA, 20 bp, Artificial Sequence
  chemically synthesized
gcagagactatcgcttatct

SEQ ID NO: 57492 - DNA, 20 bp, Artificial Sequence
  chemically synthesized
gacatcaggtagtctaagat

SEQ ID NO: 57493 - DNA, 20 bp, Artificial Sequence
  chemically synthesized
tcccagacatcaggtagtct

SEQ ID NO: 57494 - DNA, 20 bp, Artificial Sequence
  chemically synthesized
ggagtgtcccagacatcagg

SEQ ID NO: 57495 - DNA, 20 bp, Artificial Sequence
  chemically synthesized
atcttagactacctgatgtc

SEQ ID NO: 57496 - DNA, 20 bp, Artificial Sequence
  chemically synthesized
tcttagactacctgatgtct

SEQ ID NO: 57497 - DNA, 20 bp, Artificial Sequence
  chemically synthesized
ccaggagtgtcccagacatc

SEQ ID NO: 57498 - DNA, 20 bp, Artificial Sequence
  chemically synthesized
gccaggagtgtcccagacat

SEQ ID NO: 57499 - DNA, 20 bp, Artificial Sequence
  chemically synthesized
gctgtgtgccaggagtgtcc

SEQ ID NO: 57500 - DNA, 20 bp, Artificial Sequence
  chemically synthesized
cctgatgtctgggacactcc

SEQ ID NO: 57501 - DNA, 20 bp, Artificial Sequence
  chemically synthesized
aaactcctgctgtgtgccag

SEQ ID NO: 57502 - DNA, 20 bp, Artificial Sequence
  chemically synthesized
tctgggacactcctggcaca

SEQ ID NO: 57503 - DNA, 20 bp, Artificial Sequence
  chemically synthesized
caaaactcctgctgtgtgcc

SEQ ID NO: 57504 - DNA, 20 bp, Artificial Sequence
  chemically synthesized
gcaaaactcctgctgtgtgc

SEQ ID NO: 57505 - DNA, 20 bp, Artificial Sequence
  chemically synthesized
gggacactcctggcacacag

SEQ ID NO: 57506 - DNA, 20 bp, Artificial Sequence
  chemically synthesized
ggacactcctggcacacagc

SEQ ID NO: 57507 - DNA, 20 bp, Artificial Sequence
  chemically synthesized
acactcctggcacacagcag

SEQ ID NO: 57508 - DNA, 20 bp, Artificial Sequence
  chemically synthesized
ggagttttgcgaaattaaac

SEQ ID NO: 57509 - DNA, 20 bp, Artificial Sequence
  chemically synthesized
ttgcgaaattaaactggcaa

SEQ ID NO: 57510 - DNA, 20 bp, Artificial Sequence
  chemically synthesized
cgaaattaaactggcaaaag

SEQ ID NO: 57511 - DNA, 20 bp, Artificial Sequence
  chemically synthesized
tgcaagaacactacttttgc

SEQ ID NO: 57512 - DNA, 20 bp, Artificial Sequence
  chemically synthesized
ggcaaaagtagtgttcttgc

SEQ ID NO: 57513 - DNA, 20 bp, Artificial Sequence
  chemically synthesized
tgctgtcaagttaatcttgc

SEQ ID NO: 57514 - DNA, 20 bp, Artificial Sequence
  chemically synthesized
ttcttgcaagattaacttga

SEQ ID NO: 57515 - DNA, 20 bp, Artificial Sequence
  chemically synthesized
ctggtcagccaattgctgtc

SEQ ID NO: 57516 - DNA, 20 bp, Artificial Sequence
  chemically synthesized
aagattaacttgacagcaat

SEQ ID NO: 57517 - DNA, 20 bp, Artificial Sequence
  chemically synthesized
cttgacagcaattggctgac

SEQ ID NO: 57518 - DNA, 20 bp, Artificial Sequence
  chemically synthesized
acagcaattggctgaccaga

SEQ ID NO: 57519 - DNA, 20 bp, Artificial Sequence
  chemically synthesized
ctctccttcctccatctggt

SEQ ID NO: 57520 - DNA, 20 bp, Artificial Sequence
  chemically synthesized
agcaattggctgaccagatg

SEQ ID NO: 57521 - DNA, 20 bp, Artificial Sequence
  chemically synthesized
gcaattggctgaccagatgg

SEQ ID NO: 57522 - DNA, 20 bp, Artificial Sequence
  chemically synthesized
aaatctctccttcctccatc

SEQ ID NO: 57523 - DNA, 20 bp, Artificial Sequence
  chemically synthesized
attggctgaccagatggagg

SEQ ID NO: 57524 - DNA, 20 bp, Artificial Sequence
  chemically synthesized
ttggctgaccagatggagga

SEQ ID NO: 57525 - DNA, 20 bp, Artificial Sequence
  chemically synthesized
ggctgaccagatggaggaag

SEQ ID NO: 57526 - DNA, 20 bp, Artificial Sequence
  chemically synthesized
ctgaccagatggaggaagga

SEQ ID NO: 57527 - DNA, 20 bp, Artificial Sequence
  chemically synthesized
gatggaggaaggagagattt

SEQ ID NO: 57528 - DNA, 20 bp, Artificial Sequence
  chemically synthesized
atggaggaaggagagatttt

SEQ ID NO: 57529 - DNA, 20 bp, Artificial Sequence
  chemically synthesized
ggaaggagagattttaggca

SEQ ID NO: 57530 - DNA, 20 bp, Artificial Sequence
  chemically synthesized
aaggagagattttaggcata

SEQ ID NO: 57531 - DNA, 20 bp, Artificial Sequence
  chemically synthesized
agattttaggcatagagtac

SEQ ID NO: 57532 - DNA, 20 bp, Artificial Sequence
  chemically synthesized
ttttaggcatagagtacaag

SEQ ID NO: 57533 - DNA, 20 bp, Artificial Sequence
  chemically synthesized
aggcatagagtacaagtaga

SEQ ID NO: 57534 - DNA, 20 bp, Artificial Sequence
  chemically synthesized
gtgaagttgtatcattgcag

SEQ ID NO: 57535 - DNA, 20 bp, Artificial Sequence
  chemically synthesized
ggagtgaagttgtatcattg

SEQ ID NO: 57536 - DNA, 20 bp, Artificial Sequence
  chemically synthesized
gacccttgtcatgaggagtg

SEQ ID NO: 57537 - DNA, 20 bp, Artificial Sequence
  chemically synthesized
tttctgacccttgtcatgag

SEQ ID NO: 57538 - DNA, 20 bp, Artificial Sequence
  chemically synthesized
acaacttcactcctcatgac

SEQ ID NO: 57539 - DNA, 20 bp, Artificial Sequence
  chemically synthesized
caacttcactcctcatgaca

SEQ ID NO: 57540 - DNA, 20 bp, Artificial Sequence
  chemically synthesized
tttttctgacccttgtcatg

SEQ ID NO: 57541 - DNA, 20 bp, Artificial Sequence
  chemically synthesized
aacttcactcctcatgacaa

SEQ ID NO: 57542 - DNA, 20 bp, Artificial Sequence
  chemically synthesized
ttttttctgacccttgtcat

SEQ ID NO: 57543 - DNA, 20 bp, Artificial Sequence
  chemically synthesized
tcactcctcatgacaagggt

SEQ ID NO: 57544 - DNA, 20 bp, Artificial Sequence
  chemically synthesized
atgacaagggtcagaaaaaa

SEQ ID NO: 57545 - DNA, 20 bp, Artificial Sequence
  chemically synthesized
caagggtcagaaaaaatggt

SEQ ID NO: 57546 - DNA, 20 bp, Artificial Sequence
  chemically synthesized
tcagaaaaaatggttggtgt

SEQ ID NO: 57547 - DNA, 20 bp, Artificial Sequence
  chemically synthesized
gaaaaaatggttggtgtcag

SEQ ID NO: 57548 - DNA, 20 bp, Artificial Sequence
  chemically synthesized
aaaaaatggttggtgtcagc

SEQ ID NO: 57549 - DNA, 20 bp, Artificial Sequence
  chemically synthesized
ttggtgtcagcgggaatgat

SEQ ID NO: 57550 - DNA, 20 bp, Artificial Sequence
  chemically synthesized
tggtgtcagcgggaatgata

SEQ ID NO: 57551 - DNA, 20 bp, Artificial Sequence
  chemically synthesized
tcagcgggaatgataaggaa

SEQ ID NO: 57552 - DNA, 20 bp, Artificial Sequence
  chemically synthesized
cagcgggaatgataaggaat

SEQ ID NO: 57553 - DNA, 20 bp, Artificial Sequence
  chemically synthesized
gggaatgataaggaataggt

SEQ ID NO: 57554 - DNA, 20 bp, Artificial Sequence
  chemically synthesized
aaggaataggtaagtaatga

SEQ ID NO: 57555 - DNA, 20 bp, Artificial Sequence
  chemically synthesized
aagtaatgaaagatgaattg

SEQ ID NO: 57556 - DNA, 20 bp, Artificial Sequence
  chemically synthesized
agtaatgaaagatgaattga

SEQ ID NO: 57557 - DNA, 20 bp, Artificial Sequence
  chemically synthesized
gaaagatgaattgaaggaca

SEQ ID NO: 57558 - DNA, 20 bp, Artificial Sequence
  chemically synthesized
gaattgaaggacatagttcc

SEQ ID NO: 57559 - DNA, 20 bp, Artificial Sequence
  chemically synthesized
aattgaaggacatagttcct

SEQ ID NO: 57560 - DNA, 20 bp, Artificial Sequence
  chemically synthesized
aaaatgtggagtcaaagccc

SEQ ID NO: 57561 - DNA, 20 bp, Artificial Sequence
  chemically synthesized
taaaatgtggagtcaaagcc

SEQ ID NO: 57562 - DNA, 20 bp, Artificial Sequence
  chemically synthesized
atagttaaaatgtggagtca

SEQ ID NO: 57563 - DNA, 20 bp, Artificial Sequence
  chemically synthesized
ctattcatagttaaaatgtg

SEQ ID NO: 57564 - DNA, 20 bp, Artificial Sequence
  chemically synthesized
atctattcatagttaaaatg

SEQ ID NO: 57565 - DNA, 20 bp, Artificial Sequence
  chemically synthesized
ctccacattttaactatgaa

SEQ ID NO: 57566 - DNA, 20 bp, Artificial Sequence
  chemically synthesized
tcaagcttagaatctattca

SEQ ID NO: 57567 - DNA, 20 bp, Artificial Sequence
  chemically synthesized
tttaactatgaatagattct

SEQ ID NO: 57568 - DNA, 20 bp, Artificial Sequence
  chemically synthesized
ttgcacactacagtcaagct

SEQ ID NO: 57569 - DNA, 20 bp, Artificial Sequence
  chemically synthesized
atagattctaagcttgactg

SEQ ID NO: 57570 - DNA, 20 bp, Artificial Sequence
  chemically synthesized
ctaatttgcacactacagtc

SEQ ID NO: 57571 - DNA, 20 bp, Artificial Sequence
  chemically synthesized
gaggcctaatttgcacacta

SEQ ID NO: 57572 - DNA, 20 bp, Artificial Sequence
  chemically synthesized
cttgactgtagtgtgcaaat

SEQ ID NO: 57573 - DNA, 20 bp, Artificial Sequence
  chemically synthesized
ttgactgtagtgtgcaaatt

SEQ ID NO: 57574 - DNA, 20 bp, Artificial Sequence
  chemically synthesized
tgtgcaaattaggcctcttt

SEQ ID NO: 57575 - DNA, 20 bp, Artificial Sequence
  chemically synthesized
tgcaaattaggcctctttcg

SEQ ID NO: 57576 - DNA, 20 bp, Artificial Sequence
  chemically synthesized
ctgggccttctctccgaaag

SEQ ID NO: 57577 - DNA, 20 bp, Artificial Sequence
  chemically synthesized
caaattaggcctctttcgga

SEQ ID NO: 57578 - DNA, 20 bp, Artificial Sequence
  chemically synthesized
actgggccttctctccgaaa

SEQ ID NO: 57579 - DNA, 20 bp, Artificial Sequence
  chemically synthesized
atactgggccttctctccga

SEQ ID NO: 57580 - DNA, 20 bp, Artificial Sequence
  chemically synthesized
attaggcctctttcggagag

SEQ ID NO: 57581 - DNA, 20 bp, Artificial Sequence
  chemically synthesized
ttaggcctctttcggagaga

SEQ ID NO: 57582 - DNA, 20 bp, Artificial Sequence
  chemically synthesized
cctctttcggagagaaggcc

SEQ ID NO: 57583 - DNA, 20 bp, Artificial Sequence
  chemically synthesized
ttcggagagaaggcccagta

SEQ ID NO: 57584 - DNA, 20 bp, Artificial Sequence
  chemically synthesized
ggagagaaggcccagtatag

SEQ ID NO: 57585 - DNA, 20 bp, Artificial Sequence
  chemically synthesized
catgttctttctgctatact

SEQ ID NO: 57586 - DNA, 20 bp, Artificial Sequence
  chemically synthesized
tcatgttctttctgctatac

SEQ ID NO: 57587 - DNA, 20 bp, Artificial Sequence
  chemically synthesized
agaaggcccagtatagcaga

SEQ ID NO: 57588 - DNA, 20 bp, Artificial Sequence
  chemically synthesized
cagtatagcagaaagaacat

SEQ ID NO: 57589 - DNA, 20 bp, Artificial Sequence
  chemically synthesized
cagaaagaacatgagttttg

SEQ ID NO: 57590 - DNA, 20 bp, Artificial Sequence
  chemically synthesized
aaatgacatatgggacagaa

SEQ ID NO: 57591 - DNA, 20 bp, Artificial Sequence
  chemically synthesized
cacacaaatgacatatggga

SEQ ID NO: 57592 - DNA, 20 bp, Artificial Sequence
  chemically synthesized
aggtcacacaaatgacatat

SEQ ID NO: 57593 - DNA, 20 bp, Artificial Sequence
  chemically synthesized
aaggtcacacaaatgacata

SEQ ID NO: 57594 - DNA, 20 bp, Artificial Sequence
  chemically synthesized
ttttgtaaatacatttttta

SEQ ID NO: 57595 - DNA, 20 bp, Artificial Sequence
  chemically synthesized
cttttgtaaatacatttttt

SEQ ID NO: 57596 - DNA, 20 bp, Artificial Sequence
  chemically synthesized
cttaaaaaatgtatttacaa

SEQ ID NO: 57597 - DNA, 20 bp, Artificial Sequence
  chemically synthesized
ttaaaaaatgtatttacaaa

SEQ ID NO: 57598 - DNA, 20 bp, Artificial Sequence
  chemically synthesized
gggttgttgaattttgtcaa

SEQ ID NO: 57599 - DNA, 20 bp, Artificial Sequence
  chemically synthesized
agggttgttgaattttgtca

SEQ ID NO: 57600 - DNA, 20 bp, Artificial Sequence
  chemically synthesized
ttgagagtttttagcatgaa

SEQ ID NO: 57601 - DNA, 20 bp, Artificial Sequence
  chemically synthesized
attgagagtttttagcatga

SEQ ID NO: 57602 - DNA, 20 bp, Artificial Sequence
  chemically synthesized
tattgagagtttttagcatg

SEQ ID NO: 57603 - DNA, 20 bp, Artificial Sequence
  chemically synthesized
cctaatttattgagagtttt

SEQ ID NO: 57604 - DNA, 20 bp, Artificial Sequence
  chemically synthesized
atcaatacctaatttattga

SEQ ID NO: 57605 - DNA, 20 bp, Artificial Sequence
  chemically synthesized
gctaaaaactctcaataaat

SEQ ID NO: 57606 - DNA, 20 bp, Artificial Sequence
  chemically synthesized
ccatcaatacctaatttatt

SEQ ID NO: 57607 - DNA, 20 bp, Artificial Sequence
  chemically synthesized
ctaaaaactctcaataaatt

SEQ ID NO: 57608 - DNA, 20 bp, Artificial Sequence
  chemically synthesized
ctcaataaattaggtattga

SEQ ID NO: 57609 - DNA, 20 bp, Artificial Sequence
  chemically synthesized
tcaataaattaggtattgat

SEQ ID NO: 57610 - DNA, 20 bp, Artificial Sequence
  chemically synthesized
tagatagctcttattatttt

SEQ ID NO: 57611 - DNA, 20 bp, Artificial Sequence
  chemically synthesized
gggacatatctcaaaataat

SEQ ID NO: 57612 - DNA, 20 bp, Artificial Sequence
  chemically synthesized
gacatatctcaaaataataa

SEQ ID NO: 57613 - DNA, 20 bp, Artificial Sequence
  chemically synthesized
ggctgtgggtttgtcataga

SEQ ID NO: 57614 - DNA, 20 bp, Artificial Sequence
  chemically synthesized
tattggctgtgggtttgtca

SEQ ID NO: 57615 - DNA, 20 bp, Artificial Sequence
  chemically synthesized
agctatctatgacaaaccca

SEQ ID NO: 57616 - DNA, 20 bp, Artificial Sequence
  chemically synthesized
ttcagtatgatattggctgt

SEQ ID NO: 57617 - DNA, 20 bp, Artificial Sequence
  chemically synthesized
attcagtatgatattggctg

SEQ ID NO: 57618 - DNA, 20 bp, Artificial Sequence
  chemically synthesized
ttgcccattcagtatgatat

SEQ ID NO: 57619 - DNA, 20 bp, Artificial Sequence
  chemically synthesized
acagccaatatcatactgaa

SEQ ID NO: 57620 - DNA, 20 bp, Artificial Sequence
  chemically synthesized
cagccaatatcatactgaat

SEQ ID NO: 57621 - DNA, 20 bp, Artificial Sequence
  chemically synthesized
gcttccagtttttgcccatt

SEQ ID NO: 57622 - DNA, 20 bp, Artificial Sequence
  chemically synthesized
catactgaatgggcaaaaac

SEQ ID NO: 57623 - DNA, 20 bp, Artificial Sequence
  chemically synthesized
actgaatgggcaaaaactgg

SEQ ID NO: 57624 - DNA, 20 bp, Artificial Sequence
  chemically synthesized
gttttcagagggaatgcttc

SEQ ID NO: 57625 - DNA, 20 bp, Artificial Sequence
  chemically synthesized
gtcttgtgccagttttcaga

SEQ ID NO: 57626 - DNA, 20 bp, Artificial Sequence
  chemically synthesized
tgtcttgtgccagttttcag

SEQ ID NO: 57627 - DNA, 20 bp, Artificial Sequence
  chemically synthesized
gaagcattccctctgaaaac

SEQ ID NO: 57628 - DNA, 20 bp, Artificial Sequence
  chemically synthesized
ctgtcttgtgccagttttca

SEQ ID NO: 57629 - DNA, 20 bp, Artificial Sequence
  chemically synthesized
ccctgtcttgtgccagtttt

SEQ ID NO: 57630 - DNA, 20 bp, Artificial Sequence
  chemically synthesized
ttccctctgaaaactggcac

SEQ ID NO: 57631 - DNA, 20 bp, Artificial Sequence
  chemically synthesized
agggcatccctgtcttgtgc

SEQ ID NO: 57632 - DNA, 20 bp, Artificial Sequence
  chemically synthesized
ctctgaaaactggcacaaga

SEQ ID NO: 57633 - DNA, 20 bp, Artificial Sequence
  chemically synthesized
tctgaaaactggcacaagac

SEQ ID NO: 57634 - DNA, 20 bp, Artificial Sequence
  chemically synthesized
ctgaaaactggcacaagaca

SEQ ID NO: 57635 - DNA, 20 bp, Artificial Sequence
  chemically synthesized
tgaataggagtggtaagaga

SEQ ID NO: 57636 - DNA, 20 bp, Artificial Sequence
  chemically synthesized
ttgaataggagtggtaagag

SEQ ID NO: 57637 - DNA, 20 bp, Artificial Sequence
  chemically synthesized
gttgaataggagtggtaaga

SEQ ID NO: 57638 - DNA, 20 bp, Artificial Sequence
  chemically synthesized
atgttgaataggagtggtaa

SEQ ID NO: 57639 - DNA, 20 bp, Artificial Sequence
  chemically synthesized
ctatgttgaataggagtggt

SEQ ID NO: 57640 - DNA, 20 bp, Artificial Sequence
  chemically synthesized
aacactatgttgaataggag

SEQ ID NO: 57641 - DNA, 20 bp, Artificial Sequence
  chemically synthesized
tccaacactatgttgaatag

SEQ ID NO: 57642 - DNA, 20 bp, Artificial Sequence
  chemically synthesized
cttccaacactatgttgaat

SEQ ID NO: 57643 - DNA, 20 bp, Artificial Sequence
  chemically synthesized
cttaccactcctattcaaca

SEQ ID NO: 57644 - DNA, 20 bp, Artificial Sequence
  chemically synthesized
acttccaacactatgttgaa

SEQ ID NO: 57645 - DNA, 20 bp, Artificial Sequence
  chemically synthesized
actcctattcaacatagtgt

SEQ ID NO: 57646 - DNA, 20 bp, Artificial Sequence
  chemically synthesized
cctattcaacatagtgttgg

SEQ ID NO: 57647 - DNA, 20 bp, Artificial Sequence
  chemically synthesized
caacatagtgttggaagttc

SEQ ID NO: 57648 - DNA, 20 bp, Artificial Sequence
  chemically synthesized
atagtgttggaagttctggc

SEQ ID NO: 57649 - DNA, 20 bp, Artificial Sequence
  chemically synthesized
tagtgttggaagttctggcc

SEQ ID NO: 57650 - DNA, 20 bp, Artificial Sequence
  chemically synthesized
agtgttggaagttctggcca

SEQ ID NO: 57651 - DNA, 20 bp, Artificial Sequence
  chemically synthesized
tcctgcctgattgccctggc

SEQ ID NO: 57652 - DNA, 20 bp, Artificial Sequence
  chemically synthesized
gaagttctggccagggcaat

SEQ ID NO: 57653 - DNA, 20 bp, Artificial Sequence
  chemically synthesized
cttctcctgcctgattgccc

SEQ ID NO: 57654 - DNA, 20 bp, Artificial Sequence
  chemically synthesized
aagttctggccagggcaatc

SEQ ID NO: 57655 - DNA, 20 bp, Artificial Sequence
  chemically synthesized
ttctggccagggcaatcagg

SEQ ID NO: 57656 - DNA, 20 bp, Artificial Sequence
  chemically synthesized
tctggccagggcaatcaggc

SEQ ID NO: 57657 - DNA, 20 bp, Artificial Sequence
  chemically synthesized
tggccagggcaatcaggcag

SEQ ID NO: 57658 - DNA, 20 bp, Artificial Sequence
  chemically synthesized
ccagggcaatcaggcaggag

SEQ ID NO: 57659 - DNA, 20 bp, Artificial Sequence
  chemically synthesized
cagggcaatcaggcaggaga

SEQ ID NO: 57660 - DNA, 20 bp, Artificial Sequence
  chemically synthesized
tcaggcaggagaaggaaata

SEQ ID NO: 57661 - DNA, 20 bp, Artificial Sequence
  chemically synthesized
caggcaggagaaggaaataa

SEQ ID NO: 57662 - DNA, 20 bp, Artificial Sequence
  chemically synthesized
aggcaggagaaggaaataaa

SEQ ID NO: 57663 - DNA, 20 bp, Artificial Sequence
  chemically synthesized
ggaaataaagggtattcaat

SEQ ID NO: 57664 - DNA, 20 bp, Artificial Sequence
  chemically synthesized
gaaataaagggtattcaatt

SEQ ID NO: 57665 - DNA, 20 bp, Artificial Sequence
  chemically synthesized
aaagggtattcaattaggaa

SEQ ID NO: 57666 - DNA, 20 bp, Artificial Sequence
  chemically synthesized
agggtattcaattaggaaaa

SEQ ID NO: 57667 - DNA, 20 bp, Artificial Sequence
  chemically synthesized
gggtattcaattaggaaaag

SEQ ID NO: 57668 - DNA, 20 bp, Artificial Sequence
  chemically synthesized
tattcaattaggaaaagagg

SEQ ID NO: 57669 - DNA, 20 bp, Artificial Sequence
  chemically synthesized
agtcaaattgtccctgtttg

SEQ ID NO: 57670 - DNA, 20 bp, Artificial Sequence
  chemically synthesized
aatcatgtcatctgcaaaca

SEQ ID NO: 57671 - DNA, 20 bp, Artificial Sequence
  chemically synthesized
caatcatgtcatctgcaaac

SEQ ID NO: 57672 - DNA, 20 bp, Artificial Sequence
  chemically synthesized
acaatcatgtcatctgcaaa

SEQ ID NO: 57673 - DNA, 20 bp, Artificial Sequence
  chemically synthesized
agatgacatgattgtatatc

SEQ ID NO: 57674 - DNA, 20 bp, Artificial Sequence
  chemically synthesized
gttgagacgatggggttttc

SEQ ID NO: 57675 - DNA, 20 bp, Artificial Sequence
  chemically synthesized
gatttggggttgagacgatg

SEQ ID NO: 57676 - DNA, 20 bp, Artificial Sequence
  chemically synthesized
agatttggggttgagacgat

SEQ ID NO: 57677 - DNA, 20 bp, Artificial Sequence
  chemically synthesized
gagatttggggttgagacga

SEQ ID NO: 57678 - DNA, 20 bp, Artificial Sequence
  chemically synthesized
gcttaaggagatttggggtt

SEQ ID NO: 57679 - DNA, 20 bp, Artificial Sequence
  chemically synthesized
tatcagcttaaggagatttg

SEQ ID NO: 57680 - DNA, 20 bp, Artificial Sequence
  chemically synthesized
ttatcagcttaaggagattt

SEQ ID NO: 57681 - DNA, 20 bp, Artificial Sequence
  chemically synthesized
cttatcagcttaaggagatt

SEQ ID NO: 57682 - DNA, 20 bp, Artificial Sequence
  chemically synthesized
tctcaaccccaaatctcctt

SEQ ID NO: 57683 - DNA, 20 bp, Artificial Sequence
  chemically synthesized
aagttgcttatcagcttaag

SEQ ID NO: 57684 - DNA, 20 bp, Artificial Sequence
  chemically synthesized
tgaagttgcttatcagctta

SEQ ID NO: 57685 - DNA, 20 bp, Artificial Sequence
  chemically synthesized
ctgaagttgcttatcagctt

SEQ ID NO: 57686 - DNA, 20 bp, Artificial Sequence
  chemically synthesized
ccaaatctccttaagctgat

SEQ ID NO: 57687 - DNA, 20 bp, Artificial Sequence
  chemically synthesized
actttgctgaagttgcttat

SEQ ID NO: 57688 - DNA, 20 bp, Artificial Sequence
  chemically synthesized
cttaagctgataagcaactt

SEQ ID NO: 57689 - DNA, 20 bp, Artificial Sequence
  chemically synthesized
gctgataagcaacttcagca

SEQ ID NO: 57690 - DNA, 20 bp, Artificial Sequence
  chemically synthesized
tgtatcctgagactttgctg

SEQ ID NO: 57691 - DNA, 20 bp, Artificial Sequence
  chemically synthesized
aagcaacttcagcaaagtct

SEQ ID NO: 57692 - DNA, 20 bp, Artificial Sequence
  chemically synthesized
agcaacttcagcaaagtctc

SEQ ID NO: 57693 - DNA, 20 bp, Artificial Sequence
  chemically synthesized
gcacattgcttttgtatcct

SEQ ID NO: 57694 - DNA, 20 bp, Artificial Sequence
  chemically synthesized
agcaaagtctcaggatacaa

SEQ ID NO: 57695 - DNA, 20 bp, Artificial Sequence
  chemically synthesized
aagcaatgtgcaaaaatcac

SEQ ID NO: 57696 - DNA, 20 bp, Artificial Sequence
  chemically synthesized
tctgtctgttattggtgtat

SEQ ID NO: 57697 - DNA, 20 bp, Artificial Sequence
  chemically synthesized
gcattcttatacaccaataa

SEQ ID NO: 57698 - DNA, 20 bp, Artificial Sequence
  chemically synthesized
tttggctctctgtctgttat

SEQ ID NO: 57699 - DNA, 20 bp, Artificial Sequence
  chemically synthesized
tcttatacaccaataacaga

SEQ ID NO: 57700 - DNA, 20 bp, Artificial Sequence
  chemically synthesized
ttatacaccaataacagaca

SEQ ID NO: 57701 - DNA, 20 bp, Artificial Sequence
  chemically synthesized
atacaccaataacagacaga

SEQ ID NO: 57702 - DNA, 20 bp, Artificial Sequence
  chemically synthesized
cagacagagagccaaatcat

SEQ ID NO: 57703 - DNA, 20 bp, Artificial Sequence
  chemically synthesized
atgggagttcactcatgatt

SEQ ID NO: 57704 - DNA, 20 bp, Artificial Sequence
  chemically synthesized
tttgaagcaattgtgaatgg

SEQ ID NO: 57705 - DNA, 20 bp, Artificial Sequence
  chemically synthesized
tctttgaagcaattgtgaat

SEQ ID NO: 57706 - DNA, 20 bp, Artificial Sequence
  chemically synthesized
ctctttgaagcaattgtgaa

SEQ ID NO: 57707 - DNA, 20 bp, Artificial Sequence
  chemically synthesized
tcccattcacaattgcttca

SEQ ID NO: 57708 - DNA, 20 bp, Artificial Sequence
  chemically synthesized
ccattcacaattgcttcaaa

SEQ ID NO: 57709 - DNA, 20 bp, Artificial Sequence
  chemically synthesized
taggtattttattctctttg

SEQ ID NO: 57710 - DNA, 20 bp, Artificial Sequence
  chemically synthesized
ttcaaagagaataaaatacc

SEQ ID NO: 57711 - DNA, 20 bp, Artificial Sequence
  chemically synthesized
tcaaagagaataaaatacct

SEQ ID NO: 57712 - DNA, 20 bp, Artificial Sequence
  chemically synthesized
cccttgtaagttggattcct

SEQ ID NO: 57713 - DNA, 20 bp, Artificial Sequence
  chemically synthesized
tcccttgtaagttggattcc

SEQ ID NO: 57714 - DNA, 20 bp, Artificial Sequence
  chemically synthesized
tacctaggaatccaacttac

SEQ ID NO: 57715 - DNA, 20 bp, Artificial Sequence
  chemically synthesized
acctaggaatccaacttaca

SEQ ID NO: 57716 - DNA, 20 bp, Artificial Sequence
  chemically synthesized
ccttcacatcccttgtaagt

SEQ ID NO: 57717 - DNA, 20 bp, Artificial Sequence
  chemically synthesized
cctaggaatccaacttacaa

SEQ ID NO: 57718 - DNA, 20 bp, Artificial Sequence
  chemically synthesized
aggtccttcacatcccttgt

SEQ ID NO: 57719 - DNA, 20 bp, Artificial Sequence
  chemically synthesized
tccaacttacaagggatgtg

SEQ ID NO: 57720 - DNA, 20 bp, Artificial Sequence
  chemically synthesized
ccaacttacaagggatgtga

SEQ ID NO: 57721 - DNA, 20 bp, Artificial Sequence
  chemically synthesized
gggatgtgaaggacctcttc

SEQ ID NO: 57722 - DNA, 20 bp, Artificial Sequence
  chemically synthesized
ggatgtgaaggacctcttca

SEQ ID NO: 57723 - DNA, 20 bp, Artificial Sequence
  chemically synthesized
atgtgaaggacctcttcaag

SEQ ID NO: 57724 - DNA, 20 bp, Artificial Sequence
  chemically synthesized
gtttgtagttctccttgaag

SEQ ID NO: 57725 - DNA, 20 bp, Artificial Sequence
  chemically synthesized
ggtttgtagttctccttgaa

SEQ ID NO: 57726 - DNA, 20 bp, Artificial Sequence
  chemically synthesized
gtggtttgtagttctccttg

SEQ ID NO: 57727 - DNA, 20 bp, Artificial Sequence
  chemically synthesized
tttccttgagcagtggtttg

SEQ ID NO: 57728 - DNA, 20 bp, Artificial Sequence
  chemically synthesized
agaactacaaaccactgctc

SEQ ID NO: 57729 - DNA, 20 bp, Artificial Sequence
  chemically synthesized
gaactacaaaccactgctca

SEQ ID NO: 57730 - DNA, 20 bp, Artificial Sequence
  chemically synthesized
tcttttatttccttgagcag

SEQ ID NO: 57731 - DNA, 20 bp, Artificial Sequence
  chemically synthesized
tcctcttttatttccttgag

SEQ ID NO: 57732 - DNA, 20 bp, Artificial Sequence
  chemically synthesized
gtatcctcttttatttcctt

SEQ ID NO: 57733 - DNA, 20 bp, Artificial Sequence
  chemically synthesized
accactgctcaaggaaataa

SEQ ID NO: 57734 - DNA, 20 bp, Artificial Sequence
  chemically synthesized
cactgctcaaggaaataaaa

SEQ ID NO: 57735 - DNA, 20 bp, Artificial Sequence
  chemically synthesized
actgctcaaggaaataaaag

SEQ ID NO: 57736 - DNA, 20 bp, Artificial Sequence
  chemically synthesized
aggaaataaaagaggataca

SEQ ID NO: 57737 - DNA, 20 bp, Artificial Sequence
  chemically synthesized
taaaagaggatacaaagaaa

SEQ ID NO: 57738 - DNA, 20 bp, Artificial Sequence
  chemically synthesized
aagaggatacaaagaaatgg

SEQ ID NO: 57739 - DNA, 20 bp, Artificial Sequence
  chemically synthesized
ggaagaacattccatgctca

SEQ ID NO: 57740 - DNA, 20 bp, Artificial Sequence
  chemically synthesized
gaagaacattccatgctcat

SEQ ID NO: 57741 - DNA, 20 bp, Artificial Sequence
  chemically synthesized
attcttcctacccatgagca

SEQ ID NO: 57742 - DNA, 20 bp, Artificial Sequence
  chemically synthesized
gaacattccatgctcatggg

SEQ ID NO: 57743 - DNA, 20 bp, Artificial Sequence
  chemically synthesized
aacattccatgctcatgggt

SEQ ID NO: 57744 - DNA, 20 bp, Artificial Sequence
  chemically synthesized
tattgattcttcctacccat

SEQ ID NO: 57745 - DNA, 20 bp, Artificial Sequence
  chemically synthesized
attccatgctcatgggtagg

SEQ ID NO: 57746 - DNA, 20 bp, Artificial Sequence
  chemically synthesized
aagaatcaatatcgtgaaaa

SEQ ID NO: 57747 - DNA, 20 bp, Artificial Sequence
  chemically synthesized
ataaatttccttgggcagta

SEQ ID NO: 57748 - DNA, 20 bp, Artificial Sequence
  chemically synthesized
tgaaaatggccatactgccc

SEQ ID NO: 57749 - DNA, 20 bp, Artificial Sequence
  chemically synthesized
gaaaatggccatactgccca

SEQ ID NO: 57750 - DNA, 20 bp, Artificial Sequence
  chemically synthesized
aatctataaatttccttggg

SEQ ID NO: 57751 - DNA, 20 bp, Artificial Sequence
  chemically synthesized
ttgaatctataaatttcctt

SEQ ID NO: 57752 - DNA, 20 bp, Artificial Sequence
  chemically synthesized
attgaatctataaatttcct

SEQ ID NO: 57753 - DNA, 20 bp, Artificial Sequence
  chemically synthesized
atactgcccaaggaaattta

SEQ ID NO: 57754 - DNA, 20 bp, Artificial Sequence
  chemically synthesized
cattggtagcttgatgggga

SEQ ID NO: 57755 - DNA, 20 bp, Artificial Sequence
  chemically synthesized
gattcaatgccatccccatc

SEQ ID NO: 57756 - DNA, 20 bp, Artificial Sequence
  chemically synthesized
aagtcattggtagcttgatg

SEQ ID NO: 57757 - DNA, 20 bp, Artificial Sequence
  chemically synthesized
aaagtcattggtagcttgat

SEQ ID NO: 57758 - DNA, 20 bp, Artificial Sequence
  chemically synthesized
gaaagtcattggtagcttga

SEQ ID NO: 57759 - DNA, 20 bp, Artificial Sequence
  chemically synthesized
tctgtgaagaaagtcattgg

SEQ ID NO: 57760 - DNA, 20 bp, Artificial Sequence
  chemically synthesized
aattctgtgaagaaagtcat

SEQ ID NO: 57761 - DNA, 20 bp, Artificial Sequence
  chemically synthesized
gctaccaatgactttcttca

SEQ ID NO: 57762 - DNA, 20 bp, Artificial Sequence
  chemically synthesized
tttttccaattctgtgaaga

SEQ ID NO: 57763 - DNA, 20 bp, Artificial Sequence
  chemically synthesized
tagttttttccaattctgtg

SEQ ID NO: 57764 - DNA, 20 bp, Artificial Sequence
  chemically synthesized
aatgactttcttcacagaat

SEQ ID NO: 57765 - DNA, 20 bp, Artificial Sequence
  chemically synthesized
aattggaaaaaactacttta

SEQ ID NO: 57766 - DNA, 20 bp, Artificial Sequence
  chemically synthesized
gttccatatgaactttaaag

SEQ ID NO: 57767 - DNA, 20 bp, Artificial Sequence
  chemically synthesized
ttggttccatatgaacttta

SEQ ID NO: 57768 - DNA, 20 bp, Artificial Sequence
  chemically synthesized
aaactactttaaagttcata

SEQ ID NO: 57769 - DNA, 20 bp, Artificial Sequence
  chemically synthesized
aagttcatatggaaccaaaa

SEQ ID NO: 57770 - DNA, 20 bp, Artificial Sequence
  chemically synthesized
gttcatatggaaccaaaaaa

SEQ ID NO: 57771 - DNA, 20 bp, Artificial Sequence
  chemically synthesized
tggcgatgcgggctcttttt

SEQ ID NO: 57772 - DNA, 20 bp, Artificial Sequence
  chemically synthesized
taggattgacttggcgatgc

SEQ ID NO: 57773 - DNA, 20 bp, Artificial Sequence
  chemically synthesized
aaaaaagagcccgcatcgcc

SEQ ID NO: 57774 - DNA, 20 bp, Artificial Sequence
  chemically synthesized
ttaggattgacttggcgatg

SEQ ID NO: 57775 - DNA, 20 bp, Artificial Sequence
  chemically synthesized
cttttggcttaggattgact

SEQ ID NO: 57776 - DNA, 20 bp, Artificial Sequence
  chemically synthesized
cgcatcgccaagtcaatcct

SEQ ID NO: 57777 - DNA, 20 bp, Artificial Sequence
  chemically synthesized
ccaagtcaatcctaagccaa

SEQ ID NO: 57778 - DNA, 20 bp, Artificial Sequence
  chemically synthesized
cagctttgttcttttggctt

SEQ ID NO: 57779 - DNA, 20 bp, Artificial Sequence
  chemically synthesized
ccagctttgttcttttggct

SEQ ID NO: 57780 - DNA, 20 bp, Artificial Sequence
  chemically synthesized
tgcctccagctttgttcttt

SEQ ID NO: 57781 - DNA, 20 bp, Artificial Sequence
  chemically synthesized
aatcctaagccaaaagaaca

SEQ ID NO: 57782 - DNA, 20 bp, Artificial Sequence
  chemically synthesized
ctaagccaaaagaacaaagc

SEQ ID NO: 57783 - DNA, 20 bp, Artificial Sequence
  chemically synthesized
aagccaaaagaacaaagctg

SEQ ID NO: 57784 - DNA, 20 bp, Artificial Sequence
  chemically synthesized
agccaaaagaacaaagctgg

SEQ ID NO: 57785 - DNA, 20 bp, Artificial Sequence
  chemically synthesized
gtcaggtagcgtgatgcctc

SEQ ID NO: 57786 - DNA, 20 bp, Artificial Sequence
  chemically synthesized
tagtatagtttgaagtcagg

SEQ ID NO: 57787 - DNA, 20 bp, Artificial Sequence
  chemically synthesized
ttgtagtatagtttgaagtc

SEQ ID NO: 57788 - DNA, 20 bp, Artificial Sequence
  chemically synthesized
cttgtagtatagtttgaagt

SEQ ID NO: 57789 - DNA, 20 bp, Artificial Sequence
  chemically synthesized
tagccttgtagtatagtttg

SEQ ID NO: 57790 - DNA, 20 bp, Artificial Sequence
  chemically synthesized
ctgacttcaaactatactac

SEQ ID NO: 57791 - DNA, 20 bp, Artificial Sequence
  chemically synthesized
tgacttcaaactatactaca

SEQ ID NO: 57792 - DNA, 20 bp, Artificial Sequence
  chemically synthesized
cttcctgtagccttgtagta

SEQ ID NO: 57793 - DNA, 20 bp, Artificial Sequence
  chemically synthesized
ttttgcttcctgtagccttg

SEQ ID NO: 57794 - DNA, 20 bp, Artificial Sequence
  chemically synthesized
caaactatactacaaggcta

SEQ ID NO: 57795 - DNA, 20 bp, Artificial Sequence
  chemically synthesized
aaactatactacaaggctac

SEQ ID NO: 57796 - DNA, 20 bp, Artificial Sequence
  chemically synthesized
ctatactacaaggctacagg

SEQ ID NO: 57797 - DNA, 20 bp, Artificial Sequence
  chemically synthesized
ccatgctgttttgcttcctg

SEQ ID NO: 57798 - DNA, 20 bp, Artificial Sequence
  chemically synthesized
caaggctacaggaagcaaaa

SEQ ID NO: 57799 - DNA, 20 bp, Artificial Sequence
  chemically synthesized
ctacaggaagcaaaacagca

SEQ ID NO: 57800 - DNA, 20 bp, Artificial Sequence
  chemically synthesized
gaagcaaaacagcatggtac

SEQ ID NO: 57801 - DNA, 20 bp, Artificial Sequence
  chemically synthesized
ctatgtctctgttttggtac

SEQ ID NO: 57802 - DNA, 20 bp, Artificial Sequence
  chemically synthesized
gcatggtactggtaccaaaa

SEQ ID NO: 57803 - DNA, 20 bp, Artificial Sequence
  chemically synthesized
atggtactggtaccaaaaca

SEQ ID NO: 57804 - DNA, 20 bp, Artificial Sequence
  chemically synthesized
attgatctatgtctctgttt

SEQ ID NO: 57805 - DNA, 20 bp, Artificial Sequence
  chemically synthesized
ctggtaccaaaacagagaca

SEQ ID NO: 57806 - DNA, 20 bp, Artificial Sequence
  chemically synthesized
aaaacagagacatagatcaa

SEQ ID NO: 57807 - DNA, 20 bp, Artificial Sequence
  chemically synthesized
agagacatagatcaatggaa

SEQ ID NO: 57808 - DNA, 20 bp, Artificial Sequence
  chemically synthesized
catagatcaatggaacagaa

SEQ ID NO: 57809 - DNA, 20 bp, Artificial Sequence
  chemically synthesized
tagatcaatggaacagaaca

SEQ ID NO: 57810 - DNA, 20 bp, Artificial Sequence
  chemically synthesized
atggaacagaacagagccct

SEQ ID NO: 57811 - DNA, 20 bp, Artificial Sequence
  chemically synthesized
atatgcggcattatttctga

SEQ ID NO: 57812 - DNA, 20 bp, Artificial Sequence
  chemically synthesized
gatatgcggcattatttctg

SEQ ID NO: 57813 - DNA, 20 bp, Artificial Sequence
  chemically synthesized
agatatgcggcattatttct

SEQ ID NO: 57814 - DNA, 20 bp, Artificial Sequence
  chemically synthesized
atcagatggttgtagatatg

SEQ ID NO: 57815 - DNA, 20 bp, Artificial Sequence
  chemically synthesized
tgtcaaagatcagatggttg

SEQ ID NO: 57816 - DNA, 20 bp, Artificial Sequence
  chemically synthesized
caggtttgtcaaagatcaga

SEQ ID NO: 57817 - DNA, 20 bp, Artificial Sequence
  chemically synthesized
ttctcaggtttgtcaaagat

SEQ ID NO: 57818 - DNA, 20 bp, Artificial Sequence
  chemically synthesized
tgtttttctcaggtttgtca

SEQ ID NO: 57819 - DNA, 20 bp, Artificial Sequence
  chemically synthesized
atctgatctttgacaaacct

SEQ ID NO: 57820 - DNA, 20 bp, Artificial Sequence
  chemically synthesized
ccccattgcttgtttttctc

SEQ ID NO: 57821 - DNA, 20 bp, Artificial Sequence
  chemically synthesized
tccccattgcttgtttttct

SEQ ID NO: 57822 - DNA, 20 bp, Artificial Sequence
  chemically synthesized
ttgacaaacctgagaaaaac

SEQ ID NO: 57823 - DNA, 20 bp, Artificial Sequence
  chemically synthesized
aacctgagaaaaacaagcaa

SEQ ID NO: 57824 - DNA, 20 bp, Artificial Sequence
  chemically synthesized
acctgagaaaaacaagcaat

SEQ ID NO: 57825 - DNA, 20 bp, Artificial Sequence
  chemically synthesized
cctgagaaaaacaagcaatg

SEQ ID NO: 57826 - DNA, 20 bp, Artificial Sequence
  chemically synthesized
agaaaaacaagcaatgggga

SEQ ID NO: 57827 - DNA, 20 bp, Artificial Sequence
  chemically synthesized
gaaaaacaagcaatggggaa

SEQ ID NO: 57828 - DNA, 20 bp, Artificial Sequence
  chemically synthesized
ccagcaccatttattaaata

SEQ ID NO: 57829 - DNA, 20 bp, Artificial Sequence
  chemically synthesized
cccagcaccatttattaaat

SEQ ID NO: 57830 - DNA, 20 bp, Artificial Sequence
  chemically synthesized
tcccagcaccatttattaaa

SEQ ID NO: 57831 - DNA, 20 bp, Artificial Sequence
  chemically synthesized
aggattccctatttaataaa

SEQ ID NO: 57832 - DNA, 20 bp, Artificial Sequence
  chemically synthesized
ccctatttaataaatggtgc

SEQ ID NO: 57833 - DNA, 20 bp, Artificial Sequence
  chemically synthesized
cctatttaataaatggtgct

SEQ ID NO: 57834 - DNA, 20 bp, Artificial Sequence
  chemically synthesized
ataaatggtgctgggaaaac

SEQ ID NO: 57835 - DNA, 20 bp, Artificial Sequence
  chemically synthesized
atatggctagccagttttcc

SEQ ID NO: 57836 - DNA, 20 bp, Artificial Sequence
  chemically synthesized
atggtgctgggaaaactggc

SEQ ID NO: 57837 - DNA, 20 bp, Artificial Sequence
  chemically synthesized
gctttctacatatggctagc

SEQ ID NO: 57838 - DNA, 20 bp, Artificial Sequence
  chemically synthesized
ttcagctttctacatatggc

SEQ ID NO: 57839 - DNA, 20 bp, Artificial Sequence
  chemically synthesized
gaaaactggctagccatatg

SEQ ID NO: 57840 - DNA, 20 bp, Artificial Sequence
  chemically synthesized
cagtttcagctttctacata

SEQ ID NO: 57841 - DNA, 20 bp, Artificial Sequence
  chemically synthesized
actggctagccatatgtaga

SEQ ID NO: 57842 - DNA, 20 bp, Artificial Sequence
  chemically synthesized
catatgtagaaagctgaaac

SEQ ID NO: 57843 - DNA, 20 bp, Artificial Sequence
  chemically synthesized
gtaaggaagggatccagttt

SEQ ID NO: 57844 - DNA, 20 bp, Artificial Sequence
  chemically synthesized
taaggtgtaaggaagggatc

SEQ ID NO: 57845 - DNA, 20 bp, Artificial Sequence
  chemically synthesized
ttcgtataaggtgtaaggaa

SEQ ID NO: 57846 - DNA, 20 bp, Artificial Sequence
  chemically synthesized
tttcgtataaggtgtaagga

SEQ ID NO: 57847 - DNA, 20 bp, Artificial Sequence
  chemically synthesized
ttttcgtataaggtgtaagg

SEQ ID NO: 57848 - DNA, 20 bp, Artificial Sequence
  chemically synthesized
taattttcgtataaggtgta

SEQ ID NO: 57849 - DNA, 20 bp, Artificial Sequence
  chemically synthesized
ttaattttcgtataaggtgt

SEQ ID NO: 57850 - DNA, 20 bp, Artificial Sequence
  chemically synthesized
cttgaattaattttcgtata

SEQ ID NO: 57851 - DNA, 20 bp, Artificial Sequence
  chemically synthesized
tcttgaattaattttcgtat

SEQ ID NO: 57852 - DNA, 20 bp, Artificial Sequence
  chemically synthesized
ccttatacgaaaattaattc

SEQ ID NO: 57853 - DNA, 20 bp, Artificial Sequence
  chemically synthesized
atacgaaaattaattcaaga

SEQ ID NO: 57854 - DNA, 20 bp, Artificial Sequence
  chemically synthesized
aattaattcaagatggatta

SEQ ID NO: 57855 - DNA, 20 bp, Artificial Sequence
  chemically synthesized
tggattaaagacttaaatgt

SEQ ID NO: 57856 - DNA, 20 bp, Artificial Sequence
  chemically synthesized
tggttttaggtctaacattt

SEQ ID NO: 57857 - DNA, 20 bp, Artificial Sequence
  chemically synthesized
tctagagtttttgtggtttt

SEQ ID NO: 57858 - DNA, 20 bp, Artificial Sequence
  chemically synthesized
ttctagagtttttgtggttt

SEQ ID NO: 57859 - DNA, 20 bp, Artificial Sequence
  chemically synthesized
gttttcttctagagtttttg

SEQ ID NO: 57860 - DNA, 20 bp, Artificial Sequence
  chemically synthesized
acctaaaaccacaaaaactc

SEQ ID NO: 57861 - DNA, 20 bp, Artificial Sequence
  chemically synthesized
taaaaccacaaaaactctag

SEQ ID NO: 57862 - DNA, 20 bp, Artificial Sequence
  chemically synthesized
aatgcctaggttttcttcta

SEQ ID NO: 57863 - DNA, 20 bp, Artificial Sequence
  chemically synthesized
gtaatgcctaggttttcttc

SEQ ID NO: 57864 - DNA, 20 bp, Artificial Sequence
  chemically synthesized
aaaaactctagaagaaaacc

SEQ ID NO: 57865 - DNA, 20 bp, Artificial Sequence
  chemically synthesized
aaaactctagaagaaaacct

SEQ ID NO: 57866 - DNA, 20 bp, Artificial Sequence
  chemically synthesized
tgtcctgaatggtaatgcct

SEQ ID NO: 57867 - DNA, 20 bp, Artificial Sequence
  chemically synthesized
atgtcctgaatggtaatgcc

SEQ ID NO: 57868 - DNA, 20 bp, Artificial Sequence
  chemically synthesized
aaaacctaggcattaccatt

SEQ ID NO: 57869 - DNA, 20 bp, Artificial Sequence
  chemically synthesized
aaacctaggcattaccattc

SEQ ID NO: 57870 - DNA, 20 bp, Artificial Sequence
  chemically synthesized
gcccatgcctatgtcctgaa

SEQ ID NO: 57871 - DNA, 20 bp, Artificial Sequence
  chemically synthesized
aggcattaccattcaggaca

SEQ ID NO: 57872 - DNA, 20 bp, Artificial Sequence
  chemically synthesized
ggcattaccattcaggacat

SEQ ID NO: 57873 - DNA, 20 bp, Artificial Sequence
  chemically synthesized
taccattcaggacataggca

SEQ ID NO: 57874 - DNA, 20 bp, Artificial Sequence
  chemically synthesized
accattcaggacataggcat

SEQ ID NO: 57875 - DNA, 20 bp, Artificial Sequence
  chemically synthesized
ttcaggacataggcatgggc

SEQ ID NO: 57876 - DNA, 20 bp, Artificial Sequence
  chemically synthesized
tcaggacataggcatgggca

SEQ ID NO: 57877 - DNA, 20 bp, Artificial Sequence
  chemically synthesized
cttttggtgttgtagacatg

SEQ ID NO: 57878 - DNA, 20 bp, Artificial Sequence
  chemically synthesized
tgccattgcttttggtgttg

SEQ ID NO: 57879 - DNA, 20 bp, Artificial Sequence
  chemically synthesized
cttcatgtctacaacaccaa

SEQ ID NO: 57880 - DNA, 20 bp, Artificial Sequence
  chemically synthesized
gtctacaacaccaaaagcaa

SEQ ID NO: 57881 - DNA, 20 bp, Artificial Sequence
  chemically synthesized
gcttttgttgccattgcttt

SEQ ID NO: 57882 - DNA, 20 bp, Artificial Sequence
  chemically synthesized
accaaaagcaatggcaacaa

SEQ ID NO: 57883 - DNA, 20 bp, Artificial Sequence
  chemically synthesized
tagatcccatttgtcaattt

SEQ ID NO: 57884 - DNA, 20 bp, Artificial Sequence
  chemically synthesized
caaaagccaaaattgacaaa

SEQ ID NO: 57885 - DNA, 20 bp, Artificial Sequence
  chemically synthesized
aaaagccaaaattgacaaat

SEQ ID NO: 57886 - DNA, 20 bp, Artificial Sequence
  chemically synthesized
cagaagctctttagtttaat

SEQ ID NO: 57887 - DNA, 20 bp, Artificial Sequence
  chemically synthesized
aatgggatctaattaaacta

SEQ ID NO: 57888 - DNA, 20 bp, Artificial Sequence
  chemically synthesized
tgggatctaattaaactaaa

SEQ ID NO: 57889 - DNA, 20 bp, Artificial Sequence
  chemically synthesized
tttgctgtgcagaagctctt

SEQ ID NO: 57890 - DNA, 20 bp, Artificial Sequence
  chemically synthesized
taaactaaagagcttctgca

SEQ ID NO: 57891 - DNA, 20 bp, Artificial Sequence
  chemically synthesized
tagtttcttttgctgtgcag

SEQ ID NO: 57892 - DNA, 20 bp, Artificial Sequence
  chemically synthesized
tggtagtttcttttgctgtg

SEQ ID NO: 57893 - DNA, 20 bp, Artificial Sequence
  chemically synthesized
aaagagcttctgcacagcaa

SEQ ID NO: 57894 - DNA, 20 bp, Artificial Sequence
  chemically synthesized
acagcaaaagaaactaccat

SEQ ID NO: 57895 - DNA, 20 bp, Artificial Sequence
  chemically synthesized
agcaaaagaaactaccatca

SEQ ID NO: 57896 - DNA, 20 bp, Artificial Sequence
  chemically synthesized
ttgcctgttcactctgatgg

SEQ ID NO: 57897 - DNA, 20 bp, Artificial Sequence
  chemically synthesized
aggttgcctgttcactctga

SEQ ID NO: 57898 - DNA, 20 bp, Artificial Sequence
  chemically synthesized
gaaactaccatcagagtgaa

SEQ ID NO: 57899 - DNA, 20 bp, Artificial Sequence
  chemically synthesized
aaactaccatcagagtgaac

SEQ ID NO: 57900 - DNA, 20 bp, Artificial Sequence
  chemically synthesized
tgaacaggcaacctacaaaa

SEQ ID NO: 57901 - DNA, 20 bp, Artificial Sequence
  chemically synthesized
gaacaggcaacctacaaaat

SEQ ID NO: 57902 - DNA, 20 bp, Artificial Sequence
  chemically synthesized
aaatttttctcccattttgt

SEQ ID NO: 57903 - DNA, 20 bp, Artificial Sequence
  chemically synthesized
aaaatttttctcccattttg

SEQ ID NO: 57904 - DNA, 20 bp, Artificial Sequence
  chemically synthesized
acaggcaacctacaaaatgg

SEQ ID NO: 57905 - DNA, 20 bp, Artificial Sequence
  chemically synthesized
tagccctttgtcagatgagc

SEQ ID NO: 57906 - DNA, 20 bp, Artificial Sequence
  chemically synthesized
ttagccctttgtcagatgag

SEQ ID NO: 57907 - DNA, 20 bp, Artificial Sequence
  chemically synthesized
atattagccctttgtcagat

SEQ ID NO: 57908 - DNA, 20 bp, Artificial Sequence
  chemically synthesized
cgcaacctgctcatctgaca

SEQ ID NO: 57909 - DNA, 20 bp, Artificial Sequence
  chemically synthesized
gcaacctgctcatctgacaa

SEQ ID NO: 57910 - DNA, 20 bp, Artificial Sequence
  chemically synthesized
caacctgctcatctgacaaa

SEQ ID NO: 57911 - DNA, 20 bp, Artificial Sequence
  chemically synthesized
tctggatattagccctttgt

SEQ ID NO: 57912 - DNA, 20 bp, Artificial Sequence
  chemically synthesized
tctgacaaagggctaatatc

SEQ ID NO: 57913 - DNA, 20 bp, Artificial Sequence
  chemically synthesized
tcattgtagattctggatat

SEQ ID NO: 57914 - DNA, 20 bp, Artificial Sequence
  chemically synthesized
tttgagttcattgtagattc

SEQ ID NO: 57915 - DNA, 20 bp, Artificial Sequence
  chemically synthesized
acatttgtttgagttcattg

SEQ ID NO: 57916 - DNA, 20 bp, Artificial Sequence
  chemically synthesized
tttttcttgtacatttgttt

SEQ ID NO: 57917 - DNA, 20 bp, Artificial Sequence
  chemically synthesized
atgaactcaaacaaatgtac

SEQ ID NO: 57918 - DNA, 20 bp, Artificial Sequence
  chemically synthesized
aaacaaacaaccccatcaaa

SEQ ID NO: 57919 - DNA, 20 bp, Artificial Sequence
  chemically synthesized
ccttcgcccactttttgatg

SEQ ID NO: 57920 - DNA, 20 bp, Artificial Sequence
  chemically synthesized
tccttcgcccactttttgat

SEQ ID NO: 57921 - DNA, 20 bp, Artificial Sequence
  chemically synthesized
gtccttcgcccactttttga

SEQ ID NO: 57922 - DNA, 20 bp, Artificial Sequence
  chemically synthesized
caaacaaccccatcaaaaag

SEQ ID NO: 57923 - DNA, 20 bp, Artificial Sequence
  chemically synthesized
aaacaaccccatcaaaaagt

SEQ ID NO: 57924 - DNA, 20 bp, Artificial Sequence
  chemically synthesized
accccatcaaaaagtgggcg

SEQ ID NO: 57925 - DNA, 20 bp, Artificial Sequence
  chemically synthesized
ccccatcaaaaagtgggcga

SEQ ID NO: 57926 - DNA, 20 bp, Artificial Sequence
  chemically synthesized
aagtgggcgaaggacatgaa

SEQ ID NO: 57927 - DNA, 20 bp, Artificial Sequence
  chemically synthesized
catgaacagacacttctcaa

SEQ ID NO: 57928 - DNA, 20 bp, Artificial Sequence
  chemically synthesized
cataaatgtcttcttttgag

SEQ ID NO: 57929 - DNA, 20 bp, Artificial Sequence
  chemically synthesized
gaacagacacttctcaaaag

SEQ ID NO: 57930 - DNA, 20 bp, Artificial Sequence
  chemically synthesized
ctgcataaatgtcttctttt

SEQ ID NO: 57931 - DNA, 20 bp, Artificial Sequence
  chemically synthesized
ctcaaaagaagacatttatg

SEQ ID NO: 57932 - DNA, 20 bp, Artificial Sequence
  chemically synthesized
gaagacatttatgcagccaa

SEQ ID NO: 57933 - DNA, 20 bp, Artificial Sequence
  chemically synthesized
gcattttttcatgtgtcttt

SEQ ID NO: 57934 - DNA, 20 bp, Artificial Sequence
  chemically synthesized
ctctgatggccagtgatggt

SEQ ID NO: 57935 - DNA, 20 bp, Artificial Sequence
  chemically synthesized
gaaaaaatgctcaccatcac

SEQ ID NO: 57936 - DNA, 20 bp, Artificial Sequence
  chemically synthesized
atttctctgatggccagtga

SEQ ID NO: 57937 - DNA, 20 bp, Artificial Sequence
  chemically synthesized
tgctcaccatcactggccat

SEQ ID NO: 57938 - DNA, 20 bp, Artificial Sequence
  chemically synthesized
ctcaccatcactggccatca

SEQ ID NO: 57939 - DNA, 20 bp, Artificial Sequence
  chemically synthesized
atttgcatttctctgatggc

SEQ ID NO: 57940 - DNA, 20 bp, Artificial Sequence
  chemically synthesized
tttgatttgcatttctctga

SEQ ID NO: 57941 - DNA, 20 bp, Artificial Sequence
  chemically synthesized
atgcaaatcaaaaccacaat

SEQ ID NO: 57942 - DNA, 20 bp, Artificial Sequence
  chemically synthesized
tgtgagatggtatctcattg

SEQ ID NO: 57943 - DNA, 20 bp, Artificial Sequence
  chemically synthesized
ccattctaactggtgtgaga

SEQ ID NO: 57944 - DNA, 20 bp, Artificial Sequence
  chemically synthesized
aatgagataccatctcacac

SEQ ID NO: 57945 - DNA, 20 bp, Artificial Sequence
  chemically synthesized
accgccattctaactggtgt

SEQ ID NO: 57946 - DNA, 20 bp, Artificial Sequence
  chemically synthesized
agataccatctcacaccagt

SEQ ID NO: 57947 - DNA, 20 bp, Artificial Sequence
  chemically synthesized
ccatctcacaccagttagaa

SEQ ID NO: 57948 - DNA, 20 bp, Artificial Sequence
  chemically synthesized
ttaatgaccgccattctaac

SEQ ID NO: 57949 - DNA, 20 bp, Artificial Sequence
  chemically synthesized
tctcacaccagttagaatgg

SEQ ID NO: 57950 - DNA, 20 bp, Artificial Sequence
  chemically synthesized
ttagaatggcggtcattaaa

SEQ ID NO: 57951 - DNA, 20 bp, Artificial Sequence
  chemically synthesized
aatggcggtcattaaaaagt

SEQ ID NO: 57952 - DNA, 20 bp, Artificial Sequence
  chemically synthesized
atggcggtcattaaaaagtc

SEQ ID NO: 57953 - DNA, 20 bp, Artificial Sequence
  chemically synthesized
attaaaaagtcaggaaacaa

SEQ ID NO: 57954 - DNA, 20 bp, Artificial Sequence
  chemically synthesized
ttaaaaagtcaggaaacaac

SEQ ID NO: 57955 - DNA, 20 bp, Artificial Sequence
  chemically synthesized
agtcaggaaacaacaggtgc

SEQ ID NO: 57956 - DNA, 20 bp, Artificial Sequence
  chemically synthesized
tcaggaaacaacaggtgctg

SEQ ID NO: 57957 - DNA, 20 bp, Artificial Sequence
  chemically synthesized
aggaaacaacaggtgctgga

SEQ ID NO: 57958 - DNA, 20 bp, Artificial Sequence
  chemically synthesized
ggaaacaacaggtgctggag

SEQ ID NO: 57959 - DNA, 20 bp, Artificial Sequence
  chemically synthesized
ctatttctccacatcctctc

SEQ ID NO: 57960 - DNA, 20 bp, Artificial Sequence
  chemically synthesized
aacaggtgctggagaggatg

SEQ ID NO: 57961 - DNA, 20 bp, Artificial Sequence
  chemically synthesized
caggtgctggagaggatgtg

SEQ ID NO: 57962 - DNA, 20 bp, Artificial Sequence
  chemically synthesized
ctggagaggatgtggagaaa

SEQ ID NO: 57963 - DNA, 20 bp, Artificial Sequence
  chemically synthesized
tggagaggatgtggagaaat

SEQ ID NO: 57964 - DNA, 20 bp, Artificial Sequence
  chemically synthesized
cagtcccaccaacagtgtaa

SEQ ID NO: 57965 - DNA, 20 bp, Artificial Sequence
  chemically synthesized
taggaacacttttacactgt

SEQ ID NO: 57966 - DNA, 20 bp, Artificial Sequence
  chemically synthesized
gaacacttttacactgttgg

SEQ ID NO: 57967 - DNA, 20 bp, Artificial Sequence
  chemically synthesized
aacacttttacactgttggt

SEQ ID NO: 57968 - DNA, 20 bp, Artificial Sequence
  chemically synthesized
ctagtttacagtcccaccaa

SEQ ID NO: 57969 - DNA, 20 bp, Artificial Sequence
  chemically synthesized
ctgttggtgggactgtaaac

SEQ ID NO: 57970 - DNA, 20 bp, Artificial Sequence
  chemically synthesized
acaatggttgaactagttta

SEQ ID NO: 57971 - DNA, 20 bp, Artificial Sequence
  chemically synthesized
gacttccacaatggttgaac

SEQ ID NO: 57972 - DNA, 20 bp, Artificial Sequence
  chemically synthesized
gtaaactagttcaaccattg

SEQ ID NO: 57973 - DNA, 20 bp, Artificial Sequence
  chemically synthesized
aactagttcaaccattgtgg

SEQ ID NO: 57974 - DNA, 20 bp, Artificial Sequence
  chemically synthesized
cgccacactgacttccacaa

SEQ ID NO: 57975 - DNA, 20 bp, Artificial Sequence
  chemically synthesized
agttcaaccattgtggaagt

SEQ ID NO: 57976 - DNA, 20 bp, Artificial Sequence
  chemically synthesized
aaccattgtggaagtcagtg

SEQ ID NO: 57977 - DNA, 20 bp, Artificial Sequence
  chemically synthesized
aagtcagtgtggcgattcct

SEQ ID NO: 57978 - DNA, 20 bp, Artificial Sequence
  chemically synthesized
agtcagtgtggcgattcctc

SEQ ID NO: 57979 - DNA, 20 bp, Artificial Sequence
  chemically synthesized
gtcagtgtggcgattcctca

SEQ ID NO: 57980 - DNA, 20 bp, Artificial Sequence
  chemically synthesized
tttctagttctagatccctg

SEQ ID NO: 57981 - DNA, 20 bp, Artificial Sequence
  chemically synthesized
gtggcgattcctcagggatc

SEQ ID NO: 57982 - DNA, 20 bp, Artificial Sequence
  chemically synthesized
atttctagttctagatccct

SEQ ID NO: 57983 - DNA, 20 bp, Artificial Sequence
  chemically synthesized
attcctcagggatctagaac

SEQ ID NO: 57984 - DNA, 20 bp, Artificial Sequence
  chemically synthesized
tcaaatggtatttctagttc

SEQ ID NO: 57985 - DNA, 20 bp, Artificial Sequence
  chemically synthesized
gctgggtcaaatggtatttc

SEQ ID NO: 57986 - DNA, 20 bp, Artificial Sequence
  chemically synthesized
actagaaataccatttgacc

SEQ ID NO: 57987 - DNA, 20 bp, Artificial Sequence
  chemically synthesized
aatgggatggctgggtcaaa

SEQ ID NO: 57988 - DNA, 20 bp, Artificial Sequence
  chemically synthesized
tacccagtaatgggatggct

SEQ ID NO: 57989 - DNA, 20 bp, Artificial Sequence
  chemically synthesized
atacccagtaatgggatggc

SEQ ID NO: 57990 - DNA, 20 bp, Artificial Sequence
  chemically synthesized
gtatatacccagtaatggga

SEQ ID NO: 57991 - DNA, 20 bp, Artificial Sequence
  chemically synthesized
tgacccagccatcccattac

SEQ ID NO: 57992 - DNA, 20 bp, Artificial Sequence
  chemically synthesized
gacccagccatcccattact

SEQ ID NO: 57993 - DNA, 20 bp, Artificial Sequence
  chemically synthesized
ttgggtatatacccagtaat

SEQ ID NO: 57994 - DNA, 20 bp, Artificial Sequence
  chemically synthesized
tttgggtatatacccagtaa

SEQ ID NO: 57995 - DNA, 20 bp, Artificial Sequence
  chemically synthesized
tagtcctttgggtatatacc

SEQ ID NO: 57996 - DNA, 20 bp, Artificial Sequence
  chemically synthesized
cattactgggtatataccca

SEQ ID NO: 57997 - DNA, 20 bp, Artificial Sequence
  chemically synthesized
attactgggtatatacccaa

SEQ ID NO: 57998 - DNA, 20 bp, Artificial Sequence
  chemically synthesized
agcatgatttatagtccttt

SEQ ID NO: 57999 - DNA, 20 bp, Artificial Sequence
  chemically synthesized
cagcatgatttatagtcctt

SEQ ID NO: 58000 - DNA, 20 bp, Artificial Sequence
  chemically synthesized
ctttatagcagcatgattta

SEQ ID NO: 58001 - DNA, 20 bp, Artificial Sequence
  chemically synthesized
ctataaatcatgctgctata

SEQ ID NO: 58002 - DNA, 20 bp, Artificial Sequence
  chemically synthesized
gtgtgcatgtgtctttatag

SEQ ID NO: 58003 - DNA, 20 bp, Artificial Sequence
  chemically synthesized
tacgtgtgcatgtgtcttta

SEQ ID NO: 58004 - DNA, 20 bp, Artificial Sequence
  chemically synthesized
atgcacacgtacgtttattg

SEQ ID NO: 58005 - DNA, 20 bp, Artificial Sequence
  chemically synthesized
tattgtggcactattcacaa

SEQ ID NO: 58006 - DNA, 20 bp, Artificial Sequence
  chemically synthesized
caagtctttgctgttgtgaa

SEQ ID NO: 58007 - DNA, 20 bp, Artificial Sequence
  chemically synthesized
tggcactattcacaacagca

SEQ ID NO: 58008 - DNA, 20 bp, Artificial Sequence
  chemically synthesized
tattcacaacagcaaagact

SEQ ID NO: 58009 - DNA, 20 bp, Artificial Sequence
  chemically synthesized
tggacatttgggttggttcc

SEQ ID NO: 58010 - DNA, 20 bp, Artificial Sequence
  chemically synthesized
tcattgttggacatttgggt

SEQ ID NO: 58011 - DNA, 20 bp, Artificial Sequence
  chemically synthesized
cctatcattgttggacattt

SEQ ID NO: 58012 - DNA, 20 bp, Artificial Sequence
  chemically synthesized
gcctatcattgttggacatt

SEQ ID NO: 58013 - DNA, 20 bp, Artificial Sequence
  chemically synthesized
acccaaatgtccaacaatga

SEQ ID NO: 58014 - DNA, 20 bp, Artificial Sequence
  chemically synthesized
ttaatccagcctatcattgt

SEQ ID NO: 58015 - DNA, 20 bp, Artificial Sequence
  chemically synthesized
cccaaatgtccaacaatgat

SEQ ID NO: 58016 - DNA, 20 bp, Artificial Sequence
  chemically synthesized
aatgtccaacaatgataggc

SEQ ID NO: 58017 - DNA, 20 bp, Artificial Sequence
  chemically synthesized
caacaatgataggctggatt

SEQ ID NO: 58018 - DNA, 20 bp, Artificial Sequence
  chemically synthesized
tgtgccacattttcttaatc

SEQ ID NO: 58019 - DNA, 20 bp, Artificial Sequence
  chemically synthesized
taggctggattaagaaaatg

SEQ ID NO: 58020 - DNA, 20 bp, Artificial Sequence
  chemically synthesized
aatgtggcacatacgcacca

SEQ ID NO: 58021 - DNA, 20 bp, Artificial Sequence
  chemically synthesized
tatggctgcatagtattcca

SEQ ID NO: 58022 - DNA, 20 bp, Artificial Sequence
  chemically synthesized
acgcaccatggaatactatg

SEQ ID NO: 58023 - DNA, 20 bp, Artificial Sequence
  chemically synthesized
catcattttttatggctgca

SEQ ID NO: 58024 - DNA, 20 bp, Artificial Sequence
  chemically synthesized
catgaactcatcatttttta

SEQ ID NO: 58025 - DNA, 20 bp, Artificial Sequence
  chemically synthesized
atgcagccataaaaaatgat

SEQ ID NO: 58026 - DNA, 20 bp, Artificial Sequence
  chemically synthesized
tgatgagttcatgtcctttg

SEQ ID NO: 58027 - DNA, 20 bp, Artificial Sequence
  chemically synthesized
gatgagttcatgtcctttgt

SEQ ID NO: 58028 - DNA, 20 bp, Artificial Sequence
  chemically synthesized
atgagttcatgtcctttgta

SEQ ID NO: 58029 - DNA, 20 bp, Artificial Sequence
  chemically synthesized
tttcatccatgtccctacaa

SEQ ID NO: 58030 - DNA, 20 bp, Artificial Sequence
  chemically synthesized
atttcatccatgtccctaca

SEQ ID NO: 58031 - DNA, 20 bp, Artificial Sequence
  chemically synthesized
tcatgtcctttgtagggaca

SEQ ID NO: 58032 - DNA, 20 bp, Artificial Sequence
  chemically synthesized
tgtagggacatggatgaaat

SEQ ID NO: 58033 - DNA, 20 bp, Artificial Sequence
  chemically synthesized
aaattggaaatcatcattct

SEQ ID NO: 58034 - DNA, 20 bp, Artificial Sequence
  chemically synthesized
tgtccatgtgatagtttact

SEQ ID NO: 58035 - DNA, 20 bp, Artificial Sequence
  chemically synthesized
attctcagtaaactatcaca

SEQ ID NO: 58036 - DNA, 20 bp, Artificial Sequence
  chemically synthesized
ttggtcttttgtccatgtga

SEQ ID NO: 58037 - DNA, 20 bp, Artificial Sequence
  chemically synthesized
gtaaactatcacatggacaa

SEQ ID NO: 58038 - DNA, 20 bp, Artificial Sequence
  chemically synthesized
gagtgagaacatgcggtgtt

SEQ ID NO: 58039 - DNA, 20 bp, Artificial Sequence
  chemically synthesized
cacctatgagtgagaacatg

SEQ ID NO: 58040 - DNA, 20 bp, Artificial Sequence
  chemically synthesized
acaccgcatgttctcactca

SEQ ID NO: 58041 - DNA, 20 bp, Artificial Sequence
  chemically synthesized
caccgcatgttctcactcat

SEQ ID NO: 58042 - DNA, 20 bp, Artificial Sequence
  chemically synthesized
ttcaattcccacctatgagt

SEQ ID NO: 58043 - DNA, 20 bp, Artificial Sequence
  chemically synthesized
cgcatgttctcactcatagg

SEQ ID NO: 58044 - DNA, 20 bp, Artificial Sequence
  chemically synthesized
gcatgttctcactcataggt

SEQ ID NO: 58045 - DNA, 20 bp, Artificial Sequence
  chemically synthesized
attgttcaattcccacctat

SEQ ID NO: 58046 - DNA, 20 bp, Artificial Sequence
  chemically synthesized
ataggtgggaattgaacaat

SEQ ID NO: 58047 - DNA, 20 bp, Artificial Sequence
  chemically synthesized
aattgaacaatgagaacaca

SEQ ID NO: 58048 - DNA, 20 bp, Artificial Sequence
  chemically synthesized
acaatgagaacacatggaca

SEQ ID NO: 58049 - DNA, 20 bp, Artificial Sequence
  chemically synthesized
caatgagaacacatggacac

SEQ ID NO: 58050 - DNA, 20 bp, Artificial Sequence
  chemically synthesized
tgagaacacatggacacagg

SEQ ID NO: 58051 - DNA, 20 bp, Artificial Sequence
  chemically synthesized
gagaacacatggacacagga

SEQ ID NO: 58052 - DNA, 20 bp, Artificial Sequence
  chemically synthesized
agaacacatggacacaggaa

SEQ ID NO: 58053 - DNA, 20 bp, Artificial Sequence
  chemically synthesized
gaacacatggacacaggaag

SEQ ID NO: 58054 - DNA, 20 bp, Artificial Sequence
  chemically synthesized
ggaaggggaacatcacactc

SEQ ID NO: 58055 - DNA, 20 bp, Artificial Sequence
  chemically synthesized
gaaggggaacatcacactct

SEQ ID NO: 58056 - DNA, 20 bp, Artificial Sequence
  chemically synthesized
aaggggaacatcacactctg

SEQ ID NO: 58057 - DNA, 20 bp, Artificial Sequence
  chemically synthesized
ccaccccacaacagtcccca

SEQ ID NO: 58058 - DNA, 20 bp, Artificial Sequence
  chemically synthesized
ccccaccccacaacagtccc

SEQ ID NO: 58059 - DNA, 20 bp, Artificial Sequence
  chemically synthesized
tcacactctggggactgttg

SEQ ID NO: 58060 - DNA, 20 bp, Artificial Sequence
  chemically synthesized
cacactctggggactgttgt

SEQ ID NO: 58061 - DNA, 20 bp, Artificial Sequence
  chemically synthesized
acactctggggactgttgtg

SEQ ID NO: 58062 - DNA, 20 bp, Artificial Sequence
  chemically synthesized
cccctccccccaccccacaa

SEQ ID NO: 58063 - DNA, 20 bp, Artificial Sequence
  chemically synthesized
ctctggggactgttgtgggg

SEQ ID NO: 58064 - DNA, 20 bp, Artificial Sequence
  chemically synthesized
tctggggactgttgtggggt

SEQ ID NO: 58065 - DNA, 20 bp, Artificial Sequence
  chemically synthesized
ctggggactgttgtggggtg

SEQ ID NO: 58066 - DNA, 20 bp, Artificial Sequence
  chemically synthesized
tggggactgttgtggggtgg

SEQ ID NO: 58067 - DNA, 20 bp, Artificial Sequence
  chemically synthesized
ggggactgttgtggggtggg

SEQ ID NO: 58068 - DNA, 20 bp, Artificial Sequence
  chemically synthesized
ggactgttgtggggtggggg

SEQ ID NO: 58069 - DNA, 20 bp, Artificial Sequence
  chemically synthesized
gactgttgtggggtgggggg

SEQ ID NO: 58070 - DNA, 20 bp, Artificial Sequence
  chemically synthesized
actgttgtggggtgggggga

SEQ ID NO: 58071 - DNA, 20 bp, Artificial Sequence
  chemically synthesized
ctgttgtggggtggggggag

SEQ ID NO: 58072 - DNA, 20 bp, Artificial Sequence
  chemically synthesized
tgttgtggggtggggggagg

SEQ ID NO: 58073 - DNA, 20 bp, Artificial Sequence
  chemically synthesized
gttgtggggtggggggaggg

SEQ ID NO: 58074 - DNA, 20 bp, Artificial Sequence
  chemically synthesized
tgtggggtggggggaggggg

SEQ ID NO: 58075 - DNA, 20 bp, Artificial Sequence
  chemically synthesized
gtggggtggggggagggggg

SEQ ID NO: 58076 - DNA, 20 bp, Artificial Sequence
  chemically synthesized
tggggtggggggagggggga

SEQ ID NO: 58077 - DNA, 20 bp, Artificial Sequence
  chemically synthesized
gtggggggaggggggaggga

SEQ ID NO: 58078 - DNA, 20 bp, Artificial Sequence
  chemically synthesized
ggaggggggagggatagcat

SEQ ID NO: 58079 - DNA, 20 bp, Artificial Sequence
  chemically synthesized
gaggggggagggatagcatt

SEQ ID NO: 58080 - DNA, 20 bp, Artificial Sequence
  chemically synthesized
ggggggagggatagcattag

SEQ ID NO: 58081 - DNA, 20 bp, Artificial Sequence
  chemically synthesized
ttaactcgtcatttagcatt

SEQ ID NO: 58082 - DNA, 20 bp, Artificial Sequence
  chemically synthesized
attaactcgtcatttagcat

SEQ ID NO: 58083 - DNA, 20 bp, Artificial Sequence
  chemically synthesized
tatacctaatgctaaatgac

SEQ ID NO: 58084 - DNA, 20 bp, Artificial Sequence
  chemically synthesized
gcacccattaactcgtcatt

SEQ ID NO: 58085 - DNA, 20 bp, Artificial Sequence
  chemically synthesized
aatgctaaatgacgagttaa

SEQ ID NO: 58086 - DNA, 20 bp, Artificial Sequence
  chemically synthesized
atgctaaatgacgagttaat

SEQ ID NO: 58087 - DNA, 20 bp, Artificial Sequence
  chemically synthesized
aaatgacgagttaatgggtg

SEQ ID NO: 58088 - DNA, 20 bp, Artificial Sequence
  chemically synthesized
agttaatgggtgcagcacac

SEQ ID NO: 58089 - DNA, 20 bp, Artificial Sequence
  chemically synthesized
atgggtgcagcacaccagca

SEQ ID NO: 58090 - DNA, 20 bp, Artificial Sequence
  chemically synthesized
tgtgtatacatgtgccatgc

SEQ ID NO: 58091 - DNA, 20 bp, Artificial Sequence
  chemically synthesized
catgtgcacaatgtgcaggt

SEQ ID NO: 58092 - DNA, 20 bp, Artificial Sequence
  chemically synthesized
ggtacatgtgcacaatgtgc

SEQ ID NO: 58093 - DNA, 20 bp, Artificial Sequence
  chemically synthesized
gggtacatgtgcacaatgtg

SEQ ID NO: 58094 - DNA, 20 bp, Artificial Sequence
  chemically synthesized
ttattatactttaagtttta

SEQ ID NO: 58095 - DNA, 20 bp, Artificial Sequence
  chemically synthesized
tttattatactttaagtttt

SEQ ID NO: 58096 - DNA, 20 bp, Artificial Sequence
  chemically synthesized
cacatgtaccctaaaactta

SEQ ID NO: 58097 - DNA, 20 bp, Artificial Sequence
  chemically synthesized
ttttattatactttaagttt

SEQ ID NO: 58098 - DNA, 20 bp, Artificial Sequence
  chemically synthesized
tatttattttattatacttt

SEQ ID NO: 58099 - DNA, 20 bp, Artificial Sequence
  chemically synthesized
ataaaatgtatttactcttt

SEQ ID NO: 58100 - DNA, 20 bp, Artificial Sequence
  chemically synthesized
gtctactacagatgctgaaa

SEQ ID NO: 58101 - DNA, 20 bp, Artificial Sequence
  chemically synthesized
gtgtctactacagatgctga

SEQ ID NO: 58102 - DNA, 20 bp, Artificial Sequence
  chemically synthesized
atttactctttcagcatctg

SEQ ID NO: 58103 - DNA, 20 bp, Artificial Sequence
  chemically synthesized
tactctttcagcatctgtag

SEQ ID NO: 58104 - DNA, 20 bp, Artificial Sequence
  chemically synthesized
gagcgccacggtgtctacta

SEQ ID NO: 58105 - DNA, 20 bp, Artificial Sequence
  chemically synthesized
agcatctgtagtagacaccg

SEQ ID NO: 58106 - DNA, 20 bp, Artificial Sequence
  chemically synthesized
aggtccagggtggagcgcca

SEQ ID NO: 58107 - DNA, 20 bp, Artificial Sequence
  chemically synthesized
gacaccgtggcgctccaccc

SEQ ID NO: 58108 - DNA, 20 bp, Artificial Sequence
  chemically synthesized
taaagaggaggtccagggtg

SEQ ID NO: 58109 - DNA, 20 bp, Artificial Sequence
  chemically synthesized
cctaaagaggaggtccaggg

SEQ ID NO: 58110 - DNA, 20 bp, Artificial Sequence
  chemically synthesized
ggccctaaagaggaggtcca

SEQ ID NO: 58111 - DNA, 20 bp, Artificial Sequence
  chemically synthesized
aggccctaaagaggaggtcc

SEQ ID NO: 58112 - DNA, 20 bp, Artificial Sequence
  chemically synthesized
aaggccctaaagaggaggtc

SEQ ID NO: 58113 - DNA, 20 bp, Artificial Sequence
  chemically synthesized
tccaccctggacctcctctt

SEQ ID NO: 58114 - DNA, 20 bp, Artificial Sequence
  chemically synthesized
ccaccctggacctcctcttt

SEQ ID NO: 58115 - DNA, 20 bp, Artificial Sequence
  chemically synthesized
atgcaaaggccctaaagagg

SEQ ID NO: 58116 - DNA, 20 bp, Artificial Sequence
  chemically synthesized
caccctggacctcctcttta

SEQ ID NO: 58117 - DNA, 20 bp, Artificial Sequence
  chemically synthesized
catgcaaaggccctaaagag

SEQ ID NO: 58118 - DNA, 20 bp, Artificial Sequence
  chemically synthesized
tgcatgcaaaggccctaaag

SEQ ID NO: 58119 - DNA, 20 bp, Artificial Sequence
  chemically synthesized
atgcatgcaaaggccctaaa

SEQ ID NO: 58120 - DNA, 20 bp, Artificial Sequence
  chemically synthesized
ccatgcatgcaaaggcccta

SEQ ID NO: 58121 - DNA, 20 bp, Artificial Sequence
  chemically synthesized
caggtggcccatgcatgcaa

SEQ ID NO: 58122 - DNA, 20 bp, Artificial Sequence
  chemically synthesized
gcaggtggcccatgcatgca

SEQ ID NO: 58123 - DNA, 20 bp, Artificial Sequence
  chemically synthesized
ctttagggcctttgcatgca

SEQ ID NO: 58124 - DNA, 20 bp, Artificial Sequence
  chemically synthesized
tttagggcctttgcatgcat

SEQ ID NO: 58125 - DNA, 20 bp, Artificial Sequence
  chemically synthesized
gcagccaataaggcagcagg

SEQ ID NO: 58126 - DNA, 20 bp, Artificial Sequence
  chemically synthesized
ccagcagccaataaggcagc

SEQ ID NO: 58127 - DNA, 20 bp, Artificial Sequence
  chemically synthesized
gccagcagccaataaggcag

SEQ ID NO: 58128 - DNA, 20 bp, Artificial Sequence
  chemically synthesized
tgggccacctgctgccttat

SEQ ID NO: 58129 - DNA, 20 bp, Artificial Sequence
  chemically synthesized
tgagccagcagccaataagg

SEQ ID NO: 58130 - DNA, 20 bp, Artificial Sequence
  chemically synthesized
ctgtgagccagcagccaata

SEQ ID NO: 58131 - DNA, 20 bp, Artificial Sequence
  chemically synthesized
gctgtgagccagcagccaat

SEQ ID NO: 58132 - DNA, 20 bp, Artificial Sequence
  chemically synthesized
cctgctgccttattggctgc

SEQ ID NO: 58133 - DNA, 20 bp, Artificial Sequence
  chemically synthesized
aggccccagctgtgagccag

SEQ ID NO: 58134 - DNA, 20 bp, Artificial Sequence
  chemically synthesized
ccttattggctgctggctca

SEQ ID NO: 58135 - DNA, 20 bp, Artificial Sequence
  chemically synthesized
tgaaggccccagctgtgagc

SEQ ID NO: 58136 - DNA, 20 bp, Artificial Sequence
  chemically synthesized
attggctgctggctcacagc

SEQ ID NO: 58137 - DNA, 20 bp, Artificial Sequence
  chemically synthesized
ttggctgctggctcacagct

SEQ ID NO: 58138 - DNA, 20 bp, Artificial Sequence
  chemically synthesized
tggctgctggctcacagctg

SEQ ID NO: 58139 - DNA, 20 bp, Artificial Sequence
  chemically synthesized
ccaatgaaggccccagctgt

SEQ ID NO: 58140 - DNA, 20 bp, Artificial Sequence
  chemically synthesized
gcacattccaatgaaggccc

SEQ ID NO: 58141 - DNA, 20 bp, Artificial Sequence
  chemically synthesized
ctcacagctggggccttcat

SEQ ID NO: 58142 - DNA, 20 bp, Artificial Sequence
  chemically synthesized
ctgagggcacattccaatga

SEQ ID NO: 58143 - DNA, 20 bp, Artificial Sequence
  chemically synthesized
cctgagggcacattccaatg

SEQ ID NO: 58144 - DNA, 20 bp, Artificial Sequence
  chemically synthesized
ccttcattggaatgtgccct

SEQ ID NO: 58145 - DNA, 20 bp, Artificial Sequence
  chemically synthesized
cttcattggaatgtgccctc

SEQ ID NO: 58146 - DNA, 20 bp, Artificial Sequence
  chemically synthesized
ttcattggaatgtgccctca

SEQ ID NO: 58147 - DNA, 20 bp, Artificial Sequence
  chemically synthesized
tgtgtgaggcagttccctga

SEQ ID NO: 58148 - DNA, 20 bp, Artificial Sequence
  chemically synthesized
ctgtgtgaggcagttccctg

SEQ ID NO: 58149 - DNA, 20 bp, Artificial Sequence
  chemically synthesized
gctgtgtgaggcagttccct

SEQ ID NO: 58150 - DNA, 20 bp, Artificial Sequence
  chemically synthesized
cctcagggaactgcctcaca

SEQ ID NO: 58151 - DNA, 20 bp, Artificial Sequence
  chemically synthesized
ggggatgtagctgtgtgagg

SEQ ID NO: 58152 - DNA, 20 bp, Artificial Sequence
  chemically synthesized
ggaggggatgtagctgtgtg

SEQ ID NO: 58153 - DNA, 20 bp, Artificial Sequence
  chemically synthesized
gggaggggatgtagctgtgt

SEQ ID NO: 58154 - DNA, 20 bp, Artificial Sequence
  chemically synthesized
tctccctgagggaggggatg

SEQ ID NO: 58155 - DNA, 20 bp, Artificial Sequence
  chemically synthesized
cacagctacatcccctccct

SEQ ID NO: 58156 - DNA, 20 bp, Artificial Sequence
  chemically synthesized
acagctacatcccctccctc

SEQ ID NO: 58157 - DNA, 20 bp, Artificial Sequence
  chemically synthesized
taggtctctccctgagggag

SEQ ID NO: 58158 - DNA, 20 bp, Artificial Sequence
  chemically synthesized
cagctacatcccctccctca

SEQ ID NO: 58159 - DNA, 20 bp, Artificial Sequence
  chemically synthesized
ctaggtctctccctgaggga

SEQ ID NO: 58160 - DNA, 20 bp, Artificial Sequence
  chemically synthesized
cctaggtctctccctgaggg

SEQ ID NO: 58161 - DNA, 20 bp, Artificial Sequence
  chemically synthesized
gctacatcccctccctcagg

SEQ ID NO: 58162 - DNA, 20 bp, Artificial Sequence
  chemically synthesized
ccctaggtctctccctgagg

SEQ ID NO: 58163 - DNA, 20 bp, Artificial Sequence
  chemically synthesized
tacatcccctccctcaggga

SEQ ID NO: 58164 - DNA, 20 bp, Artificial Sequence
  chemically synthesized
ggccctaggtctctccctga

SEQ ID NO: 58165 - DNA, 20 bp, Artificial Sequence
  chemically synthesized
tggccctaggtctctccctg

SEQ ID NO: 58166 - DNA, 20 bp, Artificial Sequence
  chemically synthesized
ttggccctaggtctctccct

SEQ ID NO: 58167 - DNA, 20 bp, Artificial Sequence
  chemically synthesized
ccctccctcagggagagacc

SEQ ID NO: 58168 - DNA, 20 bp, Artificial Sequence
  chemically synthesized
cctccctcagggagagacct

SEQ ID NO: 58169 - DNA, 20 bp, Artificial Sequence
  chemically synthesized
ctccctcagggagagaccta

SEQ ID NO: 58170 - DNA, 20 bp, Artificial Sequence
  chemically synthesized
atcagccagtcattggccct

SEQ ID NO: 58171 - DNA, 20 bp, Artificial Sequence
  chemically synthesized
catcagccagtcattggccc

SEQ ID NO: 58172 - DNA, 20 bp, Artificial Sequence
  chemically synthesized
agagacctagggccaatgac

SEQ ID NO: 58173 - DNA, 20 bp, Artificial Sequence
  chemically synthesized
tccctgcatcagccagtcat

SEQ ID NO: 58174 - DNA, 20 bp, Artificial Sequence
  chemically synthesized
gggccaatgactggctgatg

SEQ ID NO: 58175 - DNA, 20 bp, Artificial Sequence
  chemically synthesized
gagttaatccctgcatcagc

SEQ ID NO: 58176 - DNA, 20 bp, Artificial Sequence
  chemically synthesized
ggccaatgactggctgatgc

SEQ ID NO: 58177 - DNA, 20 bp, Artificial Sequence
  chemically synthesized
gccaatgactggctgatgca

SEQ ID NO: 58178 - DNA, 20 bp, Artificial Sequence
  chemically synthesized
aaatgagttaatccctgcat

SEQ ID NO: 58179 - DNA, 20 bp, Artificial Sequence
  chemically synthesized
atggaacactaggcataaat

SEQ ID NO: 58180 - DNA, 20 bp, Artificial Sequence
  chemically synthesized
gggattaactcatttatgcc

SEQ ID NO: 58181 - DNA, 20 bp, Artificial Sequence
  chemically synthesized
cgtcccaataatggaacact

SEQ ID NO: 58182 - DNA, 20 bp, Artificial Sequence
  chemically synthesized
gcgtcccaataatggaacac

SEQ ID NO: 58183 - DNA, 20 bp, Artificial Sequence
  chemically synthesized
tatgcctagtgttccattat

SEQ ID NO: 58184 - DNA, 20 bp, Artificial Sequence
  chemically synthesized
atgcctagtgttccattatt

SEQ ID NO: 58185 - DNA, 20 bp, Artificial Sequence
  chemically synthesized
caagcttagcgtcccaataa

SEQ ID NO: 58186 - DNA, 20 bp, Artificial Sequence
  chemically synthesized
tgttccattattgggacgct

SEQ ID NO: 58187 - DNA, 20 bp, Artificial Sequence
  chemically synthesized
ttattgggacgctaagcttg

SEQ ID NO: 58188 - DNA, 20 bp, Artificial Sequence
  chemically synthesized
tattgggacgctaagcttgt

SEQ ID NO: 58189 - DNA, 20 bp, Artificial Sequence
  chemically synthesized
ataaaaaactcccacaagct

SEQ ID NO: 58190 - DNA, 20 bp, Artificial Sequence
  chemically synthesized
ttgggacgctaagcttgtgg

SEQ ID NO: 58191 - DNA, 20 bp, Artificial Sequence
  chemically synthesized
aggatataaaaaactcccac

SEQ ID NO: 58192 - DNA, 20 bp, Artificial Sequence
  chemically synthesized
ttttttatatcctactgctc

SEQ ID NO: 58193 - DNA, 20 bp, Artificial Sequence
  chemically synthesized
tggcgatgaccttgagcagt

SEQ ID NO: 58194 - DNA, 20 bp, Artificial Sequence
  chemically synthesized
tttttatatcctactgctca

SEQ ID NO: 58195 - DNA, 20 bp, Artificial Sequence
  chemically synthesized
ttggcgatgaccttgagcag

SEQ ID NO: 58196 - DNA, 20 bp, Artificial Sequence
  chemically synthesized
accttggcgatgaccttgag

SEQ ID NO: 58197 - DNA, 20 bp, Artificial Sequence
  chemically synthesized
cagaccttggcgatgacctt

SEQ ID NO: 58198 - DNA, 20 bp, Artificial Sequence
  chemically synthesized
tactgctcaaggtcatcgcc

SEQ ID NO: 58199 - DNA, 20 bp, Artificial Sequence
  chemically synthesized
actgctcaaggtcatcgcca

SEQ ID NO: 58200 - DNA, 20 bp, Artificial Sequence
  chemically synthesized
ttttgtgaaaagtcagacct

SEQ ID NO: 58201 - DNA, 20 bp, Artificial Sequence
  chemically synthesized
aaaaatgttttgtgaaaagt

SEQ ID NO: 58202 - DNA, 20 bp, Artificial Sequence
  chemically synthesized
ttgcaaaaatgttttgtgaa

SEQ ID NO: 58203 - DNA, 20 bp, Artificial Sequence
  chemically synthesized
caaaacatttttgcaacctc

SEQ ID NO: 58204 - DNA, 20 bp, Artificial Sequence
  chemically synthesized
ctttaacccatttatgctgg

SEQ ID NO: 58205 - DNA, 20 bp, Artificial Sequence
  chemically synthesized
actttaacccatttatgctg

SEQ ID NO: 58206 - DNA, 20 bp, Artificial Sequence
  chemically synthesized
tttgcaacctccagcataaa

SEQ ID NO: 58207 - DNA, 20 bp, Artificial Sequence
  chemically synthesized
agactttaacccatttatgc

SEQ ID NO: 58208 - DNA, 20 bp, Artificial Sequence
  chemically synthesized
ttgcaacctccagcataaat

SEQ ID NO: 58209 - DNA, 20 bp, Artificial Sequence
  chemically synthesized
cctccagcataaatgggtta

SEQ ID NO: 58210 - DNA, 20 bp, Artificial Sequence
  chemically synthesized
cccagtaaatcaaatgggtg

SEQ ID NO: 58211 - DNA, 20 bp, Artificial Sequence
  chemically synthesized
ttgtccccagtaaatcaaat

SEQ ID NO: 58212 - DNA, 20 bp, Artificial Sequence
  chemically synthesized
gttgtccccagtaaatcaaa

SEQ ID NO: 58213 - DNA, 20 bp, Artificial Sequence
  chemically synthesized
tcttcacccatttgatttac

SEQ ID NO: 58214 - DNA, 20 bp, Artificial Sequence
  chemically synthesized
cttcacccatttgatttact

SEQ ID NO: 58215 - DNA, 20 bp, Artificial Sequence
  chemically synthesized
ttcacccatttgatttactg

SEQ ID NO: 58216 - DNA, 20 bp, Artificial Sequence
  chemically synthesized
tggcctttcagagttgtccc

SEQ ID NO: 58217 - DNA, 20 bp, Artificial Sequence
  chemically synthesized
tttactggggacaactctga

SEQ ID NO: 58218 - DNA, 20 bp, Artificial Sequence
  chemically synthesized
ttactggggacaactctgaa

SEQ ID NO: 58219 - DNA, 20 bp, Artificial Sequence
  chemically synthesized
ggagtaggtttggcctttca

SEQ ID NO: 58220 - DNA, 20 bp, Artificial Sequence
  chemically synthesized
ctggagtaggtttggccttt

SEQ ID NO: 58221 - DNA, 20 bp, Artificial Sequence
  chemically synthesized
gggaagctctggagtaggtt

SEQ ID NO: 58222 - DNA, 20 bp, Artificial Sequence
  chemically synthesized
ctgaaaggccaaacctactc

SEQ ID NO: 58223 - DNA, 20 bp, Artificial Sequence
  chemically synthesized
gaaaggccaaacctactcca

SEQ ID NO: 58224 - DNA, 20 bp, Artificial Sequence
  chemically synthesized
atgcagggaagctctggagt

SEQ ID NO: 58225 - DNA, 20 bp, Artificial Sequence
  chemically synthesized
catgcagggaagctctggag

SEQ ID NO: 58226 - DNA, 20 bp, Artificial Sequence
  chemically synthesized
gagcatgcagggaagctctg

SEQ ID NO: 58227 - DNA, 20 bp, Artificial Sequence
  chemically synthesized
aggagcatgcagggaagctc

SEQ ID NO: 58228 - DNA, 20 bp, Artificial Sequence
  chemically synthesized
tgcagcaggagcatgcaggg

SEQ ID NO: 58229 - DNA, 20 bp, Artificial Sequence
  chemically synthesized
ggctgcagcaggagcatgca

SEQ ID NO: 58230 - DNA, 20 bp, Artificial Sequence
  chemically synthesized
tggctgcagcaggagcatgc

SEQ ID NO: 58231 - DNA, 20 bp, Artificial Sequence
  chemically synthesized
atggctgcagcaggagcatg

SEQ ID NO: 58232 - DNA, 20 bp, Artificial Sequence
  chemically synthesized
ttccctgcatgctcctgctg

SEQ ID NO: 58233 - DNA, 20 bp, Artificial Sequence
  chemically synthesized
tgcaattatggctgcagcag

SEQ ID NO: 58234 - DNA, 20 bp, Artificial Sequence
  chemically synthesized
gttgcaattatggctgcagc

SEQ ID NO: 58235 - DNA, 20 bp, Artificial Sequence
  chemically synthesized
agttgcaattatggctgcag

SEQ ID NO: 58236 - DNA, 20 bp, Artificial Sequence
  chemically synthesized
tgcagttgcaattatggctg

SEQ ID NO: 58237 - DNA, 20 bp, Artificial Sequence
  chemically synthesized
tcaccatgcagttgcaatta

SEQ ID NO: 58238 - DNA, 20 bp, Artificial Sequence
  chemically synthesized
cagccataattgcaactgca

SEQ ID NO: 58239 - DNA, 20 bp, Artificial Sequence
  chemically synthesized
ggaaaagctggttcaccatg

SEQ ID NO: 58240 - DNA, 20 bp, Artificial Sequence
  chemically synthesized
attgcaactgcatggtgaac

SEQ ID NO: 58241 - DNA, 20 bp, Artificial Sequence
  chemically synthesized
tgactgcgcagaggaaaagc

SEQ ID NO: 58242 - DNA, 20 bp, Artificial Sequence
  chemically synthesized
ggcatgactgcgcagaggaa

SEQ ID NO: 58243 - DNA, 20 bp, Artificial Sequence
  chemically synthesized
gaaccagcttttcctctgcg

SEQ ID NO: 58244 - DNA, 20 bp, Artificial Sequence
  chemically synthesized
aaaggggcatgactgcgcag

SEQ ID NO: 58245 - DNA, 20 bp, Artificial Sequence
  chemically synthesized
gaaaggggcatgactgcgca

SEQ ID NO: 58246 - DNA, 20 bp, Artificial Sequence
  chemically synthesized
ctgaaaggggcatgactgcg

SEQ ID NO: 58247 - DNA, 20 bp, Artificial Sequence
  chemically synthesized
ctgcgcagtcatgccccttt

SEQ ID NO: 58248 - DNA, 20 bp, Artificial Sequence
  chemically synthesized
cacctctaagaaactgaaag

SEQ ID NO: 58249 - DNA, 20 bp, Artificial Sequence
  chemically synthesized
acacctctaagaaactgaaa

SEQ ID NO: 58250 - DNA, 20 bp, Artificial Sequence
  chemically synthesized
tacacctctaagaaactgaa

SEQ ID NO: 58251 - DNA, 20 bp, Artificial Sequence
  chemically synthesized
ttacacctctaagaaactga

SEQ ID NO: 58252 - DNA, 20 bp, Artificial Sequence
  chemically synthesized
tcatgcccctttcagtttct

SEQ ID NO: 58253 - DNA, 20 bp, Artificial Sequence
  chemically synthesized
atgcccctttcagtttctta

SEQ ID NO: 58254 - DNA, 20 bp, Artificial Sequence
  chemically synthesized
tgcccctttcagtttcttag

SEQ ID NO: 58255 - DNA, 20 bp, Artificial Sequence
  chemically synthesized
ctctcaggatttacacctct

SEQ ID NO: 58256 - DNA, 20 bp, Artificial Sequence
  chemically synthesized
ttcttagaggtgtaaatcct

SEQ ID NO: 58257 - DNA, 20 bp, Artificial Sequence
  chemically synthesized
cttagaggtgtaaatcctga

SEQ ID NO: 58258 - DNA, 20 bp, Artificial Sequence
  chemically synthesized
tcatactgggaagtgctctc

SEQ ID NO: 58259 - DNA, 20 bp, Artificial Sequence
  chemically synthesized
gtcatactgggaagtgctct

SEQ ID NO: 58260 - DNA, 20 bp, Artificial Sequence
  chemically synthesized
taaatcctgagagcacttcc

SEQ ID NO: 58261 - DNA, 20 bp, Artificial Sequence
  chemically synthesized
aggattattgtcatactggg

SEQ ID NO: 58262 - DNA, 20 bp, Artificial Sequence
  chemically synthesized
agaaggattattgtcatact

SEQ ID NO: 58263 - DNA, 20 bp, Artificial Sequence
  chemically synthesized
cagaaggattattgtcatac

SEQ ID NO: 58264 - DNA, 20 bp, Artificial Sequence
  chemically synthesized
tatgacaataatccttctgc

SEQ ID NO: 58265 - DNA, 20 bp, Artificial Sequence
  chemically synthesized
gttggagagttgcttgcaga

SEQ ID NO: 58266 - DNA, 20 bp, Artificial Sequence
  chemically synthesized
agttggagagttgcttgcag

SEQ ID NO: 58267 - DNA, 20 bp, Artificial Sequence
  chemically synthesized
agcagttggagagttgcttg

SEQ ID NO: 58268 - DNA, 20 bp, Artificial Sequence
  chemically synthesized
cagaagcagaagcagttgga

SEQ ID NO: 58269 - DNA, 20 bp, Artificial Sequence
  chemically synthesized
ctcagaagcagaagcagttg

SEQ ID NO: 58270 - DNA, 20 bp, Artificial Sequence
  chemically synthesized
ggctcagaagcagaagcagt

SEQ ID NO: 58271 - DNA, 20 bp, Artificial Sequence
  chemically synthesized
actaggctcagaagcagaag

SEQ ID NO: 58272 - DNA, 20 bp, Artificial Sequence
  chemically synthesized
aagactaggctcagaagcag

SEQ ID NO: 58273 - DNA, 20 bp, Artificial Sequence
  chemically synthesized
ctccaactgcttctgcttct

SEQ ID NO: 58274 - DNA, 20 bp, Artificial Sequence
  chemically synthesized
tccaagactaggctcagaag

SEQ ID NO: 58275 - DNA, 20 bp, Artificial Sequence
  chemically synthesized
actgcttctgcttctgagcc

SEQ ID NO: 58276 - DNA, 20 bp, Artificial Sequence
  chemically synthesized
ctctccaagactaggctcag

SEQ ID NO: 58277 - DNA, 20 bp, Artificial Sequence
  chemically synthesized
aggctctccaagactaggct

SEQ ID NO: 58278 - DNA, 20 bp, Artificial Sequence
  chemically synthesized
tctgcttctgagcctagtct

SEQ ID NO: 58279 - DNA, 20 bp, Artificial Sequence
  chemically synthesized
tgcttctgagcctagtcttg

SEQ ID NO: 58280 - DNA, 20 bp, Artificial Sequence
  chemically synthesized
ataaaaggctctccaagact

SEQ ID NO: 58281 - DNA, 20 bp, Artificial Sequence
  chemically synthesized
aataaaaggctctccaagac

SEQ ID NO: 58282 - DNA, 20 bp, Artificial Sequence
  chemically synthesized
cttctgagcctagtcttgga

SEQ ID NO: 58283 - DNA, 20 bp, Artificial Sequence
  chemically synthesized
ttaggaataaaaggctctcc

SEQ ID NO: 58284 - DNA, 20 bp, Artificial Sequence
  chemically synthesized
tttcacagattaggaataaa

SEQ ID NO: 58285 - DNA, 20 bp, Artificial Sequence
  chemically synthesized
ctttcacagattaggaataa

SEQ ID NO: 58286 - DNA, 20 bp, Artificial Sequence
  chemically synthesized
ttttttccctttcacagatt

SEQ ID NO: 58287 - DNA, 20 bp, Artificial Sequence
  chemically synthesized
cttttttccctttcacagat

SEQ ID NO: 58288 - DNA, 20 bp, Artificial Sequence
  chemically synthesized
cttttattcctaatctgtga

SEQ ID NO: 58289 - DNA, 20 bp, Artificial Sequence
  chemically synthesized
ttttattcctaatctgtgaa

SEQ ID NO: 58290 - DNA, 20 bp, Artificial Sequence
  chemically synthesized
tttattcctaatctgtgaaa

SEQ ID NO: 58291 - DNA, 20 bp, Artificial Sequence
  chemically synthesized
tgtaccttttttccctttca

SEQ ID NO: 58292 - DNA, 20 bp, Artificial Sequence
  chemically synthesized
ctaatctgtgaaagggaaaa

SEQ ID NO: 58293 - DNA, 20 bp, Artificial Sequence
  chemically synthesized
taatctgtgaaagggaaaaa

SEQ ID NO: 58294 - DNA, 20 bp, Artificial Sequence
  chemically synthesized
tgaaagggaaaaaaggtaca

SEQ ID NO: 58295 - DNA, 20 bp, Artificial Sequence
  chemically synthesized
aaaggtacacagttgttatt

SEQ ID NO: 58296 - DNA, 20 bp, Artificial Sequence
  chemically synthesized
aggtacacagttgttattga

SEQ ID NO: 58297 - DNA, 20 bp, Artificial Sequence
  chemically synthesized
gttgttattgagagttgtgc

SEQ ID NO: 58298 - DNA, 20 bp, Artificial Sequence
  chemically synthesized
ttgttattgagagttgtgct

SEQ ID NO: 58299 - DNA, 20 bp, Artificial Sequence
  chemically synthesized
acatgatctcgttttattcc

SEQ ID NO: 58300 - DNA, 20 bp, Artificial Sequence
  chemically synthesized
agttgtgctgggaataaaac

SEQ ID NO: 58301 - DNA, 20 bp, Artificial Sequence
  chemically synthesized
ataaaacgagatcatgtgct

SEQ ID NO: 58302 - DNA, 20 bp, Artificial Sequence
  chemically synthesized
aaacgagatcatgtgcttgg

SEQ ID NO: 58303 - DNA, 20 bp, Artificial Sequence
  chemically synthesized
cttgaacacggttttctgcc

SEQ ID NO: 58304 - DNA, 20 bp, Artificial Sequence
  chemically synthesized
cttggcagaaaaccgtgttc

SEQ ID NO: 58305 - DNA, 20 bp, Artificial Sequence
  chemically synthesized
tagctgtcattgcttgaaca

SEQ ID NO: 58306 - DNA, 20 bp, Artificial Sequence
  chemically synthesized
aaaccgtgttcaagcaatga

SEQ ID NO: 58307 - DNA, 20 bp, Artificial Sequence
  chemically synthesized
gttcaagcaatgacagctaa

SEQ ID NO: 58308 - DNA, 20 bp, Artificial Sequence
  chemically synthesized
ttcaagcaatgacagctaat

SEQ ID NO: 58309 - DNA, 20 bp, Artificial Sequence
  chemically synthesized
tgtcctcaagtatcacctat

SEQ ID NO: 58310 - DNA, 20 bp, Artificial Sequence
  chemically synthesized
acagctaataggtgatactt

SEQ ID NO: 58311 - DNA, 20 bp, Artificial Sequence
  chemically synthesized
cagctaataggtgatacttg

SEQ ID NO: 58312 - DNA, 20 bp, Artificial Sequence
  chemically synthesized
tcacgtagcataatgtcctc

SEQ ID NO: 58313 - DNA, 20 bp, Artificial Sequence
  chemically synthesized
ttggactggcttatttcacg

SEQ ID NO: 58314 - DNA, 20 bp, Artificial Sequence
  chemically synthesized
gacattatgctacgtgaaat

SEQ ID NO: 58315 - DNA, 20 bp, Artificial Sequence
  chemically synthesized
ttatgctacgtgaaataagc

SEQ ID NO: 58316 - DNA, 20 bp, Artificial Sequence
  chemically synthesized
gtgaaataagccagtccaaa

SEQ ID NO: 58317 - DNA, 20 bp, Artificial Sequence
  chemically synthesized
gtatttgttcctttttggac

SEQ ID NO: 58318 - DNA, 20 bp, Artificial Sequence
  chemically synthesized
tgaaataagccagtccaaaa

SEQ ID NO: 58319 - DNA, 20 bp, Artificial Sequence
  chemically synthesized
atacagtatttgttcctttt

SEQ ID NO: 58320 - DNA, 20 bp, Artificial Sequence
  chemically synthesized
atcatgtaagcggaattata

SEQ ID NO: 58321 - DNA, 20 bp, Artificial Sequence
  chemically synthesized
ttctaggaacatcatgtaag

SEQ ID NO: 58322 - DNA, 20 bp, Artificial Sequence
  chemically synthesized
ctattctaggaacatcatgt

SEQ ID NO: 58323 - DNA, 20 bp, Artificial Sequence
  chemically synthesized
ttccgcttacatgatgttcc

SEQ ID NO: 58324 - DNA, 20 bp, Artificial Sequence
  chemically synthesized
cttacatgatgttcctagaa

SEQ ID NO: 58325 - DNA, 20 bp, Artificial Sequence
  chemically synthesized
tctatgcatttgactattct

SEQ ID NO: 58326 - DNA, 20 bp, Artificial Sequence
  chemically synthesized
ctctatgcatttgactattc

SEQ ID NO: 58327 - DNA, 20 bp, Artificial Sequence
  chemically synthesized
tcctagaatagtcaaatgca

SEQ ID NO: 58328 - DNA, 20 bp, Artificial Sequence
  chemically synthesized
ctagaatagtcaaatgcata

SEQ ID NO: 58329 - DNA, 20 bp, Artificial Sequence
  chemically synthesized
aatagtcaaatgcatagaga

SEQ ID NO: 58330 - DNA, 20 bp, Artificial Sequence
  chemically synthesized
gtcaaatgcatagagacgga

SEQ ID NO: 58331 - DNA, 20 bp, Artificial Sequence
  chemically synthesized
aaatgcatagagacggaaag

SEQ ID NO: 58332 - DNA, 20 bp, Artificial Sequence
  chemically synthesized
gcatagagacggaaagtaga

SEQ ID NO: 58333 - DNA, 20 bp, Artificial Sequence
  chemically synthesized
agagacggaaagtagaaaga

SEQ ID NO: 58334 - DNA, 20 bp, Artificial Sequence
  chemically synthesized
gaaagtagaaagatggctgc

SEQ ID NO: 58335 - DNA, 20 bp, Artificial Sequence
  chemically synthesized
aaagtagaaagatggctgcc

SEQ ID NO: 58336 - DNA, 20 bp, Artificial Sequence
  chemically synthesized
aagtagaaagatggctgcca

SEQ ID NO: 58337 - DNA, 20 bp, Artificial Sequence
  chemically synthesized
agtagaaagatggctgccag

SEQ ID NO: 58338 - DNA, 20 bp, Artificial Sequence
  chemically synthesized
tcctttcccccagcccctgg

SEQ ID NO: 58339 - DNA, 20 bp, Artificial Sequence
  chemically synthesized
gaaagatggctgccaggggc

SEQ ID NO: 58340 - DNA, 20 bp, Artificial Sequence
  chemically synthesized
aaagatggctgccaggggct

SEQ ID NO: 58341 - DNA, 20 bp, Artificial Sequence
  chemically synthesized
aagatggctgccaggggctg

SEQ ID NO: 58342 - DNA, 20 bp, Artificial Sequence
  chemically synthesized
tcctcctttcccccagcccc

SEQ ID NO: 58343 - DNA, 20 bp, Artificial Sequence
  chemically synthesized
agatggctgccaggggctgg

SEQ ID NO: 58344 - DNA, 20 bp, Artificial Sequence
  chemically synthesized
ggctgccaggggctggggga

SEQ ID NO: 58345 - DNA, 20 bp, Artificial Sequence
  chemically synthesized
gctgccaggggctgggggaa

SEQ ID NO: 58346 - DNA, 20 bp, Artificial Sequence
  chemically synthesized
tctcatttcctcctttcccc

SEQ ID NO: 58347 - DNA, 20 bp, Artificial Sequence
  chemically synthesized
tgccaggggctgggggaaag

SEQ ID NO: 58348 - DNA, 20 bp, Artificial Sequence
  chemically synthesized
gccaggggctgggggaaagg

SEQ ID NO: 58349 - DNA, 20 bp, Artificial Sequence
  chemically synthesized
gctgggggaaaggaggaaat

SEQ ID NO: 58350 - DNA, 20 bp, Artificial Sequence
  chemically synthesized
gggggaaaggaggaaatgag

SEQ ID NO: 58351 - DNA, 20 bp, Artificial Sequence
  chemically synthesized
ggaaaggaggaaatgagaag

SEQ ID NO: 58352 - DNA, 20 bp, Artificial Sequence
  chemically synthesized
ggaaatgagaagtggtttaa

SEQ ID NO: 58353 - DNA, 20 bp, Artificial Sequence
  chemically synthesized
gaaatgagaagtggtttaat

SEQ ID NO: 58354 - DNA, 20 bp, Artificial Sequence
  chemically synthesized
gagaagtggtttaatgggta

SEQ ID NO: 58355 - DNA, 20 bp, Artificial Sequence
  chemically synthesized
tggtttaatgggtacagttt

SEQ ID NO: 58356 - DNA, 20 bp, Artificial Sequence
  chemically synthesized
gggtacagtttcagatttgc

SEQ ID NO: 58357 - DNA, 20 bp, Artificial Sequence
  chemically synthesized
ggtacagtttcagatttgca

SEQ ID NO: 58358 - DNA, 20 bp, Artificial Sequence
  chemically synthesized
ttcagatttgcaaggtgaaa

SEQ ID NO: 58359 - DNA, 20 bp, Artificial Sequence
  chemically synthesized
gcaaggtgaaaaagttctgc

SEQ ID NO: 58360 - DNA, 20 bp, Artificial Sequence
  chemically synthesized
gttgtcatgtagtggacttg

SEQ ID NO: 58361 - DNA, 20 bp, Artificial Sequence
  chemically synthesized
atattcatgttgtcatgtag

SEQ ID NO: 58362 - DNA, 20 bp, Artificial Sequence
  chemically synthesized
agtatattcatgttgtcatg

SEQ ID NO: 58363 - DNA, 20 bp, Artificial Sequence
  chemically synthesized
gagtatagttcagtaatgtt

SEQ ID NO: 58364 - DNA, 20 bp, Artificial Sequence
  chemically synthesized
ccattttttagagtatagtt

SEQ ID NO: 58365 - DNA, 20 bp, Artificial Sequence
  chemically synthesized
tttaaccattttttagagta

SEQ ID NO: 58366 - DNA, 20 bp, Artificial Sequence
  chemically synthesized
ctgaactatactctaaaaaa

SEQ ID NO: 58367 - DNA, 20 bp, Artificial Sequence
  chemically synthesized
accattttaaccatttttta

SEQ ID NO: 58368 - DNA, 20 bp, Artificial Sequence
  chemically synthesized
ttaccattttaaccattttt

SEQ ID NO: 58369 - DNA, 20 bp, Artificial Sequence
  chemically synthesized
actctaaaaaatggttaaaa

SEQ ID NO: 58370 - DNA, 20 bp, Artificial Sequence
  chemically synthesized
atttctttcttttcaaattg

SEQ ID NO: 58371 - DNA, 20 bp, Artificial Sequence
  chemically synthesized
tgtttttaccacaatttgaa

SEQ ID NO: 58372 - DNA, 20 bp, Artificial Sequence
  chemically synthesized
tttaccacaatttgaaaaga

SEQ ID NO: 58373 - DNA, 20 bp, Artificial Sequence
  chemically synthesized
atttgaaaagaaagaaatga

SEQ ID NO: 58374 - DNA, 20 bp, Artificial Sequence
  chemically synthesized
aaatggaatcaatggtatgg

SEQ ID NO: 58375 - DNA, 20 bp, Artificial Sequence
  chemically synthesized
attaaatggaatcaatggta

SEQ ID NO: 58376 - DNA, 20 bp, Artificial Sequence
  chemically synthesized
aatcaattaaatggaatcaa

SEQ ID NO: 58377 - DNA, 20 bp, Artificial Sequence
  chemically synthesized
tgtgggtaaaatcaattaaa

SEQ ID NO: 58378 - DNA, 20 bp, Artificial Sequence
  chemically synthesized
atttaattgattttacccac

SEQ ID NO: 58379 - DNA, 20 bp, Artificial Sequence
  chemically synthesized
taattgattttacccacaag

SEQ ID NO: 58380 - DNA, 20 bp, Artificial Sequence
  chemically synthesized
aattgattttacccacaagc

SEQ ID NO: 58381 - DNA, 20 bp, Artificial Sequence
  chemically synthesized
cagaaaaggtacctgcttgt

SEQ ID NO: 58382 - DNA, 20 bp, Artificial Sequence
  chemically synthesized
ccagaaaaggtacctgcttg

SEQ ID NO: 58383 - DNA, 20 bp, Artificial Sequence
  chemically synthesized
ccacaagcaggtaccttttc

SEQ ID NO: 58384 - DNA, 20 bp, Artificial Sequence
  chemically synthesized
aatacaggagaagccagaaa

SEQ ID NO: 58385 - DNA, 20 bp, Artificial Sequence
  chemically synthesized
aaatacaggagaagccagaa

SEQ ID NO: 58386 - DNA, 20 bp, Artificial Sequence
  chemically synthesized
tgagaaaatacaggagaagc

SEQ ID NO: 58387 - DNA, 20 bp, Artificial Sequence
  chemically synthesized
aggatgagaaaatacaggag

SEQ ID NO: 58388 - DNA, 20 bp, Artificial Sequence
  chemically synthesized
aacaggatgagaaaatacag

SEQ ID NO: 58389 - DNA, 20 bp, Artificial Sequence
  chemically synthesized
ccaacaggatgagaaaatac

SEQ ID NO: 58390 - DNA, 20 bp, Artificial Sequence
  chemically synthesized
cccaacaggatgagaaaata

SEQ ID NO: 58391 - DNA, 20 bp, Artificial Sequence
  chemically synthesized
cctgtattttctcatcctgt

SEQ ID NO: 58392 - DNA, 20 bp, Artificial Sequence
  chemically synthesized
taggtcccacccaacaggat

SEQ ID NO: 58393 - DNA, 20 bp, Artificial Sequence
  chemically synthesized
ctgtattttctcatcctgtt

SEQ ID NO: 58394 - DNA, 20 bp, Artificial Sequence
  chemically synthesized
tattttctcatcctgttggg

SEQ ID NO: 58395 - DNA, 20 bp, Artificial Sequence
  chemically synthesized
attttctcatcctgttgggt

SEQ ID NO: 58396 - DNA, 20 bp, Artificial Sequence
  chemically synthesized
aactataggtcccacccaac

SEQ ID NO: 58397 - DNA, 20 bp, Artificial Sequence
  chemically synthesized
aaactataggtcccacccaa

SEQ ID NO: 58398 - DNA, 20 bp, Artificial Sequence
  chemically synthesized
atcctgttgggtgggaccta

SEQ ID NO: 58399 - DNA, 20 bp, Artificial Sequence
  chemically synthesized
tcaatcatgtttgaaactat

SEQ ID NO: 58400 - DNA, 20 bp, Artificial Sequence
  chemically synthesized
ttcaatcatgtttgaaacta

SEQ ID NO: 58401 - DNA, 20 bp, Artificial Sequence
  chemically synthesized
tatagtttcaaacatgattg

SEQ ID NO: 58402 - DNA, 20 bp, Artificial Sequence
  chemically synthesized
agggtgtcagaggaggcagg

SEQ ID NO: 58403 - DNA, 20 bp, Artificial Sequence
  chemically synthesized
ccagggtgtcagaggaggca

SEQ ID NO: 58404 - DNA, 20 bp, Artificial Sequence
  chemically synthesized
tccagggtgtcagaggaggc

SEQ ID NO: 58405 - DNA, 20 bp, Artificial Sequence
  chemically synthesized
atccagggtgtcagaggagg

SEQ ID NO: 58406 - DNA, 20 bp, Artificial Sequence
  chemically synthesized
aatatccagggtgtcagagg

SEQ ID NO: 58407 - DNA, 20 bp, Artificial Sequence
  chemically synthesized
taatatccagggtgtcagag

SEQ ID NO: 58408 - DNA, 20 bp, Artificial Sequence
  chemically synthesized
cgtaatatccagggtgtcag

SEQ ID NO: 58409 - DNA, 20 bp, Artificial Sequence
  chemically synthesized
acgtaatatccagggtgtca

SEQ ID NO: 58410 - DNA, 20 bp, Artificial Sequence
  chemically synthesized
ccctgcctcctctgacaccc

SEQ ID NO: 58411 - DNA, 20 bp, Artificial Sequence
  chemically synthesized
agacgtaatatccagggtgt

SEQ ID NO: 58412 - DNA, 20 bp, Artificial Sequence
  chemically synthesized
ttacggagacgtaatatcca

SEQ ID NO: 58413 - DNA, 20 bp, Artificial Sequence
  chemically synthesized
attacggagacgtaatatcc

SEQ ID NO: 58414 - DNA, 20 bp, Artificial Sequence
  chemically synthesized
gattacggagacgtaatatc

SEQ ID NO: 58415 - DNA, 20 bp, Artificial Sequence
  chemically synthesized
gtgtaaaaaatcagattacg

SEQ ID NO: 58416 - DNA, 20 bp, Artificial Sequence
  chemically synthesized
tggtgtaaaaaatcagatta

SEQ ID NO: 58417 - DNA, 20 bp, Artificial Sequence
  chemically synthesized
gaaacattggtgtaaaaaat

SEQ ID NO: 58418 - DNA, 20 bp, Artificial Sequence
  chemically synthesized
tgtgtggagattagaaacat

SEQ ID NO: 58419 - DNA, 20 bp, Artificial Sequence
  chemically synthesized
ctaaagagatgtgtggagat

SEQ ID NO: 58420 - DNA, 20 bp, Artificial Sequence
  chemically synthesized
aaagtctaaagagatgtgtg

SEQ ID NO: 58421 - DNA, 20 bp, Artificial Sequence
  chemically synthesized
ctaaagtctaaagagatgtg

SEQ ID NO: 58422 - DNA, 20 bp, Artificial Sequence
  chemically synthesized
ctaatctccacacatctctt

SEQ ID NO: 58423 - DNA, 20 bp, Artificial Sequence
  chemically synthesized
gagagaatctaaagtctaaa

SEQ ID NO: 58424 - DNA, 20 bp, Artificial Sequence
  chemically synthesized
ccacacatctctttagactt

SEQ ID NO: 58425 - DNA, 20 bp, Artificial Sequence
  chemically synthesized
atgagagaatctaaagtcta

SEQ ID NO: 58426 - DNA, 20 bp, Artificial Sequence
  chemically synthesized
tcagctcatgagagaatcta

SEQ ID NO: 58427 - DNA, 20 bp, Artificial Sequence
  chemically synthesized
tagactttagattctctcat

SEQ ID NO: 58428 - DNA, 20 bp, Artificial Sequence
  chemically synthesized
agggtgatttcagctcatga

SEQ ID NO: 58429 - DNA, 20 bp, Artificial Sequence
  chemically synthesized
ccagggtgatttcagctcat

SEQ ID NO: 58430 - DNA, 20 bp, Artificial Sequence
  chemically synthesized
agcctatgccagggtgattt

SEQ ID NO: 58431 - DNA, 20 bp, Artificial Sequence
  chemically synthesized
ctcatgagctgaaatcaccc

SEQ ID NO: 58432 - DNA, 20 bp, Artificial Sequence
  chemically synthesized
gagctgaaatcaccctggca

SEQ ID NO: 58433 - DNA, 20 bp, Artificial Sequence
  chemically synthesized
agctgaaatcaccctggcat

SEQ ID NO: 58434 - DNA, 20 bp, Artificial Sequence
  chemically synthesized
gttcctcagagcctatgcca

SEQ ID NO: 58435 - DNA, 20 bp, Artificial Sequence
  chemically synthesized
agttcctcagagcctatgcc

SEQ ID NO: 58436 - DNA, 20 bp, Artificial Sequence
  chemically synthesized
cagttcctcagagcctatgc

SEQ ID NO: 58437 - DNA, 20 bp, Artificial Sequence
  chemically synthesized
atcaccctggcataggctct

SEQ ID NO: 58438 - DNA, 20 bp, Artificial Sequence
  chemically synthesized
tcaccctggcataggctctg

SEQ ID NO: 58439 - DNA, 20 bp, Artificial Sequence
  chemically synthesized
tgcttccatgcagttcctca

SEQ ID NO: 58440 - DNA, 20 bp, Artificial Sequence
  chemically synthesized
tttgcttccatgcagttcct

SEQ ID NO: 58441 - DNA, 20 bp, Artificial Sequence
  chemically synthesized
ataggctctgaggaactgca

SEQ ID NO: 58442 - DNA, 20 bp, Artificial Sequence
  chemically synthesized
ggctctgaggaactgcatgg

SEQ ID NO: 58443 - DNA, 20 bp, Artificial Sequence
  chemically synthesized
tagtgctgtttgcttccatg

SEQ ID NO: 58444 - DNA, 20 bp, Artificial Sequence
  chemically synthesized
aggaactgcatggaagcaaa

SEQ ID NO: 58445 - DNA, 20 bp, Artificial Sequence
  chemically synthesized
gttagaggaaggaaggaaaa

SEQ ID NO: 58446 - DNA, 20 bp, Artificial Sequence
  chemically synthesized
ctgttttgttagaggaagga

SEQ ID NO: 58447 - DNA, 20 bp, Artificial Sequence
  chemically synthesized
tctgttttgttagaggaagg

SEQ ID NO: 58448 - DNA, 20 bp, Artificial Sequence
  chemically synthesized
agatctgttttgttagagga

SEQ ID NO: 58449 - DNA, 20 bp, Artificial Sequence
  chemically synthesized
gagatctgttttgttagagg

SEQ ID NO: 58450 - DNA, 20 bp, Artificial Sequence
  chemically synthesized
aaagagatctgttttgttag

SEQ ID NO: 58451 - DNA, 20 bp, Artificial Sequence
  chemically synthesized
taaagagatctgttttgtta

SEQ ID NO: 58452 - DNA, 20 bp, Artificial Sequence
  chemically synthesized
ccttccttcctctaacaaaa

SEQ ID NO: 58453 - DNA, 20 bp, Artificial Sequence
  chemically synthesized
tttaaagagatctgttttgt

SEQ ID NO: 58454 - DNA, 20 bp, Artificial Sequence
  chemically synthesized
gttatggtggtgattttaaa

SEQ ID NO: 58455 - DNA, 20 bp, Artificial Sequence
  chemically synthesized
aggttatggtggtgatttta

SEQ ID NO: 58456 - DNA, 20 bp, Artificial Sequence
  chemically synthesized
tgcttttcgaaaggttatgg

SEQ ID NO: 58457 - DNA, 20 bp, Artificial Sequence
  chemically synthesized
atgtgcttttcgaaaggtta

SEQ ID NO: 58458 - DNA, 20 bp, Artificial Sequence
  chemically synthesized
caccaccataacctttcgaa

SEQ ID NO: 58459 - DNA, 20 bp, Artificial Sequence
  chemically synthesized
agtttgatgtgcttttcgaa

SEQ ID NO: 58460 - DNA, 20 bp, Artificial Sequence
  chemically synthesized
cagtttgatgtgcttttcga

SEQ ID NO: 58461 - DNA, 20 bp, Artificial Sequence
  chemically synthesized
atttcttttgtatcatgatg

SEQ ID NO: 58462 - DNA, 20 bp, Artificial Sequence
  chemically synthesized
caaactgcatcatgatacaa

SEQ ID NO: 58463 - DNA, 20 bp, Artificial Sequence
  chemically synthesized
caaaagaaattatactctgt

SEQ ID NO: 58464 - DNA, 20 bp, Artificial Sequence
  chemically synthesized
tcaacaacctggcaccgaca

SEQ ID NO: 58465 - DNA, 20 bp, Artificial Sequence
  chemically synthesized
aaattatactctgtcggtgc

SEQ ID NO: 58466 - DNA, 20 bp, Artificial Sequence
  chemically synthesized
tttcaacaacctggcaccga

SEQ ID NO: 58467 - DNA, 20 bp, Artificial Sequence
  chemically synthesized
aattatactctgtcggtgcc

SEQ ID NO: 58468 - DNA, 20 bp, Artificial Sequence
  chemically synthesized
atcccttattttcaacaacc

SEQ ID NO: 58469 - DNA, 20 bp, Artificial Sequence
  chemically synthesized
ggtgccaggttgttgaaaat

SEQ ID NO: 58470 - DNA, 20 bp, Artificial Sequence
  chemically synthesized
gtgccaggttgttgaaaata

SEQ ID NO: 58471 - DNA, 20 bp, Artificial Sequence
  chemically synthesized
tgccaggttgttgaaaataa

SEQ ID NO: 58472 - DNA, 20 bp, Artificial Sequence
  chemically synthesized
gttgttgaaaataagggatt

SEQ ID NO: 58473 - DNA, 20 bp, Artificial Sequence
  chemically synthesized
tgaaaataagggattgagat

SEQ ID NO: 58474 - DNA, 20 bp, Artificial Sequence
  chemically synthesized
gaaaataagggattgagatc

SEQ ID NO: 58475 - DNA, 20 bp, Artificial Sequence
  chemically synthesized
aaataagggattgagatcag

SEQ ID NO: 58476 - DNA, 20 bp, Artificial Sequence
  chemically synthesized
agggattgagatcaggagtc

SEQ ID NO: 58477 - DNA, 20 bp, Artificial Sequence
  chemically synthesized
gggattgagatcaggagtct

SEQ ID NO: 58478 - DNA, 20 bp, Artificial Sequence
  chemically synthesized
ggattgagatcaggagtctg

SEQ ID NO: 58479 - DNA, 20 bp, Artificial Sequence
  chemically synthesized
ttgagatcaggagtctgggg

SEQ ID NO: 58480 - DNA, 20 bp, Artificial Sequence
  chemically synthesized
attatatctgtcaacttccc

SEQ ID NO: 58481 - DNA, 20 bp, Artificial Sequence
  chemically synthesized
caggagtctggggaagttga

SEQ ID NO: 58482 - DNA, 20 bp, Artificial Sequence
  chemically synthesized
gacagatataatgatgtgct

SEQ ID NO: 58483 - DNA, 20 bp, Artificial Sequence
  chemically synthesized
caaaatccatcaggatatct

SEQ ID NO: 58484 - DNA, 20 bp, Artificial Sequence
  chemically synthesized
gatgtgcttagatatcctga

SEQ ID NO: 58485 - DNA, 20 bp, Artificial Sequence
  chemically synthesized
aatctgtgtcaaaatccatc

SEQ ID NO: 58486 - DNA, 20 bp, Artificial Sequence
  chemically synthesized
gaatctgtgtcaaaatccat

SEQ ID NO: 58487 - DNA, 20 bp, Artificial Sequence
  chemically synthesized
tatcctgatggattttgaca

SEQ ID NO: 58488 - DNA, 20 bp, Artificial Sequence
  chemically synthesized
tttgacacagattctctgct

SEQ ID NO: 58489 - DNA, 20 bp, Artificial Sequence
  chemically synthesized
ttgacacagattctctgctt

SEQ ID NO: 58490 - DNA, 20 bp, Artificial Sequence
  chemically synthesized
tgacacagattctctgcttg

SEQ ID NO: 58491 - DNA, 20 bp, Artificial Sequence
  chemically synthesized
gacacagattctctgcttgg

SEQ ID NO: 58492 - DNA, 20 bp, Artificial Sequence
  chemically synthesized
attacactcacccccaagca

SEQ ID NO: 58493 - DNA, 20 bp, Artificial Sequence
  chemically synthesized
taattacactcacccccaag

SEQ ID NO: 58494 - DNA, 20 bp, Artificial Sequence
  chemically synthesized
cagattctctgcttgggggt

SEQ ID NO: 58495 - DNA, 20 bp, Artificial Sequence
  chemically synthesized
tagtaattacactcaccccc

SEQ ID NO: 58496 - DNA, 20 bp, Artificial Sequence
  chemically synthesized
gagtgtaattactatttgta

SEQ ID NO: 58497 - DNA, 20 bp, Artificial Sequence
  chemically synthesized
gactctgctctctgtacaaa

SEQ ID NO: 58498 - DNA, 20 bp, Artificial Sequence
  chemically synthesized
gtgtaattactatttgtaca

SEQ ID NO: 58499 - DNA, 20 bp, Artificial Sequence
  chemically synthesized
gtaattactatttgtacaga

SEQ ID NO: 58500 - DNA, 20 bp, Artificial Sequence
  chemically synthesized
attactatttgtacagagag

SEQ ID NO: 58501 - DNA, 20 bp, Artificial Sequence
  chemically synthesized
tactatttgtacagagagca

SEQ ID NO: 58502 - DNA, 20 bp, Artificial Sequence
  chemically synthesized
tttgtacagagagcagagtc

SEQ ID NO: 58503 - DNA, 20 bp, Artificial Sequence
  chemically synthesized
ttgtacagagagcagagtca

SEQ ID NO: 58504 - DNA, 20 bp, Artificial Sequence
  chemically synthesized
acagagagcagagtcaaggt

SEQ ID NO: 58505 - DNA, 20 bp, Artificial Sequence
  chemically synthesized
agagtcaaggtcagaaaata

SEQ ID NO: 58506 - DNA, 20 bp, Artificial Sequence
  chemically synthesized
gagtcaaggtcagaaaatac

SEQ ID NO: 58507 - DNA, 20 bp, Artificial Sequence
  chemically synthesized
gtcaaggtcagaaaatacag

SEQ ID NO: 58508 - DNA, 20 bp, Artificial Sequence
  chemically synthesized
caaggtcagaaaatacagga

SEQ ID NO: 58509 - DNA, 20 bp, Artificial Sequence
  chemically synthesized
aaggtcagaaaatacaggag

SEQ ID NO: 58510 - DNA, 20 bp, Artificial Sequence
  chemically synthesized
aggtcagaaaatacaggaga

SEQ ID NO: 58511 - DNA, 20 bp, Artificial Sequence
  chemically synthesized
atacaggagagggacccatc

SEQ ID NO: 58512 - DNA, 20 bp, Artificial Sequence
  chemically synthesized
gtcctctactttagcttgat

SEQ ID NO: 58513 - DNA, 20 bp, Artificial Sequence
  chemically synthesized
agtcctctactttagcttga

SEQ ID NO: 58514 - DNA, 20 bp, Artificial Sequence
  chemically synthesized
gagagggacccatcaagcta

SEQ ID NO: 58515 - DNA, 20 bp, Artificial Sequence
  chemically synthesized
agggacccatcaagctaaag

SEQ ID NO: 58516 - DNA, 20 bp, Artificial Sequence
  chemically synthesized
ggacccatcaagctaaagta

SEQ ID NO: 58517 - DNA, 20 bp, Artificial Sequence
  chemically synthesized
gacccatcaagctaaagtag

SEQ ID NO: 58518 - DNA, 20 bp, Artificial Sequence
  chemically synthesized
cactttaaagtcctctactt

SEQ ID NO: 58519 - DNA, 20 bp, Artificial Sequence
  chemically synthesized
agctaaagtagaggacttta

SEQ ID NO: 58520 - DNA, 20 bp, Artificial Sequence
  chemically synthesized
taaagtagaggactttaaag

SEQ ID NO: 58521 - DNA, 20 bp, Artificial Sequence
  chemically synthesized
aaaactccccaaccacttta

SEQ ID NO: 58522 - DNA, 20 bp, Artificial Sequence
  chemically synthesized
gtagaggactttaaagtggt

SEQ ID NO: 58523 - DNA, 20 bp, Artificial Sequence
  chemically synthesized
tagaggactttaaagtggtt

SEQ ID NO: 58524 - DNA, 20 bp, Artificial Sequence
  chemically synthesized
agaggactttaaagtggttg

SEQ ID NO: 58525 - DNA, 20 bp, Artificial Sequence
  chemically synthesized
aggactttaaagtggttggg

SEQ ID NO: 58526 - DNA, 20 bp, Artificial Sequence
  chemically synthesized
gttggggagtttttgttatt

SEQ ID NO: 58527 - DNA, 20 bp, Artificial Sequence
  chemically synthesized
ggggagtttttgttattcag

SEQ ID NO: 58528 - DNA, 20 bp, Artificial Sequence
  chemically synthesized
tgttattcagaagctcaaac

SEQ ID NO: 58529 - DNA, 20 bp, Artificial Sequence
  chemically synthesized
tttgtcctgctgaccagttt

SEQ ID NO: 58530 - DNA, 20 bp, Artificial Sequence
  chemically synthesized
attcagaagctcaaactggt

SEQ ID NO: 58531 - DNA, 20 bp, Artificial Sequence
  chemically synthesized
cagaagctcaaactggtcag

SEQ ID NO: 58532 - DNA, 20 bp, Artificial Sequence
  chemically synthesized
agaagctcaaactggtcagc

SEQ ID NO: 58533 - DNA, 20 bp, Artificial Sequence
  chemically synthesized
tattcttttgtcctgctgac

SEQ ID NO: 58534 - DNA, 20 bp, Artificial Sequence
  chemically synthesized
caaactggtcagcaggacaa

SEQ ID NO: 58535 - DNA, 20 bp, Artificial Sequence
  chemically synthesized
cagcaggacaaaagaatata

SEQ ID NO: 58536 - DNA, 20 bp, Artificial Sequence
  chemically synthesized
gcaggacaaaagaatataca

SEQ ID NO: 58537 - DNA, 20 bp, Artificial Sequence
  chemically synthesized
gacaaaagaatatacagagt

SEQ ID NO: 58538 - DNA, 20 bp, Artificial Sequence
  chemically synthesized
acaaaagaatatacagagtc

SEQ ID NO: 58539 - DNA, 20 bp, Artificial Sequence
  chemically synthesized
caaaagaatatacagagtca

SEQ ID NO: 58540 - DNA, 20 bp, Artificial Sequence
  chemically synthesized
gaatatacagagtcagggta

SEQ ID NO: 58541 - DNA, 20 bp, Artificial Sequence
  chemically synthesized
aatatacagagtcagggtat

SEQ ID NO: 58542 - DNA, 20 bp, Artificial Sequence
  chemically synthesized
atacagagtcagggtatggg

SEQ ID NO: 58543 - DNA, 20 bp, Artificial Sequence
  chemically synthesized
tacagagtcagggtatgggc

SEQ ID NO: 58544 - DNA, 20 bp, Artificial Sequence
  chemically synthesized
acagagtcagggtatgggca

SEQ ID NO: 58545 - DNA, 20 bp, Artificial Sequence
  chemically synthesized
cagagtcagggtatgggcag

SEQ ID NO: 58546 - DNA, 20 bp, Artificial Sequence
  chemically synthesized
aatttctggatattggatat

SEQ ID NO: 58547 - DNA, 20 bp, Artificial Sequence
  chemically synthesized
aggggccaatatccaatatc

SEQ ID NO: 58548 - DNA, 20 bp, Artificial Sequence
  chemically synthesized
agacaggaatttctggatat

SEQ ID NO: 58549 - DNA, 20 bp, Artificial Sequence
  chemically synthesized
tcttgctagacaggaatttc

SEQ ID NO: 58550 - DNA, 20 bp, Artificial Sequence
  chemically synthesized
aatatccagaaattcctgtc

SEQ ID NO: 58551 - DNA, 20 bp, Artificial Sequence
  chemically synthesized
tccagaaattcctgtctagc

SEQ ID NO: 58552 - DNA, 20 bp, Artificial Sequence
  chemically synthesized
cctctccattcttgctagac

SEQ ID NO: 58553 - DNA, 20 bp, Artificial Sequence
  chemically synthesized
tcctctccattcttgctaga

SEQ ID NO: 58554 - DNA, 20 bp, Artificial Sequence
  chemically synthesized
aaattcctgtctagcaagaa

SEQ ID NO: 58555 - DNA, 20 bp, Artificial Sequence
  chemically synthesized
catttcctctccattcttgc

SEQ ID NO: 58556 - DNA, 20 bp, Artificial Sequence
  chemically synthesized
attcctgtctagcaagaatg

SEQ ID NO: 58557 - DNA, 20 bp, Artificial Sequence
  chemically synthesized
tcctgtctagcaagaatgga

SEQ ID NO: 58558 - DNA, 20 bp, Artificial Sequence
  chemically synthesized
cctgtctagcaagaatggag

SEQ ID NO: 58559 - DNA, 20 bp, Artificial Sequence
  chemically synthesized
caagaatggagaggaaatgt

SEQ ID NO: 58560 - DNA, 20 bp, Artificial Sequence
  chemically synthesized
agaatggagaggaaatgtca

SEQ ID NO: 58561 - DNA, 20 bp, Artificial Sequence
  chemically synthesized
ggagaggaaatgtcagagca

SEQ ID NO: 58562 - DNA, 20 bp, Artificial Sequence
  chemically synthesized
gagaggaaatgtcagagcat

SEQ ID NO: 58563 - DNA, 20 bp, Artificial Sequence
  chemically synthesized
ggaaatgtcagagcatgggt

SEQ ID NO: 58564 - DNA, 20 bp, Artificial Sequence
  chemically synthesized
tcagagcatgggttggaatt

SEQ ID NO: 58565 - DNA, 20 bp, Artificial Sequence
  chemically synthesized
atgggttggaatttggaatg

SEQ ID NO: 58566 - DNA, 20 bp, Artificial Sequence
  chemically synthesized
aatttggaatgaagttatat

SEQ ID NO: 58567 - DNA, 20 bp, Artificial Sequence
  chemically synthesized
atttggaatgaagttatatg

SEQ ID NO: 58568 - DNA, 20 bp, Artificial Sequence
  chemically synthesized
aatgaagttatatgaggaaa

SEQ ID NO: 58569 - DNA, 20 bp, Artificial Sequence
  chemically synthesized
agttatatgaggaaacagac

SEQ ID NO: 58570 - DNA, 20 bp, Artificial Sequence
  chemically synthesized
gttatatgaggaaacagaca

SEQ ID NO: 58571 - DNA, 20 bp, Artificial Sequence
  chemically synthesized
acaaggtacaaaacgtgacc

SEQ ID NO: 58572 - DNA, 20 bp, Artificial Sequence
  chemically synthesized
aggtacaaaacgtgaccaag

SEQ ID NO: 58573 - DNA, 20 bp, Artificial Sequence
  chemically synthesized
acaaaacgtgaccaagaagt

SEQ ID NO: 58574 - DNA, 20 bp, Artificial Sequence
  chemically synthesized
cagtggcacctccaacttct

SEQ ID NO: 58575 - DNA, 20 bp, Artificial Sequence
  chemically synthesized
aaaacgtgaccaagaagttg

SEQ ID NO: 58576 - DNA, 20 bp, Artificial Sequence
  chemically synthesized
aaacgtgaccaagaagttgg

SEQ ID NO: 58577 - DNA, 20 bp, Artificial Sequence
  chemically synthesized
ttttattccaaattttgcag

SEQ ID NO: 58578 - DNA, 20 bp, Artificial Sequence
  chemically synthesized
ggaggtgccactgcaaaatt

SEQ ID NO: 58579 - DNA, 20 bp, Artificial Sequence
  chemically synthesized
cccttttattccaaattttg

SEQ ID NO: 58580 - DNA, 20 bp, Artificial Sequence
  chemically synthesized
cactgcaaaatttggaataa

SEQ ID NO: 58581 - DNA, 20 bp, Artificial Sequence
  chemically synthesized
actgcaaaatttggaataaa

SEQ ID NO: 58582 - DNA, 20 bp, Artificial Sequence
  chemically synthesized
ctgcaaaatttggaataaaa

SEQ ID NO: 58583 - DNA, 20 bp, Artificial Sequence
  chemically synthesized
tgcaaaatttggaataaaag

SEQ ID NO: 58584 - DNA, 20 bp, Artificial Sequence
  chemically synthesized
aaaatttggaataaaagggg

SEQ ID NO: 58585 - DNA, 20 bp, Artificial Sequence
  chemically synthesized
ggaataaaaggggtagtgcc

SEQ ID NO: 58586 - DNA, 20 bp, Artificial Sequence
  chemically synthesized
gaataaaaggggtagtgcca

SEQ ID NO: 58587 - DNA, 20 bp, Artificial Sequence
  chemically synthesized
taaaaggggtagtgccaagg

SEQ ID NO: 58588 - DNA, 20 bp, Artificial Sequence
  chemically synthesized
aaaaggggtagtgccaaggc

SEQ ID NO: 58589 - DNA, 20 bp, Artificial Sequence
  chemically synthesized
atcagtcctcagacctgcct

SEQ ID NO: 58590 - DNA, 20 bp, Artificial Sequence
  chemically synthesized
ggtagtgccaaggcaggtct

SEQ ID NO: 58591 - DNA, 20 bp, Artificial Sequence
  chemically synthesized
gtagtgccaaggcaggtctg

SEQ ID NO: 58592 - DNA, 20 bp, Artificial Sequence
  chemically synthesized
actggcttaggatcagtcct

SEQ ID NO: 58593 - DNA, 20 bp, Artificial Sequence
  chemically synthesized
caggtctgaggactgatcct

SEQ ID NO: 58594 - DNA, 20 bp, Artificial Sequence
  chemically synthesized
aacaaccactggcttaggat

SEQ ID NO: 58595 - DNA, 20 bp, Artificial Sequence
  chemically synthesized
tctgaggactgatcctaagc

SEQ ID NO: 58596 - DNA, 20 bp, Artificial Sequence
  chemically synthesized
gaggactgatcctaagccag

SEQ ID NO: 58597 - DNA, 20 bp, Artificial Sequence
  chemically synthesized
gaagaaacaaccactggctt

SEQ ID NO: 58598 - DNA, 20 bp, Artificial Sequence
  chemically synthesized
agaagaaacaaccactggct

SEQ ID NO: 58599 - DNA, 20 bp, Artificial Sequence
  chemically synthesized
aggacagaagaaacaaccac

SEQ ID NO: 58600 - DNA, 20 bp, Artificial Sequence
  chemically synthesized
agtggttgtttcttctgtcc

SEQ ID NO: 58601 - DNA, 20 bp, Artificial Sequence
  chemically synthesized
gctgcttaaaactaggacag

SEQ ID NO: 58602 - DNA, 20 bp, Artificial Sequence
  chemically synthesized
aaagctgcttaaaactagga

SEQ ID NO: 58603 - DNA, 20 bp, Artificial Sequence
  chemically synthesized
gtttcttctgtcctagtttt

SEQ ID NO: 58604 - DNA, 20 bp, Artificial Sequence
  chemically synthesized
taggaaagctgcttaaaact

SEQ ID NO: 58605 - DNA, 20 bp, Artificial Sequence
  chemically synthesized
ctaggaaagctgcttaaaac

SEQ ID NO: 58606 - DNA, 20 bp, Artificial Sequence
  chemically synthesized
tcttctgtcctagttttaag

SEQ ID NO: 58607 - DNA, 20 bp, Artificial Sequence
  chemically synthesized
ctagttttaagcagctttcc

SEQ ID NO: 58608 - DNA, 20 bp, Artificial Sequence
  chemically synthesized
ttttaagcagctttcctagt

SEQ ID NO: 58609 - DNA, 20 bp, Artificial Sequence
  chemically synthesized
ctcatccaccctcactagga

SEQ ID NO: 58610 - DNA, 20 bp, Artificial Sequence
  chemically synthesized
tttaagcagctttcctagtg

SEQ ID NO: 58611 - DNA, 20 bp, Artificial Sequence
  chemically synthesized
ttaagcagctttcctagtga

SEQ ID NO: 58612 - DNA, 20 bp, Artificial Sequence
  chemically synthesized
ggccctcatccaccctcact

SEQ ID NO: 58613 - DNA, 20 bp, Artificial Sequence
  chemically synthesized
agcagctttcctagtgaggg

SEQ ID NO: 58614 - DNA, 20 bp, Artificial Sequence
  chemically synthesized
tggccctcatccaccctcac

SEQ ID NO: 58615 - DNA, 20 bp, Artificial Sequence
  chemically synthesized
ctttcctagtgagggtggat

SEQ ID NO: 58616 - DNA, 20 bp, Artificial Sequence
  chemically synthesized
tttcctagtgagggtggatg

SEQ ID NO: 58617 - DNA, 20 bp, Artificial Sequence
  chemically synthesized
ttcctagtgagggtggatga

SEQ ID NO: 58618 - DNA, 20 bp, Artificial Sequence
  chemically synthesized
agtgagggtggatgagggcc

SEQ ID NO: 58619 - DNA, 20 bp, Artificial Sequence
  chemically synthesized
tgagggtggatgagggccaa

SEQ ID NO: 58620 - DNA, 20 bp, Artificial Sequence
  chemically synthesized
tggatgagggccaagagcac

SEQ ID NO: 58621 - DNA, 20 bp, Artificial Sequence
  chemically synthesized
ggggagaagcccagtgctct

SEQ ID NO: 58622 - DNA, 20 bp, Artificial Sequence
  chemically synthesized
ggatgagggccaagagcact

SEQ ID NO: 58623 - DNA, 20 bp, Artificial Sequence
  chemically synthesized
tgtgactctggggagaagcc

SEQ ID NO: 58624 - DNA, 20 bp, Artificial Sequence
  chemically synthesized
aagagcactgggcttctccc

SEQ ID NO: 58625 - DNA, 20 bp, Artificial Sequence
  chemically synthesized
gagcactgggcttctcccca

SEQ ID NO: 58626 - DNA, 20 bp, Artificial Sequence
  chemically synthesized
tcctgtgtgactctggggag

SEQ ID NO: 58627 - DNA, 20 bp, Artificial Sequence
  chemically synthesized
gaatcctgtgtgactctggg

SEQ ID NO: 58628 - DNA, 20 bp, Artificial Sequence
  chemically synthesized
cagaatcctgtgtgactctg

SEQ ID NO: 58629 - DNA, 20 bp, Artificial Sequence
  chemically synthesized
gcagaatcctgtgtgactct

SEQ ID NO: 58630 - DNA, 20 bp, Artificial Sequence
  chemically synthesized
tgcagaatcctgtgtgactc

SEQ ID NO: 58631 - DNA, 20 bp, Artificial Sequence
  chemically synthesized
ggcttctccccagagtcaca

SEQ ID NO: 58632 - DNA, 20 bp, Artificial Sequence
  chemically synthesized
gcttctccccagagtcacac

SEQ ID NO: 58633 - DNA, 20 bp, Artificial Sequence
  chemically synthesized
cagagtcacacaggattctg

SEQ ID NO: 58634 - DNA, 20 bp, Artificial Sequence
  chemically synthesized
agagtcacacaggattctgc

SEQ ID NO: 58635 - DNA, 20 bp, Artificial Sequence
  chemically synthesized
gctgtaatcattaaaacctg

SEQ ID NO: 58636 - DNA, 20 bp, Artificial Sequence
  chemically synthesized
tctgcaggttttaatgatta

SEQ ID NO: 58637 - DNA, 20 bp, Artificial Sequence
  chemically synthesized
gcaggttttaatgattacag

SEQ ID NO: 58638 - DNA, 20 bp, Artificial Sequence
  chemically synthesized
aggttttaatgattacagca

SEQ ID NO: 58639 - DNA, 20 bp, Artificial Sequence
  chemically synthesized
gttttaatgattacagcaga

SEQ ID NO: 58640 - DNA, 20 bp, Artificial Sequence
  chemically synthesized
tttaatgattacagcagaga

SEQ ID NO: 58641 - DNA, 20 bp, Artificial Sequence
  chemically synthesized
tgattacagcagagagagct

SEQ ID NO: 58642 - DNA, 20 bp, Artificial Sequence
  chemically synthesized
gcagagagagcttggtcccc

SEQ ID NO: 58643 - DNA, 20 bp, Artificial Sequence
  chemically synthesized
caagggctttccaggggacc

SEQ ID NO: 58644 - DNA, 20 bp, Artificial Sequence
  chemically synthesized
agagagcttggtcccctgga

SEQ ID NO: 58645 - DNA, 20 bp, Artificial Sequence
  chemically synthesized
gaaccgcaagggctttccag

SEQ ID NO: 58646 - DNA, 20 bp, Artificial Sequence
  chemically synthesized
agaaccgcaagggctttcca

SEQ ID NO: 58647 - DNA, 20 bp, Artificial Sequence
  chemically synthesized
tagaaccgcaagggctttcc

SEQ ID NO: 58648 - DNA, 20 bp, Artificial Sequence
  chemically synthesized
ttagaaccgcaagggctttc

SEQ ID NO: 58649 - DNA, 20 bp, Artificial Sequence
  chemically synthesized
ggtcccctggaaagcccttg

SEQ ID NO: 58650 - DNA, 20 bp, Artificial Sequence
  chemically synthesized
ttgctgggttagaaccgcaa

SEQ ID NO: 58651 - DNA, 20 bp, Artificial Sequence
  chemically synthesized
tttgctgggttagaaccgca

SEQ ID NO: 58652 - DNA, 20 bp, Artificial Sequence
  chemically synthesized
ttttgctgggttagaaccgc

SEQ ID NO: 58653 - DNA, 20 bp, Artificial Sequence
  chemically synthesized
aagcccttgcggttctaacc

SEQ ID NO: 58654 - DNA, 20 bp, Artificial Sequence
  chemically synthesized
ttcaatgcattttgctgggt

SEQ ID NO: 58655 - DNA, 20 bp, Artificial Sequence
  chemically synthesized
cagattcaatgcattttgct

SEQ ID NO: 58656 - DNA, 20 bp, Artificial Sequence
  chemically synthesized
tcagattcaatgcattttgc

SEQ ID NO: 58657 - DNA, 20 bp, Artificial Sequence
  chemically synthesized
gcaaaatgcattgaatctga

SEQ ID NO: 58658 - DNA, 20 bp, Artificial Sequence
  chemically synthesized
caaaatgcattgaatctgac

SEQ ID NO: 58659 - DNA, 20 bp, Artificial Sequence
  chemically synthesized
atgcattgaatctgacaggc

SEQ ID NO: 58660 - DNA, 20 bp, Artificial Sequence
  chemically synthesized
ggtggtaaatgctggcctgt

SEQ ID NO: 58661 - DNA, 20 bp, Artificial Sequence
  chemically synthesized
gcatcagaggtggtaaatgc

SEQ ID NO: 58662 - DNA, 20 bp, Artificial Sequence
  chemically synthesized
ccatgcactggcatcagagg

SEQ ID NO: 58663 - DNA, 20 bp, Artificial Sequence
  chemically synthesized
gcatttaccacctctgatgc

SEQ ID NO: 58664 - DNA, 20 bp, Artificial Sequence
  chemically synthesized
tccccatgcactggcatcag

SEQ ID NO: 58665 - DNA, 20 bp, Artificial Sequence
  chemically synthesized
ttccccatgcactggcatca

SEQ ID NO: 58666 - DNA, 20 bp, Artificial Sequence
  chemically synthesized
ttttccccatgcactggcat

SEQ ID NO: 58667 - DNA, 20 bp, Artificial Sequence
  chemically synthesized
ccacctctgatgccagtgca

SEQ ID NO: 58668 - DNA, 20 bp, Artificial Sequence
  chemically synthesized
cacctctgatgccagtgcat

SEQ ID NO: 58669 - DNA, 20 bp, Artificial Sequence
  chemically synthesized
acctctgatgccagtgcatg

SEQ ID NO: 58670 - DNA, 20 bp, Artificial Sequence
  chemically synthesized
atttgtttttccccatgcac

SEQ ID NO: 58671 - DNA, 20 bp, Artificial Sequence
  chemically synthesized
atgtactaagtttgcaaatg

SEQ ID NO: 58672 - DNA, 20 bp, Artificial Sequence
  chemically synthesized
tatgtactaagtttgcaaat

SEQ ID NO: 58673 - DNA, 20 bp, Artificial Sequence
  chemically synthesized
atatgtactaagtttgcaaa

SEQ ID NO: 58674 - DNA, 20 bp, Artificial Sequence
  chemically synthesized
aattgccccatttgcaaact

SEQ ID NO: 58675 - DNA, 20 bp, Artificial Sequence
  chemically synthesized
cctaactgcatatatgtact

SEQ ID NO: 58676 - DNA, 20 bp, Artificial Sequence
  chemically synthesized
gcaaacttagtacatatatg

SEQ ID NO: 58677 - DNA, 20 bp, Artificial Sequence
  chemically synthesized
acttagtacatatatgcagt

SEQ ID NO: 58678 - DNA, 20 bp, Artificial Sequence
  chemically synthesized
cttagtacatatatgcagtt

SEQ ID NO: 58679 - DNA, 20 bp, Artificial Sequence
  chemically synthesized
tagtacatatatgcagttag

SEQ ID NO: 58680 - DNA, 20 bp, Artificial Sequence
  chemically synthesized
atctttttgtgtaacgagta

SEQ ID NO: 58681 - DNA, 20 bp, Artificial Sequence
  chemically synthesized
aaatctttttgtgtaacgag

SEQ ID NO: 58682 - DNA, 20 bp, Artificial Sequence
  chemically synthesized
ataaaatctttttgtgtaac

SEQ ID NO: 58683 - DNA, 20 bp, Artificial Sequence
  chemically synthesized
tgctctactcgttacacaaa

SEQ ID NO: 58684 - DNA, 20 bp, Artificial Sequence
  chemically synthesized
gttacacaaaaagattttat

SEQ ID NO: 58685 - DNA, 20 bp, Artificial Sequence
  chemically synthesized
ttataagtaaaaaatactta

SEQ ID NO: 58686 - DNA, 20 bp, Artificial Sequence
  chemically synthesized
agtaaaaaatacttaaagtc

SEQ ID NO: 58687 - DNA, 20 bp, Artificial Sequence
  chemically synthesized
gaaacttagtgccagacttt

SEQ ID NO: 58688 - DNA, 20 bp, Artificial Sequence
  chemically synthesized
aatacttaaagtctggcact

SEQ ID NO: 58689 - DNA, 20 bp, Artificial Sequence
  chemically synthesized
agggagtagaaacttagtgc

SEQ ID NO: 58690 - DNA, 20 bp, Artificial Sequence
  chemically synthesized
acaaacagggagtagaaact

SEQ ID NO: 58691 - DNA, 20 bp, Artificial Sequence
  chemically synthesized
aaatcaaaacaaacagggag

SEQ ID NO: 58692 - DNA, 20 bp, Artificial Sequence
  chemically synthesized
tcaaaatcaaaacaaacagg

SEQ ID NO: 58693 - DNA, 20 bp, Artificial Sequence
  chemically synthesized
tatcaaaatcaaaacaaaca

SEQ ID NO: 58694 - DNA, 20 bp, Artificial Sequence
  chemically synthesized
gtatcaaaatcaaaacaaac

SEQ ID NO: 58695 - DNA, 20 bp, Artificial Sequence
  chemically synthesized
ggtatcaaaatcaaaacaaa

SEQ ID NO: 58696 - DNA, 20 bp, Artificial Sequence
  chemically synthesized
aagtctttagaatagagtac

SEQ ID NO: 58697 - DNA, 20 bp, Artificial Sequence
  chemically synthesized
caagtctttagaatagagta

SEQ ID NO: 58698 - DNA, 20 bp, Artificial Sequence
  chemically synthesized
gatacctgtactctattcta

SEQ ID NO: 58699 - DNA, 20 bp, Artificial Sequence
  chemically synthesized
actaccaagtctttagaata

SEQ ID NO: 58700 - DNA, 20 bp, Artificial Sequence
  chemically synthesized
tcactaccaagtctttagaa

SEQ ID NO: 58701 - DNA, 20 bp, Artificial Sequence
  chemically synthesized
tgtactctattctaaagact

SEQ ID NO: 58702 - DNA, 20 bp, Artificial Sequence
  chemically synthesized
tactctcactaccaagtctt

SEQ ID NO: 58703 - DNA, 20 bp, Artificial Sequence
  chemically synthesized
actctattctaaagacttgg

SEQ ID NO: 58704 - DNA, 20 bp, Artificial Sequence
  chemically synthesized
tattctaaagacttggtagt

SEQ ID NO: 58705 - DNA, 20 bp, Artificial Sequence
  chemically synthesized
cccgctctactctcactacc

SEQ ID NO: 58706 - DNA, 20 bp, Artificial Sequence
  chemically synthesized
ttctaaagacttggtagtga

SEQ ID NO: 58707 - DNA, 20 bp, Artificial Sequence
  chemically synthesized
taaagacttggtagtgagag

SEQ ID NO: 58708 - DNA, 20 bp, Artificial Sequence
  chemically synthesized
aagacttggtagtgagagta

SEQ ID NO: 58709 - DNA, 20 bp, Artificial Sequence
  chemically synthesized
acttggtagtgagagtagag

SEQ ID NO: 58710 - DNA, 20 bp, Artificial Sequence
  chemically synthesized
cttggtagtgagagtagagc

SEQ ID NO: 58711 - DNA, 20 bp, Artificial Sequence
  chemically synthesized
tggtagtgagagtagagcgg

SEQ ID NO: 58712 - DNA, 20 bp, Artificial Sequence
  chemically synthesized
ggtagtgagagtagagcggg

SEQ ID NO: 58713 - DNA, 20 bp, Artificial Sequence
  chemically synthesized
agtgagagtagagcgggagg

SEQ ID NO: 58714 - DNA, 20 bp, Artificial Sequence
  chemically synthesized
gagagtagagcgggaggtgg

SEQ ID NO: 58715 - DNA, 20 bp, Artificial Sequence
  chemically synthesized
agagtagagcgggaggtggc

SEQ ID NO: 58716 - DNA, 20 bp, Artificial Sequence
  chemically synthesized
gagtagagcgggaggtggcg

SEQ ID NO: 58717 - DNA, 20 bp, Artificial Sequence
  chemically synthesized
agtagagcgggaggtggcgg

SEQ ID NO: 58718 - DNA, 20 bp, Artificial Sequence
  chemically synthesized
gtagagcgggaggtggcggg

SEQ ID NO: 58719 - DNA, 20 bp, Artificial Sequence
  chemically synthesized
gggggaattgaatgcctccc

SEQ ID NO: 58720 - DNA, 20 bp, Artificial Sequence
  chemically synthesized
cagcccttcaaatacttggg

SEQ ID NO: 58721 - DNA, 20 bp, Artificial Sequence
  chemically synthesized
acagcccttcaaatacttgg

SEQ ID NO: 58722 - DNA, 20 bp, Artificial Sequence
  chemically synthesized
agacagcccttcaaatactt

SEQ ID NO: 58723 - DNA, 20 bp, Artificial Sequence
  chemically synthesized
aagacagcccttcaaatact

SEQ ID NO: 58724 - DNA, 20 bp, Artificial Sequence
  chemically synthesized
gaatgcctcccaagtatttg

SEQ ID NO: 58725 - DNA, 20 bp, Artificial Sequence
  chemically synthesized
aatgcctcccaagtatttga

SEQ ID NO: 58726 - DNA, 20 bp, Artificial Sequence
  chemically synthesized
atgcctcccaagtatttgaa

SEQ ID NO: 58727 - DNA, 20 bp, Artificial Sequence
  chemically synthesized
gtaaaccctcttggcaaaga

SEQ ID NO: 58728 - DNA, 20 bp, Artificial Sequence
  chemically synthesized
tttgaagggctgtctttgcc

SEQ ID NO: 58729 - DNA, 20 bp, Artificial Sequence
  chemically synthesized
tgaagggctgtctttgccaa

SEQ ID NO: 58730 - DNA, 20 bp, Artificial Sequence
  chemically synthesized
gaagggctgtctttgccaag

SEQ ID NO: 58731 - DNA, 20 bp, Artificial Sequence
  chemically synthesized
aagtgtaaaccctcttggca

SEQ ID NO: 58732 - DNA, 20 bp, Artificial Sequence
  chemically synthesized
aagggctgtctttgccaaga

SEQ ID NO: 58733 - DNA, 20 bp, Artificial Sequence
  chemically synthesized
acagtaagtgtaaaccctct

SEQ ID NO: 58734 - DNA, 20 bp, Artificial Sequence
  chemically synthesized
gctttggaaatatacacagt

SEQ ID NO: 58735 - DNA, 20 bp, Artificial Sequence
  chemically synthesized
gtatgctttggaaatataca

SEQ ID NO: 58736 - DNA, 20 bp, Artificial Sequence
  chemically synthesized
acttactgtgtatatttcca

SEQ ID NO: 58737 - DNA, 20 bp, Artificial Sequence
  chemically synthesized
ttctgtctatatgtatgctt

SEQ ID NO: 58738 - DNA, 20 bp, Artificial Sequence
  chemically synthesized
atatttccaaagcatacata

SEQ ID NO: 58739 - DNA, 20 bp, Artificial Sequence
  chemically synthesized
ttccaaagcatacatataga

SEQ ID NO: 58740 - DNA, 20 bp, Artificial Sequence
  chemically synthesized
aaagcatacatatagacaga

SEQ ID NO: 58741 - DNA, 20 bp, Artificial Sequence
  chemically synthesized
aagcatacatatagacagaa

SEQ ID NO: 58742 - DNA, 20 bp, Artificial Sequence
  chemically synthesized
catacatatagacagaaagg

SEQ ID NO: 58743 - DNA, 20 bp, Artificial Sequence
  chemically synthesized
tacatatagacagaaaggca

SEQ ID NO: 58744 - DNA, 20 bp, Artificial Sequence
  chemically synthesized
acatatagacagaaaggcag

SEQ ID NO: 58745 - DNA, 20 bp, Artificial Sequence
  chemically synthesized
agacagaaaggcagaggtta

SEQ ID NO: 58746 - DNA, 20 bp, Artificial Sequence
  chemically synthesized
gacagaaaggcagaggttat

SEQ ID NO: 58747 - DNA, 20 bp, Artificial Sequence
  chemically synthesized
agaaaggcagaggttatggg

SEQ ID NO: 58748 - DNA, 20 bp, Artificial Sequence
  chemically synthesized
ggttatgggaagatcaactt

SEQ ID NO: 58749 - DNA, 20 bp, Artificial Sequence
  chemically synthesized
ttatctcttgcattgagctg

SEQ ID NO: 58750 - DNA, 20 bp, Artificial Sequence
  chemically synthesized
gatcaacttcagctcaatgc

SEQ ID NO: 58751 - DNA, 20 bp, Artificial Sequence
  chemically synthesized
tcaacttcagctcaatgcaa

SEQ ID NO: 58752 - DNA, 20 bp, Artificial Sequence
  chemically synthesized
aggctgttatctcttgcatt

SEQ ID NO: 58753 - DNA, 20 bp, Artificial Sequence
  chemically synthesized
cagctcaatgcaagagataa

SEQ ID NO: 58754 - DNA, 20 bp, Artificial Sequence
  chemically synthesized
agagataacagcctaattat

SEQ ID NO: 58755 - DNA, 20 bp, Artificial Sequence
  chemically synthesized
gagataacagcctaattatt

SEQ ID NO: 58756 - DNA, 20 bp, Artificial Sequence
  chemically synthesized
tcacaaacaccctaataatt

SEQ ID NO: 58757 - DNA, 20 bp, Artificial Sequence
  chemically synthesized
agataacagcctaattatta

SEQ ID NO: 58758 - DNA, 20 bp, Artificial Sequence
  chemically synthesized
ttcacaaacaccctaataat

SEQ ID NO: 58759 - DNA, 20 bp, Artificial Sequence
  chemically synthesized
tagggtgtttgtgaactgaa

SEQ ID NO: 58760 - DNA, 20 bp, Artificial Sequence
  chemically synthesized
agggtgtttgtgaactgaac

SEQ ID NO: 58761 - DNA, 20 bp, Artificial Sequence
  chemically synthesized
actttgtaaagcagcctgtt

SEQ ID NO: 58762 - DNA, 20 bp, Artificial Sequence
  chemically synthesized
actgaacaggctgctttaca

SEQ ID NO: 58763 - DNA, 20 bp, Artificial Sequence
  chemically synthesized
gaactcctcactttgtaaag

SEQ ID NO: 58764 - DNA, 20 bp, Artificial Sequence
  chemically synthesized
ggggaactcctcactttgta

SEQ ID NO: 58765 - DNA, 20 bp, Artificial Sequence
  chemically synthesized
aacaggctgctttacaaagt

SEQ ID NO: 58766 - DNA, 20 bp, Artificial Sequence
  chemically synthesized
acaggctgctttacaaagtg

SEQ ID NO: 58767 - DNA, 20 bp, Artificial Sequence
  chemically synthesized
aggctgctttacaaagtgag

SEQ ID NO: 58768 - DNA, 20 bp, Artificial Sequence
  chemically synthesized
gtgaggagttccccatcact

SEQ ID NO: 58769 - DNA, 20 bp, Artificial Sequence
  chemically synthesized
aggcttaaaacttagtgatg

SEQ ID NO: 58770 - DNA, 20 bp, Artificial Sequence
  chemically synthesized
taggcttaaaacttagtgat

SEQ ID NO: 58771 - DNA, 20 bp, Artificial Sequence
  chemically synthesized
ctaggcttaaaacttagtga

SEQ ID NO: 58772 - DNA, 20 bp, Artificial Sequence
  chemically synthesized
gttccccatcactaagtttt

SEQ ID NO: 58773 - DNA, 20 bp, Artificial Sequence
  chemically synthesized
tttggcctaggcttaaaact

SEQ ID NO: 58774 - DNA, 20 bp, Artificial Sequence
  chemically synthesized
ccatcactaagttttaagcc

SEQ ID NO: 58775 - DNA, 20 bp, Artificial Sequence
  chemically synthesized
catcactaagttttaagcct

SEQ ID NO: 58776 - DNA, 20 bp, Artificial Sequence
  chemically synthesized
taagttttaagcctaggcca

SEQ ID NO: 58777 - DNA, 20 bp, Artificial Sequence
  chemically synthesized
gctagaaaacactttggcct

SEQ ID NO: 58778 - DNA, 20 bp, Artificial Sequence
  chemically synthesized
tgctagaaaacactttggcc

SEQ ID NO: 58779 - DNA, 20 bp, Artificial Sequence
  chemically synthesized
atttctgctagaaaacactt

SEQ ID NO: 58780 - DNA, 20 bp, Artificial Sequence
  chemically synthesized
gcctaggccaaagtgttttc

SEQ ID NO: 58781 - DNA, 20 bp, Artificial Sequence
  chemically synthesized
taggccaaagtgttttctag

SEQ ID NO: 58782 - DNA, 20 bp, Artificial Sequence
  chemically synthesized
gagttcttccacatttctgc

SEQ ID NO: 58783 - DNA, 20 bp, Artificial Sequence
  chemically synthesized
agtgttttctagcagaaatg

SEQ ID NO: 58784 - DNA, 20 bp, Artificial Sequence
  chemically synthesized
gttttctagcagaaatgtgg

SEQ ID NO: 58785 - DNA, 20 bp, Artificial Sequence
  chemically synthesized
aaatgtggaagaactcctga

SEQ ID NO: 58786 - DNA, 20 bp, Artificial Sequence
  chemically synthesized
aatgtggaagaactcctgaa

SEQ ID NO: 58787 - DNA, 20 bp, Artificial Sequence
  chemically synthesized
tctagtctaaatcctttcag

SEQ ID NO: 58788 - DNA, 20 bp, Artificial Sequence
  chemically synthesized
gatctagtctaaatcctttc

SEQ ID NO: 58789 - DNA, 20 bp, Artificial Sequence
  chemically synthesized
agatctagtctaaatccttt

SEQ ID NO: 58790 - DNA, 20 bp, Artificial Sequence
  chemically synthesized
gaagaactcctgaaaggatt

SEQ ID NO: 58791 - DNA, 20 bp, Artificial Sequence
  chemically synthesized
actcctgaaaggatttagac

SEQ ID NO: 58792 - DNA, 20 bp, Artificial Sequence
  chemically synthesized
aggatttagactagatcttg

SEQ ID NO: 58793 - DNA, 20 bp, Artificial Sequence
  chemically synthesized
tgaaaggggccttcaagatc

SEQ ID NO: 58794 - DNA, 20 bp, Artificial Sequence
  chemically synthesized
ggatttagactagatcttga

SEQ ID NO: 58795 - DNA, 20 bp, Artificial Sequence
  chemically synthesized
ttaggttgaaaggggccttc

SEQ ID NO: 58796 - DNA, 20 bp, Artificial Sequence
  chemically synthesized
ataaaatcttaggttgaaag

SEQ ID NO: 58797 - DNA, 20 bp, Artificial Sequence
  chemically synthesized
aataaaatcttaggttgaaa

SEQ ID NO: 58798 - DNA, 20 bp, Artificial Sequence
  chemically synthesized
taataaaatcttaggttgaa

SEQ ID NO: 58799 - DNA, 20 bp, Artificial Sequence
  chemically synthesized
ttgaaggcccctttcaacct

SEQ ID NO: 58800 - DNA, 20 bp, Artificial Sequence
  chemically synthesized
gtaataaaatcttaggttga

SEQ ID NO: 58801 - DNA, 20 bp, Artificial Sequence
  chemically synthesized
agtttgagtaataaaatctt

SEQ ID NO: 58802 - DNA, 20 bp, Artificial Sequence
  chemically synthesized
aagtttgagtaataaaatct

SEQ ID NO: 58803 - DNA, 20 bp, Artificial Sequence
  chemically synthesized
aatcacatcttaacaagttt

SEQ ID NO: 58804 - DNA, 20 bp, Artificial Sequence
  chemically synthesized
ttttattactcaaacttgtt

SEQ ID NO: 58805 - DNA, 20 bp, Artificial Sequence
  chemically synthesized
agtgttaatcacatcttaac

SEQ ID NO: 58806 - DNA, 20 bp, Artificial Sequence
  chemically synthesized
tgttaagatgtgattaacac

SEQ ID NO: 58807 - DNA, 20 bp, Artificial Sequence
  chemically synthesized
gatagttaacttatttaagc

SEQ ID NO: 58808 - DNA, 20 bp, Artificial Sequence
  chemically synthesized
tgattaacactagcttaaat

SEQ ID NO: 58809 - DNA, 20 bp, Artificial Sequence
  chemically synthesized
tctcgatagttaacttattt

SEQ ID NO: 58810 - DNA, 20 bp, Artificial Sequence
  chemically synthesized
gcttaaataagttaactatc

SEQ ID NO: 58811 - DNA, 20 bp, Artificial Sequence
  chemically synthesized
ttaaataagttaactatcga

SEQ ID NO: 58812 - DNA, 20 bp, Artificial Sequence
  chemically synthesized
tacattaggctgactctcga

SEQ ID NO: 58813 - DNA, 20 bp, Artificial Sequence
  chemically synthesized
ataagttaactatcgagagt

SEQ ID NO: 58814 - DNA, 20 bp, Artificial Sequence
  chemically synthesized
cgagagtcagcctaatgtaa

SEQ ID NO: 58815 - DNA, 20 bp, Artificial Sequence
  chemically synthesized
gtaatcctaaccattacatt

SEQ ID NO: 58816 - DNA, 20 bp, Artificial Sequence
  chemically synthesized
ggtaatcctaaccattacat

SEQ ID NO: 58817 - DNA, 20 bp, Artificial Sequence
  chemically synthesized
agtcagcctaatgtaatggt

SEQ ID NO: 58818 - DNA, 20 bp, Artificial Sequence
  chemically synthesized
gtcagcctaatgtaatggtt

SEQ ID NO: 58819 - DNA, 20 bp, Artificial Sequence
  chemically synthesized
aatgtaatggttaggattac

SEQ ID NO: 58820 - DNA, 20 bp, Artificial Sequence
  chemically synthesized
atgtaatggttaggattacc

SEQ ID NO: 58821 - DNA, 20 bp, Artificial Sequence
  chemically synthesized
ggttaggattaccaggtctg

SEQ ID NO: 58822 - DNA, 20 bp, Artificial Sequence
  chemically synthesized
aggtaatatggctgcagacc

SEQ ID NO: 58823 - DNA, 20 bp, Artificial Sequence
  chemically synthesized
aaacccaggtaatatggctg

SEQ ID NO: 58824 - DNA, 20 bp, Artificial Sequence
  chemically synthesized
aggtctgcagccatattacc

SEQ ID NO: 58825 - DNA, 20 bp, Artificial Sequence
  chemically synthesized
agattcaaacccaggtaata

SEQ ID NO: 58826 - DNA, 20 bp, Artificial Sequence
  chemically synthesized
ggtctgcagccatattacct

SEQ ID NO: 58827 - DNA, 20 bp, Artificial Sequence
  chemically synthesized
agaagccaagattcaaaccc

SEQ ID NO: 58828 - DNA, 20 bp, Artificial Sequence
  chemically synthesized
aagaagccaagattcaaacc

SEQ ID NO: 58829 - DNA, 20 bp, Artificial Sequence
  chemically synthesized
tattacctgggtttgaatct

SEQ ID NO: 58830 - DNA, 20 bp, Artificial Sequence
  chemically synthesized
cccacagctagtaagaagcc

SEQ ID NO: 58831 - DNA, 20 bp, Artificial Sequence
  chemically synthesized
tttgaatcttggcttcttac

SEQ ID NO: 58832 - DNA, 20 bp, Artificial Sequence
  chemically synthesized
caaagcccacagctagtaag

SEQ ID NO: 58833 - DNA, 20 bp, Artificial Sequence
  chemically synthesized
gcccaaagcccacagctagt

SEQ ID NO: 58834 - DNA, 20 bp, Artificial Sequence
  chemically synthesized
tcttggcttcttactagctg

SEQ ID NO: 58835 - DNA, 20 bp, Artificial Sequence
  chemically synthesized
cttggcttcttactagctgt

SEQ ID NO: 58836 - DNA, 20 bp, Artificial Sequence
  chemically synthesized
atttgcccaaagcccacagc

SEQ ID NO: 58837 - DNA, 20 bp, Artificial Sequence
  chemically synthesized
ttcttactagctgtgggctt

SEQ ID NO: 58838 - DNA, 20 bp, Artificial Sequence
  chemically synthesized
agtaatttgcccaaagccca

SEQ ID NO: 58839 - DNA, 20 bp, Artificial Sequence
  chemically synthesized
tcttactagctgtgggcttt

SEQ ID NO: 58840 - DNA, 20 bp, Artificial Sequence
  chemically synthesized
gagattgagtaatttgccca

SEQ ID NO: 58841 - DNA, 20 bp, Artificial Sequence
  chemically synthesized
gactaaggtatagagagatt

SEQ ID NO: 58842 - DNA, 20 bp, Artificial Sequence
  chemically synthesized
taagaagactaaggtataga

SEQ ID NO: 58843 - DNA, 20 bp, Artificial Sequence
  chemically synthesized
tactcaatctctctatacct

SEQ ID NO: 58844 - DNA, 20 bp, Artificial Sequence
  chemically synthesized
aataagaagactaaggtata

SEQ ID NO: 58845 - DNA, 20 bp, Artificial Sequence
  chemically synthesized
caaataagaagactaaggta

SEQ ID NO: 58846 - DNA, 20 bp, Artificial Sequence
  chemically synthesized
gtttacaaataagaagacta

SEQ ID NO: 58847 - DNA, 20 bp, Artificial Sequence
  chemically synthesized
agtttacaaataagaagact

SEQ ID NO: 58848 - DNA, 20 bp, Artificial Sequence
  chemically synthesized
attcccagtttacaaataag

SEQ ID NO: 58849 - DNA, 20 bp, Artificial Sequence
  chemically synthesized
gtaattcccagtttacaaat

SEQ ID NO: 58850 - DNA, 20 bp, Artificial Sequence
  chemically synthesized
tagtcttcttatttgtaaac

SEQ ID NO: 58851 - DNA, 20 bp, Artificial Sequence
  chemically synthesized
agtcttcttatttgtaaact

SEQ ID NO: 58852 - DNA, 20 bp, Artificial Sequence
  chemically synthesized
ataggtactgttgtaattcc

SEQ ID NO: 58853 - DNA, 20 bp, Artificial Sequence
  chemically synthesized
ttgtaaactgggaattacaa

SEQ ID NO: 58854 - DNA, 20 bp, Artificial Sequence
  chemically synthesized
ttacaacagtacctatctac

SEQ ID NO: 58855 - DNA, 20 bp, Artificial Sequence
  chemically synthesized
acaacaacgatcttgtagat

SEQ ID NO: 58856 - DNA, 20 bp, Artificial Sequence
  chemically synthesized
gacaacaacgatcttgtaga

SEQ ID NO: 58857 - DNA, 20 bp, Artificial Sequence
  chemically synthesized
gcctgacaacaacgatcttg

SEQ ID NO: 58858 - DNA, 20 bp, Artificial Sequence
  chemically synthesized
atctacaagatcgttgttgt

SEQ ID NO: 58859 - DNA, 20 bp, Artificial Sequence
  chemically synthesized
tctacaagatcgttgttgtc

SEQ ID NO: 58860 - DNA, 20 bp, Artificial Sequence
  chemically synthesized
atcgttgttgtcaggcctct

SEQ ID NO: 58861 - DNA, 20 bp, Artificial Sequence
  chemically synthesized
atggcttagcttgggctcag

SEQ ID NO: 58862 - DNA, 20 bp, Artificial Sequence
  chemically synthesized
gttgtcaggcctctgagccc

SEQ ID NO: 58863 - DNA, 20 bp, Artificial Sequence
  chemically synthesized
gatggcttagcttgggctca

SEQ ID NO: 58864 - DNA, 20 bp, Artificial Sequence
  chemically synthesized
atgatggcttagcttgggct

SEQ ID NO: 58865 - DNA, 20 bp, Artificial Sequence
  chemically synthesized
caggcctctgagcccaagct

SEQ ID NO: 58866 - DNA, 20 bp, Artificial Sequence
  chemically synthesized
gggatatgatggcttagctt

SEQ ID NO: 58867 - DNA, 20 bp, Artificial Sequence
  chemically synthesized
ggggatatgatggcttagct

SEQ ID NO: 58868 - DNA, 20 bp, Artificial Sequence
  chemically synthesized
tcacaggggatatgatggct

SEQ ID NO: 58869 - DNA, 20 bp, Artificial Sequence
  chemically synthesized
gcaggtcacaggggatatga

SEQ ID NO: 58870 - DNA, 20 bp, Artificial Sequence
  chemically synthesized
tgtatacgtgcaggtcacag

SEQ ID NO: 58871 - DNA, 20 bp, Artificial Sequence
  chemically synthesized
atgtatacgtgcaggtcaca

SEQ ID NO: 58872 - DNA, 20 bp, Artificial Sequence
  chemically synthesized
gatgtatacgtgcaggtcac

SEQ ID NO: 58873 - DNA, 20 bp, Artificial Sequence
  chemically synthesized
ggatgtatacgtgcaggtca

SEQ ID NO: 58874 - DNA, 20 bp, Artificial Sequence
  chemically synthesized
ccttctggatgtatacgtgc

SEQ ID NO: 58875 - DNA, 20 bp, Artificial Sequence
  chemically synthesized
gccttctggatgtatacgtg

SEQ ID NO: 58876 - DNA, 20 bp, Artificial Sequence
  chemically synthesized
gtgacctgcacgtatacatc

SEQ ID NO: 58877 - DNA, 20 bp, Artificial Sequence
  chemically synthesized
acctgcacgtatacatccag

SEQ ID NO: 58878 - DNA, 20 bp, Artificial Sequence
  chemically synthesized
cctgcacgtatacatccaga

SEQ ID NO: 58879 - DNA, 20 bp, Artificial Sequence
  chemically synthesized
ttcagttacttcaggccttc

SEQ ID NO: 58880 - DNA, 20 bp, Artificial Sequence
  chemically synthesized
gtatacatccagaaggcctg

SEQ ID NO: 58881 - DNA, 20 bp, Artificial Sequence
  chemically synthesized
tgtgatttttcagttacttc

SEQ ID NO: 58882 - DNA, 20 bp, Artificial Sequence
  chemically synthesized
ttgtgatttttcagttactt

SEQ ID NO: 58883 - DNA, 20 bp, Artificial Sequence
  chemically synthesized
tcacttcttttgtgattttt

SEQ ID NO: 58884 - DNA, 20 bp, Artificial Sequence
  chemically synthesized
aagtaactgaaaaatcacaa

SEQ ID NO: 58885 - DNA, 20 bp, Artificial Sequence
  chemically synthesized
taactgaaaaatcacaaaag

SEQ ID NO: 58886 - DNA, 20 bp, Artificial Sequence
  chemically synthesized
aatcacaaaagaagtgaaaa

SEQ ID NO: 58887 - DNA, 20 bp, Artificial Sequence
  chemically synthesized
tcatcagttaaggcaggaac

SEQ ID NO: 58888 - DNA, 20 bp, Artificial Sequence
  chemically synthesized
gtcatcagttaaggcaggaa

SEQ ID NO: 58889 - DNA, 20 bp, Artificial Sequence
  chemically synthesized
ggaatgtcatcagttaaggc

SEQ ID NO: 58890 - DNA, 20 bp, Artificial Sequence
  chemically synthesized
tggaatgtcatcagttaagg

SEQ ID NO: 58891 - DNA, 20 bp, Artificial Sequence
  chemically synthesized
tggtggaatgtcatcagtta

SEQ ID NO: 58892 - DNA, 20 bp, Artificial Sequence
  chemically synthesized
gtggtggaatgtcatcagtt

SEQ ID NO: 58893 - DNA, 20 bp, Artificial Sequence
  chemically synthesized
cttttgtggtggaatgtcat

SEQ ID NO: 58894 - DNA, 20 bp, Artificial Sequence
  chemically synthesized
ctgatgacattccaccacaa

SEQ ID NO: 58895 - DNA, 20 bp, Artificial Sequence
  chemically synthesized
cattttcacttcttttgtgg

SEQ ID NO: 58896 - DNA, 20 bp, Artificial Sequence
  chemically synthesized
atgacattccaccacaaaag

SEQ ID NO: 58897 - DNA, 20 bp, Artificial Sequence
  chemically synthesized
ggccattttcacttcttttg

SEQ ID NO: 58898 - DNA, 20 bp, Artificial Sequence
  chemically synthesized
caccacaaaagaagtgaaaa

SEQ ID NO: 58899 - DNA, 20 bp, Artificial Sequence
  chemically synthesized
acaaaagaagtgaaaatggc

SEQ ID NO: 58900 - DNA, 20 bp, Artificial Sequence
  chemically synthesized
tcatcagttaaggcaaggac

SEQ ID NO: 58901 - DNA, 20 bp, Artificial Sequence
  chemically synthesized
taatgtcatcagttaaggca

SEQ ID NO: 58902 - DNA, 20 bp, Artificial Sequence
  chemically synthesized
gtaatgtcatcagttaaggc

SEQ ID NO: 58903 - DNA, 20 bp, Artificial Sequence
  chemically synthesized
caaggtaatgtcatcagtta

SEQ ID NO: 58904 - DNA, 20 bp, Artificial Sequence
  chemically synthesized
acaaggtaatgtcatcagtt

SEQ ID NO: 58905 - DNA, 20 bp, Artificial Sequence
  chemically synthesized
atttcacaaggtaatgtcat

SEQ ID NO: 58906 - DNA, 20 bp, Artificial Sequence
  chemically synthesized
ccagggaaaggaatttcaca

SEQ ID NO: 58907 - DNA, 20 bp, Artificial Sequence
  chemically synthesized
gccagggaaaggaatttcac

SEQ ID NO: 58908 - DNA, 20 bp, Artificial Sequence
  chemically synthesized
ccttgtgaaattcctttccc

SEQ ID NO: 58909 - DNA, 20 bp, Artificial Sequence
  chemically synthesized
agccaggatgagccagggaa

SEQ ID NO: 58910 - DNA, 20 bp, Artificial Sequence
  chemically synthesized
gagccaggatgagccaggga

SEQ ID NO: 58911 - DNA, 20 bp, Artificial Sequence
  chemically synthesized
ttttgagccaggatgagcca

SEQ ID NO: 58912 - DNA, 20 bp, Artificial Sequence
  chemically synthesized
tttttgagccaggatgagcc

SEQ ID NO: 58913 - DNA, 20 bp, Artificial Sequence
  chemically synthesized
ctttttgagccaggatgagc

SEQ ID NO: 58914 - DNA, 20 bp, Artificial Sequence
  chemically synthesized
ttcctttccctggctcatcc

SEQ ID NO: 58915 - DNA, 20 bp, Artificial Sequence
  chemically synthesized
gaagctttttgagccaggat

SEQ ID NO: 58916 - DNA, 20 bp, Artificial Sequence
  chemically synthesized
gtggggaagctttttgagcc

SEQ ID NO: 58917 - DNA, 20 bp, Artificial Sequence
  chemically synthesized
ctggctcatcctggctcaaa

SEQ ID NO: 58918 - DNA, 20 bp, Artificial Sequence
  chemically synthesized
agtggggaagctttttgagc

SEQ ID NO: 58919 - DNA, 20 bp, Artificial Sequence
  chemically synthesized
gctcagtggggaagcttttt

SEQ ID NO: 58920 - DNA, 20 bp, Artificial Sequence
  chemically synthesized
gctcaaaaagcttccccact

SEQ ID NO: 58921 - DNA, 20 bp, Artificial Sequence
  chemically synthesized
tcacaaggtgctcagtgggg

SEQ ID NO: 58922 - DNA, 20 bp, Artificial Sequence
  chemically synthesized
gagtcacaaggtgctcagtg

SEQ ID NO: 58923 - DNA, 20 bp, Artificial Sequence
  chemically synthesized
ggagtcacaaggtgctcagt

SEQ ID NO: 58924 - DNA, 20 bp, Artificial Sequence
  chemically synthesized
gggagtcacaaggtgctcag

SEQ ID NO: 58925 - DNA, 20 bp, Artificial Sequence
  chemically synthesized
agtgggagtcacaaggtgct

SEQ ID NO: 58926 - DNA, 20 bp, Artificial Sequence
  chemically synthesized
gggcaggagtgggagtcaca

SEQ ID NO: 58927 - DNA, 20 bp, Artificial Sequence
  chemically synthesized
cgggcaggagtgggagtcac

SEQ ID NO: 58928 - DNA, 20 bp, Artificial Sequence
  chemically synthesized
tttctggcgggcaggagtgg

SEQ ID NO: 58929 - DNA, 20 bp, Artificial Sequence
  chemically synthesized
gttttctggcgggcaggagt

SEQ ID NO: 58930 - DNA, 20 bp, Artificial Sequence
  chemically synthesized
ggttttctggcgggcaggag

SEQ ID NO: 58931 - DNA, 20 bp, Artificial Sequence
  chemically synthesized
ggtggttttctggcgggcag

SEQ ID NO: 58932 - DNA, 20 bp, Artificial Sequence
  chemically synthesized
tgactcccactcctgcccgc

SEQ ID NO: 58933 - DNA, 20 bp, Artificial Sequence
  chemically synthesized
ggggtggttttctggcgggc

SEQ ID NO: 58934 - DNA, 20 bp, Artificial Sequence
  chemically synthesized
gggggtggttttctggcggg

SEQ ID NO: 58935 - DNA, 20 bp, Artificial Sequence
  chemically synthesized
atggggggtggttttctggc

SEQ ID NO: 58936 - DNA, 20 bp, Artificial Sequence
  chemically synthesized
aatggggggtggttttctgg

SEQ ID NO: 58937 - DNA, 20 bp, Artificial Sequence
  chemically synthesized
tcaaatggggggtggttttc

SEQ ID NO: 58938 - DNA, 20 bp, Artificial Sequence
  chemically synthesized
aattacagtcaaatgggggg

SEQ ID NO: 58939 - DNA, 20 bp, Artificial Sequence
  chemically synthesized
gaaaattacagtcaaatggg

SEQ ID NO: 58940 - DNA, 20 bp, Artificial Sequence
  chemically synthesized
ggaaaattacagtcaaatgg

SEQ ID NO: 58941 - DNA, 20 bp, Artificial Sequence
  chemically synthesized
aggaaaattacagtcaaatg

SEQ ID NO: 58942 - DNA, 20 bp, Artificial Sequence
  chemically synthesized
aaggaaaattacagtcaaat

SEQ ID NO: 58943 - DNA, 20 bp, Artificial Sequence
  chemically synthesized
aaaggaaaattacagtcaaa

SEQ ID NO: 58944 - DNA, 20 bp, Artificial Sequence
  chemically synthesized
gggtaggtaaaggaaaatta

SEQ ID NO: 58945 - DNA, 20 bp, Artificial Sequence
  chemically synthesized
tataagatttgggtaggtaa

SEQ ID NO: 58946 - DNA, 20 bp, Artificial Sequence
  chemically synthesized
ttataagatttgggtaggta

SEQ ID NO: 58947 - DNA, 20 bp, Artificial Sequence
  chemically synthesized
ccgttttataagatttgggt

SEQ ID NO: 58948 - DNA, 20 bp, Artificial Sequence
  chemically synthesized
gccgttttataagatttggg

SEQ ID NO: 58949 - DNA, 20 bp, Artificial Sequence
  chemically synthesized
ggggccgttttataagattt

SEQ ID NO: 58950 - DNA, 20 bp, Artificial Sequence
  chemically synthesized
tggggccgttttataagatt

SEQ ID NO: 58951 - DNA, 20 bp, Artificial Sequence
  chemically synthesized
cctacccaaatcttataaaa

SEQ ID NO: 58952 - DNA, 20 bp, Artificial Sequence
  chemically synthesized
caggggtggggccgttttat

SEQ ID NO: 58953 - DNA, 20 bp, Artificial Sequence
  chemically synthesized
agcaaagggagacaggggtg

SEQ ID NO: 58954 - DNA, 20 bp, Artificial Sequence
  chemically synthesized
cagcaaagggagacaggggt

SEQ ID NO: 58955 - DNA, 20 bp, Artificial Sequence
  chemically synthesized
tcagcaaagggagacagggg

SEQ ID NO: 58956 - DNA, 20 bp, Artificial Sequence
  chemically synthesized
gagtcagcaaagggagacag

SEQ ID NO: 58957 - DNA, 20 bp, Artificial Sequence
  chemically synthesized
agagtcagcaaagggagaca

SEQ ID NO: 58958 - DNA, 20 bp, Artificial Sequence
  chemically synthesized
aagagtcagcaaagggagac

SEQ ID NO: 58959 - DNA, 20 bp, Artificial Sequence
  chemically synthesized
aaagagtcagcaaagggaga

SEQ ID NO: 58960 - DNA, 20 bp, Artificial Sequence
  chemically synthesized
ccaaaaagagtcagcaaagg

SEQ ID NO: 58961 - DNA, 20 bp, Artificial Sequence
  chemically synthesized
gtccaaaaagagtcagcaaa

SEQ ID NO: 58962 - DNA, 20 bp, Artificial Sequence
  chemically synthesized
agtccaaaaagagtcagcaa

SEQ ID NO: 58963 - DNA, 20 bp, Artificial Sequence
  chemically synthesized
gagtccaaaaagagtcagca

SEQ ID NO: 58964 - DNA, 20 bp, Artificial Sequence
  chemically synthesized
gggctgagtccaaaaagagt

SEQ ID NO: 58965 - DNA, 20 bp, Artificial Sequence
  chemically synthesized
ctccctttgctgactctttt

SEQ ID NO: 58966 - DNA, 20 bp, Artificial Sequence
  chemically synthesized
aggcgggctgagtccaaaaa

SEQ ID NO: 58967 - DNA, 20 bp, Artificial Sequence
  chemically synthesized
gcaggcgggctgagtccaaa

SEQ ID NO: 58968 - DNA, 20 bp, Artificial Sequence
  chemically synthesized
ttgctgactctttttggact

SEQ ID NO: 58969 - DNA, 20 bp, Artificial Sequence
  chemically synthesized
cacctggatgcaggcgggct

SEQ ID NO: 58970 - DNA, 20 bp, Artificial Sequence
  chemically synthesized
ttaatcacctggatgcaggc

SEQ ID NO: 58971 - DNA, 20 bp, Artificial Sequence
  chemically synthesized
tttaatcacctggatgcagg

SEQ ID NO: 58972 - DNA, 20 bp, Artificial Sequence
  chemically synthesized
ggactcagcccgcctgcatc

SEQ ID NO: 58973 - DNA, 20 bp, Artificial Sequence
  chemically synthesized
gactcagcccgcctgcatcc

SEQ ID NO: 58974 - DNA, 20 bp, Artificial Sequence
  chemically synthesized
ctttttaatcacctggatgc

SEQ ID NO: 58975 - DNA, 20 bp, Artificial Sequence
  chemically synthesized
actttttaatcacctggatg

SEQ ID NO: 58976 - DNA, 20 bp, Artificial Sequence
  chemically synthesized
aataaaactttttaatcacc

SEQ ID NO: 58977 - DNA, 20 bp, Artificial Sequence
  chemically synthesized
cctgcatccaggtgattaaa

SEQ ID NO: 58978 - DNA, 20 bp, Artificial Sequence
  chemically synthesized
aaagttttattgctcacaca

SEQ ID NO: 58979 - DNA, 20 bp, Artificial Sequence
  chemically synthesized
ccaccaaacaggctttgtgt

SEQ ID NO: 58980 - DNA, 20 bp, Artificial Sequence
  chemically synthesized
ttgctcacacaaagcctgtt

SEQ ID NO: 58981 - DNA, 20 bp, Artificial Sequence
  chemically synthesized
ctcacacaaagcctgtttgg

SEQ ID NO: 58982 - DNA, 20 bp, Artificial Sequence
  chemically synthesized
gtgtgaagagaccaccaaac

SEQ ID NO: 58983 - DNA, 20 bp, Artificial Sequence
  chemically synthesized
cgtgtgaagagaccaccaaa

SEQ ID NO: 58984 - DNA, 20 bp, Artificial Sequence
  chemically synthesized
tgtttggtggtctcttcaca

SEQ ID NO: 58985 - DNA, 20 bp, Artificial Sequence
  chemically synthesized
ttcatgcgcgtccgtgtgaa

SEQ ID NO: 58986 - DNA, 20 bp, Artificial Sequence
  chemically synthesized
atttcatgcgcgtccgtgtg

SEQ ID NO: 58987 - DNA, 20 bp, Artificial Sequence
  chemically synthesized
acacggacgcgcatgaaatt

SEQ ID NO: 58988 - DNA, 20 bp, Artificial Sequence
  chemically synthesized
tgaaatttggtgccatcact

SEQ ID NO: 58989 - DNA, 20 bp, Artificial Sequence
  chemically synthesized
aggtcccctgatccgagtga

SEQ ID NO: 58990 - DNA, 20 bp, Artificial Sequence
  chemically synthesized
tttggtgccatcactcggat

SEQ ID NO: 58991 - DNA, 20 bp, Artificial Sequence
  chemically synthesized
ttggtgccatcactcggatc

SEQ ID NO: 58992 - DNA, 20 bp, Artificial Sequence
  chemically synthesized
tggtgccatcactcggatca

SEQ ID NO: 58993 - DNA, 20 bp, Artificial Sequence
  chemically synthesized
ggtgccatcactcggatcag

SEQ ID NO: 58994 - DNA, 20 bp, Artificial Sequence
  chemically synthesized
caagggaggtcccctgatcc

SEQ ID NO: 58995 - DNA, 20 bp, Artificial Sequence
  chemically synthesized
tcggatcaggggacctccct

SEQ ID NO: 58996 - DNA, 20 bp, Artificial Sequence
  chemically synthesized
cggatcaggggacctccctt

SEQ ID NO: 58997 - DNA, 20 bp, Artificial Sequence
  chemically synthesized
gatcaggggacctcccttgg

SEQ ID NO: 58998 - DNA, 20 bp, Artificial Sequence
  chemically synthesized
ggggatagatctcccaaggg

SEQ ID NO: 58999 - DNA, 20 bp, Artificial Sequence
  chemically synthesized
aggggatagatctcccaagg

SEQ ID NO: 59000 - DNA, 20 bp, Artificial Sequence
  chemically synthesized
acaggggatagatctcccaa

SEQ ID NO: 59001 - DNA, 20 bp, Artificial Sequence
  chemically synthesized
gacaggggatagatctccca

SEQ ID NO: 59002 - DNA, 20 bp, Artificial Sequence
  chemically synthesized
ggacaggggatagatctccc

SEQ ID NO: 59003 - DNA, 20 bp, Artificial Sequence
  chemically synthesized
aggagcaggaggacagggga

SEQ ID NO: 59004 - DNA, 20 bp, Artificial Sequence
  chemically synthesized
agcaaggagcaggaggacag

SEQ ID NO: 59005 - DNA, 20 bp, Artificial Sequence
  chemically synthesized
gagcaaggagcaggaggaca

SEQ ID NO: 59006 - DNA, 20 bp, Artificial Sequence
  chemically synthesized
agagcaaggagcaggaggac

SEQ ID NO: 59007 - DNA, 20 bp, Artificial Sequence
  chemically synthesized
cagagcaaggagcaggagga

SEQ ID NO: 59008 - DNA, 20 bp, Artificial Sequence
  chemically synthesized
ctcacagagcaaggagcagg

SEQ ID NO: 59009 - DNA, 20 bp, Artificial Sequence
  chemically synthesized
tctcacagagcaaggagcag

SEQ ID NO: 59010 - DNA, 20 bp, Artificial Sequence
  chemically synthesized
tttctcacagagcaaggagc

SEQ ID NO: 59011 - DNA, 20 bp, Artificial Sequence
  chemically synthesized
ctttctcacagagcaaggag

SEQ ID NO: 59012 - DNA, 20 bp, Artificial Sequence
  chemically synthesized
gatctttctcacagagcaag

SEQ ID NO: 59013 - DNA, 20 bp, Artificial Sequence
  chemically synthesized
tggatctttctcacagagca

SEQ ID NO: 59014 - DNA, 20 bp, Artificial Sequence
  chemically synthesized
cctcctgctccttgctctgt

SEQ ID NO: 59015 - DNA, 20 bp, Artificial Sequence
  chemically synthesized
gtggatctttctcacagagc

SEQ ID NO: 59016 - DNA, 20 bp, Artificial Sequence
  chemically synthesized
ctgctccttgctctgtgaga

SEQ ID NO: 59017 - DNA, 20 bp, Artificial Sequence
  chemically synthesized
gtaggtggatctttctcaca

SEQ ID NO: 59018 - DNA, 20 bp, Artificial Sequence
  chemically synthesized
tcgtaggtggatctttctca

SEQ ID NO: 59019 - DNA, 20 bp, Artificial Sequence
  chemically synthesized
tgaggaccagaggtcgtagg

SEQ ID NO: 59020 - DNA, 20 bp, Artificial Sequence
  chemically synthesized
gtctgaggaccagaggtcgt

SEQ ID NO: 59021 - DNA, 20 bp, Artificial Sequence
  chemically synthesized
aaagatccacctacgacctc

SEQ ID NO: 59022 - DNA, 20 bp, Artificial Sequence
  chemically synthesized
agtctgaggaccagaggtcg

SEQ ID NO: 59023 - DNA, 20 bp, Artificial Sequence
  chemically synthesized
ctggttagtctgaggaccag

SEQ ID NO: 59024 - DNA, 20 bp, Artificial Sequence
  chemically synthesized
cacctacgacctctggtcct

SEQ ID NO: 59025 - DNA, 20 bp, Artificial Sequence
  chemically synthesized
gctggttagtctgaggacca

SEQ ID NO: 59026 - DNA, 20 bp, Artificial Sequence
  chemically synthesized
gggctggttagtctgaggac

SEQ ID NO: 59027 - DNA, 20 bp, Artificial Sequence
  chemically synthesized
tccttgggctggttagtctg

SEQ ID NO: 59028 - DNA, 20 bp, Artificial Sequence
  chemically synthesized
ttccttgggctggttagtct

SEQ ID NO: 59029 - DNA, 20 bp, Artificial Sequence
  chemically synthesized
cctctggtcctcagactaac

SEQ ID NO: 59030 - DNA, 20 bp, Artificial Sequence
  chemically synthesized
gtgatgttccttgggctggt

SEQ ID NO: 59031 - DNA, 20 bp, Artificial Sequence
  chemically synthesized
gtcctcagactaaccagccc

SEQ ID NO: 59032 - DNA, 20 bp, Artificial Sequence
  chemically synthesized
tcctcagactaaccagccca

SEQ ID NO: 59033 - DNA, 20 bp, Artificial Sequence
  chemically synthesized
tggtgtgatgttccttgggc

SEQ ID NO: 59034 - DNA, 20 bp, Artificial Sequence
  chemically synthesized
aaattggtgtgatgttcctt

SEQ ID NO: 59035 - DNA, 20 bp, Artificial Sequence
  chemically synthesized
aaaattggtgtgatgttcct

SEQ ID NO: 59036 - DNA, 20 bp, Artificial Sequence
  chemically synthesized
ccgcttacctgatttaaaat

SEQ ID NO: 59037 - DNA, 20 bp, Artificial Sequence
  chemically synthesized
acatcacaccaattttaaat

SEQ ID NO: 59038 - DNA, 20 bp, Artificial Sequence
  chemically synthesized
catcacaccaattttaaatc

SEQ ID NO: 59039 - DNA, 20 bp, Artificial Sequence
  chemically synthesized
acaccaattttaaatcaggt

SEQ ID NO: 59040 - DNA, 20 bp, Artificial Sequence
  chemically synthesized
ccaattttaaatcaggtaag

SEQ ID NO: 59041 - DNA, 20 bp, Artificial Sequence
  chemically synthesized
ttggaggagagagtaaaaag

SEQ ID NO: 59042 - DNA, 20 bp, Artificial Sequence
  chemically synthesized
gttggaggagagagtaaaaa

SEQ ID NO: 59043 - DNA, 20 bp, Artificial Sequence
  chemically synthesized
aggttggaggagagagtaaa

SEQ ID NO: 59044 - DNA, 20 bp, Artificial Sequence
  chemically synthesized
tagtgagaggttggaggaga

SEQ ID NO: 59045 - DNA, 20 bp, Artificial Sequence
  chemically synthesized
gatagtgagaggttggagga

SEQ ID NO: 59046 - DNA, 20 bp, Artificial Sequence
  chemically synthesized
gggatagtgagaggttggag

SEQ ID NO: 59047 - DNA, 20 bp, Artificial Sequence
  chemically synthesized
gagggatagtgagaggttgg

SEQ ID NO: 59048 - DNA, 20 bp, Artificial Sequence
  chemically synthesized
tgagggatagtgagaggttg

SEQ ID NO: 59049 - DNA, 20 bp, Artificial Sequence
  chemically synthesized
gttgagggatagtgagaggt

SEQ ID NO: 59050 - DNA, 20 bp, Artificial Sequence
  chemically synthesized
agaggttgagggatagtgag

SEQ ID NO: 59051 - DNA, 20 bp, Artificial Sequence
  chemically synthesized
aagaggttgagggatagtga

SEQ ID NO: 59052 - DNA, 20 bp, Artificial Sequence
  chemically synthesized
gaaagaggttgagggatagt

SEQ ID NO: 59053 - DNA, 20 bp, Artificial Sequence
  chemically synthesized
aggagaaagaggttgaggga

SEQ ID NO: 59054 - DNA, 20 bp, Artificial Sequence
  chemically synthesized
tgaaaggagaaagaggttga

SEQ ID NO: 59055 - DNA, 20 bp, Artificial Sequence
  chemically synthesized
ttgaaaggagaaagaggttg

SEQ ID NO: 59056 - DNA, 20 bp, Artificial Sequence
  chemically synthesized
attgaaaggagaaagaggtt

SEQ ID NO: 59057 - DNA, 20 bp, Artificial Sequence
  chemically synthesized
ccaagattgaaaggagaaag

SEQ ID NO: 59058 - DNA, 20 bp, Artificial Sequence
  chemically synthesized
gccaagattgaaaggagaaa

SEQ ID NO: 59059 - DNA, 20 bp, Artificial Sequence
  chemically synthesized
gcgccaagattgaaaggaga

SEQ ID NO: 59060 - DNA, 20 bp, Artificial Sequence
  chemically synthesized
tggggcgccaagattgaaag

SEQ ID NO: 59061 - DNA, 20 bp, Artificial Sequence
  chemically synthesized
agtggggcgccaagattgaa

SEQ ID NO: 59062 - DNA, 20 bp, Artificial Sequence
  chemically synthesized
cctctttctcctttcaatct

SEQ ID NO: 59063 - DNA, 20 bp, Artificial Sequence
  chemically synthesized
aagtggggcgccaagattga

SEQ ID NO: 59064 - DNA, 20 bp, Artificial Sequence
  chemically synthesized
agagattgaagtggggcgcc

SEQ ID NO: 59065 - DNA, 20 bp, Artificial Sequence
  chemically synthesized
agaagggagagattgaagtg

SEQ ID NO: 59066 - DNA, 20 bp, Artificial Sequence
  chemically synthesized
gagaagggagagattgaagt

SEQ ID NO: 59067 - DNA, 20 bp, Artificial Sequence
  chemically synthesized
agagaagggagagattgaag

SEQ ID NO: 59068 - DNA, 20 bp, Artificial Sequence
  chemically synthesized
ttaagagaagggagagattg

SEQ ID NO: 59069 - DNA, 20 bp, Artificial Sequence
  chemically synthesized
actgaagttaagagaaggga

SEQ ID NO: 59070 - DNA, 20 bp, Artificial Sequence
  chemically synthesized
gaactgaagttaagagaagg

SEQ ID NO: 59071 - DNA, 20 bp, Artificial Sequence
  chemically synthesized
aggaactgaagttaagagaa

SEQ ID NO: 59072 - DNA, 20 bp, Artificial Sequence
  chemically synthesized
aaggaactgaagttaagaga

SEQ ID NO: 59073 - DNA, 20 bp, Artificial Sequence
  chemically synthesized
aaaggaactgaagttaagag

SEQ ID NO: 59074 - DNA, 20 bp, Artificial Sequence
  chemically synthesized
tctctcccttctcttaactt

SEQ ID NO: 59075 - DNA, 20 bp, Artificial Sequence
  chemically synthesized
aggaaaggaactgaagttaa

SEQ ID NO: 59076 - DNA, 20 bp, Artificial Sequence
  chemically synthesized
aaaggaaaggaactgaagtt

SEQ ID NO: 59077 - DNA, 20 bp, Artificial Sequence
  chemically synthesized
ccagaaaaggaaaggaactg

SEQ ID NO: 59078 - DNA, 20 bp, Artificial Sequence
  chemically synthesized
tgtctctaccagaaaaggaa

SEQ ID NO: 59079 - DNA, 20 bp, Artificial Sequence
  chemically synthesized
ctgtctctaccagaaaagga

SEQ ID NO: 59080 - DNA, 20 bp, Artificial Sequence
  chemically synthesized
cttcagttcctttccttttc

SEQ ID NO: 59081 - DNA, 20 bp, Artificial Sequence
  chemically synthesized
cagttcctttccttttctgg

SEQ ID NO: 59082 - DNA, 20 bp, Artificial Sequence
  chemically synthesized
tctcctgtctctaccagaaa

SEQ ID NO: 59083 - DNA, 20 bp, Artificial Sequence
  chemically synthesized
atctcctgtctctaccagaa

SEQ ID NO: 59084 - DNA, 20 bp, Artificial Sequence
  chemically synthesized
gttcctttccttttctggta

SEQ ID NO: 59085 - DNA, 20 bp, Artificial Sequence
  chemically synthesized
ctttccttttctggtagaga

SEQ ID NO: 59086 - DNA, 20 bp, Artificial Sequence
  chemically synthesized
aacgcatctcctgtctctac

SEQ ID NO: 59087 - DNA, 20 bp, Artificial Sequence
  chemically synthesized
tttccttttctggtagagac

SEQ ID NO: 59088 - DNA, 20 bp, Artificial Sequence
  chemically synthesized
tccttttctggtagagacag

SEQ ID NO: 59089 - DNA, 20 bp, Artificial Sequence
  chemically synthesized
caggagatgcgttttatccg

SEQ ID NO: 59090 - DNA, 20 bp, Artificial Sequence
  chemically synthesized
gtgccggagttttgggtcca

SEQ ID NO: 59091 - DNA, 20 bp, Artificial Sequence
  chemically synthesized
tatccgtggacccaaaactc

SEQ ID NO: 59092 - DNA, 20 bp, Artificial Sequence
  chemically synthesized
gtgaccggtgccggagtttt

SEQ ID NO: 59093 - DNA, 20 bp, Artificial Sequence
  chemically synthesized
cgtgaccggtgccggagttt

SEQ ID NO: 59094 - DNA, 20 bp, Artificial Sequence
  chemically synthesized
tggacccaaaactccggcac

SEQ ID NO: 59095 - DNA, 20 bp, Artificial Sequence
  chemically synthesized
cgagtccgtgaccggtgccg

SEQ ID NO: 59096 - DNA, 20 bp, Artificial Sequence
  chemically synthesized
tccgagtccgtgaccggtgc

SEQ ID NO: 59097 - DNA, 20 bp, Artificial Sequence
  chemically synthesized
caaaactccggcaccggtca

SEQ ID NO: 59098 - DNA, 20 bp, Artificial Sequence
  chemically synthesized
gactcttccgagtccgtgac

SEQ ID NO: 59099 - DNA, 20 bp, Artificial Sequence
  chemically synthesized
tccggcaccggtcacggact

SEQ ID NO: 59100 - DNA, 20 bp, Artificial Sequence
  chemically synthesized
ggcaccggtcacggactcgg

SEQ ID NO: 59101 - DNA, 20 bp, Artificial Sequence
  chemically synthesized
caccggtcacggactcggaa

SEQ ID NO: 59102 - DNA, 20 bp, Artificial Sequence
  chemically synthesized
taccaagggaagactcttcc

SEQ ID NO: 59103 - DNA, 20 bp, Artificial Sequence
  chemically synthesized
gactcggaagagtcttccct

SEQ ID NO: 59104 - DNA, 20 bp, Artificial Sequence
  chemically synthesized
gcgtgattaaataccaaggg

SEQ ID NO: 59105 - DNA, 20 bp, Artificial Sequence
  chemically synthesized
cccgcgtgattaaataccaa

SEQ ID NO: 59106 - DNA, 20 bp, Artificial Sequence
  chemically synthesized
ccccgcgtgattaaatacca

SEQ ID NO: 59107 - DNA, 20 bp, Artificial Sequence
  chemically synthesized
tccccgcgtgattaaatacc

SEQ ID NO: 59108 - DNA, 20 bp, Artificial Sequence
  chemically synthesized
tcccttggtatttaatcacg

SEQ ID NO: 59109 - DNA, 20 bp, Artificial Sequence
  chemically synthesized
cccttggtatttaatcacgc

SEQ ID NO: 59110 - DNA, 20 bp, Artificial Sequence
  chemically synthesized
ccttggtatttaatcacgcg

SEQ ID NO: 59111 - DNA, 20 bp, Artificial Sequence
  chemically synthesized
atgtgggtgaataatcaggc

SEQ ID NO: 59112 - DNA, 20 bp, Artificial Sequence
  chemically synthesized
aatgtgggtgaataatcagg

SEQ ID NO: 59113 - DNA, 20 bp, Artificial Sequence
  chemically synthesized
tgaaatgtgggtgaataatc

SEQ ID NO: 59114 - DNA, 20 bp, Artificial Sequence
  chemically synthesized
ctgaaatgtgggtgaataat

SEQ ID NO: 59115 - DNA, 20 bp, Artificial Sequence
  chemically synthesized
ctgattattcacccacattt

SEQ ID NO: 59116 - DNA, 20 bp, Artificial Sequence
  chemically synthesized
gtcagacacctctgaaatgt

SEQ ID NO: 59117 - DNA, 20 bp, Artificial Sequence
  chemically synthesized
gattattcacccacatttca

SEQ ID NO: 59118 - DNA, 20 bp, Artificial Sequence
  chemically synthesized
ggtcagacacctctgaaatg

SEQ ID NO: 59119 - DNA, 20 bp, Artificial Sequence
  chemically synthesized
attattcacccacatttcag

SEQ ID NO: 59120 - DNA, 20 bp, Artificial Sequence
  chemically synthesized
ttcagaggtgtctgaccaca

SEQ ID NO: 59121 - DNA, 20 bp, Artificial Sequence
  chemically synthesized
tcagaggtgtctgaccacac

SEQ ID NO: 59122 - DNA, 20 bp, Artificial Sequence
  chemically synthesized
ggcaggcgtccccgtgtggt

SEQ ID NO: 59123 - DNA, 20 bp, Artificial Sequence
  chemically synthesized
cagaggtgtctgaccacacg

SEQ ID NO: 59124 - DNA, 20 bp, Artificial Sequence
  chemically synthesized
ccaaggcaggcgtccccgtg

SEQ ID NO: 59125 - DNA, 20 bp, Artificial Sequence
  chemically synthesized
ccacacggggacgcctgcct

SEQ ID NO: 59126 - DNA, 20 bp, Artificial Sequence
  chemically synthesized
taaaggtgaaggaccaaggc

SEQ ID NO: 59127 - DNA, 20 bp, Artificial Sequence
  chemically synthesized
ctaaaggtgaaggaccaagg

SEQ ID NO: 59128 - DNA, 20 bp, Artificial Sequence
  chemically synthesized
ccgctaaaggtgaaggacca

SEQ ID NO: 59129 - DNA, 20 bp, Artificial Sequence
  chemically synthesized
gccgctaaaggtgaaggacc

SEQ ID NO: 59130 - DNA, 20 bp, Artificial Sequence
  chemically synthesized
ctgccttggtccttcacctt

SEQ ID NO: 59131 - DNA, 20 bp, Artificial Sequence
  chemically synthesized
gtacttgccgctaaaggtga

SEQ ID NO: 59132 - DNA, 20 bp, Artificial Sequence
  chemically synthesized
ggtacttgccgctaaaggtg

SEQ ID NO: 59133 - DNA, 20 bp, Artificial Sequence
  chemically synthesized
ccttggtccttcacctttag

SEQ ID NO: 59134 - DNA, 20 bp, Artificial Sequence
  chemically synthesized
aaagcggtacttgccgctaa

SEQ ID NO: 59135 - DNA, 20 bp, Artificial Sequence
  chemically synthesized
ggtccttcacctttagcggc

SEQ ID NO: 59136 - DNA, 20 bp, Artificial Sequence
  chemically synthesized
aaaagcggtacttgccgcta

SEQ ID NO: 59137 - DNA, 20 bp, Artificial Sequence
  chemically synthesized
gcggcaagtaccgcttttct

SEQ ID NO: 59138 - DNA, 20 bp, Artificial Sequence
  chemically synthesized
gttcttgcccccgagaaaag

SEQ ID NO: 59139 - DNA, 20 bp, Artificial Sequence
  chemically synthesized
cggcaagtaccgcttttctc

SEQ ID NO: 59140 - DNA, 20 bp, Artificial Sequence
  chemically synthesized
ggcaagtaccgcttttctcg

SEQ ID NO: 59141 - DNA, 20 bp, Artificial Sequence
  chemically synthesized
gcaagtaccgcttttctcgg

SEQ ID NO: 59142 - DNA, 20 bp, Artificial Sequence
  chemically synthesized
ggggttcttgcccccgagaa

SEQ ID NO: 59143 - DNA, 20 bp, Artificial Sequence
  chemically synthesized
gtaccgcttttctcgggggc

SEQ ID NO: 59144 - DNA, 20 bp, Artificial Sequence
  chemically synthesized
gttggggggttcttgccccc

SEQ ID NO: 59145 - DNA, 20 bp, Artificial Sequence
  chemically synthesized
acatggagagaagggttggg

SEQ ID NO: 59146 - DNA, 20 bp, Artificial Sequence
  chemically synthesized
gacatggagagaagggttgg

SEQ ID NO: 59147 - DNA, 20 bp, Artificial Sequence
  chemically synthesized
agacatggagagaagggttg

SEQ ID NO: 59148 - DNA, 20 bp, Artificial Sequence
  chemically synthesized
gagacatggagagaagggtt

SEQ ID NO: 59149 - DNA, 20 bp, Artificial Sequence
  chemically synthesized
agagacatggagagaagggt

SEQ ID NO: 59150 - DNA, 20 bp, Artificial Sequence
  chemically synthesized
gggtagagacatggagagaa

SEQ ID NO: 59151 - DNA, 20 bp, Artificial Sequence
  chemically synthesized
ggggtagagacatggagaga

SEQ ID NO: 59152 - DNA, 20 bp, Artificial Sequence
  chemically synthesized
aggggtagagacatggagag

SEQ ID NO: 59153 - DNA, 20 bp, Artificial Sequence
  chemically synthesized
agaaggggtagagacatgga

SEQ ID NO: 59154 - DNA, 20 bp, Artificial Sequence
  chemically synthesized
ggagaaggggtagagacatg

SEQ ID NO: 59155 - DNA, 20 bp, Artificial Sequence
  chemically synthesized
gcggagaaggggtagagaca

SEQ ID NO: 59156 - DNA, 20 bp, Artificial Sequence
  chemically synthesized
agaaaagcggagaaggggta

SEQ ID NO: 59157 - DNA, 20 bp, Artificial Sequence
  chemically synthesized
ccagaaaagcggagaagggg

SEQ ID NO: 59158 - DNA, 20 bp, Artificial Sequence
  chemically synthesized
cccccagaaaagcggagaag

SEQ ID NO: 59159 - DNA, 20 bp, Artificial Sequence
  chemically synthesized
tcccccagaaaagcggagaa

SEQ ID NO: 59160 - DNA, 20 bp, Artificial Sequence
  chemically synthesized
gtcccccagaaaagcggaga

SEQ ID NO: 59161 - DNA, 20 bp, Artificial Sequence
  chemically synthesized
tgtcccccagaaaagcggag

SEQ ID NO: 59162 - DNA, 20 bp, Artificial Sequence
  chemically synthesized
tcttgtcccccagaaaagcg

SEQ ID NO: 59163 - DNA, 20 bp, Artificial Sequence
  chemically synthesized
ctaccccttctccgcttttc

SEQ ID NO: 59164 - DNA, 20 bp, Artificial Sequence
  chemically synthesized
taccccttctccgcttttct

SEQ ID NO: 59165 - DNA, 20 bp, Artificial Sequence
  chemically synthesized
gttcttgtcccccagaaaag

SEQ ID NO: 59166 - DNA, 20 bp, Artificial Sequence
  chemically synthesized
accccttctccgcttttctg

SEQ ID NO: 59167 - DNA, 20 bp, Artificial Sequence
  chemically synthesized
ccccttctccgcttttctgg

SEQ ID NO: 59168 - DNA, 20 bp, Artificial Sequence
  chemically synthesized
ggggttcttgtcccccagaa

SEQ ID NO: 59169 - DNA, 20 bp, Artificial Sequence
  chemically synthesized
tctccgcttttctgggggac

SEQ ID NO: 59170 - DNA, 20 bp, Artificial Sequence
  chemically synthesized
ggtggggggttcttgtcccc

SEQ ID NO: 59171 - DNA, 20 bp, Artificial Sequence
  chemically synthesized
acacggagagaaggggtggg

SEQ ID NO: 59172 - DNA, 20 bp, Artificial Sequence
  chemically synthesized
gacacggagagaaggggtgg

SEQ ID NO: 59173 - DNA, 20 bp, Artificial Sequence
  chemically synthesized
agacacggagagaaggggtg

SEQ ID NO: 59174 - DNA, 20 bp, Artificial Sequence
  chemically synthesized
gagacacggagagaaggggt

SEQ ID NO: 59175 - DNA, 20 bp, Artificial Sequence
  chemically synthesized
agagacacggagagaagggg

SEQ ID NO: 59176 - DNA, 20 bp, Artificial Sequence
  chemically synthesized
agtagagacacggagagaag

SEQ ID NO: 59177 - DNA, 20 bp, Artificial Sequence
  chemically synthesized
gagtagagacacggagagaa

SEQ ID NO: 59178 - DNA, 20 bp, Artificial Sequence
  chemically synthesized
ggagtagagacacggagaga

SEQ ID NO: 59179 - DNA, 20 bp, Artificial Sequence
  chemically synthesized
gggagtagagacacggagag

SEQ ID NO: 59180 - DNA, 20 bp, Artificial Sequence
  chemically synthesized
aaagggagtagagacacgga

SEQ ID NO: 59181 - DNA, 20 bp, Artificial Sequence
  chemically synthesized
gaaaagggagtagagacacg

SEQ ID NO: 59182 - DNA, 20 bp, Artificial Sequence
  chemically synthesized
gagaaaagggagtagagaca

SEQ ID NO: 59183 - DNA, 20 bp, Artificial Sequence
  chemically synthesized
agcccagagaaaagggagta

SEQ ID NO: 59184 - DNA, 20 bp, Artificial Sequence
  chemically synthesized
caagcccagagaaaagggag

SEQ ID NO: 59185 - DNA, 20 bp, Artificial Sequence
  chemically synthesized
aggcaagcccagagaaaagg

SEQ ID NO: 59186 - DNA, 20 bp, Artificial Sequence
  chemically synthesized
tgtctctactcccttttctc

SEQ ID NO: 59187 - DNA, 20 bp, Artificial Sequence
  chemically synthesized
ggaggcaagcccagagaaaa

SEQ ID NO: 59188 - DNA, 20 bp, Artificial Sequence
  chemically synthesized
gtctctactcccttttctct

SEQ ID NO: 59189 - DNA, 20 bp, Artificial Sequence
  chemically synthesized
aggaggcaagcccagagaaa

SEQ ID NO: 59190 - DNA, 20 bp, Artificial Sequence
  chemically synthesized
aaggaggcaagcccagagaa

SEQ ID NO: 59191 - DNA, 20 bp, Artificial Sequence
  chemically synthesized
tagtgaaggaggcaagccca

SEQ ID NO: 59192 - DNA, 20 bp, Artificial Sequence
  chemically synthesized
catagtgaaggaggcaagcc

SEQ ID NO: 59193 - DNA, 20 bp, Artificial Sequence
  chemically synthesized
ttgcccatagtgaaggaggc

SEQ ID NO: 59194 - DNA, 20 bp, Artificial Sequence
  chemically synthesized
aaggttgcccatagtgaagg

SEQ ID NO: 59195 - DNA, 20 bp, Artificial Sequence
  chemically synthesized
gaaggttgcccatagtgaag

SEQ ID NO: 59196 - DNA, 20 bp, Artificial Sequence
  chemically synthesized
tgggcttgcctccttcacta

SEQ ID NO: 59197 - DNA, 20 bp, Artificial Sequence
  chemically synthesized
gggcttgcctccttcactat

SEQ ID NO: 59198 - DNA, 20 bp, Artificial Sequence
  chemically synthesized
tggaaggttgcccatagtga

SEQ ID NO: 59199 - DNA, 20 bp, Artificial Sequence
  chemically synthesized
gtggaaggttgcccatagtg

SEQ ID NO: 59200 - DNA, 20 bp, Artificial Sequence
  chemically synthesized
ggagggtggaaggttgccca

SEQ ID NO: 59201 - DNA, 20 bp, Artificial Sequence
  chemically synthesized
aaggaggaatggagggtgga

SEQ ID NO: 59202 - DNA, 20 bp, Artificial Sequence
  chemically synthesized
aaaggaggaatggagggtgg

SEQ ID NO: 59203 - DNA, 20 bp, Artificial Sequence
  chemically synthesized
gaaaaaggaggaatggaggg

SEQ ID NO: 59204 - DNA, 20 bp, Artificial Sequence
  chemically synthesized
ggagaaaaaggaggaatgga

SEQ ID NO: 59205 - DNA, 20 bp, Artificial Sequence
  chemically synthesized
gggagaaaaaggaggaatgg

SEQ ID NO: 59206 - DNA, 20 bp, Artificial Sequence
  chemically synthesized
agggagaaaaaggaggaatg

SEQ ID NO: 59207 - DNA, 20 bp, Artificial Sequence
  chemically synthesized
taagggagaaaaaggaggaa

SEQ ID NO: 59208 - DNA, 20 bp, Artificial Sequence
  chemically synthesized
caggctaagggagaaaaagg

SEQ ID NO: 59209 - DNA, 20 bp, Artificial Sequence
  chemically synthesized
acaggctaagggagaaaaag

SEQ ID NO: 59210 - DNA, 20 bp, Artificial Sequence
  chemically synthesized
gcacaggctaagggagaaaa

SEQ ID NO: 59211 - DNA, 20 bp, Artificial Sequence
  chemically synthesized
agcacaggctaagggagaaa

SEQ ID NO: 59212 - DNA, 20 bp, Artificial Sequence
  chemically synthesized
cattcctcctttttctccct

SEQ ID NO: 59213 - DNA, 20 bp, Artificial Sequence
  chemically synthesized
cttgagagcacaggctaagg

SEQ ID NO: 59214 - DNA, 20 bp, Artificial Sequence
  chemically synthesized
ttcttgagagcacaggctaa

SEQ ID NO: 59215 - DNA, 20 bp, Artificial Sequence
  chemically synthesized
gttcttgagagcacaggcta

SEQ ID NO: 59216 - DNA, 20 bp, Artificial Sequence
  chemically synthesized
agttcttgagagcacaggct

SEQ ID NO: 59217 - DNA, 20 bp, Artificial Sequence
  chemically synthesized
ttttaagttcttgagagcac

SEQ ID NO: 59218 - DNA, 20 bp, Artificial Sequence
  chemically synthesized
ctcccttagcctgtgctctc

SEQ ID NO: 59219 - DNA, 20 bp, Artificial Sequence
  chemically synthesized
gttttaagttcttgagagca

SEQ ID NO: 59220 - DNA, 20 bp, Artificial Sequence
  chemically synthesized
aagaggttttaagttcttga

SEQ ID NO: 59221 - DNA, 20 bp, Artificial Sequence
  chemically synthesized
tgaagaggttttaagttctt

SEQ ID NO: 59222 - DNA, 20 bp, Artificial Sequence
  chemically synthesized
gtgtgagttgaagaggtttt

SEQ ID NO: 59223 - DNA, 20 bp, Artificial Sequence
  chemically synthesized
aggtcaggtgtgagttgaag

SEQ ID NO: 59224 - DNA, 20 bp, Artificial Sequence
  chemically synthesized
taggtcaggtgtgagttgaa

SEQ ID NO: 59225 - DNA, 20 bp, Artificial Sequence
  chemically synthesized
tttaggtcaggtgtgagttg

SEQ ID NO: 59226 - DNA, 20 bp, Artificial Sequence
  chemically synthesized
ttaggttttaggtcaggtgt

SEQ ID NO: 59227 - DNA, 20 bp, Artificial Sequence
  chemically synthesized
aggcatttaggttttaggtc

SEQ ID NO: 59228 - DNA, 20 bp, Artificial Sequence
  chemically synthesized
aaggcatttaggttttaggt

SEQ ID NO: 59229 - DNA, 20 bp, Artificial Sequence
  chemically synthesized
aaataaggcatttaggtttt

SEQ ID NO: 59230 - DNA, 20 bp, Artificial Sequence
  chemically synthesized
aaaataaggcatttaggttt

SEQ ID NO: 59231 - DNA, 20 bp, Artificial Sequence
  chemically synthesized
cagaagaaaataaggcattt

SEQ ID NO: 59232 - DNA, 20 bp, Artificial Sequence
  chemically synthesized
gcagaagaaaataaggcatt

SEQ ID NO: 59233 - DNA, 20 bp, Artificial Sequence
  chemically synthesized
tggcatcgcagaagaaaata

SEQ ID NO: 59234 - DNA, 20 bp, Artificial Sequence
  chemically synthesized
gtggcatcgcagaagaaaat

SEQ ID NO: 59235 - DNA, 20 bp, Artificial Sequence
  chemically synthesized
ggggtcaagtggcatcgcag

SEQ ID NO: 59236 - DNA, 20 bp, Artificial Sequence
  chemically synthesized
actggggtcaagtggcatcg

SEQ ID NO: 59237 - DNA, 20 bp, Artificial Sequence
  chemically synthesized
aagtttgtactggggtcaag

SEQ ID NO: 59238 - DNA, 20 bp, Artificial Sequence
  chemically synthesized
tctgcgatgccacttgaccc

SEQ ID NO: 59239 - DNA, 20 bp, Artificial Sequence
  chemically synthesized
gtcaagtttgtactggggtc

SEQ ID NO: 59240 - DNA, 20 bp, Artificial Sequence
  chemically synthesized
ctactgtcaagtttgtactg

SEQ ID NO: 59241 - DNA, 20 bp, Artificial Sequence
  chemically synthesized
actactgtcaagtttgtact

SEQ ID NO: 59242 - DNA, 20 bp, Artificial Sequence
  chemically synthesized
aactactgtcaagtttgtac

SEQ ID NO: 59243 - DNA, 20 bp, Artificial Sequence
  chemically synthesized
tgaccccagtacaaacttga

SEQ ID NO: 59244 - DNA, 20 bp, Artificial Sequence
  chemically synthesized
ccccagtacaaacttgacag

SEQ ID NO: 59245 - DNA, 20 bp, Artificial Sequence
  chemically synthesized
ggctatttggaactactgtc

SEQ ID NO: 59246 - DNA, 20 bp, Artificial Sequence
  chemically synthesized
aacttgacagtagttccaaa

SEQ ID NO: 59247 - DNA, 20 bp, Artificial Sequence
  chemically synthesized
tgacagtagttccaaatagc

SEQ ID NO: 59248 - DNA, 20 bp, Artificial Sequence
  chemically synthesized
agtgccgttttctggctatt

SEQ ID NO: 59249 - DNA, 20 bp, Artificial Sequence
  chemically synthesized
agttccaaatagccagaaaa

SEQ ID NO: 59250 - DNA, 20 bp, Artificial Sequence
  chemically synthesized
aaattgaaagtgccgttttc

SEQ ID NO: 59251 - DNA, 20 bp, Artificial Sequence
  chemically synthesized
ttgtaggatggaaaaattga

SEQ ID NO: 59252 - DNA, 20 bp, Artificial Sequence
  chemically synthesized
tttcaatttttccatcctac

SEQ ID NO: 59253 - DNA, 20 bp, Artificial Sequence
  chemically synthesized
attatttagagcttgtagga

SEQ ID NO: 59254 - DNA, 20 bp, Artificial Sequence
  chemically synthesized
aagaattatttagagcttgt

SEQ ID NO: 59255 - DNA, 20 bp, Artificial Sequence
  chemically synthesized
caagaattatttagagcttg

SEQ ID NO: 59256 - DNA, 20 bp, Artificial Sequence
  chemically synthesized
tttatgacaagaattattta

SEQ ID NO: 59257 - DNA, 20 bp, Artificial Sequence
  chemically synthesized
attttatgacaagaattatt

SEQ ID NO: 59258 - DNA, 20 bp, Artificial Sequence
  chemically synthesized
ccgtttgcctattttatgac

SEQ ID NO: 59259 - DNA, 20 bp, Artificial Sequence
  chemically synthesized
aaataattcttgtcataaaa

SEQ ID NO: 59260 - DNA, 20 bp, Artificial Sequence
  chemically synthesized
aataattcttgtcataaaat

SEQ ID NO: 59261 - DNA, 20 bp, Artificial Sequence
  chemically synthesized
cttgtcataaaataggcaaa

SEQ ID NO: 59262 - DNA, 20 bp, Artificial Sequence
  chemically synthesized
ataaaataggcaaacggtct

SEQ ID NO: 59263 - DNA, 20 bp, Artificial Sequence
  chemically synthesized
taaaataggcaaacggtctg

SEQ ID NO: 59264 - DNA, 20 bp, Artificial Sequence
  chemically synthesized
tgcctggacatcaggcacct

SEQ ID NO: 59265 - DNA, 20 bp, Artificial Sequence
  chemically synthesized
ggtctgaggtgcctgatgtc

SEQ ID NO: 59266 - DNA, 20 bp, Artificial Sequence
  chemically synthesized
gtctgaggtgcctgatgtcc

SEQ ID NO: 59267 - DNA, 20 bp, Artificial Sequence
  chemically synthesized
taaaagaatgcctggacatc

SEQ ID NO: 59268 - DNA, 20 bp, Artificial Sequence
  chemically synthesized
gtaaaagaatgcctggacat

SEQ ID NO: 59269 - DNA, 20 bp, Artificial Sequence
  chemically synthesized
cagatgtgtaaaagaatgcc

SEQ ID NO: 59270 - DNA, 20 bp, Artificial Sequence
  chemically synthesized
ggggaggggcagatgtgtaa

SEQ ID NO: 59271 - DNA, 20 bp, Artificial Sequence
  chemically synthesized
gaacagagactggggagggg

SEQ ID NO: 59272 - DNA, 20 bp, Artificial Sequence
  chemically synthesized
tttacacatctgcccctccc

SEQ ID NO: 59273 - DNA, 20 bp, Artificial Sequence
  chemically synthesized
tgggaacagagactggggag

SEQ ID NO: 59274 - DNA, 20 bp, Artificial Sequence
  chemically synthesized
ttgggaacagagactgggga

SEQ ID NO: 59275 - DNA, 20 bp, Artificial Sequence
  chemically synthesized
attgggaacagagactgggg

SEQ ID NO: 59276 - DNA, 20 bp, Artificial Sequence
  chemically synthesized
cattgggaacagagactggg

SEQ ID NO: 59277 - DNA, 20 bp, Artificial Sequence
  chemically synthesized
tgcattgggaacagagactg

SEQ ID NO: 59278 - DNA, 20 bp, Artificial Sequence
  chemically synthesized
ttgcattgggaacagagact

SEQ ID NO: 59279 - DNA, 20 bp, Artificial Sequence
  chemically synthesized
gttgcattgggaacagagac

SEQ ID NO: 59280 - DNA, 20 bp, Artificial Sequence
  chemically synthesized
aaggagttgcattgggaaca

SEQ ID NO: 59281 - DNA, 20 bp, Artificial Sequence
  chemically synthesized
ggaaggagttgcattgggaa

SEQ ID NO: 59282 - DNA, 20 bp, Artificial Sequence
  chemically synthesized
gatttggaaggagttgcatt

SEQ ID NO: 59283 - DNA, 20 bp, Artificial Sequence
  chemically synthesized
agatttggaaggagttgcat

SEQ ID NO: 59284 - DNA, 20 bp, Artificial Sequence
  chemically synthesized
aaagaaggaagatttggaag

SEQ ID NO: 59285 - DNA, 20 bp, Artificial Sequence
  chemically synthesized
ggaaagaaggaagatttgga

SEQ ID NO: 59286 - DNA, 20 bp, Artificial Sequence
  chemically synthesized
gggaaagaaggaagatttgg

SEQ ID NO: 59287 - DNA, 20 bp, Artificial Sequence
  chemically synthesized
ggagggaaagaaggaagatt

SEQ ID NO: 59288 - DNA, 20 bp, Artificial Sequence
  chemically synthesized
caggtgggagggaaagaagg

SEQ ID NO: 59289 - DNA, 20 bp, Artificial Sequence
  chemically synthesized
ggacaggtgggagggaaaga

SEQ ID NO: 59290 - DNA, 20 bp, Artificial Sequence
  chemically synthesized
gggacaggtgggagggaaag

SEQ ID NO: 59291 - DNA, 20 bp, Artificial Sequence
  chemically synthesized
gaggggacaggtgggaggga

SEQ ID NO: 59292 - DNA, 20 bp, Artificial Sequence
  chemically synthesized
gactgaggggacaggtggga

SEQ ID NO: 59293 - DNA, 20 bp, Artificial Sequence
  chemically synthesized
ggactgaggggacaggtggg

SEQ ID NO: 59294 - DNA, 20 bp, Artificial Sequence
  chemically synthesized
gggactgaggggacaggtgg

SEQ ID NO: 59295 - DNA, 20 bp, Artificial Sequence
  chemically synthesized
ttgggactgaggggacaggt

SEQ ID NO: 59296 - DNA, 20 bp, Artificial Sequence
  chemically synthesized
gttgggactgaggggacagg

SEQ ID NO: 59297 - DNA, 20 bp, Artificial Sequence
  chemically synthesized
ttccctcccacctgtcccct

SEQ ID NO: 59298 - DNA, 20 bp, Artificial Sequence
  chemically synthesized
ggggttgggactgaggggac

SEQ ID NO: 59299 - DNA, 20 bp, Artificial Sequence
  chemically synthesized
tggggttgggactgagggga

SEQ ID NO: 59300 - DNA, 20 bp, Artificial Sequence
  chemically synthesized
tgcttggggttgggactgag

SEQ ID NO: 59301 - DNA, 20 bp, Artificial Sequence
  chemically synthesized
atgcttggggttgggactga

SEQ ID NO: 59302 - DNA, 20 bp, Artificial Sequence
  chemically synthesized
gatgcttggggttgggactg

SEQ ID NO: 59303 - DNA, 20 bp, Artificial Sequence
  chemically synthesized
cgatgcttggggttgggact

SEQ ID NO: 59304 - DNA, 20 bp, Artificial Sequence
  chemically synthesized
gtcccctcagtcccaacccc

SEQ ID NO: 59305 - DNA, 20 bp, Artificial Sequence
  chemically synthesized
actgagcgatgcttggggtt

SEQ ID NO: 59306 - DNA, 20 bp, Artificial Sequence
  chemically synthesized
gactgagcgatgcttggggt

SEQ ID NO: 59307 - DNA, 20 bp, Artificial Sequence
  chemically synthesized
gaaagactgagcgatgcttg

SEQ ID NO: 59308 - DNA, 20 bp, Artificial Sequence
  chemically synthesized
agaaagactgagcgatgctt

SEQ ID NO: 59309 - DNA, 20 bp, Artificial Sequence
  chemically synthesized
tagaaagactgagcgatgct

SEQ ID NO: 59310 - DNA, 20 bp, Artificial Sequence
  chemically synthesized
tcccaaccccaagcatcgct

SEQ ID NO: 59311 - DNA, 20 bp, Artificial Sequence
  chemically synthesized
aaaggaagattagaaagact

SEQ ID NO: 59312 - DNA, 20 bp, Artificial Sequence
  chemically synthesized
tgtagaaaaggaagattaga

SEQ ID NO: 59313 - DNA, 20 bp, Artificial Sequence
  chemically synthesized
ggtctgtagaaaaggaagat

SEQ ID NO: 59314 - DNA, 20 bp, Artificial Sequence
  chemically synthesized
agatgggtctgtagaaaagg

SEQ ID NO: 59315 - DNA, 20 bp, Artificial Sequence
  chemically synthesized
tttctaatcttccttttcta

SEQ ID NO: 59316 - DNA, 20 bp, Artificial Sequence
  chemically synthesized
gtcagatgggtctgtagaaa

SEQ ID NO: 59317 - DNA, 20 bp, Artificial Sequence
  chemically synthesized
ggtcagatgggtctgtagaa

SEQ ID NO: 59318 - DNA, 20 bp, Artificial Sequence
  chemically synthesized
ggagaggtcagatgggtctg

SEQ ID NO: 59319 - DNA, 20 bp, Artificial Sequence
  chemically synthesized
gaggaggggagaggtcagat

SEQ ID NO: 59320 - DNA, 20 bp, Artificial Sequence
  chemically synthesized
cgaggaggggagaggtcaga

SEQ ID NO: 59321 - DNA, 20 bp, Artificial Sequence
  chemically synthesized
ctggcgaggaggggagaggt

SEQ ID NO: 59322 - DNA, 20 bp, Artificial Sequence
  chemically synthesized
gggcctggcgaggaggggag

SEQ ID NO: 59323 - DNA, 20 bp, Artificial Sequence
  chemically synthesized
tgggcctggcgaggagggga

SEQ ID NO: 59324 - DNA, 20 bp, Artificial Sequence
  chemically synthesized
attgggcctggcgaggaggg

SEQ ID NO: 59325 - DNA, 20 bp, Artificial Sequence
  chemically synthesized
taattgggcctggcgaggag

SEQ ID NO: 59326 - DNA, 20 bp, Artificial Sequence
  chemically synthesized
ctgacctctcccctcctcgc

SEQ ID NO: 59327 - DNA, 20 bp, Artificial Sequence
  chemically synthesized
ataattgggcctggcgagga

SEQ ID NO: 59328 - DNA, 20 bp, Artificial Sequence
  chemically synthesized
tgacctctcccctcctcgcc

SEQ ID NO: 59329 - DNA, 20 bp, Artificial Sequence
  chemically synthesized
aataattgggcctggcgagg

SEQ ID NO: 59330 - DNA, 20 bp, Artificial Sequence
  chemically synthesized
gaataattgggcctggcgag

SEQ ID NO: 59331 - DNA, 20 bp, Artificial Sequence
  chemically synthesized
aggaataattgggcctggcg

SEQ ID NO: 59332 - DNA, 20 bp, Artificial Sequence
  chemically synthesized
gaggaataattgggcctggc

SEQ ID NO: 59333 - DNA, 20 bp, Artificial Sequence
  chemically synthesized
ggctgaggaataattgggcc

SEQ ID NO: 59334 - DNA, 20 bp, Artificial Sequence
  chemically synthesized
gcagaggctgaggaataatt

SEQ ID NO: 59335 - DNA, 20 bp, Artificial Sequence
  chemically synthesized
agcagaggctgaggaataat

SEQ ID NO: 59336 - DNA, 20 bp, Artificial Sequence
  chemically synthesized
cgccaggcccaattattcct

SEQ ID NO: 59337 - DNA, 20 bp, Artificial Sequence
  chemically synthesized
gggtggaggagcagaggctg

SEQ ID NO: 59338 - DNA, 20 bp, Artificial Sequence
  chemically synthesized
agggtggaggagcagaggct

SEQ ID NO: 59339 - DNA, 20 bp, Artificial Sequence
  chemically synthesized
attatagggtggaggagcag

SEQ ID NO: 59340 - DNA, 20 bp, Artificial Sequence
  chemically synthesized
gattatagggtggaggagca

SEQ ID NO: 59341 - DNA, 20 bp, Artificial Sequence
  chemically synthesized
aggattatagggtggaggag

SEQ ID NO: 59342 - DNA, 20 bp, Artificial Sequence
  chemically synthesized
aaaaggattatagggtggag

SEQ ID NO: 59343 - DNA, 20 bp, Artificial Sequence
  chemically synthesized
ataaaaggattatagggtgg

SEQ ID NO: 59344 - DNA, 20 bp, Artificial Sequence
  chemically synthesized
gataaaaggattatagggtg

SEQ ID NO: 59345 - DNA, 20 bp, Artificial Sequence
  chemically synthesized
gtgataaaaggattataggg

SEQ ID NO: 59346 - DNA, 20 bp, Artificial Sequence
  chemically synthesized
gaggtgataaaaggattata

SEQ ID NO: 59347 - DNA, 20 bp, Artificial Sequence
  chemically synthesized
ggaggtgataaaaggattat

SEQ ID NO: 59348 - DNA, 20 bp, Artificial Sequence
  chemically synthesized
cggaggtgataaaaggatta

SEQ ID NO: 59349 - DNA, 20 bp, Artificial Sequence
  chemically synthesized
tgaggagcggaggtgataaa

SEQ ID NO: 59350 - DNA, 20 bp, Artificial Sequence
  chemically synthesized
gtgaggagcggaggtgataa

SEQ ID NO: 59351 - DNA, 20 bp, Artificial Sequence
  chemically synthesized
ggaccgggtgtgaggagcgg

SEQ ID NO: 59352 - DNA, 20 bp, Artificial Sequence
  chemically synthesized
cggaccgggtgtgaggagcg

SEQ ID NO: 59353 - DNA, 20 bp, Artificial Sequence
  chemically synthesized
gccggaccgggtgtgaggag

SEQ ID NO: 59354 - DNA, 20 bp, Artificial Sequence
  chemically synthesized
taagccggaccgggtgtgag

SEQ ID NO: 59355 - DNA, 20 bp, Artificial Sequence
  chemically synthesized
tcacctccgctcctcacacc

SEQ ID NO: 59356 - DNA, 20 bp, Artificial Sequence
  chemically synthesized
tgtaagccggaccgggtgtg

SEQ ID NO: 59357 - DNA, 20 bp, Artificial Sequence
  chemically synthesized
ctgtaagccggaccgggtgt

SEQ ID NO: 59358 - DNA, 20 bp, Artificial Sequence
  chemically synthesized
tccgctcctcacacccggtc

SEQ ID NO: 59359 - DNA, 20 bp, Artificial Sequence
  chemically synthesized
aggaaactgtaagccggacc

SEQ ID NO: 59360 - DNA, 20 bp, Artificial Sequence
  chemically synthesized
aaggaaactgtaagccggac

SEQ ID NO: 59361 - DNA, 20 bp, Artificial Sequence
  chemically synthesized
ctcacacccggtccggctta

SEQ ID NO: 59362 - DNA, 20 bp, Artificial Sequence
  chemically synthesized
catggaaggaaactgtaagc

SEQ ID NO: 59363 - DNA, 20 bp, Artificial Sequence
  chemically synthesized
tagtcatggaaggaaactgt

SEQ ID NO: 59364 - DNA, 20 bp, Artificial Sequence
  chemically synthesized
gggggagggctagtcatgga

SEQ ID NO: 59365 - DNA, 20 bp, Artificial Sequence
  chemically synthesized
ttacagtttccttccatgac

SEQ ID NO: 59366 - DNA, 20 bp, Artificial Sequence
  chemically synthesized
tgggggagggctagtcatgg

SEQ ID NO: 59367 - DNA, 20 bp, Artificial Sequence
  chemically synthesized
aggtgggggagggctagtca

SEQ ID NO: 59368 - DNA, 20 bp, Artificial Sequence
  chemically synthesized
ctgggcaggtgggggagggc

SEQ ID NO: 59369 - DNA, 20 bp, Artificial Sequence
  chemically synthesized
attgctgggcaggtggggga

SEQ ID NO: 59370 - DNA, 20 bp, Artificial Sequence
  chemically synthesized
aattgctgggcaggtggggg

SEQ ID NO: 59371 - DNA, 20 bp, Artificial Sequence
  chemically synthesized
aaattgctgggcaggtgggg

SEQ ID NO: 59372 - DNA, 20 bp, Artificial Sequence
  chemically synthesized
ggaaattgctgggcaggtgg

SEQ ID NO: 59373 - DNA, 20 bp, Artificial Sequence
  chemically synthesized
aggaaattgctgggcaggtg

SEQ ID NO: 59374 - DNA, 20 bp, Artificial Sequence
  chemically synthesized
ctagccctcccccacctgcc

SEQ ID NO: 59375 - DNA, 20 bp, Artificial Sequence
  chemically synthesized
gaggaaattgctgggcaggt

SEQ ID NO: 59376 - DNA, 20 bp, Artificial Sequence
  chemically synthesized
agaggaaattgctgggcagg

SEQ ID NO: 59377 - DNA, 20 bp, Artificial Sequence
  chemically synthesized
ttaagaggaaattgctgggc

SEQ ID NO: 59378 - DNA, 20 bp, Artificial Sequence
  chemically synthesized
tttaagaggaaattgctggg

SEQ ID NO: 59379 - DNA, 20 bp, Artificial Sequence
  chemically synthesized
ctttttaagaggaaattgct

SEQ ID NO: 59380 - DNA, 20 bp, Artificial Sequence
  chemically synthesized
cctttttaagaggaaattgc

SEQ ID NO: 59381 - DNA, 20 bp, Artificial Sequence
  chemically synthesized
cccagcaatttcctcttaaa

SEQ ID NO: 59382 - DNA, 20 bp, Artificial Sequence
  chemically synthesized
ccagcaatttcctcttaaaa

SEQ ID NO: 59383 - DNA, 20 bp, Artificial Sequence
  chemically synthesized
gctccagccacctttttaag

SEQ ID NO: 59384 - DNA, 20 bp, Artificial Sequence
  chemically synthesized
agctccagccacctttttaa

SEQ ID NO: 59385 - DNA, 20 bp, Artificial Sequence
  chemically synthesized
gcaatttcctcttaaaaagg

SEQ ID NO: 59386 - DNA, 20 bp, Artificial Sequence
  chemically synthesized
ttagctccagccaccttttt

SEQ ID NO: 59387 - DNA, 20 bp, Artificial Sequence
  chemically synthesized
tttcctcttaaaaaggtggc

SEQ ID NO: 59388 - DNA, 20 bp, Artificial Sequence
  chemically synthesized
tcctcttaaaaaggtggctg

SEQ ID NO: 59389 - DNA, 20 bp, Artificial Sequence
  chemically synthesized
taaaaaggtggctggagcta

SEQ ID NO: 59390 - DNA, 20 bp, Artificial Sequence
  chemically synthesized
aaaaaggtggctggagctaa

SEQ ID NO: 59391 - DNA, 20 bp, Artificial Sequence
  chemically synthesized
cttgactatgcctttagctc

SEQ ID NO: 59392 - DNA, 20 bp, Artificial Sequence
  chemically synthesized
ggtggctggagctaaaggca

SEQ ID NO: 59393 - DNA, 20 bp, Artificial Sequence
  chemically synthesized
attaaccttgactatgcctt

SEQ ID NO: 59394 - DNA, 20 bp, Artificial Sequence
  chemically synthesized
ctggagctaaaggcatagtc

SEQ ID NO: 59395 - DNA, 20 bp, Artificial Sequence
  chemically synthesized
tggagctaaaggcatagtca

SEQ ID NO: 59396 - DNA, 20 bp, Artificial Sequence
  chemically synthesized
gatttgggataaagaaaaag

SEQ ID NO: 59397 - DNA, 20 bp, Artificial Sequence
  chemically synthesized
ctgatttgggataaagaaaa

SEQ ID NO: 59398 - DNA, 20 bp, Artificial Sequence
  chemically synthesized
tctgatttgggataaagaaa

SEQ ID NO: 59399 - DNA, 20 bp, Artificial Sequence
  chemically synthesized
acgctatctgatttgggata

SEQ ID NO: 59400 - DNA, 20 bp, Artificial Sequence
  chemically synthesized
cctttttctttatcccaaat

SEQ ID NO: 59401 - DNA, 20 bp, Artificial Sequence
  chemically synthesized
gcctaaacgctatctgattt

SEQ ID NO: 59402 - DNA, 20 bp, Artificial Sequence
  chemically synthesized
tttctttatcccaaatcaga

SEQ ID NO: 59403 - DNA, 20 bp, Artificial Sequence
  chemically synthesized
agcctaaacgctatctgatt

SEQ ID NO: 59404 - DNA, 20 bp, Artificial Sequence
  chemically synthesized
atcccaaatcagatagcgtt

SEQ ID NO: 59405 - DNA, 20 bp, Artificial Sequence
  chemically synthesized
tcccaaatcagatagcgttt

SEQ ID NO: 59406 - DNA, 20 bp, Artificial Sequence
  chemically synthesized
tttttttatttgatgaaaaa

SEQ ID NO: 59407 - DNA, 20 bp, Artificial Sequence
  chemically synthesized
tgtttttttatttgatgaaa

SEQ ID NO: 59408 - DNA, 20 bp, Artificial Sequence
  chemically synthesized
ttttcatcaaataaaaaaac

SEQ ID NO: 59409 - DNA, 20 bp, Artificial Sequence
  chemically synthesized
atcaaataaaaaaacaagcc

SEQ ID NO: 59410 - DNA, 20 bp, Artificial Sequence
  chemically synthesized
aaaaaaacaagcccagttca

SEQ ID NO: 59411 - DNA, 20 bp, Artificial Sequence
  chemically synthesized
tgccaaacgagccatgaact

SEQ ID NO: 59412 - DNA, 20 bp, Artificial Sequence
  chemically synthesized
ttgccaaacgagccatgaac

SEQ ID NO: 59413 - DNA, 20 bp, Artificial Sequence
  chemically synthesized
agcccagttcatggctcgtt

SEQ ID NO: 59414 - DNA, 20 bp, Artificial Sequence
  chemically synthesized
tctcagggttgttgccaaac

SEQ ID NO: 59415 - DNA, 20 bp, Artificial Sequence
  chemically synthesized
gctcgtttggcaacaaccct

SEQ ID NO: 59416 - DNA, 20 bp, Artificial Sequence
  chemically synthesized
tagggctgtaaagcatctca

SEQ ID NO: 59417 - DNA, 20 bp, Artificial Sequence
  chemically synthesized
ctagggctgtaaagcatctc

SEQ ID NO: 59418 - DNA, 20 bp, Artificial Sequence
  chemically synthesized
tctagggctgtaaagcatct

SEQ ID NO: 59419 - DNA, 20 bp, Artificial Sequence
  chemically synthesized
aacaaccctgagatgcttta

SEQ ID NO: 59420 - DNA, 20 bp, Artificial Sequence
  chemically synthesized
ttttagggtctagggctgta

SEQ ID NO: 59421 - DNA, 20 bp, Artificial Sequence
  chemically synthesized
cctgagatgctttacagccc

SEQ ID NO: 59422 - DNA, 20 bp, Artificial Sequence
  chemically synthesized
ttttgaccttttagggtcta

SEQ ID NO: 59423 - DNA, 20 bp, Artificial Sequence
  chemically synthesized
cttttgaccttttagggtct

SEQ ID NO: 59424 - DNA, 20 bp, Artificial Sequence
  chemically synthesized
ccttttgaccttttagggtc

SEQ ID NO: 59425 - DNA, 20 bp, Artificial Sequence
  chemically synthesized
tttacagccctagaccctaa

SEQ ID NO: 59426 - DNA, 20 bp, Artificial Sequence
  chemically synthesized
ttacagccctagaccctaaa

SEQ ID NO: 59427 - DNA, 20 bp, Artificial Sequence
  chemically synthesized
gacggccttttgacctttta

SEQ ID NO: 59428 - DNA, 20 bp, Artificial Sequence
  chemically synthesized
agacggccttttgacctttt

SEQ ID NO: 59429 - DNA, 20 bp, Artificial Sequence
  chemically synthesized
aagacggccttttgaccttt

SEQ ID NO: 59430 - DNA, 20 bp, Artificial Sequence
  chemically synthesized
cctagaccctaaaaggtcaa

SEQ ID NO: 59431 - DNA, 20 bp, Artificial Sequence
  chemically synthesized
ctagaccctaaaaggtcaaa

SEQ ID NO: 59432 - DNA, 20 bp, Artificial Sequence
  chemically synthesized
aatatatattgagaataaga

SEQ ID NO: 59433 - DNA, 20 bp, Artificial Sequence
  chemically synthesized
ataaaatatatattgagaat

SEQ ID NO: 59434 - DNA, 20 bp, Artificial Sequence
  chemically synthesized
tgggtaataaaatatatatt

SEQ ID NO: 59435 - DNA, 20 bp, Artificial Sequence
  chemically synthesized
tttaatgtcgggagcagatt

SEQ ID NO: 59436 - DNA, 20 bp, Artificial Sequence
  chemically synthesized
gtttaatgtcgggagcagat

SEQ ID NO: 59437 - DNA, 20 bp, Artificial Sequence
  chemically synthesized
ttggagtttaatgtcgggag

SEQ ID NO: 59438 - DNA, 20 bp, Artificial Sequence
  chemically synthesized
tttttggagtttaatgtcgg

SEQ ID NO: 59439 - DNA, 20 bp, Artificial Sequence
  chemically synthesized
aatttttggagtttaatgtc

SEQ ID NO: 59440 - DNA, 20 bp, Artificial Sequence
  chemically synthesized
taatttttggagtttaatgt

SEQ ID NO: 59441 - DNA, 20 bp, Artificial Sequence
  chemically synthesized
gggctggaatttaatttttg

SEQ ID NO: 59442 - DNA, 20 bp, Artificial Sequence
  chemically synthesized
gagggctggaatttaatttt

SEQ ID NO: 59443 - DNA, 20 bp, Artificial Sequence
  chemically synthesized
aaactccaaaaattaaattc

SEQ ID NO: 59444 - DNA, 20 bp, Artificial Sequence
  chemically synthesized
gtcttgtggggtttgagggc

SEQ ID NO: 59445 - DNA, 20 bp, Artificial Sequence
  chemically synthesized
ttaagtcttgtggggtttga

SEQ ID NO: 59446 - DNA, 20 bp, Artificial Sequence
  chemically synthesized
attaagtcttgtggggtttg

SEQ ID NO: 59447 - DNA, 20 bp, Artificial Sequence
  chemically synthesized
aattaagtcttgtggggttt

SEQ ID NO: 59448 - DNA, 20 bp, Artificial Sequence
  chemically synthesized
ttccagccctcaaaccccac

SEQ ID NO: 59449 - DNA, 20 bp, Artificial Sequence
  chemically synthesized
gaggttaattaagtcttgtg

SEQ ID NO: 59450 - DNA, 20 bp, Artificial Sequence
  chemically synthesized
cgaggttaattaagtcttgt

SEQ ID NO: 59451 - DNA, 20 bp, Artificial Sequence
  chemically synthesized
gcgaggttaattaagtcttg

SEQ ID NO: 59452 - DNA, 20 bp, Artificial Sequence
  chemically synthesized
ccttgaaggcgaggttaatt

SEQ ID NO: 59453 - DNA, 20 bp, Artificial Sequence
  chemically synthesized
acttaattaacctcgccttc

SEQ ID NO: 59454 - DNA, 20 bp, Artificial Sequence
  chemically synthesized
tattgtacaccttgaaggcg

SEQ ID NO: 59455 - DNA, 20 bp, Artificial Sequence
  chemically synthesized
cttaattaacctcgccttca

SEQ ID NO: 59456 - DNA, 20 bp, Artificial Sequence
  chemically synthesized
ttattgtacaccttgaaggc

SEQ ID NO: 59457 - DNA, 20 bp, Artificial Sequence
  chemically synthesized
tttattattgtacaccttga

SEQ ID NO: 59458 - DNA, 20 bp, Artificial Sequence
  chemically synthesized
ctttattattgtacaccttg

SEQ ID NO: 59459 - DNA, 20 bp, Artificial Sequence
  chemically synthesized
cttcaaggtgtacaataata

SEQ ID NO: 59460 - DNA, 20 bp, Artificial Sequence
  chemically synthesized
caaggtgtacaataataaag

SEQ ID NO: 59461 - DNA, 20 bp, Artificial Sequence
  chemically synthesized
aggtgtacaataataaagta

SEQ ID NO: 59462 - DNA, 20 bp, Artificial Sequence
  chemically synthesized
ggtgtacaataataaagtag

SEQ ID NO: 59463 - DNA, 20 bp, Artificial Sequence
  chemically synthesized
gtacaataataaagtagagg

SEQ ID NO: 59464 - DNA, 20 bp, Artificial Sequence
  chemically synthesized
ataataaagtagaggcagcc

SEQ ID NO: 59465 - DNA, 20 bp, Artificial Sequence
  chemically synthesized
ataaagtagaggcagccaag

SEQ ID NO: 59466 - DNA, 20 bp, Artificial Sequence
  chemically synthesized
ctcagaaatacattgctact

SEQ ID NO: 59467 - DNA, 20 bp, Artificial Sequence
  chemically synthesized
ccaagtagcaatgtatttct

SEQ ID NO: 59468 - DNA, 20 bp, Artificial Sequence
  chemically synthesized
ggagggaaggaattgcaact

SEQ ID NO: 59469 - DNA, 20 bp, Artificial Sequence
  chemically synthesized
tttgtctcacagtggaggga

SEQ ID NO: 59470 - DNA, 20 bp, Artificial Sequence
  chemically synthesized
gtttgtctcacagtggaggg

SEQ ID NO: 59471 - DNA, 20 bp, Artificial Sequence
  chemically synthesized
ggggtttgtctcacagtgga

SEQ ID NO: 59472 - DNA, 20 bp, Artificial Sequence
  chemically synthesized
caattccttccctccactgt

SEQ ID NO: 59473 - DNA, 20 bp, Artificial Sequence
  chemically synthesized
tggggtttgtctcacagtgg

SEQ ID NO: 59474 - DNA, 20 bp, Artificial Sequence
  chemically synthesized
ctggggtttgtctcacagtg

SEQ ID NO: 59475 - DNA, 20 bp, Artificial Sequence
  chemically synthesized
ggctggggtttgtctcacag

SEQ ID NO: 59476 - DNA, 20 bp, Artificial Sequence
  chemically synthesized
tatggctggggtttgtctca

SEQ ID NO: 59477 - DNA, 20 bp, Artificial Sequence
  chemically synthesized
ctccactgtgagacaaaccc

SEQ ID NO: 59478 - DNA, 20 bp, Artificial Sequence
  chemically synthesized
ctgtgctggagatatggctg

SEQ ID NO: 59479 - DNA, 20 bp, Artificial Sequence
  chemically synthesized
tctgtgctggagatatggct

SEQ ID NO: 59480 - DNA, 20 bp, Artificial Sequence
  chemically synthesized
ttctgtgctggagatatggc

SEQ ID NO: 59481 - DNA, 20 bp, Artificial Sequence
  chemically synthesized
acaaaccccagccatatctc

SEQ ID NO: 59482 - DNA, 20 bp, Artificial Sequence
  chemically synthesized
gttcttctgtgctggagata

SEQ ID NO: 59483 - DNA, 20 bp, Artificial Sequence
  chemically synthesized
ccccagccatatctccagca

SEQ ID NO: 59484 - DNA, 20 bp, Artificial Sequence
  chemically synthesized
tttggagttcttctgtgctg

SEQ ID NO: 59485 - DNA, 20 bp, Artificial Sequence
  chemically synthesized
cagccatatctccagcacag

SEQ ID NO: 59486 - DNA, 20 bp, Artificial Sequence
  chemically synthesized
catttggagttcttctgtgc

SEQ ID NO: 59487 - DNA, 20 bp, Artificial Sequence
  chemically synthesized
agctgcagttcaggcatttg

SEQ ID NO: 59488 - DNA, 20 bp, Artificial Sequence
  chemically synthesized
gcagctgcagttcaggcatt

SEQ ID NO: 59489 - DNA, 20 bp, Artificial Sequence
  chemically synthesized
aactccaaatgcctgaactg

SEQ ID NO: 59490 - DNA, 20 bp, Artificial Sequence
  chemically synthesized
acccctcgcagctgcagttc

SEQ ID NO: 59491 - DNA, 20 bp, Artificial Sequence
  chemically synthesized
aacccctcgcagctgcagtt

SEQ ID NO: 59492 - DNA, 20 bp, Artificial Sequence
  chemically synthesized
aatgcctgaactgcagctgc

SEQ ID NO: 59493 - DNA, 20 bp, Artificial Sequence
  chemically synthesized
ggaggaacccctcgcagctg

SEQ ID NO: 59494 - DNA, 20 bp, Artificial Sequence
  chemically synthesized
atgcctgaactgcagctgcg

SEQ ID NO: 59495 - DNA, 20 bp, Artificial Sequence
  chemically synthesized
tgcctgaactgcagctgcga

SEQ ID NO: 59496 - DNA, 20 bp, Artificial Sequence
  chemically synthesized
gcctgaactgcagctgcgag

SEQ ID NO: 59497 - DNA, 20 bp, Artificial Sequence
  chemically synthesized
cattctggaggaacccctcg

SEQ ID NO: 59498 - DNA, 20 bp, Artificial Sequence
  chemically synthesized
gcagctgcgaggggttcctc

SEQ ID NO: 59499 - DNA, 20 bp, Artificial Sequence
  chemically synthesized
tgcgaggggttcctccagaa

SEQ ID NO: 59500 - DNA, 20 bp, Artificial Sequence
  chemically synthesized
cctgggggaggccattctgg

SEQ ID NO: 59501 - DNA, 20 bp, Artificial Sequence
  chemically synthesized
tcctgggggaggccattctg

SEQ ID NO: 59502 - DNA, 20 bp, Artificial Sequence
  chemically synthesized
gctcctgggggaggccattc

SEQ ID NO: 59503 - DNA, 20 bp, Artificial Sequence
  chemically synthesized
tcctccagaatggcctcccc

SEQ ID NO: 59504 - DNA, 20 bp, Artificial Sequence
  chemically synthesized
cctccagaatggcctccccc

SEQ ID NO: 59505 - DNA, 20 bp, Artificial Sequence
  chemically synthesized
tccagaatggcctcccccag

SEQ ID NO: 59506 - DNA, 20 bp, Artificial Sequence
  chemically synthesized
ttgtagcaagctcctggggg

SEQ ID NO: 59507 - DNA, 20 bp, Artificial Sequence
  chemically synthesized
cttgtagcaagctcctgggg

SEQ ID NO: 59508 - DNA, 20 bp, Artificial Sequence
  chemically synthesized
cacttgtagcaagctcctgg

SEQ ID NO: 59509 - DNA, 20 bp, Artificial Sequence
  chemically synthesized
gcacttgtagcaagctcctg

SEQ ID NO: 59510 - DNA, 20 bp, Artificial Sequence
  chemically synthesized
ggcacttgtagcaagctcct

SEQ ID NO: 59511 - DNA, 20 bp, Artificial Sequence
  chemically synthesized
tggcacttgtagcaagctcc

SEQ ID NO: 59512 - DNA, 20 bp, Artificial Sequence
  chemically synthesized
ctcccccaggagcttgctac

SEQ ID NO: 59513 - DNA, 20 bp, Artificial Sequence
  chemically synthesized
agatttctggcacttgtagc

SEQ ID NO: 59514 - DNA, 20 bp, Artificial Sequence
  chemically synthesized
caggagcttgctacaagtgc

SEQ ID NO: 59515 - DNA, 20 bp, Artificial Sequence
  chemically synthesized
ggccagatttctggcacttg

SEQ ID NO: 59516 - DNA, 20 bp, Artificial Sequence
  chemically synthesized
tgctacaagtgccagaaatc

SEQ ID NO: 59517 - DNA, 20 bp, Artificial Sequence
  chemically synthesized
tggcccagtggccagatttc

SEQ ID NO: 59518 - DNA, 20 bp, Artificial Sequence
  chemically synthesized
agtgccagaaatctggccac

SEQ ID NO: 59519 - DNA, 20 bp, Artificial Sequence
  chemically synthesized
gtgccagaaatctggccact

SEQ ID NO: 59520 - DNA, 20 bp, Artificial Sequence
  chemically synthesized
gcattccttggcccagtggc

SEQ ID NO: 59521 - DNA, 20 bp, Artificial Sequence
  chemically synthesized
agaaatctggccactgggcc

SEQ ID NO: 59522 - DNA, 20 bp, Artificial Sequence
  chemically synthesized
gcgggcattccttggcccag

SEQ ID NO: 59523 - DNA, 20 bp, Artificial Sequence
  chemically synthesized
gaaatctggccactgggcca

SEQ ID NO: 59524 - DNA, 20 bp, Artificial Sequence
  chemically synthesized
gctgcgggcattccttggcc

SEQ ID NO: 59525 - DNA, 20 bp, Artificial Sequence
  chemically synthesized
cccgggctgcgggcattcct

SEQ ID NO: 59526 - DNA, 20 bp, Artificial Sequence
  chemically synthesized
actgggccaaggaatgcccg

SEQ ID NO: 59527 - DNA, 20 bp, Artificial Sequence
  chemically synthesized
gccaaggaatgcccgcagcc

SEQ ID NO: 59528 - DNA, 20 bp, Artificial Sequence
  chemically synthesized
ccaaggaatgcccgcagccc

SEQ ID NO: 59529 - DNA, 20 bp, Artificial Sequence
  chemically synthesized
taggaggaatcccgggctgc

SEQ ID NO: 59530 - DNA, 20 bp, Artificial Sequence
  chemically synthesized
ttaggaggaatcccgggctg

SEQ ID NO: 59531 - DNA, 20 bp, Artificial Sequence
  chemically synthesized
catggcttaggaggaatccc

SEQ ID NO: 59532 - DNA, 20 bp, Artificial Sequence
  chemically synthesized
acatggcttaggaggaatcc

SEQ ID NO: 59533 - DNA, 20 bp, Artificial Sequence
  chemically synthesized
cgcagcccgggattcctcct

SEQ ID NO: 59534 - DNA, 20 bp, Artificial Sequence
  chemically synthesized
cagatgggacatggcttagg

SEQ ID NO: 59535 - DNA, 20 bp, Artificial Sequence
  chemically synthesized
acagatgggacatggcttag

SEQ ID NO: 59536 - DNA, 20 bp, Artificial Sequence
  chemically synthesized
ccacagatgggacatggctt

SEQ ID NO: 59537 - DNA, 20 bp, Artificial Sequence
  chemically synthesized
tccacagatgggacatggct

SEQ ID NO: 59538 - DNA, 20 bp, Artificial Sequence
  chemically synthesized
ggtcctccacagatgggaca

SEQ ID NO: 59539 - DNA, 20 bp, Artificial Sequence
  chemically synthesized
cctaagccatgtcccatctg

SEQ ID NO: 59540 - DNA, 20 bp, Artificial Sequence
  chemically synthesized
taagccatgtcccatctgtg

SEQ ID NO: 59541 - DNA, 20 bp, Artificial Sequence
  chemically synthesized
cagtggggtcctccacagat

SEQ ID NO: 59542 - DNA, 20 bp, Artificial Sequence
  chemically synthesized
aagccatgtcccatctgtgg

SEQ ID NO: 59543 - DNA, 20 bp, Artificial Sequence
  chemically synthesized
tcagtggggtcctccacaga

SEQ ID NO: 59544 - DNA, 20 bp, Artificial Sequence
  chemically synthesized
attttcagtggggtcctcca

SEQ ID NO: 59545 - DNA, 20 bp, Artificial Sequence
  chemically synthesized
gaacagtccgattttcagtg

SEQ ID NO: 59546 - DNA, 20 bp, Artificial Sequence
  chemically synthesized
tgaacagtccgattttcagt

SEQ ID NO: 59547 - DNA, 20 bp, Artificial Sequence
  chemically synthesized
ttgaacagtccgattttcag

SEQ ID NO: 59548 - DNA, 20 bp, Artificial Sequence
  chemically synthesized
tggaggaccccactgaaaat

SEQ ID NO: 59549 - DNA, 20 bp, Artificial Sequence
  chemically synthesized
gagttgaacagtccgatttt

SEQ ID NO: 59550 - DNA, 20 bp, Artificial Sequence
  chemically synthesized
tggctgccaggtgagttgaa

SEQ ID NO: 59551 - DNA, 20 bp, Artificial Sequence
  chemically synthesized
atcggactgttcaactcacc

SEQ ID NO: 59552 - DNA, 20 bp, Artificial Sequence
  chemically synthesized
ggactgttcaactcacctgg

SEQ ID NO: 59553 - DNA, 20 bp, Artificial Sequence
  chemically synthesized
tctgggagtggctgccaggt

SEQ ID NO: 59554 - DNA, 20 bp, Artificial Sequence
  chemically synthesized
gggctctgggagtggctgcc

SEQ ID NO: 59555 - DNA, 20 bp, Artificial Sequence
  chemically synthesized
ggggctctgggagtggctgc

SEQ ID NO: 59556 - DNA, 20 bp, Artificial Sequence
  chemically synthesized
actcacctggcagccactcc

SEQ ID NO: 59557 - DNA, 20 bp, Artificial Sequence
  chemically synthesized
tcacctggcagccactccca

SEQ ID NO: 59558 - DNA, 20 bp, Artificial Sequence
  chemically synthesized
agttccaggggctctgggag

SEQ ID NO: 59559 - DNA, 20 bp, Artificial Sequence
  chemically synthesized
cagagttccaggggctctgg

SEQ ID NO: 59560 - DNA, 20 bp, Artificial Sequence
  chemically synthesized
gccagagttccaggggctct

SEQ ID NO: 59561 - DNA, 20 bp, Artificial Sequence
  chemically synthesized
gcagccactcccagagcccc

SEQ ID NO: 59562 - DNA, 20 bp, Artificial Sequence
  chemically synthesized
ggccagagttccaggggctc

SEQ ID NO: 59563 - DNA, 20 bp, Artificial Sequence
  chemically synthesized
gccttgggccagagttccag

SEQ ID NO: 59564 - DNA, 20 bp, Artificial Sequence
  chemically synthesized
agccttgggccagagttcca

SEQ ID NO: 59565 - DNA, 20 bp, Artificial Sequence
  chemically synthesized
tcccagagcccctggaactc

SEQ ID NO: 59566 - DNA, 20 bp, Artificial Sequence
  chemically synthesized
gagccttgggccagagttcc

SEQ ID NO: 59567 - DNA, 20 bp, Artificial Sequence
  chemically synthesized
agagccttgggccagagttc

SEQ ID NO: 59568 - DNA, 20 bp, Artificial Sequence
  chemically synthesized
agcccctggaactctggccc

SEQ ID NO: 59569 - DNA, 20 bp, Artificial Sequence
  chemically synthesized
gcccctggaactctggccca

SEQ ID NO: 59570 - DNA, 20 bp, Artificial Sequence
  chemically synthesized
agtcagagagccttgggcca

SEQ ID NO: 59571 - DNA, 20 bp, Artificial Sequence
  chemically synthesized
ggagtcagagagccttgggc

SEQ ID NO: 59572 - DNA, 20 bp, Artificial Sequence
  chemically synthesized
ggaaggagtcagagagcctt

SEQ ID NO: 59573 - DNA, 20 bp, Artificial Sequence
  chemically synthesized
gggaaggagtcagagagcct

SEQ ID NO: 59574 - DNA, 20 bp, Artificial Sequence
  chemically synthesized
agatctgggaaggagtcaga

SEQ ID NO: 59575 - DNA, 20 bp, Artificial Sequence
  chemically synthesized
gaagatctgggaaggagtca

SEQ ID NO: 59576 - DNA, 20 bp, Artificial Sequence
  chemically synthesized
gagaagatctgggaaggagt

SEQ ID NO: 59577 - DNA, 20 bp, Artificial Sequence
  chemically synthesized
aaggctctctgactccttcc

SEQ ID NO: 59578 - DNA, 20 bp, Artificial Sequence
  chemically synthesized
aaccgagaagatctgggaag

SEQ ID NO: 59579 - DNA, 20 bp, Artificial Sequence
  chemically synthesized
taaaccgagaagatctggga

SEQ ID NO: 59580 - DNA, 20 bp, Artificial Sequence
  chemically synthesized
ctaaaccgagaagatctggg

SEQ ID NO: 59581 - DNA, 20 bp, Artificial Sequence
  chemically synthesized
ccactaaaccgagaagatct

SEQ ID NO: 59582 - DNA, 20 bp, Artificial Sequence
  chemically synthesized
gccactaaaccgagaagatc

SEQ ID NO: 59583 - DNA, 20 bp, Artificial Sequence
  chemically synthesized
gactccttcccagatcttct

SEQ ID NO: 59584 - DNA, 20 bp, Artificial Sequence
  chemically synthesized
cttcccagatcttctcggtt

SEQ ID NO: 59585 - DNA, 20 bp, Artificial Sequence
  chemically synthesized
tcttcagccactaaaccgag

SEQ ID NO: 59586 - DNA, 20 bp, Artificial Sequence
  chemically synthesized
cccagatcttctcggtttag

SEQ ID NO: 59587 - DNA, 20 bp, Artificial Sequence
  chemically synthesized
cagtcttcagccactaaacc

SEQ ID NO: 59588 - DNA, 20 bp, Artificial Sequence
  chemically synthesized
tcttctcggtttagtggctg

SEQ ID NO: 59589 - DNA, 20 bp, Artificial Sequence
  chemically synthesized
aatcgggcagcgtcagtctt

SEQ ID NO: 59590 - DNA, 20 bp, Artificial Sequence
  chemically synthesized
ctgaggcaatcgggcagcgt

SEQ ID NO: 59591 - DNA, 20 bp, Artificial Sequence
  chemically synthesized
gggcttctgaggcaatcggg

SEQ ID NO: 59592 - DNA, 20 bp, Artificial Sequence
  chemically synthesized
agggggcttctgaggcaatc

SEQ ID NO: 59593 - DNA, 20 bp, Artificial Sequence
  chemically synthesized
ctgacgctgcccgattgcct

SEQ ID NO: 59594 - DNA, 20 bp, Artificial Sequence
  chemically synthesized
tagggggcttctgaggcaat

SEQ ID NO: 59595 - DNA, 20 bp, Artificial Sequence
  chemically synthesized
acgctgcccgattgcctcag

SEQ ID NO: 59596 - DNA, 20 bp, Artificial Sequence
  chemically synthesized
gatggtctagggggcttctg

SEQ ID NO: 59597 - DNA, 20 bp, Artificial Sequence
  chemically synthesized
tgatggtctagggggcttct

SEQ ID NO: 59598 - DNA, 20 bp, Artificial Sequence
  chemically synthesized
cgattgcctcagaagccccc

SEQ ID NO: 59599 - DNA, 20 bp, Artificial Sequence
  chemically synthesized
ggcatctgtgatggtctagg

SEQ ID NO: 59600 - DNA, 20 bp, Artificial Sequence
  chemically synthesized
cggcatctgtgatggtctag

SEQ ID NO: 59601 - DNA, 20 bp, Artificial Sequence
  chemically synthesized
tcggcatctgtgatggtcta

SEQ ID NO: 59602 - DNA, 20 bp, Artificial Sequence
  chemically synthesized
atcggcatctgtgatggtct

SEQ ID NO: 59603 - DNA, 20 bp, Artificial Sequence
  chemically synthesized
gatcggcatctgtgatggtc

SEQ ID NO: 59604 - DNA, 20 bp, Artificial Sequence
  chemically synthesized
agaagccccctagaccatca

SEQ ID NO: 59605 - DNA, 20 bp, Artificial Sequence
  chemically synthesized
ctgaagatcggcatctgtga

SEQ ID NO: 59606 - DNA, 20 bp, Artificial Sequence
  chemically synthesized
ccatcacagatgccgatctt

SEQ ID NO: 59607 - DNA, 20 bp, Artificial Sequence
  chemically synthesized
catcacagatgccgatcttc

SEQ ID NO: 59608 - DNA, 20 bp, Artificial Sequence
  chemically synthesized
tgtgagagttacctgaagat

SEQ ID NO: 59609 - DNA, 20 bp, Artificial Sequence
  chemically synthesized
tccactgtgagagttacctg

SEQ ID NO: 59610 - DNA, 20 bp, Artificial Sequence
  chemically synthesized
cgatcttcaggtaactctca

SEQ ID NO: 59611 - DNA, 20 bp, Artificial Sequence
  chemically synthesized
tcttcaggtaactctcacag

SEQ ID NO: 59612 - DNA, 20 bp, Artificial Sequence
  chemically synthesized
ggacttaccctccactgtga

SEQ ID NO: 59613 - DNA, 20 bp, Artificial Sequence
  chemically synthesized
ttcaggtaactctcacagtg

SEQ ID NO: 59614 - DNA, 20 bp, Artificial Sequence
  chemically synthesized
tcaggtaactctcacagtgg

SEQ ID NO: 59615 - DNA, 20 bp, Artificial Sequence
  chemically synthesized
acggacttaccctccactgt

SEQ ID NO: 59616 - DNA, 20 bp, Artificial Sequence
  chemically synthesized
caggtaactctcacagtgga

SEQ ID NO: 59617 - DNA, 20 bp, Artificial Sequence
  chemically synthesized
taactctcacagtggagggt

SEQ ID NO: 59618 - DNA, 20 bp, Artificial Sequence
  chemically synthesized
cgtattgattaagaagggga

SEQ ID NO: 59619 - DNA, 20 bp, Artificial Sequence
  chemically synthesized
cctccgtattgattaagaag

SEQ ID NO: 59620 - DNA, 20 bp, Artificial Sequence
  chemically synthesized
gcctccgtattgattaagaa

SEQ ID NO: 59621 - DNA, 20 bp, Artificial Sequence
  chemically synthesized
agcctccgtattgattaaga

SEQ ID NO: 59622 - DNA, 20 bp, Artificial Sequence
  chemically synthesized
tagcctccgtattgattaag

SEQ ID NO: 59623 - DNA, 20 bp, Artificial Sequence
  chemically synthesized
gggtagcctccgtattgatt

SEQ ID NO: 59624 - DNA, 20 bp, Artificial Sequence
  chemically synthesized
cgtccccttcttaatcaata

SEQ ID NO: 59625 - DNA, 20 bp, Artificial Sequence
  chemically synthesized
tccccttcttaatcaatacg

SEQ ID NO: 59626 - DNA, 20 bp, Artificial Sequence
  chemically synthesized
ccccttcttaatcaatacgg

SEQ ID NO: 59627 - DNA, 20 bp, Artificial Sequence
  chemically synthesized
agaaggtaatgtggagtggg

SEQ ID NO: 59628 - DNA, 20 bp, Artificial Sequence
  chemically synthesized
aaaagaaggtaatgtggagt

SEQ ID NO: 59629 - DNA, 20 bp, Artificial Sequence
  chemically synthesized
gaaaagaaggtaatgtggag

SEQ ID NO: 59630 - DNA, 20 bp, Artificial Sequence
  chemically synthesized
cttgaaaagaaggtaatgtg

SEQ ID NO: 59631 - DNA, 20 bp, Artificial Sequence
  chemically synthesized
cccttgaaaagaaggtaatg

SEQ ID NO: 59632 - DNA, 20 bp, Artificial Sequence
  chemically synthesized
ctccacattaccttcttttc

SEQ ID NO: 59633 - DNA, 20 bp, Artificial Sequence
  chemically synthesized
gaaacaggcccttgaaaaga

SEQ ID NO: 59634 - DNA, 20 bp, Artificial Sequence
  chemically synthesized
tccacattaccttcttttca

SEQ ID NO: 59635 - DNA, 20 bp, Artificial Sequence
  chemically synthesized
ggaaacaggcccttgaaaag

SEQ ID NO: 59636 - DNA, 20 bp, Artificial Sequence
  chemically synthesized
ccacattaccttcttttcaa

SEQ ID NO: 59637 - DNA, 20 bp, Artificial Sequence
  chemically synthesized
aagggaaacaggcccttgaa

SEQ ID NO: 59638 - DNA, 20 bp, Artificial Sequence
  chemically synthesized
gttatggaggtaagggaaac

SEQ ID NO: 59639 - DNA, 20 bp, Artificial Sequence
  chemically synthesized
agttatggaggtaagggaaa

SEQ ID NO: 59640 - DNA, 20 bp, Artificial Sequence
  chemically synthesized
tacaacagttatggaggtaa

SEQ ID NO: 59641 - DNA, 20 bp, Artificial Sequence
  chemically synthesized
ctacaacagttatggaggta

SEQ ID NO: 59642 - DNA, 20 bp, Artificial Sequence
  chemically synthesized
cctacaacagttatggaggt

SEQ ID NO: 59643 - DNA, 20 bp, Artificial Sequence
  chemically synthesized
aatacctacaacagttatgg

SEQ ID NO: 59644 - DNA, 20 bp, Artificial Sequence
  chemically synthesized
caatacctacaacagttatg

SEQ ID NO: 59645 - DNA, 20 bp, Artificial Sequence
  chemically synthesized
gtcaatacctacaacagtta

SEQ ID NO: 59646 - DNA, 20 bp, Artificial Sequence
  chemically synthesized
ccttacctccataactgttg

SEQ ID NO: 59647 - DNA, 20 bp, Artificial Sequence
  chemically synthesized
cttacctccataactgttgt

SEQ ID NO: 59648 - DNA, 20 bp, Artificial Sequence
  chemically synthesized
ctggccgtcaatacctacaa

SEQ ID NO: 59649 - DNA, 20 bp, Artificial Sequence
  chemically synthesized
ataactgttgtaggtattga

SEQ ID NO: 59650 - DNA, 20 bp, Artificial Sequence
  chemically synthesized
ctgttgtaggtattgacggc

SEQ ID NO: 59651 - DNA, 20 bp, Artificial Sequence
  chemically synthesized
tgttgtaggtattgacggcc

SEQ ID NO: 59652 - DNA, 20 bp, Artificial Sequence
  chemically synthesized
ttttaagaggtttagaagcc

SEQ ID NO: 59653 - DNA, 20 bp, Artificial Sequence
  chemically synthesized
gggagttttaagaggtttag

SEQ ID NO: 59654 - DNA, 20 bp, Artificial Sequence
  chemically synthesized
tttgggagttttaagaggtt

SEQ ID NO: 59655 - DNA, 20 bp, Artificial Sequence
  chemically synthesized
cagagtttgggagttttaag

SEQ ID NO: 59656 - DNA, 20 bp, Artificial Sequence
  chemically synthesized
ccagagtttgggagttttaa

SEQ ID NO: 59657 - DNA, 20 bp, Artificial Sequence
  chemically synthesized
caccagagtttgggagtttt

SEQ ID NO: 59658 - DNA, 20 bp, Artificial Sequence
  chemically synthesized
aagttggcaccagagtttgg

SEQ ID NO: 59659 - DNA, 20 bp, Artificial Sequence
  chemically synthesized
ctcttaaaactcccaaactc

SEQ ID NO: 59660 - DNA, 20 bp, Artificial Sequence
  chemically synthesized
ctaagttggcaccagagttt

SEQ ID NO: 59661 - DNA, 20 bp, Artificial Sequence
  chemically synthesized
tctaagttggcaccagagtt

SEQ ID NO: 59662 - DNA, 20 bp, Artificial Sequence
  chemically synthesized
tatcgtctaagttggcacca

SEQ ID NO: 59663 - DNA, 20 bp, Artificial Sequence
  chemically synthesized
agtatcgtctaagttggcac

SEQ ID NO: 59664 - DNA, 20 bp, Artificial Sequence
  chemically synthesized
cccaaactctggtgccaact

SEQ ID NO: 59665 - DNA, 20 bp, Artificial Sequence
  chemically synthesized
taaaagagtatcgtctaagt

SEQ ID NO: 59666 - DNA, 20 bp, Artificial Sequence
  chemically synthesized
tgcttaaaagagtatcgtct

SEQ ID NO: 59667 - DNA, 20 bp, Artificial Sequence
  chemically synthesized
aacttagacgatactctttt

SEQ ID NO: 59668 - DNA, 20 bp, Artificial Sequence
  chemically synthesized
ctaaaaaggagtgcttaaaa

SEQ ID NO: 59669 - DNA, 20 bp, Artificial Sequence
  chemically synthesized
aactaaaaaggagtgcttaa

SEQ ID NO: 59670 - DNA, 20 bp, Artificial Sequence
  chemically synthesized
ctcttttaagcactcctttt

SEQ ID NO: 59671 - DNA, 20 bp, Artificial Sequence
  chemically synthesized
aggtggggataactaaaaag

SEQ ID NO: 59672 - DNA, 20 bp, Artificial Sequence
  chemically synthesized
gcaggtggggataactaaaa

SEQ ID NO: 59673 - DNA, 20 bp, Artificial Sequence
  chemically synthesized
ggcaggtggggataactaaa

SEQ ID NO: 59674 - DNA, 20 bp, Artificial Sequence
  chemically synthesized
aatagggaactgggcaggtg

SEQ ID NO: 59675 - DNA, 20 bp, Artificial Sequence
  chemically synthesized
tttagttatccccacctgcc

SEQ ID NO: 59676 - DNA, 20 bp, Artificial Sequence
  chemically synthesized
taatagggaactgggcaggt

SEQ ID NO: 59677 - DNA, 20 bp, Artificial Sequence
  chemically synthesized
ctaatagggaactgggcagg

SEQ ID NO: 59678 - DNA, 20 bp, Artificial Sequence
  chemically synthesized
ggcctaatagggaactgggc

SEQ ID NO: 59679 - DNA, 20 bp, Artificial Sequence
  chemically synthesized
cggcctaatagggaactggg

SEQ ID NO: 59680 - DNA, 20 bp, Artificial Sequence
  chemically synthesized
tctcggcctaatagggaact

SEQ ID NO: 59681 - DNA, 20 bp, Artificial Sequence
  chemically synthesized
gtctcggcctaatagggaac

SEQ ID NO: 59682 - DNA, 20 bp, Artificial Sequence
  chemically synthesized
ccacctgcccagttccctat

SEQ ID NO: 59683 - DNA, 20 bp, Artificial Sequence
  chemically synthesized
cacctgcccagttccctatt

SEQ ID NO: 59684 - DNA, 20 bp, Artificial Sequence
  chemically synthesized
taaagtgtctcggcctaata

SEQ ID NO: 59685 - DNA, 20 bp, Artificial Sequence
  chemically synthesized
ttaaagtgtctcggcctaat

SEQ ID NO: 59686 - DNA, 20 bp, Artificial Sequence
  chemically synthesized
gcccagttccctattaggcc

SEQ ID NO: 59687 - DNA, 20 bp, Artificial Sequence
  chemically synthesized
gttaaagtgtctcggcctaa

SEQ ID NO: 59688 - DNA, 20 bp, Artificial Sequence
  chemically synthesized
atcatttagttaaagtgtct

SEQ ID NO: 59689 - DNA, 20 bp, Artificial Sequence
  chemically synthesized
ggaagcagatcatttagtta

SEQ ID NO: 59690 - DNA, 20 bp, Artificial Sequence
  chemically synthesized
agtcagggaagcagatcatt

SEQ ID NO: 59691 - DNA, 20 bp, Artificial Sequence
  chemically synthesized
cctaggaatagtcagggaag

SEQ ID NO: 59692 - DNA, 20 bp, Artificial Sequence
  chemically synthesized
tagcctaggaatagtcaggg

SEQ ID NO: 59693 - DNA, 20 bp, Artificial Sequence
  chemically synthesized
ctctagcctaggaatagtca

SEQ ID NO: 59694 - DNA, 20 bp, Artificial Sequence
  chemically synthesized
gctctagcctaggaatagtc

SEQ ID NO: 59695 - DNA, 20 bp, Artificial Sequence
  chemically synthesized
ggctctagcctaggaatagt

SEQ ID NO: 59696 - DNA, 20 bp, Artificial Sequence
  chemically synthesized
tctgcttccctgactattcc

SEQ ID NO: 59697 - DNA, 20 bp, Artificial Sequence
  chemically synthesized
ctgcttccctgactattcct

SEQ ID NO: 59698 - DNA, 20 bp, Artificial Sequence
  chemically synthesized
gtgtggctctagcctaggaa

SEQ ID NO: 59699 - DNA, 20 bp, Artificial Sequence
  chemically synthesized
ttccctgactattcctaggc

SEQ ID NO: 59700 - DNA, 20 bp, Artificial Sequence
  chemically synthesized
ccctgactattcctaggcta

SEQ ID NO: 59701 - DNA, 20 bp, Artificial Sequence
  chemically synthesized
atgaggtgtggctctagcct

SEQ ID NO: 59702 - DNA, 20 bp, Artificial Sequence
  chemically synthesized
aatgaggtgtggctctagcc

SEQ ID NO: 59703 - DNA, 20 bp, Artificial Sequence
  chemically synthesized
gcggcaatgaggtgtggctc

SEQ ID NO: 59704 - DNA, 20 bp, Artificial Sequence
  chemically synthesized
gaaaaggcggcaatgaggtg

SEQ ID NO: 59705 - DNA, 20 bp, Artificial Sequence
  chemically synthesized
tgggggaaaaggcggcaatg

SEQ ID NO: 59706 - DNA, 20 bp, Artificial Sequence
  chemically synthesized
ctgggggaaaaggcggcaat

SEQ ID NO: 59707 - DNA, 20 bp, Artificial Sequence
  chemically synthesized
ctttgaactgggggaaaagg

SEQ ID NO: 59708 - DNA, 20 bp, Artificial Sequence
  chemically synthesized
ctcattgccgccttttcccc

SEQ ID NO: 59709 - DNA, 20 bp, Artificial Sequence
  chemically synthesized
aggctttgaactgggggaaa

SEQ ID NO: 59710 - DNA, 20 bp, Artificial Sequence
  chemically synthesized
gaggctttgaactgggggaa

SEQ ID NO: 59711 - DNA, 20 bp, Artificial Sequence
  chemically synthesized
tgaaggaggctttgaactgg

SEQ ID NO: 59712 - DNA, 20 bp, Artificial Sequence
  chemically synthesized
ccgccttttcccccagttca

SEQ ID NO: 59713 - DNA, 20 bp, Artificial Sequence
  chemically synthesized
gtgaaggaggctttgaactg

SEQ ID NO: 59714 - DNA, 20 bp, Artificial Sequence
  chemically synthesized
tgtgaaggaggctttgaact

SEQ ID NO: 59715 - DNA, 20 bp, Artificial Sequence
  chemically synthesized
atgtgaaggaggctttgaac

SEQ ID NO: 59716 - DNA, 20 bp, Artificial Sequence
  chemically synthesized
tacaaggggagatgtgaagg

SEQ ID NO: 59717 - DNA, 20 bp, Artificial Sequence
  chemically synthesized
atacaaggggagatgtgaag

SEQ ID NO: 59718 - DNA, 20 bp, Artificial Sequence
  chemically synthesized
agatacaaggggagatgtga

SEQ ID NO: 59719 - DNA, 20 bp, Artificial Sequence
  chemically synthesized
gagatacaaggggagatgtg

SEQ ID NO: 59720 - DNA, 20 bp, Artificial Sequence
  chemically synthesized
aaggtggggagatacaaggg

SEQ ID NO: 59721 - DNA, 20 bp, Artificial Sequence
  chemically synthesized
ttaaggtggggagatacaag

SEQ ID NO: 59722 - DNA, 20 bp, Artificial Sequence
  chemically synthesized
gttaaggtggggagatacaa

SEQ ID NO: 59723 - DNA, 20 bp, Artificial Sequence
  chemically synthesized
ggttaaggtggggagataca

SEQ ID NO: 59724 - DNA, 20 bp, Artificial Sequence
  chemically synthesized
gggttaaggtggggagatac

SEQ ID NO: 59725 - DNA, 20 bp, Artificial Sequence
  chemically synthesized
tgcttgtgggttaaggtggg

SEQ ID NO: 59726 - DNA, 20 bp, Artificial Sequence
  chemically synthesized
tatgcttgtgggttaaggtg

SEQ ID NO: 59727 - DNA, 20 bp, Artificial Sequence
  chemically synthesized
ttatgcttgtgggttaaggt

SEQ ID NO: 59728 - DNA, 20 bp, Artificial Sequence
  chemically synthesized
cttatgcttgtgggttaagg

SEQ ID NO: 59729 - DNA, 20 bp, Artificial Sequence
  chemically synthesized
tgtcttatgcttgtgggtta

SEQ ID NO: 59730 - DNA, 20 bp, Artificial Sequence
  chemically synthesized
atctccccaccttaacccac

SEQ ID NO: 59731 - DNA, 20 bp, Artificial Sequence
  chemically synthesized
gtgtcttatgcttgtgggtt

SEQ ID NO: 59732 - DNA, 20 bp, Artificial Sequence
  chemically synthesized
tagaggtgtcttatgcttgt

SEQ ID NO: 59733 - DNA, 20 bp, Artificial Sequence
  chemically synthesized
ccaccttaacccacaagcat

SEQ ID NO: 59734 - DNA, 20 bp, Artificial Sequence
  chemically synthesized
gtagaggtgtcttatgcttg

SEQ ID NO: 59735 - DNA, 20 bp, Artificial Sequence
  chemically synthesized
ggtcgctaaggagggagtag

SEQ ID NO: 59736 - DNA, 20 bp, Artificial Sequence
  chemically synthesized
tggtcgctaaggagggagta

SEQ ID NO: 59737 - DNA, 20 bp, Artificial Sequence
  chemically synthesized
attggtcgctaaggagggag

SEQ ID NO: 59738 - DNA, 20 bp, Artificial Sequence
  chemically synthesized
agacacctctactccctcct

SEQ ID NO: 59739 - DNA, 20 bp, Artificial Sequence
  chemically synthesized
atgattggtcgctaaggagg

SEQ ID NO: 59740 - DNA, 20 bp, Artificial Sequence
  chemically synthesized
gcatgattggtcgctaagga

SEQ ID NO: 59741 - DNA, 20 bp, Artificial Sequence
  chemically synthesized
tgcatgattggtcgctaagg

SEQ ID NO: 59742 - DNA, 20 bp, Artificial Sequence
  chemically synthesized
gtgcatgattggtcgctaag

SEQ ID NO: 59743 - DNA, 20 bp, Artificial Sequence
  chemically synthesized
gggtgcatgattggtcgcta

SEQ ID NO: 59744 - DNA, 20 bp, Artificial Sequence
  chemically synthesized
ggggtgcatgattggtcgct

SEQ ID NO: 59745 - DNA, 20 bp, Artificial Sequence
  chemically synthesized
gatggtaaggggtgcatgat

SEQ ID NO: 59746 - DNA, 20 bp, Artificial Sequence
  chemically synthesized
ggttttaatgggatggtaag

SEQ ID NO: 59747 - DNA, 20 bp, Artificial Sequence
  chemically synthesized
aggttttaatgggatggtaa

SEQ ID NO: 59748 - DNA, 20 bp, Artificial Sequence
  chemically synthesized
taggttttaatgggatggta

SEQ ID NO: 59749 - DNA, 20 bp, Artificial Sequence
  chemically synthesized
ttaggttttaatgggatggt

SEQ ID NO: 59750 - DNA, 20 bp, Artificial Sequence
  chemically synthesized
gtgattaggttttaatggga

SEQ ID NO: 59751 - DNA, 20 bp, Artificial Sequence
  chemically synthesized
aagggtgattaggttttaat

SEQ ID NO: 59752 - DNA, 20 bp, Artificial Sequence
  chemically synthesized
taagggtgattaggttttaa

SEQ ID NO: 59753 - DNA, 20 bp, Artificial Sequence
  chemically synthesized
tgagcggagtaagggtgatt

SEQ ID NO: 59754 - DNA, 20 bp, Artificial Sequence
  chemically synthesized
ttgagcggagtaagggtgat

SEQ ID NO: 59755 - DNA, 20 bp, Artificial Sequence
  chemically synthesized
gttggcattgagcggagtaa

SEQ ID NO: 59756 - DNA, 20 bp, Artificial Sequence
  chemically synthesized
tgttggcattgagcggagta

SEQ ID NO: 59757 - DNA, 20 bp, Artificial Sequence
  chemically synthesized
atgttggcattgagcggagt

SEQ ID NO: 59758 - DNA, 20 bp, Artificial Sequence
  chemically synthesized
tgggatgttggcattgagcg

SEQ ID NO: 59759 - DNA, 20 bp, Artificial Sequence
  chemically synthesized
gatgggatgttggcattgag

SEQ ID NO: 59760 - DNA, 20 bp, Artificial Sequence
  chemically synthesized
tgggatgggatgttggcatt

SEQ ID NO: 59761 - DNA, 20 bp, Artificial Sequence
  chemically synthesized
cgtgctgtgggatgggatgt

SEQ ID NO: 59762 - DNA, 20 bp, Artificial Sequence
  chemically synthesized
aatgccaacatcccatccca

SEQ ID NO: 59763 - DNA, 20 bp, Artificial Sequence
  chemically synthesized
tttaaagcgtgctgtgggat

SEQ ID NO: 59764 - DNA, 20 bp, Artificial Sequence
  chemically synthesized
ttttaaagcgtgctgtggga

SEQ ID NO: 59765 - DNA, 20 bp, Artificial Sequence
  chemically synthesized
atccttttaaagcgtgctgt

SEQ ID NO: 59766 - DNA, 20 bp, Artificial Sequence
  chemically synthesized
aatccttttaaagcgtgctg

SEQ ID NO: 59767 - DNA, 20 bp, Artificial Sequence
  chemically synthesized
catcccacagcacgctttaa

SEQ ID NO: 59768 - DNA, 20 bp, Artificial Sequence
  chemically synthesized
atcccacagcacgctttaaa

SEQ ID NO: 59769 - DNA, 20 bp, Artificial Sequence
  chemically synthesized
aacagactgtaatcctttta

SEQ ID NO: 59770 - DNA, 20 bp, Artificial Sequence
  chemically synthesized
agcacgctttaaaaggatta

SEQ ID NO: 59771 - DNA, 20 bp, Artificial Sequence
  chemically synthesized
ctgtagcaggcgagtgataa

SEQ ID NO: 59772 - DNA, 20 bp, Artificial Sequence
  chemically synthesized
aaggccatgctgtagcaggc

SEQ ID NO: 59773 - DNA, 20 bp, Artificial Sequence
  chemically synthesized
ctgttatcactcgcctgcta

SEQ ID NO: 59774 - DNA, 20 bp, Artificial Sequence
  chemically synthesized
ttaaaaggccatgctgtagc

SEQ ID NO: 59775 - DNA, 20 bp, Artificial Sequence
  chemically synthesized
tttaaaaggccatgctgtag

SEQ ID NO: 59776 - DNA, 20 bp, Artificial Sequence
  chemically synthesized
atcactcgcctgctacagca

SEQ ID NO: 59777 - DNA, 20 bp, Artificial Sequence
  chemically synthesized
ggctttaaaaggccatgctg

SEQ ID NO: 59778 - DNA, 20 bp, Artificial Sequence
  chemically synthesized
tgctacagcatggcctttta

SEQ ID NO: 59779 - DNA, 20 bp, Artificial Sequence
  chemically synthesized
gggagtttataggctttaaa

SEQ ID NO: 59780 - DNA, 20 bp, Artificial Sequence
  chemically synthesized
ggggagtttataggctttaa

SEQ ID NO: 59781 - DNA, 20 bp, Artificial Sequence
  chemically synthesized
gaattgtaaggggagtttat

SEQ ID NO: 59782 - DNA, 20 bp, Artificial Sequence
  chemically synthesized
ggaattgtaaggggagttta

SEQ ID NO: 59783 - DNA, 20 bp, Artificial Sequence
  chemically synthesized
aaatgggggaattgtaaggg

SEQ ID NO: 59784 - DNA, 20 bp, Artificial Sequence
  chemically synthesized
taaaatgggggaattgtaag

SEQ ID NO: 59785 - DNA, 20 bp, Artificial Sequence
  chemically synthesized
gtaaaatgggggaattgtaa

SEQ ID NO: 59786 - DNA, 20 bp, Artificial Sequence
  chemically synthesized
ggtaaaatgggggaattgta

SEQ ID NO: 59787 - DNA, 20 bp, Artificial Sequence
  chemically synthesized
aggtaaaatgggggaattgt

SEQ ID NO: 59788 - DNA, 20 bp, Artificial Sequence
  chemically synthesized
ttttaggacaggtaaaatgg

SEQ ID NO: 59789 - DNA, 20 bp, Artificial Sequence
  chemically synthesized
cttttaggacaggtaaaatg

SEQ ID NO: 59790 - DNA, 20 bp, Artificial Sequence
  chemically synthesized
gcttttaggacaggtaaaat

SEQ ID NO: 59791 - DNA, 20 bp, Artificial Sequence
  chemically synthesized
tgcttttaggacaggtaaaa

SEQ ID NO: 59792 - DNA, 20 bp, Artificial Sequence
  chemically synthesized
ccccattttacctgtcctaa

SEQ ID NO: 59793 - DNA, 20 bp, Artificial Sequence
  chemically synthesized
accttgtctgcttttaggac

SEQ ID NO: 59794 - DNA, 20 bp, Artificial Sequence
  chemically synthesized
aaccttgtctgcttttagga

SEQ ID NO: 59795 - DNA, 20 bp, Artificial Sequence
  chemically synthesized
cattttacctgtcctaaaag

SEQ ID NO: 59796 - DNA, 20 bp, Artificial Sequence
  chemically synthesized
tgtaaaccttgtctgctttt

SEQ ID NO: 59797 - DNA, 20 bp, Artificial Sequence
  chemically synthesized
ctgtaaaccttgtctgcttt

SEQ ID NO: 59798 - DNA, 20 bp, Artificial Sequence
  chemically synthesized
tacctgtcctaaaagcagac

SEQ ID NO: 59799 - DNA, 20 bp, Artificial Sequence
  chemically synthesized
acctgtcctaaaagcagaca

SEQ ID NO: 59800 - DNA, 20 bp, Artificial Sequence
  chemically synthesized
ctaaaagcagacaaggttta

SEQ ID NO: 59801 - DNA, 20 bp, Artificial Sequence
  chemically synthesized
taaaagcagacaaggtttac

SEQ ID NO: 59802 - DNA, 20 bp, Artificial Sequence
  chemically synthesized
agcagacaaggtttacaggt

SEQ ID NO: 59803 - DNA, 20 bp, Artificial Sequence
  chemically synthesized
acaaggtttacaggttagtt

SEQ ID NO: 59804 - DNA, 20 bp, Artificial Sequence
  chemically synthesized
caaggtttacaggttagttc

SEQ ID NO: 59805 - DNA, 20 bp, Artificial Sequence
  chemically synthesized
acaatttggttgataaggtg

SEQ ID NO: 59806 - DNA, 20 bp, Artificial Sequence
  chemically synthesized
gcaaaacaatttggttgata

SEQ ID NO: 59807 - DNA, 20 bp, Artificial Sequence
  chemically synthesized
ggcaaaacaatttggttgat

SEQ ID NO: 59808 - DNA, 20 bp, Artificial Sequence
  chemically synthesized
ggttgataggcaaaacaatt

SEQ ID NO: 59809 - DNA, 20 bp, Artificial Sequence
  chemically synthesized
tttggcaccacagggttgat

SEQ ID NO: 59810 - DNA, 20 bp, Artificial Sequence
  chemically synthesized
gtttggcaccacagggttga

SEQ ID NO: 59811 - DNA, 20 bp, Artificial Sequence
  chemically synthesized
tgttttgcctatcaaccctg

SEQ ID NO: 59812 - DNA, 20 bp, Artificial Sequence
  chemically synthesized
tatatgggtttggcaccaca

SEQ ID NO: 59813 - DNA, 20 bp, Artificial Sequence
  chemically synthesized
gtatatgggtttggcaccac

SEQ ID NO: 59814 - DNA, 20 bp, Artificial Sequence
  chemically synthesized
agtatatgggtttggcacca

SEQ ID NO: 59815 - DNA, 20 bp, Artificial Sequence
  chemically synthesized
gacaggagagtatatgggtt

SEQ ID NO: 59816 - DNA, 20 bp, Artificial Sequence
  chemically synthesized
ttgaggacaggagagtatat

SEQ ID NO: 59817 - DNA, 20 bp, Artificial Sequence
  chemically synthesized
attgaggacaggagagtata

SEQ ID NO: 59818 - DNA, 20 bp, Artificial Sequence
  chemically synthesized
gggaggtattgaggacagga

SEQ ID NO: 59819 - DNA, 20 bp, Artificial Sequence
  chemically synthesized
gagggaggtattgaggacag

SEQ ID NO: 59820 - DNA, 20 bp, Artificial Sequence
  chemically synthesized
tggagggaggtattgaggac

SEQ ID NO: 59821 - DNA, 20 bp, Artificial Sequence
  chemically synthesized
gtggagggaggtattgagga

SEQ ID NO: 59822 - DNA, 20 bp, Artificial Sequence
  chemically synthesized
ggttgtggagggaggtattg

SEQ ID NO: 59823 - DNA, 20 bp, Artificial Sequence
  chemically synthesized
gggttgtggagggaggtatt

SEQ ID NO: 59824 - DNA, 20 bp, Artificial Sequence
  chemically synthesized
gaataatgggttgtggaggg

SEQ ID NO: 59825 - DNA, 20 bp, Artificial Sequence
  chemically synthesized
agaataatgggttgtggagg

SEQ ID NO: 59826 - DNA, 20 bp, Artificial Sequence
  chemically synthesized
acagaataatgggttgtgga

SEQ ID NO: 59827 - DNA, 20 bp, Artificial Sequence
  chemically synthesized
aacagaataatgggttgtgg

SEQ ID NO: 59828 - DNA, 20 bp, Artificial Sequence
  chemically synthesized
gaacagaataatgggttgtg

SEQ ID NO: 59829 - DNA, 20 bp, Artificial Sequence
  chemically synthesized
cagaacagaataatgggttg

SEQ ID NO: 59830 - DNA, 20 bp, Artificial Sequence
  chemically synthesized
gagatccagaacagaataat

SEQ ID NO: 59831 - DNA, 20 bp, Artificial Sequence
  chemically synthesized
tgagatccagaacagaataa

SEQ ID NO: 59832 - DNA, 20 bp, Artificial Sequence
  chemically synthesized
cacaacccattattctgttc

SEQ ID NO: 59833 - DNA, 20 bp, Artificial Sequence
  chemically synthesized
agcatgtttgagatccagaa

SEQ ID NO: 59834 - DNA, 20 bp, Artificial Sequence
  chemically synthesized
aagaaagcatgtttgagatc

SEQ ID NO: 59835 - DNA, 20 bp, Artificial Sequence
  chemically synthesized
atagtgaagaaagcatgttt

SEQ ID NO: 59836 - DNA, 20 bp, Artificial Sequence
  chemically synthesized
gtgcaaaggaatagtgaaga

SEQ ID NO: 59837 - DNA, 20 bp, Artificial Sequence
  chemically synthesized
aagggtgcaaaggaatagtg

SEQ ID NO: 59838 - DNA, 20 bp, Artificial Sequence
  chemically synthesized
gggtgaagggtgcaaaggaa

SEQ ID NO: 59839 - DNA, 20 bp, Artificial Sequence
  chemically synthesized
ggctggggtgaagggtgcaa

SEQ ID NO: 59840 - DNA, 20 bp, Artificial Sequence
  chemically synthesized
aggctggggtgaagggtgca

SEQ ID NO: 59841 - DNA, 20 bp, Artificial Sequence
  chemically synthesized
ttcctttgcacccttcaccc

SEQ ID NO: 59842 - DNA, 20 bp, Artificial Sequence
  chemically synthesized
tgaagagaggctggggtgaa

SEQ ID NO: 59843 - DNA, 20 bp, Artificial Sequence
  chemically synthesized
gtgaagagaggctggggtga

SEQ ID NO: 59844 - DNA, 20 bp, Artificial Sequence
  chemically synthesized
agtgaagagaggctggggtg

SEQ ID NO: 59845 - DNA, 20 bp, Artificial Sequence
  chemically synthesized
gtgaaagtgaagagaggctg

SEQ ID NO: 59846 - DNA, 20 bp, Artificial Sequence
  chemically synthesized
agtgaaagtgaagagaggct

SEQ ID NO: 59847 - DNA, 20 bp, Artificial Sequence
  chemically synthesized
aagtgaaagtgaagagaggc

SEQ ID NO: 59848 - DNA, 20 bp, Artificial Sequence
  chemically synthesized
gtccaagtgaaagtgaagag

SEQ ID NO: 59849 - DNA, 20 bp, Artificial Sequence
  chemically synthesized
agtccaagtgaaagtgaaga

SEQ ID NO: 59850 - DNA, 20 bp, Artificial Sequence
  chemically synthesized
tcagtccaagtgaaagtgaa

SEQ ID NO: 59851 - DNA, 20 bp, Artificial Sequence
  chemically synthesized
ggtcagtccaagtgaaagtg

SEQ ID NO: 59852 - DNA, 20 bp, Artificial Sequence
  chemically synthesized
agcctctcttcactttcact

SEQ ID NO: 59853 - DNA, 20 bp, Artificial Sequence
  chemically synthesized
gtcagggtcagtccaagtga

SEQ ID NO: 59854 - DNA, 20 bp, Artificial Sequence
  chemically synthesized
atgggtgtcagggtcagtcc

SEQ ID NO: 59855 - DNA, 20 bp, Artificial Sequence
  chemically synthesized
agcctgatgggtgtcagggt

SEQ ID NO: 59856 - DNA, 20 bp, Artificial Sequence
  chemically synthesized
gctgagcctgatgggtgtca

SEQ ID NO: 59857 - DNA, 20 bp, Artificial Sequence
  chemically synthesized
tgctgagcctgatgggtgtc

SEQ ID NO: 59858 - DNA, 20 bp, Artificial Sequence
  chemically synthesized
ttgctgagcctgatgggtgt

SEQ ID NO: 59859 - DNA, 20 bp, Artificial Sequence
  chemically synthesized
ggactgaccctgacacccat

SEQ ID NO: 59860 - DNA, 20 bp, Artificial Sequence
  chemically synthesized
gactgaccctgacacccatc

SEQ ID NO: 59861 - DNA, 20 bp, Artificial Sequence
  chemically synthesized
ggtaatttgctgagcctgat

SEQ ID NO: 59862 - DNA, 20 bp, Artificial Sequence
  chemically synthesized
accctgacacccatcaggct

SEQ ID NO: 59863 - DNA, 20 bp, Artificial Sequence
  chemically synthesized
aggtaatttgctgagcctga

SEQ ID NO: 59864 - DNA, 20 bp, Artificial Sequence
  chemically synthesized
tacagcccaggtaatttgct

SEQ ID NO: 59865 - DNA, 20 bp, Artificial Sequence
  chemically synthesized
atcaggctcagcaaattacc

SEQ ID NO: 59866 - DNA, 20 bp, Artificial Sequence
  chemically synthesized
tcaggctcagcaaattacct

SEQ ID NO: 59867 - DNA, 20 bp, Artificial Sequence
  chemically synthesized
gccttgaggcagtacagccc

SEQ ID NO: 59868 - DNA, 20 bp, Artificial Sequence
  chemically synthesized
agccttgaggcagtacagcc

SEQ ID NO: 59869 - DNA, 20 bp, Artificial Sequence
  chemically synthesized
tgtgaagccttgaggcagta

SEQ ID NO: 59870 - DNA, 20 bp, Artificial Sequence
  chemically synthesized
tacctgggctgtactgcctc

SEQ ID NO: 59871 - DNA, 20 bp, Artificial Sequence
  chemically synthesized
acctgggctgtactgcctca

SEQ ID NO: 59872 - DNA, 20 bp, Artificial Sequence
  chemically synthesized
ctgtctgtgaagccttgagg

SEQ ID NO: 59873 - DNA, 20 bp, Artificial Sequence
  chemically synthesized
gggctgtctgtgaagccttg

SEQ ID NO: 59874 - DNA, 20 bp, Artificial Sequence
  chemically synthesized
ggggctgtctgtgaagcctt

SEQ ID NO: 59875 - DNA, 20 bp, Artificial Sequence
  chemically synthesized
tgtactgcctcaaggcttca

SEQ ID NO: 59876 - DNA, 20 bp, Artificial Sequence
  chemically synthesized
ctgcctcaaggcttcacaga

SEQ ID NO: 59877 - DNA, 20 bp, Artificial Sequence
  chemically synthesized
agtaatgggggctgtctgtg

SEQ ID NO: 59878 - DNA, 20 bp, Artificial Sequence
  chemically synthesized
gggcttgactgaagtaatgg

SEQ ID NO: 59879 - DNA, 20 bp, Artificial Sequence
  chemically synthesized
tgggcttgactgaagtaatg

SEQ ID NO: 59880 - DNA, 20 bp, Artificial Sequence
  chemically synthesized
acagacagcccccattactt

SEQ ID NO: 59881 - DNA, 20 bp, Artificial Sequence
  chemically synthesized
ttgggcttgactgaagtaat

SEQ ID NO: 59882 - DNA, 20 bp, Artificial Sequence
  chemically synthesized
tttgggcttgactgaagtaa

SEQ ID NO: 59883 - DNA, 20 bp, Artificial Sequence
  chemically synthesized
cagcccccattacttcagtc

SEQ ID NO: 59884 - DNA, 20 bp, Artificial Sequence
  chemically synthesized
aagaaatttgggcttgactg

SEQ ID NO: 59885 - DNA, 20 bp, Artificial Sequence
  chemically synthesized
aacaggtgaggaagaaattt

SEQ ID NO: 59886 - DNA, 20 bp, Artificial Sequence
  chemically synthesized
taacaggtgaggaagaaatt

SEQ ID NO: 59887 - DNA, 20 bp, Artificial Sequence
  chemically synthesized
gagataggtaacaggtgagg

SEQ ID NO: 59888 - DNA, 20 bp, Artificial Sequence
  chemically synthesized
gccgagataggtaacaggtg

SEQ ID NO: 59889 - DNA, 20 bp, Artificial Sequence
  chemically synthesized
tgccgagataggtaacaggt

SEQ ID NO: 59890 - DNA, 20 bp, Artificial Sequence
  chemically synthesized
attatgccgagataggtaac

SEQ ID NO: 59891 - DNA, 20 bp, Artificial Sequence
  chemically synthesized
aattatgccgagataggtaa

SEQ ID NO: 59892 - DNA, 20 bp, Artificial Sequence
  chemically synthesized
tcctcacctgttacctatct

SEQ ID NO: 59893 - DNA, 20 bp, Artificial Sequence
  chemically synthesized
tatgagaattatgccgagat

SEQ ID NO: 59894 - DNA, 20 bp, Artificial Sequence
  chemically synthesized
ttatgagaattatgccgaga

SEQ ID NO: 59895 - DNA, 20 bp, Artificial Sequence
  chemically synthesized
gtttttatgagaattatgcc

SEQ ID NO: 59896 - DNA, 20 bp, Artificial Sequence
  chemically synthesized
gagagcacgtgtgtttttat

SEQ ID NO: 59897 - DNA, 20 bp, Artificial Sequence
  chemically synthesized
tcagacatgatcagcaggga

SEQ ID NO: 59898 - DNA, 20 bp, Artificial Sequence
  chemically synthesized
agtcagacatgatcagcagg

SEQ ID NO: 59899 - DNA, 20 bp, Artificial Sequence
  chemically synthesized
ttagtcagacatgatcagca

SEQ ID NO: 59900 - DNA, 20 bp, Artificial Sequence
  chemically synthesized
attagtcagacatgatcagc

SEQ ID NO: 59901 - DNA, 20 bp, Artificial Sequence
  chemically synthesized
gattagtcagacatgatcag

SEQ ID NO: 59902 - DNA, 20 bp, Artificial Sequence
  chemically synthesized
ggagattagtcagacatgat

SEQ ID NO: 59903 - DNA, 20 bp, Artificial Sequence
  chemically synthesized
ttggggtttgggagattagt

SEQ ID NO: 59904 - DNA, 20 bp, Artificial Sequence
  chemically synthesized
gggattggggtttgggagat

SEQ ID NO: 59905 - DNA, 20 bp, Artificial Sequence
  chemically synthesized
tagaagggattggggtttgg

SEQ ID NO: 59906 - DNA, 20 bp, Artificial Sequence
  chemically synthesized
tctagaagggattggggttt

SEQ ID NO: 59907 - DNA, 20 bp, Artificial Sequence
  chemically synthesized
ttctagaagggattggggtt

SEQ ID NO: 59908 - DNA, 20 bp, Artificial Sequence
  chemically synthesized
ttgttttctagaagggattg

SEQ ID NO: 59909 - DNA, 20 bp, Artificial Sequence
  chemically synthesized
gttgttttctagaagggatt

SEQ ID NO: 59910 - DNA, 20 bp, Artificial Sequence
  chemically synthesized
tgttgttttctagaagggat

SEQ ID NO: 59911 - DNA, 20 bp, Artificial Sequence
  chemically synthesized
tcccaaaccccaatcccttc

SEQ ID NO: 59912 - DNA, 20 bp, Artificial Sequence
  chemically synthesized
aaacttgttgttttctagaa

SEQ ID NO: 59913 - DNA, 20 bp, Artificial Sequence
  chemically synthesized
aaaacttgttgttttctaga

SEQ ID NO: 59914 - DNA, 20 bp, Artificial Sequence
  chemically synthesized
aaaaacttgttgttttctag

SEQ ID NO: 59915 - DNA, 20 bp, Artificial Sequence
  chemically synthesized
ggaaaaaacttgttgttttc

SEQ ID NO: 59916 - DNA, 20 bp, Artificial Sequence
  chemically synthesized
aatcccttctagaaaacaac

SEQ ID NO: 59917 - DNA, 20 bp, Artificial Sequence
  chemically synthesized
aacaacaagttttttcctcc

SEQ ID NO: 59918 - DNA, 20 bp, Artificial Sequence
  chemically synthesized
acaacaagttttttcctcct

SEQ ID NO: 59919 - DNA, 20 bp, Artificial Sequence
  chemically synthesized
agtatctaaccatgcctagg

SEQ ID NO: 59920 - DNA, 20 bp, Artificial Sequence
  chemically synthesized
aagttttttcctcctaggca

SEQ ID NO: 59921 - DNA, 20 bp, Artificial Sequence
  chemically synthesized
aagtatctaaccatgcctag

SEQ ID NO: 59922 - DNA, 20 bp, Artificial Sequence
  chemically synthesized
gaaagtatctaaccatgcct

SEQ ID NO: 59923 - DNA, 20 bp, Artificial Sequence
  chemically synthesized
cgaaagtatctaaccatgcc

SEQ ID NO: 59924 - DNA, 20 bp, Artificial Sequence
  chemically synthesized
tttttcctcctaggcatggt

SEQ ID NO: 59925 - DNA, 20 bp, Artificial Sequence
  chemically synthesized
tggttagatactttcgactt

SEQ ID NO: 59926 - DNA, 20 bp, Artificial Sequence
  chemically synthesized
aaccaggtatctaaagtcga

SEQ ID NO: 59927 - DNA, 20 bp, Artificial Sequence
  chemically synthesized
atggcaaaaccaggtatcta

SEQ ID NO: 59928 - DNA, 20 bp, Artificial Sequence
  chemically synthesized
tactttcgactttagatacc

SEQ ID NO: 59929 - DNA, 20 bp, Artificial Sequence
  chemically synthesized
tttgttaggatggcaaaacc

SEQ ID NO: 59930 - DNA, 20 bp, Artificial Sequence
  chemically synthesized
ttttgttaggatggcaaaac

SEQ ID NO: 59931 - DNA, 20 bp, Artificial Sequence
  chemically synthesized
atataatggttttgttagga

SEQ ID NO: 59932 - DNA, 20 bp, Artificial Sequence
  chemically synthesized
gtttatataatggttttgtt

SEQ ID NO: 59933 - DNA, 20 bp, Artificial Sequence
  chemically synthesized
agtttatataatggttttgt

SEQ ID NO: 59934 - DNA, 20 bp, Artificial Sequence
  chemically synthesized
ccttttgtgagtttatataa

SEQ ID NO: 59935 - DNA, 20 bp, Artificial Sequence
  chemically synthesized
accattatataaactcacaa

SEQ ID NO: 59936 - DNA, 20 bp, Artificial Sequence
  chemically synthesized
ccattatataaactcacaaa

SEQ ID NO: 59937 - DNA, 20 bp, Artificial Sequence
  chemically synthesized
tcagctaggtttccttttgt

SEQ ID NO: 59938 - DNA, 20 bp, Artificial Sequence
  chemically synthesized
taaactcacaaaaggaaacc

SEQ ID NO: 59939 - DNA, 20 bp, Artificial Sequence
  chemically synthesized
taggatctatggggtcagct

SEQ ID NO: 59940 - DNA, 20 bp, Artificial Sequence
  chemically synthesized
ttaggatctatggggtcagc

SEQ ID NO: 59941 - DNA, 20 bp, Artificial Sequence
  chemically synthesized
aggaaacctagctgacccca

SEQ ID NO: 59942 - DNA, 20 bp, Artificial Sequence
  chemically synthesized
ggatttaggatctatggggt

SEQ ID NO: 59943 - DNA, 20 bp, Artificial Sequence
  chemically synthesized
gaaaggatttaggatctatg

SEQ ID NO: 59944 - DNA, 20 bp, Artificial Sequence
  chemically synthesized
ggaaaggatttaggatctat

SEQ ID NO: 59945 - DNA, 20 bp, Artificial Sequence
  chemically synthesized
gggaaaggatttaggatcta

SEQ ID NO: 59946 - DNA, 20 bp, Artificial Sequence
  chemically synthesized
gaggagtggggaaaggattt

SEQ ID NO: 59947 - DNA, 20 bp, Artificial Sequence
  chemically synthesized
agaggagtggggaaaggatt

SEQ ID NO: 59948 - DNA, 20 bp, Artificial Sequence
  chemically synthesized
atggaaagaggagtggggaa

SEQ ID NO: 59949 - DNA, 20 bp, Artificial Sequence
  chemically synthesized
aatggaaagaggagtgggga

SEQ ID NO: 59950 - DNA, 20 bp, Artificial Sequence
  chemically synthesized
aaggaatggaaagaggagtg

SEQ ID NO: 59951 - DNA, 20 bp, Artificial Sequence
  chemically synthesized
caaggaatggaaagaggagt

SEQ ID NO: 59952 - DNA, 20 bp, Artificial Sequence
  chemically synthesized
tcaaggaatggaaagaggag

SEQ ID NO: 59953 - DNA, 20 bp, Artificial Sequence
  chemically synthesized
tcttcaaggaatggaaagag

SEQ ID NO: 59954 - DNA, 20 bp, Artificial Sequence
  chemically synthesized
tgtcttcaaggaatggaaag

SEQ ID NO: 59955 - DNA, 20 bp, Artificial Sequence
  chemically synthesized
ctgtcttcaaggaatggaaa

SEQ ID NO: 59956 - DNA, 20 bp, Artificial Sequence
  chemically synthesized
agctgtcttcaaggaatgga

SEQ ID NO: 59957 - DNA, 20 bp, Artificial Sequence
  chemically synthesized
actcctctttccattccttg

SEQ ID NO: 59958 - DNA, 20 bp, Artificial Sequence
  chemically synthesized
ctaaagctgtcttcaaggaa

SEQ ID NO: 59959 - DNA, 20 bp, Artificial Sequence
  chemically synthesized
ctctttccattccttgaaga

SEQ ID NO: 59960 - DNA, 20 bp, Artificial Sequence
  chemically synthesized
agtctctaaagctgtcttca

SEQ ID NO: 59961 - DNA, 20 bp, Artificial Sequence
  chemically synthesized
cagtctctaaagctgtcttc

SEQ ID NO: 59962 - DNA, 20 bp, Artificial Sequence
  chemically synthesized
ccattccttgaagacagctt

SEQ ID NO: 59963 - DNA, 20 bp, Artificial Sequence
  chemically synthesized
attccttgaagacagcttta

SEQ ID NO: 59964 - DNA, 20 bp, Artificial Sequence
  chemically synthesized
tcgggtgggagcagtctcta

SEQ ID NO: 59965 - DNA, 20 bp, Artificial Sequence
  chemically synthesized
agggagagctcgggtgggag

SEQ ID NO: 59966 - DNA, 20 bp, Artificial Sequence
  chemically synthesized
tttagagactgctcccaccc

SEQ ID NO: 59967 - DNA, 20 bp, Artificial Sequence
  chemically synthesized
gtcagggagagctcgggtgg

SEQ ID NO: 59968 - DNA, 20 bp, Artificial Sequence
  chemically synthesized
gagtcagggagagctcgggt

SEQ ID NO: 59969 - DNA, 20 bp, Artificial Sequence
  chemically synthesized
tgagtcagggagagctcggg

SEQ ID NO: 59970 - DNA, 20 bp, Artificial Sequence
  chemically synthesized
ggatgagtcagggagagctc

SEQ ID NO: 59971 - DNA, 20 bp, Artificial Sequence
  chemically synthesized
gggatgagtcagggagagct

SEQ ID NO: 59972 - DNA, 20 bp, Artificial Sequence
  chemically synthesized
gggttgggatgagtcaggga

SEQ ID NO: 59973 - DNA, 20 bp, Artificial Sequence
  chemically synthesized
aagggttgggatgagtcagg

SEQ ID NO: 59974 - DNA, 20 bp, Artificial Sequence
  chemically synthesized
aaaagggttgggatgagtca

SEQ ID NO: 59975 - DNA, 20 bp, Artificial Sequence
  chemically synthesized
gaaaagggttgggatgagtc

SEQ ID NO: 59976 - DNA, 20 bp, Artificial Sequence
  chemically synthesized
tgaaaagggttgggatgagt

SEQ ID NO: 59977 - DNA, 20 bp, Artificial Sequence
  chemically synthesized
gtaatgaaaagggttgggat

SEQ ID NO: 59978 - DNA, 20 bp, Artificial Sequence
  chemically synthesized
ggtgtgtaatgaaaagggtt

SEQ ID NO: 59979 - DNA, 20 bp, Artificial Sequence
  chemically synthesized
cggtgtgtaatgaaaagggt

SEQ ID NO: 59980 - DNA, 20 bp, Artificial Sequence
  chemically synthesized
tcagcggtgtgtaatgaaaa

SEQ ID NO: 59981 - DNA, 20 bp, Artificial Sequence
  chemically synthesized
ttcagcggtgtgtaatgaaa

SEQ ID NO: 59982 - DNA, 20 bp, Artificial Sequence
  chemically synthesized
cttcagcggtgtgtaatgaa

SEQ ID NO: 59983 - DNA, 20 bp, Artificial Sequence
  chemically synthesized
cttttcattacacaccgctg

SEQ ID NO: 59984 - DNA, 20 bp, Artificial Sequence
  chemically synthesized
tgcacagccctgcacttcag

SEQ ID NO: 59985 - DNA, 20 bp, Artificial Sequence
  chemically synthesized
cattacacaccgctgaagtg

SEQ ID NO: 59986 - DNA, 20 bp, Artificial Sequence
  chemically synthesized
attacacaccgctgaagtgc

SEQ ID NO: 59987 - DNA, 20 bp, Artificial Sequence
  chemically synthesized
ttacacaccgctgaagtgca

SEQ ID NO: 59988 - DNA, 20 bp, Artificial Sequence
  chemically synthesized
gactgcacagccctgcactt

SEQ ID NO: 59989 - DNA, 20 bp, Artificial Sequence
  chemically synthesized
cgctgaagtgcagggctgtg

SEQ ID NO: 59990 - DNA, 20 bp, Artificial Sequence
  chemically synthesized
gaagtgcagggctgtgcagt

SEQ ID NO: 59991 - DNA, 20 bp, Artificial Sequence
  chemically synthesized
aagtgcagggctgtgcagtc

SEQ ID NO: 59992 - DNA, 20 bp, Artificial Sequence
  chemically synthesized
atgtaagaatcctgactgca

SEQ ID NO: 59993 - DNA, 20 bp, Artificial Sequence
  chemically synthesized
tgcagtcaggattcttacat

SEQ ID NO: 59994 - DNA, 20 bp, Artificial Sequence
  chemically synthesized
gcagtcaggattcttacata

SEQ ID NO: 59995 - DNA, 20 bp, Artificial Sequence
  chemically synthesized
cgtgatcccagtccttatgt

SEQ ID NO: 59996 - DNA, 20 bp, Artificial Sequence
  chemically synthesized
caggattcttacataaggac

SEQ ID NO: 59997 - DNA, 20 bp, Artificial Sequence
  chemically synthesized
aggattcttacataaggact

SEQ ID NO: 59998 - DNA, 20 bp, Artificial Sequence
  chemically synthesized
aaggctacaggacgtgatcc

SEQ ID NO: 59999 - DNA, 20 bp, Artificial Sequence
  chemically synthesized
aggactgggatcacgtcctg

SEQ ID NO: 60000 - DNA, 20 bp, Artificial Sequence
  chemically synthesized
tgtttggataaaaaggctac

SEQ ID NO: 60001 - DNA, 20 bp, Artificial Sequence
  chemically synthesized
ttgtttggataaaaaggcta

SEQ ID NO: 60002 - DNA, 20 bp, Artificial Sequence
  chemically synthesized
gtcaagttgtttggataaaa

SEQ ID NO: 60003 - DNA, 20 bp, Artificial Sequence
  chemically synthesized
ggtcaagttgtttggataaa

SEQ ID NO: 60004 - DNA, 20 bp, Artificial Sequence
  chemically synthesized
aacagtaaggtcaagttgtt

SEQ ID NO: 60005 - DNA, 20 bp, Artificial Sequence
  chemically synthesized
ctaggcaaaacagtaaggtc

SEQ ID NO: 60006 - DNA, 20 bp, Artificial Sequence
  chemically synthesized
gagggctaggcaaaacagta

SEQ ID NO: 60007 - DNA, 20 bp, Artificial Sequence
  chemically synthesized
tgagggctaggcaaaacagt

SEQ ID NO: 60008 - DNA, 20 bp, Artificial Sequence
  chemically synthesized
cttgaccttactgttttgcc

SEQ ID NO: 60009 - DNA, 20 bp, Artificial Sequence
  chemically synthesized
gacatgagggctaggcaaaa

SEQ ID NO: 60010 - DNA, 20 bp, Artificial Sequence
  chemically synthesized
cgcacgcagacatgagggct

SEQ ID NO: 60011 - DNA, 20 bp, Artificial Sequence
  chemically synthesized
ccgcacgcagacatgagggc

SEQ ID NO: 60012 - DNA, 20 bp, Artificial Sequence
  chemically synthesized
gctgccgcacgcagacatga

SEQ ID NO: 60013 - DNA, 20 bp, Artificial Sequence
  chemically synthesized
ggctgccgcacgcagacatg

SEQ ID NO: 60014 - DNA, 20 bp, Artificial Sequence
  chemically synthesized
cggctgccgcacgcagacat

SEQ ID NO: 60015 - DNA, 20 bp, Artificial Sequence
  chemically synthesized
ctagccctcatgtctgcgtg

SEQ ID NO: 60016 - DNA, 20 bp, Artificial Sequence
  chemically synthesized
gccctcatgtctgcgtgcgg

SEQ ID NO: 60017 - DNA, 20 bp, Artificial Sequence
  chemically synthesized
gtggtggcggctgccgcacg

SEQ ID NO: 60018 - DNA, 20 bp, Artificial Sequence
  chemically synthesized
taaaagtattagggtggtgg

SEQ ID NO: 60019 - DNA, 20 bp, Artificial Sequence
  chemically synthesized
ctctaaaagtattagggtgg

SEQ ID NO: 60020 - DNA, 20 bp, Artificial Sequence
  chemically synthesized
ggcctctaaaagtattaggg

SEQ ID NO: 60021 - DNA, 20 bp, Artificial Sequence
  chemically synthesized
gagggcctctaaaagtatta

SEQ ID NO: 60022 - DNA, 20 bp, Artificial Sequence
  chemically synthesized
tgagggcctctaaaagtatt

SEQ ID NO: 60023 - DNA, 20 bp, Artificial Sequence
  chemically synthesized
cgccaccaccctaatacttt

SEQ ID NO: 60024 - DNA, 20 bp, Artificial Sequence
  chemically synthesized
ttgagggcctctaaaagtat

SEQ ID NO: 60025 - DNA, 20 bp, Artificial Sequence
  chemically synthesized
ccaccaccctaatactttta

SEQ ID NO: 60026 - DNA, 20 bp, Artificial Sequence
  chemically synthesized
caccaccctaatacttttag

SEQ ID NO: 60027 - DNA, 20 bp, Artificial Sequence
  chemically synthesized
gtgattttgagggcctctaa

SEQ ID NO: 60028 - DNA, 20 bp, Artificial Sequence
  chemically synthesized
agcatagtttgtgattttga

SEQ ID NO: 60029 - DNA, 20 bp, Artificial Sequence
  chemically synthesized
gagcatagtttgtgattttg

SEQ ID NO: 60030 - DNA, 20 bp, Artificial Sequence
  chemically synthesized
tgagcatagtttgtgatttt

SEQ ID NO: 60031 - DNA, 20 bp, Artificial Sequence
  chemically synthesized
tgtagagagtgagttgagca

SEQ ID NO: 60032 - DNA, 20 bp, Artificial Sequence
  chemically synthesized
agaactgtagagagtgagtt

SEQ ID NO: 60033 - DNA, 20 bp, Artificial Sequence
  chemically synthesized
ttatgagaactgtagagagt

SEQ ID NO: 60034 - DNA, 20 bp, Artificial Sequence
  chemically synthesized
tatgctcaactcactctcta

SEQ ID NO: 60035 - DNA, 20 bp, Artificial Sequence
  chemically synthesized
gaagttatgagaactgtaga

SEQ ID NO: 60036 - DNA, 20 bp, Artificial Sequence
  chemically synthesized
tggaagttatgagaactgta

SEQ ID NO: 60037 - DNA, 20 bp, Artificial Sequence
  chemically synthesized
tttggaagttatgagaactg

SEQ ID NO: 60038 - DNA, 20 bp, Artificial Sequence
  chemically synthesized
aaatagattttggaagttat

SEQ ID NO: 60039 - DNA, 20 bp, Artificial Sequence
  chemically synthesized
aggaagaaaatagattttgg

SEQ ID NO: 60040 - DNA, 20 bp, Artificial Sequence
  chemically synthesized
gtgaggaagaaaatagattt

SEQ ID NO: 60041 - DNA, 20 bp, Artificial Sequence
  chemically synthesized
gtcaggtgtgaggaagaaaa

SEQ ID NO: 60042 - DNA, 20 bp, Artificial Sequence
  chemically synthesized
catatgcgtcaggtgtgagg

SEQ ID NO: 60043 - DNA, 20 bp, Artificial Sequence
  chemically synthesized
aagcatatgcgtcaggtgtg

SEQ ID NO: 60044 - DNA, 20 bp, Artificial Sequence
  chemically synthesized
aaagcatatgcgtcaggtgt

SEQ ID NO: 60045 - DNA, 20 bp, Artificial Sequence
  chemically synthesized
gagcagaaagcatatgcgtc

SEQ ID NO: 60046 - DNA, 20 bp, Artificial Sequence
  chemically synthesized
ggagcagaaagcatatgcgt

SEQ ID NO: 60047 - DNA, 20 bp, Artificial Sequence
  chemically synthesized
tgaaggagccggggagcaga

SEQ ID NO: 60048 - DNA, 20 bp, Artificial Sequence
  chemically synthesized
cgcatatgctttctgctccc

SEQ ID NO: 60049 - DNA, 20 bp, Artificial Sequence
  chemically synthesized
cagctgaaggagccggggag

SEQ ID NO: 60050 - DNA, 20 bp, Artificial Sequence
  chemically synthesized
gtacagctgaaggagccggg

SEQ ID NO: 60051 - DNA, 20 bp, Artificial Sequence
  chemically synthesized
gagtacagctgaaggagccg

SEQ ID NO: 60052 - DNA, 20 bp, Artificial Sequence
  chemically synthesized
tgagtacagctgaaggagcc

SEQ ID NO: 60053 - DNA, 20 bp, Artificial Sequence
  chemically synthesized
tttctgctccccggctcctt

SEQ ID NO: 60054 - DNA, 20 bp, Artificial Sequence
  chemically synthesized
gtgagtacagctgaaggagc

SEQ ID NO: 60055 - DNA, 20 bp, Artificial Sequence
  chemically synthesized
aagagtgagtacagctgaag

SEQ ID NO: 60056 - DNA, 20 bp, Artificial Sequence
  chemically synthesized
caaagagtgagtacagctga

SEQ ID NO: 60057 - DNA, 20 bp, Artificial Sequence
  chemically synthesized
acaaagagtgagtacagctg

SEQ ID NO: 60058 - DNA, 20 bp, Artificial Sequence
  chemically synthesized
gactcaacaaagagtgagta

SEQ ID NO: 60059 - DNA, 20 bp, Artificial Sequence
  chemically synthesized
tgggagactcaacaaagagt

SEQ ID NO: 60060 - DNA, 20 bp, Artificial Sequence
  chemically synthesized
agctgtactcactctttgtt

SEQ ID NO: 60061 - DNA, 20 bp, Artificial Sequence
  chemically synthesized
attgtgggagactcaacaaa

SEQ ID NO: 60062 - DNA, 20 bp, Artificial Sequence
  chemically synthesized
taattgtgggagactcaaca

SEQ ID NO: 60063 - DNA, 20 bp, Artificial Sequence
  chemically synthesized
aggaacaatggtaattgtgg

SEQ ID NO: 60064 - DNA, 20 bp, Artificial Sequence
  chemically synthesized
ccaggaacaatggtaattgt

SEQ ID NO: 60065 - DNA, 20 bp, Artificial Sequence
  chemically synthesized
gccaggaacaatggtaattg

SEQ ID NO: 60066 - DNA, 20 bp, Artificial Sequence
  chemically synthesized
cccacaattaccattgttcc

SEQ ID NO: 60067 - DNA, 20 bp, Artificial Sequence
  chemically synthesized
gaagtctgggccaggaacaa

SEQ ID NO: 60068 - DNA, 20 bp, Artificial Sequence
  chemically synthesized
aattaccattgttcctggcc

SEQ ID NO: 60069 - DNA, 20 bp, Artificial Sequence
  chemically synthesized
gccggattgaagtctgggcc

SEQ ID NO: 60070 - DNA, 20 bp, Artificial Sequence
  chemically synthesized
ggccggattgaagtctgggc

SEQ ID NO: 60071 - DNA, 20 bp, Artificial Sequence
  chemically synthesized
gggaggccggattgaagtct

SEQ ID NO: 60072 - DNA, 20 bp, Artificial Sequence
  chemically synthesized
tgggaggccggattgaagtc

SEQ ID NO: 60073 - DNA, 20 bp, Artificial Sequence
  chemically synthesized
tcctggcccagacttcaatc

SEQ ID NO: 60074 - DNA, 20 bp, Artificial Sequence
  chemically synthesized
taatgtgggaggccggattg

SEQ ID NO: 60075 - DNA, 20 bp, Artificial Sequence
  chemically synthesized
tcaggaataatgtgggaggc

SEQ ID NO: 60076 - DNA, 20 bp, Artificial Sequence
  chemically synthesized
ggtatcaggaataatgtggg

SEQ ID NO: 60077 - DNA, 20 bp, Artificial Sequence
  chemically synthesized
tggtatcaggaataatgtgg

SEQ ID NO: 60078 - DNA, 20 bp, Artificial Sequence
  chemically synthesized
cgtggtatcaggaataatgt

SEQ ID NO: 60079 - DNA, 20 bp, Artificial Sequence
  chemically synthesized
gcgtggtatcaggaataatg

SEQ ID NO: 60080 - DNA, 20 bp, Artificial Sequence
  chemically synthesized
tgggggtcaggcgtggtatc

SEQ ID NO: 60081 - DNA, 20 bp, Artificial Sequence
  chemically synthesized
atgggggtcaggcgtggtat

SEQ ID NO: 60082 - DNA, 20 bp, Artificial Sequence
  chemically synthesized
acagtcatgggggtcaggcg

SEQ ID NO: 60083 - DNA, 20 bp, Artificial Sequence
  chemically synthesized
gagatacagtcatgggggtc

SEQ ID NO: 60084 - DNA, 20 bp, Artificial Sequence
  chemically synthesized
agagatacagtcatgggggt

SEQ ID NO: 60085 - DNA, 20 bp, Artificial Sequence
  chemically synthesized
gatcagagatacagtcatgg

SEQ ID NO: 60086 - DNA, 20 bp, Artificial Sequence
  chemically synthesized
ggatcagagatacagtcatg

SEQ ID NO: 60087 - DNA, 20 bp, Artificial Sequence
  chemically synthesized
tggatcagagatacagtcat

SEQ ID NO: 60088 - DNA, 20 bp, Artificial Sequence
  chemically synthesized
gtggatcagagatacagtca

SEQ ID NO: 60089 - DNA, 20 bp, Artificial Sequence
  chemically synthesized
tgtctggtggatcagagata

SEQ ID NO: 60090 - DNA, 20 bp, Artificial Sequence
  chemically synthesized
gttgaatgtctggtggatca

SEQ ID NO: 60091 - DNA, 20 bp, Artificial Sequence
  chemically synthesized
tgactgtatctctgatccac

SEQ ID NO: 60092 - DNA, 20 bp, Artificial Sequence
  chemically synthesized
gggttgaatgtctggtggat

SEQ ID NO: 60093 - DNA, 20 bp, Artificial Sequence
  chemically synthesized
aaatggggttgaatgtctgg

SEQ ID NO: 60094 - DNA, 20 bp, Artificial Sequence
  chemically synthesized
gggaaatggggttgaatgtc

SEQ ID NO: 60095 - DNA, 20 bp, Artificial Sequence
  chemically synthesized
gaaggaaatatggggaaatg

SEQ ID NO: 60096 - DNA, 20 bp, Artificial Sequence
  chemically synthesized
agaaggaaatatggggaaat

SEQ ID NO: 60097 - DNA, 20 bp, Artificial Sequence
  chemically synthesized
aagaaggaaatatggggaaa

SEQ ID NO: 60098 - DNA, 20 bp, Artificial Sequence
  chemically synthesized
acaggaaagaaggaaatatg

SEQ ID NO: 60099 - DNA, 20 bp, Artificial Sequence
  chemically synthesized
aacaggaaagaaggaaatat

SEQ ID NO: 60100 - DNA, 20 bp, Artificial Sequence
  chemically synthesized
gaacaggaaagaaggaaata

SEQ ID NO: 60101 - DNA, 20 bp, Artificial Sequence
  chemically synthesized
agggtgaggaacaggaaaga

SEQ ID NO: 60102 - DNA, 20 bp, Artificial Sequence
  chemically synthesized
cagggtgaggaacaggaaag

SEQ ID NO: 60103 - DNA, 20 bp, Artificial Sequence
  chemically synthesized
gatcagggtgaggaacagga

SEQ ID NO: 60104 - DNA, 20 bp, Artificial Sequence
  chemically synthesized
gtgtgatcagggtgaggaac

SEQ ID NO: 60105 - DNA, 20 bp, Artificial Sequence
  chemically synthesized
agtgtgatcagggtgaggaa

SEQ ID NO: 60106 - DNA, 20 bp, Artificial Sequence
  chemically synthesized
aaccaagtgtgatcagggtg

SEQ ID NO: 60107 - DNA, 20 bp, Artificial Sequence
  chemically synthesized
aaaccaagtgtgatcagggt

SEQ ID NO: 60108 - DNA, 20 bp, Artificial Sequence
  chemically synthesized
caataaaccaagtgtgatca

SEQ ID NO: 60109 - DNA, 20 bp, Artificial Sequence
  chemically synthesized
tcaataaaccaagtgtgatc

SEQ ID NO: 60110 - DNA, 20 bp, Artificial Sequence
  chemically synthesized
atcaataaaccaagtgtgat

SEQ ID NO: 60111 - DNA, 20 bp, Artificial Sequence
  chemically synthesized
ttcctcaccctgatcacact

SEQ ID NO: 60112 - DNA, 20 bp, Artificial Sequence
  chemically synthesized
ggaactgccatcaataaacc

SEQ ID NO: 60113 - DNA, 20 bp, Artificial Sequence
  chemically synthesized
gatcacacttggtttattga

SEQ ID NO: 60114 - DNA, 20 bp, Artificial Sequence
  chemically synthesized
cacacttggtttattgatgg

SEQ ID NO: 60115 - DNA, 20 bp, Artificial Sequence
  chemically synthesized
tttattgatggcagttccac

SEQ ID NO: 60116 - DNA, 20 bp, Artificial Sequence
  chemically synthesized
ttattgatggcagttccacc

SEQ ID NO: 60117 - DNA, 20 bp, Artificial Sequence
  chemically synthesized
tgtgtggccattaggcctgg

SEQ ID NO: 60118 - DNA, 20 bp, Artificial Sequence
  chemically synthesized
ggcagttccaccaggcctaa

SEQ ID NO: 60119 - DNA, 20 bp, Artificial Sequence
  chemically synthesized
tggtgtgtggccattaggcc

SEQ ID NO: 60120 - DNA, 20 bp, Artificial Sequence
  chemically synthesized
tttgctggtgtgtggccatt

SEQ ID NO: 60121 - DNA, 20 bp, Artificial Sequence
  chemically synthesized
ctttgctggtgtgtggccat

SEQ ID NO: 60122 - DNA, 20 bp, Artificial Sequence
  chemically synthesized
caggcctaatggccacacac

SEQ ID NO: 60123 - DNA, 20 bp, Artificial Sequence
  chemically synthesized
agcctgcctttgctggtgtg

SEQ ID NO: 60124 - DNA, 20 bp, Artificial Sequence
  chemically synthesized
ctaatggccacacaccagca

SEQ ID NO: 60125 - DNA, 20 bp, Artificial Sequence
  chemically synthesized
taatggccacacaccagcaa

SEQ ID NO: 60126 - DNA, 20 bp, Artificial Sequence
  chemically synthesized
tggccacacaccagcaaagg

SEQ ID NO: 60127 - DNA, 20 bp, Artificial Sequence
  chemically synthesized
atagcatagcctgcctttgc

SEQ ID NO: 60128 - DNA, 20 bp, Artificial Sequence
  chemically synthesized
ggccacacaccagcaaaggc

SEQ ID NO: 60129 - DNA, 20 bp, Artificial Sequence
  chemically synthesized
agcaaaggcaggctatgcta

SEQ ID NO: 60130 - DNA, 20 bp, Artificial Sequence
  chemically synthesized
tagtggcttgtactatagca

SEQ ID NO: 60131 - DNA, 20 bp, Artificial Sequence
  chemically synthesized
ggcaggctatgctatagtac

SEQ ID NO: 60132 - DNA, 20 bp, Artificial Sequence
  chemically synthesized
caggctagtggcttgtacta

SEQ ID NO: 60133 - DNA, 20 bp, Artificial Sequence
  chemically synthesized
tatgctatagtacaagccac

SEQ ID NO: 60134 - DNA, 20 bp, Artificial Sequence
  chemically synthesized
agttctaagaggcaggctag

SEQ ID NO: 60135 - DNA, 20 bp, Artificial Sequence
  chemically synthesized
agaagttctaagaggcaggc

SEQ ID NO: 60136 - DNA, 20 bp, Artificial Sequence
  chemically synthesized
caagccactagcctgcctct

SEQ ID NO: 60137 - DNA, 20 bp, Artificial Sequence
  chemically synthesized
aatgagaagttctaagaggc

SEQ ID NO: 60138 - DNA, 20 bp, Artificial Sequence
  chemically synthesized
aaatgagaagttctaagagg

SEQ ID NO: 60139 - DNA, 20 bp, Artificial Sequence
  chemically synthesized
aggaaatgagaagttctaag

SEQ ID NO: 60140 - DNA, 20 bp, Artificial Sequence
  chemically synthesized
aaggaaatgagaagttctaa

SEQ ID NO: 60141 - DNA, 20 bp, Artificial Sequence
  chemically synthesized
gaaaggaaatgagaagttct

SEQ ID NO: 60142 - DNA, 20 bp, Artificial Sequence
  chemically synthesized
cacgatggaaaggaaatgag

SEQ ID NO: 60143 - DNA, 20 bp, Artificial Sequence
  chemically synthesized
ttccacgatggaaaggaaat

SEQ ID NO: 60144 - DNA, 20 bp, Artificial Sequence
  chemically synthesized
gatagatttccacgatggaa

SEQ ID NO: 60145 - DNA, 20 bp, Artificial Sequence
  chemically synthesized
ttctcatttcctttccatcg

SEQ ID NO: 60146 - DNA, 20 bp, Artificial Sequence
  chemically synthesized
ggatagatttccacgatgga

SEQ ID NO: 60147 - DNA, 20 bp, Artificial Sequence
  chemically synthesized
ttgaggatagatttccacga

SEQ ID NO: 60148 - DNA, 20 bp, Artificial Sequence
  chemically synthesized
atcgtggaaatctatcctca

SEQ ID NO: 60149 - DNA, 20 bp, Artificial Sequence
  chemically synthesized
agaagttatttctttgagga

SEQ ID NO: 60150 - DNA, 20 bp, Artificial Sequence
  chemically synthesized
actgagaagttatttctttg

SEQ ID NO: 60151 - DNA, 20 bp, Artificial Sequence
  chemically synthesized
cactgagaagttatttcttt

SEQ ID NO: 60152 - DNA, 20 bp, Artificial Sequence
  chemically synthesized
tcctcaaagaaataacttct

SEQ ID NO: 60153 - DNA, 20 bp, Artificial Sequence
  chemically synthesized
atagcagatggaacactgag

SEQ ID NO: 60154 - DNA, 20 bp, Artificial Sequence
  chemically synthesized
agaatagcagatggaacact

SEQ ID NO: 60155 - DNA, 20 bp, Artificial Sequence
  chemically synthesized
aggagtagtagaatagcaga

SEQ ID NO: 60156 - DNA, 20 bp, Artificial Sequence
  chemically synthesized
cctgaggagtagtagaatag

SEQ ID NO: 60157 - DNA, 20 bp, Artificial Sequence
  chemically synthesized
atccctgaggagtagtagaa

SEQ ID NO: 60158 - DNA, 20 bp, Artificial Sequence
  chemically synthesized
gaataatccctgaggagtag

SEQ ID NO: 60159 - DNA, 20 bp, Artificial Sequence
  chemically synthesized
tctgctattctactactcct

SEQ ID NO: 60160 - DNA, 20 bp, Artificial Sequence
  chemically synthesized
ctgctattctactactcctc

SEQ ID NO: 60161 - DNA, 20 bp, Artificial Sequence
  chemically synthesized
tgctattctactactcctca

SEQ ID NO: 60162 - DNA, 20 bp, Artificial Sequence
  chemically synthesized
cctgaataatccctgaggag

SEQ ID NO: 60163 - DNA, 20 bp, Artificial Sequence
  chemically synthesized
gggcctgaataatccctgag

SEQ ID NO: 60164 - DNA, 20 bp, Artificial Sequence
  chemically synthesized
gggggcctgaataatccctg

SEQ ID NO: 60165 - DNA, 20 bp, Artificial Sequence
  chemically synthesized
agggggcctgaataatccct

SEQ ID NO: 60166 - DNA, 20 bp, Artificial Sequence
  chemically synthesized
actactcctcagggattatt

SEQ ID NO: 60167 - DNA, 20 bp, Artificial Sequence
  chemically synthesized
ctactcctcagggattattc

SEQ ID NO: 60168 - DNA, 20 bp, Artificial Sequence
  chemically synthesized
tgatgtgtggggaagggagg

SEQ ID NO: 60169 - DNA, 20 bp, Artificial Sequence
  chemically synthesized
ttgatgtgtggggaagggag

SEQ ID NO: 60170 - DNA, 20 bp, Artificial Sequence
  chemically synthesized
cttgatgtgtggggaaggga

SEQ ID NO: 60171 - DNA, 20 bp, Artificial Sequence
  chemically synthesized
acttgatgtgtggggaaggg

SEQ ID NO: 60172 - DNA, 20 bp, Artificial Sequence
  chemically synthesized
aacttgatgtgtggggaagg

SEQ ID NO: 60173 - DNA, 20 bp, Artificial Sequence
  chemically synthesized
cgaacttgatgtgtggggaa

SEQ ID NO: 60174 - DNA, 20 bp, Artificial Sequence
  chemically synthesized
tcgaacttgatgtgtgggga

SEQ ID NO: 60175 - DNA, 20 bp, Artificial Sequence
  chemically synthesized
ctcgaacttgatgtgtgggg

SEQ ID NO: 60176 - DNA, 20 bp, Artificial Sequence
  chemically synthesized
atcctcgaacttgatgtgtg

SEQ ID NO: 60177 - DNA, 20 bp, Artificial Sequence
  chemically synthesized
ccctcccttccccacacatc

SEQ ID NO: 60178 - DNA, 20 bp, Artificial Sequence
  chemically synthesized
aatcctcgaacttgatgtgt

SEQ ID NO: 60179 - DNA, 20 bp, Artificial Sequence
  chemically synthesized
aaatcctcgaacttgatgtg

SEQ ID NO: 60180 - DNA, 20 bp, Artificial Sequence
  chemically synthesized
cttccccacacatcaagttc

SEQ ID NO: 60181 - DNA, 20 bp, Artificial Sequence
  chemically synthesized
ttccccacacatcaagttcg

SEQ ID NO: 60182 - DNA, 20 bp, Artificial Sequence
  chemically synthesized
ttcgaggatttgcccccgcc

SEQ ID NO: 60183 - DNA, 20 bp, Artificial Sequence
  chemically synthesized
tcgaggatttgcccccgccc

SEQ ID NO: 60184 - DNA, 20 bp, Artificial Sequence
  chemically synthesized
aatttgccagtcctgggcgg

SEQ ID NO: 60185 - DNA, 20 bp, Artificial Sequence
  chemically synthesized
caatttgccagtcctgggcg

SEQ ID NO: 60186 - DNA, 20 bp, Artificial Sequence
  chemically synthesized
ccaatttgccagtcctgggc

SEQ ID NO: 60187 - DNA, 20 bp, Artificial Sequence
  chemically synthesized
gccaatttgccagtcctggg

SEQ ID NO: 60188 - DNA, 20 bp, Artificial Sequence
  chemically synthesized
gatttgcccccgcccaggac

SEQ ID NO: 60189 - DNA, 20 bp, Artificial Sequence
  chemically synthesized
aaagccaatttgccagtcct

SEQ ID NO: 60190 - DNA, 20 bp, Artificial Sequence
  chemically synthesized
taaagccaatttgccagtcc

SEQ ID NO: 60191 - DNA, 20 bp, Artificial Sequence
  chemically synthesized
cccgcccaggactggcaaat

SEQ ID NO: 60192 - DNA, 20 bp, Artificial Sequence
  chemically synthesized
gtttagtaaagccaatttgc

SEQ ID NO: 60193 - DNA, 20 bp, Artificial Sequence
  chemically synthesized
gactcggggcatgtttagta

SEQ ID NO: 60194 - DNA, 20 bp, Artificial Sequence
  chemically synthesized
ttcttgactcggggcatgtt

SEQ ID NO: 60195 - DNA, 20 bp, Artificial Sequence
  chemically synthesized
ggctttactaaacatgcccc

SEQ ID NO: 60196 - DNA, 20 bp, Artificial Sequence
  chemically synthesized
tactaaacatgccccgagtc

SEQ ID NO: 60197 - DNA, 20 bp, Artificial Sequence
  chemically synthesized
tattttagtttcttgactcg

SEQ ID NO: 60198 - DNA, 20 bp, Artificial Sequence
  chemically synthesized
gtattttagtttcttgactc

SEQ ID NO: 60199 - DNA, 20 bp, Artificial Sequence
  chemically synthesized
ggtattttagtttcttgact

SEQ ID NO: 60200 - DNA, 20 bp, Artificial Sequence
  chemically synthesized
acctagaccaagaggtattt

SEQ ID NO: 60201 - DNA, 20 bp, Artificial Sequence
  chemically synthesized
caagaaactaaaatacctct

SEQ ID NO: 60202 - DNA, 20 bp, Artificial Sequence
  chemically synthesized
aactaaaatacctcttggtc

SEQ ID NO: 60203 - DNA, 20 bp, Artificial Sequence
  chemically synthesized
aagtgtctacctagaccaag

SEQ ID NO: 60204 - DNA, 20 bp, Artificial Sequence
  chemically synthesized
actaaaatacctcttggtct

SEQ ID NO: 60205 - DNA, 20 bp, Artificial Sequence
  chemically synthesized
aaagtgtctacctagaccaa

SEQ ID NO: 60206 - DNA, 20 bp, Artificial Sequence
  chemically synthesized
tgaaagtgtctacctagacc

SEQ ID NO: 60207 - DNA, 20 bp, Artificial Sequence
  chemically synthesized
aaaatacctcttggtctagg

SEQ ID NO: 60208 - DNA, 20 bp, Artificial Sequence
  chemically synthesized
atccagtgaaagtgtctacc

SEQ ID NO: 60209 - DNA, 20 bp, Artificial Sequence
  chemically synthesized
gtctaggtagacactttcac

SEQ ID NO: 60210 - DNA, 20 bp, Artificial Sequence
  chemically synthesized
ggcctctacctatccagtga

SEQ ID NO: 60211 - DNA, 20 bp, Artificial Sequence
  chemically synthesized
aggtagacactttcactgga

SEQ ID NO: 60212 - DNA, 20 bp, Artificial Sequence
  chemically synthesized
ggtagacactttcactggat

SEQ ID NO: 60213 - DNA, 20 bp, Artificial Sequence
  chemically synthesized
agacactttcactggatagg

SEQ ID NO: 60214 - DNA, 20 bp, Artificial Sequence
  chemically synthesized
gggaaaggcctctacctatc

SEQ ID NO: 60215 - DNA, 20 bp, Artificial Sequence
  chemically synthesized
acactttcactggataggta

SEQ ID NO: 60216 - DNA, 20 bp, Artificial Sequence
  chemically synthesized
cactttcactggataggtag

SEQ ID NO: 60217 - DNA, 20 bp, Artificial Sequence
  chemically synthesized
ataggtagaggcctttccca

SEQ ID NO: 60218 - DNA, 20 bp, Artificial Sequence
  chemically synthesized
taggtagaggcctttcccac

SEQ ID NO: 60219 - DNA, 20 bp, Artificial Sequence
  chemically synthesized
attatgtttccctgtgggaa

SEQ ID NO: 60220 - DNA, 20 bp, Artificial Sequence
  chemically synthesized
aggtagaggcctttcccaca

SEQ ID NO: 60221 - DNA, 20 bp, Artificial Sequence
  chemically synthesized
aattatgtttccctgtggga

SEQ ID NO: 60222 - DNA, 20 bp, Artificial Sequence
  chemically synthesized
gaggaattatgtttccctgt

SEQ ID NO: 60223 - DNA, 20 bp, Artificial Sequence
  chemically synthesized
cgaggaattatgtttccctg

SEQ ID NO: 60224 - DNA, 20 bp, Artificial Sequence
  chemically synthesized
cacagggaaacataattcct

SEQ ID NO: 60225 - DNA, 20 bp, Artificial Sequence
  chemically synthesized
ggaaacataattcctcggtt

SEQ ID NO: 60226 - DNA, 20 bp, Artificial Sequence
  chemically synthesized
gaggtgggaaggccaaaccg

SEQ ID NO: 60227 - DNA, 20 bp, Artificial Sequence
  chemically synthesized
agaggtgggaaggccaaacc

SEQ ID NO: 60228 - DNA, 20 bp, Artificial Sequence
  chemically synthesized
aggaccgtatagaggtggga

SEQ ID NO: 60229 - DNA, 20 bp, Artificial Sequence
  chemically synthesized
taggaccgtatagaggtggg

SEQ ID NO: 60230 - DNA, 20 bp, Artificial Sequence
  chemically synthesized
ttataggaccgtatagaggt

SEQ ID NO: 60231 - DNA, 20 bp, Artificial Sequence
  chemically synthesized
gttataggaccgtatagagg

SEQ ID NO: 60232 - DNA, 20 bp, Artificial Sequence
  chemically synthesized
ttggccttcccacctctata

SEQ ID NO: 60233 - DNA, 20 bp, Artificial Sequence
  chemically synthesized
tctgttataggaccgtatag

SEQ ID NO: 60234 - DNA, 20 bp, Artificial Sequence
  chemically synthesized
gtctgttataggaccgtata

SEQ ID NO: 60235 - DNA, 20 bp, Artificial Sequence
  chemically synthesized
cagtctgttataggaccgta

SEQ ID NO: 60236 - DNA, 20 bp, Artificial Sequence
  chemically synthesized
acctctatacggtcctataa

SEQ ID NO: 60237 - DNA, 20 bp, Artificial Sequence
  chemically synthesized
aataaagtccagtctgttat

SEQ ID NO: 60238 - DNA, 20 bp, Artificial Sequence
  chemically synthesized
taataaagtccagtctgtta

SEQ ID NO: 60239 - DNA, 20 bp, Artificial Sequence
  chemically synthesized
tatacggtcctataacagac

SEQ ID NO: 60240 - DNA, 20 bp, Artificial Sequence
  chemically synthesized
gtgatttgactaataaagtc

SEQ ID NO: 60241 - DNA, 20 bp, Artificial Sequence
  chemically synthesized
tataacagactggactttat

SEQ ID NO: 60242 - DNA, 20 bp, Artificial Sequence
  chemically synthesized
cttgggtgatttgactaata

SEQ ID NO: 60243 - DNA, 20 bp, Artificial Sequence
  chemically synthesized
ctttattagtcaaatcaccc

SEQ ID NO: 60244 - DNA, 20 bp, Artificial Sequence
  chemically synthesized
tattagtcaaatcacccaag

SEQ ID NO: 60245 - DNA, 20 bp, Artificial Sequence
  chemically synthesized
aagagcctgagaaactgctt

SEQ ID NO: 60246 - DNA, 20 bp, Artificial Sequence
  chemically synthesized
taagagcctgagaaactgct

SEQ ID NO: 60247 - DNA, 20 bp, Artificial Sequence
  chemically synthesized
aaatcacccaagcagtttct

SEQ ID NO: 60248 - DNA, 20 bp, Artificial Sequence
  chemically synthesized
aatcacccaagcagtttctc

SEQ ID NO: 60249 - DNA, 20 bp, Artificial Sequence
  chemically synthesized
caagcagtttctcaggctct

SEQ ID NO: 60250 - DNA, 20 bp, Artificial Sequence
  chemically synthesized
tcactgaatactaagagcct

SEQ ID NO: 60251 - DNA, 20 bp, Artificial Sequence
  chemically synthesized
attagttcactgaatactaa

SEQ ID NO: 60252 - DNA, 20 bp, Artificial Sequence
  chemically synthesized
tttctcaggctcttagtatt

SEQ ID NO: 60253 - DNA, 20 bp, Artificial Sequence
  chemically synthesized
ccattagttcactgaatact

SEQ ID NO: 60254 - DNA, 20 bp, Artificial Sequence
  chemically synthesized
cttagtattcagtgaactaa

SEQ ID NO: 60255 - DNA, 20 bp, Artificial Sequence
  chemically synthesized
gtgtgtttttaaaagaccat

SEQ ID NO: 60256 - DNA, 20 bp, Artificial Sequence
  chemically synthesized
ttggtgaggtgtgtttttaa

SEQ ID NO: 60257 - DNA, 20 bp, Artificial Sequence
  chemically synthesized
ttttaaaaacacacctcacc

SEQ ID NO: 60258 - DNA, 20 bp, Artificial Sequence
  chemically synthesized
gttggtggctgagcttggtg

SEQ ID NO: 60259 - DNA, 20 bp, Artificial Sequence
  chemically synthesized
agttggtggctgagcttggt

SEQ ID NO: 60260 - DNA, 20 bp, Artificial Sequence
  chemically synthesized
aaaacacacctcaccaagct

SEQ ID NO: 60261 - DNA, 20 bp, Artificial Sequence
  chemically synthesized
tttaagttggtggctgagct

SEQ ID NO: 60262 - DNA, 20 bp, Artificial Sequence
  chemically synthesized
tcctttttaagttggtggct

SEQ ID NO: 60263 - DNA, 20 bp, Artificial Sequence
  chemically synthesized
tccagtcctttttaagttgg

SEQ ID NO: 60264 - DNA, 20 bp, Artificial Sequence
  chemically synthesized
agctcagccaccaacttaaa

SEQ ID NO: 60265 - DNA, 20 bp, Artificial Sequence
  chemically synthesized
ttgtccagtcctttttaagt

SEQ ID NO: 60266 - DNA, 20 bp, Artificial Sequence
  chemically synthesized
gctcagccaccaacttaaaa

SEQ ID NO: 60267 - DNA, 20 bp, Artificial Sequence
  chemically synthesized
agtattgtccagtccttttt

SEQ ID NO: 60268 - DNA, 20 bp, Artificial Sequence
  chemically synthesized
gccaccaacttaaaaaggac

SEQ ID NO: 60269 - DNA, 20 bp, Artificial Sequence
  chemically synthesized
caagtggtaaaagtattgtc

SEQ ID NO: 60270 - DNA, 20 bp, Artificial Sequence
  chemically synthesized
ctgagaagggcaagtggtaa

SEQ ID NO: 60271 - DNA, 20 bp, Artificial Sequence
  chemically synthesized
tgaattctgagaagggcaag

SEQ ID NO: 60272 - DNA, 20 bp, Artificial Sequence
  chemically synthesized
gcctgaattctgagaagggc

SEQ ID NO: 60273 - DNA, 20 bp, Artificial Sequence
  chemically synthesized
cttttaccacttgcccttct

SEQ ID NO: 60274 - DNA, 20 bp, Artificial Sequence
  chemically synthesized
acaggcctgaattctgagaa

SEQ ID NO: 60275 - DNA, 20 bp, Artificial Sequence
  chemically synthesized
gacaggcctgaattctgaga

SEQ ID NO: 60276 - DNA, 20 bp, Artificial Sequence
  chemically synthesized
ggacaggcctgaattctgag

SEQ ID NO: 60277 - DNA, 20 bp, Artificial Sequence
  chemically synthesized
cacttgcccttctcagaatt

SEQ ID NO: 60278 - DNA, 20 bp, Artificial Sequence
  chemically synthesized
acttgcccttctcagaattc

SEQ ID NO: 60279 - DNA, 20 bp, Artificial Sequence
  chemically synthesized
tgaggacaggcctgaattct

SEQ ID NO: 60280 - DNA, 20 bp, Artificial Sequence
  chemically synthesized
tcagaattcaggcctgtcct

SEQ ID NO: 60281 - DNA, 20 bp, Artificial Sequence
  chemically synthesized
ccttgtagcattctgaggac

SEQ ID NO: 60282 - DNA, 20 bp, Artificial Sequence
  chemically synthesized
accttgtagcattctgagga

SEQ ID NO: 60283 - DNA, 20 bp, Artificial Sequence
  chemically synthesized
ctgtaccttgtagcattctg

SEQ ID NO: 60284 - DNA, 20 bp, Artificial Sequence
  chemically synthesized
gctgtaccttgtagcattct

SEQ ID NO: 60285 - DNA, 20 bp, Artificial Sequence
  chemically synthesized
gcctgtcctcagaatgctac

SEQ ID NO: 60286 - DNA, 20 bp, Artificial Sequence
  chemically synthesized
cctgtcctcagaatgctaca

SEQ ID NO: 60287 - DNA, 20 bp, Artificial Sequence
  chemically synthesized
cctcagaatgctacaaggta

SEQ ID NO: 60288 - DNA, 20 bp, Artificial Sequence
  chemically synthesized
cttaaatgggctgtaccttg

SEQ ID NO: 60289 - DNA, 20 bp, Artificial Sequence
  chemically synthesized
ctacaaggtacagcccattt

SEQ ID NO: 60290 - DNA, 20 bp, Artificial Sequence
  chemically synthesized
gtccatacaggagcttaaat

SEQ ID NO: 60291 - DNA, 20 bp, Artificial Sequence
  chemically synthesized
cgtccatacaggagcttaaa

SEQ ID NO: 60292 - DNA, 20 bp, Artificial Sequence
  chemically synthesized
agcccatttaagctcctgta

SEQ ID NO: 60293 - DNA, 20 bp, Artificial Sequence
  chemically synthesized
aaaaaggagcgtccatacag

SEQ ID NO: 60294 - DNA, 20 bp, Artificial Sequence
  chemically synthesized
ataaaaaggagcgtccatac

SEQ ID NO: 60295 - DNA, 20 bp, Artificial Sequence
  chemically synthesized
aataaaaaggagcgtccata

SEQ ID NO: 60296 - DNA, 20 bp, Artificial Sequence
  chemically synthesized
gactggggcctaataaaaag

SEQ ID NO: 60297 - DNA, 20 bp, Artificial Sequence
  chemically synthesized
gtatggacgctcctttttat

SEQ ID NO: 60298 - DNA, 20 bp, Artificial Sequence
  chemically synthesized
tatggacgctcctttttatt

SEQ ID NO: 60299 - DNA, 20 bp, Artificial Sequence
  chemically synthesized
gagactggggcctaataaaa

SEQ ID NO: 60300 - DNA, 20 bp, Artificial Sequence
  chemically synthesized
tgagactggggcctaataaa

SEQ ID NO: 60301 - DNA, 20 bp, Artificial Sequence
  chemically synthesized
cgctcctttttattaggccc

SEQ ID NO: 60302 - DNA, 20 bp, Artificial Sequence
  chemically synthesized
tggtgtctggaatgagactg

SEQ ID NO: 60303 - DNA, 20 bp, Artificial Sequence
  chemically synthesized
ctggtgtctggaatgagact

SEQ ID NO: 60304 - DNA, 20 bp, Artificial Sequence
  chemically synthesized
tctggtgtctggaatgagac

SEQ ID NO: 60305 - DNA, 20 bp, Artificial Sequence
  chemically synthesized
attaggccccagtctcattc

SEQ ID NO: 60306 - DNA, 20 bp, Artificial Sequence
  chemically synthesized
gttggtctggtgtctggaat

SEQ ID NO: 60307 - DNA, 20 bp, Artificial Sequence
  chemically synthesized
cccagtctcattccagacac

SEQ ID NO: 60308 - DNA, 20 bp, Artificial Sequence
  chemically synthesized
gtctaagttggtctggtgtc

SEQ ID NO: 60309 - DNA, 20 bp, Artificial Sequence
  chemically synthesized
gggtgcagtctaagttggtc

SEQ ID NO: 60310 - DNA, 20 bp, Artificial Sequence
  chemically synthesized
ttccagacaccagaccaact

SEQ ID NO: 60311 - DNA, 20 bp, Artificial Sequence
  chemically synthesized
ttttggggtgcagtctaagt

SEQ ID NO: 60312 - DNA, 20 bp, Artificial Sequence
  chemically synthesized
agttttttggggtgcagtct

SEQ ID NO: 60313 - DNA, 20 bp, Artificial Sequence
  chemically synthesized
atgacaagttttttggggtg

SEQ ID NO: 60314 - DNA, 20 bp, Artificial Sequence
  chemically synthesized
gagggatgacaagttttttg

SEQ ID NO: 60315 - DNA, 20 bp, Artificial Sequence
  chemically synthesized
ggagggatgacaagtttttt

SEQ ID NO: 60316 - DNA, 20 bp, Artificial Sequence
  chemically synthesized
aggagggatgacaagttttt

SEQ ID NO: 60317 - DNA, 20 bp, Artificial Sequence
  chemically synthesized
cagaagataggagggatgac

SEQ ID NO: 60318 - DNA, 20 bp, Artificial Sequence
  chemically synthesized
tgactagacagaagatagga

SEQ ID NO: 60319 - DNA, 20 bp, Artificial Sequence
  chemically synthesized
atgactagacagaagatagg

SEQ ID NO: 60320 - DNA, 20 bp, Artificial Sequence
  chemically synthesized
tatgactagacagaagatag

SEQ ID NO: 60321 - DNA, 20 bp, Artificial Sequence
  chemically synthesized
agtatgactagacagaagat

SEQ ID NO: 60322 - DNA, 20 bp, Artificial Sequence
  chemically synthesized
gagtatgactagacagaaga

SEQ ID NO: 60323 - DNA, 20 bp, Artificial Sequence
  chemically synthesized
catccctcctatcttctgtc

SEQ ID NO: 60324 - DNA, 20 bp, Artificial Sequence
  chemically synthesized
ataggagtatgactagacag

SEQ ID NO: 60325 - DNA, 20 bp, Artificial Sequence
  chemically synthesized
tgaataggagtatgactaga

SEQ ID NO: 60326 - DNA, 20 bp, Artificial Sequence
  chemically synthesized
ctggtgaataggagtatgac

SEQ ID NO: 60327 - DNA, 20 bp, Artificial Sequence
  chemically synthesized
tagttgagactggtgaatag

SEQ ID NO: 60328 - DNA, 20 bp, Artificial Sequence
  chemically synthesized
ctagtcatactcctattcac

SEQ ID NO: 60329 - DNA, 20 bp, Artificial Sequence
  chemically synthesized
actagttgagactggtgaat

SEQ ID NO: 60330 - DNA, 20 bp, Artificial Sequence
  chemically synthesized
gactagttgagactggtgaa

SEQ ID NO: 60331 - DNA, 20 bp, Artificial Sequence
  chemically synthesized
catttatgactagttgagac

SEQ ID NO: 60332 - DNA, 20 bp, Artificial Sequence
  chemically synthesized
tcctattcaccagtctcaac

SEQ ID NO: 60333 - DNA, 20 bp, Artificial Sequence
  chemically synthesized
cagggcatttatgactagtt

SEQ ID NO: 60334 - DNA, 20 bp, Artificial Sequence
  chemically synthesized
aagagcagggcatttatgac

SEQ ID NO: 60335 - DNA, 20 bp, Artificial Sequence
  chemically synthesized
cagcagtgtaaacaagagca

SEQ ID NO: 60336 - DNA, 20 bp, Artificial Sequence
  chemically synthesized
ccagcagtgtaaacaagagc

SEQ ID NO: 60337 - DNA, 20 bp, Artificial Sequence
  chemically synthesized
accagcagtgtaaacaagag

SEQ ID NO: 60338 - DNA, 20 bp, Artificial Sequence
  chemically synthesized
taaaccagcagtgtaaacaa

SEQ ID NO: 60339 - DNA, 20 bp, Artificial Sequence
  chemically synthesized
tgtaaaccagcagtgtaaac

SEQ ID NO: 60340 - DNA, 20 bp, Artificial Sequence
  chemically synthesized
cctgctcttgtttacactgc

SEQ ID NO: 60341 - DNA, 20 bp, Artificial Sequence
  chemically synthesized
ggagaaacagtgtaaaccag

SEQ ID NO: 60342 - DNA, 20 bp, Artificial Sequence
  chemically synthesized
cttggagaaacagtgtaaac

SEQ ID NO: 60343 - DNA, 20 bp, Artificial Sequence
  chemically synthesized
ctggtttacactgtttctcc

SEQ ID NO: 60344 - DNA, 20 bp, Artificial Sequence
  chemically synthesized
gctgtgatggcttggagaaa

SEQ ID NO: 60345 - DNA, 20 bp, Artificial Sequence
  chemically synthesized
atatcagctgtgatggcttg

SEQ ID NO: 60346 - DNA, 20 bp, Artificial Sequence
  chemically synthesized
agatatcagctgtgatggct

SEQ ID NO: 60347 - DNA, 20 bp, Artificial Sequence
  chemically synthesized
actgtttctccaagccatca

SEQ ID NO: 60348 - DNA, 20 bp, Artificial Sequence
  chemically synthesized
ccaagagatatcagctgtga

SEQ ID NO: 60349 - DNA, 20 bp, Artificial Sequence
  chemically synthesized
gggatagcaccaagagatat

SEQ ID NO: 60350 - DNA, 20 bp, Artificial Sequence
  chemically synthesized
ccatcacagctgatatctct

SEQ ID NO: 60351 - DNA, 20 bp, Artificial Sequence
  chemically synthesized
tggtttggggatagcaccaa

SEQ ID NO: 60352 - DNA, 20 bp, Artificial Sequence
  chemically synthesized
ggtggtttggggatagcacc

SEQ ID NO: 60353 - DNA, 20 bp, Artificial Sequence
  chemically synthesized
taagagtggtggtttgggga

SEQ ID NO: 60354 - DNA, 20 bp, Artificial Sequence
  chemically synthesized
gagttaagagtggtggtttg

SEQ ID NO: 60355 - DNA, 20 bp, Artificial Sequence
  chemically synthesized
agagttaagagtggtggttt

SEQ ID NO: 60356 - DNA, 20 bp, Artificial Sequence
  chemically synthesized
aagagttaagagtggtggtt

SEQ ID NO: 60357 - DNA, 20 bp, Artificial Sequence
  chemically synthesized
actttaagagttaagagtgg

SEQ ID NO: 60358 - DNA, 20 bp, Artificial Sequence
  chemically synthesized
tttactttaagagttaagag

SEQ ID NO: 60359 - DNA, 20 bp, Artificial Sequence
  chemically synthesized
ttatttactttaagagttaa

SEQ ID NO: 60360 - DNA, 20 bp, Artificial Sequence
  chemically synthesized
gattatttactttaagagtt

SEQ ID NO: 60361 - DNA, 20 bp, Artificial Sequence
  chemically synthesized
accaccactcttaactctta

SEQ ID NO: 60362 - DNA, 20 bp, Artificial Sequence
  chemically synthesized
gcaaagattatttactttaa

SEQ ID NO: 60363 - DNA, 20 bp, Artificial Sequence
  chemically synthesized
cagcaaagattatttacttt

SEQ ID NO: 60364 - DNA, 20 bp, Artificial Sequence
  chemically synthesized
ttaaagtaaataatctttgc

SEQ ID NO: 60365 - DNA, 20 bp, Artificial Sequence
  chemically synthesized
agtaaataatctttgctggc

SEQ ID NO: 60366 - DNA, 20 bp, Artificial Sequence
  chemically synthesized
tcagcatagccttgccagca

SEQ ID NO: 60367 - DNA, 20 bp, Artificial Sequence
  chemically synthesized
gtaaataatctttgctggca

SEQ ID NO: 60368 - DNA, 20 bp, Artificial Sequence
  chemically synthesized
gaggttcagcatagccttgc

SEQ ID NO: 60369 - DNA, 20 bp, Artificial Sequence
  chemically synthesized
gtgcctaaggaggttcagca

SEQ ID NO: 60370 - DNA, 20 bp, Artificial Sequence
  chemically synthesized
agagagtgcctaaggaggtt

SEQ ID NO: 60371 - DNA, 20 bp, Artificial Sequence
  chemically synthesized
aaggctatgctgaacctcct

SEQ ID NO: 60372 - DNA, 20 bp, Artificial Sequence
  chemically synthesized
aggctatgctgaacctcctt

SEQ ID NO: 60373 - DNA, 20 bp, Artificial Sequence
  chemically synthesized
taattagagagtgcctaagg

SEQ ID NO: 60374 - DNA, 20 bp, Artificial Sequence
  chemically synthesized
ctaattagagagtgcctaag

SEQ ID NO: 60375 - DNA, 20 bp, Artificial Sequence
  chemically synthesized
gtctaattagagagtgccta

SEQ ID NO: 60376 - DNA, 20 bp, Artificial Sequence
  chemically synthesized
cgtctaattagagagtgcct

SEQ ID NO: 60377 - DNA, 20 bp, Artificial Sequence
  chemically synthesized
ctccttaggcactctctaat

SEQ ID NO: 60378 - DNA, 20 bp, Artificial Sequence
  chemically synthesized
acctaggacgtctaattaga

SEQ ID NO: 60379 - DNA, 20 bp, Artificial Sequence
  chemically synthesized
ggacctaggacgtctaatta

SEQ ID NO: 60380 - DNA, 20 bp, Artificial Sequence
  chemically synthesized
gaggacctaggacgtctaat

SEQ ID NO: 60381 - DNA, 20 bp, Artificial Sequence
  chemically synthesized
cactctctaattagacgtcc

SEQ ID NO: 60382 - DNA, 20 bp, Artificial Sequence
  chemically synthesized
actctctaattagacgtcct

SEQ ID NO: 60383 - DNA, 20 bp, Artificial Sequence
  chemically synthesized
acgaagaattgggaggacct

SEQ ID NO: 60384 - DNA, 20 bp, Artificial Sequence
  chemically synthesized
gacgaagaattgggaggacc

SEQ ID NO: 60385 - DNA, 20 bp, Artificial Sequence
  chemically synthesized
ttaaaggacgaagaattggg

SEQ ID NO: 60386 - DNA, 20 bp, Artificial Sequence
  chemically synthesized
attaaaggacgaagaattgg

SEQ ID NO: 60387 - DNA, 20 bp, Artificial Sequence
  chemically synthesized
gtattaaaggacgaagaatt

SEQ ID NO: 60388 - DNA, 20 bp, Artificial Sequence
  chemically synthesized
ggtattaaaggacgaagaat

SEQ ID NO: 60389 - DNA, 20 bp, Artificial Sequence
  chemically synthesized
aaaacaggtattaaaggacg

SEQ ID NO: 60390 - DNA, 20 bp, Artificial Sequence
  chemically synthesized
aggagaaaaacaggtattaa

SEQ ID NO: 60391 - DNA, 20 bp, Artificial Sequence
  chemically synthesized
aaggagaaaaacaggtatta

SEQ ID NO: 60392 - DNA, 20 bp, Artificial Sequence
  chemically synthesized
aataagagaaggagaaaaac

SEQ ID NO: 60393 - DNA, 20 bp, Artificial Sequence
  chemically synthesized
gaataagagaaggagaaaaa

SEQ ID NO: 60394 - DNA, 20 bp, Artificial Sequence
  chemically synthesized
actaaacggaataagagaag

SEQ ID NO: 60395 - DNA, 20 bp, Artificial Sequence
  chemically synthesized
aaactaaacggaataagaga

SEQ ID NO: 60396 - DNA, 20 bp, Artificial Sequence
  chemically synthesized
aaaactaaacggaataagag

SEQ ID NO: 60397 - DNA, 20 bp, Artificial Sequence
  chemically synthesized
tgaaaaactaaacggaataa

SEQ ID NO: 60398 - DNA, 20 bp, Artificial Sequence
  chemically synthesized
attgaaaaactaaacggaat

SEQ ID NO: 60399 - DNA, 20 bp, Artificial Sequence
  chemically synthesized
tctccttctcttattccgtt

SEQ ID NO: 60400 - DNA, 20 bp, Artificial Sequence
  chemically synthesized
gtatgaattgaaaaactaaa

SEQ ID NO: 60401 - DNA, 20 bp, Artificial Sequence
  chemically synthesized
aattcatacaaaaccgtatc

SEQ ID NO: 60402 - DNA, 20 bp, Artificial Sequence
  chemically synthesized
attcatacaaaaccgtatcc

SEQ ID NO: 60403 - DNA, 20 bp, Artificial Sequence
  chemically synthesized
tattggtgatggcctggata

SEQ ID NO: 60404 - DNA, 20 bp, Artificial Sequence
  chemically synthesized
tagaattattggtgatggcc

SEQ ID NO: 60405 - DNA, 20 bp, Artificial Sequence
  chemically synthesized
tcatgtagaattattggtga

SEQ ID NO: 60406 - DNA, 20 bp, Artificial Sequence
  chemically synthesized
catttgtcatgtagaattat

SEQ ID NO: 60407 - DNA, 20 bp, Artificial Sequence
  chemically synthesized
tagaagaaacatttgtcatg

SEQ ID NO: 60408 - DNA, 20 bp, Artificial Sequence
  chemically synthesized
tgatattgtggggttgttag

SEQ ID NO: 60409 - DNA, 20 bp, Artificial Sequence
  chemically synthesized
gggtgatattgtggggttgt

SEQ ID NO: 60410 - DNA, 20 bp, Artificial Sequence
  chemically synthesized
tggtaaggggtgatattgtg

SEQ ID NO: 60411 - DNA, 20 bp, Artificial Sequence
  chemically synthesized
gtggtaaggggtgatattgt

SEQ ID NO: 60412 - DNA, 20 bp, Artificial Sequence
  chemically synthesized
tgtggtaaggggtgatattg

SEQ ID NO: 60413 - DNA, 20 bp, Artificial Sequence
  chemically synthesized
aaggaagattttgtggtaag

SEQ ID NO: 60414 - DNA, 20 bp, Artificial Sequence
  chemically synthesized
gaaggaagattttgtggtaa

SEQ ID NO: 60415 - DNA, 20 bp, Artificial Sequence
  chemically synthesized
tgaaggaagattttgtggta

SEQ ID NO: 60416 - DNA, 20 bp, Artificial Sequence
  chemically synthesized
ctgaaggaagattttgtggt

SEQ ID NO: 60417 - DNA, 20 bp, Artificial Sequence
  chemically synthesized
taagctgaaggaagattttg

SEQ ID NO: 60418 - DNA, 20 bp, Artificial Sequence
  chemically synthesized
cttaccacaaaatcttcctt

SEQ ID NO: 60419 - DNA, 20 bp, Artificial Sequence
  chemically synthesized
gggagggattaagctgaagg

SEQ ID NO: 60420 - DNA, 20 bp, Artificial Sequence
  chemically synthesized
agtgggagggattaagctga

SEQ ID NO: 60421 - DNA, 20 bp, Artificial Sequence
  chemically synthesized
gagtgggagggattaagctg

SEQ ID NO: 60422 - DNA, 20 bp, Artificial Sequence
  chemically synthesized
aacctagagtgggagggatt

SEQ ID NO: 60423 - DNA, 20 bp, Artificial Sequence
  chemically synthesized
cgtgggaacctagagtggga

SEQ ID NO: 60424 - DNA, 20 bp, Artificial Sequence
  chemically synthesized
cagcttaatccctcccactc

SEQ ID NO: 60425 - DNA, 20 bp, Artificial Sequence
  chemically synthesized
gcgtgggaacctagagtggg

SEQ ID NO: 60426 - DNA, 20 bp, Artificial Sequence
  chemically synthesized
agcttaatccctcccactct

SEQ ID NO: 60427 - DNA, 20 bp, Artificial Sequence
  chemically synthesized
ggcgtgggaacctagagtgg

SEQ ID NO: 60428 - DNA, 20 bp, Artificial Sequence
  chemically synthesized
gtggcgtgggaacctagagt

SEQ ID NO: 60429 - DNA, 20 bp, Artificial Sequence
  chemically synthesized
ggtggcgtgggaacctagag

SEQ ID NO: 60430 - DNA, 20 bp, Artificial Sequence
  chemically synthesized
aggggtggcgtgggaaccta

SEQ ID NO: 60431 - DNA, 20 bp, Artificial Sequence
  chemically synthesized
tcaggggtggcgtgggaacc

SEQ ID NO: 60432 - DNA, 20 bp, Artificial Sequence
  chemically synthesized
aggtggatcaggggtggcgt

SEQ ID NO: 60433 - DNA, 20 bp, Artificial Sequence
  chemically synthesized
gaggtggatcaggggtggcg

SEQ ID NO: 60434 - DNA, 20 bp, Artificial Sequence
  chemically synthesized
gcttcgaggtggatcagggg

SEQ ID NO: 60435 - DNA, 20 bp, Artificial Sequence
  chemically synthesized
gctgcttcgaggtggatcag

SEQ ID NO: 60436 - DNA, 20 bp, Artificial Sequence
  chemically synthesized
ggctgcttcgaggtggatca

SEQ ID NO: 60437 - DNA, 20 bp, Artificial Sequence
  chemically synthesized
gggctgcttcgaggtggatc

SEQ ID NO: 60438 - DNA, 20 bp, Artificial Sequence
  chemically synthesized
agggctgcttcgaggtggat

SEQ ID NO: 60439 - DNA, 20 bp, Artificial Sequence
  chemically synthesized
gccacccctgatccacctcg

SEQ ID NO: 60440 - DNA, 20 bp, Artificial Sequence
  chemically synthesized
ttctcagggctgcttcgagg

SEQ ID NO: 60441 - DNA, 20 bp, Artificial Sequence
  chemically synthesized
acccctgatccacctcgaag

SEQ ID NO: 60442 - DNA, 20 bp, Artificial Sequence
  chemically synthesized
tgtttctcagggctgcttcg

SEQ ID NO: 60443 - DNA, 20 bp, Artificial Sequence
  chemically synthesized
atgtttctcagggctgcttc

SEQ ID NO: 60444 - DNA, 20 bp, Artificial Sequence
  chemically synthesized
atccacctcgaagcagccct

SEQ ID NO: 60445 - DNA, 20 bp, Artificial Sequence
  chemically synthesized
ataatgggtgatgtttctca

SEQ ID NO: 60446 - DNA, 20 bp, Artificial Sequence
  chemically synthesized
gataatgggtgatgtttctc

SEQ ID NO: 60447 - DNA, 20 bp, Artificial Sequence
  chemically synthesized
agataatgggtgatgtttct

SEQ ID NO: 60448 - DNA, 20 bp, Artificial Sequence
  chemically synthesized
gggtggtgtggagagataat

SEQ ID NO: 60449 - DNA, 20 bp, Artificial Sequence
  chemically synthesized
ggggtggtgtggagagataa

SEQ ID NO: 60450 - DNA, 20 bp, Artificial Sequence
  chemically synthesized
aattttcggggtggtgtgga

SEQ ID NO: 60451 - DNA, 20 bp, Artificial Sequence
  chemically synthesized
aaaattttcggggtggtgtg

SEQ ID NO: 60452 - DNA, 20 bp, Artificial Sequence
  chemically synthesized
cgaaaattttcggggtggtg

SEQ ID NO: 60453 - DNA, 20 bp, Artificial Sequence
  chemically synthesized
ggcggcgaaaattttcgggg

SEQ ID NO: 60454 - DNA, 20 bp, Artificial Sequence
  chemically synthesized
tggggcggcgaaaattttcg

SEQ ID NO: 60455 - DNA, 20 bp, Artificial Sequence
  chemically synthesized
ttggggcggcgaaaattttc

SEQ ID NO: 60456 - DNA, 20 bp, Artificial Sequence
  chemically synthesized
gttggggcggcgaaaatttt

SEQ ID NO: 60457 - DNA, 20 bp, Artificial Sequence
  chemically synthesized
atagtgttgaagtgttgggg

SEQ ID NO: 60458 - DNA, 20 bp, Artificial Sequence
  chemically synthesized
aaaatagtgttgaagtgttg

SEQ ID NO: 60459 - DNA, 20 bp, Artificial Sequence
  chemically synthesized
caaaatagtgttgaagtgtt

SEQ ID NO: 60460 - DNA, 20 bp, Artificial Sequence
  chemically synthesized
acaaaatagtgttgaagtgt

SEQ ID NO: 60461 - DNA, 20 bp, Artificial Sequence
  chemically synthesized
aataaaacaaaatagtgttg

SEQ ID NO: 60462 - DNA, 20 bp, Artificial Sequence
  chemically synthesized
ataagaaaaataaaacaaaa

SEQ ID NO: 60463 - DNA, 20 bp, Artificial Sequence
  chemically synthesized
tcctgtcttcttatattaat

SEQ ID NO: 60464 - DNA, 20 bp, Artificial Sequence
  chemically synthesized
tttatttttcttattaatat

SEQ ID NO: 60465 - DNA, 20 bp, Artificial Sequence
  chemically synthesized
atttttcttattaatataag

SEQ ID NO: 60466 - DNA, 20 bp, Artificial Sequence
  chemically synthesized
ttcttattaatataagaaga

SEQ ID NO: 60467 - DNA, 20 bp, Artificial Sequence
  chemically synthesized
tcttattaatataagaagac

SEQ ID NO: 60468 - DNA, 20 bp, Artificial Sequence
  chemically synthesized
atataagaagacaggaatgt

SEQ ID NO: 60469 - DNA, 20 bp, Artificial Sequence
  chemically synthesized
tataagaagacaggaatgtc

SEQ ID NO: 60470 - DNA, 20 bp, Artificial Sequence
  chemically synthesized
gacaggaatgtcaggcctct

SEQ ID NO: 60471 - DNA, 20 bp, Artificial Sequence
  chemically synthesized
atggcttagcttgggctcag

SEQ ID NO: 60472 - DNA, 20 bp, Artificial Sequence
  chemically synthesized
aatgtcaggcctctgagccc

SEQ ID NO: 60473 - DNA, 20 bp, Artificial Sequence
  chemically synthesized
gatggcttagcttgggctca

SEQ ID NO: 60474 - DNA, 20 bp, Artificial Sequence
  chemically synthesized
atgatggcttagcttgggct

SEQ ID NO: 60475 - DNA, 20 bp, Artificial Sequence
  chemically synthesized
caggcctctgagcccaagct

SEQ ID NO: 60476 - DNA, 20 bp, Artificial Sequence
  chemically synthesized
gggatatgatggcttagctt

SEQ ID NO: 60477 - DNA, 20 bp, Artificial Sequence
  chemically synthesized
ggggatatgatggcttagct

SEQ ID NO: 60478 - DNA, 20 bp, Artificial Sequence
  chemically synthesized
tcacaggggatatgatggct

SEQ ID NO: 60479 - DNA, 20 bp, Artificial Sequence
  chemically synthesized
gtaggtcacaggggatatga

SEQ ID NO: 60480 - DNA, 20 bp, Artificial Sequence
  chemically synthesized
tgtatatgtgtaggtcacag

SEQ ID NO: 60481 - DNA, 20 bp, Artificial Sequence
  chemically synthesized
atgtatatgtgtaggtcaca

SEQ ID NO: 60482 - DNA, 20 bp, Artificial Sequence
  chemically synthesized
gatgtatatgtgtaggtcac

SEQ ID NO: 60483 - DNA, 20 bp, Artificial Sequence
  chemically synthesized
ggatgtatatgtgtaggtca

SEQ ID NO: 60484 - DNA, 20 bp, Artificial Sequence
  chemically synthesized
ccatctggatgtatatgtgt

SEQ ID NO: 60485 - DNA, 20 bp, Artificial Sequence
  chemically synthesized
gccatctggatgtatatgtg

SEQ ID NO: 60486 - DNA, 20 bp, Artificial Sequence
  chemically synthesized
gtgacctacacatatacatc

SEQ ID NO: 60487 - DNA, 20 bp, Artificial Sequence
  chemically synthesized
cctacacatatacatccaga

SEQ ID NO: 60488 - DNA, 20 bp, Artificial Sequence
  chemically synthesized
ttcagttacttcaggccatc

SEQ ID NO: 60489 - DNA, 20 bp, Artificial Sequence
  chemically synthesized
atatacatccagatggcctg

SEQ ID NO: 60490 - DNA, 20 bp, Artificial Sequence
  chemically synthesized
tgtgatttttcagttacttc

SEQ ID NO: 60491 - DNA, 20 bp, Artificial Sequence
  chemically synthesized
ttgtgatttttcagttactt

SEQ ID NO: 60492 - DNA, 20 bp, Artificial Sequence
  chemically synthesized
tcacttcttttgtgattttt

SEQ ID NO: 60493 - DNA, 20 bp, Artificial Sequence
  chemically synthesized
aagtaactgaaaaatcacaa

SEQ ID NO: 60494 - DNA, 20 bp, Artificial Sequence
  chemically synthesized
taactgaaaaatcacaaaag

SEQ ID NO: 60495 - DNA, 20 bp, Artificial Sequence
  chemically synthesized
caaaagaagtgaaatttaaa

SEQ ID NO: 60496 - DNA, 20 bp, Artificial Sequence
  chemically synthesized
tcatcagttaaggcaggaac

SEQ ID NO: 60497 - DNA, 20 bp, Artificial Sequence
  chemically synthesized
gtcatcagttaaggcaggaa

SEQ ID NO: 60498 - DNA, 20 bp, Artificial Sequence
  chemically synthesized
ggaatgtcatcagttaaggc

SEQ ID NO: 60499 - DNA, 20 bp, Artificial Sequence
  chemically synthesized
tggaatgtcatcagttaagg

SEQ ID NO: 60500 - DNA, 20 bp, Artificial Sequence
  chemically synthesized
tggtggaatgtcatcagtta

SEQ ID NO: 60501 - DNA, 20 bp, Artificial Sequence
  chemically synthesized
gtggtggaatgtcatcagtt

SEQ ID NO: 60502 - DNA, 20 bp, Artificial Sequence
  chemically synthesized
cttttgtggtggaatgtcat

SEQ ID NO: 60503 - DNA, 20 bp, Artificial Sequence
  chemically synthesized
ctgatgacattccaccacaa

SEQ ID NO: 60504 - DNA, 20 bp, Artificial Sequence
  chemically synthesized
cattttcacttcttttgtgg

SEQ ID NO: 60505 - DNA, 20 bp, Artificial Sequence
  chemically synthesized
atgacattccaccacaaaag

SEQ ID NO: 60506 - DNA, 20 bp, Artificial Sequence
  chemically synthesized
ggccattttcacttcttttg

SEQ ID NO: 60507 - DNA, 20 bp, Artificial Sequence
  chemically synthesized
caccacaaaagaagtgaaaa

SEQ ID NO: 60508 - DNA, 20 bp, Artificial Sequence
  chemically synthesized
acaaaagaagtgaaaatggc

SEQ ID NO: 60509 - DNA, 20 bp, Artificial Sequence
  chemically synthesized
tcatcagttaaggcaaggac

SEQ ID NO: 60510 - DNA, 20 bp, Artificial Sequence
  chemically synthesized
taatgtcatcagttaaggca

SEQ ID NO: 60511 - DNA, 20 bp, Artificial Sequence
  chemically synthesized
gtaatgtcatcagttaaggc

SEQ ID NO: 60512 - DNA, 20 bp, Artificial Sequence
  chemically synthesized
caaggtaatgtcatcagtta

SEQ ID NO: 60513 - DNA, 20 bp, Artificial Sequence
  chemically synthesized
acaaggtaatgtcatcagtt

SEQ ID NO: 60514 - DNA, 20 bp, Artificial Sequence
  chemically synthesized
atttcacaaggtaatgtcat

SEQ ID NO: 60515 - DNA, 20 bp, Artificial Sequence
  chemically synthesized
ccaggagaaggaatttcaca

SEQ ID NO: 60516 - DNA, 20 bp, Artificial Sequence
  chemically synthesized
gccaggagaaggaatttcac

SEQ ID NO: 60517 - DNA, 20 bp, Artificial Sequence
  chemically synthesized
ccttgtgaaattccttctcc

SEQ ID NO: 60518 - DNA, 20 bp, Artificial Sequence
  chemically synthesized
agccaggaagagccaggaga

SEQ ID NO: 60519 - DNA, 20 bp, Artificial Sequence
  chemically synthesized
gagccaggaagagccaggag

SEQ ID NO: 60520 - DNA, 20 bp, Artificial Sequence
  chemically synthesized
tttgagccaggaagagccag

SEQ ID NO: 60521 - DNA, 20 bp, Artificial Sequence
  chemically synthesized
cttttgagccaggaagagcc

SEQ ID NO: 60522 - DNA, 20 bp, Artificial Sequence
  chemically synthesized
gcttttgagccaggaagagc

SEQ ID NO: 60523 - DNA, 20 bp, Artificial Sequence
  chemically synthesized
ttccttctcctggctcttcc

SEQ ID NO: 60524 - DNA, 20 bp, Artificial Sequence
  chemically synthesized
gggagcttttgagccaggaa

SEQ ID NO: 60525 - DNA, 20 bp, Artificial Sequence
  chemically synthesized
gggggagcttttgagccagg

SEQ ID NO: 60526 - DNA, 20 bp, Artificial Sequence
  chemically synthesized
cctggctcttcctggctcaa

SEQ ID NO: 60527 - DNA, 20 bp, Artificial Sequence
  chemically synthesized
agtgggggagcttttgagcc

SEQ ID NO: 60528 - DNA, 20 bp, Artificial Sequence
  chemically synthesized
cagtgggggagcttttgagc

SEQ ID NO: 60529 - DNA, 20 bp, Artificial Sequence
  chemically synthesized
tgctcagtgggggagctttt

SEQ ID NO: 60530 - DNA, 20 bp, Artificial Sequence
  chemically synthesized
ggctcaaaagctcccccact

SEQ ID NO: 60531 - DNA, 20 bp, Artificial Sequence
  chemically synthesized
tcacaaggtgctcagtgggg

SEQ ID NO: 60532 - DNA, 20 bp, Artificial Sequence
  chemically synthesized
gatcacaaggtgctcagtgg

SEQ ID NO: 60533 - DNA, 20 bp, Artificial Sequence
  chemically synthesized
ggatcacaaggtgctcagtg

SEQ ID NO: 60534 - DNA, 20 bp, Artificial Sequence
  chemically synthesized
gggatcacaaggtgctcagt

SEQ ID NO: 60535 - DNA, 20 bp, Artificial Sequence
  chemically synthesized
ggggatcacaaggtgctcag

SEQ ID NO: 60536 - DNA, 20 bp, Artificial Sequence
  chemically synthesized
agtggggatcacaaggtgct

SEQ ID NO: 60537 - DNA, 20 bp, Artificial Sequence
  chemically synthesized
gggcaggagtggggatcaca

SEQ ID NO: 60538 - DNA, 20 bp, Artificial Sequence
  chemically synthesized
tgggcaggagtggggatcac

SEQ ID NO: 60539 - DNA, 20 bp, Artificial Sequence
  chemically synthesized
tcctctggtgggcaggagtg

SEQ ID NO: 60540 - DNA, 20 bp, Artificial Sequence
  chemically synthesized
gtcctctggtgggcaggagt

SEQ ID NO: 60541 - DNA, 20 bp, Artificial Sequence
  chemically synthesized
tgtcctctggtgggcaggag

SEQ ID NO: 60542 - DNA, 20 bp, Artificial Sequence
  chemically synthesized
ggttgtcctctggtgggcag

SEQ ID NO: 60543 - DNA, 20 bp, Artificial Sequence
  chemically synthesized
tgatccccactcctgcccac

SEQ ID NO: 60544 - DNA, 20 bp, Artificial Sequence
  chemically synthesized
ggggttgtcctctggtgggc

SEQ ID NO: 60545 - DNA, 20 bp, Artificial Sequence
  chemically synthesized
atccccactcctgcccacca

SEQ ID NO: 60546 - DNA, 20 bp, Artificial Sequence
  chemically synthesized
gggggttgtcctctggtggg

SEQ ID NO: 60547 - DNA, 20 bp, Artificial Sequence
  chemically synthesized
tccccactcctgcccaccag

SEQ ID NO: 60548 - DNA, 20 bp, Artificial Sequence
  chemically synthesized
aaggggggttgtcctctggt

SEQ ID NO: 60549 - DNA, 20 bp, Artificial Sequence
  chemically synthesized
aaaggggggttgtcctctgg

SEQ ID NO: 60550 - DNA, 20 bp, Artificial Sequence
  chemically synthesized
gtcaaaggggggttgtcctc

SEQ ID NO: 60551 - DNA, 20 bp, Artificial Sequence
  chemically synthesized
ggaaaattacagtcaaaggg

SEQ ID NO: 60552 - DNA, 20 bp, Artificial Sequence
  chemically synthesized
aggaaaattacagtcaaagg

SEQ ID NO: 60553 - DNA, 20 bp, Artificial Sequence
  chemically synthesized
aaggaaaattacagtcaaag

SEQ ID NO: 60554 - DNA, 20 bp, Artificial Sequence
  chemically synthesized
taaggaaaattacagtcaaa

SEQ ID NO: 60555 - DNA, 20 bp, Artificial Sequence
  chemically synthesized
ttaaggaaaattacagtcaa

SEQ ID NO: 60556 - DNA, 20 bp, Artificial Sequence
  chemically synthesized
gttaaggaaaattacagtca

SEQ ID NO: 60557 - DNA, 20 bp, Artificial Sequence
  chemically synthesized
gggtaggttaaggaaaatta

SEQ ID NO: 60558 - DNA, 20 bp, Artificial Sequence
  chemically synthesized
tataagatttgggtaggtta

SEQ ID NO: 60559 - DNA, 20 bp, Artificial Sequence
  chemically synthesized
ctataagatttgggtaggtt

SEQ ID NO: 60560 - DNA, 20 bp, Artificial Sequence
  chemically synthesized
ccgttctataagatttgggt

SEQ ID NO: 60561 - DNA, 20 bp, Artificial Sequence
  chemically synthesized
gccgttctataagatttggg

SEQ ID NO: 60562 - DNA, 20 bp, Artificial Sequence
  chemically synthesized
agggccgttctataagattt

SEQ ID NO: 60563 - DNA, 20 bp, Artificial Sequence
  chemically synthesized
cttaacctacccaaatctta

SEQ ID NO: 60564 - DNA, 20 bp, Artificial Sequence
  chemically synthesized
tagggccgttctataagatt

SEQ ID NO: 60565 - DNA, 20 bp, Artificial Sequence
  chemically synthesized
cctacccaaatcttatagaa

SEQ ID NO: 60566 - DNA, 20 bp, Artificial Sequence
  chemically synthesized
taggggtagggccgttctat

SEQ ID NO: 60567 - DNA, 20 bp, Artificial Sequence
  chemically synthesized
agcgaagggagataggggta

SEQ ID NO: 60568 - DNA, 20 bp, Artificial Sequence
  chemically synthesized
cagcgaagggagataggggt

SEQ ID NO: 60569 - DNA, 20 bp, Artificial Sequence
  chemically synthesized
tcagcgaagggagatagggg

SEQ ID NO: 60570 - DNA, 20 bp, Artificial Sequence
  chemically synthesized
gagtcagcgaagggagatag

SEQ ID NO: 60571 - DNA, 20 bp, Artificial Sequence
  chemically synthesized
agagtcagcgaagggagata

SEQ ID NO: 60572 - DNA, 20 bp, Artificial Sequence
  chemically synthesized
aagagtcagcgaagggagat

SEQ ID NO: 60573 - DNA, 20 bp, Artificial Sequence
  chemically synthesized
aaagagtcagcgaagggaga

SEQ ID NO: 60574 - DNA, 20 bp, Artificial Sequence
  chemically synthesized
ccgaaaagagtcagcgaagg

SEQ ID NO: 60575 - DNA, 20 bp, Artificial Sequence
  chemically synthesized
gtccgaaaagagtcagcgaa

SEQ ID NO: 60576 - DNA, 20 bp, Artificial Sequence
  chemically synthesized
agtccgaaaagagtcagcga

SEQ ID NO: 60577 - DNA, 20 bp, Artificial Sequence
  chemically synthesized
gagtccgaaaagagtcagcg

SEQ ID NO: 60578 - DNA, 20 bp, Artificial Sequence
  chemically synthesized
gagctgagtccgaaaagagt

SEQ ID NO: 60579 - DNA, 20 bp, Artificial Sequence
  chemically synthesized
ctcccttcgctgactctttt

SEQ ID NO: 60580 - DNA, 20 bp, Artificial Sequence
  chemically synthesized
aggcgagctgagtccgaaaa

SEQ ID NO: 60581 - DNA, 20 bp, Artificial Sequence
  chemically synthesized
gcaggcgagctgagtccgaa

SEQ ID NO: 60582 - DNA, 20 bp, Artificial Sequence
  chemically synthesized
tcgctgactcttttcggact

SEQ ID NO: 60583 - DNA, 20 bp, Artificial Sequence
  chemically synthesized
cacctgggcgcaggcgagct

SEQ ID NO: 60584 - DNA, 20 bp, Artificial Sequence
  chemically synthesized
gtaatcacctgggcgcaggc

SEQ ID NO: 60585 - DNA, 20 bp, Artificial Sequence
  chemically synthesized
ggactcagctcgcctgcgcc

SEQ ID NO: 60586 - DNA, 20 bp, Artificial Sequence
  chemically synthesized
gactcagctcgcctgcgccc

SEQ ID NO: 60587 - DNA, 20 bp, Artificial Sequence
  chemically synthesized
ctttgtaatcacctgggcgc

SEQ ID NO: 60588 - DNA, 20 bp, Artificial Sequence
  chemically synthesized
gctttgtaatcacctgggcg

SEQ ID NO: 60589 - DNA, 20 bp, Artificial Sequence
  chemically synthesized
ataaagctttgtaatcacct

SEQ ID NO: 60590 - DNA, 20 bp, Artificial Sequence
  chemically synthesized
aataaagctttgtaatcacc

SEQ ID NO: 60591 - DNA, 20 bp, Artificial Sequence
  chemically synthesized
cctgcgcccaggtgattaca

SEQ ID NO: 60592 - DNA, 20 bp, Artificial Sequence
  chemically synthesized
cagtctttgtgtgagcaata

SEQ ID NO: 60593 - DNA, 20 bp, Artificial Sequence
  chemically synthesized
aaagctttattgctcacaca

SEQ ID NO: 60594 - DNA, 20 bp, Artificial Sequence
  chemically synthesized
ccaccaaacagtctttgtgt

SEQ ID NO: 60595 - DNA, 20 bp, Artificial Sequence
  chemically synthesized
ttgctcacacaaagactgtt

SEQ ID NO: 60596 - DNA, 20 bp, Artificial Sequence
  chemically synthesized
ctcacacaaagactgtttgg

SEQ ID NO: 60597 - DNA, 20 bp, Artificial Sequence
  chemically synthesized
cgtgtgaagagaccaccaaa

SEQ ID NO: 60598 - DNA, 20 bp, Artificial Sequence
  chemically synthesized
tgtttggtggtctcttcaca

SEQ ID NO: 60599 - DNA, 20 bp, Artificial Sequence
  chemically synthesized
ttcactcgcgtccgtgtgaa

SEQ ID NO: 60600 - DNA, 20 bp, Artificial Sequence
  chemically synthesized
ctttcactcgcgtccgtgtg

SEQ ID NO: 60601 - DNA, 20 bp, Artificial Sequence
  chemically synthesized
tggtctcttcacacggacgc

SEQ ID NO: 60602 - DNA, 20 bp, Artificial Sequence
  chemically synthesized
cttcacacggacgcgagtga

SEQ ID NO: 60603 - DNA, 20 bp, Artificial Sequence
  chemically synthesized
cgagtgaaagttgtaacaat

SEQ ID NO: 60604 - DNA, 20 bp, Artificial Sequence
  chemically synthesized
gagtgaaagttgtaacaatt

SEQ ID NO: 60605 - DNA, 20 bp, Artificial Sequence
  chemically synthesized
gaaagttgtaacaattaggt

SEQ ID NO: 60606 - DNA, 20 bp, Artificial Sequence
  chemically synthesized
gtaacaattaggttggtgaa

SEQ ID NO: 60607 - DNA, 20 bp, Artificial Sequence
  chemically synthesized
taggttggtgaatagatatg

SEQ ID NO: 60608 - DNA, 20 bp, Artificial Sequence
  chemically synthesized
gtgaatagatatgaagtacg

SEQ ID NO: 60609 - DNA, 20 bp, Artificial Sequence
  chemically synthesized
tgaagtacgtagataatgct

SEQ ID NO: 60610 - DNA, 20 bp, Artificial Sequence
  chemically synthesized
cgtagataatgcttggtatg

SEQ ID NO: 60611 - DNA, 20 bp, Artificial Sequence
  chemically synthesized
aatactaactactacatacc

SEQ ID NO: 60612 - DNA, 20 bp, Artificial Sequence
  chemically synthesized
agataatgcttggtatgtag

SEQ ID NO: 60613 - DNA, 20 bp, Artificial Sequence
  chemically synthesized
aatgcttggtatgtagtagt

SEQ ID NO: 60614 - DNA, 20 bp, Artificial Sequence
  chemically synthesized
agtagtagcagcagcaacag

SEQ ID NO: 60615 - DNA, 20 bp, Artificial Sequence
  chemically synthesized
agtagtagtagcagcagcaa

SEQ ID NO: 60616 - DNA, 20 bp, Artificial Sequence
  chemically synthesized
aatagtagtagtagtagcag

SEQ ID NO: 60617 - DNA, 20 bp, Artificial Sequence
  chemically synthesized
agtaatagtagtagtagtag

SEQ ID NO: 60618 - DNA, 20 bp, Artificial Sequence
  chemically synthesized
agtagtaatagtagtagtag

SEQ ID NO: 60619 - DNA, 20 bp, Artificial Sequence
  chemically synthesized
atcagtagtaatagtagtag

SEQ ID NO: 60620 - DNA, 20 bp, Artificial Sequence
  chemically synthesized
cctatcagtagtaatagtag

SEQ ID NO: 60621 - DNA, 20 bp, Artificial Sequence
  chemically synthesized
gtccctatcagtagtaatag

SEQ ID NO: 60622 - DNA, 20 bp, Artificial Sequence
  chemically synthesized
cctgtccctatcagtagtaa

SEQ ID NO: 60623 - DNA, 20 bp, Artificial Sequence
  chemically synthesized
actactactattactactga

SEQ ID NO: 60624 - DNA, 20 bp, Artificial Sequence
  chemically synthesized
ctactactattactactgat

SEQ ID NO: 60625 - DNA, 20 bp, Artificial Sequence
  chemically synthesized
tactactattactactgata

SEQ ID NO: 60626 - DNA, 20 bp, Artificial Sequence
  chemically synthesized
ctgcctcctgtccctatcag

SEQ ID NO: 60627 - DNA, 20 bp, Artificial Sequence
  chemically synthesized
actattactactgataggga

SEQ ID NO: 60628 - DNA, 20 bp, Artificial Sequence
  chemically synthesized
tccctgcctcctgtccctat

SEQ ID NO: 60629 - DNA, 20 bp, Artificial Sequence
  chemically synthesized
ctattactactgatagggac

SEQ ID NO: 60630 - DNA, 20 bp, Artificial Sequence
  chemically synthesized
attactactgatagggacag

SEQ ID NO: 60631 - DNA, 20 bp, Artificial Sequence
  chemically synthesized
ttactactgatagggacagg

SEQ ID NO: 60632 - DNA, 20 bp, Artificial Sequence
  chemically synthesized
ctactgatagggacaggagg

SEQ ID NO: 60633 - DNA, 20 bp, Artificial Sequence
  chemically synthesized
tactgatagggacaggaggc

SEQ ID NO: 60634 - DNA, 20 bp, Artificial Sequence
  chemically synthesized
actgatagggacaggaggca

SEQ ID NO: 60635 - DNA, 20 bp, Artificial Sequence
  chemically synthesized
gacaggaggcagggaaattc

SEQ ID NO: 60636 - DNA, 20 bp, Artificial Sequence
  chemically synthesized
ggaggcagggaaattctgga

SEQ ID NO: 60637 - DNA, 20 bp, Artificial Sequence
  chemically synthesized
ggcagggaaattctggacag

SEQ ID NO: 60638 - DNA, 20 bp, Artificial Sequence
  chemically synthesized
cagggaaattctggacagaa

SEQ ID NO: 60639 - DNA, 20 bp, Artificial Sequence
  chemically synthesized
gagacccgccctcttctgtc

SEQ ID NO: 60640 - DNA, 20 bp, Artificial Sequence
  chemically synthesized
agggaaattctggacagaag

SEQ ID NO: 60641 - DNA, 20 bp, Artificial Sequence
  chemically synthesized
gggaaattctggacagaaga

SEQ ID NO: 60642 - DNA, 20 bp, Artificial Sequence
  chemically synthesized
aaattctggacagaagaggg

SEQ ID NO: 60643 - DNA, 20 bp, Artificial Sequence
  chemically synthesized
aattctggacagaagagggc

SEQ ID NO: 60644 - DNA, 20 bp, Artificial Sequence
  chemically synthesized
gacagaagagggcgggtctc

SEQ ID NO: 60645 - DNA, 20 bp, Artificial Sequence
  chemically synthesized
gaagagggcgggtctctggc

SEQ ID NO: 60646 - DNA, 20 bp, Artificial Sequence
  chemically synthesized
aagagggcgggtctctggca

SEQ ID NO: 60647 - DNA, 20 bp, Artificial Sequence
  chemically synthesized
agagggcgggtctctggcaa

SEQ ID NO: 60648 - DNA, 20 bp, Artificial Sequence
  chemically synthesized
taagggtggggcccttgcca

SEQ ID NO: 60649 - DNA, 20 bp, Artificial Sequence
  chemically synthesized
cttaagggtggggcccttgc

SEQ ID NO: 60650 - DNA, 20 bp, Artificial Sequence
  chemically synthesized
ctggcaagggccccaccctt

SEQ ID NO: 60651 - DNA, 20 bp, Artificial Sequence
  chemically synthesized
ggcttttaggcttaagggtg

SEQ ID NO: 60652 - DNA, 20 bp, Artificial Sequence
  chemically synthesized
aggcttttaggcttaagggt

SEQ ID NO: 60653 - DNA, 20 bp, Artificial Sequence
  chemically synthesized
caggcttttaggcttaaggg

SEQ ID NO: 60654 - DNA, 20 bp, Artificial Sequence
  chemically synthesized
ttccaggcttttaggcttaa

SEQ ID NO: 60655 - DNA, 20 bp, Artificial Sequence
  chemically synthesized
gttccaggcttttaggctta

SEQ ID NO: 60656 - DNA, 20 bp, Artificial Sequence
  chemically synthesized
agttccaggcttttaggctt

SEQ ID NO: 60657 - DNA, 20 bp, Artificial Sequence
  chemically synthesized
ggccccacccttaagcctaa

SEQ ID NO: 60658 - DNA, 20 bp, Artificial Sequence
  chemically synthesized
cacccttaagcctaaaagcc

SEQ ID NO: 60659 - DNA, 20 bp, Artificial Sequence
  chemically synthesized
ggccacagttccaggctttt

SEQ ID NO: 60660 - DNA, 20 bp, Artificial Sequence
  chemically synthesized
gggccacagttccaggcttt

SEQ ID NO: 60661 - DNA, 20 bp, Artificial Sequence
  chemically synthesized
agcctaaaagcctggaactg

SEQ ID NO: 60662 - DNA, 20 bp, Artificial Sequence
  chemically synthesized
tcactttgggccacagttcc

SEQ ID NO: 60663 - DNA, 20 bp, Artificial Sequence
  chemically synthesized
ctcactttgggccacagttc

SEQ ID NO: 60664 - DNA, 20 bp, Artificial Sequence
  chemically synthesized
aagcctggaactgtggccca

SEQ ID NO: 60665 - DNA, 20 bp, Artificial Sequence
  chemically synthesized
taagttctcactttgggcca

SEQ ID NO: 60666 - DNA, 20 bp, Artificial Sequence
  chemically synthesized
ctggaactgtggcccaaagt

SEQ ID NO: 60667 - DNA, 20 bp, Artificial Sequence
  chemically synthesized
gggatgtaagttctcacttt

SEQ ID NO: 60668 - DNA, 20 bp, Artificial Sequence
  chemically synthesized
agggatgtaagttctcactt

SEQ ID NO: 60669 - DNA, 20 bp, Artificial Sequence
  chemically synthesized
gagcaggaaaacagggatgt

SEQ ID NO: 60670 - DNA, 20 bp, Artificial Sequence
  chemically synthesized
aacatttgagcaggaaaaca

SEQ ID NO: 60671 - DNA, 20 bp, Artificial Sequence
  chemically synthesized
caacatttgagcaggaaaac

SEQ ID NO: 60672 - DNA, 20 bp, Artificial Sequence
  chemically synthesized
gcaacatttgagcaggaaaa

SEQ ID NO: 60673 - DNA, 20 bp, Artificial Sequence
  chemically synthesized
ggaaaaggcaacatttgagc

SEQ ID NO: 60674 - DNA, 20 bp, Artificial Sequence
  chemically synthesized
tggaaaaggcaacatttgag

SEQ ID NO: 60675 - DNA, 20 bp, Artificial Sequence
  chemically synthesized
ttttggaaaaggcaacattt

SEQ ID NO: 60676 - DNA, 20 bp, Artificial Sequence
  chemically synthesized
gctatgggtggttttggaaa

SEQ ID NO: 60677 - DNA, 20 bp, Artificial Sequence
  chemically synthesized
ggctatgggtggttttggaa

SEQ ID NO: 60678 - DNA, 20 bp, Artificial Sequence
  chemically synthesized
gggtgggctatgggtggttt

SEQ ID NO: 60679 - DNA, 20 bp, Artificial Sequence
  chemically synthesized
gccttttccaaaaccaccca

SEQ ID NO: 60680 - DNA, 20 bp, Artificial Sequence
  chemically synthesized
agggcagggtgggctatggg

SEQ ID NO: 60681 - DNA, 20 bp, Artificial Sequence
  chemically synthesized
tggagggcagggtgggctat

SEQ ID NO: 60682 - DNA, 20 bp, Artificial Sequence
  chemically synthesized
atggagggcagggtgggcta

SEQ ID NO: 60683 - DNA, 20 bp, Artificial Sequence
  chemically synthesized
cacaggatggagggcagggt

SEQ ID NO: 60684 - DNA, 20 bp, Artificial Sequence
  chemically synthesized
gcacaggatggagggcaggg

SEQ ID NO: 60685 - DNA, 20 bp, Artificial Sequence
  chemically synthesized
caggcacaggatggagggca

SEQ ID NO: 60686 - DNA, 20 bp, Artificial Sequence
  chemically synthesized
acaggcacaggatggagggc

SEQ ID NO: 60687 - DNA, 20 bp, Artificial Sequence
  chemically synthesized
tacaggcacaggatggaggg

SEQ ID NO: 60688 - DNA, 20 bp, Artificial Sequence
  chemically synthesized
ttttacaggcacaggatgga

SEQ ID NO: 60689 - DNA, 20 bp, Artificial Sequence
  chemically synthesized
tttttacaggcacaggatgg

SEQ ID NO: 60690 - DNA, 20 bp, Artificial Sequence
  chemically synthesized
atttttacaggcacaggatg

SEQ ID NO: 60691 - DNA, 20 bp, Artificial Sequence
  chemically synthesized
ggatttttacaggcacagga

SEQ ID NO: 60692 - DNA, 20 bp, Artificial Sequence
  chemically synthesized
cctgggatttttacaggcac

SEQ ID NO: 60693 - DNA, 20 bp, Artificial Sequence
  chemically synthesized
gcctgggatttttacaggca

SEQ ID NO: 60694 - DNA, 20 bp, Artificial Sequence
  chemically synthesized
gctgagcctgggatttttac

SEQ ID NO: 60695 - DNA, 20 bp, Artificial Sequence
  chemically synthesized
ggctgagcctgggattttta

SEQ ID NO: 60696 - DNA, 20 bp, Artificial Sequence
  chemically synthesized
tcctgtgcctgtaaaaatcc

SEQ ID NO: 60697 - DNA, 20 bp, Artificial Sequence
  chemically synthesized
cctgtgcctgtaaaaatccc

SEQ ID NO: 60698 - DNA, 20 bp, Artificial Sequence
  chemically synthesized
gcctgtaaaaatcccaggct

SEQ ID NO: 60699 - DNA, 20 bp, Artificial Sequence
  chemically synthesized
cctctgtgccggctgagcct

SEQ ID NO: 60700 - DNA, 20 bp, Artificial Sequence
  chemically synthesized
tcctctgtgccggctgagcc

SEQ ID NO: 60701 - DNA, 20 bp, Artificial Sequence
  chemically synthesized
gtaaaaatcccaggctcagc

SEQ ID NO: 60702 - DNA, 20 bp, Artificial Sequence
  chemically synthesized
gcttctcctctgtgccggct

SEQ ID NO: 60703 - DNA, 20 bp, Artificial Sequence
  chemically synthesized
aatcccaggctcagccggca

SEQ ID NO: 60704 - DNA, 20 bp, Artificial Sequence
  chemically synthesized
tcccaggctcagccggcaca

SEQ ID NO: 60705 - DNA, 20 bp, Artificial Sequence
  chemically synthesized
cccaggctcagccggcacag

SEQ ID NO: 60706 - DNA, 20 bp, Artificial Sequence
  chemically synthesized
cagctgcttctcctctgtgc

SEQ ID NO: 60707 - DNA, 20 bp, Artificial Sequence
  chemically synthesized
caggctcagccggcacagag

SEQ ID NO: 60708 - DNA, 20 bp, Artificial Sequence
  chemically synthesized
gctcagccggcacagaggag

SEQ ID NO: 60709 - DNA, 20 bp, Artificial Sequence
  chemically synthesized
cagccggcacagaggagaag

SEQ ID NO: 60710 - DNA, 20 bp, Artificial Sequence
  chemically synthesized
cggcacagaggagaagcagc

SEQ ID NO: 60711 - DNA, 20 bp, Artificial Sequence
  chemically synthesized
gaggagaagcagctggatgt

SEQ ID NO: 60712 - DNA, 20 bp, Artificial Sequence
  chemically synthesized
caaccatagtttccaacatc

SEQ ID NO: 60713 - DNA, 20 bp, Artificial Sequence
  chemically synthesized
cagctggatgttggaaacta

SEQ ID NO: 60714 - DNA, 20 bp, Artificial Sequence
  chemically synthesized
ttctctccaatgcacaacca

SEQ ID NO: 60715 - DNA, 20 bp, Artificial Sequence
  chemically synthesized
tggaaactatggttgtgcat

SEQ ID NO: 60716 - DNA, 20 bp, Artificial Sequence
  chemically synthesized
gaaactatggttgtgcattg

SEQ ID NO: 60717 - DNA, 20 bp, Artificial Sequence
  chemically synthesized
aactatggttgtgcattgga

SEQ ID NO: 60718 - DNA, 20 bp, Artificial Sequence
  chemically synthesized
tatggttgtgcattggagag

SEQ ID NO: 60719 - DNA, 20 bp, Artificial Sequence
  chemically synthesized
ggttgtgcattggagagaag

SEQ ID NO: 60720 - DNA, 20 bp, Artificial Sequence
  chemically synthesized
agagaagtggcttgacttcc

SEQ ID NO: 60721 - DNA, 20 bp, Artificial Sequence
  chemically synthesized
caggctgtccctcggaagtc

SEQ ID NO: 60722 - DNA, 20 bp, Artificial Sequence
  chemically synthesized
gagaagtggcttgacttccg

SEQ ID NO: 60723 - DNA, 20 bp, Artificial Sequence
  chemically synthesized
agaagtggcttgacttccga

SEQ ID NO: 60724 - DNA, 20 bp, Artificial Sequence
  chemically synthesized
gctgccaggctgtccctcgg

SEQ ID NO: 60725 - DNA, 20 bp, Artificial Sequence
  chemically synthesized
gtggcttgacttccgaggga

SEQ ID NO: 60726 - DNA, 20 bp, Artificial Sequence
  chemically synthesized
tatgctgccaggctgtccct

SEQ ID NO: 60727 - DNA, 20 bp, Artificial Sequence
  chemically synthesized
ttgacttccgagggacagcc

SEQ ID NO: 60728 - DNA, 20 bp, Artificial Sequence
  chemically synthesized
acttccgagggacagcctgg

SEQ ID NO: 60729 - DNA, 20 bp, Artificial Sequence
  chemically synthesized
cgagggacagcctggcagca

SEQ ID NO: 60730 - DNA, 20 bp, Artificial Sequence
  chemically synthesized
ctctctgaagctatgctgcc

SEQ ID NO: 60731 - DNA, 20 bp, Artificial Sequence
  chemically synthesized
cctctctgaagctatgctgc

SEQ ID NO: 60732 - DNA, 20 bp, Artificial Sequence
  chemically synthesized
acagcctggcagcatagctt

SEQ ID NO: 60733 - DNA, 20 bp, Artificial Sequence
  chemically synthesized
agcctggcagcatagcttca

SEQ ID NO: 60734 - DNA, 20 bp, Artificial Sequence
  chemically synthesized
cctggcagcatagcttcaga

SEQ ID NO: 60735 - DNA, 20 bp, Artificial Sequence
  chemically synthesized
ctggcagcatagcttcagag

SEQ ID NO: 60736 - DNA, 20 bp, Artificial Sequence
  chemically synthesized
ggcagcatagcttcagagag

SEQ ID NO: 60737 - DNA, 20 bp, Artificial Sequence
  chemically synthesized
cgcaatcagactcctctctg

SEQ ID NO: 60738 - DNA, 20 bp, Artificial Sequence
  chemically synthesized
ttcagagaggagtctgattg

SEQ ID NO: 60739 - DNA, 20 bp, Artificial Sequence
  chemically synthesized
cgagtccagctgtccgcaat

SEQ ID NO: 60740 - DNA, 20 bp, Artificial Sequence
  chemically synthesized
gagaggagtctgattgcgga

SEQ ID NO: 60741 - DNA, 20 bp, Artificial Sequence
  chemically synthesized
ggagtctgattgcggacagc

SEQ ID NO: 60742 - DNA, 20 bp, Artificial Sequence
  chemically synthesized
gattgcggacagctggactc

SEQ ID NO: 60743 - DNA, 20 bp, Artificial Sequence
  chemically synthesized
attgcggacagctggactcg

SEQ ID NO: 60744 - DNA, 20 bp, Artificial Sequence
  chemically synthesized
ggtaatcttcacctcgagtc

SEQ ID NO: 60745 - DNA, 20 bp, Artificial Sequence
  chemically synthesized
ggacagctggactcgaggtg

SEQ ID NO: 60746 - DNA, 20 bp, Artificial Sequence
  chemically synthesized
aggaaggtaatcttcacctc

SEQ ID NO: 60747 - DNA, 20 bp, Artificial Sequence
  chemically synthesized
gaaaaggggacagagcagga

SEQ ID NO: 60748 - DNA, 20 bp, Artificial Sequence
  chemically synthesized
tgaaaaggggacagagcagg

SEQ ID NO: 60749 - DNA, 20 bp, Artificial Sequence
  chemically synthesized
agctgaaaaggggacagagc

SEQ ID NO: 60750 - DNA, 20 bp, Artificial Sequence
  chemically synthesized
gagctgaaaaggggacagag

SEQ ID NO: 60751 - DNA, 20 bp, Artificial Sequence
  chemically synthesized
aaggagctgaaaaggggaca

SEQ ID NO: 60752 - DNA, 20 bp, Artificial Sequence
  chemically synthesized
aaaaggagctgaaaagggga

SEQ ID NO: 60753 - DNA, 20 bp, Artificial Sequence
  chemically synthesized
ttcctgctctgtcccctttt

SEQ ID NO: 60754 - DNA, 20 bp, Artificial Sequence
  chemically synthesized
caggaaaaggagctgaaaag

SEQ ID NO: 60755 - DNA, 20 bp, Artificial Sequence
  chemically synthesized
gcaggaaaaggagctgaaaa

SEQ ID NO: 60756 - DNA, 20 bp, Artificial Sequence
  chemically synthesized
agcaggaaaaggagctgaaa

SEQ ID NO: 60757 - DNA, 20 bp, Artificial Sequence
  chemically synthesized
cagcaggaaaaggagctgaa

SEQ ID NO: 60758 - DNA, 20 bp, Artificial Sequence
  chemically synthesized
gtggctctcagcaggaaaag

SEQ ID NO: 60759 - DNA, 20 bp, Artificial Sequence
  chemically synthesized
aagtggctctcagcaggaaa

SEQ ID NO: 60760 - DNA, 20 bp, Artificial Sequence
  chemically synthesized
aaagtggctctcagcaggaa

SEQ ID NO: 60761 - DNA, 20 bp, Artificial Sequence
  chemically synthesized
tttcagctccttttcctgct

SEQ ID NO: 60762 - DNA, 20 bp, Artificial Sequence
  chemically synthesized
tcagctccttttcctgctga

SEQ ID NO: 60763 - DNA, 20 bp, Artificial Sequence
  chemically synthesized
tgatgaaagtggctctcagc

SEQ ID NO: 60764 - DNA, 20 bp, Artificial Sequence
  chemically synthesized
ctgatgaaagtggctctcag

SEQ ID NO: 60765 - DNA, 20 bp, Artificial Sequence
  chemically synthesized
ttgctgatgaaagtggctct

SEQ ID NO: 60766 - DNA, 20 bp, Artificial Sequence
  chemically synthesized
ctgctgagagccactttcat

SEQ ID NO: 60767 - DNA, 20 bp, Artificial Sequence
  chemically synthesized
gattttattgctgatgaaag

SEQ ID NO: 60768 - DNA, 20 bp, Artificial Sequence
  chemically synthesized
ggggattttattgctgatga

SEQ ID NO: 60769 - DNA, 20 bp, Artificial Sequence
  chemically synthesized
attggagatggtaaatgcgg

SEQ ID NO: 60770 - DNA, 20 bp, Artificial Sequence
  chemically synthesized
aattggagatggtaaatgcg

SEQ ID NO: 60771 - DNA, 20 bp, Artificial Sequence
  chemically synthesized
taattggagatggtaaatgc

SEQ ID NO: 60772 - DNA, 20 bp, Artificial Sequence
  chemically synthesized
ctaattggagatggtaaatg

SEQ ID NO: 60773 - DNA, 20 bp, Artificial Sequence
  chemically synthesized
tcacacaaactaattggaga

SEQ ID NO: 60774 - DNA, 20 bp, Artificial Sequence
  chemically synthesized
ccgcatttaccatctccaat

SEQ ID NO: 60775 - DNA, 20 bp, Artificial Sequence
  chemically synthesized
gaggtcacacaaactaattg

SEQ ID NO: 60776 - DNA, 20 bp, Artificial Sequence
  chemically synthesized
atgaggtcacacaaactaat

SEQ ID NO: 60777 - DNA, 20 bp, Artificial Sequence
  chemically synthesized
cccattttccaggaggaatg

SEQ ID NO: 60778 - DNA, 20 bp, Artificial Sequence
  chemically synthesized
gcccattttccaggaggaat

SEQ ID NO: 60779 - DNA, 20 bp, Artificial Sequence
  chemically synthesized
ttgtgtgacctcattcctcc

SEQ ID NO: 60780 - DNA, 20 bp, Artificial Sequence
  chemically synthesized
gatcttgcccattttccagg

SEQ ID NO: 60781 - DNA, 20 bp, Artificial Sequence
  chemically synthesized
agatcttgcccattttccag

SEQ ID NO: 60782 - DNA, 20 bp, Artificial Sequence
  chemically synthesized
acctcattcctcctggaaaa

SEQ ID NO: 60783 - DNA, 20 bp, Artificial Sequence
  chemically synthesized
cctcattcctcctggaaaat

SEQ ID NO: 60784 - DNA, 20 bp, Artificial Sequence
  chemically synthesized
tcagatcttgcccattttcc

SEQ ID NO: 60785 - DNA, 20 bp, Artificial Sequence
  chemically synthesized
ctcagatcttgcccattttc

SEQ ID NO: 60786 - DNA, 20 bp, Artificial Sequence
  chemically synthesized
attcctcctggaaaatgggc

SEQ ID NO: 60787 - DNA, 20 bp, Artificial Sequence
  chemically synthesized
ctggaaaatgggcaagatct

SEQ ID NO: 60788 - DNA, 20 bp, Artificial Sequence
  chemically synthesized
tggaaaatgggcaagatctg

SEQ ID NO: 60789 - DNA, 20 bp, Artificial Sequence
  chemically synthesized
tactcgcacttgtggcacct

SEQ ID NO: 60790 - DNA, 20 bp, Artificial Sequence
  chemically synthesized
ggcaagatctgaggtgccac

SEQ ID NO: 60791 - DNA, 20 bp, Artificial Sequence
  chemically synthesized
atctgaggtgccacaagtgc

SEQ ID NO: 60792 - DNA, 20 bp, Artificial Sequence
  chemically synthesized
gccttctgtactcgcacttg

SEQ ID NO: 60793 - DNA, 20 bp, Artificial Sequence
  chemically synthesized
aggtgccacaagtgcgagta

SEQ ID NO: 60794 - DNA, 20 bp, Artificial Sequence
  chemically synthesized
tgccacaagtgcgagtacag

SEQ ID NO: 60795 - DNA, 20 bp, Artificial Sequence
  chemically synthesized
gccacaagtgcgagtacaga

SEQ ID NO: 60796 - DNA, 20 bp, Artificial Sequence
  chemically synthesized
tcagtggagggtcagtgtga

SEQ ID NO: 60797 - DNA, 20 bp, Artificial Sequence
  chemically synthesized
ttaacagctcagtggagggt

SEQ ID NO: 60798 - DNA, 20 bp, Artificial Sequence
  chemically synthesized
tgtcacactgaccctccact

SEQ ID NO: 60799 - DNA, 20 bp, Artificial Sequence
  chemically synthesized
agtgttaacagctcagtgga

SEQ ID NO: 60800 - DNA, 20 bp, Artificial Sequence
  chemically synthesized
aagtgttaacagctcagtgg

SEQ ID NO: 60801 - DNA, 20 bp, Artificial Sequence
  chemically synthesized
taagtgttaacagctcagtg

SEQ ID NO: 60802 - DNA, 20 bp, Artificial Sequence
  chemically synthesized
cttaagtgttaacagctcag

SEQ ID NO: 60803 - DNA, 20 bp, Artificial Sequence
  chemically synthesized
tggcttaagtgttaacagct

SEQ ID NO: 60804 - DNA, 20 bp, Artificial Sequence
  chemically synthesized
gcagatggcttaagtgttaa

SEQ ID NO: 60805 - DNA, 20 bp, Artificial Sequence
  chemically synthesized
ccactgagctgttaacactt

SEQ ID NO: 60806 - DNA, 20 bp, Artificial Sequence
  chemically synthesized
ttgccatctgcagatggctt

SEQ ID NO: 60807 - DNA, 20 bp, Artificial Sequence
  chemically synthesized
gttaacacttaagccatctg

SEQ ID NO: 60808 - DNA, 20 bp, Artificial Sequence
  chemically synthesized
ttatctttgccatctgcaga

SEQ ID NO: 60809 - DNA, 20 bp, Artificial Sequence
  chemically synthesized
acacttaagccatctgcaga

SEQ ID NO: 60810 - DNA, 20 bp, Artificial Sequence
  chemically synthesized
ccttttatctttgccatctg

SEQ ID NO: 60811 - DNA, 20 bp, Artificial Sequence
  chemically synthesized
taagccatctgcagatggca

SEQ ID NO: 60812 - DNA, 20 bp, Artificial Sequence
  chemically synthesized
tctgcagatggcaaagataa

SEQ ID NO: 60813 - DNA, 20 bp, Artificial Sequence
  chemically synthesized
ctgcagatggcaaagataaa

SEQ ID NO: 60814 - DNA, 20 bp, Artificial Sequence
  chemically synthesized
tgcagatggcaaagataaaa

SEQ ID NO: 60815 - DNA, 20 bp, Artificial Sequence
  chemically synthesized
tccccagaaggagtgttaca

SEQ ID NO: 60816 - DNA, 20 bp, Artificial Sequence
  chemically synthesized
atccccagaaggagtgttac

SEQ ID NO: 60817 - DNA, 20 bp, Artificial Sequence
  chemically synthesized
aatccccagaaggagtgtta

SEQ ID NO: 60818 - DNA, 20 bp, Artificial Sequence
  chemically synthesized
gggccctgtaacactccttc

SEQ ID NO: 60819 - DNA, 20 bp, Artificial Sequence
  chemically synthesized
ggccctgtaacactccttct

SEQ ID NO: 60820 - DNA, 20 bp, Artificial Sequence
  chemically synthesized
gccctgtaacactccttctg

SEQ ID NO: 60821 - DNA, 20 bp, Artificial Sequence
  chemically synthesized
gacccttgaatccccagaag

SEQ ID NO: 60822 - DNA, 20 bp, Artificial Sequence
  chemically synthesized
gcgacccttgaatccccaga

SEQ ID NO: 60823 - DNA, 20 bp, Artificial Sequence
  chemically synthesized
cgcgacccttgaatccccag

SEQ ID NO: 60824 - DNA, 20 bp, Artificial Sequence
  chemically synthesized
aacactccttctggggattc

SEQ ID NO: 60825 - DNA, 20 bp, Artificial Sequence
  chemically synthesized
gcccgcgacccttgaatccc

SEQ ID NO: 60826 - DNA, 20 bp, Artificial Sequence
  chemically synthesized
acactccttctggggattca

SEQ ID NO: 60827 - DNA, 20 bp, Artificial Sequence
  chemically synthesized
cactccttctggggattcaa

SEQ ID NO: 60828 - DNA, 20 bp, Artificial Sequence
  chemically synthesized
ttctggggattcaagggtcg

SEQ ID NO: 60829 - DNA, 20 bp, Artificial Sequence
  chemically synthesized
tctggggattcaagggtcgc

SEQ ID NO: 60830 - DNA, 20 bp, Artificial Sequence
  chemically synthesized
aagggtcgcgggcaccctcc

SEQ ID NO: 60831 - DNA, 20 bp, Artificial Sequence
  chemically synthesized
ccccatggcagtgtctagga

SEQ ID NO: 60832 - DNA, 20 bp, Artificial Sequence
  chemically synthesized
gccccatggcagtgtctagg

SEQ ID NO: 60833 - DNA, 20 bp, Artificial Sequence
  chemically synthesized
ggccccatggcagtgtctag

SEQ ID NO: 60834 - DNA, 20 bp, Artificial Sequence
  chemically synthesized
tgggccccatggcagtgtct

SEQ ID NO: 60835 - DNA, 20 bp, Artificial Sequence
  chemically synthesized
gtgggccccatggcagtgtc

SEQ ID NO: 60836 - DNA, 20 bp, Artificial Sequence
  chemically synthesized
caccctcctagacactgcca

SEQ ID NO: 60837 - DNA, 20 bp, Artificial Sequence
  chemically synthesized
accctcctagacactgccat

SEQ ID NO: 60838 - DNA, 20 bp, Artificial Sequence
  chemically synthesized
ccctcctagacactgccatg

SEQ ID NO: 60839 - DNA, 20 bp, Artificial Sequence
  chemically synthesized
actctgtgtgggccccatgg

SEQ ID NO: 60840 - DNA, 20 bp, Artificial Sequence
  chemically synthesized
aaaactctgtgtgggcccca

SEQ ID NO: 60841 - DNA, 20 bp, Artificial Sequence
  chemically synthesized
acactgccatggggcccaca

SEQ ID NO: 60842 - DNA, 20 bp, Artificial Sequence
  chemically synthesized
actgccatggggcccacaca

SEQ ID NO: 60843 - DNA, 20 bp, Artificial Sequence
  chemically synthesized
gcaggaacaaaactctgtgt

SEQ ID NO: 60844 - DNA, 20 bp, Artificial Sequence
  chemically synthesized
agcaggaacaaaactctgtg

SEQ ID NO: 60845 - DNA, 20 bp, Artificial Sequence
  chemically synthesized
acacagagttttgttcctgc

SEQ ID NO: 60846 - DNA, 20 bp, Artificial Sequence
  chemically synthesized
gagtgcttttgggcgccagc

SEQ ID NO: 60847 - DNA, 20 bp, Artificial Sequence
  chemically synthesized
tgagtgcttttgggcgccag

SEQ ID NO: 60848 - DNA, 20 bp, Artificial Sequence
  chemically synthesized
gggtgagtgcttttgggcgc

SEQ ID NO: 60849 - DNA, 20 bp, Artificial Sequence
  chemically synthesized
ttgttcctgctggcgcccaa

SEQ ID NO: 60850 - DNA, 20 bp, Artificial Sequence
  chemically synthesized
gagccagggtgagtgctttt

SEQ ID NO: 60851 - DNA, 20 bp, Artificial Sequence
  chemically synthesized
ggagccagggtgagtgcttt

SEQ ID NO: 60852 - DNA, 20 bp, Artificial Sequence
  chemically synthesized
gcgcccaaaagcactcaccc

SEQ ID NO: 60853 - DNA, 20 bp, Artificial Sequence
  chemically synthesized
gtgggtacaggagccagggt

SEQ ID NO: 60854 - DNA, 20 bp, Artificial Sequence
  chemically synthesized
gtgagtgggtacaggagcca

SEQ ID NO: 60855 - DNA, 20 bp, Artificial Sequence
  chemically synthesized
ggtgagtgggtacaggagcc

SEQ ID NO: 60856 - DNA, 20 bp, Artificial Sequence
  chemically synthesized
aggtgagtgggtacaggagc

SEQ ID NO: 60857 - DNA, 20 bp, Artificial Sequence
  chemically synthesized
gcacaggtgagtgggtacag

SEQ ID NO: 60858 - DNA, 20 bp, Artificial Sequence
  chemically synthesized
aagcacaggtgagtgggtac

SEQ ID NO: 60859 - DNA, 20 bp, Artificial Sequence
  chemically synthesized
gaagcacaggtgagtgggta

SEQ ID NO: 60860 - DNA, 20 bp, Artificial Sequence
  chemically synthesized
gagaggaagcacaggtgagt

SEQ ID NO: 60861 - DNA, 20 bp, Artificial Sequence
  chemically synthesized
ggagaggaagcacaggtgag

SEQ ID NO: 60862 - DNA, 20 bp, Artificial Sequence
  chemically synthesized
atgggagaggaagcacaggt

SEQ ID NO: 60863 - DNA, 20 bp, Artificial Sequence
  chemically synthesized
cctcatgggagaggaagcac

SEQ ID NO: 60864 - DNA, 20 bp, Artificial Sequence
  chemically synthesized
ccctcatgggagaggaagca

SEQ ID NO: 60865 - DNA, 20 bp, Artificial Sequence
  chemically synthesized
tccacccctcatgggagagg

SEQ ID NO: 60866 - DNA, 20 bp, Artificial Sequence
  chemically synthesized
acctgtgcttcctctcccat

SEQ ID NO: 60867 - DNA, 20 bp, Artificial Sequence
  chemically synthesized
agttccacccctcatgggag

SEQ ID NO: 60868 - DNA, 20 bp, Artificial Sequence
  chemically synthesized
cctgtgcttcctctcccatg

SEQ ID NO: 60869 - DNA, 20 bp, Artificial Sequence
  chemically synthesized
gagttccacccctcatggga

SEQ ID NO: 60870 - DNA, 20 bp, Artificial Sequence
  chemically synthesized
ctgtgcttcctctcccatga

SEQ ID NO: 60871 - DNA, 20 bp, Artificial Sequence
  chemically synthesized
tgtgcttcctctcccatgag

SEQ ID NO: 60872 - DNA, 20 bp, Artificial Sequence
  chemically synthesized
ctgagttccacccctcatgg

SEQ ID NO: 60873 - DNA, 20 bp, Artificial Sequence
  chemically synthesized
cactgagttccacccctcat

SEQ ID NO: 60874 - DNA, 20 bp, Artificial Sequence
  chemically synthesized
gcttcctctcccatgagggg

SEQ ID NO: 60875 - DNA, 20 bp, Artificial Sequence
  chemically synthesized
tcactgagttccacccctca

SEQ ID NO: 60876 - DNA, 20 bp, Artificial Sequence
  chemically synthesized
ctcccatgaggggtggaact

SEQ ID NO: 60877 - DNA, 20 bp, Artificial Sequence
  chemically synthesized
catgaggggtggaactcagt

SEQ ID NO: 60878 - DNA, 20 bp, Artificial Sequence
  chemically synthesized
tccactggctcagtctcact

SEQ ID NO: 60879 - DNA, 20 bp, Artificial Sequence
  chemically synthesized
gggtggaactcagtgagact

SEQ ID NO: 60880 - DNA, 20 bp, Artificial Sequence
  chemically synthesized
ggaactcagtgagactgagc

SEQ ID NO: 60881 - DNA, 20 bp, Artificial Sequence
  chemically synthesized
actcagtgagactgagccag

SEQ ID NO: 60882 - DNA, 20 bp, Artificial Sequence
  chemically synthesized
aggggcagactccactggct

SEQ ID NO: 60883 - DNA, 20 bp, Artificial Sequence
  chemically synthesized
tcagtgagactgagccagtg

SEQ ID NO: 60884 - DNA, 20 bp, Artificial Sequence
  chemically synthesized
ctggcaggggcagactccac

SEQ ID NO: 60885 - DNA, 20 bp, Artificial Sequence
  chemically synthesized
ccagtggagtctgcccctgc

SEQ ID NO: 60886 - DNA, 20 bp, Artificial Sequence
  chemically synthesized
cgcttcggtgctggcagggg

SEQ ID NO: 60887 - DNA, 20 bp, Artificial Sequence
  chemically synthesized
agccgcttcggtgctggcag

SEQ ID NO: 60888 - DNA, 20 bp, Artificial Sequence
  chemically synthesized
tagccgcttcggtgctggca

SEQ ID NO: 60889 - DNA, 20 bp, Artificial Sequence
  chemically synthesized
atagccgcttcggtgctggc

SEQ ID NO: 60890 - DNA, 20 bp, Artificial Sequence
  chemically synthesized
catagccgcttcggtgctgg

SEQ ID NO: 60891 - DNA, 20 bp, Artificial Sequence
  chemically synthesized
gtctgcccctgccagcaccg

SEQ ID NO: 60892 - DNA, 20 bp, Artificial Sequence
  chemically synthesized
ctgcatagccgcttcggtgc

SEQ ID NO: 60893 - DNA, 20 bp, Artificial Sequence
  chemically synthesized
tgcccctgccagcaccgaag

SEQ ID NO: 60894 - DNA, 20 bp, Artificial Sequence
  chemically synthesized
actggactgcatagccgctt

SEQ ID NO: 60895 - DNA, 20 bp, Artificial Sequence
  chemically synthesized
ccagcaccgaagcggctatg

SEQ ID NO: 60896 - DNA, 20 bp, Artificial Sequence
  chemically synthesized
accgaagcggctatgcagtc

SEQ ID NO: 60897 - DNA, 20 bp, Artificial Sequence
  chemically synthesized
cgggcgggaactggactgca

SEQ ID NO: 60898 - DNA, 20 bp, Artificial Sequence
  chemically synthesized
atcccctcgcgggcgggaac

SEQ ID NO: 60899 - DNA, 20 bp, Artificial Sequence
  chemically synthesized
gcagtccagttcccgcccgc

SEQ ID NO: 60900 - DNA, 20 bp, Artificial Sequence
  chemically synthesized
cagtccagttcccgcccgcg

SEQ ID NO: 60901 - DNA, 20 bp, Artificial Sequence
  chemically synthesized
accctgatcccctcgcgggc

SEQ ID NO: 60902 - DNA, 20 bp, Artificial Sequence
  chemically synthesized
agtccagttcccgcccgcga

SEQ ID NO: 60903 - DNA, 20 bp, Artificial Sequence
  chemically synthesized
taccctgatcccctcgcggg

SEQ ID NO: 60904 - DNA, 20 bp, Artificial Sequence
  chemically synthesized
gtccagttcccgcccgcgag

SEQ ID NO: 60905 - DNA, 20 bp, Artificial Sequence
  chemically synthesized
tattaccctgatcccctcgc

SEQ ID NO: 60906 - DNA, 20 bp, Artificial Sequence
  chemically synthesized
atattaccctgatcccctcg

SEQ ID NO: 60907 - DNA, 20 bp, Artificial Sequence
  chemically synthesized
gttcccgcccgcgaggggat

SEQ ID NO: 60908 - DNA, 20 bp, Artificial Sequence
  chemically synthesized
ttcccgcccgcgaggggatc

SEQ ID NO: 60909 - DNA, 20 bp, Artificial Sequence
  chemically synthesized
tcccgcccgcgaggggatca

SEQ ID NO: 60910 - DNA, 20 bp, Artificial Sequence
  chemically synthesized
agtagtagtagtagtgaagc

SEQ ID NO: 60911 - DNA, 20 bp, Artificial Sequence
  chemically synthesized
tagtagtagtagtagtgaag

SEQ ID NO: 60912 - DNA, 20 bp, Artificial Sequence
  chemically synthesized
tagtagtagtagtagtagtg

SEQ ID NO: 60913 - DNA, 20 bp, Artificial Sequence
  chemically synthesized
agtagtagtagtagtagtag

SEQ ID NO: 60914 - DNA, 20 bp, Artificial Sequence
  chemically synthesized
agtagtagtagtagtagtag

SEQ ID NO: 60915 - DNA, 20 bp, Artificial Sequence
  chemically synthesized
agtagtagtagtagtagtag

SEQ ID NO: 60916 - DNA, 20 bp, Artificial Sequence
  chemically synthesized
agtagtagtagtagtagtag

SEQ ID NO: 60917 - DNA, 20 bp, Artificial Sequence
  chemically synthesized
agtagtagtagtagtagtag

SEQ ID NO: 60918 - DNA, 20 bp, Artificial Sequence
  chemically synthesized
agtagtagtagtagtagtag

SEQ ID NO: 60919 - DNA, 20 bp, Artificial Sequence
  chemically synthesized
agtagtagtagtagtagtag

SEQ ID NO: 60920 - DNA, 20 bp, Artificial Sequence
  chemically synthesized
agtagtagtagtagtagtag

SEQ ID NO: 60921 - DNA, 20 bp, Artificial Sequence
  chemically synthesized
agtagtagtagtagtagtag

SEQ ID NO: 60922 - DNA, 20 bp, Artificial Sequence
  chemically synthesized
agtagtagtagtagtagtag

SEQ ID NO: 60923 - DNA, 20 bp, Artificial Sequence
  chemically synthesized
agtagtagtagtagtagtag

SEQ ID NO: 60924 - DNA, 20 bp, Artificial Sequence
  chemically synthesized
taaagtagtagtagtagtag

SEQ ID NO: 60925 - DNA, 20 bp, Artificial Sequence
  chemically synthesized
agctaaagtagtagtagtag

SEQ ID NO: 60926 - DNA, 20 bp, Artificial Sequence
  chemically synthesized
tgaagctaaagtagtagtag

SEQ ID NO: 60927 - DNA, 20 bp, Artificial Sequence
  chemically synthesized
ctatgaagctaaagtagtag

SEQ ID NO: 60928 - DNA, 20 bp, Artificial Sequence
  chemically synthesized
tactactactactactactt

SEQ ID NO: 60929 - DNA, 20 bp, Artificial Sequence
  chemically synthesized
tatctatgaagctaaagtag

SEQ ID NO: 60930 - DNA, 20 bp, Artificial Sequence
  chemically synthesized
tgatatctatgaagctaaag

SEQ ID NO: 60931 - DNA, 20 bp, Artificial Sequence
  chemically synthesized
aattgatatctatgaagcta

SEQ ID NO: 60932 - DNA, 20 bp, Artificial Sequence
  chemically synthesized
ctactactactttagcttca

SEQ ID NO: 60933 - DNA, 20 bp, Artificial Sequence
  chemically synthesized
agcaagaattgatatctatg

SEQ ID NO: 60934 - DNA, 20 bp, Artificial Sequence
  chemically synthesized
agatatcaattcttgctttt

SEQ ID NO: 60935 - DNA, 20 bp, Artificial Sequence
  chemically synthesized
caaaatcacaaccaaaaagc

SEQ ID NO: 60936 - DNA, 20 bp, Artificial Sequence
  chemically synthesized
agtacaaaatcacaaccaaa

SEQ ID NO: 60937 - DNA, 20 bp, Artificial Sequence
  chemically synthesized
tgattttgtactctgatgac

SEQ ID NO: 60938 - DNA, 20 bp, Artificial Sequence
  chemically synthesized
gttctcttctctggtcatca

SEQ ID NO: 60939 - DNA, 20 bp, Artificial Sequence
  chemically synthesized
attttgtactctgatgacca

SEQ ID NO: 60940 - DNA, 20 bp, Artificial Sequence
  chemically synthesized
ctgttctcttctctggtcat

SEQ ID NO: 60941 - DNA, 20 bp, Artificial Sequence
  chemically synthesized
ttgtactctgatgaccagag

SEQ ID NO: 60942 - DNA, 20 bp, Artificial Sequence
  chemically synthesized
gtactctgatgaccagagaa

SEQ ID NO: 60943 - DNA, 20 bp, Artificial Sequence
  chemically synthesized
caggtccctgttctcttctc

SEQ ID NO: 60944 - DNA, 20 bp, Artificial Sequence
  chemically synthesized
ctgatgaccagagaagagaa

SEQ ID NO: 60945 - DNA, 20 bp, Artificial Sequence
  chemically synthesized
tgatgaccagagaagagaac

SEQ ID NO: 60946 - DNA, 20 bp, Artificial Sequence
  chemically synthesized
gatgaccagagaagagaaca

SEQ ID NO: 60947 - DNA, 20 bp, Artificial Sequence
  chemically synthesized
gagaagagaacagggacctg

SEQ ID NO: 60948 - DNA, 20 bp, Artificial Sequence
  chemically synthesized
accatgaatttatattccac

SEQ ID NO: 60949 - DNA, 20 bp, Artificial Sequence
  chemically synthesized
caccatgaatttatattcca

SEQ ID NO: 60950 - DNA, 20 bp, Artificial Sequence
  chemically synthesized
acctgtggaatataaattca

SEQ ID NO: 60951 - DNA, 20 bp, Artificial Sequence
  chemically synthesized
tggaatataaattcatggtg

SEQ ID NO: 60952 - DNA, 20 bp, Artificial Sequence
  chemically synthesized
tctacatttcagggtttttc

SEQ ID NO: 60953 - DNA, 20 bp, Artificial Sequence
  chemically synthesized
tcttgaaaaaccctgaaatg

SEQ ID NO: 60954 - DNA, 20 bp, Artificial Sequence
  chemically synthesized
ggaaatgagtctacatttca

SEQ ID NO: 60955 - DNA, 20 bp, Artificial Sequence
  chemically synthesized
gggaaatgagtctacatttc

SEQ ID NO: 60956 - DNA, 20 bp, Artificial Sequence
  chemically synthesized
ggggaaatgagtctacattt

SEQ ID NO: 60957 - DNA, 20 bp, Artificial Sequence
  chemically synthesized
caaacctgcatgggggaaat

SEQ ID NO: 60958 - DNA, 20 bp, Artificial Sequence
  chemically synthesized
gtagactcatttcccccatg

SEQ ID NO: 60959 - DNA, 20 bp, Artificial Sequence
  chemically synthesized
tagactcatttcccccatgc

SEQ ID NO: 60960 - DNA, 20 bp, Artificial Sequence
  chemically synthesized
aaaacaacaaacctgcatgg

SEQ ID NO: 60961 - DNA, 20 bp, Artificial Sequence
  chemically synthesized
aaaaacaacaaacctgcatg

SEQ ID NO: 60962 - DNA, 20 bp, Artificial Sequence
  chemically synthesized
caaaaacaacaaacctgcat

SEQ ID NO: 60963 - DNA, 20 bp, Artificial Sequence
  chemically synthesized
tcaaaaacaacaaacctgca

SEQ ID NO: 60964 - DNA, 20 bp, Artificial Sequence
  chemically synthesized
catgcaggtttgttgttttt

SEQ ID NO: 60965 - DNA, 20 bp, Artificial Sequence
  chemically synthesized
atgcaggtttgttgtttttg

SEQ ID NO: 60966 - DNA, 20 bp, Artificial Sequence
  chemically synthesized
aggtttgttgtttttgagga

SEQ ID NO: 60967 - DNA, 20 bp, Artificial Sequence
  chemically synthesized
gtttttgaggaaagaaatga

SEQ ID NO: 60968 - DNA, 20 bp, Artificial Sequence
  chemically synthesized
agaaatgacagctgtgaaac

SEQ ID NO: 60969 - DNA, 20 bp, Artificial Sequence
  chemically synthesized
cacaatttagacttgtttca

SEQ ID NO: 60970 - DNA, 20 bp, Artificial Sequence
  chemically synthesized
tcagacattagggcacaatt

SEQ ID NO: 60971 - DNA, 20 bp, Artificial Sequence
  chemically synthesized
tgttggacactcagacatta

SEQ ID NO: 60972 - DNA, 20 bp, Artificial Sequence
  chemically synthesized
taaattgtgccctaatgtct

SEQ ID NO: 60973 - DNA, 20 bp, Artificial Sequence
  chemically synthesized
ctgttggacactcagacatt

SEQ ID NO: 60974 - DNA, 20 bp, Artificial Sequence
  chemically synthesized
actgttggacactcagacat

SEQ ID NO: 60975 - DNA, 20 bp, Artificial Sequence
  chemically synthesized
gcagcatactgttggacact

SEQ ID NO: 60976 - DNA, 20 bp, Artificial Sequence
  chemically synthesized
cctaatgtctgagtgtccaa

SEQ ID NO: 60977 - DNA, 20 bp, Artificial Sequence
  chemically synthesized
cttcaacagcagcatactgt

SEQ ID NO: 60978 - DNA, 20 bp, Artificial Sequence
  chemically synthesized
ccaacagtatgctgctgttg

SEQ ID NO: 60979 - DNA, 20 bp, Artificial Sequence
  chemically synthesized
ctttgctattgcttcaacag

SEQ ID NO: 60980 - DNA, 20 bp, Artificial Sequence
  chemically synthesized
ctgctttgctattgcttcaa

SEQ ID NO: 60981 - DNA, 20 bp, Artificial Sequence
  chemically synthesized
gtatgctgctgttgaagcaa

SEQ ID NO: 60982 - DNA, 20 bp, Artificial Sequence
  chemically synthesized
ctgctgttgaagcaatagca

SEQ ID NO: 60983 - DNA, 20 bp, Artificial Sequence
  chemically synthesized
ctgttgaagcaatagcaaag

SEQ ID NO: 60984 - DNA, 20 bp, Artificial Sequence
  chemically synthesized
gttgaagcaatagcaaagca

SEQ ID NO: 60985 - DNA, 20 bp, Artificial Sequence
  chemically synthesized
atacagggagaggaaacaat

SEQ ID NO: 60986 - DNA, 20 bp, Artificial Sequence
  chemically synthesized
tatacagggagaggaaacaa

SEQ ID NO: 60987 - DNA, 20 bp, Artificial Sequence
  chemically synthesized
ggtttcagttatacagggag

SEQ ID NO: 60988 - DNA, 20 bp, Artificial Sequence
  chemically synthesized
tggtttcagttatacaggga

SEQ ID NO: 60989 - DNA, 20 bp, Artificial Sequence
  chemically synthesized
catggtttcagttatacagg

SEQ ID NO: 60990 - DNA, 20 bp, Artificial Sequence
  chemically synthesized
gccatggtttcagttataca

SEQ ID NO: 60991 - DNA, 20 bp, Artificial Sequence
  chemically synthesized
ggccatggtttcagttatac

SEQ ID NO: 60992 - DNA, 20 bp, Artificial Sequence
  chemically synthesized
cggccatggtttcagttata

SEQ ID NO: 60993 - DNA, 20 bp, Artificial Sequence
  chemically synthesized
tccctgtataactgaaacca

SEQ ID NO: 60994 - DNA, 20 bp, Artificial Sequence
  chemically synthesized
agggcaaccggccatggttt

SEQ ID NO: 60995 - DNA, 20 bp, Artificial Sequence
  chemically synthesized
tgtataactgaaaccatggc

SEQ ID NO: 60996 - DNA, 20 bp, Artificial Sequence
  chemically synthesized
cagaaaagggcaaccggcca

SEQ ID NO: 60997 - DNA, 20 bp, Artificial Sequence
  chemically synthesized
catggacagaaaagggcaac

SEQ ID NO: 60998 - DNA, 20 bp, Artificial Sequence
  chemically synthesized
tccacatcatggacagaaaa

SEQ ID NO: 60999 - DNA, 20 bp, Artificial Sequence
  chemically synthesized
ttccacatcatggacagaaa

SEQ ID NO: 61000 - DNA, 20 bp, Artificial Sequence
  chemically synthesized
tttccacatcatggacagaa

SEQ ID NO: 61001 - DNA, 20 bp, Artificial Sequence
  chemically synthesized
agagctttccacatcatgga

SEQ ID NO: 61002 - DNA, 20 bp, Artificial Sequence
  chemically synthesized
gcccttttctgtccatgatg

SEQ ID NO: 61003 - DNA, 20 bp, Artificial Sequence
  chemically synthesized
gagcagagctttccacatca

SEQ ID NO: 61004 - DNA, 20 bp, Artificial Sequence
  chemically synthesized
ttttctgtccatgatgtgga

SEQ ID NO: 61005 - DNA, 20 bp, Artificial Sequence
  chemically synthesized
tttttgaggtcatgagagca

SEQ ID NO: 61006 - DNA, 20 bp, Artificial Sequence
  chemically synthesized
catttttgaggtcatgagag

SEQ ID NO: 61007 - DNA, 20 bp, Artificial Sequence
  chemically synthesized
gcccatttttgaggtcatga

SEQ ID NO: 61008 - DNA, 20 bp, Artificial Sequence
  chemically synthesized
atgcccatttttgaggtcat

SEQ ID NO: 61009 - DNA, 20 bp, Artificial Sequence
  chemically synthesized
tgctctcatgacctcaaaaa

SEQ ID NO: 61010 - DNA, 20 bp, Artificial Sequence
  chemically synthesized
gctctcatgacctcaaaaat

SEQ ID NO: 61011 - DNA, 20 bp, Artificial Sequence
  chemically synthesized
gtgaaacatgcccatttttg

SEQ ID NO: 61012 - DNA, 20 bp, Artificial Sequence
  chemically synthesized
ggtgaaacatgcccattttt

SEQ ID NO: 61013 - DNA, 20 bp, Artificial Sequence
  chemically synthesized
ggcatgtttcaccattcact

SEQ ID NO: 61014 - DNA, 20 bp, Artificial Sequence
  chemically synthesized
taggatcttctctgagtgaa

SEQ ID NO: 61015 - DNA, 20 bp, Artificial Sequence
  chemically synthesized
catgtttcaccattcactca

SEQ ID NO: 61016 - DNA, 20 bp, Artificial Sequence
  chemically synthesized
gtttcaccattcactcagag

SEQ ID NO: 61017 - DNA, 20 bp, Artificial Sequence
  chemically synthesized
tctgtaataggatcttctct

SEQ ID NO: 61018 - DNA, 20 bp, Artificial Sequence
  chemically synthesized
actcagagaagatcctatta

SEQ ID NO: 61019 - DNA, 20 bp, Artificial Sequence
  chemically synthesized
gggtattgtttttctgtaat

SEQ ID NO: 61020 - DNA, 20 bp, Artificial Sequence
  chemically synthesized
tgggtattgtttttctgtaa

SEQ ID NO: 61021 - DNA, 20 bp, Artificial Sequence
  chemically synthesized
tattacagaaaaacaatacc

SEQ ID NO: 61022 - DNA, 20 bp, Artificial Sequence
  chemically synthesized
ctctgagttaaattgcagct

SEQ ID NO: 61023 - DNA, 20 bp, Artificial Sequence
  chemically synthesized
gctctgagttaaattgcagc

SEQ ID NO: 61024 - DNA, 20 bp, Artificial Sequence
  chemically synthesized
ctcagctctgagttaaattg

SEQ ID NO: 61025 - DNA, 20 bp, Artificial Sequence
  chemically synthesized
tacccagctgcaatttaact

SEQ ID NO: 61026 - DNA, 20 bp, Artificial Sequence
  chemically synthesized
cccagctgcaatttaactca

SEQ ID NO: 61027 - DNA, 20 bp, Artificial Sequence
  chemically synthesized
ctgcaatttaactcagagct

SEQ ID NO: 61028 - DNA, 20 bp, Artificial Sequence
  chemically synthesized
gtagagggtttctcagctct

SEQ ID NO: 61029 - DNA, 20 bp, Artificial Sequence
  chemically synthesized
tcattgggtagagggtttct

SEQ ID NO: 61030 - DNA, 20 bp, Artificial Sequence
  chemically synthesized
gcccataatcattgggtaga

SEQ ID NO: 61031 - DNA, 20 bp, Artificial Sequence
  chemically synthesized
ggcccataatcattgggtag

SEQ ID NO: 61032 - DNA, 20 bp, Artificial Sequence
  chemically synthesized
gggcccataatcattgggta

SEQ ID NO: 61033 - DNA, 20 bp, Artificial Sequence
  chemically synthesized
gtgggcccataatcattggg

SEQ ID NO: 61034 - DNA, 20 bp, Artificial Sequence
  chemically synthesized
aaagtgggcccataatcatt

SEQ ID NO: 61035 - DNA, 20 bp, Artificial Sequence
  chemically synthesized
aaccctctacccaatgatta

SEQ ID NO: 61036 - DNA, 20 bp, Artificial Sequence
  chemically synthesized
aaaagtgggcccataatcat

SEQ ID NO: 61037 - DNA, 20 bp, Artificial Sequence
  chemically synthesized
accctctacccaatgattat

SEQ ID NO: 61038 - DNA, 20 bp, Artificial Sequence
  chemically synthesized
cacaggtagatcacaaaagt

SEQ ID NO: 61039 - DNA, 20 bp, Artificial Sequence
  chemically synthesized
tcacaggtagatcacaaaag

SEQ ID NO: 61040 - DNA, 20 bp, Artificial Sequence
  chemically synthesized
gcctcacaggtagatcacaa

SEQ ID NO: 61041 - DNA, 20 bp, Artificial Sequence
  chemically synthesized
cacttttgtgatctacctgt

SEQ ID NO: 61042 - DNA, 20 bp, Artificial Sequence
  chemically synthesized
acttttgtgatctacctgtg

SEQ ID NO: 61043 - DNA, 20 bp, Artificial Sequence
  chemically synthesized
tgttctttttgcctcacagg

SEQ ID NO: 61044 - DNA, 20 bp, Artificial Sequence
  chemically synthesized
gaatgttctttttgcctcac

SEQ ID NO: 61045 - DNA, 20 bp, Artificial Sequence
  chemically synthesized
agaatgttctttttgcctca

SEQ ID NO: 61046 - DNA, 20 bp, Artificial Sequence
  chemically synthesized
tgatctacctgtgaggcaaa

SEQ ID NO: 61047 - DNA, 20 bp, Artificial Sequence
  chemically synthesized
catcctacgcacatcgttga

SEQ ID NO: 61048 - DNA, 20 bp, Artificial Sequence
  chemically synthesized
cattctttcaacgatgtgcg

SEQ ID NO: 61049 - DNA, 20 bp, Artificial Sequence
  chemically synthesized
attctttcaacgatgtgcgt

SEQ ID NO: 61050 - DNA, 20 bp, Artificial Sequence
  chemically synthesized
tgtgcgtaggatgtctgtat

SEQ ID NO: 61051 - DNA, 20 bp, Artificial Sequence
  chemically synthesized
gtgcgtaggatgtctgtatt

SEQ ID NO: 61052 - DNA, 20 bp, Artificial Sequence
  chemically synthesized
atttatcagttttcctaata

SEQ ID NO: 61053 - DNA, 20 bp, Artificial Sequence
  chemically synthesized
gtattaggaaaactgataaa

SEQ ID NO: 61054 - DNA, 20 bp, Artificial Sequence
  chemically synthesized
tcctccacgtttccatttat

SEQ ID NO: 61055 - DNA, 20 bp, Artificial Sequence
  chemically synthesized
aaaactgataaatggaaacg

SEQ ID NO: 61056 - DNA, 20 bp, Artificial Sequence
  chemically synthesized
aactgataaatggaaacgtg

SEQ ID NO: 61057 - DNA, 20 bp, Artificial Sequence
  chemically synthesized
actgataaatggaaacgtgg

SEQ ID NO: 61058 - DNA, 20 bp, Artificial Sequence
  chemically synthesized
gacttgatgagaattatttg

SEQ ID NO: 61059 - DNA, 20 bp, Artificial Sequence
  chemically synthesized
gacttcaaataattctcatc

SEQ ID NO: 61060 - DNA, 20 bp, Artificial Sequence
  chemically synthesized
attttaagaacagacttgat

SEQ ID NO: 61061 - DNA, 20 bp, Artificial Sequence
  chemically synthesized
gaagtttgccattttaagaa

SEQ ID NO: 61062 - DNA, 20 bp, Artificial Sequence
  chemically synthesized
catcaagtctgttcttaaaa

SEQ ID NO: 61063 - DNA, 20 bp, Artificial Sequence
  chemically synthesized
ctttggaagtttgccatttt

SEQ ID NO: 61064 - DNA, 20 bp, Artificial Sequence
  chemically synthesized
cttaaaatggcaaacttcca

SEQ ID NO: 61065 - DNA, 20 bp, Artificial Sequence
  chemically synthesized
gtattctcaagggactttgg

SEQ ID NO: 61066 - DNA, 20 bp, Artificial Sequence
  chemically synthesized
tgtgtattctcaagggactt

SEQ ID NO: 61067 - DNA, 20 bp, Artificial Sequence
  chemically synthesized
gcaaacttccaaagtccctt

SEQ ID NO: 61068 - DNA, 20 bp, Artificial Sequence
  chemically synthesized
tgagacctgtgtattctcaa

SEQ ID NO: 61069 - DNA, 20 bp, Artificial Sequence
  chemically synthesized
ttgagacctgtgtattctca

SEQ ID NO: 61070 - DNA, 20 bp, Artificial Sequence
  chemically synthesized
attgagacctgtgtattctc

SEQ ID NO: 61071 - DNA, 20 bp, Artificial Sequence
  chemically synthesized
caaagtcccttgagaataca

SEQ ID NO: 61072 - DNA, 20 bp, Artificial Sequence
  chemically synthesized
aaagtcccttgagaatacac

SEQ ID NO: 61073 - DNA, 20 bp, Artificial Sequence
  chemically synthesized
gagaatacacaggtctcaat

SEQ ID NO: 61074 - DNA, 20 bp, Artificial Sequence
  chemically synthesized
aatacacaggtctcaatgag

SEQ ID NO: 61075 - DNA, 20 bp, Artificial Sequence
  chemically synthesized
agccgctttttcttctcatt

SEQ ID NO: 61076 - DNA, 20 bp, Artificial Sequence
  chemically synthesized
caggtctcaatgagaagaaa

SEQ ID NO: 61077 - DNA, 20 bp, Artificial Sequence
  chemically synthesized
gtctcaatgagaagaaaaag

SEQ ID NO: 61078 - DNA, 20 bp, Artificial Sequence
  chemically synthesized
tggaaagcctaatgttttat

SEQ ID NO: 61079 - DNA, 20 bp, Artificial Sequence
  chemically synthesized
aaaagcggctgataaaacat

SEQ ID NO: 61080 - DNA, 20 bp, Artificial Sequence
  chemically synthesized
aaagcggctgataaaacatt

SEQ ID NO: 61081 - DNA, 20 bp, Artificial Sequence
  chemically synthesized
agaaatgggcaatttttgga

SEQ ID NO: 61082 - DNA, 20 bp, Artificial Sequence
  chemically synthesized
gaggagaaatgggcaatttt

SEQ ID NO: 61083 - DNA, 20 bp, Artificial Sequence
  chemically synthesized
taggaattttgaggagaaat

SEQ ID NO: 61084 - DNA, 20 bp, Artificial Sequence
  chemically synthesized
gtaggaattttgaggagaaa

SEQ ID NO: 61085 - DNA, 20 bp, Artificial Sequence
  chemically synthesized
cttcatgtaggaattttgag

SEQ ID NO: 61086 - DNA, 20 bp, Artificial Sequence
  chemically synthesized
accttcatgtaggaattttg

SEQ ID NO: 61087 - DNA, 20 bp, Artificial Sequence
  chemically synthesized
aaccttcatgtaggaatttt

SEQ ID NO: 61088 - DNA, 20 bp, Artificial Sequence
  chemically synthesized
ctcctcaaaattcctacatg

SEQ ID NO: 61089 - DNA, 20 bp, Artificial Sequence
  chemically synthesized
tcctcaaaattcctacatga

SEQ ID NO: 61090 - DNA, 20 bp, Artificial Sequence
  chemically synthesized
aaccttgtgaaccttcatgt

SEQ ID NO: 61091 - DNA, 20 bp, Artificial Sequence
  chemically synthesized
aaaccttgtgaaccttcatg

SEQ ID NO: 61092 - DNA, 20 bp, Artificial Sequence
  chemically synthesized
attcctacatgaaggttcac

SEQ ID NO: 61093 - DNA, 20 bp, Artificial Sequence
  chemically synthesized
ttcctacatgaaggttcaca

SEQ ID NO: 61094 - DNA, 20 bp, Artificial Sequence
  chemically synthesized
ggttcacaaggtttaacgta

SEQ ID NO: 61095 - DNA, 20 bp, Artificial Sequence
  chemically synthesized
gttcacaaggtttaacgtac

SEQ ID NO: 61096 - DNA, 20 bp, Artificial Sequence
  chemically synthesized
aggtttaacgtacaggttgt

SEQ ID NO: 61097 - DNA, 20 bp, Artificial Sequence
  chemically synthesized
tttaacgtacaggttgttgg

SEQ ID NO: 61098 - DNA, 20 bp, Artificial Sequence
  chemically synthesized
aagcacaaacaaatctacct

SEQ ID NO: 61099 - DNA, 20 bp, Artificial Sequence
  chemically synthesized
agcacaaacaaatctacctc

SEQ ID NO: 61100 - DNA, 20 bp, Artificial Sequence
  chemically synthesized
cacaaacaaatctacctcag

SEQ ID NO: 61101 - DNA, 20 bp, Artificial Sequence
  chemically synthesized
gtgaattaactctcctgagg

SEQ ID NO: 61102 - DNA, 20 bp, Artificial Sequence
  chemically synthesized
caaacaaatctacctcagga

SEQ ID NO: 61103 - DNA, 20 bp, Artificial Sequence
  chemically synthesized
gaggtgaattaactctcctg

SEQ ID NO: 61104 - DNA, 20 bp, Artificial Sequence
  chemically synthesized
tgaggtgaattaactctcct

SEQ ID NO: 61105 - DNA, 20 bp, Artificial Sequence
  chemically synthesized
tcaggagagttaattcacct

SEQ ID NO: 61106 - DNA, 20 bp, Artificial Sequence
  chemically synthesized
caggagagttaattcacctc

SEQ ID NO: 61107 - DNA, 20 bp, Artificial Sequence
  chemically synthesized
cagaggagaaattggtcctg

SEQ ID NO: 61108 - DNA, 20 bp, Artificial Sequence
  chemically synthesized
gcagaggagaaattggtcct

SEQ ID NO: 61109 - DNA, 20 bp, Artificial Sequence
  chemically synthesized
tgtaccagcagaggagaaat

SEQ ID NO: 61110 - DNA, 20 bp, Artificial Sequence
  chemically synthesized
aggaccaatttctcctctgc

SEQ ID NO: 61111 - DNA, 20 bp, Artificial Sequence
  chemically synthesized
tagtagatgtaccagcagag

SEQ ID NO: 61112 - DNA, 20 bp, Artificial Sequence
  chemically synthesized
aatagtagatgtaccagcag

SEQ ID NO: 61113 - DNA, 20 bp, Artificial Sequence
  chemically synthesized
gaatagtagatgtaccagca

SEQ ID NO: 61114 - DNA, 20 bp, Artificial Sequence
  chemically synthesized
atgaatagtagatgtaccag

SEQ ID NO: 61115 - DNA, 20 bp, Artificial Sequence
  chemically synthesized
taaatgaatagtagatgtac

SEQ ID NO: 61116 - DNA, 20 bp, Artificial Sequence
  chemically synthesized
cagggctgctaaatgaatag

SEQ ID NO: 61117 - DNA, 20 bp, Artificial Sequence
  chemically synthesized
tggtacatctactattcatt

SEQ ID NO: 61118 - DNA, 20 bp, Artificial Sequence
  chemically synthesized
aagcagggctgctaaatgaa

SEQ ID NO: 61119 - DNA, 20 bp, Artificial Sequence
  chemically synthesized
tacatctactattcatttag

SEQ ID NO: 61120 - DNA, 20 bp, Artificial Sequence
  chemically synthesized
attcatttagcagccctgct

SEQ ID NO: 61121 - DNA, 20 bp, Artificial Sequence
  chemically synthesized
ctctgggctttatccaagca

SEQ ID NO: 61122 - DNA, 20 bp, Artificial Sequence
  chemically synthesized
gctctgggctttatccaagc

SEQ ID NO: 61123 - DNA, 20 bp, Artificial Sequence
  chemically synthesized
ggctctgggctttatccaag

SEQ ID NO: 61124 - DNA, 20 bp, Artificial Sequence
  chemically synthesized
ttagcagccctgcttggata

SEQ ID NO: 61125 - DNA, 20 bp, Artificial Sequence
  chemically synthesized
aatggctctgggctttatcc

SEQ ID NO: 61126 - DNA, 20 bp, Artificial Sequence
  chemically synthesized
agccctgcttggataaagcc

SEQ ID NO: 61127 - DNA, 20 bp, Artificial Sequence
  chemically synthesized
ccctgcttggataaagccca

SEQ ID NO: 61128 - DNA, 20 bp, Artificial Sequence
  chemically synthesized
actgccgttgaaatggctct

SEQ ID NO: 61129 - DNA, 20 bp, Artificial Sequence
  chemically synthesized
tactgccgttgaaatggctc

SEQ ID NO: 61130 - DNA, 20 bp, Artificial Sequence
  chemically synthesized
aaagcccagagccatttcaa

SEQ ID NO: 61131 - DNA, 20 bp, Artificial Sequence
  chemically synthesized
ccttcctactgccgttgaaa

SEQ ID NO: 61132 - DNA, 20 bp, Artificial Sequence
  chemically synthesized
gcccagagccatttcaacgg

SEQ ID NO: 61133 - DNA, 20 bp, Artificial Sequence
  chemically synthesized
cagagccatttcaacggcag

SEQ ID NO: 61134 - DNA, 20 bp, Artificial Sequence
  chemically synthesized
agagccatttcaacggcagt

SEQ ID NO: 61135 - DNA, 20 bp, Artificial Sequence
  chemically synthesized
gccatttcaacggcagtagg

SEQ ID NO: 61136 - DNA, 20 bp, Artificial Sequence
  chemically synthesized
ccatttcaacggcagtagga

SEQ ID NO: 61137 - DNA, 20 bp, Artificial Sequence
  chemically synthesized
catttcaacggcagtaggaa

SEQ ID NO: 61138 - DNA, 20 bp, Artificial Sequence
  chemically synthesized
cggcagtaggaagggacgtt

SEQ ID NO: 61139 - DNA, 20 bp, Artificial Sequence
  chemically synthesized
gcagtaggaagggacgttta

SEQ ID NO: 61140 - DNA, 20 bp, Artificial Sequence
  chemically synthesized
agtaggaagggacgtttaga

SEQ ID NO: 61141 - DNA, 20 bp, Artificial Sequence
  chemically synthesized
gacgtttagagagttatcat

SEQ ID NO: 61142 - DNA, 20 bp, Artificial Sequence
  chemically synthesized
gattcagttgttaacagcgc

SEQ ID NO: 61143 - DNA, 20 bp, Artificial Sequence
  chemically synthesized
tgattcagttgttaacagcg

SEQ ID NO: 61144 - DNA, 20 bp, Artificial Sequence
  chemically synthesized
gttattgattcagttgttaa

SEQ ID NO: 61145 - DNA, 20 bp, Artificial Sequence
  chemically synthesized
tagcactgatgttattgatt

SEQ ID NO: 61146 - DNA, 20 bp, Artificial Sequence
  chemically synthesized
aacaactgaatcaataacat

SEQ ID NO: 61147 - DNA, 20 bp, Artificial Sequence
  chemically synthesized
aatcaataacatcagtgcta

SEQ ID NO: 61148 - DNA, 20 bp, Artificial Sequence
  chemically synthesized
tcaataacatcagtgctatg

SEQ ID NO: 61149 - DNA, 20 bp, Artificial Sequence
  chemically synthesized
aataacatcagtgctatgga

SEQ ID NO: 61150 - DNA, 20 bp, Artificial Sequence
  chemically synthesized
ggctctgaaggtgctctcca

SEQ ID NO: 61151 - DNA, 20 bp, Artificial Sequence
  chemically synthesized
agtgctatggagagcacctt

SEQ ID NO: 61152 - DNA, 20 bp, Artificial Sequence
  chemically synthesized
tgctatggagagcaccttca

SEQ ID NO: 61153 - DNA, 20 bp, Artificial Sequence
  chemically synthesized
acatcctaactaggctctga

SEQ ID NO: 61154 - DNA, 20 bp, Artificial Sequence
  chemically synthesized
tggagagcaccttcagagcc

SEQ ID NO: 61155 - DNA, 20 bp, Artificial Sequence
  chemically synthesized
gacatcctaactaggctctg

SEQ ID NO: 61156 - DNA, 20 bp, Artificial Sequence
  chemically synthesized
gagcaccttcagagcctagt

SEQ ID NO: 61157 - DNA, 20 bp, Artificial Sequence
  chemically synthesized
agcaccttcagagcctagtt

SEQ ID NO: 61158 - DNA, 20 bp, Artificial Sequence
  chemically synthesized
caactgcagacatcctaact

SEQ ID NO: 61159 - DNA, 20 bp, Artificial Sequence
  chemically synthesized
acaactgcagacatcctaac

SEQ ID NO: 61160 - DNA, 20 bp, Artificial Sequence
  chemically synthesized
gagcctagttaggatgtctg

SEQ ID NO: 61161 - DNA, 20 bp, Artificial Sequence
  chemically synthesized
gttaggatgtctgcagttgt

SEQ ID NO: 61162 - DNA, 20 bp, Artificial Sequence
  chemically synthesized
cctgtctaatctgacaactg

SEQ ID NO: 61163 - DNA, 20 bp, Artificial Sequence
  chemically synthesized
gatgtctgcagttgtcagat

SEQ ID NO: 61164 - DNA, 20 bp, Artificial Sequence
  chemically synthesized
tctgcagttgtcagattaga

SEQ ID NO: 61165 - DNA, 20 bp, Artificial Sequence
  chemically synthesized
ctgcagttgtcagattagac

SEQ ID NO: 61166 - DNA, 20 bp, Artificial Sequence
  chemically synthesized
agttgtcagattagacaggc

SEQ ID NO: 61167 - DNA, 20 bp, Artificial Sequence
  chemically synthesized
attagacaggcaagatgttt

SEQ ID NO: 61168 - DNA, 20 bp, Artificial Sequence
  chemically synthesized
ttttggaaacatatttgttt

SEQ ID NO: 61169 - DNA, 20 bp, Artificial Sequence
  chemically synthesized
tttggaaacatatttgtttc

SEQ ID NO: 61170 - DNA, 20 bp, Artificial Sequence
  chemically synthesized
atttgtttcaggaaatgttt

SEQ ID NO: 61171 - DNA, 20 bp, Artificial Sequence
  chemically synthesized
tgtttcaggaaatgtttaag

SEQ ID NO: 61172 - DNA, 20 bp, Artificial Sequence
  chemically synthesized
tcaggaaatgtttaagtggt

SEQ ID NO: 61173 - DNA, 20 bp, Artificial Sequence
  chemically synthesized
gtttaagtggtaagcatcca

SEQ ID NO: 61174 - DNA, 20 bp, Artificial Sequence
  chemically synthesized
tttaagtggtaagcatccac

SEQ ID NO: 61175 - DNA, 20 bp, Artificial Sequence
  chemically synthesized
ttaagtggtaagcatccaca

SEQ ID NO: 61176 - DNA, 20 bp, Artificial Sequence
  chemically synthesized
aggatggccacagaaccctg

SEQ ID NO: 61177 - DNA, 20 bp, Artificial Sequence
  chemically synthesized
taagcatccacagggttctg

SEQ ID NO: 61178 - DNA, 20 bp, Artificial Sequence
  chemically synthesized
gtttgtgaacaggatggcca

SEQ ID NO: 61179 - DNA, 20 bp, Artificial Sequence
  chemically synthesized
atccatgtttgtgaacagga

SEQ ID NO: 61180 - DNA, 20 bp, Artificial Sequence
  chemically synthesized
atatatccatgtttgtgaac

SEQ ID NO: 61181 - DNA, 20 bp, Artificial Sequence
  chemically synthesized
aatatatccatgtttgtgaa

SEQ ID NO: 61182 - DNA, 20 bp, Artificial Sequence
  chemically synthesized
ggccatcctgttcacaaaca

SEQ ID NO: 61183 - DNA, 20 bp, Artificial Sequence
  chemically synthesized
cacaaacatggatatattaa

SEQ ID NO: 61184 - DNA, 20 bp, Artificial Sequence
  chemically synthesized
atatattaatagatttaatt

SEQ ID NO: 61185 - DNA, 20 bp, Artificial Sequence
  chemically synthesized
tttaatttggttgactaatg

SEQ ID NO: 61186 - DNA, 20 bp, Artificial Sequence
  chemically synthesized
gcaacaataaatatcttcat

SEQ ID NO: 61187 - DNA, 20 bp, Artificial Sequence
  chemically synthesized
aattataagaatttttttta

SEQ ID NO: 61188 - DNA, 20 bp, Artificial Sequence
  chemically synthesized
tgtgtacctacaaaaattat

SEQ ID NO: 61189 - DNA, 20 bp, Artificial Sequence
  chemically synthesized
aaaaattcttataatttttg

SEQ ID NO: 61190 - DNA, 20 bp, Artificial Sequence
  chemically synthesized
aaaattcttataatttttgt

SEQ ID NO: 61191 - DNA, 20 bp, Artificial Sequence
  chemically synthesized
aatttttgtaggtacacatt

SEQ ID NO: 61192 - DNA, 20 bp, Artificial Sequence
  chemically synthesized
acattaagcgtatatattta

SEQ ID NO: 61193 - DNA, 20 bp, Artificial Sequence
  chemically synthesized
attaagcgtatatatttata

SEQ ID NO: 61194 - DNA, 20 bp, Artificial Sequence
  chemically synthesized
tatatatttatagagcatat

SEQ ID NO: 61195 - DNA, 20 bp, Artificial Sequence
  chemically synthesized
gcatatgagatgttttgata

SEQ ID NO: 61196 - DNA, 20 bp, Artificial Sequence
  chemically synthesized
catatgagatgttttgatac

SEQ ID NO: 61197 - DNA, 20 bp, Artificial Sequence
  chemically synthesized
acaggcatgcaatgtgaaat

SEQ ID NO: 61198 - DNA, 20 bp, Artificial Sequence
  chemically synthesized
acatcatctcttaatataaa

SEQ ID NO: 61199 - DNA, 20 bp, Artificial Sequence
  chemically synthesized
cacattatgctttttatatt

SEQ ID NO: 61200 - DNA, 20 bp, Artificial Sequence
  chemically synthesized
cattatgctttttatattaa

SEQ ID NO: 61201 - DNA, 20 bp, Artificial Sequence
  chemically synthesized
ttatattaagagatgatgtt

SEQ ID NO: 61202 - DNA, 20 bp, Artificial Sequence
  chemically synthesized
atattaagagatgatgttca

SEQ ID NO: 61203 - DNA, 20 bp, Artificial Sequence
  chemically synthesized
atgcaaatcaaaaccacaat

SEQ ID NO: 61204 - DNA, 20 bp, Artificial Sequence
  chemically synthesized
tgcaaatcaaaaccacaatg

SEQ ID NO: 61205 - DNA, 20 bp, Artificial Sequence
  chemically synthesized
tgtgagatggtacctcattg

SEQ ID NO: 61206 - DNA, 20 bp, Artificial Sequence
  chemically synthesized
ccattctaactggtgtgaga

SEQ ID NO: 61207 - DNA, 20 bp, Artificial Sequence
  chemically synthesized
aatgaggtaccatctcacac

SEQ ID NO: 61208 - DNA, 20 bp, Artificial Sequence
  chemically synthesized
atagccattctaactggtgt

SEQ ID NO: 61209 - DNA, 20 bp, Artificial Sequence
  chemically synthesized
aggtaccatctcacaccagt

SEQ ID NO: 61210 - DNA, 20 bp, Artificial Sequence
  chemically synthesized
ccatctcacaccagttagaa

SEQ ID NO: 61211 - DNA, 20 bp, Artificial Sequence
  chemically synthesized
tgaatgatagccattctaac

SEQ ID NO: 61212 - DNA, 20 bp, Artificial Sequence
  chemically synthesized
gtttcctgacttttgaatga

SEQ ID NO: 61213 - DNA, 20 bp, Artificial Sequence
  chemically synthesized
ttagaatggctatcattcaa

SEQ ID NO: 61214 - DNA, 20 bp, Artificial Sequence
  chemically synthesized
aatggctatcattcaaaagt

SEQ ID NO: 61215 - DNA, 20 bp, Artificial Sequence
  chemically synthesized
atggctatcattcaaaagtc

SEQ ID NO: 61216 - DNA, 20 bp, Artificial Sequence
  chemically synthesized
attcaaaagtcaggaaacaa

SEQ ID NO: 61217 - DNA, 20 bp, Artificial Sequence
  chemically synthesized
agtcaggaaacaacagatgc

SEQ ID NO: 61218 - DNA, 20 bp, Artificial Sequence
  chemically synthesized
tcaggaaacaacagatgcca

SEQ ID NO: 61219 - DNA, 20 bp, Artificial Sequence
  chemically synthesized
aggaaacaacagatgccaga

SEQ ID NO: 61220 - DNA, 20 bp, Artificial Sequence
  chemically synthesized
ggaaacaacagatgccagag

SEQ ID NO: 61221 - DNA, 20 bp, Artificial Sequence
  chemically synthesized
ctatttctccacatcctctc

SEQ ID NO: 61222 - DNA, 20 bp, Artificial Sequence
  chemically synthesized
aacagatgccagagaggatg

SEQ ID NO: 61223 - DNA, 20 bp, Artificial Sequence
  chemically synthesized
cagatgccagagaggatgtg

SEQ ID NO: 61224 - DNA, 20 bp, Artificial Sequence
  chemically synthesized
ccagagaggatgtggagaaa

SEQ ID NO: 61225 - DNA, 20 bp, Artificial Sequence
  chemically synthesized
cagtcccaccaacagtgtaa

SEQ ID NO: 61226 - DNA, 20 bp, Artificial Sequence
  chemically synthesized
aaatagcacttttacactgt

SEQ ID NO: 61227 - DNA, 20 bp, Artificial Sequence
  chemically synthesized
tagcacttttacactgttgg

SEQ ID NO: 61228 - DNA, 20 bp, Artificial Sequence
  chemically synthesized
agcacttttacactgttggt

SEQ ID NO: 61229 - DNA, 20 bp, Artificial Sequence
  chemically synthesized
ctagtttacagtcccaccaa

SEQ ID NO: 61230 - DNA, 20 bp, Artificial Sequence
  chemically synthesized
ctgttggtgggactgtaaac

SEQ ID NO: 61231 - DNA, 20 bp, Artificial Sequence
  chemically synthesized
acaatggttgaactagttta

SEQ ID NO: 61232 - DNA, 20 bp, Artificial Sequence
  chemically synthesized
gtcttccacaatggttgaac

SEQ ID NO: 61233 - DNA, 20 bp, Artificial Sequence
  chemically synthesized
gtaaactagttcaaccattg

SEQ ID NO: 61234 - DNA, 20 bp, Artificial Sequence
  chemically synthesized
aactagttcaaccattgtgg

SEQ ID NO: 61235 - DNA, 20 bp, Artificial Sequence
  chemically synthesized
tgccacactgtcttccacaa

SEQ ID NO: 61236 - DNA, 20 bp, Artificial Sequence
  chemically synthesized
agttcaaccattgtggaaga

SEQ ID NO: 61237 - DNA, 20 bp, Artificial Sequence
  chemically synthesized
aaccattgtggaagacagtg

SEQ ID NO: 61238 - DNA, 20 bp, Artificial Sequence
  chemically synthesized
agacagtgtggcaattcctc

SEQ ID NO: 61239 - DNA, 20 bp, Artificial Sequence
  chemically synthesized
gacagtgtggcaattcctca

SEQ ID NO: 61240 - DNA, 20 bp, Artificial Sequence
  chemically synthesized
tttctagttctagatccttg

SEQ ID NO: 61241 - DNA, 20 bp, Artificial Sequence
  chemically synthesized
gtggcaattcctcaaggatc

SEQ ID NO: 61242 - DNA, 20 bp, Artificial Sequence
  chemically synthesized
atttctagttctagatcctt

SEQ ID NO: 61243 - DNA, 20 bp, Artificial Sequence
  chemically synthesized
attcctcaaggatctagaac

SEQ ID NO: 61244 - DNA, 20 bp, Artificial Sequence
  chemically synthesized
tcaaatggtatttctagttc

SEQ ID NO: 61245 - DNA, 20 bp, Artificial Sequence
  chemically synthesized
gctgggtcaaatggtatttc

SEQ ID NO: 61246 - DNA, 20 bp, Artificial Sequence
  chemically synthesized
actagaaataccatttgacc

SEQ ID NO: 61247 - DNA, 20 bp, Artificial Sequence
  chemically synthesized
aatgggatggctgggtcaaa

SEQ ID NO: 61248 - DNA, 20 bp, Artificial Sequence
  chemically synthesized
tacccagtaatgggatggct

SEQ ID NO: 61249 - DNA, 20 bp, Artificial Sequence
  chemically synthesized
atacccagtaatgggatggc

SEQ ID NO: 61250 - DNA, 20 bp, Artificial Sequence
  chemically synthesized
gtatatacccagtaatggga

SEQ ID NO: 61251 - DNA, 20 bp, Artificial Sequence
  chemically synthesized
tgacccagccatcccattac

SEQ ID NO: 61252 - DNA, 20 bp, Artificial Sequence
  chemically synthesized
gacccagccatcccattact

SEQ ID NO: 61253 - DNA, 20 bp, Artificial Sequence
  chemically synthesized
ttgggtatatacccagtaat

SEQ ID NO: 61254 - DNA, 20 bp, Artificial Sequence
  chemically synthesized
tttgggtatatacccagtaa

SEQ ID NO: 61255 - DNA, 20 bp, Artificial Sequence
  chemically synthesized
taatcctttgggtatatacc

SEQ ID NO: 61256 - DNA, 20 bp, Artificial Sequence
  chemically synthesized
cattactgggtatataccca

SEQ ID NO: 61257 - DNA, 20 bp, Artificial Sequence
  chemically synthesized
attactgggtatatacccaa

SEQ ID NO: 61258 - DNA, 20 bp, Artificial Sequence
  chemically synthesized
agcatgatttataatccttt

SEQ ID NO: 61259 - DNA, 20 bp, Artificial Sequence
  chemically synthesized
cagcatgatttataatcctt

SEQ ID NO: 61260 - DNA, 20 bp, Artificial Sequence
  chemically synthesized
ttataaatcatgctgctatg

SEQ ID NO: 61261 - DNA, 20 bp, Artificial Sequence
  chemically synthesized
gtgtgcatgtgtcttcatag

SEQ ID NO: 61262 - DNA, 20 bp, Artificial Sequence
  chemically synthesized
tacgtgtgcatgtgtcttca

SEQ ID NO: 61263 - DNA, 20 bp, Artificial Sequence
  chemically synthesized
atgcacacgtatgtttattg

SEQ ID NO: 61264 - DNA, 20 bp, Artificial Sequence
  chemically synthesized
tattgcggcactgttcacaa

SEQ ID NO: 61265 - DNA, 20 bp, Artificial Sequence
  chemically synthesized
caaatctttgctattgtgaa

SEQ ID NO: 61266 - DNA, 20 bp, Artificial Sequence
  chemically synthesized
cggcactgttcacaatagca

SEQ ID NO: 61267 - DNA, 20 bp, Artificial Sequence
  chemically synthesized
tgttcacaatagcaaagatt

SEQ ID NO: 61268 - DNA, 20 bp, Artificial Sequence
  chemically synthesized
tcattgatggacatttgggt

SEQ ID NO: 61269 - DNA, 20 bp, Artificial Sequence
  chemically synthesized
tctatcattgatggacattt

SEQ ID NO: 61270 - DNA, 20 bp, Artificial Sequence
  chemically synthesized
gtctatcattgatggacatt

SEQ ID NO: 61271 - DNA, 20 bp, Artificial Sequence
  chemically synthesized
acccaaatgtccatcaatga

SEQ ID NO: 61272 - DNA, 20 bp, Artificial Sequence
  chemically synthesized
ttaatccagtctatcattga

SEQ ID NO: 61273 - DNA, 20 bp, Artificial Sequence
  chemically synthesized
aatgtccatcaatgatagac

SEQ ID NO: 61274 - DNA, 20 bp, Artificial Sequence
  chemically synthesized
catcaatgatagactggatt

SEQ ID NO: 61275 - DNA, 20 bp, Artificial Sequence
  chemically synthesized
tgtgccacattttcttaatc

SEQ ID NO: 61276 - DNA, 20 bp, Artificial Sequence
  chemically synthesized
tagactggattaagaaaatg

SEQ ID NO: 61277 - DNA, 20 bp, Artificial Sequence
  chemically synthesized
aatgtggcacatatacacca

SEQ ID NO: 61278 - DNA, 20 bp, Artificial Sequence
  chemically synthesized
tatggctgcatagtattcca

SEQ ID NO: 61279 - DNA, 20 bp, Artificial Sequence
  chemically synthesized
atacaccatggaatactatg

SEQ ID NO: 61280 - DNA, 20 bp, Artificial Sequence
  chemically synthesized
catccttttttatggctgca

SEQ ID NO: 61281 - DNA, 20 bp, Artificial Sequence
  chemically synthesized
aatactatgcagccataaaa

SEQ ID NO: 61282 - DNA, 20 bp, Artificial Sequence
  chemically synthesized
atactatgcagccataaaaa

SEQ ID NO: 61283 - DNA, 20 bp, Artificial Sequence
  chemically synthesized
tatgaattcatcctttttta

SEQ ID NO: 61284 - DNA, 20 bp, Artificial Sequence
  chemically synthesized
ggatgaattcatatcctttg

SEQ ID NO: 61285 - DNA, 20 bp, Artificial Sequence
  chemically synthesized
gatgaattcatatcctttgt

SEQ ID NO: 61286 - DNA, 20 bp, Artificial Sequence
  chemically synthesized
atgaattcatatcctttgta

SEQ ID NO: 61287 - DNA, 20 bp, Artificial Sequence
  chemically synthesized
cttcatccatgtccctacaa

SEQ ID NO: 61288 - DNA, 20 bp, Artificial Sequence
  chemically synthesized
gcttcatccatgtccctaca

SEQ ID NO: 61289 - DNA, 20 bp, Artificial Sequence
  chemically synthesized
tcatatcctttgtagggaca

SEQ ID NO: 61290 - DNA, 20 bp, Artificial Sequence
  chemically synthesized
cctttgtagggacatggatg

SEQ ID NO: 61291 - DNA, 20 bp, Artificial Sequence
  chemically synthesized
tgtagggacatggatgaagc

SEQ ID NO: 61292 - DNA, 20 bp, Artificial Sequence
  chemically synthesized
ttgctgagaatgatggtttc

SEQ ID NO: 61293 - DNA, 20 bp, Artificial Sequence
  chemically synthesized
aagctggaaaccatcattct

SEQ ID NO: 61294 - DNA, 20 bp, Artificial Sequence
  chemically synthesized
tgatagtttgctgagaatga

SEQ ID NO: 61295 - DNA, 20 bp, Artificial Sequence
  chemically synthesized
tgtccttgtgatagtttgct

SEQ ID NO: 61296 - DNA, 20 bp, Artificial Sequence
  chemically synthesized
cattctcagcaaactatcac

SEQ ID NO: 61297 - DNA, 20 bp, Artificial Sequence
  chemically synthesized
attctcagcaaactatcaca

SEQ ID NO: 61298 - DNA, 20 bp, Artificial Sequence
  chemically synthesized
ttggttttctgtccttgtga

SEQ ID NO: 61299 - DNA, 20 bp, Artificial Sequence
  chemically synthesized
tcagcaaactatcacaagga

SEQ ID NO: 61300 - DNA, 20 bp, Artificial Sequence
  chemically synthesized
gagtgagaacatgcaatgtt

SEQ ID NO: 61301 - DNA, 20 bp, Artificial Sequence
  chemically synthesized
cattgcatgttctcactcat

SEQ ID NO: 61302 - DNA, 20 bp, Artificial Sequence
  chemically synthesized
ttcaattcccacttatgagt

SEQ ID NO: 61303 - DNA, 20 bp, Artificial Sequence
  chemically synthesized
tgcatgttctcactcataag

SEQ ID NO: 61304 - DNA, 20 bp, Artificial Sequence
  chemically synthesized
gcatgttctcactcataagt

SEQ ID NO: 61305 - DNA, 20 bp, Artificial Sequence
  chemically synthesized
attgttcaattcccacttat

SEQ ID NO: 61306 - DNA, 20 bp, Artificial Sequence
  chemically synthesized
ataagtgggaattgaacaat

SEQ ID NO: 61307 - DNA, 20 bp, Artificial Sequence
  chemically synthesized
aattgaacaatgagaacaca

SEQ ID NO: 61308 - DNA, 20 bp, Artificial Sequence
  chemically synthesized
acaatgagaacacatggaca

SEQ ID NO: 61309 - DNA, 20 bp, Artificial Sequence
  chemically synthesized
caatgagaacacatggacac

SEQ ID NO: 61310 - DNA, 20 bp, Artificial Sequence
  chemically synthesized
tgagaacacatggacacagg

SEQ ID NO: 61311 - DNA, 20 bp, Artificial Sequence
  chemically synthesized
gagaacacatggacacagga

SEQ ID NO: 61312 - DNA, 20 bp, Artificial Sequence
  chemically synthesized
gaacacatggacacaggaag

SEQ ID NO: 61313 - DNA, 20 bp, Artificial Sequence
  chemically synthesized
ggaaggagaacatcacacac

SEQ ID NO: 61314 - DNA, 20 bp, Artificial Sequence
  chemically synthesized
gaaggagaacatcacacacc

SEQ ID NO: 61315 - DNA, 20 bp, Artificial Sequence
  chemically synthesized
aaggagaacatcacacacca

SEQ ID NO: 61316 - DNA, 20 bp, Artificial Sequence
  chemically synthesized
cctcaccccaaaacagtccc

SEQ ID NO: 61317 - DNA, 20 bp, Artificial Sequence
  chemically synthesized
tcacacaccagggactgttt

SEQ ID NO: 61318 - DNA, 20 bp, Artificial Sequence
  chemically synthesized
cacacaccagggactgtttt

SEQ ID NO: 61319 - DNA, 20 bp, Artificial Sequence
  chemically synthesized
acacaccagggactgttttg

SEQ ID NO: 61320 - DNA, 20 bp, Artificial Sequence
  chemically synthesized
tccctcccctcaccccaaaa

SEQ ID NO: 61321 - DNA, 20 bp, Artificial Sequence
  chemically synthesized
accagggactgttttggggt

SEQ ID NO: 61322 - DNA, 20 bp, Artificial Sequence
  chemically synthesized
ccagggactgttttggggtg

SEQ ID NO: 61323 - DNA, 20 bp, Artificial Sequence
  chemically synthesized
cagggactgttttggggtga

SEQ ID NO: 61324 - DNA, 20 bp, Artificial Sequence
  chemically synthesized
agggactgttttggggtgag

SEQ ID NO: 61325 - DNA, 20 bp, Artificial Sequence
  chemically synthesized
ggactgttttggggtgaggg

SEQ ID NO: 61326 - DNA, 20 bp, Artificial Sequence
  chemically synthesized
gactgttttggggtgagggg

SEQ ID NO: 61327 - DNA, 20 bp, Artificial Sequence
  chemically synthesized
actgttttggggtgagggga

SEQ ID NO: 61328 - DNA, 20 bp, Artificial Sequence
  chemically synthesized
tgttttggggtgaggggagg

SEQ ID NO: 61329 - DNA, 20 bp, Artificial Sequence
  chemically synthesized
gttttggggtgaggggaggg

SEQ ID NO: 61330 - DNA, 20 bp, Artificial Sequence
  chemically synthesized
tttggggtgaggggagggag

SEQ ID NO: 61331 - DNA, 20 bp, Artificial Sequence
  chemically synthesized
ttggggtgaggggagggagg

SEQ ID NO: 61332 - DNA, 20 bp, Artificial Sequence
  chemically synthesized
tggggtgaggggagggagga

SEQ ID NO: 61333 - DNA, 20 bp, Artificial Sequence
  chemically synthesized
gtgaggggagggaggaggga

SEQ ID NO: 61334 - DNA, 20 bp, Artificial Sequence
  chemically synthesized
ggagggaggagggatagcat

SEQ ID NO: 61335 - DNA, 20 bp, Artificial Sequence
  chemically synthesized
gagggaggagggatagcatt

SEQ ID NO: 61336 - DNA, 20 bp, Artificial Sequence
  chemically synthesized
gggaggagggatagcattag

SEQ ID NO: 61337 - DNA, 20 bp, Artificial Sequence
  chemically synthesized
attaactcgtcatttacatt

SEQ ID NO: 61338 - DNA, 20 bp, Artificial Sequence
  chemically synthesized
cattaactcgtcatttacat

SEQ ID NO: 61339 - DNA, 20 bp, Artificial Sequence
  chemically synthesized
atatacctaatgtaaatgac

SEQ ID NO: 61340 - DNA, 20 bp, Artificial Sequence
  chemically synthesized
taatgtaaatgacgagttaa

SEQ ID NO: 61341 - DNA, 20 bp, Artificial Sequence
  chemically synthesized
aatgtaaatgacgagttaat

SEQ ID NO: 61342 - DNA, 20 bp, Artificial Sequence
  chemically synthesized
aaatgacgagttaatgggtg

SEQ ID NO: 61343 - DNA, 20 bp, Artificial Sequence
  chemically synthesized
atgggtgcagcacaccaaca

SEQ ID NO: 61344 - DNA, 20 bp, Artificial Sequence
  chemically synthesized
tatgtatacatgtgccatgt

SEQ ID NO: 61345 - DNA, 20 bp, Artificial Sequence
  chemically synthesized
ggtacatgtgcacaacgtgc

SEQ ID NO: 61346 - DNA, 20 bp, Artificial Sequence
  chemically synthesized
gggtacatgtgcacaacgtg

SEQ ID NO: 61347 - DNA, 20 bp, Artificial Sequence
  chemically synthesized
cacgttgtgcacatgtaccc

SEQ ID NO: 61348 - DNA, 20 bp, Artificial Sequence
  chemically synthesized
ttactatagtttaagttcta

SEQ ID NO: 61349 - DNA, 20 bp, Artificial Sequence
  chemically synthesized
attactatagtttaagttct

SEQ ID NO: 61350 - DNA, 20 bp, Artificial Sequence
  chemically synthesized
tattactatagtttaagttc

SEQ ID NO: 61351 - DNA, 20 bp, Artificial Sequence
  chemically synthesized
gtaccctagaacttaaacta

SEQ ID NO: 61352 - DNA, 20 bp, Artificial Sequence
  chemically synthesized
ttttattattactatagttt

SEQ ID NO: 61353 - DNA, 20 bp, Artificial Sequence
  chemically synthesized
ttttttttttattattacta

SEQ ID NO: 61354 - DNA, 20 bp, Artificial Sequence
  chemically synthesized
tatagtaataataaaaaaaa

SEQ ID NO: 61355 - DNA, 20 bp, Artificial Sequence
  chemically synthesized
agtaataataaaaaaaaaag

SEQ ID NO: 61356 - DNA, 20 bp, Artificial Sequence
  chemically synthesized
taataataaaaaaaaaagaa

SEQ ID NO: 61357 - DNA, 20 bp, Artificial Sequence
  chemically synthesized
aaaagaagagatgatgttga

SEQ ID NO: 61358 - DNA, 20 bp, Artificial Sequence
  chemically synthesized
aaagaagagatgatgttgat

SEQ ID NO: 61359 - DNA, 20 bp, Artificial Sequence
  chemically synthesized
aagaagagatgatgttgatg

SEQ ID NO: 61360 - DNA, 20 bp, Artificial Sequence
  chemically synthesized
agaagagatgatgttgatgg

SEQ ID NO: 61361 - DNA, 20 bp, Artificial Sequence
  chemically synthesized
gagatgatgttgatgggggt

SEQ ID NO: 61362 - DNA, 20 bp, Artificial Sequence
  chemically synthesized
tttcagcctcacacagacat

SEQ ID NO: 61363 - DNA, 20 bp, Artificial Sequence
  chemically synthesized
ttttcagcctcacacagaca

SEQ ID NO: 61364 - DNA, 20 bp, Artificial Sequence
  chemically synthesized
tggttttcctatgtctgtgt

SEQ ID NO: 61365 - DNA, 20 bp, Artificial Sequence
  chemically synthesized
ggttttcctatgtctgtgtg

SEQ ID NO: 61366 - DNA, 20 bp, Artificial Sequence
  chemically synthesized
accagcttttcagcctcaca

SEQ ID NO: 61367 - DNA, 20 bp, Artificial Sequence
  chemically synthesized
tatgtctgtgtgaggctgaa

SEQ ID NO: 61368 - DNA, 20 bp, Artificial Sequence
  chemically synthesized
tctgtgtgaggctgaaaagc

SEQ ID NO: 61369 - DNA, 20 bp, Artificial Sequence
  chemically synthesized
aactgaaaataccagctttt

SEQ ID NO: 61370 - DNA, 20 bp, Artificial Sequence
  chemically synthesized
ggctgaaaagctggtatttt

SEQ ID NO: 61371 - DNA, 20 bp, Artificial Sequence
  chemically synthesized
aaacagaaaactgaaaatac

SEQ ID NO: 61372 - DNA, 20 bp, Artificial Sequence
  chemically synthesized
attttcagttttctgttttt

SEQ ID NO: 61373 - DNA, 20 bp, Artificial Sequence
  chemically synthesized
ggaaggcattttctgaaaaa

SEQ ID NO: 61374 - DNA, 20 bp, Artificial Sequence
  chemically synthesized
tcagaaaatgccttcccctt

SEQ ID NO: 61375 - DNA, 20 bp, Artificial Sequence
  chemically synthesized
aatacagaacccaaagggga

SEQ ID NO: 61376 - DNA, 20 bp, Artificial Sequence
  chemically synthesized
cagaaaatgccttccccttt

SEQ ID NO: 61377 - DNA, 20 bp, Artificial Sequence
  chemically synthesized
taatacagaacccaaagggg

SEQ ID NO: 61378 - DNA, 20 bp, Artificial Sequence
  chemically synthesized
acataatacagaacccaaag

SEQ ID NO: 61379 - DNA, 20 bp, Artificial Sequence
  chemically synthesized
tacataatacagaacccaaa

SEQ ID NO: 61380 - DNA, 20 bp, Artificial Sequence
  chemically synthesized
ttacataatacagaacccaa

SEQ ID NO: 61381 - DNA, 20 bp, Artificial Sequence
  chemically synthesized
attacataatacagaaccca

SEQ ID NO: 61382 - DNA, 20 bp, Artificial Sequence
  chemically synthesized
agtgctatgattacataata

SEQ ID NO: 61383 - DNA, 20 bp, Artificial Sequence
  chemically synthesized
ggttctgtattatgtaatca

SEQ ID NO: 61384 - DNA, 20 bp, Artificial Sequence
  chemically synthesized
taaatgaggtaaggcattaa

SEQ ID NO: 61385 - DNA, 20 bp, Artificial Sequence
  chemically synthesized
tgaagaaattaaatgaggta

SEQ ID NO: 61386 - DNA, 20 bp, Artificial Sequence
  chemically synthesized
atgaagaaattaaatgaggt

SEQ ID NO: 61387 - DNA, 20 bp, Artificial Sequence
  chemically synthesized
ccatatgaagaaattaaatg

SEQ ID NO: 61388 - DNA, 20 bp, Artificial Sequence
  chemically synthesized
cccatatgaagaaattaaat

SEQ ID NO: 61389 - DNA, 20 bp, Artificial Sequence
  chemically synthesized
cctcatttaatttcttcata

SEQ ID NO: 61390 - DNA, 20 bp, Artificial Sequence
  chemically synthesized
ctcatttaatttcttcatat

SEQ ID NO: 61391 - DNA, 20 bp, Artificial Sequence
  chemically synthesized
catttaatttcttcatatgg

SEQ ID NO: 61392 - DNA, 20 bp, Artificial Sequence
  chemically synthesized
ttagacctccctcccatatg

SEQ ID NO: 61393 - DNA, 20 bp, Artificial Sequence
  chemically synthesized
atttaatttcttcatatggg

SEQ ID NO: 61394 - DNA, 20 bp, Artificial Sequence
  chemically synthesized
tttaatttcttcatatggga

SEQ ID NO: 61395 - DNA, 20 bp, Artificial Sequence
  chemically synthesized
taatttcttcatatgggagg

SEQ ID NO: 61396 - DNA, 20 bp, Artificial Sequence
  chemically synthesized
aatttcttcatatgggaggg

SEQ ID NO: 61397 - DNA, 20 bp, Artificial Sequence
  chemically synthesized
ggagggaggtctaactctgc

SEQ ID NO: 61398 - DNA, 20 bp, Artificial Sequence
  chemically synthesized
agcataaagactagcagagt

SEQ ID NO: 61399 - DNA, 20 bp, Artificial Sequence
  chemically synthesized
agggagcataaagactagca

SEQ ID NO: 61400 - DNA, 20 bp, Artificial Sequence
  chemically synthesized
ccagggagcataaagactag

SEQ ID NO: 61401 - DNA, 20 bp, Artificial Sequence
  chemically synthesized
tccccagggagcataaagac

SEQ ID NO: 61402 - DNA, 20 bp, Artificial Sequence
  chemically synthesized
ccctgtccccagggagcata

SEQ ID NO: 61403 - DNA, 20 bp, Artificial Sequence
  chemically synthesized
ctgctagtctttatgctccc

SEQ ID NO: 61404 - DNA, 20 bp, Artificial Sequence
  chemically synthesized
tgctagtctttatgctccct

SEQ ID NO: 61405 - DNA, 20 bp, Artificial Sequence
  chemically synthesized
gctagtctttatgctccctg

SEQ ID NO: 61406 - DNA, 20 bp, Artificial Sequence
  chemically synthesized
attagacccctgtccccagg

SEQ ID NO: 61407 - DNA, 20 bp, Artificial Sequence
  chemically synthesized
gtctttatgctccctgggga

SEQ ID NO: 61408 - DNA, 20 bp, Artificial Sequence
  chemically synthesized
tctttatgctccctggggac

SEQ ID NO: 61409 - DNA, 20 bp, Artificial Sequence
  chemically synthesized
ggattagacccctgtcccca

SEQ ID NO: 61410 - DNA, 20 bp, Artificial Sequence
  chemically synthesized
ctttatgctccctggggaca

SEQ ID NO: 61411 - DNA, 20 bp, Artificial Sequence
  chemically synthesized
tggattagacccctgtcccc

SEQ ID NO: 61412 - DNA, 20 bp, Artificial Sequence
  chemically synthesized
tttatgctccctggggacag

SEQ ID NO: 61413 - DNA, 20 bp, Artificial Sequence
  chemically synthesized
atggattagacccctgtccc

SEQ ID NO: 61414 - DNA, 20 bp, Artificial Sequence
  chemically synthesized
ctggaaacacagagatggat

SEQ ID NO: 61415 - DNA, 20 bp, Artificial Sequence
  chemically synthesized
aaattctggaaacacagaga

SEQ ID NO: 61416 - DNA, 20 bp, Artificial Sequence
  chemically synthesized
tgttaaattctggaaacaca

SEQ ID NO: 61417 - DNA, 20 bp, Artificial Sequence
  chemically synthesized
ctaatccatctctgtgtttc

SEQ ID NO: 61418 - DNA, 20 bp, Artificial Sequence
  chemically synthesized
tgtgttaaattctggaaaca

SEQ ID NO: 61419 - DNA, 20 bp, Artificial Sequence
  chemically synthesized
ccaagcactgtgttaaattc

SEQ ID NO: 61420 - DNA, 20 bp, Artificial Sequence
  chemically synthesized
tgtgtttccagaatttaaca

SEQ ID NO: 61421 - DNA, 20 bp, Artificial Sequence
  chemically synthesized
ccagaatttaacacagtgct

SEQ ID NO: 61422 - DNA, 20 bp, Artificial Sequence
  chemically synthesized
ttgagcatccattatgtgcc

SEQ ID NO: 61423 - DNA, 20 bp, Artificial Sequence
  chemically synthesized
acacagtgcttggcacataa

SEQ ID NO: 61424 - DNA, 20 bp, Artificial Sequence
  chemically synthesized
gtgattcagtaaacaatatt

SEQ ID NO: 61425 - DNA, 20 bp, Artificial Sequence
  chemically synthesized
tcatcatacagtcagtgatt

SEQ ID NO: 61426 - DNA, 20 bp, Artificial Sequence
  chemically synthesized
tcattcattcatcatacagt

SEQ ID NO: 61427 - DNA, 20 bp, Artificial Sequence
  chemically synthesized
gtgttcattcattcatcata

SEQ ID NO: 61428 - DNA, 20 bp, Artificial Sequence
  chemically synthesized
gatgaatgaatgaacacatg

SEQ ID NO: 61429 - DNA, 20 bp, Artificial Sequence
  chemically synthesized
catgaagtaaaaacatgatt

SEQ ID NO: 61430 - DNA, 20 bp, Artificial Sequence
  chemically synthesized
tgaagtaaaaacatgattta

SEQ ID NO: 61431 - DNA, 20 bp, Artificial Sequence
  chemically synthesized
cctttgtgattagatagatc

SEQ ID NO: 61432 - DNA, 20 bp, Artificial Sequence
  chemically synthesized
tcctttgtgattagatagat

SEQ ID NO: 61433 - DNA, 20 bp, Artificial Sequence
  chemically synthesized
agagttcctttgtgattaga

SEQ ID NO: 61434 - DNA, 20 bp, Artificial Sequence
  chemically synthesized
tcctgatctatctaatcaca

SEQ ID NO: 61435 - DNA, 20 bp, Artificial Sequence
  chemically synthesized
cctgatctatctaatcacaa

SEQ ID NO: 61436 - DNA, 20 bp, Artificial Sequence
  chemically synthesized
ccaaagagttcctttgtgat

SEQ ID NO: 61437 - DNA, 20 bp, Artificial Sequence
  chemically synthesized
ctaatcacaaaggaactctt

SEQ ID NO: 61438 - DNA, 20 bp, Artificial Sequence
  chemically synthesized
cttgatagattgaaaccaaa

SEQ ID NO: 61439 - DNA, 20 bp, Artificial Sequence
  chemically synthesized
tacttgatagattgaaacca

SEQ ID NO: 61440 - DNA, 20 bp, Artificial Sequence
  chemically synthesized
ctctttggtttcaatctatc

SEQ ID NO: 61441 - DNA, 20 bp, Artificial Sequence
  chemically synthesized
tttggtttcaatctatcaag

SEQ ID NO: 61442 - DNA, 20 bp, Artificial Sequence
  chemically synthesized
tgacagtcacaactacttga

SEQ ID NO: 61443 - DNA, 20 bp, Artificial Sequence
  chemically synthesized
agtagttgtgactgtcataa

SEQ ID NO: 61444 - DNA, 20 bp, Artificial Sequence
  chemically synthesized
acagctgaaagccattatga

SEQ ID NO: 61445 - DNA, 20 bp, Artificial Sequence
  chemically synthesized
gtgactgtcataatggcttt

SEQ ID NO: 61446 - DNA, 20 bp, Artificial Sequence
  chemically synthesized
gcagagctaaagacagctga

SEQ ID NO: 61447 - DNA, 20 bp, Artificial Sequence
  chemically synthesized
taatggctttcagctgtctt

SEQ ID NO: 61448 - DNA, 20 bp, Artificial Sequence
  chemically synthesized
aactactgcagagctaaaga

SEQ ID NO: 61449 - DNA, 20 bp, Artificial Sequence
  chemically synthesized
aaaaaactactgcagagcta

SEQ ID NO: 61450 - DNA, 20 bp, Artificial Sequence
  chemically synthesized
ttcagctgtctttagctctg

SEQ ID NO: 61451 - DNA, 20 bp, Artificial Sequence
  chemically synthesized
agctgtctttagctctgcag

SEQ ID NO: 61452 - DNA, 20 bp, Artificial Sequence
  chemically synthesized
ctattaaaaaaactactgca

SEQ ID NO: 61453 - DNA, 20 bp, Artificial Sequence
  chemically synthesized
gcctattaaaaaaactactg

SEQ ID NO: 61454 - DNA, 20 bp, Artificial Sequence
  chemically synthesized
ctctgcagtagtttttttaa

SEQ ID NO: 61455 - DNA, 20 bp, Artificial Sequence
  chemically synthesized
tctgcagtagtttttttaat

SEQ ID NO: 61456 - DNA, 20 bp, Artificial Sequence
  chemically synthesized
ttttttaataggcttcattc

SEQ ID NO: 61457 - DNA, 20 bp, Artificial Sequence
  chemically synthesized
gagtatatgtgtctagaatg

SEQ ID NO: 61458 - DNA, 20 bp, Artificial Sequence
  chemically synthesized
aacacctgagtatatgtgtc

SEQ ID NO: 61459 - DNA, 20 bp, Artificial Sequence
  chemically synthesized
tcattctagacacatatact

SEQ ID NO: 61460 - DNA, 20 bp, Artificial Sequence
  chemically synthesized
cattctagacacatatactc

SEQ ID NO: 61461 - DNA, 20 bp, Artificial Sequence
  chemically synthesized
gaagcagctcaggaacacct

SEQ ID NO: 61462 - DNA, 20 bp, Artificial Sequence
  chemically synthesized
acatatactcaggtgttcct

SEQ ID NO: 61463 - DNA, 20 bp, Artificial Sequence
  chemically synthesized
atgccttaaggaagcagctc

SEQ ID NO: 61464 - DNA, 20 bp, Artificial Sequence
  chemically synthesized
aatgccttaaggaagcagct

SEQ ID NO: 61465 - DNA, 20 bp, Artificial Sequence
  chemically synthesized
tgttcctgagctgcttcctt

SEQ ID NO: 61466 - DNA, 20 bp, Artificial Sequence
  chemically synthesized
gaggaaatgccttaaggaag

SEQ ID NO: 61467 - DNA, 20 bp, Artificial Sequence
  chemically synthesized
gttcctgagctgcttcctta

SEQ ID NO: 61468 - DNA, 20 bp, Artificial Sequence
  chemically synthesized
accgaggaaatgccttaagg

SEQ ID NO: 61469 - DNA, 20 bp, Artificial Sequence
  chemically synthesized
ctgaccgaggaaatgcctta

SEQ ID NO: 61470 - DNA, 20 bp, Artificial Sequence
  chemically synthesized
tctgaccgaggaaatgcctt

SEQ ID NO: 61471 - DNA, 20 bp, Artificial Sequence
  chemically synthesized
gcttccttaaggcatttcct

SEQ ID NO: 61472 - DNA, 20 bp, Artificial Sequence
  chemically synthesized
ccttaaggcatttcctcggt

SEQ ID NO: 61473 - DNA, 20 bp, Artificial Sequence
  chemically synthesized
accataagtagatctgaccg

SEQ ID NO: 61474 - DNA, 20 bp, Artificial Sequence
  chemically synthesized
aaccataagtagatctgacc

SEQ ID NO: 61475 - DNA, 20 bp, Artificial Sequence
  chemically synthesized
tcctcggtcagatctactta

SEQ ID NO: 61476 - DNA, 20 bp, Artificial Sequence
  chemically synthesized
ggtgagatgtcaaccataag

SEQ ID NO: 61477 - DNA, 20 bp, Artificial Sequence
  chemically synthesized
tgtggtgagatgtcaaccat

SEQ ID NO: 61478 - DNA, 20 bp, Artificial Sequence
  chemically synthesized
gtggtcatgttagttgtggt

SEQ ID NO: 61479 - DNA, 20 bp, Artificial Sequence
  chemically synthesized
caaggtggtcatgttagttg

SEQ ID NO: 61480 - DNA, 20 bp, Artificial Sequence
  chemically synthesized
tattcccaaggtggtcatgt

SEQ ID NO: 61481 - DNA, 20 bp, Artificial Sequence
  chemically synthesized
cacaactaacatgaccacct

SEQ ID NO: 61482 - DNA, 20 bp, Artificial Sequence
  chemically synthesized
acaactaacatgaccacctt

SEQ ID NO: 61483 - DNA, 20 bp, Artificial Sequence
  chemically synthesized
aaagagcaatattcccaagg

SEQ ID NO: 61484 - DNA, 20 bp, Artificial Sequence
  chemically synthesized
aaaaaagagcaatattccca

SEQ ID NO: 61485 - DNA, 20 bp, Artificial Sequence
  chemically synthesized
caaaaaagagcaatattccc

SEQ ID NO: 61486 - DNA, 20 bp, Artificial Sequence
  chemically synthesized
cccaaacattacgcaaaaaa

SEQ ID NO: 61487 - DNA, 20 bp, Artificial Sequence
  chemically synthesized
ggcccaaacattacgcaaaa

SEQ ID NO: 61488 - DNA, 20 bp, Artificial Sequence
  chemically synthesized
gctcttttttgcgtaatgtt

SEQ ID NO: 61489 - DNA, 20 bp, Artificial Sequence
  chemically synthesized
ctcttttttgcgtaatgttt

SEQ ID NO: 61490 - DNA, 20 bp, Artificial Sequence
  chemically synthesized
ttgcgtaatgtttgggccaa

SEQ ID NO: 61491 - DNA, 20 bp, Artificial Sequence
  chemically synthesized
tgcgtaatgtttgggccaac

SEQ ID NO: 61492 - DNA, 20 bp, Artificial Sequence
  chemically synthesized
tgtttggcttcataacctgt

SEQ ID NO: 61493 - DNA, 20 bp, Artificial Sequence
  chemically synthesized
gtttgggccaacaggttatg

SEQ ID NO: 61494 - DNA, 20 bp, Artificial Sequence
  chemically synthesized
acaggttatgaagccaaaca

SEQ ID NO: 61495 - DNA, 20 bp, Artificial Sequence
  chemically synthesized
ctagtcctaatcactgtgtt

SEQ ID NO: 61496 - DNA, 20 bp, Artificial Sequence
  chemically synthesized
atgaagccaaacacagtgat

SEQ ID NO: 61497 - DNA, 20 bp, Artificial Sequence
  chemically synthesized
tgaagccaaacacagtgatt

SEQ ID NO: 61498 - DNA, 20 bp, Artificial Sequence
  chemically synthesized
ccaaacacagtgattaggac

SEQ ID NO: 61499 - DNA, 20 bp, Artificial Sequence
  chemically synthesized
aacacagtgattaggactag

SEQ ID NO: 61500 - DNA, 20 bp, Artificial Sequence
  chemically synthesized
gtgattaggactagtggact

SEQ ID NO: 61501 - DNA, 20 bp, Artificial Sequence
  chemically synthesized
caggaagcccccaagtccac

SEQ ID NO: 61502 - DNA, 20 bp, Artificial Sequence
  chemically synthesized
tgattaggactagtggactt

SEQ ID NO: 61503 - DNA, 20 bp, Artificial Sequence
  chemically synthesized
gattaggactagtggacttg

SEQ ID NO: 61504 - DNA, 20 bp, Artificial Sequence
  chemically synthesized
attaggactagtggacttgg

SEQ ID NO: 61505 - DNA, 20 bp, Artificial Sequence
  chemically synthesized
tgctcccccaggaagccccc

SEQ ID NO: 61506 - DNA, 20 bp, Artificial Sequence
  chemically synthesized
tagtggacttgggggcttcc

SEQ ID NO: 61507 - DNA, 20 bp, Artificial Sequence
  chemically synthesized
agtggacttgggggcttcct

SEQ ID NO: 61508 - DNA, 20 bp, Artificial Sequence
  chemically synthesized
gtggacttgggggcttcctg

SEQ ID NO: 61509 - DNA, 20 bp, Artificial Sequence
  chemically synthesized
tggacttgggggcttcctgg

SEQ ID NO: 61510 - DNA, 20 bp, Artificial Sequence
  chemically synthesized
gacttgggggcttcctgggg

SEQ ID NO: 61511 - DNA, 20 bp, Artificial Sequence
  chemically synthesized
acctgtaatgctcccccagg

SEQ ID NO: 61512 - DNA, 20 bp, Artificial Sequence
  chemically synthesized
gtcacctgtaatgctccccc

SEQ ID NO: 61513 - DNA, 20 bp, Artificial Sequence
  chemically synthesized
tgtcacctgtaatgctcccc

SEQ ID NO: 61514 - DNA, 20 bp, Artificial Sequence
  chemically synthesized
ggcttcctgggggagcatta

SEQ ID NO: 61515 - DNA, 20 bp, Artificial Sequence
  chemically synthesized
gcttcctgggggagcattac

SEQ ID NO: 61516 - DNA, 20 bp, Artificial Sequence
  chemically synthesized
tacaggtgacacaaaatcct

SEQ ID NO: 61517 - DNA, 20 bp, Artificial Sequence
  chemically synthesized
aatgtacttaatgtcaacca

SEQ ID NO: 61518 - DNA, 20 bp, Artificial Sequence
  chemically synthesized
aaatgtacttaatgtcaacc

SEQ ID NO: 61519 - DNA, 20 bp, Artificial Sequence
  chemically synthesized
caaaatccttggttgacatt

SEQ ID NO: 61520 - DNA, 20 bp, Artificial Sequence
  chemically synthesized
gttgacattaagtacatttg

SEQ ID NO: 61521 - DNA, 20 bp, Artificial Sequence
  chemically synthesized
ggatttgatgcttacaaatc

SEQ ID NO: 61522 - DNA, 20 bp, Artificial Sequence
  chemically synthesized
ggagtcacagctggatttgt

SEQ ID NO: 61523 - DNA, 20 bp, Artificial Sequence
  chemically synthesized
cttgccaagggagtcacagc

SEQ ID NO: 61524 - DNA, 20 bp, Artificial Sequence
  chemically synthesized
tgaacttgccaagggagtca

SEQ ID NO: 61525 - DNA, 20 bp, Artificial Sequence
  chemically synthesized
aaatccagctgtgactccct

SEQ ID NO: 61526 - DNA, 20 bp, Artificial Sequence
  chemically synthesized
ccagctgtgactcccttggc

SEQ ID NO: 61527 - DNA, 20 bp, Artificial Sequence
  chemically synthesized
aagacttgaacttgccaagg

SEQ ID NO: 61528 - DNA, 20 bp, Artificial Sequence
  chemically synthesized
ctaagacttgaacttgccaa

SEQ ID NO: 61529 - DNA, 20 bp, Artificial Sequence
  chemically synthesized
tctaagacttgaacttgcca

SEQ ID NO: 61530 - DNA, 20 bp, Artificial Sequence
  chemically synthesized
gtctaagacttgaacttgcc

SEQ ID NO: 61531 - DNA, 20 bp, Artificial Sequence
  chemically synthesized
gtgactcccttggcaagttc

SEQ ID NO: 61532 - DNA, 20 bp, Artificial Sequence
  chemically synthesized
cccttggcaagttcaagtct

SEQ ID NO: 61533 - DNA, 20 bp, Artificial Sequence
  chemically synthesized
tttagcttcctatagagtct

SEQ ID NO: 61534 - DNA, 20 bp, Artificial Sequence
  chemically synthesized
agttcaagtcttagactcta

SEQ ID NO: 61535 - DNA, 20 bp, Artificial Sequence
  chemically synthesized
gttcaagtcttagactctat

SEQ ID NO: 61536 - DNA, 20 bp, Artificial Sequence
  chemically synthesized
caagtcttagactctatagg

SEQ ID NO: 61537 - DNA, 20 bp, Artificial Sequence
  chemically synthesized
accatttttagcttcctata

SEQ ID NO: 61538 - DNA, 20 bp, Artificial Sequence
  chemically synthesized
tgaccatttttagcttccta

SEQ ID NO: 61539 - DNA, 20 bp, Artificial Sequence
  chemically synthesized
actctataggaagctaaaaa

SEQ ID NO: 61540 - DNA, 20 bp, Artificial Sequence
  chemically synthesized
gatggaacaatgaccatttt

SEQ ID NO: 61541 - DNA, 20 bp, Artificial Sequence
  chemically synthesized
ggtcattgttccatcaaatt

SEQ ID NO: 61542 - DNA, 20 bp, Artificial Sequence
  chemically synthesized
tcagatcataccaaatttga

SEQ ID NO: 61543 - DNA, 20 bp, Artificial Sequence
  chemically synthesized
ttggtatgatctgaaatcta

SEQ ID NO: 61544 - DNA, 20 bp, Artificial Sequence
  chemically synthesized
gaaagcatggctgtagattt

SEQ ID NO: 61545 - DNA, 20 bp, Artificial Sequence
  chemically synthesized
aatgacagaaagcatggctg

SEQ ID NO: 61546 - DNA, 20 bp, Artificial Sequence
  chemically synthesized
ttaaaaaatgacagaaagca

SEQ ID NO: 61547 - DNA, 20 bp, Artificial Sequence
  chemically synthesized
gccttttaaaaaatgacaga

SEQ ID NO: 61548 - DNA, 20 bp, Artificial Sequence
  chemically synthesized
atgtgccttttaaaaaatga

SEQ ID NO: 61549 - DNA, 20 bp, Artificial Sequence
  chemically synthesized
tgctttctgtcattttttaa

SEQ ID NO: 61550 - DNA, 20 bp, Artificial Sequence
  chemically synthesized
gctttctgtcattttttaaa

SEQ ID NO: 61551 - DNA, 20 bp, Artificial Sequence
  chemically synthesized
taaaaggcacattgacctca

SEQ ID NO: 61552 - DNA, 20 bp, Artificial Sequence
  chemically synthesized
aaaggcacattgacctcaaa

SEQ ID NO: 61553 - DNA, 20 bp, Artificial Sequence
  chemically synthesized
ctctcaaattgtgctctttg

SEQ ID NO: 61554 - DNA, 20 bp, Artificial Sequence
  chemically synthesized
cctctcaaattgtgctcttt

SEQ ID NO: 61555 - DNA, 20 bp, Artificial Sequence
  chemically synthesized
gacctcaaagagcacaattt

SEQ ID NO: 61556 - DNA, 20 bp, Artificial Sequence
  chemically synthesized
cctcaaagagcacaatttga

SEQ ID NO: 61557 - DNA, 20 bp, Artificial Sequence
  chemically synthesized
ctcaaagagcacaatttgag

SEQ ID NO: 61558 - DNA, 20 bp, Artificial Sequence
  chemically synthesized
agcacaatttgagaggaatt

SEQ ID NO: 61559 - DNA, 20 bp, Artificial Sequence
  chemically synthesized
aatttgagaggaattcagat

SEQ ID NO: 61560 - DNA, 20 bp, Artificial Sequence
  chemically synthesized
atttgagaggaattcagatg

SEQ ID NO: 61561 - DNA, 20 bp, Artificial Sequence
  chemically synthesized
agatgaggtgaattctaacc

SEQ ID NO: 61562 - DNA, 20 bp, Artificial Sequence
  chemically synthesized
atttaatgtgatatctgggt

SEQ ID NO: 61563 - DNA, 20 bp, Artificial Sequence
  chemically synthesized
agctatttaatgtgatatct

SEQ ID NO: 61564 - DNA, 20 bp, Artificial Sequence
  chemically synthesized
cagctatttaatgtgatatc

SEQ ID NO: 61565 - DNA, 20 bp, Artificial Sequence
  chemically synthesized
aacccagatatcacattaaa

SEQ ID NO: 61566 - DNA, 20 bp, Artificial Sequence
  chemically synthesized
aagacttggccaagatgaca

SEQ ID NO: 61567 - DNA, 20 bp, Artificial Sequence
  chemically synthesized
attaaatagctgtgtcatct

SEQ ID NO: 61568 - DNA, 20 bp, Artificial Sequence
  chemically synthesized
atagctgtgtcatcttggcc

SEQ ID NO: 61569 - DNA, 20 bp, Artificial Sequence
  chemically synthesized
aaaaaggttaagacttggcc

SEQ ID NO: 61570 - DNA, 20 bp, Artificial Sequence
  chemically synthesized
agttcaaaaaggttaagact

SEQ ID NO: 61571 - DNA, 20 bp, Artificial Sequence
  chemically synthesized
tagacaagttcaaaaaggtt

SEQ ID NO: 61572 - DNA, 20 bp, Artificial Sequence
  chemically synthesized
cttactagacaagttcaaaa

SEQ ID NO: 61573 - DNA, 20 bp, Artificial Sequence
  chemically synthesized
ccttactagacaagttcaaa

SEQ ID NO: 61574 - DNA, 20 bp, Artificial Sequence
  chemically synthesized
ttaacctttttgaacttgtc

SEQ ID NO: 61575 - DNA, 20 bp, Artificial Sequence
  chemically synthesized
cctttttgaacttgtctagt

SEQ ID NO: 61576 - DNA, 20 bp, Artificial Sequence
  chemically synthesized
gtctaacacccttactagac

SEQ ID NO: 61577 - DNA, 20 bp, Artificial Sequence
  chemically synthesized
ctttttgaacttgtctagta

SEQ ID NO: 61578 - DNA, 20 bp, Artificial Sequence
  chemically synthesized
tttttgaacttgtctagtaa

SEQ ID NO: 61579 - DNA, 20 bp, Artificial Sequence
  chemically synthesized
atctagtctaacacccttac

SEQ ID NO: 61580 - DNA, 20 bp, Artificial Sequence
  chemically synthesized
aacttgtctagtaagggtgt

SEQ ID NO: 61581 - DNA, 20 bp, Artificial Sequence
  chemically synthesized
gtctagtaagggtgttagac

SEQ ID NO: 61582 - DNA, 20 bp, Artificial Sequence
  chemically synthesized
ttacatatcatgagatcatc

SEQ ID NO: 61583 - DNA, 20 bp, Artificial Sequence
  chemically synthesized
agaattaatttacatatcat

SEQ ID NO: 61584 - DNA, 20 bp, Artificial Sequence
  chemically synthesized
ctgtctcaaacaaaaaaaaa

SEQ ID NO: 61585 - DNA, 20 bp, Artificial Sequence
  chemically synthesized
aattctttttttttttgttt

SEQ ID NO: 61586 - DNA, 20 bp, Artificial Sequence
  chemically synthesized
ctttttttttttgtttgaga

SEQ ID NO: 61587 - DNA, 20 bp, Artificial Sequence
  chemically synthesized
ttttttttttgtttgagaca

SEQ ID NO: 61588 - DNA, 20 bp, Artificial Sequence
  chemically synthesized
tccagcctgggtgacagagc

SEQ ID NO: 61589 - DNA, 20 bp, Artificial Sequence
  chemically synthesized
cagagtctcgctctgtcacc

SEQ ID NO: 61590 - DNA, 20 bp, Artificial Sequence
  chemically synthesized
gtactccagcctgggtgaca

SEQ ID NO: 61591 - DNA, 20 bp, Artificial Sequence
  chemically synthesized
agagtctcgctctgtcaccc

SEQ ID NO: 61592 - DNA, 20 bp, Artificial Sequence
  chemically synthesized
ctgtactccagcctgggtga

SEQ ID NO: 61593 - DNA, 20 bp, Artificial Sequence
  chemically synthesized
tctcgctctgtcacccaggc

SEQ ID NO: 61594 - DNA, 20 bp, Artificial Sequence
  chemically synthesized
tcgctctgtcacccaggctg

SEQ ID NO: 61595 - DNA, 20 bp, Artificial Sequence
  chemically synthesized
gcaccactgtactccagcct

SEQ ID NO: 61596 - DNA, 20 bp, Artificial Sequence
  chemically synthesized
tgcaccactgtactccagcc

SEQ ID NO: 61597 - DNA, 20 bp, Artificial Sequence
  chemically synthesized
ctgtcacccaggctggagta

SEQ ID NO: 61598 - DNA, 20 bp, Artificial Sequence
  chemically synthesized
aagattgcaccactgtactc

SEQ ID NO: 61599 - DNA, 20 bp, Artificial Sequence
  chemically synthesized
tcacccaggctggagtacag

SEQ ID NO: 61600 - DNA, 20 bp, Artificial Sequence
  chemically synthesized
ggagtacagtggtgcaatct

SEQ ID NO: 61601 - DNA, 20 bp, Artificial Sequence
  chemically synthesized
ggcagaggatgcagtgagcc

SEQ ID NO: 61602 - DNA, 20 bp, Artificial Sequence
  chemically synthesized
caggaggcagaggatgcagt

SEQ ID NO: 61603 - DNA, 20 bp, Artificial Sequence
  chemically synthesized
aacccaggaggcagaggatg

SEQ ID NO: 61604 - DNA, 20 bp, Artificial Sequence
  chemically synthesized
cacatgaacccaggaggcag

SEQ ID NO: 61605 - DNA, 20 bp, Artificial Sequence
  chemically synthesized
tcactgcatcctctgcctcc

SEQ ID NO: 61606 - DNA, 20 bp, Artificial Sequence
  chemically synthesized
tcacatgaacccaggaggca

SEQ ID NO: 61607 - DNA, 20 bp, Artificial Sequence
  chemically synthesized
cactgcatcctctgcctcct

SEQ ID NO: 61608 - DNA, 20 bp, Artificial Sequence
  chemically synthesized
agtcacatgaacccaggagg

SEQ ID NO: 61609 - DNA, 20 bp, Artificial Sequence
  chemically synthesized
gagagtcacatgaacccagg

SEQ ID NO: 61610 - DNA, 20 bp, Artificial Sequence
  chemically synthesized
ggagagtcacatgaacccag

SEQ ID NO: 61611 - DNA, 20 bp, Artificial Sequence
  chemically synthesized
caggagagtcacatgaaccc

SEQ ID NO: 61612 - DNA, 20 bp, Artificial Sequence
  chemically synthesized
gcaggagagtcacatgaacc

SEQ ID NO: 61613 - DNA, 20 bp, Artificial Sequence
  chemically synthesized
cttgggaggctgaggcagga

SEQ ID NO: 61614 - DNA, 20 bp, Artificial Sequence
  chemically synthesized
ttcatgtgactctcctgcct

SEQ ID NO: 61615 - DNA, 20 bp, Artificial Sequence
  chemically synthesized
tacttgggaggctgaggcag

SEQ ID NO: 61616 - DNA, 20 bp, Artificial Sequence
  chemically synthesized
gctacttgggaggctgaggc

SEQ ID NO: 61617 - DNA, 20 bp, Artificial Sequence
  chemically synthesized
ggctacttgggaggctgagg

SEQ ID NO: 61618 - DNA, 20 bp, Artificial Sequence
  chemically synthesized
cccggctacttgggaggctg

SEQ ID NO: 61619 - DNA, 20 bp, Artificial Sequence
  chemically synthesized
tcccggctacttgggaggct

SEQ ID NO: 61620 - DNA, 20 bp, Artificial Sequence
  chemically synthesized
ctctcctgcctcagcctccc

SEQ ID NO: 61621 - DNA, 20 bp, Artificial Sequence
  chemically synthesized
tcctgcctcagcctcccaag

SEQ ID NO: 61622 - DNA, 20 bp, Artificial Sequence
  chemically synthesized
catagtcccggctacttggg

SEQ ID NO: 61623 - DNA, 20 bp, Artificial Sequence
  chemically synthesized
ccatagtcccggctacttgg

SEQ ID NO: 61624 - DNA, 20 bp, Artificial Sequence
  chemically synthesized
gcctcagcctcccaagtagc

SEQ ID NO: 61625 - DNA, 20 bp, Artificial Sequence
  chemically synthesized
gcccatagtcccggctactt

SEQ ID NO: 61626 - DNA, 20 bp, Artificial Sequence
  chemically synthesized
cctcagcctcccaagtagcc

SEQ ID NO: 61627 - DNA, 20 bp, Artificial Sequence
  chemically synthesized
tgcccatagtcccggctact

SEQ ID NO: 61628 - DNA, 20 bp, Artificial Sequence
  chemically synthesized
ctcccaagtagccgggacta

SEQ ID NO: 61629 - DNA, 20 bp, Artificial Sequence
  chemically synthesized
tcccaagtagccgggactat

SEQ ID NO: 61630 - DNA, 20 bp, Artificial Sequence
  chemically synthesized
gtggtgcatgcccatagtcc

SEQ ID NO: 61631 - DNA, 20 bp, Artificial Sequence
  chemically synthesized
ggcatagtggtgcatgccca

SEQ ID NO: 61632 - DNA, 20 bp, Artificial Sequence
  chemically synthesized
tgggcatgcaccactatgcc

SEQ ID NO: 61633 - DNA, 20 bp, Artificial Sequence
  chemically synthesized
caaaacttagccaggcatag

SEQ ID NO: 61634 - DNA, 20 bp, Artificial Sequence
  chemically synthesized
atacaaaacttagccaggca

SEQ ID NO: 61635 - DNA, 20 bp, Artificial Sequence
  chemically synthesized
atgcaccactatgcctggct

SEQ ID NO: 61636 - DNA, 20 bp, Artificial Sequence
  chemically synthesized
taaaaatacaaaacttagcc

SEQ ID NO: 61637 - DNA, 20 bp, Artificial Sequence
  chemically synthesized
ctaaaaatacaaaacttagc

SEQ ID NO: 61638 - DNA, 20 bp, Artificial Sequence
  chemically synthesized
tctactaaaaatacaaaact

SEQ ID NO: 61639 - DNA, 20 bp, Artificial Sequence
  chemically synthesized
ctggctaagttttgtatttt

SEQ ID NO: 61640 - DNA, 20 bp, Artificial Sequence
  chemically synthesized
gctaagttttgtatttttag

SEQ ID NO: 61641 - DNA, 20 bp, Artificial Sequence
  chemically synthesized
taagttttgtatttttagta

SEQ ID NO: 61642 - DNA, 20 bp, Artificial Sequence
  chemically synthesized
ttgtatttttagtagagacg

SEQ ID NO: 61643 - DNA, 20 bp, Artificial Sequence
  chemically synthesized
gagacgcggttttgccatgt

SEQ ID NO: 61644 - DNA, 20 bp, Artificial Sequence
  chemically synthesized
cgcggttttgccatgttggc

SEQ ID NO: 61645 - DNA, 20 bp, Artificial Sequence
  chemically synthesized
caagaccagcctggccaaca

SEQ ID NO: 61646 - DNA, 20 bp, Artificial Sequence
  chemically synthesized
gcggttttgccatgttggcc

SEQ ID NO: 61647 - DNA, 20 bp, Artificial Sequence
  chemically synthesized
ttttgccatgttggccaggc

SEQ ID NO: 61648 - DNA, 20 bp, Artificial Sequence
  chemically synthesized
tcaggagttcaagaccagcc

SEQ ID NO: 61649 - DNA, 20 bp, Artificial Sequence
  chemically synthesized
tgaggtcaggagttcaagac

SEQ ID NO: 61650 - DNA, 20 bp, Artificial Sequence
  chemically synthesized
tcacctgaggtcaggagttc

SEQ ID NO: 61651 - DNA, 20 bp, Artificial Sequence
  chemically synthesized
tggtcttgaactcctgacct

SEQ ID NO: 61652 - DNA, 20 bp, Artificial Sequence
  chemically synthesized
ggtggatcacctgaggtcag

SEQ ID NO: 61653 - DNA, 20 bp, Artificial Sequence
  chemically synthesized
ggtcttgaactcctgacctc

SEQ ID NO: 61654 - DNA, 20 bp, Artificial Sequence
  chemically synthesized
cgggtggatcacctgaggtc

SEQ ID NO: 61655 - DNA, 20 bp, Artificial Sequence
  chemically synthesized
gcgggtggatcacctgaggt

SEQ ID NO: 61656 - DNA, 20 bp, Artificial Sequence
  chemically synthesized
caaggcgggtggatcacctg

SEQ ID NO: 61657 - DNA, 20 bp, Artificial Sequence
  chemically synthesized
ccaaggcgggtggatcacct

SEQ ID NO: 61658 - DNA, 20 bp, Artificial Sequence
  chemically synthesized
ctcaggtgatccacccgcct

SEQ ID NO: 61659 - DNA, 20 bp, Artificial Sequence
  chemically synthesized
cttttggaggccaaggcggg

SEQ ID NO: 61660 - DNA, 20 bp, Artificial Sequence
  chemically synthesized
gcacttttggaggccaaggc

SEQ ID NO: 61661 - DNA, 20 bp, Artificial Sequence
  chemically synthesized
agcacttttggaggccaagg

SEQ ID NO: 61662 - DNA, 20 bp, Artificial Sequence
  chemically synthesized
cccagcacttttggaggcca

SEQ ID NO: 61663 - DNA, 20 bp, Artificial Sequence
  chemically synthesized
tcccagcacttttggaggcc

SEQ ID NO: 61664 - DNA, 20 bp, Artificial Sequence
  chemically synthesized
ccacccgccttggcctccaa

SEQ ID NO: 61665 - DNA, 20 bp, Artificial Sequence
  chemically synthesized
tgtaatcccagcacttttgg

SEQ ID NO: 61666 - DNA, 20 bp, Artificial Sequence
  chemically synthesized
ctgtaatcccagcacttttg

SEQ ID NO: 61667 - DNA, 20 bp, Artificial Sequence
  chemically synthesized
gccttggcctccaaaagtgc

SEQ ID NO: 61668 - DNA, 20 bp, Artificial Sequence
  chemically synthesized
acctgtaatcccagcacttt

SEQ ID NO: 61669 - DNA, 20 bp, Artificial Sequence
  chemically synthesized
ccttggcctccaaaagtgct

SEQ ID NO: 61670 - DNA, 20 bp, Artificial Sequence
  chemically synthesized
ctccaaaagtgctgggatta

SEQ ID NO: 61671 - DNA, 20 bp, Artificial Sequence
  chemically synthesized
tccaaaagtgctgggattac

SEQ ID NO: 61672 - DNA, 20 bp, Artificial Sequence
  chemically synthesized
gtggctcacacctgtaatcc

SEQ ID NO: 61673 - DNA, 20 bp, Artificial Sequence
  chemically synthesized
agtgctgggattacaggtgt

SEQ ID NO: 61674 - DNA, 20 bp, Artificial Sequence
  chemically synthesized
caggtgtgagccaccacacc

SEQ ID NO: 61675 - DNA, 20 bp, Artificial Sequence
  chemically synthesized
aagaattaggccaggtgtgg

SEQ ID NO: 61676 - DNA, 20 bp, Artificial Sequence
  chemically synthesized
taaaagaattaggccaggtg

SEQ ID NO: 61677 - DNA, 20 bp, Artificial Sequence
  chemically synthesized
acatttaaaagaattaggcc

SEQ ID NO: 61678 - DNA, 20 bp, Artificial Sequence
  chemically synthesized
aacatttaaaagaattaggc

SEQ ID NO: 61679 - DNA, 20 bp, Artificial Sequence
  chemically synthesized
atataacatttaaaagaatt

SEQ ID NO: 61680 - DNA, 20 bp, Artificial Sequence
  chemically synthesized
tatataacatttaaaagaat

SEQ ID NO: 61681 - DNA, 20 bp, Artificial Sequence
  chemically synthesized
gctgattatataacatttaa

SEQ ID NO: 61682 - DNA, 20 bp, Artificial Sequence
  chemically synthesized
tcttttaaatgttatataat

SEQ ID NO: 61683 - DNA, 20 bp, Artificial Sequence
  chemically synthesized
taaatgttatataatcagct

SEQ ID NO: 61684 - DNA, 20 bp, Artificial Sequence
  chemically synthesized
aaagtccttgaggcaagact

SEQ ID NO: 61685 - DNA, 20 bp, Artificial Sequence
  chemically synthesized
aatcagcttagtcttgcctc

SEQ ID NO: 61686 - DNA, 20 bp, Artificial Sequence
  chemically synthesized
atcagcttagtcttgcctca

SEQ ID NO: 61687 - DNA, 20 bp, Artificial Sequence
  chemically synthesized
acataaaaagtccttgaggc

SEQ ID NO: 61688 - DNA, 20 bp, Artificial Sequence
  chemically synthesized
caacacataaaaagtccttg

SEQ ID NO: 61689 - DNA, 20 bp, Artificial Sequence
  chemically synthesized
gcaacacataaaaagtcctt

SEQ ID NO: 61690 - DNA, 20 bp, Artificial Sequence
  chemically synthesized
caaacagggcaacacataaa

SEQ ID NO: 61691 - DNA, 20 bp, Artificial Sequence
  chemically synthesized
tttttatgtgttgccctgtt

SEQ ID NO: 61692 - DNA, 20 bp, Artificial Sequence
  chemically synthesized
ttttatgtgttgccctgttt

SEQ ID NO: 61693 - DNA, 20 bp, Artificial Sequence
  chemically synthesized
gaggaattgtgtcccaaaca

SEQ ID NO: 61694 - DNA, 20 bp, Artificial Sequence
  chemically synthesized
tgaggaattgtgtcccaaac

SEQ ID NO: 61695 - DNA, 20 bp, Artificial Sequence
  chemically synthesized
atgaggaattgtgtcccaaa

SEQ ID NO: 61696 - DNA, 20 bp, Artificial Sequence
  chemically synthesized
gggagacccgaaagttcatg

SEQ ID NO: 61697 - DNA, 20 bp, Artificial Sequence
  chemically synthesized
agggagacccgaaagttcat

SEQ ID NO: 61698 - DNA, 20 bp, Artificial Sequence
  chemically synthesized
cacaattcctcatgaacttt

SEQ ID NO: 61699 - DNA, 20 bp, Artificial Sequence
  chemically synthesized
acaattcctcatgaactttc

SEQ ID NO: 61700 - DNA, 20 bp, Artificial Sequence
  chemically synthesized
aagtggggagggagacccga

SEQ ID NO: 61701 - DNA, 20 bp, Artificial Sequence
  chemically synthesized
acctgaaagaagtggggagg

SEQ ID NO: 61702 - DNA, 20 bp, Artificial Sequence
  chemically synthesized
agacctgaaagaagtgggga

SEQ ID NO: 61703 - DNA, 20 bp, Artificial Sequence
  chemically synthesized
aagacctgaaagaagtgggg

SEQ ID NO: 61704 - DNA, 20 bp, Artificial Sequence
  chemically synthesized
aaagacctgaaagaagtggg

SEQ ID NO: 61705 - DNA, 20 bp, Artificial Sequence
  chemically synthesized
ggaaagacctgaaagaagtg

SEQ ID NO: 61706 - DNA, 20 bp, Artificial Sequence
  chemically synthesized
aggaaagacctgaaagaagt

SEQ ID NO: 61707 - DNA, 20 bp, Artificial Sequence
  chemically synthesized
gtctccctccccacttcttt

SEQ ID NO: 61708 - DNA, 20 bp, Artificial Sequence
  chemically synthesized
gaggaaagacctgaaagaag

SEQ ID NO: 61709 - DNA, 20 bp, Artificial Sequence
  chemically synthesized
tctccctccccacttctttc

SEQ ID NO: 61710 - DNA, 20 bp, Artificial Sequence
  chemically synthesized
tttgaggaaagacctgaaag

SEQ ID NO: 61711 - DNA, 20 bp, Artificial Sequence
  chemically synthesized
acatttgaggaaagacctga

SEQ ID NO: 61712 - DNA, 20 bp, Artificial Sequence
  chemically synthesized
gaggaggtgacatttgagga

SEQ ID NO: 61713 - DNA, 20 bp, Artificial Sequence
  chemically synthesized
cactgaggaggtgacatttg

SEQ ID NO: 61714 - DNA, 20 bp, Artificial Sequence
  chemically synthesized
ccactgaggaggtgacattt

SEQ ID NO: 61715 - DNA, 20 bp, Artificial Sequence
  chemically synthesized
ttcctcaaatgtcacctcct

SEQ ID NO: 61716 - DNA, 20 bp, Artificial Sequence
  chemically synthesized
ctcaaatgtcacctcctcag

SEQ ID NO: 61717 - DNA, 20 bp, Artificial Sequence
  chemically synthesized
cagggaaggttccactgagg

SEQ ID NO: 61718 - DNA, 20 bp, Artificial Sequence
  chemically synthesized
tcagggaaggttccactgag

SEQ ID NO: 61719 - DNA, 20 bp, Artificial Sequence
  chemically synthesized
gatcagggaaggttccactg

SEQ ID NO: 61720 - DNA, 20 bp, Artificial Sequence
  chemically synthesized
tgatcagggaaggttccact

SEQ ID NO: 61721 - DNA, 20 bp, Artificial Sequence
  chemically synthesized
ttatataaggtgatcaggga

SEQ ID NO: 61722 - DNA, 20 bp, Artificial Sequence
  chemically synthesized
tttatataaggtgatcaggg

SEQ ID NO: 61723 - DNA, 20 bp, Artificial Sequence
  chemically synthesized
cattttatataaggtgatca

SEQ ID NO: 61724 - DNA, 20 bp, Artificial Sequence
  chemically synthesized
tcattttatataaggtgatc

SEQ ID NO: 61725 - DNA, 20 bp, Artificial Sequence
  chemically synthesized
gtcattttatataaggtgat

SEQ ID NO: 61726 - DNA, 20 bp, Artificial Sequence
  chemically synthesized
aggaattgtcattttatata

SEQ ID NO: 61727 - DNA, 20 bp, Artificial Sequence
  chemically synthesized
aaggaattgtcattttatat

SEQ ID NO: 61728 - DNA, 20 bp, Artificial Sequence
  chemically synthesized
gctagagagttgttcatgga

SEQ ID NO: 61729 - DNA, 20 bp, Artificial Sequence
  chemically synthesized
cgctagagagttgttcatgg

SEQ ID NO: 61730 - DNA, 20 bp, Artificial Sequence
  chemically synthesized
agacgctagagagttgttca

SEQ ID NO: 61731 - DNA, 20 bp, Artificial Sequence
  chemically synthesized
tccttccatgaacaactctc

SEQ ID NO: 61732 - DNA, 20 bp, Artificial Sequence
  chemically synthesized
aaagcaaggaagacgctaga

SEQ ID NO: 61733 - DNA, 20 bp, Artificial Sequence
  chemically synthesized
ataaagcaaggaagacgcta

SEQ ID NO: 61734 - DNA, 20 bp, Artificial Sequence
  chemically synthesized
aaataaagcaaggaagacgc

SEQ ID NO: 61735 - DNA, 20 bp, Artificial Sequence
  chemically synthesized
ttgaaataaataaagcaagg

SEQ ID NO: 61736 - DNA, 20 bp, Artificial Sequence
  chemically synthesized
atgttgaaataaataaagca

SEQ ID NO: 61737 - DNA, 20 bp, Artificial Sequence
  chemically synthesized
catgttgaaataaataaagc

SEQ ID NO: 61738 - DNA, 20 bp, Artificial Sequence
  chemically synthesized
acagcatgttgaaataaata

SEQ ID NO: 61739 - DNA, 20 bp, Artificial Sequence
  chemically synthesized
ataacaattttaaatagtga

SEQ ID NO: 61740 - DNA, 20 bp, Artificial Sequence
  chemically synthesized
tatcatataacaattttaaa

SEQ ID NO: 61741 - DNA, 20 bp, Artificial Sequence
  chemically synthesized
aaagaagaaagatgataaac

SEQ ID NO: 61742 - DNA, 20 bp, Artificial Sequence
  chemically synthesized
aaaccgaaaaacaaagaaga

SEQ ID NO: 61743 - DNA, 20 bp, Artificial Sequence
  chemically synthesized
aaaaaaaccgaaaaacaaag

SEQ ID NO: 61744 - DNA, 20 bp, Artificial Sequence
  chemically synthesized
catctttcttctttgttttt

SEQ ID NO: 61745 - DNA, 20 bp, Artificial Sequence
  chemically synthesized
aaaaaaaaaaccgaaaaaca

SEQ ID NO: 61746 - DNA, 20 bp, Artificial Sequence
  chemically synthesized
tttcggtttttttttttttt

SEQ ID NO: 61747 - DNA, 20 bp, Artificial Sequence
  chemically synthesized
ggttttttttttttttgaga

SEQ ID NO: 61748 - DNA, 20 bp, Artificial Sequence
  chemically synthesized
ttttgagatggaatcttgct

SEQ ID NO: 61749 - DNA, 20 bp, Artificial Sequence
  chemically synthesized
tccagcctgggtgactgagc

SEQ ID NO: 61750 - DNA, 20 bp, Artificial Sequence
  chemically synthesized
tggaatcttgctcagtcacc

SEQ ID NO: 61751 - DNA, 20 bp, Artificial Sequence
  chemically synthesized
gcactccagcctgggtgact

SEQ ID NO: 61752 - DNA, 20 bp, Artificial Sequence
  chemically synthesized
ggaatcttgctcagtcaccc

SEQ ID NO: 61753 - DNA, 20 bp, Artificial Sequence
  chemically synthesized
tcttgctcagtcacccaggc

SEQ ID NO: 61754 - DNA, 20 bp, Artificial Sequence
  chemically synthesized
ttgctcagtcacccaggctg

SEQ ID NO: 61755 - DNA, 20 bp, Artificial Sequence
  chemically synthesized
gtgccactgcactccagcct

SEQ ID NO: 61756 - DNA, 20 bp, Artificial Sequence
  chemically synthesized
cgtgccactgcactccagcc

SEQ ID NO: 61757 - DNA, 20 bp, Artificial Sequence
  chemically synthesized
cagtcacccaggctggagtg

SEQ ID NO: 61758 - DNA, 20 bp, Artificial Sequence
  chemically synthesized
gagatcgtgccactgcactc

SEQ ID NO: 61759 - DNA, 20 bp, Artificial Sequence
  chemically synthesized
tcacccaggctggagtgcag

SEQ ID NO: 61760 - DNA, 20 bp, Artificial Sequence
  chemically synthesized
ggagtgcagtggcacgatct

SEQ ID NO: 61761 - DNA, 20 bp, Artificial Sequence
  chemically synthesized
gctggagattgcagtgagcc

SEQ ID NO: 61762 - DNA, 20 bp, Artificial Sequence
  chemically synthesized
tgggagctggagattgcagt

SEQ ID NO: 61763 - DNA, 20 bp, Artificial Sequence
  chemically synthesized
tctcggctcactgcaatctc

SEQ ID NO: 61764 - DNA, 20 bp, Artificial Sequence
  chemically synthesized
aacctgggagctggagattg

SEQ ID NO: 61765 - DNA, 20 bp, Artificial Sequence
  chemically synthesized
tcactgcaatctccagctcc

SEQ ID NO: 61766 - DNA, 20 bp, Artificial Sequence
  chemically synthesized
tggcatgaacctgggagctg

SEQ ID NO: 61767 - DNA, 20 bp, Artificial Sequence
  chemically synthesized
cactgcaatctccagctccc

SEQ ID NO: 61768 - DNA, 20 bp, Artificial Sequence
  chemically synthesized
aatggcatgaacctgggagc

SEQ ID NO: 61769 - DNA, 20 bp, Artificial Sequence
  chemically synthesized
ggagaatggcatgaacctgg

SEQ ID NO: 61770 - DNA, 20 bp, Artificial Sequence
  chemically synthesized
caggagaatggcatgaacct

SEQ ID NO: 61771 - DNA, 20 bp, Artificial Sequence
  chemically synthesized
gcaggagaatggcatgaacc

SEQ ID NO: 61772 - DNA, 20 bp, Artificial Sequence
  chemically synthesized
gggaggctgaggcaggagaa

SEQ ID NO: 61773 - DNA, 20 bp, Artificial Sequence
  chemically synthesized
ttcatgccattctcctgcct

SEQ ID NO: 61774 - DNA, 20 bp, Artificial Sequence
  chemically synthesized
tactcgggaggctgaggcag

SEQ ID NO: 61775 - DNA, 20 bp, Artificial Sequence
  chemically synthesized
gctactcgggaggctgaggc

SEQ ID NO: 61776 - DNA, 20 bp, Artificial Sequence
  chemically synthesized
agctactcgggaggctgagg

SEQ ID NO: 61777 - DNA, 20 bp, Artificial Sequence
  chemically synthesized
cccagctactcgggaggctg

SEQ ID NO: 61778 - DNA, 20 bp, Artificial Sequence
  chemically synthesized
tcccagctactcgggaggct

SEQ ID NO: 61779 - DNA, 20 bp, Artificial Sequence
  chemically synthesized
ttctcctgcctcagcctccc

SEQ ID NO: 61780 - DNA, 20 bp, Artificial Sequence
  chemically synthesized
tcctgcctcagcctcccgag

SEQ ID NO: 61781 - DNA, 20 bp, Artificial Sequence
  chemically synthesized
tgtagtcccagctactcggg

SEQ ID NO: 61782 - DNA, 20 bp, Artificial Sequence
  chemically synthesized
ctgtagtcccagctactcgg

SEQ ID NO: 61783 - DNA, 20 bp, Artificial Sequence
  chemically synthesized
gcctcagcctcccgagtagc

SEQ ID NO: 61784 - DNA, 20 bp, Artificial Sequence
  chemically synthesized
acctgtagtcccagctactc

SEQ ID NO: 61785 - DNA, 20 bp, Artificial Sequence
  chemically synthesized
cctcagcctcccgagtagct

SEQ ID NO: 61786 - DNA, 20 bp, Artificial Sequence
  chemically synthesized
cacctgtagtcccagctact

SEQ ID NO: 61787 - DNA, 20 bp, Artificial Sequence
  chemically synthesized
ctcccgagtagctgggacta

SEQ ID NO: 61788 - DNA, 20 bp, Artificial Sequence
  chemically synthesized
tcccgagtagctgggactac

SEQ ID NO: 61789 - DNA, 20 bp, Artificial Sequence
  chemically synthesized
gtggtgggcacctgtagtcc

SEQ ID NO: 61790 - DNA, 20 bp, Artificial Sequence
  chemically synthesized
ggcttggtggtgggcacctg

SEQ ID NO: 61791 - DNA, 20 bp, Artificial Sequence
  chemically synthesized
gactacaggtgcccaccacc

SEQ ID NO: 61792 - DNA, 20 bp, Artificial Sequence
  chemically synthesized
aattagccgggcttggtggt

SEQ ID NO: 61793 - DNA, 20 bp, Artificial Sequence
  chemically synthesized
aaattagccgggcttggtgg

SEQ ID NO: 61794 - DNA, 20 bp, Artificial Sequence
  chemically synthesized
caggtgcccaccaccaagcc

SEQ ID NO: 61795 - DNA, 20 bp, Artificial Sequence
  chemically synthesized
aaaaaattagccgggcttgg

SEQ ID NO: 61796 - DNA, 20 bp, Artificial Sequence
  chemically synthesized
aaaaaaaaattagccgggct

SEQ ID NO: 61797 - DNA, 20 bp, Artificial Sequence
  chemically synthesized
atacaaaaaaaaaattagcc

SEQ ID NO: 61798 - DNA, 20 bp, Artificial Sequence
  chemically synthesized
aatacaaaaaaaaaattagc

SEQ ID NO: 61799 - DNA, 20 bp, Artificial Sequence
  chemically synthesized
taaaaatacaaaaaaaaaat

SEQ ID NO: 61800 - DNA, 20 bp, Artificial Sequence
  chemically synthesized
taattttttttttgtatttt

SEQ ID NO: 61801 - DNA, 20 bp, Artificial Sequence
  chemically synthesized
ttttttttttgtatttttag

SEQ ID NO: 61802 - DNA, 20 bp, Artificial Sequence
  chemically synthesized
ttttttttgtatttttagta

SEQ ID NO: 61803 - DNA, 20 bp, Artificial Sequence
  chemically synthesized
ttttgtatttttagtagaga

SEQ ID NO: 61804 - DNA, 20 bp, Artificial Sequence
  chemically synthesized
ttgtatttttagtagagacg

SEQ ID NO: 61805 - DNA, 20 bp, Artificial Sequence
  chemically synthesized
gagacggagtttcaccatgt

SEQ ID NO: 61806 - DNA, 20 bp, Artificial Sequence
  chemically synthesized
cggagtttcaccatgttagc

SEQ ID NO: 61807 - DNA, 20 bp, Artificial Sequence
  chemically synthesized
cgagaccgtcctggctaaca

SEQ ID NO: 61808 - DNA, 20 bp, Artificial Sequence
  chemically synthesized
ggagtttcaccatgttagcc

SEQ ID NO: 61809 - DNA, 20 bp, Artificial Sequence
  chemically synthesized
tttcaccatgttagccagga

SEQ ID NO: 61810 - DNA, 20 bp, Artificial Sequence
  chemically synthesized
tcaggagatcgagaccgtcc

SEQ ID NO: 61811 - DNA, 20 bp, Artificial Sequence
  chemically synthesized
gatcacgaggtcaggagatc

SEQ ID NO: 61812 - DNA, 20 bp, Artificial Sequence
  chemically synthesized
cgggtggatcacgaggtcag

SEQ ID NO: 61813 - DNA, 20 bp, Artificial Sequence
  chemically synthesized
ggcgggtggatcacgaggtc

SEQ ID NO: 61814 - DNA, 20 bp, Artificial Sequence
  chemically synthesized
aggcgggtggatcacgaggt

SEQ ID NO: 61815 - DNA, 20 bp, Artificial Sequence
  chemically synthesized
gccaaggcgggtggatcacg

SEQ ID NO: 61816 - DNA, 20 bp, Artificial Sequence
  chemically synthesized
ggccaaggcgggtggatcac

SEQ ID NO: 61817 - DNA, 20 bp, Artificial Sequence
  chemically synthesized
acctcgtgatccacccgcct

SEQ ID NO: 61818 - DNA, 20 bp, Artificial Sequence
  chemically synthesized
ctttgggaggccaaggcggg

SEQ ID NO: 61819 - DNA, 20 bp, Artificial Sequence
  chemically synthesized
gcactttgggaggccaaggc

SEQ ID NO: 61820 - DNA, 20 bp, Artificial Sequence
  chemically synthesized
agcactttgggaggccaagg

SEQ ID NO: 61821 - DNA, 20 bp, Artificial Sequence
  chemically synthesized
ctcagcactttgggaggcca

SEQ ID NO: 61822 - DNA, 20 bp, Artificial Sequence
  chemically synthesized
tctcagcactttgggaggcc

SEQ ID NO: 61823 - DNA, 20 bp, Artificial Sequence
  chemically synthesized
ccacccgccttggcctccca

SEQ ID NO: 61824 - DNA, 20 bp, Artificial Sequence
  chemically synthesized
tgtaatctcagcactttggg

SEQ ID NO: 61825 - DNA, 20 bp, Artificial Sequence
  chemically synthesized
ctgtaatctcagcactttgg

SEQ ID NO: 61826 - DNA, 20 bp, Artificial Sequence
  chemically synthesized
tcctgtaatctcagcacttt

SEQ ID NO: 61827 - DNA, 20 bp, Artificial Sequence
  chemically synthesized
ccttggcctcccaaagtgct

SEQ ID NO: 61828 - DNA, 20 bp, Artificial Sequence
  chemically synthesized
ctcctgtaatctcagcactt

SEQ ID NO: 61829 - DNA, 20 bp, Artificial Sequence
  chemically synthesized
ctcccaaagtgctgagatta

SEQ ID NO: 61830 - DNA, 20 bp, Artificial Sequence
  chemically synthesized
tcccaaagtgctgagattac

SEQ ID NO: 61831 - DNA, 20 bp, Artificial Sequence
  chemically synthesized
gtggctcactcctgtaatct

SEQ ID NO: 61832 - DNA, 20 bp, Artificial Sequence
  chemically synthesized
ccaaagtgctgagattacag

SEQ ID NO: 61833 - DNA, 20 bp, Artificial Sequence
  chemically synthesized
agtgctgagattacaggagt

SEQ ID NO: 61834 - DNA, 20 bp, Artificial Sequence
  chemically synthesized
caggagtgagccaccacgcc

SEQ ID NO: 61835 - DNA, 20 bp, Artificial Sequence
  chemically synthesized
agatgataggccgggcgtgg

SEQ ID NO: 61836 - DNA, 20 bp, Artificial Sequence
  chemically synthesized
gacagatgataggccgggcg

SEQ ID NO: 61837 - DNA, 20 bp, Artificial Sequence
  chemically synthesized
aagaagacagatgataggcc

SEQ ID NO: 61838 - DNA, 20 bp, Artificial Sequence
  chemically synthesized
aaagaagacagatgataggc

SEQ ID NO: 61839 - DNA, 20 bp, Artificial Sequence
  chemically synthesized
ttgtaaagaagacagatgat

SEQ ID NO: 61840 - DNA, 20 bp, Artificial Sequence
  chemically synthesized
cttgtaaagaagacagatga

SEQ ID NO: 61841 - DNA, 20 bp, Artificial Sequence
  chemically synthesized
ttacattcttgtaaagaaga

SEQ ID NO: 61842 - DNA, 20 bp, Artificial Sequence
  chemically synthesized
ctatcatctgtcttctttac

SEQ ID NO: 61843 - DNA, 20 bp, Artificial Sequence
  chemically synthesized
gagcttacattcttgtaaag

SEQ ID NO: 61844 - DNA, 20 bp, Artificial Sequence
  chemically synthesized
ggagagcttacattcttgta

SEQ ID NO: 61845 - DNA, 20 bp, Artificial Sequence
  chemically synthesized
tgtcttctttacaagaatgt

SEQ ID NO: 61846 - DNA, 20 bp, Artificial Sequence
  chemically synthesized
acaagaatgtaagctctcct

SEQ ID NO: 61847 - DNA, 20 bp, Artificial Sequence
  chemically synthesized
caagaatgtaagctctcctg

SEQ ID NO: 61848 - DNA, 20 bp, Artificial Sequence
  chemically synthesized
aagaatgtaagctctcctga

SEQ ID NO: 61849 - DNA, 20 bp, Artificial Sequence
  chemically synthesized
caaaacccctgccctcagga

SEQ ID NO: 61850 - DNA, 20 bp, Artificial Sequence
  chemically synthesized
aatgtaagctctcctgaggg

SEQ ID NO: 61851 - DNA, 20 bp, Artificial Sequence
  chemically synthesized
gacaaaacccctgccctcag

SEQ ID NO: 61852 - DNA, 20 bp, Artificial Sequence
  chemically synthesized
atgtaagctctcctgagggc

SEQ ID NO: 61853 - DNA, 20 bp, Artificial Sequence
  chemically synthesized
tgtaagctctcctgagggca

SEQ ID NO: 61854 - DNA, 20 bp, Artificial Sequence
  chemically synthesized
aagacaaaacccctgccctc

SEQ ID NO: 61855 - DNA, 20 bp, Artificial Sequence
  chemically synthesized
gtaagctctcctgagggcag

SEQ ID NO: 61856 - DNA, 20 bp, Artificial Sequence
  chemically synthesized
caagacaaaacccctgccct

SEQ ID NO: 61857 - DNA, 20 bp, Artificial Sequence
  chemically synthesized
ttgataataaagcagcaaac

SEQ ID NO: 61858 - DNA, 20 bp, Artificial Sequence
  chemically synthesized
tttaggtattgataataaag

SEQ ID NO: 61859 - DNA, 20 bp, Artificial Sequence
  chemically synthesized
cattttaggtattgataata

SEQ ID NO: 61860 - DNA, 20 bp, Artificial Sequence
  chemically synthesized
tttattatcaatacctaaaa

SEQ ID NO: 61861 - DNA, 20 bp, Artificial Sequence
  chemically synthesized
tatatgccaggcgccatttt

SEQ ID NO: 61862 - DNA, 20 bp, Artificial Sequence
  chemically synthesized
ttatatgccaggcgccattt

SEQ ID NO: 61863 - DNA, 20 bp, Artificial Sequence
  chemically synthesized
tcaatacctaaaatggcgcc

SEQ ID NO: 61864 - DNA, 20 bp, Artificial Sequence
  chemically synthesized
ttgtgggtctgttatatgcc

SEQ ID NO: 61865 - DNA, 20 bp, Artificial Sequence
  chemically synthesized
attgtgggtctgttatatgc

SEQ ID NO: 61866 - DNA, 20 bp, Artificial Sequence
  chemically synthesized
aaatggcgcctggcatataa

SEQ ID NO: 61867 - DNA, 20 bp, Artificial Sequence
  chemically synthesized
ggcatataacagacccacaa

SEQ ID NO: 61868 - DNA, 20 bp, Artificial Sequence
  chemically synthesized
attcaattaatatctattgt

SEQ ID NO: 61869 - DNA, 20 bp, Artificial Sequence
  chemically synthesized
cattcaattaatatctattg

SEQ ID NO: 61870 - DNA, 20 bp, Artificial Sequence
  chemically synthesized
tagatattaattgaatgact

SEQ ID NO: 61871 - DNA, 20 bp, Artificial Sequence
  chemically synthesized
taggagtttaaatattcact

SEQ ID NO: 61872 - DNA, 20 bp, Artificial Sequence
  chemically synthesized
taagtgaatatttaaactcc

SEQ ID NO: 61873 - DNA, 20 bp, Artificial Sequence
  chemically synthesized
cctgaagactttttagctag

SEQ ID NO: 61874 - DNA, 20 bp, Artificial Sequence
  chemically synthesized
tatttaaactcctagctaaa

SEQ ID NO: 61875 - DNA, 20 bp, Artificial Sequence
  chemically synthesized
accctgaagactttttagct

SEQ ID NO: 61876 - DNA, 20 bp, Artificial Sequence
  chemically synthesized
aaccctgaagactttttagc

SEQ ID NO: 61877 - DNA, 20 bp, Artificial Sequence
  chemically synthesized
aagaaaccctgaagactttt

SEQ ID NO: 61878 - DNA, 20 bp, Artificial Sequence
  chemically synthesized
actcctagctaaaaagtctt

SEQ ID NO: 61879 - DNA, 20 bp, Artificial Sequence
  chemically synthesized
ctcctagctaaaaagtcttc

SEQ ID NO: 61880 - DNA, 20 bp, Artificial Sequence
  chemically synthesized
tcctagctaaaaagtcttca

SEQ ID NO: 61881 - DNA, 20 bp, Artificial Sequence
  chemically synthesized
attacacctaagaaaccctg

SEQ ID NO: 61882 - DNA, 20 bp, Artificial Sequence
  chemically synthesized
aaaaagtcttcagggtttct

SEQ ID NO: 61883 - DNA, 20 bp, Artificial Sequence
  chemically synthesized
aaaagtcttcagggtttctt

SEQ ID NO: 61884 - DNA, 20 bp, Artificial Sequence
  chemically synthesized
tgttaaaccagattacacct

SEQ ID NO: 61885 - DNA, 20 bp, Artificial Sequence
  chemically synthesized
agggtttcttaggtgtaatc

SEQ ID NO: 61886 - DNA, 20 bp, Artificial Sequence
  chemically synthesized
ctcaacttggtgtgttaaac

SEQ ID NO: 61887 - DNA, 20 bp, Artificial Sequence
  chemically synthesized
gtaatctggtttaacacacc

SEQ ID NO: 61888 - DNA, 20 bp, Artificial Sequence
  chemically synthesized
ctggtttaacacaccaagtt

SEQ ID NO: 61889 - DNA, 20 bp, Artificial Sequence
  chemically synthesized
taattctgtgattctcaact

SEQ ID NO: 61890 - DNA, 20 bp, Artificial Sequence
  chemically synthesized
acacaccaagttgagaatca

SEQ ID NO: 61891 - DNA, 20 bp, Artificial Sequence
  chemically synthesized
gttgagaatcacagaattat

SEQ ID NO: 61892 - DNA, 20 bp, Artificial Sequence
  chemically synthesized
acagaattattagataatta

SEQ ID NO: 61893 - DNA, 20 bp, Artificial Sequence
  chemically synthesized
ttagataattaaagcgaaaa

SEQ ID NO: 61894 - DNA, 20 bp, Artificial Sequence
  chemically synthesized
ttaaagcgaaaaaagacatt

SEQ ID NO: 61895 - DNA, 20 bp, Artificial Sequence
  chemically synthesized
aaaaagacattaagtttacc

SEQ ID NO: 61896 - DNA, 20 bp, Artificial Sequence
  chemically synthesized
tcaaaatgaggtattgagct

SEQ ID NO: 61897 - DNA, 20 bp, Artificial Sequence
  chemically synthesized
ttcaaaatgaggtattgagc

SEQ ID NO: 61898 - DNA, 20 bp, Artificial Sequence
  chemically synthesized
tgtcttcaaaatgaggtatt

SEQ ID NO: 61899 - DNA, 20 bp, Artificial Sequence
  chemically synthesized
tagctcaatacctcattttg

SEQ ID NO: 61900 - DNA, 20 bp, Artificial Sequence
  chemically synthesized
ctttttctgtcttcaaaatg

SEQ ID NO: 61901 - DNA, 20 bp, Artificial Sequence
  chemically synthesized
actttttctgtcttcaaaat

SEQ ID NO: 61902 - DNA, 20 bp, Artificial Sequence
  chemically synthesized
tcaatacctcattttgaaga

SEQ ID NO: 61903 - DNA, 20 bp, Artificial Sequence
  chemically synthesized
cctcattttgaagacagaaa

SEQ ID NO: 61904 - DNA, 20 bp, Artificial Sequence
  chemically synthesized
tttgaagacagaaaaagtga

SEQ ID NO: 61905 - DNA, 20 bp, Artificial Sequence
  chemically synthesized
agaaaaagtgaaagtcaaaa

SEQ ID NO: 61906 - DNA, 20 bp, Artificial Sequence
  chemically synthesized
gaaagtcaaaatggttaaat

SEQ ID NO: 61907 - DNA, 20 bp, Artificial Sequence
  chemically synthesized
aaagtcaaaatggttaaatg

SEQ ID NO: 61908 - DNA, 20 bp, Artificial Sequence
  chemically synthesized
tcaaaatggttaaatgaggc

SEQ ID NO: 61909 - DNA, 20 bp, Artificial Sequence
  chemically synthesized
caaaatggttaaatgaggcc

SEQ ID NO: 61910 - DNA, 20 bp, Artificial Sequence
  chemically synthesized
aaatggttaaatgaggccag

SEQ ID NO: 61911 - DNA, 20 bp, Artificial Sequence
  chemically synthesized
tggttaaatgaggccaggag

SEQ ID NO: 61912 - DNA, 20 bp, Artificial Sequence
  chemically synthesized
ttaaatgaggccaggagcgg

SEQ ID NO: 61913 - DNA, 20 bp, Artificial Sequence
  chemically synthesized
caggcatgagccaccgctcc

SEQ ID NO: 61914 - DNA, 20 bp, Artificial Sequence
  chemically synthesized
agtgctgggattacaggcat

SEQ ID NO: 61915 - DNA, 20 bp, Artificial Sequence
  chemically synthesized
gtggctcatgcctgtaatcc

SEQ ID NO: 61916 - DNA, 20 bp, Artificial Sequence
  chemically synthesized
tcctaaagtgctgggattac

SEQ ID NO: 61917 - DNA, 20 bp, Artificial Sequence
  chemically synthesized
ctcctaaagtgctgggatta

SEQ ID NO: 61918 - DNA, 20 bp, Artificial Sequence
  chemically synthesized
tgcctgtaatcccagcactt

SEQ ID NO: 61919 - DNA, 20 bp, Artificial Sequence
  chemically synthesized
ccttggcctcctaaagtgct

SEQ ID NO: 61920 - DNA, 20 bp, Artificial Sequence
  chemically synthesized
gcctgtaatcccagcacttt

SEQ ID NO: 61921 - DNA, 20 bp, Artificial Sequence
  chemically synthesized
accttggcctcctaaagtgc

SEQ ID NO: 61922 - DNA, 20 bp, Artificial Sequence
  chemically synthesized
ctgtaatcccagcactttag

SEQ ID NO: 61923 - DNA, 20 bp, Artificial Sequence
  chemically synthesized
tgtaatcccagcactttagg

SEQ ID NO: 61924 - DNA, 20 bp, Artificial Sequence
  chemically synthesized
ccgcccaccttggcctccta

SEQ ID NO: 61925 - DNA, 20 bp, Artificial Sequence
  chemically synthesized
tcccagcactttaggaggcc

SEQ ID NO: 61926 - DNA, 20 bp, Artificial Sequence
  chemically synthesized
cccagcactttaggaggcca

SEQ ID NO: 61927 - DNA, 20 bp, Artificial Sequence
  chemically synthesized
agcactttaggaggccaagg

SEQ ID NO: 61928 - DNA, 20 bp, Artificial Sequence
  chemically synthesized
gcactttaggaggccaaggt

SEQ ID NO: 61929 - DNA, 20 bp, Artificial Sequence
  chemically synthesized
ctttaggaggccaaggtggg

SEQ ID NO: 61930 - DNA, 20 bp, Artificial Sequence
  chemically synthesized
ctcaggtgatccgcccacct

SEQ ID NO: 61931 - DNA, 20 bp, Artificial Sequence
  chemically synthesized
ccaaggtgggcggatcacct

SEQ ID NO: 61932 - DNA, 20 bp, Artificial Sequence
  chemically synthesized
caaggtgggcggatcacctg

SEQ ID NO: 61933 - DNA, 20 bp, Artificial Sequence
  chemically synthesized
gtgggcggatcacctgaggt

SEQ ID NO: 61934 - DNA, 20 bp, Artificial Sequence
  chemically synthesized
tgggcggatcacctgaggtc

SEQ ID NO: 61935 - DNA, 20 bp, Artificial Sequence
  chemically synthesized
ggtctcaaactcctgacctc

SEQ ID NO: 61936 - DNA, 20 bp, Artificial Sequence
  chemically synthesized
ggcggatcacctgaggtcag

SEQ ID NO: 61937 - DNA, 20 bp, Artificial Sequence
  chemically synthesized
tggtctcaaactcctgacct

SEQ ID NO: 61938 - DNA, 20 bp, Artificial Sequence
  chemically synthesized
tcacctgaggtcaggagttt

SEQ ID NO: 61939 - DNA, 20 bp, Artificial Sequence
  chemically synthesized
tgaggtcaggagtttgagac

SEQ ID NO: 61940 - DNA, 20 bp, Artificial Sequence
  chemically synthesized
ttttgccatgttggtcaggc

SEQ ID NO: 61941 - DNA, 20 bp, Artificial Sequence
  chemically synthesized
gggattttgccatgttggtc

SEQ ID NO: 61942 - DNA, 20 bp, Artificial Sequence
  chemically synthesized
tgagaccagcctgaccaaca

SEQ ID NO: 61943 - DNA, 20 bp, Artificial Sequence
  chemically synthesized
cgggattttgccatgttggt

SEQ ID NO: 61944 - DNA, 20 bp, Artificial Sequence
  chemically synthesized
gagacgggattttgccatgt

SEQ ID NO: 61945 - DNA, 20 bp, Artificial Sequence
  chemically synthesized
tttgtatttttagtagagac

SEQ ID NO: 61946 - DNA, 20 bp, Artificial Sequence
  chemically synthesized
ttttgtatttttagtagaga

SEQ ID NO: 61947 - DNA, 20 bp, Artificial Sequence
  chemically synthesized
taatttttgtatttttagta

SEQ ID NO: 61948 - DNA, 20 bp, Artificial Sequence
  chemically synthesized
gctaatttttgtatttttag

SEQ ID NO: 61949 - DNA, 20 bp, Artificial Sequence
  chemically synthesized
ctggctaatttttgtatttt

SEQ ID NO: 61950 - DNA, 20 bp, Artificial Sequence
  chemically synthesized
tctactaaaaatacaaaaat

SEQ ID NO: 61951 - DNA, 20 bp, Artificial Sequence
  chemically synthesized
ctaaaaatacaaaaattagc

SEQ ID NO: 61952 - DNA, 20 bp, Artificial Sequence
  chemically synthesized
taaaaatacaaaaattagcc

SEQ ID NO: 61953 - DNA, 20 bp, Artificial Sequence
  chemically synthesized
atacaaaaattagccaggca

SEQ ID NO: 61954 - DNA, 20 bp, Artificial Sequence
  chemically synthesized
caaaaattagccaggcatgg

SEQ ID NO: 61955 - DNA, 20 bp, Artificial Sequence
  chemically synthesized
caagtgcctgccaccatgcc

SEQ ID NO: 61956 - DNA, 20 bp, Artificial Sequence
  chemically synthesized
aaattagccaggcatggtgg

SEQ ID NO: 61957 - DNA, 20 bp, Artificial Sequence
  chemically synthesized
aattagccaggcatggtggc

SEQ ID NO: 61958 - DNA, 20 bp, Artificial Sequence
  chemically synthesized
gtggcaggcacttgtaatcc

SEQ ID NO: 61959 - DNA, 20 bp, Artificial Sequence
  chemically synthesized
tcccaagcagctgggattac

SEQ ID NO: 61960 - DNA, 20 bp, Artificial Sequence
  chemically synthesized
cacttgtaatcccagctgct

SEQ ID NO: 61961 - DNA, 20 bp, Artificial Sequence
  chemically synthesized
cctcagcctcccaagcagct

SEQ ID NO: 61962 - DNA, 20 bp, Artificial Sequence
  chemically synthesized
acttgtaatcccagctgctt

SEQ ID NO: 61963 - DNA, 20 bp, Artificial Sequence
  chemically synthesized
gcctcagcctcccaagcagc

SEQ ID NO: 61964 - DNA, 20 bp, Artificial Sequence
  chemically synthesized
ttgtaatcccagctgcttgg

SEQ ID NO: 61965 - DNA, 20 bp, Artificial Sequence
  chemically synthesized
tgtaatcccagctgcttggg

SEQ ID NO: 61966 - DNA, 20 bp, Artificial Sequence
  chemically synthesized
tcctgcctcagcctcccaag

SEQ ID NO: 61967 - DNA, 20 bp, Artificial Sequence
  chemically synthesized
ttctcctgcctcagcctccc

SEQ ID NO: 61968 - DNA, 20 bp, Artificial Sequence
  chemically synthesized
tcccagctgcttgggaggct

SEQ ID NO: 61969 - DNA, 20 bp, Artificial Sequence
  chemically synthesized
cccagctgcttgggaggctg

SEQ ID NO: 61970 - DNA, 20 bp, Artificial Sequence
  chemically synthesized
agctgcttgggaggctgagg

SEQ ID NO: 61971 - DNA, 20 bp, Artificial Sequence
  chemically synthesized
gctgcttgggaggctgaggc

SEQ ID NO: 61972 - DNA, 20 bp, Artificial Sequence
  chemically synthesized
tgcttgggaggctgaggcag

SEQ ID NO: 61973 - DNA, 20 bp, Artificial Sequence
  chemically synthesized
ttcaagcaattctcctgcct

SEQ ID NO: 61974 - DNA, 20 bp, Artificial Sequence
  chemically synthesized
aacctccacctcacgggttc

SEQ ID NO: 61975 - DNA, 20 bp, Artificial Sequence
  chemically synthesized
ggagaattgcttgaacccgt

SEQ ID NO: 61976 - DNA, 20 bp, Artificial Sequence
  chemically synthesized
gagaattgcttgaacccgtg

SEQ ID NO: 61977 - DNA, 20 bp, Artificial Sequence
  chemically synthesized
aattgcttgaacccgtgagg

SEQ ID NO: 61978 - DNA, 20 bp, Artificial Sequence
  chemically synthesized
cactgcaacctccacctcac

SEQ ID NO: 61979 - DNA, 20 bp, Artificial Sequence
  chemically synthesized
ttgcttgaacccgtgaggtg

SEQ ID NO: 61980 - DNA, 20 bp, Artificial Sequence
  chemically synthesized
tcactgcaacctccacctca

SEQ ID NO: 61981 - DNA, 20 bp, Artificial Sequence
  chemically synthesized
tgcttgaacccgtgaggtgg

SEQ ID NO: 61982 - DNA, 20 bp, Artificial Sequence
  chemically synthesized
aacccgtgaggtggaggttg

SEQ ID NO: 61983 - DNA, 20 bp, Artificial Sequence
  chemically synthesized
cgtgaggtggaggttgcagt

SEQ ID NO: 61984 - DNA, 20 bp, Artificial Sequence
  chemically synthesized
ggtggaggttgcagtgagcc

SEQ ID NO: 61985 - DNA, 20 bp, Artificial Sequence
  chemically synthesized
ggagtgcagtggcgtgatct

SEQ ID NO: 61986 - DNA, 20 bp, Artificial Sequence
  chemically synthesized
tcacccaggctggagtgcag

SEQ ID NO: 61987 - DNA, 20 bp, Artificial Sequence
  chemically synthesized
aagatcacgccactgcactc

SEQ ID NO: 61988 - DNA, 20 bp, Artificial Sequence
  chemically synthesized
ctgtcacccaggctggagtg

SEQ ID NO: 61989 - DNA, 20 bp, Artificial Sequence
  chemically synthesized
cacgccactgcactccagcc

SEQ ID NO: 61990 - DNA, 20 bp, Artificial Sequence
  chemically synthesized
acgccactgcactccagcct

SEQ ID NO: 61991 - DNA, 20 bp, Artificial Sequence
  chemically synthesized
tcactctgtcacccaggctg

SEQ ID NO: 61992 - DNA, 20 bp, Artificial Sequence
  chemically synthesized
tctcactctgtcacccaggc

SEQ ID NO: 61993 - DNA, 20 bp, Artificial Sequence
  chemically synthesized
ctgcactccagcctgggtga

SEQ ID NO: 61994 - DNA, 20 bp, Artificial Sequence
  chemically synthesized
ggagtctcactctgtcaccc

SEQ ID NO: 61995 - DNA, 20 bp, Artificial Sequence
  chemically synthesized
gcactccagcctgggtgaca

SEQ ID NO: 61996 - DNA, 20 bp, Artificial Sequence
  chemically synthesized
cggagtctcactctgtcacc

SEQ ID NO: 61997 - DNA, 20 bp, Artificial Sequence
  chemically synthesized
tccagcctgggtgacagagt

SEQ ID NO: 61998 - DNA, 20 bp, Artificial Sequence
  chemically synthesized
ttgttttgttttttgagacg

SEQ ID NO: 61999 - DNA, 20 bp, Artificial Sequence
  chemically synthesized
ttttgttttgttttttgaga

SEQ ID NO: 62000 - DNA, 20 bp, Artificial Sequence
  chemically synthesized
tttgttttgttttgtttttt

SEQ ID NO: 62001 - DNA, 20 bp, Artificial Sequence
  chemically synthesized
caatggtctcaaatgttttt

SEQ ID NO: 62002 - DNA, 20 bp, Artificial Sequence
  chemically synthesized
aacaaaaccaaaaaacattt

SEQ ID NO: 62003 - DNA, 20 bp, Artificial Sequence
  chemically synthesized
caaaaaacatttgagaccat

SEQ ID NO: 62004 - DNA, 20 bp, Artificial Sequence
  chemically synthesized
aaaacatttgagaccattgg

SEQ ID NO: 62005 - DNA, 20 bp, Artificial Sequence
  chemically synthesized
aacatttgagaccattggaa

SEQ ID NO: 62006 - DNA, 20 bp, Artificial Sequence
  chemically synthesized
ctgagattcagctcttccaa

SEQ ID NO: 62007 - DNA, 20 bp, Artificial Sequence
  chemically synthesized
ccattggaagagctgaatct

SEQ ID NO: 62008 - DNA, 20 bp, Artificial Sequence
  chemically synthesized
cctaataggatgctgagatt

SEQ ID NO: 62009 - DNA, 20 bp, Artificial Sequence
  chemically synthesized
acttttcctaataggatgct

SEQ ID NO: 62010 - DNA, 20 bp, Artificial Sequence
  chemically synthesized
gctgaatctcagcatcctat

SEQ ID NO: 62011 - DNA, 20 bp, Artificial Sequence
  chemically synthesized
ctgaatctcagcatcctatt

SEQ ID NO: 62012 - DNA, 20 bp, Artificial Sequence
  chemically synthesized
taagtttaacttttcctaat

SEQ ID NO: 62013 - DNA, 20 bp, Artificial Sequence
  chemically synthesized
tctcagcatcctattaggaa

SEQ ID NO: 62014 - DNA, 20 bp, Artificial Sequence
  chemically synthesized
gtaagtttaacttttcctaa

SEQ ID NO: 62015 - DNA, 20 bp, Artificial Sequence
  chemically synthesized
attaggaaaagttaaactta

SEQ ID NO: 62016 - DNA, 20 bp, Artificial Sequence
  chemically synthesized
tacttttgcaaattttctgt

SEQ ID NO: 62017 - DNA, 20 bp, Artificial Sequence
  chemically synthesized
aacttacagaaaatttgcaa

SEQ ID NO: 62018 - DNA, 20 bp, Artificial Sequence
  chemically synthesized
ttacagaaaatttgcaaaag

SEQ ID NO: 62019 - DNA, 20 bp, Artificial Sequence
  chemically synthesized
gaaaatttgcaaaagtagta

SEQ ID NO: 62020 - DNA, 20 bp, Artificial Sequence
  chemically synthesized
atttgcaaaagtagtataga

SEQ ID NO: 62021 - DNA, 20 bp, Artificial Sequence
  chemically synthesized
aagttggacaaattgtatat

SEQ ID NO: 62022 - DNA, 20 bp, Artificial Sequence
  chemically synthesized
gaagttggacaaattgtata

SEQ ID NO: 62023 - DNA, 20 bp, Artificial Sequence
  chemically synthesized
tagtaaaagaagttggaagt

SEQ ID NO: 62024 - DNA, 20 bp, Artificial Sequence
  chemically synthesized
ttcctagtaaaagaagttgg

SEQ ID NO: 62025 - DNA, 20 bp, Artificial Sequence
  chemically synthesized
aatttcctagtaaaagaagt

SEQ ID NO: 62026 - DNA, 20 bp, Artificial Sequence
  chemically synthesized
caacttccaacttcttttac

SEQ ID NO: 62027 - DNA, 20 bp, Artificial Sequence
  chemically synthesized
aactaatttcctagtaaaag

SEQ ID NO: 62028 - DNA, 20 bp, Artificial Sequence
  chemically synthesized
aacttccaacttcttttact

SEQ ID NO: 62029 - DNA, 20 bp, Artificial Sequence
  chemically synthesized
gcaaactaatttcctagtaa

SEQ ID NO: 62030 - DNA, 20 bp, Artificial Sequence
  chemically synthesized
aacttcttttactaggaaat

SEQ ID NO: 62031 - DNA, 20 bp, Artificial Sequence
  chemically synthesized
gggcaggcaaactaatttcc

SEQ ID NO: 62032 - DNA, 20 bp, Artificial Sequence
  chemically synthesized
ggaaattagtttgcctgccc

SEQ ID NO: 62033 - DNA, 20 bp, Artificial Sequence
  chemically synthesized
cttgcagacatttcttgggc

SEQ ID NO: 62034 - DNA, 20 bp, Artificial Sequence
  chemically synthesized
ccttgcagacatttcttggg

SEQ ID NO: 62035 - DNA, 20 bp, Artificial Sequence
  chemically synthesized
accccttgcagacatttctt

SEQ ID NO: 62036 - DNA, 20 bp, Artificial Sequence
  chemically synthesized
aaccccttgcagacatttct

SEQ ID NO: 62037 - DNA, 20 bp, Artificial Sequence
  chemically synthesized
cctgcccaagaaatgtctgc

SEQ ID NO: 62038 - DNA, 20 bp, Artificial Sequence
  chemically synthesized
ctgcccaagaaatgtctgca

SEQ ID NO: 62039 - DNA, 20 bp, Artificial Sequence
  chemically synthesized
tgcccaagaaatgtctgcaa

SEQ ID NO: 62040 - DNA, 20 bp, Artificial Sequence
  chemically synthesized
gcccaagaaatgtctgcaag

SEQ ID NO: 62041 - DNA, 20 bp, Artificial Sequence
  chemically synthesized
aatagtcataaaaccccttg

SEQ ID NO: 62042 - DNA, 20 bp, Artificial Sequence
  chemically synthesized
tgtagaggatcaaaatgaaa

SEQ ID NO: 62043 - DNA, 20 bp, Artificial Sequence
  chemically synthesized
tctcaagtttcaatatgtag

SEQ ID NO: 62044 - DNA, 20 bp, Artificial Sequence
  chemically synthesized
atctcaagtttcaatatgta

SEQ ID NO: 62045 - DNA, 20 bp, Artificial Sequence
  chemically synthesized
gcatctcaagtttcaatatg

SEQ ID NO: 62046 - DNA, 20 bp, Artificial Sequence
  chemically synthesized
tcctctacatattgaaactt

SEQ ID NO: 62047 - DNA, 20 bp, Artificial Sequence
  chemically synthesized
taagtcagctggagcatctc

SEQ ID NO: 62048 - DNA, 20 bp, Artificial Sequence
  chemically synthesized
tattgaaacttgagatgctc

SEQ ID NO: 62049 - DNA, 20 bp, Artificial Sequence
  chemically synthesized
gataatgaataagtcagctg

SEQ ID NO: 62050 - DNA, 20 bp, Artificial Sequence
  chemically synthesized
aagataatgaataagtcagc

SEQ ID NO: 62051 - DNA, 20 bp, Artificial Sequence
  chemically synthesized
ccccaagataatgaataagt

SEQ ID NO: 62052 - DNA, 20 bp, Artificial Sequence
  chemically synthesized
actcccccaagataatgaat

SEQ ID NO: 62053 - DNA, 20 bp, Artificial Sequence
  chemically synthesized
agctgacttattcattatct

SEQ ID NO: 62054 - DNA, 20 bp, Artificial Sequence
  chemically synthesized
gctgacttattcattatctt

SEQ ID NO: 62055 - DNA, 20 bp, Artificial Sequence
  chemically synthesized
ctgacttattcattatcttg

SEQ ID NO: 62056 - DNA, 20 bp, Artificial Sequence
  chemically synthesized
tgacttattcattatcttgg

SEQ ID NO: 62057 - DNA, 20 bp, Artificial Sequence
  chemically synthesized
acttattcattatcttgggg

SEQ ID NO: 62058 - DNA, 20 bp, Artificial Sequence
  chemically synthesized
caaataatctacactccccc

SEQ ID NO: 62059 - DNA, 20 bp, Artificial Sequence
  chemically synthesized
ttcattatcttgggggagtg

SEQ ID NO: 62060 - DNA, 20 bp, Artificial Sequence
  chemically synthesized
agtgtagattatttgtgcaa

SEQ ID NO: 62061 - DNA, 20 bp, Artificial Sequence
  chemically synthesized
gtgtagattatttgtgcaac

SEQ ID NO: 62062 - DNA, 20 bp, Artificial Sequence
  chemically synthesized
aacaggcatattcttatttt

SEQ ID NO: 62063 - DNA, 20 bp, Artificial Sequence
  chemically synthesized
tggataaaatggcttaaaat

SEQ ID NO: 62064 - DNA, 20 bp, Artificial Sequence
  chemically synthesized
tttgatgacgttggataaaa

SEQ ID NO: 62065 - DNA, 20 bp, Artificial Sequence
  chemically synthesized
gttaaatcatttgatgacgt

SEQ ID NO: 62066 - DNA, 20 bp, Artificial Sequence
  chemically synthesized
acgtcatcaaatgatttaac

SEQ ID NO: 62067 - DNA, 20 bp, Artificial Sequence
  chemically synthesized
gtcatcaaatgatttaacaa

SEQ ID NO: 62068 - DNA, 20 bp, Artificial Sequence
  chemically synthesized
gaatattctgagaagtttaa

SEQ ID NO: 62069 - DNA, 20 bp, Artificial Sequence
  chemically synthesized
caagagacttttaaacttct

SEQ ID NO: 62070 - DNA, 20 bp, Artificial Sequence
  chemically synthesized
ataaggaagaatattctgag

SEQ ID NO: 62071 - DNA, 20 bp, Artificial Sequence
  chemically synthesized
tttataaggaagaatattct

SEQ ID NO: 62072 - DNA, 20 bp, Artificial Sequence
  chemically synthesized
acctcctgttatttataagg

SEQ ID NO: 62073 - DNA, 20 bp, Artificial Sequence
  chemically synthesized
ggcacctcctgttatttata

SEQ ID NO: 62074 - DNA, 20 bp, Artificial Sequence
  chemically synthesized
aggcacctcctgttatttat

SEQ ID NO: 62075 - DNA, 20 bp, Artificial Sequence
  chemically synthesized
atattcttccttataaataa

SEQ ID NO: 62076 - DNA, 20 bp, Artificial Sequence
  chemically synthesized
tattcttccttataaataac

SEQ ID NO: 62077 - DNA, 20 bp, Artificial Sequence
  chemically synthesized
ttcttccttataaataacag

SEQ ID NO: 62078 - DNA, 20 bp, Artificial Sequence
  chemically synthesized
tcttccttataaataacagg

SEQ ID NO: 62079 - DNA, 20 bp, Artificial Sequence
  chemically synthesized
ataaataacaggaggtgcct

SEQ ID NO: 62080 - DNA, 20 bp, Artificial Sequence
  chemically synthesized
taacaggaggtgccttagtt

SEQ ID NO: 62081 - DNA, 20 bp, Artificial Sequence
  chemically synthesized
aacaggaggtgccttagttt

SEQ ID NO: 62082 - DNA, 20 bp, Artificial Sequence
  chemically synthesized
tgtctgccattcctaaacta

SEQ ID NO: 62083 - DNA, 20 bp, Artificial Sequence
  chemically synthesized
ttgtctgccattcctaaact

SEQ ID NO: 62084 - DNA, 20 bp, Artificial Sequence
  chemically synthesized
gaggtgccttagtttaggaa

SEQ ID NO: 62085 - DNA, 20 bp, Artificial Sequence
  chemically synthesized
gtgccttagtttaggaatgg

SEQ ID NO: 62086 - DNA, 20 bp, Artificial Sequence
  chemically synthesized
aggaatggcagacaaatgta

SEQ ID NO: 62087 - DNA, 20 bp, Artificial Sequence
  chemically synthesized
aaatgagaaaataatggtac

SEQ ID NO: 62088 - DNA, 20 bp, Artificial Sequence
  chemically synthesized
ggtattaaatgagaaaataa

SEQ ID NO: 62089 - DNA, 20 bp, Artificial Sequence
  chemically synthesized
ttctaccattggtattaaat

SEQ ID NO: 62090 - DNA, 20 bp, Artificial Sequence
  chemically synthesized
attttctcatttaataccaa

SEQ ID NO: 62091 - DNA, 20 bp, Artificial Sequence
  chemically synthesized
ttctcatttaataccaatgg

SEQ ID NO: 62092 - DNA, 20 bp, Artificial Sequence
  chemically synthesized
tgattagtaatttctaccat

SEQ ID NO: 62093 - DNA, 20 bp, Artificial Sequence
  chemically synthesized
caatggtagaaattactaat

SEQ ID NO: 62094 - DNA, 20 bp, Artificial Sequence
  chemically synthesized
atacagtgccataggctgat

SEQ ID NO: 62095 - DNA, 20 bp, Artificial Sequence
  chemically synthesized
agaaattactaatcagccta

SEQ ID NO: 62096 - DNA, 20 bp, Artificial Sequence
  chemically synthesized
agactacaatacagtgccat

SEQ ID NO: 62097 - DNA, 20 bp, Artificial Sequence
  chemically synthesized
aagactacaatacagtgcca

SEQ ID NO: 62098 - DNA, 20 bp, Artificial Sequence
  chemically synthesized
cagcctatggcactgtattg

SEQ ID NO: 62099 - DNA, 20 bp, Artificial Sequence
  chemically synthesized
aattggggaagactacaata

SEQ ID NO: 62100 - DNA, 20 bp, Artificial Sequence
  chemically synthesized
gagcataaagcaaattgggg

SEQ ID NO: 62101 - DNA, 20 bp, Artificial Sequence
  chemically synthesized
aaagagcataaagcaaattg

SEQ ID NO: 62102 - DNA, 20 bp, Artificial Sequence
  chemically synthesized
aaaagagcataaagcaaatt

SEQ ID NO: 62103 - DNA, 20 bp, Artificial Sequence
  chemically synthesized
taaaagagcataaagcaaat

SEQ ID NO: 62104 - DNA, 20 bp, Artificial Sequence
  chemically synthesized
gtttattgtaaaagagcata

SEQ ID NO: 62105 - DNA, 20 bp, Artificial Sequence
  chemically synthesized
tagagtggtttattgtaaaa

SEQ ID NO: 62106 - DNA, 20 bp, Artificial Sequence
  chemically synthesized
cctagagtggtttattgtaa

SEQ ID NO: 62107 - DNA, 20 bp, Artificial Sequence
  chemically synthesized
tcttttacaataaaccactc

SEQ ID NO: 62108 - DNA, 20 bp, Artificial Sequence
  chemically synthesized
cttttacaataaaccactct

SEQ ID NO: 62109 - DNA, 20 bp, Artificial Sequence
  chemically synthesized
ttacaataaaccactctagg

SEQ ID NO: 62110 - DNA, 20 bp, Artificial Sequence
  chemically synthesized
ctgatatcagctgcctagag

SEQ ID NO: 62111 - DNA, 20 bp, Artificial Sequence
  chemically synthesized
tgactgatatcagctgccta

SEQ ID NO: 62112 - DNA, 20 bp, Artificial Sequence
  chemically synthesized
attgactgatatcagctgcc

SEQ ID NO: 62113 - DNA, 20 bp, Artificial Sequence
  chemically synthesized
ccactctaggcagctgatat

SEQ ID NO: 62114 - DNA, 20 bp, Artificial Sequence
  chemically synthesized
aagctcttattgactgatat

SEQ ID NO: 62115 - DNA, 20 bp, Artificial Sequence
  chemically synthesized
ggcagctgatatcagtcaat

SEQ ID NO: 62116 - DNA, 20 bp, Artificial Sequence
  chemically synthesized
cagctgatatcagtcaataa

SEQ ID NO: 62117 - DNA, 20 bp, Artificial Sequence
  chemically synthesized
gtcaataagagcttgcttgt

SEQ ID NO: 62118 - DNA, 20 bp, Artificial Sequence
  chemically synthesized
atattgttcatctcacaagc

SEQ ID NO: 62119 - DNA, 20 bp, Artificial Sequence
  chemically synthesized
gtaaatattgttcatctcac

SEQ ID NO: 62120 - DNA, 20 bp, Artificial Sequence
  chemically synthesized
atgaacaatatttaccattc

SEQ ID NO: 62121 - DNA, 20 bp, Artificial Sequence
  chemically synthesized
ttactgcactatatctggaa

SEQ ID NO: 62122 - DNA, 20 bp, Artificial Sequence
  chemically synthesized
aatatttaccattccagata

SEQ ID NO: 62123 - DNA, 20 bp, Artificial Sequence
  chemically synthesized
attccttactgcactatatc

SEQ ID NO: 62124 - DNA, 20 bp, Artificial Sequence
  chemically synthesized
ttaccattccagatatagtg

SEQ ID NO: 62125 - DNA, 20 bp, Artificial Sequence
  chemically synthesized
cattccagatatagtgcagt

SEQ ID NO: 62126 - DNA, 20 bp, Artificial Sequence
  chemically synthesized
attccagatatagtgcagta

SEQ ID NO: 62127 - DNA, 20 bp, Artificial Sequence
  chemically synthesized
gatatagtgcagtaaggaat

SEQ ID NO: 62128 - DNA, 20 bp, Artificial Sequence
  chemically synthesized
gtgcagtaaggaataagata

SEQ ID NO: 62129 - DNA, 20 bp, Artificial Sequence
  chemically synthesized
aagataaagatgccgaaact

SEQ ID NO: 62130 - DNA, 20 bp, Artificial Sequence
  chemically synthesized
ttataatagaatctgagttt

SEQ ID NO: 62131 - DNA, 20 bp, Artificial Sequence
  chemically synthesized
ctgtgattataatagaatct

SEQ ID NO: 62132 - DNA, 20 bp, Artificial Sequence
  chemically synthesized
tggataatctgtgattataa

SEQ ID NO: 62133 - DNA, 20 bp, Artificial Sequence
  chemically synthesized
ctcagattctattataatca

SEQ ID NO: 62134 - DNA, 20 bp, Artificial Sequence
  chemically synthesized
atcacagattatccattgat

SEQ ID NO: 62135 - DNA, 20 bp, Artificial Sequence
  chemically synthesized
aaactcactaagctaatcaa

SEQ ID NO: 62136 - DNA, 20 bp, Artificial Sequence
  chemically synthesized
agattatccattgattagct

SEQ ID NO: 62137 - DNA, 20 bp, Artificial Sequence
  chemically synthesized
tatccattgattagcttagt

SEQ ID NO: 62138 - DNA, 20 bp, Artificial Sequence
  chemically synthesized
atgattttttaaaactcact

SEQ ID NO: 62139 - DNA, 20 bp, Artificial Sequence
  chemically synthesized
tgaagtagggcacagaagtg

SEQ ID NO: 62140 - DNA, 20 bp, Artificial Sequence
  chemically synthesized
ctgtgtgaagtagggcacag

SEQ ID NO: 62141 - DNA, 20 bp, Artificial Sequence
  chemically synthesized
taactgtgtgaagtagggca

SEQ ID NO: 62142 - DNA, 20 bp, Artificial Sequence
  chemically synthesized
catcctaactgtgtgaagta

SEQ ID NO: 62143 - DNA, 20 bp, Artificial Sequence
  chemically synthesized
tcatcctaactgtgtgaagt

SEQ ID NO: 62144 - DNA, 20 bp, Artificial Sequence
  chemically synthesized
cttctgtgccctacttcaca

SEQ ID NO: 62145 - DNA, 20 bp, Artificial Sequence
  chemically synthesized
ctcatcctaactgtgtgaag

SEQ ID NO: 62146 - DNA, 20 bp, Artificial Sequence
  chemically synthesized
accctcatcctaactgtgtg

SEQ ID NO: 62147 - DNA, 20 bp, Artificial Sequence
  chemically synthesized
tgtgccctacttcacacagt

SEQ ID NO: 62148 - DNA, 20 bp, Artificial Sequence
  chemically synthesized
gtgccctacttcacacagtt

SEQ ID NO: 62149 - DNA, 20 bp, Artificial Sequence
  chemically synthesized
ctacttcacacagttaggat

SEQ ID NO: 62150 - DNA, 20 bp, Artificial Sequence
  chemically synthesized
tacttcacacagttaggatg

SEQ ID NO: 62151 - DNA, 20 bp, Artificial Sequence
  chemically synthesized
acttcacacagttaggatga

SEQ ID NO: 62152 - DNA, 20 bp, Artificial Sequence
  chemically synthesized
cagttaggatgagggttaaa

SEQ ID NO: 62153 - DNA, 20 bp, Artificial Sequence
  chemically synthesized
aggatgagggttaaatggaa

SEQ ID NO: 62154 - DNA, 20 bp, Artificial Sequence
  chemically synthesized
aaatggaatagacacatcta

SEQ ID NO: 62155 - DNA, 20 bp, Artificial Sequence
  chemically synthesized
aatggaatagacacatctaa

SEQ ID NO: 62156 - DNA, 20 bp, Artificial Sequence
  chemically synthesized
tacatttcacaaagcacctt

SEQ ID NO: 62157 - DNA, 20 bp, Artificial Sequence
  chemically synthesized
ataattctttacatttcaca

SEQ ID NO: 62158 - DNA, 20 bp, Artificial Sequence
  chemically synthesized
aaggtgctttgtgaaatgta

SEQ ID NO: 62159 - DNA, 20 bp, Artificial Sequence
  chemically synthesized
atatacatgaaacctgatct

SEQ ID NO: 62160 - DNA, 20 bp, Artificial Sequence
  chemically synthesized
tatacatgaaacctgatctt

SEQ ID NO: 62161 - DNA, 20 bp, Artificial Sequence
  chemically synthesized
ttcttgaatatcctaagatc

SEQ ID NO: 62162 - DNA, 20 bp, Artificial Sequence
  chemically synthesized
tttcttgaatatcctaagat

SEQ ID NO: 62163 - DNA, 20 bp, Artificial Sequence
  chemically synthesized
tcaattttcttgaatatcct

SEQ ID NO: 62164 - DNA, 20 bp, Artificial Sequence
  chemically synthesized
aacctgatcttaggatattc

SEQ ID NO: 62165 - DNA, 20 bp, Artificial Sequence
  chemically synthesized
atattcaagaaaattgacca

SEQ ID NO: 62166 - DNA, 20 bp, Artificial Sequence
  chemically synthesized
attggagaaatgcatttcta

SEQ ID NO: 62167 - DNA, 20 bp, Artificial Sequence
  chemically synthesized
aggattcttaaagtatattg

SEQ ID NO: 62168 - DNA, 20 bp, Artificial Sequence
  chemically synthesized
aaaggattcttaaagtatat

SEQ ID NO: 62169 - DNA, 20 bp, Artificial Sequence
  chemically synthesized
gcatttctccaatatacttt

SEQ ID NO: 62170 - DNA, 20 bp, Artificial Sequence
  chemically synthesized
agaaaaacaaaggattctta

SEQ ID NO: 62171 - DNA, 20 bp, Artificial Sequence
  chemically synthesized
aacagatggtagaaaaacaa

SEQ ID NO: 62172 - DNA, 20 bp, Artificial Sequence
  chemically synthesized
aaacagatggtagaaaaaca

SEQ ID NO: 62173 - DNA, 20 bp, Artificial Sequence
  chemically synthesized
agactaaactaaacagatgg

SEQ ID NO: 62174 - DNA, 20 bp, Artificial Sequence
  chemically synthesized
ttgtttttctaccatctgtt

SEQ ID NO: 62175 - DNA, 20 bp, Artificial Sequence
  chemically synthesized
tacagactaaactaaacaga

SEQ ID NO: 62176 - DNA, 20 bp, Artificial Sequence
  chemically synthesized
tttctaccatctgtttagtt

SEQ ID NO: 62177 - DNA, 20 bp, Artificial Sequence
  chemically synthesized
tgtatacagactaaactaaa

SEQ ID NO: 62178 - DNA, 20 bp, Artificial Sequence
  chemically synthesized
gaataaaagttagatgtata

SEQ ID NO: 62179 - DNA, 20 bp, Artificial Sequence
  chemically synthesized
ttggacatgggaataaaagt

SEQ ID NO: 62180 - DNA, 20 bp, Artificial Sequence
  chemically synthesized
tctgttggacatgggaataa

SEQ ID NO: 62181 - DNA, 20 bp, Artificial Sequence
  chemically synthesized
acttcagttctgttggacat

SEQ ID NO: 62182 - DNA, 20 bp, Artificial Sequence
  chemically synthesized
acttttattcccatgtccaa

SEQ ID NO: 62183 - DNA, 20 bp, Artificial Sequence
  chemically synthesized
aacttcagttctgttggaca

SEQ ID NO: 62184 - DNA, 20 bp, Artificial Sequence
  chemically synthesized
cactctaacttcagttctgt

SEQ ID NO: 62185 - DNA, 20 bp, Artificial Sequence
  chemically synthesized
tcccatgtccaacagaactg

SEQ ID NO: 62186 - DNA, 20 bp, Artificial Sequence
  chemically synthesized
atgtccaacagaactgaagt

SEQ ID NO: 62187 - DNA, 20 bp, Artificial Sequence
  chemically synthesized
gtccaacagaactgaagtta

SEQ ID NO: 62188 - DNA, 20 bp, Artificial Sequence
  chemically synthesized
aatctctcacactctaactt

SEQ ID NO: 62189 - DNA, 20 bp, Artificial Sequence
  chemically synthesized
cagaactgaagttagagtgt

SEQ ID NO: 62190 - DNA, 20 bp, Artificial Sequence
  chemically synthesized
gaactgaagttagagtgtga

SEQ ID NO: 62191 - DNA, 20 bp, Artificial Sequence
  chemically synthesized
agtgtgagagattccttctt

SEQ ID NO: 62192 - DNA, 20 bp, Artificial Sequence
  chemically synthesized
tttattccattagctgaaga

SEQ ID NO: 62193 - DNA, 20 bp, Artificial Sequence
  chemically synthesized
atttattccattagctgaag

SEQ ID NO: 62194 - DNA, 20 bp, Artificial Sequence
  chemically synthesized
gagattccttcttcagctaa

SEQ ID NO: 62195 - DNA, 20 bp, Artificial Sequence
  chemically synthesized
atcatttattccattagctg

SEQ ID NO: 62196 - DNA, 20 bp, Artificial Sequence
  chemically synthesized
ctctatatcatttattccat

SEQ ID NO: 62197 - DNA, 20 bp, Artificial Sequence
  chemically synthesized
agctaatggaataaatgata

SEQ ID NO: 62198 - DNA, 20 bp, Artificial Sequence
  chemically synthesized
ctaatggaataaatgatata

SEQ ID NO: 62199 - DNA, 20 bp, Artificial Sequence
  chemically synthesized
ggaataaatgatatagagct

SEQ ID NO: 62200 - DNA, 20 bp, Artificial Sequence
  chemically synthesized
ataaatgatatagagctcag

SEQ ID NO: 62201 - DNA, 20 bp, Artificial Sequence
  chemically synthesized
caagcacatgtttatccact

SEQ ID NO: 62202 - DNA, 20 bp, Artificial Sequence
  chemically synthesized
cagtggataaacatgtgctt

SEQ ID NO: 62203 - DNA, 20 bp, Artificial Sequence
  chemically synthesized
cttgctctagaatggcactc

SEQ ID NO: 62204 - DNA, 20 bp, Artificial Sequence
  chemically synthesized
catgtgcttgagtgccattc

SEQ ID NO: 62205 - DNA, 20 bp, Artificial Sequence
  chemically synthesized
tgtgcttgagtgccattcta

SEQ ID NO: 62206 - DNA, 20 bp, Artificial Sequence
  chemically synthesized
catgagggcttgctctagaa

SEQ ID NO: 62207 - DNA, 20 bp, Artificial Sequence
  chemically synthesized
cttgagtgccattctagagc

SEQ ID NO: 62208 - DNA, 20 bp, Artificial Sequence
  chemically synthesized
gctgtcatgagggcttgctc

SEQ ID NO: 62209 - DNA, 20 bp, Artificial Sequence
  chemically synthesized
tctagagcaagccctcatga

SEQ ID NO: 62210 - DNA, 20 bp, Artificial Sequence
  chemically synthesized
ctctggctcagctgtcatga

SEQ ID NO: 62211 - DNA, 20 bp, Artificial Sequence
  chemically synthesized
tctctggctcagctgtcatg

SEQ ID NO: 62212 - DNA, 20 bp, Artificial Sequence
  chemically synthesized
ttctctggctcagctgtcat

SEQ ID NO: 62213 - DNA, 20 bp, Artificial Sequence
  chemically synthesized
agcaagccctcatgacagct

SEQ ID NO: 62214 - DNA, 20 bp, Artificial Sequence
  chemically synthesized
agccctcatgacagctgagc

SEQ ID NO: 62215 - DNA, 20 bp, Artificial Sequence
  chemically synthesized
ccctcatgacagctgagcca

SEQ ID NO: 62216 - DNA, 20 bp, Artificial Sequence
  chemically synthesized
tgaaatatgtttctctggct

SEQ ID NO: 62217 - DNA, 20 bp, Artificial Sequence
  chemically synthesized
gtggctgaaatatgtttctc

SEQ ID NO: 62218 - DNA, 20 bp, Artificial Sequence
  chemically synthesized
tgagccagagaaacatattt

SEQ ID NO: 62219 - DNA, 20 bp, Artificial Sequence
  chemically synthesized
gaagcaatgagatagggaag

SEQ ID NO: 62220 - DNA, 20 bp, Artificial Sequence
  chemically synthesized
tatgaagcaatgagataggg

SEQ ID NO: 62221 - DNA, 20 bp, Artificial Sequence
  chemically synthesized
agatatgaagcaatgagata

SEQ ID NO: 62222 - DNA, 20 bp, Artificial Sequence
  chemically synthesized
gagatatgaagcaatgagat

SEQ ID NO: 62223 - DNA, 20 bp, Artificial Sequence
  chemically synthesized
tgagatatgaagcaatgaga

SEQ ID NO: 62224 - DNA, 20 bp, Artificial Sequence
  chemically synthesized
tatctgagatatgaagcaat

SEQ ID NO: 62225 - DNA, 20 bp, Artificial Sequence
  chemically synthesized
tatctcattgcttcatatct

SEQ ID NO: 62226 - DNA, 20 bp, Artificial Sequence
  chemically synthesized
tctaaattatctgagatatg

SEQ ID NO: 62227 - DNA, 20 bp, Artificial Sequence
  chemically synthesized
catatacttctaaattatct

SEQ ID NO: 62228 - DNA, 20 bp, Artificial Sequence
  chemically synthesized
gcttcatatctcagataatt

SEQ ID NO: 62229 - DNA, 20 bp, Artificial Sequence
  chemically synthesized
tcatatctcagataatttag

SEQ ID NO: 62230 - DNA, 20 bp, Artificial Sequence
  chemically synthesized
attgatacttgatcagaaag

SEQ ID NO: 62231 - DNA, 20 bp, Artificial Sequence
  chemically synthesized
aaaatcactgctttctgatc

SEQ ID NO: 62232 - DNA, 20 bp, Artificial Sequence
  chemically synthesized
ttaattgatacttgatcaga

SEQ ID NO: 62233 - DNA, 20 bp, Artificial Sequence
  chemically synthesized
gatgttaattgatacttgat

SEQ ID NO: 62234 - DNA, 20 bp, Artificial Sequence
  chemically synthesized
caagtatcaattaacatcct

SEQ ID NO: 62235 - DNA, 20 bp, Artificial Sequence
  chemically synthesized
acaccctcccaaattatctg

SEQ ID NO: 62236 - DNA, 20 bp, Artificial Sequence
  chemically synthesized
cacaccctcccaaattatct

SEQ ID NO: 62237 - DNA, 20 bp, Artificial Sequence
  chemically synthesized
attaacatcctcagataatt

SEQ ID NO: 62238 - DNA, 20 bp, Artificial Sequence
  chemically synthesized
ttaacatcctcagataattt

SEQ ID NO: 62239 - DNA, 20 bp, Artificial Sequence
  chemically synthesized
aacatcctcagataatttgg

SEQ ID NO: 62240 - DNA, 20 bp, Artificial Sequence
  chemically synthesized
acatcctcagataatttggg

SEQ ID NO: 62241 - DNA, 20 bp, Artificial Sequence
  chemically synthesized
catcctcagataatttggga

SEQ ID NO: 62242 - DNA, 20 bp, Artificial Sequence
  chemically synthesized
tcagataatttgggagggtg

SEQ ID NO: 62243 - DNA, 20 bp, Artificial Sequence
  chemically synthesized
cagataatttgggagggtgt

SEQ ID NO: 62244 - DNA, 20 bp, Artificial Sequence
  chemically synthesized
ttgggagggtgtgggattcg

SEQ ID NO: 62245 - DNA, 20 bp, Artificial Sequence
  chemically synthesized
gagggtgtgggattcgtagc

SEQ ID NO: 62246 - DNA, 20 bp, Artificial Sequence
  chemically synthesized
tgggattcgtagccggattg

SEQ ID NO: 62247 - DNA, 20 bp, Artificial Sequence
  chemically synthesized
gttccaactttgctacaatc

SEQ ID NO: 62248 - DNA, 20 bp, Artificial Sequence
  chemically synthesized
ttcgtagccggattgtagca

SEQ ID NO: 62249 - DNA, 20 bp, Artificial Sequence
  chemically synthesized
tagccggattgtagcaaagt

SEQ ID NO: 62250 - DNA, 20 bp, Artificial Sequence
  chemically synthesized
agcaaagttggaacttaaaa

SEQ ID NO: 62251 - DNA, 20 bp, Artificial Sequence
  chemically synthesized
ttgttttttttttccatttt

SEQ ID NO: 62252 - DNA, 20 bp, Artificial Sequence
  chemically synthesized
aaatggaaaaaaaaaacaaa

SEQ ID NO: 62253 - DNA, 20 bp, Artificial Sequence
  chemically synthesized
gaaaaaaaaaacaaaaagcc

SEQ ID NO: 62254 - DNA, 20 bp, Artificial Sequence
  chemically synthesized
aaacaaaaagcccagaccga

SEQ ID NO: 62255 - DNA, 20 bp, Artificial Sequence
  chemically synthesized
tgatggatggctttcggtct

SEQ ID NO: 62256 - DNA, 20 bp, Artificial Sequence
  chemically synthesized
gtgatggatggctttcggtc

SEQ ID NO: 62257 - DNA, 20 bp, Artificial Sequence
  chemically synthesized
tgtaagtgatggatggcttt

SEQ ID NO: 62258 - DNA, 20 bp, Artificial Sequence
  chemically synthesized
ataaatgtgtaagtgatgga

SEQ ID NO: 62259 - DNA, 20 bp, Artificial Sequence
  chemically synthesized
gtgaataaatgtgtaagtga

SEQ ID NO: 62260 - DNA, 20 bp, Artificial Sequence
  chemically synthesized
aaggatgtgaataaatgtgt

SEQ ID NO: 62261 - DNA, 20 bp, Artificial Sequence
  chemically synthesized
atatgacatctcagaattca

SEQ ID NO: 62262 - DNA, 20 bp, Artificial Sequence
  chemically synthesized
tattcacatccttgaattct

SEQ ID NO: 62263 - DNA, 20 bp, Artificial Sequence
  chemically synthesized
aatatgacatctcagaattc

SEQ ID NO: 62264 - DNA, 20 bp, Artificial Sequence
  chemically synthesized
atcaaaagaatatgacatct

SEQ ID NO: 62265 - DNA, 20 bp, Artificial Sequence
  chemically synthesized
agaagtcagtcaaaaatcaa

SEQ ID NO: 62266 - DNA, 20 bp, Artificial Sequence
  chemically synthesized
agaggtaggagaagagaagt

SEQ ID NO: 62267 - DNA, 20 bp, Artificial Sequence
  chemically synthesized
aagcagaggtaggagaagag

SEQ ID NO: 62268 - DNA, 20 bp, Artificial Sequence
  chemically synthesized
gtcaagcagaggtaggagaa

SEQ ID NO: 62269 - DNA, 20 bp, Artificial Sequence
  chemically synthesized
aagtcaagcagaggtaggag

SEQ ID NO: 62270 - DNA, 20 bp, Artificial Sequence
  chemically synthesized
aagaagtcaagcagaggtag

SEQ ID NO: 62271 - DNA, 20 bp, Artificial Sequence
  chemically synthesized
aaaagaagtcaagcagaggt

SEQ ID NO: 62272 - DNA, 20 bp, Artificial Sequence
  chemically synthesized
aaaaagaagtcaagcagagg

SEQ ID NO: 62273 - DNA, 20 bp, Artificial Sequence
  chemically synthesized
aagaaaaagaagtcaagcag

SEQ ID NO: 62274 - DNA, 20 bp, Artificial Sequence
  chemically synthesized
caagaaaaagaagtcaagca

SEQ ID NO: 62275 - DNA, 20 bp, Artificial Sequence
  chemically synthesized
ttcaagaaaaagaagtcaag

SEQ ID NO: 62276 - DNA, 20 bp, Artificial Sequence
  chemically synthesized
aacttcaagaaaaagaagtc

SEQ ID NO: 62277 - DNA, 20 bp, Artificial Sequence
  chemically synthesized
tgataaacttcaagaaaaag

SEQ ID NO: 62278 - DNA, 20 bp, Artificial Sequence
  chemically synthesized
tgcttgacttctttttcttg

SEQ ID NO: 62279 - DNA, 20 bp, Artificial Sequence
  chemically synthesized
ccttgataaacttcaagaaa

SEQ ID NO: 62280 - DNA, 20 bp, Artificial Sequence
  chemically synthesized
accaaaccttgataaacttc

SEQ ID NO: 62281 - DNA, 20 bp, Artificial Sequence
  chemically synthesized
tctttttcttgaagtttatc

SEQ ID NO: 62282 - DNA, 20 bp, Artificial Sequence
  chemically synthesized
ctttttcttgaagtttatca

SEQ ID NO: 62283 - DNA, 20 bp, Artificial Sequence
  chemically synthesized
tcttgaagtttatcaaggtt

SEQ ID NO: 62284 - DNA, 20 bp, Artificial Sequence
  chemically synthesized
agtttatcaaggtttggtcc

SEQ ID NO: 62285 - DNA, 20 bp, Artificial Sequence
  chemically synthesized
gtttatcaaggtttggtcct

SEQ ID NO: 62286 - DNA, 20 bp, Artificial Sequence
  chemically synthesized
gagggaagggaagatggcct

SEQ ID NO: 62287 - DNA, 20 bp, Artificial Sequence
  chemically synthesized
agagggaagggaagatggcc

SEQ ID NO: 62288 - DNA, 20 bp, Artificial Sequence
  chemically synthesized
tgtaaagagggaagggaaga

SEQ ID NO: 62289 - DNA, 20 bp, Artificial Sequence
  chemically synthesized
agcatgtaaagagggaaggg

SEQ ID NO: 62290 - DNA, 20 bp, Artificial Sequence
  chemically synthesized
cttagcatgtaaagagggaa

SEQ ID NO: 62291 - DNA, 20 bp, Artificial Sequence
  chemically synthesized
acttagcatgtaaagaggga

SEQ ID NO: 62292 - DNA, 20 bp, Artificial Sequence
  chemically synthesized
cacttagcatgtaaagaggg

SEQ ID NO: 62293 - DNA, 20 bp, Artificial Sequence
  chemically synthesized
aatcacttagcatgtaaaga

SEQ ID NO: 62294 - DNA, 20 bp, Artificial Sequence
  chemically synthesized
aaatcacttagcatgtaaag

SEQ ID NO: 62295 - DNA, 20 bp, Artificial Sequence
  chemically synthesized
gaaatcacttagcatgtaaa

SEQ ID NO: 62296 - DNA, 20 bp, Artificial Sequence
  chemically synthesized
tggaaatcacttagcatgta

SEQ ID NO: 62297 - DNA, 20 bp, Artificial Sequence
  chemically synthesized
cccttccctctttacatgct

SEQ ID NO: 62298 - DNA, 20 bp, Artificial Sequence
  chemically synthesized
catccagaatggaaatcact

SEQ ID NO: 62299 - DNA, 20 bp, Artificial Sequence
  chemically synthesized
atgctaagtgatttccattc

SEQ ID NO: 62300 - DNA, 20 bp, Artificial Sequence
  chemically synthesized
ggaatttagagcatccagaa

SEQ ID NO: 62301 - DNA, 20 bp, Artificial Sequence
  chemically synthesized
aaaatggaatttagagcatc

SEQ ID NO: 62302 - DNA, 20 bp, Artificial Sequence
  chemically synthesized
ttgatacaaaatggaattta

SEQ ID NO: 62303 - DNA, 20 bp, Artificial Sequence
  chemically synthesized
tattgatacaaaatggaatt

SEQ ID NO: 62304 - DNA, 20 bp, Artificial Sequence
  chemically synthesized
agaaaaatattgatacaaaa

SEQ ID NO: 62305 - DNA, 20 bp, Artificial Sequence
  chemically synthesized
cccgagctagaagcgtaaat

SEQ ID NO: 62306 - DNA, 20 bp, Artificial Sequence
  chemically synthesized
atttttctcatttacgcttc

SEQ ID NO: 62307 - DNA, 20 bp, Artificial Sequence
  chemically synthesized
tctcatttacgcttctagct

SEQ ID NO: 62308 - DNA, 20 bp, Artificial Sequence
  chemically synthesized
ctcatttacgcttctagctc

SEQ ID NO: 62309 - DNA, 20 bp, Artificial Sequence
  chemically synthesized
aaaggagagacccgagctag

SEQ ID NO: 62310 - DNA, 20 bp, Artificial Sequence
  chemically synthesized
ctcaaaggagagacccgagc

SEQ ID NO: 62311 - DNA, 20 bp, Artificial Sequence
  chemically synthesized
atagctcaaaggagagaccc

SEQ ID NO: 62312 - DNA, 20 bp, Artificial Sequence
  chemically synthesized
ctagctcgggtctctccttt

SEQ ID NO: 62313 - DNA, 20 bp, Artificial Sequence
  chemically synthesized
ttcaattatagctcaaagga

SEQ ID NO: 62314 - DNA, 20 bp, Artificial Sequence
  chemically synthesized
aattcaattatagctcaaag

SEQ ID NO: 62315 - DNA, 20 bp, Artificial Sequence
  chemically synthesized
caaattcaattatagctcaa

SEQ ID NO: 62316 - DNA, 20 bp, Artificial Sequence
  chemically synthesized
tcaaattcaattatagctca

SEQ ID NO: 62317 - DNA, 20 bp, Artificial Sequence
  chemically synthesized
gcagaagtcaaattcaatta

SEQ ID NO: 62318 - DNA, 20 bp, Artificial Sequence
  chemically synthesized
ttgaatttgacttctgcact

SEQ ID NO: 62319 - DNA, 20 bp, Artificial Sequence
  chemically synthesized
tgtgatatgtccaagtgcag

SEQ ID NO: 62320 - DNA, 20 bp, Artificial Sequence
  chemically synthesized
gtgtgtgatatgtccaagtg

SEQ ID NO: 62321 - DNA, 20 bp, Artificial Sequence
  chemically synthesized
gaaatgtgtgtgatatgtcc

SEQ ID NO: 62322 - DNA, 20 bp, Artificial Sequence
  chemically synthesized
agttcagttttagacatgtt

SEQ ID NO: 62323 - DNA, 20 bp, Artificial Sequence
  chemically synthesized
aaagatcaacagttcagttt

SEQ ID NO: 62324 - DNA, 20 bp, Artificial Sequence
  chemically synthesized
tttggaaaagatcaacagtt

SEQ ID NO: 62325 - DNA, 20 bp, Artificial Sequence
  chemically synthesized
gcagatttggaaaagatcaa

SEQ ID NO: 62326 - DNA, 20 bp, Artificial Sequence
  chemically synthesized
aggaggaagcagatttggaa

SEQ ID NO: 62327 - DNA, 20 bp, Artificial Sequence
  chemically synthesized
gatggaggaggaagcagatt

SEQ ID NO: 62328 - DNA, 20 bp, Artificial Sequence
  chemically synthesized
gataaagatggaggaggaag

SEQ ID NO: 62329 - DNA, 20 bp, Artificial Sequence
  chemically synthesized
ggtgataaagatggaggagg

SEQ ID NO: 62330 - DNA, 20 bp, Artificial Sequence
  chemically synthesized
tgaggtgataaagatggagg

SEQ ID NO: 62331 - DNA, 20 bp, Artificial Sequence
  chemically synthesized
ctgaggtgataaagatggag

SEQ ID NO: 62332 - DNA, 20 bp, Artificial Sequence
  chemically synthesized
tgctgaggtgataaagatgg

SEQ ID NO: 62333 - DNA, 20 bp, Artificial Sequence
  chemically synthesized
ttgctgaggtgataaagatg

SEQ ID NO: 62334 - DNA, 20 bp, Artificial Sequence
  chemically synthesized
gtttgctgaggtgataaaga

SEQ ID NO: 62335 - DNA, 20 bp, Artificial Sequence
  chemically synthesized
tactgtttgctgaggtgata

SEQ ID NO: 62336 - DNA, 20 bp, Artificial Sequence
  chemically synthesized
ctcctccatctttatcacct

SEQ ID NO: 62337 - DNA, 20 bp, Artificial Sequence
  chemically synthesized
atctttatcacctcagcaaa

SEQ ID NO: 62338 - DNA, 20 bp, Artificial Sequence
  chemically synthesized
acttgttgtactgtttgctg

SEQ ID NO: 62339 - DNA, 20 bp, Artificial Sequence
  chemically synthesized
aacttgttgtactgtttgct

SEQ ID NO: 62340 - DNA, 20 bp, Artificial Sequence
  chemically synthesized
acctcagcaaacagtacaac

SEQ ID NO: 62341 - DNA, 20 bp, Artificial Sequence
  chemically synthesized
ttgatcaaacaaaaaaaact

SEQ ID NO: 62342 - DNA, 20 bp, Artificial Sequence
  chemically synthesized
tgatcaaacaaaaaaaactt

SEQ ID NO: 62343 - DNA, 20 bp, Artificial Sequence
  chemically synthesized
atcaaacaaaaaaaacttgg

SEQ ID NO: 62344 - DNA, 20 bp, Artificial Sequence
  chemically synthesized
agggattgaggatgactccc

SEQ ID NO: 62345 - DNA, 20 bp, Artificial Sequence
  chemically synthesized
atgtcaggcatgagggattg

SEQ ID NO: 62346 - DNA, 20 bp, Artificial Sequence
  chemically synthesized
gatgtcaggcatgagggatt

SEQ ID NO: 62347 - DNA, 20 bp, Artificial Sequence
  chemically synthesized
ggattagatgtcaggcatga

SEQ ID NO: 62348 - DNA, 20 bp, Artificial Sequence
  chemically synthesized
tggattagatgtcaggcatg

SEQ ID NO: 62349 - DNA, 20 bp, Artificial Sequence
  chemically synthesized
atggattagatgtcaggcat

SEQ ID NO: 62350 - DNA, 20 bp, Artificial Sequence
  chemically synthesized
ttggtgatggattagatgtc

SEQ ID NO: 62351 - DNA, 20 bp, Artificial Sequence
  chemically synthesized
cttggtgatggattagatgt

SEQ ID NO: 62352 - DNA, 20 bp, Artificial Sequence
  chemically synthesized
tgtatgacttggtgatggat

SEQ ID NO: 62353 - DNA, 20 bp, Artificial Sequence
  chemically synthesized
ctgacatctaatccatcacc

SEQ ID NO: 62354 - DNA, 20 bp, Artificial Sequence
  chemically synthesized
aaatctgtatgacttggtga

SEQ ID NO: 62355 - DNA, 20 bp, Artificial Sequence
  chemically synthesized
taatccatcaccaagtcata

SEQ ID NO: 62356 - DNA, 20 bp, Artificial Sequence
  chemically synthesized
gagacaaaatctgtatgact

SEQ ID NO: 62357 - DNA, 20 bp, Artificial Sequence
  chemically synthesized
cagatttgagatgtattttc

SEQ ID NO: 62358 - DNA, 20 bp, Artificial Sequence
  chemically synthesized
agagagaaatgaacagattt

SEQ ID NO: 62359 - DNA, 20 bp, Artificial Sequence
  chemically synthesized
tggaaatagagagaaatgaa

SEQ ID NO: 62360 - DNA, 20 bp, Artificial Sequence
  chemically synthesized
atggcggcaatggaaataga

SEQ ID NO: 62361 - DNA, 20 bp, Artificial Sequence
  chemically synthesized
agatggcggcaatggaaata

SEQ ID NO: 62362 - DNA, 20 bp, Artificial Sequence
  chemically synthesized
taagatggcggcaatggaaa

SEQ ID NO: 62363 - DNA, 20 bp, Artificial Sequence
  chemically synthesized
tgggagtaagatggcggcaa

SEQ ID NO: 62364 - DNA, 20 bp, Artificial Sequence
  chemically synthesized
gactactgggagtaagatgg

SEQ ID NO: 62365 - DNA, 20 bp, Artificial Sequence
  chemically synthesized
aatgactactgggagtaaga

SEQ ID NO: 62366 - DNA, 20 bp, Artificial Sequence
  chemically synthesized
cattgccgccatcttactcc

SEQ ID NO: 62367 - DNA, 20 bp, Artificial Sequence
  chemically synthesized
agaaaatgactactgggagt

SEQ ID NO: 62368 - DNA, 20 bp, Artificial Sequence
  chemically synthesized
tgccgccatcttactcccag

SEQ ID NO: 62369 - DNA, 20 bp, Artificial Sequence
  chemically synthesized
tgaaagaaaatgactactgg

SEQ ID NO: 62370 - DNA, 20 bp, Artificial Sequence
  chemically synthesized
gatgaaagaaaatgactact

SEQ ID NO: 62371 - DNA, 20 bp, Artificial Sequence
  chemically synthesized
tgatgaaagaaaatgactac

SEQ ID NO: 62372 - DNA, 20 bp, Artificial Sequence
  chemically synthesized
agtagtcattttctttcatc

SEQ ID NO: 62373 - DNA, 20 bp, Artificial Sequence
  chemically synthesized
atttgcagttgtcttgatga

SEQ ID NO: 62374 - DNA, 20 bp, Artificial Sequence
  chemically synthesized
ggccaggtaagaggcatttg

SEQ ID NO: 62375 - DNA, 20 bp, Artificial Sequence
  chemically synthesized
aactgcaaatgcctcttacc

SEQ ID NO: 62376 - DNA, 20 bp, Artificial Sequence
  chemically synthesized
aagcaaagaggccaggtaag

SEQ ID NO: 62377 - DNA, 20 bp, Artificial Sequence
  chemically synthesized
gaagcaaagaggccaggtaa

SEQ ID NO: 62378 - DNA, 20 bp, Artificial Sequence
  chemically synthesized
tagaagcaaagaggccaggt

SEQ ID NO: 62379 - DNA, 20 bp, Artificial Sequence
  chemically synthesized
agagtagaagcaaagaggcc

SEQ ID NO: 62380 - DNA, 20 bp, Artificial Sequence
  chemically synthesized
aagagtagaagcaaagaggc

SEQ ID NO: 62381 - DNA, 20 bp, Artificial Sequence
  chemically synthesized
tggcaagagtagaagcaaag

SEQ ID NO: 62382 - DNA, 20 bp, Artificial Sequence
  chemically synthesized
gtggcaagagtagaagcaaa

SEQ ID NO: 62383 - DNA, 20 bp, Artificial Sequence
  chemically synthesized
atgtggcaagagtagaagca

SEQ ID NO: 62384 - DNA, 20 bp, Artificial Sequence
  chemically synthesized
attgaatgtggcaagagtag

SEQ ID NO: 62385 - DNA, 20 bp, Artificial Sequence
  chemically synthesized
gagattgaatgtggcaagag

SEQ ID NO: 62386 - DNA, 20 bp, Artificial Sequence
  chemically synthesized
tgagagattgaatgtggcaa

SEQ ID NO: 62387 - DNA, 20 bp, Artificial Sequence
  chemically synthesized
aatgagagattgaatgtggc

SEQ ID NO: 62388 - DNA, 20 bp, Artificial Sequence
  chemically synthesized
tataaatgagagattgaatg

SEQ ID NO: 62389 - DNA, 20 bp, Artificial Sequence
  chemically synthesized
tggacctgctgtataaatga

SEQ ID NO: 62390 - DNA, 20 bp, Artificial Sequence
  chemically synthesized
cattcaatctctcatttata

SEQ ID NO: 62391 - DNA, 20 bp, Artificial Sequence
  chemically synthesized
gatggacctgctgtataaat

SEQ ID NO: 62392 - DNA, 20 bp, Artificial Sequence
  chemically synthesized
tcaatctctcatttatacag

SEQ ID NO: 62393 - DNA, 20 bp, Artificial Sequence
  chemically synthesized
caatctctcatttatacagc

SEQ ID NO: 62394 - DNA, 20 bp, Artificial Sequence
  chemically synthesized
catttatacagcaggtccat

SEQ ID NO: 62395 - DNA, 20 bp, Artificial Sequence
  chemically synthesized
caaaacatcatacaatctga

SEQ ID NO: 62396 - DNA, 20 bp, Artificial Sequence
  chemically synthesized
tcagattgtatgatgttttg

SEQ ID NO: 62397 - DNA, 20 bp, Artificial Sequence
  chemically synthesized
cagattgtatgatgttttgc

SEQ ID NO: 62398 - DNA, 20 bp, Artificial Sequence
  chemically synthesized
atgatgttttgcaggtacat

SEQ ID NO: 62399 - DNA, 20 bp, Artificial Sequence
  chemically synthesized
gttttgcaggtacatcagct

SEQ ID NO: 62400 - DNA, 20 bp, Artificial Sequence
  chemically synthesized
ttttgcaggtacatcagctc

SEQ ID NO: 62401 - DNA, 20 bp, Artificial Sequence
  chemically synthesized
gtacctgtgaaagtacacct

SEQ ID NO: 62402 - DNA, 20 bp, Artificial Sequence
  chemically synthesized
tcagctcaggtgtactttca

SEQ ID NO: 62403 - DNA, 20 bp, Artificial Sequence
  chemically synthesized
cagctcaggtgtactttcac

SEQ ID NO: 62404 - DNA, 20 bp, Artificial Sequence
  chemically synthesized
ataatctgacgtacctgtga

SEQ ID NO: 62405 - DNA, 20 bp, Artificial Sequence
  chemically synthesized
gtgtactttcacaggtacgt

SEQ ID NO: 62406 - DNA, 20 bp, Artificial Sequence
  chemically synthesized
gtttattttatgggtaagca

SEQ ID NO: 62407 - DNA, 20 bp, Artificial Sequence
  chemically synthesized
gagtttattttatgggtaag

SEQ ID NO: 62408 - DNA, 20 bp, Artificial Sequence
  chemically synthesized
ggagagtttattttatgggt

SEQ ID NO: 62409 - DNA, 20 bp, Artificial Sequence
  chemically synthesized
ggctggagagtttattttat

SEQ ID NO: 62410 - DNA, 20 bp, Artificial Sequence
  chemically synthesized
aggctggagagtttatttta

SEQ ID NO: 62411 - DNA, 20 bp, Artificial Sequence
  chemically synthesized
tacccataaaataaactctc

SEQ ID NO: 62412 - DNA, 20 bp, Artificial Sequence
  chemically synthesized
tggtacaggacaaggctgga

SEQ ID NO: 62413 - DNA, 20 bp, Artificial Sequence
  chemically synthesized
agtggtacaggacaaggctg

SEQ ID NO: 62414 - DNA, 20 bp, Artificial Sequence
  chemically synthesized
tgagtggtacaggacaaggc

SEQ ID NO: 62415 - DNA, 20 bp, Artificial Sequence
  chemically synthesized
ggggtgagtggtacaggaca

SEQ ID NO: 62416 - DNA, 20 bp, Artificial Sequence
  chemically synthesized
gggggtgagtggtacaggac

SEQ ID NO: 62417 - DNA, 20 bp, Artificial Sequence
  chemically synthesized
actgagggggtgagtggtac

SEQ ID NO: 62418 - DNA, 20 bp, Artificial Sequence
  chemically synthesized
gactgagggggtgagtggta

SEQ ID NO: 62419 - DNA, 20 bp, Artificial Sequence
  chemically synthesized
ctaatgactgagggggtgag

SEQ ID NO: 62420 - DNA, 20 bp, Artificial Sequence
  chemically synthesized
tcctgtaccactcaccccct

SEQ ID NO: 62421 - DNA, 20 bp, Artificial Sequence
  chemically synthesized
gagctaatgactgagggggt

SEQ ID NO: 62422 - DNA, 20 bp, Artificial Sequence
  chemically synthesized
ctaggagctaatgactgagg

SEQ ID NO: 62423 - DNA, 20 bp, Artificial Sequence
  chemically synthesized
gctaggagctaatgactgag

SEQ ID NO: 62424 - DNA, 20 bp, Artificial Sequence
  chemically synthesized
ggctaggagctaatgactga

SEQ ID NO: 62425 - DNA, 20 bp, Artificial Sequence
  chemically synthesized
ccactcaccccctcagtcat

SEQ ID NO: 62426 - DNA, 20 bp, Artificial Sequence
  chemically synthesized
tggctaggagctaatgactg

SEQ ID NO: 62427 - DNA, 20 bp, Artificial Sequence
  chemically synthesized
atggctaggagctaatgact

SEQ ID NO: 62428 - DNA, 20 bp, Artificial Sequence
  chemically synthesized
ccccctcagtcattagctcc

SEQ ID NO: 62429 - DNA, 20 bp, Artificial Sequence
  chemically synthesized
aaggaggcaagtatggctag

SEQ ID NO: 62430 - DNA, 20 bp, Artificial Sequence
  chemically synthesized
aaaaggaggcaagtatggct

SEQ ID NO: 62431 - DNA, 20 bp, Artificial Sequence
  chemically synthesized
taaaaggaggcaagtatggc

SEQ ID NO: 62432 - DNA, 20 bp, Artificial Sequence
  chemically synthesized
gacctaaaaggaggcaagta

SEQ ID NO: 62433 - DNA, 20 bp, Artificial Sequence
  chemically synthesized
acaatgacctaaaaggaggc

SEQ ID NO: 62434 - DNA, 20 bp, Artificial Sequence
  chemically synthesized
tagccatacttgcctccttt

SEQ ID NO: 62435 - DNA, 20 bp, Artificial Sequence
  chemically synthesized
agccatacttgcctcctttt

SEQ ID NO: 62436 - DNA, 20 bp, Artificial Sequence
  chemically synthesized
caagacaatgacctaaaagg

SEQ ID NO: 62437 - DNA, 20 bp, Artificial Sequence
  chemically synthesized
tcaagacaatgacctaaaag

SEQ ID NO: 62438 - DNA, 20 bp, Artificial Sequence
  chemically synthesized
tttcaagacaatgacctaaa

SEQ ID NO: 62439 - DNA, 20 bp, Artificial Sequence
  chemically synthesized
ttttcaagacaatgacctaa

SEQ ID NO: 62440 - DNA, 20 bp, Artificial Sequence
  chemically synthesized
gggaatggaataatattttc

SEQ ID NO: 62441 - DNA, 20 bp, Artificial Sequence
  chemically synthesized
catatgaacagggaggggaa

SEQ ID NO: 62442 - DNA, 20 bp, Artificial Sequence
  chemically synthesized
tcagtcatatgaacagggag

SEQ ID NO: 62443 - DNA, 20 bp, Artificial Sequence
  chemically synthesized
gtcagtcatatgaacaggga

SEQ ID NO: 62444 - DNA, 20 bp, Artificial Sequence
  chemically synthesized
ggtcagtcatatgaacaggg

SEQ ID NO: 62445 - DNA, 20 bp, Artificial Sequence
  chemically synthesized
aggtcagtcatatgaacagg

SEQ ID NO: 62446 - DNA, 20 bp, Artificial Sequence
  chemically synthesized
ttaggtcagtcatatgaaca

SEQ ID NO: 62447 - DNA, 20 bp, Artificial Sequence
  chemically synthesized
gttaggtcagtcatatgaac

SEQ ID NO: 62448 - DNA, 20 bp, Artificial Sequence
  chemically synthesized
ggttaggtcagtcatatgaa

SEQ ID NO: 62449 - DNA, 20 bp, Artificial Sequence
  chemically synthesized
ctaaaatctgaaggttaggt

SEQ ID NO: 62450 - DNA, 20 bp, Artificial Sequence
  chemically synthesized
catatgactgacctaacctt

SEQ ID NO: 62451 - DNA, 20 bp, Artificial Sequence
  chemically synthesized
taagctaaaatctgaaggtt

SEQ ID NO: 62452 - DNA, 20 bp, Artificial Sequence
  chemically synthesized
ttaagctaaaatctgaaggt

SEQ ID NO: 62453 - DNA, 20 bp, Artificial Sequence
  chemically synthesized
atatttaagctaaaatctga

SEQ ID NO: 62454 - DNA, 20 bp, Artificial Sequence
  chemically synthesized
ctgacctaaccttcagattt

SEQ ID NO: 62455 - DNA, 20 bp, Artificial Sequence
  chemically synthesized
tatatttaagctaaaatctg

SEQ ID NO: 62456 - DNA, 20 bp, Artificial Sequence
  chemically synthesized
tctctgaaaaggatatattt

SEQ ID NO: 62457 - DNA, 20 bp, Artificial Sequence
  chemically synthesized
tagcttaaatatatcctttt

SEQ ID NO: 62458 - DNA, 20 bp, Artificial Sequence
  chemically synthesized
gcttaaatatatccttttca

SEQ ID NO: 62459 - DNA, 20 bp, Artificial Sequence
  chemically synthesized
ttaaatatatccttttcaga

SEQ ID NO: 62460 - DNA, 20 bp, Artificial Sequence
  chemically synthesized
ctaggaaggcctctctgaaa

SEQ ID NO: 62461 - DNA, 20 bp, Artificial Sequence
  chemically synthesized
taaatatatccttttcagag

SEQ ID NO: 62462 - DNA, 20 bp, Artificial Sequence
  chemically synthesized
tctaggaaggcctctctgaa

SEQ ID NO: 62463 - DNA, 20 bp, Artificial Sequence
  chemically synthesized
ccttttcagagaggccttcc

SEQ ID NO: 62464 - DNA, 20 bp, Artificial Sequence
  chemically synthesized
aacttcttcatagtctagga

SEQ ID NO: 62465 - DNA, 20 bp, Artificial Sequence
  chemically synthesized
gaacttcttcatagtctagg

SEQ ID NO: 62466 - DNA, 20 bp, Artificial Sequence
  chemically synthesized
tgggaacttcttcatagtct

SEQ ID NO: 62467 - DNA, 20 bp, Artificial Sequence
  chemically synthesized
agaggccttcctagactatg

SEQ ID NO: 62468 - DNA, 20 bp, Artificial Sequence
  chemically synthesized
gtgggaacttcttcatagtc

SEQ ID NO: 62469 - DNA, 20 bp, Artificial Sequence
  chemically synthesized
ggccttcctagactatgaag

SEQ ID NO: 62470 - DNA, 20 bp, Artificial Sequence
  chemically synthesized
taatagtgggaacttcttca

SEQ ID NO: 62471 - DNA, 20 bp, Artificial Sequence
  chemically synthesized
tactttggaagaataatagt

SEQ ID NO: 62472 - DNA, 20 bp, Artificial Sequence
  chemically synthesized
ctactttggaagaataatag

SEQ ID NO: 62473 - DNA, 20 bp, Artificial Sequence
  chemically synthesized
aggctactttggaagaataa

SEQ ID NO: 62474 - DNA, 20 bp, Artificial Sequence
  chemically synthesized
ttcccactattattcttcca

SEQ ID NO: 62475 - DNA, 20 bp, Artificial Sequence
  chemically synthesized
ccactattattcttccaaag

SEQ ID NO: 62476 - DNA, 20 bp, Artificial Sequence
  chemically synthesized
caaagaataggctactttgg

SEQ ID NO: 62477 - DNA, 20 bp, Artificial Sequence
  chemically synthesized
agacaaagaataggctactt

SEQ ID NO: 62478 - DNA, 20 bp, Artificial Sequence
  chemically synthesized
atgttatgaagacaaagaat

SEQ ID NO: 62479 - DNA, 20 bp, Artificial Sequence
  chemically synthesized
aatgttatgaagacaaagaa

SEQ ID NO: 62480 - DNA, 20 bp, Artificial Sequence
  chemically synthesized
tgagaaatgttatgaagaca

SEQ ID NO: 62481 - DNA, 20 bp, Artificial Sequence
  chemically synthesized
aaatagtgagaaatgttatg

SEQ ID NO: 62482 - DNA, 20 bp, Artificial Sequence
  chemically synthesized
aaaataaaaagaaaaatagt

SEQ ID NO: 62483 - DNA, 20 bp, Artificial Sequence
  chemically synthesized
aaataaaataaaaagaaaaa

SEQ ID NO: 62484 - DNA, 20 bp, Artificial Sequence
  chemically synthesized
aaaaataaaaataaaataaa

SEQ ID NO: 62485 - DNA, 20 bp, Artificial Sequence
  chemically synthesized
tattttatttttattttttt

SEQ ID NO: 62486 - DNA, 20 bp, Artificial Sequence
  chemically synthesized
ttatttttatttttttgaga

SEQ ID NO: 62487 - DNA, 20 bp, Artificial Sequence
  chemically synthesized
atttttatttttttgagaca

SEQ ID NO: 62488 - DNA, 20 bp, Artificial Sequence
  chemically synthesized
tccagcctgggtgatagggc

SEQ ID NO: 62489 - DNA, 20 bp, Artificial Sequence
  chemically synthesized
cagagtcttgccctatcacc

SEQ ID NO: 62490 - DNA, 20 bp, Artificial Sequence
  chemically synthesized
gtgctccagcctgggtgata

SEQ ID NO: 62491 - DNA, 20 bp, Artificial Sequence
  chemically synthesized
agagtcttgccctatcaccc

SEQ ID NO: 62492 - DNA, 20 bp, Artificial Sequence
  chemically synthesized
tgtgctccagcctgggtgat

SEQ ID NO: 62493 - DNA, 20 bp, Artificial Sequence
  chemically synthesized
ctgtgctccagcctgggtga

SEQ ID NO: 62494 - DNA, 20 bp, Artificial Sequence
  chemically synthesized
tcttgccctatcacccaggc

SEQ ID NO: 62495 - DNA, 20 bp, Artificial Sequence
  chemically synthesized
ttgccctatcacccaggctg

SEQ ID NO: 62496 - DNA, 20 bp, Artificial Sequence
  chemically synthesized
acgtcactgtgctccagcct

SEQ ID NO: 62497 - DNA, 20 bp, Artificial Sequence
  chemically synthesized
cacgtcactgtgctccagcc

SEQ ID NO: 62498 - DNA, 20 bp, Artificial Sequence
  chemically synthesized
ctatcacccaggctggagca

SEQ ID NO: 62499 - DNA, 20 bp, Artificial Sequence
  chemically synthesized
gagatcacgtcactgtgctc

SEQ ID NO: 62500 - DNA, 20 bp, Artificial Sequence
  chemically synthesized
ggagcacagtgacgtgatct

SEQ ID NO: 62501 - DNA, 20 bp, Artificial Sequence
  chemically synthesized
ggcggaggttgcagtgagcc

SEQ ID NO: 62502 - DNA, 20 bp, Artificial Sequence
  chemically synthesized
caagaggcggaggttgcagt

SEQ ID NO: 62503 - DNA, 20 bp, Artificial Sequence
  chemically synthesized
aacccaagaggcggaggttg

SEQ ID NO: 62504 - DNA, 20 bp, Artificial Sequence
  chemically synthesized
tgctggaacccaagaggcgg

SEQ ID NO: 62505 - DNA, 20 bp, Artificial Sequence
  chemically synthesized
tcactgcaacctccgcctct

SEQ ID NO: 62506 - DNA, 20 bp, Artificial Sequence
  chemically synthesized
ttgctggaacccaagaggcg

SEQ ID NO: 62507 - DNA, 20 bp, Artificial Sequence
  chemically synthesized
cactgcaacctccgcctctt

SEQ ID NO: 62508 - DNA, 20 bp, Artificial Sequence
  chemically synthesized
aattgctggaacccaagagg

SEQ ID NO: 62509 - DNA, 20 bp, Artificial Sequence
  chemically synthesized
gagaattgctggaacccaag

SEQ ID NO: 62510 - DNA, 20 bp, Artificial Sequence
  chemically synthesized
ggagaattgctggaacccaa

SEQ ID NO: 62511 - DNA, 20 bp, Artificial Sequence
  chemically synthesized
aacctccgcctcttgggttc

SEQ ID NO: 62512 - DNA, 20 bp, Artificial Sequence
  chemically synthesized
ccggagaattgctggaaccc

SEQ ID NO: 62513 - DNA, 20 bp, Artificial Sequence
  chemically synthesized
ggctgaggccggagaattgc

SEQ ID NO: 62514 - DNA, 20 bp, Artificial Sequence
  chemically synthesized
cttgggttccagcaattctc

SEQ ID NO: 62515 - DNA, 20 bp, Artificial Sequence
  chemically synthesized
ttccagcaattctccggcct

SEQ ID NO: 62516 - DNA, 20 bp, Artificial Sequence
  chemically synthesized
tacttaagaggctgaggccg

SEQ ID NO: 62517 - DNA, 20 bp, Artificial Sequence
  chemically synthesized
gctacttaagaggctgaggc

SEQ ID NO: 62518 - DNA, 20 bp, Artificial Sequence
  chemically synthesized
tccagctacttaagaggctg

SEQ ID NO: 62519 - DNA, 20 bp, Artificial Sequence
  chemically synthesized
ttccagctacttaagaggct

SEQ ID NO: 62520 - DNA, 20 bp, Artificial Sequence
  chemically synthesized
ttctccggcctcagcctctt

SEQ ID NO: 62521 - DNA, 20 bp, Artificial Sequence
  chemically synthesized
tccggcctcagcctcttaag

SEQ ID NO: 62522 - DNA, 20 bp, Artificial Sequence
  chemically synthesized
tgtacttccagctacttaag

SEQ ID NO: 62523 - DNA, 20 bp, Artificial Sequence
  chemically synthesized
ctgtacttccagctacttaa

SEQ ID NO: 62524 - DNA, 20 bp, Artificial Sequence
  chemically synthesized
gcctcagcctcttaagtagc

SEQ ID NO: 62525 - DNA, 20 bp, Artificial Sequence
  chemically synthesized
gtctgtacttccagctactt

SEQ ID NO: 62526 - DNA, 20 bp, Artificial Sequence
  chemically synthesized
tcagcctcttaagtagctgg

SEQ ID NO: 62527 - DNA, 20 bp, Artificial Sequence
  chemically synthesized
ctcttaagtagctggaagta

SEQ ID NO: 62528 - DNA, 20 bp, Artificial Sequence
  chemically synthesized
tgaaaccctgtctgtacttc

SEQ ID NO: 62529 - DNA, 20 bp, Artificial Sequence
  chemically synthesized
taagtagctggaagtacaga

SEQ ID NO: 62530 - DNA, 20 bp, Artificial Sequence
  chemically synthesized
aagtagctggaagtacagac

SEQ ID NO: 62531 - DNA, 20 bp, Artificial Sequence
  chemically synthesized
agtagctggaagtacagaca

SEQ ID NO: 62532 - DNA, 20 bp, Artificial Sequence
  chemically synthesized
cagacagggtttcaccatgt

SEQ ID NO: 62533 - DNA, 20 bp, Artificial Sequence
  chemically synthesized
cagggtttcaccatgttggt

SEQ ID NO: 62534 - DNA, 20 bp, Artificial Sequence
  chemically synthesized
caagaccagcctgaccaaca

SEQ ID NO: 62535 - DNA, 20 bp, Artificial Sequence
  chemically synthesized
agggtttcaccatgttggtc

SEQ ID NO: 62536 - DNA, 20 bp, Artificial Sequence
  chemically synthesized
tttcaccatgttggtcaggc

SEQ ID NO: 62537 - DNA, 20 bp, Artificial Sequence
  chemically synthesized
tgaggtcaggagttcaagac

SEQ ID NO: 62538 - DNA, 20 bp, Artificial Sequence
  chemically synthesized
tcacttgaggtcaggagttc

SEQ ID NO: 62539 - DNA, 20 bp, Artificial Sequence
  chemically synthesized
ggcggatcacttgaggtcag

SEQ ID NO: 62540 - DNA, 20 bp, Artificial Sequence
  chemically synthesized
ggtcttgaactcctgacctc

SEQ ID NO: 62541 - DNA, 20 bp, Artificial Sequence
  chemically synthesized
cgggcggatcacttgaggtc

SEQ ID NO: 62542 - DNA, 20 bp, Artificial Sequence
  chemically synthesized
gcgggcggatcacttgaggt

SEQ ID NO: 62543 - DNA, 20 bp, Artificial Sequence
  chemically synthesized
cgaggcgggcggatcacttg

SEQ ID NO: 62544 - DNA, 20 bp, Artificial Sequence
  chemically synthesized
ccgaggcgggcggatcactt

SEQ ID NO: 62545 - DNA, 20 bp, Artificial Sequence
  chemically synthesized
ctcaagtgatccgcccgcct

SEQ ID NO: 62546 - DNA, 20 bp, Artificial Sequence
  chemically synthesized
ctttgggaccccgaggcggg

SEQ ID NO: 62547 - DNA, 20 bp, Artificial Sequence
  chemically synthesized
tcaagtgatccgcccgcctc

SEQ ID NO: 62548 - DNA, 20 bp, Artificial Sequence
  chemically synthesized
caagtgatccgcccgcctcg

SEQ ID NO: 62549 - DNA, 20 bp, Artificial Sequence
  chemically synthesized
gcactttgggaccccgaggc

SEQ ID NO: 62550 - DNA, 20 bp, Artificial Sequence
  chemically synthesized
agcactttgggaccccgagg

SEQ ID NO: 62551 - DNA, 20 bp, Artificial Sequence
  chemically synthesized
cccagcactttgggaccccg

SEQ ID NO: 62552 - DNA, 20 bp, Artificial Sequence
  chemically synthesized
tcccagcactttgggacccc

SEQ ID NO: 62553 - DNA, 20 bp, Artificial Sequence
  chemically synthesized
ccgcccgcctcggggtccca

SEQ ID NO: 62554 - DNA, 20 bp, Artificial Sequence
  chemically synthesized
gcctcggggtcccaaagtgc

SEQ ID NO: 62555 - DNA, 20 bp, Artificial Sequence
  chemically synthesized
gcctgtaatcccagcacttt

SEQ ID NO: 62556 - DNA, 20 bp, Artificial Sequence
  chemically synthesized
cctcggggtcccaaagtgct

SEQ ID NO: 62557 - DNA, 20 bp, Artificial Sequence
  chemically synthesized
tgcctgtaatcccagcactt

SEQ ID NO: 62558 - DNA, 20 bp, Artificial Sequence
  chemically synthesized
gtcccaaagtgctgggatta

SEQ ID NO: 62559 - DNA, 20 bp, Artificial Sequence
  chemically synthesized
tcccaaagtgctgggattac

SEQ ID NO: 62560 - DNA, 20 bp, Artificial Sequence
  chemically synthesized
gtggctcatgcctgtaatcc

SEQ ID NO: 62561 - DNA, 20 bp, Artificial Sequence
  chemically synthesized
agtgctgggattacaggcat

SEQ ID NO: 62562 - DNA, 20 bp, Artificial Sequence
  chemically synthesized
caggcatgagccactgcgcc

SEQ ID NO: 62563 - DNA, 20 bp, Artificial Sequence
  chemically synthesized
gagaaatgctccaggcgcag

SEQ ID NO: 62564 - DNA, 20 bp, Artificial Sequence
  chemically synthesized
ggcatgagccactgcgcctg

SEQ ID NO: 62565 - DNA, 20 bp, Artificial Sequence
  chemically synthesized
agtgagaaatgctccaggcg

SEQ ID NO: 62566 - DNA, 20 bp, Artificial Sequence
  chemically synthesized
aaaatagtgagaaatgctcc

SEQ ID NO: 62567 - DNA, 20 bp, Artificial Sequence
  chemically synthesized
aaaaatagtgagaaatgctc

SEQ ID NO: 62568 - DNA, 20 bp, Artificial Sequence
  chemically synthesized
aatatattattaaaaatagt

SEQ ID NO: 62569 - DNA, 20 bp, Artificial Sequence
  chemically synthesized
cattaatatattattaaaaa

SEQ ID NO: 62570 - DNA, 20 bp, Artificial Sequence
  chemically synthesized
caaatagccagtaaaaatgt

SEQ ID NO: 62571 - DNA, 20 bp, Artificial Sequence
  chemically synthesized
attaatgctaacatttttac

SEQ ID NO: 62572 - DNA, 20 bp, Artificial Sequence
  chemically synthesized
aagacagtgagacaaatagc

SEQ ID NO: 62573 - DNA, 20 bp, Artificial Sequence
  chemically synthesized
ttgcaagacagtgagacaaa

SEQ ID NO: 62574 - DNA, 20 bp, Artificial Sequence
  chemically synthesized
caaggaatttgcaagacagt

SEQ ID NO: 62575 - DNA, 20 bp, Artificial Sequence
  chemically synthesized
gtgccaaggaatttgcaaga

SEQ ID NO: 62576 - DNA, 20 bp, Artificial Sequence
  chemically synthesized
ggacgtgccaaggaatttgc

SEQ ID NO: 62577 - DNA, 20 bp, Artificial Sequence
  chemically synthesized
tcactgtcttgcaaattcct

SEQ ID NO: 62578 - DNA, 20 bp, Artificial Sequence
  chemically synthesized
aaatatttttggacgtgcca

SEQ ID NO: 62579 - DNA, 20 bp, Artificial Sequence
  chemically synthesized
gaaatatttttggacgtgcc

SEQ ID NO: 62580 - DNA, 20 bp, Artificial Sequence
  chemically synthesized
aaaataggaagaaatatttt

SEQ ID NO: 62581 - DNA, 20 bp, Artificial Sequence
  chemically synthesized
attgtctggcacaaaatagg

SEQ ID NO: 62582 - DNA, 20 bp, Artificial Sequence
  chemically synthesized
catattgtctggcacaaaat

SEQ ID NO: 62583 - DNA, 20 bp, Artificial Sequence
  chemically synthesized
gcatattgtctggcacaaaa

SEQ ID NO: 62584 - DNA, 20 bp, Artificial Sequence
  chemically synthesized
tatttcttcctattttgtgc

SEQ ID NO: 62585 - DNA, 20 bp, Artificial Sequence
  chemically synthesized
caaacacccggcatattgtc

SEQ ID NO: 62586 - DNA, 20 bp, Artificial Sequence
  chemically synthesized
ttttgtgccagacaatatgc

SEQ ID NO: 62587 - DNA, 20 bp, Artificial Sequence
  chemically synthesized
tttgtgccagacaatatgcc

SEQ ID NO: 62588 - DNA, 20 bp, Artificial Sequence
  chemically synthesized
cagacaatatgccgggtgtt

SEQ ID NO: 62589 - DNA, 20 bp, Artificial Sequence
  chemically synthesized
atcttcatagtccaaacacc

SEQ ID NO: 62590 - DNA, 20 bp, Artificial Sequence
  chemically synthesized
tgccgggtgtttggactatg

SEQ ID NO: 62591 - DNA, 20 bp, Artificial Sequence
  chemically synthesized
cctttcattataaatcttca

SEQ ID NO: 62592 - DNA, 20 bp, Artificial Sequence
  chemically synthesized
actatgaagatttataatga

SEQ ID NO: 62593 - DNA, 20 bp, Artificial Sequence
  chemically synthesized
ctatgaagatttataatgaa

SEQ ID NO: 62594 - DNA, 20 bp, Artificial Sequence
  chemically synthesized
atgtgtagccttttagttca

SEQ ID NO: 62595 - DNA, 20 bp, Artificial Sequence
  chemically synthesized
atgaaaggtccttgaactaa

SEQ ID NO: 62596 - DNA, 20 bp, Artificial Sequence
  chemically synthesized
aatgtgtagccttttagttc

SEQ ID NO: 62597 - DNA, 20 bp, Artificial Sequence
  chemically synthesized
tgaaaggtccttgaactaaa

SEQ ID NO: 62598 - DNA, 20 bp, Artificial Sequence
  chemically synthesized
ccagccaatgtgtagccttt

SEQ ID NO: 62599 - DNA, 20 bp, Artificial Sequence
  chemically synthesized
tgaactaaaaggctacacat

SEQ ID NO: 62600 - DNA, 20 bp, Artificial Sequence
  chemically synthesized
caccgcacccagccaatgtg

SEQ ID NO: 62601 - DNA, 20 bp, Artificial Sequence
  chemically synthesized
ctaaaaggctacacattggc

SEQ ID NO: 62602 - DNA, 20 bp, Artificial Sequence
  chemically synthesized
taaaaggctacacattggct

SEQ ID NO: 62603 - DNA, 20 bp, Artificial Sequence
  chemically synthesized
ggctacacattggctgggtg

SEQ ID NO: 62604 - DNA, 20 bp, Artificial Sequence
  chemically synthesized
caggtgtgagtcaccgcacc

SEQ ID NO: 62605 - DNA, 20 bp, Artificial Sequence
  chemically synthesized
agtgctgggattacaggtgt

SEQ ID NO: 62606 - DNA, 20 bp, Artificial Sequence
  chemically synthesized
gtgactcacacctgtaatcc

SEQ ID NO: 62607 - DNA, 20 bp, Artificial Sequence
  chemically synthesized
tcccaaagtgctgggattac

SEQ ID NO: 62608 - DNA, 20 bp, Artificial Sequence
  chemically synthesized
ctcccaaagtgctgggatta

SEQ ID NO: 62609 - DNA, 20 bp, Artificial Sequence
  chemically synthesized
cacctgtaatcccagcactt

SEQ ID NO: 62610 - DNA, 20 bp, Artificial Sequence
  chemically synthesized
tctcagcctcccaaagtgct

SEQ ID NO: 62611 - DNA, 20 bp, Artificial Sequence
  chemically synthesized
acctgtaatcccagcacttt

SEQ ID NO: 62612 - DNA, 20 bp, Artificial Sequence
  chemically synthesized
atctcagcctcccaaagtgc

SEQ ID NO: 62613 - DNA, 20 bp, Artificial Sequence
  chemically synthesized
ctgtaatcccagcactttgg

SEQ ID NO: 62614 - DNA, 20 bp, Artificial Sequence
  chemically synthesized
tgtaatcccagcactttggg

SEQ ID NO: 62615 - DNA, 20 bp, Artificial Sequence
  chemically synthesized
ccgcccatctcagcctccca

SEQ ID NO: 62616 - DNA, 20 bp, Artificial Sequence
  chemically synthesized
tcccagcactttgggaggct

SEQ ID NO: 62617 - DNA, 20 bp, Artificial Sequence
  chemically synthesized
agcactttgggaggctgaga

SEQ ID NO: 62618 - DNA, 20 bp, Artificial Sequence
  chemically synthesized
gcactttgggaggctgagat

SEQ ID NO: 62619 - DNA, 20 bp, Artificial Sequence
  chemically synthesized
ctttgggaggctgagatggg

SEQ ID NO: 62620 - DNA, 20 bp, Artificial Sequence
  chemically synthesized
acctcgtgatccgcccatct

SEQ ID NO: 62621 - DNA, 20 bp, Artificial Sequence
  chemically synthesized
ggctgagatgggcggatcac

SEQ ID NO: 62622 - DNA, 20 bp, Artificial Sequence
  chemically synthesized
gctgagatgggcggatcacg

SEQ ID NO: 62623 - DNA, 20 bp, Artificial Sequence
  chemically synthesized
gatgggcggatcacgaggtc

SEQ ID NO: 62624 - DNA, 20 bp, Artificial Sequence
  chemically synthesized
tgggcggatcacgaggtctg

SEQ ID NO: 62625 - DNA, 20 bp, Artificial Sequence
  chemically synthesized
gatcacgaggtctggagttc

SEQ ID NO: 62626 - DNA, 20 bp, Artificial Sequence
  chemically synthesized
atcatgctggtctcgaactc

SEQ ID NO: 62627 - DNA, 20 bp, Artificial Sequence
  chemically synthesized
cgaggtctggagttcgagac

SEQ ID NO: 62628 - DNA, 20 bp, Artificial Sequence
  chemically synthesized
tttcaccatgttgatcatgc

SEQ ID NO: 62629 - DNA, 20 bp, Artificial Sequence
  chemically synthesized
cgagaccagcatgatcaaca

SEQ ID NO: 62630 - DNA, 20 bp, Artificial Sequence
  chemically synthesized
ttgtatttttaggagacatg

SEQ ID NO: 62631 - DNA, 20 bp, Artificial Sequence
  chemically synthesized
tttgtatttttaggagacat

SEQ ID NO: 62632 - DNA, 20 bp, Artificial Sequence
  chemically synthesized
ttttgtatttttaggagaca

SEQ ID NO: 62633 - DNA, 20 bp, Artificial Sequence
  chemically synthesized
gctaatttttgtatttttag

SEQ ID NO: 62634 - DNA, 20 bp, Artificial Sequence
  chemically synthesized
cagctaatttttgtattttt

SEQ ID NO: 62635 - DNA, 20 bp, Artificial Sequence
  chemically synthesized
ccagctaatttttgtatttt

SEQ ID NO: 62636 - DNA, 20 bp, Artificial Sequence
  chemically synthesized
tctcctaaaaatacaaaaat

SEQ ID NO: 62637 - DNA, 20 bp, Artificial Sequence
  chemically synthesized
ctaaaaatacaaaaattagc

SEQ ID NO: 62638 - DNA, 20 bp, Artificial Sequence
  chemically synthesized
taaaaatacaaaaattagct

SEQ ID NO: 62639 - DNA, 20 bp, Artificial Sequence
  chemically synthesized
atacaaaaattagctgggcg

SEQ ID NO: 62640 - DNA, 20 bp, Artificial Sequence
  chemically synthesized
caaaaattagctgggcgtgg

SEQ ID NO: 62641 - DNA, 20 bp, Artificial Sequence
  chemically synthesized
caggtgtgtgccaccacgcc

SEQ ID NO: 62642 - DNA, 20 bp, Artificial Sequence
  chemically synthesized
gtggcacacacctgtaatcc

SEQ ID NO: 62643 - DNA, 20 bp, Artificial Sequence
  chemically synthesized
tcctgagtagctgggattac

SEQ ID NO: 62644 - DNA, 20 bp, Artificial Sequence
  chemically synthesized
ctcctgagtagctgggatta

SEQ ID NO: 62645 - DNA, 20 bp, Artificial Sequence
  chemically synthesized
cacctgtaatcccagctact

SEQ ID NO: 62646 - DNA, 20 bp, Artificial Sequence
  chemically synthesized
cctcagcctcctgagtagct

SEQ ID NO: 62647 - DNA, 20 bp, Artificial Sequence
  chemically synthesized
acctgtaatcccagctactc

SEQ ID NO: 62648 - DNA, 20 bp, Artificial Sequence
  chemically synthesized
gcctcagcctcctgagtagc

SEQ ID NO: 62649 - DNA, 20 bp, Artificial Sequence
  chemically synthesized
ctgtaatcccagctactcag

SEQ ID NO: 62650 - DNA, 20 bp, Artificial Sequence
  chemically synthesized
tgtaatcccagctactcagg

SEQ ID NO: 62651 - DNA, 20 bp, Artificial Sequence
  chemically synthesized
tcctgcctcagcctcctgag

SEQ ID NO: 62652 - DNA, 20 bp, Artificial Sequence
  chemically synthesized
ttctcctgcctcagcctcct

SEQ ID NO: 62653 - DNA, 20 bp, Artificial Sequence
  chemically synthesized
tcccagctactcaggaggct

SEQ ID NO: 62654 - DNA, 20 bp, Artificial Sequence
  chemically synthesized
cccagctactcaggaggctg

SEQ ID NO: 62655 - DNA, 20 bp, Artificial Sequence
  chemically synthesized
agctactcaggaggctgagg

SEQ ID NO: 62656 - DNA, 20 bp, Artificial Sequence
  chemically synthesized
gctactcaggaggctgaggc

SEQ ID NO: 62657 - DNA, 20 bp, Artificial Sequence
  chemically synthesized
tactcaggaggctgaggcag

SEQ ID NO: 62658 - DNA, 20 bp, Artificial Sequence
  chemically synthesized
ttcaagcaattctcctgcct

SEQ ID NO: 62659 - DNA, 20 bp, Artificial Sequence
  chemically synthesized
gcaggagaattgcttgaacc

SEQ ID NO: 62660 - DNA, 20 bp, Artificial Sequence
  chemically synthesized
caggagaattgcttgaacct

SEQ ID NO: 62661 - DNA, 20 bp, Artificial Sequence
  chemically synthesized
aacctccgcctcccaggttc

SEQ ID NO: 62662 - DNA, 20 bp, Artificial Sequence
  chemically synthesized
ggagaattgcttgaacctgg

SEQ ID NO: 62663 - DNA, 20 bp, Artificial Sequence
  chemically synthesized
gagaattgcttgaacctggg

SEQ ID NO: 62664 - DNA, 20 bp, Artificial Sequence
  chemically synthesized
aattgcttgaacctgggagg

SEQ ID NO: 62665 - DNA, 20 bp, Artificial Sequence
  chemically synthesized
cactgcaacctccgcctccc

SEQ ID NO: 62666 - DNA, 20 bp, Artificial Sequence
  chemically synthesized
ttgcttgaacctgggaggcg

SEQ ID NO: 62667 - DNA, 20 bp, Artificial Sequence
  chemically synthesized
tcactgcaacctccgcctcc

SEQ ID NO: 62668 - DNA, 20 bp, Artificial Sequence
  chemically synthesized
tgcttgaacctgggaggcgg

SEQ ID NO: 62669 - DNA, 20 bp, Artificial Sequence
  chemically synthesized
aacctgggaggcggaggttg

SEQ ID NO: 62670 - DNA, 20 bp, Artificial Sequence
  chemically synthesized
tgggaggcggaggttgcagt

SEQ ID NO: 62671 - DNA, 20 bp, Artificial Sequence
  chemically synthesized
ggcggaggttgcagtgagcc

SEQ ID NO: 62672 - DNA, 20 bp, Artificial Sequence
  chemically synthesized
ggagtgcagtggcgtgatct

SEQ ID NO: 62673 - DNA, 20 bp, Artificial Sequence
  chemically synthesized
tcccccaggctggagtgcag

SEQ ID NO: 62674 - DNA, 20 bp, Artificial Sequence
  chemically synthesized
gagatcacgccactgcactc

SEQ ID NO: 62675 - DNA, 20 bp, Artificial Sequence
  chemically synthesized
ctctcccccaggctggagtg

SEQ ID NO: 62676 - DNA, 20 bp, Artificial Sequence
  chemically synthesized
cacgccactgcactccagcc

SEQ ID NO: 62677 - DNA, 20 bp, Artificial Sequence
  chemically synthesized
acgccactgcactccagcct

SEQ ID NO: 62678 - DNA, 20 bp, Artificial Sequence
  chemically synthesized
cgccactgcactccagcctg

SEQ ID NO: 62679 - DNA, 20 bp, Artificial Sequence
  chemically synthesized
tcactctctcccccaggctg

SEQ ID NO: 62680 - DNA, 20 bp, Artificial Sequence
  chemically synthesized
gccactgcactccagcctgg

SEQ ID NO: 62681 - DNA, 20 bp, Artificial Sequence
  chemically synthesized
cctcactctctcccccaggc

SEQ ID NO: 62682 - DNA, 20 bp, Artificial Sequence
  chemically synthesized
cactgcactccagcctgggg

SEQ ID NO: 62683 - DNA, 20 bp, Artificial Sequence
  chemically synthesized
ctgcactccagcctggggga

SEQ ID NO: 62684 - DNA, 20 bp, Artificial Sequence
  chemically synthesized
ggagcctcactctctccccc

SEQ ID NO: 62685 - DNA, 20 bp, Artificial Sequence
  chemically synthesized
gcactccagcctgggggaga

SEQ ID NO: 62686 - DNA, 20 bp, Artificial Sequence
  chemically synthesized
tggagcctcactctctcccc

SEQ ID NO: 62687 - DNA, 20 bp, Artificial Sequence
  chemically synthesized
tccagcctgggggagagagt

SEQ ID NO: 62688 - DNA, 20 bp, Artificial Sequence
  chemically synthesized
ccagcctgggggagagagtg

SEQ ID NO: 62689 - DNA, 20 bp, Artificial Sequence
  chemically synthesized
tgttttttgtttttgagatg

SEQ ID NO: 62690 - DNA, 20 bp, Artificial Sequence
  chemically synthesized
tttgttttttgtttttgaga

SEQ ID NO: 62691 - DNA, 20 bp, Artificial Sequence
  chemically synthesized
gctttttgttttttgttttt

SEQ ID NO: 62692 - DNA, 20 bp, Artificial Sequence
  chemically synthesized
tctcaaaaacaaaaaacaaa

SEQ ID NO: 62693 - DNA, 20 bp, Artificial Sequence
  chemically synthesized
aaaaacaaaaaacaaaaagc

SEQ ID NO: 62694 - DNA, 20 bp, Artificial Sequence
  chemically synthesized
caaaaagcaagcaaaaaaaa

SEQ ID NO: 62695 - DNA, 20 bp, Artificial Sequence
  chemically synthesized
aaaaaaaacggccacacatt

SEQ ID NO: 62696 - DNA, 20 bp, Artificial Sequence
  chemically synthesized
gatttttcctactaaatgtg

SEQ ID NO: 62697 - DNA, 20 bp, Artificial Sequence
  chemically synthesized
aaaaacggccacacatttag

SEQ ID NO: 62698 - DNA, 20 bp, Artificial Sequence
  chemically synthesized
aaaacggccacacatttagt

SEQ ID NO: 62699 - DNA, 20 bp, Artificial Sequence
  chemically synthesized
cacatttagtaggaaaaatc

SEQ ID NO: 62700 - DNA, 20 bp, Artificial Sequence
  chemically synthesized
ttagtaggaaaaatcaagaa

SEQ ID NO: 62701 - DNA, 20 bp, Artificial Sequence
  chemically synthesized
tagtaggaaaaatcaagaaa

SEQ ID NO: 62702 - DNA, 20 bp, Artificial Sequence
  chemically synthesized
atcaagaaaaggtttataaa

SEQ ID NO: 62703 - DNA, 20 bp, Artificial Sequence
  chemically synthesized
caagaaaaggtttataaata

SEQ ID NO: 62704 - DNA, 20 bp, Artificial Sequence
  chemically synthesized
gaaaaggtttataaatagag

SEQ ID NO: 62705 - DNA, 20 bp, Artificial Sequence
  chemically synthesized
aaggtttataaatagagtgg

SEQ ID NO: 62706 - DNA, 20 bp, Artificial Sequence
  chemically synthesized
aatagagtggtagacactgt

SEQ ID NO: 62707 - DNA, 20 bp, Artificial Sequence
  chemically synthesized
gttgttgatgaggcaaccaa

SEQ ID NO: 62708 - DNA, 20 bp, Artificial Sequence
  chemically synthesized
gagtggaatggttgttgatg

SEQ ID NO: 62709 - DNA, 20 bp, Artificial Sequence
  chemically synthesized
agagtggaatggttgttgat

SEQ ID NO: 62710 - DNA, 20 bp, Artificial Sequence
  chemically synthesized
agaaaaaagggagagtggaa

SEQ ID NO: 62711 - DNA, 20 bp, Artificial Sequence
  chemically synthesized
actagagaaaaaagggagag

SEQ ID NO: 62712 - DNA, 20 bp, Artificial Sequence
  chemically synthesized
atcactagagaaaaaaggga

SEQ ID NO: 62713 - DNA, 20 bp, Artificial Sequence
  chemically synthesized
taatcactagagaaaaaagg

SEQ ID NO: 62714 - DNA, 20 bp, Artificial Sequence
  chemically synthesized
gataatcactagagaaaaaa

SEQ ID NO: 62715 - DNA, 20 bp, Artificial Sequence
  chemically synthesized
agataatcactagagaaaaa

SEQ ID NO: 62716 - DNA, 20 bp, Artificial Sequence
  chemically synthesized
tccactctcccttttttctc

SEQ ID NO: 62717 - DNA, 20 bp, Artificial Sequence
  chemically synthesized
tagataatcactagagaaaa

SEQ ID NO: 62718 - DNA, 20 bp, Artificial Sequence
  chemically synthesized
gtggaaatagataatcacta

SEQ ID NO: 62719 - DNA, 20 bp, Artificial Sequence
  chemically synthesized
gtgtggaaatagataatcac

SEQ ID NO: 62720 - DNA, 20 bp, Artificial Sequence
  chemically synthesized
tttttttgtgtgtgtggaaa

SEQ ID NO: 62721 - DNA, 20 bp, Artificial Sequence
  chemically synthesized
taaacttttttttgtgtgtg

SEQ ID NO: 62722 - DNA, 20 bp, Artificial Sequence
  chemically synthesized
atttccacacacacaaaaaa

SEQ ID NO: 62723 - DNA, 20 bp, Artificial Sequence
  chemically synthesized
cacacaaaaaaaagtttaaa

SEQ ID NO: 62724 - DNA, 20 bp, Artificial Sequence
  chemically synthesized
aaaagtttaaaaagcactga

SEQ ID NO: 62725 - DNA, 20 bp, Artificial Sequence
  chemically synthesized
gaaactaagaaattgactat

SEQ ID NO: 62726 - DNA, 20 bp, Artificial Sequence
  chemically synthesized
agcactgatagtcaatttct

SEQ ID NO: 62727 - DNA, 20 bp, Artificial Sequence
  chemically synthesized
atctacctgcaagggaaact

SEQ ID NO: 62728 - DNA, 20 bp, Artificial Sequence
  chemically synthesized
caatttcttagtttcccttg

SEQ ID NO: 62729 - DNA, 20 bp, Artificial Sequence
  chemically synthesized
aatttcttagtttcccttgc

SEQ ID NO: 62730 - DNA, 20 bp, Artificial Sequence
  chemically synthesized
ttcttagtttcccttgcagg

SEQ ID NO: 62731 - DNA, 20 bp, Artificial Sequence
  chemically synthesized
gtagctgcatctacctgcaa

SEQ ID NO: 62732 - DNA, 20 bp, Artificial Sequence
  chemically synthesized
agtagctgcatctacctgca

SEQ ID NO: 62733 - DNA, 20 bp, Artificial Sequence
  chemically synthesized
aagtagctgcatctacctgc

SEQ ID NO: 62734 - DNA, 20 bp, Artificial Sequence
  chemically synthesized
gtttcccttgcaggtagatg

SEQ ID NO: 62735 - DNA, 20 bp, Artificial Sequence
  chemically synthesized
gtagatgcagctacttgacc

SEQ ID NO: 62736 - DNA, 20 bp, Artificial Sequence
  chemically synthesized
ttggccagaactaggtcaag

SEQ ID NO: 62737 - DNA, 20 bp, Artificial Sequence
  chemically synthesized
tctttggccagaactaggtc

SEQ ID NO: 62738 - DNA, 20 bp, Artificial Sequence
  chemically synthesized
gcagctacttgacctagttc

SEQ ID NO: 62739 - DNA, 20 bp, Artificial Sequence
  chemically synthesized
acatctctttggccagaact

SEQ ID NO: 62740 - DNA, 20 bp, Artificial Sequence
  chemically synthesized
aacatctctttggccagaac

SEQ ID NO: 62741 - DNA, 20 bp, Artificial Sequence
  chemically synthesized
acttgacctagttctggcca

SEQ ID NO: 62742 - DNA, 20 bp, Artificial Sequence
  chemically synthesized
ttgacctagttctggccaaa

SEQ ID NO: 62743 - DNA, 20 bp, Artificial Sequence
  chemically synthesized
ctccctaacatctctttggc

SEQ ID NO: 62744 - DNA, 20 bp, Artificial Sequence
  chemically synthesized
atgtctccctaacatctctt

SEQ ID NO: 62745 - DNA, 20 bp, Artificial Sequence
  chemically synthesized
agttctggccaaagagatgt

SEQ ID NO: 62746 - DNA, 20 bp, Artificial Sequence
  chemically synthesized
gttctggccaaagagatgtt

SEQ ID NO: 62747 - DNA, 20 bp, Artificial Sequence
  chemically synthesized
ttctggccaaagagatgtta

SEQ ID NO: 62748 - DNA, 20 bp, Artificial Sequence
  chemically synthesized
ctggccaaagagatgttagg

SEQ ID NO: 62749 - DNA, 20 bp, Artificial Sequence
  chemically synthesized
ttgtcatgtttcagaagcaa

SEQ ID NO: 62750 - DNA, 20 bp, Artificial Sequence
  chemically synthesized
cagttcttgtcatgtttcag

SEQ ID NO: 62751 - DNA, 20 bp, Artificial Sequence
  chemically synthesized
tggcagttcttgtcatgttt

SEQ ID NO: 62752 - DNA, 20 bp, Artificial Sequence
  chemically synthesized
tgttgcttctgaaacatgac

SEQ ID NO: 62753 - DNA, 20 bp, Artificial Sequence
  chemically synthesized
ggaaaataaaggaagagtgg

SEQ ID NO: 62754 - DNA, 20 bp, Artificial Sequence
  chemically synthesized
aatggaaaataaaggaagag

SEQ ID NO: 62755 - DNA, 20 bp, Artificial Sequence
  chemically synthesized
gtgaatggaaaataaaggaa

SEQ ID NO: 62756 - DNA, 20 bp, Artificial Sequence
  chemically synthesized
gtgtgaatggaaaataaagg

SEQ ID NO: 62757 - DNA, 20 bp, Artificial Sequence
  chemically synthesized
acagtgtgaatggaaaataa

SEQ ID NO: 62758 - DNA, 20 bp, Artificial Sequence
  chemically synthesized
gacagtgtgaatggaaaata

SEQ ID NO: 62759 - DNA, 20 bp, Artificial Sequence
  chemically synthesized
ttgcatcatgacagtgtgaa

SEQ ID NO: 62760 - DNA, 20 bp, Artificial Sequence
  chemically synthesized
ctccaggaattgcatcatga

SEQ ID NO: 62761 - DNA, 20 bp, Artificial Sequence
  chemically synthesized
cactgtcatgatgcaattcc

SEQ ID NO: 62762 - DNA, 20 bp, Artificial Sequence
  chemically synthesized
ctgtcatgatgcaattcctg

SEQ ID NO: 62763 - DNA, 20 bp, Artificial Sequence
  chemically synthesized
atgatgcaattcctggagtg

SEQ ID NO: 62764 - DNA, 20 bp, Artificial Sequence
  chemically synthesized
taaaatggctgccacactcc

SEQ ID NO: 62765 - DNA, 20 bp, Artificial Sequence
  chemically synthesized
ataaaatggctgccacactc

SEQ ID NO: 62766 - DNA, 20 bp, Artificial Sequence
  chemically synthesized
atgcaattcctggagtgtgg

SEQ ID NO: 62767 - DNA, 20 bp, Artificial Sequence
  chemically synthesized
gtcacgcgatggttataaaa

SEQ ID NO: 62768 - DNA, 20 bp, Artificial Sequence
  chemically synthesized
tctttggaattgtcacgcga

SEQ ID NO: 62769 - DNA, 20 bp, Artificial Sequence
  chemically synthesized
accatcgcgtgacaattcca

SEQ ID NO: 62770 - DNA, 20 bp, Artificial Sequence
  chemically synthesized
cgtgacaattccaaagacca

SEQ ID NO: 62771 - DNA, 20 bp, Artificial Sequence
  chemically synthesized
tagcctttggctttggtctt

SEQ ID NO: 62772 - DNA, 20 bp, Artificial Sequence
  chemically synthesized
aattccaaagaccaaagcca

SEQ ID NO: 62773 - DNA, 20 bp, Artificial Sequence
  chemically synthesized
attccaaagaccaaagccaa

SEQ ID NO: 62774 - DNA, 20 bp, Artificial Sequence
  chemically synthesized
ctatccttagcctttggctt

SEQ ID NO: 62775 - DNA, 20 bp, Artificial Sequence
  chemically synthesized
aaagaccaaagccaaaggct

SEQ ID NO: 62776 - DNA, 20 bp, Artificial Sequence
  chemically synthesized
aagaccaaagccaaaggcta

SEQ ID NO: 62777 - DNA, 20 bp, Artificial Sequence
  chemically synthesized
catttgctatccttagcctt

SEQ ID NO: 62778 - DNA, 20 bp, Artificial Sequence
  chemically synthesized
ccaaagccaaaggctaagga

SEQ ID NO: 62779 - DNA, 20 bp, Artificial Sequence
  chemically synthesized
atctttgcatttgctatcct

SEQ ID NO: 62780 - DNA, 20 bp, Artificial Sequence
  chemically synthesized
ggctaaggatagcaaatgca

SEQ ID NO: 62781 - DNA, 20 bp, Artificial Sequence
  chemically synthesized
aaggatagcaaatgcaaaga

SEQ ID NO: 62782 - DNA, 20 bp, Artificial Sequence
  chemically synthesized
atagcaaatgcaaagatgga

SEQ ID NO: 62783 - DNA, 20 bp, Artificial Sequence
  chemically synthesized
atgcaaagatggaaagacat

SEQ ID NO: 62784 - DNA, 20 bp, Artificial Sequence
  chemically synthesized
attagctcaacagtttcatt

SEQ ID NO: 62785 - DNA, 20 bp, Artificial Sequence
  chemically synthesized
ggattctgaatgaaactgtt

SEQ ID NO: 62786 - DNA, 20 bp, Artificial Sequence
  chemically synthesized
aaattggtttattagctcaa

SEQ ID NO: 62787 - DNA, 20 bp, Artificial Sequence
  chemically synthesized
tatacccaaaattggtttat

SEQ ID NO: 62788 - DNA, 20 bp, Artificial Sequence
  chemically synthesized
ttgagctaataaaccaattt

SEQ ID NO: 62789 - DNA, 20 bp, Artificial Sequence
  chemically synthesized
tgagctaataaaccaatttt

SEQ ID NO: 62790 - DNA, 20 bp, Artificial Sequence
  chemically synthesized
gagaaagatatacccaaaat

SEQ ID NO: 62791 - DNA, 20 bp, Artificial Sequence
  chemically synthesized
cataataggaatttaagaga

SEQ ID NO: 62792 - DNA, 20 bp, Artificial Sequence
  chemically synthesized
ctcacataataggaatttaa

SEQ ID NO: 62793 - DNA, 20 bp, Artificial Sequence
  chemically synthesized
ttctcacataataggaattt

SEQ ID NO: 62794 - DNA, 20 bp, Artificial Sequence
  chemically synthesized
ctcttaaattcctattatgt

SEQ ID NO: 62795 - DNA, 20 bp, Artificial Sequence
  chemically synthesized
gtttatttttctcacataat

SEQ ID NO: 62796 - DNA, 20 bp, Artificial Sequence
  chemically synthesized
cgtttatttttctcacataa

SEQ ID NO: 62797 - DNA, 20 bp, Artificial Sequence
  chemically synthesized
tatgtgagaaaaataaacga

SEQ ID NO: 62798 - DNA, 20 bp, Artificial Sequence
  chemically synthesized
gggatatataatgaaaatgt

SEQ ID NO: 62799 - DNA, 20 bp, Artificial Sequence
  chemically synthesized
ttcattatatatccctttac

SEQ ID NO: 62800 - DNA, 20 bp, Artificial Sequence
  chemically synthesized
aggctttaacttctagtaaa

SEQ ID NO: 62801 - DNA, 20 bp, Artificial Sequence
  chemically synthesized
attatatatccctttactag

SEQ ID NO: 62802 - DNA, 20 bp, Artificial Sequence
  chemically synthesized
gaggctttaacttctagtaa

SEQ ID NO: 62803 - DNA, 20 bp, Artificial Sequence
  chemically synthesized
agaggctttaacttctagta

SEQ ID NO: 62804 - DNA, 20 bp, Artificial Sequence
  chemically synthesized
tatccctttactagaagtta

SEQ ID NO: 62805 - DNA, 20 bp, Artificial Sequence
  chemically synthesized
ggtatagaggctttaacttc

SEQ ID NO: 62806 - DNA, 20 bp, Artificial Sequence
  chemically synthesized
aacagtttgtgtcggtatag

SEQ ID NO: 62807 - DNA, 20 bp, Artificial Sequence
  chemically synthesized
gaacagtttgtgtcggtata

SEQ ID NO: 62808 - DNA, 20 bp, Artificial Sequence
  chemically synthesized
aggaacagtttgtgtcggta

SEQ ID NO: 62809 - DNA, 20 bp, Artificial Sequence
  chemically synthesized
acagcaggaacagtttgtgt

SEQ ID NO: 62810 - DNA, 20 bp, Artificial Sequence
  chemically synthesized
tattgttgtcacagcaggaa

SEQ ID NO: 62811 - DNA, 20 bp, Artificial Sequence
  chemically synthesized
ggctatattgttgtcacagc

SEQ ID NO: 62812 - DNA, 20 bp, Artificial Sequence
  chemically synthesized
tggctatattgttgtcacag

SEQ ID NO: 62813 - DNA, 20 bp, Artificial Sequence
  chemically synthesized
tgctggctatattgttgtca

SEQ ID NO: 62814 - DNA, 20 bp, Artificial Sequence
  chemically synthesized
ttcctgctgtgacaacaata

SEQ ID NO: 62815 - DNA, 20 bp, Artificial Sequence
  chemically synthesized
tgctgtgacaacaatatagc

SEQ ID NO: 62816 - DNA, 20 bp, Artificial Sequence
  chemically synthesized
gacaacaatatagccagcac

SEQ ID NO: 62817 - DNA, 20 bp, Artificial Sequence
  chemically synthesized
tggtttggggggacttgtgc

SEQ ID NO: 62818 - DNA, 20 bp, Artificial Sequence
  chemically synthesized
caggggatctgtggtttggg

SEQ ID NO: 62819 - DNA, 20 bp, Artificial Sequence
  chemically synthesized
tcaggggatctgtggtttgg

SEQ ID NO: 62820 - DNA, 20 bp, Artificial Sequence
  chemically synthesized
gcacaagtccccccaaacca

SEQ ID NO: 62821 - DNA, 20 bp, Artificial Sequence
  chemically synthesized
gtcaggggatctgtggtttg

SEQ ID NO: 62822 - DNA, 20 bp, Artificial Sequence
  chemically synthesized
ggtcaggggatctgtggttt

SEQ ID NO: 62823 - DNA, 20 bp, Artificial Sequence
  chemically synthesized
gggtcaggggatctgtggtt

SEQ ID NO: 62824 - DNA, 20 bp, Artificial Sequence
  chemically synthesized
caccagggtcaggggatctg

SEQ ID NO: 62825 - DNA, 20 bp, Artificial Sequence
  chemically synthesized
aaccacagatcccctgaccc

SEQ ID NO: 62826 - DNA, 20 bp, Artificial Sequence
  chemically synthesized
aatcttgacaccagggtcag

SEQ ID NO: 62827 - DNA, 20 bp, Artificial Sequence
  chemically synthesized
caatcttgacaccagggtca

SEQ ID NO: 62828 - DNA, 20 bp, Artificial Sequence
  chemically synthesized
ccaatcttgacaccagggtc

SEQ ID NO: 62829 - DNA, 20 bp, Artificial Sequence
  chemically synthesized
cccaatcttgacaccagggt

SEQ ID NO: 62830 - DNA, 20 bp, Artificial Sequence
  chemically synthesized
gatcccctgaccctggtgtc

SEQ ID NO: 62831 - DNA, 20 bp, Artificial Sequence
  chemically synthesized
aagacccaatcttgacacca

SEQ ID NO: 62832 - DNA, 20 bp, Artificial Sequence
  chemically synthesized
gaagacccaatcttgacacc

SEQ ID NO: 62833 - DNA, 20 bp, Artificial Sequence
  chemically synthesized
agaagacccaatcttgacac

SEQ ID NO: 62834 - DNA, 20 bp, Artificial Sequence
  chemically synthesized
cctgaccctggtgtcaagat

SEQ ID NO: 62835 - DNA, 20 bp, Artificial Sequence
  chemically synthesized
ctgaccctggtgtcaagatt

SEQ ID NO: 62836 - DNA, 20 bp, Artificial Sequence
  chemically synthesized
gtacccagatgcagaattag

SEQ ID NO: 62837 - DNA, 20 bp, Artificial Sequence
  chemically synthesized
agagtacccagatgcagaat

SEQ ID NO: 62838 - DNA, 20 bp, Artificial Sequence
  chemically synthesized
gggtcttctaattctgcatc

SEQ ID NO: 62839 - DNA, 20 bp, Artificial Sequence
  chemically synthesized
ggtcttctaattctgcatct

SEQ ID NO: 62840 - DNA, 20 bp, Artificial Sequence
  chemically synthesized
cttcctagagtacccagatg

SEQ ID NO: 62841 - DNA, 20 bp, Artificial Sequence
  chemically synthesized
aattctgcatctgggtactc

SEQ ID NO: 62842 - DNA, 20 bp, Artificial Sequence
  chemically synthesized
acaaagcttcctagagtacc

SEQ ID NO: 62843 - DNA, 20 bp, Artificial Sequence
  chemically synthesized
attctgcatctgggtactct

SEQ ID NO: 62844 - DNA, 20 bp, Artificial Sequence
  chemically synthesized
ctgcatctgggtactctagg

SEQ ID NO: 62845 - DNA, 20 bp, Artificial Sequence
  chemically synthesized
ggaagccacaaagcttccta

SEQ ID NO: 62846 - DNA, 20 bp, Artificial Sequence
  chemically synthesized
tgggaagccacaaagcttcc

SEQ ID NO: 62847 - DNA, 20 bp, Artificial Sequence
  chemically synthesized
gggtactctaggaagctttg

SEQ ID NO: 62848 - DNA, 20 bp, Artificial Sequence
  chemically synthesized
catataaatgggaagccaca

SEQ ID NO: 62849 - DNA, 20 bp, Artificial Sequence
  chemically synthesized
gcttcagtcatataaatggg

SEQ ID NO: 62850 - DNA, 20 bp, Artificial Sequence
  chemically synthesized
cgcgcttcagtcatataaat

SEQ ID NO: 62851 - DNA, 20 bp, Artificial Sequence
  chemically synthesized
tcgcgcttcagtcatataaa

SEQ ID NO: 62852 - DNA, 20 bp, Artificial Sequence
  chemically synthesized
gcttcccatttatatgactg

SEQ ID NO: 62853 - DNA, 20 bp, Artificial Sequence
  chemically synthesized
tatagacacagttcgcgctt

SEQ ID NO: 62854 - DNA, 20 bp, Artificial Sequence
  chemically synthesized
tgtgcatacacatatagaca

SEQ ID NO: 62855 - DNA, 20 bp, Artificial Sequence
  chemically synthesized
tgcatgtgtgcatacacata

SEQ ID NO: 62856 - DNA, 20 bp, Artificial Sequence
  chemically synthesized
gtgtatgcacacatgcacac

SEQ ID NO: 62857 - DNA, 20 bp, Artificial Sequence
  chemically synthesized
gtatgcacacatgcacactg

SEQ ID NO: 62858 - DNA, 20 bp, Artificial Sequence
  chemically synthesized
atgcacacatgcacactgga

SEQ ID NO: 62859 - DNA, 20 bp, Artificial Sequence
  chemically synthesized
acacatgcacactggagaga

SEQ ID NO: 62860 - DNA, 20 bp, Artificial Sequence
  chemically synthesized
cacatgcacactggagagaa

SEQ ID NO: 62861 - DNA, 20 bp, Artificial Sequence
  chemically synthesized
gatcttttgtcctttctctc

SEQ ID NO: 62862 - DNA, 20 bp, Artificial Sequence
  chemically synthesized
acactggagagaaaggacaa

SEQ ID NO: 62863 - DNA, 20 bp, Artificial Sequence
  chemically synthesized
caaaagatcattccacaatt

SEQ ID NO: 62864 - DNA, 20 bp, Artificial Sequence
  chemically synthesized
tagccttcaagtctcaattg

SEQ ID NO: 62865 - DNA, 20 bp, Artificial Sequence
  chemically synthesized
cattccacaattgagacttg

SEQ ID NO: 62866 - DNA, 20 bp, Artificial Sequence
  chemically synthesized
attccacaattgagacttga

SEQ ID NO: 62867 - DNA, 20 bp, Artificial Sequence
  chemically synthesized
catcttacagtttagccttc

SEQ ID NO: 62868 - DNA, 20 bp, Artificial Sequence
  chemically synthesized
agacttgaaggctaaactgt

SEQ ID NO: 62869 - DNA, 20 bp, Artificial Sequence
  chemically synthesized
cgtacagccatcttacagtt

SEQ ID NO: 62870 - DNA, 20 bp, Artificial Sequence
  chemically synthesized
ttgaaggctaaactgtaaga

SEQ ID NO: 62871 - DNA, 20 bp, Artificial Sequence
  chemically synthesized
tattacgtacagccatctta

SEQ ID NO: 62872 - DNA, 20 bp, Artificial Sequence
  chemically synthesized
gattagagctttattacgta

SEQ ID NO: 62873 - DNA, 20 bp, Artificial Sequence
  chemically synthesized
taagatggctgtacgtaata

SEQ ID NO: 62874 - DNA, 20 bp, Artificial Sequence
  chemically synthesized
aggagcctaatagaggatta

SEQ ID NO: 62875 - DNA, 20 bp, Artificial Sequence
  chemically synthesized
tcaggagcctaatagaggat

SEQ ID NO: 62876 - DNA, 20 bp, Artificial Sequence
  chemically synthesized
ataaagctctaatcctctat

SEQ ID NO: 62877 - DNA, 20 bp, Artificial Sequence
  chemically synthesized
taaagctctaatcctctatt

SEQ ID NO: 62878 - DNA, 20 bp, Artificial Sequence
  chemically synthesized
agatttcaggagcctaatag

SEQ ID NO: 62879 - DNA, 20 bp, Artificial Sequence
  chemically synthesized
tagatttcaggagcctaata

SEQ ID NO: 62880 - DNA, 20 bp, Artificial Sequence
  chemically synthesized
cctagatttcaggagcctaa

SEQ ID NO: 62881 - DNA, 20 bp, Artificial Sequence
  chemically synthesized
ccataaaacctagatttcag

SEQ ID NO: 62882 - DNA, 20 bp, Artificial Sequence
  chemically synthesized
tctattaggctcctgaaatc

SEQ ID NO: 62883 - DNA, 20 bp, Artificial Sequence
  chemically synthesized
ctattaggctcctgaaatct

SEQ ID NO: 62884 - DNA, 20 bp, Artificial Sequence
  chemically synthesized
aaccataaaacctagatttc

SEQ ID NO: 62885 - DNA, 20 bp, Artificial Sequence
  chemically synthesized
aaaccataaaacctagattt

SEQ ID NO: 62886 - DNA, 20 bp, Artificial Sequence
  chemically synthesized
ctcctgaaatctaggtttta

SEQ ID NO: 62887 - DNA, 20 bp, Artificial Sequence
  chemically synthesized
cattactaaaccataaaacc

SEQ ID NO: 62888 - DNA, 20 bp, Artificial Sequence
  chemically synthesized
gaaatctaggttttatggtt

SEQ ID NO: 62889 - DNA, 20 bp, Artificial Sequence
  chemically synthesized
gtaatgttttcattatttca

SEQ ID NO: 62890 - DNA, 20 bp, Artificial Sequence
  chemically synthesized
ttttcattatttcaaagact

SEQ ID NO: 62891 - DNA, 20 bp, Artificial Sequence
  chemically synthesized
cctcagagagaaagaattct

SEQ ID NO: 62892 - DNA, 20 bp, Artificial Sequence
  chemically synthesized
actcagaattctttctctct

SEQ ID NO: 62893 - DNA, 20 bp, Artificial Sequence
  chemically synthesized
tttgtgatgcctcagagaga

SEQ ID NO: 62894 - DNA, 20 bp, Artificial Sequence
  chemically synthesized
ctcagaattctttctctctg

SEQ ID NO: 62895 - DNA, 20 bp, Artificial Sequence
  chemically synthesized
agcttttgtgatgcctcaga

SEQ ID NO: 62896 - DNA, 20 bp, Artificial Sequence
  chemically synthesized
gaagcttttgtgatgcctca

SEQ ID NO: 62897 - DNA, 20 bp, Artificial Sequence
  chemically synthesized
tggaagcttttgtgatgcct

SEQ ID NO: 62898 - DNA, 20 bp, Artificial Sequence
  chemically synthesized
ttctctctgaggcatcacaa

SEQ ID NO: 62899 - DNA, 20 bp, Artificial Sequence
  chemically synthesized
aggcatcacaaaagcttcca

SEQ ID NO: 62900 - DNA, 20 bp, Artificial Sequence
  chemically synthesized
ttctctatctgtttctatgg

SEQ ID NO: 62901 - DNA, 20 bp, Artificial Sequence
  chemically synthesized
cacaaaagcttccatagaaa

SEQ ID NO: 62902 - DNA, 20 bp, Artificial Sequence
  chemically synthesized
tcattctctatctgtttcta

SEQ ID NO: 62903 - DNA, 20 bp, Artificial Sequence
  chemically synthesized
aaagcttccatagaaacaga

SEQ ID NO: 62904 - DNA, 20 bp, Artificial Sequence
  chemically synthesized
agcttccatagaaacagata

SEQ ID NO: 62905 - DNA, 20 bp, Artificial Sequence
  chemically synthesized
tagagaatgaatgtcacacc

SEQ ID NO: 62906 - DNA, 20 bp, Artificial Sequence
  chemically synthesized
aatgaatgtcacaccaagaa

SEQ ID NO: 62907 - DNA, 20 bp, Artificial Sequence
  chemically synthesized
atgaatgtcacaccaagaat

SEQ ID NO: 62908 - DNA, 20 bp, Artificial Sequence
  chemically synthesized
tttgctttatttcctattct

SEQ ID NO: 62909 - DNA, 20 bp, Artificial Sequence
  chemically synthesized
cacaccaagaataggaaata

SEQ ID NO: 62910 - DNA, 20 bp, Artificial Sequence
  chemically synthesized
caagaataggaaataaagca

SEQ ID NO: 62911 - DNA, 20 bp, Artificial Sequence
  chemically synthesized
ataaagcaaagaaaaatttg

SEQ ID NO: 62912 - DNA, 20 bp, Artificial Sequence
  chemically synthesized
aagaaaaatttgcagtgaac

SEQ ID NO: 62913 - DNA, 20 bp, Artificial Sequence
  chemically synthesized
ttatacctttcattaatgac

SEQ ID NO: 62914 - DNA, 20 bp, Artificial Sequence
  chemically synthesized
agtgaactagtcattaatga

SEQ ID NO: 62915 - DNA, 20 bp, Artificial Sequence
  chemically synthesized
gtgaactagtcattaatgaa

SEQ ID NO: 62916 - DNA, 20 bp, Artificial Sequence
  chemically synthesized
agtcattaatgaaaggtata

SEQ ID NO: 62917 - DNA, 20 bp, Artificial Sequence
  chemically synthesized
tcattaatgaaaggtataaa

SEQ ID NO: 62918 - DNA, 20 bp, Artificial Sequence
  chemically synthesized
aaatgttaataaatcattaa

SEQ ID NO: 62919 - DNA, 20 bp, Artificial Sequence
  chemically synthesized
aatgttaataaatcattaaa

SEQ ID NO: 62920 - DNA, 20 bp, Artificial Sequence
  chemically synthesized
ttaataaatcattaaaaggt

SEQ ID NO: 62921 - DNA, 20 bp, Artificial Sequence
  chemically synthesized
taataaatcattaaaaggtt

SEQ ID NO: 62922 - DNA, 20 bp, Artificial Sequence
  chemically synthesized
aaatcattaaaaggttagga

SEQ ID NO: 62923 - DNA, 20 bp, Artificial Sequence
  chemically synthesized
taaaaggttaggaaagtttc

SEQ ID NO: 62924 - DNA, 20 bp, Artificial Sequence
  chemically synthesized
aggttaggaaagtttccagc

SEQ ID NO: 62925 - DNA, 20 bp, Artificial Sequence
  chemically synthesized
ggttaggaaagtttccagca

SEQ ID NO: 62926 - DNA, 20 bp, Artificial Sequence
  chemically synthesized
taggaaagtttccagcaagg

SEQ ID NO: 62927 - DNA, 20 bp, Artificial Sequence
  chemically synthesized
ctcagagacctcttccttgc

SEQ ID NO: 62928 - DNA, 20 bp, Artificial Sequence
  chemically synthesized
ggaaagtttccagcaaggaa

SEQ ID NO: 62929 - DNA, 20 bp, Artificial Sequence
  chemically synthesized
gaaagtttccagcaaggaag

SEQ ID NO: 62930 - DNA, 20 bp, Artificial Sequence
  chemically synthesized
ccagcaaggaagaggtctct

SEQ ID NO: 62931 - DNA, 20 bp, Artificial Sequence
  chemically synthesized
atcctcaaccttttggctca

SEQ ID NO: 62932 - DNA, 20 bp, Artificial Sequence
  chemically synthesized
ggaagaggtctctgagccaa

SEQ ID NO: 62933 - DNA, 20 bp, Artificial Sequence
  chemically synthesized
gaagaggtctctgagccaaa

SEQ ID NO: 62934 - DNA, 20 bp, Artificial Sequence
  chemically synthesized
ttatcctcaaccttttggct

SEQ ID NO: 62935 - DNA, 20 bp, Artificial Sequence
  chemically synthesized
ggtctctgagccaaaaggtt

SEQ ID NO: 62936 - DNA, 20 bp, Artificial Sequence
  chemically synthesized
ccttgttatcctcaaccttt

SEQ ID NO: 62937 - DNA, 20 bp, Artificial Sequence
  chemically synthesized
gtctctgagccaaaaggttg

SEQ ID NO: 62938 - DNA, 20 bp, Artificial Sequence
  chemically synthesized
gccaaaaggttgaggataac

SEQ ID NO: 62939 - DNA, 20 bp, Artificial Sequence
  chemically synthesized
ccaaaaggttgaggataaca

SEQ ID NO: 62940 - DNA, 20 bp, Artificial Sequence
  chemically synthesized
ggataacaaggtacctcatt

SEQ ID NO: 62941 - DNA, 20 bp, Artificial Sequence
  chemically synthesized
tgacagaatatggctgaatg

SEQ ID NO: 62942 - DNA, 20 bp, Artificial Sequence
  chemically synthesized
atgacagaatatggctgaat

SEQ ID NO: 62943 - DNA, 20 bp, Artificial Sequence
  chemically synthesized
gtggagatgatgacagaata

SEQ ID NO: 62944 - DNA, 20 bp, Artificial Sequence
  chemically synthesized
atgatatgtggagatgatga

SEQ ID NO: 62945 - DNA, 20 bp, Artificial Sequence
  chemically synthesized
tttcaaaacaatgatatgtg

SEQ ID NO: 62946 - DNA, 20 bp, Artificial Sequence
  chemically synthesized
aatttcaaaacaatgatatg

SEQ ID NO: 62947 - DNA, 20 bp, Artificial Sequence
  chemically synthesized
attgttttgaaattttaata

SEQ ID NO: 62948 - DNA, 20 bp, Artificial Sequence
  chemically synthesized
ttttgaaattttaatatgga

SEQ ID NO: 62949 - DNA, 20 bp, Artificial Sequence
  chemically synthesized
tgaaattttaatatggaaag

SEQ ID NO: 62950 - DNA, 20 bp, Artificial Sequence
  chemically synthesized
gaaattttaatatggaaagc

SEQ ID NO: 62951 - DNA, 20 bp, Artificial Sequence
  chemically synthesized
gatgcagttcagttttttaa

SEQ ID NO: 62952 - DNA, 20 bp, Artificial Sequence
  chemically synthesized
aattgattttagatgcagtt

SEQ ID NO: 62953 - DNA, 20 bp, Artificial Sequence
  chemically synthesized
gatctaattgattttagatg

SEQ ID NO: 62954 - DNA, 20 bp, Artificial Sequence
  chemically synthesized
tcatgagatctaattgattt

SEQ ID NO: 62955 - DNA, 20 bp, Artificial Sequence
  chemically synthesized
gaactgcatctaaaatcaat

SEQ ID NO: 62956 - DNA, 20 bp, Artificial Sequence
  chemically synthesized
gaggtgaacatgtagatcat

SEQ ID NO: 62957 - DNA, 20 bp, Artificial Sequence
  chemically synthesized
cctaagatgaggtgaacatg

SEQ ID NO: 62958 - DNA, 20 bp, Artificial Sequence
  chemically synthesized
tctacatgttcacctcatct

SEQ ID NO: 62959 - DNA, 20 bp, Artificial Sequence
  chemically synthesized
ctacatgttcacctcatctt

SEQ ID NO: 62960 - DNA, 20 bp, Artificial Sequence
  chemically synthesized
tacatgttcacctcatctta

SEQ ID NO: 62961 - DNA, 20 bp, Artificial Sequence
  chemically synthesized
ctatactgtgccctaagatg

SEQ ID NO: 62962 - DNA, 20 bp, Artificial Sequence
  chemically synthesized
actatactgtgccctaagat

SEQ ID NO: 62963 - DNA, 20 bp, Artificial Sequence
  chemically synthesized
gttcacctcatcttagggca

SEQ ID NO: 62964 - DNA, 20 bp, Artificial Sequence
  chemically synthesized
catttactatactgtgccct

SEQ ID NO: 62965 - DNA, 20 bp, Artificial Sequence
  chemically synthesized
cctcatcttagggcacagta

SEQ ID NO: 62966 - DNA, 20 bp, Artificial Sequence
  chemically synthesized
aaaaatattttaaacaagtt

SEQ ID NO: 62967 - DNA, 20 bp, Artificial Sequence
  chemically synthesized
caagaaaaaatattttaaac

SEQ ID NO: 62968 - DNA, 20 bp, Artificial Sequence
  chemically synthesized
ttgtttaaaatattttttct

SEQ ID NO: 62969 - DNA, 20 bp, Artificial Sequence
  chemically synthesized
ttaaaatattttttcttggc

SEQ ID NO: 62970 - DNA, 20 bp, Artificial Sequence
  chemically synthesized
taaaatattttttcttggct

SEQ ID NO: 62971 - DNA, 20 bp, Artificial Sequence
  chemically synthesized
atgagccaccatgcccagcc

SEQ ID NO: 62972 - DNA, 20 bp, Artificial Sequence
  chemically synthesized
tattttttcttggctgggca

SEQ ID NO: 62973 - DNA, 20 bp, Artificial Sequence
  chemically synthesized
tttttcttggctgggcatgg

SEQ ID NO: 62974 - DNA, 20 bp, Artificial Sequence
  chemically synthesized
caggcatgagccaccatgcc

SEQ ID NO: 62975 - DNA, 20 bp, Artificial Sequence
  chemically synthesized
agtgctgggatgacaggcat

SEQ ID NO: 62976 - DNA, 20 bp, Artificial Sequence
  chemically synthesized
gtggctcatgcctgtcatcc

SEQ ID NO: 62977 - DNA, 20 bp, Artificial Sequence
  chemically synthesized
tcccaaagtgctgggatgac

SEQ ID NO: 62978 - DNA, 20 bp, Artificial Sequence
  chemically synthesized
ctcccaaagtgctgggatga

SEQ ID NO: 62979 - DNA, 20 bp, Artificial Sequence
  chemically synthesized
tgcctgtcatcccagcactt

SEQ ID NO: 62980 - DNA, 20 bp, Artificial Sequence
  chemically synthesized
cctcggcctcccaaagtgct

SEQ ID NO: 62981 - DNA, 20 bp, Artificial Sequence
  chemically synthesized
gcctgtcatcccagcacttt

SEQ ID NO: 62982 - DNA, 20 bp, Artificial Sequence
  chemically synthesized
gcctcggcctcccaaagtgc

SEQ ID NO: 62983 - DNA, 20 bp, Artificial Sequence
  chemically synthesized
ctgtcatcccagcactttgg

SEQ ID NO: 62984 - DNA, 20 bp, Artificial Sequence
  chemically synthesized
tgtcatcccagcactttggg

SEQ ID NO: 62985 - DNA, 20 bp, Artificial Sequence
  chemically synthesized
ccacctgcctcggcctccca

SEQ ID NO: 62986 - DNA, 20 bp, Artificial Sequence
  chemically synthesized
tcccagcactttgggaggcc

SEQ ID NO: 62987 - DNA, 20 bp, Artificial Sequence
  chemically synthesized
cccagcactttgggaggccg

SEQ ID NO: 62988 - DNA, 20 bp, Artificial Sequence
  chemically synthesized
agcactttgggaggccgagg

SEQ ID NO: 62989 - DNA, 20 bp, Artificial Sequence
  chemically synthesized
gcactttgggaggccgaggc

SEQ ID NO: 62990 - DNA, 20 bp, Artificial Sequence
  chemically synthesized
ctttgggaggccgaggcagg

SEQ ID NO: 62991 - DNA, 20 bp, Artificial Sequence
  chemically synthesized
atcttgtgatccacctgcct

SEQ ID NO: 62992 - DNA, 20 bp, Artificial Sequence
  chemically synthesized
ggccgaggcaggtggatcac

SEQ ID NO: 62993 - DNA, 20 bp, Artificial Sequence
  chemically synthesized
aggcaggtggatcacaagat

SEQ ID NO: 62994 - DNA, 20 bp, Artificial Sequence
  chemically synthesized
ggcaggtggatcacaagatc

SEQ ID NO: 62995 - DNA, 20 bp, Artificial Sequence
  chemically synthesized
caggtggatcacaagatcag

SEQ ID NO: 62996 - DNA, 20 bp, Artificial Sequence
  chemically synthesized
gatcacaagatcaggagttc

SEQ ID NO: 62997 - DNA, 20 bp, Artificial Sequence
  chemically synthesized
caagatcaggagttcgagac

SEQ ID NO: 62998 - DNA, 20 bp, Artificial Sequence
  chemically synthesized
tcaggagttcgagaccagcc

SEQ ID NO: 62999 - DNA, 20 bp, Artificial Sequence
  chemically synthesized
ttcaccatatttggccaggc

SEQ ID NO: 63000 - DNA, 20 bp, Artificial Sequence
  chemically synthesized
gggtttcaccatatttggcc

SEQ ID NO: 63001 - DNA, 20 bp, Artificial Sequence
  chemically synthesized
cgggtttcaccatatttggc

SEQ ID NO: 63002 - DNA, 20 bp, Artificial Sequence
  chemically synthesized
gagaccagcctggccaaata

SEQ ID NO: 63003 - DNA, 20 bp, Artificial Sequence
  chemically synthesized
agaccgggtttcaccatatt

SEQ ID NO: 63004 - DNA, 20 bp, Artificial Sequence
  chemically synthesized
tggccaaatatggtgaaacc

SEQ ID NO: 63005 - DNA, 20 bp, Artificial Sequence
  chemically synthesized
ttgtatttttagtggagacc

SEQ ID NO: 63006 - DNA, 20 bp, Artificial Sequence
  chemically synthesized
tttgtatttttagtggagac

SEQ ID NO: 63007 - DNA, 20 bp, Artificial Sequence
  chemically synthesized
taatttttgtatttttagtg

SEQ ID NO: 63008 - DNA, 20 bp, Artificial Sequence
  chemically synthesized
gctaatttttgtatttttag

SEQ ID NO: 63009 - DNA, 20 bp, Artificial Sequence
  chemically synthesized
ccggctaatttttgtatttt

SEQ ID NO: 63010 - DNA, 20 bp, Artificial Sequence
  chemically synthesized
tccactaaaaatacaaaaat

SEQ ID NO: 63011 - DNA, 20 bp, Artificial Sequence
  chemically synthesized
ctaaaaatacaaaaattagc

SEQ ID NO: 63012 - DNA, 20 bp, Artificial Sequence
  chemically synthesized
taaaaatacaaaaattagcc

SEQ ID NO: 63013 - DNA, 20 bp, Artificial Sequence
  chemically synthesized
atacaaaaattagccgggca

SEQ ID NO: 63014 - DNA, 20 bp, Artificial Sequence
  chemically synthesized
caaaaattagccgggcatgg

SEQ ID NO: 63015 - DNA, 20 bp, Artificial Sequence
  chemically synthesized
caggcgtccgccaccatgcc

SEQ ID NO: 63016 - DNA, 20 bp, Artificial Sequence
  chemically synthesized
aaattagccgggcatggtgg

SEQ ID NO: 63017 - DNA, 20 bp, Artificial Sequence
  chemically synthesized
ggcatggtggcggacgcctg

SEQ ID NO: 63018 - DNA, 20 bp, Artificial Sequence
  chemically synthesized
gtggcggacgcctgtagtcc

SEQ ID NO: 63019 - DNA, 20 bp, Artificial Sequence
  chemically synthesized
tccagagtagctgggactac

SEQ ID NO: 63020 - DNA, 20 bp, Artificial Sequence
  chemically synthesized
ctccagagtagctgggacta

SEQ ID NO: 63021 - DNA, 20 bp, Artificial Sequence
  chemically synthesized
cctcagcctccagagtagct

SEQ ID NO: 63022 - DNA, 20 bp, Artificial Sequence
  chemically synthesized
gcctgtagtcccagctactc

SEQ ID NO: 63023 - DNA, 20 bp, Artificial Sequence
  chemically synthesized
gcctcagcctccagagtagc

SEQ ID NO: 63024 - DNA, 20 bp, Artificial Sequence
  chemically synthesized
ctgtagtcccagctactctg

SEQ ID NO: 63025 - DNA, 20 bp, Artificial Sequence
  chemically synthesized
tgtagtcccagctactctgg

SEQ ID NO: 63026 - DNA, 20 bp, Artificial Sequence
  chemically synthesized
ccctgcctcagcctccagag

SEQ ID NO: 63027 - DNA, 20 bp, Artificial Sequence
  chemically synthesized
ttcccctgcctcagcctcca

SEQ ID NO: 63028 - DNA, 20 bp, Artificial Sequence
  chemically synthesized
tcccagctactctggaggct

SEQ ID NO: 63029 - DNA, 20 bp, Artificial Sequence
  chemically synthesized
cccagctactctggaggctg

SEQ ID NO: 63030 - DNA, 20 bp, Artificial Sequence
  chemically synthesized
aattcccctgcctcagcctc

SEQ ID NO: 63031 - DNA, 20 bp, Artificial Sequence
  chemically synthesized
agctactctggaggctgagg

SEQ ID NO: 63032 - DNA, 20 bp, Artificial Sequence
  chemically synthesized
gctactctggaggctgaggc

SEQ ID NO: 63033 - DNA, 20 bp, Artificial Sequence
  chemically synthesized
ctactctggaggctgaggca

SEQ ID NO: 63034 - DNA, 20 bp, Artificial Sequence
  chemically synthesized
tactctggaggctgaggcag

SEQ ID NO: 63035 - DNA, 20 bp, Artificial Sequence
  chemically synthesized
tttaagcaattcccctgcct

SEQ ID NO: 63036 - DNA, 20 bp, Artificial Sequence
  chemically synthesized
gcaggggaattgcttaaacc

SEQ ID NO: 63037 - DNA, 20 bp, Artificial Sequence
  chemically synthesized
caggggaattgcttaaaccc

SEQ ID NO: 63038 - DNA, 20 bp, Artificial Sequence
  chemically synthesized
aacctctgtctcctgggttt

SEQ ID NO: 63039 - DNA, 20 bp, Artificial Sequence
  chemically synthesized
ggggaattgcttaaacccag

SEQ ID NO: 63040 - DNA, 20 bp, Artificial Sequence
  chemically synthesized
aattgcttaaacccaggaga

SEQ ID NO: 63041 - DNA, 20 bp, Artificial Sequence
  chemically synthesized
cactgcaacctctgtctcct

SEQ ID NO: 63042 - DNA, 20 bp, Artificial Sequence
  chemically synthesized
ttgcttaaacccaggagaca

SEQ ID NO: 63043 - DNA, 20 bp, Artificial Sequence
  chemically synthesized
tcactgcaacctctgtctcc

SEQ ID NO: 63044 - DNA, 20 bp, Artificial Sequence
  chemically synthesized
tgcttaaacccaggagacag

SEQ ID NO: 63045 - DNA, 20 bp, Artificial Sequence
  chemically synthesized
aacccaggagacagaggttg

SEQ ID NO: 63046 - DNA, 20 bp, Artificial Sequence
  chemically synthesized
caggagacagaggttgcagt

SEQ ID NO: 63047 - DNA, 20 bp, Artificial Sequence
  chemically synthesized
gacagaggttgcagtgagcc

SEQ ID NO: 63048 - DNA, 20 bp, Artificial Sequence
  chemically synthesized
agagtgcagtggcgcaatct

SEQ ID NO: 63049 - DNA, 20 bp, Artificial Sequence
  chemically synthesized
tcgcccaggccagagtgcag

SEQ ID NO: 63050 - DNA, 20 bp, Artificial Sequence
  chemically synthesized
gagattgcgccactgcactc

SEQ ID NO: 63051 - DNA, 20 bp, Artificial Sequence
  chemically synthesized
ctgtcgcccaggccagagtg

SEQ ID NO: 63052 - DNA, 20 bp, Artificial Sequence
  chemically synthesized
tgcgccactgcactctggcc

SEQ ID NO: 63053 - DNA, 20 bp, Artificial Sequence
  chemically synthesized
gcgccactgcactctggcct

SEQ ID NO: 63054 - DNA, 20 bp, Artificial Sequence
  chemically synthesized
tcactctgtcgcccaggcca

SEQ ID NO: 63055 - DNA, 20 bp, Artificial Sequence
  chemically synthesized
tctcactctgtcgcccaggc

SEQ ID NO: 63056 - DNA, 20 bp, Artificial Sequence
  chemically synthesized
ctgcactctggcctgggcga

SEQ ID NO: 63057 - DNA, 20 bp, Artificial Sequence
  chemically synthesized
ggagtctcactctgtcgccc

SEQ ID NO: 63058 - DNA, 20 bp, Artificial Sequence
  chemically synthesized
gcactctggcctgggcgaca

SEQ ID NO: 63059 - DNA, 20 bp, Artificial Sequence
  chemically synthesized
tggagtctcactctgtcgcc

SEQ ID NO: 63060 - DNA, 20 bp, Artificial Sequence
  chemically synthesized
tctggcctgggcgacagagt

SEQ ID NO: 63061 - DNA, 20 bp, Artificial Sequence
  chemically synthesized
ttttttttttttttgagatg

SEQ ID NO: 63062 - DNA, 20 bp, Artificial Sequence
  chemically synthesized
gtttttttttttttttgaga

SEQ ID NO: 63063 - DNA, 20 bp, Artificial Sequence
  chemically synthesized
ttttgttttttttttttttt

SEQ ID NO: 63064 - DNA, 20 bp, Artificial Sequence
  chemically synthesized
tttgattttaagaaaaagtt

SEQ ID NO: 63065 - DNA, 20 bp, Artificial Sequence
  chemically synthesized
atttgattttaagaaaaagt

SEQ ID NO: 63066 - DNA, 20 bp, Artificial Sequence
  chemically synthesized
gaatatttgattttaagaaa

SEQ ID NO: 63067 - DNA, 20 bp, Artificial Sequence
  chemically synthesized
cctatggaatatttgatttt

SEQ ID NO: 63068 - DNA, 20 bp, Artificial Sequence
  chemically synthesized
tcttaaaatcaaatattcca

SEQ ID NO: 63069 - DNA, 20 bp, Artificial Sequence
  chemically synthesized
cttaaaatcaaatattccat

SEQ ID NO: 63070 - DNA, 20 bp, Artificial Sequence
  chemically synthesized
aaatcaaatattccatagga

SEQ ID NO: 63071 - DNA, 20 bp, Artificial Sequence
  chemically synthesized
atgctcatcacaccatccta

SEQ ID NO: 63072 - DNA, 20 bp, Artificial Sequence
  chemically synthesized
attccataggatggtgtgat

SEQ ID NO: 63073 - DNA, 20 bp, Artificial Sequence
  chemically synthesized
gtgatgagcattcacatatc

SEQ ID NO: 63074 - DNA, 20 bp, Artificial Sequence
  chemically synthesized
gatgagcattcacatatcaa

SEQ ID NO: 63075 - DNA, 20 bp, Artificial Sequence
  chemically synthesized
gtcatcatcatatcaacaac

SEQ ID NO: 63076 - DNA, 20 bp, Artificial Sequence
  chemically synthesized
agttggtattcaataatttc

SEQ ID NO: 63077 - DNA, 20 bp, Artificial Sequence
  chemically synthesized
tggagcacctggtgtatagt

SEQ ID NO: 63078 - DNA, 20 bp, Artificial Sequence
  chemically synthesized
attgaataccaactatacac

SEQ ID NO: 63079 - DNA, 20 bp, Artificial Sequence
  chemically synthesized
ttgaataccaactatacacc

SEQ ID NO: 63080 - DNA, 20 bp, Artificial Sequence
  chemically synthesized
aaagtggagcacctggtgta

SEQ ID NO: 63081 - DNA, 20 bp, Artificial Sequence
  chemically synthesized
aaaatgcaaagtggagcacc

SEQ ID NO: 63082 - DNA, 20 bp, Artificial Sequence
  chemically synthesized
tgcttgcaaaatgcaaagtg

SEQ ID NO: 63083 - DNA, 20 bp, Artificial Sequence
  chemically synthesized
aatgcttgcaaaatgcaaag

SEQ ID NO: 63084 - DNA, 20 bp, Artificial Sequence
  chemically synthesized
gacaatgcttgcaaaatgca

SEQ ID NO: 63085 - DNA, 20 bp, Artificial Sequence
  chemically synthesized
tgctccactttgcattttgc

SEQ ID NO: 63086 - DNA, 20 bp, Artificial Sequence
  chemically synthesized
gagttgtctgaggattagat

SEQ ID NO: 63087 - DNA, 20 bp, Artificial Sequence
  chemically synthesized
gcattgtctcatctaatcct

SEQ ID NO: 63088 - DNA, 20 bp, Artificial Sequence
  chemically synthesized
tcaaagagttgtctgaggat

SEQ ID NO: 63089 - DNA, 20 bp, Artificial Sequence
  chemically synthesized
ctcgctcaaagagttgtctg

SEQ ID NO: 63090 - DNA, 20 bp, Artificial Sequence
  chemically synthesized
actcgctcaaagagttgtct

SEQ ID NO: 63091 - DNA, 20 bp, Artificial Sequence
  chemically synthesized
taatcctcagacaactcttt

SEQ ID NO: 63092 - DNA, 20 bp, Artificial Sequence
  chemically synthesized
cctcagacaactctttgagc

SEQ ID NO: 63093 - DNA, 20 bp, Artificial Sequence
  chemically synthesized
aataatagcactcgctcaaa

SEQ ID NO: 63094 - DNA, 20 bp, Artificial Sequence
  chemically synthesized
gtaataatagcactcgctca

SEQ ID NO: 63095 - DNA, 20 bp, Artificial Sequence
  chemically synthesized
ctgttcaataggagtaataa

SEQ ID NO: 63096 - DNA, 20 bp, Artificial Sequence
  chemically synthesized
tttatttatctgttcaatag

SEQ ID NO: 63097 - DNA, 20 bp, Artificial Sequence
  chemically synthesized
ctattattactcctattgaa

SEQ ID NO: 63098 - DNA, 20 bp, Artificial Sequence
  chemically synthesized
catttatttatctgttcaat

SEQ ID NO: 63099 - DNA, 20 bp, Artificial Sequence
  chemically synthesized
ccatttatttatctgttcaa

SEQ ID NO: 63100 - DNA, 20 bp, Artificial Sequence
  chemically synthesized
ctattgaacagataaataaa

SEQ ID NO: 63101 - DNA, 20 bp, Artificial Sequence
  chemically synthesized
ttgaacagataaataaatgg

SEQ ID NO: 63102 - DNA, 20 bp, Artificial Sequence
  chemically synthesized
aataaatggaagcactacaa

SEQ ID NO: 63103 - DNA, 20 bp, Artificial Sequence
  chemically synthesized
ataaatggaagcactacaaa

SEQ ID NO: 63104 - DNA, 20 bp, Artificial Sequence
  chemically synthesized
taaatggaagcactacaaaa

SEQ ID NO: 63105 - DNA, 20 bp, Artificial Sequence
  chemically synthesized
aatggaagcactacaaaagg

SEQ ID NO: 63106 - DNA, 20 bp, Artificial Sequence
  chemically synthesized
ttactaacaactcccttttg

SEQ ID NO: 63107 - DNA, 20 bp, Artificial Sequence
  chemically synthesized
gcactacaaaagggagttgt

SEQ ID NO: 63108 - DNA, 20 bp, Artificial Sequence
  chemically synthesized
tacaaaagggagttgttagt

SEQ ID NO: 63109 - DNA, 20 bp, Artificial Sequence
  chemically synthesized
aaaagggagttgttagtaag

SEQ ID NO: 63110 - DNA, 20 bp, Artificial Sequence
  chemically synthesized
ggagttgttagtaagtggtg

SEQ ID NO: 63111 - DNA, 20 bp, Artificial Sequence
  chemically synthesized
tcaacgtgtggggtgtgaat

SEQ ID NO: 63112 - DNA, 20 bp, Artificial Sequence
  chemically synthesized
agtctgggagtcaacgtgtg

SEQ ID NO: 63113 - DNA, 20 bp, Artificial Sequence
  chemically synthesized
gagtctgggagtcaacgtgt

SEQ ID NO: 63114 - DNA, 20 bp, Artificial Sequence
  chemically synthesized
agagtctgggagtcaacgtg

SEQ ID NO: 63115 - DNA, 20 bp, Artificial Sequence
  chemically synthesized
acaccccacacgttgactcc

SEQ ID NO: 63116 - DNA, 20 bp, Artificial Sequence
  chemically synthesized
tgaaaattttcagagtctgg

SEQ ID NO: 63117 - DNA, 20 bp, Artificial Sequence
  chemically synthesized
tctgaaaattttcagagtct

SEQ ID NO: 63118 - DNA, 20 bp, Artificial Sequence
  chemically synthesized
gtctgaaaattttcagagtc

SEQ ID NO: 63119 - DNA, 20 bp, Artificial Sequence
  chemically synthesized
ttagagtctgaaaattttca

SEQ ID NO: 63120 - DNA, 20 bp, Artificial Sequence
  chemically synthesized
gcttagagtctgaaaatttt

SEQ ID NO: 63121 - DNA, 20 bp, Artificial Sequence
  chemically synthesized
tcccagactctgaaaatttt

SEQ ID NO: 63122 - DNA, 20 bp, Artificial Sequence
  chemically synthesized
tctgaaaattttcagactct

SEQ ID NO: 63123 - DNA, 20 bp, Artificial Sequence
  chemically synthesized
tttctatatttttaagctta

SEQ ID NO: 63124 - DNA, 20 bp, Artificial Sequence
  chemically synthesized
tatttctatatttttaagct

SEQ ID NO: 63125 - DNA, 20 bp, Artificial Sequence
  chemically synthesized
agactctaagcttaaaaata

SEQ ID NO: 63126 - DNA, 20 bp, Artificial Sequence
  chemically synthesized
ttgcttatttctatattttt

SEQ ID NO: 63127 - DNA, 20 bp, Artificial Sequence
  chemically synthesized
aagcttaaaaatatagaaat

SEQ ID NO: 63128 - DNA, 20 bp, Artificial Sequence
  chemically synthesized
aaataagcaaatgaataaac

SEQ ID NO: 63129 - DNA, 20 bp, Artificial Sequence
  chemically synthesized
ttctgggctgataagaacgc

SEQ ID NO: 63130 - DNA, 20 bp, Artificial Sequence
  chemically synthesized
gaataaactagcgttcttat

SEQ ID NO: 63131 - DNA, 20 bp, Artificial Sequence
  chemically synthesized
aactagcgttcttatcagcc

SEQ ID NO: 63132 - DNA, 20 bp, Artificial Sequence
  chemically synthesized
agactcctttctgggctgat

SEQ ID NO: 63133 - DNA, 20 bp, Artificial Sequence
  chemically synthesized
agcgttcttatcagcccaga

SEQ ID NO: 63134 - DNA, 20 bp, Artificial Sequence
  chemically synthesized
gcgttcttatcagcccagaa

SEQ ID NO: 63135 - DNA, 20 bp, Artificial Sequence
  chemically synthesized
gttcttatcagcccagaaag

SEQ ID NO: 63136 - DNA, 20 bp, Artificial Sequence
  chemically synthesized
taaagtgaagactcctttct

SEQ ID NO: 63137 - DNA, 20 bp, Artificial Sequence
  chemically synthesized
ataaagtgaagactcctttc

SEQ ID NO: 63138 - DNA, 20 bp, Artificial Sequence
  chemically synthesized
tgtttaacatgcataaagtg

SEQ ID NO: 63139 - DNA, 20 bp, Artificial Sequence
  chemically synthesized
aacagtgtttaacatgcata

SEQ ID NO: 63140 - DNA, 20 bp, Artificial Sequence
  chemically synthesized
atgttaaacactgttactgt

SEQ ID NO: 63141 - DNA, 20 bp, Artificial Sequence
  chemically synthesized
agcaatttagctaacagtaa

SEQ ID NO: 63142 - DNA, 20 bp, Artificial Sequence
  chemically synthesized
gtaaagagcaatttagctaa

SEQ ID NO: 63143 - DNA, 20 bp, Artificial Sequence
  chemically synthesized
ccttgttgtaaagagcaatt

SEQ ID NO: 63144 - DNA, 20 bp, Artificial Sequence
  chemically synthesized
cttgtaagccttgttgtaaa

SEQ ID NO: 63145 - DNA, 20 bp, Artificial Sequence
  chemically synthesized
gctaaattgctctttacaac

SEQ ID NO: 63146 - DNA, 20 bp, Artificial Sequence
  chemically synthesized
ctaaattgctctttacaaca

SEQ ID NO: 63147 - DNA, 20 bp, Artificial Sequence
  chemically synthesized
atcttgtaagccttgttgta

SEQ ID NO: 63148 - DNA, 20 bp, Artificial Sequence
  chemically synthesized
ctctttacaacaaggcttac

SEQ ID NO: 63149 - DNA, 20 bp, Artificial Sequence
  chemically synthesized
tgatagtatcatcatcttgt

SEQ ID NO: 63150 - DNA, 20 bp, Artificial Sequence
  chemically synthesized
cctcatatacaaaatgttga

SEQ ID NO: 63151 - DNA, 20 bp, Artificial Sequence
  chemically synthesized
actatcaacattttgtatat

SEQ ID NO: 63152 - DNA, 20 bp, Artificial Sequence
  chemically synthesized
ctatcaacattttgtatatg

SEQ ID NO: 63153 - DNA, 20 bp, Artificial Sequence
  chemically synthesized
ttttgtatatgaggaaactg

SEQ ID NO: 63154 - DNA, 20 bp, Artificial Sequence
  chemically synthesized
tatgaggaaactgaagtctt

SEQ ID NO: 63155 - DNA, 20 bp, Artificial Sequence
  chemically synthesized
ctagatttatcttaagactt

SEQ ID NO: 63156 - DNA, 20 bp, Artificial Sequence
  chemically synthesized
tagctagctagatttatctt

SEQ ID NO: 63157 - DNA, 20 bp, Artificial Sequence
  chemically synthesized
ctgaagtcttaagataaatc

SEQ ID NO: 63158 - DNA, 20 bp, Artificial Sequence
  chemically synthesized
agtcttaagataaatctagc

SEQ ID NO: 63159 - DNA, 20 bp, Artificial Sequence
  chemically synthesized
ctggctctgccatagctagc

SEQ ID NO: 63160 - DNA, 20 bp, Artificial Sequence
  chemically synthesized
aagataaatctagctagcta

SEQ ID NO: 63161 - DNA, 20 bp, Artificial Sequence
  chemically synthesized
ataaatctagctagctatgg

SEQ ID NO: 63162 - DNA, 20 bp, Artificial Sequence
  chemically synthesized
ggttctggctctgccatagc

SEQ ID NO: 63163 - DNA, 20 bp, Artificial Sequence
  chemically synthesized
aaatctagctagctatggca

SEQ ID NO: 63164 - DNA, 20 bp, Artificial Sequence
  chemically synthesized
ctcaggttctggctctgcca

SEQ ID NO: 63165 - DNA, 20 bp, Artificial Sequence
  chemically synthesized
ctagctagctatggcagagc

SEQ ID NO: 63166 - DNA, 20 bp, Artificial Sequence
  chemically synthesized
ctatggcagagccagaacct

SEQ ID NO: 63167 - DNA, 20 bp, Artificial Sequence
  chemically synthesized
aataaacagagctcaggttc

SEQ ID NO: 63168 - DNA, 20 bp, Artificial Sequence
  chemically synthesized
aataaaaataaacagagctc

SEQ ID NO: 63169 - DNA, 20 bp, Artificial Sequence
  chemically synthesized
gaataaaaataaacagagct

SEQ ID NO: 63170 - DNA, 20 bp, Artificial Sequence
  chemically synthesized
ctttagaataaaaataaaca

SEQ ID NO: 63171 - DNA, 20 bp, Artificial Sequence
  chemically synthesized
agctttagaataaaaataaa

SEQ ID NO: 63172 - DNA, 20 bp, Artificial Sequence
  chemically synthesized
ctctgtttatttttattcta

SEQ ID NO: 63173 - DNA, 20 bp, Artificial Sequence
  chemically synthesized
agcaaatattgacatagctt

SEQ ID NO: 63174 - DNA, 20 bp, Artificial Sequence
  chemically synthesized
agtattagcaaatattgaca

SEQ ID NO: 63175 - DNA, 20 bp, Artificial Sequence
  chemically synthesized
tgtcaatatttgctaatact

SEQ ID NO: 63176 - DNA, 20 bp, Artificial Sequence
  chemically synthesized
atattaccaataccaagtat

SEQ ID NO: 63177 - DNA, 20 bp, Artificial Sequence
  chemically synthesized
tatttgctaatacttggtat

SEQ ID NO: 63178 - DNA, 20 bp, Artificial Sequence
  chemically synthesized
attgtaatattaccaatacc

SEQ ID NO: 63179 - DNA, 20 bp, Artificial Sequence
  chemically synthesized
tggtattggtaatattacaa

SEQ ID NO: 63180 - DNA, 20 bp, Artificial Sequence
  chemically synthesized
tatcatgtgtcataaaaaga

SEQ ID NO: 63181 - DNA, 20 bp, Artificial Sequence
  chemically synthesized
tggatatcatgtgtcataaa

SEQ ID NO: 63182 - DNA, 20 bp, Artificial Sequence
  chemically synthesized
ataatctaatatttttgaga

SEQ ID NO: 63183 - DNA, 20 bp, Artificial Sequence
  chemically synthesized
tgttataatctaatattttt

SEQ ID NO: 63184 - DNA, 20 bp, Artificial Sequence
  chemically synthesized
gatatccatctcaaaaatat

SEQ ID NO: 63185 - DNA, 20 bp, Artificial Sequence
  chemically synthesized
ataacatttgtatgcaactt

SEQ ID NO: 63186 - DNA, 20 bp, Artificial Sequence
  chemically synthesized
catttgtatgcaacttaaga

SEQ ID NO: 63187 - DNA, 20 bp, Artificial Sequence
  chemically synthesized
caaataacttcatctttctt

SEQ ID NO: 63188 - DNA, 20 bp, Artificial Sequence
  chemically synthesized
tatgcaacttaagaaagatg

SEQ ID NO: 63189 - DNA, 20 bp, Artificial Sequence
  chemically synthesized
ttaagaaagatgaagttatt

SEQ ID NO: 63190 - DNA, 20 bp, Artificial Sequence
  chemically synthesized
aaagatgaagttatttggaa

SEQ ID NO: 63191 - DNA, 20 bp, Artificial Sequence
  chemically synthesized
aagatgaagttatttggaaa

SEQ ID NO: 63192 - DNA, 20 bp, Artificial Sequence
  chemically synthesized
agatgaagttatttggaaaa

SEQ ID NO: 63193 - DNA, 20 bp, Artificial Sequence
  chemically synthesized
agttatttggaaaagggatt

SEQ ID NO: 63194 - DNA, 20 bp, Artificial Sequence
  chemically synthesized
ggaaaagggattgagatatg

SEQ ID NO: 63195 - DNA, 20 bp, Artificial Sequence
  chemically synthesized
agatatgaagattgtgatat

SEQ ID NO: 63196 - DNA, 20 bp, Artificial Sequence
  chemically synthesized
gattgtgatataagaattgt

SEQ ID NO: 63197 - DNA, 20 bp, Artificial Sequence
  chemically synthesized
attgtgatataagaattgtt

SEQ ID NO: 63198 - DNA, 20 bp, Artificial Sequence
  chemically synthesized
taagaattgttaggtgacta

SEQ ID NO: 63199 - DNA, 20 bp, Artificial Sequence
  chemically synthesized
aaacctttccatcagagctg

SEQ ID NO: 63200 - DNA, 20 bp, Artificial Sequence
  chemically synthesized
ttaggtgactacagctctga

SEQ ID NO: 63201 - DNA, 20 bp, Artificial Sequence
  chemically synthesized
gtgactacagctctgatgga

SEQ ID NO: 63202 - DNA, 20 bp, Artificial Sequence
  chemically synthesized
gcgcataaacctttccatca

SEQ ID NO: 63203 - DNA, 20 bp, Artificial Sequence
  chemically synthesized
tgactacagctctgatggaa

SEQ ID NO: 63204 - DNA, 20 bp, Artificial Sequence
  chemically synthesized
gtgcgcataaacctttccat

SEQ ID NO: 63205 - DNA, 20 bp, Artificial Sequence
  chemically synthesized
atggaaaggtttatgcgcac

SEQ ID NO: 63206 - DNA, 20 bp, Artificial Sequence
  chemically synthesized
gtttatgcgcaccagaatct

SEQ ID NO: 63207 - DNA, 20 bp, Artificial Sequence
  chemically synthesized
cagagctacagctgagattc

SEQ ID NO: 63208 - DNA, 20 bp, Artificial Sequence
  chemically synthesized
gcgcaccagaatctcagctg

SEQ ID NO: 63209 - DNA, 20 bp, Artificial Sequence
  chemically synthesized
aagagaacagagctacagct

SEQ ID NO: 63210 - DNA, 20 bp, Artificial Sequence
  chemically synthesized
ctccaaagagaacagagcta

SEQ ID NO: 63211 - DNA, 20 bp, Artificial Sequence
  chemically synthesized
ttgtttctccaaagagaaca

SEQ ID NO: 63212 - DNA, 20 bp, Artificial Sequence
  chemically synthesized
agctgtagctctgttctctt

SEQ ID NO: 63213 - DNA, 20 bp, Artificial Sequence
  chemically synthesized
agttgtttctccaaagagaa

SEQ ID NO: 63214 - DNA, 20 bp, Artificial Sequence
  chemically synthesized
ctgtagctctgttctctttg

SEQ ID NO: 63215 - DNA, 20 bp, Artificial Sequence
  chemically synthesized
ttacaagttgtttctccaaa

SEQ ID NO: 63216 - DNA, 20 bp, Artificial Sequence
  chemically synthesized
ttttacaagttgtttctcca

SEQ ID NO: 63217 - DNA, 20 bp, Artificial Sequence
  chemically synthesized
aacaaggatcatatttttac

SEQ ID NO: 63218 - DNA, 20 bp, Artificial Sequence
  chemically synthesized
tgtaaaaatatgatccttgt

SEQ ID NO: 63219 - DNA, 20 bp, Artificial Sequence
  chemically synthesized
aaaaatatgatccttgttag

SEQ ID NO: 63220 - DNA, 20 bp, Artificial Sequence
  chemically synthesized
aaaatatgatccttgttagc

SEQ ID NO: 63221 - DNA, 20 bp, Artificial Sequence
  chemically synthesized
tattagatatcctgctaaca

SEQ ID NO: 63222 - DNA, 20 bp, Artificial Sequence
  chemically synthesized
atattagatatcctgctaac

SEQ ID NO: 63223 - DNA, 20 bp, Artificial Sequence
  chemically synthesized
aatggaacaagaatggatat

SEQ ID NO: 63224 - DNA, 20 bp, Artificial Sequence
  chemically synthesized
tgctatcaatggaacaagaa

SEQ ID NO: 63225 - DNA, 20 bp, Artificial Sequence
  chemically synthesized
tcaaatgctatcaatggaac

SEQ ID NO: 63226 - DNA, 20 bp, Artificial Sequence
  chemically synthesized
atccattcttgttccattga

SEQ ID NO: 63227 - DNA, 20 bp, Artificial Sequence
  chemically synthesized
taaatttcaaatgctatcaa

SEQ ID NO: 63228 - DNA, 20 bp, Artificial Sequence
  chemically synthesized
tatttatcaaataatcactt

SEQ ID NO: 63229 - DNA, 20 bp, Artificial Sequence
  chemically synthesized
aaggtagtttagaaaaactg

SEQ ID NO: 63230 - DNA, 20 bp, Artificial Sequence
  chemically synthesized
aaaatatttttaaggtagtt

SEQ ID NO: 63231 - DNA, 20 bp, Artificial Sequence
  chemically synthesized
ttttaaaaatatttttaagg

SEQ ID NO: 63232 - DNA, 20 bp, Artificial Sequence
  chemically synthesized
aggttttaaaaatattttta

SEQ ID NO: 63233 - DNA, 20 bp, Artificial Sequence
  chemically synthesized
caggttttaaaaatattttt

SEQ ID NO: 63234 - DNA, 20 bp, Artificial Sequence
  chemically synthesized
taaaaatatttttaaaacct

SEQ ID NO: 63235 - DNA, 20 bp, Artificial Sequence
  chemically synthesized
aaaaatatttttaaaacctg

SEQ ID NO: 63236 - DNA, 20 bp, Artificial Sequence
  chemically synthesized
atttttaaaacctgaggata

SEQ ID NO: 63237 - DNA, 20 bp, Artificial Sequence
  chemically synthesized
aatgtgtcctctttatcctc

SEQ ID NO: 63238 - DNA, 20 bp, Artificial Sequence
  chemically synthesized
aaatgtgtcctctttatcct

SEQ ID NO: 63239 - DNA, 20 bp, Artificial Sequence
  chemically synthesized
ttttaaaacctgaggataaa

SEQ ID NO: 63240 - DNA, 20 bp, Artificial Sequence
  chemically synthesized
tttaaaacctgaggataaag

SEQ ID NO: 63241 - DNA, 20 bp, Artificial Sequence
  chemically synthesized
aagaggacacatttttaaac

SEQ ID NO: 63242 - DNA, 20 bp, Artificial Sequence
  chemically synthesized
attgtaagagaaaaatgcac

SEQ ID NO: 63243 - DNA, 20 bp, Artificial Sequence
  chemically synthesized
gaatatcgatttaattgtaa

SEQ ID NO: 63244 - DNA, 20 bp, Artificial Sequence
  chemically synthesized
tggaatatcgatttaattgt

SEQ ID NO: 63245 - DNA, 20 bp, Artificial Sequence
  chemically synthesized
ttacaattaaatcgatattc

SEQ ID NO: 63246 - DNA, 20 bp, Artificial Sequence
  chemically synthesized
aattaaatcgatattccagc

SEQ ID NO: 63247 - DNA, 20 bp, Artificial Sequence
  chemically synthesized
attaaatcgatattccagct

SEQ ID NO: 63248 - DNA, 20 bp, Artificial Sequence
  chemically synthesized
cacgagccactgcacccagc

SEQ ID NO: 63249 - DNA, 20 bp, Artificial Sequence
  chemically synthesized
atcgatattccagctgggtg

SEQ ID NO: 63250 - DNA, 20 bp, Artificial Sequence
  chemically synthesized
gatattccagctgggtgcag

SEQ ID NO: 63251 - DNA, 20 bp, Artificial Sequence
  chemically synthesized
caggcacgagccactgcacc

SEQ ID NO: 63252 - DNA, 20 bp, Artificial Sequence
  chemically synthesized
agtgctgggattacaggcac

SEQ ID NO: 63253 - DNA, 20 bp, Artificial Sequence
  chemically synthesized
gtggctcgtgcctgtaatcc

SEQ ID NO: 63254 - DNA, 20 bp, Artificial Sequence
  chemically synthesized
tcccaaagtgctgggattac

SEQ ID NO: 63255 - DNA, 20 bp, Artificial Sequence
  chemically synthesized
ctcccaaagtgctgggatta

SEQ ID NO: 63256 - DNA, 20 bp, Artificial Sequence
  chemically synthesized
tgcctgtaatcccagcactt

SEQ ID NO: 63257 - DNA, 20 bp, Artificial Sequence
  chemically synthesized
cctcgacctcccaaagtgct

SEQ ID NO: 63258 - DNA, 20 bp, Artificial Sequence
  chemically synthesized
gcctgtaatcccagcacttt

SEQ ID NO: 63259 - DNA, 20 bp, Artificial Sequence
  chemically synthesized
acctcgacctcccaaagtgc

SEQ ID NO: 63260 - DNA, 20 bp, Artificial Sequence
  chemically synthesized
ctgtaatcccagcactttgg

SEQ ID NO: 63261 - DNA, 20 bp, Artificial Sequence
  chemically synthesized
tgtaatcccagcactttggg

SEQ ID NO: 63262 - DNA, 20 bp, Artificial Sequence
  chemically synthesized
ccacccacctcgacctccca

SEQ ID NO: 63263 - DNA, 20 bp, Artificial Sequence
  chemically synthesized
tcccagcactttgggaggtc

SEQ ID NO: 63264 - DNA, 20 bp, Artificial Sequence
  chemically synthesized
cccagcactttgggaggtcg

SEQ ID NO: 63265 - DNA, 20 bp, Artificial Sequence
  chemically synthesized
agcactttgggaggtcgagg

SEQ ID NO: 63266 - DNA, 20 bp, Artificial Sequence
  chemically synthesized
gcactttgggaggtcgaggt

SEQ ID NO: 63267 - DNA, 20 bp, Artificial Sequence
  chemically synthesized
ctttgggaggtcgaggtggg

SEQ ID NO: 63268 - DNA, 20 bp, Artificial Sequence
  chemically synthesized
tcgaggtgggtggatcacct

SEQ ID NO: 63269 - DNA, 20 bp, Artificial Sequence
  chemically synthesized
cgaggtgggtggatcacctg

SEQ ID NO: 63270 - DNA, 20 bp, Artificial Sequence
  chemically synthesized
gtgggtggatcacctgaggt

SEQ ID NO: 63271 - DNA, 20 bp, Artificial Sequence
  chemically synthesized
tgggtggatcacctgaggtc

SEQ ID NO: 63272 - DNA, 20 bp, Artificial Sequence
  chemically synthesized
gttccgaaactcctgacctc

SEQ ID NO: 63273 - DNA, 20 bp, Artificial Sequence
  chemically synthesized
ggtggatcacctgaggtcag

SEQ ID NO: 63274 - DNA, 20 bp, Artificial Sequence
  chemically synthesized
tgttccgaaactcctgacct

SEQ ID NO: 63275 - DNA, 20 bp, Artificial Sequence
  chemically synthesized
tcacctgaggtcaggagttt

SEQ ID NO: 63276 - DNA, 20 bp, Artificial Sequence
  chemically synthesized
tgaggtcaggagtttcggaa

SEQ ID NO: 63277 - DNA, 20 bp, Artificial Sequence
  chemically synthesized
tcaggagtttcggaacagcc

SEQ ID NO: 63278 - DNA, 20 bp, Artificial Sequence
  chemically synthesized
agagtttcaccatgttggcc

SEQ ID NO: 63279 - DNA, 20 bp, Artificial Sequence
  chemically synthesized
tcggaacagcctggccaaca

SEQ ID NO: 63280 - DNA, 20 bp, Artificial Sequence
  chemically synthesized
cagagtttcaccatgttggc

SEQ ID NO: 63281 - DNA, 20 bp, Artificial Sequence
  chemically synthesized
gagacagagtttcaccatgt

SEQ ID NO: 63282 - DNA, 20 bp, Artificial Sequence
  chemically synthesized
ttgtattttcagtagagaca

SEQ ID NO: 63283 - DNA, 20 bp, Artificial Sequence
  chemically synthesized
ttttgtattttcagtagaga

SEQ ID NO: 63284 - DNA, 20 bp, Artificial Sequence
  chemically synthesized
taatttttgtattttcagta

SEQ ID NO: 63285 - DNA, 20 bp, Artificial Sequence
  chemically synthesized
gctaatttttgtattttcag

SEQ ID NO: 63286 - DNA, 20 bp, Artificial Sequence
  chemically synthesized
ccagctaatttttgtatttt

SEQ ID NO: 63287 - DNA, 20 bp, Artificial Sequence
  chemically synthesized
tctactgaaaatacaaaaat

SEQ ID NO: 63288 - DNA, 20 bp, Artificial Sequence
  chemically synthesized
ctgaaaatacaaaaattagc

SEQ ID NO: 63289 - DNA, 20 bp, Artificial Sequence
  chemically synthesized
tgaaaatacaaaaattagct

SEQ ID NO: 63290 - DNA, 20 bp, Artificial Sequence
  chemically synthesized
atacaaaaattagctgggtg

SEQ ID NO: 63291 - DNA, 20 bp, Artificial Sequence
  chemically synthesized
caaaaattagctgggtgtgg

SEQ ID NO: 63292 - DNA, 20 bp, Artificial Sequence
  chemically synthesized
caggcacgtgccaccacacc

SEQ ID NO: 63293 - DNA, 20 bp, Artificial Sequence
  chemically synthesized
ggtgtggtggcacgtgcctg

SEQ ID NO: 63294 - DNA, 20 bp, Artificial Sequence
  chemically synthesized
gtggcacgtgcctgtagtcc

SEQ ID NO: 63295 - DNA, 20 bp, Artificial Sequence
  chemically synthesized
tcctgagtagctgggactac

SEQ ID NO: 63296 - DNA, 20 bp, Artificial Sequence
  chemically synthesized
ctcctgagtagctgggacta

SEQ ID NO: 63297 - DNA, 20 bp, Artificial Sequence
  chemically synthesized
tgcctgtagtcccagctact

SEQ ID NO: 63298 - DNA, 20 bp, Artificial Sequence
  chemically synthesized
cctcagcctcctgagtagct

SEQ ID NO: 63299 - DNA, 20 bp, Artificial Sequence
  chemically synthesized
gcctgtagtcccagctactc

SEQ ID NO: 63300 - DNA, 20 bp, Artificial Sequence
  chemically synthesized
gcctcagcctcctgagtagc

SEQ ID NO: 63301 - DNA, 20 bp, Artificial Sequence
  chemically synthesized
ctgtagtcccagctactcag

SEQ ID NO: 63302 - DNA, 20 bp, Artificial Sequence
  chemically synthesized
tgtagtcccagctactcagg

SEQ ID NO: 63303 - DNA, 20 bp, Artificial Sequence
  chemically synthesized
tcctgcctcagcctcctgag

SEQ ID NO: 63304 - DNA, 20 bp, Artificial Sequence
  chemically synthesized
ttctcctgcctcagcctcct

SEQ ID NO: 63305 - DNA, 20 bp, Artificial Sequence
  chemically synthesized
tcccagctactcaggaggct

SEQ ID NO: 63306 - DNA, 20 bp, Artificial Sequence
  chemically synthesized
cccagctactcaggaggctg

SEQ ID NO: 63307 - DNA, 20 bp, Artificial Sequence
  chemically synthesized
agctactcaggaggctgagg

SEQ ID NO: 63308 - DNA, 20 bp, Artificial Sequence
  chemically synthesized
gctactcaggaggctgaggc

SEQ ID NO: 63309 - DNA, 20 bp, Artificial Sequence
  chemically synthesized
tactcaggaggctgaggcag

SEQ ID NO: 63310 - DNA, 20 bp, Artificial Sequence
  chemically synthesized
ttcaagcaattctcctgcct

SEQ ID NO: 63311 - DNA, 20 bp, Artificial Sequence
  chemically synthesized
gcaggagaattgcttgaacc

SEQ ID NO: 63312 - DNA, 20 bp, Artificial Sequence
  chemically synthesized
caggagaattgcttgaaccc

SEQ ID NO: 63313 - DNA, 20 bp, Artificial Sequence
  chemically synthesized
aacctctggctcccgggttc

SEQ ID NO: 63314 - DNA, 20 bp, Artificial Sequence
  chemically synthesized
ggagaattgcttgaacccgg

SEQ ID NO: 63315 - DNA, 20 bp, Artificial Sequence
  chemically synthesized
aattgcttgaacccgggagc

SEQ ID NO: 63316 - DNA, 20 bp, Artificial Sequence
  chemically synthesized
cactgcaacctctggctccc

SEQ ID NO: 63317 - DNA, 20 bp, Artificial Sequence
  chemically synthesized
ttgcttgaacccgggagcca

SEQ ID NO: 63318 - DNA, 20 bp, Artificial Sequence
  chemically synthesized
tcactgcaacctctggctcc

SEQ ID NO: 63319 - DNA, 20 bp, Artificial Sequence
  chemically synthesized
tgcttgaacccgggagccag

SEQ ID NO: 63320 - DNA, 20 bp, Artificial Sequence
  chemically synthesized
aacccgggagccagaggttg

SEQ ID NO: 63321 - DNA, 20 bp, Artificial Sequence
  chemically synthesized
tctcagctcactgcaacctc

SEQ ID NO: 63322 - DNA, 20 bp, Artificial Sequence
  chemically synthesized
cgggagccagaggttgcagt

SEQ ID NO: 63323 - DNA, 20 bp, Artificial Sequence
  chemically synthesized
gccagaggttgcagtgagct

SEQ ID NO: 63324 - DNA, 20 bp, Artificial Sequence
  chemically synthesized
ggagtccaatggcatgatct

SEQ ID NO: 63325 - DNA, 20 bp, Artificial Sequence
  chemically synthesized
gtgagctgagatcatgccat

SEQ ID NO: 63326 - DNA, 20 bp, Artificial Sequence
  chemically synthesized
tggcccagactggagtccaa

SEQ ID NO: 63327 - DNA, 20 bp, Artificial Sequence
  chemically synthesized
gagatcatgccattggactc

SEQ ID NO: 63328 - DNA, 20 bp, Artificial Sequence
  chemically synthesized
catgccattggactccagtc

SEQ ID NO: 63329 - DNA, 20 bp, Artificial Sequence
  chemically synthesized
atgccattggactccagtct

SEQ ID NO: 63330 - DNA, 20 bp, Artificial Sequence
  chemically synthesized
tcgctccgtggcccagactg

SEQ ID NO: 63331 - DNA, 20 bp, Artificial Sequence
  chemically synthesized
tctcgctccgtggcccagac

SEQ ID NO: 63332 - DNA, 20 bp, Artificial Sequence
  chemically synthesized
ttggactccagtctgggcca

SEQ ID NO: 63333 - DNA, 20 bp, Artificial Sequence
  chemically synthesized
ggactccagtctgggccacg

SEQ ID NO: 63334 - DNA, 20 bp, Artificial Sequence
  chemically synthesized
cagagtctcgctccgtggcc

SEQ ID NO: 63335 - DNA, 20 bp, Artificial Sequence
  chemically synthesized
tccagtctgggccacggagc

SEQ ID NO: 63336 - DNA, 20 bp, Artificial Sequence
  chemically synthesized
tgagacagagtctcgctccg

SEQ ID NO: 63337 - DNA, 20 bp, Artificial Sequence
  chemically synthesized
aaaaaattttttttgagaca

SEQ ID NO: 63338 - DNA, 20 bp, Artificial Sequence
  chemically synthesized
ttaaaaaattttttttgaga

SEQ ID NO: 63339 - DNA, 20 bp, Artificial Sequence
  chemically synthesized
aactttaaaaaatttttttt

SEQ ID NO: 63340 - DNA, 20 bp, Artificial Sequence
  chemically synthesized
gtctcaaaaaaaatttttta

SEQ ID NO: 63341 - DNA, 20 bp, Artificial Sequence
  chemically synthesized
tttaagtggagaaaaataaa

SEQ ID NO: 63342 - DNA, 20 bp, Artificial Sequence
  chemically synthesized
aaaaaatctgtatttaagtg

SEQ ID NO: 63343 - DNA, 20 bp, Artificial Sequence
  chemically synthesized
aaaaaaaatctgtatttaag

SEQ ID NO: 63344 - DNA, 20 bp, Artificial Sequence
  chemically synthesized
tatttttctccacttaaata

SEQ ID NO: 63345 - DNA, 20 bp, Artificial Sequence
  chemically synthesized
cataaaaaaaatctgtattt

SEQ ID NO: 63346 - DNA, 20 bp, Artificial Sequence
  chemically synthesized
gattttttttatgatctcat

SEQ ID NO: 63347 - DNA, 20 bp, Artificial Sequence
  chemically synthesized
attttttttatgatctcata

SEQ ID NO: 63348 - DNA, 20 bp, Artificial Sequence
  chemically synthesized
ctattcattgtgatccttat

SEQ ID NO: 63349 - DNA, 20 bp, Artificial Sequence
  chemically synthesized
ctcataaggatcacaatgaa

SEQ ID NO: 63350 - DNA, 20 bp, Artificial Sequence
  chemically synthesized
taaggatcacaatgaatagc

SEQ ID NO: 63351 - DNA, 20 bp, Artificial Sequence
  chemically synthesized
aaggatcacaatgaatagct

SEQ ID NO: 63352 - DNA, 20 bp, Artificial Sequence
  chemically synthesized
cacaatgaatagctaggcct

SEQ ID NO: 63353 - DNA, 20 bp, Artificial Sequence
  chemically synthesized
aaagctgcaaaactaaggcc

SEQ ID NO: 63354 - DNA, 20 bp, Artificial Sequence
  chemically synthesized
aaactaaagctgcaaaacta

SEQ ID NO: 63355 - DNA, 20 bp, Artificial Sequence
  chemically synthesized
atagctaggccttagttttg

SEQ ID NO: 63356 - DNA, 20 bp, Artificial Sequence
  chemically synthesized
gaaactaaagctgcaaaact

SEQ ID NO: 63357 - DNA, 20 bp, Artificial Sequence
  chemically synthesized
aggccttagttttgcagctt

SEQ ID NO: 63358 - DNA, 20 bp, Artificial Sequence
  chemically synthesized
ctctcatagtaatgaaacta

SEQ ID NO: 63359 - DNA, 20 bp, Artificial Sequence
  chemically synthesized
agctttagtttcattactat

SEQ ID NO: 63360 - DNA, 20 bp, Artificial Sequence
  chemically synthesized
ctttagtttcattactatga

SEQ ID NO: 63361 - DNA, 20 bp, Artificial Sequence
  chemically synthesized
ttagtttcattactatgaga

SEQ ID NO: 63362 - DNA, 20 bp, Artificial Sequence
  chemically synthesized
agtttcattactatgagaga

SEQ ID NO: 63363 - DNA, 20 bp, Artificial Sequence
  chemically synthesized
tcacccttctctctctctca

SEQ ID NO: 63364 - DNA, 20 bp, Artificial Sequence
  chemically synthesized
tttcattactatgagagaga

SEQ ID NO: 63365 - DNA, 20 bp, Artificial Sequence
  chemically synthesized
cattactatgagagagagag

SEQ ID NO: 63366 - DNA, 20 bp, Artificial Sequence
  chemically synthesized
attactatgagagagagaga

SEQ ID NO: 63367 - DNA, 20 bp, Artificial Sequence
  chemically synthesized
ttactatgagagagagagaa

SEQ ID NO: 63368 - DNA, 20 bp, Artificial Sequence
  chemically synthesized
tatgagagagagagaagggt

SEQ ID NO: 63369 - DNA, 20 bp, Artificial Sequence
  chemically synthesized
tgagagagagagaagggtga

SEQ ID NO: 63370 - DNA, 20 bp, Artificial Sequence
  chemically synthesized
agagagagagaagggtgaga

SEQ ID NO: 63371 - DNA, 20 bp, Artificial Sequence
  chemically synthesized
agagagagaagggtgagaga

SEQ ID NO: 63372 - DNA, 20 bp, Artificial Sequence
  chemically synthesized
agagagaagggtgagagaga

SEQ ID NO: 63373 - DNA, 20 bp, Artificial Sequence
  chemically synthesized
agagaagggtgagagagaga

SEQ ID NO: 63374 - DNA, 20 bp, Artificial Sequence
  chemically synthesized
agaagggtgagagagagaga

SEQ ID NO: 63375 - DNA, 20 bp, Artificial Sequence
  chemically synthesized
aagggtgagagagagagaga

SEQ ID NO: 63376 - DNA, 20 bp, Artificial Sequence
  chemically synthesized
gggtgagagagagagagaga

SEQ ID NO: 63377 - DNA, 20 bp, Artificial Sequence
  chemically synthesized
gtgagagagagagagagaga

SEQ ID NO: 63378 - DNA, 20 bp, Artificial Sequence
  chemically synthesized
gagagagagagagagagaga

SEQ ID NO: 63379 - DNA, 20 bp, Artificial Sequence
  chemically synthesized
gagagagagagagagagacc

SEQ ID NO: 63380 - DNA, 20 bp, Artificial Sequence
  chemically synthesized
agagagagagagaccaagtg

SEQ ID NO: 63381 - DNA, 20 bp, Artificial Sequence
  chemically synthesized
atatgtcttctcaccacact

SEQ ID NO: 63382 - DNA, 20 bp, Artificial Sequence
  chemically synthesized
agagagagaccaagtgtggt

SEQ ID NO: 63383 - DNA, 20 bp, Artificial Sequence
  chemically synthesized
gagagaccaagtgtggtgag

SEQ ID NO: 63384 - DNA, 20 bp, Artificial Sequence
  chemically synthesized
gaagacatatgttgtctttg

SEQ ID NO: 63385 - DNA, 20 bp, Artificial Sequence
  chemically synthesized
aagacatatgttgtctttgt

SEQ ID NO: 63386 - DNA, 20 bp, Artificial Sequence
  chemically synthesized
gatgaaatactggacccaca

SEQ ID NO: 63387 - DNA, 20 bp, Artificial Sequence
  chemically synthesized
atatgttgtctttgtgggtc

SEQ ID NO: 63388 - DNA, 20 bp, Artificial Sequence
  chemically synthesized
ttagtagaaggatgaaatac

SEQ ID NO: 63389 - DNA, 20 bp, Artificial Sequence
  chemically synthesized
acaaccaggcagttagtaga

SEQ ID NO: 63390 - DNA, 20 bp, Artificial Sequence
  chemically synthesized
aacaaccaggcagttagtag

SEQ ID NO: 63391 - DNA, 20 bp, Artificial Sequence
  chemically synthesized
aacaacaaccaggcagttag

SEQ ID NO: 63392 - DNA, 20 bp, Artificial Sequence
  chemically synthesized
tcatccttctactaactgcc

SEQ ID NO: 63393 - DNA, 20 bp, Artificial Sequence
  chemically synthesized
agaaacaacaaccaggcagt

SEQ ID NO: 63394 - DNA, 20 bp, Artificial Sequence
  chemically synthesized
aaacagaaacaacaaccagg

SEQ ID NO: 63395 - DNA, 20 bp, Artificial Sequence
  chemically synthesized
caaaaacagaaacaacaacc

SEQ ID NO: 63396 - DNA, 20 bp, Artificial Sequence
  chemically synthesized
acaaaaacagaaacaacaac

SEQ ID NO: 63397 - DNA, 20 bp, Artificial Sequence
  chemically synthesized
cctcaaaggaaaaacaaaaa

SEQ ID NO: 63398 - DNA, 20 bp, Artificial Sequence
  chemically synthesized
tctgtttttgtttttccttt

SEQ ID NO: 63399 - DNA, 20 bp, Artificial Sequence
  chemically synthesized
ctgtttttgtttttcctttg

SEQ ID NO: 63400 - DNA, 20 bp, Artificial Sequence
  chemically synthesized
tggggaaagcgattcctcaa

SEQ ID NO: 63401 - DNA, 20 bp, Artificial Sequence
  chemically synthesized
atggggaaagcgattcctca

SEQ ID NO: 63402 - DNA, 20 bp, Artificial Sequence
  chemically synthesized
agtcacaagaaatatgggga

SEQ ID NO: 63403 - DNA, 20 bp, Artificial Sequence
  chemically synthesized
ctagagtcacaagaaatatg

SEQ ID NO: 63404 - DNA, 20 bp, Artificial Sequence
  chemically synthesized
actagagtcacaagaaatat

SEQ ID NO: 63405 - DNA, 20 bp, Artificial Sequence
  chemically synthesized
tactagagtcacaagaaata

SEQ ID NO: 63406 - DNA, 20 bp, Artificial Sequence
  chemically synthesized
ccccatatttcttgtgactc

SEQ ID NO: 63407 - DNA, 20 bp, Artificial Sequence
  chemically synthesized
ggcagctctactagagtcac

SEQ ID NO: 63408 - DNA, 20 bp, Artificial Sequence
  chemically synthesized
catatttcttgtgactctag

SEQ ID NO: 63409 - DNA, 20 bp, Artificial Sequence
  chemically synthesized
tatttcttgtgactctagta

SEQ ID NO: 63410 - DNA, 20 bp, Artificial Sequence
  chemically synthesized
catgattggcagctctacta

SEQ ID NO: 63411 - DNA, 20 bp, Artificial Sequence
  chemically synthesized
accatgattggcagctctac

SEQ ID NO: 63412 - DNA, 20 bp, Artificial Sequence
  chemically synthesized
tctagtagagctgccaatca

SEQ ID NO: 63413 - DNA, 20 bp, Artificial Sequence
  chemically synthesized
caaaaaggtaccatgattgg

SEQ ID NO: 63414 - DNA, 20 bp, Artificial Sequence
  chemically synthesized
aggcaaaaaggtaccatgat

SEQ ID NO: 63415 - DNA, 20 bp, Artificial Sequence
  chemically synthesized
gggaattgaggaaggcaaaa

SEQ ID NO: 63416 - DNA, 20 bp, Artificial Sequence
  chemically synthesized
ggggaattgaggaaggcaaa

SEQ ID NO: 63417 - DNA, 20 bp, Artificial Sequence
  chemically synthesized
ctctttaggggaattgagga

SEQ ID NO: 63418 - DNA, 20 bp, Artificial Sequence
  chemically synthesized
actctttaggggaattgagg

SEQ ID NO: 63419 - DNA, 20 bp, Artificial Sequence
  chemically synthesized
tgaactctttaggggaattg

SEQ ID NO: 63420 - DNA, 20 bp, Artificial Sequence
  chemically synthesized
ttgaactctttaggggaatt

SEQ ID NO: 63421 - DNA, 20 bp, Artificial Sequence
  chemically synthesized
tgccttcctcaattccccta

SEQ ID NO: 63422 - DNA, 20 bp, Artificial Sequence
  chemically synthesized
ccttcctcaattcccctaaa

SEQ ID NO: 63423 - DNA, 20 bp, Artificial Sequence
  chemically synthesized
ggggtctttgaactctttag

SEQ ID NO: 63424 - DNA, 20 bp, Artificial Sequence
  chemically synthesized
tggggtctttgaactcttta

SEQ ID NO: 63425 - DNA, 20 bp, Artificial Sequence
  chemically synthesized
atggggtctttgaactcttt

SEQ ID NO: 63426 - DNA, 20 bp, Artificial Sequence
  chemically synthesized
tatggggtctttgaactctt

SEQ ID NO: 63427 - DNA, 20 bp, Artificial Sequence
  chemically synthesized
caattcccctaaagagttca

SEQ ID NO: 63428 - DNA, 20 bp, Artificial Sequence
  chemically synthesized
taaagagttcaaagacccca

SEQ ID NO: 63429 - DNA, 20 bp, Artificial Sequence
  chemically synthesized
aaagagttcaaagaccccat

SEQ ID NO: 63430 - DNA, 20 bp, Artificial Sequence
  chemically synthesized
cagagtctgagtaacctatg

SEQ ID NO: 63431 - DNA, 20 bp, Artificial Sequence
  chemically synthesized
gcagagtctgagtaacctat

SEQ ID NO: 63432 - DNA, 20 bp, Artificial Sequence
  chemically synthesized
ggcagagtctgagtaaccta

SEQ ID NO: 63433 - DNA, 20 bp, Artificial Sequence
  chemically synthesized
caaagaccccataggttact

SEQ ID NO: 63434 - DNA, 20 bp, Artificial Sequence
  chemically synthesized
cttcctgagtggcagagtct

SEQ ID NO: 63435 - DNA, 20 bp, Artificial Sequence
  chemically synthesized
gttactcagactctgccact

SEQ ID NO: 63436 - DNA, 20 bp, Artificial Sequence
  chemically synthesized
tgtcagcttcctgagtggca

SEQ ID NO: 63437 - DNA, 20 bp, Artificial Sequence
  chemically synthesized
ttactcagactctgccactc

SEQ ID NO: 63438 - DNA, 20 bp, Artificial Sequence
  chemically synthesized
tttgtcagcttcctgagtgg

SEQ ID NO: 63439 - DNA, 20 bp, Artificial Sequence
  chemically synthesized
ctcagactctgccactcagg

SEQ ID NO: 63440 - DNA, 20 bp, Artificial Sequence
  chemically synthesized
tcctttgtcagcttcctgag

SEQ ID NO: 63441 - DNA, 20 bp, Artificial Sequence
  chemically synthesized
tcttcctttgtcagcttcct

SEQ ID NO: 63442 - DNA, 20 bp, Artificial Sequence
  chemically synthesized
tgccactcaggaagctgaca

SEQ ID NO: 63443 - DNA, 20 bp, Artificial Sequence
  chemically synthesized
gccactcaggaagctgacaa

SEQ ID NO: 63444 - DNA, 20 bp, Artificial Sequence
  chemically synthesized
actcaggaagctgacaaagg

SEQ ID NO: 63445 - DNA, 20 bp, Artificial Sequence
  chemically synthesized
gtattattttcttcctttgt

SEQ ID NO: 63446 - DNA, 20 bp, Artificial Sequence
  chemically synthesized
acaaaggaagaaaataatac

SEQ ID NO: 63447 - DNA, 20 bp, Artificial Sequence
  chemically synthesized
caaaggaagaaaataataca

SEQ ID NO: 63448 - DNA, 20 bp, Artificial Sequence
  chemically synthesized
ggaagaaaataatacaaggt

SEQ ID NO: 63449 - DNA, 20 bp, Artificial Sequence
  chemically synthesized
gaaaataatacaaggttgga

SEQ ID NO: 63450 - DNA, 20 bp, Artificial Sequence
  chemically synthesized
atacaaggttggaaagactt

SEQ ID NO: 63451 - DNA, 20 bp, Artificial Sequence
  chemically synthesized
acaaggttggaaagactttg

SEQ ID NO: 63452 - DNA, 20 bp, Artificial Sequence
  chemically synthesized
gttggaaagactttggagct

SEQ ID NO: 63453 - DNA, 20 bp, Artificial Sequence
  chemically synthesized
ctttgaaatactaagctcca

SEQ ID NO: 63454 - DNA, 20 bp, Artificial Sequence
  chemically synthesized
agtgttgtctttgaaatact

SEQ ID NO: 63455 - DNA, 20 bp, Artificial Sequence
  chemically synthesized
ctttggagcttagtatttca

SEQ ID NO: 63456 - DNA, 20 bp, Artificial Sequence
  chemically synthesized
tttcaaagacaacacttaaa

SEQ ID NO: 63457 - DNA, 20 bp, Artificial Sequence
  chemically synthesized
caaagacaacacttaaaaag

SEQ ID NO: 63458 - DNA, 20 bp, Artificial Sequence
  chemically synthesized
aacacatgcatcttcttttt

SEQ ID NO: 63459 - DNA, 20 bp, Artificial Sequence
  chemically synthesized
atgcatgtgttcctgctttt

SEQ ID NO: 63460 - DNA, 20 bp, Artificial Sequence
  chemically synthesized
agttctaaaatctcaaaagc

SEQ ID NO: 63461 - DNA, 20 bp, Artificial Sequence
  chemically synthesized
gagttctaaaatctcaaaag

SEQ ID NO: 63462 - DNA, 20 bp, Artificial Sequence
  chemically synthesized
taagagttctaaaatctcaa

SEQ ID NO: 63463 - DNA, 20 bp, Artificial Sequence
  chemically synthesized
tgttcctgcttttgagattt

SEQ ID NO: 63464 - DNA, 20 bp, Artificial Sequence
  chemically synthesized
gaataggacatgaagtataa

SEQ ID NO: 63465 - DNA, 20 bp, Artificial Sequence
  chemically synthesized
cagaataggacatgaagtat

SEQ ID NO: 63466 - DNA, 20 bp, Artificial Sequence
  chemically synthesized
aggtctcagaataggacatg

SEQ ID NO: 63467 - DNA, 20 bp, Artificial Sequence
  chemically synthesized
tatacttcatgtcctattct

SEQ ID NO: 63468 - DNA, 20 bp, Artificial Sequence
  chemically synthesized
tgaaaactaggtctcagaat

SEQ ID NO: 63469 - DNA, 20 bp, Artificial Sequence
  chemically synthesized
ttgaaaactaggtctcagaa

SEQ ID NO: 63470 - DNA, 20 bp, Artificial Sequence
  chemically synthesized
tcatgtcctattctgagacc

SEQ ID NO: 63471 - DNA, 20 bp, Artificial Sequence
  chemically synthesized
gtaatttgaaaactaggtct

SEQ ID NO: 63472 - DNA, 20 bp, Artificial Sequence
  chemically synthesized
aacgaagtaatttgaaaact

SEQ ID NO: 63473 - DNA, 20 bp, Artificial Sequence
  chemically synthesized
gaacgaagtaatttgaaaac

SEQ ID NO: 63474 - DNA, 20 bp, Artificial Sequence
  chemically synthesized
gatactcatagaaatgaacg

SEQ ID NO: 63475 - DNA, 20 bp, Artificial Sequence
  chemically synthesized
attacttcgttcatttctat

SEQ ID NO: 63476 - DNA, 20 bp, Artificial Sequence
  chemically synthesized
ctttatttaaaagatactca

SEQ ID NO: 63477 - DNA, 20 bp, Artificial Sequence
  chemically synthesized
ctatgagtatcttttaaata

SEQ ID NO: 63478 - DNA, 20 bp, Artificial Sequence
  chemically synthesized
ggtaggggctctttatttaa

SEQ ID NO: 63479 - DNA, 20 bp, Artificial Sequence
  chemically synthesized
atgagtatcttttaaataaa

SEQ ID NO: 63480 - DNA, 20 bp, Artificial Sequence
  chemically synthesized
aaacaaaggggatggggtag

SEQ ID NO: 63481 - DNA, 20 bp, Artificial Sequence
  chemically synthesized
aaaacaaaggggatggggta

SEQ ID NO: 63482 - DNA, 20 bp, Artificial Sequence
  chemically synthesized
gaaaacaaaggggatggggt

SEQ ID NO: 63483 - DNA, 20 bp, Artificial Sequence
  chemically synthesized
ggaaaacaaaggggatgggg

SEQ ID NO: 63484 - DNA, 20 bp, Artificial Sequence
  chemically synthesized
cagggaaaacaaaggggatg

SEQ ID NO: 63485 - DNA, 20 bp, Artificial Sequence
  chemically synthesized
tcagggaaaacaaaggggat

SEQ ID NO: 63486 - DNA, 20 bp, Artificial Sequence
  chemically synthesized
gtcagggaaaacaaagggga

SEQ ID NO: 63487 - DNA, 20 bp, Artificial Sequence
  chemically synthesized
tcaagtcagggaaaacaaag

SEQ ID NO: 63488 - DNA, 20 bp, Artificial Sequence
  chemically synthesized
ttcaagtcagggaaaacaaa

SEQ ID NO: 63489 - DNA, 20 bp, Artificial Sequence
  chemically synthesized
attcaagtcagggaaaacaa

SEQ ID NO: 63490 - DNA, 20 bp, Artificial Sequence
  chemically synthesized
aattcaagtcagggaaaaca

SEQ ID NO: 63491 - DNA, 20 bp, Artificial Sequence
  chemically synthesized
actctggctaattcaagtca

SEQ ID NO: 63492 - DNA, 20 bp, Artificial Sequence
  chemically synthesized
aactctggctaattcaagtc

SEQ ID NO: 63493 - DNA, 20 bp, Artificial Sequence
  chemically synthesized
taactctggctaattcaagt

SEQ ID NO: 63494 - DNA, 20 bp, Artificial Sequence
  chemically synthesized
ttgttttccctgacttgaat

SEQ ID NO: 63495 - DNA, 20 bp, Artificial Sequence
  chemically synthesized
cagctaactctggctaattc

SEQ ID NO: 63496 - DNA, 20 bp, Artificial Sequence
  chemically synthesized
tttccctgacttgaattagc

SEQ ID NO: 63497 - DNA, 20 bp, Artificial Sequence
  chemically synthesized
tccctgacttgaattagcca

SEQ ID NO: 63498 - DNA, 20 bp, Artificial Sequence
  chemically synthesized
tgacttgaattagccagagt

SEQ ID NO: 63499 - DNA, 20 bp, Artificial Sequence
  chemically synthesized
taaacaccagcagctaactc

SEQ ID NO: 63500 - DNA, 20 bp, Artificial Sequence
  chemically synthesized
aattagccagagttagctgc

SEQ ID NO: 63501 - DNA, 20 bp, Artificial Sequence
  chemically synthesized
tcttcagttataaacaccag

SEQ ID NO: 63502 - DNA, 20 bp, Artificial Sequence
  chemically synthesized
cggtcttcagttataaacac

SEQ ID NO: 63503 - DNA, 20 bp, Artificial Sequence
  chemically synthesized
gctgctggtgtttataactg

SEQ ID NO: 63504 - DNA, 20 bp, Artificial Sequence
  chemically synthesized
tggtgtttataactgaagac

SEQ ID NO: 63505 - DNA, 20 bp, Artificial Sequence
  chemically synthesized
cggcagtgtctgccggtctt

SEQ ID NO: 63506 - DNA, 20 bp, Artificial Sequence
  chemically synthesized
tgtttataactgaagaccgg

SEQ ID NO: 63507 - DNA, 20 bp, Artificial Sequence
  chemically synthesized
agctaaccggcagtgtctgc

SEQ ID NO: 63508 - DNA, 20 bp, Artificial Sequence
  chemically synthesized
tgaagaccggcagacactgc

SEQ ID NO: 63509 - DNA, 20 bp, Artificial Sequence
  chemically synthesized
gaccggcagacactgccggt

SEQ ID NO: 63510 - DNA, 20 bp, Artificial Sequence
  chemically synthesized
gtattgaagtagctaaccgg

SEQ ID NO: 63511 - DNA, 20 bp, Artificial Sequence
  chemically synthesized
caggtattgaagtagctaac

SEQ ID NO: 63512 - DNA, 20 bp, Artificial Sequence
  chemically synthesized
gttttcaacaggtattgaag

SEQ ID NO: 63513 - DNA, 20 bp, Artificial Sequence
  chemically synthesized
gtggttttcaacaggtattg

SEQ ID NO: 63514 - DNA, 20 bp, Artificial Sequence
  chemically synthesized
agggagaagtggttttcaac

SEQ ID NO: 63515 - DNA, 20 bp, Artificial Sequence
  chemically synthesized
tagggagaagtggttttcaa

SEQ ID NO: 63516 - DNA, 20 bp, Artificial Sequence
  chemically synthesized
aaaagatggctagggagaag

SEQ ID NO: 63517 - DNA, 20 bp, Artificial Sequence
  chemically synthesized
tgttgaaaaccacttctccc

SEQ ID NO: 63518 - DNA, 20 bp, Artificial Sequence
  chemically synthesized
acaaaaagatggctagggag

SEQ ID NO: 63519 - DNA, 20 bp, Artificial Sequence
  chemically synthesized
ccaacaaaaagatggctagg

SEQ ID NO: 63520 - DNA, 20 bp, Artificial Sequence
  chemically synthesized
caccaacaaaaagatggcta

SEQ ID NO: 63521 - DNA, 20 bp, Artificial Sequence
  chemically synthesized
ccaccaacaaaaagatggct

SEQ ID NO: 63522 - DNA, 20 bp, Artificial Sequence
  chemically synthesized
gccaccaacaaaaagatggc

SEQ ID NO: 63523 - DNA, 20 bp, Artificial Sequence
  chemically synthesized
gacagccaccaacaaaaaga

SEQ ID NO: 63524 - DNA, 20 bp, Artificial Sequence
  chemically synthesized
ctccctagccatctttttgt

SEQ ID NO: 63525 - DNA, 20 bp, Artificial Sequence
  chemically synthesized
acatgacagccaccaacaaa

SEQ ID NO: 63526 - DNA, 20 bp, Artificial Sequence
  chemically synthesized
cctagccatctttttgttgg

SEQ ID NO: 63527 - DNA, 20 bp, Artificial Sequence
  chemically synthesized
tgtagaactgtgtcacatga

SEQ ID NO: 63528 - DNA, 20 bp, Artificial Sequence
  chemically synthesized
ttggtggctgtcatgtgaca

SEQ ID NO: 63529 - DNA, 20 bp, Artificial Sequence
  chemically synthesized
tctacttgtatatcattgtg

SEQ ID NO: 63530 - DNA, 20 bp, Artificial Sequence
  chemically synthesized
agttctacacaatgatatac

SEQ ID NO: 63531 - DNA, 20 bp, Artificial Sequence
  chemically synthesized
tctacacaatgatatacaag

SEQ ID NO: 63532 - DNA, 20 bp, Artificial Sequence
  chemically synthesized
acacaatgatatacaagtag

SEQ ID NO: 63533 - DNA, 20 bp, Artificial Sequence
  chemically synthesized
caagtagaagtctttcaaaa

SEQ ID NO: 63534 - DNA, 20 bp, Artificial Sequence
  chemically synthesized
aagtagaagtctttcaaaaa

SEQ ID NO: 63535 - DNA, 20 bp, Artificial Sequence
  chemically synthesized
ttcccagaaaccttttttga

SEQ ID NO: 63536 - DNA, 20 bp, Artificial Sequence
  chemically synthesized
agtctttcaaaaaaggtttc

SEQ ID NO: 63537 - DNA, 20 bp, Artificial Sequence
  chemically synthesized
gtctttcaaaaaaggtttct

SEQ ID NO: 63538 - DNA, 20 bp, Artificial Sequence
  chemically synthesized
ttataaagccaaaaatttcc

SEQ ID NO: 63539 - DNA, 20 bp, Artificial Sequence
  chemically synthesized
aaaggtttctgggaaatttt

SEQ ID NO: 63540 - DNA, 20 bp, Artificial Sequence
  chemically synthesized
tgagtcttatcatttttata

SEQ ID NO: 63541 - DNA, 20 bp, Artificial Sequence
  chemically synthesized
tttggctttataaaaatgat

SEQ ID NO: 63542 - DNA, 20 bp, Artificial Sequence
  chemically synthesized
tttataaaaatgataagact

SEQ ID NO: 63543 - DNA, 20 bp, Artificial Sequence
  chemically synthesized
taaaaatgataagactcaga

SEQ ID NO: 63544 - DNA, 20 bp, Artificial Sequence
  chemically synthesized
gcaaaaagggtgtactatct

SEQ ID NO: 63545 - DNA, 20 bp, Artificial Sequence
  chemically synthesized
tgaaaaagagaaggcaaaaa

SEQ ID NO: 63546 - DNA, 20 bp, Artificial Sequence
  chemically synthesized
gtgaaaaagagaaggcaaaa

SEQ ID NO: 63547 - DNA, 20 bp, Artificial Sequence
  chemically synthesized
ggtgaaaaagagaaggcaaa

SEQ ID NO: 63548 - DNA, 20 bp, Artificial Sequence
  chemically synthesized
ttcacagggtgaaaaagaga

SEQ ID NO: 63549 - DNA, 20 bp, Artificial Sequence
  chemically synthesized
tttcacagggtgaaaaagag

SEQ ID NO: 63550 - DNA, 20 bp, Artificial Sequence
  chemically synthesized
ttatttcacagggtgaaaaa

SEQ ID NO: 63551 - DNA, 20 bp, Artificial Sequence
  chemically synthesized
cattatttcacagggtgaaa

SEQ ID NO: 63552 - DNA, 20 bp, Artificial Sequence
  chemically synthesized
gcagccaccattatttcaca

SEQ ID NO: 63553 - DNA, 20 bp, Artificial Sequence
  chemically synthesized
agcagccaccattatttcac

SEQ ID NO: 63554 - DNA, 20 bp, Artificial Sequence
  chemically synthesized
tagcagccaccattatttca

SEQ ID NO: 63555 - DNA, 20 bp, Artificial Sequence
  chemically synthesized
tttttcaccctgtgaaataa

SEQ ID NO: 63556 - DNA, 20 bp, Artificial Sequence
  chemically synthesized
ttcaccctgtgaaataatgg

SEQ ID NO: 63557 - DNA, 20 bp, Artificial Sequence
  chemically synthesized
cttttcctcatgcaatatag

SEQ ID NO: 63558 - DNA, 20 bp, Artificial Sequence
  chemically synthesized
tgacttttcctcatgcaata

SEQ ID NO: 63559 - DNA, 20 bp, Artificial Sequence
  chemically synthesized
tggtggctgctatattgcat

SEQ ID NO: 63560 - DNA, 20 bp, Artificial Sequence
  chemically synthesized
ggtggctgctatattgcatg

SEQ ID NO: 63561 - DNA, 20 bp, Artificial Sequence
  chemically synthesized
ctgctatattgcatgaggaa

SEQ ID NO: 63562 - DNA, 20 bp, Artificial Sequence
  chemically synthesized
aaaagtcaataaaaaatata

SEQ ID NO: 63563 - DNA, 20 bp, Artificial Sequence
  chemically synthesized
aataaaaaatatacagatgc

SEQ ID NO: 63564 - DNA, 20 bp, Artificial Sequence
  chemically synthesized
gggcccaacagtatcaggac

SEQ ID NO: 63565 - DNA, 20 bp, Artificial Sequence
  chemically synthesized
gctttgggcccaacagtatc

SEQ ID NO: 63566 - DNA, 20 bp, Artificial Sequence
  chemically synthesized
gatgccagtcctgatactgt

SEQ ID NO: 63567 - DNA, 20 bp, Artificial Sequence
  chemically synthesized
tgctttgggcccaacagtat

SEQ ID NO: 63568 - DNA, 20 bp, Artificial Sequence
  chemically synthesized
atgccagtcctgatactgtt

SEQ ID NO: 63569 - DNA, 20 bp, Artificial Sequence
  chemically synthesized
ataaggtgctttgggcccaa

SEQ ID NO: 63570 - DNA, 20 bp, Artificial Sequence
  chemically synthesized
tcctgatactgttgggccca

SEQ ID NO: 63571 - DNA, 20 bp, Artificial Sequence
  chemically synthesized
gtctggaaataaggtgcttt

SEQ ID NO: 63572 - DNA, 20 bp, Artificial Sequence
  chemically synthesized
tgtctggaaataaggtgctt

SEQ ID NO: 63573 - DNA, 20 bp, Artificial Sequence
  chemically synthesized
ggcccaaagcaccttatttc

SEQ ID NO: 63574 - DNA, 20 bp, Artificial Sequence
  chemically synthesized
tattaagatgtctggaaata

SEQ ID NO: 63575 - DNA, 20 bp, Artificial Sequence
  chemically synthesized
atattaagatgtctggaaat

SEQ ID NO: 63576 - DNA, 20 bp, Artificial Sequence
  chemically synthesized
atctccaatattaagatgtc

SEQ ID NO: 63577 - DNA, 20 bp, Artificial Sequence
  chemically synthesized
atttccagacatcttaatat

SEQ ID NO: 63578 - DNA, 20 bp, Artificial Sequence
  chemically synthesized
ttccagacatcttaatattg

SEQ ID NO: 63579 - DNA, 20 bp, Artificial Sequence
  chemically synthesized
ttttatttatctccaatatt

SEQ ID NO: 63580 - DNA, 20 bp, Artificial Sequence
  chemically synthesized
tacagtggcttaaataaata

SEQ ID NO: 63581 - DNA, 20 bp, Artificial Sequence
  chemically synthesized
aaataaaactctatttattt

SEQ ID NO: 63582 - DNA, 20 bp, Artificial Sequence
  chemically synthesized
tctacagtggcttaaataaa

SEQ ID NO: 63583 - DNA, 20 bp, Artificial Sequence
  chemically synthesized
tctatttatttaagccactg

SEQ ID NO: 63584 - DNA, 20 bp, Artificial Sequence
  chemically synthesized
tttatttaagccactgtaga

SEQ ID NO: 63585 - DNA, 20 bp, Artificial Sequence
  chemically synthesized
aacacagaagctatctacag

SEQ ID NO: 63586 - DNA, 20 bp, Artificial Sequence
  chemically synthesized
aaaaacacagaagctatcta

SEQ ID NO: 63587 - DNA, 20 bp, Artificial Sequence
  chemically synthesized
aatggcagcaaaaaacacag

SEQ ID NO: 63588 - DNA, 20 bp, Artificial Sequence
  chemically synthesized
tgcaatggcagcaaaaaaca

SEQ ID NO: 63589 - DNA, 20 bp, Artificial Sequence
  chemically synthesized
tggggttagaattgcaatgg

SEQ ID NO: 63590 - DNA, 20 bp, Artificial Sequence
  chemically synthesized
ggctggggttagaattgcaa

SEQ ID NO: 63591 - DNA, 20 bp, Artificial Sequence
  chemically synthesized
tgccattgcaattctaaccc

SEQ ID NO: 63592 - DNA, 20 bp, Artificial Sequence
  chemically synthesized
cccattttattggctggggt

SEQ ID NO: 63593 - DNA, 20 bp, Artificial Sequence
  chemically synthesized
tattcccattttattggctg

SEQ ID NO: 63594 - DNA, 20 bp, Artificial Sequence
  chemically synthesized
atattcccattttattggct

SEQ ID NO: 63595 - DNA, 20 bp, Artificial Sequence
  chemically synthesized
catattcccattttattggc

SEQ ID NO: 63596 - DNA, 20 bp, Artificial Sequence
  chemically synthesized
tctaaccccagccaataaaa

SEQ ID NO: 63597 - DNA, 20 bp, Artificial Sequence
  chemically synthesized
ctaaccccagccaataaaat

SEQ ID NO: 63598 - DNA, 20 bp, Artificial Sequence
  chemically synthesized
ttttcatattcccattttat

SEQ ID NO: 63599 - DNA, 20 bp, Artificial Sequence
  chemically synthesized
taaattcttcattgtttaga

SEQ ID NO: 63600 - DNA, 20 bp, Artificial Sequence
  chemically synthesized
ataaattcttcattgtttag

SEQ ID NO: 63601 - DNA, 20 bp, Artificial Sequence
  chemically synthesized
atgaatccttctaaacaatg

SEQ ID NO: 63602 - DNA, 20 bp, Artificial Sequence
  chemically synthesized
cccataaattcttcattgtt

SEQ ID NO: 63603 - DNA, 20 bp, Artificial Sequence
  chemically synthesized
tctaaacaatgaagaattta

SEQ ID NO: 63604 - DNA, 20 bp, Artificial Sequence
  chemically synthesized
ctaaacaatgaagaatttat

SEQ ID NO: 63605 - DNA, 20 bp, Artificial Sequence
  chemically synthesized
taaacaatgaagaatttatg

SEQ ID NO: 63606 - DNA, 20 bp, Artificial Sequence
  chemically synthesized
caatgaagaatttatggggt

SEQ ID NO: 63607 - DNA, 20 bp, Artificial Sequence
  chemically synthesized
aatgaagaatttatggggtt

SEQ ID NO: 63608 - DNA, 20 bp, Artificial Sequence
  chemically synthesized
atgaagaatttatggggtta

SEQ ID NO: 63609 - DNA, 20 bp, Artificial Sequence
  chemically synthesized
gaatttatggggttagggtt

SEQ ID NO: 63610 - DNA, 20 bp, Artificial Sequence
  chemically synthesized
aatttatggggttagggttt

SEQ ID NO: 63611 - DNA, 20 bp, Artificial Sequence
  chemically synthesized
tttatggggttagggtttgg

SEQ ID NO: 63612 - DNA, 20 bp, Artificial Sequence
  chemically synthesized
ttatggggttagggtttggg

SEQ ID NO: 63613 - DNA, 20 bp, Artificial Sequence
  chemically synthesized
gggttagggtttgggaggaa

SEQ ID NO: 63614 - DNA, 20 bp, Artificial Sequence
  chemically synthesized
ttagggtttgggaggaacag

SEQ ID NO: 63615 - DNA, 20 bp, Artificial Sequence
  chemically synthesized
tttgggaggaacagaagata

SEQ ID NO: 63616 - DNA, 20 bp, Artificial Sequence
  chemically synthesized
ggaggaacagaagatatagc

SEQ ID NO: 63617 - DNA, 20 bp, Artificial Sequence
  chemically synthesized
gagatatgcctaaattcatc

SEQ ID NO: 63618 - DNA, 20 bp, Artificial Sequence
  chemically synthesized
aagatatagccagatgaatt

SEQ ID NO: 63619 - DNA, 20 bp, Artificial Sequence
  chemically synthesized
agatatagccagatgaattt

SEQ ID NO: 63620 - DNA, 20 bp, Artificial Sequence
  chemically synthesized
atgaatttaggcatatctct

SEQ ID NO: 63621 - DNA, 20 bp, Artificial Sequence
  chemically synthesized
tgaatttaggcatatctctc

SEQ ID NO: 63622 - DNA, 20 bp, Artificial Sequence
  chemically synthesized
ggacaaaggtcagttcctga

SEQ ID NO: 63623 - DNA, 20 bp, Artificial Sequence
  chemically synthesized
aaggacaaaggtcagttcct

SEQ ID NO: 63624 - DNA, 20 bp, Artificial Sequence
  chemically synthesized
aatagctaaaggacaaaggt

SEQ ID NO: 63625 - DNA, 20 bp, Artificial Sequence
  chemically synthesized
cagtaatagctaaaggacaa

SEQ ID NO: 63626 - DNA, 20 bp, Artificial Sequence
  chemically synthesized
aggaactgacctttgtcctt

SEQ ID NO: 63627 - DNA, 20 bp, Artificial Sequence
  chemically synthesized
acagtaatagctaaaggaca

SEQ ID NO: 63628 - DNA, 20 bp, Artificial Sequence
  chemically synthesized
taatcaacagtaatagctaa

SEQ ID NO: 63629 - DNA, 20 bp, Artificial Sequence
  chemically synthesized
ctaatcaacagtaatagcta

SEQ ID NO: 63630 - DNA, 20 bp, Artificial Sequence
  chemically synthesized
ctaagactaatcaacagtaa

SEQ ID NO: 63631 - DNA, 20 bp, Artificial Sequence
  chemically synthesized
ctttagctattactgttgat

SEQ ID NO: 63632 - DNA, 20 bp, Artificial Sequence
  chemically synthesized
tgccatctaagactaatcaa

SEQ ID NO: 63633 - DNA, 20 bp, Artificial Sequence
  chemically synthesized
ctattactgttgattagtct

SEQ ID NO: 63634 - DNA, 20 bp, Artificial Sequence
  chemically synthesized
tactgttgattagtcttaga

SEQ ID NO: 63635 - DNA, 20 bp, Artificial Sequence
  chemically synthesized
tgttgattagtcttagatgg

SEQ ID NO: 63636 - DNA, 20 bp, Artificial Sequence
  chemically synthesized
tacaaggttcactgccatct

SEQ ID NO: 63637 - DNA, 20 bp, Artificial Sequence
  chemically synthesized
ttagatggcagtgaaccttg

SEQ ID NO: 63638 - DNA, 20 bp, Artificial Sequence
  chemically synthesized
ttgcattaacatcagctaca

SEQ ID NO: 63639 - DNA, 20 bp, Artificial Sequence
  chemically synthesized
tttgcattaacatcagctac

SEQ ID NO: 63640 - DNA, 20 bp, Artificial Sequence
  chemically synthesized
ctccagttttgcattaacat

SEQ ID NO: 63641 - DNA, 20 bp, Artificial Sequence
  chemically synthesized
agctgatgttaatgcaaaac

SEQ ID NO: 63642 - DNA, 20 bp, Artificial Sequence
  chemically synthesized
ctgatgttaatgcaaaactg

SEQ ID NO: 63643 - DNA, 20 bp, Artificial Sequence
  chemically synthesized
atccaggatgcaatgttctc

SEQ ID NO: 63644 - DNA, 20 bp, Artificial Sequence
  chemically synthesized
aactggagaacattgcatcc

SEQ ID NO: 63645 - DNA, 20 bp, Artificial Sequence
  chemically synthesized
agaacattgcatcctggata

SEQ ID NO: 63646 - DNA, 20 bp, Artificial Sequence
  chemically synthesized
gaacattgcatcctggatat

SEQ ID NO: 63647 - DNA, 20 bp, Artificial Sequence
  chemically synthesized
atcagaatatacctatatcc

SEQ ID NO: 63648 - DNA, 20 bp, Artificial Sequence
  chemically synthesized
tatcagaatatacctatatc

SEQ ID NO: 63649 - DNA, 20 bp, Artificial Sequence
  chemically synthesized
agggccctgtatcagagtat

SEQ ID NO: 63650 - DNA, 20 bp, Artificial Sequence
  chemically synthesized
tatattctgatactctgata

SEQ ID NO: 63651 - DNA, 20 bp, Artificial Sequence
  chemically synthesized
atattctgatactctgatac

SEQ ID NO: 63652 - DNA, 20 bp, Artificial Sequence
  chemically synthesized
tattctgatactctgataca

SEQ ID NO: 63653 - DNA, 20 bp, Artificial Sequence
  chemically synthesized
aagctaagggccctgtatca

SEQ ID NO: 63654 - DNA, 20 bp, Artificial Sequence
  chemically synthesized
ggaagctaagggccctgtat

SEQ ID NO: 63655 - DNA, 20 bp, Artificial Sequence
  chemically synthesized
atactctgatacagggccct

SEQ ID NO: 63656 - DNA, 20 bp, Artificial Sequence
  chemically synthesized
ttgtcatctttggaagctaa

SEQ ID NO: 63657 - DNA, 20 bp, Artificial Sequence
  chemically synthesized
attgtcatctttggaagcta

SEQ ID NO: 63658 - DNA, 20 bp, Artificial Sequence
  chemically synthesized
aattgtcatctttggaagct

SEQ ID NO: 63659 - DNA, 20 bp, Artificial Sequence
  chemically synthesized
tacagggcccttagcttcca

SEQ ID NO: 63660 - DNA, 20 bp, Artificial Sequence
  chemically synthesized
aaaaaaattgtcatctttgg

SEQ ID NO: 63661 - DNA, 20 bp, Artificial Sequence
  chemically synthesized
aaaaaaaaaattgtcatctt

SEQ ID NO: 63662 - DNA, 20 bp, Artificial Sequence
  chemically synthesized
aatttttttttttttttttt

SEQ ID NO: 63663 - DNA, 20 bp, Artificial Sequence
  chemically synthesized
ttttttttttttttttgaga

SEQ ID NO: 63664 - DNA, 20 bp, Artificial Sequence
  chemically synthesized
ttttttttttttttgagacg

SEQ ID NO: 63665 - DNA, 20 bp, Artificial Sequence
  chemically synthesized
tgagacggagtctcgctctg

SEQ ID NO: 63666 - DNA, 20 bp, Artificial Sequence
  chemically synthesized
tccagcctgggccacagagc

SEQ ID NO: 63667 - DNA, 20 bp, Artificial Sequence
  chemically synthesized
cggagtctcgctctgtggcc

SEQ ID NO: 63668 - DNA, 20 bp, Artificial Sequence
  chemically synthesized
gcactccagcctgggccaca

SEQ ID NO: 63669 - DNA, 20 bp, Artificial Sequence
  chemically synthesized
ggagtctcgctctgtggccc

SEQ ID NO: 63670 - DNA, 20 bp, Artificial Sequence
  chemically synthesized
ctgcactccagcctgggcca

SEQ ID NO: 63671 - DNA, 20 bp, Artificial Sequence
  chemically synthesized
tctcgctctgtggcccaggc

SEQ ID NO: 63672 - DNA, 20 bp, Artificial Sequence
  chemically synthesized
tcgctctgtggcccaggctg

SEQ ID NO: 63673 - DNA, 20 bp, Artificial Sequence
  chemically synthesized
gcgccactgcactccagcct

SEQ ID NO: 63674 - DNA, 20 bp, Artificial Sequence
  chemically synthesized
cgcgccactgcactccagcc

SEQ ID NO: 63675 - DNA, 20 bp, Artificial Sequence
  chemically synthesized
ctgtggcccaggctggagtg

SEQ ID NO: 63676 - DNA, 20 bp, Artificial Sequence
  chemically synthesized
gagatcgcgccactgcactc

SEQ ID NO: 63677 - DNA, 20 bp, Artificial Sequence
  chemically synthesized
tggcccaggctggagtgcag

SEQ ID NO: 63678 - DNA, 20 bp, Artificial Sequence
  chemically synthesized
ggagtgcagtggcgcgatct

SEQ ID NO: 63679 - DNA, 20 bp, Artificial Sequence
  chemically synthesized
ggcggagcttgcagtgagcc

SEQ ID NO: 63680 - DNA, 20 bp, Artificial Sequence
  chemically synthesized
gcgcgatctcggctcactgc

SEQ ID NO: 63681 - DNA, 20 bp, Artificial Sequence
  chemically synthesized
cgggaggcggagcttgcagt

SEQ ID NO: 63682 - DNA, 20 bp, Artificial Sequence
  chemically synthesized
aacccgggaggcggagcttg

SEQ ID NO: 63683 - DNA, 20 bp, Artificial Sequence
  chemically synthesized
tcactgcaagctccgcctcc

SEQ ID NO: 63684 - DNA, 20 bp, Artificial Sequence
  chemically synthesized
tggcgtgaacccgggaggcg

SEQ ID NO: 63685 - DNA, 20 bp, Artificial Sequence
  chemically synthesized
cactgcaagctccgcctccc

SEQ ID NO: 63686 - DNA, 20 bp, Artificial Sequence
  chemically synthesized
aatggcgtgaacccgggagg

SEQ ID NO: 63687 - DNA, 20 bp, Artificial Sequence
  chemically synthesized
gagaatggcgtgaacccggg

SEQ ID NO: 63688 - DNA, 20 bp, Artificial Sequence
  chemically synthesized
ggagaatggcgtgaacccgg

SEQ ID NO: 63689 - DNA, 20 bp, Artificial Sequence
  chemically synthesized
caggagaatggcgtgaaccc

SEQ ID NO: 63690 - DNA, 20 bp, Artificial Sequence
  chemically synthesized
gcaggagaatggcgtgaacc

SEQ ID NO: 63691 - DNA, 20 bp, Artificial Sequence
  chemically synthesized
aggaggctgaggcaggagaa

SEQ ID NO: 63692 - DNA, 20 bp, Artificial Sequence
  chemically synthesized
ttcacgccattctcctgcct

SEQ ID NO: 63693 - DNA, 20 bp, Artificial Sequence
  chemically synthesized
tactcaggaggctgaggcag

SEQ ID NO: 63694 - DNA, 20 bp, Artificial Sequence
  chemically synthesized
gctactcaggaggctgaggc

SEQ ID NO: 63695 - DNA, 20 bp, Artificial Sequence
  chemically synthesized
agctactcaggaggctgagg

SEQ ID NO: 63696 - DNA, 20 bp, Artificial Sequence
  chemically synthesized
cccagctactcaggaggctg

SEQ ID NO: 63697 - DNA, 20 bp, Artificial Sequence
  chemically synthesized
tcccagctactcaggaggct

SEQ ID NO: 63698 - DNA, 20 bp, Artificial Sequence
  chemically synthesized
ttctcctgcctcagcctcct

SEQ ID NO: 63699 - DNA, 20 bp, Artificial Sequence
  chemically synthesized
tcctgcctcagcctcctgag

SEQ ID NO: 63700 - DNA, 20 bp, Artificial Sequence
  chemically synthesized
tgtagtcccagctactcagg

SEQ ID NO: 63701 - DNA, 20 bp, Artificial Sequence
  chemically synthesized
ctgtagtcccagctactcag

SEQ ID NO: 63702 - DNA, 20 bp, Artificial Sequence
  chemically synthesized
gcctcagcctcctgagtagc

SEQ ID NO: 63703 - DNA, 20 bp, Artificial Sequence
  chemically synthesized
gcctgtagtcccagctactc

SEQ ID NO: 63704 - DNA, 20 bp, Artificial Sequence
  chemically synthesized
cctcagcctcctgagtagct

SEQ ID NO: 63705 - DNA, 20 bp, Artificial Sequence
  chemically synthesized
cgcctgtagtcccagctact

SEQ ID NO: 63706 - DNA, 20 bp, Artificial Sequence
  chemically synthesized
ctcctgagtagctgggacta

SEQ ID NO: 63707 - DNA, 20 bp, Artificial Sequence
  chemically synthesized
tcctgagtagctgggactac

SEQ ID NO: 63708 - DNA, 20 bp, Artificial Sequence
  chemically synthesized
gttgcgggcgcctgtagtcc

SEQ ID NO: 63709 - DNA, 20 bp, Artificial Sequence
  chemically synthesized
ggcgtggttgcgggcgcctg

SEQ ID NO: 63710 - DNA, 20 bp, Artificial Sequence
  chemically synthesized
aattagccgggcgtggttgc

SEQ ID NO: 63711 - DNA, 20 bp, Artificial Sequence
  chemically synthesized
aaattagccgggcgtggttg

SEQ ID NO: 63712 - DNA, 20 bp, Artificial Sequence
  chemically synthesized
caggcgcccgcaaccacgcc

SEQ ID NO: 63713 - DNA, 20 bp, Artificial Sequence
  chemically synthesized
tacaaaaaattagccgggcg

SEQ ID NO: 63714 - DNA, 20 bp, Artificial Sequence
  chemically synthesized
aaaaatacaaaaaattagcc

SEQ ID NO: 63715 - DNA, 20 bp, Artificial Sequence
  chemically synthesized
taaaaatacaaaaaattagc

SEQ ID NO: 63716 - DNA, 20 bp, Artificial Sequence
  chemically synthesized
ctactaaaaatacaaaaaat

SEQ ID NO: 63717 - DNA, 20 bp, Artificial Sequence
  chemically synthesized
cggctaattttttgtatttt

SEQ ID NO: 63718 - DNA, 20 bp, Artificial Sequence
  chemically synthesized
ctaattttttgtatttttag

SEQ ID NO: 63719 - DNA, 20 bp, Artificial Sequence
  chemically synthesized
aattttttgtatttttagta

SEQ ID NO: 63720 - DNA, 20 bp, Artificial Sequence
  chemically synthesized
ttttgtatttttagtagaga

SEQ ID NO: 63721 - DNA, 20 bp, Artificial Sequence
  chemically synthesized
tttgtatttttagtagagac

SEQ ID NO: 63722 - DNA, 20 bp, Artificial Sequence
  chemically synthesized
ttgtatttttagtagagacg

SEQ ID NO: 63723 - DNA, 20 bp, Artificial Sequence
  chemically synthesized
gagacggggtttcaccgtgt

SEQ ID NO: 63724 - DNA, 20 bp, Artificial Sequence
  chemically synthesized
cggggtttcaccgtgttagc

SEQ ID NO: 63725 - DNA, 20 bp, Artificial Sequence
  chemically synthesized
ggagaccatcctggctaaca

SEQ ID NO: 63726 - DNA, 20 bp, Artificial Sequence
  chemically synthesized
ggggtttcaccgtgttagcc

SEQ ID NO: 63727 - DNA, 20 bp, Artificial Sequence
  chemically synthesized
tttcaccgtgttagccagga

SEQ ID NO: 63728 - DNA, 20 bp, Artificial Sequence
  chemically synthesized
tcaggagatggagaccatcc

SEQ ID NO: 63729 - DNA, 20 bp, Artificial Sequence
  chemically synthesized
gatcacgaggtcaggagatg

SEQ ID NO: 63730 - DNA, 20 bp, Artificial Sequence
  chemically synthesized
cggatcacgaggtcaggaga

SEQ ID NO: 63731 - DNA, 20 bp, Artificial Sequence
  chemically synthesized
cgggcggatcacgaggtcag

SEQ ID NO: 63732 - DNA, 20 bp, Artificial Sequence
  chemically synthesized
ggcgggcggatcacgaggtc

SEQ ID NO: 63733 - DNA, 20 bp, Artificial Sequence
  chemically synthesized
aggcgggcggatcacgaggt

SEQ ID NO: 63734 - DNA, 20 bp, Artificial Sequence
  chemically synthesized
gccgaggcgggcggatcacg

SEQ ID NO: 63735 - DNA, 20 bp, Artificial Sequence
  chemically synthesized
ggccgaggcgggcggatcac

SEQ ID NO: 63736 - DNA, 20 bp, Artificial Sequence
  chemically synthesized
acctcgtgatccgcccgcct

SEQ ID NO: 63737 - DNA, 20 bp, Artificial Sequence
  chemically synthesized
ctttgggaggccgaggcggg

SEQ ID NO: 63738 - DNA, 20 bp, Artificial Sequence
  chemically synthesized
gcactttgggaggccgaggc

SEQ ID NO: 63739 - DNA, 20 bp, Artificial Sequence
  chemically synthesized
agcactttgggaggccgagg

SEQ ID NO: 63740 - DNA, 20 bp, Artificial Sequence
  chemically synthesized
cccagcactttgggaggccg

SEQ ID NO: 63741 - DNA, 20 bp, Artificial Sequence
  chemically synthesized
tcccagcactttgggaggcc

SEQ ID NO: 63742 - DNA, 20 bp, Artificial Sequence
  chemically synthesized
ccgcccgcctcggcctccca

SEQ ID NO: 63743 - DNA, 20 bp, Artificial Sequence
  chemically synthesized
tgtaatcccagcactttggg

SEQ ID NO: 63744 - DNA, 20 bp, Artificial Sequence
  chemically synthesized
ctgtaatcccagcactttgg

SEQ ID NO: 63745 - DNA, 20 bp, Artificial Sequence
  chemically synthesized
gcctcggcctcccaaagtgc

SEQ ID NO: 63746 - DNA, 20 bp, Artificial Sequence
  chemically synthesized
gcctgtaatcccagcacttt

SEQ ID NO: 63747 - DNA, 20 bp, Artificial Sequence
  chemically synthesized
cctcggcctcccaaagtgct

SEQ ID NO: 63748 - DNA, 20 bp, Artificial Sequence
  chemically synthesized
cgcctgtaatcccagcactt

SEQ ID NO: 63749 - DNA, 20 bp, Artificial Sequence
  chemically synthesized
ctcccaaagtgctgggatta

SEQ ID NO: 63750 - DNA, 20 bp, Artificial Sequence
  chemically synthesized
tcccaaagtgctgggattac

SEQ ID NO: 63751 - DNA, 20 bp, Artificial Sequence
  chemically synthesized
gtggctcacgcctgtaatcc

SEQ ID NO: 63752 - DNA, 20 bp, Artificial Sequence
  chemically synthesized
agtgctgggattacaggcgt

SEQ ID NO: 63753 - DNA, 20 bp, Artificial Sequence
  chemically synthesized
caggcgtgagccaccgcgcc

SEQ ID NO: 63754 - DNA, 20 bp, Artificial Sequence
  chemically synthesized
catctttgggccgggcgcgg

SEQ ID NO: 63755 - DNA, 20 bp, Artificial Sequence
  chemically synthesized
tgtcatctttgggccgggcg

SEQ ID NO: 63756 - DNA, 20 bp, Artificial Sequence
  chemically synthesized
gagccaccgcgcccggccca

SEQ ID NO: 63757 - DNA, 20 bp, Artificial Sequence
  chemically synthesized
ataattgtcatctttgggcc

SEQ ID NO: 63758 - DNA, 20 bp, Artificial Sequence
  chemically synthesized
tataattgtcatctttgggc

SEQ ID NO: 63759 - DNA, 20 bp, Artificial Sequence
  chemically synthesized
cacatataattgtcatcttt

SEQ ID NO: 63760 - DNA, 20 bp, Artificial Sequence
  chemically synthesized
acacatataattgtcatctt

SEQ ID NO: 63761 - DNA, 20 bp, Artificial Sequence
  chemically synthesized
aatatgtgtgcacttgtact

SEQ ID NO: 63762 - DNA, 20 bp, Artificial Sequence
  chemically synthesized
gtctctattttactcagtac

SEQ ID NO: 63763 - DNA, 20 bp, Artificial Sequence
  chemically synthesized
tgcacttgtactgagtaaaa

SEQ ID NO: 63764 - DNA, 20 bp, Artificial Sequence
  chemically synthesized
agatcagtctctattttact

SEQ ID NO: 63765 - DNA, 20 bp, Artificial Sequence
  chemically synthesized
cacttgtactgagtaaaata

SEQ ID NO: 63766 - DNA, 20 bp, Artificial Sequence
  chemically synthesized
aattgacgtatgggtgagat

SEQ ID NO: 63767 - DNA, 20 bp, Artificial Sequence
  chemically synthesized
agtagaattgacgtatgggt

SEQ ID NO: 63768 - DNA, 20 bp, Artificial Sequence
  chemically synthesized
tctaagtagaattgacgtat

SEQ ID NO: 63769 - DNA, 20 bp, Artificial Sequence
  chemically synthesized
gtctaagtagaattgacgta

SEQ ID NO: 63770 - DNA, 20 bp, Artificial Sequence
  chemically synthesized
acccatacgtcaattctact

SEQ ID NO: 63771 - DNA, 20 bp, Artificial Sequence
  chemically synthesized
tgggatttcctttgtctaag

SEQ ID NO: 63772 - DNA, 20 bp, Artificial Sequence
  chemically synthesized
acgtcaattctacttagaca

SEQ ID NO: 63773 - DNA, 20 bp, Artificial Sequence
  chemically synthesized
cgtcaattctacttagacaa

SEQ ID NO: 63774 - DNA, 20 bp, Artificial Sequence
  chemically synthesized
ccctgggatttcctttgtct

SEQ ID NO: 63775 - DNA, 20 bp, Artificial Sequence
  chemically synthesized
tacttagacaaaggaaatcc

SEQ ID NO: 63776 - DNA, 20 bp, Artificial Sequence
  chemically synthesized
acttagacaaaggaaatccc

SEQ ID NO: 63777 - DNA, 20 bp, Artificial Sequence
  chemically synthesized
cttagacaaaggaaatccca

SEQ ID NO: 63778 - DNA, 20 bp, Artificial Sequence
  chemically synthesized
aaaaaaaaaaaaaaaaccct

SEQ ID NO: 63779 - DNA, 20 bp, Artificial Sequence
  chemically synthesized
aaaaaaaaaaaaaaaaaccc

SEQ ID NO: 63780 - DNA, 20 bp, Artificial Sequence
  chemically synthesized
ttttaatagcacattatgga

SEQ ID NO: 63781 - DNA, 20 bp, Artificial Sequence
  chemically synthesized
tattttaatagcacattatg

SEQ ID NO: 63782 - DNA, 20 bp, Artificial Sequence
  chemically synthesized
tttattttaatagcacatta

SEQ ID NO: 63783 - DNA, 20 bp, Artificial Sequence
  chemically synthesized
aaaatagcattttattttaa

SEQ ID NO: 63784 - DNA, 20 bp, Artificial Sequence
  chemically synthesized
aaaataaaatgctattttgt

SEQ ID NO: 63785 - DNA, 20 bp, Artificial Sequence
  chemically synthesized
agaaaaaggcactgacaaaa

SEQ ID NO: 63786 - DNA, 20 bp, Artificial Sequence
  chemically synthesized
ggattgaaagcaaaagaaaa

SEQ ID NO: 63787 - DNA, 20 bp, Artificial Sequence
  chemically synthesized
aggattgaaagcaaaagaaa

SEQ ID NO: 63788 - DNA, 20 bp, Artificial Sequence
  chemically synthesized
cagtccaggattgaaagcaa

SEQ ID NO: 63789 - DNA, 20 bp, Artificial Sequence
  chemically synthesized
ttttcttttgctttcaatcc

SEQ ID NO: 63790 - DNA, 20 bp, Artificial Sequence
  chemically synthesized
tgcctacagtccaggattga

SEQ ID NO: 63791 - DNA, 20 bp, Artificial Sequence
  chemically synthesized
ttgctttcaatcctggactg

SEQ ID NO: 63792 - DNA, 20 bp, Artificial Sequence
  chemically synthesized
tgctttcaatcctggactgt

SEQ ID NO: 63793 - DNA, 20 bp, Artificial Sequence
  chemically synthesized
gtatgtcttgcctacagtcc

SEQ ID NO: 63794 - DNA, 20 bp, Artificial Sequence
  chemically synthesized
tgtatgtcttgcctacagtc

SEQ ID NO: 63795 - DNA, 20 bp, Artificial Sequence
  chemically synthesized
ttcaatcctggactgtaggc

SEQ ID NO: 63796 - DNA, 20 bp, Artificial Sequence
  chemically synthesized
gagactgtatgtcttgccta

SEQ ID NO: 63797 - DNA, 20 bp, Artificial Sequence
  chemically synthesized
tggactgtaggcaagacata

SEQ ID NO: 63798 - DNA, 20 bp, Artificial Sequence
  chemically synthesized
ggcaagacatacagtctcct

SEQ ID NO: 63799 - DNA, 20 bp, Artificial Sequence
  chemically synthesized
caagacatacagtctcctca

SEQ ID NO: 63800 - DNA, 20 bp, Artificial Sequence
  chemically synthesized
gacctttctcaatctctgag

SEQ ID NO: 63801 - DNA, 20 bp, Artificial Sequence
  chemically synthesized
ttgacctttctcaatctctg

SEQ ID NO: 63802 - DNA, 20 bp, Artificial Sequence
  chemically synthesized
atacagtctcctcagagatt

SEQ ID NO: 63803 - DNA, 20 bp, Artificial Sequence
  chemically synthesized
attgacctttctcaatctct

SEQ ID NO: 63804 - DNA, 20 bp, Artificial Sequence
  chemically synthesized
agtctcctcagagattgaga

SEQ ID NO: 63805 - DNA, 20 bp, Artificial Sequence
  chemically synthesized
gtctcctcagagattgagaa

SEQ ID NO: 63806 - DNA, 20 bp, Artificial Sequence
  chemically synthesized
agattgagaaaggtcaataa

SEQ ID NO: 63807 - DNA, 20 bp, Artificial Sequence
  chemically synthesized
agttagtgaaaggaggaaaa

SEQ ID NO: 63808 - DNA, 20 bp, Artificial Sequence
  chemically synthesized
tttaatcagttagtgaaagg

SEQ ID NO: 63809 - DNA, 20 bp, Artificial Sequence
  chemically synthesized
atttaatcagttagtgaaag

SEQ ID NO: 63810 - DNA, 20 bp, Artificial Sequence
  chemically synthesized
ttatttaatcagttagtgaa

SEQ ID NO: 63811 - DNA, 20 bp, Artificial Sequence
  chemically synthesized
gttatttaatcagttagtga

SEQ ID NO: 63812 - DNA, 20 bp, Artificial Sequence
  chemically synthesized
ccatgcgttatttaatcagt

SEQ ID NO: 63813 - DNA, 20 bp, Artificial Sequence
  chemically synthesized
atgcccatgcgttatttaat

SEQ ID NO: 63814 - DNA, 20 bp, Artificial Sequence
  chemically synthesized
ctaactgattaaataacgca

SEQ ID NO: 63815 - DNA, 20 bp, Artificial Sequence
  chemically synthesized
taactgattaaataacgcat

SEQ ID NO: 63816 - DNA, 20 bp, Artificial Sequence
  chemically synthesized
ataacgcatgggcatatgta

SEQ ID NO: 63817 - DNA, 20 bp, Artificial Sequence
  chemically synthesized
tttccttagaaatacacgtg

SEQ ID NO: 63818 - DNA, 20 bp, Artificial Sequence
  chemically synthesized
atagctacacgtgtatttct

SEQ ID NO: 63819 - DNA, 20 bp, Artificial Sequence
  chemically synthesized
tagctacacgtgtatttcta

SEQ ID NO: 63820 - DNA, 20 bp, Artificial Sequence
  chemically synthesized
agtttttgaatgattttcct

SEQ ID NO: 63821 - DNA, 20 bp, Artificial Sequence
  chemically synthesized
ggtcacctcaggaaatcatg

SEQ ID NO: 63822 - DNA, 20 bp, Artificial Sequence
  chemically synthesized
caaaaactgcatgatttcct

SEQ ID NO: 63823 - DNA, 20 bp, Artificial Sequence
  chemically synthesized
aaaaactgcatgatttcctg

SEQ ID NO: 63824 - DNA, 20 bp, Artificial Sequence
  chemically synthesized
agcaccctggaggtcacctc

SEQ ID NO: 63825 - DNA, 20 bp, Artificial Sequence
  chemically synthesized
cagcaccctggaggtcacct

SEQ ID NO: 63826 - DNA, 20 bp, Artificial Sequence
  chemically synthesized
tgatttcctgaggtgacctc

SEQ ID NO: 63827 - DNA, 20 bp, Artificial Sequence
  chemically synthesized
gatttcctgaggtgacctcc

SEQ ID NO: 63828 - DNA, 20 bp, Artificial Sequence
  chemically synthesized
atttcctgaggtgacctcca

SEQ ID NO: 63829 - DNA, 20 bp, Artificial Sequence
  chemically synthesized
ctaaattttcagcaccctgg

SEQ ID NO: 63830 - DNA, 20 bp, Artificial Sequence
  chemically synthesized
tctaaattttcagcaccctg

SEQ ID NO: 63831 - DNA, 20 bp, Artificial Sequence
  chemically synthesized
tttctaaattttcagcaccc

SEQ ID NO: 63832 - DNA, 20 bp, Artificial Sequence
  chemically synthesized
cctccagggtgctgaaaatt

SEQ ID NO: 63833 - DNA, 20 bp, Artificial Sequence
  chemically synthesized
tgttacgttttctaaatttt

SEQ ID NO: 63834 - DNA, 20 bp, Artificial Sequence
  chemically synthesized
cttgattttattgattgcat

SEQ ID NO: 63835 - DNA, 20 bp, Artificial Sequence
  chemically synthesized
ctaatgcaatcaataaaatc

SEQ ID NO: 63836 - DNA, 20 bp, Artificial Sequence
  chemically synthesized
ataaaatcaagaatctgtgt

SEQ ID NO: 63837 - DNA, 20 bp, Artificial Sequence
  chemically synthesized
taaaatcaagaatctgtgtt

SEQ ID NO: 63838 - DNA, 20 bp, Artificial Sequence
  chemically synthesized
aactctcaaaatgcctaaca

SEQ ID NO: 63839 - DNA, 20 bp, Artificial Sequence
  chemically synthesized
gaatctgtgttaggcatttt

SEQ ID NO: 63840 - DNA, 20 bp, Artificial Sequence
  chemically synthesized
atctgtgttaggcattttga

SEQ ID NO: 63841 - DNA, 20 bp, Artificial Sequence
  chemically synthesized
gttaggcattttgagagttt

SEQ ID NO: 63842 - DNA, 20 bp, Artificial Sequence
  chemically synthesized
taggcattttgagagttttg

SEQ ID NO: 63843 - DNA, 20 bp, Artificial Sequence
  chemically synthesized
cattttgagagttttggagt

SEQ ID NO: 63844 - DNA, 20 bp, Artificial Sequence
  chemically synthesized
gagagttttggagtgagtga

SEQ ID NO: 63845 - DNA, 20 bp, Artificial Sequence
  chemically synthesized
ttttggagtgagtgacagta

SEQ ID NO: 63846 - DNA, 20 bp, Artificial Sequence
  chemically synthesized
gacagtacagccaattgata

SEQ ID NO: 63847 - DNA, 20 bp, Artificial Sequence
  chemically synthesized
ttcacggggactatatcaat

SEQ ID NO: 63848 - DNA, 20 bp, Artificial Sequence
  chemically synthesized
aattgatatagtccccgtga

SEQ ID NO: 63849 - DNA, 20 bp, Artificial Sequence
  chemically synthesized
attgatatagtccccgtgaa

SEQ ID NO: 63850 - DNA, 20 bp, Artificial Sequence
  chemically synthesized
tgccttacctgcctttcacg

SEQ ID NO: 63851 - DNA, 20 bp, Artificial Sequence
  chemically synthesized
atgccttacctgcctttcac

SEQ ID NO: 63852 - DNA, 20 bp, Artificial Sequence
  chemically synthesized
gatatagtccccgtgaaagg

SEQ ID NO: 63853 - DNA, 20 bp, Artificial Sequence
  chemically synthesized
gatgccttacctgcctttca

SEQ ID NO: 63854 - DNA, 20 bp, Artificial Sequence
  chemically synthesized
atatagtccccgtgaaaggc

SEQ ID NO: 63855 - DNA, 20 bp, Artificial Sequence
  chemically synthesized
agtccccgtgaaaggcaggt

SEQ ID NO: 63856 - DNA, 20 bp, Artificial Sequence
  chemically synthesized
gtccccgtgaaaggcaggta

SEQ ID NO: 63857 - DNA, 20 bp, Artificial Sequence
  chemically synthesized
gcaggtaaggcatctttatg

SEQ ID NO: 63858 - DNA, 20 bp, Artificial Sequence
  chemically synthesized
catcaatagagagccacata

SEQ ID NO: 63859 - DNA, 20 bp, Artificial Sequence
  chemically synthesized
agacttttctcatcaataga

SEQ ID NO: 63860 - DNA, 20 bp, Artificial Sequence
  chemically synthesized
ttatgtggctctctattgat

SEQ ID NO: 63861 - DNA, 20 bp, Artificial Sequence
  chemically synthesized
gaagacttttctcatcaata

SEQ ID NO: 63862 - DNA, 20 bp, Artificial Sequence
  chemically synthesized
aggaagacttttctcatcaa

SEQ ID NO: 63863 - DNA, 20 bp, Artificial Sequence
  chemically synthesized
tggctctctattgatgagaa

SEQ ID NO: 63864 - DNA, 20 bp, Artificial Sequence
  chemically synthesized
ttgatgagaaaagtcttcct

SEQ ID NO: 63865 - DNA, 20 bp, Artificial Sequence
  chemically synthesized
gatgagaaaagtcttcctaa

SEQ ID NO: 63866 - DNA, 20 bp, Artificial Sequence
  chemically synthesized
atctagtttattctcttagg

SEQ ID NO: 63867 - DNA, 20 bp, Artificial Sequence
  chemically synthesized
taaatctagtttattctctt

SEQ ID NO: 63868 - DNA, 20 bp, Artificial Sequence
  chemically synthesized
ctaaatctagtttattctct

SEQ ID NO: 63869 - DNA, 20 bp, Artificial Sequence
  chemically synthesized
gtcttcctaagagaataaac

SEQ ID NO: 63870 - DNA, 20 bp, Artificial Sequence
  chemically synthesized
ctaagagaataaactagatt

SEQ ID NO: 63871 - DNA, 20 bp, Artificial Sequence
  chemically synthesized
aagagaataaactagattta

SEQ ID NO: 63872 - DNA, 20 bp, Artificial Sequence
  chemically synthesized
cataagacacactctaaatc

SEQ ID NO: 63873 - DNA, 20 bp, Artificial Sequence
  chemically synthesized
ggggaaacaacagttttcat

SEQ ID NO: 63874 - DNA, 20 bp, Artificial Sequence
  chemically synthesized
ggaaggcatgggggaaacaa

SEQ ID NO: 63875 - DNA, 20 bp, Artificial Sequence
  chemically synthesized
agttaactgggaaggcatgg

SEQ ID NO: 63876 - DNA, 20 bp, Artificial Sequence
  chemically synthesized
gagttaactgggaaggcatg

SEQ ID NO: 63877 - DNA, 20 bp, Artificial Sequence
  chemically synthesized
tgagttaactgggaaggcat

SEQ ID NO: 63878 - DNA, 20 bp, Artificial Sequence
  chemically synthesized
atgagttaactgggaaggca

SEQ ID NO: 63879 - DNA, 20 bp, Artificial Sequence
  chemically synthesized
ttgtttcccccatgccttcc

SEQ ID NO: 63880 - DNA, 20 bp, Artificial Sequence
  chemically synthesized
tacaaatgagttaactggga

SEQ ID NO: 63881 - DNA, 20 bp, Artificial Sequence
  chemically synthesized
atacaaatgagttaactggg

SEQ ID NO: 63882 - DNA, 20 bp, Artificial Sequence
  chemically synthesized
attatacaaatgagttaact

SEQ ID NO: 63883 - DNA, 20 bp, Artificial Sequence
  chemically synthesized
aattatacaaatgagttaac

SEQ ID NO: 63884 - DNA, 20 bp, Artificial Sequence
  chemically synthesized
agccccaaaattatacaaat

SEQ ID NO: 63885 - DNA, 20 bp, Artificial Sequence
  chemically synthesized
ttaactcatttgtataattt

SEQ ID NO: 63886 - DNA, 20 bp, Artificial Sequence
  chemically synthesized
taactcatttgtataatttt

SEQ ID NO: 63887 - DNA, 20 bp, Artificial Sequence
  chemically synthesized
aactcatttgtataattttg

SEQ ID NO: 63888 - DNA, 20 bp, Artificial Sequence
  chemically synthesized
tttgtataattttggggctt

SEQ ID NO: 63889 - DNA, 20 bp, Artificial Sequence
  chemically synthesized
aaggagccccatcaaagctg

SEQ ID NO: 63890 - DNA, 20 bp, Artificial Sequence
  chemically synthesized
ttttggggcttcagctttga

SEQ ID NO: 63891 - DNA, 20 bp, Artificial Sequence
  chemically synthesized
tttggggcttcagctttgat

SEQ ID NO: 63892 - DNA, 20 bp, Artificial Sequence
  chemically synthesized
ttggggcttcagctttgatg

SEQ ID NO: 63893 - DNA, 20 bp, Artificial Sequence
  chemically synthesized
caaataaaggagccccatca

SEQ ID NO: 63894 - DNA, 20 bp, Artificial Sequence
  chemically synthesized
tctaaatgttgcaaataaag

SEQ ID NO: 63895 - DNA, 20 bp, Artificial Sequence
  chemically synthesized
aatctaaatgttgcaaataa

SEQ ID NO: 63896 - DNA, 20 bp, Artificial Sequence
  chemically synthesized
taatctaaatgttgcaaata

SEQ ID NO: 63897 - DNA, 20 bp, Artificial Sequence
  chemically synthesized
gctcctttatttgcaacatt

SEQ ID NO: 63898 - DNA, 20 bp, Artificial Sequence
  chemically synthesized
ttatttgcaacatttagatt

SEQ ID NO: 63899 - DNA, 20 bp, Artificial Sequence
  chemically synthesized
tgctcttagctatgataaaa

SEQ ID NO: 63900 - DNA, 20 bp, Artificial Sequence
  chemically synthesized
agttaatgactgttttatca

SEQ ID NO: 63901 - DNA, 20 bp, Artificial Sequence
  chemically synthesized
atgactgttttatcatagct

SEQ ID NO: 63902 - DNA, 20 bp, Artificial Sequence
  chemically synthesized
gactgttttatcatagctaa

SEQ ID NO: 63903 - DNA, 20 bp, Artificial Sequence
  chemically synthesized
tttatcatagctaagagcac

SEQ ID NO: 63904 - DNA, 20 bp, Artificial Sequence
  chemically synthesized
cctcctaattctagtgctct

SEQ ID NO: 63905 - DNA, 20 bp, Artificial Sequence
  chemically synthesized
atagctaagagcactagaat

SEQ ID NO: 63906 - DNA, 20 bp, Artificial Sequence
  chemically synthesized
tagctaagagcactagaatt

SEQ ID NO: 63907 - DNA, 20 bp, Artificial Sequence
  chemically synthesized
gctaagagcactagaattag

SEQ ID NO: 63908 - DNA, 20 bp, Artificial Sequence
  chemically synthesized
agccattgacctcctaattc

SEQ ID NO: 63909 - DNA, 20 bp, Artificial Sequence
  chemically synthesized
ctaagagcactagaattagg

SEQ ID NO: 63910 - DNA, 20 bp, Artificial Sequence
  chemically synthesized
cactagaattaggaggtcaa

SEQ ID NO: 63911 - DNA, 20 bp, Artificial Sequence
  chemically synthesized
attaggaggtcaatggctat

SEQ ID NO: 63912 - DNA, 20 bp, Artificial Sequence
  chemically synthesized
tcaagaaaatcaaatgctaa

SEQ ID NO: 63913 - DNA, 20 bp, Artificial Sequence
  chemically synthesized
ctcatctctttggtatcatc

SEQ ID NO: 63914 - DNA, 20 bp, Artificial Sequence
  chemically synthesized
tgattttcttgatgatacca

SEQ ID NO: 63915 - DNA, 20 bp, Artificial Sequence
  chemically synthesized
attttcttgatgataccaaa

SEQ ID NO: 63916 - DNA, 20 bp, Artificial Sequence
  chemically synthesized
cttgatgataccaaagagat

SEQ ID NO: 63917 - DNA, 20 bp, Artificial Sequence
  chemically synthesized
ccccctcaaactcatctctt

SEQ ID NO: 63918 - DNA, 20 bp, Artificial Sequence
  chemically synthesized
gataccaaagagatgagttt

SEQ ID NO: 63919 - DNA, 20 bp, Artificial Sequence
  chemically synthesized
ataccaaagagatgagtttg

SEQ ID NO: 63920 - DNA, 20 bp, Artificial Sequence
  chemically synthesized
taccaaagagatgagtttga

SEQ ID NO: 63921 - DNA, 20 bp, Artificial Sequence
  chemically synthesized
accaaagagatgagtttgag

SEQ ID NO: 63922 - DNA, 20 bp, Artificial Sequence
  chemically synthesized
ccaaagagatgagtttgagg

SEQ ID NO: 63923 - DNA, 20 bp, Artificial Sequence
  chemically synthesized
aagagatgagtttgaggggg

SEQ ID NO: 63924 - DNA, 20 bp, Artificial Sequence
  chemically synthesized
agatgagtttgagggggaag

SEQ ID NO: 63925 - DNA, 20 bp, Artificial Sequence
  chemically synthesized
agtttgagggggaagaagtg

SEQ ID NO: 63926 - DNA, 20 bp, Artificial Sequence
  chemically synthesized
gtttgagggggaagaagtgt

SEQ ID NO: 63927 - DNA, 20 bp, Artificial Sequence
  chemically synthesized
aaattaaaacatgagtaatc

SEQ ID NO: 63928 - DNA, 20 bp, Artificial Sequence
  chemically synthesized
ctgagatgaaattaaaacat

SEQ ID NO: 63929 - DNA, 20 bp, Artificial Sequence
  chemically synthesized
ctcatgttttaatttcatct

SEQ ID NO: 63930 - DNA, 20 bp, Artificial Sequence
  chemically synthesized
atgttttaatttcatctcag

SEQ ID NO: 63931 - DNA, 20 bp, Artificial Sequence
  chemically synthesized
tcattttggatttgtctact

SEQ ID NO: 63932 - DNA, 20 bp, Artificial Sequence
  chemically synthesized
tcatccctgagacatcattt

SEQ ID NO: 63933 - DNA, 20 bp, Artificial Sequence
  chemically synthesized
acaaatccaaaatgatgtct

SEQ ID NO: 63934 - DNA, 20 bp, Artificial Sequence
  chemically synthesized
caaatccaaaatgatgtctc

SEQ ID NO: 63935 - DNA, 20 bp, Artificial Sequence
  chemically synthesized
aaatccaaaatgatgtctca

SEQ ID NO: 63936 - DNA, 20 bp, Artificial Sequence
  chemically synthesized
tggaattctgagtcatccct

SEQ ID NO: 63937 - DNA, 20 bp, Artificial Sequence
  chemically synthesized
atgatgtctcagggatgact

SEQ ID NO: 63938 - DNA, 20 bp, Artificial Sequence
  chemically synthesized
tcagggatgactcagaattc

SEQ ID NO: 63939 - DNA, 20 bp, Artificial Sequence
  chemically synthesized
catatcccatctggaattct

SEQ ID NO: 63940 - DNA, 20 bp, Artificial Sequence
  chemically synthesized
ggatgactcagaattccaga

SEQ ID NO: 63941 - DNA, 20 bp, Artificial Sequence
  chemically synthesized
gatgactcagaattccagat

SEQ ID NO: 63942 - DNA, 20 bp, Artificial Sequence
  chemically synthesized
aaaagtacacatatcccatc

SEQ ID NO: 63943 - DNA, 20 bp, Artificial Sequence
  chemically synthesized
aaggactggacaaagggcaa

SEQ ID NO: 63944 - DNA, 20 bp, Artificial Sequence
  chemically synthesized
gtgtacttttgccctttgtc

SEQ ID NO: 63945 - DNA, 20 bp, Artificial Sequence
  chemically synthesized
tgtgcaaaggactggacaaa

SEQ ID NO: 63946 - DNA, 20 bp, Artificial Sequence
  chemically synthesized
gtgtgcaaaggactggacaa

SEQ ID NO: 63947 - DNA, 20 bp, Artificial Sequence
  chemically synthesized
agtgtgcaaaggactggaca

SEQ ID NO: 63948 - DNA, 20 bp, Artificial Sequence
  chemically synthesized
atgcccagtgtgcaaaggac

SEQ ID NO: 63949 - DNA, 20 bp, Artificial Sequence
  chemically synthesized
tggatatgcccagtgtgcaa

SEQ ID NO: 63950 - DNA, 20 bp, Artificial Sequence
  chemically synthesized
ttgtccagtcctttgcacac

SEQ ID NO: 63951 - DNA, 20 bp, Artificial Sequence
  chemically synthesized
gtggatatgcccagtgtgca

SEQ ID NO: 63952 - DNA, 20 bp, Artificial Sequence
  chemically synthesized
tgtccagtcctttgcacact

SEQ ID NO: 63953 - DNA, 20 bp, Artificial Sequence
  chemically synthesized
gtgttgtcagtggatatgcc

SEQ ID NO: 63954 - DNA, 20 bp, Artificial Sequence
  chemically synthesized
tctgacagttgtgttgtcag

SEQ ID NO: 63955 - DNA, 20 bp, Artificial Sequence
  chemically synthesized
tcctctgacagttgtgttgt

SEQ ID NO: 63956 - DNA, 20 bp, Artificial Sequence
  chemically synthesized
tccactgacaacacaactgt

SEQ ID NO: 63957 - DNA, 20 bp, Artificial Sequence
  chemically synthesized
cactgacaacacaactgtca

SEQ ID NO: 63958 - DNA, 20 bp, Artificial Sequence
  chemically synthesized
actgacaacacaactgtcag

SEQ ID NO: 63959 - DNA, 20 bp, Artificial Sequence
  chemically synthesized
ttgaaagcttgttcctctga

SEQ ID NO: 63960 - DNA, 20 bp, Artificial Sequence
  chemically synthesized
aacacaactgtcagaggaac

SEQ ID NO: 63961 - DNA, 20 bp, Artificial Sequence
  chemically synthesized
ctcttgaaactggaaattga

SEQ ID NO: 63962 - DNA, 20 bp, Artificial Sequence
  chemically synthesized
aggaacaagctttcaatttc

SEQ ID NO: 63963 - DNA, 20 bp, Artificial Sequence
  chemically synthesized
agctttcaatttccagtttc

SEQ ID NO: 63964 - DNA, 20 bp, Artificial Sequence
  chemically synthesized
ctttcaatttccagtttcaa

SEQ ID NO: 63965 - DNA, 20 bp, Artificial Sequence
  chemically synthesized
atctcattccctcttgaaac

SEQ ID NO: 63966 - DNA, 20 bp, Artificial Sequence
  chemically synthesized
tttcaatttccagtttcaag

SEQ ID NO: 63967 - DNA, 20 bp, Artificial Sequence
  chemically synthesized
ttcaatttccagtttcaaga

SEQ ID NO: 63968 - DNA, 20 bp, Artificial Sequence
  chemically synthesized
ttccagtttcaagagggaat

SEQ ID NO: 63969 - DNA, 20 bp, Artificial Sequence
  chemically synthesized
gtttcaagagggaatgagat

SEQ ID NO: 63970 - DNA, 20 bp, Artificial Sequence
  chemically synthesized
tttcaagagggaatgagatc

SEQ ID NO: 63971 - DNA, 20 bp, Artificial Sequence
  chemically synthesized
gtcaccataaatgatcattc

SEQ ID NO: 63972 - DNA, 20 bp, Artificial Sequence
  chemically synthesized
caggcttgaatgatcattta

SEQ ID NO: 63973 - DNA, 20 bp, Artificial Sequence
  chemically synthesized
ccttgtcggagaaagcaatt

SEQ ID NO: 63974 - DNA, 20 bp, Artificial Sequence
  chemically synthesized
tgaggcttccttgtcggaga

SEQ ID NO: 63975 - DNA, 20 bp, Artificial Sequence
  chemically synthesized
actgaattgctttctccgac

SEQ ID NO: 63976 - DNA, 20 bp, Artificial Sequence
  chemically synthesized
ctgaattgctttctccgaca

SEQ ID NO: 63977 - DNA, 20 bp, Artificial Sequence
  chemically synthesized
caagtgaggcttccttgtcg

SEQ ID NO: 63978 - DNA, 20 bp, Artificial Sequence
  chemically synthesized
aattgctttctccgacaagg

SEQ ID NO: 63979 - DNA, 20 bp, Artificial Sequence
  chemically synthesized
aacaagtgaggcttccttgt

SEQ ID NO: 63980 - DNA, 20 bp, Artificial Sequence
  chemically synthesized
gtaaagtccacgaacaagtg

SEQ ID NO: 63981 - DNA, 20 bp, Artificial Sequence
  chemically synthesized
cgtaaagtccacgaacaagt

SEQ ID NO: 63982 - DNA, 20 bp, Artificial Sequence
  chemically synthesized
aaggaagcctcacttgttcg

SEQ ID NO: 63983 - DNA, 20 bp, Artificial Sequence
  chemically synthesized
catccgtaaagtccacgaac

SEQ ID NO: 63984 - DNA, 20 bp, Artificial Sequence
  chemically synthesized
tcacttgttcgtggacttta

SEQ ID NO: 63985 - DNA, 20 bp, Artificial Sequence
  chemically synthesized
ttgttcgtggactttacgga

SEQ ID NO: 63986 - DNA, 20 bp, Artificial Sequence
  chemically synthesized
ttttgagagcaccatccgta

SEQ ID NO: 63987 - DNA, 20 bp, Artificial Sequence
  chemically synthesized
attaactggccaatttttga

SEQ ID NO: 63988 - DNA, 20 bp, Artificial Sequence
  chemically synthesized
cggatggtgctctcaaaaat

SEQ ID NO: 63989 - DNA, 20 bp, Artificial Sequence
  chemically synthesized
agattaactggccaattttt

SEQ ID NO: 63990 - DNA, 20 bp, Artificial Sequence
  chemically synthesized
tggtgctctcaaaaattggc

SEQ ID NO: 63991 - DNA, 20 bp, Artificial Sequence
  chemically synthesized
caacagataaagagattaac

SEQ ID NO: 63992 - DNA, 20 bp, Artificial Sequence
  chemically synthesized
ggaaagatgcaacagataaa

SEQ ID NO: 63993 - DNA, 20 bp, Artificial Sequence
  chemically synthesized
taggaaagatgcaacagata

SEQ ID NO: 63994 - DNA, 20 bp, Artificial Sequence
  chemically synthesized
ggaatctaggaaagatgcaa

SEQ ID NO: 63995 - DNA, 20 bp, Artificial Sequence
  chemically synthesized
tttatctgttgcatctttcc

SEQ ID NO: 63996 - DNA, 20 bp, Artificial Sequence
  chemically synthesized
agacacaatggaatctagga

SEQ ID NO: 63997 - DNA, 20 bp, Artificial Sequence
  chemically synthesized
cgaaagacacaatggaatct

SEQ ID NO: 63998 - DNA, 20 bp, Artificial Sequence
  chemically synthesized
tcgaaagacacaatggaatc

SEQ ID NO: 63999 - DNA, 20 bp, Artificial Sequence
  chemically synthesized
agtattttcgaaagacacaa

SEQ ID NO: 64000 - DNA, 20 bp, Artificial Sequence
  chemically synthesized
aaattttacagtattttcga

SEQ ID NO: 64001 - DNA, 20 bp, Artificial Sequence
  chemically synthesized
agctacatttgtaaatttta

SEQ ID NO: 64002 - DNA, 20 bp, Artificial Sequence
  chemically synthesized
tactgtaaaatttacaaatg

SEQ ID NO: 64003 - DNA, 20 bp, Artificial Sequence
  chemically synthesized
taaaatttacaaatgtagct

SEQ ID NO: 64004 - DNA, 20 bp, Artificial Sequence
  chemically synthesized
aaaatttacaaatgtagctt

SEQ ID NO: 64005 - DNA, 20 bp, Artificial Sequence
  chemically synthesized
aacacatttgcattttgcct

SEQ ID NO: 64006 - DNA, 20 bp, Artificial Sequence
  chemically synthesized
aaatgtgtttctgtcttaaa

SEQ ID NO: 64007 - DNA, 20 bp, Artificial Sequence
  chemically synthesized
gctatttcctctttttaaga

SEQ ID NO: 64008 - DNA, 20 bp, Artificial Sequence
  chemically synthesized
atgtgtttctgtcttaaaaa

SEQ ID NO: 64009 - DNA, 20 bp, Artificial Sequence
  chemically synthesized
tgtgtttctgtcttaaaaag

SEQ ID NO: 64010 - DNA, 20 bp, Artificial Sequence
  chemically synthesized
gatagctatttcctcttttt

SEQ ID NO: 64011 - DNA, 20 bp, Artificial Sequence
  chemically synthesized
tctgtcttaaaaagaggaaa

SEQ ID NO: 64012 - DNA, 20 bp, Artificial Sequence
  chemically synthesized
ccatcccatatcgttgcaga

SEQ ID NO: 64013 - DNA, 20 bp, Artificial Sequence
  chemically synthesized
ctctccatcccatatcgttg

SEQ ID NO: 64014 - DNA, 20 bp, Artificial Sequence
  chemically synthesized
aatagctatctgcaacgata

SEQ ID NO: 64015 - DNA, 20 bp, Artificial Sequence
  chemically synthesized
atagctatctgcaacgatat

SEQ ID NO: 64016 - DNA, 20 bp, Artificial Sequence
  chemically synthesized
ctatctgcaacgatatggga

SEQ ID NO: 64017 - DNA, 20 bp, Artificial Sequence
  chemically synthesized
atctgcaacgatatgggatg

SEQ ID NO: 64018 - DNA, 20 bp, Artificial Sequence
  chemically synthesized
ctgcaacgatatgggatgga

SEQ ID NO: 64019 - DNA, 20 bp, Artificial Sequence
  chemically synthesized
aacgatatgggatggagaga

SEQ ID NO: 64020 - DNA, 20 bp, Artificial Sequence
  chemically synthesized
tgggatggagagaaagcgaa

SEQ ID NO: 64021 - DNA, 20 bp, Artificial Sequence
  chemically synthesized
gggatggagagaaagcgaac

SEQ ID NO: 64022 - DNA, 20 bp, Artificial Sequence
  chemically synthesized
gatggagagaaagcgaacag

SEQ ID NO: 64023 - DNA, 20 bp, Artificial Sequence
  chemically synthesized
atggagagaaagcgaacagg

SEQ ID NO: 64024 - DNA, 20 bp, Artificial Sequence
  chemically synthesized
aagcgaacaggaggaccgtt

SEQ ID NO: 64025 - DNA, 20 bp, Artificial Sequence
  chemically synthesized
tcctacatcatgattctaaa

SEQ ID NO: 64026 - DNA, 20 bp, Artificial Sequence
  chemically synthesized
gaccgtttagaatcatgatg

SEQ ID NO: 64027 - DNA, 20 bp, Artificial Sequence
  chemically synthesized
accgtttagaatcatgatgt

SEQ ID NO: 64028 - DNA, 20 bp, Artificial Sequence
  chemically synthesized
gaaacataatgcaaaattgt

SEQ ID NO: 64029 - DNA, 20 bp, Artificial Sequence
  chemically synthesized
aaacataatgcaaaattgta

SEQ ID NO: 64030 - DNA, 20 bp, Artificial Sequence
  chemically synthesized
ataatgcaaaattgtaaggc

SEQ ID NO: 64031 - DNA, 20 bp, Artificial Sequence
  chemically synthesized
gcaaaattgtaaggctggtg

SEQ ID NO: 64032 - DNA, 20 bp, Artificial Sequence
  chemically synthesized
caaaattgtaaggctggtgt

SEQ ID NO: 64033 - DNA, 20 bp, Artificial Sequence
  chemically synthesized
aaaattgtaaggctggtgtg

SEQ ID NO: 64034 - DNA, 20 bp, Artificial Sequence
  chemically synthesized
aaattgtaaggctggtgtgg

SEQ ID NO: 64035 - DNA, 20 bp, Artificial Sequence
  chemically synthesized
tccttgccatacccccacac

SEQ ID NO: 64036 - DNA, 20 bp, Artificial Sequence
  chemically synthesized
gtaaggctggtgtgggggta

SEQ ID NO: 64037 - DNA, 20 bp, Artificial Sequence
  chemically synthesized
ggctggtgtgggggtatggc

SEQ ID NO: 64038 - DNA, 20 bp, Artificial Sequence
  chemically synthesized
gctggtgtgggggtatggca

SEQ ID NO: 64039 - DNA, 20 bp, Artificial Sequence
  chemically synthesized
gggggtatggcaaggataac

SEQ ID NO: 64040 - DNA, 20 bp, Artificial Sequence
  chemically synthesized
gtatggcaaggataactagt

SEQ ID NO: 64041 - DNA, 20 bp, Artificial Sequence
  chemically synthesized
atggcaaggataactagtga

SEQ ID NO: 64042 - DNA, 20 bp, Artificial Sequence
  chemically synthesized
ctccgttggggatctctcac

SEQ ID NO: 64043 - DNA, 20 bp, Artificial Sequence
  chemically synthesized
aactagtgagagatccccaa

SEQ ID NO: 64044 - DNA, 20 bp, Artificial Sequence
  chemically synthesized
ctagtgagagatccccaacg

SEQ ID NO: 64045 - DNA, 20 bp, Artificial Sequence
  chemically synthesized
caaatttcacatctccgttg

SEQ ID NO: 64046 - DNA, 20 bp, Artificial Sequence
  chemically synthesized
ccaaatttcacatctccgtt

SEQ ID NO: 64047 - DNA, 20 bp, Artificial Sequence
  chemically synthesized
tccaaatttcacatctccgt

SEQ ID NO: 64048 - DNA, 20 bp, Artificial Sequence
  chemically synthesized
cccaacggagatgtgaaatt

SEQ ID NO: 64049 - DNA, 20 bp, Artificial Sequence
  chemically synthesized
caacggagatgtgaaatttg

SEQ ID NO: 64050 - DNA, 20 bp, Artificial Sequence
  chemically synthesized
gagatgtgaaatttggagaa

SEQ ID NO: 64051 - DNA, 20 bp, Artificial Sequence
  chemically synthesized
gtgaaatttggagaaaagca

SEQ ID NO: 64052 - DNA, 20 bp, Artificial Sequence
  chemically synthesized
tgaaatttggagaaaagcat

SEQ ID NO: 64053 - DNA, 20 bp, Artificial Sequence
  chemically synthesized
aggaaactttgcattatgtg

SEQ ID NO: 64054 - DNA, 20 bp, Artificial Sequence
  chemically synthesized
taggaactgcacataatgca

SEQ ID NO: 64055 - DNA, 20 bp, Artificial Sequence
  chemically synthesized
actgagctcaaagtgagaga

SEQ ID NO: 64056 - DNA, 20 bp, Artificial Sequence
  chemically synthesized
cactgagctcaaagtgagag

SEQ ID NO: 64057 - DNA, 20 bp, Artificial Sequence
  chemically synthesized
aagtttccttctctcacttt

SEQ ID NO: 64058 - DNA, 20 bp, Artificial Sequence
  chemically synthesized
attcactgagctcaaagtga

SEQ ID NO: 64059 - DNA, 20 bp, Artificial Sequence
  chemically synthesized
agattcactgagctcaaagt

SEQ ID NO: 64060 - DNA, 20 bp, Artificial Sequence
  chemically synthesized
tccttctctcactttgagct

SEQ ID NO: 64061 - DNA, 20 bp, Artificial Sequence
  chemically synthesized
tcccagattcactgagctca

SEQ ID NO: 64062 - DNA, 20 bp, Artificial Sequence
  chemically synthesized
aaacaaatcccagattcact

SEQ ID NO: 64063 - DNA, 20 bp, Artificial Sequence
  chemically synthesized
cactttgagctcagtgaatc

SEQ ID NO: 64064 - DNA, 20 bp, Artificial Sequence
  chemically synthesized
actttgagctcagtgaatct

SEQ ID NO: 64065 - DNA, 20 bp, Artificial Sequence
  chemically synthesized
tttgttcataaaacaaatcc

SEQ ID NO: 64066 - DNA, 20 bp, Artificial Sequence
  chemically synthesized
tgggatttgttttatgaaca

SEQ ID NO: 64067 - DNA, 20 bp, Artificial Sequence
  chemically synthesized
atttgttttatgaacaaaga

SEQ ID NO: 64068 - DNA, 20 bp, Artificial Sequence
  chemically synthesized
gttttatgaacaaagatagc

SEQ ID NO: 64069 - DNA, 20 bp, Artificial Sequence
  chemically synthesized
gatagcaagttgctttatga

SEQ ID NO: 64070 - DNA, 20 bp, Artificial Sequence
  chemically synthesized
ttataaccactgccatcata

SEQ ID NO: 64071 - DNA, 20 bp, Artificial Sequence
  chemically synthesized
agcaagttgctttatgatgg

SEQ ID NO: 64072 - DNA, 20 bp, Artificial Sequence
  chemically synthesized
aagttgctttatgatggcag

SEQ ID NO: 64073 - DNA, 20 bp, Artificial Sequence
  chemically synthesized
ttataacaaatgcatgaaca

SEQ ID NO: 64074 - DNA, 20 bp, Artificial Sequence
  chemically synthesized
caaatgcatgaacaaagtaa

SEQ ID NO: 64075 - DNA, 20 bp, Artificial Sequence
  chemically synthesized
aaatgcatgaacaaagtaac

SEQ ID NO: 64076 - DNA, 20 bp, Artificial Sequence
  chemically synthesized
taacgggtaaacacataaaa

SEQ ID NO: 64077 - DNA, 20 bp, Artificial Sequence
  chemically synthesized
aagaacaattgaccttgcgt

SEQ ID NO: 64078 - DNA, 20 bp, Artificial Sequence
  chemically synthesized
agaacaattgaccttgcgta

SEQ ID NO: 64079 - DNA, 20 bp, Artificial Sequence
  chemically synthesized
gaacaattgaccttgcgtaa

SEQ ID NO: 64080 - DNA, 20 bp, Artificial Sequence
  chemically synthesized
catttgctctcccttacgca

SEQ ID NO: 64081 - DNA, 20 bp, Artificial Sequence
  chemically synthesized
acatttgctctcccttacgc

SEQ ID NO: 64082 - DNA, 20 bp, Artificial Sequence
  chemically synthesized
acaattgaccttgcgtaagg

SEQ ID NO: 64083 - DNA, 20 bp, Artificial Sequence
  chemically synthesized
aattgaccttgcgtaaggga

SEQ ID NO: 64084 - DNA, 20 bp, Artificial Sequence
  chemically synthesized
ttattcttagcacataagtc

SEQ ID NO: 64085 - DNA, 20 bp, Artificial Sequence
  chemically synthesized
tgtaacttgacttatgtgct

SEQ ID NO: 64086 - DNA, 20 bp, Artificial Sequence
  chemically synthesized
ttgcattattcttagcacat

SEQ ID NO: 64087 - DNA, 20 bp, Artificial Sequence
  chemically synthesized
ctttttctttgcattattct

SEQ ID NO: 64088 - DNA, 20 bp, Artificial Sequence
  chemically synthesized
tatgtgctaagaataatgca

SEQ ID NO: 64089 - DNA, 20 bp, Artificial Sequence
  chemically synthesized
ctaagaataatgcaaagaaa

SEQ ID NO: 64090 - DNA, 20 bp, Artificial Sequence
  chemically synthesized
taatgcaaagaaaaagaact

SEQ ID NO: 64091 - DNA, 20 bp, Artificial Sequence
  chemically synthesized
tgttgcacatagtaagtgct

SEQ ID NO: 64092 - DNA, 20 bp, Artificial Sequence
  chemically synthesized
ctatatgtgttgcacatagt

SEQ ID NO: 64093 - DNA, 20 bp, Artificial Sequence
  chemically synthesized
catactatatgtgttgcaca

SEQ ID NO: 64094 - DNA, 20 bp, Artificial Sequence
  chemically synthesized
cttactatgtgcaacacata

SEQ ID NO: 64095 - DNA, 20 bp, Artificial Sequence
  chemically synthesized
taatcctcatgtacataaca

SEQ ID NO: 64096 - DNA, 20 bp, Artificial Sequence
  chemically synthesized
atgtactgtgttatgtacat

SEQ ID NO: 64097 - DNA, 20 bp, Artificial Sequence
  chemically synthesized
tgtactgtgttatgtacatg

SEQ ID NO: 64098 - DNA, 20 bp, Artificial Sequence
  chemically synthesized
agtgaggattaaatgagatg

SEQ ID NO: 64099 - DNA, 20 bp, Artificial Sequence
  chemically synthesized
ggttgtagtgaggattaaat

SEQ ID NO: 64100 - DNA, 20 bp, Artificial Sequence
  chemically synthesized
tttttcatagggttgtagtg

SEQ ID NO: 64101 - DNA, 20 bp, Artificial Sequence
  chemically synthesized
ttttttcatagggttgtagt

SEQ ID NO: 64102 - DNA, 20 bp, Artificial Sequence
  chemically synthesized
gtgcttttttcatagggttg

SEQ ID NO: 64103 - DNA, 20 bp, Artificial Sequence
  chemically synthesized
acagtagtgcttttttcata

SEQ ID NO: 64104 - DNA, 20 bp, Artificial Sequence
  chemically synthesized
tcactacaaccctatgaaaa

SEQ ID NO: 64105 - DNA, 20 bp, Artificial Sequence
  chemically synthesized
tacagtagtgcttttttcat

SEQ ID NO: 64106 - DNA, 20 bp, Artificial Sequence
  chemically synthesized
atacagtagtgcttttttca

SEQ ID NO: 64107 - DNA, 20 bp, Artificial Sequence
  chemically synthesized
gtagaatgaaaataatacag

SEQ ID NO: 64108 - DNA, 20 bp, Artificial Sequence
  chemically synthesized
tcagtagaatgaaaataata

SEQ ID NO: 64109 - DNA, 20 bp, Artificial Sequence
  chemically synthesized
attattttcattctactgat

SEQ ID NO: 64110 - DNA, 20 bp, Artificial Sequence
  chemically synthesized
ttattttcattctactgatg

SEQ ID NO: 64111 - DNA, 20 bp, Artificial Sequence
  chemically synthesized
tgcctcagtttcctcatcag

SEQ ID NO: 64112 - DNA, 20 bp, Artificial Sequence
  chemically synthesized
ctatgcctcagtttcctcat

SEQ ID NO: 64113 - DNA, 20 bp, Artificial Sequence
  chemically synthesized
attctactgatgaggaaact

SEQ ID NO: 64114 - DNA, 20 bp, Artificial Sequence
  chemically synthesized
ttctactgatgaggaaactg

SEQ ID NO: 64115 - DNA, 20 bp, Artificial Sequence
  chemically synthesized
ctgatgaggaaactgaggca

SEQ ID NO: 64116 - DNA, 20 bp, Artificial Sequence
  chemically synthesized
tcaagttatgtactatgcct

SEQ ID NO: 64117 - DNA, 20 bp, Artificial Sequence
  chemically synthesized
gcatagtacataacttgatt

SEQ ID NO: 64118 - DNA, 20 bp, Artificial Sequence
  chemically synthesized
catagtacataacttgattg

SEQ ID NO: 64119 - DNA, 20 bp, Artificial Sequence
  chemically synthesized
ctgctttgccaacctcaatc

SEQ ID NO: 64120 - DNA, 20 bp, Artificial Sequence
  chemically synthesized
gtacataacttgattgaggt

SEQ ID NO: 64121 - DNA, 20 bp, Artificial Sequence
  chemically synthesized
taacttgattgaggttggca

SEQ ID NO: 64122 - DNA, 20 bp, Artificial Sequence
  chemically synthesized
cttgattgaggttggcaaag

SEQ ID NO: 64123 - DNA, 20 bp, Artificial Sequence
  chemically synthesized
attgaggttggcaaagcaga

SEQ ID NO: 64124 - DNA, 20 bp, Artificial Sequence
  chemically synthesized
gcaaagcagacagaatctga

SEQ ID NO: 64125 - DNA, 20 bp, Artificial Sequence
  chemically synthesized
gatttaaattgcaattctgt

SEQ ID NO: 64126 - DNA, 20 bp, Artificial Sequence
  chemically synthesized
acagaattgcaatttaaatc

SEQ ID NO: 64127 - DNA, 20 bp, Artificial Sequence
  chemically synthesized
agaattgcaatttaaatcta

SEQ ID NO: 64128 - DNA, 20 bp, Artificial Sequence
  chemically synthesized
gtggcttagttcagaggctc

SEQ ID NO: 64129 - DNA, 20 bp, Artificial Sequence
  chemically synthesized
aaatctagagcctctgaact

SEQ ID NO: 64130 - DNA, 20 bp, Artificial Sequence
  chemically synthesized
attttagtggcttagttcag

SEQ ID NO: 64131 - DNA, 20 bp, Artificial Sequence
  chemically synthesized
cattttagtggcttagttca

SEQ ID NO: 64132 - DNA, 20 bp, Artificial Sequence
  chemically synthesized
tccattttagtggcttagtt

SEQ ID NO: 64133 - DNA, 20 bp, Artificial Sequence
  chemically synthesized
gccagtccattttagtggct

SEQ ID NO: 64134 - DNA, 20 bp, Artificial Sequence
  chemically synthesized
tctgaactaagccactaaaa

SEQ ID NO: 64135 - DNA, 20 bp, Artificial Sequence
  chemically synthesized
tctgagccagtccattttag

SEQ ID NO: 64136 - DNA, 20 bp, Artificial Sequence
  chemically synthesized
aactctgagccagtccattt

SEQ ID NO: 64137 - DNA, 20 bp, Artificial Sequence
  chemically synthesized
actaagccactaaaatggac

SEQ ID NO: 64138 - DNA, 20 bp, Artificial Sequence
  chemically synthesized
gccactaaaatggactggct

SEQ ID NO: 64139 - DNA, 20 bp, Artificial Sequence
  chemically synthesized
cactaaaatggactggctca

SEQ ID NO: 64140 - DNA, 20 bp, Artificial Sequence
  chemically synthesized
attcttattcaactctgagc

SEQ ID NO: 64141 - DNA, 20 bp, Artificial Sequence
  chemically synthesized
tcctattcttattcaactct

SEQ ID NO: 64142 - DNA, 20 bp, Artificial Sequence
  chemically synthesized
ggactggctcagagttgaat

SEQ ID NO: 64143 - DNA, 20 bp, Artificial Sequence
  chemically synthesized
ggctcagagttgaataagaa

SEQ ID NO: 64144 - DNA, 20 bp, Artificial Sequence
  chemically synthesized
gctcagagttgaataagaat

SEQ ID NO: 64145 - DNA, 20 bp, Artificial Sequence
  chemically synthesized
tgaataagaataggaatttc

SEQ ID NO: 64146 - DNA, 20 bp, Artificial Sequence
  chemically synthesized
gaataagaataggaatttcc

SEQ ID NO: 64147 - DNA, 20 bp, Artificial Sequence
  chemically synthesized
ataggaatttccaggtttat

SEQ ID NO: 64148 - DNA, 20 bp, Artificial Sequence
  chemically synthesized
ctggaaagcccttataaacc

SEQ ID NO: 64149 - DNA, 20 bp, Artificial Sequence
  chemically synthesized
taggaatttccaggtttata

SEQ ID NO: 64150 - DNA, 20 bp, Artificial Sequence
  chemically synthesized
aggaatttccaggtttataa

SEQ ID NO: 64151 - DNA, 20 bp, Artificial Sequence
  chemically synthesized
ccaggtttataagggctttc

SEQ ID NO: 64152 - DNA, 20 bp, Artificial Sequence
  chemically synthesized
caggtttataagggctttcc

SEQ ID NO: 64153 - DNA, 20 bp, Artificial Sequence
  chemically synthesized
atactctttctatgcctgga

SEQ ID NO: 64154 - DNA, 20 bp, Artificial Sequence
  chemically synthesized
ttataagggctttccaggca

SEQ ID NO: 64155 - DNA, 20 bp, Artificial Sequence
  chemically synthesized
gaaaatactctttctatgcc

SEQ ID NO: 64156 - DNA, 20 bp, Artificial Sequence
  chemically synthesized
aagggctttccaggcataga

SEQ ID NO: 64157 - DNA, 20 bp, Artificial Sequence
  chemically synthesized
gggctttccaggcatagaaa

SEQ ID NO: 64158 - DNA, 20 bp, Artificial Sequence
  chemically synthesized
gcatagaaagagtattttca

SEQ ID NO: 64159 - DNA, 20 bp, Artificial Sequence
  chemically synthesized
catagaaagagtattttcaa

SEQ ID NO: 64160 - DNA, 20 bp, Artificial Sequence
  chemically synthesized
agagtattttcaaaggcatg

SEQ ID NO: 64161 - DNA, 20 bp, Artificial Sequence
  chemically synthesized
attttcaaaggcatgaagct

SEQ ID NO: 64162 - DNA, 20 bp, Artificial Sequence
  chemically synthesized
tcaaaggcatgaagctgaga

SEQ ID NO: 64163 - DNA, 20 bp, Artificial Sequence
  chemically synthesized
ccctctcgctatgtctttct

SEQ ID NO: 64164 - DNA, 20 bp, Artificial Sequence
  chemically synthesized
gcatgaagctgagaaagaca

SEQ ID NO: 64165 - DNA, 20 bp, Artificial Sequence
  chemically synthesized
gaagctgagaaagacatagc

SEQ ID NO: 64166 - DNA, 20 bp, Artificial Sequence
  chemically synthesized
agctgagaaagacatagcga

SEQ ID NO: 64167 - DNA, 20 bp, Artificial Sequence
  chemically synthesized
gctgagaaagacatagcgag

SEQ ID NO: 64168 - DNA, 20 bp, Artificial Sequence
  chemically synthesized
ctgagaaagacatagcgaga

SEQ ID NO: 64169 - DNA, 20 bp, Artificial Sequence
  chemically synthesized
gaaagacatagcgagagggc

SEQ ID NO: 64170 - DNA, 20 bp, Artificial Sequence
  chemically synthesized
aagacatagcgagagggcca

SEQ ID NO: 64171 - DNA, 20 bp, Artificial Sequence
  chemically synthesized
agacatagcgagagggccag

SEQ ID NO: 64172 - DNA, 20 bp, Artificial Sequence
  chemically synthesized
agcgagagggccagaggccg

SEQ ID NO: 64173 - DNA, 20 bp, Artificial Sequence
  chemically synthesized
cttatttactcttcggcctc

SEQ ID NO: 64174 - DNA, 20 bp, Artificial Sequence
  chemically synthesized
cgagagggccagaggccgaa

SEQ ID NO: 64175 - DNA, 20 bp, Artificial Sequence
  chemically synthesized
ttgcaaccttatttactctt

SEQ ID NO: 64176 - DNA, 20 bp, Artificial Sequence
  chemically synthesized
ccagaggccgaagagtaaat

SEQ ID NO: 64177 - DNA, 20 bp, Artificial Sequence
  chemically synthesized
cagaggccgaagagtaaata

SEQ ID NO: 64178 - DNA, 20 bp, Artificial Sequence
  chemically synthesized
cgaagagtaaataaggttgc

SEQ ID NO: 64179 - DNA, 20 bp, Artificial Sequence
  chemically synthesized
gaagagtaaataaggttgca

SEQ ID NO: 64180 - DNA, 20 bp, Artificial Sequence
  chemically synthesized
aagagtaaataaggttgcaa

SEQ ID NO: 64181 - DNA, 20 bp, Artificial Sequence
  chemically synthesized
agagtaaataaggttgcaag

SEQ ID NO: 64182 - DNA, 20 bp, Artificial Sequence
  chemically synthesized
gagtaaataaggttgcaagg

SEQ ID NO: 64183 - DNA, 20 bp, Artificial Sequence
  chemically synthesized
taaataaggttgcaaggggg

SEQ ID NO: 64184 - DNA, 20 bp, Artificial Sequence
  chemically synthesized
aaataaggttgcaagggggt

SEQ ID NO: 64185 - DNA, 20 bp, Artificial Sequence
  chemically synthesized
aataaggttgcaagggggta

SEQ ID NO: 64186 - DNA, 20 bp, Artificial Sequence
  chemically synthesized
aaggttgcaagggggtaggg

SEQ ID NO: 64187 - DNA, 20 bp, Artificial Sequence
  chemically synthesized
aggttgcaagggggtagggt

SEQ ID NO: 64188 - DNA, 20 bp, Artificial Sequence
  chemically synthesized
ggttgcaagggggtagggtg

SEQ ID NO: 64189 - DNA, 20 bp, Artificial Sequence
  chemically synthesized
ttgcaagggggtagggtggg

SEQ ID NO: 64190 - DNA, 20 bp, Artificial Sequence
  chemically synthesized
caagggggtagggtggggag

SEQ ID NO: 64191 - DNA, 20 bp, Artificial Sequence
  chemically synthesized
aagggggtagggtggggagc

SEQ ID NO: 64192 - DNA, 20 bp, Artificial Sequence
  chemically synthesized
agggggtagggtggggagca

SEQ ID NO: 64193 - DNA, 20 bp, Artificial Sequence
  chemically synthesized
ggggtagggtggggagcagg

SEQ ID NO: 64194 - DNA, 20 bp, Artificial Sequence
  chemically synthesized
gggtagggtggggagcaggg

SEQ ID NO: 64195 - DNA, 20 bp, Artificial Sequence
  chemically synthesized
ctacaacacattttttcaaa

SEQ ID NO: 64196 - DNA, 20 bp, Artificial Sequence
  chemically synthesized
ctttttgaaaaaatgtgttg

SEQ ID NO: 64197 - DNA, 20 bp, Artificial Sequence
  chemically synthesized
aaaaatgtgttgtagatatg

SEQ ID NO: 64198 - DNA, 20 bp, Artificial Sequence
  chemically synthesized
accagcctgggaaacatagt

SEQ ID NO: 64199 - DNA, 20 bp, Artificial Sequence
  chemically synthesized
tgaagtctcactatgtttcc

SEQ ID NO: 64200 - DNA, 20 bp, Artificial Sequence
  chemically synthesized
caagaccagcctgggaaaca

SEQ ID NO: 64201 - DNA, 20 bp, Artificial Sequence
  chemically synthesized
gaagtctcactatgtttccc

SEQ ID NO: 64202 - DNA, 20 bp, Artificial Sequence
  chemically synthesized
tctcactatgtttcccaggc

SEQ ID NO: 64203 - DNA, 20 bp, Artificial Sequence
  chemically synthesized
caggagttcaagaccagcct

SEQ ID NO: 64204 - DNA, 20 bp, Artificial Sequence
  chemically synthesized
ccaggagttcaagaccagcc

SEQ ID NO: 64205 - DNA, 20 bp, Artificial Sequence
  chemically synthesized
tgagcccaggagttcaagac

SEQ ID NO: 64206 - DNA, 20 bp, Artificial Sequence
  chemically synthesized
ccaggctggtcttgaactcc

SEQ ID NO: 64207 - DNA, 20 bp, Artificial Sequence
  chemically synthesized
ttgcttgagcccaggagttc

SEQ ID NO: 64208 - DNA, 20 bp, Artificial Sequence
  chemically synthesized
caggctggtcttgaactcct

SEQ ID NO: 64209 - DNA, 20 bp, Artificial Sequence
  chemically synthesized
ggagaattgcttgagcccag

SEQ ID NO: 64210 - DNA, 20 bp, Artificial Sequence
  chemically synthesized
ggtcttgaactcctgggctc

SEQ ID NO: 64211 - DNA, 20 bp, Artificial Sequence
  chemically synthesized
caggagaattgcttgagccc

SEQ ID NO: 64212 - DNA, 20 bp, Artificial Sequence
  chemically synthesized
acaggagaattgcttgagcc

SEQ ID NO: 64213 - DNA, 20 bp, Artificial Sequence
  chemically synthesized
ccaagacaggagaattgctt

SEQ ID NO: 64214 - DNA, 20 bp, Artificial Sequence
  chemically synthesized
ctcaagcaattctcctgtct

SEQ ID NO: 64215 - DNA, 20 bp, Artificial Sequence
  chemically synthesized
actttgagaggccaagacag

SEQ ID NO: 64216 - DNA, 20 bp, Artificial Sequence
  chemically synthesized
gcactttgagaggccaagac

SEQ ID NO: 64217 - DNA, 20 bp, Artificial Sequence
  chemically synthesized
agcactttgagaggccaaga

SEQ ID NO: 64218 - DNA, 20 bp, Artificial Sequence
  chemically synthesized
tcctagcactttgagaggcc

SEQ ID NO: 64219 - DNA, 20 bp, Artificial Sequence
  chemically synthesized
tctcctgtcttggcctctca

SEQ ID NO: 64220 - DNA, 20 bp, Artificial Sequence
  chemically synthesized
tgtaatcctagcactttgag

SEQ ID NO: 64221 - DNA, 20 bp, Artificial Sequence
  chemically synthesized
ctgtaatcctagcactttga

SEQ ID NO: 64222 - DNA, 20 bp, Artificial Sequence
  chemically synthesized
gtcttggcctctcaaagtgc

SEQ ID NO: 64223 - DNA, 20 bp, Artificial Sequence
  chemically synthesized
gcctgtaatcctagcacttt

SEQ ID NO: 64224 - DNA, 20 bp, Artificial Sequence
  chemically synthesized
tcttggcctctcaaagtgct

SEQ ID NO: 64225 - DNA, 20 bp, Artificial Sequence
  chemically synthesized
ctctcaaagtgctaggatta

SEQ ID NO: 64226 - DNA, 20 bp, Artificial Sequence
  chemically synthesized
tctcaaagtgctaggattac

SEQ ID NO: 64227 - DNA, 20 bp, Artificial Sequence
  chemically synthesized
gtggcttatgcctgtaatcc

SEQ ID NO: 64228 - DNA, 20 bp, Artificial Sequence
  chemically synthesized
agtgctaggattacaggcat

SEQ ID NO: 64229 - DNA, 20 bp, Artificial Sequence
  chemically synthesized
caggcataagccactgtgcc

SEQ ID NO: 64230 - DNA, 20 bp, Artificial Sequence
  chemically synthesized
ttcctcctggctgggcacag

SEQ ID NO: 64231 - DNA, 20 bp, Artificial Sequence
  chemically synthesized
tccttcctcctggctgggca

SEQ ID NO: 64232 - DNA, 20 bp, Artificial Sequence
  chemically synthesized
cataagccactgtgcccagc

SEQ ID NO: 64233 - DNA, 20 bp, Artificial Sequence
  chemically synthesized
ataagccactgtgcccagcc

SEQ ID NO: 64234 - DNA, 20 bp, Artificial Sequence
  chemically synthesized
aagccactgtgcccagccag

SEQ ID NO: 64235 - DNA, 20 bp, Artificial Sequence
  chemically synthesized
agccactgtgcccagccagg

SEQ ID NO: 64236 - DNA, 20 bp, Artificial Sequence
  chemically synthesized
tgaattccttcctcctggct

SEQ ID NO: 64237 - DNA, 20 bp, Artificial Sequence
  chemically synthesized
ctgaattccttcctcctggc

SEQ ID NO: 64238 - DNA, 20 bp, Artificial Sequence
  chemically synthesized
cactgtgcccagccaggagg

SEQ ID NO: 64239 - DNA, 20 bp, Artificial Sequence
  chemically synthesized
actgtgcccagccaggagga

SEQ ID NO: 64240 - DNA, 20 bp, Artificial Sequence
  chemically synthesized
ttaactgaattccttcctcc

SEQ ID NO: 64241 - DNA, 20 bp, Artificial Sequence
  chemically synthesized
ccagccaggaggaaggaatt

SEQ ID NO: 64242 - DNA, 20 bp, Artificial Sequence
  chemically synthesized
caggaggaaggaattcagtt

SEQ ID NO: 64243 - DNA, 20 bp, Artificial Sequence
  chemically synthesized
ggaggaaggaattcagttaa

SEQ ID NO: 64244 - DNA, 20 bp, Artificial Sequence
  chemically synthesized
gaggaaggaattcagttaag

SEQ ID NO: 64245 - DNA, 20 bp, Artificial Sequence
  chemically synthesized
aaggaattcagttaagaggc

SEQ ID NO: 64246 - DNA, 20 bp, Artificial Sequence
  chemically synthesized
attcagttaagaggctagat

SEQ ID NO: 64247 - DNA, 20 bp, Artificial Sequence
  chemically synthesized
gtggctccaattcactgatc

SEQ ID NO: 64248 - DNA, 20 bp, Artificial Sequence
  chemically synthesized
aagaggctagatcagtgaat

SEQ ID NO: 64249 - DNA, 20 bp, Artificial Sequence
  chemically synthesized
gaggctagatcagtgaattg

SEQ ID NO: 64250 - DNA, 20 bp, Artificial Sequence
  chemically synthesized
aagaaaaaatatatatgatg

SEQ ID NO: 64251 - DNA, 20 bp, Artificial Sequence
  chemically synthesized
catatatattttttcttttt

SEQ ID NO: 64252 - DNA, 20 bp, Artificial Sequence
  chemically synthesized
tatatattttttctttttta

SEQ ID NO: 64253 - DNA, 20 bp, Artificial Sequence
  chemically synthesized
gcaagatctcatctctaaaa

SEQ ID NO: 64254 - DNA, 20 bp, Artificial Sequence
  chemically synthesized
attttttcttttttagagat

SEQ ID NO: 64255 - DNA, 20 bp, Artificial Sequence
  chemically synthesized
tccagccttggcaacatagc

SEQ ID NO: 64256 - DNA, 20 bp, Artificial Sequence
  chemically synthesized
tgagatcttgctatgttgcc

SEQ ID NO: 64257 - DNA, 20 bp, Artificial Sequence
  chemically synthesized
gccctccagccttggcaaca

SEQ ID NO: 64258 - DNA, 20 bp, Artificial Sequence
  chemically synthesized
gagatcttgctatgttgcca

SEQ ID NO: 64259 - DNA, 20 bp, Artificial Sequence
  chemically synthesized
tcttgctatgttgccaaggc

SEQ ID NO: 64260 - DNA, 20 bp, Artificial Sequence
  chemically synthesized
ttgctatgttgccaaggctg

SEQ ID NO: 64261 - DNA, 20 bp, Artificial Sequence
  chemically synthesized
tgctatgttgccaaggctgg

SEQ ID NO: 64262 - DNA, 20 bp, Artificial Sequence
  chemically synthesized
tagccactgccctccagcct

SEQ ID NO: 64263 - DNA, 20 bp, Artificial Sequence
  chemically synthesized
gctatgttgccaaggctgga

SEQ ID NO: 64264 - DNA, 20 bp, Artificial Sequence
  chemically synthesized
atgttgccaaggctggaggg

SEQ ID NO: 64265 - DNA, 20 bp, Artificial Sequence
  chemically synthesized
tgtgaatagccactgccctc

SEQ ID NO: 64266 - DNA, 20 bp, Artificial Sequence
  chemically synthesized
ttgccaaggctggagggcag

SEQ ID NO: 64267 - DNA, 20 bp, Artificial Sequence
  chemically synthesized
tggagggcagtggctattca

SEQ ID NO: 64268 - DNA, 20 bp, Artificial Sequence
  chemically synthesized
ggagggcagtggctattcac

SEQ ID NO: 64269 - DNA, 20 bp, Artificial Sequence
  chemically synthesized
actgtggttgtacctgtgaa

SEQ ID NO: 64270 - DNA, 20 bp, Artificial Sequence
  chemically synthesized
gctattcacaggtacaacca

SEQ ID NO: 64271 - DNA, 20 bp, Artificial Sequence
  chemically synthesized
gtttgaggctgtaggcactg

SEQ ID NO: 64272 - DNA, 20 bp, Artificial Sequence
  chemically synthesized
aggtacaaccacagtgccta

SEQ ID NO: 64273 - DNA, 20 bp, Artificial Sequence
  chemically synthesized
acccagaagtttgaggctgt

SEQ ID NO: 64274 - DNA, 20 bp, Artificial Sequence
  chemically synthesized
aacccagaagtttgaggctg

SEQ ID NO: 64275 - DNA, 20 bp, Artificial Sequence
  chemically synthesized
ctcttgaacccagaagtttg

SEQ ID NO: 64276 - DNA, 20 bp, Artificial Sequence
  chemically synthesized
tgcctacagcctcaaacttc

SEQ ID NO: 64277 - DNA, 20 bp, Artificial Sequence
  chemically synthesized
tctcttgaacccagaagttt

SEQ ID NO: 64278 - DNA, 20 bp, Artificial Sequence
  chemically synthesized
gcctacagcctcaaacttct

SEQ ID NO: 64279 - DNA, 20 bp, Artificial Sequence
  chemically synthesized
ggaggatctcttgaacccag

SEQ ID NO: 64280 - DNA, 20 bp, Artificial Sequence
  chemically synthesized
agcctcaaacttctgggttc

SEQ ID NO: 64281 - DNA, 20 bp, Artificial Sequence
  chemically synthesized
cctcaaacttctgggttcaa

SEQ ID NO: 64282 - DNA, 20 bp, Artificial Sequence
  chemically synthesized
gtgggaggatctcttgaacc

SEQ ID NO: 64283 - DNA, 20 bp, Artificial Sequence
  chemically synthesized
ttcaagagatcctcccacct

SEQ ID NO: 64284 - DNA, 20 bp, Artificial Sequence
  chemically synthesized
actgaagaggctgaggtggg

SEQ ID NO: 64285 - DNA, 20 bp, Artificial Sequence
  chemically synthesized
tactgaagaggctgaggtgg

SEQ ID NO: 64286 - DNA, 20 bp, Artificial Sequence
  chemically synthesized
actactgaagaggctgaggt

SEQ ID NO: 64287 - DNA, 20 bp, Artificial Sequence
  chemically synthesized
aactactgaagaggctgagg

SEQ ID NO: 64288 - DNA, 20 bp, Artificial Sequence
  chemically synthesized
cccaactactgaagaggctg

SEQ ID NO: 64289 - DNA, 20 bp, Artificial Sequence
  chemically synthesized
tcccaactactgaagaggct

SEQ ID NO: 64290 - DNA, 20 bp, Artificial Sequence
  chemically synthesized
tcctcccacctcagcctctt

SEQ ID NO: 64291 - DNA, 20 bp, Artificial Sequence
  chemically synthesized
tcccacctcagcctcttcag

SEQ ID NO: 64292 - DNA, 20 bp, Artificial Sequence
  chemically synthesized
tatagtcccaactactgaag

SEQ ID NO: 64293 - DNA, 20 bp, Artificial Sequence
  chemically synthesized
ctatagtcccaactactgaa

SEQ ID NO: 64294 - DNA, 20 bp, Artificial Sequence
  chemically synthesized
acctcagcctcttcagtagt

SEQ ID NO: 64295 - DNA, 20 bp, Artificial Sequence
  chemically synthesized
acctatagtcccaactactg

SEQ ID NO: 64296 - DNA, 20 bp, Artificial Sequence
  chemically synthesized
cctcagcctcttcagtagtt

SEQ ID NO: 64297 - DNA, 20 bp, Artificial Sequence
  chemically synthesized
ctcttcagtagttgggacta

SEQ ID NO: 64298 - DNA, 20 bp, Artificial Sequence
  chemically synthesized
tcttcagtagttgggactat

SEQ ID NO: 64299 - DNA, 20 bp, Artificial Sequence
  chemically synthesized
ggcacagtggtatacaccta

SEQ ID NO: 64300 - DNA, 20 bp, Artificial Sequence
  chemically synthesized
tcagctccagtgaggcacag

SEQ ID NO: 64301 - DNA, 20 bp, Artificial Sequence
  chemically synthesized
ccttcagctccagtgaggca

SEQ ID NO: 64302 - DNA, 20 bp, Artificial Sequence
  chemically synthesized
tgtataccactgtgcctcac

SEQ ID NO: 64303 - DNA, 20 bp, Artificial Sequence
  chemically synthesized
tataccactgtgcctcactg

SEQ ID NO: 64304 - DNA, 20 bp, Artificial Sequence
  chemically synthesized
atcctccttcagctccagtg

SEQ ID NO: 64305 - DNA, 20 bp, Artificial Sequence
  chemically synthesized
tatcctccttcagctccagt

SEQ ID NO: 64306 - DNA, 20 bp, Artificial Sequence
  chemically synthesized
actgtgcctcactggagctg

SEQ ID NO: 64307 - DNA, 20 bp, Artificial Sequence
  chemically synthesized
ctgtgcctcactggagctga

SEQ ID NO: 64308 - DNA, 20 bp, Artificial Sequence
  chemically synthesized
gaaatatcctccttcagctc

SEQ ID NO: 64309 - DNA, 20 bp, Artificial Sequence
  chemically synthesized
gtgcctcactggagctgaag

SEQ ID NO: 64310 - DNA, 20 bp, Artificial Sequence
  chemically synthesized
tgcctcactggagctgaagg

SEQ ID NO: 64311 - DNA, 20 bp, Artificial Sequence
  chemically synthesized
atcagggaaatatcctcctt

SEQ ID NO: 64312 - DNA, 20 bp, Artificial Sequence
  chemically synthesized
tcccacccacgaagggatca

SEQ ID NO: 64313 - DNA, 20 bp, Artificial Sequence
  chemically synthesized
ttcccacccacgaagggatc

SEQ ID NO: 64314 - DNA, 20 bp, Artificial Sequence
  chemically synthesized
gttcccacccacgaagggat

SEQ ID NO: 64315 - DNA, 20 bp, Artificial Sequence
  chemically synthesized
atatttccctgatcccttcg

SEQ ID NO: 64316 - DNA, 20 bp, Artificial Sequence
  chemically synthesized
tatttccctgatcccttcgt

SEQ ID NO: 64317 - DNA, 20 bp, Artificial Sequence
  chemically synthesized
ctccagttcccacccacgaa

SEQ ID NO: 64318 - DNA, 20 bp, Artificial Sequence
  chemically synthesized
ttccctgatcccttcgtggg

SEQ ID NO: 64319 - DNA, 20 bp, Artificial Sequence
  chemically synthesized
cctccagttcccacccacga

SEQ ID NO: 64320 - DNA, 20 bp, Artificial Sequence
  chemically synthesized
tccctgatcccttcgtgggt

SEQ ID NO: 64321 - DNA, 20 bp, Artificial Sequence
  chemically synthesized
ccctccagttcccacccacg

SEQ ID NO: 64322 - DNA, 20 bp, Artificial Sequence
  chemically synthesized
atcccttcgtgggtgggaac

SEQ ID NO: 64323 - DNA, 20 bp, Artificial Sequence
  chemically synthesized
cccttcgtgggtgggaactg

SEQ ID NO: 64324 - DNA, 20 bp, Artificial Sequence
  chemically synthesized
ccttcgtgggtgggaactgg

SEQ ID NO: 64325 - DNA, 20 bp, Artificial Sequence
  chemically synthesized
cttcgtgggtgggaactgga

SEQ ID NO: 64326 - DNA, 20 bp, Artificial Sequence
  chemically synthesized
ttcgtgggtgggaactggag

SEQ ID NO: 64327 - DNA, 20 bp, Artificial Sequence
  chemically synthesized
cgtgggtgggaactggaggg

SEQ ID NO: 64328 - DNA, 20 bp, Artificial Sequence
  chemically synthesized
gagtggagtttgctcccctc

SEQ ID NO: 64329 - DNA, 20 bp, Artificial Sequence
  chemically synthesized
ggtggaccagcgagtgagtg

SEQ ID NO: 64330 - DNA, 20 bp, Artificial Sequence
  chemically synthesized
ggggtggaccagcgagtgag

SEQ ID NO: 64331 - DNA, 20 bp, Artificial Sequence
  chemically synthesized
agcaaactccactcactcgc

SEQ ID NO: 64332 - DNA, 20 bp, Artificial Sequence
  chemically synthesized
tgaggggtggaccagcgagt

SEQ ID NO: 64333 - DNA, 20 bp, Artificial Sequence
  chemically synthesized
tccatgaggggtggaccagc

SEQ ID NO: 64334 - DNA, 20 bp, Artificial Sequence
  chemically synthesized
cccttccatgaggggtggac

SEQ ID NO: 64335 - DNA, 20 bp, Artificial Sequence
  chemically synthesized
actcgctggtccacccctca

SEQ ID NO: 64336 - DNA, 20 bp, Artificial Sequence
  chemically synthesized
gctcccccttccatgagggg

SEQ ID NO: 64337 - DNA, 20 bp, Artificial Sequence
  chemically synthesized
cgctggtccacccctcatgg

SEQ ID NO: 64338 - DNA, 20 bp, Artificial Sequence
  chemically synthesized
tgtgctcccccttccatgag

SEQ ID NO: 64339 - DNA, 20 bp, Artificial Sequence
  chemically synthesized
gctggtccacccctcatgga

SEQ ID NO: 64340 - DNA, 20 bp, Artificial Sequence
  chemically synthesized
ctgtgctcccccttccatga

SEQ ID NO: 64341 - DNA, 20 bp, Artificial Sequence
  chemically synthesized
ctggtccacccctcatggaa

SEQ ID NO: 64342 - DNA, 20 bp, Artificial Sequence
  chemically synthesized
cctgtgctcccccttccatg

SEQ ID NO: 64343 - DNA, 20 bp, Artificial Sequence
  chemically synthesized
tggtccacccctcatggaag

SEQ ID NO: 64344 - DNA, 20 bp, Artificial Sequence
  chemically synthesized
acctgtgctcccccttccat

SEQ ID NO: 64345 - DNA, 20 bp, Artificial Sequence
  chemically synthesized
ggtccacccctcatggaagg

SEQ ID NO: 64346 - DNA, 20 bp, Artificial Sequence
  chemically synthesized
tccacccctcatggaagggg

SEQ ID NO: 64347 - DNA, 20 bp, Artificial Sequence
  chemically synthesized
ccctcatggaagggggagca

SEQ ID NO: 64348 - DNA, 20 bp, Artificial Sequence
  chemically synthesized
cctcatggaagggggagcac

SEQ ID NO: 64349 - DNA, 20 bp, Artificial Sequence
  chemically synthesized
atggaagggggagcacaggt

SEQ ID NO: 64350 - DNA, 20 bp, Artificial Sequence
  chemically synthesized
gaagggggagcacaggtgag

SEQ ID NO: 64351 - DNA, 20 bp, Artificial Sequence
  chemically synthesized
aagggggagcacaggtgagc

SEQ ID NO: 64352 - DNA, 20 bp, Artificial Sequence
  chemically synthesized
ggagcacaggtgagcaggtg

SEQ ID NO: 64353 - DNA, 20 bp, Artificial Sequence
  chemically synthesized
gcacaggtgagcaggtgcag

SEQ ID NO: 64354 - DNA, 20 bp, Artificial Sequence
  chemically synthesized
aggtgagcaggtgcagcagc

SEQ ID NO: 64355 - DNA, 20 bp, Artificial Sequence
  chemically synthesized
ggtgagcaggtgcagcagct

SEQ ID NO: 64356 - DNA, 20 bp, Artificial Sequence
  chemically synthesized
gtgagcaggtgcagcagctg

SEQ ID NO: 64357 - DNA, 20 bp, Artificial Sequence
  chemically synthesized
gcaggtgcagcagctggggc

SEQ ID NO: 64358 - DNA, 20 bp, Artificial Sequence
  chemically synthesized
gcactcaaaaatgctggccc

SEQ ID NO: 64359 - DNA, 20 bp, Artificial Sequence
  chemically synthesized
ttgccagcactcaaaaatgc

SEQ ID NO: 64360 - DNA, 20 bp, Artificial Sequence
  chemically synthesized
cagctggggccagcattttt

SEQ ID NO: 64361 - DNA, 20 bp, Artificial Sequence
  chemically synthesized
gggccagcatttttgagtgc

SEQ ID NO: 64362 - DNA, 20 bp, Artificial Sequence
  chemically synthesized
cagcatttttgagtgctggc

SEQ ID NO: 64363 - DNA, 20 bp, Artificial Sequence
  chemically synthesized
gcatttttgagtgctggcaa

SEQ ID NO: 64364 - DNA, 20 bp, Artificial Sequence
  chemically synthesized
cgtacggtgttcactcttgc

SEQ ID NO: 64365 - DNA, 20 bp, Artificial Sequence
  chemically synthesized
tggcaagagtgaacaccgta

SEQ ID NO: 64366 - DNA, 20 bp, Artificial Sequence
  chemically synthesized
ggcaagagtgaacaccgtac

SEQ ID NO: 64367 - DNA, 20 bp, Artificial Sequence
  chemically synthesized
aggctgctgcagggcccgta

SEQ ID NO: 64368 - DNA, 20 bp, Artificial Sequence
  chemically synthesized
tgaacaccgtacgggccctg

SEQ ID NO: 64369 - DNA, 20 bp, Artificial Sequence
  chemically synthesized
acaccgtacgggccctgcag

SEQ ID NO: 64370 - DNA, 20 bp, Artificial Sequence
  chemically synthesized
ctcccctagaggctgctgca

SEQ ID NO: 64371 - DNA, 20 bp, Artificial Sequence
  chemically synthesized
cctcccctagaggctgctgc

SEQ ID NO: 64372 - DNA, 20 bp, Artificial Sequence
  chemically synthesized
ccctcccctagaggctgctg

SEQ ID NO: 64373 - DNA, 20 bp, Artificial Sequence
  chemically synthesized
acgggccctgcagcagcctc

SEQ ID NO: 64374 - DNA, 20 bp, Artificial Sequence
  chemically synthesized
cgggccctgcagcagcctct

SEQ ID NO: 64375 - DNA, 20 bp, Artificial Sequence
  chemically synthesized
gggccctgcagcagcctcta

SEQ ID NO: 64376 - DNA, 20 bp, Artificial Sequence
  chemically synthesized
ggccctgcagcagcctctag

SEQ ID NO: 64377 - DNA, 20 bp, Artificial Sequence
  chemically synthesized
ccctgcagcagcctctaggg

SEQ ID NO: 64378 - DNA, 20 bp, Artificial Sequence
  chemically synthesized
cctgcagcagcctctagggg

SEQ ID NO: 64379 - DNA, 20 bp, Artificial Sequence
  chemically synthesized
tcatgggcaccctcccctag

SEQ ID NO: 64380 - DNA, 20 bp, Artificial Sequence
  chemically synthesized
ctgcagcagcctctagggga

SEQ ID NO: 64381 - DNA, 20 bp, Artificial Sequence
  chemically synthesized
ctcatgggcaccctccccta

SEQ ID NO: 64382 - DNA, 20 bp, Artificial Sequence
  chemically synthesized
tcctcatgggcaccctcccc

SEQ ID NO: 64383 - DNA, 20 bp, Artificial Sequence
  chemically synthesized
ctctaggggagggtgcccat

SEQ ID NO: 64384 - DNA, 20 bp, Artificial Sequence
  chemically synthesized
tctaggggagggtgcccatg

SEQ ID NO: 64385 - DNA, 20 bp, Artificial Sequence
  chemically synthesized
aggggagggtgcccatgagg

SEQ ID NO: 64386 - DNA, 20 bp, Artificial Sequence
  chemically synthesized
gcgctgtaacacttcctcat

SEQ ID NO: 64387 - DNA, 20 bp, Artificial Sequence
  chemically synthesized
ggcgctgtaacacttcctca

SEQ ID NO: 64388 - DNA, 20 bp, Artificial Sequence
  chemically synthesized
gtgcccatgaggaagtgtta

SEQ ID NO: 64389 - DNA, 20 bp, Artificial Sequence
  chemically synthesized
gaagtgttacagcgcccttt

SEQ ID NO: 64390 - DNA, 20 bp, Artificial Sequence
  chemically synthesized
tgtgaatggcaaagctaaaa

SEQ ID NO: 64391 - DNA, 20 bp, Artificial Sequence
  chemically synthesized
ctgtgaatggcaaagctaaa

SEQ ID NO: 64392 - DNA, 20 bp, Artificial Sequence
  chemically synthesized
tctgtgaatggcaaagctaa

SEQ ID NO: 64393 - DNA, 20 bp, Artificial Sequence
  chemically synthesized
taagccatctgtgaatggca

SEQ ID NO: 64394 - DNA, 20 bp, Artificial Sequence
  chemically synthesized
ccttttagctttgccattca

SEQ ID NO: 64395 - DNA, 20 bp, Artificial Sequence
  chemically synthesized
acacttaagccatctgtgaa

SEQ ID NO: 64396 - DNA, 20 bp, Artificial Sequence
  chemically synthesized
ttagctttgccattcacaga

SEQ ID NO: 64397 - DNA, 20 bp, Artificial Sequence
  chemically synthesized
ttgccattcacagatggctt

SEQ ID NO: 64398 - DNA, 20 bp, Artificial Sequence
  chemically synthesized
ccactgagctgttaacactt

SEQ ID NO: 64399 - DNA, 20 bp, Artificial Sequence
  chemically synthesized
acagatggcttaagtgttaa

SEQ ID NO: 64400 - DNA, 20 bp, Artificial Sequence
  chemically synthesized
tggcttaagtgttaacagct

SEQ ID NO: 64401 - DNA, 20 bp, Artificial Sequence
  chemically synthesized
cttaagtgttaacagctcag

SEQ ID NO: 64402 - DNA, 20 bp, Artificial Sequence
  chemically synthesized
taagtgttaacagctcagtg

SEQ ID NO: 64403 - DNA, 20 bp, Artificial Sequence
  chemically synthesized
aagtgttaacagctcagtgg

SEQ ID NO: 64404 - DNA, 20 bp, Artificial Sequence
  chemically synthesized
agtgttaacagctcagtgga

SEQ ID NO: 64405 - DNA, 20 bp, Artificial Sequence
  chemically synthesized
tgtcacactgaccctccact

SEQ ID NO: 64406 - DNA, 20 bp, Artificial Sequence
  chemically synthesized
ttaacagctcagtggagggt

SEQ ID NO: 64407 - DNA, 20 bp, Artificial Sequence
  chemically synthesized
tcagtggagggtcagtgtga

SEQ ID NO: 64408 - DNA, 20 bp, Artificial Sequence
  chemically synthesized
gccatgcgtgtgggtgaaaa

SEQ ID NO: 64409 - DNA, 20 bp, Artificial Sequence
  chemically synthesized
tgccatgcgtgtgggtgaaa

SEQ ID NO: 64410 - DNA, 20 bp, Artificial Sequence
  chemically synthesized
gcctttttcacccacacgca

SEQ ID NO: 64411 - DNA, 20 bp, Artificial Sequence
  chemically synthesized
aacttgggtgccatgcgtgt

SEQ ID NO: 64412 - DNA, 20 bp, Artificial Sequence
  chemically synthesized
gaacttgggtgccatgcgtg

SEQ ID NO: 64413 - DNA, 20 bp, Artificial Sequence
  chemically synthesized
cacccacacgcatggcaccc

SEQ ID NO: 64414 - DNA, 20 bp, Artificial Sequence
  chemically synthesized
tggatgctggacaagaactt

SEQ ID NO: 64415 - DNA, 20 bp, Artificial Sequence
  chemically synthesized
ctggatgctggacaagaact

SEQ ID NO: 64416 - DNA, 20 bp, Artificial Sequence
  chemically synthesized
atggcacccaagttcttgtc

SEQ ID NO: 64417 - DNA, 20 bp, Artificial Sequence
  chemically synthesized
attcctcctggatgctggac

SEQ ID NO: 64418 - DNA, 20 bp, Artificial Sequence
  chemically synthesized
ccaagttcttgtccagcatc

SEQ ID NO: 64419 - DNA, 20 bp, Artificial Sequence
  chemically synthesized
caagttcttgtccagcatcc

SEQ ID NO: 64420 - DNA, 20 bp, Artificial Sequence
  chemically synthesized
acctcattcctcctggatgc

SEQ ID NO: 64421 - DNA, 20 bp, Artificial Sequence
  chemically synthesized
agttcttgtccagcatccag

SEQ ID NO: 64422 - DNA, 20 bp, Artificial Sequence
  chemically synthesized
gttcttgtccagcatccagg

SEQ ID NO: 64423 - DNA, 20 bp, Artificial Sequence
  chemically synthesized
tcatgtgacctcattcctcc

SEQ ID NO: 64424 - DNA, 20 bp, Artificial Sequence
  chemically synthesized
gtccagcatccaggaggaat

SEQ ID NO: 64425 - DNA, 20 bp, Artificial Sequence
  chemically synthesized
tccagcatccaggaggaatg

SEQ ID NO: 64426 - DNA, 20 bp, Artificial Sequence
  chemically synthesized
gaggtcacatgaacaaattg

SEQ ID NO: 64427 - DNA, 20 bp, Artificial Sequence
  chemically synthesized
tcacatgaacaaattgaaga

SEQ ID NO: 64428 - DNA, 20 bp, Artificial Sequence
  chemically synthesized
caaattgaagatggtaaata

SEQ ID NO: 64429 - DNA, 20 bp, Artificial Sequence
  chemically synthesized
aaattgaagatggtaaatat

SEQ ID NO: 64430 - DNA, 20 bp, Artificial Sequence
  chemically synthesized
aattgaagatggtaaatatg

SEQ ID NO: 64431 - DNA, 20 bp, Artificial Sequence
  chemically synthesized
attgaagatggtaaatatgg

SEQ ID NO: 64432 - DNA, 20 bp, Artificial Sequence
  chemically synthesized
ggggattttattgccaatga

SEQ ID NO: 64433 - DNA, 20 bp, Artificial Sequence
  chemically synthesized
gattttattgccaatgaaag

SEQ ID NO: 64434 - DNA, 20 bp, Artificial Sequence
  chemically synthesized
ccactgagagccactttcat

SEQ ID NO: 64435 - DNA, 20 bp, Artificial Sequence
  chemically synthesized
ttgccaatgaaagtggctct

SEQ ID NO: 64436 - DNA, 20 bp, Artificial Sequence
  chemically synthesized
ccaatgaaagtggctctcag

SEQ ID NO: 64437 - DNA, 20 bp, Artificial Sequence
  chemically synthesized
caatgaaagtggctctcagt

SEQ ID NO: 64438 - DNA, 20 bp, Artificial Sequence
  chemically synthesized
tcagctccccttcccactga

SEQ ID NO: 64439 - DNA, 20 bp, Artificial Sequence
  chemically synthesized
tgaaagtggctctcagtggg

SEQ ID NO: 64440 - DNA, 20 bp, Artificial Sequence
  chemically synthesized
gaaagtggctctcagtggga

SEQ ID NO: 64441 - DNA, 20 bp, Artificial Sequence
  chemically synthesized
tttcagctccccttcccact

SEQ ID NO: 64442 - DNA, 20 bp, Artificial Sequence
  chemically synthesized
aaagtggctctcagtgggaa

SEQ ID NO: 64443 - DNA, 20 bp, Artificial Sequence
  chemically synthesized
aagtggctctcagtgggaag

SEQ ID NO: 64444 - DNA, 20 bp, Artificial Sequence
  chemically synthesized
gtggctctcagtgggaaggg

SEQ ID NO: 64445 - DNA, 20 bp, Artificial Sequence
  chemically synthesized
cagtgggaaggggagctgaa

SEQ ID NO: 64446 - DNA, 20 bp, Artificial Sequence
  chemically synthesized
agtgggaaggggagctgaaa

SEQ ID NO: 64447 - DNA, 20 bp, Artificial Sequence
  chemically synthesized
gtgggaaggggagctgaaaa

SEQ ID NO: 64448 - DNA, 20 bp, Artificial Sequence
  chemically synthesized
tgggaaggggagctgaaaag

SEQ ID NO: 64449 - DNA, 20 bp, Artificial Sequence
  chemically synthesized
ttcccactccatcccctttt

SEQ ID NO: 64450 - DNA, 20 bp, Artificial Sequence
  chemically synthesized
aaggggagctgaaaagggga

SEQ ID NO: 64451 - DNA, 20 bp, Artificial Sequence
  chemically synthesized
ggggagctgaaaaggggatg

SEQ ID NO: 64452 - DNA, 20 bp, Artificial Sequence
  chemically synthesized
gagctgaaaaggggatggag

SEQ ID NO: 64453 - DNA, 20 bp, Artificial Sequence
  chemically synthesized
agctgaaaaggggatggagt

SEQ ID NO: 64454 - DNA, 20 bp, Artificial Sequence
  chemically synthesized
tgaaaaggggatggagtggg

SEQ ID NO: 64455 - DNA, 20 bp, Artificial Sequence
  chemically synthesized
gaaaaggggatggagtggga

SEQ ID NO: 64456 - DNA, 20 bp, Artificial Sequence
  chemically synthesized
gtgggaaggtaatcttcccc

SEQ ID NO: 64457 - DNA, 20 bp, Artificial Sequence
  chemically synthesized
gggaaggtaatcttcccctg

SEQ ID NO: 64458 - DNA, 20 bp, Artificial Sequence
  chemically synthesized
ggatggtcagactccagggg

SEQ ID NO: 64459 - DNA, 20 bp, Artificial Sequence
  chemically synthesized
tgtggatggtcagactccag

SEQ ID NO: 64460 - DNA, 20 bp, Artificial Sequence
  chemically synthesized
ctgtggatggtcagactcca

SEQ ID NO: 64461 - DNA, 20 bp, Artificial Sequence
  chemically synthesized
gctgtggatggtcagactcc

SEQ ID NO: 64462 - DNA, 20 bp, Artificial Sequence
  chemically synthesized
agctgtggatggtcagactc

SEQ ID NO: 64463 - DNA, 20 bp, Artificial Sequence
  chemically synthesized
ggagtccagctgtggatggt

SEQ ID NO: 64464 - DNA, 20 bp, Artificial Sequence
  chemically synthesized
ccctggagtctgaccatcca

SEQ ID NO: 64465 - DNA, 20 bp, Artificial Sequence
  chemically synthesized
gagaggagtccagctgtgga

SEQ ID NO: 64466 - DNA, 20 bp, Artificial Sequence
  chemically synthesized
ggagtctgaccatccacagc

SEQ ID NO: 64467 - DNA, 20 bp, Artificial Sequence
  chemically synthesized
tttggagaggagtccagctg

SEQ ID NO: 64468 - DNA, 20 bp, Artificial Sequence
  chemically synthesized
catagctttggagaggagtc

SEQ ID NO: 64469 - DNA, 20 bp, Artificial Sequence
  chemically synthesized
cacagctggactcctctcca

SEQ ID NO: 64470 - DNA, 20 bp, Artificial Sequence
  chemically synthesized
gacagcatagctttggagag

SEQ ID NO: 64471 - DNA, 20 bp, Artificial Sequence
  chemically synthesized
ttgacagcatagctttggag

SEQ ID NO: 64472 - DNA, 20 bp, Artificial Sequence
  chemically synthesized
tttgacagcatagctttgga

SEQ ID NO: 64473 - DNA, 20 bp, Artificial Sequence
  chemically synthesized
agtttgacagcatagctttg

SEQ ID NO: 64474 - DNA, 20 bp, Artificial Sequence
  chemically synthesized
acagtttgacagcatagctt

SEQ ID NO: 64475 - DNA, 20 bp, Artificial Sequence
  chemically synthesized
agagggacagtttgacagca

SEQ ID NO: 64476 - DNA, 20 bp, Artificial Sequence
  chemically synthesized
actttagagggacagtttga

SEQ ID NO: 64477 - DNA, 20 bp, Artificial Sequence
  chemically synthesized
gcggcttgactttagaggga

SEQ ID NO: 64478 - DNA, 20 bp, Artificial Sequence
  chemically synthesized
gctgtcaaactgtccctcta

SEQ ID NO: 64479 - DNA, 20 bp, Artificial Sequence
  chemically synthesized
agaagcggcttgactttaga

SEQ ID NO: 64480 - DNA, 20 bp, Artificial Sequence
  chemically synthesized
gagaagcggcttgactttag

SEQ ID NO: 64481 - DNA, 20 bp, Artificial Sequence
  chemically synthesized
caaactgtccctctaaagtc

SEQ ID NO: 64482 - DNA, 20 bp, Artificial Sequence
  chemically synthesized
agagaagcggcttgacttta

SEQ ID NO: 64483 - DNA, 20 bp, Artificial Sequence
  chemically synthesized
aaagagaagcggcttgactt

SEQ ID NO: 64484 - DNA, 20 bp, Artificial Sequence
  chemically synthesized
agttggacatcaaagagaag

SEQ ID NO: 64485 - DNA, 20 bp, Artificial Sequence
  chemically synthesized
tacagttggacatcaaagag

SEQ ID NO: 64486 - DNA, 20 bp, Artificial Sequence
  chemically synthesized
aactacagttggacatcaaa

SEQ ID NO: 64487 - DNA, 20 bp, Artificial Sequence
  chemically synthesized
gaaactacagttggacatca

SEQ ID NO: 64488 - DNA, 20 bp, Artificial Sequence
  chemically synthesized
ttctctttgatgtccaactg

SEQ ID NO: 64489 - DNA, 20 bp, Artificial Sequence
  chemically synthesized
tggatgtcagaaactacagt

SEQ ID NO: 64490 - DNA, 20 bp, Artificial Sequence
  chemically synthesized
cagatggatgtcagaaacta

SEQ ID NO: 64491 - DNA, 20 bp, Artificial Sequence
  chemically synthesized
gaggagaagcagatggatgt

SEQ ID NO: 64492 - DNA, 20 bp, Artificial Sequence
  chemically synthesized
gcagaaggaggagaagcaga

SEQ ID NO: 64493 - DNA, 20 bp, Artificial Sequence
  chemically synthesized
gctggcagaaggaggagaag

SEQ ID NO: 64494 - DNA, 20 bp, Artificial Sequence
  chemically synthesized
tcagctggcagaaggaggag

SEQ ID NO: 64495 - DNA, 20 bp, Artificial Sequence
  chemically synthesized
agctcagctggcagaaggag

SEQ ID NO: 64496 - DNA, 20 bp, Artificial Sequence
  chemically synthesized
agagctcagctggcagaagg

SEQ ID NO: 64497 - DNA, 20 bp, Artificial Sequence
  chemically synthesized
tctgcttctcctccttctgc

SEQ ID NO: 64498 - DNA, 20 bp, Artificial Sequence
  chemically synthesized
cagagctcagctggcagaag

SEQ ID NO: 64499 - DNA, 20 bp, Artificial Sequence
  chemically synthesized
cccagagctcagctggcaga

SEQ ID NO: 64500 - DNA, 20 bp, Artificial Sequence
  chemically synthesized
ccccagagctcagctggcag

SEQ ID NO: 64501 - DNA, 20 bp, Artificial Sequence
  chemically synthesized
ttctcctccttctgccagct

SEQ ID NO: 64502 - DNA, 20 bp, Artificial Sequence
  chemically synthesized
aaaccccagagctcagctgg

SEQ ID NO: 64503 - DNA, 20 bp, Artificial Sequence
  chemically synthesized
taaaaaccccagagctcagc

SEQ ID NO: 64504 - DNA, 20 bp, Artificial Sequence
  chemically synthesized
tccttctgccagctgagctc

SEQ ID NO: 64505 - DNA, 20 bp, Artificial Sequence
  chemically synthesized
ccttctgccagctgagctct

SEQ ID NO: 64506 - DNA, 20 bp, Artificial Sequence
  chemically synthesized
cttctgccagctgagctctg

SEQ ID NO: 64507 - DNA, 20 bp, Artificial Sequence
  chemically synthesized
cctataaaaaccccagagct

SEQ ID NO: 64508 - DNA, 20 bp, Artificial Sequence
  chemically synthesized
ctgtgcctataaaaacccca

SEQ ID NO: 64509 - DNA, 20 bp, Artificial Sequence
  chemically synthesized
acctgtgcctataaaaaccc

SEQ ID NO: 64510 - DNA, 20 bp, Artificial Sequence
  chemically synthesized
gctgagctctggggttttta

SEQ ID NO: 64511 - DNA, 20 bp, Artificial Sequence
  chemically synthesized
ctgagctctggggtttttat

SEQ ID NO: 64512 - DNA, 20 bp, Artificial Sequence
  chemically synthesized
ctctggggtttttataggca

SEQ ID NO: 64513 - DNA, 20 bp, Artificial Sequence
  chemically synthesized
tctggggtttttataggcac

SEQ ID NO: 64514 - DNA, 20 bp, Artificial Sequence
  chemically synthesized
gggtttttataggcacaggt

SEQ ID NO: 64515 - DNA, 20 bp, Artificial Sequence
  chemically synthesized
ggtttttataggcacaggtt

SEQ ID NO: 64516 - DNA, 20 bp, Artificial Sequence
  chemically synthesized
gtttttataggcacaggttg

SEQ ID NO: 64517 - DNA, 20 bp, Artificial Sequence
  chemically synthesized
tttttataggcacaggttgg

SEQ ID NO: 64518 - DNA, 20 bp, Artificial Sequence
  chemically synthesized
ttttataggcacaggttggg

SEQ ID NO: 64519 - DNA, 20 bp, Artificial Sequence
  chemically synthesized
tataggcacaggttgggggg

SEQ ID NO: 64520 - DNA, 20 bp, Artificial Sequence
  chemically synthesized
ataggcacaggttggggggt

SEQ ID NO: 64521 - DNA, 20 bp, Artificial Sequence
  chemically synthesized
ggcacaggttggggggtggg

SEQ ID NO: 64522 - DNA, 20 bp, Artificial Sequence
  chemically synthesized
gcacaggttggggggtgggt

SEQ ID NO: 64523 - DNA, 20 bp, Artificial Sequence
  chemically synthesized
cacaggttggggggtgggtg

SEQ ID NO: 64524 - DNA, 20 bp, Artificial Sequence
  chemically synthesized
acaggttggggggtgggtgg

SEQ ID NO: 64525 - DNA, 20 bp, Artificial Sequence
  chemically synthesized
caggttggggggtgggtggg

SEQ ID NO: 64526 - DNA, 20 bp, Artificial Sequence
  chemically synthesized
ggggggtgggtggggggtaa

SEQ ID NO: 64527 - DNA, 20 bp, Artificial Sequence
  chemically synthesized
ggtgggtggggggtaatgga

SEQ ID NO: 64528 - DNA, 20 bp, Artificial Sequence
  chemically synthesized
tggggggtaatggatggttt

SEQ ID NO: 64529 - DNA, 20 bp, Artificial Sequence
  chemically synthesized
ggtaatggatggttttggaa

SEQ ID NO: 64530 - DNA, 20 bp, Artificial Sequence
  chemically synthesized
gtaatggatggttttggaaa

SEQ ID NO: 64531 - DNA, 20 bp, Artificial Sequence
  chemically synthesized
ttttggaaaaggcacccttc

SEQ ID NO: 64532 - DNA, 20 bp, Artificial Sequence
  chemically synthesized
ttggaaaaggcacccttcaa

SEQ ID NO: 64533 - DNA, 20 bp, Artificial Sequence
  chemically synthesized
tggaaaaggcacccttcaag

SEQ ID NO: 64534 - DNA, 20 bp, Artificial Sequence
  chemically synthesized
ggaaaaggcacccttcaaga

SEQ ID NO: 64535 - DNA, 20 bp, Artificial Sequence
  chemically synthesized
tccctgttttccctcttgaa

SEQ ID NO: 64536 - DNA, 20 bp, Artificial Sequence
  chemically synthesized
atccctgttttccctcttga

SEQ ID NO: 64537 - DNA, 20 bp, Artificial Sequence
  chemically synthesized
catccctgttttccctcttg

SEQ ID NO: 64538 - DNA, 20 bp, Artificial Sequence
  chemically synthesized
gcacccttcaagagggaaaa

SEQ ID NO: 64539 - DNA, 20 bp, Artificial Sequence
  chemically synthesized
cacccttcaagagggaaaac

SEQ ID NO: 64540 - DNA, 20 bp, Artificial Sequence
  chemically synthesized
acccttcaagagggaaaaca

SEQ ID NO: 64541 - DNA, 20 bp, Artificial Sequence
  chemically synthesized
aagagggaaaacagggatgt

SEQ ID NO: 64542 - DNA, 20 bp, Artificial Sequence
  chemically synthesized
agggatgtaagttctcactt

SEQ ID NO: 64543 - DNA, 20 bp, Artificial Sequence
  chemically synthesized
gggatgtaagttctcacttt

SEQ ID NO: 64544 - DNA, 20 bp, Artificial Sequence
  chemically synthesized
ctggaaccatggcccaaagt

SEQ ID NO: 64545 - DNA, 20 bp, Artificial Sequence
  chemically synthesized
taagttctcactttgggcca

SEQ ID NO: 64546 - DNA, 20 bp, Artificial Sequence
  chemically synthesized
aagcctggaaccatggccca

SEQ ID NO: 64547 - DNA, 20 bp, Artificial Sequence
  chemically synthesized
ctcactttgggccatggttc

SEQ ID NO: 64548 - DNA, 20 bp, Artificial Sequence
  chemically synthesized
tcactttgggccatggttcc

SEQ ID NO: 64549 - DNA, 20 bp, Artificial Sequence
  chemically synthesized
agccaaaaagcctggaacca

SEQ ID NO: 64550 - DNA, 20 bp, Artificial Sequence
  chemically synthesized
ggccatggttccaggctttt

SEQ ID NO: 64551 - DNA, 20 bp, Artificial Sequence
  chemically synthesized
caccctcaagccaaaaagcc

SEQ ID NO: 64552 - DNA, 20 bp, Artificial Sequence
  chemically synthesized
ggacccaccctcaagccaaa

SEQ ID NO: 64553 - DNA, 20 bp, Artificial Sequence
  chemically synthesized
ggttccaggctttttggctt

SEQ ID NO: 64554 - DNA, 20 bp, Artificial Sequence
  chemically synthesized
gttccaggctttttggcttg

SEQ ID NO: 64555 - DNA, 20 bp, Artificial Sequence
  chemically synthesized
ttccaggctttttggcttga

SEQ ID NO: 64556 - DNA, 20 bp, Artificial Sequence
  chemically synthesized
caggctttttggcttgaggg

SEQ ID NO: 64557 - DNA, 20 bp, Artificial Sequence
  chemically synthesized
aggctttttggcttgagggt

SEQ ID NO: 64558 - DNA, 20 bp, Artificial Sequence
  chemically synthesized
cccattgaggacccaccctc

SEQ ID NO: 64559 - DNA, 20 bp, Artificial Sequence
  chemically synthesized
gcttgagggtgggtcctcaa

SEQ ID NO: 64560 - DNA, 20 bp, Artificial Sequence
  chemically synthesized
cttgagggtgggtcctcaat

SEQ ID NO: 64561 - DNA, 20 bp, Artificial Sequence
  chemically synthesized
ttgagggtgggtcctcaatg

SEQ ID NO: 64562 - DNA, 20 bp, Artificial Sequence
  chemically synthesized
aagagggcaggtccccattg

SEQ ID NO: 64563 - DNA, 20 bp, Artificial Sequence
  chemically synthesized
gaagagggcaggtccccatt

SEQ ID NO: 64564 - DNA, 20 bp, Artificial Sequence
  chemically synthesized
aattctgggcagaagagggc

SEQ ID NO: 64565 - DNA, 20 bp, Artificial Sequence
  chemically synthesized
aaattctgggcagaagaggg

SEQ ID NO: 64566 - DNA, 20 bp, Artificial Sequence
  chemically synthesized
gggaaattctgggcagaaga

SEQ ID NO: 64567 - DNA, 20 bp, Artificial Sequence
  chemically synthesized
agggaaattctgggcagaag

SEQ ID NO: 64568 - DNA, 20 bp, Artificial Sequence
  chemically synthesized
gggacctgccctcttctgcc

SEQ ID NO: 64569 - DNA, 20 bp, Artificial Sequence
  chemically synthesized
cagggaaattctgggcagaa

SEQ ID NO: 64570 - DNA, 20 bp, Artificial Sequence
  chemically synthesized
ggcagggaaattctgggcag

SEQ ID NO: 64571 - DNA, 20 bp, Artificial Sequence
  chemically synthesized
gaaggcagggaaattctggg

SEQ ID NO: 64572 - DNA, 20 bp, Artificial Sequence
  chemically synthesized
acagaaggcagggaaattct

SEQ ID NO: 64573 - DNA, 20 bp, Artificial Sequence
  chemically synthesized
gacagaaggcagggaaattc

SEQ ID NO: 64574 - DNA, 20 bp, Artificial Sequence
  chemically synthesized
ttgataaaggacagaaggca

SEQ ID NO: 64575 - DNA, 20 bp, Artificial Sequence
  chemically synthesized
tttgataaaggacagaaggc

SEQ ID NO: 64576 - DNA, 20 bp, Artificial Sequence
  chemically synthesized
ctttgataaaggacagaagg

SEQ ID NO: 64577 - DNA, 20 bp, Artificial Sequence
  chemically synthesized
tggctttgataaaggacaga

SEQ ID NO: 64578 - DNA, 20 bp, Artificial Sequence
  chemically synthesized
gtggctttgataaaggacag

SEQ ID NO: 64579 - DNA, 20 bp, Artificial Sequence
  chemically synthesized
gatgtggctttgataaagga

SEQ ID NO: 64580 - DNA, 20 bp, Artificial Sequence
  chemically synthesized
ctgccttctgtcctttatca

SEQ ID NO: 64581 - DNA, 20 bp, Artificial Sequence
  chemically synthesized
tcaagatgtggctttgataa

SEQ ID NO: 64582 - DNA, 20 bp, Artificial Sequence
  chemically synthesized
gtcaagatgtggctttgata

SEQ ID NO: 64583 - DNA, 20 bp, Artificial Sequence
  chemically synthesized
atccatagcctgtcaagatg

SEQ ID NO: 64584 - DNA, 20 bp, Artificial Sequence
  chemically synthesized
ttatcaaagccacatcttga

SEQ ID NO: 64585 - DNA, 20 bp, Artificial Sequence
  chemically synthesized
tatcaaagccacatcttgac

SEQ ID NO: 64586 - DNA, 20 bp, Artificial Sequence
  chemically synthesized
gtcagtatccatagcctgtc

SEQ ID NO: 64587 - DNA, 20 bp, Artificial Sequence
  chemically synthesized
agccacatcttgacaggcta

SEQ ID NO: 64588 - DNA, 20 bp, Artificial Sequence
  chemically synthesized
tccctccaggtcagtatcca

SEQ ID NO: 64589 - DNA, 20 bp, Artificial Sequence
  chemically synthesized
acaggctatggatactgacc

SEQ ID NO: 64590 - DNA, 20 bp, Artificial Sequence
  chemically synthesized
aggctatggatactgacctg

SEQ ID NO: 64591 - DNA, 20 bp, Artificial Sequence
  chemically synthesized
ggctatggatactgacctgg

SEQ ID NO: 64592 - DNA, 20 bp, Artificial Sequence
  chemically synthesized
gctatggatactgacctgga

SEQ ID NO: 64593 - DNA, 20 bp, Artificial Sequence
  chemically synthesized
agctttctctccctccaggt

SEQ ID NO: 64594 - DNA, 20 bp, Artificial Sequence
  chemically synthesized
tatggatactgacctggagg

SEQ ID NO: 64595 - DNA, 20 bp, Artificial Sequence
  chemically synthesized
tggatactgacctggaggga

SEQ ID NO: 64596 - DNA, 20 bp, Artificial Sequence
  chemically synthesized
ctacagctttctctccctcc

SEQ ID NO: 64597 - DNA, 20 bp, Artificial Sequence
  chemically synthesized
gctacagctttctctccctc

SEQ ID NO: 64598 - DNA, 20 bp, Artificial Sequence
  chemically synthesized
tactgacctggagggagaga

SEQ ID NO: 64599 - DNA, 20 bp, Artificial Sequence
  chemically synthesized
cctggagggagagaaagctg

SEQ ID NO: 64600 - DNA, 20 bp, Artificial Sequence
  chemically synthesized
gggagagaaagctgtagcta

SEQ ID NO: 64601 - DNA, 20 bp, Artificial Sequence
  chemically synthesized
aaaaaaatcttctatagcta

SEQ ID NO: 64602 - DNA, 20 bp, Artificial Sequence
  chemically synthesized
agagaaagctgtagctatag

SEQ ID NO: 64603 - DNA, 20 bp, Artificial Sequence
  chemically synthesized
tatattaaaaaaatcttcta

SEQ ID NO: 64604 - DNA, 20 bp, Artificial Sequence
  chemically synthesized
agaagatttttttaatataa

SEQ ID NO: 64605 - DNA, 20 bp, Artificial Sequence
  chemically synthesized
gaagatttttttaatataat

SEQ ID NO: 64606 - DNA, 20 bp, Artificial Sequence
  chemically synthesized
aagatttttttaatataatg

SEQ ID NO: 64607 - DNA, 20 bp, Artificial Sequence
  chemically synthesized
tttttaatataatggggtac

SEQ ID NO: 64608 - DNA, 20 bp, Artificial Sequence
  chemically synthesized
ttttaatataatggggtact

SEQ ID NO: 64609 - DNA, 20 bp, Artificial Sequence
  chemically synthesized
atataatggggtactaggat

SEQ ID NO: 64610 - DNA, 20 bp, Artificial Sequence
  chemically synthesized
ctaaacaacagatctaatcc

SEQ ID NO: 64611 - DNA, 20 bp, Artificial Sequence
  chemically synthesized
ctaggattagatctgttgtt

SEQ ID NO: 64612 - DNA, 20 bp, Artificial Sequence
  chemically synthesized
ctagttatcttgctaaacaa

SEQ ID NO: 64613 - DNA, 20 bp, Artificial Sequence
  chemically synthesized
gattagatctgttgtttagc

SEQ ID NO: 64614 - DNA, 20 bp, Artificial Sequence
  chemically synthesized
ctgttgtttagcaagataac

SEQ ID NO: 64615 - DNA, 20 bp, Artificial Sequence
  chemically synthesized
tttagcaagataactagcca

SEQ ID NO: 64616 - DNA, 20 bp, Artificial Sequence
  chemically synthesized
tccatctttatcactatggc

SEQ ID NO: 64617 - DNA, 20 bp, Artificial Sequence
  chemically synthesized
tttatccatctttatcacta

SEQ ID NO: 64618 - DNA, 20 bp, Artificial Sequence
  chemically synthesized
gataactagccatagtgata

SEQ ID NO: 64619 - DNA, 20 bp, Artificial Sequence
  chemically synthesized
actagccatagtgataaaga

SEQ ID NO: 64620 - DNA, 20 bp, Artificial Sequence
  chemically synthesized
atagtgataaagatggataa

SEQ ID NO: 64621 - DNA, 20 bp, Artificial Sequence
  chemically synthesized
gataaagatggataaaagtc

SEQ ID NO: 64622 - DNA, 20 bp, Artificial Sequence
  chemically synthesized
ataaagatggataaaagtct

SEQ ID NO: 64623 - DNA, 20 bp, Artificial Sequence
  chemically synthesized
taaagatggataaaagtctg

SEQ ID NO: 64624 - DNA, 20 bp, Artificial Sequence
  chemically synthesized
gatggataaaagtctgggga

SEQ ID NO: 64625 - DNA, 20 bp, Artificial Sequence
  chemically synthesized
atggataaaagtctggggac

SEQ ID NO: 64626 - DNA, 20 bp, Artificial Sequence
  chemically synthesized
tggataaaagtctggggaca

SEQ ID NO: 64627 - DNA, 20 bp, Artificial Sequence
  chemically synthesized
atgattagcctccctgtccc

SEQ ID NO: 64628 - DNA, 20 bp, Artificial Sequence
  chemically synthesized
gataaaagtctggggacagg

SEQ ID NO: 64629 - DNA, 20 bp, Artificial Sequence
  chemically synthesized
ataaaagtctggggacaggg

SEQ ID NO: 64630 - DNA, 20 bp, Artificial Sequence
  chemically synthesized
gggacagggaggctaatcat

SEQ ID NO: 64631 - DNA, 20 bp, Artificial Sequence
  chemically synthesized
tgatttggccttctaatgat

SEQ ID NO: 64632 - DNA, 20 bp, Artificial Sequence
  chemically synthesized
acagggaggctaatcattag

SEQ ID NO: 64633 - DNA, 20 bp, Artificial Sequence
  chemically synthesized
cagggaggctaatcattaga

SEQ ID NO: 64634 - DNA, 20 bp, Artificial Sequence
  chemically synthesized
ctcagtgactattaatgatt

SEQ ID NO: 64635 - DNA, 20 bp, Artificial Sequence
  chemically synthesized
ttagaaggccaaatcattaa

SEQ ID NO: 64636 - DNA, 20 bp, Artificial Sequence
  chemically synthesized
ccaaatcattaatagtcact

SEQ ID NO: 64637 - DNA, 20 bp, Artificial Sequence
  chemically synthesized
atcattaatagtcactgaga

SEQ ID NO: 64638 - DNA, 20 bp, Artificial Sequence
  chemically synthesized
tcattaatagtcactgagaa

SEQ ID NO: 64639 - DNA, 20 bp, Artificial Sequence
  chemically synthesized
cccttccctcagtcctttct

SEQ ID NO: 64640 - DNA, 20 bp, Artificial Sequence
  chemically synthesized
atagtcactgagaaaggact

SEQ ID NO: 64641 - DNA, 20 bp, Artificial Sequence
  chemically synthesized
tagtcactgagaaaggactg

SEQ ID NO: 64642 - DNA, 20 bp, Artificial Sequence
  chemically synthesized
agtcactgagaaaggactga

SEQ ID NO: 64643 - DNA, 20 bp, Artificial Sequence
  chemically synthesized
cactgagaaaggactgaggg

SEQ ID NO: 64644 - DNA, 20 bp, Artificial Sequence
  chemically synthesized
actgagaaaggactgaggga

SEQ ID NO: 64645 - DNA, 20 bp, Artificial Sequence
  chemically synthesized
ctgagaaaggactgagggaa

SEQ ID NO: 64646 - DNA, 20 bp, Artificial Sequence
  chemically synthesized
taactactctgcccttccct

SEQ ID NO: 64647 - DNA, 20 bp, Artificial Sequence
  chemically synthesized
agaaaggactgagggaaggg

SEQ ID NO: 64648 - DNA, 20 bp, Artificial Sequence
  chemically synthesized
aaaggactgagggaagggca

SEQ ID NO: 64649 - DNA, 20 bp, Artificial Sequence
  chemically synthesized
ggactgagggaagggcagag

SEQ ID NO: 64650 - DNA, 20 bp, Artificial Sequence
  chemically synthesized
tgagggaagggcagagtagt

SEQ ID NO: 64651 - DNA, 20 bp, Artificial Sequence
  chemically synthesized
agggaagggcagagtagtta

SEQ ID NO: 64652 - DNA, 20 bp, Artificial Sequence
  chemically synthesized
ggaagggcagagtagttaga

SEQ ID NO: 64653 - DNA, 20 bp, Artificial Sequence
  chemically synthesized
gaagggcagagtagttagag

SEQ ID NO: 64654 - DNA, 20 bp, Artificial Sequence
  chemically synthesized
gcagagtagttagagaggaa

SEQ ID NO: 64655 - DNA, 20 bp, Artificial Sequence
  chemically synthesized
agtagttagagaggaatagc

SEQ ID NO: 64656 - DNA, 20 bp, Artificial Sequence
  chemically synthesized
agagaggaatagctggattt

SEQ ID NO: 64657 - DNA, 20 bp, Artificial Sequence
  chemically synthesized
aaaataaaaacactcaaatc

SEQ ID NO: 64658 - DNA, 20 bp, Artificial Sequence
  chemically synthesized
gatttgagtgtttttatttt

SEQ ID NO: 64659 - DNA, 20 bp, Artificial Sequence
  chemically synthesized
gtgtttttatttttagatat

SEQ ID NO: 64660 - DNA, 20 bp, Artificial Sequence
  chemically synthesized
gtttttatttttagatataa

SEQ ID NO: 64661 - DNA, 20 bp, Artificial Sequence
  chemically synthesized
ttatttttagatataagagt

SEQ ID NO: 64662 - DNA, 20 bp, Artificial Sequence
  chemically synthesized
tagatataagagtcagcaaa

SEQ ID NO: 64663 - DNA, 20 bp, Artificial Sequence
  chemically synthesized
aagagtcagcaaacagaatt

SEQ ID NO: 64664 - DNA, 20 bp, Artificial Sequence
  chemically synthesized
tattatcttcagtttttatt

SEQ ID NO: 64665 - DNA, 20 bp, Artificial Sequence
  chemically synthesized
tagtgaccaaataaaaactg

SEQ ID NO: 64666 - DNA, 20 bp, Artificial Sequence
  chemically synthesized
caaataaaaactgaagataa

SEQ ID NO: 64667 - DNA, 20 bp, Artificial Sequence
  chemically synthesized
ttcttcctctctattatctt

SEQ ID NO: 64668 - DNA, 20 bp, Artificial Sequence
  chemically synthesized
aataaaaactgaagataata

SEQ ID NO: 64669 - DNA, 20 bp, Artificial Sequence
  chemically synthesized
taaaaactgaagataataga

SEQ ID NO: 64670 - DNA, 20 bp, Artificial Sequence
  chemically synthesized
aaaaactgaagataatagag

SEQ ID NO: 64671 - DNA, 20 bp, Artificial Sequence
  chemically synthesized
aactgaagataatagagagg

SEQ ID NO: 64672 - DNA, 20 bp, Artificial Sequence
  chemically synthesized
tgaagataatagagaggaag

SEQ ID NO: 64673 - DNA, 20 bp, Artificial Sequence
  chemically synthesized
tagagaggaagaagtaaatg

SEQ ID NO: 64674 - DNA, 20 bp, Artificial Sequence
  chemically synthesized
attgcaatttagaaaatttg

SEQ ID NO: 64675 - DNA, 20 bp, Artificial Sequence
  chemically synthesized
cattgcaatttagaaaattt

SEQ ID NO: 64676 - DNA, 20 bp, Artificial Sequence
  chemically synthesized
tcattgcaatttagaaaatt

SEQ ID NO: 64677 - DNA, 20 bp, Artificial Sequence
  chemically synthesized
ttaatgatgtcattgcaatt

SEQ ID NO: 64678 - DNA, 20 bp, Artificial Sequence
  chemically synthesized
ttgcaatgacatcattaata

SEQ ID NO: 64679 - DNA, 20 bp, Artificial Sequence
  chemically synthesized
aatgacatcattaataaaga

SEQ ID NO: 64680 - DNA, 20 bp, Artificial Sequence
  chemically synthesized
ttaataaagaaagtaaatgc

SEQ ID NO: 64681 - DNA, 20 bp, Artificial Sequence
  chemically synthesized
taataaagaaagtaaatgca

SEQ ID NO: 64682 - DNA, 20 bp, Artificial Sequence
  chemically synthesized
agtaaatgcaaggtgcaaaa

SEQ ID NO: 64683 - DNA, 20 bp, Artificial Sequence
  chemically synthesized
gtaaatgcaaggtgcaaaac

SEQ ID NO: 64684 - DNA, 20 bp, Artificial Sequence
  chemically synthesized
aaacaggtttgattgtgata

SEQ ID NO: 64685 - DNA, 20 bp, Artificial Sequence
  chemically synthesized
tttgattgtgatatggtatg

SEQ ID NO: 64686 - DNA, 20 bp, Artificial Sequence
  chemically synthesized
ttgattgtgatatggtatgt

SEQ ID NO: 64687 - DNA, 20 bp, Artificial Sequence
  chemically synthesized
ggaaacacaatcatttccat

SEQ ID NO: 64688 - DNA, 20 bp, Artificial Sequence
  chemically synthesized
acacaatcatttccattggt

SEQ ID NO: 64689 - DNA, 20 bp, Artificial Sequence
  chemically synthesized
cacaatcatttccattggtt

SEQ ID NO: 64690 - DNA, 20 bp, Artificial Sequence
  chemically synthesized
tccagatatggcccaaccaa

SEQ ID NO: 64691 - DNA, 20 bp, Artificial Sequence
  chemically synthesized
tccattggttgggccatatc

SEQ ID NO: 64692 - DNA, 20 bp, Artificial Sequence
  chemically synthesized
tgatgataatattccagata

SEQ ID NO: 64693 - DNA, 20 bp, Artificial Sequence
  chemically synthesized
cagaactgatgataatattc

SEQ ID NO: 64694 - DNA, 20 bp, Artificial Sequence
  chemically synthesized
catatctggaatattatcat

SEQ ID NO: 64695 - DNA, 20 bp, Artificial Sequence
  chemically synthesized
tggaatattatcatcagttc

SEQ ID NO: 64696 - DNA, 20 bp, Artificial Sequence
  chemically synthesized
atattatcatcagttctgga

SEQ ID NO: 64697 - DNA, 20 bp, Artificial Sequence
  chemically synthesized
cactttcaatataagctatc

SEQ ID NO: 64698 - DNA, 20 bp, Artificial Sequence
  chemically synthesized
ttctggatagcttatattga

SEQ ID NO: 64699 - DNA, 20 bp, Artificial Sequence
  chemically synthesized
tcctttcacactttcaatat

SEQ ID NO: 64700 - DNA, 20 bp, Artificial Sequence
  chemically synthesized
agcttatattgaaagtgtga

SEQ ID NO: 64701 - DNA, 20 bp, Artificial Sequence
  chemically synthesized
gcttatattgaaagtgtgaa

SEQ ID NO: 64702 - DNA, 20 bp, Artificial Sequence
  chemically synthesized
tgtgaaaggaaaataaatct

SEQ ID NO: 64703 - DNA, 20 bp, Artificial Sequence
  chemically synthesized
gtgaaaggaaaataaatctt

SEQ ID NO: 64704 - DNA, 20 bp, Artificial Sequence
  chemically synthesized
tgaaaggaaaataaatcttg

SEQ ID NO: 64705 - DNA, 20 bp, Artificial Sequence
  chemically synthesized
tttggtgattttgaggcccc

SEQ ID NO: 64706 - DNA, 20 bp, Artificial Sequence
  chemically synthesized
cctttagtttggtgattttg

SEQ ID NO: 64707 - DNA, 20 bp, Artificial Sequence
  chemically synthesized
ccctttagtttggtgatttt

SEQ ID NO: 64708 - DNA, 20 bp, Artificial Sequence
  chemically synthesized
gcctcaaaatcaccaaacta

SEQ ID NO: 64709 - DNA, 20 bp, Artificial Sequence
  chemically synthesized
cctcaaaatcaccaaactaa

SEQ ID NO: 64710 - DNA, 20 bp, Artificial Sequence
  chemically synthesized
ctcaaaatcaccaaactaaa

SEQ ID NO: 64711 - DNA, 20 bp, Artificial Sequence
  chemically synthesized
cttgacttttccctttagtt

SEQ ID NO: 64712 - DNA, 20 bp, Artificial Sequence
  chemically synthesized
aatcaccaaactaaagggaa

SEQ ID NO: 64713 - DNA, 20 bp, Artificial Sequence
  chemically synthesized
cccagcttgacttttccctt

SEQ ID NO: 64714 - DNA, 20 bp, Artificial Sequence
  chemically synthesized
ccaaactaaagggaaaagtc

SEQ ID NO: 64715 - DNA, 20 bp, Artificial Sequence
  chemically synthesized
actaaagggaaaagtcaagc

SEQ ID NO: 64716 - DNA, 20 bp, Artificial Sequence
  chemically synthesized
ctaaagggaaaagtcaagct

SEQ ID NO: 64717 - DNA, 20 bp, Artificial Sequence
  chemically synthesized
ggtttgccctaagcagttcc

SEQ ID NO: 64718 - DNA, 20 bp, Artificial Sequence
  chemically synthesized
aagtcaagctgggaactgct

SEQ ID NO: 64719 - DNA, 20 bp, Artificial Sequence
  chemically synthesized
agtcaagctgggaactgctt

SEQ ID NO: 64720 - DNA, 20 bp, Artificial Sequence
  chemically synthesized
gtcaagctgggaactgctta

SEQ ID NO: 64721 - DNA, 20 bp, Artificial Sequence
  chemically synthesized
ggagacaggtttgccctaag

SEQ ID NO: 64722 - DNA, 20 bp, Artificial Sequence
  chemically synthesized
atgggagacaggtttgccct

SEQ ID NO: 64723 - DNA, 20 bp, Artificial Sequence
  chemically synthesized
ctttgaatagaatgggagac

SEQ ID NO: 64724 - DNA, 20 bp, Artificial Sequence
  chemically synthesized
actttgaatagaatgggaga

SEQ ID NO: 64725 - DNA, 20 bp, Artificial Sequence
  chemically synthesized
gatgactttgaatagaatgg

SEQ ID NO: 64726 - DNA, 20 bp, Artificial Sequence
  chemically synthesized
gggatgactttgaatagaat

SEQ ID NO: 64727 - DNA, 20 bp, Artificial Sequence
  chemically synthesized
agggatgactttgaatagaa

SEQ ID NO: 64728 - DNA, 20 bp, Artificial Sequence
  chemically synthesized
cctgtctcccattctattca

SEQ ID NO: 64729 - DNA, 20 bp, Artificial Sequence
  chemically synthesized
agcagagggatgactttgaa

SEQ ID NO: 64730 - DNA, 20 bp, Artificial Sequence
  chemically synthesized
catctatctcagtgagcaga

SEQ ID NO: 64731 - DNA, 20 bp, Artificial Sequence
  chemically synthesized
gcatctatctcagtgagcag

SEQ ID NO: 64732 - DNA, 20 bp, Artificial Sequence
  chemically synthesized
agcatctatctcagtgagca

SEQ ID NO: 64733 - DNA, 20 bp, Artificial Sequence
  chemically synthesized
aagtcatccctctgctcact

SEQ ID NO: 64734 - DNA, 20 bp, Artificial Sequence
  chemically synthesized
taagcatctatctcagtgag

SEQ ID NO: 64735 - DNA, 20 bp, Artificial Sequence
  chemically synthesized
catccctctgctcactgaga

SEQ ID NO: 64736 - DNA, 20 bp, Artificial Sequence
  chemically synthesized
agataagcatctatctcagt

SEQ ID NO: 64737 - DNA, 20 bp, Artificial Sequence
  chemically synthesized
aatcagataagcatctatct

SEQ ID NO: 64738 - DNA, 20 bp, Artificial Sequence
  chemically synthesized
tccaaaggaggcaatcagat

SEQ ID NO: 64739 - DNA, 20 bp, Artificial Sequence
  chemically synthesized
gcctttccaaaggaggcaat

SEQ ID NO: 64740 - DNA, 20 bp, Artificial Sequence
  chemically synthesized
gcttatctgattgcctcctt

SEQ ID NO: 64741 - DNA, 20 bp, Artificial Sequence
  chemically synthesized
ctgattcgcctttccaaagg

SEQ ID NO: 64742 - DNA, 20 bp, Artificial Sequence
  chemically synthesized
atctgattgcctcctttgga

SEQ ID NO: 64743 - DNA, 20 bp, Artificial Sequence
  chemically synthesized
tctgattcgcctttccaaag

SEQ ID NO: 64744 - DNA, 20 bp, Artificial Sequence
  chemically synthesized
tctgattgcctcctttggaa

SEQ ID NO: 64745 - DNA, 20 bp, Artificial Sequence
  chemically synthesized
tatctgattcgcctttccaa

SEQ ID NO: 64746 - DNA, 20 bp, Artificial Sequence
  chemically synthesized
gtatctgattcgcctttcca

SEQ ID NO: 64747 - DNA, 20 bp, Artificial Sequence
  chemically synthesized
cctcctttggaaaggcgaat

SEQ ID NO: 64748 - DNA, 20 bp, Artificial Sequence
  chemically synthesized
aaggcgaatcagatactcaa

SEQ ID NO: 64749 - DNA, 20 bp, Artificial Sequence
  chemically synthesized
ataaatggttgcattctttt

SEQ ID NO: 64750 - DNA, 20 bp, Artificial Sequence
  chemically synthesized
acaggtaggtgagagataaa

SEQ ID NO: 64751 - DNA, 20 bp, Artificial Sequence
  chemically synthesized
tccaggtcacaggtaggtga

SEQ ID NO: 64752 - DNA, 20 bp, Artificial Sequence
  chemically synthesized
cttccaggtcacaggtaggt

SEQ ID NO: 64753 - DNA, 20 bp, Artificial Sequence
  chemically synthesized
ggggcttccaggtcacaggt

SEQ ID NO: 64754 - DNA, 20 bp, Artificial Sequence
  chemically synthesized
aggggcttccaggtcacagg

SEQ ID NO: 64755 - DNA, 20 bp, Artificial Sequence
  chemically synthesized
tctctcacctacctgtgacc

SEQ ID NO: 64756 - DNA, 20 bp, Artificial Sequence
  chemically synthesized
aggaggggcttccaggtcac

SEQ ID NO: 64757 - DNA, 20 bp, Artificial Sequence
  chemically synthesized
aaggaggggcttccaggtca

SEQ ID NO: 64758 - DNA, 20 bp, Artificial Sequence
  chemically synthesized
ctcacctacctgtgacctgg

SEQ ID NO: 64759 - DNA, 20 bp, Artificial Sequence
  chemically synthesized
tgaagcaaggaggggcttcc

SEQ ID NO: 64760 - DNA, 20 bp, Artificial Sequence
  chemically synthesized
ttgaagcaaggaggggcttc

SEQ ID NO: 64761 - DNA, 20 bp, Artificial Sequence
  chemically synthesized
ggacaacttgaagcaaggag

SEQ ID NO: 64762 - DNA, 20 bp, Artificial Sequence
  chemically synthesized
gggacaacttgaagcaagga

SEQ ID NO: 64763 - DNA, 20 bp, Artificial Sequence
  chemically synthesized
tgggacaacttgaagcaagg

SEQ ID NO: 64764 - DNA, 20 bp, Artificial Sequence
  chemically synthesized
gtgggacaacttgaagcaag

SEQ ID NO: 64765 - DNA, 20 bp, Artificial Sequence
  chemically synthesized
tggaagcccctccttgcttc

SEQ ID NO: 64766 - DNA, 20 bp, Artificial Sequence
  chemically synthesized
gggtgggacaacttgaagca

SEQ ID NO: 64767 - DNA, 20 bp, Artificial Sequence
  chemically synthesized
agggtgggacaacttgaagc

SEQ ID NO: 64768 - DNA, 20 bp, Artificial Sequence
  chemically synthesized
cagaagggtgggacaacttg

SEQ ID NO: 64769 - DNA, 20 bp, Artificial Sequence
  chemically synthesized
ttcaagttgtcccacccttc

SEQ ID NO: 64770 - DNA, 20 bp, Artificial Sequence
  chemically synthesized
tttgttccatccagaagggt

SEQ ID NO: 64771 - DNA, 20 bp, Artificial Sequence
  chemically synthesized
atttgttccatccagaaggg

SEQ ID NO: 64772 - DNA, 20 bp, Artificial Sequence
  chemically synthesized
agttgtcccacccttctgga

SEQ ID NO: 64773 - DNA, 20 bp, Artificial Sequence
  chemically synthesized
tacatttgttccatccagaa

SEQ ID NO: 64774 - DNA, 20 bp, Artificial Sequence
  chemically synthesized
gtacatttgttccatccaga

SEQ ID NO: 64775 - DNA, 20 bp, Artificial Sequence
  chemically synthesized
tgtacatttgttccatccag

SEQ ID NO: 64776 - DNA, 20 bp, Artificial Sequence
  chemically synthesized
agatgtacatttgttccatc

SEQ ID NO: 64777 - DNA, 20 bp, Artificial Sequence
  chemically synthesized
agacatcaaccaatatatgt

SEQ ID NO: 64778 - DNA, 20 bp, Artificial Sequence
  chemically synthesized
aatgtacatcttacatatat

SEQ ID NO: 64779 - DNA, 20 bp, Artificial Sequence
  chemically synthesized
atatatatttagggagacat

SEQ ID NO: 64780 - DNA, 20 bp, Artificial Sequence
  chemically synthesized
tggttttatatatatttagg

SEQ ID NO: 64781 - DNA, 20 bp, Artificial Sequence
  chemically synthesized
cttggttttatatatattta

SEQ ID NO: 64782 - DNA, 20 bp, Artificial Sequence
  chemically synthesized
gcttggttttatatatattt

SEQ ID NO: 64783 - DNA, 20 bp, Artificial Sequence
  chemically synthesized
agcttggttttatatatatt

SEQ ID NO: 64784 - DNA, 20 bp, Artificial Sequence
  chemically synthesized
ccctaaatatatataaaacc

SEQ ID NO: 64785 - DNA, 20 bp, Artificial Sequence
  chemically synthesized
aaggtgtttggggcacagct

SEQ ID NO: 64786 - DNA, 20 bp, Artificial Sequence
  chemically synthesized
tgcccaaggtgtttggggca

SEQ ID NO: 64787 - DNA, 20 bp, Artificial Sequence
  chemically synthesized
acatgtgcccaaggtgtttg

SEQ ID NO: 64788 - DNA, 20 bp, Artificial Sequence
  chemically synthesized
gacatgtgcccaaggtgttt

SEQ ID NO: 64789 - DNA, 20 bp, Artificial Sequence
  chemically synthesized
aagctgtgccccaaacacct

SEQ ID NO: 64790 - DNA, 20 bp, Artificial Sequence
  chemically synthesized
cgacatgtgcccaaggtgtt

SEQ ID NO: 64791 - DNA, 20 bp, Artificial Sequence
  chemically synthesized
agctgtgccccaaacacctt

SEQ ID NO: 64792 - DNA, 20 bp, Artificial Sequence
  chemically synthesized
gttctaacgacatgtgccca

SEQ ID NO: 64793 - DNA, 20 bp, Artificial Sequence
  chemically synthesized
ggttctaacgacatgtgccc

SEQ ID NO: 64794 - DNA, 20 bp, Artificial Sequence
  chemically synthesized
acaccttgggcacatgtcgt

SEQ ID NO: 64795 - DNA, 20 bp, Artificial Sequence
  chemically synthesized
acatgtcgttagaacctcct

SEQ ID NO: 64796 - DNA, 20 bp, Artificial Sequence
  chemically synthesized
catgtcgttagaacctcctg

SEQ ID NO: 64797 - DNA, 20 bp, Artificial Sequence
  chemically synthesized
acccatgaaacagcctcagg

SEQ ID NO: 64798 - DNA, 20 bp, Artificial Sequence
  chemically synthesized
cacccatgaaacagcctcag

SEQ ID NO: 64799 - DNA, 20 bp, Artificial Sequence
  chemically synthesized
tgcacccatgaaacagcctc

SEQ ID NO: 64800 - DNA, 20 bp, Artificial Sequence
  chemically synthesized
atgcacccatgaaacagcct

SEQ ID NO: 64801 - DNA, 20 bp, Artificial Sequence
  chemically synthesized
aacctcctgaggctgtttca

SEQ ID NO: 64802 - DNA, 20 bp, Artificial Sequence
  chemically synthesized
acctcctgaggctgtttcat

SEQ ID NO: 64803 - DNA, 20 bp, Artificial Sequence
  chemically synthesized
gagaatatgcacccatgaaa

SEQ ID NO: 64804 - DNA, 20 bp, Artificial Sequence
  chemically synthesized
tgggtgcatattctcaacct

SEQ ID NO: 64805 - DNA, 20 bp, Artificial Sequence
  chemically synthesized
aagtttattttgccaaggtt

SEQ ID NO: 64806 - DNA, 20 bp, Artificial Sequence
  chemically synthesized
ttaggaagtttattttgcca

SEQ ID NO: 64807 - DNA, 20 bp, Artificial Sequence
  chemically synthesized
tttaggaagtttattttgcc

SEQ ID NO: 64808 - DNA, 20 bp, Artificial Sequence
  chemically synthesized
ctggtctcagttaatttagg

SEQ ID NO: 64809 - DNA, 20 bp, Artificial Sequence
  chemically synthesized
agactggtctcagttaattt

SEQ ID NO: 64810 - DNA, 20 bp, Artificial Sequence
  chemically synthesized
gagactggtctcagttaatt

SEQ ID NO: 64811 - DNA, 20 bp, Artificial Sequence
  chemically synthesized
ataaacttcctaaattaact

SEQ ID NO: 64812 - DNA, 20 bp, Artificial Sequence
  chemically synthesized
cttcctaaattaactgagac

SEQ ID NO: 64813 - DNA, 20 bp, Artificial Sequence
  chemically synthesized
caaatatctgagactggtct

SEQ ID NO: 64814 - DNA, 20 bp, Artificial Sequence
  chemically synthesized
aaattaactgagaccagtct

SEQ ID NO: 64815 - DNA, 20 bp, Artificial Sequence
  chemically synthesized
gaacttcaaatatctgagac

SEQ ID NO: 64816 - DNA, 20 bp, Artificial Sequence
  chemically synthesized
tttgtgaacttcaaatatct

SEQ ID NO: 64817 - DNA, 20 bp, Artificial Sequence
  chemically synthesized
agaccagtctcagatatttg

SEQ ID NO: 64818 - DNA, 20 bp, Artificial Sequence
  chemically synthesized
cagatatttgaagttcacaa

SEQ ID NO: 64819 - DNA, 20 bp, Artificial Sequence
  chemically synthesized
agatatttgaagttcacaaa

SEQ ID NO: 64820 - DNA, 20 bp, Artificial Sequence
  chemically synthesized
gatatttgaagttcacaaaa

SEQ ID NO: 64821 - DNA, 20 bp, Artificial Sequence
  chemically synthesized
tcctctgcaagaattaacag

SEQ ID NO: 64822 - DNA, 20 bp, Artificial Sequence
  chemically synthesized
tcttcctctgcaagaattaa

SEQ ID NO: 64823 - DNA, 20 bp, Artificial Sequence
  chemically synthesized
gggaccactgttaattcttg

SEQ ID NO: 64824 - DNA, 20 bp, Artificial Sequence
  chemically synthesized
gaccactgttaattcttgca

SEQ ID NO: 64825 - DNA, 20 bp, Artificial Sequence
  chemically synthesized
accactgttaattcttgcag

SEQ ID NO: 64826 - DNA, 20 bp, Artificial Sequence
  chemically synthesized
actgttaattcttgcagagg

SEQ ID NO: 64827 - DNA, 20 bp, Artificial Sequence
  chemically synthesized
tcgtctttatcttcctctgc

SEQ ID NO: 64828 - DNA, 20 bp, Artificial Sequence
  chemically synthesized
aattcttgcagaggaagata

SEQ ID NO: 64829 - DNA, 20 bp, Artificial Sequence
  chemically synthesized
tgcagaggaagataaagacg

SEQ ID NO: 64830 - DNA, 20 bp, Artificial Sequence
  chemically synthesized
gaagataaagacgaagatga

SEQ ID NO: 64831 - DNA, 20 bp, Artificial Sequence
  chemically synthesized
cgaagatgaaagtcttgact

SEQ ID NO: 64832 - DNA, 20 bp, Artificial Sequence
  chemically synthesized
gaagatgaaagtcttgactg

SEQ ID NO: 64833 - DNA, 20 bp, Artificial Sequence
  chemically synthesized
aagatgaaagtcttgactga

SEQ ID NO: 64834 - DNA, 20 bp, Artificial Sequence
  chemically synthesized
cctcataattaccctcagtc

SEQ ID NO: 64835 - DNA, 20 bp, Artificial Sequence
  chemically synthesized
ttgttcctcataattaccct

SEQ ID NO: 64836 - DNA, 20 bp, Artificial Sequence
  chemically synthesized
tcttgactgagggtaattat

SEQ ID NO: 64837 - DNA, 20 bp, Artificial Sequence
  chemically synthesized
cttgactgagggtaattatg

SEQ ID NO: 64838 - DNA, 20 bp, Artificial Sequence
  chemically synthesized
agggtaattatgaggaacaa

SEQ ID NO: 64839 - DNA, 20 bp, Artificial Sequence
  chemically synthesized
ggtaattatgaggaacaaca

SEQ ID NO: 64840 - DNA, 20 bp, Artificial Sequence
  chemically synthesized
gtaattatgaggaacaacag

SEQ ID NO: 64841 - DNA, 20 bp, Artificial Sequence
  chemically synthesized
taattatgaggaacaacaga

SEQ ID NO: 64842 - DNA, 20 bp, Artificial Sequence
  chemically synthesized
ataattgaatacttttacaa

SEQ ID NO: 64843 - DNA, 20 bp, Artificial Sequence
  chemically synthesized
ctaaataactgcttttgtaa

SEQ ID NO: 64844 - DNA, 20 bp, Artificial Sequence
  chemically synthesized
attgaatacttttacaaaag

SEQ ID NO: 64845 - DNA, 20 bp, Artificial Sequence
  chemically synthesized
cttttacaaaagcagttatt

SEQ ID NO: 64846 - DNA, 20 bp, Artificial Sequence
  chemically synthesized
tttacaaaagcagttattta

SEQ ID NO: 64847 - DNA, 20 bp, Artificial Sequence
  chemically synthesized
agagtgtataccctgaactc

SEQ ID NO: 64848 - DNA, 20 bp, Artificial Sequence
  chemically synthesized
tgtaacagaacttgagttca

SEQ ID NO: 64849 - DNA, 20 bp, Artificial Sequence
  chemically synthesized
gtgtaacagaacttgagttc

SEQ ID NO: 64850 - DNA, 20 bp, Artificial Sequence
  chemically synthesized
tgtgtaacagaacttgagtt

SEQ ID NO: 64851 - DNA, 20 bp, Artificial Sequence
  chemically synthesized
cccactgtgtaacagaactt

SEQ ID NO: 64852 - DNA, 20 bp, Artificial Sequence
  chemically synthesized
tgaactcaagttctgttaca

SEQ ID NO: 64853 - DNA, 20 bp, Artificial Sequence
  chemically synthesized
ttatatatcccactgtgtaa

SEQ ID NO: 64854 - DNA, 20 bp, Artificial Sequence
  chemically synthesized
actcaagttctgttacacag

SEQ ID NO: 64855 - DNA, 20 bp, Artificial Sequence
  chemically synthesized
ctcaagttctgttacacagt

SEQ ID NO: 64856 - DNA, 20 bp, Artificial Sequence
  chemically synthesized
ttacacagtgggatatataa

SEQ ID NO: 64857 - DNA, 20 bp, Artificial Sequence
  chemically synthesized
gggatatataacagtgatga

SEQ ID NO: 64858 - DNA, 20 bp, Artificial Sequence
  chemically synthesized
gatatataacagtgatgaaa

SEQ ID NO: 64859 - DNA, 20 bp, Artificial Sequence
  chemically synthesized
ataacagtgatgaaagagcc

SEQ ID NO: 64860 - DNA, 20 bp, Artificial Sequence
  chemically synthesized
tcgaaaagctaagaaaagct

SEQ ID NO: 64861 - DNA, 20 bp, Artificial Sequence
  chemically synthesized
tgaaagagccaagcttttct

SEQ ID NO: 64862 - DNA, 20 bp, Artificial Sequence
  chemically synthesized
ctaagtcgaaaagctaagaa

SEQ ID NO: 64863 - DNA, 20 bp, Artificial Sequence
  chemically synthesized
tcctgctaagtcgaaaagct

SEQ ID NO: 64864 - DNA, 20 bp, Artificial Sequence
  chemically synthesized
cttttcttagcttttcgact

SEQ ID NO: 64865 - DNA, 20 bp, Artificial Sequence
  chemically synthesized
cattgtcctgctaagtcgaa

SEQ ID NO: 64866 - DNA, 20 bp, Artificial Sequence
  chemically synthesized
ttcttagcttttcgacttag

SEQ ID NO: 64867 - DNA, 20 bp, Artificial Sequence
  chemically synthesized
tcttagcttttcgacttagc

SEQ ID NO: 64868 - DNA, 20 bp, Artificial Sequence
  chemically synthesized
attgttttcattgtcctgct

SEQ ID NO: 64869 - DNA, 20 bp, Artificial Sequence
  chemically synthesized
aaaacaatcaaaaacccaac

SEQ ID NO: 64870 - DNA, 20 bp, Artificial Sequence
  chemically synthesized
caagctgatgtgaactagtt

SEQ ID NO: 64871 - DNA, 20 bp, Artificial Sequence
  chemically synthesized
tcaagctgatgtgaactagt

SEQ ID NO: 64872 - DNA, 20 bp, Artificial Sequence
  chemically synthesized
cgtttcaagctgatgtgaac

SEQ ID NO: 64873 - DNA, 20 bp, Artificial Sequence
  chemically synthesized
aaaacccaactagttcacat

SEQ ID NO: 64874 - DNA, 20 bp, Artificial Sequence
  chemically synthesized
agttcacatcagcttgaaac

SEQ ID NO: 64875 - DNA, 20 bp, Artificial Sequence
  chemically synthesized
gttcacatcagcttgaaacg

SEQ ID NO: 64876 - DNA, 20 bp, Artificial Sequence
  chemically synthesized
tctctaagcatcctcgtttc

SEQ ID NO: 64877 - DNA, 20 bp, Artificial Sequence
  chemically synthesized
cagcttgaaacgaggatgct

SEQ ID NO: 64878 - DNA, 20 bp, Artificial Sequence
  chemically synthesized
gcttgaaacgaggatgctta

SEQ ID NO: 64879 - DNA, 20 bp, Artificial Sequence
  chemically synthesized
tgaaacgaggatgcttagag

SEQ ID NO: 64880 - DNA, 20 bp, Artificial Sequence
  chemically synthesized
tcaattttcgtatcttctct

SEQ ID NO: 64881 - DNA, 20 bp, Artificial Sequence
  chemically synthesized
aagatacgaaaattgacaac

SEQ ID NO: 64882 - DNA, 20 bp, Artificial Sequence
  chemically synthesized
aattgacaacgagtatttta

SEQ ID NO: 64883 - DNA, 20 bp, Artificial Sequence
  chemically synthesized
caacgagtattttacagatg

SEQ ID NO: 64884 - DNA, 20 bp, Artificial Sequence
  chemically synthesized
acgagtattttacagatgta

SEQ ID NO: 64885 - DNA, 20 bp, Artificial Sequence
  chemically synthesized
agtattttacagatgtagag

SEQ ID NO: 64886 - DNA, 20 bp, Artificial Sequence
  chemically synthesized
agagaagtgacgtttctctt

SEQ ID NO: 64887 - DNA, 20 bp, Artificial Sequence
  chemically synthesized
tcctgcccactggagccaaa

SEQ ID NO: 64888 - DNA, 20 bp, Artificial Sequence
  chemically synthesized
gtgacgtttctctttggctc

SEQ ID NO: 64889 - DNA, 20 bp, Artificial Sequence
  chemically synthesized
attcctgcccactggagcca

SEQ ID NO: 64890 - DNA, 20 bp, Artificial Sequence
  chemically synthesized
acgtttctctttggctccag

SEQ ID NO: 64891 - DNA, 20 bp, Artificial Sequence
  chemically synthesized
cgtttctctttggctccagt

SEQ ID NO: 64892 - DNA, 20 bp, Artificial Sequence
  chemically synthesized
ttctctttggctccagtggg

SEQ ID NO: 64893 - DNA, 20 bp, Artificial Sequence
  chemically synthesized
tgatctattcctgcccactg

SEQ ID NO: 64894 - DNA, 20 bp, Artificial Sequence
  chemically synthesized
tctctttggctccagtgggc

SEQ ID NO: 64895 - DNA, 20 bp, Artificial Sequence
  chemically synthesized
attgatctattcctgcccac

SEQ ID NO: 64896 - DNA, 20 bp, Artificial Sequence
  chemically synthesized
ttggctccagtgggcaggaa

SEQ ID NO: 64897 - DNA, 20 bp, Artificial Sequence
  chemically synthesized
ggcaggaatagatcaatata

SEQ ID NO: 64898 - DNA, 20 bp, Artificial Sequence
  chemically synthesized
caggaatagatcaatatata

SEQ ID NO: 64899 - DNA, 20 bp, Artificial Sequence
  chemically synthesized
agatcaatatatagagattt

SEQ ID NO: 64900 - DNA, 20 bp, Artificial Sequence
  chemically synthesized
gatcaatatatagagatttc

SEQ ID NO: 64901 - DNA, 20 bp, Artificial Sequence
  chemically synthesized
aatatatagagatttcagga

SEQ ID NO: 64902 - DNA, 20 bp, Artificial Sequence
  chemically synthesized
tctttataataaatgaaaat

SEQ ID NO: 64903 - DNA, 20 bp, Artificial Sequence
  chemically synthesized
gccaattttcatttattata

SEQ ID NO: 64904 - DNA, 20 bp, Artificial Sequence
  chemically synthesized
gagcagttctggttgtttca

SEQ ID NO: 64905 - DNA, 20 bp, Artificial Sequence
  chemically synthesized
tataaagactttgaaacaac

SEQ ID NO: 64906 - DNA, 20 bp, Artificial Sequence
  chemically synthesized
cttttcccagggagcagttc

SEQ ID NO: 64907 - DNA, 20 bp, Artificial Sequence
  chemically synthesized
aaacaaccagaactgctccc

SEQ ID NO: 64908 - DNA, 20 bp, Artificial Sequence
  chemically synthesized
aacaaccagaactgctccct

SEQ ID NO: 64909 - DNA, 20 bp, Artificial Sequence
  chemically synthesized
atcacccttttcccagggag

SEQ ID NO: 64910 - DNA, 20 bp, Artificial Sequence
  chemically synthesized
taaatcacccttttcccagg

SEQ ID NO: 64911 - DNA, 20 bp, Artificial Sequence
  chemically synthesized
ccagaactgctccctgggaa

SEQ ID NO: 64912 - DNA, 20 bp, Artificial Sequence
  chemically synthesized
cagaactgctccctgggaaa

SEQ ID NO: 64913 - DNA, 20 bp, Artificial Sequence
  chemically synthesized
gataaatcacccttttccca

SEQ ID NO: 64914 - DNA, 20 bp, Artificial Sequence
  chemically synthesized
agaactgctccctgggaaaa

SEQ ID NO: 64915 - DNA, 20 bp, Artificial Sequence
  chemically synthesized
tgataaatcacccttttccc

SEQ ID NO: 64916 - DNA, 20 bp, Artificial Sequence
  chemically synthesized
atgataaatcacccttttcc

SEQ ID NO: 64917 - DNA, 20 bp, Artificial Sequence
  chemically synthesized
attcaaacccagtttgagta

SEQ ID NO: 64918 - DNA, 20 bp, Artificial Sequence
  chemically synthesized
atcaatgactgtactcaaac

SEQ ID NO: 64919 - DNA, 20 bp, Artificial Sequence
  chemically synthesized
tcaatgactgtactcaaact

SEQ ID NO: 64920 - DNA, 20 bp, Artificial Sequence
  chemically synthesized
tggtcattcaaacccagttt

SEQ ID NO: 64921 - DNA, 20 bp, Artificial Sequence
  chemically synthesized
tcagtttggtcattcaaacc

SEQ ID NO: 64922 - DNA, 20 bp, Artificial Sequence
  chemically synthesized
ggtttgaatgaccaaactga

SEQ ID NO: 64923 - DNA, 20 bp, Artificial Sequence
  chemically synthesized
gtttgaatgaccaaactgac

SEQ ID NO: 64924 - DNA, 20 bp, Artificial Sequence
  chemically synthesized
ctataaaatccctgtcagtt

SEQ ID NO: 64925 - DNA, 20 bp, Artificial Sequence
  chemically synthesized
tttgaatgaccaaactgaca

SEQ ID NO: 64926 - DNA, 20 bp, Artificial Sequence
  chemically synthesized
cgaccctataaaatccctgt

SEQ ID NO: 64927 - DNA, 20 bp, Artificial Sequence
  chemically synthesized
ccaaactgacagggatttta

SEQ ID NO: 64928 - DNA, 20 bp, Artificial Sequence
  chemically synthesized
caaactgacagggattttat

SEQ ID NO: 64929 - DNA, 20 bp, Artificial Sequence
  chemically synthesized
aaactgacagggattttata

SEQ ID NO: 64930 - DNA, 20 bp, Artificial Sequence
  chemically synthesized
tatagggtcgaatcctgcct

SEQ ID NO: 64931 - DNA, 20 bp, Artificial Sequence
  chemically synthesized
atagggtcgaatcctgcctt

SEQ ID NO: 64932 - DNA, 20 bp, Artificial Sequence
  chemically synthesized
attcattttcttcctaaggc

SEQ ID NO: 64933 - DNA, 20 bp, Artificial Sequence
  chemically synthesized
gggtcgaatcctgccttagg

SEQ ID NO: 64934 - DNA, 20 bp, Artificial Sequence
  chemically synthesized
cattcattttcttcctaagg

SEQ ID NO: 64935 - DNA, 20 bp, Artificial Sequence
  chemically synthesized
aatcattcattttcttccta

SEQ ID NO: 64936 - DNA, 20 bp, Artificial Sequence
  chemically synthesized
gaatcattcattttcttcct

SEQ ID NO: 64937 - DNA, 20 bp, Artificial Sequence
  chemically synthesized
ctcagaatttaaagggattt

SEQ ID NO: 64938 - DNA, 20 bp, Artificial Sequence
  chemically synthesized
atgcaatctcagaatttaaa

SEQ ID NO: 64939 - DNA, 20 bp, Artificial Sequence
  chemically synthesized
catgcaatctcagaatttaa

SEQ ID NO: 64940 - DNA, 20 bp, Artificial Sequence
  chemically synthesized
ccatgcaatctcagaattta

SEQ ID NO: 64941 - DNA, 20 bp, Artificial Sequence
  chemically synthesized
cttaaatccctttaaattct

SEQ ID NO: 64942 - DNA, 20 bp, Artificial Sequence
  chemically synthesized
gtgcttctgccatgcaatct

SEQ ID NO: 64943 - DNA, 20 bp, Artificial Sequence
  chemically synthesized
ctttaaattctgagattgca

SEQ ID NO: 64944 - DNA, 20 bp, Artificial Sequence
  chemically synthesized
taaattctgagattgcatgg

SEQ ID NO: 64945 - DNA, 20 bp, Artificial Sequence
  chemically synthesized
attctgagattgcatggcag

SEQ ID NO: 64946 - DNA, 20 bp, Artificial Sequence
  chemically synthesized
tgcatggcagaagcacgatg

SEQ ID NO: 64947 - DNA, 20 bp, Artificial Sequence
  chemically synthesized
tgaagatcacactacctaaa

SEQ ID NO: 64948 - DNA, 20 bp, Artificial Sequence
  chemically synthesized
tcagatcctctctttttagg

SEQ ID NO: 64949 - DNA, 20 bp, Artificial Sequence
  chemically synthesized
aagatcacactacctaaaaa

SEQ ID NO: 64950 - DNA, 20 bp, Artificial Sequence
  chemically synthesized
gatcacactacctaaaaaga

SEQ ID NO: 64951 - DNA, 20 bp, Artificial Sequence
  chemically synthesized
aaatcagatcctctcttttt

SEQ ID NO: 64952 - DNA, 20 bp, Artificial Sequence
  chemically synthesized
atcacactacctaaaaagag

SEQ ID NO: 64953 - DNA, 20 bp, Artificial Sequence
  chemically synthesized
gaaatcagatcctctctttt

SEQ ID NO: 64954 - DNA, 20 bp, Artificial Sequence
  chemically synthesized
aaaaagagaggatctgattt

SEQ ID NO: 64955 - DNA, 20 bp, Artificial Sequence
  chemically synthesized
aaaagagaggatctgatttc

SEQ ID NO: 64956 - DNA, 20 bp, Artificial Sequence
  chemically synthesized
aggcttctaggacctgaaat

SEQ ID NO: 64957 - DNA, 20 bp, Artificial Sequence
  chemically synthesized
gaggatctgatttcaggtcc

SEQ ID NO: 64958 - DNA, 20 bp, Artificial Sequence
  chemically synthesized
gatctgatttcaggtcctag

SEQ ID NO: 64959 - DNA, 20 bp, Artificial Sequence
  chemically synthesized
ccaataaaaccaaggcttct

SEQ ID NO: 64960 - DNA, 20 bp, Artificial Sequence
  chemically synthesized
atttcaggtcctagaagcct

SEQ ID NO: 64961 - DNA, 20 bp, Artificial Sequence
  chemically synthesized
gccaataaaaccaaggcttc

SEQ ID NO: 64962 - DNA, 20 bp, Artificial Sequence
  chemically synthesized
actaagggccaataaaacca

SEQ ID NO: 64963 - DNA, 20 bp, Artificial Sequence
  chemically synthesized
aactaagggccaataaaacc

SEQ ID NO: 64964 - DNA, 20 bp, Artificial Sequence
  chemically synthesized
cctagaagccttggttttat

SEQ ID NO: 64965 - DNA, 20 bp, Artificial Sequence
  chemically synthesized
gccttggttttattggccct

SEQ ID NO: 64966 - DNA, 20 bp, Artificial Sequence
  chemically synthesized
atcatagatatggaaactaa

SEQ ID NO: 64967 - DNA, 20 bp, Artificial Sequence
  chemically synthesized
tatcatagatatggaaacta

SEQ ID NO: 64968 - DNA, 20 bp, Artificial Sequence
  chemically synthesized
atatcatagatatggaaact

SEQ ID NO: 64969 - DNA, 20 bp, Artificial Sequence
  chemically synthesized
ctaaactcatatcatagata

SEQ ID NO: 64970 - DNA, 20 bp, Artificial Sequence
  chemically synthesized
agtttccatatctatgatat

SEQ ID NO: 64971 - DNA, 20 bp, Artificial Sequence
  chemically synthesized
actcatctaaactcatatca

SEQ ID NO: 64972 - DNA, 20 bp, Artificial Sequence
  chemically synthesized
ccatatctatgatatgagtt

SEQ ID NO: 64973 - DNA, 20 bp, Artificial Sequence
  chemically synthesized
tctatgatatgagtttagat

SEQ ID NO: 64974 - DNA, 20 bp, Artificial Sequence
  chemically synthesized
agtttagatgagttatttct

SEQ ID NO: 64975 - DNA, 20 bp, Artificial Sequence
  chemically synthesized
gtttagatgagttatttcta

SEQ ID NO: 64976 - DNA, 20 bp, Artificial Sequence
  chemically synthesized
tttaaagcaacaggaaacct

SEQ ID NO: 64977 - DNA, 20 bp, Artificial Sequence
  chemically synthesized
attgaatgttttaaagcaac

SEQ ID NO: 64978 - DNA, 20 bp, Artificial Sequence
  chemically synthesized
cattgaatgttttaaagcaa

SEQ ID NO: 64979 - DNA, 20 bp, Artificial Sequence
  chemically synthesized
taaaatcattgaatgtttta

SEQ ID NO: 64980 - DNA, 20 bp, Artificial Sequence
  chemically synthesized
tttaaaacattcaatgattt

SEQ ID NO: 64981 - DNA, 20 bp, Artificial Sequence
  chemically synthesized
taaaacattcaatgatttta

SEQ ID NO: 64982 - DNA, 20 bp, Artificial Sequence
  chemically synthesized
tcaatatttctaacgacatc

SEQ ID NO: 64983 - DNA, 20 bp, Artificial Sequence
  chemically synthesized
ttagagttgcttgatgtcgt

SEQ ID NO: 64984 - DNA, 20 bp, Artificial Sequence
  chemically synthesized
tcgttagaaatattgaatgc

SEQ ID NO: 64985 - DNA, 20 bp, Artificial Sequence
  chemically synthesized
aaatattgaatgccagaatg

SEQ ID NO: 64986 - DNA, 20 bp, Artificial Sequence
  chemically synthesized
taaataaatattccacattc

SEQ ID NO: 64987 - DNA, 20 bp, Artificial Sequence
  chemically synthesized
atgtggaatatttatttaat

SEQ ID NO: 64988 - DNA, 20 bp, Artificial Sequence
  chemically synthesized
gaatatttatttaattggat

SEQ ID NO: 64989 - DNA, 20 bp, Artificial Sequence
  chemically synthesized
ttatttaattggataagaaa

SEQ ID NO: 64990 - DNA, 20 bp, Artificial Sequence
  chemically synthesized
tttcttaaaatttttgaaca

SEQ ID NO: 64991 - DNA, 20 bp, Artificial Sequence
  chemically synthesized
aaactttgttcaaaaatttt

SEQ ID NO: 64992 - DNA, 20 bp, Artificial Sequence
  chemically synthesized
ttaagaaacaatcactatta

SEQ ID NO: 64993 - DNA, 20 bp, Artificial Sequence
  chemically synthesized
gcctctaagtgcagctttaa

SEQ ID NO: 64994 - DNA, 20 bp, Artificial Sequence
  chemically synthesized
atcactattaaagctgcact

SEQ ID NO: 64995 - DNA, 20 bp, Artificial Sequence
  chemically synthesized
cactattaaagctgcactta

SEQ ID NO: 64996 - DNA, 20 bp, Artificial Sequence
  chemically synthesized
actattaaagctgcacttag

SEQ ID NO: 64997 - DNA, 20 bp, Artificial Sequence
  chemically synthesized
agataaatagcctctaagtg

SEQ ID NO: 64998 - DNA, 20 bp, Artificial Sequence
  chemically synthesized
gttgcagataaatagcctct

SEQ ID NO: 64999 - DNA, 20 bp, Artificial Sequence
  chemically synthesized
tactcattgttgcagataaa

SEQ ID NO: 65000 - DNA, 20 bp, Artificial Sequence
  chemically synthesized
ggctatttatctgcaacaat

SEQ ID NO: 65001 - DNA, 20 bp, Artificial Sequence
  chemically synthesized
gttacgtctactcattgttg

SEQ ID NO: 65002 - DNA, 20 bp, Artificial Sequence
  chemically synthesized
tatttatctgcaacaatgag

SEQ ID NO: 65003 - DNA, 20 bp, Artificial Sequence
  chemically synthesized
atgagtagacgtaaccatgt

SEQ ID NO: 65004 - DNA, 20 bp, Artificial Sequence
  chemically synthesized
ttaataaatgttagctgaca

SEQ ID NO: 65005 - DNA, 20 bp, Artificial Sequence
  chemically synthesized
aaataggatttaataaatgt

SEQ ID NO: 65006 - DNA, 20 bp, Artificial Sequence
  chemically synthesized
acatttattaaatcctattt

SEQ ID NO: 65007 - DNA, 20 bp, Artificial Sequence
  chemically synthesized
cttagctcactagctgaaat

SEQ ID NO: 65008 - DNA, 20 bp, Artificial Sequence
  chemically synthesized
ttattaaatcctatttcagc

SEQ ID NO: 65009 - DNA, 20 bp, Artificial Sequence
  chemically synthesized
gcttagctcactagctgaaa

SEQ ID NO: 65010 - DNA, 20 bp, Artificial Sequence
  chemically synthesized
taaatcctatttcagctagt

SEQ ID NO: 65011 - DNA, 20 bp, Artificial Sequence
  chemically synthesized
cctatttcagctagtgagct

SEQ ID NO: 65012 - DNA, 20 bp, Artificial Sequence
  chemically synthesized
atatcaggtgcttagctcac

SEQ ID NO: 65013 - DNA, 20 bp, Artificial Sequence
  chemically synthesized
gatcatttatatcaggtgct

SEQ ID NO: 65014 - DNA, 20 bp, Artificial Sequence
  chemically synthesized
taaatgagatcatttatatc

SEQ ID NO: 65015 - DNA, 20 bp, Artificial Sequence
  chemically synthesized
ttaaatgagatcatttatat

SEQ ID NO: 65016 - DNA, 20 bp, Artificial Sequence
  chemically synthesized
ggttgttatgagaattaaat

SEQ ID NO: 65017 - DNA, 20 bp, Artificial Sequence
  chemically synthesized
ctatgttacagggttgttat

SEQ ID NO: 65018 - DNA, 20 bp, Artificial Sequence
  chemically synthesized
ctcataacaaccctgtaaca

SEQ ID NO: 65019 - DNA, 20 bp, Artificial Sequence
  chemically synthesized
tgaatagtacctatgttaca

SEQ ID NO: 65020 - DNA, 20 bp, Artificial Sequence
  chemically synthesized
tcataacaaccctgtaacat

SEQ ID NO: 65021 - DNA, 20 bp, Artificial Sequence
  chemically synthesized
gtgaatagtacctatgttac

SEQ ID NO: 65022 - DNA, 20 bp, Artificial Sequence
  chemically synthesized
tgtgaatagtacctatgtta

SEQ ID NO: 65023 - DNA, 20 bp, Artificial Sequence
  chemically synthesized
tgtaacataggtactattca

SEQ ID NO: 65024 - DNA, 20 bp, Artificial Sequence
  chemically synthesized
ttggtttccctgactgtgaa

SEQ ID NO: 65025 - DNA, 20 bp, Artificial Sequence
  chemically synthesized
acataggtactattcacagt

SEQ ID NO: 65026 - DNA, 20 bp, Artificial Sequence
  chemically synthesized
cataggtactattcacagtc

SEQ ID NO: 65027 - DNA, 20 bp, Artificial Sequence
  chemically synthesized
ataggtactattcacagtca

SEQ ID NO: 65028 - DNA, 20 bp, Artificial Sequence
  chemically synthesized
cagtcagggaaaccaaacct

SEQ ID NO: 65029 - DNA, 20 bp, Artificial Sequence
  chemically synthesized
gtcagggaaaccaaaccttg

SEQ ID NO: 65030 - DNA, 20 bp, Artificial Sequence
  chemically synthesized
gttttaacctctccaaggtt

SEQ ID NO: 65031 - DNA, 20 bp, Artificial Sequence
  chemically synthesized
cagggaaaccaaaccttgga

SEQ ID NO: 65032 - DNA, 20 bp, Artificial Sequence
  chemically synthesized
agggaaaccaaaccttggag

SEQ ID NO: 65033 - DNA, 20 bp, Artificial Sequence
  chemically synthesized
caaatgttttaacctctcca

SEQ ID NO: 65034 - DNA, 20 bp, Artificial Sequence
  chemically synthesized
gcaaatgttttaacctctcc

SEQ ID NO: 65035 - DNA, 20 bp, Artificial Sequence
  chemically synthesized
agaggttaaaacatttgccc

SEQ ID NO: 65036 - DNA, 20 bp, Artificial Sequence
  chemically synthesized
gaggttaaaacatttgccca

SEQ ID NO: 65037 - DNA, 20 bp, Artificial Sequence
  chemically synthesized
cttagaaactgtgtaacctt

SEQ ID NO: 65038 - DNA, 20 bp, Artificial Sequence
  chemically synthesized
acttagaaactgtgtaacct

SEQ ID NO: 65039 - DNA, 20 bp, Artificial Sequence
  chemically synthesized
aacatttgcccaaggttaca

SEQ ID NO: 65040 - DNA, 20 bp, Artificial Sequence
  chemically synthesized
cccaaggttacacagtttct

SEQ ID NO: 65041 - DNA, 20 bp, Artificial Sequence
  chemically synthesized
aaggttacacagtttctaag

SEQ ID NO: 65042 - DNA, 20 bp, Artificial Sequence
  chemically synthesized
gttacacagtttctaagtgg

SEQ ID NO: 65043 - DNA, 20 bp, Artificial Sequence
  chemically synthesized
tacacagtttctaagtggta

SEQ ID NO: 65044 - DNA, 20 bp, Artificial Sequence
  chemically synthesized
tatgaatcctctctaccact

SEQ ID NO: 65045 - DNA, 20 bp, Artificial Sequence
  chemically synthesized
cacagtttctaagtggtaga

SEQ ID NO: 65046 - DNA, 20 bp, Artificial Sequence
  chemically synthesized
acagtttctaagtggtagag

SEQ ID NO: 65047 - DNA, 20 bp, Artificial Sequence
  chemically synthesized
agagaggattcataccctga

SEQ ID NO: 65048 - DNA, 20 bp, Artificial Sequence
  chemically synthesized
attcctgttgacagctgtca

SEQ ID NO: 65049 - DNA, 20 bp, Artificial Sequence
  chemically synthesized
aattcctgttgacagctgtc

SEQ ID NO: 65050 - DNA, 20 bp, Artificial Sequence
  chemically synthesized
taattcctgttgacagctgt

SEQ ID NO: 65051 - DNA, 20 bp, Artificial Sequence
  chemically synthesized
cataccctgacagctgtcaa

SEQ ID NO: 65052 - DNA, 20 bp, Artificial Sequence
  chemically synthesized
ataccctgacagctgtcaac

SEQ ID NO: 65053 - DNA, 20 bp, Artificial Sequence
  chemically synthesized
ctttcattaattcctgttga

SEQ ID NO: 65054 - DNA, 20 bp, Artificial Sequence
  chemically synthesized
ctgtcaacaggaattaatga

SEQ ID NO: 65055 - DNA, 20 bp, Artificial Sequence
  chemically synthesized
attaatgaaagttctctgta

SEQ ID NO: 65056 - DNA, 20 bp, Artificial Sequence
  chemically synthesized
ttaatgaaagttctctgtaa

SEQ ID NO: 65057 - DNA, 20 bp, Artificial Sequence
  chemically synthesized
taatgaaagttctctgtaaa

SEQ ID NO: 65058 - DNA, 20 bp, Artificial Sequence
  chemically synthesized
ttactttctggccctttaca

SEQ ID NO: 65059 - DNA, 20 bp, Artificial Sequence
  chemically synthesized
atttactttctggcccttta

SEQ ID NO: 65060 - DNA, 20 bp, Artificial Sequence
  chemically synthesized
gaaagttctctgtaaagggc

SEQ ID NO: 65061 - DNA, 20 bp, Artificial Sequence
  chemically synthesized
gttctctgtaaagggccaga

SEQ ID NO: 65062 - DNA, 20 bp, Artificial Sequence
  chemically synthesized
agccagaaatatttactttc

SEQ ID NO: 65063 - DNA, 20 bp, Artificial Sequence
  chemically synthesized
ggccagaaagtaaatatttc

SEQ ID NO: 65064 - DNA, 20 bp, Artificial Sequence
  chemically synthesized
aagtaaatatttctggcttt

SEQ ID NO: 65065 - DNA, 20 bp, Artificial Sequence
  chemically synthesized
agtaaatatttctggctttg

SEQ ID NO: 65066 - DNA, 20 bp, Artificial Sequence
  chemically synthesized
atttatgtgttcctcaaagc

SEQ ID NO: 65067 - DNA, 20 bp, Artificial Sequence
  chemically synthesized
ggagatttatgtgttcctca

SEQ ID NO: 65068 - DNA, 20 bp, Artificial Sequence
  chemically synthesized
ccaaagaagaatatgtaacg

SEQ ID NO: 65069 - DNA, 20 bp, Artificial Sequence
  chemically synthesized
acccaaagaagaatatgtaa

SEQ ID NO: 65070 - DNA, 20 bp, Artificial Sequence
  chemically synthesized
ctccgttacatattcttctt

SEQ ID NO: 65071 - DNA, 20 bp, Artificial Sequence
  chemically synthesized
tccgttacatattcttcttt

SEQ ID NO: 65072 - DNA, 20 bp, Artificial Sequence
  chemically synthesized
aagttgtacgaaacccaaag

SEQ ID NO: 65073 - DNA, 20 bp, Artificial Sequence
  chemically synthesized
aataagttgtacgaaaccca

SEQ ID NO: 65074 - DNA, 20 bp, Artificial Sequence
  chemically synthesized
aacagtttacttgttttaat

SEQ ID NO: 65075 - DNA, 20 bp, Artificial Sequence
  chemically synthesized
ttcgtacaacttattaaaac

SEQ ID NO: 65076 - DNA, 20 bp, Artificial Sequence
  chemically synthesized
taaaacaagtaaactgtttt

SEQ ID NO: 65077 - DNA, 20 bp, Artificial Sequence
  chemically synthesized
aatagcaggggagctaaaaa

SEQ ID NO: 65078 - DNA, 20 bp, Artificial Sequence
  chemically synthesized
ggttttttttaatagcaggg

SEQ ID NO: 65079 - DNA, 20 bp, Artificial Sequence
  chemically synthesized
tgggttttttttaatagcag

SEQ ID NO: 65080 - DNA, 20 bp, Artificial Sequence
  chemically synthesized
ctgggttttttttaatagca

SEQ ID NO: 65081 - DNA, 20 bp, Artificial Sequence
  chemically synthesized
cctgggttttttttaatagc

SEQ ID NO: 65082 - DNA, 20 bp, Artificial Sequence
  chemically synthesized
gcctgggttttttttaatag

SEQ ID NO: 65083 - DNA, 20 bp, Artificial Sequence
  chemically synthesized
ggggcctgggttttttttaa

SEQ ID NO: 65084 - DNA, 20 bp, Artificial Sequence
  chemically synthesized
ccctgctattaaaaaaaacc

SEQ ID NO: 65085 - DNA, 20 bp, Artificial Sequence
  chemically synthesized
cctgctattaaaaaaaaccc

SEQ ID NO: 65086 - DNA, 20 bp, Artificial Sequence
  chemically synthesized
acaaattcaacatggggcct

SEQ ID NO: 65087 - DNA, 20 bp, Artificial Sequence
  chemically synthesized
tacaaattcaacatggggcc

SEQ ID NO: 65088 - DNA, 20 bp, Artificial Sequence
  chemically synthesized
ctcagtacaaattcaacatg

SEQ ID NO: 65089 - DNA, 20 bp, Artificial Sequence
  chemically synthesized
tctcagtacaaattcaacat

SEQ ID NO: 65090 - DNA, 20 bp, Artificial Sequence
  chemically synthesized
gtctcagtacaaattcaaca

SEQ ID NO: 65091 - DNA, 20 bp, Artificial Sequence
  chemically synthesized
ccccatgttgaatttgtact

SEQ ID NO: 65092 - DNA, 20 bp, Artificial Sequence
  chemically synthesized
tgaatttgtactgagacctg

SEQ ID NO: 65093 - DNA, 20 bp, Artificial Sequence
  chemically synthesized
ggacagcaaactacaggtct

SEQ ID NO: 65094 - DNA, 20 bp, Artificial Sequence
  chemically synthesized
agcaggggacagcaaactac

SEQ ID NO: 65095 - DNA, 20 bp, Artificial Sequence
  chemically synthesized
gagcaggggacagcaaacta

SEQ ID NO: 65096 - DNA, 20 bp, Artificial Sequence
  chemically synthesized
taagagagcagagcagggga

SEQ ID NO: 65097 - DNA, 20 bp, Artificial Sequence
  chemically synthesized
gtagtaagagagcagagcag

SEQ ID NO: 65098 - DNA, 20 bp, Artificial Sequence
  chemically synthesized
tgtagtaagagagcagagca

SEQ ID NO: 65099 - DNA, 20 bp, Artificial Sequence
  chemically synthesized
ttgtagtaagagagcagagc

SEQ ID NO: 65100 - DNA, 20 bp, Artificial Sequence
  chemically synthesized
gttgtagtaagagagcagag

SEQ ID NO: 65101 - DNA, 20 bp, Artificial Sequence
  chemically synthesized
ggtgttgtagtaagagagca

SEQ ID NO: 65102 - DNA, 20 bp, Artificial Sequence
  chemically synthesized
agggtgttgtagtaagagag

SEQ ID NO: 65103 - DNA, 20 bp, Artificial Sequence
  chemically synthesized
agtagggtgttgtagtaaga

SEQ ID NO: 65104 - DNA, 20 bp, Artificial Sequence
  chemically synthesized
gcagtagggtgttgtagtaa

SEQ ID NO: 65105 - DNA, 20 bp, Artificial Sequence
  chemically synthesized
aagcagtagggtgttgtagt

SEQ ID NO: 65106 - DNA, 20 bp, Artificial Sequence
  chemically synthesized
ggggaagcagtagggtgttg

SEQ ID NO: 65107 - DNA, 20 bp, Artificial Sequence
  chemically synthesized
gtagtcttggggaagcagta

SEQ ID NO: 65108 - DNA, 20 bp, Artificial Sequence
  chemically synthesized
agtagtcttggggaagcagt

SEQ ID NO: 65109 - DNA, 20 bp, Artificial Sequence
  chemically synthesized
tagtagtcttggggaagcag

SEQ ID NO: 65110 - DNA, 20 bp, Artificial Sequence
  chemically synthesized
caacaccctactgcttcccc

SEQ ID NO: 65111 - DNA, 20 bp, Artificial Sequence
  chemically synthesized
aaatagtagtcttggggaag

SEQ ID NO: 65112 - DNA, 20 bp, Artificial Sequence
  chemically synthesized
agtaaatagtagtcttgggg

SEQ ID NO: 65113 - DNA, 20 bp, Artificial Sequence
  chemically synthesized
ctcagtaaatagtagtcttg

SEQ ID NO: 65114 - DNA, 20 bp, Artificial Sequence
  chemically synthesized
cctcagtaaatagtagtctt

SEQ ID NO: 65115 - DNA, 20 bp, Artificial Sequence
  chemically synthesized
tcctcagtaaatagtagtct

SEQ ID NO: 65116 - DNA, 20 bp, Artificial Sequence
  chemically synthesized
aagaagtcctcagtaaatag

SEQ ID NO: 65117 - DNA, 20 bp, Artificial Sequence
  chemically synthesized
ccccaagactactatttact

SEQ ID NO: 65118 - DNA, 20 bp, Artificial Sequence
  chemically synthesized
cccaagactactatttactg

SEQ ID NO: 65119 - DNA, 20 bp, Artificial Sequence
  chemically synthesized
cataagaagtcctcagtaaa

SEQ ID NO: 65120 - DNA, 20 bp, Artificial Sequence
  chemically synthesized
tctggcccataagaagtcct

SEQ ID NO: 65121 - DNA, 20 bp, Artificial Sequence
  chemically synthesized
tatttactgaggacttctta

SEQ ID NO: 65122 - DNA, 20 bp, Artificial Sequence
  chemically synthesized
atttactgaggacttcttat

SEQ ID NO: 65123 - DNA, 20 bp, Artificial Sequence
  chemically synthesized
cgcagtgtctggcccataag

SEQ ID NO: 65124 - DNA, 20 bp, Artificial Sequence
  chemically synthesized
actgaggacttcttatgggc

SEQ ID NO: 65125 - DNA, 20 bp, Artificial Sequence
  chemically synthesized
tagcgcagtgtctggcccat

SEQ ID NO: 65126 - DNA, 20 bp, Artificial Sequence
  chemically synthesized
aaagcatttagcgcagtgtc

SEQ ID NO: 65127 - DNA, 20 bp, Artificial Sequence
  chemically synthesized
tgcatgaaaagcatttagcg

SEQ ID NO: 65128 - DNA, 20 bp, Artificial Sequence
  chemically synthesized
gatattgcatgaaaagcatt

SEQ ID NO: 65129 - DNA, 20 bp, Artificial Sequence
  chemically synthesized
ttacagagatattgcatgaa

SEQ ID NO: 65130 - DNA, 20 bp, Artificial Sequence
  chemically synthesized
cagaggctcgttgtattaca

SEQ ID NO: 65131 - DNA, 20 bp, Artificial Sequence
  chemically synthesized
cccagaggctcgttgtatta

SEQ ID NO: 65132 - DNA, 20 bp, Artificial Sequence
  chemically synthesized
caatatctctgtaatacaac

SEQ ID NO: 65133 - DNA, 20 bp, Artificial Sequence
  chemically synthesized
tctgtaatacaacgagcctc

SEQ ID NO: 65134 - DNA, 20 bp, Artificial Sequence
  chemically synthesized
ctgtaatacaacgagcctct

SEQ ID NO: 65135 - DNA, 20 bp, Artificial Sequence
  chemically synthesized
aatacaacgagcctctgggt

SEQ ID NO: 65136 - DNA, 20 bp, Artificial Sequence
  chemically synthesized
taaaatggaaaccaacccag

SEQ ID NO: 65137 - DNA, 20 bp, Artificial Sequence
  chemically synthesized
ataaaatggaaaccaaccca

SEQ ID NO: 65138 - DNA, 20 bp, Artificial Sequence
  chemically synthesized
ctataaaatggaaaccaacc

SEQ ID NO: 65139 - DNA, 20 bp, Artificial Sequence
  chemically synthesized
ctgggttggtttccatttta

SEQ ID NO: 65140 - DNA, 20 bp, Artificial Sequence
  chemically synthesized
cctattttccatctataaaa

SEQ ID NO: 65141 - DNA, 20 bp, Artificial Sequence
  chemically synthesized
gttggtttccattttataga

SEQ ID NO: 65142 - DNA, 20 bp, Artificial Sequence
  chemically synthesized
tccattttatagatggaaaa

SEQ ID NO: 65143 - DNA, 20 bp, Artificial Sequence
  chemically synthesized
ccattttatagatggaaaat

SEQ ID NO: 65144 - DNA, 20 bp, Artificial Sequence
  chemically synthesized
ttatagatggaaaataggct

SEQ ID NO: 65145 - DNA, 20 bp, Artificial Sequence
  chemically synthesized
atagatggaaaataggctta

SEQ ID NO: 65146 - DNA, 20 bp, Artificial Sequence
  chemically synthesized
agatggaaaataggcttaga

SEQ ID NO: 65147 - DNA, 20 bp, Artificial Sequence
  chemically synthesized
agttgctgctgaaactctct

SEQ ID NO: 65148 - DNA, 20 bp, Artificial Sequence
  chemically synthesized
aaaataggcttagagagttt

SEQ ID NO: 65149 - DNA, 20 bp, Artificial Sequence
  chemically synthesized
ataggcttagagagtttcag

SEQ ID NO: 65150 - DNA, 20 bp, Artificial Sequence
  chemically synthesized
ctagccttgtatttgtgttt

SEQ ID NO: 65151 - DNA, 20 bp, Artificial Sequence
  chemically synthesized
agcaactgaaacacaaatac

SEQ ID NO: 65152 - DNA, 20 bp, Artificial Sequence
  chemically synthesized
gcaactgaaacacaaataca

SEQ ID NO: 65153 - DNA, 20 bp, Artificial Sequence
  chemically synthesized
ctgaaacacaaatacaaggc

SEQ ID NO: 65154 - DNA, 20 bp, Artificial Sequence
  chemically synthesized
aacacaaatacaaggctaga

SEQ ID NO: 65155 - DNA, 20 bp, Artificial Sequence
  chemically synthesized
acaaatacaaggctagaaag

SEQ ID NO: 65156 - DNA, 20 bp, Artificial Sequence
  chemically synthesized
ctcacagctctgccactttc

SEQ ID NO: 65157 - DNA, 20 bp, Artificial Sequence
  chemically synthesized
aatacaaggctagaaagtgg

SEQ ID NO: 65158 - DNA, 20 bp, Artificial Sequence
  chemically synthesized
tacaaggctagaaagtggca

SEQ ID NO: 65159 - DNA, 20 bp, Artificial Sequence
  chemically synthesized
ctagaaagtggcagagctgt

SEQ ID NO: 65160 - DNA, 20 bp, Artificial Sequence
  chemically synthesized
ttccagattcacaaagctca

SEQ ID NO: 65161 - DNA, 20 bp, Artificial Sequence
  chemically synthesized
tcacagtttccagattcaca

SEQ ID NO: 65162 - DNA, 20 bp, Artificial Sequence
  chemically synthesized
agctgtgagctttgtgaatc

SEQ ID NO: 65163 - DNA, 20 bp, Artificial Sequence
  chemically synthesized
atggataaaatcacagtttc

SEQ ID NO: 65164 - DNA, 20 bp, Artificial Sequence
  chemically synthesized
tactgcaatggataaaatca

SEQ ID NO: 65165 - DNA, 20 bp, Artificial Sequence
  chemically synthesized
aactgtgattttatccattg

SEQ ID NO: 65166 - DNA, 20 bp, Artificial Sequence
  chemically synthesized
tgtgattttatccattgcag

SEQ ID NO: 65167 - DNA, 20 bp, Artificial Sequence
  chemically synthesized
actcagcctctctactgcaa

SEQ ID NO: 65168 - DNA, 20 bp, Artificial Sequence
  chemically synthesized
tgattttatccattgcagta

SEQ ID NO: 65169 - DNA, 20 bp, Artificial Sequence
  chemically synthesized
attttatccattgcagtaga

SEQ ID NO: 65170 - DNA, 20 bp, Artificial Sequence
  chemically synthesized
ttttatccattgcagtagag

SEQ ID NO: 65171 - DNA, 20 bp, Artificial Sequence
  chemically synthesized
tccattgcagtagagaggct

SEQ ID NO: 65172 - DNA, 20 bp, Artificial Sequence
  chemically synthesized
attgcagtagagaggctgag

SEQ ID NO: 65173 - DNA, 20 bp, Artificial Sequence
  chemically synthesized
tgcagtagagaggctgagta

SEQ ID NO: 65174 - DNA, 20 bp, Artificial Sequence
  chemically synthesized
cagtcccagttcactctact

SEQ ID NO: 65175 - DNA, 20 bp, Artificial Sequence
  chemically synthesized
agaggctgagtagagtgaac

SEQ ID NO: 65176 - DNA, 20 bp, Artificial Sequence
  chemically synthesized
gaggctgagtagagtgaact

SEQ ID NO: 65177 - DNA, 20 bp, Artificial Sequence
  chemically synthesized
tgagtagagtgaactgggac

SEQ ID NO: 65178 - DNA, 20 bp, Artificial Sequence
  chemically synthesized
gagtagagtgaactgggact

SEQ ID NO: 65179 - DNA, 20 bp, Artificial Sequence
  chemically synthesized
agtagagtgaactgggactg

SEQ ID NO: 65180 - DNA, 20 bp, Artificial Sequence
  chemically synthesized
gtccctccctgccccagtcc

SEQ ID NO: 65181 - DNA, 20 bp, Artificial Sequence
  chemically synthesized
agagtgaactgggactgggg

SEQ ID NO: 65182 - DNA, 20 bp, Artificial Sequence
  chemically synthesized
gagtgaactgggactggggc

SEQ ID NO: 65183 - DNA, 20 bp, Artificial Sequence
  chemically synthesized
agtgaactgggactggggca

SEQ ID NO: 65184 - DNA, 20 bp, Artificial Sequence
  chemically synthesized
tgaactgggactggggcagg

SEQ ID NO: 65185 - DNA, 20 bp, Artificial Sequence
  chemically synthesized
attccagtccctccctgccc

SEQ ID NO: 65186 - DNA, 20 bp, Artificial Sequence
  chemically synthesized
gaactgggactggggcaggg

SEQ ID NO: 65187 - DNA, 20 bp, Artificial Sequence
  chemically synthesized
aactgggactggggcaggga

SEQ ID NO: 65188 - DNA, 20 bp, Artificial Sequence
  chemically synthesized
ggactggggcagggagggac

SEQ ID NO: 65189 - DNA, 20 bp, Artificial Sequence
  chemically synthesized
gggcagggagggactggaat

SEQ ID NO: 65190 - DNA, 20 bp, Artificial Sequence
  chemically synthesized
acacaccagttttcttattc

SEQ ID NO: 65191 - DNA, 20 bp, Artificial Sequence
  chemically synthesized
agggactggaataagaaaac

SEQ ID NO: 65192 - DNA, 20 bp, Artificial Sequence
  chemically synthesized
ggaataagaaaactggtgtg

SEQ ID NO: 65193 - DNA, 20 bp, Artificial Sequence
  chemically synthesized
aataagaaaactggtgtgta

SEQ ID NO: 65194 - DNA, 20 bp, Artificial Sequence
  chemically synthesized
tgttgccatgctctacacac

SEQ ID NO: 65195 - DNA, 20 bp, Artificial Sequence
  chemically synthesized
gaaaactggtgtgtagagca

SEQ ID NO: 65196 - DNA, 20 bp, Artificial Sequence
  chemically synthesized
tggtgtgtagagcatggcaa

SEQ ID NO: 65197 - DNA, 20 bp, Artificial Sequence
  chemically synthesized
tgtagagcatggcaacagcc

SEQ ID NO: 65198 - DNA, 20 bp, Artificial Sequence
  chemically synthesized
aaaccataccataattgtct

SEQ ID NO: 65199 - DNA, 20 bp, Artificial Sequence
  chemically synthesized
caaaccataccataattgtc
